United States Patent 7,943,754 (BIOINFORMATICALLY DETECTABLE GROUP OF NOVEL REGULATORY BACTERIAL AND BACTERIAL ASSOCIATED OLIGONUCLEOTIDES AND USES THEREOF) - sequence listing, part 15

SEQ ID NO: 564166 - RNA, 21 nt, Coxiella burnetii RSA 493
gauccgucgcuuugcggccuc

SEQ ID NO: 564167 - RNA, 21 nt, Coxiella burnetii RSA 493
gaucguuucugguuuccuuuc

SEQ ID NO: 564168 - RNA, 12 nt, Coxiella burnetii RSA 493
gaucgcuguauu

SEQ ID NO: 564169 - RNA, 12 nt, Coxiella burnetii RSA 493
gaucguuuuuug

SEQ ID NO: 564170 - RNA, 16 nt, Coxiella burnetii RSA 493
gaucuaacguuuuguc

SEQ ID NO: 564171 - RNA, 21 nt, Coxiella burnetii RSA 493
gaucucuugcccccauugaua

SEQ ID NO: 564172 - RNA, 20 nt, Coxiella burnetii RSA 493
gaggguugcacgaugucuuu

SEQ ID NO: 564173 - RNA, 13 nt, Coxiella burnetii RSA 493
gaguaacgccagc

SEQ ID NO: 564174 - RNA, 21 nt, Coxiella burnetii RSA 493
gaguaaugguuuugaucacac

SEQ ID NO: 564175 - RNA, 20 nt, Coxiella burnetii RSA 493
gagucaaaaauaaaaauuuc

SEQ ID NO: 564176 - RNA, 18 nt, Coxiella burnetii RSA 493
gaguauuuuuuuuaaaau

SEQ ID NO: 564177 - RNA, 21 nt, Coxiella burnetii RSA 493
gagucggugacgaggaaagau

SEQ ID NO: 564178 - RNA, 14 nt, Coxiella burnetii RSA 493
gaguggcugcuucu

SEQ ID NO: 564179 - RNA, 15 nt, Coxiella burnetii RSA 493
gaguggcugcuucuu

SEQ ID NO: 564180 - RNA, 13 nt, Coxiella burnetii RSA 493
gagugguaaugac

SEQ ID NO: 564181 - RNA, 15 nt, Coxiella burnetii RSA 493
gauaacuauuauuaa

SEQ ID NO: 564182 - RNA, 17 nt, Coxiella burnetii RSA 493
gauaacuauuauuaaaa

SEQ ID NO: 564183 - RNA, 18 nt, Coxiella burnetii RSA 493
gauaacuauuauuaaaag

SEQ ID NO: 564184 - RNA, 19 nt, Coxiella burnetii RSA 493
gauaacuauuauuaaaaga

SEQ ID NO: 564185 - RNA, 16 nt, Coxiella burnetii RSA 493
gauaacgcuucuuuua

SEQ ID NO: 564186 - RNA, 23 nt, Coxiella burnetii RSA 493
gauaaagagccgucauccaaacg

SEQ ID NO: 564187 - RNA, 18 nt, Coxiella burnetii RSA 493
gaguucgcuaguggcucg

SEQ ID NO: 564188 - RNA, 20 nt, Coxiella burnetii RSA 493
gaguucugucacuaauaauc

SEQ ID NO: 564189 - RNA, 14 nt, Coxiella burnetii RSA 493
gauaaaacuugauu

SEQ ID NO: 564190 - RNA, 14 nt, Coxiella burnetii RSA 493
gagccgucauccaa

SEQ ID NO: 564191 - RNA, 15 nt, Coxiella burnetii RSA 493
gagccagauaaauca

SEQ ID NO: 564192 - RNA, 19 nt, Coxiella burnetii RSA 493
gagccgaucgcugugaaaa

SEQ ID NO: 564193 - RNA, 16 nt, Coxiella burnetii RSA 493
gagcgacuucauugag

SEQ ID NO: 564194 - RNA, 14 nt, Coxiella burnetii RSA 493
gagcuauaauucuc

SEQ ID NO: 564195 - RNA, 13 nt, Coxiella burnetii RSA 493
gagcguaaaacac

SEQ ID NO: 564196 - RNA, 17 nt, Coxiella burnetii RSA 493
gagcggauauaacgcca

SEQ ID NO: 564197 - RNA, 12 nt, Coxiella burnetii RSA 493
gagauuauucaa

SEQ ID NO: 564198 - RNA, 20 nt, Coxiella burnetii RSA 493
gagaggugaaccaaaaggaa

SEQ ID NO: 564199 - RNA, 18 nt, Coxiella burnetii RSA 493
gacucaaccgguuuuucu

SEQ ID NO: 564200 - RNA, 21 nt, Coxiella burnetii RSA 493
gacucaguggcagcuucuuua

SEQ ID NO: 564201 - RNA, 22 nt, Coxiella burnetii RSA 493
gagcaauggcgcgaggaauuga

SEQ ID NO: 564202 - RNA, 22 nt, Coxiella burnetii RSA 493
gagcaauaucugaucaaaaaua

SEQ ID NO: 564203 - RNA, 22 nt, Coxiella burnetii RSA 493
cuuucaucaaaucaauaaucau

SEQ ID NO: 564204 - RNA, 15 nt, Coxiella burnetii RSA 493
cuuucauuacuuggc

SEQ ID NO: 564205 - RNA, 14 nt, Coxiella burnetii RSA 493
cuuucauuaucuag

SEQ ID NO: 564206 - RNA, 18 nt, Coxiella burnetii RSA 493
cuuucauuuaauuuuaaa

SEQ ID NO: 564207 - RNA, 23 nt, Coxiella burnetii RSA 493
cuuuccaaacuacucucaaaauc

SEQ ID NO: 564208 - RNA, 20 nt, Coxiella burnetii RSA 493
cuuucugacgcuuuuucccu

SEQ ID NO: 564209 - RNA, 23 nt, Coxiella burnetii RSA 493
cuuugaaaaaacggcguauuuuu

SEQ ID NO: 564210 - RNA, 15 nt, Coxiella burnetii RSA 493
cuuucuuuucuucug

SEQ ID NO: 564211 - RNA, 18 nt, Coxiella burnetii RSA 493
cuuucuagaaggggagcg

SEQ ID NO: 564212 - RNA, 17 nt, Coxiella burnetii RSA 493
cuuugacauaucauucc

SEQ ID NO: 564213 - RNA, 23 nt, Coxiella burnetii RSA 493
cuuugugaguucccgugcaauug

SEQ ID NO: 564214 - RNA, 14 nt, Coxiella burnetii RSA 493
cuuuauaguucauu

SEQ ID NO: 564215 - RNA, 15 nt, Coxiella burnetii RSA 493
cuuuauuauaaaaaa

SEQ ID NO: 564216 - RNA, 17 nt, Coxiella burnetii RSA 493
cuuucaauaaacccguu

SEQ ID NO: 564217 - RNA, 15 nt, Coxiella burnetii RSA 493
cuuucaauuacuuuu

SEQ ID NO: 564218 - RNA, 16 nt, Coxiella burnetii RSA 493
cuuucacaauuugaug

SEQ ID NO: 564219 - RNA, 20 nt, Coxiella burnetii RSA 493
cuuucaggaaggugcguccc

SEQ ID NO: 564220 - RNA, 11 nt, Coxiella burnetii RSA 493
aaagaccaauc

SEQ ID NO: 564221 - RNA, 13 nt, Coxiella burnetii RSA 493
cuucgcuuuuucc

SEQ ID NO: 564222 - RNA, 23 nt, Coxiella burnetii RSA 493
cuucgcuccauacgggcuacuuc

SEQ ID NO: 564223 - RNA, 13 nt, Coxiella burnetii RSA 493
cuuuaccuaucac

SEQ ID NO: 564224 - RNA, 17 nt, Coxiella burnetii RSA 493
cuuuacgcgcuucuuuu

SEQ ID NO: 564225 - RNA, 19 nt, Coxiella burnetii RSA 493
cuuuugccuuggagcucuu

SEQ ID NO: 564226 - RNA, 21 nt, Coxiella burnetii RSA 493
cuuuugccggaguuaacagcu

SEQ ID NO: 564227 - RNA, 15 nt, Coxiella burnetii RSA 493
cuuuucuauuuuuuu

SEQ ID NO: 564228 - RNA, 12 nt, Coxiella burnetii RSA 493
cuuuucuauuug

SEQ ID NO: 564229 - RNA, 21 nt, Coxiella burnetii RSA 493
cuuuucggagaaaucuuuuuu

SEQ ID NO: 564230 - RNA, 23 nt, Coxiella burnetii RSA 493
cuuuuaugaaagaguauuuuuuu

SEQ ID NO: 564231 - RNA, 20 nt, Coxiella burnetii RSA 493
cuuuuaugucguucaauucu

SEQ ID NO: 564232 - RNA, 14 nt, Coxiella burnetii RSA 493
cuuuuauuccuuuu

SEQ ID NO: 564233 - RNA, 17 nt, Coxiella burnetii RSA 493
cuuuuauuccuuuuuuu

SEQ ID NO: 564234 - RNA, 21 nt, Coxiella burnetii RSA 493
cuuuuauuucuuuugccucuu

SEQ ID NO: 564235 - RNA, 18 nt, Coxiella burnetii RSA 493
cuuuuaaacagucuucac

SEQ ID NO: 564236 - RNA, 19 nt, Coxiella burnetii RSA 493
cuuuuaaacgcuucaaagu

SEQ ID NO: 564237 - RNA, 12 nt, Coxiella burnetii RSA 493
cuuuuaaauaag

SEQ ID NO: 564238 - RNA, 15 nt, Coxiella burnetii RSA 493
cuuuuaaauaaggga

SEQ ID NO: 564239 - RNA, 20 nt, Coxiella burnetii RSA 493
cuuuucauuaagcaauuuuu

SEQ ID NO: 564240 - RNA, 16 nt, Coxiella burnetii RSA 493
cuuuuccgugguuuaa

SEQ ID NO: 564241 - RNA, 15 nt, Coxiella burnetii RSA 493
cuuuuccugaacagg

SEQ ID NO: 564242 - RNA, 15 nt, Coxiella burnetii RSA 493
cuuuuguuuuuaaga

SEQ ID NO: 564243 - RNA, 22 nt, Coxiella burnetii RSA 493
cuuuuuaaaaaauuccuucucc

SEQ ID NO: 564244 - RNA, 23 nt, Coxiella burnetii RSA 493
cuuuuuguuugauuuguucuaaa

SEQ ID NO: 564245 - RNA, 15 nt, Coxiella burnetii RSA 493
gaaaaauaaaaggag

SEQ ID NO: 564246 - RNA, 22 nt, Coxiella burnetii RSA 493
gaaaaaggcucgugcauagcau

SEQ ID NO: 564247 - RNA, 19 nt, Coxiella burnetii RSA 493
gaaaaagcgauuccaaagc

SEQ ID NO: 564248 - RNA, 18 nt, Coxiella burnetii RSA 493
gaaaaaacuuuauucgcc

SEQ ID NO: 564249 - RNA, 15 nt, Coxiella burnetii RSA 493
cuuuuuuuucuucuu

SEQ ID NO: 564250 - RNA, 13 nt, Coxiella burnetii RSA 493
cuuuuuuuugaaa

SEQ ID NO: 564251 - RNA, 19 nt, Coxiella burnetii RSA 493
gaaaagauuccaauauuga

SEQ ID NO: 564252 - RNA, 22 nt, Coxiella burnetii RSA 493
gaaaacuuucaggaaggugcgu

SEQ ID NO: 564253 - RNA, 17 nt, Coxiella burnetii RSA 493
gaaaauaccuuugcaaa

SEQ ID NO: 564254 - RNA, 21 nt, Coxiella burnetii RSA 493
gaaaaccacaauuuuaaaaca

SEQ ID NO: 564255 - RNA, 18 nt, Coxiella burnetii RSA 493
gaaaacccgagcggaugg

SEQ ID NO: 564256 - RNA, 21 nt, Coxiella burnetii RSA 493
gaaaacgcgaguguuuuguau

SEQ ID NO: 564257 - RNA, 20 nt, Coxiella burnetii RSA 493
gaaaacuaguuauuuuuaaa

SEQ ID NO: 564258 - RNA, 21 nt, Coxiella burnetii RSA 493
gaaaaccgcagcucaaacaaa

SEQ ID NO: 564259 - RNA, 22 nt, Coxiella burnetii RSA 493
gaaaaccuacacuuuuaaucac

SEQ ID NO: 564260 - RNA, 16 nt, Coxiella burnetii RSA 493
gaaauccguaauuuua

SEQ ID NO: 564261 - RNA, 23 nt, Coxiella burnetii RSA 493
gaaauauuuucucaauagaaaaa

SEQ ID NO: 564262 - RNA, 18 nt, Coxiella burnetii RSA 493
gaaauacaggauuauauu

SEQ ID NO: 564263 - RNA, 20 nt, Coxiella burnetii RSA 493
gaaauacggggaaauaauga

SEQ ID NO: 564264 - RNA, 22 nt, Coxiella burnetii RSA 493
gaaauacggggacaauagauga

SEQ ID NO: 564265 - RNA, 13 nt, Coxiella burnetii RSA 493
gaaaguagaaaac

SEQ ID NO: 564266 - RNA, 14 nt, Coxiella burnetii RSA 493
gaaaguagaaaacu

SEQ ID NO: 564267 - RNA, 20 nt, Coxiella burnetii RSA 493
gaaauaaacuggaaaaaggu

SEQ ID NO: 564268 - RNA, 14 nt, Coxiella burnetii RSA 493
gaaauaaugacaau

SEQ ID NO: 564269 - RNA, 13 nt, Coxiella burnetii RSA 493
gaaauaaugugac

SEQ ID NO: 564270 - RNA, 15 nt, Coxiella burnetii RSA 493
gaaagcuaaaaaaga

SEQ ID NO: 564271 - RNA, 19 nt, Coxiella burnetii RSA 493
gaaagcuaaaaaagaaaua

SEQ ID NO: 564272 - RNA, 15 nt, Coxiella burnetii RSA 493
gaaaaucgauggaag

SEQ ID NO: 564273 - RNA, 21 nt, Coxiella burnetii RSA 493
gaaaaugcucgcgaaauuuaa

SEQ ID NO: 564274 - RNA, 22 nt, Coxiella burnetii RSA 493
gaaacuaagcauuaaaaaauaa

SEQ ID NO: 564275 - RNA, 16 nt, Coxiella burnetii RSA 493
gaaauucuuguccuuu

SEQ ID NO: 564276 - RNA, 20 nt, Coxiella burnetii RSA 493
gaacaauauuagccacauuu

SEQ ID NO: 564277 - RNA, 18 nt, Coxiella burnetii RSA 493
gaacgugcacgaaauaau

SEQ ID NO: 564278 - RNA, 15 nt, Coxiella burnetii RSA 493
gaacucagcccaaca

SEQ ID NO: 564279 - RNA, 22 nt, Coxiella burnetii RSA 493
gaacgacuuuuuuuaccauuuc

SEQ ID NO: 564280 - RNA, 22 nt, Coxiella burnetii RSA 493
gaaccgucacuucuucuccauu

SEQ ID NO: 564281 - RNA, 18 nt, Coxiella burnetii RSA 493
gaaccgauucauaaaaaa

SEQ ID NO: 564282 - RNA, 14 nt, Coxiella burnetii RSA 493
gaacccguuuuaau

SEQ ID NO: 564283 - RNA, 22 nt, Coxiella burnetii RSA 493
gaaccaaaagcaucgucaucgu

SEQ ID NO: 564284 - RNA, 14 nt, Coxiella burnetii RSA 493
gaaccaccaaauca

SEQ ID NO: 564285 - RNA, 22 nt, Coxiella burnetii RSA 493
gaaccauucaauuggagguucu

SEQ ID NO: 564286 - RNA, 15 nt, Coxiella burnetii RSA 493
gacccccaauuuaau

SEQ ID NO: 564287 - RNA, 22 nt, Coxiella burnetii RSA 493
gaccccaaugcuccgcguuuuu

SEQ ID NO: 564288 - RNA, 15 nt, Coxiella burnetii RSA 493
gaccgcuaaagcaaa

SEQ ID NO: 564289 - RNA, 16 nt, Coxiella burnetii RSA 493
gaccgcuaaagcaaaa

SEQ ID NO: 564290 - RNA, 19 nt, Coxiella burnetii RSA 493
gaccgcuuagcaauguuuc

SEQ ID NO: 564291 - RNA, 12 nt, Coxiella burnetii RSA 493
gaccaaaagccg

SEQ ID NO: 564292 - RNA, 20 nt, Coxiella burnetii RSA 493
gacauuguucauaaaauaau

SEQ ID NO: 564293 - RNA, 19 nt, Coxiella burnetii RSA 493
gaccaaucguaaagaucau

SEQ ID NO: 564294 - RNA, 14 nt, Coxiella burnetii RSA 493
gacaucauuguuuu

SEQ ID NO: 564295 - RNA, 13 nt, Coxiella burnetii RSA 493
gacagguauuuua

SEQ ID NO: 564296 - RNA, 16 nt, Coxiella burnetii RSA 493
gacgacggguuuuaag

SEQ ID NO: 564297 - RNA, 19 nt, Coxiella burnetii RSA 493
gacgccauuuuuuagcacc

SEQ ID NO: 564298 - RNA, 14 nt, Coxiella burnetii RSA 493
gaccugugagggau

SEQ ID NO: 564299 - RNA, 12 nt, Coxiella burnetii RSA 493
gacuaaaauaaa

SEQ ID NO: 564300 - RNA, 18 nt, Coxiella burnetii RSA 493
gacuagucaacaaacgaa

SEQ ID NO: 564301 - RNA, 19 nt, Coxiella burnetii RSA 493
gacuacgcauucagaaaau

SEQ ID NO: 564302 - RNA, 15 nt, Coxiella burnetii RSA 493
gacggaauuugugau

SEQ ID NO: 564303 - RNA, 20 nt, Coxiella burnetii RSA 493
gacggaauuugugauuuuaa

SEQ ID NO: 564304 - RNA, 22 nt, Coxiella burnetii RSA 493
gacggaauuugugauuuuaaaa

SEQ ID NO: 564305 - RNA, 16 nt, Coxiella burnetii RSA 493
gacguaccauuaaaag

SEQ ID NO: 564306 - RNA, 13 nt, Coxiella burnetii RSA 493
gaacuuauccaug

SEQ ID NO: 564307 - RNA, 14 nt, Coxiella burnetii RSA 493
gaagaacgauaaug

SEQ ID NO: 564308 - RNA, 20 nt, Coxiella burnetii RSA 493
aaagaguauuuuuuuuaaaa

SEQ ID NO: 564309 - RNA, 21 nt, Coxiella burnetii RSA 493
aaagaguugagcgaagaaaaa

SEQ ID NO: 564310 - RNA, 16 nt, Coxiella burnetii RSA 493
gaagaguaaaaaacca

SEQ ID NO: 564311 - RNA, 21 nt, Coxiella burnetii RSA 493
gaagcaauugucuaacauuug

SEQ ID NO: 564312 - RNA, 18 nt, Coxiella burnetii RSA 493
gaaggguuuugugcauaa

SEQ ID NO: 564313 - RNA, 21 nt, Coxiella burnetii RSA 493
gaaguaaaaagagucauugua

SEQ ID NO: 564314 - RNA, 16 nt, Coxiella burnetii RSA 493
gaaguucuauuuccgc

SEQ ID NO: 564315 - RNA, 16 nt, Coxiella burnetii RSA 493
gaaguucucaaauuuu

SEQ ID NO: 564316 - RNA, 23 nt, Coxiella burnetii RSA 493
aaagauauucuucuagaaaaccc

SEQ ID NO: 564317 - RNA, 20 nt, Coxiella burnetii RSA 493
gaagucugguuaaacccauu

SEQ ID NO: 564318 - RNA, 21 nt, Coxiella burnetii RSA 493
gaaguccuuaucacuagcuau

SEQ ID NO: 564319 - RNA, 13 nt, Coxiella burnetii RSA 493
gaauaaaacggcu

SEQ ID NO: 564320 - RNA, 18 nt, Coxiella burnetii RSA 493
gaauaaaacggcuugauu

SEQ ID NO: 564321 - RNA, 17 nt, Coxiella burnetii RSA 493
aaagauuccaauauuga

SEQ ID NO: 564322 - RNA, 13 nt, Coxiella burnetii RSA 493
gaauauuuuucuc

SEQ ID NO: 564323 - RNA, 16 nt, Coxiella burnetii RSA 493
gaaucaaauuaaaaua

SEQ ID NO: 564324 - RNA, 12 nt, Coxiella burnetii RSA 493
gaaucagcuuaa

SEQ ID NO: 564325 - RNA, 22 nt, Coxiella burnetii RSA 493
gaaucaaguagccaaaauaaua

SEQ ID NO: 564326 - RNA, 13 nt, Coxiella burnetii RSA 493
gaaucauugaaga

SEQ ID NO: 564327 - RNA, 15 nt, Coxiella burnetii RSA 493
gaaugaauagaaaaa

SEQ ID NO: 564328 - RNA, 14 nt, Coxiella burnetii RSA 493
gaaucugcuuccuc

SEQ ID NO: 564329 - RNA, 15 nt, Coxiella burnetii RSA 493
gaaugguugaaagaa

SEQ ID NO: 564330 - RNA, 19 nt, Coxiella burnetii RSA 493
gaaugguugaaagaaaaaa

SEQ ID NO: 564331 - RNA, 21 nt, Coxiella burnetii RSA 493
gaauguuauccgguuuugguu

SEQ ID NO: 564332 - RNA, 15 nt, Coxiella burnetii RSA 493
gacacauuuuuucaa

SEQ ID NO: 564333 - RNA, 21 nt, Coxiella burnetii RSA 493
gacaaugcccgaaaaggaaau

SEQ ID NO: 564334 - RNA, 15 nt, Coxiella burnetii RSA 493
gacaaugcguuuuaa

SEQ ID NO: 564335 - RNA, 23 nt, Coxiella burnetii RSA 493
gacaaugcuuucuuuuaauucau

SEQ ID NO: 564336 - RNA, 15 nt, Coxiella burnetii RSA 493
gacaauagaauaaug

SEQ ID NO: 564337 - RNA, 16 nt, Coxiella burnetii RSA 493
gacaaaaauaucccuu

SEQ ID NO: 564338 - RNA, 15 nt, Coxiella burnetii RSA 493
gaauuuuuugaaaaa

SEQ ID NO: 564339 - RNA, 22 nt, Coxiella burnetii RSA 493
gaauuuuuugcggaauuugaua

SEQ ID NO: 564340 - RNA, 23 nt, Coxiella burnetii RSA 493
gaauugggcgcacucaaccagaa

SEQ ID NO: 564341 - RNA, 20 nt, Coxiella burnetii RSA 493
gaauugccaauccuuaacgu

SEQ ID NO: 564342 - RNA, 14 nt, Coxiella burnetii RSA 493
gaauuaaauauccg

SEQ ID NO: 564343 - RNA, 23 nt, Coxiella burnetii RSA 493
gaauuaaccaaucaauaaaaaua

SEQ ID NO: 564344 - RNA, 12 nt, Coxiella burnetii RSA 493
gaauuaaaaaua

SEQ ID NO: 564345 - RNA, 13 nt, Coxiella burnetii RSA 493
gaauuaaaaauau

SEQ ID NO: 564346 - RNA, 21 nt, Coxiella burnetii RSA 493
cugagcucauugccaaagaaa

SEQ ID NO: 564347 - RNA, 19 nt, Coxiella burnetii RSA 493
cugagcgccuuuuuuaaau

SEQ ID NO: 564348 - RNA, 20 nt, Coxiella burnetii RSA 493
cugagcgccuuuuuuaaauu

SEQ ID NO: 564349 - RNA, 16 nt, Coxiella burnetii RSA 493
cugauacuucuucauu

SEQ ID NO: 564350 - RNA, 17 nt, Coxiella burnetii RSA 493
cugauacuucuucauua

SEQ ID NO: 564351 - RNA, 19 nt, Coxiella burnetii RSA 493
cugauacuucuucauuaaa

SEQ ID NO: 564352 - RNA, 22 nt, Coxiella burnetii RSA 493
cugauguaaggcaucuuuuucu

SEQ ID NO: 564353 - RNA, 14 nt, Coxiella burnetii RSA 493
cugauggaugaaag

SEQ ID NO: 564354 - RNA, 23 nt, Coxiella burnetii RSA 493
cugauuuuacgcuauuuuuuaaa

SEQ ID NO: 564355 - RNA, 19 nt, Coxiella burnetii RSA 493
cugacuuccagauuuagua

SEQ ID NO: 564356 - RNA, 23 nt, Coxiella burnetii RSA 493
cugacuuccagauuuaguaaagu

SEQ ID NO: 564357 - RNA, 22 nt, Coxiella burnetii RSA 493
cugaauuuaugaaugcuggagu

SEQ ID NO: 564358 - RNA, 15 nt, Coxiella burnetii RSA 493
cugaaguccuuguug

SEQ ID NO: 564359 - RNA, 15 nt, Coxiella burnetii RSA 493
cugaaucacuucuuc

SEQ ID NO: 564360 - RNA, 17 nt, Coxiella burnetii RSA 493
cugaaucacuucuucca

SEQ ID NO: 564361 - RNA, 21 nt, Coxiella burnetii RSA 493
cugaauguuaauuauaaagaa

SEQ ID NO: 564362 - RNA, 20 nt, Coxiella burnetii RSA 493
cugaauugaaguccuuauca

SEQ ID NO: 564363 - RNA, 18 nt, Coxiella burnetii RSA 493
cugcaaccgacgaauaac

SEQ ID NO: 564364 - RNA, 15 nt, Coxiella burnetii RSA 493
cugcaccauaacuaa

SEQ ID NO: 564365 - RNA, 23 nt, Coxiella burnetii RSA 493
cugccauuuucauuuucucuaau

SEQ ID NO: 564366 - RNA, 14 nt, Coxiella burnetii RSA 493
cugccaccuuugau

SEQ ID NO: 564367 - RNA, 16 nt, Coxiella burnetii RSA 493
cugcgguauuguucaa

SEQ ID NO: 564368 - RNA, 16 nt, Coxiella burnetii RSA 493
aaacuauuccccugca

SEQ ID NO: 564369 - RNA, 13 nt, Coxiella burnetii RSA 493
aaacuauucccug

SEQ ID NO: 564370 - RNA, 19 nt, Coxiella burnetii RSA 493
cugcuaggauuuccuuuuc

SEQ ID NO: 564371 - RNA, 21 nt, Coxiella burnetii RSA 493
cugcuguauaaacaguucagu

SEQ ID NO: 564372 - RNA, 23 nt, Coxiella burnetii RSA 493
cugcuguauaaacaguucaguuc

SEQ ID NO: 564373 - RNA, 21 nt, Coxiella burnetii RSA 493
cuggauaagcauauugcaaua

SEQ ID NO: 564374 - RNA, 20 nt, Coxiella burnetii RSA 493
cuggaugggcgcguggauuu

SEQ ID NO: 564375 - RNA, 15 nt, Coxiella burnetii RSA 493
cuggcuaguaaauaa

SEQ ID NO: 564376 - RNA, 14 nt, Coxiella burnetii RSA 493
cuggcuuggacaaa

SEQ ID NO: 564377 - RNA, 15 nt, Coxiella burnetii RSA 493
cugggauaacgaauc

SEQ ID NO: 564378 - RNA, 22 nt, Coxiella burnetii RSA 493
cuggccugaucauaaagcgcuc

SEQ ID NO: 564379 - RNA, 14 nt, Coxiella burnetii RSA 493
cugguuuccuuucu

SEQ ID NO: 564380 - RNA, 16 nt, Coxiella burnetii RSA 493
cugguuuccuuucuga

SEQ ID NO: 564381 - RNA, 21 nt, Coxiella burnetii RSA 493
cuggugcgauaguuuuauuua

SEQ ID NO: 564382 - RNA, 23 nt, Coxiella burnetii RSA 493
cuguaacuuuuccaucuccuuuu

SEQ ID NO: 564383 - RNA, 15 nt, Coxiella burnetii RSA 493
cuguaaaauaagaag

SEQ ID NO: 564384 - RNA, 22 nt, Coxiella burnetii RSA 493
cuguaaguugggguuuaauugc

SEQ ID NO: 564385 - RNA, 21 nt, Coxiella burnetii RSA 493
cugucauauccauaucguuuu

SEQ ID NO: 564386 - RNA, 18 nt, Coxiella burnetii RSA 493
cugucaaacguccuucuc

SEQ ID NO: 564387 - RNA, 14 nt, Coxiella burnetii RSA 493
cuguauaaacaguu

SEQ ID NO: 564388 - RNA, 15 nt, Coxiella burnetii RSA 493
cuguauaaacaguuc

SEQ ID NO: 564389 - RNA, 20 nt, Coxiella burnetii RSA 493
cuguccuaaggauaggaucu

SEQ ID NO: 564390 - RNA, 20 nt, Coxiella burnetii RSA 493
cuguccucuguccucugccu

SEQ ID NO: 564391 - RNA, 21 nt, Coxiella burnetii RSA 493
cugucgauacccaaucaauuc

SEQ ID NO: 564392 - RNA, 22 nt, Coxiella burnetii RSA 493
cugucuagucgaaucaccugcu

SEQ ID NO: 564393 - RNA, 23 nt, Coxiella burnetii RSA 493
cugugcaucgguuagaguuaauu

SEQ ID NO: 564394 - RNA, 16 nt, Coxiella burnetii RSA 493
cugugcggauuaaaua

SEQ ID NO: 564395 - RNA, 22 nt, Coxiella burnetii RSA 493
cugugcggauuaaauaacucau

SEQ ID NO: 564396 - RNA, 13 nt, Coxiella burnetii RSA 493
cugugguuaauuc

SEQ ID NO: 564397 - RNA, 20 nt, Coxiella burnetii RSA 493
cugugguuaauucuucuuca

SEQ ID NO: 564398 - RNA, 16 nt, Coxiella burnetii RSA 493
cuguguccuaaaauga

SEQ ID NO: 564399 - RNA, 18 nt, Coxiella burnetii RSA 493
cuguguccugcuuuugca

SEQ ID NO: 564400 - RNA, 20 nt, Coxiella burnetii RSA 493
cuguguuccuuacucccgaa

SEQ ID NO: 564401 - RNA, 9 nt, Coxiella burnetii RSA 493
cuuaacuuc

SEQ ID NO: 564402 - RNA, 20 nt, Coxiella burnetii RSA 493
aaacuggcuuggacaaauca

SEQ ID NO: 564403 - RNA, 18 nt, Coxiella burnetii RSA 493
cuguuuucguaaucuuua

SEQ ID NO: 564404 - RNA, 19 nt, Coxiella burnetii RSA 493
cuguuuuacugccuacaaa

SEQ ID NO: 564405 - RNA, 18 nt, Coxiella burnetii RSA 493
cuuauaggaaucugaauu

SEQ ID NO: 564406 - RNA, 21 nt, Coxiella burnetii RSA 493
cuuauuauucauaucuuuuuc

SEQ ID NO: 564407 - RNA, 16 nt, Coxiella burnetii RSA 493
cuuaucuuaaaccuca

SEQ ID NO: 564408 - RNA, 21 nt, Coxiella burnetii RSA 493
cuuauacuaaauuguccuuuu

SEQ ID NO: 564409 - RNA, 14 nt, Coxiella burnetii RSA 493
cuuacgcugaagua

SEQ ID NO: 564410 - RNA, 21 nt, Coxiella burnetii RSA 493
cuuacagaacgcccuauuccc

SEQ ID NO: 564411 - RNA, 13 nt, Coxiella burnetii RSA 493
cuuaauuuuuccu

SEQ ID NO: 564412 - RNA, 23 nt, Coxiella burnetii RSA 493
cuuaauuuuuccuuucuuucuuc

SEQ ID NO: 564413 - RNA, 12 nt, Coxiella burnetii RSA 493
cuuacaaaaaua

SEQ ID NO: 564414 - RNA, 23 nt, Coxiella burnetii RSA 493
cuuaagagauaagcuguuucuuu

SEQ ID NO: 564415 - RNA, 19 nt, Coxiella burnetii RSA 493
cuuaagagauagugcuauu

SEQ ID NO: 564416 - RNA, 20 nt, Coxiella burnetii RSA 493
cuuaauacccguuucuuauu

SEQ ID NO: 564417 - RNA, 19 nt, Coxiella burnetii RSA 493
cuuaauuuaaucuacucua

SEQ ID NO: 564418 - RNA, 16 nt, Coxiella burnetii RSA 493
cuuaauuuuaaaaaac

SEQ ID NO: 564419 - RNA, 18 nt, Coxiella burnetii RSA 493
cuuaauuuuaaaaaaccc

SEQ ID NO: 564420 - RNA, 13 nt, Coxiella burnetii RSA 493
cuucacuuuucug

SEQ ID NO: 564421 - RNA, 14 nt, Coxiella burnetii RSA 493
cuucauacuaacug

SEQ ID NO: 564422 - RNA, 16 nt, Coxiella burnetii RSA 493
cuucauacuaacugca

SEQ ID NO: 564423 - RNA, 18 nt, Coxiella burnetii RSA 493
cuucaugaauauuuuucu

SEQ ID NO: 564424 - RNA, 13 nt, Coxiella burnetii RSA 493
cuucaucuaaauu

SEQ ID NO: 564425 - RNA, 22 nt, Coxiella burnetii RSA 493
cuucaaauucagccguuauaaa

SEQ ID NO: 564426 - RNA, 14 nt, Coxiella burnetii RSA 493
cuucaaggauugaa

SEQ ID NO: 564427 - RNA, 22 nt, Coxiella burnetii RSA 493
cuuauugcccucguuuuaucgu

SEQ ID NO: 564428 - RNA, 23 nt, Coxiella burnetii RSA 493
cuuauucauuaaauauuucuucc

SEQ ID NO: 564429 - RNA, 18 nt, Coxiella burnetii RSA 493
cuucacgcauuucccaau

SEQ ID NO: 564430 - RNA, 23 nt, Coxiella burnetii RSA 493
cuucacgcauuucccaaucauca

SEQ ID NO: 564431 - RNA, 19 nt, Coxiella burnetii RSA 493
cuuccauuaauuucuuuuu

SEQ ID NO: 564432 - RNA, 20 nt, Coxiella burnetii RSA 493
cuuccccaauuuauucaacu

SEQ ID NO: 564433 - RNA, 15 nt, Coxiella burnetii RSA 493
aaacuuacgcugaag

SEQ ID NO: 564434 - RNA, 16 nt, Coxiella burnetii RSA 493
aaacuuacgcugaagu

SEQ ID NO: 564435 - RNA, 12 nt, Coxiella burnetii RSA 493
cuuccaauaagg

SEQ ID NO: 564436 - RNA, 21 nt, Coxiella burnetii RSA 493
cuucgcacaucauugaaaacc

SEQ ID NO: 564437 - RNA, 15 nt, Coxiella burnetii RSA 493
cuucgcaaagcucag

SEQ ID NO: 564438 - RNA, 15 nt, Coxiella burnetii RSA 493
cuuccucuucuacug

SEQ ID NO: 564439 - RNA, 19 nt, Coxiella burnetii RSA 493
cguacugacguuugagagg

SEQ ID NO: 564440 - RNA, 17 nt, Coxiella burnetii RSA 493
cguacaagugcuuccaa

SEQ ID NO: 564441 - RNA, 19 nt, Coxiella burnetii RSA 493
cguaauuuuaacgaccgug

SEQ ID NO: 564442 - RNA, 18 nt, Coxiella burnetii RSA 493
cguaauuaccugaaugcu

SEQ ID NO: 564443 - RNA, 23 nt, Coxiella burnetii RSA 493
cguagagauucccgcugccuuua

SEQ ID NO: 564444 - RNA, 21 nt, Coxiella burnetii RSA 493
cgucaccgguuaggaugcgaa

SEQ ID NO: 564445 - RNA, 16 nt, Coxiella burnetii RSA 493
cguauugaguuuuuga

SEQ ID NO: 564446 - RNA, 18 nt, Coxiella burnetii RSA 493
cgucacuucuucuccauu

SEQ ID NO: 564447 - RNA, 16 nt, Coxiella burnetii RSA 493
cgucagaaaacagccu

SEQ ID NO: 564448 - RNA, 20 nt, Coxiella burnetii RSA 493
cgucuuggagauuuagccaa

SEQ ID NO: 564449 - RNA, 14 nt, Coxiella burnetii RSA 493
cgucuuuaauacaa

SEQ ID NO: 564450 - RNA, 21 nt, Coxiella burnetii RSA 493
cgugaugggauaaaaaacccc

SEQ ID NO: 564451 - RNA, 16 nt, Coxiella burnetii RSA 493
cgugcauagcauccuu

SEQ ID NO: 564452 - RNA, 21 nt, Coxiella burnetii RSA 493
cgugccgccgaaauuuaacac

SEQ ID NO: 564453 - RNA, 16 nt, Coxiella burnetii RSA 493
cgugcccguucucaag

SEQ ID NO: 564454 - RNA, 14 nt, Coxiella burnetii RSA 493
cgucguuuguauuc

SEQ ID NO: 564455 - RNA, 16 nt, Coxiella burnetii RSA 493
cuaauuugaaaaaccc

SEQ ID NO: 564456 - RNA, 18 nt, Coxiella burnetii RSA 493
cuaauuugauuuuuuuug

SEQ ID NO: 564457 - RNA, 13 nt, Coxiella burnetii RSA 493
cuaauuuuccuuu

SEQ ID NO: 564458 - RNA, 14 nt, Coxiella burnetii RSA 493
cuaauuuuccuuuu

SEQ ID NO: 564459 - RNA, 13 nt, Coxiella burnetii RSA 493
cuaauuaaauuac

SEQ ID NO: 564460 - RNA, 15 nt, Coxiella burnetii RSA 493
cuaauucuuuuuuaa

SEQ ID NO: 564461 - RNA, 18 nt, Coxiella burnetii RSA 493
cuaauucuuuuuuaauau

SEQ ID NO: 564462 - RNA, 11 nt, Coxiella burnetii RSA 493
cuaauuuaaug

SEQ ID NO: 564463 - RNA, 16 nt, Coxiella burnetii RSA 493
cuaauaacauugggau

SEQ ID NO: 564464 - RNA, 15 nt, Coxiella burnetii RSA 493
cuaauacuaaacaaa

SEQ ID NO: 564465 - RNA, 20 nt, Coxiella burnetii RSA 493
cuaaucgcaaugcuucuuca

SEQ ID NO: 564466 - RNA, 20 nt, Coxiella burnetii RSA 493
cuaaucccgccccauuuuug

SEQ ID NO: 564467 - RNA, 22 nt, Coxiella burnetii RSA 493
cuaaguaaacagcauuagcuuc

SEQ ID NO: 564468 - RNA, 13 nt, Coxiella burnetii RSA 493
cuaauaaaaauau

SEQ ID NO: 564469 - RNA, 15 nt, Coxiella burnetii RSA 493
cuaagagcugucgcc

SEQ ID NO: 564470 - RNA, 14 nt, Coxiella burnetii RSA 493
cuaacuuugauaag

SEQ ID NO: 564471 - RNA, 19 nt, Coxiella burnetii RSA 493
cuaagcauuaaaaaauaag

SEQ ID NO: 564472 - RNA, 19 nt, Coxiella burnetii RSA 493
cuaagcuaucagcaaucaa

SEQ ID NO: 564473 - RNA, 23 nt, Coxiella burnetii RSA 493
cuaagcguaacgucacaaauaaa

SEQ ID NO: 564474 - RNA, 16 nt, Coxiella burnetii RSA 493
cuaagccaguucucua

SEQ ID NO: 564475 - RNA, 20 nt, Coxiella burnetii RSA 493
cuaacgcaaucggauuaacg

SEQ ID NO: 564476 - RNA, 13 nt, Coxiella burnetii RSA 493
cuaacggcuagag

SEQ ID NO: 564477 - RNA, 14 nt, Coxiella burnetii RSA 493
cuaacuacgacccu

SEQ ID NO: 564478 - RNA, 19 nt, Coxiella burnetii RSA 493
cuaacguuuugucguuuuc

SEQ ID NO: 564479 - RNA, 19 nt, Coxiella burnetii RSA 493
cuaacguuaguuucuuuua

SEQ ID NO: 564480 - RNA, 19 nt, Coxiella burnetii RSA 493
cuaaaccacgcuauaauuu

SEQ ID NO: 564481 - RNA, 21 nt, Coxiella burnetii RSA 493
cuaacaauuguugauuuaacu

SEQ ID NO: 564482 - RNA, 23 nt, Coxiella burnetii RSA 493
cuaaccccggaaaaucuuguuua

SEQ ID NO: 564483 - RNA, 22 nt, Coxiella burnetii RSA 493
cguuauucuaacguuaguuucu

SEQ ID NO: 564484 - RNA, 18 nt, Coxiella burnetii RSA 493
cguuauugggauuuaccu

SEQ ID NO: 564485 - RNA, 16 nt, Coxiella burnetii RSA 493
cguucaccccauuuca

SEQ ID NO: 564486 - RNA, 23 nt, Coxiella burnetii RSA 493
cguuaauacgauagcgucuuuuu

SEQ ID NO: 564487 - RNA, 19 nt, Coxiella burnetii RSA 493
cguuaauuuaucauuuuuc

SEQ ID NO: 564488 - RNA, 11 nt, Coxiella burnetii RSA 493
cguuaccacuu

SEQ ID NO: 564489 - RNA, 20 nt, Coxiella burnetii RSA 493
cguuaucacuugauaaucaa

SEQ ID NO: 564490 - RNA, 19 nt, Coxiella burnetii RSA 493
cguuauagaguaaauacuc

SEQ ID NO: 564491 - RNA, 11 nt, Coxiella burnetii RSA 493
cguuaugaaaa

SEQ ID NO: 564492 - RNA, 14 nt, Coxiella burnetii RSA 493
cguuaccuucugua

SEQ ID NO: 564493 - RNA, 13 nt, Coxiella burnetii RSA 493
cguuuucuaucca

SEQ ID NO: 564494 - RNA, 11 nt, Coxiella burnetii RSA 493
cguuuuuaacc

SEQ ID NO: 564495 - RNA, 16 nt, Coxiella burnetii RSA 493
cuaaaaaauuacgaua

SEQ ID NO: 564496 - RNA, 22 nt, Coxiella burnetii RSA 493
cuaaaccaacgaacgccaagcu

SEQ ID NO: 564497 - RNA, 15 nt, Coxiella burnetii RSA 493
cuaaacaaaauaaua

SEQ ID NO: 564498 - RNA, 17 nt, Coxiella burnetii RSA 493
cguuguggacuuguucg

SEQ ID NO: 564499 - RNA, 15 nt, Coxiella burnetii RSA 493
cguugaugucuucuu

SEQ ID NO: 564500 - RNA, 16 nt, Coxiella burnetii RSA 493
cguugauuaauaaugu

SEQ ID NO: 564501 - RNA, 21 nt, Coxiella burnetii RSA 493
cguugcaagcguuuuucaucc

SEQ ID NO: 564502 - RNA, 17 nt, Coxiella burnetii RSA 493
cguuucgucgauaucca

SEQ ID NO: 564503 - RNA, 23 nt, Coxiella burnetii RSA 493
cguuugguugguuugcaaaacua

SEQ ID NO: 564504 - RNA, 14 nt, Coxiella burnetii RSA 493
cucauuaggcuuua

SEQ ID NO: 564505 - RNA, 22 nt, Coxiella burnetii RSA 493
cuccaaagggaccuuuuuugca

SEQ ID NO: 564506 - RNA, 21 nt, Coxiella burnetii RSA 493
cuccaaauugggugcauugcu

SEQ ID NO: 564507 - RNA, 20 nt, Coxiella burnetii RSA 493
cucauuguggauuaugugga

SEQ ID NO: 564508 - RNA, 22 nt, Coxiella burnetii RSA 493
cucauuguuaauccacuuaaaa

SEQ ID NO: 564509 - RNA, 14 nt, Coxiella burnetii RSA 493
cuccaauaauaaaa

SEQ ID NO: 564510 - RNA, 21 nt, Coxiella burnetii RSA 493
cuccacgguuaccuugucaca

SEQ ID NO: 564511 - RNA, 22 nt, Coxiella burnetii RSA 493
cuccauuacauaauuuaaacuc

SEQ ID NO: 564512 - RNA, 13 nt, Coxiella burnetii RSA 493
cuccccgcuccaa

SEQ ID NO: 564513 - RNA, 21 nt, Coxiella burnetii RSA 493
cucccuaagccaguucucuau

SEQ ID NO: 564514 - RNA, 23 nt, Coxiella burnetii RSA 493
cucccggauaaaguguugucggc

SEQ ID NO: 564515 - RNA, 16 nt, Coxiella burnetii RSA 493
cuccuaaauuuucuug

SEQ ID NO: 564516 - RNA, 21 nt, Coxiella burnetii RSA 493
cuccgugcgagcaauaauuuc

SEQ ID NO: 564517 - RNA, 17 nt, Coxiella burnetii RSA 493
cucgcaagaaucuccac

SEQ ID NO: 564518 - RNA, 17 nt, Coxiella burnetii RSA 493
cucgcgaaauuguauug

SEQ ID NO: 564519 - RNA, 21 nt, Coxiella burnetii RSA 493
cucgcgaaauuuaauaaaauu

SEQ ID NO: 564520 - RNA, 15 nt, Coxiella burnetii RSA 493
cucgcccauggaaau

SEQ ID NO: 564521 - RNA, 17 nt, Coxiella burnetii RSA 493
cucuaagauaucuguuu

SEQ ID NO: 564522 - RNA, 20 nt, Coxiella burnetii RSA 493
cucuaaugauaauccacaau

SEQ ID NO: 564523 - RNA, 13 nt, Coxiella burnetii RSA 493
cucuaauucugau

SEQ ID NO: 564524 - RNA, 22 nt, Coxiella burnetii RSA 493
cucguuucggauuuugaacagu

SEQ ID NO: 564525 - RNA, 16 nt, Coxiella burnetii RSA 493
cucguugagguucgca

SEQ ID NO: 564526 - RNA, 15 nt, Coxiella burnetii RSA 493
cucgugcauagcauc

SEQ ID NO: 564527 - RNA, 16 nt, Coxiella burnetii RSA 493
cucgcucuuguuucug

SEQ ID NO: 564528 - RNA, 22 nt, Coxiella burnetii RSA 493
cuauuagucuuaauuuuaaaaa

SEQ ID NO: 564529 - RNA, 12 nt, Coxiella burnetii RSA 493
cuaucuuuuuca

SEQ ID NO: 564530 - RNA, 14 nt, Coxiella burnetii RSA 493
cuauugaaaaaaac

SEQ ID NO: 564531 - RNA, 15 nt, Coxiella burnetii RSA 493
cuauuggauuuacuu

SEQ ID NO: 564532 - RNA, 16 nt, Coxiella burnetii RSA 493
cuauuggauuuacuuc

SEQ ID NO: 564533 - RNA, 11 nt, Coxiella burnetii RSA 493
cuauuuuuccc

SEQ ID NO: 564534 - RNA, 13 nt, Coxiella burnetii RSA 493
cuauuuuuuaaau

SEQ ID NO: 564535 - RNA, 17 nt, Coxiella burnetii RSA 493
cuauuucgagauuauua

SEQ ID NO: 564536 - RNA, 13 nt, Coxiella burnetii RSA 493
cucacaaagauuu

SEQ ID NO: 564537 - RNA, 18 nt, Coxiella burnetii RSA 493
cucacaacauuccuuucg

SEQ ID NO: 564538 - RNA, 19 nt, Coxiella burnetii RSA 493
cucaaagaaacgauuaaaa

SEQ ID NO: 564539 - RNA, 13 nt, Coxiella burnetii RSA 493
cucaaacaaauca

SEQ ID NO: 564540 - RNA, 14 nt, Coxiella burnetii RSA 493
cucaaacaaaucaa

SEQ ID NO: 564541 - RNA, 22 nt, Coxiella burnetii RSA 493
cucaaaggccuuggguaaguga

SEQ ID NO: 564542 - RNA, 15 nt, Coxiella burnetii RSA 493
cucacuuuuuucagc

SEQ ID NO: 564543 - RNA, 14 nt, Coxiella burnetii RSA 493
cucagcaucagccu

SEQ ID NO: 564544 - RNA, 16 nt, Coxiella burnetii RSA 493
cucagccguuaacucu

SEQ ID NO: 564545 - RNA, 22 nt, Coxiella burnetii RSA 493
cuauaaaguaguugaaaaaucu

SEQ ID NO: 564546 - RNA, 14 nt, Coxiella burnetii RSA 493
cuaguuuuacuaca

SEQ ID NO: 564547 - RNA, 20 nt, Coxiella burnetii RSA 493
cuagucgaaucaccugcucc

SEQ ID NO: 564548 - RNA, 16 nt, Coxiella burnetii RSA 493
cuaguuauuuuuaaaa

SEQ ID NO: 564549 - RNA, 18 nt, Coxiella burnetii RSA 493
cuaguuauuuuuaaaaga

SEQ ID NO: 564550 - RNA, 19 nt, Coxiella burnetii RSA 493
cuaguuauuuuucaucuug

SEQ ID NO: 564551 - RNA, 21 nt, Coxiella burnetii RSA 493
cuaggaaaaaauaauuauaga

SEQ ID NO: 564552 - RNA, 15 nt, Coxiella burnetii RSA 493
cuagaaguauuucca

SEQ ID NO: 564553 - RNA, 15 nt, Coxiella burnetii RSA 493
cuagaaauauuagaa

SEQ ID NO: 564554 - RNA, 16 nt, Coxiella burnetii RSA 493
cuagaaauauuagaaa

SEQ ID NO: 564555 - RNA, 20 nt, Coxiella burnetii RSA 493
cuacguuuuuugcauuuuua

SEQ ID NO: 564556 - RNA, 20 nt, Coxiella burnetii RSA 493
cuaccaugcuccucgguagc

SEQ ID NO: 564557 - RNA, 22 nt, Coxiella burnetii RSA 493
cuaccagcauccgggaauaguu

SEQ ID NO: 564558 - RNA, 18 nt, Coxiella burnetii RSA 493
cuaccgagucaaaaauaa

SEQ ID NO: 564559 - RNA, 20 nt, Coxiella burnetii RSA 493
cuacauagcaaauaucugcu

SEQ ID NO: 564560 - RNA, 15 nt, Coxiella burnetii RSA 493
cuacacuuucaaucg

SEQ ID NO: 564561 - RNA, 17 nt, Coxiella burnetii RSA 493
cuacacuuuuaaucaca

SEQ ID NO: 564562 - RNA, 16 nt, Coxiella burnetii RSA 493
cuacacuauugaaguc

SEQ ID NO: 564563 - RNA, 12 nt, Coxiella burnetii RSA 493
aaaaaaagaaaa

SEQ ID NO: 564564 - RNA, 22 nt, Coxiella burnetii RSA 493
aaaaaaacaucggaagaacgau

SEQ ID NO: 564565 - RNA, 20 nt, Coxiella burnetii RSA 493
aaaaaacgauugcuaaacca

SEQ ID NO: 564566 - RNA, 11 nt, Coxiella burnetii RSA 493
aaaaaagaaaa

SEQ ID NO: 564567 - RNA, 13 nt, Coxiella burnetii RSA 493
aaaaaagaaaaua

SEQ ID NO: 564568 - RNA, 19 nt, Coxiella burnetii RSA 493
aaaaaaaguuuagaaaaau

SEQ ID NO: 564569 - RNA, 19 nt, Coxiella burnetii RSA 493
aaaaaaccuaaagaaagaa

SEQ ID NO: 564570 - RNA, 12 nt, Coxiella burnetii RSA 493
aaaaaagaaaau

SEQ ID NO: 564571 - RNA, 17 nt, Coxiella burnetii RSA 493
aaaaaacuagaaauauu

SEQ ID NO: 564572 - RNA, 15 nt, Coxiella burnetii RSA 493
aaaaacaaaacaaac

SEQ ID NO: 564573 - RNA, 12 nt, Coxiella burnetii RSA 493
aaaaaauuaaau

SEQ ID NO: 564574 - RNA, 10 nt, Coxiella burnetii RSA 493
aaaaaauucc

SEQ ID NO: 564575 - RNA, 21 nt, Coxiella burnetii RSA 493
aaaaaauugggaguuguauaa

SEQ ID NO: 564576 - RNA, 17 nt, Coxiella burnetii RSA 493
aaaacaagacaacaaaa

SEQ ID NO: 564577 - RNA, 17 nt, Coxiella burnetii RSA 493
aaaaccauucaaugcua

SEQ ID NO: 564578 - RNA, 21 nt, Coxiella burnetii RSA 493
aaaaccgcagcucaaacaaau

SEQ ID NO: 564579 - RNA, 24 nt, Coxiella burnetii RSA 493
aaaaccuacacguuaaauagccaa

SEQ ID NO: 564580 - RNA, 15 nt, Coxiella burnetii RSA 493
aaaaccuacuuuucu

SEQ ID NO: 564581 - RNA, 16 nt, Coxiella burnetii RSA 493
aaaaccuacuuuucua

SEQ ID NO: 564582 - RNA, 20 nt, Coxiella burnetii RSA 493
aaaaaguuuagaaaaaugcu

SEQ ID NO: 564583 - RNA, 22 nt, Coxiella burnetii RSA 493
aaaaaguucaccgcaaaguccu

SEQ ID NO: 564584 - RNA, 15 nt, Coxiella burnetii RSA 493
aaaaauucguuaaaa

SEQ ID NO: 564585 - RNA, 16 nt, Coxiella burnetii RSA 493
aaaaauuccaaaaaca

SEQ ID NO: 564586 - RNA, 18 nt, Coxiella burnetii RSA 493
aaaaauuccaaaaacauu

SEQ ID NO: 564587 - RNA, 22 nt, Coxiella burnetii RSA 493
aaaaaucuuugcucuaaauuaa

SEQ ID NO: 564588 - RNA, 18 nt, Coxiella burnetii RSA 493
aaaaacgccugaaauauu

SEQ ID NO: 564589 - RNA, 19 nt, Coxiella burnetii RSA 493
aaaaacgccugaaauauuu

SEQ ID NO: 564590 - RNA, 14 nt, Coxiella burnetii RSA 493
aaaaaccuuuuaaa

SEQ ID NO: 564591 - RNA, 16 nt, Coxiella burnetii RSA 493
aaaaaccuucguaaga

SEQ ID NO: 564592 - RNA, 15 nt, Coxiella burnetii RSA 493
aaaaacgccugaaau

SEQ ID NO: 564593 - RNA, 16 nt, Coxiella burnetii RSA 493
aaaaacccauuaagua

SEQ ID NO: 564594 - RNA, 23 nt, Coxiella burnetii RSA 493
aaaaacuccgcugcuccacaaug

SEQ ID NO: 564595 - RNA, 21 nt, Coxiella burnetii RSA 493
aaaaacggcgacaguauuucu

SEQ ID NO: 564596 - RNA, 13 nt, Coxiella burnetii RSA 493
aaaaacuagaaau

SEQ ID NO: 564597 - RNA, 19 nt, Coxiella burnetii RSA 493
aaaaacuagaaauauuaga

SEQ ID NO: 564598 - RNA, 11 nt, Coxiella burnetii RSA 493
aaaaagaaaau

SEQ ID NO: 564599 - RNA, 23 nt, Coxiella burnetii RSA 493
aaaaacuucaugcaaaaauuguu

SEQ ID NO: 564600 - RNA, 10 nt, Coxiella burnetii RSA 493
aaaaagaaaa

SEQ ID NO: 564601 - RNA, 13 nt, Coxiella burnetii RSA 493
aaaaagcaugauu

SEQ ID NO: 564602 - RNA, 16 nt, Coxiella burnetii RSA 493
aaaaagauaaucccaa

SEQ ID NO: 564603 - RNA, 22 nt, Coxiella burnetii RSA 493
aaaaagcggauaagccauuaaa

SEQ ID NO: 564604 - RNA, 24 nt, Coxiella burnetii RSA 493
aaaaaggacaccguugagcaagca

SEQ ID NO: 564605 - RNA, 17 nt, Coxiella burnetii RSA 493
aaaaaggugcccaagaa

SEQ ID NO: 564606 - RNA, 17 nt, Coxiella burnetii RSA 493
aaaaugaccuugccauc

SEQ ID NO: 564607 - RNA, 23 nt, Coxiella burnetii RSA 493
aaaauggugaaaagccaaagacc

SEQ ID NO: 564608 - RNA, 20 nt, Coxiella burnetii RSA 493
aaaauucuccuuaauaaagu

SEQ ID NO: 564609 - RNA, 18 nt, Coxiella burnetii RSA 493
aaaauuaauauaaucagc

SEQ ID NO: 564610 - RNA, 21 nt, Coxiella burnetii RSA 493
aaaauuaauauaaucagcaag

SEQ ID NO: 564611 - RNA, 17 nt, Coxiella burnetii RSA 493
aaaauuacuuuauuacc

SEQ ID NO: 564612 - RNA, 12 nt, Coxiella burnetii RSA 493
aaaauuaaaauc

SEQ ID NO: 564613 - RNA, 14 nt, Coxiella burnetii RSA 493
aaaauuaaaaucuu

SEQ ID NO: 564614 - RNA, 15 nt, Coxiella burnetii RSA 493
aaaauguuaggaagg

SEQ ID NO: 564615 - RNA, 22 nt, Coxiella burnetii RSA 493
aaaaucuucugaucgauaaaaa

SEQ ID NO: 564616 - RNA, 23 nt, Coxiella burnetii RSA 493
aaaaucuuugcucuaaauuaaau

SEQ ID NO: 564617 - RNA, 20 nt, Coxiella burnetii RSA 493
aaaauauuaucccgaaaacc

SEQ ID NO: 564618 - RNA, 18 nt, Coxiella burnetii RSA 493
aaaauacaguaaauaauc

SEQ ID NO: 564619 - RNA, 12 nt, Coxiella burnetii RSA 493
aaaauaagaagg

SEQ ID NO: 564620 - RNA, 12 nt, Coxiella burnetii RSA 493
aaaauaaauaca

SEQ ID NO: 564621 - RNA, 22 nt, Coxiella burnetii RSA 493
aaaaguccuguucuuuucaacu

SEQ ID NO: 564622 - RNA, 16 nt, Coxiella burnetii RSA 493
aaaaggagaaauugac

SEQ ID NO: 564623 - RNA, 17 nt, Coxiella burnetii RSA 493
aaaaggagaaauugaca

SEQ ID NO: 564624 - RNA, 14 nt, Coxiella burnetii RSA 493
aaaaggaauucuaa

SEQ ID NO: 564625 - RNA, 17 nt, Coxiella burnetii RSA 493
aaaaggaaauguaaaaa

SEQ ID NO: 564626 - RNA, 18 nt, Coxiella burnetii RSA 493
aaaagcguuuaaauaacu

SEQ ID NO: 564627 - RNA, 22 nt, Coxiella burnetii RSA 493
aaaacgcgccccucaagcaaag

SEQ ID NO: 564628 - RNA, 16 nt, Coxiella burnetii RSA 493
aaaacgccugaaauau

SEQ ID NO: 564629 - RNA, 20 nt, Coxiella burnetii RSA 493
aaaaacuucaugcaaaaauu

SEQ ID NO: 564630 - RNA, 18 nt, Coxiella burnetii RSA 493
aaaaacuuccgccacuaa

SEQ ID NO: 564631 - RNA, 19 nt, Coxiella burnetii RSA 493
aaacaccgcccauuuccca

SEQ ID NO: 564632 - RNA, 13 nt, Coxiella burnetii RSA 493
aaaauugaaagaa

SEQ ID NO: 564633 - RNA, 17 nt, Coxiella burnetii RSA 493
aaaauugaaagaauuuc

SEQ ID NO: 564634 - RNA, 19 nt, Coxiella burnetii RSA 493
aaaauugggaguuguauaa

SEQ ID NO: 564635 - RNA, 13 nt, Coxiella burnetii RSA 493
aaacaaucaaugc

SEQ ID NO: 564636 - RNA, 17 nt, Coxiella burnetii RSA 493
aaacaaguuaacaaaau

SEQ ID NO: 564637 - RNA, 13 nt, Coxiella burnetii RSA 493
aaacagccuccau

SEQ ID NO: 564638 - RNA, 14 nt, Coxiella burnetii RSA 493
aaacacuuguuugc

SEQ ID NO: 564639 - RNA, 18 nt, Coxiella burnetii RSA 493
aaacagauuuaaauagcu

SEQ ID NO: 564640 - RNA, 23 nt, Coxiella burnetii RSA 493
aaacagcaauuaaucccuuugca

SEQ ID NO: 564641 - RNA, 14 nt, Coxiella burnetii RSA 493
aaacauaaaggcca

SEQ ID NO: 564642 - RNA, 21 nt, Coxiella burnetii RSA 493
aaacaguauuggcggaugagu

SEQ ID NO: 564643 - RNA, 17 nt, Coxiella burnetii RSA 493
aaacagugccccuccuc

SEQ ID NO: 564644 - RNA, 22 nt, Coxiella burnetii RSA 493
aaaccgcagcucaaacaaauca

SEQ ID NO: 564645 - RNA, 22 nt, Coxiella burnetii RSA 493
aaaccgacgccauuuuuuagca

SEQ ID NO: 564646 - RNA, 15 nt, Coxiella burnetii RSA 493
aaaccgagcuucaug

SEQ ID NO: 564647 - RNA, 16 nt, Coxiella burnetii RSA 493
aaaccauaaauggaua

SEQ ID NO: 564648 - RNA, 16 nt, Coxiella burnetii RSA 493
aaaccauaagcaagcu

SEQ ID NO: 564649 - RNA, 22 nt, Coxiella burnetii RSA 493
aaacccagcgggugaugaaauc

SEQ ID NO: 564650 - RNA, 12 nt, Coxiella burnetii RSA 493
aaaccccaacuc

SEQ ID NO: 564651 - RNA, 18 nt, Coxiella burnetii RSA 493
aaaccccaccgagguaag

SEQ ID NO: 564652 - RNA, 20 nt, Coxiella burnetii RSA 493
aaaccaccgcucgcuugaaa

SEQ ID NO: 564653 - RNA, 21 nt, Coxiella burnetii RSA 493
aaaccaccgcucgcuugaaaa

SEQ ID NO: 564654 - RNA, 15 nt, Coxiella burnetii RSA 493
aaaccacgcuauaau

SEQ ID NO: 564655 - RNA, 18 nt, Coxiella burnetii RSA 493
aaaccaaucacuaaguca

SEQ ID NO: 564656 - RNA, 22 nt, Coxiella burnetii RSA 493
aaacauucgauauguuucaaua

SEQ ID NO: 564657 - RNA, 13 nt, Coxiella burnetii RSA 493
aaacauccuccau

SEQ ID NO: 564658 - RNA, 15 nt, Coxiella burnetii RSA 493
aaacaugcgaaagca

SEQ ID NO: 564659 - RNA, 20 nt, Coxiella burnetii RSA 493
aaauccagaccuguuaaaaa

SEQ ID NO: 564660 - RNA, 22 nt, Coxiella burnetii RSA 493
aaauccaggcugcuagaaguau

SEQ ID NO: 564661 - RNA, 17 nt, Coxiella burnetii RSA 493
aaauccguaauuuuaac

SEQ ID NO: 564662 - RNA, 16 nt, Coxiella burnetii RSA 493
aaaucggaaaagccaa

SEQ ID NO: 564663 - RNA, 23 nt, Coxiella burnetii RSA 493
aaaucgaaucgggccgccuuaau

SEQ ID NO: 564664 - RNA, 16 nt, Coxiella burnetii RSA 493
aaauccuuaauuaacu

SEQ ID NO: 564665 - RNA, 23 nt, Coxiella burnetii RSA 493
aaaucuucugaucgauaaaaaua

SEQ ID NO: 564666 - RNA, 20 nt, Coxiella burnetii RSA 493
aaaugaccaugguuucuuua

SEQ ID NO: 564667 - RNA, 22 nt, Coxiella burnetii RSA 493
aaaugaccuugccauccaaaug

SEQ ID NO: 564668 - RNA, 17 nt, Coxiella burnetii RSA 493
aaaugaauaauauugua

SEQ ID NO: 564669 - RNA, 21 nt, Coxiella burnetii RSA 493
aaauuaagacuaggaaaaaau

SEQ ID NO: 564670 - RNA, 21 nt, Coxiella burnetii RSA 493
aaauuaauauuaucguuuuca

SEQ ID NO: 564671 - RNA, 12 nt, Coxiella burnetii RSA 493
aaauuaaaauaa

SEQ ID NO: 564672 - RNA, 15 nt, Coxiella burnetii RSA 493
aaauguuugaguggu

SEQ ID NO: 564673 - RNA, 14 nt, Coxiella burnetii RSA 493
aaauuaaaaaauag

SEQ ID NO: 564674 - RNA, 14 nt, Coxiella burnetii RSA 493
aaauuaaaaaucgg

SEQ ID NO: 564675 - RNA, 19 nt, Coxiella burnetii RSA 493
aaauuaggagaucuuuuaa

SEQ ID NO: 564676 - RNA, 22 nt, Coxiella burnetii RSA 493
aaauuaggagaucuuuuaauuu

SEQ ID NO: 564677 - RNA, 19 nt, Coxiella burnetii RSA 493
aaauuagguaauuuauaac

SEQ ID NO: 564678 - RNA, 23 nt, Coxiella burnetii RSA 493
aaauuagaauuacuguaaacuag

SEQ ID NO: 564679 - RNA, 22 nt, Coxiella burnetii RSA 493
aaauuagaauugcugacaccua

SEQ ID NO: 564680 - RNA, 13 nt, Coxiella burnetii RSA 493
aaauuauaaaugg

SEQ ID NO: 564681 - RNA, 14 nt, Coxiella burnetii RSA 493
aaauuauuuuaaua

SEQ ID NO: 564682 - RNA, 15 nt, Coxiella burnetii RSA 493
aaauuauuuuaauau

SEQ ID NO: 564683 - RNA, 23 nt, Coxiella burnetii RSA 493
aaaugguugauuuuuuaauuaag

SEQ ID NO: 564684 - RNA, 16 nt, Coxiella burnetii RSA 493
aaauggcuuuuuucuu

SEQ ID NO: 564685 - RNA, 11 nt, Coxiella burnetii RSA 493
aaauuuuccca

SEQ ID NO: 564686 - RNA, 18 nt, Coxiella burnetii RSA 493
aaauuuugaauccucagu

SEQ ID NO: 564687 - RNA, 18 nt, Coxiella burnetii RSA 493
aacaaacguucaucguca

SEQ ID NO: 564688 - RNA, 22 nt, Coxiella burnetii RSA 493
aacaaacgaauggcccaauaaa

SEQ ID NO: 564689 - RNA, 23 nt, Coxiella burnetii RSA 493
aacaaacgauaaucucaucaucu

SEQ ID NO: 564690 - RNA, 17 nt, Coxiella burnetii RSA 493
aacaaaggcacaaagau

SEQ ID NO: 564691 - RNA, 23 nt, Coxiella burnetii RSA 493
aacaaaguaaguagcucuuaaaa

SEQ ID NO: 564692 - RNA, 16 nt, Coxiella burnetii RSA 493
aacaaaaucaccagaa

SEQ ID NO: 564693 - RNA, 15 nt, Coxiella burnetii RSA 493
aacaacguaacugau

SEQ ID NO: 564694 - RNA, 22 nt, Coxiella burnetii RSA 493
aacaacguuucgacaucggcuu

SEQ ID NO: 564695 - RNA, 15 nt, Coxiella burnetii RSA 493
aacaacgaaaucuac

SEQ ID NO: 564696 - RNA, 23 nt, Coxiella burnetii RSA 493
aacaacugcgccgcaaaguaaaa

SEQ ID NO: 564697 - RNA, 16 nt, Coxiella burnetii RSA 493
aacaacuaccugauaa

SEQ ID NO: 564698 - RNA, 23 nt, Coxiella burnetii RSA 493
aacaagaauggcgggaaaaaaua

SEQ ID NO: 564699 - RNA, 12 nt, Coxiella burnetii RSA 493
aacaagcuggca

SEQ ID NO: 564700 - RNA, 21 nt, Coxiella burnetii RSA 493
aacaagcuggcauugaaaauc

SEQ ID NO: 564701 - RNA, 14 nt, Coxiella burnetii RSA 493
aaauugacaaauaa

SEQ ID NO: 564702 - RNA, 18 nt, Coxiella burnetii RSA 493
aaauugaauauaacuuuc

SEQ ID NO: 564703 - RNA, 15 nt, Coxiella burnetii RSA 493
aaauuccaaaaacau

SEQ ID NO: 564704 - RNA, 17 nt, Coxiella burnetii RSA 493
aaauugcucuuuuucca

SEQ ID NO: 564705 - RNA, 18 nt, Coxiella burnetii RSA 493
aaauugcugaauugauaa

SEQ ID NO: 564706 - RNA, 16 nt, Coxiella burnetii RSA 493
aaauugcggaaauuuc

SEQ ID NO: 564707 - RNA, 20 nt, Coxiella burnetii RSA 493
aaauugcacauggaaaaacg

SEQ ID NO: 564708 - RNA, 20 nt, Coxiella burnetii RSA 493
aaauugauuagcaucuugaa

SEQ ID NO: 564709 - RNA, 18 nt, Coxiella burnetii RSA 493
aaauuguccuuuucuauu

SEQ ID NO: 564710 - RNA, 19 nt, Coxiella burnetii RSA 493
aaauuuaauaagucuuugc

SEQ ID NO: 564711 - RNA, 14 nt, Coxiella burnetii RSA 493
aaauuuacuuuacg

SEQ ID NO: 564712 - RNA, 13 nt, Coxiella burnetii RSA 493
aaauuuaaaguuu

SEQ ID NO: 564713 - RNA, 22 nt, Coxiella burnetii RSA 493
aaauuugcauuaaucuuccauu

SEQ ID NO: 564714 - RNA, 21 nt, Coxiella burnetii RSA 493
aaauuucuuuccagccuuuag

SEQ ID NO: 564715 - RNA, 13 nt, Coxiella burnetii RSA 493
aaauuugauuaau

SEQ ID NO: 564716 - RNA, 21 nt, Coxiella burnetii RSA 493
aaauuucucaucugucaucau

SEQ ID NO: 564717 - RNA, 16 nt, Coxiella burnetii RSA 493
aaauaccuuugcaaac

SEQ ID NO: 564718 - RNA, 20 nt, Coxiella burnetii RSA 493
aaauaauugauuguucggcu

SEQ ID NO: 564719 - RNA, 20 nt, Coxiella burnetii RSA 493
aaauaaugugacucauuacu

SEQ ID NO: 564720 - RNA, 21 nt, Coxiella burnetii RSA 493
aaauaaugugacucauuacua

SEQ ID NO: 564721 - RNA, 19 nt, Coxiella burnetii RSA 493
aaauaucaucaacagaaca

SEQ ID NO: 564722 - RNA, 14 nt, Coxiella burnetii RSA 493
aaauagaauuuuug

SEQ ID NO: 564723 - RNA, 17 nt, Coxiella burnetii RSA 493
aaauagacuucgcuaaa

SEQ ID NO: 564724 - RNA, 19 nt, Coxiella burnetii RSA 493
aaauagcacuaucucuuaa

SEQ ID NO: 564725 - RNA, 15 nt, Coxiella burnetii RSA 493
aaaguagaaaacuuu

SEQ ID NO: 564726 - RNA, 17 nt, Coxiella burnetii RSA 493
aaagugguaagcuugcu

SEQ ID NO: 564727 - RNA, 17 nt, Coxiella burnetii RSA 493
aaaguguagguuuucaa

SEQ ID NO: 564728 - RNA, 20 nt, Coxiella burnetii RSA 493
aaaguguagguuuucaacaa

SEQ ID NO: 564729 - RNA, 12 nt, Coxiella burnetii RSA 493
aaagugauuuuu

SEQ ID NO: 564730 - RNA, 15 nt, Coxiella burnetii RSA 493
aaagugauuuuucuu

SEQ ID NO: 564731 - RNA, 22 nt, Coxiella burnetii RSA 493
aaaguuacgccccaaaguuccg

SEQ ID NO: 564732 - RNA, 22 nt, Coxiella burnetii RSA 493
aaaguucauuaaguauauuugc

SEQ ID NO: 564733 - RNA, 14 nt, Coxiella burnetii RSA 493
aaaguuauuucuuu

SEQ ID NO: 564734 - RNA, 12 nt, Coxiella burnetii RSA 493
aaaguuucauaa

SEQ ID NO: 564735 - RNA, 16 nt, Coxiella burnetii RSA 493
aaaguuuagaaaaaug

SEQ ID NO: 564736 - RNA, 18 nt, Coxiella burnetii RSA 493
aaaguuuagaaaaaugcu

SEQ ID NO: 564737 - RNA, 13 nt, Coxiella burnetii RSA 493
aaagguaaaaaga

SEQ ID NO: 564738 - RNA, 19 nt, Coxiella burnetii RSA 493
aaaggcuaauaggaaaaau

SEQ ID NO: 564739 - RNA, 20 nt, Coxiella burnetii RSA 493
aaaggcuaauaggaaaaaug

SEQ ID NO: 564740 - RNA, 13 nt, Coxiella burnetii RSA 493
aaaguaaauuuau

SEQ ID NO: 564741 - RNA, 20 nt, Coxiella burnetii RSA 493
aaagccuaaguuuaacagac

SEQ ID NO: 564742 - RNA, 23 nt, Coxiella burnetii RSA 493
aaagcgagcaaucaaaacagcaa

SEQ ID NO: 564743 - RNA, 18 nt, Coxiella burnetii RSA 493
aaagcgcccaaaugaucg

SEQ ID NO: 564744 - RNA, 22 nt, Coxiella burnetii RSA 493
aaagaauuucucgauaaaaaca

SEQ ID NO: 564745 - RNA, 13 nt, Coxiella burnetii RSA 493
aaagaaagcagau

SEQ ID NO: 564746 - RNA, 13 nt, Coxiella burnetii RSA 493
aaagaaaaaaaac

SEQ ID NO: 564747 - RNA, 22 nt, Coxiella burnetii RSA 493
aaaccuacacuuuuaaucacau

SEQ ID NO: 564748 - RNA, 23 nt, Coxiella burnetii RSA 493
aaaccuaccgagucaaaaauaaa

SEQ ID NO: 564749 - RNA, 13 nt, Coxiella burnetii RSA 493
aaaccuacuuuuc

SEQ ID NO: 564750 - RNA, 15 nt, Coxiella burnetii RSA 493
aaaccuacuuuucua

SEQ ID NO: 564751 - RNA, 17 nt, Coxiella burnetii RSA 493
aaaccuauccaaaaaga

SEQ ID NO: 564752 - RNA, 20 nt, Coxiella burnetii RSA 493
aaaccuauccaaaaagauaa

SEQ ID NO: 564753 - RNA, 15 nt, Coxiella burnetii RSA 493
aaaccuaaagaaaga

SEQ ID NO: 564754 - RNA, 19 nt, Coxiella burnetii RSA 493
aaaccuaaagaaagaagaa

SEQ ID NO: 564755 - RNA, 14 nt, Coxiella burnetii RSA 493
aaagcaaugaaaua

SEQ ID NO: 564756 - RNA, 22 nt, Coxiella burnetii RSA 493
aaagcaacgacuucucuuucug

SEQ ID NO: 564757 - RNA, 17 nt, Coxiella burnetii RSA 493
aaagacauuguucauaa

SEQ ID NO: 564758 - RNA, 18 nt, Coxiella burnetii RSA 493
aaagacauuguucauaaa

SEQ ID NO: 564759 - RNA, 13 nt, Coxiella burnetii RSA 493
aaagacaacuuua

SEQ ID NO: 564760 - RNA, 20 nt, Coxiella burnetii RSA 493
aaagaucuccccuucuuuaa

SEQ ID NO: 564761 - RNA, 22 nt, Coxiella burnetii RSA 493
aaagaucuccuugaggaauuuu

SEQ ID NO: 564762 - RNA, 19 nt, Coxiella burnetii RSA 493
aaagaguauuuuuuuuaaa

SEQ ID NO: 564763 - RNA, 22 nt, Coxiella burnetii RSA 493
aaagaguauuuuuuuuaaaauu

SEQ ID NO: 564764 - RNA, 18 nt, Coxiella burnetii RSA 493
caaagacuuugcuguucc

SEQ ID NO: 564765 - RNA, 15 nt, Coxiella burnetii RSA 493
caaagcagauaaaug

SEQ ID NO: 564766 - RNA, 16 nt, Coxiella burnetii RSA 493
caaauaauaugaauau

SEQ ID NO: 564767 - RNA, 23 nt, Coxiella burnetii RSA 493
caaauaaugaguggcugcuucuu

SEQ ID NO: 564768 - RNA, 21 nt, Coxiella burnetii RSA 493
caaagugaucauaguggauga

SEQ ID NO: 564769 - RNA, 11 nt, Coxiella burnetii RSA 493
caaaguuucac

SEQ ID NO: 564770 - RNA, 21 nt, Coxiella burnetii RSA 493
caaauaaacaaguuaacaaaa

SEQ ID NO: 564771 - RNA, 13 nt, Coxiella burnetii RSA 493
caaaauaugauaa

SEQ ID NO: 564772 - RNA, 20 nt, Coxiella burnetii RSA 493
caaaaucaccagaaaacguu

SEQ ID NO: 564773 - RNA, 22 nt, Coxiella burnetii RSA 493
caaaauaagucgcaauuugaug

SEQ ID NO: 564774 - RNA, 13 nt, Coxiella burnetii RSA 493
caaaauaauaacc

SEQ ID NO: 564775 - RNA, 12 nt, Coxiella burnetii RSA 493
caaaauaauaau

SEQ ID NO: 564776 - RNA, 18 nt, Coxiella burnetii RSA 493
caaaacccauccaucccg

SEQ ID NO: 564777 - RNA, 13 nt, Coxiella burnetii RSA 493
caaaauuuuucau

SEQ ID NO: 564778 - RNA, 19 nt, Coxiella burnetii RSA 493
caaacagugccccuccucu

SEQ ID NO: 564779 - RNA, 16 nt, Coxiella burnetii RSA 493
caaacagcgaaaacaa

SEQ ID NO: 564780 - RNA, 19 nt, Coxiella burnetii RSA 493
caaacgccaucgauuuugu

SEQ ID NO: 564781 - RNA, 15 nt, Coxiella burnetii RSA 493
caaacuacucucaaa

SEQ ID NO: 564782 - RNA, 22 nt, Coxiella burnetii RSA 493
caaaugggcugugguuguuucg

SEQ ID NO: 564783 - RNA, 21 nt, Coxiella burnetii RSA 493
caaauucuuggaugaccgcug

SEQ ID NO: 564784 - RNA, 19 nt, Coxiella burnetii RSA 493
caaauuuucccaggaaaga

SEQ ID NO: 564785 - RNA, 22 nt, Coxiella burnetii RSA 493
caaauuuuccgugcagaaacaa

SEQ ID NO: 564786 - RNA, 13 nt, Coxiella burnetii RSA 493
caaauuuuaaagg

SEQ ID NO: 564787 - RNA, 17 nt, Coxiella burnetii RSA 493
caaauuuuaaagguucu

SEQ ID NO: 564788 - RNA, 16 nt, Coxiella burnetii RSA 493
caacaagcguuguaaa

SEQ ID NO: 564789 - RNA, 23 nt, Coxiella burnetii RSA 493
caacaagcguuguaaauuuugcc

SEQ ID NO: 564790 - RNA, 13 nt, Coxiella burnetii RSA 493
caacaagaaaaau

SEQ ID NO: 564791 - RNA, 16 nt, Coxiella burnetii RSA 493
caacaaucaguuuuga

SEQ ID NO: 564792 - RNA, 23 nt, Coxiella burnetii RSA 493
caacauauggcccacuuggaaau

SEQ ID NO: 564793 - RNA, 19 nt, Coxiella burnetii RSA 493
caacgaugcugauagcauu

SEQ ID NO: 564794 - RNA, 14 nt, Coxiella burnetii RSA 493
caacgauaaaauua

SEQ ID NO: 564795 - RNA, 17 nt, Coxiella burnetii RSA 493
caacgauaaaauuacua

SEQ ID NO: 564796 - RNA, 13 nt, Coxiella burnetii RSA 493
caaccgcaugaau

SEQ ID NO: 564797 - RNA, 19 nt, Coxiella burnetii RSA 493
caaccgcaugaauuaaaua

SEQ ID NO: 564798 - RNA, 23 nt, Coxiella burnetii RSA 493
caacguuugauuuucaaguuuau

SEQ ID NO: 564799 - RNA, 19 nt, Coxiella burnetii RSA 493
caacuaccugauaaaauaa

SEQ ID NO: 564800 - RNA, 13 nt, Coxiella burnetii RSA 493
caacuuuaacauu

SEQ ID NO: 564801 - RNA, 17 nt, Coxiella burnetii RSA 493
caagaaaaauuccaaaa

SEQ ID NO: 564802 - RNA, 17 nt, Coxiella burnetii RSA 493
caagaaauugcggaaau

SEQ ID NO: 564803 - RNA, 20 nt, Coxiella burnetii RSA 493
caagaaauugcggaaauuuc

SEQ ID NO: 564804 - RNA, 18 nt, Coxiella burnetii RSA 493
caagaaccgcgacuaaac

SEQ ID NO: 564805 - RNA, 21 nt, Coxiella burnetii RSA 493
caagaaccgcgacuaaaccaa

SEQ ID NO: 564806 - RNA, 12 nt, Coxiella burnetii RSA 493
caagacucaaag

SEQ ID NO: 564807 - RNA, 16 nt, Coxiella burnetii RSA 493
caagacucaaagaaau

SEQ ID NO: 564808 - RNA, 15 nt, Coxiella burnetii RSA 493
caagaggaguucuaa

SEQ ID NO: 564809 - RNA, 16 nt, Coxiella burnetii RSA 493
caagaggaguucuaaa

SEQ ID NO: 564810 - RNA, 17 nt, Coxiella burnetii RSA 493
caagaggaguucuaaaa

SEQ ID NO: 564811 - RNA, 20 nt, Coxiella burnetii RSA 493
caagcacugcuuugguucca

SEQ ID NO: 564812 - RNA, 20 nt, Coxiella burnetii RSA 493
caagcaaagcgcguaagcag

SEQ ID NO: 564813 - RNA, 22 nt, Coxiella burnetii RSA 493
caagcgggguuaaggaaaagca

SEQ ID NO: 564814 - RNA, 20 nt, Coxiella burnetii RSA 493
caagcagggcaguaaauaga

SEQ ID NO: 564815 - RNA, 14 nt, Coxiella burnetii RSA 493
caagggcaaaaaca

SEQ ID NO: 564816 - RNA, 13 nt, Coxiella burnetii RSA 493
caaucauuuuugu

SEQ ID NO: 564817 - RNA, 14 nt, Coxiella burnetii RSA 493
caaucaucauccuu

SEQ ID NO: 564818 - RNA, 15 nt, Coxiella burnetii RSA 493
caauauuucuugaaa

SEQ ID NO: 564819 - RNA, 17 nt, Coxiella burnetii RSA 493
caaucaucaauucggau

SEQ ID NO: 564820 - RNA, 17 nt, Coxiella burnetii RSA 493
caaugaaacaaacaaaa

SEQ ID NO: 564821 - RNA, 20 nt, Coxiella burnetii RSA 493
caaugaaacaaacaaaaaau

SEQ ID NO: 564822 - RNA, 16 nt, Coxiella burnetii RSA 493
caaugcaccauuuucc

SEQ ID NO: 564823 - RNA, 15 nt, Coxiella burnetii RSA 493
caauagucuuuuuau

SEQ ID NO: 564824 - RNA, 23 nt, Coxiella burnetii RSA 493
caauacuuuccagugacucaucu

SEQ ID NO: 564825 - RNA, 14 nt, Coxiella burnetii RSA 493
caauagaauaauga

SEQ ID NO: 564826 - RNA, 23 nt, Coxiella burnetii RSA 493
caauagaggucguaccuucaauu

SEQ ID NO: 564827 - RNA, 23 nt, Coxiella burnetii RSA 493
caauacaucuugauccuuuugau

SEQ ID NO: 564828 - RNA, 18 nt, Coxiella burnetii RSA 493
caauacuguguuggaauu

SEQ ID NO: 564829 - RNA, 19 nt, Coxiella burnetii RSA 493
caaguucuuugccaccccc

SEQ ID NO: 564830 - RNA, 14 nt, Coxiella burnetii RSA 493
caaguucuucuaaa

SEQ ID NO: 564831 - RNA, 18 nt, Coxiella burnetii RSA 493
caaguucuucuaaagaau

SEQ ID NO: 564832 - RNA, 16 nt, Coxiella burnetii RSA 493
caaguaagccauauca

SEQ ID NO: 564833 - RNA, 15 nt, Coxiella burnetii RSA 493
caauaacaaauaaac

SEQ ID NO: 564834 - RNA, 15 nt, Coxiella burnetii RSA 493
caauaacaaaugaug

SEQ ID NO: 564835 - RNA, 17 nt, Coxiella burnetii RSA 493
caauaacaagcucccag

SEQ ID NO: 564836 - RNA, 19 nt, Coxiella burnetii RSA 493
caauaacauaucuucaaca

SEQ ID NO: 564837 - RNA, 21 nt, Coxiella burnetii RSA 493
caauaaucucacacaacucca

SEQ ID NO: 564838 - RNA, 16 nt, Coxiella burnetii RSA 493
caauuguuugaaaaaa

SEQ ID NO: 564839 - RNA, 20 nt, Coxiella burnetii RSA 493
caauuguuugaaaaaauacc

SEQ ID NO: 564840 - RNA, 23 nt, Coxiella burnetii RSA 493
caauuguuuguuguguugagaga

SEQ ID NO: 564841 - RNA, 11 nt, Coxiella burnetii RSA 493
caauuuaauug

SEQ ID NO: 564842 - RNA, 18 nt, Coxiella burnetii RSA 493
caauuuaccaauuaaaga

SEQ ID NO: 564843 - RNA, 20 nt, Coxiella burnetii RSA 493
caauuuaccaauuaaagaau

SEQ ID NO: 564844 - RNA, 19 nt, Coxiella burnetii RSA 493
caauuuuauaaacgcccuc

SEQ ID NO: 564845 - RNA, 16 nt, Coxiella burnetii RSA 493
cacaaaagguaaaaaa

SEQ ID NO: 564846 - RNA, 22 nt, Coxiella burnetii RSA 493
cacaaaauaagucgcaauuuga

SEQ ID NO: 564847 - RNA, 21 nt, Coxiella burnetii RSA 493
cacaaagauuuagggcuuuac

SEQ ID NO: 564848 - RNA, 15 nt, Coxiella burnetii RSA 493
caauuuuucuuuuuu

SEQ ID NO: 564849 - RNA, 23 nt, Coxiella burnetii RSA 493
caauuuuucuuuuuuuucuucuu

SEQ ID NO: 564850 - RNA, 17 nt, Coxiella burnetii RSA 493
caauuuuuuagaaagaa

SEQ ID NO: 564851 - RNA, 21 nt, Coxiella burnetii RSA 493
caauuuuuuugauaggauuau

SEQ ID NO: 564852 - RNA, 15 nt, Coxiella burnetii RSA 493
caauuagcauuuucu

SEQ ID NO: 564853 - RNA, 14 nt, Coxiella burnetii RSA 493
caauuauacugaca

SEQ ID NO: 564854 - RNA, 24 nt, Coxiella burnetii RSA 493
caauuauccuggccugaucauaaa

SEQ ID NO: 564855 - RNA, 21 nt, Coxiella burnetii RSA 493
caauuaucuuaaugaaauuuc

SEQ ID NO: 564856 - RNA, 15 nt, Coxiella burnetii RSA 493
caauugaguuagcau

SEQ ID NO: 564857 - RNA, 16 nt, Coxiella burnetii RSA 493
caauugaguuagcaua

SEQ ID NO: 564858 - RNA, 11 nt, Coxiella burnetii RSA 493
caauucuuuuu

SEQ ID NO: 564859 - RNA, 15 nt, Coxiella burnetii RSA 493
caauucaauuuuuuu

SEQ ID NO: 564860 - RNA, 14 nt, Coxiella burnetii RSA 493
caauguuucaaucu

SEQ ID NO: 564861 - RNA, 17 nt, Coxiella burnetii RSA 493
caauguuuccaaauaau

SEQ ID NO: 564862 - RNA, 15 nt, Coxiella burnetii RSA 493
caaugcguuuuaaau

SEQ ID NO: 564863 - RNA, 12 nt, Coxiella burnetii RSA 493
caauuaaagaau

SEQ ID NO: 564864 - RNA, 18 nt, Coxiella burnetii RSA 493
caauuaaagaaucguaau

SEQ ID NO: 564865 - RNA, 18 nt, Coxiella burnetii RSA 493
caauuaacuuugcaaagc

SEQ ID NO: 564866 - RNA, 19 nt, Coxiella burnetii RSA 493
caauuaaggucugggugau

SEQ ID NO: 564867 - RNA, 15 nt, Coxiella burnetii RSA 493
caauuacuuaaauua

SEQ ID NO: 564868 - RNA, 20 nt, Coxiella burnetii RSA 493
cacaggcuccgggaauagga

SEQ ID NO: 564869 - RNA, 19 nt, Coxiella burnetii RSA 493
cacaauuucaacuucaguu

SEQ ID NO: 564870 - RNA, 22 nt, Coxiella burnetii RSA 493
cacaccccucgguucaagcacu

SEQ ID NO: 564871 - RNA, 18 nt, Coxiella burnetii RSA 493
cacauuucggacaacaaa

SEQ ID NO: 564872 - RNA, 22 nt, Coxiella burnetii RSA 493
cacauuucggacaacaaauaaa

SEQ ID NO: 564873 - RNA, 13 nt, Coxiella burnetii RSA 493
cacaucuguuaac

SEQ ID NO: 564874 - RNA, 15 nt, Coxiella burnetii RSA 493
cacaucuucacgcau

SEQ ID NO: 564875 - RNA, 19 nt, Coxiella burnetii RSA 493
cacaucguuucaaacacuu

SEQ ID NO: 564876 - RNA, 21 nt, Coxiella burnetii RSA 493
cacaguucuuaacgaagguuu

SEQ ID NO: 564877 - RNA, 23 nt, Coxiella burnetii RSA 493
cacaguucuuaacgaagguuuca

SEQ ID NO: 564878 - RNA, 15 nt, Coxiella burnetii RSA 493
caccacuuugccccg

SEQ ID NO: 564879 - RNA, 22 nt, Coxiella burnetii RSA 493
caccagaaaacguuucaucaaa

SEQ ID NO: 564880 - RNA, 15 nt, Coxiella burnetii RSA 493
aaaaguuuagaaaaa

SEQ ID NO: 564881 - RNA, 20 nt, Coxiella burnetii RSA 493
caccauauccaacauauggc

SEQ ID NO: 564882 - RNA, 15 nt, Coxiella burnetii RSA 493
caccagggguuauaa

SEQ ID NO: 564883 - RNA, 17 nt, Coxiella burnetii RSA 493
cacccaaccaauaagcu

SEQ ID NO: 564884 - RNA, 22 nt, Coxiella burnetii RSA 493
cacccgcaaacuucauuaaauc

SEQ ID NO: 564885 - RNA, 15 nt, Coxiella burnetii RSA 493
aaaauaagaaacuuu

SEQ ID NO: 564886 - RNA, 16 nt, Coxiella burnetii RSA 493
aaaauaagaaacuuug

SEQ ID NO: 564887 - RNA, 22 nt, Coxiella burnetii RSA 493
caccuucuucuuuggauugcuc

SEQ ID NO: 564888 - RNA, 20 nt, Coxiella burnetii RSA 493
cacgaacgcuuugaauggcu

SEQ ID NO: 564889 - RNA, 13 nt, Coxiella burnetii RSA 493
aaaauacuuaaaa

SEQ ID NO: 564890 - RNA, 19 nt, Coxiella burnetii RSA 493
cacgaucaccgccgauggc

SEQ ID NO: 564891 - RNA, 22 nt, Coxiella burnetii RSA 493
cacgccaaggcuauuccccuuc

SEQ ID NO: 564892 - RNA, 14 nt, Coxiella burnetii RSA 493
cacgguaauaauau

SEQ ID NO: 564893 - RNA, 18 nt, Coxiella burnetii RSA 493
cacguauugcaauauuua

SEQ ID NO: 564894 - RNA, 18 nt, Coxiella burnetii RSA 493
auuucauucauucgcuuu

SEQ ID NO: 564895 - RNA, 15 nt, Coxiella burnetii RSA 493
auuucauuuaauaaa

SEQ ID NO: 564896 - RNA, 16 nt, Coxiella burnetii RSA 493
auuucauuuaauaaau

SEQ ID NO: 564897 - RNA, 17 nt, Coxiella burnetii RSA 493
auuuccacuuguuuuuc

SEQ ID NO: 564898 - RNA, 23 nt, Coxiella burnetii RSA 493
auuuccugaaccuaaauuauaaa

SEQ ID NO: 564899 - RNA, 14 nt, Coxiella burnetii RSA 493
auuuccuuuucauu

SEQ ID NO: 564900 - RNA, 16 nt, Coxiella burnetii RSA 493
auuuccuuuucauuuu

SEQ ID NO: 564901 - RNA, 16 nt, Coxiella burnetii RSA 493
auuucgagauuauuau

SEQ ID NO: 564902 - RNA, 22 nt, Coxiella burnetii RSA 493
auuucuaucgccguuucugcuu

SEQ ID NO: 564903 - RNA, 11 nt, Coxiella burnetii RSA 493
auuucacuuua

SEQ ID NO: 564904 - RNA, 18 nt, Coxiella burnetii RSA 493
auuucacuuuauuuucau

SEQ ID NO: 564905 - RNA, 20 nt, Coxiella burnetii RSA 493
auuuaggggugaauuuuugc

SEQ ID NO: 564906 - RNA, 21 nt, Coxiella burnetii RSA 493
auuuaggcucaauuuauccgc

SEQ ID NO: 564907 - RNA, 18 nt, Coxiella burnetii RSA 493
auuuauaacaagguuuua

SEQ ID NO: 564908 - RNA, 20 nt, Coxiella burnetii RSA 493
auuuauaacaagguuuuauu

SEQ ID NO: 564909 - RNA, 13 nt, Coxiella burnetii RSA 493
auuucaaguaauc

SEQ ID NO: 564910 - RNA, 16 nt, Coxiella burnetii RSA 493
auuucaaguaaucuac

SEQ ID NO: 564911 - RNA, 18 nt, Coxiella burnetii RSA 493
auuuguuauugcuaaaau

SEQ ID NO: 564912 - RNA, 24 nt, Coxiella burnetii RSA 493
auuuguucgauacagccuucauga

SEQ ID NO: 564913 - RNA, 17 nt, Coxiella burnetii RSA 493
auuuguucguaauaaua

SEQ ID NO: 564914 - RNA, 16 nt, Coxiella burnetii RSA 493
auuuguucuaaaucgg

SEQ ID NO: 564915 - RNA, 12 nt, Coxiella burnetii RSA 493
auuuguucuuua

SEQ ID NO: 564916 - RNA, 19 nt, Coxiella burnetii RSA 493
auuuguugaacagagugau

SEQ ID NO: 564917 - RNA, 16 nt, Coxiella burnetii RSA 493
auuuguauggcgccug

SEQ ID NO: 564918 - RNA, 18 nt, Coxiella burnetii RSA 493
auuugcugaauuuuauug

SEQ ID NO: 564919 - RNA, 15 nt, Coxiella burnetii RSA 493
auuuggauugccaau

SEQ ID NO: 564920 - RNA, 19 nt, Coxiella burnetii RSA 493
auuucuugucgaaaacuag

SEQ ID NO: 564921 - RNA, 18 nt, Coxiella burnetii RSA 493
auuucuuuucuaaauaau

SEQ ID NO: 564922 - RNA, 13 nt, Coxiella burnetii RSA 493
auuugauuaugcu

SEQ ID NO: 564923 - RNA, 22 nt, Coxiella burnetii RSA 493
auuugcagccgccaauuuuguu

SEQ ID NO: 564924 - RNA, 15 nt, Coxiella burnetii RSA 493
auuugcaguuugcag

SEQ ID NO: 564925 - RNA, 16 nt, Coxiella burnetii RSA 493
auuugcggaaaaggag

SEQ ID NO: 564926 - RNA, 20 nt, Coxiella burnetii RSA 493
auuugcggaaaaggagaaag

SEQ ID NO: 564927 - RNA, 22 nt, Coxiella burnetii RSA 493
auuugcggaaaaggagaaagug

SEQ ID NO: 564928 - RNA, 13 nt, Coxiella burnetii RSA 493
caaaacagcccca

SEQ ID NO: 564929 - RNA, 20 nt, Coxiella burnetii RSA 493
caaaaauacaagcugacaau

SEQ ID NO: 564930 - RNA, 23 nt, Coxiella burnetii RSA 493
caaaaauacaagcugacaauagg

SEQ ID NO: 564931 - RNA, 17 nt, Coxiella burnetii RSA 493
caaaaacgacaagcccc

SEQ ID NO: 564932 - RNA, 23 nt, Coxiella burnetii RSA 493
caaaaacccauaacgaaaauugu

SEQ ID NO: 564933 - RNA, 17 nt, Coxiella burnetii RSA 493
caaaaacagauuuaaau

SEQ ID NO: 564934 - RNA, 13 nt, Coxiella burnetii RSA 493
caaaaacauuauu

SEQ ID NO: 564935 - RNA, 20 nt, Coxiella burnetii RSA 493
auuuuuauuuccagcaguaa

SEQ ID NO: 564936 - RNA, 20 nt, Coxiella burnetii RSA 493
auuuuugugcguaucuuuca

SEQ ID NO: 564937 - RNA, 14 nt, Coxiella burnetii RSA 493
auuuuuuaaaucuu

SEQ ID NO: 564938 - RNA, 22 nt, Coxiella burnetii RSA 493
auuuuuaugcuucaauaaaaaa

SEQ ID NO: 564939 - RNA, 13 nt, Coxiella burnetii RSA 493
auuuuuuuuaaaa

SEQ ID NO: 564940 - RNA, 18 nt, Coxiella burnetii RSA 493
auuuuuuggaaugagcau

SEQ ID NO: 564941 - RNA, 20 nt, Coxiella burnetii RSA 493
auuuuuuggaaugagcauaa

SEQ ID NO: 564942 - RNA, 23 nt, Coxiella burnetii RSA 493
auuuuuuggcauccucaucaaac

SEQ ID NO: 564943 - RNA, 11 nt, Coxiella burnetii RSA 493
auuuuuuucuu

SEQ ID NO: 564944 - RNA, 13 nt, Coxiella burnetii RSA 493
auuuuuuugccag

SEQ ID NO: 564945 - RNA, 22 nt, Coxiella burnetii RSA 493
auuuuuuugccggacuuuuuca

SEQ ID NO: 564946 - RNA, 16 nt, Coxiella burnetii RSA 493
auuuucauuuucucua

SEQ ID NO: 564947 - RNA, 18 nt, Coxiella burnetii RSA 493
auuuucauuuucucuaau

SEQ ID NO: 564948 - RNA, 18 nt, Coxiella burnetii RSA 493
auuuucccaggaaagaaa

SEQ ID NO: 564949 - RNA, 23 nt, Coxiella burnetii RSA 493
auuuuggugcuggcguuuuuaac

SEQ ID NO: 564950 - RNA, 19 nt, Coxiella burnetii RSA 493
auuuuguagauuagaaaaa

SEQ ID NO: 564951 - RNA, 16 nt, Coxiella burnetii RSA 493
auuuugaauuuugccu

SEQ ID NO: 564952 - RNA, 16 nt, Coxiella burnetii RSA 493
auuuagcgauuuugac

SEQ ID NO: 564953 - RNA, 15 nt, Coxiella burnetii RSA 493
auuuagaaaaaauac

SEQ ID NO: 564954 - RNA, 15 nt, Coxiella burnetii RSA 493
auuuacaauaacaaa

SEQ ID NO: 564955 - RNA, 20 nt, Coxiella burnetii RSA 493
auuuaccaauuaaagaaucg

SEQ ID NO: 564956 - RNA, 20 nt, Coxiella burnetii RSA 493
auuuaccuccaaaacccauc

SEQ ID NO: 564957 - RNA, 13 nt, Coxiella burnetii RSA 493
auuuaaaaaacua

SEQ ID NO: 564958 - RNA, 13 nt, Coxiella burnetii RSA 493
auuguuuucgaua

SEQ ID NO: 564959 - RNA, 19 nt, Coxiella burnetii RSA 493
auuuaauugggaagcaauu

SEQ ID NO: 564960 - RNA, 13 nt, Coxiella burnetii RSA 493
auuuaauuuuaaa

SEQ ID NO: 564961 - RNA, 14 nt, Coxiella burnetii RSA 493
auuuaauuuuaaau

SEQ ID NO: 564962 - RNA, 17 nt, Coxiella burnetii RSA 493
auuuaaucuacucuacu

SEQ ID NO: 564963 - RNA, 18 nt, Coxiella burnetii RSA 493
auugcgccgguuuaaaac

SEQ ID NO: 564964 - RNA, 14 nt, Coxiella burnetii RSA 493
auugcugaacaaaa

SEQ ID NO: 564965 - RNA, 14 nt, Coxiella burnetii RSA 493
auugaguuuuugac

SEQ ID NO: 564966 - RNA, 17 nt, Coxiella burnetii RSA 493
auugauaaaccguuucu

SEQ ID NO: 564967 - RNA, 18 nt, Coxiella burnetii RSA 493
auugauugcguaaugcaa

SEQ ID NO: 564968 - RNA, 12 nt, Coxiella burnetii RSA 493
auugauuuuguc

SEQ ID NO: 564969 - RNA, 20 nt, Coxiella burnetii RSA 493
auugauuuuguccuguucuu

SEQ ID NO: 564970 - RNA, 15 nt, Coxiella burnetii RSA 493
auuccugaaguaauu

SEQ ID NO: 564971 - RNA, 20 nt, Coxiella burnetii RSA 493
auuccugaaguaauuuuucg

SEQ ID NO: 564972 - RNA, 20 nt, Coxiella burnetii RSA 493
auucccuuuuucguguuuuu

SEQ ID NO: 564973 - RNA, 24 nt, Coxiella burnetii RSA 493
auuccagcacccgccgcaacuaaa

SEQ ID NO: 564974 - RNA, 13 nt, Coxiella burnetii RSA 493
auucccagauaaa

SEQ ID NO: 564975 - RNA, 20 nt, Coxiella burnetii RSA 493
auucggauacgaccuucuga

SEQ ID NO: 564976 - RNA, 16 nt, Coxiella burnetii RSA 493
auucgcuuuuuugcuu

SEQ ID NO: 564977 - RNA, 22 nt, Coxiella burnetii RSA 493
auucgcuuuuuugcuucuucca

SEQ ID NO: 564978 - RNA, 15 nt, Coxiella burnetii RSA 493
auucgauauguuuca

SEQ ID NO: 564979 - RNA, 21 nt, Coxiella burnetii RSA 493
auucgaacgacuuuuuuuacc

SEQ ID NO: 564980 - RNA, 20 nt, Coxiella burnetii RSA 493
auuccuguggaagguugaga

SEQ ID NO: 564981 - RNA, 18 nt, Coxiella burnetii RSA 493
auugaggaaaauaagaug

SEQ ID NO: 564982 - RNA, 16 nt, Coxiella burnetii RSA 493
auugagcggcuuuuuc

SEQ ID NO: 564983 - RNA, 21 nt, Coxiella burnetii RSA 493
auugaguggugguagaauucu

SEQ ID NO: 564984 - RNA, 20 nt, Coxiella burnetii RSA 493
auugaggucguuaaaaaauu

SEQ ID NO: 564985 - RNA, 18 nt, Coxiella burnetii RSA 493
auugaguauccaacucuc

SEQ ID NO: 564986 - RNA, 17 nt, Coxiella burnetii RSA 493
auugacuucuuugugag

SEQ ID NO: 564987 - RNA, 20 nt, Coxiella burnetii RSA 493
auugagaaucucuucgaguu

SEQ ID NO: 564988 - RNA, 15 nt, Coxiella burnetii RSA 493
auugaagaauuuguu

SEQ ID NO: 564989 - RNA, 12 nt, Coxiella burnetii RSA 493
auugaaguccuu

SEQ ID NO: 564990 - RNA, 23 nt, Coxiella burnetii RSA 493
auugaauggacgugcaaaugagu

SEQ ID NO: 564991 - RNA, 17 nt, Coxiella burnetii RSA 493
auugacagccagcaauu

SEQ ID NO: 564992 - RNA, 14 nt, Coxiella burnetii RSA 493
auugacaaauaaag

SEQ ID NO: 564993 - RNA, 14 nt, Coxiella burnetii RSA 493
auucuuuuggcauu

SEQ ID NO: 564994 - RNA, 19 nt, Coxiella burnetii RSA 493
auucuuuuggcauuguucu

SEQ ID NO: 564995 - RNA, 12 nt, Coxiella burnetii RSA 493
auucuuauccuu

SEQ ID NO: 564996 - RNA, 22 nt, Coxiella burnetii RSA 493
auucuuucauuaauuccaucac

SEQ ID NO: 564997 - RNA, 19 nt, Coxiella burnetii RSA 493
auucuuucauuaucuagau

SEQ ID NO: 564998 - RNA, 16 nt, Coxiella burnetii RSA 493
auucucccuuuuccug

SEQ ID NO: 564999 - RNA, 14 nt, Coxiella burnetii RSA 493
auucuuaauuuuuc

SEQ ID NO: 565000 - RNA, 16 nt, Coxiella burnetii RSA 493
auucuuaauuuuuccu

SEQ ID NO: 565001 - RNA, 20 nt, Coxiella burnetii RSA 493
auucuauaaucauuuuuccu

SEQ ID NO: 565002 - RNA, 18 nt, Coxiella burnetii RSA 493
auucuagugugauaauca

SEQ ID NO: 565003 - RNA, 15 nt, Coxiella burnetii RSA 493
augaucuaacguuuu

SEQ ID NO: 565004 - RNA, 18 nt, Coxiella burnetii RSA 493
augaucggaggaaauauu

SEQ ID NO: 565005 - RNA, 13 nt, Coxiella burnetii RSA 493
augcacucuuuaa

SEQ ID NO: 565006 - RNA, 16 nt, Coxiella burnetii RSA 493
augcccgaaaaggaaa

SEQ ID NO: 565007 - RNA, 20 nt, Coxiella burnetii RSA 493
augcgguacuuaagaaagua

SEQ ID NO: 565008 - RNA, 14 nt, Coxiella burnetii RSA 493
augcgggguuuuuu

SEQ ID NO: 565009 - RNA, 20 nt, Coxiella burnetii RSA 493
augcuauaauugaauuugag

SEQ ID NO: 565010 - RNA, 16 nt, Coxiella burnetii RSA 493
aaaagagugcaauuag

SEQ ID NO: 565011 - RNA, 22 nt, Coxiella burnetii RSA 493
augcucuuuauagaguucggua

SEQ ID NO: 565012 - RNA, 13 nt, Coxiella burnetii RSA 493
augcuaaaugcgu

SEQ ID NO: 565013 - RNA, 17 nt, Coxiella burnetii RSA 493
augcguuuuaaaugcuu

SEQ ID NO: 565014 - RNA, 22 nt, Coxiella burnetii RSA 493
augcguuuuaaaugcuuuucuu

SEQ ID NO: 565015 - RNA, 16 nt, Coxiella burnetii RSA 493
aaaagacuuuguuuua

SEQ ID NO: 565016 - RNA, 19 nt, Coxiella burnetii RSA 493
augcuaagugauugauuuu

SEQ ID NO: 565017 - RNA, 14 nt, Coxiella burnetii RSA 493
auggauuuccacuu

SEQ ID NO: 565018 - RNA, 20 nt, Coxiella burnetii RSA 493
auggccuuugcgguuaaaaa

SEQ ID NO: 565019 - RNA, 14 nt, Coxiella burnetii RSA 493
auggcgccugacaa

SEQ ID NO: 565020 - RNA, 15 nt, Coxiella burnetii RSA 493
auggcauuacaaacg

SEQ ID NO: 565021 - RNA, 16 nt, Coxiella burnetii RSA 493
auggucaaaccaauca

SEQ ID NO: 565022 - RNA, 15 nt, Coxiella burnetii RSA 493
auggucacaugauuu

SEQ ID NO: 565023 - RNA, 15 nt, Coxiella burnetii RSA 493
auggggccgcccaac

SEQ ID NO: 565024 - RNA, 15 nt, Coxiella burnetii RSA 493
augggaauuuuugaa

SEQ ID NO: 565025 - RNA, 18 nt, Coxiella burnetii RSA 493
augggaauuuuugaauac

SEQ ID NO: 565026 - RNA, 23 nt, Coxiella burnetii RSA 493
auggcuuuauucccgauggggau

SEQ ID NO: 565027 - RNA, 21 nt, Coxiella burnetii RSA 493
auggcuuguuccgccauuucc

SEQ ID NO: 565028 - RNA, 22 nt, Coxiella burnetii RSA 493
auggcuuguuccgccauuuccc

SEQ ID NO: 565029 - RNA, 23 nt, Coxiella burnetii RSA 493
auggcgcuuucguuaagccugaa

SEQ ID NO: 565030 - RNA, 19 nt, Coxiella burnetii RSA 493
auggucuguuucuucuuug

SEQ ID NO: 565031 - RNA, 21 nt, Coxiella burnetii RSA 493
augguuggacuacaucaaaua

SEQ ID NO: 565032 - RNA, 16 nt, Coxiella burnetii RSA 493
auguaaggcaucuuuu

SEQ ID NO: 565033 - RNA, 17 nt, Coxiella burnetii RSA 493
auguagcccaacaaaau

SEQ ID NO: 565034 - RNA, 21 nt, Coxiella burnetii RSA 493
auguaugggucgcauucuauu

SEQ ID NO: 565035 - RNA, 21 nt, Coxiella burnetii RSA 493
auguauuucaaggaaugauuc

SEQ ID NO: 565036 - RNA, 21 nt, Coxiella burnetii RSA 493
augucacuauuaaucauucuc

SEQ ID NO: 565037 - RNA, 12 nt, Coxiella burnetii RSA 493
augucauaauca

SEQ ID NO: 565038 - RNA, 19 nt, Coxiella burnetii RSA 493
augucauaaucacaaaagg

SEQ ID NO: 565039 - RNA, 23 nt, Coxiella burnetii RSA 493
augucauaaucacaaaagguaaa

SEQ ID NO: 565040 - RNA, 17 nt, Coxiella burnetii RSA 493
aaaagauuuuaucuuau

SEQ ID NO: 565041 - RNA, 14 nt, Coxiella burnetii RSA 493
aaaagaucuccuug

SEQ ID NO: 565042 - RNA, 23 nt, Coxiella burnetii RSA 493
aaaagauauucgguuuuuuuaaa

SEQ ID NO: 565043 - RNA, 21 nt, Coxiella burnetii RSA 493
auguauccuaauaaaaauauu

SEQ ID NO: 565044 - RNA, 13 nt, Coxiella burnetii RSA 493
auuagcuucguua

SEQ ID NO: 565045 - RNA, 15 nt, Coxiella burnetii RSA 493
auuacgauuaaucau

SEQ ID NO: 565046 - RNA, 11 nt, Coxiella burnetii RSA 493
auuagccuuaa

SEQ ID NO: 565047 - RNA, 13 nt, Coxiella burnetii RSA 493
auuagccuuaauu

SEQ ID NO: 565048 - RNA, 14 nt, Coxiella burnetii RSA 493
auuagccuuuaugc

SEQ ID NO: 565049 - RNA, 12 nt, Coxiella burnetii RSA 493
auuauaaaugga

SEQ ID NO: 565050 - RNA, 20 nt, Coxiella burnetii RSA 493
auuauaacuauuuuaaaucu

SEQ ID NO: 565051 - RNA, 13 nt, Coxiella burnetii RSA 493
auuaguuuaaauu

SEQ ID NO: 565052 - RNA, 20 nt, Coxiella burnetii RSA 493
auuaucuuaaugaaauuucu

SEQ ID NO: 565053 - RNA, 23 nt, Coxiella burnetii RSA 493
auuaugaaaacgacuuauuuuau

SEQ ID NO: 565054 - RNA, 19 nt, Coxiella burnetii RSA 493
auuaugcaagguugaugcu

SEQ ID NO: 565055 - RNA, 23 nt, Coxiella burnetii RSA 493
auuauuaaucauauaauuuuuga

SEQ ID NO: 565056 - RNA, 19 nt, Coxiella burnetii RSA 493
auuaucaugcauuugauuu

SEQ ID NO: 565057 - RNA, 12 nt, Coxiella burnetii RSA 493
auuaucaaaacg

SEQ ID NO: 565058 - RNA, 16 nt, Coxiella burnetii RSA 493
auucaggacugaaaua

SEQ ID NO: 565059 - RNA, 17 nt, Coxiella burnetii RSA 493
auucaggggcaaucaau

SEQ ID NO: 565060 - RNA, 14 nt, Coxiella burnetii RSA 493
auuauugaauuaua

SEQ ID NO: 565061 - RNA, 11 nt, Coxiella burnetii RSA 493
auucaaauaau

SEQ ID NO: 565062 - RNA, 18 nt, Coxiella burnetii RSA 493
auucaaauaauacugcaa

SEQ ID NO: 565063 - RNA, 12 nt, Coxiella burnetii RSA 493
auuauugauguc

SEQ ID NO: 565064 - RNA, 18 nt, Coxiella burnetii RSA 493
auucaauacagauuuuag

SEQ ID NO: 565065 - RNA, 15 nt, Coxiella burnetii RSA 493
auuaaccaaucaaua

SEQ ID NO: 565066 - RNA, 16 nt, Coxiella burnetii RSA 493
auuaaggucuggguga

SEQ ID NO: 565067 - RNA, 19 nt, Coxiella burnetii RSA 493
auuaagguggauuuucaaa

SEQ ID NO: 565068 - RNA, 16 nt, Coxiella burnetii RSA 493
aaaagcaccccgugaa

SEQ ID NO: 565069 - RNA, 12 nt, Coxiella burnetii RSA 493
auuaacaacaaa

SEQ ID NO: 565070 - RNA, 21 nt, Coxiella burnetii RSA 493
auuaacauauuuacuugcuuu

SEQ ID NO: 565071 - RNA, 15 nt, Coxiella burnetii RSA 493
auuaauauuaaaaca

SEQ ID NO: 565072 - RNA, 19 nt, Coxiella burnetii RSA 493
aaaagcaucaauaaugcca

SEQ ID NO: 565073 - RNA, 23 nt, Coxiella burnetii RSA 493
aaaagccaaagaccaaucguaaa

SEQ ID NO: 565074 - RNA, 18 nt, Coxiella burnetii RSA 493
auuaaugaucaaugaaac

SEQ ID NO: 565075 - RNA, 17 nt, Coxiella burnetii RSA 493
auuaauccuuauacuaa

SEQ ID NO: 565076 - RNA, 13 nt, Coxiella burnetii RSA 493
auuaaucgauuug

SEQ ID NO: 565077 - RNA, 17 nt, Coxiella burnetii RSA 493
auuaaugcgccuacaaa

SEQ ID NO: 565078 - RNA, 16 nt, Coxiella burnetii RSA 493
auuaauuauccaaaau

SEQ ID NO: 565079 - RNA, 22 nt, Coxiella burnetii RSA 493
auuaauucccaagcuuuugccu

SEQ ID NO: 565080 - RNA, 21 nt, Coxiella burnetii RSA 493
auuaauugcugauauuuuuua

SEQ ID NO: 565081 - RNA, 20 nt, Coxiella burnetii RSA 493
augucccccgagcaaagcau

SEQ ID NO: 565082 - RNA, 17 nt, Coxiella burnetii RSA 493
auguuauuuauuuuucu

SEQ ID NO: 565083 - RNA, 20 nt, Coxiella burnetii RSA 493
auguuauuuuccucccauug

SEQ ID NO: 565084 - RNA, 17 nt, Coxiella burnetii RSA 493
auguuucaauaacagag

SEQ ID NO: 565085 - RNA, 19 nt, Coxiella burnetii RSA 493
auguuucaauaacagagau

SEQ ID NO: 565086 - RNA, 15 nt, Coxiella burnetii RSA 493
auguuuccaaauaau

SEQ ID NO: 565087 - RNA, 13 nt, Coxiella burnetii RSA 493
auuaaaagcagcu

SEQ ID NO: 565088 - RNA, 21 nt, Coxiella burnetii RSA 493
auguuuccguuuggguugaga

SEQ ID NO: 565089 - RNA, 16 nt, Coxiella burnetii RSA 493
auguuuuuuaaucgag

SEQ ID NO: 565090 - RNA, 23 nt, Coxiella burnetii RSA 493
auuaaacgcgauaucuccauuuu

SEQ ID NO: 565091 - RNA, 13 nt, Coxiella burnetii RSA 493
auuaaacguauuc

SEQ ID NO: 565092 - RNA, 19 nt, Coxiella burnetii RSA 493
auuaaacguauuccaaaua

SEQ ID NO: 565093 - RNA, 22 nt, Coxiella burnetii RSA 493
auuaaacguauuccaaauaauc

SEQ ID NO: 565094 - RNA, 18 nt, Coxiella burnetii RSA 493
auuaaauuuaaucuuuau

SEQ ID NO: 565095 - RNA, 14 nt, Coxiella burnetii RSA 493
augaaaaguaaauu

SEQ ID NO: 565096 - RNA, 21 nt, Coxiella burnetii RSA 493
augaaaucccgagccccaaaa

SEQ ID NO: 565097 - RNA, 16 nt, Coxiella burnetii RSA 493
augaaaucguuuuguu

SEQ ID NO: 565098 - RNA, 13 nt, Coxiella burnetii RSA 493
aucuuuuaaauua

SEQ ID NO: 565099 - RNA, 21 nt, Coxiella burnetii RSA 493
aucuuucauguaauuuauccc

SEQ ID NO: 565100 - RNA, 20 nt, Coxiella burnetii RSA 493
aucuuuauccaaaucggcaa

SEQ ID NO: 565101 - RNA, 20 nt, Coxiella burnetii RSA 493
augaagugggggaacagagg

SEQ ID NO: 565102 - RNA, 23 nt, Coxiella burnetii RSA 493
augaaguuccauuccaaaaacag

SEQ ID NO: 565103 - RNA, 14 nt, Coxiella burnetii RSA 493
augacauuuaaaaa

SEQ ID NO: 565104 - RNA, 17 nt, Coxiella burnetii RSA 493
augacaugcgccacuaa

SEQ ID NO: 565105 - RNA, 14 nt, Coxiella burnetii RSA 493
augaggccaaaaau

SEQ ID NO: 565106 - RNA, 13 nt, Coxiella burnetii RSA 493
augaguaaaaaag

SEQ ID NO: 565107 - RNA, 22 nt, Coxiella burnetii RSA 493
augagugcauucauucuuuuuu

SEQ ID NO: 565108 - RNA, 20 nt, Coxiella burnetii RSA 493
augacuuugguaguccugag

SEQ ID NO: 565109 - RNA, 15 nt, Coxiella burnetii RSA 493
augagcgaagcgaaa

SEQ ID NO: 565110 - RNA, 18 nt, Coxiella burnetii RSA 493
augaucaaugaaacaaac

SEQ ID NO: 565111 - RNA, 14 nt, Coxiella burnetii RSA 493
augaucaucaucaa

SEQ ID NO: 565112 - RNA, 15 nt, Coxiella burnetii RSA 493
augaucauuuucuca

SEQ ID NO: 565113 - RNA, 21 nt, Coxiella burnetii RSA 493
augauaauuuuggugcuggcg

SEQ ID NO: 565114 - RNA, 17 nt, Coxiella burnetii RSA 493
augauaagguguuuuac

SEQ ID NO: 565115 - RNA, 14 nt, Coxiella burnetii RSA 493
augauacaaauuuu

SEQ ID NO: 565116 - RNA, 14 nt, Coxiella burnetii RSA 493
augaguucauuaau

SEQ ID NO: 565117 - RNA, 14 nt, Coxiella burnetii RSA 493
aucucacacaacuc

SEQ ID NO: 565118 - RNA, 19 nt, Coxiella burnetii RSA 493
aucuauauuaauuugauca

SEQ ID NO: 565119 - RNA, 14 nt, Coxiella burnetii RSA 493
aucuagauuuuccu

SEQ ID NO: 565120 - RNA, 14 nt, Coxiella burnetii RSA 493
aucgucaaauggag

SEQ ID NO: 565121 - RNA, 21 nt, Coxiella burnetii RSA 493
aucucucggugcuugcucagg

SEQ ID NO: 565122 - RNA, 17 nt, Coxiella burnetii RSA 493
aucucgauuuugguucu

SEQ ID NO: 565123 - RNA, 22 nt, Coxiella burnetii RSA 493
aucucauuaggcuuuagaagau

SEQ ID NO: 565124 - RNA, 21 nt, Coxiella burnetii RSA 493
aucuccuugaggaauuuuuca

SEQ ID NO: 565125 - RNA, 19 nt, Coxiella burnetii RSA 493
aucuuauuauucauaucuu

SEQ ID NO: 565126 - RNA, 23 nt, Coxiella burnetii RSA 493
aucuuauuauucauaucuuuuuc

SEQ ID NO: 565127 - RNA, 19 nt, Coxiella burnetii RSA 493
aucuucaacaucaacccca

SEQ ID NO: 565128 - RNA, 21 nt, Coxiella burnetii RSA 493
aucuucaacaucaaccccagc

SEQ ID NO: 565129 - RNA, 14 nt, Coxiella burnetii RSA 493
aucuucaaaaccua

SEQ ID NO: 565130 - RNA, 19 nt, Coxiella burnetii RSA 493
aucuuaaugaaauuucuca

SEQ ID NO: 565131 - RNA, 21 nt, Coxiella burnetii RSA 493
aucuucacgcauuucccaauc

SEQ ID NO: 565132 - RNA, 20 nt, Coxiella burnetii RSA 493
aaaacuagaaauauuagaaa

SEQ ID NO: 565133 - RNA, 17 nt, Coxiella burnetii RSA 493
aaaacuuccgccacuaa

SEQ ID NO: 565134 - RNA, 22 nt, Coxiella burnetii RSA 493
aucauuucgagcgcgauuuucu

SEQ ID NO: 565135 - RNA, 23 nt, Coxiella burnetii RSA 493
aucauuuuugugcguaucuuuca

SEQ ID NO: 565136 - RNA, 13 nt, Coxiella burnetii RSA 493
auccaagucuucc

SEQ ID NO: 565137 - RNA, 20 nt, Coxiella burnetii RSA 493
auccaagugugggaaaaaua

SEQ ID NO: 565138 - RNA, 18 nt, Coxiella burnetii RSA 493
auccacuuucucgcuuaa

SEQ ID NO: 565139 - RNA, 15 nt, Coxiella burnetii RSA 493
auccgacauucuucu

SEQ ID NO: 565140 - RNA, 16 nt, Coxiella burnetii RSA 493
auccgcaauaugcagc

SEQ ID NO: 565141 - RNA, 18 nt, Coxiella burnetii RSA 493
auccgaugagaaaggagu

SEQ ID NO: 565142 - RNA, 18 nt, Coxiella burnetii RSA 493
auccgcauugcauuucuu

SEQ ID NO: 565143 - RNA, 14 nt, Coxiella burnetii RSA 493
auccgccccgaaau

SEQ ID NO: 565144 - RNA, 13 nt, Coxiella burnetii RSA 493
aucccuuuaaccg

SEQ ID NO: 565145 - RNA, 18 nt, Coxiella burnetii RSA 493
aucccucggccaaagaaa

SEQ ID NO: 565146 - RNA, 13 nt, Coxiella burnetii RSA 493
aucgcuccuaaau

SEQ ID NO: 565147 - RNA, 14 nt, Coxiella burnetii RSA 493
aucgcuccuaaauu

SEQ ID NO: 565148 - RNA, 18 nt, Coxiella burnetii RSA 493
aucgcggacaauaagagc

SEQ ID NO: 565149 - RNA, 13 nt, Coxiella burnetii RSA 493
aucgguugaagaa

SEQ ID NO: 565150 - RNA, 15 nt, Coxiella burnetii RSA 493
aucggcuucacagag

SEQ ID NO: 565151 - RNA, 17 nt, Coxiella burnetii RSA 493
aucggccuacuuuuucu

SEQ ID NO: 565152 - RNA, 17 nt, Coxiella burnetii RSA 493
auccgcuuuaauacagu

SEQ ID NO: 565153 - RNA, 12 nt, Coxiella burnetii RSA 493
aucgaaauaacg

SEQ ID NO: 565154 - RNA, 10 nt, Coxiella burnetii RSA 493
auccuugagg

SEQ ID NO: 565155 - RNA, 14 nt, Coxiella burnetii RSA 493
aucgauaaaaauaa

SEQ ID NO: 565156 - RNA, 20 nt, Coxiella burnetii RSA 493
aucgccaaaagguauguugu

SEQ ID NO: 565157 - RNA, 22 nt, Coxiella burnetii RSA 493
aucgccaaaagguauguuguca

SEQ ID NO: 565158 - RNA, 20 nt, Coxiella burnetii RSA 493
auacugcuuguaccugccau

SEQ ID NO: 565159 - RNA, 17 nt, Coxiella burnetii RSA 493
auacugcccaagaaauu

SEQ ID NO: 565160 - RNA, 15 nt, Coxiella burnetii RSA 493
auacucuaaguuaug

SEQ ID NO: 565161 - RNA, 15 nt, Coxiella burnetii RSA 493
auacuccccuacuuu

SEQ ID NO: 565162 - RNA, 20 nt, Coxiella burnetii RSA 493
auacucacccacaucuggaa

SEQ ID NO: 565163 - RNA, 23 nt, Coxiella burnetii RSA 493
auaccucguccagcucguaagcg

SEQ ID NO: 565164 - RNA, 13 nt, Coxiella burnetii RSA 493
auacaggaaaaag

SEQ ID NO: 565165 - RNA, 17 nt, Coxiella burnetii RSA 493
auacgauauaaaagcau

SEQ ID NO: 565166 - RNA, 13 nt, Coxiella burnetii RSA 493
auagacuucgcua

SEQ ID NO: 565167 - RNA, 16 nt, Coxiella burnetii RSA 493
auagacuucgcuaaau

SEQ ID NO: 565168 - RNA, 18 nt, Coxiella burnetii RSA 493
auagacuucgcuaaauaa

SEQ ID NO: 565169 - RNA, 20 nt, Coxiella burnetii RSA 493
auagacuucgcuaaauaaca

SEQ ID NO: 565170 - RNA, 14 nt, Coxiella burnetii RSA 493
auagacuaccgaga

SEQ ID NO: 565171 - RNA, 18 nt, Coxiella burnetii RSA 493
auacuuuguuuuuuuuca

SEQ ID NO: 565172 - RNA, 15 nt, Coxiella burnetii RSA 493
auagaaaaaagaaau

SEQ ID NO: 565173 - RNA, 19 nt, Coxiella burnetii RSA 493
auagagucgggaaauaaaa

SEQ ID NO: 565174 - RNA, 21 nt, Coxiella burnetii RSA 493
auagagucgggaaauaaaauu

SEQ ID NO: 565175 - RNA, 13 nt, Coxiella burnetii RSA 493
auagcauuguugg

SEQ ID NO: 565176 - RNA, 20 nt, Coxiella burnetii RSA 493
auagcaucaagggcaaaaac

SEQ ID NO: 565177 - RNA, 21 nt, Coxiella burnetii RSA 493
auagcaucaagggcaaaaaca

SEQ ID NO: 565178 - RNA, 12 nt, Coxiella burnetii RSA 493
auagcacagcgu

SEQ ID NO: 565179 - RNA, 13 nt, Coxiella burnetii RSA 493
auagcgugagagg

SEQ ID NO: 565180 - RNA, 20 nt, Coxiella burnetii RSA 493
auagcauuagacauuuuucg

SEQ ID NO: 565181 - RNA, 12 nt, Coxiella burnetii RSA 493
auagugcuuuua

SEQ ID NO: 565182 - RNA, 14 nt, Coxiella burnetii RSA 493
auagugcuauuuuu

SEQ ID NO: 565183 - RNA, 15 nt, Coxiella burnetii RSA 493
auagucuugaucuuc

SEQ ID NO: 565184 - RNA, 14 nt, Coxiella burnetii RSA 493
auauaaaaguuacg

SEQ ID NO: 565185 - RNA, 20 nt, Coxiella burnetii RSA 493
auaguuuuggcguaugaaua

SEQ ID NO: 565186 - RNA, 21 nt, Coxiella burnetii RSA 493
auaguuuuggcguaugaauaa

SEQ ID NO: 565187 - RNA, 17 nt, Coxiella burnetii RSA 493
auaguuuuauuuaaaaa

SEQ ID NO: 565188 - RNA, 20 nt, Coxiella burnetii RSA 493
auauaaugggaguaaugaca

SEQ ID NO: 565189 - RNA, 12 nt, Coxiella burnetii RSA 493
auauaauugagg

SEQ ID NO: 565190 - RNA, 24 nt, Coxiella burnetii RSA 493
auauaauugagguuuuaauuugcc

SEQ ID NO: 565191 - RNA, 21 nt, Coxiella burnetii RSA 493
auauacccgaggaugaugaaa

SEQ ID NO: 565192 - RNA, 22 nt, Coxiella burnetii RSA 493
auauacccgaggaugaugaaaa

SEQ ID NO: 565193 - RNA, 18 nt, Coxiella burnetii RSA 493
auauccagguguuuuuca

SEQ ID NO: 565194 - RNA, 18 nt, Coxiella burnetii RSA 493
auaucaaaaaaccauaaa

SEQ ID NO: 565195 - RNA, 20 nt, Coxiella burnetii RSA 493
auauauugggguucauuuuu

SEQ ID NO: 565196 - RNA, 14 nt, Coxiella burnetii RSA 493
auauccuucuuuua

SEQ ID NO: 565197 - RNA, 17 nt, Coxiella burnetii RSA 493
auauccuucuuuuaaag

SEQ ID NO: 565198 - RNA, 13 nt, Coxiella burnetii RSA 493
auaucuuuuaaau

SEQ ID NO: 565199 - RNA, 19 nt, Coxiella burnetii RSA 493
auaucuuuuaaauuaacau

SEQ ID NO: 565200 - RNA, 15 nt, Coxiella burnetii RSA 493
auaucuccauuuuca

SEQ ID NO: 565201 - RNA, 21 nt, Coxiella burnetii RSA 493
auaucguagccuucuuuuuca

SEQ ID NO: 565202 - RNA, 17 nt, Coxiella burnetii RSA 493
auaucgugcucuuuuuu

SEQ ID NO: 565203 - RNA, 13 nt, Coxiella burnetii RSA 493
auaucuguuuuau

SEQ ID NO: 565204 - RNA, 22 nt, Coxiella burnetii RSA 493
auaucuguuuucgauaaaugca

SEQ ID NO: 565205 - RNA, 22 nt, Coxiella burnetii RSA 493
auauuucgcaauccucucucuc

SEQ ID NO: 565206 - RNA, 17 nt, Coxiella burnetii RSA 493
auauuuggguuuucuuu

SEQ ID NO: 565207 - RNA, 19 nt, Coxiella burnetii RSA 493
auauuuggguuuucuuuug

SEQ ID NO: 565208 - RNA, 20 nt, Coxiella burnetii RSA 493
auauuuguauccgcuuuaau

SEQ ID NO: 565209 - RNA, 22 nt, Coxiella burnetii RSA 493
aucaaaacgaaaagcugaaauu

SEQ ID NO: 565210 - RNA, 18 nt, Coxiella burnetii RSA 493
auauugauuuaaauuuaa

SEQ ID NO: 565211 - RNA, 20 nt, Coxiella burnetii RSA 493
auauugaugcguuuuuuuau

SEQ ID NO: 565212 - RNA, 22 nt, Coxiella burnetii RSA 493
auauugcugauaguuaaauggg

SEQ ID NO: 565213 - RNA, 11 nt, Coxiella burnetii RSA 493
auauucccaug

SEQ ID NO: 565214 - RNA, 14 nt, Coxiella burnetii RSA 493
aucaagaaagacau

SEQ ID NO: 565215 - RNA, 16 nt, Coxiella burnetii RSA 493
aucaaccucagguuuu

SEQ ID NO: 565216 - RNA, 16 nt, Coxiella burnetii RSA 493
aucaaaauuaaaaucu

SEQ ID NO: 565217 - RNA, 22 nt, Coxiella burnetii RSA 493
aucaaacguuuacgucuuuucu

SEQ ID NO: 565218 - RNA, 14 nt, Coxiella burnetii RSA 493
aucaaugaaacaaa

SEQ ID NO: 565219 - RNA, 23 nt, Coxiella burnetii RSA 493
aucaaugaaacaaacaaaaaaua

SEQ ID NO: 565220 - RNA, 15 nt, Coxiella burnetii RSA 493
aucaaugcaguuaac

SEQ ID NO: 565221 - RNA, 17 nt, Coxiella burnetii RSA 493
aucaaugcaguuaacca

SEQ ID NO: 565222 - RNA, 18 nt, Coxiella burnetii RSA 493
aucaaugcaguuaaccaa

SEQ ID NO: 565223 - RNA, 15 nt, Coxiella burnetii RSA 493
aucaaucgaaaaaaa

SEQ ID NO: 565224 - RNA, 20 nt, Coxiella burnetii RSA 493
aucaaucgcagcauuuuucg

SEQ ID NO: 565225 - RNA, 23 nt, Coxiella burnetii RSA 493
aucaaucguguagaaagaaaguu

SEQ ID NO: 565226 - RNA, 14 nt, Coxiella burnetii RSA 493
aucaaucaaaugaa

SEQ ID NO: 565227 - RNA, 20 nt, Coxiella burnetii RSA 493
aucaaguccaauuauaacua

SEQ ID NO: 565228 - RNA, 22 nt, Coxiella burnetii RSA 493
aucaaguccaauuauaacuauu

SEQ ID NO: 565229 - RNA, 14 nt, Coxiella burnetii RSA 493
aucaaguuucuccc

SEQ ID NO: 565230 - RNA, 14 nt, Coxiella burnetii RSA 493
aucaaguguucaca

SEQ ID NO: 565231 - RNA, 19 nt, Coxiella burnetii RSA 493
aucaauaaaacucuugccg

SEQ ID NO: 565232 - RNA, 16 nt, Coxiella burnetii RSA 493
aucauauaauuuuuga

SEQ ID NO: 565233 - RNA, 12 nt, Coxiella burnetii RSA 493
aucaucgcaaga

SEQ ID NO: 565234 - RNA, 16 nt, Coxiella burnetii RSA 493
aucaucgcacuugcuu

SEQ ID NO: 565235 - RNA, 20 nt, Coxiella burnetii RSA 493
aucacgccaaagcauuccga

SEQ ID NO: 565236 - RNA, 17 nt, Coxiella burnetii RSA 493
aucacgccgcaucacgc

SEQ ID NO: 565237 - RNA, 22 nt, Coxiella burnetii RSA 493
aucaauguuaauagacuaccga

SEQ ID NO: 565238 - RNA, 19 nt, Coxiella burnetii RSA 493
aguuuucacuguugagcaa

SEQ ID NO: 565239 - RNA, 15 nt, Coxiella burnetii RSA 493
aguuuuauaacaagg

SEQ ID NO: 565240 - RNA, 23 nt, Coxiella burnetii RSA 493
auaaaauuuaauaagucuuugcu

SEQ ID NO: 565241 - RNA, 13 nt, Coxiella burnetii RSA 493
auaaaauuaggua

SEQ ID NO: 565242 - RNA, 19 nt, Coxiella burnetii RSA 493
auaaacaaguuaacaaaau

SEQ ID NO: 565243 - RNA, 22 nt, Coxiella burnetii RSA 493
auaaacaaguuaacaaaaucac

SEQ ID NO: 565244 - RNA, 14 nt, Coxiella burnetii RSA 493
auaaaccuauccaa

SEQ ID NO: 565245 - RNA, 19 nt, Coxiella burnetii RSA 493
auaaagauucuguaacuuu

SEQ ID NO: 565246 - RNA, 18 nt, Coxiella burnetii RSA 493
auaaagcagcaauuguuu

SEQ ID NO: 565247 - RNA, 21 nt, Coxiella burnetii RSA 493
auaaagcgcucguaauugaga

SEQ ID NO: 565248 - RNA, 18 nt, Coxiella burnetii RSA 493
auaaagcgcuuacagcag

SEQ ID NO: 565249 - RNA, 19 nt, Coxiella burnetii RSA 493
auaaagcgcuugagcgcaa

SEQ ID NO: 565250 - RNA, 16 nt, Coxiella burnetii RSA 493
auaaagguuuuuccuu

SEQ ID NO: 565251 - RNA, 21 nt, Coxiella burnetii RSA 493
auaaagguuuuuccuuuuauu

SEQ ID NO: 565252 - RNA, 12 nt, Coxiella burnetii RSA 493
auaaaguaauuu

SEQ ID NO: 565253 - RNA, 17 nt, Coxiella burnetii RSA 493
auaaaguaauuuuaaaa

SEQ ID NO: 565254 - RNA, 20 nt, Coxiella burnetii RSA 493
auaaaguaauuuuaaaaaaa

SEQ ID NO: 565255 - RNA, 17 nt, Coxiella burnetii RSA 493
auaaaguaguugaaaaa

SEQ ID NO: 565256 - RNA, 18 nt, Coxiella burnetii RSA 493
auaaaguaguugaaaaau

SEQ ID NO: 565257 - RNA, 14 nt, Coxiella burnetii RSA 493
auaaauaaucuucc

SEQ ID NO: 565258 - RNA, 15 nt, Coxiella burnetii RSA 493
auaacauaucuucaa

SEQ ID NO: 565259 - RNA, 17 nt, Coxiella burnetii RSA 493
auaacauaucuucaaca

SEQ ID NO: 565260 - RNA, 15 nt, Coxiella burnetii RSA 493
auaacagcgaacauc

SEQ ID NO: 565261 - RNA, 12 nt, Coxiella burnetii RSA 493
auaacaaauaaa

SEQ ID NO: 565262 - RNA, 17 nt, Coxiella burnetii RSA 493
auaacaaauaaaccuau

SEQ ID NO: 565263 - RNA, 21 nt, Coxiella burnetii RSA 493
auaacaagguuuuauuuuuaa

SEQ ID NO: 565264 - RNA, 12 nt, Coxiella burnetii RSA 493
auaaauuuuugu

SEQ ID NO: 565265 - RNA, 22 nt, Coxiella burnetii RSA 493
auaacccgcguauaaaugggag

SEQ ID NO: 565266 - RNA, 20 nt, Coxiella burnetii RSA 493
auaaccggcuucuaaguaaa

SEQ ID NO: 565267 - RNA, 15 nt, Coxiella burnetii RSA 493
auaacgcuugcaaua

SEQ ID NO: 565268 - RNA, 21 nt, Coxiella burnetii RSA 493
auaacucuucuuaaaccaaau

SEQ ID NO: 565269 - RNA, 14 nt, Coxiella burnetii RSA 493
auaacugaauacca

SEQ ID NO: 565270 - RNA, 14 nt, Coxiella burnetii RSA 493
auaacuguaaccuu

SEQ ID NO: 565271 - RNA, 14 nt, Coxiella burnetii RSA 493
auaauccuucuuuu

SEQ ID NO: 565272 - RNA, 20 nt, Coxiella burnetii RSA 493
auaauccuucuuuugucuug

SEQ ID NO: 565273 - RNA, 15 nt, Coxiella burnetii RSA 493
auaaugaguggcugc

SEQ ID NO: 565274 - RNA, 21 nt, Coxiella burnetii RSA 493
auaaugacuuugauauggcgc

SEQ ID NO: 565275 - RNA, 21 nt, Coxiella burnetii RSA 493
auaaugagaugaucaucauca

SEQ ID NO: 565276 - RNA, 17 nt, Coxiella burnetii RSA 493
auaaucuggguuucuuu

SEQ ID NO: 565277 - RNA, 22 nt, Coxiella burnetii RSA 493
auaaucucgucgcccucauuca

SEQ ID NO: 565278 - RNA, 16 nt, Coxiella burnetii RSA 493
auaagaauaagaauaa

SEQ ID NO: 565279 - RNA, 18 nt, Coxiella burnetii RSA 493
auaaguguggucugaaaa

SEQ ID NO: 565280 - RNA, 19 nt, Coxiella burnetii RSA 493
auaauaacgcuaugaaaac

SEQ ID NO: 565281 - RNA, 13 nt, Coxiella burnetii RSA 493
auaauaauugcug

SEQ ID NO: 565282 - RNA, 14 nt, Coxiella burnetii RSA 493
auaauuuuugaguu

SEQ ID NO: 565283 - RNA, 21 nt, Coxiella burnetii RSA 493
auaauuuuuuuaauuuuuuca

SEQ ID NO: 565284 - RNA, 17 nt, Coxiella burnetii RSA 493
auaauuugguaaugcuu

SEQ ID NO: 565285 - RNA, 16 nt, Coxiella burnetii RSA 493
auaaugggguaaagcu

SEQ ID NO: 565286 - RNA, 21 nt, Coxiella burnetii RSA 493
auaaugggaguaaugacagaa

SEQ ID NO: 565287 - RNA, 23 nt, Coxiella burnetii RSA 493
auaaugggaguaaugacagaaaa

SEQ ID NO: 565288 - RNA, 16 nt, Coxiella burnetii RSA 493
auaauuuaaugagguu

SEQ ID NO: 565289 - RNA, 14 nt, Coxiella burnetii RSA 493
auaauuuaaacuca

SEQ ID NO: 565290 - RNA, 14 nt, Coxiella burnetii RSA 493
auaauuuauaacaa

SEQ ID NO: 565291 - RNA, 13 nt, Coxiella burnetii RSA 493
auacacaucuuuu

SEQ ID NO: 565292 - RNA, 16 nt, Coxiella burnetii RSA 493
auacaaauuuuuaaga

SEQ ID NO: 565293 - RNA, 18 nt, Coxiella burnetii RSA 493
aguuacgagcuguuugcc

SEQ ID NO: 565294 - RNA, 22 nt, Coxiella burnetii RSA 493
aguguauuuucaccuuuucccu

SEQ ID NO: 565295 - RNA, 14 nt, Coxiella burnetii RSA 493
agugucaaaggccg

SEQ ID NO: 565296 - RNA, 23 nt, Coxiella burnetii RSA 493
aguucagacgcuaauugauuaau

SEQ ID NO: 565297 - RNA, 17 nt, Coxiella burnetii RSA 493
aguucucaaauuuuccc

SEQ ID NO: 565298 - RNA, 19 nt, Coxiella burnetii RSA 493
aguucuauccaauaaacgg

SEQ ID NO: 565299 - RNA, 13 nt, Coxiella burnetii RSA 493
aguucuauuuccg

SEQ ID NO: 565300 - RNA, 20 nt, Coxiella burnetii RSA 493
aguucuauuuccgcuacauc

SEQ ID NO: 565301 - RNA, 12 nt, Coxiella burnetii RSA 493
aguucuaaaaaa

SEQ ID NO: 565302 - RNA, 23 nt, Coxiella burnetii RSA 493
aguucuaagcuaucagcaaucaa

SEQ ID NO: 565303 - RNA, 16 nt, Coxiella burnetii RSA 493
aguuuagaaaaaugcu

SEQ ID NO: 565304 - RNA, 17 nt, Coxiella burnetii RSA 493
aguuuaucguaaauauu

SEQ ID NO: 565305 - RNA, 21 nt, Coxiella burnetii RSA 493
aguuuaucguaaauauuuuua

SEQ ID NO: 565306 - RNA, 14 nt, Coxiella burnetii RSA 493
aguuuaaaguuauu

SEQ ID NO: 565307 - RNA, 22 nt, Coxiella burnetii RSA 493
aguuuaaaguuauuucuuuuga

SEQ ID NO: 565308 - RNA, 14 nt, Coxiella burnetii RSA 493
aguuguuuuaaauc

SEQ ID NO: 565309 - RNA, 15 nt, Coxiella burnetii RSA 493
aguuguauaaagguu

SEQ ID NO: 565310 - RNA, 22 nt, Coxiella burnetii RSA 493
aguuguauaaagguuuuuccuu

SEQ ID NO: 565311 - RNA, 13 nt, Coxiella burnetii RSA 493
aguugucauguaa

SEQ ID NO: 565312 - RNA, 17 nt, Coxiella burnetii RSA 493
aguuuccccuucuucgg

SEQ ID NO: 565313 - RNA, 21 nt, Coxiella burnetii RSA 493
aguuucccguauuucgcuucg

SEQ ID NO: 565314 - RNA, 20 nt, Coxiella burnetii RSA 493
aguuucuucauauucuucau

SEQ ID NO: 565315 - RNA, 21 nt, Coxiella burnetii RSA 493
aguuucuucauauucuucaua

SEQ ID NO: 565316 - RNA, 13 nt, Coxiella burnetii RSA 493
aguuuuaagaaaa

SEQ ID NO: 565317 - RNA, 16 nt, Coxiella burnetii RSA 493
aguuugcaauaccauu

SEQ ID NO: 565318 - RNA, 23 nt, Coxiella burnetii RSA 493
aguuugcaauaccauuuuuaaau

SEQ ID NO: 565319 - RNA, 18 nt, Coxiella burnetii RSA 493
aguuugccauuacgcaug

SEQ ID NO: 565320 - RNA, 14 nt, Coxiella burnetii RSA 493
aguggauuucagau

SEQ ID NO: 565321 - RNA, 21 nt, Coxiella burnetii RSA 493
agugaugacauuuaaaaaaac

SEQ ID NO: 565322 - RNA, 14 nt, Coxiella burnetii RSA 493
agugauuuuucuuu

SEQ ID NO: 565323 - RNA, 22 nt, Coxiella burnetii RSA 493
agugauuuuuuuagcacagcga

SEQ ID NO: 565324 - RNA, 20 nt, Coxiella burnetii RSA 493
agugccacaaagucagacuu

SEQ ID NO: 565325 - RNA, 20 nt, Coxiella burnetii RSA 493
agucugaacaggcagaugau

SEQ ID NO: 565326 - RNA, 20 nt, Coxiella burnetii RSA 493
agucggggccgguucuuuuc

SEQ ID NO: 565327 - RNA, 15 nt, Coxiella burnetii RSA 493
agucgggaaauaaaa

SEQ ID NO: 565328 - RNA, 17 nt, Coxiella burnetii RSA 493
agucggaaguucuauuu

SEQ ID NO: 565329 - RNA, 14 nt, Coxiella burnetii RSA 493
aguauuuuucuuug

SEQ ID NO: 565330 - RNA, 15 nt, Coxiella burnetii RSA 493
aguauuuuuuuuaaa

SEQ ID NO: 565331 - RNA, 19 nt, Coxiella burnetii RSA 493
agucaaaaacuucaugcaa

SEQ ID NO: 565332 - RNA, 16 nt, Coxiella burnetii RSA 493
aguccgcuuuucccug

SEQ ID NO: 565333 - RNA, 18 nt, Coxiella burnetii RSA 493
aguccggccggauuuuuu

SEQ ID NO: 565334 - RNA, 22 nt, Coxiella burnetii RSA 493
aguccuaaaauacuuaaaauuu

SEQ ID NO: 565335 - RNA, 17 nt, Coxiella burnetii RSA 493
aguccuccuucaaggau

SEQ ID NO: 565336 - RNA, 18 nt, Coxiella burnetii RSA 493
agucgcuccccccauuuu

SEQ ID NO: 565337 - RNA, 18 nt, Coxiella burnetii RSA 493
agucgcaacaagcaacga

SEQ ID NO: 565338 - RNA, 19 nt, Coxiella burnetii RSA 493
agucgcaacaagcaacgau

SEQ ID NO: 565339 - RNA, 15 nt, Coxiella burnetii RSA 493
aguaagucucugcuu

SEQ ID NO: 565340 - RNA, 13 nt, Coxiella burnetii RSA 493
aguaauuuuaaaa

SEQ ID NO: 565341 - RNA, 15 nt, Coxiella burnetii RSA 493
aguaauuuuaaaaaa

SEQ ID NO: 565342 - RNA, 16 nt, Coxiella burnetii RSA 493
aguaaucucaauagag

SEQ ID NO: 565343 - RNA, 20 nt, Coxiella burnetii RSA 493
aguaaaacaacguaacugau

SEQ ID NO: 565344 - RNA, 18 nt, Coxiella burnetii RSA 493
aguaaaccgcuuucuaga

SEQ ID NO: 565345 - RNA, 22 nt, Coxiella burnetii RSA 493
agguugucaacaaaauuuuuca

SEQ ID NO: 565346 - RNA, 16 nt, Coxiella burnetii RSA 493
aguagccaaaauaaua

SEQ ID NO: 565347 - RNA, 15 nt, Coxiella burnetii RSA 493
aguagcuaaaaaauu

SEQ ID NO: 565348 - RNA, 11 nt, Coxiella burnetii RSA 493
aguauccaucc

SEQ ID NO: 565349 - RNA, 16 nt, Coxiella burnetii RSA 493
aguauccaacucucua

SEQ ID NO: 565350 - RNA, 15 nt, Coxiella burnetii RSA 493
aguauauuugcaguu

SEQ ID NO: 565351 - RNA, 18 nt, Coxiella burnetii RSA 493
aguauauuugcaguuugc

SEQ ID NO: 565352 - RNA, 16 nt, Coxiella burnetii RSA 493
aguauuaacgcaggau

SEQ ID NO: 565353 - RNA, 19 nt, Coxiella burnetii RSA 493
aggcuuucuuuuucuuuca

SEQ ID NO: 565354 - RNA, 22 nt, Coxiella burnetii RSA 493
agggaaguugccgauaaaaagg

SEQ ID NO: 565355 - RNA, 21 nt, Coxiella burnetii RSA 493
agggacuuuaagcacuucuuu

SEQ ID NO: 565356 - RNA, 22 nt, Coxiella burnetii RSA 493
agggacuauaaaguaguugaaa

SEQ ID NO: 565357 - RNA, 11 nt, Coxiella burnetii RSA 493
agggguuuuuu

SEQ ID NO: 565358 - RNA, 15 nt, Coxiella burnetii RSA 493
agggguuacuucuuu

SEQ ID NO: 565359 - RNA, 19 nt, Coxiella burnetii RSA 493
agggguuacuucuuuuucg

SEQ ID NO: 565360 - RNA, 16 nt, Coxiella burnetii RSA 493
agggcuauuuuaagcu

SEQ ID NO: 565361 - RNA, 22 nt, Coxiella burnetii RSA 493
aggguaauaaaguaauuuuaaa

SEQ ID NO: 565362 - RNA, 17 nt, Coxiella burnetii RSA 493
aggguagucaggaagca

SEQ ID NO: 565363 - RNA, 21 nt, Coxiella burnetii RSA 493
agggugacggcggauuaaaaa

SEQ ID NO: 565364 - RNA, 17 nt, Coxiella burnetii RSA 493
agggugcgauuaaaagu

SEQ ID NO: 565365 - RNA, 14 nt, Coxiella burnetii RSA 493
aggucguuaaaaaa

SEQ ID NO: 565366 - RNA, 15 nt, Coxiella burnetii RSA 493
aggucguuaaaaaau

SEQ ID NO: 565367 - RNA, 16 nt, Coxiella burnetii RSA 493
aggucguuaaaaaauu

SEQ ID NO: 565368 - RNA, 19 nt, Coxiella burnetii RSA 493
aggugcguuccagcgggga

SEQ ID NO: 565369 - RNA, 12 nt, Coxiella burnetii RSA 493
aggauuuucacg

SEQ ID NO: 565370 - RNA, 11 nt, Coxiella burnetii RSA 493
aggcaaaauaa

SEQ ID NO: 565371 - RNA, 12 nt, Coxiella burnetii RSA 493
aggcaaaauaaa

SEQ ID NO: 565372 - RNA, 17 nt, Coxiella burnetii RSA 493
aggccaacauucuuuga

SEQ ID NO: 565373 - RNA, 18 nt, Coxiella burnetii RSA 493
aggcaucuuuuucuccuu

SEQ ID NO: 565374 - RNA, 14 nt, Coxiella burnetii RSA 493
aggcauucugggca

SEQ ID NO: 565375 - RNA, 15 nt, Coxiella burnetii RSA 493
aggcacgaugcacag

SEQ ID NO: 565376 - RNA, 15 nt, Coxiella burnetii RSA 493
aggccuuaauguuuu

SEQ ID NO: 565377 - RNA, 14 nt, Coxiella burnetii RSA 493
agcuggugggaacg

SEQ ID NO: 565378 - RNA, 19 nt, Coxiella burnetii RSA 493
agcugccauuuucauuuuc

SEQ ID NO: 565379 - RNA, 14 nt, Coxiella burnetii RSA 493
agcuuauauaaagg

SEQ ID NO: 565380 - RNA, 16 nt, Coxiella burnetii RSA 493
agcuugugcaauucca

SEQ ID NO: 565381 - RNA, 20 nt, Coxiella burnetii RSA 493
aggaauugagaguccuaaaa

SEQ ID NO: 565382 - RNA, 13 nt, Coxiella burnetii RSA 493
aggacagaaggca

SEQ ID NO: 565383 - RNA, 15 nt, Coxiella burnetii RSA 493
aggacagaaggcaga

SEQ ID NO: 565384 - RNA, 14 nt, Coxiella burnetii RSA 493
aggacagaggacag

SEQ ID NO: 565385 - RNA, 21 nt, Coxiella burnetii RSA 493
aggaaggacaaaaauaucccu

SEQ ID NO: 565386 - RNA, 23 nt, Coxiella burnetii RSA 493
aggaaggugcgucccgcuuaaac

SEQ ID NO: 565387 - RNA, 13 nt, Coxiella burnetii RSA 493
aggacugcucuua

SEQ ID NO: 565388 - RNA, 16 nt, Coxiella burnetii RSA 493
aggacuuaagcccuuu

SEQ ID NO: 565389 - RNA, 21 nt, Coxiella burnetii RSA 493
aggacuuaagcccuuuagcca

SEQ ID NO: 565390 - RNA, 24 nt, Coxiella burnetii RSA 493
aggacucugcgauuguuuucuuac

SEQ ID NO: 565391 - RNA, 19 nt, Coxiella burnetii RSA 493
aggacugaaauaauguuua

SEQ ID NO: 565392 - RNA, 18 nt, Coxiella burnetii RSA 493
aggacagugguugugucg

SEQ ID NO: 565393 - RNA, 20 nt, Coxiella burnetii RSA 493
aggaaagauaaggugggggg

SEQ ID NO: 565394 - RNA, 23 nt, Coxiella burnetii RSA 493
aggaaauuugcauuaaucuucca

SEQ ID NO: 565395 - RNA, 22 nt, Coxiella burnetii RSA 493
aggaacauucuaauaaaauagc

SEQ ID NO: 565396 - RNA, 21 nt, Coxiella burnetii RSA 493
aggaaccaccaaaucacgcuu

SEQ ID NO: 565397 - RNA, 22 nt, Coxiella burnetii RSA 493
agaaaacuuuucaucccccgcu

SEQ ID NO: 565398 - RNA, 18 nt, Coxiella burnetii RSA 493
agaaaacccacucgguaa

SEQ ID NO: 565399 - RNA, 17 nt, Coxiella burnetii RSA 493
agaaaaccgcagcucaa

SEQ ID NO: 565400 - RNA, 21 nt, Coxiella burnetii RSA 493
agaaaaccgcagcucaaacaa

SEQ ID NO: 565401 - RNA, 19 nt, Coxiella burnetii RSA 493
agaaaacguuucaucaaaa

SEQ ID NO: 565402 - RNA, 12 nt, Coxiella burnetii RSA 493
agaaaauaaccu

SEQ ID NO: 565403 - RNA, 13 nt, Coxiella burnetii RSA 493
agaaaauaaccua

SEQ ID NO: 565404 - RNA, 15 nt, Coxiella burnetii RSA 493
agaaaauaaccuaaa

SEQ ID NO: 565405 - RNA, 12 nt, Coxiella burnetii RSA 493
agaaaaguaaaa

SEQ ID NO: 565406 - RNA, 16 nt, Coxiella burnetii RSA 493
acuuuuuacugcaugc

SEQ ID NO: 565407 - RNA, 18 nt, Coxiella burnetii RSA 493
acuuuuuacugcaugcca

SEQ ID NO: 565408 - RNA, 18 nt, Coxiella burnetii RSA 493
acuuuuuagggcugaaaa

SEQ ID NO: 565409 - RNA, 15 nt, Coxiella burnetii RSA 493
agaaaaagaaauugu

SEQ ID NO: 565410 - RNA, 19 nt, Coxiella burnetii RSA 493
acuuuugcgcuuauagcuu

SEQ ID NO: 565411 - RNA, 15 nt, Coxiella burnetii RSA 493
acuugauauucccuc

SEQ ID NO: 565412 - RNA, 19 nt, Coxiella burnetii RSA 493
agaaacucaaccaccacuu

SEQ ID NO: 565413 - RNA, 16 nt, Coxiella burnetii RSA 493
agaaacuuugcagggc

SEQ ID NO: 565414 - RNA, 12 nt, Coxiella burnetii RSA 493
agaaagaagaag

SEQ ID NO: 565415 - RNA, 23 nt, Coxiella burnetii RSA 493
agaaagacauuguucauaaaaua

SEQ ID NO: 565416 - RNA, 17 nt, Coxiella burnetii RSA 493
agaaagcgagcaaucaa

SEQ ID NO: 565417 - RNA, 18 nt, Coxiella burnetii RSA 493
agaaagcgagcaaucaaa

SEQ ID NO: 565418 - RNA, 20 nt, Coxiella burnetii RSA 493
agaaagcgagcaaucaaaac

SEQ ID NO: 565419 - RNA, 23 nt, Coxiella burnetii RSA 493
agaaagcgagcaaucaaaacagc

SEQ ID NO: 565420 - RNA, 15 nt, Coxiella burnetii RSA 493
agaaaguuucccaca

SEQ ID NO: 565421 - RNA, 20 nt, Coxiella burnetii RSA 493
agaaaguuucccacaaaaua

SEQ ID NO: 565422 - RNA, 17 nt, Coxiella burnetii RSA 493
agaaauugacaaauaaa

SEQ ID NO: 565423 - RNA, 21 nt, Coxiella burnetii RSA 493
agaaauugcgcguaaaauucc

SEQ ID NO: 565424 - RNA, 22 nt, Coxiella burnetii RSA 493
agaaauugcgcguaaaauucca

SEQ ID NO: 565425 - RNA, 15 nt, Coxiella burnetii RSA 493
aaaacacauaucgcu

SEQ ID NO: 565426 - RNA, 22 nt, Coxiella burnetii RSA 493
aaaacaaugaugucaucuaucg

SEQ ID NO: 565427 - RNA, 18 nt, Coxiella burnetii RSA 493
agaaauauuagaaauaau

SEQ ID NO: 565428 - RNA, 21 nt, Coxiella burnetii RSA 493
agaaauauuagaaauaauacu

SEQ ID NO: 565429 - RNA, 24 nt, Coxiella burnetii RSA 493
agaacaacugcgccgcaaaguaaa

SEQ ID NO: 565430 - RNA, 23 nt, Coxiella burnetii RSA 493
agaaguaaaaagagucauuguau

SEQ ID NO: 565431 - RNA, 22 nt, Coxiella burnetii RSA 493
agaaguaugaucauuuucucag

SEQ ID NO: 565432 - RNA, 22 nt, Coxiella burnetii RSA 493
agaauccaacgguucucaaauu

SEQ ID NO: 565433 - RNA, 14 nt, Coxiella burnetii RSA 493
agaauucucccaug

SEQ ID NO: 565434 - RNA, 22 nt, Coxiella burnetii RSA 493
agaauuuuugacuaagucaaaa

SEQ ID NO: 565435 - RNA, 22 nt, Coxiella burnetii RSA 493
agaauuuuuuuauaauuaucca

SEQ ID NO: 565436 - RNA, 20 nt, Coxiella burnetii RSA 493
agacagacgcuggaaaaaua

SEQ ID NO: 565437 - RNA, 16 nt, Coxiella burnetii RSA 493
agacaauguuaaaaca

SEQ ID NO: 565438 - RNA, 18 nt, Coxiella burnetii RSA 493
agacaauguuaaaacaca

SEQ ID NO: 565439 - RNA, 23 nt, Coxiella burnetii RSA 493
agacaaugcuuucuuuuaauuca

SEQ ID NO: 565440 - RNA, 11 nt, Coxiella burnetii RSA 493
agacaauuuuu

SEQ ID NO: 565441 - RNA, 15 nt, Coxiella burnetii RSA 493
agacacgaccccaau

SEQ ID NO: 565442 - RNA, 12 nt, Coxiella burnetii RSA 493
aaaacagcccca

SEQ ID NO: 565443 - RNA, 16 nt, Coxiella burnetii RSA 493
agacauuguucauaaa

SEQ ID NO: 565444 - RNA, 21 nt, Coxiella burnetii RSA 493
agacauuguucauaaaauaau

SEQ ID NO: 565445 - RNA, 14 nt, Coxiella burnetii RSA 493
agacguauuuggaa

SEQ ID NO: 565446 - RNA, 20 nt, Coxiella burnetii RSA 493
agagcuugccuguaaaauaa

SEQ ID NO: 565447 - RNA, 17 nt, Coxiella burnetii RSA 493
aaaacauucgauauguu

SEQ ID NO: 565448 - RNA, 15 nt, Coxiella burnetii RSA 493
agaggagugggguug

SEQ ID NO: 565449 - RNA, 21 nt, Coxiella burnetii RSA 493
agaggggguuaggagcaagua

SEQ ID NO: 565450 - RNA, 17 nt, Coxiella burnetii RSA 493
agaguaaauguuucuuu

SEQ ID NO: 565451 - RNA, 22 nt, Coxiella burnetii RSA 493
agaguaaauguuucuuuuauaa

SEQ ID NO: 565452 - RNA, 14 nt, Coxiella burnetii RSA 493
agaguaacgauuuc

SEQ ID NO: 565453 - RNA, 17 nt, Coxiella burnetii RSA 493
agaguaacgauuucucu

SEQ ID NO: 565454 - RNA, 18 nt, Coxiella burnetii RSA 493
agaguaacgauuucucuu

SEQ ID NO: 565455 - RNA, 15 nt, Coxiella burnetii RSA 493
agaguaaaaaaccaa

SEQ ID NO: 565456 - RNA, 13 nt, Coxiella burnetii RSA 493
agagguauugcuu

SEQ ID NO: 565457 - RNA, 19 nt, Coxiella burnetii RSA 493
agauaagcuguuucuuuua

SEQ ID NO: 565458 - RNA, 16 nt, Coxiella burnetii RSA 493
agauacuguacuggaa

SEQ ID NO: 565459 - RNA, 19 nt, Coxiella burnetii RSA 493
agaguacgccaaccauaau

SEQ ID NO: 565460 - RNA, 23 nt, Coxiella burnetii RSA 493
aaaaccgacgccauuuuuuagca

SEQ ID NO: 565461 - RNA, 22 nt, Coxiella burnetii RSA 493
aaaacccauuugccgccaggcu

SEQ ID NO: 565462 - RNA, 19 nt, Coxiella burnetii RSA 493
agaugccaacgguaacccu

SEQ ID NO: 565463 - RNA, 14 nt, Coxiella burnetii RSA 493
agauucaugaaaau

SEQ ID NO: 565464 - RNA, 14 nt, Coxiella burnetii RSA 493
agauuagaaaaagc

SEQ ID NO: 565465 - RNA, 21 nt, Coxiella burnetii RSA 493
agauuagaaaaagcgauucca

SEQ ID NO: 565466 - RNA, 14 nt, Coxiella burnetii RSA 493
agauucuuucugau

SEQ ID NO: 565467 - RNA, 13 nt, Coxiella burnetii RSA 493
agauucccgcugc

SEQ ID NO: 565468 - RNA, 23 nt, Coxiella burnetii RSA 493
agauucccgcugccuuuaccuug

SEQ ID NO: 565469 - RNA, 21 nt, Coxiella burnetii RSA 493
agauugccacucuuuauuaua

SEQ ID NO: 565470 - RNA, 13 nt, Coxiella burnetii RSA 493
agauuuagccaaa

SEQ ID NO: 565471 - RNA, 12 nt, Coxiella burnetii RSA 493
agauuuaaauag

SEQ ID NO: 565472 - RNA, 15 nt, Coxiella burnetii RSA 493
agauuuuggcucccu

SEQ ID NO: 565473 - RNA, 16 nt, Coxiella burnetii RSA 493
agauuuuaaauaccau

SEQ ID NO: 565474 - RNA, 22 nt, Coxiella burnetii RSA 493
agauuuuaaauaccauuuuccu

SEQ ID NO: 565475 - RNA, 19 nt, Coxiella burnetii RSA 493
agauuucuucacggauaau

SEQ ID NO: 565476 - RNA, 13 nt, Coxiella burnetii RSA 493
agcaaaaauacaa

SEQ ID NO: 565477 - RNA, 15 nt, Coxiella burnetii RSA 493
agccgccaauuuugu

SEQ ID NO: 565478 - RNA, 17 nt, Coxiella burnetii RSA 493
agcgaaagccaaguuuu

SEQ ID NO: 565479 - RNA, 16 nt, Coxiella burnetii RSA 493
agcgacggauuuugcu

SEQ ID NO: 565480 - RNA, 17 nt, Coxiella burnetii RSA 493
agcgcggccgcggcugg

SEQ ID NO: 565481 - RNA, 16 nt, Coxiella burnetii RSA 493
agcgauuguaauugcu

SEQ ID NO: 565482 - RNA, 20 nt, Coxiella burnetii RSA 493
agcgucuuuuuuaguuaaag

SEQ ID NO: 565483 - RNA, 16 nt, Coxiella burnetii RSA 493
agcguuaauugaagaa

SEQ ID NO: 565484 - RNA, 20 nt, Coxiella burnetii RSA 493
agcgugaugggauaaaaaac

SEQ ID NO: 565485 - RNA, 15 nt, Coxiella burnetii RSA 493
agcgcuaaugagaaa

SEQ ID NO: 565486 - RNA, 12 nt, Coxiella burnetii RSA 493
agcgggaauuuu

SEQ ID NO: 565487 - RNA, 14 nt, Coxiella burnetii RSA 493
agcuaauucuuuuu

SEQ ID NO: 565488 - RNA, 16 nt, Coxiella burnetii RSA 493
agcuagcgaaauuugu

SEQ ID NO: 565489 - RNA, 16 nt, Coxiella burnetii RSA 493
agcuagccauuguuuu

SEQ ID NO: 565490 - RNA, 22 nt, Coxiella burnetii RSA 493
agcuagcccccgaaacaggcgg

SEQ ID NO: 565491 - RNA, 14 nt, Coxiella burnetii RSA 493
agcguucuuaaagu

SEQ ID NO: 565492 - RNA, 14 nt, Coxiella burnetii RSA 493
agcuaaaaaauuca

SEQ ID NO: 565493 - RNA, 17 nt, Coxiella burnetii RSA 493
agcuauaagcaaugggu

SEQ ID NO: 565494 - RNA, 14 nt, Coxiella burnetii RSA 493
agcucaaacaaauc

SEQ ID NO: 565495 - RNA, 13 nt, Coxiella burnetii RSA 493
agcuccaaacggu

SEQ ID NO: 565496 - RNA, 17 nt, Coxiella burnetii RSA 493
agcucauugaaaucaau

SEQ ID NO: 565497 - RNA, 11 nt, Coxiella burnetii RSA 493
agcaugcccau

SEQ ID NO: 565498 - RNA, 20 nt, Coxiella burnetii RSA 493
agcaugcccauaaauaacuu

SEQ ID NO: 565499 - RNA, 20 nt, Coxiella burnetii RSA 493
agccaaguuuuaagaaaaac

SEQ ID NO: 565500 - RNA, 14 nt, Coxiella burnetii RSA 493
agccaccgcaugaa

SEQ ID NO: 565501 - RNA, 18 nt, Coxiella burnetii RSA 493
agccaucacaccaagaaa

SEQ ID NO: 565502 - RNA, 15 nt, Coxiella burnetii RSA 493
agccaguucucuauu

SEQ ID NO: 565503 - RNA, 15 nt, Coxiella burnetii RSA 493
agcccaauaacaagc

SEQ ID NO: 565504 - RNA, 17 nt, Coxiella burnetii RSA 493
agcccgcagcgcccacu

SEQ ID NO: 565505 - RNA, 14 nt, Coxiella burnetii RSA 493
agcccgcaauccuc

SEQ ID NO: 565506 - RNA, 21 nt, Coxiella burnetii RSA 493
agcaaccguugagcaagcaga

SEQ ID NO: 565507 - RNA, 21 nt, Coxiella burnetii RSA 493
agcagcgugcagcugauuucu

SEQ ID NO: 565508 - RNA, 14 nt, Coxiella burnetii RSA 493
agcaguaaugagca

SEQ ID NO: 565509 - RNA, 23 nt, Coxiella burnetii RSA 493
agcauauaaaaguuacgccccaa

SEQ ID NO: 565510 - RNA, 14 nt, Coxiella burnetii RSA 493
accaugguuucuuu

SEQ ID NO: 565511 - RNA, 20 nt, Coxiella burnetii RSA 493
accagaaauauuuucucaau

SEQ ID NO: 565512 - RNA, 12 nt, Coxiella burnetii RSA 493
accauuuuuaaa

SEQ ID NO: 565513 - RNA, 20 nt, Coxiella burnetii RSA 493
acccaaucaauucgaaagaa

SEQ ID NO: 565514 - RNA, 21 nt, Coxiella burnetii RSA 493
acccacagccgcuuuuuauug

SEQ ID NO: 565515 - RNA, 13 nt, Coxiella burnetii RSA 493
accccaauuuuug

SEQ ID NO: 565516 - RNA, 19 nt, Coxiella burnetii RSA 493
acccaucucgaaauuauuu

SEQ ID NO: 565517 - RNA, 18 nt, Coxiella burnetii RSA 493
acccaccgcuggugagac

SEQ ID NO: 565518 - RNA, 19 nt, Coxiella burnetii RSA 493
accccaucuacuucccgca

SEQ ID NO: 565519 - RNA, 18 nt, Coxiella burnetii RSA 493
accccaugaaacuuacgc

SEQ ID NO: 565520 - RNA, 18 nt, Coxiella burnetii RSA 493
accccgauuuaauaauca

SEQ ID NO: 565521 - RNA, 18 nt, Coxiella burnetii RSA 493
acccucuuuuuaaaaaau

SEQ ID NO: 565522 - RNA, 19 nt, Coxiella burnetii RSA 493
acccugaacauuaagaaag

SEQ ID NO: 565523 - RNA, 14 nt, Coxiella burnetii RSA 493
accgagauuuuucc

SEQ ID NO: 565524 - RNA, 18 nt, Coxiella burnetii RSA 493
accgagcuucauggcuug

SEQ ID NO: 565525 - RNA, 21 nt, Coxiella burnetii RSA 493
accgcaaguggggacagugaa

SEQ ID NO: 565526 - RNA, 20 nt, Coxiella burnetii RSA 493
accgccaaaagggaacaaug

SEQ ID NO: 565527 - RNA, 14 nt, Coxiella burnetii RSA 493
accgccuuuaagau

SEQ ID NO: 565528 - RNA, 22 nt, Coxiella burnetii RSA 493
accgcugacgucagaaaacagc

SEQ ID NO: 565529 - RNA, 17 nt, Coxiella burnetii RSA 493
accgggcgaugauaaag

SEQ ID NO: 565530 - RNA, 16 nt, Coxiella burnetii RSA 493
accggcuagcagagcc

SEQ ID NO: 565531 - RNA, 16 nt, Coxiella burnetii RSA 493
accucaccagacguac

SEQ ID NO: 565532 - RNA, 16 nt, Coxiella burnetii RSA 493
accucagggaauuuaa

SEQ ID NO: 565533 - RNA, 16 nt, Coxiella burnetii RSA 493
accuauccaaaaagau

SEQ ID NO: 565534 - RNA, 14 nt, Coxiella burnetii RSA 493
accuagcaauaacu

SEQ ID NO: 565535 - RNA, 17 nt, Coxiella burnetii RSA 493
accgguuaggaugcgaa

SEQ ID NO: 565536 - RNA, 20 nt, Coxiella burnetii RSA 493
acgaaaagcugaaauugaau

SEQ ID NO: 565537 - RNA, 19 nt, Coxiella burnetii RSA 493
accuuuaauugcuuccuua

SEQ ID NO: 565538 - RNA, 20 nt, Coxiella burnetii RSA 493
accuuaacgccuaucuuuuu

SEQ ID NO: 565539 - RNA, 13 nt, Coxiella burnetii RSA 493
accuucaaaaaua

SEQ ID NO: 565540 - RNA, 15 nt, Coxiella burnetii RSA 493
accuucaaaaauaaa

SEQ ID NO: 565541 - RNA, 17 nt, Coxiella burnetii RSA 493
accugauaaaauaacag

SEQ ID NO: 565542 - RNA, 12 nt, Coxiella burnetii RSA 493
acgauuaaaaau

SEQ ID NO: 565543 - RNA, 22 nt, Coxiella burnetii RSA 493
acgauuaaaaauuuuaaaaaaa

SEQ ID NO: 565544 - RNA, 23 nt, Coxiella burnetii RSA 493
acgauuaaaaauuuuaaaaaaau

SEQ ID NO: 565545 - RNA, 12 nt, Coxiella burnetii RSA 493
acgauuaacaac

SEQ ID NO: 565546 - RNA, 15 nt, Coxiella burnetii RSA 493
acgauuaacaacaaa

SEQ ID NO: 565547 - RNA, 12 nt, Coxiella burnetii RSA 493
acgcaacaaaag

SEQ ID NO: 565548 - RNA, 22 nt, Coxiella burnetii RSA 493
acgauagaugacaucauuguuu

SEQ ID NO: 565549 - RNA, 13 nt, Coxiella burnetii RSA 493
acgauagaggcgc

SEQ ID NO: 565550 - RNA, 13 nt, Coxiella burnetii RSA 493
acgaagcugccac

SEQ ID NO: 565551 - RNA, 14 nt, Coxiella burnetii RSA 493
acgaagauuaugaa

SEQ ID NO: 565552 - RNA, 22 nt, Coxiella burnetii RSA 493
acgcaauucgcggguaaauuua

SEQ ID NO: 565553 - RNA, 22 nt, Coxiella burnetii RSA 493
acgcaaugcuuccgauuccaau

SEQ ID NO: 565554 - RNA, 20 nt, Coxiella burnetii RSA 493
acgcacgggcguucaauuau

SEQ ID NO: 565555 - RNA, 16 nt, Coxiella burnetii RSA 493
acgcacucugugcauc

SEQ ID NO: 565556 - RNA, 21 nt, Coxiella burnetii RSA 493
acgcaugucaauaacccacag

SEQ ID NO: 565557 - RNA, 18 nt, Coxiella burnetii RSA 493
acgcauuucccaaucauc

SEQ ID NO: 565558 - RNA, 13 nt, Coxiella burnetii RSA 493
acggaaaaacaaa

SEQ ID NO: 565559 - RNA, 21 nt, Coxiella burnetii RSA 493
acggauaauaucuagauuuaa

SEQ ID NO: 565560 - RNA, 22 nt, Coxiella burnetii RSA 493
acggauaauaucuagauuuaaa

SEQ ID NO: 565561 - RNA, 12 nt, Coxiella burnetii RSA 493
acggagaaaauc

SEQ ID NO: 565562 - RNA, 17 nt, Coxiella burnetii RSA 493
acggaauuugaaauaaa

SEQ ID NO: 565563 - RNA, 15 nt, Coxiella burnetii RSA 493
acgcuaguuuuuaag

SEQ ID NO: 565564 - RNA, 17 nt, Coxiella burnetii RSA 493
acgcuaugaaaaccaca

SEQ ID NO: 565565 - RNA, 16 nt, Coxiella burnetii RSA 493
acgcuauuuuuuaaau

SEQ ID NO: 565566 - RNA, 17 nt, Coxiella burnetii RSA 493
acgcuucagaaucugcu

SEQ ID NO: 565567 - RNA, 17 nt, Coxiella burnetii RSA 493
acgcugaaguugacgca

SEQ ID NO: 565568 - RNA, 19 nt, Coxiella burnetii RSA 493
acgcugaguggaaaaccac

SEQ ID NO: 565569 - RNA, 13 nt, Coxiella burnetii RSA 493
acgcugcaauaau

SEQ ID NO: 565570 - RNA, 14 nt, Coxiella burnetii RSA 493
acgguaauaauaua

SEQ ID NO: 565571 - RNA, 22 nt, Coxiella burnetii RSA 493
acggguggguaaugauaugaga

SEQ ID NO: 565572 - RNA, 19 nt, Coxiella burnetii RSA 493
acgggcuacuugaaaaccu

SEQ ID NO: 565573 - RNA, 20 nt, Coxiella burnetii RSA 493
acgggcuacuuggcgacagc

SEQ ID NO: 565574 - RNA, 15 nt, Coxiella burnetii RSA 493
acggugcagaaggcc

SEQ ID NO: 565575 - RNA, 23 nt, Coxiella burnetii RSA 493
acguaauggaauauguuguccac

SEQ ID NO: 565576 - RNA, 12 nt, Coxiella burnetii RSA 493
acguaauuauua

SEQ ID NO: 565577 - RNA, 20 nt, Coxiella burnetii RSA 493
acguagaaguuuaaaguuau

SEQ ID NO: 565578 - RNA, 14 nt, Coxiella burnetii RSA 493
acgggaaugacgaa

SEQ ID NO: 565579 - RNA, 19 nt, Coxiella burnetii RSA 493
acggcuugauuucaggcgc

SEQ ID NO: 565580 - RNA, 18 nt, Coxiella burnetii RSA 493
acggcuuuauuuuggaua

SEQ ID NO: 565581 - RNA, 21 nt, Coxiella burnetii RSA 493
acggcaagucccucugaaaaa

SEQ ID NO: 565582 - RNA, 13 nt, Coxiella burnetii RSA 493
acggcaaauaaag

SEQ ID NO: 565583 - RNA, 18 nt, Coxiella burnetii RSA 493
acggcgcgcguguuuuua

SEQ ID NO: 565584 - RNA, 14 nt, Coxiella burnetii RSA 493
acuagaaauauuag

SEQ ID NO: 565585 - RNA, 22 nt, Coxiella burnetii RSA 493
acuaauuauaagacgcuuucaa

SEQ ID NO: 565586 - RNA, 22 nt, Coxiella burnetii RSA 493
acuaauagcucauauuccgugu

SEQ ID NO: 565587 - RNA, 18 nt, Coxiella burnetii RSA 493
acuaaucgcuguuaauaa

SEQ ID NO: 565588 - RNA, 19 nt, Coxiella burnetii RSA 493
acuaaucgcuguuaauaau

SEQ ID NO: 565589 - RNA, 20 nt, Coxiella burnetii RSA 493
acuaaucccgccccauuuuu

SEQ ID NO: 565590 - RNA, 20 nt, Coxiella burnetii RSA 493
acuaaugguuggacuacauc

SEQ ID NO: 565591 - RNA, 14 nt, Coxiella burnetii RSA 493
acuaagucgccauu

SEQ ID NO: 565592 - RNA, 20 nt, Coxiella burnetii RSA 493
acuaagucgccauuggcucu

SEQ ID NO: 565593 - RNA, 12 nt, Coxiella burnetii RSA 493
acuaaauugucc

SEQ ID NO: 565594 - RNA, 21 nt, Coxiella burnetii RSA 493
acgucuuuucugugaaauaaa

SEQ ID NO: 565595 - RNA, 19 nt, Coxiella burnetii RSA 493
acgugccgccgaaauuuaa

SEQ ID NO: 565596 - RNA, 15 nt, Coxiella burnetii RSA 493
acguugcaauaacaa

SEQ ID NO: 565597 - RNA, 21 nt, Coxiella burnetii RSA 493
acguuugauuuucaaguuuau

SEQ ID NO: 565598 - RNA, 16 nt, Coxiella burnetii RSA 493
acguuuaaauaacaaa

SEQ ID NO: 565599 - RNA, 13 nt, Coxiella burnetii RSA 493
acguuucaucaaa

SEQ ID NO: 565600 - RNA, 12 nt, Coxiella burnetii RSA 493
acuaaacaaaau

SEQ ID NO: 565601 - RNA, 14 nt, Coxiella burnetii RSA 493
acuaaagguaaaaa

SEQ ID NO: 565602 - RNA, 19 nt, Coxiella burnetii RSA 493
acuaaagguaaaaagauca

SEQ ID NO: 565603 - RNA, 20 nt, Coxiella burnetii RSA 493
acguuuuuugcauuuuuaaa

SEQ ID NO: 565604 - RNA, 23 nt, Coxiella burnetii RSA 493
acuuaaccgcugacgucagaaaa

SEQ ID NO: 565605 - RNA, 17 nt, Coxiella burnetii RSA 493
acugugagcgcgaaaag

SEQ ID NO: 565606 - RNA, 20 nt, Coxiella burnetii RSA 493
acuuagcugauuucucuuuu

SEQ ID NO: 565607 - RNA, 21 nt, Coxiella burnetii RSA 493
acuuagcgaauuguaaaaaga

SEQ ID NO: 565608 - RNA, 14 nt, Coxiella burnetii RSA 493
acuuauuuguugaa

SEQ ID NO: 565609 - RNA, 19 nt, Coxiella burnetii RSA 493
acuuauuuguugaacagag

SEQ ID NO: 565610 - RNA, 12 nt, Coxiella burnetii RSA 493
acuuauuuuuau

SEQ ID NO: 565611 - RNA, 16 nt, Coxiella burnetii RSA 493
acuuauuuuuauucuu

SEQ ID NO: 565612 - RNA, 19 nt, Coxiella burnetii RSA 493
acuucuucauuaaauccuc

SEQ ID NO: 565613 - RNA, 19 nt, Coxiella burnetii RSA 493
acuucuuuuucgauuuuuu

SEQ ID NO: 565614 - RNA, 20 nt, Coxiella burnetii RSA 493
acuucuaccguggccggcaa

SEQ ID NO: 565615 - RNA, 22 nt, Coxiella burnetii RSA 493
acuucuggcggugcgaauaaca

SEQ ID NO: 565616 - RNA, 22 nt, Coxiella burnetii RSA 493
acuucaugcaaaaauuguuuau

SEQ ID NO: 565617 - RNA, 17 nt, Coxiella burnetii RSA 493
acuucccgcaaaugauc

SEQ ID NO: 565618 - RNA, 22 nt, Coxiella burnetii RSA 493
acuuccagauuuaguaaaguag

SEQ ID NO: 565619 - RNA, 16 nt, Coxiella burnetii RSA 493
acucuuucauaaaagg

SEQ ID NO: 565620 - RNA, 18 nt, Coxiella burnetii RSA 493
acucuuucauaaaaggaa

SEQ ID NO: 565621 - RNA, 11 nt, Coxiella burnetii RSA 493
acucuuuggcg

SEQ ID NO: 565622 - RNA, 18 nt, Coxiella burnetii RSA 493
acugaaaaguaaaagucc

SEQ ID NO: 565623 - RNA, 21 nt, Coxiella burnetii RSA 493
acugcgccgcaaaguaaaaau

SEQ ID NO: 565624 - RNA, 16 nt, Coxiella burnetii RSA 493
acuauuugcuuucuuu

SEQ ID NO: 565625 - RNA, 17 nt, Coxiella burnetii RSA 493
acuauuugcuuucuuug

SEQ ID NO: 565626 - RNA, 20 nt, Coxiella burnetii RSA 493
acuauuugcuuucuuugaac

SEQ ID NO: 565627 - RNA, 16 nt, Coxiella burnetii RSA 493
acuccuaagcaaggcg

SEQ ID NO: 565628 - RNA, 14 nt, Coxiella burnetii RSA 493
acucuaauugagua

SEQ ID NO: 565629 - RNA, 14 nt, Coxiella burnetii RSA 493
acucuaauuuucuu

SEQ ID NO: 565630 - RNA, 17 nt, Coxiella burnetii RSA 493
acucuaauuuucuuucc

SEQ ID NO: 565631 - RNA, 18 nt, Coxiella burnetii RSA 493
acucuaaguuauggauac

SEQ ID NO: 565632 - RNA, 19 nt, Coxiella burnetii RSA 493
acucguuucggauuuugaa

SEQ ID NO: 565633 - RNA, 22 nt, Coxiella burnetii RSA 493
acucguuucggauuuugaacag

SEQ ID NO: 565634 - RNA, 23 nt, Coxiella burnetii RSA 493
acucguuucggauuuugaacagu

SEQ ID NO: 565635 - RNA, 16 nt, Coxiella burnetii RSA 493
acucucuuuauuuuuu

SEQ ID NO: 565636 - RNA, 18 nt, Coxiella burnetii RSA 493
acucucuuuauuuuuucu

SEQ ID NO: 565637 - RNA, 20 nt, Coxiella burnetii RSA 493
acucucuagcuguuuuuucu

SEQ ID NO: 565638 - RNA, 13 nt, Coxiella burnetii RSA 493
acucuuauuuucu

SEQ ID NO: 565639 - RNA, 14 nt, Coxiella burnetii RSA 493
acucuuauuuucug

SEQ ID NO: 565640 - RNA, 16 nt, Coxiella burnetii RSA 493
aaucauauaauuuuug

SEQ ID NO: 565641 - RNA, 15 nt, Coxiella burnetii RSA 493
aauaugauaaaaggc

SEQ ID NO: 565642 - RNA, 19 nt, Coxiella burnetii RSA 493
aauaugauaaaaggcagcu

SEQ ID NO: 565643 - RNA, 17 nt, Coxiella burnetii RSA 493
aaaaauuccaaaaacau

SEQ ID NO: 565644 - RNA, 22 nt, Coxiella burnetii RSA 493
aaaaauuauuaaucauauaauu

SEQ ID NO: 565645 - RNA, 14 nt, Coxiella burnetii RSA 493
aaucauuaacgaau

SEQ ID NO: 565646 - RNA, 18 nt, Coxiella burnetii RSA 493
aauccaguuuuuuaacuc

SEQ ID NO: 565647 - RNA, 21 nt, Coxiella burnetii RSA 493
aaucuagcauaaucuuuuuag

SEQ ID NO: 565648 - RNA, 19 nt, Coxiella burnetii RSA 493
aaucgguuuuuuucuuuuu

SEQ ID NO: 565649 - RNA, 12 nt, Coxiella burnetii RSA 493
aauccucucucu

SEQ ID NO: 565650 - RNA, 19 nt, Coxiella burnetii RSA 493
aaucccgccccauuuuugu

SEQ ID NO: 565651 - RNA, 12 nt, Coxiella burnetii RSA 493
aaaaauuuuaaa

SEQ ID NO: 565652 - RNA, 17 nt, Coxiella burnetii RSA 493
aaaaauuuuaaaaaaau

SEQ ID NO: 565653 - RNA, 13 nt, Coxiella burnetii RSA 493
aaaaauuucauuu

SEQ ID NO: 565654 - RNA, 17 nt, Coxiella burnetii RSA 493
aaaaauuucauuuaaua

SEQ ID NO: 565655 - RNA, 19 nt, Coxiella burnetii RSA 493
aaaaauuucauccguggaa

SEQ ID NO: 565656 - RNA, 22 nt, Coxiella burnetii RSA 493
aauccuuuuuguaauccuuguu

SEQ ID NO: 565657 - RNA, 18 nt, Coxiella burnetii RSA 493
aaucgacggcucucucua

SEQ ID NO: 565658 - RNA, 15 nt, Coxiella burnetii RSA 493
aaugaaaaauagggc

SEQ ID NO: 565659 - RNA, 17 nt, Coxiella burnetii RSA 493
aaugaauaagcaaagau

SEQ ID NO: 565660 - RNA, 14 nt, Coxiella burnetii RSA 493
aaugaauagaaaaa

SEQ ID NO: 565661 - RNA, 16 nt, Coxiella burnetii RSA 493
aaugaauagaaaaacu

SEQ ID NO: 565662 - RNA, 19 nt, Coxiella burnetii RSA 493
aaugaaauuucucauauau

SEQ ID NO: 565663 - RNA, 14 nt, Coxiella burnetii RSA 493
aaugaacaaaguag

SEQ ID NO: 565664 - RNA, 12 nt, Coxiella burnetii RSA 493
aaugagugcuuu

SEQ ID NO: 565665 - RNA, 14 nt, Coxiella burnetii RSA 493
aaugagaucaaagc

SEQ ID NO: 565666 - RNA, 21 nt, Coxiella burnetii RSA 493
aaugagaugaucaucaucaaa

SEQ ID NO: 565667 - RNA, 23 nt, Coxiella burnetii RSA 493
aaugagcguaaucaauaaaacuc

SEQ ID NO: 565668 - RNA, 18 nt, Coxiella burnetii RSA 493
aaugagaaacgugagaga

SEQ ID NO: 565669 - RNA, 14 nt, Coxiella burnetii RSA 493
aaugacuuuaacuc

SEQ ID NO: 565670 - RNA, 22 nt, Coxiella burnetii RSA 493
aaugacguauugucaaaauuag

SEQ ID NO: 565671 - RNA, 17 nt, Coxiella burnetii RSA 493
aaugacgaucgucuaaa

SEQ ID NO: 565672 - RNA, 22 nt, Coxiella burnetii RSA 493
aaugacgauuaaaaauaaaacc

SEQ ID NO: 565673 - RNA, 16 nt, Coxiella burnetii RSA 493
aaugacgauuaacaac

SEQ ID NO: 565674 - RNA, 20 nt, Coxiella burnetii RSA 493
aaugacggaauuugugauuu

SEQ ID NO: 565675 - RNA, 16 nt, Coxiella burnetii RSA 493
aaugaauucaaaccaa

SEQ ID NO: 565676 - RNA, 14 nt, Coxiella burnetii RSA 493
aaugaccaaauaau

SEQ ID NO: 565677 - RNA, 19 nt, Coxiella burnetii RSA 493
aaugcgguacuuaagaaag

SEQ ID NO: 565678 - RNA, 17 nt, Coxiella burnetii RSA 493
aaugccggcuaauuuuu

SEQ ID NO: 565679 - RNA, 14 nt, Coxiella burnetii RSA 493
aauggauucccaua

SEQ ID NO: 565680 - RNA, 19 nt, Coxiella burnetii RSA 493
aauggauucuucuuuugcc

SEQ ID NO: 565681 - RNA, 14 nt, Coxiella burnetii RSA 493
aauggauugcacuu

SEQ ID NO: 565682 - RNA, 18 nt, Coxiella burnetii RSA 493
aaugggaaguuuuauaac

SEQ ID NO: 565683 - RNA, 16 nt, Coxiella burnetii RSA 493
aauggcgggaaaaaau

SEQ ID NO: 565684 - RNA, 16 nt, Coxiella burnetii RSA 493
aaugaucugcucuuuu

SEQ ID NO: 565685 - RNA, 20 nt, Coxiella burnetii RSA 493
aaugaucugcucuuuuguau

SEQ ID NO: 565686 - RNA, 19 nt, Coxiella burnetii RSA 493
aaugaugcuucuuugauaa

SEQ ID NO: 565687 - RNA, 13 nt, Coxiella burnetii RSA 493
aaugcaguuaacc

SEQ ID NO: 565688 - RNA, 15 nt, Coxiella burnetii RSA 493
aauuuucccauucua

SEQ ID NO: 565689 - RNA, 20 nt, Coxiella burnetii RSA 493
aauuuuccagggaaguugcc

SEQ ID NO: 565690 - RNA, 22 nt, Coxiella burnetii RSA 493
aauuuuccgugcagaaacaaua

SEQ ID NO: 565691 - RNA, 13 nt, Coxiella burnetii RSA 493
aauuuuauuauuu

SEQ ID NO: 565692 - RNA, 14 nt, Coxiella burnetii RSA 493
aauuuuauuauuua

SEQ ID NO: 565693 - RNA, 13 nt, Coxiella burnetii RSA 493
aauuuucuuguuc

SEQ ID NO: 565694 - RNA, 19 nt, Coxiella burnetii RSA 493
aauuuugaauccucaguaa

SEQ ID NO: 565695 - RNA, 21 nt, Coxiella burnetii RSA 493
aauuuugggguuugucucuaa

SEQ ID NO: 565696 - RNA, 12 nt, Coxiella burnetii RSA 493
aauuuuuccuuu

SEQ ID NO: 565697 - RNA, 13 nt, Coxiella burnetii RSA 493
aauuuuuccuuuc

SEQ ID NO: 565698 - RNA, 23 nt, Coxiella burnetii RSA 493
aauuuuuccuuucuuucuucacu

SEQ ID NO: 565699 - RNA, 20 nt, Coxiella burnetii RSA 493
aauuugcauuaaucuuccau

SEQ ID NO: 565700 - RNA, 20 nt, Coxiella burnetii RSA 493
aauuugauuuuuuuugcuuu

SEQ ID NO: 565701 - RNA, 15 nt, Coxiella burnetii RSA 493
aauuugaugccauaa

SEQ ID NO: 565702 - RNA, 22 nt, Coxiella burnetii RSA 493
aauuugaugaucggaggaaaua

SEQ ID NO: 565703 - RNA, 16 nt, Coxiella burnetii RSA 493
aauuugugauuuuaaa

SEQ ID NO: 565704 - RNA, 19 nt, Coxiella burnetii RSA 493
aauuugugauuuuaaaaau

SEQ ID NO: 565705 - RNA, 19 nt, Coxiella burnetii RSA 493
aauuugugaaauaugcacu

SEQ ID NO: 565706 - RNA, 17 nt, Coxiella burnetii RSA 493
aauuuguaauugcuucc

SEQ ID NO: 565707 - RNA, 19 nt, Coxiella burnetii RSA 493
aauuuguaauugcuuccaa

SEQ ID NO: 565708 - RNA, 16 nt, Coxiella burnetii RSA 493
aauuuuaaaaaacccu

SEQ ID NO: 565709 - RNA, 11 nt, Coxiella burnetii RSA 493
aauuuuaaauc

SEQ ID NO: 565710 - RNA, 13 nt, Coxiella burnetii RSA 493
aauuuuaaaucca

SEQ ID NO: 565711 - RNA, 18 nt, Coxiella burnetii RSA 493
aauuucauccguggaagu

SEQ ID NO: 565712 - RNA, 18 nt, Coxiella burnetii RSA 493
aauuucucgaaugacaac

SEQ ID NO: 565713 - RNA, 23 nt, Coxiella burnetii RSA 493
aauuucucguugauaaagauucu

SEQ ID NO: 565714 - RNA, 11 nt, Coxiella burnetii RSA 493
aauuucuuccu

SEQ ID NO: 565715 - RNA, 23 nt, Coxiella burnetii RSA 493
aauuucuggcuugcuaugaugcc

SEQ ID NO: 565716 - RNA, 17 nt, Coxiella burnetii RSA 493
aauuucggguucaaaaa

SEQ ID NO: 565717 - RNA, 13 nt, Coxiella burnetii RSA 493
aauuucuaaaaau

SEQ ID NO: 565718 - RNA, 13 nt, Coxiella burnetii RSA 493
aauuucgauuuua

SEQ ID NO: 565719 - RNA, 17 nt, Coxiella burnetii RSA 493
aauuucaaugacuuuaa

SEQ ID NO: 565720 - RNA, 15 nt, Coxiella burnetii RSA 493
aauuuauucaacucu

SEQ ID NO: 565721 - RNA, 19 nt, Coxiella burnetii RSA 493
aauuuagcuuuuuucaaaa

SEQ ID NO: 565722 - RNA, 17 nt, Coxiella burnetii RSA 493
aauugcuccaaacagac

SEQ ID NO: 565723 - RNA, 13 nt, Coxiella burnetii RSA 493
aauuuacuuuacg

SEQ ID NO: 565724 - RNA, 19 nt, Coxiella burnetii RSA 493
aauuuacuuuacgcucaau

SEQ ID NO: 565725 - RNA, 12 nt, Coxiella burnetii RSA 493
aauuuaccucca

SEQ ID NO: 565726 - RNA, 19 nt, Coxiella burnetii RSA 493
aauuuaaaguuucuaacuc

SEQ ID NO: 565727 - RNA, 23 nt, Coxiella burnetii RSA 493
aauugcgccgguuuaaaacgacu

SEQ ID NO: 565728 - RNA, 15 nt, Coxiella burnetii RSA 493
aauugcgcguaaaau

SEQ ID NO: 565729 - RNA, 22 nt, Coxiella burnetii RSA 493
aaugguggucggcaccaaaauc

SEQ ID NO: 565730 - RNA, 18 nt, Coxiella burnetii RSA 493
aauuaagcuugaaaaaau

SEQ ID NO: 565731 - RNA, 19 nt, Coxiella burnetii RSA 493
aauuaagcuugaaaaaauu

SEQ ID NO: 565732 - RNA, 15 nt, Coxiella burnetii RSA 493
aauguauccgggcca

SEQ ID NO: 565733 - RNA, 17 nt, Coxiella burnetii RSA 493
aauuacaauccaauacu

SEQ ID NO: 565734 - RNA, 18 nt, Coxiella burnetii RSA 493
aauuaauuuauaaaauuu

SEQ ID NO: 565735 - RNA, 23 nt, Coxiella burnetii RSA 493
aauuaaugaucaaugaaacaaac

SEQ ID NO: 565736 - RNA, 19 nt, Coxiella burnetii RSA 493
aauuaaugcgccuacaaau

SEQ ID NO: 565737 - RNA, 20 nt, Coxiella burnetii RSA 493
aauuaaugcgccuacaaaua

SEQ ID NO: 565738 - RNA, 21 nt, Coxiella burnetii RSA 493
aauuacuacacgcuugaaaua

SEQ ID NO: 565739 - RNA, 15 nt, Coxiella burnetii RSA 493
aauuagcauuuucuc

SEQ ID NO: 565740 - RNA, 16 nt, Coxiella burnetii RSA 493
aauuaggagaucuuuu

SEQ ID NO: 565741 - RNA, 13 nt, Coxiella burnetii RSA 493
aauuaugaaaacg

SEQ ID NO: 565742 - RNA, 20 nt, Coxiella burnetii RSA 493
aauuaucuuaaugaaauuuc

SEQ ID NO: 565743 - RNA, 14 nt, Coxiella burnetii RSA 493
aauugaauuugcuu

SEQ ID NO: 565744 - RNA, 16 nt, Coxiella burnetii RSA 493
aauucuuucugaaaau

SEQ ID NO: 565745 - RNA, 12 nt, Coxiella burnetii RSA 493
aauucuucuuca

SEQ ID NO: 565746 - RNA, 16 nt, Coxiella burnetii RSA 493
aauucuucuucauuua

SEQ ID NO: 565747 - RNA, 15 nt, Coxiella burnetii RSA 493
aauucuugcagugaa

SEQ ID NO: 565748 - RNA, 19 nt, Coxiella burnetii RSA 493
aauucuugcagugaaauaa

SEQ ID NO: 565749 - RNA, 23 nt, Coxiella burnetii RSA 493
aauugaggucgagcguaaaacac

SEQ ID NO: 565750 - RNA, 14 nt, Coxiella burnetii RSA 493
aauugcaaaacagc

SEQ ID NO: 565751 - RNA, 19 nt, Coxiella burnetii RSA 493
aauugcaaaacuucccauu

SEQ ID NO: 565752 - RNA, 14 nt, Coxiella burnetii RSA 493
aauucccuuuugaa

SEQ ID NO: 565753 - RNA, 14 nt, Coxiella burnetii RSA 493
aauuccgccauuaa

SEQ ID NO: 565754 - RNA, 19 nt, Coxiella burnetii RSA 493
aauuccgccauuaaugaua

SEQ ID NO: 565755 - RNA, 21 nt, Coxiella burnetii RSA 493
aauucgcacaaugcuuuucuc

SEQ ID NO: 565756 - RNA, 22 nt, Coxiella burnetii RSA 493
aauuccggucgugagguuuuac

SEQ ID NO: 565757 - RNA, 18 nt, Coxiella burnetii RSA 493
aauucaaaccaacgaugc

SEQ ID NO: 565758 - RNA, 17 nt, Coxiella burnetii RSA 493
aauucaauuuuuuugau

SEQ ID NO: 565759 - RNA, 20 nt, Coxiella burnetii RSA 493
aauucgggcaacgaggugca

SEQ ID NO: 565760 - RNA, 19 nt, Coxiella burnetii RSA 493
aauucgcuccucaauuucc

SEQ ID NO: 565761 - RNA, 19 nt, Coxiella burnetii RSA 493
aauucgcggguaaauuuau

SEQ ID NO: 565762 - RNA, 10 nt, Coxiella burnetii RSA 493
aauucuaagg

SEQ ID NO: 565763 - RNA, 13 nt, Coxiella burnetii RSA 493
acaagaauuuuuu

SEQ ID NO: 565764 - RNA, 17 nt, Coxiella burnetii RSA 493
acaagcagggcaguaaa

SEQ ID NO: 565765 - RNA, 13 nt, Coxiella burnetii RSA 493
acaagccccuuua

SEQ ID NO: 565766 - RNA, 18 nt, Coxiella burnetii RSA 493
acaauagaauaaugaaca

SEQ ID NO: 565767 - RNA, 17 nt, Coxiella burnetii RSA 493
acaauaagagcuccaaa

SEQ ID NO: 565768 - RNA, 14 nt, Coxiella burnetii RSA 493
acaagucucagaau

SEQ ID NO: 565769 - RNA, 14 nt, Coxiella burnetii RSA 493
acaaguauaacaaa

SEQ ID NO: 565770 - RNA, 17 nt, Coxiella burnetii RSA 493
acaacguaacugaugua

SEQ ID NO: 565771 - RNA, 14 nt, Coxiella burnetii RSA 493
acaacgcuguuaaa

SEQ ID NO: 565772 - RNA, 15 nt, Coxiella burnetii RSA 493
acaacgcuguuaaaa

SEQ ID NO: 565773 - RNA, 14 nt, Coxiella burnetii RSA 493
aauuuuugccaaua

SEQ ID NO: 565774 - RNA, 21 nt, Coxiella burnetii RSA 493
aauuuuucuuuuuuuucuucu

SEQ ID NO: 565775 - RNA, 16 nt, Coxiella burnetii RSA 493
aauuuuugaauaccag

SEQ ID NO: 565776 - RNA, 14 nt, Coxiella burnetii RSA 493
aauuuuuugcugau

SEQ ID NO: 565777 - RNA, 14 nt, Coxiella burnetii RSA 493
aauuuuuugaaaaa

SEQ ID NO: 565778 - RNA, 15 nt, Coxiella burnetii RSA 493
acaacuaccugauaa

SEQ ID NO: 565779 - RNA, 20 nt, Coxiella burnetii RSA 493
acaacuaccugauaaaauaa

SEQ ID NO: 565780 - RNA, 21 nt, Coxiella burnetii RSA 493
acaacuaccugauaaaauaac

SEQ ID NO: 565781 - RNA, 17 nt, Coxiella burnetii RSA 493
acaacuacuaagccacc

SEQ ID NO: 565782 - RNA, 17 nt, Coxiella burnetii RSA 493
acaauuacuuaaauuau

SEQ ID NO: 565783 - RNA, 19 nt, Coxiella burnetii RSA 493
acaauuaaugcgccuacaa

SEQ ID NO: 565784 - RNA, 23 nt, Coxiella burnetii RSA 493
acaauuaaugcgccuacaaauac

SEQ ID NO: 565785 - RNA, 16 nt, Coxiella burnetii RSA 493
acaauuaacuuugcaa

SEQ ID NO: 565786 - RNA, 17 nt, Coxiella burnetii RSA 493
acaauuaacuuugcaaa

SEQ ID NO: 565787 - RNA, 16 nt, Coxiella burnetii RSA 493
acaaugcguuuuaaau

SEQ ID NO: 565788 - RNA, 14 nt, Coxiella burnetii RSA 493
acacauaaugaucg

SEQ ID NO: 565789 - RNA, 14 nt, Coxiella burnetii RSA 493
acacuauugaaguc

SEQ ID NO: 565790 - RNA, 17 nt, Coxiella burnetii RSA 493
acacuaaagguaaaaag

SEQ ID NO: 565791 - RNA, 19 nt, Coxiella burnetii RSA 493
acagacagacgcuggaaaa

SEQ ID NO: 565792 - RNA, 21 nt, Coxiella burnetii RSA 493
acacuuuuaaucacaucccuu

SEQ ID NO: 565793 - RNA, 13 nt, Coxiella burnetii RSA 493
acagaucauuccu

SEQ ID NO: 565794 - RNA, 15 nt, Coxiella burnetii RSA 493
acagccgaugacaaa

SEQ ID NO: 565795 - RNA, 19 nt, Coxiella burnetii RSA 493
acagccgaugacaaauaaa

SEQ ID NO: 565796 - RNA, 16 nt, Coxiella burnetii RSA 493
acaggagcgauaaaau

SEQ ID NO: 565797 - RNA, 19 nt, Coxiella burnetii RSA 493
acaggagcgauaaaauaac

SEQ ID NO: 565798 - RNA, 16 nt, Coxiella burnetii RSA 493
acaggacaaaccuggc

SEQ ID NO: 565799 - RNA, 15 nt, Coxiella burnetii RSA 493
acagcucugaaagca

SEQ ID NO: 565800 - RNA, 17 nt, Coxiella burnetii RSA 493
acaucaaauagaugacu

SEQ ID NO: 565801 - RNA, 21 nt, Coxiella burnetii RSA 493
acaucagcggggagauuaaaa

SEQ ID NO: 565802 - RNA, 19 nt, Coxiella burnetii RSA 493
acauaucgcuccccuugcc

SEQ ID NO: 565803 - RNA, 14 nt, Coxiella burnetii RSA 493
acauauuucuuuuc

SEQ ID NO: 565804 - RNA, 14 nt, Coxiella burnetii RSA 493
acaggauuauauua

SEQ ID NO: 565805 - RNA, 16 nt, Coxiella burnetii RSA 493
acauaggagauuuuua

SEQ ID NO: 565806 - RNA, 15 nt, Coxiella burnetii RSA 493
acauagccucuauaa

SEQ ID NO: 565807 - RNA, 17 nt, Coxiella burnetii RSA 493
acauacgacuucauuuc

SEQ ID NO: 565808 - RNA, 23 nt, Coxiella burnetii RSA 493
acauuaaggccaauuccaauaau

SEQ ID NO: 565809 - RNA, 17 nt, Coxiella burnetii RSA 493
acauuauugaugucaca

SEQ ID NO: 565810 - RNA, 20 nt, Coxiella burnetii RSA 493
acauuauuacauauuucuuu

SEQ ID NO: 565811 - RNA, 18 nt, Coxiella burnetii RSA 493
acauucgauauguuucaa

SEQ ID NO: 565812 - RNA, 21 nt, Coxiella burnetii RSA 493
acauucugaacgcucuuccaa

SEQ ID NO: 565813 - RNA, 18 nt, Coxiella burnetii RSA 493
acauuggcaguguaaauu

SEQ ID NO: 565814 - RNA, 16 nt, Coxiella burnetii RSA 493
acauuucacccagacu

SEQ ID NO: 565815 - RNA, 21 nt, Coxiella burnetii RSA 493
acauggcgguaaugagaacca

SEQ ID NO: 565816 - RNA, 15 nt, Coxiella burnetii RSA 493
acaucgcaauuaaua

SEQ ID NO: 565817 - RNA, 12 nt, Coxiella burnetii RSA 493
acaucuucacgc

SEQ ID NO: 565818 - RNA, 14 nt, Coxiella burnetii RSA 493
acaucuucauuuuc

SEQ ID NO: 565819 - RNA, 11 nt, Coxiella burnetii RSA 493
accaaugaaac

SEQ ID NO: 565820 - RNA, 22 nt, Coxiella burnetii RSA 493
accaaugaaacgcgccaaacaa

SEQ ID NO: 565821 - RNA, 20 nt, Coxiella burnetii RSA 493
accaaucguaaagaucauca

SEQ ID NO: 565822 - RNA, 19 nt, Coxiella burnetii RSA 493
accaaucuauuagcuggca

SEQ ID NO: 565823 - RNA, 20 nt, Coxiella burnetii RSA 493
acauuucggacaacaaauaa

SEQ ID NO: 565824 - RNA, 22 nt, Coxiella burnetii RSA 493
acauuucggacaacaaauaaau

SEQ ID NO: 565825 - RNA, 15 nt, Coxiella burnetii RSA 493
accaagcucaugaaa

SEQ ID NO: 565826 - RNA, 21 nt, Coxiella burnetii RSA 493
accaccuggcuaguaaauaaa

SEQ ID NO: 565827 - RNA, 12 nt, Coxiella burnetii RSA 493
aauaggaaaaau

SEQ ID NO: 565828 - RNA, 21 nt, Coxiella burnetii RSA 493
aauaguacuguauugagcagc

SEQ ID NO: 565829 - RNA, 18 nt, Coxiella burnetii RSA 493
aauaggcuuucuuuuucu

SEQ ID NO: 565830 - RNA, 19 nt, Coxiella burnetii RSA 493
aauagggcggcaaucagaa

SEQ ID NO: 565831 - RNA, 15 nt, Coxiella burnetii RSA 493
aauaguggcauuaaa

SEQ ID NO: 565832 - RNA, 21 nt, Coxiella burnetii RSA 493
aauaguggcauuaaaagauuu

SEQ ID NO: 565833 - RNA, 22 nt, Coxiella burnetii RSA 493
aauaguuugcaauaccauuuuu

SEQ ID NO: 565834 - RNA, 18 nt, Coxiella burnetii RSA 493
aauagauuagugaaucua

SEQ ID NO: 565835 - RNA, 15 nt, Coxiella burnetii RSA 493
aauagacuucgcuaa

SEQ ID NO: 565836 - RNA, 19 nt, Coxiella burnetii RSA 493
aauagacuucgcuaaauaa

SEQ ID NO: 565837 - RNA, 21 nt, Coxiella burnetii RSA 493
aauagacuucgcuaaauaaca

SEQ ID NO: 565838 - RNA, 15 nt, Coxiella burnetii RSA 493
aauagccuucucaau

SEQ ID NO: 565839 - RNA, 23 nt, Coxiella burnetii RSA 493
aauagcucagcugguagagcaca

SEQ ID NO: 565840 - RNA, 23 nt, Coxiella burnetii RSA 493
aauauaaugggaguaaugacaga

SEQ ID NO: 565841 - RNA, 22 nt, Coxiella burnetii RSA 493
aauauaacgcuccaguauuuca

SEQ ID NO: 565842 - RNA, 18 nt, Coxiella burnetii RSA 493
aauaucaaaaaaccauaa

SEQ ID NO: 565843 - RNA, 15 nt, Coxiella burnetii RSA 493
aauauccuuacuauu

SEQ ID NO: 565844 - RNA, 17 nt, Coxiella burnetii RSA 493
aauauccuuguaauuca

SEQ ID NO: 565845 - RNA, 16 nt, Coxiella burnetii RSA 493
aauauccgcaauaugc

SEQ ID NO: 565846 - RNA, 22 nt, Coxiella burnetii RSA 493
aauaucccaugacgauuuuaau

SEQ ID NO: 565847 - RNA, 13 nt, Coxiella burnetii RSA 493
aauaucugaucaa

SEQ ID NO: 565848 - RNA, 17 nt, Coxiella burnetii RSA 493
aauaucuagauuuaaaa

SEQ ID NO: 565849 - RNA, 20 nt, Coxiella burnetii RSA 493
aauaucgcuauaauuagaua

SEQ ID NO: 565850 - RNA, 16 nt, Coxiella burnetii RSA 493
aauaagccaauacgaa

SEQ ID NO: 565851 - RNA, 24 nt, Coxiella burnetii RSA 493
aauaagccaauacgaacaauuguu

SEQ ID NO: 565852 - RNA, 18 nt, Coxiella burnetii RSA 493
aauaagccuaaacgcuua

SEQ ID NO: 565853 - RNA, 14 nt, Coxiella burnetii RSA 493
aauaagcugauuaa

SEQ ID NO: 565854 - RNA, 15 nt, Coxiella burnetii RSA 493
aaaaaguucaccgca

SEQ ID NO: 565855 - RNA, 17 nt, Coxiella burnetii RSA 493
aaaaaguuggucuuuuu

SEQ ID NO: 565856 - RNA, 17 nt, Coxiella burnetii RSA 493
aaaaauaaaaauuucau

SEQ ID NO: 565857 - RNA, 11 nt, Coxiella burnetii RSA 493
aaaaauaaaag

SEQ ID NO: 565858 - RNA, 14 nt, Coxiella burnetii RSA 493
aauaagucuuugcu

SEQ ID NO: 565859 - RNA, 17 nt, Coxiella burnetii RSA 493
aauaaggagcaucuguu

SEQ ID NO: 565860 - RNA, 11 nt, Coxiella burnetii RSA 493
aauaauaaaac

SEQ ID NO: 565861 - RNA, 14 nt, Coxiella burnetii RSA 493
aauaauaagcgucc

SEQ ID NO: 565862 - RNA, 17 nt, Coxiella burnetii RSA 493
aaguugggccaaaauag

SEQ ID NO: 565863 - RNA, 15 nt, Coxiella burnetii RSA 493
aauaaauccuuggga

SEQ ID NO: 565864 - RNA, 15 nt, Coxiella burnetii RSA 493
aauaaaucaauuaaa

SEQ ID NO: 565865 - RNA, 18 nt, Coxiella burnetii RSA 493
aauaacuuuaguuuuucc

SEQ ID NO: 565866 - RNA, 17 nt, Coxiella burnetii RSA 493
aauaacccacagccgcu

SEQ ID NO: 565867 - RNA, 17 nt, Coxiella burnetii RSA 493
aauaacucggaacugau

SEQ ID NO: 565868 - RNA, 20 nt, Coxiella burnetii RSA 493
aauaaugucugcauuuuuaa

SEQ ID NO: 565869 - RNA, 14 nt, Coxiella burnetii RSA 493
aauaauuuuccguc

SEQ ID NO: 565870 - RNA, 20 nt, Coxiella burnetii RSA 493
aauaauuuuuuuaauuuuuu

SEQ ID NO: 565871 - RNA, 18 nt, Coxiella burnetii RSA 493
aaaaauaguuucaauuuc

SEQ ID NO: 565872 - RNA, 16 nt, Coxiella burnetii RSA 493
aauaauggaucguuaa

SEQ ID NO: 565873 - RNA, 18 nt, Coxiella burnetii RSA 493
aauaaugguagcuaccag

SEQ ID NO: 565874 - RNA, 15 nt, Coxiella burnetii RSA 493
aauaccagcagugaa

SEQ ID NO: 565875 - RNA, 18 nt, Coxiella burnetii RSA 493
aauaccaauucaaauaau

SEQ ID NO: 565876 - RNA, 19 nt, Coxiella burnetii RSA 493
aauacaccggaaauuuuuu

SEQ ID NO: 565877 - RNA, 13 nt, Coxiella burnetii RSA 493
aauaccauuuucc

SEQ ID NO: 565878 - RNA, 15 nt, Coxiella burnetii RSA 493
aauaccauuuuccuu

SEQ ID NO: 565879 - RNA, 16 nt, Coxiella burnetii RSA 493
aauaccauuuuccuuu

SEQ ID NO: 565880 - RNA, 13 nt, Coxiella burnetii RSA 493
aauaccauuuuua

SEQ ID NO: 565881 - RNA, 13 nt, Coxiella burnetii RSA 493
aagguuuuuccuu

SEQ ID NO: 565882 - RNA, 18 nt, Coxiella burnetii RSA 493
aagggaccuuuuuugcaa

SEQ ID NO: 565883 - RNA, 20 nt, Coxiella burnetii RSA 493
aagggcucgcuaaucgcaau

SEQ ID NO: 565884 - RNA, 18 nt, Coxiella burnetii RSA 493
aaguacccaacaauaaaa

SEQ ID NO: 565885 - RNA, 22 nt, Coxiella burnetii RSA 493
aaguacccaacaauaaaaccga

SEQ ID NO: 565886 - RNA, 15 nt, Coxiella burnetii RSA 493
aaguaauucagcauu

SEQ ID NO: 565887 - RNA, 20 nt, Coxiella burnetii RSA 493
aagucagcuuuggaaaaaca

SEQ ID NO: 565888 - RNA, 14 nt, Coxiella burnetii RSA 493
aagucagacuugcu

SEQ ID NO: 565889 - RNA, 15 nt, Coxiella burnetii RSA 493
aagucagacuugcuu

SEQ ID NO: 565890 - RNA, 19 nt, Coxiella burnetii RSA 493
aaguaugugggcucacuug

SEQ ID NO: 565891 - RNA, 14 nt, Coxiella burnetii RSA 493
aaguaugaucauuu

SEQ ID NO: 565892 - RNA, 14 nt, Coxiella burnetii RSA 493
aaguaugauguuuc

SEQ ID NO: 565893 - RNA, 16 nt, Coxiella burnetii RSA 493
aaguagccaaaauaau

SEQ ID NO: 565894 - RNA, 17 nt, Coxiella burnetii RSA 493
aaguagccaaaauaaua

SEQ ID NO: 565895 - RNA, 15 nt, Coxiella burnetii RSA 493
aaguagcuaaaaaau

SEQ ID NO: 565896 - RNA, 19 nt, Coxiella burnetii RSA 493
aaguccggacgcaauaccc

SEQ ID NO: 565897 - RNA, 18 nt, Coxiella burnetii RSA 493
aaguccuugcugaauucc

SEQ ID NO: 565898 - RNA, 14 nt, Coxiella burnetii RSA 493
aaguccuuguugca

SEQ ID NO: 565899 - RNA, 15 nt, Coxiella burnetii RSA 493
aaguccaauuauaac

SEQ ID NO: 565900 - RNA, 19 nt, Coxiella burnetii RSA 493
aaguccaauuauaacuauu

SEQ ID NO: 565901 - RNA, 15 nt, Coxiella burnetii RSA 493
aagucugaacaggca

SEQ ID NO: 565902 - RNA, 19 nt, Coxiella burnetii RSA 493
aagucgcccguaugcagcg

SEQ ID NO: 565903 - RNA, 19 nt, Coxiella burnetii RSA 493
aagucggggccgguucuuu

SEQ ID NO: 565904 - RNA, 18 nt, Coxiella burnetii RSA 493
aagucgggugauugaaaa

SEQ ID NO: 565905 - RNA, 19 nt, Coxiella burnetii RSA 493
aagucuauugaaaaaaacg

SEQ ID NO: 565906 - RNA, 22 nt, Coxiella burnetii RSA 493
aaguucccccuggugcugguag

SEQ ID NO: 565907 - RNA, 15 nt, Coxiella burnetii RSA 493
aaguuaagauaauaa

SEQ ID NO: 565908 - RNA, 13 nt, Coxiella burnetii RSA 493
aagugcuaaaaaa

SEQ ID NO: 565909 - RNA, 14 nt, Coxiella burnetii RSA 493
aagugcuaaaaaau

SEQ ID NO: 565910 - RNA, 15 nt, Coxiella burnetii RSA 493
aagugugggaaaaau

SEQ ID NO: 565911 - RNA, 16 nt, Coxiella burnetii RSA 493
aagugugggaaaaaua

SEQ ID NO: 565912 - RNA, 19 nt, Coxiella burnetii RSA 493
aaguguucacaagucucag

SEQ ID NO: 565913 - RNA, 20 nt, Coxiella burnetii RSA 493
aaguguucacaagucucaga

SEQ ID NO: 565914 - RNA, 22 nt, Coxiella burnetii RSA 493
aaguguucacaagucucagaau

SEQ ID NO: 565915 - RNA, 19 nt, Coxiella burnetii RSA 493
aagcugcuuuuuaaaacgc

SEQ ID NO: 565916 - RNA, 21 nt, Coxiella burnetii RSA 493
aagcuucucggauagcgacaa

SEQ ID NO: 565917 - RNA, 20 nt, Coxiella burnetii RSA 493
aaggaauacaaucgacagga

SEQ ID NO: 565918 - RNA, 12 nt, Coxiella burnetii RSA 493
aaggaauaaaac

SEQ ID NO: 565919 - RNA, 17 nt, Coxiella burnetii RSA 493
aaggaaccaccaaauca

SEQ ID NO: 565920 - RNA, 18 nt, Coxiella burnetii RSA 493
aaggaauccuuuuucuag

SEQ ID NO: 565921 - RNA, 22 nt, Coxiella burnetii RSA 493
aaggccucuuuagaaaauugau

SEQ ID NO: 565922 - RNA, 15 nt, Coxiella burnetii RSA 493
aaggcucacaauuaa

SEQ ID NO: 565923 - RNA, 15 nt, Coxiella burnetii RSA 493
aaggcaugaaauuuu

SEQ ID NO: 565924 - RNA, 18 nt, Coxiella burnetii RSA 493
aaggcagaggacagagga

SEQ ID NO: 565925 - RNA, 22 nt, Coxiella burnetii RSA 493
aaggcagcuuccagaaauucau

SEQ ID NO: 565926 - RNA, 15 nt, Coxiella burnetii RSA 493
aagcuagaaaauaac

SEQ ID NO: 565927 - RNA, 23 nt, Coxiella burnetii RSA 493
aagcuagaaaauaaccuaaaaua

SEQ ID NO: 565928 - RNA, 18 nt, Coxiella burnetii RSA 493
aagcgggguuaaggaaaa

SEQ ID NO: 565929 - RNA, 20 nt, Coxiella burnetii RSA 493
aagcgauugacuucuuugug

SEQ ID NO: 565930 - RNA, 17 nt, Coxiella burnetii RSA 493
aagcgauuccaaagcag

SEQ ID NO: 565931 - RNA, 21 nt, Coxiella burnetii RSA 493
aagcgcauauucgccuucuug

SEQ ID NO: 565932 - RNA, 22 nt, Coxiella burnetii RSA 493
aagcgccugccgcaacaagaaa

SEQ ID NO: 565933 - RNA, 16 nt, Coxiella burnetii RSA 493
aagcggccgcugugcc

SEQ ID NO: 565934 - RNA, 16 nt, Coxiella burnetii RSA 493
aagcgcgauucauucc

SEQ ID NO: 565935 - RNA, 16 nt, Coxiella burnetii RSA 493
aagccguuauccauga

SEQ ID NO: 565936 - RNA, 15 nt, Coxiella burnetii RSA 493
aacaggagcgauaaa

SEQ ID NO: 565937 - RNA, 18 nt, Coxiella burnetii RSA 493
aacaggagcgauaaaaua

SEQ ID NO: 565938 - RNA, 19 nt, Coxiella burnetii RSA 493
aacaggagcgauaaaauaa

SEQ ID NO: 565939 - RNA, 18 nt, Coxiella burnetii RSA 493
aacaggcagaugauuaaa

SEQ ID NO: 565940 - RNA, 21 nt, Coxiella burnetii RSA 493
aacaggcagaugauuaaaagc

SEQ ID NO: 565941 - RNA, 14 nt, Coxiella burnetii RSA 493
aacaguauaaaauu

SEQ ID NO: 565942 - RNA, 21 nt, Coxiella burnetii RSA 493
aacagucaugggguaaaauau

SEQ ID NO: 565943 - RNA, 21 nt, Coxiella burnetii RSA 493
aacaagguauugauuaacuuu

SEQ ID NO: 565944 - RNA, 23 nt, Coxiella burnetii RSA 493
aacagugccgguucccgcuucca

SEQ ID NO: 565945 - RNA, 19 nt, Coxiella burnetii RSA 493
aacaguguuuaacucuguu

SEQ ID NO: 565946 - RNA, 13 nt, Coxiella burnetii RSA 493
aacaguucaguuc

SEQ ID NO: 565947 - RNA, 20 nt, Coxiella burnetii RSA 493
aaccacuucaagaaagacau

SEQ ID NO: 565948 - RNA, 20 nt, Coxiella burnetii RSA 493
aaccaccuggcuaguaaaua

SEQ ID NO: 565949 - RNA, 20 nt, Coxiella burnetii RSA 493
aaccacuguccucuguccuc

SEQ ID NO: 565950 - RNA, 15 nt, Coxiella burnetii RSA 493
aaccauaagcaagcu

SEQ ID NO: 565951 - RNA, 20 nt, Coxiella burnetii RSA 493
aacccauuugccgccaggcu

SEQ ID NO: 565952 - RNA, 15 nt, Coxiella burnetii RSA 493
aaccucaacaguagu

SEQ ID NO: 565953 - RNA, 13 nt, Coxiella burnetii RSA 493
aaccuacuuuucu

SEQ ID NO: 565954 - RNA, 20 nt, Coxiella burnetii RSA 493
aaccuauccaaaaagauaau

SEQ ID NO: 565955 - RNA, 21 nt, Coxiella burnetii RSA 493
aaccuaaagaaagaagaaggu

SEQ ID NO: 565956 - RNA, 12 nt, Coxiella burnetii RSA 493
aaccgguuuuuc

SEQ ID NO: 565957 - RNA, 14 nt, Coxiella burnetii RSA 493
aacccgcaaaccag

SEQ ID NO: 565958 - RNA, 12 nt, Coxiella burnetii RSA 493
aaccuucccgga

SEQ ID NO: 565959 - RNA, 21 nt, Coxiella burnetii RSA 493
aaccuuguuauaaauuuuccc

SEQ ID NO: 565960 - RNA, 21 nt, Coxiella burnetii RSA 493
aacgcaucggccuuuuucauu

SEQ ID NO: 565961 - RNA, 17 nt, Coxiella burnetii RSA 493
aacgcacgaaccgccgg

SEQ ID NO: 565962 - RNA, 18 nt, Coxiella burnetii RSA 493
aacgauaaaauuacuauu

SEQ ID NO: 565963 - RNA, 23 nt, Coxiella burnetii RSA 493
aacgagggcugcaaccgacgaau

SEQ ID NO: 565964 - RNA, 17 nt, Coxiella burnetii RSA 493
aacgaggugcaaaccgu

SEQ ID NO: 565965 - RNA, 18 nt, Coxiella burnetii RSA 493
aacgaagguuucauaagg

SEQ ID NO: 565966 - RNA, 23 nt, Coxiella burnetii RSA 493
aacgaaguucucaaauuuuccca

SEQ ID NO: 565967 - RNA, 20 nt, Coxiella burnetii RSA 493
aacgaauggcccaauaaaga

SEQ ID NO: 565968 - RNA, 20 nt, Coxiella burnetii RSA 493
aacgacagguauuuuaagua

SEQ ID NO: 565969 - RNA, 18 nt, Coxiella burnetii RSA 493
aacgacuucucuuucuga

SEQ ID NO: 565970 - RNA, 17 nt, Coxiella burnetii RSA 493
aacgacggacauuuuuu

SEQ ID NO: 565971 - RNA, 17 nt, Coxiella burnetii RSA 493
aacgcucgauucuuugu

SEQ ID NO: 565972 - RNA, 14 nt, Coxiella burnetii RSA 493
aacgcguuuccucc

SEQ ID NO: 565973 - RNA, 18 nt, Coxiella burnetii RSA 493
aacggaugagcaaugaca

SEQ ID NO: 565974 - RNA, 14 nt, Coxiella burnetii RSA 493
aacggcgaaaggga

SEQ ID NO: 565975 - RNA, 15 nt, Coxiella burnetii RSA 493
aacgcgccaaacaac

SEQ ID NO: 565976 - RNA, 17 nt, Coxiella burnetii RSA 493
aacgcguacaguuuuuu

SEQ ID NO: 565977 - RNA, 16 nt, Coxiella burnetii RSA 493
aacgcgacaagaauuu

SEQ ID NO: 565978 - RNA, 24 nt, Coxiella burnetii RSA 493
aacgcgagagucgcaacaagcaac

SEQ ID NO: 565979 - RNA, 22 nt, Coxiella burnetii RSA 493
aacuuugauaagcauaauucau

SEQ ID NO: 565980 - RNA, 17 nt, Coxiella burnetii RSA 493
aacuuuguagaccaauc

SEQ ID NO: 565981 - RNA, 21 nt, Coxiella burnetii RSA 493
aacuuuuuagggcugaaaaaa

SEQ ID NO: 565982 - RNA, 23 nt, Coxiella burnetii RSA 493
aacuuuucggagaaaucuuuuuu

SEQ ID NO: 565983 - RNA, 12 nt, Coxiella burnetii RSA 493
aacuucucuuga

SEQ ID NO: 565984 - RNA, 14 nt, Coxiella burnetii RSA 493
aacuucucuugaau

SEQ ID NO: 565985 - RNA, 16 nt, Coxiella burnetii RSA 493
aacuuuaggaggaagg

SEQ ID NO: 565986 - RNA, 22 nt, Coxiella burnetii RSA 493
aacuuucguugugcucucccuu

SEQ ID NO: 565987 - RNA, 18 nt, Coxiella burnetii RSA 493
aacuuuaguuuuucccuc

SEQ ID NO: 565988 - RNA, 16 nt, Coxiella burnetii RSA 493
aacuguguucgcugua

SEQ ID NO: 565989 - RNA, 17 nt, Coxiella burnetii RSA 493
aacuucaugcaaaaauu

SEQ ID NO: 565990 - RNA, 23 nt, Coxiella burnetii RSA 493
aacuucgcacaucauugaaaacc

SEQ ID NO: 565991 - RNA, 17 nt, Coxiella burnetii RSA 493
aacuucgacgggaaaaa

SEQ ID NO: 565992 - RNA, 21 nt, Coxiella burnetii RSA 493
aacugcgccgcaaaguaaaaa

SEQ ID NO: 565993 - RNA, 19 nt, Coxiella burnetii RSA 493
aacucaauucgcuuaaauu

SEQ ID NO: 565994 - RNA, 22 nt, Coxiella burnetii RSA 493
aacgggaauguuuuuuaauaaa

SEQ ID NO: 565995 - RNA, 23 nt, Coxiella burnetii RSA 493
aacggcuaacccgcaaaccaggc

SEQ ID NO: 565996 - RNA, 22 nt, Coxiella burnetii RSA 493
aacuaucguugccuuuuugaau

SEQ ID NO: 565997 - RNA, 22 nt, Coxiella burnetii RSA 493
aacuccugaaaaauaauuuuag

SEQ ID NO: 565998 - RNA, 18 nt, Coxiella burnetii RSA 493
aacucgcccauggaaauc

SEQ ID NO: 565999 - RNA, 19 nt, Coxiella burnetii RSA 493
aacuccuucgcuuuuucca

SEQ ID NO: 566000 - RNA, 14 nt, Coxiella burnetii RSA 493
aacucggaacugau

SEQ ID NO: 566001 - RNA, 19 nt, Coxiella burnetii RSA 493
aacucuguuagauauugaa

SEQ ID NO: 566002 - RNA, 22 nt, Coxiella burnetii RSA 493
aacucuuaucuuaaaccucaac

SEQ ID NO: 566003 - RNA, 18 nt, Coxiella burnetii RSA 493
aagaccaaucguaaagau

SEQ ID NO: 566004 - RNA, 22 nt, Coxiella burnetii RSA 493
aagaccaaucguaaagaucauc

SEQ ID NO: 566005 - RNA, 19 nt, Coxiella burnetii RSA 493
aagacauuguucauaaaau

SEQ ID NO: 566006 - RNA, 21 nt, Coxiella burnetii RSA 493
aagacauuguucauaaaauaa

SEQ ID NO: 566007 - RNA, 17 nt, Coxiella burnetii RSA 493
aagacaauguuaaaaca

SEQ ID NO: 566008 - RNA, 19 nt, Coxiella burnetii RSA 493
aagacaauguuaaaacaca

SEQ ID NO: 566009 - RNA, 21 nt, Coxiella burnetii RSA 493
aagacaauguuaaaacacaua

SEQ ID NO: 566010 - RNA, 18 nt, Coxiella burnetii RSA 493
aagacaacaaaauguuug

SEQ ID NO: 566011 - RNA, 15 nt, Coxiella burnetii RSA 493
aagacaacuuuauag

SEQ ID NO: 566012 - RNA, 18 nt, Coxiella burnetii RSA 493
aagaaaguuucccacaaa

SEQ ID NO: 566013 - RNA, 18 nt, Coxiella burnetii RSA 493
aagaauggcgggaaaaaa

SEQ ID NO: 566014 - RNA, 17 nt, Coxiella burnetii RSA 493
aagacucaaagaaauaa

SEQ ID NO: 566015 - RNA, 13 nt, Coxiella burnetii RSA 493
aagacugauaacu

SEQ ID NO: 566016 - RNA, 14 nt, Coxiella burnetii RSA 493
aagacuaggaaaaa

SEQ ID NO: 566017 - RNA, 12 nt, Coxiella burnetii RSA 493
aagagaaaaaac

SEQ ID NO: 566018 - RNA, 13 nt, Coxiella burnetii RSA 493
aagagaaaaaacc

SEQ ID NO: 566019 - RNA, 16 nt, Coxiella burnetii RSA 493
aagagaaauuaaauuu

SEQ ID NO: 566020 - RNA, 18 nt, Coxiella burnetii RSA 493
aagacguaccauuaaaag

SEQ ID NO: 566021 - RNA, 14 nt, Coxiella burnetii RSA 493
aagagacaaaguuu

SEQ ID NO: 566022 - RNA, 12 nt, Coxiella burnetii RSA 493
aagagauaagcu

SEQ ID NO: 566023 - RNA, 21 nt, Coxiella burnetii RSA 493
aagaucaauaccgguaaucau

SEQ ID NO: 566024 - RNA, 19 nt, Coxiella burnetii RSA 493
aagauauucuucuagaaaa

SEQ ID NO: 566025 - RNA, 12 nt, Coxiella burnetii RSA 493
aagauaauaauu

SEQ ID NO: 566026 - RNA, 18 nt, Coxiella burnetii RSA 493
aagauaaucccaauaaaa

SEQ ID NO: 566027 - RNA, 19 nt, Coxiella burnetii RSA 493
aagaguugagcgaagaaaa

SEQ ID NO: 566028 - RNA, 19 nt, Coxiella burnetii RSA 493
aagaguauuuuuuuuaaaa

SEQ ID NO: 566029 - RNA, 21 nt, Coxiella burnetii RSA 493
cggcaucaacggaaaaacaaa

SEQ ID NO: 566030 - RNA, 13 nt, Coxiella burnetii RSA 493
cggcaucguuaaa

SEQ ID NO: 566031 - RNA, 17 nt, Coxiella burnetii RSA 493
cggcgauaaucauuaac

SEQ ID NO: 566032 - RNA, 18 nt, Coxiella burnetii RSA 493
cgcggaucucccgccucc

SEQ ID NO: 566033 - RNA, 23 nt, Coxiella burnetii RSA 493
cgcgcguuuuuuuaucuggccag

SEQ ID NO: 566034 - RNA, 16 nt, Coxiella burnetii RSA 493
cgccgguaccccauga

SEQ ID NO: 566035 - RNA, 15 nt, Coxiella burnetii RSA 493
cgcgaaauuguauug

SEQ ID NO: 566036 - RNA, 18 nt, Coxiella burnetii RSA 493
cgcgacaagaauuuuuuu

SEQ ID NO: 566037 - RNA, 11 nt, Coxiella burnetii RSA 493
cgcucauacgg

SEQ ID NO: 566038 - RNA, 23 nt, Coxiella burnetii RSA 493
cgcucaugggaugucgcuuuauu

SEQ ID NO: 566039 - RNA, 16 nt, Coxiella burnetii RSA 493
cgcuccauaccucuuc

SEQ ID NO: 566040 - RNA, 14 nt, Coxiella burnetii RSA 493
cgcuaguuuuuaag

SEQ ID NO: 566041 - RNA, 23 nt, Coxiella burnetii RSA 493
cgcucaaugagugcuuuuaacca

SEQ ID NO: 566042 - RNA, 21 nt, Coxiella burnetii RSA 493
cgcguucuugggcaauuugug

SEQ ID NO: 566043 - RNA, 19 nt, Coxiella burnetii RSA 493
cgcugacgucagaaaacag

SEQ ID NO: 566044 - RNA, 11 nt, Coxiella burnetii RSA 493
cgcugcaauaa

SEQ ID NO: 566045 - RNA, 18 nt, Coxiella burnetii RSA 493
cgcugcaauaauucuuuc

SEQ ID NO: 566046 - RNA, 15 nt, Coxiella burnetii RSA 493
cgcuucaauucuuuu

SEQ ID NO: 566047 - RNA, 16 nt, Coxiella burnetii RSA 493
cgcuucgaaaaucgaa

SEQ ID NO: 566048 - RNA, 22 nt, Coxiella burnetii RSA 493
cgcuucgaaaaucgaauuccaa

SEQ ID NO: 566049 - RNA, 23 nt, Coxiella burnetii RSA 493
cgcuucgaaaaucgaauuccaac

SEQ ID NO: 566050 - RNA, 21 nt, Coxiella burnetii RSA 493
cgcugugaaaaugucauucaa

SEQ ID NO: 566051 - RNA, 14 nt, Coxiella burnetii RSA 493
cgcuggcuuugauu

SEQ ID NO: 566052 - RNA, 15 nt, Coxiella burnetii RSA 493
cgcuggcuuugauuc

SEQ ID NO: 566053 - RNA, 12 nt, Coxiella burnetii RSA 493
cgcauaauaauc

SEQ ID NO: 566054 - RNA, 16 nt, Coxiella burnetii RSA 493
cgccagcuuccuucaa

SEQ ID NO: 566055 - RNA, 16 nt, Coxiella burnetii RSA 493
cgccaucaaccaauaa

SEQ ID NO: 566056 - RNA, 17 nt, Coxiella burnetii RSA 493
cgccauccgacauucuu

SEQ ID NO: 566057 - RNA, 13 nt, Coxiella burnetii RSA 493
cgccauugucuca

SEQ ID NO: 566058 - RNA, 22 nt, Coxiella burnetii RSA 493
cgccauuucgcuuuuauuuccu

SEQ ID NO: 566059 - RNA, 12 nt, Coxiella burnetii RSA 493
cgccauuuuuua

SEQ ID NO: 566060 - RNA, 19 nt, Coxiella burnetii RSA 493
cgcccaaaugaucggcgca

SEQ ID NO: 566061 - RNA, 14 nt, Coxiella burnetii RSA 493
cgauaacucagcgg

SEQ ID NO: 566062 - RNA, 16 nt, Coxiella burnetii RSA 493
cgauacuuguugacau

SEQ ID NO: 566063 - RNA, 15 nt, Coxiella burnetii RSA 493
cgaucaguuuguccu

SEQ ID NO: 566064 - RNA, 20 nt, Coxiella burnetii RSA 493
cgaucgcugugaaaauguca

SEQ ID NO: 566065 - RNA, 19 nt, Coxiella burnetii RSA 493
cgaucuauauuaauuugau

SEQ ID NO: 566066 - RNA, 19 nt, Coxiella burnetii RSA 493
cgaucuuucgcccauagcu

SEQ ID NO: 566067 - RNA, 20 nt, Coxiella burnetii RSA 493
cgaugacccucuuuuuaaaa

SEQ ID NO: 566068 - RNA, 14 nt, Coxiella burnetii RSA 493
cgaugcacucuuua

SEQ ID NO: 566069 - RNA, 22 nt, Coxiella burnetii RSA 493
cgaugcaauuagcgacccagcc

SEQ ID NO: 566070 - RNA, 14 nt, Coxiella burnetii RSA 493
cgauuccaaagcag

SEQ ID NO: 566071 - RNA, 12 nt, Coxiella burnetii RSA 493
cgauuccaauga

SEQ ID NO: 566072 - RNA, 19 nt, Coxiella burnetii RSA 493
cgauucauaaaaaaugauu

SEQ ID NO: 566073 - RNA, 19 nt, Coxiella burnetii RSA 493
cgauuucucuuaccauggu

SEQ ID NO: 566074 - RNA, 16 nt, Coxiella burnetii RSA 493
cgcaagcguggagcaa

SEQ ID NO: 566075 - RNA, 15 nt, Coxiella burnetii RSA 493
cgcacgguaauaaua

SEQ ID NO: 566076 - RNA, 20 nt, Coxiella burnetii RSA 493
cgcagccagcuugugcaauu

SEQ ID NO: 566077 - RNA, 18 nt, Coxiella burnetii RSA 493
ccauaauguuugauccuu

SEQ ID NO: 566078 - RNA, 22 nt, Coxiella burnetii RSA 493
ccauacgggcuacuuccuucuu

SEQ ID NO: 566079 - RNA, 23 nt, Coxiella burnetii RSA 493
ccagucguuuuuuaauauuuggg

SEQ ID NO: 566080 - RNA, 22 nt, Coxiella burnetii RSA 493
ccaguauuuuucuuuggguugg

SEQ ID NO: 566081 - RNA, 21 nt, Coxiella burnetii RSA 493
ccauccggaugucauaaucac

SEQ ID NO: 566082 - RNA, 16 nt, Coxiella burnetii RSA 493
ccaucgcccaguacug

SEQ ID NO: 566083 - RNA, 20 nt, Coxiella burnetii RSA 493
ccauauuugcugaauuuuau

SEQ ID NO: 566084 - RNA, 12 nt, Coxiella burnetii RSA 493
ccauauucaaca

SEQ ID NO: 566085 - RNA, 20 nt, Coxiella burnetii RSA 493
ccauccaacuuccuaucaau

SEQ ID NO: 566086 - RNA, 12 nt, Coxiella burnetii RSA 493
ccauccaauaac

SEQ ID NO: 566087 - RNA, 14 nt, Coxiella burnetii RSA 493
ccauccaauaacga

SEQ ID NO: 566088 - RNA, 15 nt, Coxiella burnetii RSA 493
cccaacuguuuuagu

SEQ ID NO: 566089 - RNA, 12 nt, Coxiella burnetii RSA 493
ccauuuuuucgu

SEQ ID NO: 566090 - RNA, 12 nt, Coxiella burnetii RSA 493
ccauuuuccuca

SEQ ID NO: 566091 - RNA, 19 nt, Coxiella burnetii RSA 493
ccauuugcggaaaaggaga

SEQ ID NO: 566092 - RNA, 14 nt, Coxiella burnetii RSA 493
ccauugcuuauuaa

SEQ ID NO: 566093 - RNA, 17 nt, Coxiella burnetii RSA 493
ccauucgcguuuuuaaa

SEQ ID NO: 566094 - RNA, 21 nt, Coxiella burnetii RSA 493
ccauucgcguuuuuaaaugaa

SEQ ID NO: 566095 - RNA, 14 nt, Coxiella burnetii RSA 493
ccauuauauuugua

SEQ ID NO: 566096 - RNA, 11 nt, Coxiella burnetii RSA 493
ccauuaaaagc

SEQ ID NO: 566097 - RNA, 18 nt, Coxiella burnetii RSA 493
ccauuaaugauaauuucu

SEQ ID NO: 566098 - RNA, 13 nt, Coxiella burnetii RSA 493
ccaugucuugaac

SEQ ID NO: 566099 - RNA, 20 nt, Coxiella burnetii RSA 493
aaacacauaucgcuccccuu

SEQ ID NO: 566100 - RNA, 21 nt, Coxiella burnetii RSA 493
aaacaauugagcggcuuuuuc

SEQ ID NO: 566101 - RNA, 11 nt, Coxiella burnetii RSA 493
aaacaauuccg

SEQ ID NO: 566102 - RNA, 21 nt, Coxiella burnetii RSA 493
cccagguaguaauuucuuccu

SEQ ID NO: 566103 - RNA, 21 nt, Coxiella burnetii RSA 493
cccgccgagcuuuucacccaa

SEQ ID NO: 566104 - RNA, 15 nt, Coxiella burnetii RSA 493
cccgccaggcuauga

SEQ ID NO: 566105 - RNA, 22 nt, Coxiella burnetii RSA 493
ccccuuugcggcuaaugcuuuu

SEQ ID NO: 566106 - RNA, 14 nt, Coxiella burnetii RSA 493
cccgaaacaggcgg

SEQ ID NO: 566107 - RNA, 13 nt, Coxiella burnetii RSA 493
ccccaucuacuuc

SEQ ID NO: 566108 - RNA, 23 nt, Coxiella burnetii RSA 493
ccccaaaggugucaaaauuauuc

SEQ ID NO: 566109 - RNA, 22 nt, Coxiella burnetii RSA 493
ccccaaaguuccgcuggggccg

SEQ ID NO: 566110 - RNA, 14 nt, Coxiella burnetii RSA 493
ccccaaaguuucac

SEQ ID NO: 566111 - RNA, 21 nt, Coxiella burnetii RSA 493
cccauuugccgccaggcuuca

SEQ ID NO: 566112 - RNA, 22 nt, Coxiella burnetii RSA 493
cccauuugccgccaggcuucau

SEQ ID NO: 566113 - RNA, 18 nt, Coxiella burnetii RSA 493
cccaugucguuauugcuc

SEQ ID NO: 566114 - RNA, 19 nt, Coxiella burnetii RSA 493
cccaugcgcaucgcgccau

SEQ ID NO: 566115 - RNA, 18 nt, Coxiella burnetii RSA 493
cccaucucgaaauuauuu

SEQ ID NO: 566116 - RNA, 19 nt, Coxiella burnetii RSA 493
cccucaucuccgcaggcgg

SEQ ID NO: 566117 - RNA, 22 nt, Coxiella burnetii RSA 493
cccucucgucggguauuuucau

SEQ ID NO: 566118 - RNA, 19 nt, Coxiella burnetii RSA 493
cccucuacaauaaacacau

SEQ ID NO: 566119 - RNA, 20 nt, Coxiella burnetii RSA 493
cccucuuuaccccgcucccu

SEQ ID NO: 566120 - RNA, 20 nt, Coxiella burnetii RSA 493
cccuaauaaaacaagauacc

SEQ ID NO: 566121 - RNA, 21 nt, Coxiella burnetii RSA 493
cccguuccaauauuuucggau

SEQ ID NO: 566122 - RNA, 16 nt, Coxiella burnetii RSA 493
cccguaucaccaaaau

SEQ ID NO: 566123 - RNA, 18 nt, Coxiella burnetii RSA 493
cccguauuucgcuucgcu

SEQ ID NO: 566124 - RNA, 14 nt, Coxiella burnetii RSA 493
aaacagcgaaaaca

SEQ ID NO: 566125 - RNA, 14 nt, Coxiella burnetii RSA 493
aaacagauuuaaau

SEQ ID NO: 566126 - RNA, 15 nt, Coxiella burnetii RSA 493
aaacagauuuaaaua

SEQ ID NO: 566127 - RNA, 14 nt, Coxiella burnetii RSA 493
cccuggugguuauu

SEQ ID NO: 566128 - RNA, 24 nt, Coxiella burnetii RSA 493
aaacauccgcucgucuugcacauu

SEQ ID NO: 566129 - RNA, 21 nt, Coxiella burnetii RSA 493
ccgaagcgcggccauaaccau

SEQ ID NO: 566130 - RNA, 16 nt, Coxiella burnetii RSA 493
aaaccacuauuugcuu

SEQ ID NO: 566131 - RNA, 22 nt, Coxiella burnetii RSA 493
ccgacauggcgguaaugagaac

SEQ ID NO: 566132 - RNA, 19 nt, Coxiella burnetii RSA 493
ccgagcccaauaacaagcu

SEQ ID NO: 566133 - RNA, 14 nt, Coxiella burnetii RSA 493
aaacccagaaaagu

SEQ ID NO: 566134 - RNA, 11 nt, Coxiella burnetii RSA 493
aaaccauucaa

SEQ ID NO: 566135 - RNA, 22 nt, Coxiella burnetii RSA 493
aaacccgagcggauggauuaaa

SEQ ID NO: 566136 - RNA, 20 nt, Coxiella burnetii RSA 493
aaacccgauggcauucuugc

SEQ ID NO: 566137 - RNA, 14 nt, Coxiella burnetii RSA 493
ccgccuacccuuuu

SEQ ID NO: 566138 - RNA, 13 nt, Coxiella burnetii RSA 493
aaaccaguuuuca

SEQ ID NO: 566139 - RNA, 13 nt, Coxiella burnetii RSA 493
ccgccaaaaggga

SEQ ID NO: 566140 - RNA, 20 nt, Coxiella burnetii RSA 493
ccgauuguuguggauaaagg

SEQ ID NO: 566141 - RNA, 12 nt, Coxiella burnetii RSA 493
ccuaaaucaauu

SEQ ID NO: 566142 - RNA, 20 nt, Coxiella burnetii RSA 493
ccuaauacaugacuuuaucu

SEQ ID NO: 566143 - RNA, 14 nt, Coxiella burnetii RSA 493
ccuaauaaaaauau

SEQ ID NO: 566144 - RNA, 15 nt, Coxiella burnetii RSA 493
ccuaaagaaagaaga

SEQ ID NO: 566145 - RNA, 17 nt, Coxiella burnetii RSA 493
ccuaaagaaagaagaag

SEQ ID NO: 566146 - RNA, 22 nt, Coxiella burnetii RSA 493
ccguuuugaaaaauaaaaggag

SEQ ID NO: 566147 - RNA, 22 nt, Coxiella burnetii RSA 493
ccguucggaaacaaagguucca

SEQ ID NO: 566148 - RNA, 20 nt, Coxiella burnetii RSA 493
ccguucaccccauuucaaca

SEQ ID NO: 566149 - RNA, 16 nt, Coxiella burnetii RSA 493
ccguuaugaaaacaua

SEQ ID NO: 566150 - RNA, 17 nt, Coxiella burnetii RSA 493
aaacgauauuaucaaaa

SEQ ID NO: 566151 - RNA, 12 nt, Coxiella burnetii RSA 493
aaacgauuaaaa

SEQ ID NO: 566152 - RNA, 21 nt, Coxiella burnetii RSA 493
aaacgacguggaauuauugaa

SEQ ID NO: 566153 - RNA, 17 nt, Coxiella burnetii RSA 493
aaacgacaagccccuuu

SEQ ID NO: 566154 - RNA, 24 nt, Coxiella burnetii RSA 493
aaacgacaagccccuuuaaugcau

SEQ ID NO: 566155 - RNA, 15 nt, Coxiella burnetii RSA 493
aaacgaaucuuuaca

SEQ ID NO: 566156 - RNA, 20 nt, Coxiella burnetii RSA 493
aaacgaauggcccaauaaag

SEQ ID NO: 566157 - RNA, 19 nt, Coxiella burnetii RSA 493
ccgucgcuuugcggccucg

SEQ ID NO: 566158 - RNA, 22 nt, Coxiella burnetii RSA 493
ccgucgcuuugcggccucgccu

SEQ ID NO: 566159 - RNA, 11 nt, Coxiella burnetii RSA 493
ccgguucuuuu

SEQ ID NO: 566160 - RNA, 12 nt, Coxiella burnetii RSA 493
ccuacuuuucua

SEQ ID NO: 566161 - RNA, 14 nt, Coxiella burnetii RSA 493
ccuacuuuuguuuu

SEQ ID NO: 566162 - RNA, 20 nt, Coxiella burnetii RSA 493
ccuacacuuuuaaucacauc

SEQ ID NO: 566163 - RNA, 21 nt, Coxiella burnetii RSA 493
ccuauugcggaauucaggacu

SEQ ID NO: 566164 - RNA, 13 nt, Coxiella burnetii RSA 493
ccucaauuucaau

SEQ ID NO: 566165 - RNA, 17 nt, Coxiella burnetii RSA 493
ccuauuuuugauuacuu

SEQ ID NO: 566166 - RNA, 15 nt, Coxiella burnetii RSA 493
ccucggaaguuagua

SEQ ID NO: 566167 - RNA, 12 nt, Coxiella burnetii RSA 493
ccgcuguuuaua

SEQ ID NO: 566168 - RNA, 12 nt, Coxiella burnetii RSA 493
ccggauuuuaau

SEQ ID NO: 566169 - RNA, 14 nt, Coxiella burnetii RSA 493
ccggcaaacccauc

SEQ ID NO: 566170 - RNA, 16 nt, Coxiella burnetii RSA 493
ccggaucgcauugaag

SEQ ID NO: 566171 - RNA, 15 nt, Coxiella burnetii RSA 493
ccggacgccaccaaa

SEQ ID NO: 566172 - RNA, 15 nt, Coxiella burnetii RSA 493
ccggcaaugcaccau

SEQ ID NO: 566173 - RNA, 22 nt, Coxiella burnetii RSA 493
aaaccgcgcugaaguccuuguu

SEQ ID NO: 566174 - RNA, 16 nt, Coxiella burnetii RSA 493
ccggcgucgucccaaa

SEQ ID NO: 566175 - RNA, 14 nt, Coxiella burnetii RSA 493
ccuggagaaggcau

SEQ ID NO: 566176 - RNA, 21 nt, Coxiella burnetii RSA 493
ccugcuucgcuucauccaaaa

SEQ ID NO: 566177 - RNA, 19 nt, Coxiella burnetii RSA 493
ccuguaaucuuuuggcaua

SEQ ID NO: 566178 - RNA, 17 nt, Coxiella burnetii RSA 493
ccuuaauaaaguuuuag

SEQ ID NO: 566179 - RNA, 13 nt, Coxiella burnetii RSA 493
ccuuaaucgugaa

SEQ ID NO: 566180 - RNA, 17 nt, Coxiella burnetii RSA 493
ccuuaauguuuuuucua

SEQ ID NO: 566181 - RNA, 12 nt, Coxiella burnetii RSA 493
ccuucacuuuuc

SEQ ID NO: 566182 - RNA, 13 nt, Coxiella burnetii RSA 493
ccuucuuuuucaa

SEQ ID NO: 566183 - RNA, 18 nt, Coxiella burnetii RSA 493
ccuucuuuuuuauguuug

SEQ ID NO: 566184 - RNA, 20 nt, Coxiella burnetii RSA 493
ccuucuuuuaaagugauuuu

SEQ ID NO: 566185 - RNA, 16 nt, Coxiella burnetii RSA 493
ccuucuugccgcccuu

SEQ ID NO: 566186 - RNA, 14 nt, Coxiella burnetii RSA 493
ccuucuucuuugga

SEQ ID NO: 566187 - RNA, 22 nt, Coxiella burnetii RSA 493
ccuucuguuuaagacgugaaau

SEQ ID NO: 566188 - RNA, 14 nt, Coxiella burnetii RSA 493
ccuugacgcucaga

SEQ ID NO: 566189 - RNA, 14 nt, Coxiella burnetii RSA 493
ccuugcucaagucc

SEQ ID NO: 566190 - RNA, 22 nt, Coxiella burnetii RSA 493
ccuuguugaauuccuuguugaa

SEQ ID NO: 566191 - RNA, 14 nt, Coxiella burnetii RSA 493
ccuugucacaagug

SEQ ID NO: 566192 - RNA, 13 nt, Coxiella burnetii RSA 493
ccuuguuuuaagc

SEQ ID NO: 566193 - RNA, 22 nt, Coxiella burnetii RSA 493
ccuuuaccuugggccacauaac

SEQ ID NO: 566194 - RNA, 18 nt, Coxiella burnetii RSA 493
ccuuuaucguugcugagc

SEQ ID NO: 566195 - RNA, 16 nt, Coxiella burnetii RSA 493
ccuuugcuaacaauug

SEQ ID NO: 566196 - RNA, 14 nt, Coxiella burnetii RSA 493
ccuuuggcaauaau

SEQ ID NO: 566197 - RNA, 13 nt, Coxiella burnetii RSA 493
ccuuucgcgcgcu

SEQ ID NO: 566198 - RNA, 17 nt, Coxiella burnetii RSA 493
ccuuucgcuuguuuaua

SEQ ID NO: 566199 - RNA, 23 nt, Coxiella burnetii RSA 493
ccuuuccgguucagcauaacuaa

SEQ ID NO: 566200 - RNA, 13 nt, Coxiella burnetii RSA 493
cgaccuucuuuuu

SEQ ID NO: 566201 - RNA, 14 nt, Coxiella burnetii RSA 493
cgaccuucuuuuuu

SEQ ID NO: 566202 - RNA, 14 nt, Coxiella burnetii RSA 493
cgacggguuuuaag

SEQ ID NO: 566203 - RNA, 10 nt, Coxiella burnetii RSA 493
cgaauaacaa

SEQ ID NO: 566204 - RNA, 20 nt, Coxiella burnetii RSA 493
cgaaucaccugcuccuuuuc

SEQ ID NO: 566205 - RNA, 22 nt, Coxiella burnetii RSA 493
cgaaucucguuucccgcuccag

SEQ ID NO: 566206 - RNA, 16 nt, Coxiella burnetii RSA 493
cgaaugguugaaagaa

SEQ ID NO: 566207 - RNA, 17 nt, Coxiella burnetii RSA 493
cgaaugguugaaagaaa

SEQ ID NO: 566208 - RNA, 19 nt, Coxiella burnetii RSA 493
cgaaugguugaaagaaaaa

SEQ ID NO: 566209 - RNA, 22 nt, Coxiella burnetii RSA 493
cgaauggccuuacuuaccguuu

SEQ ID NO: 566210 - RNA, 14 nt, Coxiella burnetii RSA 493
cgacaguauuucua

SEQ ID NO: 566211 - RNA, 20 nt, Coxiella burnetii RSA 493
cgaauuuuugccaauauaaa

SEQ ID NO: 566212 - RNA, 15 nt, Coxiella burnetii RSA 493
cgaauuguaaaaaga

SEQ ID NO: 566213 - RNA, 19 nt, Coxiella burnetii RSA 493
cgacaauaaaagcgccugc

SEQ ID NO: 566214 - RNA, 16 nt, Coxiella burnetii RSA 493
cgacaaucauuuuugu

SEQ ID NO: 566215 - RNA, 20 nt, Coxiella burnetii RSA 493
cgacaauucccccaaaaacu

SEQ ID NO: 566216 - RNA, 19 nt, Coxiella burnetii RSA 493
cgacacaaccacuguccuc

SEQ ID NO: 566217 - RNA, 16 nt, Coxiella burnetii RSA 493
cauacuuaauuucgcu

SEQ ID NO: 566218 - RNA, 14 nt, Coxiella burnetii RSA 493
cauagcaagaacau

SEQ ID NO: 566219 - RNA, 20 nt, Coxiella burnetii RSA 493
cauaggcgucaacuuaagag

SEQ ID NO: 566220 - RNA, 17 nt, Coxiella burnetii RSA 493
cauaguaauucaucauu

SEQ ID NO: 566221 - RNA, 22 nt, Coxiella burnetii RSA 493
cauaggagauuuuuaugaaaaa

SEQ ID NO: 566222 - RNA, 21 nt, Coxiella burnetii RSA 493
cauagcuggacucgaugggaa

SEQ ID NO: 566223 - RNA, 13 nt, Coxiella burnetii RSA 493
cauagcgaaaauu

SEQ ID NO: 566224 - RNA, 18 nt, Coxiella burnetii RSA 493
caucaagggcaaaaacau

SEQ ID NO: 566225 - RNA, 18 nt, Coxiella burnetii RSA 493
cauaucgggauaaguaaa

SEQ ID NO: 566226 - RNA, 16 nt, Coxiella burnetii RSA 493
cauaucgccauauaaa

SEQ ID NO: 566227 - RNA, 16 nt, Coxiella burnetii RSA 493
cauaucgcuccccuug

SEQ ID NO: 566228 - RNA, 16 nt, Coxiella burnetii RSA 493
cauauugcaauaauaa

SEQ ID NO: 566229 - RNA, 23 nt, Coxiella burnetii RSA 493
cauauugcaauaauaacgcuugc

SEQ ID NO: 566230 - RNA, 22 nt, Coxiella burnetii RSA 493
cauauauuuaccucuaaaaauu

SEQ ID NO: 566231 - RNA, 13 nt, Coxiella burnetii RSA 493
cauauauuccaca

SEQ ID NO: 566232 - RNA, 15 nt, Coxiella burnetii RSA 493
caucacaccaagaaa

SEQ ID NO: 566233 - RNA, 20 nt, Coxiella burnetii RSA 493
caucaauaccgauuaauucu

SEQ ID NO: 566234 - RNA, 12 nt, Coxiella burnetii RSA 493
caucauuuuugu

SEQ ID NO: 566235 - RNA, 12 nt, Coxiella burnetii RSA 493
caucauuucccg

SEQ ID NO: 566236 - RNA, 12 nt, Coxiella burnetii RSA 493
caucauuuucca

SEQ ID NO: 566237 - RNA, 14 nt, Coxiella burnetii RSA 493
cauccauucuuuca

SEQ ID NO: 566238 - RNA, 15 nt, Coxiella burnetii RSA 493
caucggccuuuuuca

SEQ ID NO: 566239 - RNA, 11 nt, Coxiella burnetii RSA 493
caugagaggau

SEQ ID NO: 566240 - RNA, 10 nt, Coxiella burnetii RSA 493
caugaggcca

SEQ ID NO: 566241 - RNA, 22 nt, Coxiella burnetii RSA 493
caugaggagucaucgccaaaag

SEQ ID NO: 566242 - RNA, 17 nt, Coxiella burnetii RSA 493
caugaagcaauugucua

SEQ ID NO: 566243 - RNA, 16 nt, Coxiella burnetii RSA 493
caugaauauuuuucuc

SEQ ID NO: 566244 - RNA, 16 nt, Coxiella burnetii RSA 493
caugacaugcgccacu

SEQ ID NO: 566245 - RNA, 17 nt, Coxiella burnetii RSA 493
caucuuuuucuccuuuu

SEQ ID NO: 566246 - RNA, 22 nt, Coxiella burnetii RSA 493
caucuuuuucuccuuuucccag

SEQ ID NO: 566247 - RNA, 12 nt, Coxiella burnetii RSA 493
caugaaaagcag

SEQ ID NO: 566248 - RNA, 14 nt, Coxiella burnetii RSA 493
caugaaauuuuugg

SEQ ID NO: 566249 - RNA, 18 nt, Coxiella burnetii RSA 493
caugaaaggaauccuuuu

SEQ ID NO: 566250 - RNA, 21 nt, Coxiella burnetii RSA 493
caugaaaggaauccuuuuucu

SEQ ID NO: 566251 - RNA, 22 nt, Coxiella burnetii RSA 493
caucuugaucuugggcaaaaaa

SEQ ID NO: 566252 - RNA, 16 nt, Coxiella burnetii RSA 493
caucuucuauucccuu

SEQ ID NO: 566253 - RNA, 23 nt, Coxiella burnetii RSA 493
caugauauccagguguuuuucaa

SEQ ID NO: 566254 - RNA, 12 nt, Coxiella burnetii RSA 493
caugaucgguuu

SEQ ID NO: 566255 - RNA, 16 nt, Coxiella burnetii RSA 493
caugcccauaaauaac

SEQ ID NO: 566256 - RNA, 17 nt, Coxiella burnetii RSA 493
caugcccauaaauaacu

SEQ ID NO: 566257 - RNA, 18 nt, Coxiella burnetii RSA 493
cauguagcccaacaaaau

SEQ ID NO: 566258 - RNA, 20 nt, Coxiella burnetii RSA 493
caugggaugucgcuuuauuc

SEQ ID NO: 566259 - RNA, 14 nt, Coxiella burnetii RSA 493
cauguuuacauuaa

SEQ ID NO: 566260 - RNA, 14 nt, Coxiella burnetii RSA 493
cauguuugcuggca

SEQ ID NO: 566261 - RNA, 15 nt, Coxiella burnetii RSA 493
caugucaauaaccca

SEQ ID NO: 566262 - RNA, 21 nt, Coxiella burnetii RSA 493
cauguauuccgccuuaaaaca

SEQ ID NO: 566263 - RNA, 18 nt, Coxiella burnetii RSA 493
cauuaagcaauuuuuuau

SEQ ID NO: 566264 - RNA, 18 nt, Coxiella burnetii RSA 493
cauuaaauccucuuuaga

SEQ ID NO: 566265 - RNA, 13 nt, Coxiella burnetii RSA 493
cauuaaaaacaau

SEQ ID NO: 566266 - RNA, 14 nt, Coxiella burnetii RSA 493
cauuccaaaaacag

SEQ ID NO: 566267 - RNA, 13 nt, Coxiella burnetii RSA 493
cauucauucuuuu

SEQ ID NO: 566268 - RNA, 14 nt, Coxiella burnetii RSA 493
cauucauucuuuuu

SEQ ID NO: 566269 - RNA, 14 nt, Coxiella burnetii RSA 493
cauucauuaacauu

SEQ ID NO: 566270 - RNA, 19 nt, Coxiella burnetii RSA 493
cauuaucucuuaaaauucc

SEQ ID NO: 566271 - RNA, 17 nt, Coxiella burnetii RSA 493
cauuaucauguucaucc

SEQ ID NO: 566272 - RNA, 19 nt, Coxiella burnetii RSA 493
cauuaucauguucauccaa

SEQ ID NO: 566273 - RNA, 20 nt, Coxiella burnetii RSA 493
cauuaucuagauuuuccugc

SEQ ID NO: 566274 - RNA, 15 nt, Coxiella burnetii RSA 493
cauuaaucuuccauu

SEQ ID NO: 566275 - RNA, 18 nt, Coxiella burnetii RSA 493
cauuaaugcggcauucaa

SEQ ID NO: 566276 - RNA, 17 nt, Coxiella burnetii RSA 493
cauuaauuucuuuuuuu

SEQ ID NO: 566277 - RNA, 14 nt, Coxiella burnetii RSA 493
cauucccgcgcagg

SEQ ID NO: 566278 - RNA, 14 nt, Coxiella burnetii RSA 493
cauucuauaaucau

SEQ ID NO: 566279 - RNA, 14 nt, Coxiella burnetii RSA 493
cauucccuuuuucg

SEQ ID NO: 566280 - RNA, 21 nt, Coxiella burnetii RSA 493
cauucuagguuauuuuuuccu

SEQ ID NO: 566281 - RNA, 19 nt, Coxiella burnetii RSA 493
cauuccccaccacucacag

SEQ ID NO: 566282 - RNA, 21 nt, Coxiella burnetii RSA 493
cauucccauagaagaacaauu

SEQ ID NO: 566283 - RNA, 14 nt, Coxiella burnetii RSA 493
cauucuucuaauga

SEQ ID NO: 566284 - RNA, 20 nt, Coxiella burnetii RSA 493
cauucuuauccuuacaaaaa

SEQ ID NO: 566285 - RNA, 18 nt, Coxiella burnetii RSA 493
cauugaaaaccuacuuuu

SEQ ID NO: 566286 - RNA, 21 nt, Coxiella burnetii RSA 493
cauugagaauaccccgcuguu

SEQ ID NO: 566287 - RNA, 23 nt, Coxiella burnetii RSA 493
cauugacaugaagguacugaaga

SEQ ID NO: 566288 - RNA, 23 nt, Coxiella burnetii RSA 493
cauuuucuccaaagggaccuuuu

SEQ ID NO: 566289 - RNA, 20 nt, Coxiella burnetii RSA 493
cauuuugauucucuauuucg

SEQ ID NO: 566290 - RNA, 19 nt, Coxiella burnetii RSA 493
cauuuugauuuuuuaauuc

SEQ ID NO: 566291 - RNA, 14 nt, Coxiella burnetii RSA 493
cauugauaauaauu

SEQ ID NO: 566292 - RNA, 17 nt, Coxiella burnetii RSA 493
cauuuuuaugcuucaau

SEQ ID NO: 566293 - RNA, 22 nt, Coxiella burnetii RSA 493
cauuuuuaaaagugacaaugcc

SEQ ID NO: 566294 - RNA, 18 nt, Coxiella burnetii RSA 493
cauuuuuuacagugugca

SEQ ID NO: 566295 - RNA, 14 nt, Coxiella burnetii RSA 493
cauuuuuuauaaaa

SEQ ID NO: 566296 - RNA, 11 nt, Coxiella burnetii RSA 493
cauuuuuucaa

SEQ ID NO: 566297 - RNA, 17 nt, Coxiella burnetii RSA 493
cauuuuuucaaauugcu

SEQ ID NO: 566298 - RNA, 14 nt, Coxiella burnetii RSA 493
ccaaaaaaaaaccu

SEQ ID NO: 566299 - RNA, 18 nt, Coxiella burnetii RSA 493
ccaaaaaacuuagccaau

SEQ ID NO: 566300 - RNA, 23 nt, Coxiella burnetii RSA 493
ccaaaagcaucgucaucguuuga

SEQ ID NO: 566301 - RNA, 19 nt, Coxiella burnetii RSA 493
ccaaaauacaguaaauaau

SEQ ID NO: 566302 - RNA, 22 nt, Coxiella burnetii RSA 493
ccaaaauacaguaaauaaucau

SEQ ID NO: 566303 - RNA, 19 nt, Coxiella burnetii RSA 493
ccaaaaauucguuaaaacc

SEQ ID NO: 566304 - RNA, 18 nt, Coxiella burnetii RSA 493
ccaaaaauuucauuuaau

SEQ ID NO: 566305 - RNA, 16 nt, Coxiella burnetii RSA 493
ccaaaaaguuuauaaa

SEQ ID NO: 566306 - RNA, 18 nt, Coxiella burnetii RSA 493
ccaaaaaguuuauaaaaa

SEQ ID NO: 566307 - RNA, 19 nt, Coxiella burnetii RSA 493
ccaaaaaguuuauaaaaau

SEQ ID NO: 566308 - RNA, 11 nt, Coxiella burnetii RSA 493
ccaaaccguuc

SEQ ID NO: 566309 - RNA, 18 nt, Coxiella burnetii RSA 493
ccaagcggaccacagauc

SEQ ID NO: 566310 - RNA, 20 nt, Coxiella burnetii RSA 493
ccaagcgggguuaaggaaaa

SEQ ID NO: 566311 - RNA, 15 nt, Coxiella burnetii RSA 493
ccaagcucaugaaaa

SEQ ID NO: 566312 - RNA, 18 nt, Coxiella burnetii RSA 493
ccaagcucaugaaaagca

SEQ ID NO: 566313 - RNA, 13 nt, Coxiella burnetii RSA 493
ccaacauucuuug

SEQ ID NO: 566314 - RNA, 23 nt, Coxiella burnetii RSA 493
ccaacccagcuauggaguucuug

SEQ ID NO: 566315 - RNA, 13 nt, Coxiella burnetii RSA 493
ccaacccaaggaa

SEQ ID NO: 566316 - RNA, 20 nt, Coxiella burnetii RSA 493
ccaaccauaauccuucuuuu

SEQ ID NO: 566317 - RNA, 12 nt, Coxiella burnetii RSA 493
ccaaagcaaaaa

SEQ ID NO: 566318 - RNA, 12 nt, Coxiella burnetii RSA 493
ccaaaguucauu

SEQ ID NO: 566319 - RNA, 22 nt, Coxiella burnetii RSA 493
ccaaaugcgacaaucauuuuug

SEQ ID NO: 566320 - RNA, 23 nt, Coxiella burnetii RSA 493
ccaaaugcgacaaucauuuuugu

SEQ ID NO: 566321 - RNA, 23 nt, Coxiella burnetii RSA 493
ccaaaugaucggcgcauuuuuau

SEQ ID NO: 566322 - RNA, 13 nt, Coxiella burnetii RSA 493
ccaauucaaauaa

SEQ ID NO: 566323 - RNA, 16 nt, Coxiella burnetii RSA 493
ccacaacuuucuucca

SEQ ID NO: 566324 - RNA, 21 nt, Coxiella burnetii RSA 493
ccaauaauugcugaacaaaag

SEQ ID NO: 566325 - RNA, 18 nt, Coxiella burnetii RSA 493
ccaauaacucggaacuga

SEQ ID NO: 566326 - RNA, 21 nt, Coxiella burnetii RSA 493
ccaauaagcuagaaaauaacc

SEQ ID NO: 566327 - RNA, 13 nt, Coxiella burnetii RSA 493
ccaauaauaaaac

SEQ ID NO: 566328 - RNA, 15 nt, Coxiella burnetii RSA 493
ccaauaauaaaaccc

SEQ ID NO: 566329 - RNA, 15 nt, Coxiella burnetii RSA 493
ccaauaaaacgccca

SEQ ID NO: 566330 - RNA, 20 nt, Coxiella burnetii RSA 493
ccaauuaaggucugggugau

SEQ ID NO: 566331 - RNA, 21 nt, Coxiella burnetii RSA 493
ccacauuucggacaacaaaua

SEQ ID NO: 566332 - RNA, 23 nt, Coxiella burnetii RSA 493
ccacaauuaaugcgccuacaaau

SEQ ID NO: 566333 - RNA, 10 nt, Coxiella burnetii RSA 493
ccacacuguc

SEQ ID NO: 566334 - RNA, 12 nt, Coxiella burnetii RSA 493
ccaccaaugguc

SEQ ID NO: 566335 - RNA, 18 nt, Coxiella burnetii RSA 493
ccaccuuugauuuugcug

SEQ ID NO: 566336 - RNA, 16 nt, Coxiella burnetii RSA 493
ccacuggguuuucccc

SEQ ID NO: 566337 - RNA, 14 nt, Coxiella burnetii RSA 493
ccacuggaaucaau

SEQ ID NO: 566338 - RNA, 23 nt, Coxiella burnetii RSA 493
ccacuucauacgggcuacucuaa

SEQ ID NO: 566339 - RNA, 15 nt, Coxiella burnetii RSA 493
ccagaaauucauuuu

SEQ ID NO: 566340 - RNA, 18 nt, Coxiella burnetii RSA 493
ccagaaauucauuuuuca

SEQ ID NO: 566341 - RNA, 19 nt, Coxiella burnetii RSA 493
ccagaaauucauuuuucag

SEQ ID NO: 566342 - RNA, 21 nt, Coxiella burnetii RSA 493
ccacuuucgauaaauuuugaa

SEQ ID NO: 566343 - RNA, 13 nt, Coxiella burnetii RSA 493
ccagaaacauaac

SEQ ID NO: 566344 - RNA, 12 nt, Coxiella burnetii RSA 493
ccagaaacaacu

SEQ ID NO: 566345 - RNA, 16 nt, Coxiella burnetii RSA 493
ccagagauuuuuuucu

SEQ ID NO: 566346 - RNA, 18 nt, Coxiella burnetii RSA 493
ccagacguacaaggaaug

SEQ ID NO: 566347 - RNA, 21 nt, Coxiella burnetii RSA 493
ccagaccuguuaaaaacgccu

SEQ ID NO: 566348 - RNA, 11 nt, Coxiella burnetii RSA 493
ccagcagugaa

SEQ ID NO: 566349 - RNA, 17 nt, Coxiella burnetii RSA 493
ccagccgaagcgcggcc

SEQ ID NO: 566350 - RNA, 11 nt, Coxiella burnetii RSA 493
aaaauuuaaac

SEQ ID NO: 566351 - RNA, 12 nt, Coxiella burnetii RSA 493
aaaauuguuuau

SEQ ID NO: 566352 - RNA, 15 nt, Coxiella burnetii RSA 493
aaaauuguaagcucu

SEQ ID NO: 566353 - RNA, 22 nt, Coxiella burnetii RSA 493
aaaauugauuagcaucuugaau

SEQ ID NO: 566354 - RNA, 14 nt, Coxiella burnetii RSA 493
cagcucaaacaaau

SEQ ID NO: 566355 - RNA, 17 nt, Coxiella burnetii RSA 493
cagcuuuccguaaaaca

SEQ ID NO: 566356 - RNA, 11 nt, Coxiella burnetii RSA 493
caggaacaacg

SEQ ID NO: 566357 - RNA, 16 nt, Coxiella burnetii RSA 493
cagcuuaaucaaccuc

SEQ ID NO: 566358 - RNA, 13 nt, Coxiella burnetii RSA 493
aaaauuuuauucu

SEQ ID NO: 566359 - RNA, 14 nt, Coxiella burnetii RSA 493
caggacuuaagccc

SEQ ID NO: 566360 - RNA, 16 nt, Coxiella burnetii RSA 493
caggauaauguuugau

SEQ ID NO: 566361 - RNA, 15 nt, Coxiella burnetii RSA 493
aaaauuuuaaaaaaa

SEQ ID NO: 566362 - RNA, 23 nt, Coxiella burnetii RSA 493
caggaucuugucgauaauaguua

SEQ ID NO: 566363 - RNA, 19 nt, Coxiella burnetii RSA 493
cagggcccacuuucacaau

SEQ ID NO: 566364 - RNA, 17 nt, Coxiella burnetii RSA 493
cagggcaguaaauagaa

SEQ ID NO: 566365 - RNA, 12 nt, Coxiella burnetii RSA 493
caggcuucauac

SEQ ID NO: 566366 - RNA, 12 nt, Coxiella burnetii RSA 493
cagggaaguugu

SEQ ID NO: 566367 - RNA, 18 nt, Coxiella burnetii RSA 493
aaacaacguaacugaugu

SEQ ID NO: 566368 - RNA, 22 nt, Coxiella burnetii RSA 493
aaacaacuaccugauaaaauaa

SEQ ID NO: 566369 - RNA, 14 nt, Coxiella burnetii RSA 493
aaacaaagugaaau

SEQ ID NO: 566370 - RNA, 20 nt, Coxiella burnetii RSA 493
cagguucggauuucacuuua

SEQ ID NO: 566371 - RNA, 20 nt, Coxiella burnetii RSA 493
caguaacucuaauuuuccug

SEQ ID NO: 566372 - RNA, 13 nt, Coxiella burnetii RSA 493
caguaaugagcau

SEQ ID NO: 566373 - RNA, 15 nt, Coxiella burnetii RSA 493
cagucucuuagcaua

SEQ ID NO: 566374 - RNA, 17 nt, Coxiella burnetii RSA 493
cagugacucaucuccuu

SEQ ID NO: 566375 - RNA, 16 nt, Coxiella burnetii RSA 493
cagugauaaagcguuu

SEQ ID NO: 566376 - RNA, 18 nt, Coxiella burnetii RSA 493
cagucucauuuuguauug

SEQ ID NO: 566377 - RNA, 20 nt, Coxiella burnetii RSA 493
cagucacucggccugggcaa

SEQ ID NO: 566378 - RNA, 12 nt, Coxiella burnetii RSA 493
cagucauuuucg

SEQ ID NO: 566379 - RNA, 20 nt, Coxiella burnetii RSA 493
cagucauuuucguccaauuc

SEQ ID NO: 566380 - RNA, 14 nt, Coxiella burnetii RSA 493
cagucauucauuuc

SEQ ID NO: 566381 - RNA, 14 nt, Coxiella burnetii RSA 493
caguaguacccagg

SEQ ID NO: 566382 - RNA, 17 nt, Coxiella burnetii RSA 493
cagcauaaaggcuaaua

SEQ ID NO: 566383 - RNA, 14 nt, Coxiella burnetii RSA 493
cagccugaucaagu

SEQ ID NO: 566384 - RNA, 21 nt, Coxiella burnetii RSA 493
cagccugaucaaguuucuccc

SEQ ID NO: 566385 - RNA, 19 nt, Coxiella burnetii RSA 493
cagccgcuuuuuauuggaa

SEQ ID NO: 566386 - RNA, 17 nt, Coxiella burnetii RSA 493
cagccuccaucccuccu

SEQ ID NO: 566387 - RNA, 14 nt, Coxiella burnetii RSA 493
cagcgaauaagauc

SEQ ID NO: 566388 - RNA, 22 nt, Coxiella burnetii RSA 493
cagcgaaauacgagguuuuuuu

SEQ ID NO: 566389 - RNA, 17 nt, Coxiella burnetii RSA 493
cagcccuaauaaaacaa

SEQ ID NO: 566390 - RNA, 23 nt, Coxiella burnetii RSA 493
cagccauauaaucgcaaaauuca

SEQ ID NO: 566391 - RNA, 21 nt, Coxiella burnetii RSA 493
cagccgccacucgaauuuguu

SEQ ID NO: 566392 - RNA, 18 nt, Coxiella burnetii RSA 493
cagccgaugacaaauaaa

SEQ ID NO: 566393 - RNA, 19 nt, Coxiella burnetii RSA 493
cagccgaugacaaauaaac

SEQ ID NO: 566394 - RNA, 18 nt, Coxiella burnetii RSA 493
cagcgcacuacgugcgcu

SEQ ID NO: 566395 - RNA, 15 nt, Coxiella burnetii RSA 493
cacuuucgauaaauu

SEQ ID NO: 566396 - RNA, 13 nt, Coxiella burnetii RSA 493
cagaacaccguug

SEQ ID NO: 566397 - RNA, 21 nt, Coxiella burnetii RSA 493
cagacaagucguuuauaucau

SEQ ID NO: 566398 - RNA, 14 nt, Coxiella burnetii RSA 493
cagaggacagagga

SEQ ID NO: 566399 - RNA, 17 nt, Coxiella burnetii RSA 493
cagaggacagaggacag

SEQ ID NO: 566400 - RNA, 13 nt, Coxiella burnetii RSA 493
cagagauaaauua

SEQ ID NO: 566401 - RNA, 19 nt, Coxiella burnetii RSA 493
cagacgcuaauugauuaau

SEQ ID NO: 566402 - RNA, 19 nt, Coxiella burnetii RSA 493
cagacgcuggaaaaauaaa

SEQ ID NO: 566403 - RNA, 22 nt, Coxiella burnetii RSA 493
aaaaugaccaugguuucuuuau

SEQ ID NO: 566404 - RNA, 16 nt, Coxiella burnetii RSA 493
aaaaugcucgcgaaau

SEQ ID NO: 566405 - RNA, 21 nt, Coxiella burnetii RSA 493
cagcaauucgaccuuugaaaa

SEQ ID NO: 566406 - RNA, 19 nt, Coxiella burnetii RSA 493
cagcaauggugauuucuuc

SEQ ID NO: 566407 - RNA, 21 nt, Coxiella burnetii RSA 493
cagcaauggugauuucuucca

SEQ ID NO: 566408 - RNA, 17 nt, Coxiella burnetii RSA 493
cagaugauuaaaagcaa

SEQ ID NO: 566409 - RNA, 17 nt, Coxiella burnetii RSA 493
aaaaucuuguuuaagcu

SEQ ID NO: 566410 - RNA, 18 nt, Coxiella burnetii RSA 493
uuuuuguaauccuuguug

SEQ ID NO: 566411 - RNA, 11 nt, Coxiella burnetii RSA 493
uuuuuuacuuu

SEQ ID NO: 566412 - RNA, 11 nt, Coxiella burnetii RSA 493
uuuuuuuguug

SEQ ID NO: 566413 - RNA, 12 nt, Coxiella burnetii RSA 493
uuuuuuuuaaaa

SEQ ID NO: 566414 - RNA, 13 nt, Coxiella burnetii RSA 493
uuuuuuuugaaau

SEQ ID NO: 566415 - RNA, 12 nt, Coxiella burnetii RSA 493
uuuuucuucuga

SEQ ID NO: 566416 - RNA, 16 nt, Coxiella burnetii RSA 493
uuuuugaaaguaguuu

SEQ ID NO: 566417 - RNA, 22 nt, Coxiella burnetii RSA 493
uuuuuggaaugagcauaacgaa

SEQ ID NO: 566418 - RNA, 22 nt, Coxiella burnetii RSA 493
uuuuuggcauaaauagcauuaa

SEQ ID NO: 566419 - RNA, 22 nt, Coxiella burnetii RSA 493
uuuuuggcaugauguucucucc

SEQ ID NO: 566420 - RNA, 16 nt, Coxiella burnetii RSA 493
uuuuugccagacuucu

SEQ ID NO: 566421 - RNA, 16 nt, Coxiella burnetii RSA 493
uuuugauuaaccacuc

SEQ ID NO: 566422 - RNA, 12 nt, Coxiella burnetii RSA 493
uuuuucucuucu

SEQ ID NO: 566423 - RNA, 14 nt, Coxiella burnetii RSA 493
uuuuucuccuuuuc

SEQ ID NO: 566424 - RNA, 18 nt, Coxiella burnetii RSA 493
uuuuucuccuuuucccag

SEQ ID NO: 566425 - RNA, 24 nt, Coxiella burnetii RSA 493
uuuuucggggcggcuuuuuucgcu

SEQ ID NO: 566426 - RNA, 11 nt, Coxiella burnetii RSA 493
uuuuaaguaac

SEQ ID NO: 566427 - RNA, 13 nt, Coxiella burnetii RSA 493
uuuuaaguuuuca

SEQ ID NO: 566428 - RNA, 13 nt, Coxiella burnetii RSA 493
uuuuaacuucucu

SEQ ID NO: 566429 - RNA, 14 nt, Coxiella burnetii RSA 493
uuuuaaauuucuca

SEQ ID NO: 566430 - RNA, 13 nt, Coxiella burnetii RSA 493
uuuuaaauuaucu

SEQ ID NO: 566431 - RNA, 17 nt, Coxiella burnetii RSA 493
uuuuaaauaacuuuacu

SEQ ID NO: 566432 - RNA, 16 nt, Coxiella burnetii RSA 493
uuuuaaaaaaaucgcu

SEQ ID NO: 566433 - RNA, 12 nt, Coxiella burnetii RSA 493
uuuuaaaaauaa

SEQ ID NO: 566434 - RNA, 13 nt, Coxiella burnetii RSA 493
uuuuaaaagauuu

SEQ ID NO: 566435 - RNA, 13 nt, Coxiella burnetii RSA 493
uuugugauuuuaa

SEQ ID NO: 566436 - RNA, 21 nt, Coxiella burnetii RSA 493
uuugugcauaaauuauuuuaa

SEQ ID NO: 566437 - RNA, 13 nt, Coxiella burnetii RSA 493
uuuguugaacaga

SEQ ID NO: 566438 - RNA, 22 nt, Coxiella burnetii RSA 493
uuuguucgagaaggccacauuu

SEQ ID NO: 566439 - RNA, 17 nt, Coxiella burnetii RSA 493
uuuguucgguuaaagca

SEQ ID NO: 566440 - RNA, 19 nt, Coxiella burnetii RSA 493
uuuguuuugaucagagaaa

SEQ ID NO: 566441 - RNA, 19 nt, Coxiella burnetii RSA 493
uuugcuggagaucacugga

SEQ ID NO: 566442 - RNA, 17 nt, Coxiella burnetii RSA 493
uuugcugaccuuuuccu

SEQ ID NO: 566443 - RNA, 18 nt, Coxiella burnetii RSA 493
uuugcucuaauucugauu

SEQ ID NO: 566444 - RNA, 21 nt, Coxiella burnetii RSA 493
uuugcuagaucguuuuuugau

SEQ ID NO: 566445 - RNA, 19 nt, Coxiella burnetii RSA 493
uuugcuaagauaauuacaa

SEQ ID NO: 566446 - RNA, 19 nt, Coxiella burnetii RSA 493
uuugcgcuugcguaaaguu

SEQ ID NO: 566447 - RNA, 14 nt, Coxiella burnetii RSA 493
uuugcggaauuuga

SEQ ID NO: 566448 - RNA, 16 nt, Coxiella burnetii RSA 493
uuugcuuuguucaucc

SEQ ID NO: 566449 - RNA, 18 nt, Coxiella burnetii RSA 493
uuugcuugaguaaccucu

SEQ ID NO: 566450 - RNA, 16 nt, Coxiella burnetii RSA 493
uuuggcagaauuugua

SEQ ID NO: 566451 - RNA, 23 nt, Coxiella burnetii RSA 493
uuuguagauuagaaaaagcgauu

SEQ ID NO: 566452 - RNA, 15 nt, Coxiella burnetii RSA 493
uuuguauaguucuaa

SEQ ID NO: 566453 - RNA, 23 nt, Coxiella burnetii RSA 493
uuuguauugaggucguuaaaaaa

SEQ ID NO: 566454 - RNA, 12 nt, Coxiella burnetii RSA 493
uuugucaauggg

SEQ ID NO: 566455 - RNA, 23 nt, Coxiella burnetii RSA 493
uuuugauaggauuauuaucaaag

SEQ ID NO: 566456 - RNA, 22 nt, Coxiella burnetii RSA 493
uuuugauaggguucgcaccuaa

SEQ ID NO: 566457 - RNA, 19 nt, Coxiella burnetii RSA 493
uuuugaaaaauaaaaggag

SEQ ID NO: 566458 - RNA, 15 nt, Coxiella burnetii RSA 493
uuuugaauaucaugg

SEQ ID NO: 566459 - RNA, 15 nt, Coxiella burnetii RSA 493
uuuucccucuacaaa

SEQ ID NO: 566460 - RNA, 16 nt, Coxiella burnetii RSA 493
uuuucguaaaccuuua

SEQ ID NO: 566461 - RNA, 23 nt, Coxiella burnetii RSA 493
uuuuccccccaucccgaucaaaa

SEQ ID NO: 566462 - RNA, 16 nt, Coxiella burnetii RSA 493
uuuuccaugaggccaa

SEQ ID NO: 566463 - RNA, 21 nt, Coxiella burnetii RSA 493
uuuuccaugaggccaaaaauu

SEQ ID NO: 566464 - RNA, 14 nt, Coxiella burnetii RSA 493
uuuucguuguuugg

SEQ ID NO: 566465 - RNA, 18 nt, Coxiella burnetii RSA 493
uuuucguuuaacaaugaa

SEQ ID NO: 566466 - RNA, 22 nt, Coxiella burnetii RSA 493
uuuucaaggccgugaauucgga

SEQ ID NO: 566467 - RNA, 14 nt, Coxiella burnetii RSA 493
uuuucaaugccauu

SEQ ID NO: 566468 - RNA, 22 nt, Coxiella burnetii RSA 493
uuuucaaaacaaucaaugcagu

SEQ ID NO: 566469 - RNA, 13 nt, Coxiella burnetii RSA 493
uuuucauuuuuuc

SEQ ID NO: 566470 - RNA, 22 nt, Coxiella burnetii RSA 493
uuuuauuguuaaucgucauucc

SEQ ID NO: 566471 - RNA, 13 nt, Coxiella burnetii RSA 493
uuuuauuuaaaaa

SEQ ID NO: 566472 - RNA, 19 nt, Coxiella burnetii RSA 493
uuuuauuccuuuuuuuaau

SEQ ID NO: 566473 - RNA, 12 nt, Coxiella burnetii RSA 493
uuuuauuuccag

SEQ ID NO: 566474 - RNA, 13 nt, Coxiella burnetii RSA 493
uuuuauuaucauc

SEQ ID NO: 566475 - RNA, 20 nt, Coxiella burnetii RSA 493
uuuuaugcuucaauaaaaaa

SEQ ID NO: 566476 - RNA, 21 nt, Coxiella burnetii RSA 493
uuuuagcacagcgaaauacga

SEQ ID NO: 566477 - RNA, 13 nt, Coxiella burnetii RSA 493
uuuuacuuuuuca

SEQ ID NO: 566478 - RNA, 21 nt, Coxiella burnetii RSA 493
uuuuacugccuacaaauagag

SEQ ID NO: 566479 - RNA, 13 nt, Coxiella burnetii RSA 493
uuuuacguuuaaa

SEQ ID NO: 566480 - RNA, 16 nt, Coxiella burnetii RSA 493
uuuuacgcuauuuuuu

SEQ ID NO: 566481 - RNA, 20 nt, Coxiella burnetii RSA 493
uuuuacgcuauuuuuuaaau

SEQ ID NO: 566482 - RNA, 22 nt, Coxiella burnetii RSA 493
uuuuacgacccccaauuuaauu

SEQ ID NO: 566483 - RNA, 12 nt, Coxiella burnetii RSA 493
uuuuaauuuuuu

SEQ ID NO: 566484 - RNA, 14 nt, Coxiella burnetii RSA 493
uuuuaauugaauuu

SEQ ID NO: 566485 - RNA, 20 nt, Coxiella burnetii RSA 493
uuuuaauuaagcuugaaaaa

SEQ ID NO: 566486 - RNA, 23 nt, Coxiella burnetii RSA 493
uuuuaaucacaucccuuuucauu

SEQ ID NO: 566487 - RNA, 12 nt, Coxiella burnetii RSA 493
uuuuaauauuug

SEQ ID NO: 566488 - RNA, 14 nt, Coxiella burnetii RSA 493
uuuuaauauuuuuu

SEQ ID NO: 566489 - RNA, 15 nt, Coxiella burnetii RSA 493
uuuuacccguuuaaa

SEQ ID NO: 566490 - RNA, 16 nt, Coxiella burnetii RSA 493
uuuuacccguuuaaau

SEQ ID NO: 566491 - RNA, 17 nt, Coxiella burnetii RSA 493
uuuuacccguuuaaauu

SEQ ID NO: 566492 - RNA, 14 nt, Coxiella burnetii RSA 493
uuuuacaauaaucc

SEQ ID NO: 566493 - RNA, 13 nt, Coxiella burnetii RSA 493
uuuuaauuuuuuc

SEQ ID NO: 566494 - RNA, 14 nt, Coxiella burnetii RSA 493
uuuuaauuuuuuca

SEQ ID NO: 566495 - RNA, 13 nt, Coxiella burnetii RSA 493
uuuuaucaggcag

SEQ ID NO: 566496 - RNA, 21 nt, Coxiella burnetii RSA 493
uuuuaucauacuuaauuucgc

SEQ ID NO: 566497 - RNA, 19 nt, Coxiella burnetii RSA 493
uuuuaucuuauuauucaua

SEQ ID NO: 566498 - RNA, 17 nt, Coxiella burnetii RSA 493
uuuuaugaaaaaaauca

SEQ ID NO: 566499 - RNA, 21 nt, Coxiella burnetii RSA 493
uuuuaugaaagaguauuuuuu

SEQ ID NO: 566500 - RNA, 23 nt, Coxiella burnetii RSA 493
uuuuaugcgcuuuccauuuuuua

SEQ ID NO: 566501 - RNA, 13 nt, Coxiella burnetii RSA 493
uuuuauaaacgcc

SEQ ID NO: 566502 - RNA, 23 nt, Coxiella burnetii RSA 493
uuuuagggcugaaaaaauuaaau

SEQ ID NO: 566503 - RNA, 16 nt, Coxiella burnetii RSA 493
uuucugccgcugauau

SEQ ID NO: 566504 - RNA, 19 nt, Coxiella burnetii RSA 493
uuucugccgcugauauucc

SEQ ID NO: 566505 - RNA, 19 nt, Coxiella burnetii RSA 493
uuucugagcuuguuuuugg

SEQ ID NO: 566506 - RNA, 15 nt, Coxiella burnetii RSA 493
uuucugaaaauucug

SEQ ID NO: 566507 - RNA, 15 nt, Coxiella burnetii RSA 493
uuucucuucaacgcc

SEQ ID NO: 566508 - RNA, 16 nt, Coxiella burnetii RSA 493
uuucucgauauucuau

SEQ ID NO: 566509 - RNA, 14 nt, Coxiella burnetii RSA 493
uuucucaucauuuu

SEQ ID NO: 566510 - RNA, 13 nt, Coxiella burnetii RSA 493
uuucucaauuucu

SEQ ID NO: 566511 - RNA, 16 nt, Coxiella burnetii RSA 493
uuucucaauuucucgu

SEQ ID NO: 566512 - RNA, 16 nt, Coxiella burnetii RSA 493
uuucucaauagaaaaa

SEQ ID NO: 566513 - RNA, 17 nt, Coxiella burnetii RSA 493
uuucucaauagaaaaaa

SEQ ID NO: 566514 - RNA, 15 nt, Coxiella burnetii RSA 493
uuucuauauuuucuu

SEQ ID NO: 566515 - RNA, 15 nt, Coxiella burnetii RSA 493
uuucgucuguuucuu

SEQ ID NO: 566516 - RNA, 17 nt, Coxiella burnetii RSA 493
uuucgucuguuucuugg

SEQ ID NO: 566517 - RNA, 14 nt, Coxiella burnetii RSA 493
uuucgcuuuuauuu

SEQ ID NO: 566518 - RNA, 13 nt, Coxiella burnetii RSA 493
uuucgggguuaug

SEQ ID NO: 566519 - RNA, 15 nt, Coxiella burnetii RSA 493
uuucggacaacaaau

SEQ ID NO: 566520 - RNA, 22 nt, Coxiella burnetii RSA 493
uuucuaaauaaugaauauucug

SEQ ID NO: 566521 - RNA, 23 nt, Coxiella burnetii RSA 493
uuucuaauucguugcauucaaua

SEQ ID NO: 566522 - RNA, 21 nt, Coxiella burnetii RSA 493
uuucuagagcaacgauuuucc

SEQ ID NO: 566523 - RNA, 14 nt, Coxiella burnetii RSA 493
uuuccuuucuuucu

SEQ ID NO: 566524 - RNA, 15 nt, Coxiella burnetii RSA 493
uuuccuuucuuucuu

SEQ ID NO: 566525 - RNA, 12 nt, Coxiella burnetii RSA 493
uuuccuguuuuu

SEQ ID NO: 566526 - RNA, 15 nt, Coxiella burnetii RSA 493
uuucgagaauauauu

SEQ ID NO: 566527 - RNA, 14 nt, Coxiella burnetii RSA 493
uuucgauaaauuuu

SEQ ID NO: 566528 - RNA, 13 nt, Coxiella burnetii RSA 493
uuuccugaacagg

SEQ ID NO: 566529 - RNA, 17 nt, Coxiella burnetii RSA 493
uuuccuagauuuuggcu

SEQ ID NO: 566530 - RNA, 20 nt, Coxiella burnetii RSA 493
uuuccugucguuaauacgau

SEQ ID NO: 566531 - RNA, 18 nt, Coxiella burnetii RSA 493
uuuccguaaaacaaugca

SEQ ID NO: 566532 - RNA, 13 nt, Coxiella burnetii RSA 493
uuucccucucagu

SEQ ID NO: 566533 - RNA, 16 nt, Coxiella burnetii RSA 493
uuuccgaguauuuauu

SEQ ID NO: 566534 - RNA, 14 nt, Coxiella burnetii RSA 493
uuuccccuucuucg

SEQ ID NO: 566535 - RNA, 15 nt, Coxiella burnetii RSA 493
uuuccccuucuucgg

SEQ ID NO: 566536 - RNA, 21 nt, Coxiella burnetii RSA 493
uuucccgacuguucaucugug

SEQ ID NO: 566537 - RNA, 19 nt, Coxiella burnetii RSA 493
uuuccauguuuacauuaag

SEQ ID NO: 566538 - RNA, 20 nt, Coxiella burnetii RSA 493
uuuccagccuuuaguuuuau

SEQ ID NO: 566539 - RNA, 13 nt, Coxiella burnetii RSA 493
uuuccacucgucu

SEQ ID NO: 566540 - RNA, 14 nt, Coxiella burnetii RSA 493
uuucuuuucuaaau

SEQ ID NO: 566541 - RNA, 23 nt, Coxiella burnetii RSA 493
uuucuuuuuguguugauccuuga

SEQ ID NO: 566542 - RNA, 22 nt, Coxiella burnetii RSA 493
uuugaaaaauaaaaggagaaau

SEQ ID NO: 566543 - RNA, 14 nt, Coxiella burnetii RSA 493
uuucuuuccaucac

SEQ ID NO: 566544 - RNA, 13 nt, Coxiella burnetii RSA 493
uuucuuucuucac

SEQ ID NO: 566545 - RNA, 14 nt, Coxiella burnetii RSA 493
uuucuuucuuuucu

SEQ ID NO: 566546 - RNA, 13 nt, Coxiella burnetii RSA 493
uuugaaauaaacu

SEQ ID NO: 566547 - RNA, 23 nt, Coxiella burnetii RSA 493
uuugaaccaugagugccacaaag

SEQ ID NO: 566548 - RNA, 20 nt, Coxiella burnetii RSA 493
uuugaaggaauaaaaccuuc

SEQ ID NO: 566549 - RNA, 14 nt, Coxiella burnetii RSA 493
uuugacaagcuucu

SEQ ID NO: 566550 - RNA, 13 nt, Coxiella burnetii RSA 493
uuugaagcgauug

SEQ ID NO: 566551 - RNA, 23 nt, Coxiella burnetii RSA 493
uuucugugguuaauucuucuuca

SEQ ID NO: 566552 - RNA, 17 nt, Coxiella burnetii RSA 493
uuucugguuuccuuucu

SEQ ID NO: 566553 - RNA, 23 nt, Coxiella burnetii RSA 493
uuucugggagauuuauuccugug

SEQ ID NO: 566554 - RNA, 20 nt, Coxiella burnetii RSA 493
uuucugggccaaauaaaaaa

SEQ ID NO: 566555 - RNA, 18 nt, Coxiella burnetii RSA 493
uuucuucacuuuccuuau

SEQ ID NO: 566556 - RNA, 19 nt, Coxiella burnetii RSA 493
uuucuucacggauaauauc

SEQ ID NO: 566557 - RNA, 16 nt, Coxiella burnetii RSA 493
uuucuugaaaaacuuc

SEQ ID NO: 566558 - RNA, 12 nt, Coxiella burnetii RSA 493
uuucuucauuug

SEQ ID NO: 566559 - RNA, 14 nt, Coxiella burnetii RSA 493
uuucuuucaauaaa

SEQ ID NO: 566560 - RNA, 17 nt, Coxiella burnetii RSA 493
uuucuuggcguguuaaa

SEQ ID NO: 566561 - RNA, 19 nt, Coxiella burnetii RSA 493
uuugauaggguucgcaccu

SEQ ID NO: 566562 - RNA, 19 nt, Coxiella burnetii RSA 493
uuugauaaaacuugauuau

SEQ ID NO: 566563 - RNA, 21 nt, Coxiella burnetii RSA 493
uuugagugguugaaaacgaua

SEQ ID NO: 566564 - RNA, 16 nt, Coxiella burnetii RSA 493
uuugaguaagaaaugc

SEQ ID NO: 566565 - RNA, 17 nt, Coxiella burnetii RSA 493
uuugauuuguucuaaau

SEQ ID NO: 566566 - RNA, 15 nt, Coxiella burnetii RSA 493
uuugauuuugcugaa

SEQ ID NO: 566567 - RNA, 13 nt, Coxiella burnetii RSA 493
uuugcaaaacuaa

SEQ ID NO: 566568 - RNA, 19 nt, Coxiella burnetii RSA 493
uuugaugugaaaaauucua

SEQ ID NO: 566569 - RNA, 14 nt, Coxiella burnetii RSA 493
uuugaucauuuccu

SEQ ID NO: 566570 - RNA, 19 nt, Coxiella burnetii RSA 493
uuugcauuaaucuuccauu

SEQ ID NO: 566571 - RNA, 17 nt, Coxiella burnetii RSA 493
uuugcaucggucgaaau

SEQ ID NO: 566572 - RNA, 16 nt, Coxiella burnetii RSA 493
uuugcaaaugaauaac

SEQ ID NO: 566573 - RNA, 18 nt, Coxiella burnetii RSA 493
uuugcaaaugaauaacau

SEQ ID NO: 566574 - RNA, 15 nt, Coxiella burnetii RSA 493
uuugcaacuuccgcu

SEQ ID NO: 566575 - RNA, 16 nt, Coxiella burnetii RSA 493
uuugcagaugcuccau

SEQ ID NO: 566576 - RNA, 10 nt, Coxiella burnetii RSA 493
uuugcacaua

SEQ ID NO: 566577 - RNA, 17 nt, Coxiella burnetii RSA 493
uuugcgcaaaauuagga

SEQ ID NO: 566578 - RNA, 23 nt, Coxiella burnetii RSA 493
uuugcgcccgccaggcuaugauu

SEQ ID NO: 566579 - RNA, 22 nt, Coxiella burnetii RSA 493
uuugccacuauauacuccccua

SEQ ID NO: 566580 - RNA, 18 nt, Coxiella burnetii RSA 493
uuucaauguauccgggcc

SEQ ID NO: 566581 - RNA, 17 nt, Coxiella burnetii RSA 493
uuucaauggauucuucu

SEQ ID NO: 566582 - RNA, 19 nt, Coxiella burnetii RSA 493
uuucacuguugagcaaagc

SEQ ID NO: 566583 - RNA, 14 nt, Coxiella burnetii RSA 493
uuucacuaauuaua

SEQ ID NO: 566584 - RNA, 17 nt, Coxiella burnetii RSA 493
uuucacgaauuaaaaaa

SEQ ID NO: 566585 - RNA, 18 nt, Coxiella burnetii RSA 493
uuucacgaauuaaaaaau

SEQ ID NO: 566586 - RNA, 17 nt, Coxiella burnetii RSA 493
uuucacgauuuuucuca

SEQ ID NO: 566587 - RNA, 18 nt, Coxiella burnetii RSA 493
uuucacgauuuuucucau

SEQ ID NO: 566588 - RNA, 17 nt, Coxiella burnetii RSA 493
uuucaaugccauuuuua

SEQ ID NO: 566589 - RNA, 19 nt, Coxiella burnetii RSA 493
uuucaacgccucucucaua

SEQ ID NO: 566590 - RNA, 16 nt, Coxiella burnetii RSA 493
uuucaacauauuucuu

SEQ ID NO: 566591 - RNA, 17 nt, Coxiella burnetii RSA 493
uuuauuuucaaaugaau

SEQ ID NO: 566592 - RNA, 22 nt, Coxiella burnetii RSA 493
uuuauuugaaauagccauuaau

SEQ ID NO: 566593 - RNA, 21 nt, Coxiella burnetii RSA 493
uuucaaagauaucguccagcu

SEQ ID NO: 566594 - RNA, 14 nt, Coxiella burnetii RSA 493
uuucaaaugaauaa

SEQ ID NO: 566595 - RNA, 18 nt, Coxiella burnetii RSA 493
uuucaaaugaccaaauaa

SEQ ID NO: 566596 - RNA, 20 nt, Coxiella burnetii RSA 493
uuucaaaugaccaaauaauu

SEQ ID NO: 566597 - RNA, 21 nt, Coxiella burnetii RSA 493
uuucaaacacuuguuugccca

SEQ ID NO: 566598 - RNA, 20 nt, Coxiella burnetii RSA 493
uuuauucucccaaacaauca

SEQ ID NO: 566599 - RNA, 20 nt, Coxiella burnetii RSA 493
uuucaggcgccugcaaaauc

SEQ ID NO: 566600 - RNA, 22 nt, Coxiella burnetii RSA 493
uuucauaaguccgcuuuucccu

SEQ ID NO: 566601 - RNA, 23 nt, Coxiella burnetii RSA 493
uuucauagguuuuuuuaaacguu

SEQ ID NO: 566602 - RNA, 14 nt, Coxiella burnetii RSA 493
uuucagauuuuuua

SEQ ID NO: 566603 - RNA, 18 nt, Coxiella burnetii RSA 493
uuuccaacccagcuaugg

SEQ ID NO: 566604 - RNA, 16 nt, Coxiella burnetii RSA 493
uuuccaauuguuugaa

SEQ ID NO: 566605 - RNA, 23 nt, Coxiella burnetii RSA 493
uuucauuuuuuccucuuaaggac

SEQ ID NO: 566606 - RNA, 19 nt, Coxiella burnetii RSA 493
uuucauuuugauucucuau

SEQ ID NO: 566607 - RNA, 12 nt, Coxiella burnetii RSA 493
uuucauucucuu

SEQ ID NO: 566608 - RNA, 17 nt, Coxiella burnetii RSA 493
uuucauuacuuggccga

SEQ ID NO: 566609 - RNA, 14 nt, Coxiella burnetii RSA 493
uuucaucuugcugc

SEQ ID NO: 566610 - RNA, 13 nt, Coxiella burnetii RSA 493
uuucaucuuguaa

SEQ ID NO: 566611 - RNA, 17 nt, Coxiella burnetii RSA 493
uuucaugaaguuccauu

SEQ ID NO: 566612 - RNA, 19 nt, Coxiella burnetii RSA 493
uuucauguaauuuauccca

SEQ ID NO: 566613 - RNA, 16 nt, Coxiella burnetii RSA 493
uuucauuaagcaauuu

SEQ ID NO: 566614 - RNA, 19 nt, Coxiella burnetii RSA 493
uuucauuaagcaauuuuuu

SEQ ID NO: 566615 - RNA, 20 nt, Coxiella burnetii RSA 493
uuucauuaagcaauuuuuua

SEQ ID NO: 566616 - RNA, 14 nt, Coxiella burnetii RSA 493
uuucauccaaaaua

SEQ ID NO: 566617 - RNA, 21 nt, Coxiella burnetii RSA 493
uuuagaaagcggaauaagaaa

SEQ ID NO: 566618 - RNA, 12 nt, Coxiella burnetii RSA 493
uuuagaaucuca

SEQ ID NO: 566619 - RNA, 13 nt, Coxiella burnetii RSA 493
uuuagccuuuacc

SEQ ID NO: 566620 - RNA, 13 nt, Coxiella burnetii RSA 493
uuuagucggaaau

SEQ ID NO: 566621 - RNA, 21 nt, Coxiella burnetii RSA 493
uuuaggcgaagcgacuaaauu

SEQ ID NO: 566622 - RNA, 21 nt, Coxiella burnetii RSA 493
uuuacgacccccaauuuaauu

SEQ ID NO: 566623 - RNA, 21 nt, Coxiella burnetii RSA 493
uuuacauagccucuauaaaua

SEQ ID NO: 566624 - RNA, 16 nt, Coxiella burnetii RSA 493
uuuacuaaaaaacgau

SEQ ID NO: 566625 - RNA, 15 nt, Coxiella burnetii RSA 493
uuuacugagaaaacu

SEQ ID NO: 566626 - RNA, 21 nt, Coxiella burnetii RSA 493
uuuacuaggucugauaggaau

SEQ ID NO: 566627 - RNA, 15 nt, Coxiella burnetii RSA 493
uuuaucaaacguuua

SEQ ID NO: 566628 - RNA, 18 nt, Coxiella burnetii RSA 493
uuuaucacuccaauaaua

SEQ ID NO: 566629 - RNA, 21 nt, Coxiella burnetii RSA 493
uuuaucacuccaauaauaaaa

SEQ ID NO: 566630 - RNA, 14 nt, Coxiella burnetii RSA 493
uuuauauuccugaa

SEQ ID NO: 566631 - RNA, 20 nt, Coxiella burnetii RSA 493
uuuauauguguaacaaaaac

SEQ ID NO: 566632 - RNA, 13 nt, Coxiella burnetii RSA 493
uuuauaaaauuua

SEQ ID NO: 566633 - RNA, 13 nt, Coxiella burnetii RSA 493
uuuauagcuugcu

SEQ ID NO: 566634 - RNA, 17 nt, Coxiella burnetii RSA 493
uuuauacccaaaaaccc

SEQ ID NO: 566635 - RNA, 17 nt, Coxiella burnetii RSA 493
uuuauaccuuuuuccca

SEQ ID NO: 566636 - RNA, 14 nt, Coxiella burnetii RSA 493
uuuauuaaaaacua

SEQ ID NO: 566637 - RNA, 21 nt, Coxiella burnetii RSA 493
uugcaugaggagucaucgcca

SEQ ID NO: 566638 - RNA, 15 nt, Coxiella burnetii RSA 493
uugcagcauccccca

SEQ ID NO: 566639 - RNA, 18 nt, Coxiella burnetii RSA 493
uugcagcaucccccaaga

SEQ ID NO: 566640 - RNA, 16 nt, Coxiella burnetii RSA 493
uugcauuguuuucuua

SEQ ID NO: 566641 - RNA, 18 nt, Coxiella burnetii RSA 493
uugccacacauaaaugcu

SEQ ID NO: 566642 - RNA, 16 nt, Coxiella burnetii RSA 493
uugcauuuuuaaaagu

SEQ ID NO: 566643 - RNA, 17 nt, Coxiella burnetii RSA 493
uugccggacuuuuucaa

SEQ ID NO: 566644 - RNA, 17 nt, Coxiella burnetii RSA 493
uugccgcccuugcugca

SEQ ID NO: 566645 - RNA, 16 nt, Coxiella burnetii RSA 493
uugcgcguaaaauucc

SEQ ID NO: 566646 - RNA, 22 nt, Coxiella burnetii RSA 493
uugcguauuuguucguaauaau

SEQ ID NO: 566647 - RNA, 18 nt, Coxiella burnetii RSA 493
uugcguaaugcaaugaau

SEQ ID NO: 566648 - RNA, 19 nt, Coxiella burnetii RSA 493
uugcgcucauuuucacuau

SEQ ID NO: 566649 - RNA, 16 nt, Coxiella burnetii RSA 493
uugcucaaguccuugc

SEQ ID NO: 566650 - RNA, 12 nt, Coxiella burnetii RSA 493
uugcuuuaacuc

SEQ ID NO: 566651 - RNA, 22 nt, Coxiella burnetii RSA 493
uugcuuaauacgagugcgcccg

SEQ ID NO: 566652 - RNA, 22 nt, Coxiella burnetii RSA 493
uugcuuaccgaggucuuuuauu

SEQ ID NO: 566653 - RNA, 23 nt, Coxiella burnetii RSA 493
uugcuuaccgaggucuuuuauuu

SEQ ID NO: 566654 - RNA, 18 nt, Coxiella burnetii RSA 493
uugcugcauauauuccac

SEQ ID NO: 566655 - RNA, 16 nt, Coxiella burnetii RSA 493
uugcuuuguucaucca

SEQ ID NO: 566656 - RNA, 17 nt, Coxiella burnetii RSA 493
uuggacaaaucaucaaa

SEQ ID NO: 566657 - RNA, 18 nt, Coxiella burnetii RSA 493
uugggauucgaauuuguu

SEQ ID NO: 566658 - RNA, 13 nt, Coxiella burnetii RSA 493
uuggcucccagcg

SEQ ID NO: 566659 - RNA, 18 nt, Coxiella burnetii RSA 493
uuggcuacuuucucaauu

SEQ ID NO: 566660 - RNA, 18 nt, Coxiella burnetii RSA 493
uugguaaugcuucuaauu

SEQ ID NO: 566661 - RNA, 22 nt, Coxiella burnetii RSA 493
uugguagcccgaaaaaguagcg

SEQ ID NO: 566662 - RNA, 19 nt, Coxiella burnetii RSA 493
uugguaguccugagucgga

SEQ ID NO: 566663 - RNA, 20 nt, Coxiella burnetii RSA 493
uugggcuucgcaaagcucag

SEQ ID NO: 566664 - RNA, 21 nt, Coxiella burnetii RSA 493
uugguauaaaugaucccaugc

SEQ ID NO: 566665 - RNA, 13 nt, Coxiella burnetii RSA 493
uuggucaaagaga

SEQ ID NO: 566666 - RNA, 18 nt, Coxiella burnetii RSA 493
uuuaacucgaaucacuug

SEQ ID NO: 566667 - RNA, 18 nt, Coxiella burnetii RSA 493
uuuaacgauuuuaaguaa

SEQ ID NO: 566668 - RNA, 16 nt, Coxiella burnetii RSA 493
uuuaagucccaauuuc

SEQ ID NO: 566669 - RNA, 13 nt, Coxiella burnetii RSA 493
uuuaaguuuuuca

SEQ ID NO: 566670 - RNA, 13 nt, Coxiella burnetii RSA 493
uuuaauuuuaaau

SEQ ID NO: 566671 - RNA, 20 nt, Coxiella burnetii RSA 493
uuuaauugacuuauuuuuau

SEQ ID NO: 566672 - RNA, 14 nt, Coxiella burnetii RSA 493
uuuaauacauaaaa

SEQ ID NO: 566673 - RNA, 15 nt, Coxiella burnetii RSA 493
uuuaauacauaaaau

SEQ ID NO: 566674 - RNA, 20 nt, Coxiella burnetii RSA 493
uuuaaaucugacguuaucac

SEQ ID NO: 566675 - RNA, 13 nt, Coxiella burnetii RSA 493
uuuaaauaacaaa

SEQ ID NO: 566676 - RNA, 16 nt, Coxiella burnetii RSA 493
uuguugggcuucgcaa

SEQ ID NO: 566677 - RNA, 21 nt, Coxiella burnetii RSA 493
uuguuccuugagaguaaaugu

SEQ ID NO: 566678 - RNA, 14 nt, Coxiella burnetii RSA 493
uuguauaaagguuu

SEQ ID NO: 566679 - RNA, 13 nt, Coxiella burnetii RSA 493
uuguaccugccau

SEQ ID NO: 566680 - RNA, 21 nt, Coxiella burnetii RSA 493
uuguaagcguacaacaacaaa

SEQ ID NO: 566681 - RNA, 22 nt, Coxiella burnetii RSA 493
uuguaauucacgauuuucguug

SEQ ID NO: 566682 - RNA, 20 nt, Coxiella burnetii RSA 493
uuguaauaaugucugcauuu

SEQ ID NO: 566683 - RNA, 12 nt, Coxiella burnetii RSA 493
uuguggagaggu

SEQ ID NO: 566684 - RNA, 12 nt, Coxiella burnetii RSA 493
uuguguuuuaau

SEQ ID NO: 566685 - RNA, 12 nt, Coxiella burnetii RSA 493
uuguucuaaauc

SEQ ID NO: 566686 - RNA, 18 nt, Coxiella burnetii RSA 493
uuguuccgccauuuccca

SEQ ID NO: 566687 - RNA, 22 nt, Coxiella burnetii RSA 493
uuguuaaucgucauucccgccu

SEQ ID NO: 566688 - RNA, 17 nt, Coxiella burnetii RSA 493
uugucucguuagaaaag

SEQ ID NO: 566689 - RNA, 14 nt, Coxiella burnetii RSA 493
uucuucuuuggauu

SEQ ID NO: 566690 - RNA, 11 nt, Coxiella burnetii RSA 493
uucuucuuuuc

SEQ ID NO: 566691 - RNA, 15 nt, Coxiella burnetii RSA 493
uucuuuaauaucaaa

SEQ ID NO: 566692 - RNA, 23 nt, Coxiella burnetii RSA 493
uucuuuaacuuuagcuaauucuu

SEQ ID NO: 566693 - RNA, 16 nt, Coxiella burnetii RSA 493
uucuuucauuaauucc

SEQ ID NO: 566694 - RNA, 13 nt, Coxiella burnetii RSA 493
uucuuucauuauu

SEQ ID NO: 566695 - RNA, 13 nt, Coxiella burnetii RSA 493
uucuuucaauauc

SEQ ID NO: 566696 - RNA, 15 nt, Coxiella burnetii RSA 493
uucuuucacuaaaag

SEQ ID NO: 566697 - RNA, 18 nt, Coxiella burnetii RSA 493
uucuuuuggcauuguucu

SEQ ID NO: 566698 - RNA, 17 nt, Coxiella burnetii RSA 493
uugaaaaauugaaagaa

SEQ ID NO: 566699 - RNA, 19 nt, Coxiella burnetii RSA 493
uugaaaacguuauuguuaa

SEQ ID NO: 566700 - RNA, 14 nt, Coxiella burnetii RSA 493
uugaaauagccauu

SEQ ID NO: 566701 - RNA, 20 nt, Coxiella burnetii RSA 493
uugaauaauucguuuacuug

SEQ ID NO: 566702 - RNA, 23 nt, Coxiella burnetii RSA 493
uugaauacaacgcuguuaaaauc

SEQ ID NO: 566703 - RNA, 14 nt, Coxiella burnetii RSA 493
uugaauccucagua

SEQ ID NO: 566704 - RNA, 20 nt, Coxiella burnetii RSA 493
uugacaccacgcuaaauggu

SEQ ID NO: 566705 - RNA, 20 nt, Coxiella burnetii RSA 493
uugacaccuuuggcaauaau

SEQ ID NO: 566706 - RNA, 23 nt, Coxiella burnetii RSA 493
uugaaucaaauuaaaauaaucca

SEQ ID NO: 566707 - RNA, 15 nt, Coxiella burnetii RSA 493
uugacauugggguaa

SEQ ID NO: 566708 - RNA, 23 nt, Coxiella burnetii RSA 493
uugacccgaaaagucguguuagg

SEQ ID NO: 566709 - RNA, 17 nt, Coxiella burnetii RSA 493
uugauaagcauaauuca

SEQ ID NO: 566710 - RNA, 19 nt, Coxiella burnetii RSA 493
uugauacugcguuuuucag

SEQ ID NO: 566711 - RNA, 14 nt, Coxiella burnetii RSA 493
uugcaaaacagccc

SEQ ID NO: 566712 - RNA, 20 nt, Coxiella burnetii RSA 493
uugauuacuugauauucccu

SEQ ID NO: 566713 - RNA, 13 nt, Coxiella burnetii RSA 493
uugauuaauuaau

SEQ ID NO: 566714 - RNA, 19 nt, Coxiella burnetii RSA 493
uugauccggcuuuugauua

SEQ ID NO: 566715 - RNA, 15 nt, Coxiella burnetii RSA 493
uugaucauuuccuag

SEQ ID NO: 566716 - RNA, 20 nt, Coxiella burnetii RSA 493
uugauaucaaucgaaaaaaa

SEQ ID NO: 566717 - RNA, 16 nt, Coxiella burnetii RSA 493
uugauauccuucuuuu

SEQ ID NO: 566718 - RNA, 19 nt, Coxiella burnetii RSA 493
uucuucuaaugauugcucu

SEQ ID NO: 566719 - RNA, 17 nt, Coxiella burnetii RSA 493
uucuuaacgaagguuuc

SEQ ID NO: 566720 - RNA, 17 nt, Coxiella burnetii RSA 493
uucuuauccuuacaaaa

SEQ ID NO: 566721 - RNA, 17 nt, Coxiella burnetii RSA 493
uucucuauuucgagauu

SEQ ID NO: 566722 - RNA, 20 nt, Coxiella burnetii RSA 493
uucucuauuucgagauuauu

SEQ ID NO: 566723 - RNA, 20 nt, Coxiella burnetii RSA 493
uucucugcgaggaccucucc

SEQ ID NO: 566724 - RNA, 21 nt, Coxiella burnetii RSA 493
uucucuucaacgccagcuucc

SEQ ID NO: 566725 - RNA, 14 nt, Coxiella burnetii RSA 493
uucucuuuuuucca

SEQ ID NO: 566726 - RNA, 21 nt, Coxiella burnetii RSA 493
uucucuucuuuuuuguaaaug

SEQ ID NO: 566727 - RNA, 14 nt, Coxiella burnetii RSA 493
uucucuuucauaau

SEQ ID NO: 566728 - RNA, 16 nt, Coxiella burnetii RSA 493
uucugcagauuguaaa

SEQ ID NO: 566729 - RNA, 21 nt, Coxiella burnetii RSA 493
uucugauuuuacgcuauuuuu

SEQ ID NO: 566730 - RNA, 13 nt, Coxiella burnetii RSA 493
uuaucacuccaau

SEQ ID NO: 566731 - RNA, 17 nt, Coxiella burnetii RSA 493
uuaucacuccaauaaua

SEQ ID NO: 566732 - RNA, 16 nt, Coxiella burnetii RSA 493
uucggcgccagcauug

SEQ ID NO: 566733 - RNA, 15 nt, Coxiella burnetii RSA 493
uucgguaagcgcuuu

SEQ ID NO: 566734 - RNA, 13 nt, Coxiella burnetii RSA 493
uucguauaauuca

SEQ ID NO: 566735 - RNA, 16 nt, Coxiella burnetii RSA 493
uucguuucgaaaaauu

SEQ ID NO: 566736 - RNA, 14 nt, Coxiella burnetii RSA 493
uucguucugaaauu

SEQ ID NO: 566737 - RNA, 13 nt, Coxiella burnetii RSA 493
uucuauuagcugc

SEQ ID NO: 566738 - RNA, 20 nt, Coxiella burnetii RSA 493
uucucaaauugcuccaaaca

SEQ ID NO: 566739 - RNA, 15 nt, Coxiella burnetii RSA 493
uucucaaauuuuccc

SEQ ID NO: 566740 - RNA, 20 nt, Coxiella burnetii RSA 493
uucuaucgugccaguauuuu

SEQ ID NO: 566741 - RNA, 18 nt, Coxiella burnetii RSA 493
uucuaucgaugaagcuga

SEQ ID NO: 566742 - RNA, 16 nt, Coxiella burnetii RSA 493
uucuacggccaucgcc

SEQ ID NO: 566743 - RNA, 16 nt, Coxiella burnetii RSA 493
uucuaauuugaaaaac

SEQ ID NO: 566744 - RNA, 17 nt, Coxiella burnetii RSA 493
uucuaauuugaaaaacc

SEQ ID NO: 566745 - RNA, 17 nt, Coxiella burnetii RSA 493
uucuaaagaauuuuuca

SEQ ID NO: 566746 - RNA, 15 nt, Coxiella burnetii RSA 493
ugaauuuuuugaaaa

SEQ ID NO: 566747 - RNA, 17 nt, Coxiella burnetii RSA 493
ugaauuuuuugaaaaac

SEQ ID NO: 566748 - RNA, 14 nt, Coxiella burnetii RSA 493
ugacaaauaaagaa

SEQ ID NO: 566749 - RNA, 23 nt, Coxiella burnetii RSA 493
ugaauuucaccguuuucuaucca

SEQ ID NO: 566750 - RNA, 20 nt, Coxiella burnetii RSA 493
ugaauugaaguccuuaucac

SEQ ID NO: 566751 - RNA, 18 nt, Coxiella burnetii RSA 493
ugaauuccuugcucaagu

SEQ ID NO: 566752 - RNA, 13 nt, Coxiella burnetii RSA 493
ugaauacaacgcu

SEQ ID NO: 566753 - RNA, 20 nt, Coxiella burnetii RSA 493
ucuuuauuuggcuuuacaua

SEQ ID NO: 566754 - RNA, 12 nt, Coxiella burnetii RSA 493
ucuuuauuuuuu

SEQ ID NO: 566755 - RNA, 15 nt, Coxiella burnetii RSA 493
ucuuuauuuuuucuu

SEQ ID NO: 566756 - RNA, 23 nt, Coxiella burnetii RSA 493
ugaauauuaguggaauuaaauau

SEQ ID NO: 566757 - RNA, 18 nt, Coxiella burnetii RSA 493
ugacacccugaacauuaa

SEQ ID NO: 566758 - RNA, 18 nt, Coxiella burnetii RSA 493
ugacaccuuuggcaauaa

SEQ ID NO: 566759 - RNA, 17 nt, Coxiella burnetii RSA 493
ugaccaugguuucuuua

SEQ ID NO: 566760 - RNA, 22 nt, Coxiella burnetii RSA 493
ugaccgcuaaagcaaaaguaau

SEQ ID NO: 566761 - RNA, 21 nt, Coxiella burnetii RSA 493
ugaccggguuuacauaagaaa

SEQ ID NO: 566762 - RNA, 14 nt, Coxiella burnetii RSA 493
ugacuugucaauuu

SEQ ID NO: 566763 - RNA, 23 nt, Coxiella burnetii RSA 493
ugacuucuuugugagucgccaau

SEQ ID NO: 566764 - RNA, 16 nt, Coxiella burnetii RSA 493
ugacuuuaucuuuuuu

SEQ ID NO: 566765 - RNA, 17 nt, Coxiella burnetii RSA 493
ugagaacguuucccaag

SEQ ID NO: 566766 - RNA, 20 nt, Coxiella burnetii RSA 493
ugagcgaagaaaaagaaauu

SEQ ID NO: 566767 - RNA, 17 nt, Coxiella burnetii RSA 493
ugagcgaagcgaaauac

SEQ ID NO: 566768 - RNA, 22 nt, Coxiella burnetii RSA 493
ugagaauggcggucacucgguu

SEQ ID NO: 566769 - RNA, 22 nt, Coxiella burnetii RSA 493
ugagcucauugccaaagaaaug

SEQ ID NO: 566770 - RNA, 16 nt, Coxiella burnetii RSA 493
ugaggcugauucaaau

SEQ ID NO: 566771 - RNA, 14 nt, Coxiella burnetii RSA 493
ugagggauuuugca

SEQ ID NO: 566772 - RNA, 20 nt, Coxiella burnetii RSA 493
ugaggucgagcguaaaacac

SEQ ID NO: 566773 - RNA, 19 nt, Coxiella burnetii RSA 493
ugaguauggcuauuauuaa

SEQ ID NO: 566774 - RNA, 22 nt, Coxiella burnetii RSA 493
ugaguauuuggcagaauuugua

SEQ ID NO: 566775 - RNA, 19 nt, Coxiella burnetii RSA 493
ugauauccagguguuuuuc

SEQ ID NO: 566776 - RNA, 16 nt, Coxiella burnetii RSA 493
ugauauccuucuuuua

SEQ ID NO: 566777 - RNA, 17 nt, Coxiella burnetii RSA 493
ugauauccuucuuuuaa

SEQ ID NO: 566778 - RNA, 11 nt, Coxiella burnetii RSA 493
ugauauuccca

SEQ ID NO: 566779 - RNA, 19 nt, Coxiella burnetii RSA 493
ugaugcguuuuuuuauuau

SEQ ID NO: 566780 - RNA, 14 nt, Coxiella burnetii RSA 493
ugaucgauaaaaau

SEQ ID NO: 566781 - RNA, 19 nt, Coxiella burnetii RSA 493
ugaucggcgcauuuuuauu

SEQ ID NO: 566782 - RNA, 16 nt, Coxiella burnetii RSA 493
ugaucggcggaaagau

SEQ ID NO: 566783 - RNA, 15 nt, Coxiella burnetii RSA 493
ugaugaauaacaaug

SEQ ID NO: 566784 - RNA, 19 nt, Coxiella burnetii RSA 493
ugauucuauacuucaucuc

SEQ ID NO: 566785 - RNA, 17 nt, Coxiella burnetii RSA 493
ugauucucucaaagaaa

SEQ ID NO: 566786 - RNA, 16 nt, Coxiella burnetii RSA 493
ugauuucguaaaacga

SEQ ID NO: 566787 - RNA, 12 nt, Coxiella burnetii RSA 493
ugauuuaaauuu

SEQ ID NO: 566788 - RNA, 15 nt, Coxiella burnetii RSA 493
ugauuuaaauuuaaa

SEQ ID NO: 566789 - RNA, 12 nt, Coxiella burnetii RSA 493
ugauuuuaaaaa

SEQ ID NO: 566790 - RNA, 14 nt, Coxiella burnetii RSA 493
ugauuuuaaaaaua

SEQ ID NO: 566791 - RNA, 19 nt, Coxiella burnetii RSA 493
ugauuuuaaaaauaaauua

SEQ ID NO: 566792 - RNA, 17 nt, Coxiella burnetii RSA 493
ugauuuguucuaaaucg

SEQ ID NO: 566793 - RNA, 20 nt, Coxiella burnetii RSA 493
ugauuuuacgcuauuuuuua

SEQ ID NO: 566794 - RNA, 13 nt, Coxiella burnetii RSA 493
ugauuuuucccaa

SEQ ID NO: 566795 - RNA, 15 nt, Coxiella burnetii RSA 493
ugauuuuuuaaugaa

SEQ ID NO: 566796 - RNA, 14 nt, Coxiella burnetii RSA 493
ugauguuuuaaaau

SEQ ID NO: 566797 - RNA, 12 nt, Coxiella burnetii RSA 493
ugaugugaaaaa

SEQ ID NO: 566798 - RNA, 18 nt, Coxiella burnetii RSA 493
ugaugugaaaaauucuaa

SEQ ID NO: 566799 - RNA, 12 nt, Coxiella burnetii RSA 493
ugauucaauaau

SEQ ID NO: 566800 - RNA, 16 nt, Coxiella burnetii RSA 493
ugauucaauaaucuca

SEQ ID NO: 566801 - RNA, 15 nt, Coxiella burnetii RSA 493
ugcaauaacaaauaa

SEQ ID NO: 566802 - RNA, 20 nt, Coxiella burnetii RSA 493
ugcaauaacaaauaaaccua

SEQ ID NO: 566803 - RNA, 22 nt, Coxiella burnetii RSA 493
ugcaagcaccgcuggcuuugau

SEQ ID NO: 566804 - RNA, 15 nt, Coxiella burnetii RSA 493
ugcaagcguuuuuca

SEQ ID NO: 566805 - RNA, 19 nt, Coxiella burnetii RSA 493
ugcaagcguuuuucaucca

SEQ ID NO: 566806 - RNA, 23 nt, Coxiella burnetii RSA 493
ugcaagcugcgcauaaacuuuaa

SEQ ID NO: 566807 - RNA, 22 nt, Coxiella burnetii RSA 493
ugcaauaauucuuucugaaaau

SEQ ID NO: 566808 - RNA, 20 nt, Coxiella burnetii RSA 493
ugcaauaagcuaucagcaga

SEQ ID NO: 566809 - RNA, 22 nt, Coxiella burnetii RSA 493
ugcacgaaauaauuacaacuac

SEQ ID NO: 566810 - RNA, 23 nt, Coxiella burnetii RSA 493
ugcacaucuucacgcauuuccca

SEQ ID NO: 566811 - RNA, 13 nt, Coxiella burnetii RSA 493
ugcagaaacaaua

SEQ ID NO: 566812 - RNA, 19 nt, Coxiella burnetii RSA 493
ugcacgggcaccauuuuuc

SEQ ID NO: 566813 - RNA, 13 nt, Coxiella burnetii RSA 493
ugcagaguuauua

SEQ ID NO: 566814 - RNA, 19 nt, Coxiella burnetii RSA 493
ugcaggcgcguuuuauaaa

SEQ ID NO: 566815 - RNA, 19 nt, Coxiella burnetii RSA 493
ugcagcucuuucaauguau

SEQ ID NO: 566816 - RNA, 17 nt, Coxiella burnetii RSA 493
ugcagcugauuucuggu

SEQ ID NO: 566817 - RNA, 22 nt, Coxiella burnetii RSA 493
ugcagcuucgugcaauuucugg

SEQ ID NO: 566818 - RNA, 20 nt, Coxiella burnetii RSA 493
ugccacucuuuauuauaaaa

SEQ ID NO: 566819 - RNA, 24 nt, Coxiella burnetii RSA 493
ugccaggacuuuaagauuucuuca

SEQ ID NO: 566820 - RNA, 15 nt, Coxiella burnetii RSA 493
ugccaguauuuuucu

SEQ ID NO: 566821 - RNA, 18 nt, Coxiella burnetii RSA 493
ugccaguauuuuucuuug

SEQ ID NO: 566822 - RNA, 21 nt, Coxiella burnetii RSA 493
ugccagcaauggugauuucuu

SEQ ID NO: 566823 - RNA, 23 nt, Coxiella burnetii RSA 493
ugccagcaauggugauuucuucc

SEQ ID NO: 566824 - RNA, 11 nt, Coxiella burnetii RSA 493
ugcccaagaac

SEQ ID NO: 566825 - RNA, 22 nt, Coxiella burnetii RSA 493
ugccaguguuaauggauuccca

SEQ ID NO: 566826 - RNA, 12 nt, Coxiella burnetii RSA 493
ugccccuccucu

SEQ ID NO: 566827 - RNA, 13 nt, Coxiella burnetii RSA 493
ugccccuccucua

SEQ ID NO: 566828 - RNA, 15 nt, Coxiella burnetii RSA 493
ugcccgaaaaggaaa

SEQ ID NO: 566829 - RNA, 23 nt, Coxiella burnetii RSA 493
ugcccgaaaaggaaauguaaaaa

SEQ ID NO: 566830 - RNA, 23 nt, Coxiella burnetii RSA 493
ugccuuugagguuggagguuucu

SEQ ID NO: 566831 - RNA, 18 nt, Coxiella burnetii RSA 493
ugcgauuuuguuucuuug

SEQ ID NO: 566832 - RNA, 13 nt, Coxiella burnetii RSA 493
ugcgauucuuuuu

SEQ ID NO: 566833 - RNA, 16 nt, Coxiella burnetii RSA 493
ugcgauaguuuuauuu

SEQ ID NO: 566834 - RNA, 21 nt, Coxiella burnetii RSA 493
ugcgauaguuuuauuuaaaaa

SEQ ID NO: 566835 - RNA, 20 nt, Coxiella burnetii RSA 493
ugcgaugaauggaauguuaa

SEQ ID NO: 566836 - RNA, 12 nt, Coxiella burnetii RSA 493
ugcgagcaauaa

SEQ ID NO: 566837 - RNA, 23 nt, Coxiella burnetii RSA 493
ugcuauuugcccaucugauggau

SEQ ID NO: 566838 - RNA, 12 nt, Coxiella burnetii RSA 493
ugcuauuuuucc

SEQ ID NO: 566839 - RNA, 15 nt, Coxiella burnetii RSA 493
ugcguuuuuuuauua

SEQ ID NO: 566840 - RNA, 12 nt, Coxiella burnetii RSA 493
ugcguuuuaaau

SEQ ID NO: 566841 - RNA, 14 nt, Coxiella burnetii RSA 493
ugcguuuuaaaugc

SEQ ID NO: 566842 - RNA, 16 nt, Coxiella burnetii RSA 493
ugcguuuuaaaugcuu

SEQ ID NO: 566843 - RNA, 18 nt, Coxiella burnetii RSA 493
ugcucuaaauuaaaugcu

SEQ ID NO: 566844 - RNA, 15 nt, Coxiella burnetii RSA 493
ugcucuuuauagagu

SEQ ID NO: 566845 - RNA, 15 nt, Coxiella burnetii RSA 493
ugcucucccuuaacu

SEQ ID NO: 566846 - RNA, 13 nt, Coxiella burnetii RSA 493
ugcucgcgaaauu

SEQ ID NO: 566847 - RNA, 14 nt, Coxiella burnetii RSA 493
ugcgguauuuuucc

SEQ ID NO: 566848 - RNA, 15 nt, Coxiella burnetii RSA 493
ugcgcuccucuauau

SEQ ID NO: 566849 - RNA, 17 nt, Coxiella burnetii RSA 493
ugcgcuuauagcuuguu

SEQ ID NO: 566850 - RNA, 13 nt, Coxiella burnetii RSA 493
ugcuuccaauaag

SEQ ID NO: 566851 - RNA, 18 nt, Coxiella burnetii RSA 493
ugcuucauugacagccag

SEQ ID NO: 566852 - RNA, 17 nt, Coxiella burnetii RSA 493
ugcuuaccgaggucuuu

SEQ ID NO: 566853 - RNA, 21 nt, Coxiella burnetii RSA 493
ugcuucuaauuugaaaaaccc

SEQ ID NO: 566854 - RNA, 15 nt, Coxiella burnetii RSA 493
ugcuugcucuucuuc

SEQ ID NO: 566855 - RNA, 15 nt, Coxiella burnetii RSA 493
ugcuugggaacaacg

SEQ ID NO: 566856 - RNA, 17 nt, Coxiella burnetii RSA 493
ugcuucuuccaauaaca

SEQ ID NO: 566857 - RNA, 18 nt, Coxiella burnetii RSA 493
ugcuugcgcauccgcccc

SEQ ID NO: 566858 - RNA, 22 nt, Coxiella burnetii RSA 493
ugcuuucuuugaaccacuaagu

SEQ ID NO: 566859 - RNA, 16 nt, Coxiella burnetii RSA 493
ugcuuuugaauuuuuu

SEQ ID NO: 566860 - RNA, 19 nt, Coxiella burnetii RSA 493
ugcugugcgguauuuuucc

SEQ ID NO: 566861 - RNA, 20 nt, Coxiella burnetii RSA 493
uggaaauaaugugacucauu

SEQ ID NO: 566862 - RNA, 13 nt, Coxiella burnetii RSA 493
ugcuuuuuaaaac

SEQ ID NO: 566863 - RNA, 13 nt, Coxiella burnetii RSA 493
ugcuuuuuaaaua

SEQ ID NO: 566864 - RNA, 13 nt, Coxiella burnetii RSA 493
uggaauucauaau

SEQ ID NO: 566865 - RNA, 17 nt, Coxiella burnetii RSA 493
uggaauggauauuuuaa

SEQ ID NO: 566866 - RNA, 20 nt, Coxiella burnetii RSA 493
uggaaucaaguagccaaaau

SEQ ID NO: 566867 - RNA, 23 nt, Coxiella burnetii RSA 493
uuagggugacggcggauuaaaaa

SEQ ID NO: 566868 - RNA, 21 nt, Coxiella burnetii RSA 493
uuaguaacccuuucauuuaau

SEQ ID NO: 566869 - RNA, 23 nt, Coxiella burnetii RSA 493
uuaguaacccuuucauuuaauuu

SEQ ID NO: 566870 - RNA, 19 nt, Coxiella burnetii RSA 493
uuaguggaauuaaauaucc

SEQ ID NO: 566871 - RNA, 20 nt, Coxiella burnetii RSA 493
uuaguuucccguauuucgcu

SEQ ID NO: 566872 - RNA, 22 nt, Coxiella burnetii RSA 493
uuaguuuuauuugaaaguagaa

SEQ ID NO: 566873 - RNA, 23 nt, Coxiella burnetii RSA 493
uuaguuuuauuugaaaguagaaa

SEQ ID NO: 566874 - RNA, 13 nt, Coxiella burnetii RSA 493
uuauauuuaauuu

SEQ ID NO: 566875 - RNA, 12 nt, Coxiella burnetii RSA 493
uuauaaaucccg

SEQ ID NO: 566876 - RNA, 17 nt, Coxiella burnetii RSA 493
uuauaacuauuuuaaau

SEQ ID NO: 566877 - RNA, 18 nt, Coxiella burnetii RSA 493
uuauaacuauuuuaaauc

SEQ ID NO: 566878 - RNA, 13 nt, Coxiella burnetii RSA 493
uuacuucuauaca

SEQ ID NO: 566879 - RNA, 14 nt, Coxiella burnetii RSA 493
uuaccuucuguaau

SEQ ID NO: 566880 - RNA, 16 nt, Coxiella burnetii RSA 493
uuagauauugaacagg

SEQ ID NO: 566881 - RNA, 15 nt, Coxiella burnetii RSA 493
uuagauuucuggaug

SEQ ID NO: 566882 - RNA, 17 nt, Coxiella burnetii RSA 493
uuagcgccgugcaaaac

SEQ ID NO: 566883 - RNA, 22 nt, Coxiella burnetii RSA 493
uuagcgcuaaugagaaacguga

SEQ ID NO: 566884 - RNA, 15 nt, Coxiella burnetii RSA 493
uuagcugauuucucu

SEQ ID NO: 566885 - RNA, 16 nt, Coxiella burnetii RSA 493
uuagcugauuucucuu

SEQ ID NO: 566886 - RNA, 23 nt, Coxiella burnetii RSA 493
uuagcugauuucucuuuuaacuu

SEQ ID NO: 566887 - RNA, 11 nt, Coxiella burnetii RSA 493
uuagcuuccau

SEQ ID NO: 566888 - RNA, 15 nt, Coxiella burnetii RSA 493
uuagcuuccauugcu

SEQ ID NO: 566889 - RNA, 13 nt, Coxiella burnetii RSA 493
uuagcuuuucuuu

SEQ ID NO: 566890 - RNA, 20 nt, Coxiella burnetii RSA 493
uuagcuuuuuucaaaauuua

SEQ ID NO: 566891 - RNA, 19 nt, Coxiella burnetii RSA 493
uuaggaaggacaaaaauau

SEQ ID NO: 566892 - RNA, 20 nt, Coxiella burnetii RSA 493
uuaggaaggacaaaaauauc

SEQ ID NO: 566893 - RNA, 21 nt, Coxiella burnetii RSA 493
uuaggaaggacaaaaauaucc

SEQ ID NO: 566894 - RNA, 19 nt, Coxiella burnetii RSA 493
uuaggaugcgaauguaaug

SEQ ID NO: 566895 - RNA, 17 nt, Coxiella burnetii RSA 493
uuagcaucuugaaucau

SEQ ID NO: 566896 - RNA, 16 nt, Coxiella burnetii RSA 493
uuagcaacuccgucug

SEQ ID NO: 566897 - RNA, 15 nt, Coxiella burnetii RSA 493
uuagcaggauuuuca

SEQ ID NO: 566898 - RNA, 17 nt, Coxiella burnetii RSA 493
uuaccuaacucaaccuc

SEQ ID NO: 566899 - RNA, 22 nt, Coxiella burnetii RSA 493
uuaccugaaugcuuuuaaagug

SEQ ID NO: 566900 - RNA, 21 nt, Coxiella burnetii RSA 493
uuacaauccaauacuagcuuu

SEQ ID NO: 566901 - RNA, 15 nt, Coxiella burnetii RSA 493
uuacagguucacucg

SEQ ID NO: 566902 - RNA, 12 nt, Coxiella burnetii RSA 493
uuaccacuccug

SEQ ID NO: 566903 - RNA, 20 nt, Coxiella burnetii RSA 493
uuaauccguuuugaaaaaua

SEQ ID NO: 566904 - RNA, 21 nt, Coxiella burnetii RSA 493
uuaauccguuuugaaaaauaa

SEQ ID NO: 566905 - RNA, 22 nt, Coxiella burnetii RSA 493
uuaaucgcuccgaaaauaaaua

SEQ ID NO: 566906 - RNA, 18 nt, Coxiella burnetii RSA 493
uuaaucgcuccuaaauuu

SEQ ID NO: 566907 - RNA, 21 nt, Coxiella burnetii RSA 493
uuaaucgcuccuaaauuuucu

SEQ ID NO: 566908 - RNA, 12 nt, Coxiella burnetii RSA 493
uuaauuuuuccu

SEQ ID NO: 566909 - RNA, 21 nt, Coxiella burnetii RSA 493
uuaauuuuugcaucgguagaa

SEQ ID NO: 566910 - RNA, 14 nt, Coxiella burnetii RSA 493
uuaauuuuuucucu

SEQ ID NO: 566911 - RNA, 19 nt, Coxiella burnetii RSA 493
uuacaauacggugaaccga

SEQ ID NO: 566912 - RNA, 12 nt, Coxiella burnetii RSA 493
uuaauuuuauua

SEQ ID NO: 566913 - RNA, 23 nt, Coxiella burnetii RSA 493
uuaauugcugauauuuuuuauuu

SEQ ID NO: 566914 - RNA, 14 nt, Coxiella burnetii RSA 493
uuaauuucuaaaaa

SEQ ID NO: 566915 - RNA, 16 nt, Coxiella burnetii RSA 493
uuaauuucuaaaaauc

SEQ ID NO: 566916 - RNA, 17 nt, Coxiella burnetii RSA 493
uuaauuucuaaaaauca

SEQ ID NO: 566917 - RNA, 13 nt, Coxiella burnetii RSA 493
uuaauuuuaaaaa

SEQ ID NO: 566918 - RNA, 13 nt, Coxiella burnetii RSA 493
uuaaucauauaau

SEQ ID NO: 566919 - RNA, 15 nt, Coxiella burnetii RSA 493
uuaauauuaaaacaa

SEQ ID NO: 566920 - RNA, 14 nt, Coxiella burnetii RSA 493
uuaauaucaaaaaa

SEQ ID NO: 566921 - RNA, 15 nt, Coxiella burnetii RSA 493
uuaauaugauaaaag

SEQ ID NO: 566922 - RNA, 20 nt, Coxiella burnetii RSA 493
uuaaguuaagauaauaauua

SEQ ID NO: 566923 - RNA, 13 nt, Coxiella burnetii RSA 493
uuaauacaaggaa

SEQ ID NO: 566924 - RNA, 15 nt, Coxiella burnetii RSA 493
uuaauacaaggaaaa

SEQ ID NO: 566925 - RNA, 16 nt, Coxiella burnetii RSA 493
uuaauacaggaaaaag

SEQ ID NO: 566926 - RNA, 19 nt, Coxiella burnetii RSA 493
uuaauacaggaaaaagaua

SEQ ID NO: 566927 - RNA, 15 nt, Coxiella burnetii RSA 493
uuaauacauucuuca

SEQ ID NO: 566928 - RNA, 19 nt, Coxiella burnetii RSA 493
uuaauacauucuucaguaa

SEQ ID NO: 566929 - RNA, 12 nt, Coxiella burnetii RSA 493
uuaauauaauca

SEQ ID NO: 566930 - RNA, 14 nt, Coxiella burnetii RSA 493
uuaagugacagcuc

SEQ ID NO: 566931 - RNA, 17 nt, Coxiella burnetii RSA 493
uuaagucccaauuucuu

SEQ ID NO: 566932 - RNA, 23 nt, Coxiella burnetii RSA 493
uuaagacuaggaaaaaauaauua

SEQ ID NO: 566933 - RNA, 17 nt, Coxiella burnetii RSA 493
uuaagagagcgagguaa

SEQ ID NO: 566934 - RNA, 21 nt, Coxiella burnetii RSA 493
uuaagagauagugcuauuuuu

SEQ ID NO: 566935 - RNA, 22 nt, Coxiella burnetii RSA 493
uuaaggccucuuuagaaaauug

SEQ ID NO: 566936 - RNA, 22 nt, Coxiella burnetii RSA 493
uuaaauccagaccuguuaaaaa

SEQ ID NO: 566937 - RNA, 22 nt, Coxiella burnetii RSA 493
uuaaaucuuuggguauaaauaa

SEQ ID NO: 566938 - RNA, 20 nt, Coxiella burnetii RSA 493
ugugcauaaauuauuuuaau

SEQ ID NO: 566939 - RNA, 22 nt, Coxiella burnetii RSA 493
ugugcaauuccauuaaaaacaa

SEQ ID NO: 566940 - RNA, 12 nt, Coxiella burnetii RSA 493
ugugccugccau

SEQ ID NO: 566941 - RNA, 15 nt, Coxiella burnetii RSA 493
ugucacguuaucauu

SEQ ID NO: 566942 - RNA, 17 nt, Coxiella burnetii RSA 493
ugucagccgcuuccaga

SEQ ID NO: 566943 - RNA, 14 nt, Coxiella burnetii RSA 493
ugugguacacgcaa

SEQ ID NO: 566944 - RNA, 18 nt, Coxiella burnetii RSA 493
ugugcucaucuucuauuc

SEQ ID NO: 566945 - RNA, 11 nt, Coxiella burnetii RSA 493
uguuaaaacac

SEQ ID NO: 566946 - RNA, 21 nt, Coxiella burnetii RSA 493
ugugucgcuacgcgacaacua

SEQ ID NO: 566947 - RNA, 14 nt, Coxiella burnetii RSA 493
ugugucucuauacc

SEQ ID NO: 566948 - RNA, 23 nt, Coxiella burnetii RSA 493
uguuaacuuuucggagaaaucuu

SEQ ID NO: 566949 - RNA, 20 nt, Coxiella burnetii RSA 493
uguuccgcagccuaaaucua

SEQ ID NO: 566950 - RNA, 16 nt, Coxiella burnetii RSA 493
uguuccgccauuuccc

SEQ ID NO: 566951 - RNA, 16 nt, Coxiella burnetii RSA 493
uguuccaugucuugaa

SEQ ID NO: 566952 - RNA, 18 nt, Coxiella burnetii RSA 493
uguucccccacuucauac

SEQ ID NO: 566953 - RNA, 14 nt, Coxiella burnetii RSA 493
uguucuaaaucggu

SEQ ID NO: 566954 - RNA, 14 nt, Coxiella burnetii RSA 493
uguuggauuucauc

SEQ ID NO: 566955 - RNA, 15 nt, Coxiella burnetii RSA 493
uguugauuuaacuuc

SEQ ID NO: 566956 - RNA, 23 nt, Coxiella burnetii RSA 493
uguugucaacaaucaguuuugau

SEQ ID NO: 566957 - RNA, 15 nt, Coxiella burnetii RSA 493
uguuguaagaauucu

SEQ ID NO: 566958 - RNA, 17 nt, Coxiella burnetii RSA 493
uguuuuucgguuucuuc

SEQ ID NO: 566959 - RNA, 18 nt, Coxiella burnetii RSA 493
uguuuuucgguuucuuca

SEQ ID NO: 566960 - RNA, 16 nt, Coxiella burnetii RSA 493
uguuuuuauuuugacu

SEQ ID NO: 566961 - RNA, 14 nt, Coxiella burnetii RSA 493
uguuuuuuuucagc

SEQ ID NO: 566962 - RNA, 13 nt, Coxiella burnetii RSA 493
uuaaaaaagaaaa

SEQ ID NO: 566963 - RNA, 20 nt, Coxiella burnetii RSA 493
uuaaaaaacuagaaauauua

SEQ ID NO: 566964 - RNA, 22 nt, Coxiella burnetii RSA 493
uguuuuuggcauaccuuuugcu

SEQ ID NO: 566965 - RNA, 12 nt, Coxiella burnetii RSA 493
uguuuuuuaauc

SEQ ID NO: 566966 - RNA, 15 nt, Coxiella burnetii RSA 493
uguuuuuuuguagaa

SEQ ID NO: 566967 - RNA, 18 nt, Coxiella burnetii RSA 493
uuaaaaacgccugaaaua

SEQ ID NO: 566968 - RNA, 21 nt, Coxiella burnetii RSA 493
uuaaaaacgccugaaauauuu

SEQ ID NO: 566969 - RNA, 20 nt, Coxiella burnetii RSA 493
uuaaaaccuuuuuuuucaaa

SEQ ID NO: 566970 - RNA, 11 nt, Coxiella burnetii RSA 493
uuaaaaauauu

SEQ ID NO: 566971 - RNA, 18 nt, Coxiella burnetii RSA 493
uuaaaagcgcccaaauga

SEQ ID NO: 566972 - RNA, 22 nt, Coxiella burnetii RSA 493
uuaaaagacguaccauuaaaag

SEQ ID NO: 566973 - RNA, 20 nt, Coxiella burnetii RSA 493
uuaaaagagcgaauaaaaaa

SEQ ID NO: 566974 - RNA, 17 nt, Coxiella burnetii RSA 493
uuaaagcccucaucucc

SEQ ID NO: 566975 - RNA, 15 nt, Coxiella burnetii RSA 493
uuaaagucuucaaaa

SEQ ID NO: 566976 - RNA, 19 nt, Coxiella burnetii RSA 493
uuaaagucuucaaaaguga

SEQ ID NO: 566977 - RNA, 19 nt, Coxiella burnetii RSA 493
uuaaacguauuccaaauaa

SEQ ID NO: 566978 - RNA, 15 nt, Coxiella burnetii RSA 493
uguuucaauaacaga

SEQ ID NO: 566979 - RNA, 16 nt, Coxiella burnetii RSA 493
uguuucaauaacagag

SEQ ID NO: 566980 - RNA, 16 nt, Coxiella burnetii RSA 493
uguuuaaauuaauauu

SEQ ID NO: 566981 - RNA, 23 nt, Coxiella burnetii RSA 493
uguuuaaucgcuccuaaauuuuc

SEQ ID NO: 566982 - RNA, 19 nt, Coxiella burnetii RSA 493
uguuuagucggaaauuucu

SEQ ID NO: 566983 - RNA, 12 nt, Coxiella burnetii RSA 493
uguuugauuuac

SEQ ID NO: 566984 - RNA, 16 nt, Coxiella burnetii RSA 493
uguuugauuuguucua

SEQ ID NO: 566985 - RNA, 18 nt, Coxiella burnetii RSA 493
uguuugagugguugaaaa

SEQ ID NO: 566986 - RNA, 13 nt, Coxiella burnetii RSA 493
uguuucuuuuaua

SEQ ID NO: 566987 - RNA, 18 nt, Coxiella burnetii RSA 493
uguuucuaauauguuuuu

SEQ ID NO: 566988 - RNA, 18 nt, Coxiella burnetii RSA 493
uguuuucccguauuucgc

SEQ ID NO: 566989 - RNA, 21 nt, Coxiella burnetii RSA 493
uguuuugaucagagaaaccca

SEQ ID NO: 566990 - RNA, 12 nt, Coxiella burnetii RSA 493
uguuuuaauucc

SEQ ID NO: 566991 - RNA, 19 nt, Coxiella burnetii RSA 493
uggagaggugaaccaaaag

SEQ ID NO: 566992 - RNA, 18 nt, Coxiella burnetii RSA 493
uggaggacugcucuuaau

SEQ ID NO: 566993 - RNA, 22 nt, Coxiella burnetii RSA 493
uggagguuucuuuccagcuucc

SEQ ID NO: 566994 - RNA, 15 nt, Coxiella burnetii RSA 493
uggauaguuucaaau

SEQ ID NO: 566995 - RNA, 20 nt, Coxiella burnetii RSA 493
uggauaaaggagauccacuu

SEQ ID NO: 566996 - RNA, 20 nt, Coxiella burnetii RSA 493
uggaguucuugcucccaagc

SEQ ID NO: 566997 - RNA, 14 nt, Coxiella burnetii RSA 493
uggauuaaaugcaa

SEQ ID NO: 566998 - RNA, 18 nt, Coxiella burnetii RSA 493
uggauuuuaagauaaguu

SEQ ID NO: 566999 - RNA, 17 nt, Coxiella burnetii RSA 493
uggauuuuuuaauuggu

SEQ ID NO: 567000 - RNA, 14 nt, Coxiella burnetii RSA 493
uggcaauuaugaaa

SEQ ID NO: 567001 - RNA, 15 nt, Coxiella burnetii RSA 493
uggcaauuaugaaaa

SEQ ID NO: 567002 - RNA, 16 nt, Coxiella burnetii RSA 493
uggcauagggaucauu

SEQ ID NO: 567003 - RNA, 20 nt, Coxiella burnetii RSA 493
uggcaguuaaauuuuuaaug

SEQ ID NO: 567004 - RNA, 19 nt, Coxiella burnetii RSA 493
uggcaguggggucuucauc

SEQ ID NO: 567005 - RNA, 16 nt, Coxiella burnetii RSA 493
uggccgacaaagaagg

SEQ ID NO: 567006 - RNA, 23 nt, Coxiella burnetii RSA 493
uggcccgacgcucgguuccaaaa

SEQ ID NO: 567007 - RNA, 15 nt, Coxiella burnetii RSA 493
uggcaucauuucccg

SEQ ID NO: 567008 - RNA, 13 nt, Coxiella burnetii RSA 493
uggcgccugacaa

SEQ ID NO: 567009 - RNA, 15 nt, Coxiella burnetii RSA 493
uggcgccugacaaag

SEQ ID NO: 567010 - RNA, 14 nt, Coxiella burnetii RSA 493
ugggcaaaaaaaga

SEQ ID NO: 567011 - RNA, 22 nt, Coxiella burnetii RSA 493
uggggcgagcgcccauuuuuuc

SEQ ID NO: 567012 - RNA, 19 nt, Coxiella burnetii RSA 493
uggguaggcugaaauaacg

SEQ ID NO: 567013 - RNA, 13 nt, Coxiella burnetii RSA 493
uggguccucgccu

SEQ ID NO: 567014 - RNA, 15 nt, Coxiella burnetii RSA 493
uggucucuuuuuuug

SEQ ID NO: 567015 - RNA, 18 nt, Coxiella burnetii RSA 493
ugguccggcgaacagccg

SEQ ID NO: 567016 - RNA, 19 nt, Coxiella burnetii RSA 493
ugguauccucagaaguuuu

SEQ ID NO: 567017 - RNA, 18 nt, Coxiella burnetii RSA 493
uggguuagggugcaauuc

SEQ ID NO: 567018 - RNA, 17 nt, Coxiella burnetii RSA 493
ugggugggauuguuuuc

SEQ ID NO: 567019 - RNA, 16 nt, Coxiella burnetii RSA 493
ugguacacgcaaaaau

SEQ ID NO: 567020 - RNA, 15 nt, Coxiella burnetii RSA 493
uguagauuagaaaaa

SEQ ID NO: 567021 - RNA, 20 nt, Coxiella burnetii RSA 493
uguauccuaauaaaaauauu

SEQ ID NO: 567022 - RNA, 16 nt, Coxiella burnetii RSA 493
uguauccgcuuuaaua

SEQ ID NO: 567023 - RNA, 21 nt, Coxiella burnetii RSA 493
uguauccagucguuuuuuaau

SEQ ID NO: 567024 - RNA, 20 nt, Coxiella burnetii RSA 493
uguauuccgccuuaaaacau

SEQ ID NO: 567025 - RNA, 22 nt, Coxiella burnetii RSA 493
uguauuauuauccgguuuugau

SEQ ID NO: 567026 - RNA, 18 nt, Coxiella burnetii RSA 493
uguauuaacauuuggauu

SEQ ID NO: 567027 - RNA, 17 nt, Coxiella burnetii RSA 493
uguacugcuguauaaac

SEQ ID NO: 567028 - RNA, 18 nt, Coxiella burnetii RSA 493
uguacugaaaaguaaaag

SEQ ID NO: 567029 - RNA, 13 nt, Coxiella burnetii RSA 493
uguacucagcuuu

SEQ ID NO: 567030 - RNA, 18 nt, Coxiella burnetii RSA 493
uguacccgaagucuaggc

SEQ ID NO: 567031 - RNA, 13 nt, Coxiella burnetii RSA 493
uguaauaaugucu

SEQ ID NO: 567032 - RNA, 12 nt, Coxiella burnetii RSA 493
uguaauaauuca

SEQ ID NO: 567033 - RNA, 13 nt, Coxiella burnetii RSA 493
uguaauugcuucc

SEQ ID NO: 567034 - RNA, 13 nt, Coxiella burnetii RSA 493
uguaaaauacugg

SEQ ID NO: 567035 - RNA, 20 nt, Coxiella burnetii RSA 493
uguaaacagguccuaaaaaa

SEQ ID NO: 567036 - RNA, 16 nt, Coxiella burnetii RSA 493
uguaaaccaaacguaa

SEQ ID NO: 567037 - RNA, 17 nt, Coxiella burnetii RSA 493
uguaacuuuuccaucuc

SEQ ID NO: 567038 - RNA, 23 nt, Coxiella burnetii RSA 493
uguaaaucauugguuuuugauug

SEQ ID NO: 567039 - RNA, 16 nt, Coxiella burnetii RSA 493
ucuucauuuauuucug

SEQ ID NO: 567040 - RNA, 16 nt, Coxiella burnetii RSA 493
ucuucauauccuuucu

SEQ ID NO: 567041 - RNA, 22 nt, Coxiella burnetii RSA 493
ucuuaagaagagacaaaguuuc

SEQ ID NO: 567042 - RNA, 18 nt, Coxiella burnetii RSA 493
ucuuaaugaaauuucuca

SEQ ID NO: 567043 - RNA, 14 nt, Coxiella burnetii RSA 493
ucuuaauuucuaaa

SEQ ID NO: 567044 - RNA, 20 nt, Coxiella burnetii RSA 493
ucuuaauuucuaaaaaucau

SEQ ID NO: 567045 - RNA, 14 nt, Coxiella burnetii RSA 493
ucuuaauuuuuccu

SEQ ID NO: 567046 - RNA, 19 nt, Coxiella burnetii RSA 493
ucuuaauuuuuccuuucuu

SEQ ID NO: 567047 - RNA, 21 nt, Coxiella burnetii RSA 493
ucuucgauccgucgcuuugcg

SEQ ID NO: 567048 - RNA, 19 nt, Coxiella burnetii RSA 493
ucuucuaaagaauuuuuca

SEQ ID NO: 567049 - RNA, 23 nt, Coxiella burnetii RSA 493
ucuucguuauugggauuuaccuu

SEQ ID NO: 567050 - RNA, 16 nt, Coxiella burnetii RSA 493
ucuucuucauuuauuu

SEQ ID NO: 567051 - RNA, 16 nt, Coxiella burnetii RSA 493
ucuucuucaucuaaau

SEQ ID NO: 567052 - RNA, 18 nt, Coxiella burnetii RSA 493
ucuucuucaucuaaauua

SEQ ID NO: 567053 - RNA, 20 nt, Coxiella burnetii RSA 493
ucuucuuauaaucuuaucaa

SEQ ID NO: 567054 - RNA, 14 nt, Coxiella burnetii RSA 493
ucuucuuuggccgc

SEQ ID NO: 567055 - RNA, 16 nt, Coxiella burnetii RSA 493
ucuucuuuuaagugga

SEQ ID NO: 567056 - RNA, 15 nt, Coxiella burnetii RSA 493
ucuucuuuuuuguaa

SEQ ID NO: 567057 - RNA, 21 nt, Coxiella burnetii RSA 493
ucuucuugcaucugacauucu

SEQ ID NO: 567058 - RNA, 19 nt, Coxiella burnetii RSA 493
ucuugaacggcaaaaccaa

SEQ ID NO: 567059 - RNA, 19 nt, Coxiella burnetii RSA 493
ucuuuagcaauauaacgcu

SEQ ID NO: 567060 - RNA, 17 nt, Coxiella burnetii RSA 493
ucuuuagauucaugaaa

SEQ ID NO: 567061 - RNA, 15 nt, Coxiella burnetii RSA 493
ucuuuaaacugagug

SEQ ID NO: 567062 - RNA, 15 nt, Coxiella burnetii RSA 493
ucuuuaccuccuccc

SEQ ID NO: 567063 - RNA, 20 nt, Coxiella burnetii RSA 493
ucuugucggccggauuuuaa

SEQ ID NO: 567064 - RNA, 22 nt, Coxiella burnetii RSA 493
ucuugucggccggauuuuaauu

SEQ ID NO: 567065 - RNA, 19 nt, Coxiella burnetii RSA 493
ucuuguaaucgcugauacu

SEQ ID NO: 567066 - RNA, 18 nt, Coxiella burnetii RSA 493
ucuugcagugaaauaacc

SEQ ID NO: 567067 - RNA, 21 nt, Coxiella burnetii RSA 493
ucugggagauuuauuccugug

SEQ ID NO: 567068 - RNA, 16 nt, Coxiella burnetii RSA 493
ucugcuuuuauuuaag

SEQ ID NO: 567069 - RNA, 14 nt, Coxiella burnetii RSA 493
ucugcuuccucuuc

SEQ ID NO: 567070 - RNA, 17 nt, Coxiella burnetii RSA 493
ucugugaaauaaacaga

SEQ ID NO: 567071 - RNA, 13 nt, Coxiella burnetii RSA 493
ucugguauuguug

SEQ ID NO: 567072 - RNA, 15 nt, Coxiella burnetii RSA 493
ucuuaaaagacguac

SEQ ID NO: 567073 - RNA, 19 nt, Coxiella burnetii RSA 493
ucuccuuuuguuaauucuu

SEQ ID NO: 567074 - RNA, 15 nt, Coxiella burnetii RSA 493
ucugauggaugaaag

SEQ ID NO: 567075 - RNA, 16 nt, Coxiella burnetii RSA 493
ucugaauuaauuccca

SEQ ID NO: 567076 - RNA, 15 nt, Coxiella burnetii RSA 493
ucugacaguuggcua

SEQ ID NO: 567077 - RNA, 16 nt, Coxiella burnetii RSA 493
ucugaacgcucuucca

SEQ ID NO: 567078 - RNA, 19 nt, Coxiella burnetii RSA 493
ucugccgcugauauuccca

SEQ ID NO: 567079 - RNA, 19 nt, Coxiella burnetii RSA 493
ucugauuuuacgcuauuuu

SEQ ID NO: 567080 - RNA, 22 nt, Coxiella burnetii RSA 493
ucgguuggucggaauugcuaaa

SEQ ID NO: 567081 - RNA, 21 nt, Coxiella burnetii RSA 493
ucgguucaagcacuaguuuua

SEQ ID NO: 567082 - RNA, 19 nt, Coxiella burnetii RSA 493
ucggcauauucugccaucg

SEQ ID NO: 567083 - RNA, 14 nt, Coxiella burnetii RSA 493
ucgucauuuccgug

SEQ ID NO: 567084 - RNA, 22 nt, Coxiella burnetii RSA 493
ucgugcucuuuuuucaaaacuc

SEQ ID NO: 567085 - RNA, 13 nt, Coxiella burnetii RSA 493
ucguuuuggcugc

SEQ ID NO: 567086 - RNA, 20 nt, Coxiella burnetii RSA 493
ucuaacauuuggccaaacua

SEQ ID NO: 567087 - RNA, 20 nt, Coxiella burnetii RSA 493
ucguugcauucaauacagau

SEQ ID NO: 567088 - RNA, 16 nt, Coxiella burnetii RSA 493
ucguugcauaauauuu

SEQ ID NO: 567089 - RNA, 16 nt, Coxiella burnetii RSA 493
ucguugauuaauaaug

SEQ ID NO: 567090 - RNA, 17 nt, Coxiella burnetii RSA 493
ucguguuagggagugaa

SEQ ID NO: 567091 - RNA, 21 nt, Coxiella burnetii RSA 493
ucguuucugguuuccuuucug

SEQ ID NO: 567092 - RNA, 21 nt, Coxiella burnetii RSA 493
ucguugcugagcaaacagcua

SEQ ID NO: 567093 - RNA, 12 nt, Coxiella burnetii RSA 493
ucguuuguaaua

SEQ ID NO: 567094 - RNA, 15 nt, Coxiella burnetii RSA 493
ucguuuguaauaauu

SEQ ID NO: 567095 - RNA, 12 nt, Coxiella burnetii RSA 493
ucuaccguggcc

SEQ ID NO: 567096 - RNA, 15 nt, Coxiella burnetii RSA 493
ucuaccguauuuaau

SEQ ID NO: 567097 - RNA, 15 nt, Coxiella burnetii RSA 493
ucuacagaacuuuuu

SEQ ID NO: 567098 - RNA, 20 nt, Coxiella burnetii RSA 493
ucuacagaacuuuuuuuaau

SEQ ID NO: 567099 - RNA, 23 nt, Coxiella burnetii RSA 493
ucuaaccauaacaaugaauuguc

SEQ ID NO: 567100 - RNA, 16 nt, Coxiella burnetii RSA 493
ucuauuagcugccauu

SEQ ID NO: 567101 - RNA, 19 nt, Coxiella burnetii RSA 493
ucuaucguccccguauuuc

SEQ ID NO: 567102 - RNA, 19 nt, Coxiella burnetii RSA 493
ucuaucgugccaguauuuu

SEQ ID NO: 567103 - RNA, 17 nt, Coxiella burnetii RSA 493
ucuauagcuucaaguuc

SEQ ID NO: 567104 - RNA, 19 nt, Coxiella burnetii RSA 493
ucuauauaagcuuucaaua

SEQ ID NO: 567105 - RNA, 20 nt, Coxiella burnetii RSA 493
ucuauauaagcuuucaauaa

SEQ ID NO: 567106 - RNA, 21 nt, Coxiella burnetii RSA 493
ucuauauaagcuuucaauaaa

SEQ ID NO: 567107 - RNA, 21 nt, Coxiella burnetii RSA 493
ucuauaucuuuuaaauuaaca

SEQ ID NO: 567108 - RNA, 14 nt, Coxiella burnetii RSA 493
ucuaucgaugaagc

SEQ ID NO: 567109 - RNA, 13 nt, Coxiella burnetii RSA 493
ucuauccaauaaa

SEQ ID NO: 567110 - RNA, 13 nt, Coxiella burnetii RSA 493
ucuauaaauaaca

SEQ ID NO: 567111 - RNA, 17 nt, Coxiella burnetii RSA 493
ucuagugugauaaucau

SEQ ID NO: 567112 - RNA, 17 nt, Coxiella burnetii RSA 493
ucuaggaccaaaugcga

SEQ ID NO: 567113 - RNA, 21 nt, Coxiella burnetii RSA 493
ucuagaaaacccacucgguaa

SEQ ID NO: 567114 - RNA, 14 nt, Coxiella burnetii RSA 493
ucuagauuuaaaac

SEQ ID NO: 567115 - RNA, 14 nt, Coxiella burnetii RSA 493
ucuagauuuuccug

SEQ ID NO: 567116 - RNA, 12 nt, Coxiella burnetii RSA 493
ucuccguaauaa

SEQ ID NO: 567117 - RNA, 21 nt, Coxiella burnetii RSA 493
ucuccuugaggaauuuuucaa

SEQ ID NO: 567118 - RNA, 15 nt, Coxiella burnetii RSA 493
ucuccauuuagaaaa

SEQ ID NO: 567119 - RNA, 23 nt, Coxiella burnetii RSA 493
ucucccaacgagcucaaaaguug

SEQ ID NO: 567120 - RNA, 14 nt, Coxiella burnetii RSA 493
ucucaguuaaaaua

SEQ ID NO: 567121 - RNA, 15 nt, Coxiella burnetii RSA 493
ucucaguuaaaauaa

SEQ ID NO: 567122 - RNA, 16 nt, Coxiella burnetii RSA 493
ucucaguuaaaauaau

SEQ ID NO: 567123 - RNA, 18 nt, Coxiella burnetii RSA 493
ucucaguuaaaauaauga

SEQ ID NO: 567124 - RNA, 22 nt, Coxiella burnetii RSA 493
ucucauauauuuaccucuaaaa

SEQ ID NO: 567125 - RNA, 16 nt, Coxiella burnetii RSA 493
ucucaucaucuucaaa

SEQ ID NO: 567126 - RNA, 19 nt, Coxiella burnetii RSA 493
ucucacaacauuccuuucg

SEQ ID NO: 567127 - RNA, 23 nt, Coxiella burnetii RSA 493
ucucaauuucaacgccucucuca

SEQ ID NO: 567128 - RNA, 19 nt, Coxiella burnetii RSA 493
ucucacuuggauuuuauuu

SEQ ID NO: 567129 - RNA, 20 nt, Coxiella burnetii RSA 493
ucgcuaagcgaaaaaugacc

SEQ ID NO: 567130 - RNA, 21 nt, Coxiella burnetii RSA 493
ucgcuaauccuaccgcccgcc

SEQ ID NO: 567131 - RNA, 14 nt, Coxiella burnetii RSA 493
ucgcucuuguuucu

SEQ ID NO: 567132 - RNA, 22 nt, Coxiella burnetii RSA 493
ucgcucgcaagaaucuccacca

SEQ ID NO: 567133 - RNA, 23 nt, Coxiella burnetii RSA 493
ucggaauugcuaaauguuuagcu

SEQ ID NO: 567134 - RNA, 20 nt, Coxiella burnetii RSA 493
ucggaaauuucucucucaua

SEQ ID NO: 567135 - RNA, 13 nt, Coxiella burnetii RSA 493
ucgcuucaauucu

SEQ ID NO: 567136 - RNA, 20 nt, Coxiella burnetii RSA 493
ucgcuucaauucuuuuuaag

SEQ ID NO: 567137 - RNA, 21 nt, Coxiella burnetii RSA 493
ucgcuucaauucuuuuuaaga

SEQ ID NO: 567138 - RNA, 17 nt, Coxiella burnetii RSA 493
ucgcggaaaauuuaaac

SEQ ID NO: 567139 - RNA, 20 nt, Coxiella burnetii RSA 493
ucgcgaaauuuaauaaaauu

SEQ ID NO: 567140 - RNA, 15 nt, Coxiella burnetii RSA 493
uccuguucuuuuucc

SEQ ID NO: 567141 - RNA, 17 nt, Coxiella burnetii RSA 493
uccuguucuuuuuccau

SEQ ID NO: 567142 - RNA, 18 nt, Coxiella burnetii RSA 493
uccuguucuuuuuccaug

SEQ ID NO: 567143 - RNA, 16 nt, Coxiella burnetii RSA 493
ucgaauggccuuacuu

SEQ ID NO: 567144 - RNA, 15 nt, Coxiella burnetii RSA 493
ucgaagcacaguuac

SEQ ID NO: 567145 - RNA, 21 nt, Coxiella burnetii RSA 493
ucgaauuuuugccaauauaaa

SEQ ID NO: 567146 - RNA, 22 nt, Coxiella burnetii RSA 493
ucgacuuugauaaauuaaaaaa

SEQ ID NO: 567147 - RNA, 13 nt, Coxiella burnetii RSA 493
ucgcaaagcucag

SEQ ID NO: 567148 - RNA, 22 nt, Coxiella burnetii RSA 493
ucgcauucuauuagcugccauu

SEQ ID NO: 567149 - RNA, 21 nt, Coxiella burnetii RSA 493
ucgccacuggguuuuccccau

SEQ ID NO: 567150 - RNA, 23 nt, Coxiella burnetii RSA 493
ucgaugggaauuuuugaauacca

SEQ ID NO: 567151 - RNA, 21 nt, Coxiella burnetii RSA 493
ucgauccgagcccaauaacaa

SEQ ID NO: 567152 - RNA, 16 nt, Coxiella burnetii RSA 493
ucgauagaccaaaucc

SEQ ID NO: 567153 - RNA, 23 nt, Coxiella burnetii RSA 493
ucgagcgcgauuuucucuucaac

SEQ ID NO: 567154 - RNA, 15 nt, Coxiella burnetii RSA 493
ucgagcgacuucauu

SEQ ID NO: 567155 - RNA, 16 nt, Coxiella burnetii RSA 493
uccgucaauuuuucag

SEQ ID NO: 567156 - RNA, 19 nt, Coxiella burnetii RSA 493
uccgucaauuuuucuuuuu

SEQ ID NO: 567157 - RNA, 18 nt, Coxiella burnetii RSA 493
uccggguuauauuuaauu

SEQ ID NO: 567158 - RNA, 16 nt, Coxiella burnetii RSA 493
uccggaugucauaauc

SEQ ID NO: 567159 - RNA, 17 nt, Coxiella burnetii RSA 493
uccgcuuuauuuuucgc

SEQ ID NO: 567160 - RNA, 19 nt, Coxiella burnetii RSA 493
uccgccuuuauuagaaaag

SEQ ID NO: 567161 - RNA, 19 nt, Coxiella burnetii RSA 493
uccgcccccguaucaccaa

SEQ ID NO: 567162 - RNA, 20 nt, Coxiella burnetii RSA 493
uccgccgcuugaagcuaaga

SEQ ID NO: 567163 - RNA, 15 nt, Coxiella burnetii RSA 493
uccgccuaaauuaau

SEQ ID NO: 567164 - RNA, 15 nt, Coxiella burnetii RSA 493
uccucucucucacaa

SEQ ID NO: 567165 - RNA, 17 nt, Coxiella burnetii RSA 493
uccucucucucacaaaa

SEQ ID NO: 567166 - RNA, 21 nt, Coxiella burnetii RSA 493
uccucuauauaagcuuucaau

SEQ ID NO: 567167 - RNA, 16 nt, Coxiella burnetii RSA 493
uccucguuuuggcugc

SEQ ID NO: 567168 - RNA, 15 nt, Coxiella burnetii RSA 493
uccugaaaaauaauu

SEQ ID NO: 567169 - RNA, 20 nt, Coxiella burnetii RSA 493
uccuggccugaucauaaagc

SEQ ID NO: 567170 - RNA, 14 nt, Coxiella burnetii RSA 493
uccucaacgguaug

SEQ ID NO: 567171 - RNA, 23 nt, Coxiella burnetii RSA 493
uccucacgauagccagcaauauc

SEQ ID NO: 567172 - RNA, 20 nt, Coxiella burnetii RSA 493
uccuauccccaaagguguca

SEQ ID NO: 567173 - RNA, 22 nt, Coxiella burnetii RSA 493
uccuauccccaaaggugucaaa

SEQ ID NO: 567174 - RNA, 21 nt, Coxiella burnetii RSA 493
uccuccccaucaguuggcugu

SEQ ID NO: 567175 - RNA, 15 nt, Coxiella burnetii RSA 493
uccuccccacucucu

SEQ ID NO: 567176 - RNA, 17 nt, Coxiella burnetii RSA 493
uccuccccacucucuuu

SEQ ID NO: 567177 - RNA, 18 nt, Coxiella burnetii RSA 493
uccguucggaaacaaagg

SEQ ID NO: 567178 - RNA, 23 nt, Coxiella burnetii RSA 493
uccguuacaucgguuuuuccguu

SEQ ID NO: 567179 - RNA, 16 nt, Coxiella burnetii RSA 493
uccuaagcuuucuccc

SEQ ID NO: 567180 - RNA, 17 nt, Coxiella burnetii RSA 493
uccuaauaaaaauauua

SEQ ID NO: 567181 - RNA, 11 nt, Coxiella burnetii RSA 493
uccuaaaauga

SEQ ID NO: 567182 - RNA, 15 nt, Coxiella burnetii RSA 493
uccccguauuucgcu

SEQ ID NO: 567183 - RNA, 14 nt, Coxiella burnetii RSA 493
ucccgauuccagcc

SEQ ID NO: 567184 - RNA, 15 nt, Coxiella burnetii RSA 493
ucccgccuacccuuu

SEQ ID NO: 567185 - RNA, 20 nt, Coxiella burnetii RSA 493
ucccggauaaaguguugucg

SEQ ID NO: 567186 - RNA, 21 nt, Coxiella burnetii RSA 493
ucccgcuugcacgggaaugac

SEQ ID NO: 567187 - RNA, 14 nt, Coxiella burnetii RSA 493
ucccucugcagcag

SEQ ID NO: 567188 - RNA, 15 nt, Coxiella burnetii RSA 493
ucccucugcagcagg

SEQ ID NO: 567189 - RNA, 19 nt, Coxiella burnetii RSA 493
ucccuccuuuugaggucua

SEQ ID NO: 567190 - RNA, 17 nt, Coxiella burnetii RSA 493
ucccuuuuaauuuaggc

SEQ ID NO: 567191 - RNA, 13 nt, Coxiella burnetii RSA 493
uccgacauucuuc

SEQ ID NO: 567192 - RNA, 18 nt, Coxiella burnetii RSA 493
uccgaucauuaccccauc

SEQ ID NO: 567193 - RNA, 21 nt, Coxiella burnetii RSA 493
uccgagcccaauaacaagcuc

SEQ ID NO: 567194 - RNA, 18 nt, Coxiella burnetii RSA 493
uccccgaaggcgccuaau

SEQ ID NO: 567195 - RNA, 18 nt, Coxiella burnetii RSA 493
uccccaucaguuggcugu

SEQ ID NO: 567196 - RNA, 20 nt, Coxiella burnetii RSA 493
ucccagcuuuccguaaaaca

SEQ ID NO: 567197 - RNA, 16 nt, Coxiella burnetii RSA 493
ucccaggaaagaaaau

SEQ ID NO: 567198 - RNA, 20 nt, Coxiella burnetii RSA 493
ucccaggaaagaaaaugagu

SEQ ID NO: 567199 - RNA, 13 nt, Coxiella burnetii RSA 493
ucccauaacaagg

SEQ ID NO: 567200 - RNA, 18 nt, Coxiella burnetii RSA 493
ucccaugacgauuuuaau

SEQ ID NO: 567201 - RNA, 15 nt, Coxiella burnetii RSA 493
uccccaaaguuucac

SEQ ID NO: 567202 - RNA, 16 nt, Coxiella burnetii RSA 493
uccccaauuuauucaa

SEQ ID NO: 567203 - RNA, 13 nt, Coxiella burnetii RSA 493
uccaucuccuuuu

SEQ ID NO: 567204 - RNA, 18 nt, Coxiella burnetii RSA 493
uccaugaggccaaaaauu

SEQ ID NO: 567205 - RNA, 22 nt, Coxiella burnetii RSA 493
uccauucgcguuuuuaaaugaa

SEQ ID NO: 567206 - RNA, 13 nt, Coxiella burnetii RSA 493
uccauucuuucau

SEQ ID NO: 567207 - RNA, 15 nt, Coxiella burnetii RSA 493
uccauucuuucauua

SEQ ID NO: 567208 - RNA, 15 nt, Coxiella burnetii RSA 493
uccauuaauuucuuu

SEQ ID NO: 567209 - RNA, 15 nt, Coxiella burnetii RSA 493
uccauuacauaauuu

SEQ ID NO: 567210 - RNA, 14 nt, Coxiella burnetii RSA 493
uccaugucuugaac

SEQ ID NO: 567211 - RNA, 14 nt, Coxiella burnetii RSA 493
uccauuuagaaaaa

SEQ ID NO: 567212 - RNA, 19 nt, Coxiella burnetii RSA 493
ucccaauuucuuuucuaaa

SEQ ID NO: 567213 - RNA, 15 nt, Coxiella burnetii RSA 493
ucccacaaaauaccc

SEQ ID NO: 567214 - RNA, 19 nt, Coxiella burnetii RSA 493
uccauccggaugucauaau

SEQ ID NO: 567215 - RNA, 16 nt, Coxiella burnetii RSA 493
uccauacuaauuucag

SEQ ID NO: 567216 - RNA, 16 nt, Coxiella burnetii RSA 493
uccagguguuuuucaa

SEQ ID NO: 567217 - RNA, 17 nt, Coxiella burnetii RSA 493
uccagucguuuuuuaau

SEQ ID NO: 567218 - RNA, 13 nt, Coxiella burnetii RSA 493
uccaggaauugca

SEQ ID NO: 567219 - RNA, 21 nt, Coxiella burnetii RSA 493
uccagcccccucuacaauaaa

SEQ ID NO: 567220 - RNA, 17 nt, Coxiella burnetii RSA 493
uccagccgaagcgcggc

SEQ ID NO: 567221 - RNA, 14 nt, Coxiella burnetii RSA 493
uccagcaguaauga

SEQ ID NO: 567222 - RNA, 18 nt, Coxiella burnetii RSA 493
uccagcaguuuuuuacuu

SEQ ID NO: 567223 - RNA, 17 nt, Coxiella burnetii RSA 493
uccacggaguuuucauu

SEQ ID NO: 567224 - RNA, 14 nt, Coxiella burnetii RSA 493
uccacuuucucgcu

SEQ ID NO: 567225 - RNA, 19 nt, Coxiella burnetii RSA 493
uccacaaugcauuugcgcu

SEQ ID NO: 567226 - RNA, 16 nt, Coxiella burnetii RSA 493
uccaacuuccuaucaa

SEQ ID NO: 567227 - RNA, 14 nt, Coxiella burnetii RSA 493
uccaagauuuuuuu

SEQ ID NO: 567228 - RNA, 18 nt, Coxiella burnetii RSA 493
uccaagauuuuuuuaagu

SEQ ID NO: 567229 - RNA, 19 nt, Coxiella burnetii RSA 493
uccaagauuuuuuuaaguu

SEQ ID NO: 567230 - RNA, 21 nt, Coxiella burnetii RSA 493
uccaauaauugcugaacaaaa

SEQ ID NO: 567231 - RNA, 14 nt, Coxiella burnetii RSA 493
uccaauuauaacua

SEQ ID NO: 567232 - RNA, 16 nt, Coxiella burnetii RSA 493
uccaauuauaacuauu

SEQ ID NO: 567233 - RNA, 17 nt, Coxiella burnetii RSA 493
uccaauuauaacuauuu

SEQ ID NO: 567234 - RNA, 19 nt, Coxiella burnetii RSA 493
uccaauuguuugaaaaaau

SEQ ID NO: 567235 - RNA, 17 nt, Coxiella burnetii RSA 493
ucagcggggagauuaaa

SEQ ID NO: 567236 - RNA, 20 nt, Coxiella burnetii RSA 493
ucagcggggagauuaaaaau

SEQ ID NO: 567237 - RNA, 19 nt, Coxiella burnetii RSA 493
ucaggacacauuuuuucaa

SEQ ID NO: 567238 - RNA, 18 nt, Coxiella burnetii RSA 493
ucaggaagcaaaguaggu

SEQ ID NO: 567239 - RNA, 22 nt, Coxiella burnetii RSA 493
ucagcugguagagcacaaccuu

SEQ ID NO: 567240 - RNA, 15 nt, Coxiella burnetii RSA 493
ucaggcaauuuugau

SEQ ID NO: 567241 - RNA, 12 nt, Coxiella burnetii RSA 493
ucaguuaaaaua

SEQ ID NO: 567242 - RNA, 20 nt, Coxiella burnetii RSA 493
ucaguuggcucauuguuaau

SEQ ID NO: 567243 - RNA, 12 nt, Coxiella burnetii RSA 493
ucaguuggcugu

SEQ ID NO: 567244 - RNA, 18 nt, Coxiella burnetii RSA 493
ucaguugucauguaauca

SEQ ID NO: 567245 - RNA, 23 nt, Coxiella burnetii RSA 493
ucagucugucguuucugauuuuu

SEQ ID NO: 567246 - RNA, 18 nt, Coxiella burnetii RSA 493
ucaguguaacacggccuu

SEQ ID NO: 567247 - RNA, 20 nt, Coxiella burnetii RSA 493
ucaguaaaaacauccuccau

SEQ ID NO: 567248 - RNA, 15 nt, Coxiella burnetii RSA 493
ucaguaauuucucga

SEQ ID NO: 567249 - RNA, 17 nt, Coxiella burnetii RSA 493
ucauacgggcuacuugu

SEQ ID NO: 567250 - RNA, 17 nt, Coxiella burnetii RSA 493
ucauacuuaauuucgcu

SEQ ID NO: 567251 - RNA, 17 nt, Coxiella burnetii RSA 493
ucauagguuuuuuuaaa

SEQ ID NO: 567252 - RNA, 20 nt, Coxiella burnetii RSA 493
ucauagguuuuuuuaaacgu

SEQ ID NO: 567253 - RNA, 20 nt, Coxiella burnetii RSA 493
ucauaaucaaaaucagaaac

SEQ ID NO: 567254 - RNA, 16 nt, Coxiella burnetii RSA 493
ucauaauuuuauaaag

SEQ ID NO: 567255 - RNA, 18 nt, Coxiella burnetii RSA 493
ucaucaauauauucgcua

SEQ ID NO: 567256 - RNA, 18 nt, Coxiella burnetii RSA 493
ucaucaaacuugccuuga

SEQ ID NO: 567257 - RNA, 18 nt, Coxiella burnetii RSA 493
ucauaucuuuuucaauua

SEQ ID NO: 567258 - RNA, 14 nt, Coxiella burnetii RSA 493
ucauauauuuaccu

SEQ ID NO: 567259 - RNA, 16 nt, Coxiella burnetii RSA 493
ucaucauuuuccaaaa

SEQ ID NO: 567260 - RNA, 19 nt, Coxiella burnetii RSA 493
ucaucauuuugauacgcua

SEQ ID NO: 567261 - RNA, 19 nt, Coxiella burnetii RSA 493
ucauccaaaauaugauaag

SEQ ID NO: 567262 - RNA, 19 nt, Coxiella burnetii RSA 493
ucauccaaaauuugagguu

SEQ ID NO: 567263 - RNA, 17 nt, Coxiella burnetii RSA 493
ucauccagugaaaaccc

SEQ ID NO: 567264 - RNA, 18 nt, Coxiella burnetii RSA 493
ucauccagugaaaacccg

SEQ ID NO: 567265 - RNA, 23 nt, Coxiella burnetii RSA 493
ucauccucguauuccgcuucgcu

SEQ ID NO: 567266 - RNA, 19 nt, Coxiella burnetii RSA 493
ucaucgcauacagcggaac

SEQ ID NO: 567267 - RNA, 15 nt, Coxiella burnetii RSA 493
ucaucuccuuuugcu

SEQ ID NO: 567268 - RNA, 14 nt, Coxiella burnetii RSA 493
ucaucuucaaaacc

SEQ ID NO: 567269 - RNA, 15 nt, Coxiella burnetii RSA 493
ucaugaaaaguaaau

SEQ ID NO: 567270 - RNA, 20 nt, Coxiella burnetii RSA 493
ucaugaaaaguaaauuuaua

SEQ ID NO: 567271 - RNA, 23 nt, Coxiella burnetii RSA 493
ucaugcaaaaaccgacgccauuu

SEQ ID NO: 567272 - RNA, 14 nt, Coxiella burnetii RSA 493
ucaugcauuugauu

SEQ ID NO: 567273 - RNA, 15 nt, Coxiella burnetii RSA 493
uccaacacguauuuu

SEQ ID NO: 567274 - RNA, 16 nt, Coxiella burnetii RSA 493
uccaacacguauuuuc

SEQ ID NO: 567275 - RNA, 16 nt, Coxiella burnetii RSA 493
uccaacauauggccca

SEQ ID NO: 567276 - RNA, 16 nt, Coxiella burnetii RSA 493
uccaacgguucucaaa

SEQ ID NO: 567277 - RNA, 14 nt, Coxiella burnetii RSA 493
uccaaauagauggu

SEQ ID NO: 567278 - RNA, 19 nt, Coxiella burnetii RSA 493
uccaaaauuugagguugaa

SEQ ID NO: 567279 - RNA, 14 nt, Coxiella burnetii RSA 493
uccaaaaagauaau

SEQ ID NO: 567280 - RNA, 16 nt, Coxiella burnetii RSA 493
uccaaaaauuucauuu

SEQ ID NO: 567281 - RNA, 20 nt, Coxiella burnetii RSA 493
uccaaaaauuucauuuaaua

SEQ ID NO: 567282 - RNA, 21 nt, Coxiella burnetii RSA 493
ucauugggccauuuaacaaaa

SEQ ID NO: 567283 - RNA, 16 nt, Coxiella burnetii RSA 493
ucauugguuuuugauu

SEQ ID NO: 567284 - RNA, 15 nt, Coxiella burnetii RSA 493
ucauuuaauuuuaaa

SEQ ID NO: 567285 - RNA, 14 nt, Coxiella burnetii RSA 493
ucauuguuaaucca

SEQ ID NO: 567286 - RNA, 21 nt, Coxiella burnetii RSA 493
ucauuuccugaaccuaaauua

SEQ ID NO: 567287 - RNA, 19 nt, Coxiella burnetii RSA 493
ucauuugggucuccguaau

SEQ ID NO: 567288 - RNA, 15 nt, Coxiella burnetii RSA 493
ucauuuguucuauca

SEQ ID NO: 567289 - RNA, 15 nt, Coxiella burnetii RSA 493
ucauuuucacuauuu

SEQ ID NO: 567290 - RNA, 12 nt, Coxiella burnetii RSA 493
ucauuuucucua

SEQ ID NO: 567291 - RNA, 21 nt, Coxiella burnetii RSA 493
ucauuuugauacgcuaaccac

SEQ ID NO: 567292 - RNA, 14 nt, Coxiella burnetii RSA 493
ucauuuugauuuuu

SEQ ID NO: 567293 - RNA, 17 nt, Coxiella burnetii RSA 493
ucauuuuuaugcuucaa

SEQ ID NO: 567294 - RNA, 13 nt, Coxiella burnetii RSA 493
ucauugccaaaga

SEQ ID NO: 567295 - RNA, 18 nt, Coxiella burnetii RSA 493
ucauugaagaauuuguuu

SEQ ID NO: 567296 - RNA, 16 nt, Coxiella burnetii RSA 493
ucauugacagccagca

SEQ ID NO: 567297 - RNA, 22 nt, Coxiella burnetii RSA 493
ucauugagcgggauauuuuuua

SEQ ID NO: 567298 - RNA, 13 nt, Coxiella burnetii RSA 493
ucauugaaaucug

SEQ ID NO: 567299 - RNA, 19 nt, Coxiella burnetii RSA 493
ucauucauuucaauauuuc

SEQ ID NO: 567300 - RNA, 17 nt, Coxiella burnetii RSA 493
ucauucgggcauacgau

SEQ ID NO: 567301 - RNA, 18 nt, Coxiella burnetii RSA 493
ucauucgggcauacgaua

SEQ ID NO: 567302 - RNA, 15 nt, Coxiella burnetii RSA 493
ucauucgcuuuuuug

SEQ ID NO: 567303 - RNA, 17 nt, Coxiella burnetii RSA 493
ucauucgcuuuuuugcu

SEQ ID NO: 567304 - RNA, 20 nt, Coxiella burnetii RSA 493
ucauuaucaugcauuugauu

SEQ ID NO: 567305 - RNA, 21 nt, Coxiella burnetii RSA 493
ucauuaucucuuaaaauuccg

SEQ ID NO: 567306 - RNA, 11 nt, Coxiella burnetii RSA 493
ucaugggaugu

SEQ ID NO: 567307 - RNA, 17 nt, Coxiella burnetii RSA 493
ucaugggguaaaauauc

SEQ ID NO: 567308 - RNA, 22 nt, Coxiella burnetii RSA 493
ucauggcuuguuccgccauuuc

SEQ ID NO: 567309 - RNA, 18 nt, Coxiella burnetii RSA 493
ucauuaagcaauuuuuua

SEQ ID NO: 567310 - RNA, 19 nt, Coxiella burnetii RSA 493
ucauuaagcaauuuuuuau

SEQ ID NO: 567311 - RNA, 21 nt, Coxiella burnetii RSA 493
ucauuaauccaguuuuuuaac

SEQ ID NO: 567312 - RNA, 20 nt, Coxiella burnetii RSA 493
ucauuaaugcgucgaagcau

SEQ ID NO: 567313 - RNA, 13 nt, Coxiella burnetii RSA 493
ggaauuuuuugcg

SEQ ID NO: 567314 - RNA, 20 nt, Coxiella burnetii RSA 493
ggaaucgcggacaauaagag

SEQ ID NO: 567315 - RNA, 12 nt, Coxiella burnetii RSA 493
ggaaguucuauu

SEQ ID NO: 567316 - RNA, 22 nt, Coxiella burnetii RSA 493
ggaaguuguucggaauauaauu

SEQ ID NO: 567317 - RNA, 17 nt, Coxiella burnetii RSA 493
ggaccguuaugaaaaca

SEQ ID NO: 567318 - RNA, 20 nt, Coxiella burnetii RSA 493
ggaccgcaugguccaaaaaa

SEQ ID NO: 567319 - RNA, 23 nt, Coxiella burnetii RSA 493
ggacaaguucuuugccacccccu

SEQ ID NO: 567320 - RNA, 14 nt, Coxiella burnetii RSA 493
ggacgauagauggc

SEQ ID NO: 567321 - RNA, 15 nt, Coxiella burnetii RSA 493
ggaguaaugacagaa

SEQ ID NO: 567322 - RNA, 18 nt, Coxiella burnetii RSA 493
ggauacgaccuucugaau

SEQ ID NO: 567323 - RNA, 15 nt, Coxiella burnetii RSA 493
ggauuguaaacagac

SEQ ID NO: 567324 - RNA, 12 nt, Coxiella burnetii RSA 493
ggaugaugcauu

SEQ ID NO: 567325 - RNA, 19 nt, Coxiella burnetii RSA 493
ggcaaauguugauaauaaa

SEQ ID NO: 567326 - RNA, 17 nt, Coxiella burnetii RSA 493
ggcaaaaaaagaaaauc

SEQ ID NO: 567327 - RNA, 19 nt, Coxiella burnetii RSA 493
ggcaaagccgcuauuucua

SEQ ID NO: 567328 - RNA, 22 nt, Coxiella burnetii RSA 493
ggcaaucagaaugcugauaauu

SEQ ID NO: 567329 - RNA, 21 nt, Coxiella burnetii RSA 493
ggcacaaaaaaauuauuuuua

SEQ ID NO: 567330 - RNA, 15 nt, Coxiella burnetii RSA 493
ggcaauuugugaaau

SEQ ID NO: 567331 - RNA, 16 nt, Coxiella burnetii RSA 493
ggcaucuuuuucuccu

SEQ ID NO: 567332 - RNA, 19 nt, Coxiella burnetii RSA 493
ggcaucaacggaaaaacaa

SEQ ID NO: 567333 - RNA, 17 nt, Coxiella burnetii RSA 493
ggccaauuucuaaucuc

SEQ ID NO: 567334 - RNA, 15 nt, Coxiella burnetii RSA 493
ggccccgucaucguc

SEQ ID NO: 567335 - RNA, 17 nt, Coxiella burnetii RSA 493
ggccguaucuauuugca

SEQ ID NO: 567336 - RNA, 16 nt, Coxiella burnetii RSA 493
ggcuaauaggaaaaau

SEQ ID NO: 567337 - RNA, 18 nt, Coxiella burnetii RSA 493
ggcuaauaggaaaaauga

SEQ ID NO: 567338 - RNA, 13 nt, Coxiella burnetii RSA 493
ggcuaauuuuccu

SEQ ID NO: 567339 - RNA, 20 nt, Coxiella burnetii RSA 493
ggcuacguuguccugauuua

SEQ ID NO: 567340 - RNA, 14 nt, Coxiella burnetii RSA 493
ggcuacuuccuucu

SEQ ID NO: 567341 - RNA, 12 nt, Coxiella burnetii RSA 493
ggcuaaagguuu

SEQ ID NO: 567342 - RNA, 16 nt, Coxiella burnetii RSA 493
ggcuaaagguuucaaa

SEQ ID NO: 567343 - RNA, 18 nt, Coxiella burnetii RSA 493
ggcguccuguugauacua

SEQ ID NO: 567344 - RNA, 21 nt, Coxiella burnetii RSA 493
ggccuucgauagcgcaguaag

SEQ ID NO: 567345 - RNA, 23 nt, Coxiella burnetii RSA 493
ggcgaacagccgaugacaaauaa

SEQ ID NO: 567346 - RNA, 21 nt, Coxiella burnetii RSA 493
ggcgaagucgggugauugaaa

SEQ ID NO: 567347 - RNA, 21 nt, Coxiella burnetii RSA 493
ggcucaugaaaaugaaugagu

SEQ ID NO: 567348 - RNA, 19 nt, Coxiella burnetii RSA 493
ggcucagugauuaaauugc

SEQ ID NO: 567349 - RNA, 15 nt, Coxiella burnetii RSA 493
ggcuuaaguuuuuga

SEQ ID NO: 567350 - RNA, 17 nt, Coxiella burnetii RSA 493
ggcuuaaguuuuugaua

SEQ ID NO: 567351 - RNA, 19 nt, Coxiella burnetii RSA 493
ggcuuaaugcgaaaaauga

SEQ ID NO: 567352 - RNA, 18 nt, Coxiella burnetii RSA 493
ggcuguucgccagaaaca

SEQ ID NO: 567353 - RNA, 22 nt, Coxiella burnetii RSA 493
ggcuguucgccagaaacaacua

SEQ ID NO: 567354 - RNA, 21 nt, Coxiella burnetii RSA 493
ggcuuguuuaagugacagcuc

SEQ ID NO: 567355 - RNA, 18 nt, Coxiella burnetii RSA 493
ggcuuuuucaagcuuuug

SEQ ID NO: 567356 - RNA, 17 nt, Coxiella burnetii RSA 493
ggcuucuaaguaaacag

SEQ ID NO: 567357 - RNA, 17 nt, Coxiella burnetii RSA 493
ggcugcuagaaguauuu

SEQ ID NO: 567358 - RNA, 18 nt, Coxiella burnetii RSA 493
gggagucggugacgagga

SEQ ID NO: 567359 - RNA, 23 nt, Coxiella burnetii RSA 493
gggagguuaaaauggugaaaagc

SEQ ID NO: 567360 - RNA, 23 nt, Coxiella burnetii RSA 493
gggaucguuucugguuuccuuuc

SEQ ID NO: 567361 - RNA, 13 nt, Coxiella burnetii RSA 493
gggcgcacucaac

SEQ ID NO: 567362 - RNA, 19 nt, Coxiella burnetii RSA 493
gggcgauuggcgcaucaaa

SEQ ID NO: 567363 - RNA, 13 nt, Coxiella burnetii RSA 493
gguaaaaaacuaa

SEQ ID NO: 567364 - RNA, 19 nt, Coxiella burnetii RSA 493
gguaaagagggacuauaaa

SEQ ID NO: 567365 - RNA, 23 nt, Coxiella burnetii RSA 493
gguaacauacgacuucauuucua

SEQ ID NO: 567366 - RNA, 14 nt, Coxiella burnetii RSA 493
gguaaaaaaauagu

SEQ ID NO: 567367 - RNA, 18 nt, Coxiella burnetii RSA 493
ggguuguccuuggaacaa

SEQ ID NO: 567368 - RNA, 19 nt, Coxiella burnetii RSA 493
ggguuguccuuggaacaaa

SEQ ID NO: 567369 - RNA, 13 nt, Coxiella burnetii RSA 493
ggguuaaggaaaa

SEQ ID NO: 567370 - RNA, 23 nt, Coxiella burnetii RSA 493
ggguuacguuauaauuucuuuuu

SEQ ID NO: 567371 - RNA, 17 nt, Coxiella burnetii RSA 493
ggguuaucccgagaucc

SEQ ID NO: 567372 - RNA, 13 nt, Coxiella burnetii RSA 493
gggugagaagaau

SEQ ID NO: 567373 - RNA, 13 nt, Coxiella burnetii RSA 493
gggucuuuuuuuc

SEQ ID NO: 567374 - RNA, 22 nt, Coxiella burnetii RSA 493
gguagagcccgucauguaauuu

SEQ ID NO: 567375 - RNA, 23 nt, Coxiella burnetii RSA 493
gguacgaaccacuggaaucaauc

SEQ ID NO: 567376 - RNA, 20 nt, Coxiella burnetii RSA 493
gguaauaaaguaauuuuaaa

SEQ ID NO: 567377 - RNA, 21 nt, Coxiella burnetii RSA 493
ggugauaaugagaucaaagcg

SEQ ID NO: 567378 - RNA, 12 nt, Coxiella burnetii RSA 493
ggugacgaggaa

SEQ ID NO: 567379 - RNA, 14 nt, Coxiella burnetii RSA 493
ggucgcauucuauu

SEQ ID NO: 567380 - RNA, 16 nt, Coxiella burnetii RSA 493
ggucggcaccaaaauc

SEQ ID NO: 567381 - RNA, 20 nt, Coxiella burnetii RSA 493
ggugcgaauaacaaagacuu

SEQ ID NO: 567382 - RNA, 12 nt, Coxiella burnetii RSA 493
gguggaacaaua

SEQ ID NO: 567383 - RNA, 23 nt, Coxiella burnetii RSA 493
guaauccuuguugaauuccuugu

SEQ ID NO: 567384 - RNA, 21 nt, Coxiella burnetii RSA 493
guaauaaaguaauuuuaaaaa

SEQ ID NO: 567385 - RNA, 16 nt, Coxiella burnetii RSA 493
guaagucugaacaggc

SEQ ID NO: 567386 - RNA, 14 nt, Coxiella burnetii RSA 493
guaaccaaaacuau

SEQ ID NO: 567387 - RNA, 17 nt, Coxiella burnetii RSA 493
guaacccuuucauuuaa

SEQ ID NO: 567388 - RNA, 22 nt, Coxiella burnetii RSA 493
guaacccuuucauuuaauuuua

SEQ ID NO: 567389 - RNA, 22 nt, Coxiella burnetii RSA 493
guaacgauggucaaaccaauca

SEQ ID NO: 567390 - RNA, 12 nt, Coxiella burnetii RSA 493
guaacgauuucu

SEQ ID NO: 567391 - RNA, 15 nt, Coxiella burnetii RSA 493
guaacgauuucucuu

SEQ ID NO: 567392 - RNA, 13 nt, Coxiella burnetii RSA 493
guaacuuuuccau

SEQ ID NO: 567393 - RNA, 12 nt, Coxiella burnetii RSA 493
gguuaacucuuu

SEQ ID NO: 567394 - RNA, 23 nt, Coxiella burnetii RSA 493
gguuaacagcggcaguuucuggc

SEQ ID NO: 567395 - RNA, 23 nt, Coxiella burnetii RSA 493
guaaaauuccaccggcgucugaa

SEQ ID NO: 567396 - RNA, 14 nt, Coxiella burnetii RSA 493
guaaauuuucccau

SEQ ID NO: 567397 - RNA, 13 nt, Coxiella burnetii RSA 493
guaaauuuugccc

SEQ ID NO: 567398 - RNA, 23 nt, Coxiella burnetii RSA 493
guaaauuucguugauuaauaaug

SEQ ID NO: 567399 - RNA, 15 nt, Coxiella burnetii RSA 493
guaaaucguuuuacc

SEQ ID NO: 567400 - RNA, 14 nt, Coxiella burnetii RSA 493
guaaauguuucuuu

SEQ ID NO: 567401 - RNA, 18 nt, Coxiella burnetii RSA 493
guaaauguuucuuuuaua

SEQ ID NO: 567402 - RNA, 21 nt, Coxiella burnetii RSA 493
guaaauguuucuuuuauaaaa

SEQ ID NO: 567403 - RNA, 19 nt, Coxiella burnetii RSA 493
guaaauggcuuuuuucuua

SEQ ID NO: 567404 - RNA, 22 nt, Coxiella burnetii RSA 493
guaaaguugccgguauuuugca

SEQ ID NO: 567405 - RNA, 23 nt, Coxiella burnetii RSA 493
guaaaguugccgguauuuugcaa

SEQ ID NO: 567406 - RNA, 22 nt, Coxiella burnetii RSA 493
guaaauaaucauuuuuaugcuu

SEQ ID NO: 567407 - RNA, 13 nt, Coxiella burnetii RSA 493
guaaauauuuuua

SEQ ID NO: 567408 - RNA, 20 nt, Coxiella burnetii RSA 493
guaccgaagaauaaugaacg

SEQ ID NO: 567409 - RNA, 17 nt, Coxiella burnetii RSA 493
guaauggucguugcaua

SEQ ID NO: 567410 - RNA, 23 nt, Coxiella burnetii RSA 493
guaaucucacuuggauuuuauuu

SEQ ID NO: 567411 - RNA, 18 nt, Coxiella burnetii RSA 493
guaaucgcugauacuucu

SEQ ID NO: 567412 - RNA, 19 nt, Coxiella burnetii RSA 493
guaaucgcugauacuucuu

SEQ ID NO: 567413 - RNA, 15 nt, Coxiella burnetii RSA 493
guaaucgcgggauca

SEQ ID NO: 567414 - RNA, 23 nt, Coxiella burnetii RSA 493
guacucagcuuuccccccaacua

SEQ ID NO: 567415 - RNA, 16 nt, Coxiella burnetii RSA 493
guagcucuuaaaagac

SEQ ID NO: 567416 - RNA, 21 nt, Coxiella burnetii RSA 493
guaggccuaaaguacccaaca

SEQ ID NO: 567417 - RNA, 12 nt, Coxiella burnetii RSA 493
guagucaggaag

SEQ ID NO: 567418 - RNA, 16 nt, Coxiella burnetii RSA 493
guaguaugagcggcaa

SEQ ID NO: 567419 - RNA, 15 nt, Coxiella burnetii RSA 493
guaggugauaaugag

SEQ ID NO: 567420 - RNA, 15 nt, Coxiella burnetii RSA 493
gucaaaaccccccgc

SEQ ID NO: 567421 - RNA, 14 nt, Coxiella burnetii RSA 493
guauauuugcaguu

SEQ ID NO: 567422 - RNA, 16 nt, Coxiella burnetii RSA 493
guauaccaaaaagcgu

SEQ ID NO: 567423 - RNA, 19 nt, Coxiella burnetii RSA 493
gucacuauuaaucauucuc

SEQ ID NO: 567424 - RNA, 17 nt, Coxiella burnetii RSA 493
gucacuccggguuuucc

SEQ ID NO: 567425 - RNA, 14 nt, Coxiella burnetii RSA 493
gucaauuuaccucc

SEQ ID NO: 567426 - RNA, 15 nt, Coxiella burnetii RSA 493
gucaauuuaccucca

SEQ ID NO: 567427 - RNA, 23 nt, Coxiella burnetii RSA 493
gucaauuuuucagucuggccugc

SEQ ID NO: 567428 - RNA, 16 nt, Coxiella burnetii RSA 493
gucaauuucaaugacu

SEQ ID NO: 567429 - RNA, 19 nt, Coxiella burnetii RSA 493
gucaauuucaaugacuuua

SEQ ID NO: 567430 - RNA, 20 nt, Coxiella burnetii RSA 493
gucacaaauaaagcagcaau

SEQ ID NO: 567431 - RNA, 14 nt, Coxiella burnetii RSA 493
gucauaaagguuuu

SEQ ID NO: 567432 - RNA, 22 nt, Coxiella burnetii RSA 493
gucaugaucgguuuuuugacug

SEQ ID NO: 567433 - RNA, 13 nt, Coxiella burnetii RSA 493
gucaugaaauaaa

SEQ ID NO: 567434 - RNA, 18 nt, Coxiella burnetii RSA 493
gucccgcuuaaacccaga

SEQ ID NO: 567435 - RNA, 22 nt, Coxiella burnetii RSA 493
guccuaaaauacuuaaaauuuc

SEQ ID NO: 567436 - RNA, 14 nt, Coxiella burnetii RSA 493
guccuaaaaugaua

SEQ ID NO: 567437 - RNA, 15 nt, Coxiella burnetii RSA 493
guccuaagcuuucuc

SEQ ID NO: 567438 - RNA, 16 nt, Coxiella burnetii RSA 493
gucauuuguucuauca

SEQ ID NO: 567439 - RNA, 18 nt, Coxiella burnetii RSA 493
gucauuuuuuauaaaauu

SEQ ID NO: 567440 - RNA, 15 nt, Coxiella burnetii RSA 493
guccccaaaguuuca

SEQ ID NO: 567441 - RNA, 22 nt, Coxiella burnetii RSA 493
guccuuaucacuagcuauucuu

SEQ ID NO: 567442 - RNA, 18 nt, Coxiella burnetii RSA 493
guccuguucuuuuuccau

SEQ ID NO: 567443 - RNA, 16 nt, Coxiella burnetii RSA 493
guccuugcugaauucc

SEQ ID NO: 567444 - RNA, 20 nt, Coxiella burnetii RSA 493
gucgaucaaagucaugaucg

SEQ ID NO: 567445 - RNA, 14 nt, Coxiella burnetii RSA 493
gucgcaauuugaug

SEQ ID NO: 567446 - RNA, 21 nt, Coxiella burnetii RSA 493
gucgcaauuugaugccauaau

SEQ ID NO: 567447 - RNA, 23 nt, Coxiella burnetii RSA 493
gucgcauagccaaccgccauuuc

SEQ ID NO: 567448 - RNA, 19 nt, Coxiella burnetii RSA 493
gucgccucaguaauuucuc

SEQ ID NO: 567449 - RNA, 20 nt, Coxiella burnetii RSA 493
gucgccucaguaauuucucg

SEQ ID NO: 567450 - RNA, 17 nt, Coxiella burnetii RSA 493
gucgcauucuauuagcu

SEQ ID NO: 567451 - RNA, 23 nt, Coxiella burnetii RSA 493
gugauuaaauugcucuuuuucca

SEQ ID NO: 567452 - RNA, 15 nt, Coxiella burnetii RSA 493
gugauucauuaucau

SEQ ID NO: 567453 - RNA, 19 nt, Coxiella burnetii RSA 493
gugaugggauaaaaaaccc

SEQ ID NO: 567454 - RNA, 23 nt, Coxiella burnetii RSA 493
gugcuauucccgccaucaccaca

SEQ ID NO: 567455 - RNA, 16 nt, Coxiella burnetii RSA 493
gugcguaagcaaacac

SEQ ID NO: 567456 - RNA, 20 nt, Coxiella burnetii RSA 493
gugccuucguaaacuuuacc

SEQ ID NO: 567457 - RNA, 14 nt, Coxiella burnetii RSA 493
gugccuugaugaau

SEQ ID NO: 567458 - RNA, 17 nt, Coxiella burnetii RSA 493
guggauuuucaaagucg

SEQ ID NO: 567459 - RNA, 12 nt, Coxiella burnetii RSA 493
guggguaaugau

SEQ ID NO: 567460 - RNA, 15 nt, Coxiella burnetii RSA 493
gugguuauaauuuug

SEQ ID NO: 567461 - RNA, 20 nt, Coxiella burnetii RSA 493
gugguggccucgauagacca

SEQ ID NO: 567462 - RNA, 18 nt, Coxiella burnetii RSA 493
guguaacaaaaacgacaa

SEQ ID NO: 567463 - RNA, 16 nt, Coxiella burnetii RSA 493
guuaaacccauuugau

SEQ ID NO: 567464 - RNA, 18 nt, Coxiella burnetii RSA 493
guuaaacccauuugaucu

SEQ ID NO: 567465 - RNA, 12 nt, Coxiella burnetii RSA 493
guguuuuuauuu

SEQ ID NO: 567466 - RNA, 14 nt, Coxiella burnetii RSA 493
guguuguagaauug

SEQ ID NO: 567467 - RNA, 23 nt, Coxiella burnetii RSA 493
guguugucggcgauacggugcag

SEQ ID NO: 567468 - RNA, 16 nt, Coxiella burnetii RSA 493
guuaaguagcuaaaaa

SEQ ID NO: 567469 - RNA, 23 nt, Coxiella burnetii RSA 493
guuaaguagcuaaaaaauucauc

SEQ ID NO: 567470 - RNA, 11 nt, Coxiella burnetii RSA 493
guuaauaguca

SEQ ID NO: 567471 - RNA, 14 nt, Coxiella burnetii RSA 493
guuaauuuaucauu

SEQ ID NO: 567472 - RNA, 20 nt, Coxiella burnetii RSA 493
guuaauucgagcaucuuuuu

SEQ ID NO: 567473 - RNA, 15 nt, Coxiella burnetii RSA 493
guuacaguaaaacac

SEQ ID NO: 567474 - RNA, 23 nt, Coxiella burnetii RSA 493
guuacuccgcccccccaaacaaa

SEQ ID NO: 567475 - RNA, 17 nt, Coxiella burnetii RSA 493
guucggaauauaauucu

SEQ ID NO: 567476 - RNA, 23 nt, Coxiella burnetii RSA 493
guucagacgcuaauugauuaaug

SEQ ID NO: 567477 - RNA, 20 nt, Coxiella burnetii RSA 493
guucacguggcccaucgucc

SEQ ID NO: 567478 - RNA, 13 nt, Coxiella burnetii RSA 493
guucauuaaauuu

SEQ ID NO: 567479 - RNA, 13 nt, Coxiella burnetii RSA 493
guucauaaaauaa

SEQ ID NO: 567480 - RNA, 12 nt, Coxiella burnetii RSA 493
guucuugcugcu

SEQ ID NO: 567481 - RNA, 18 nt, Coxiella burnetii RSA 493
guucuugggcaauuugug

SEQ ID NO: 567482 - RNA, 15 nt, Coxiella burnetii RSA 493
guucuuucaauaucu

SEQ ID NO: 567483 - RNA, 19 nt, Coxiella burnetii RSA 493
guucuaauaauuuuuuauc

SEQ ID NO: 567484 - RNA, 14 nt, Coxiella burnetii RSA 493
guucuaaaaaauug

SEQ ID NO: 567485 - RNA, 15 nt, Coxiella burnetii RSA 493
guucuuuuuccaugu

SEQ ID NO: 567486 - RNA, 23 nt, Coxiella burnetii RSA 493
guugaaaaccuacacuuucaauc

SEQ ID NO: 567487 - RNA, 22 nt, Coxiella burnetii RSA 493
guugaaaaccuacacuuuuaau

SEQ ID NO: 567488 - RNA, 12 nt, Coxiella burnetii RSA 493
guucuuuuauuu

SEQ ID NO: 567489 - RNA, 13 nt, Coxiella burnetii RSA 493
guugaaccacuuc

SEQ ID NO: 567490 - RNA, 22 nt, Coxiella burnetii RSA 493
guugaaccacuucaagaaagac

SEQ ID NO: 567491 - RNA, 14 nt, Coxiella burnetii RSA 493
guugaauuccuugc

SEQ ID NO: 567492 - RNA, 19 nt, Coxiella burnetii RSA 493
guugaaugcguucuuuaau

SEQ ID NO: 567493 - RNA, 15 nt, Coxiella burnetii RSA 493
guugaaucaaauuaa

SEQ ID NO: 567494 - RNA, 13 nt, Coxiella burnetii RSA 493
guugcauaauauu

SEQ ID NO: 567495 - RNA, 18 nt, Coxiella burnetii RSA 493
guugcauaauauuuucug

SEQ ID NO: 567496 - RNA, 21 nt, Coxiella burnetii RSA 493
guugcaggcgcguuuuauaaa

SEQ ID NO: 567497 - RNA, 22 nt, Coxiella burnetii RSA 493
guugcaggcgcguuuuauaaau

SEQ ID NO: 567498 - RNA, 19 nt, Coxiella burnetii RSA 493
guugcagaguuauuauccc

SEQ ID NO: 567499 - RNA, 16 nt, Coxiella burnetii RSA 493
guugauuuuuuaaauc

SEQ ID NO: 567500 - RNA, 19 nt, Coxiella burnetii RSA 493
guugcaauaacaaauaaac

SEQ ID NO: 567501 - RNA, 18 nt, Coxiella burnetii RSA 493
guugccgguauuuugcaa

SEQ ID NO: 567502 - RNA, 14 nt, Coxiella burnetii RSA 493
guugccgauaaaaa

SEQ ID NO: 567503 - RNA, 16 nt, Coxiella burnetii RSA 493
guuggcaggaaaaaua

SEQ ID NO: 567504 - RNA, 15 nt, Coxiella burnetii RSA 493
guugggcugagcuug

SEQ ID NO: 567505 - RNA, 20 nt, Coxiella burnetii RSA 493
guuucccguauuucgcuucg

SEQ ID NO: 567506 - RNA, 13 nt, Coxiella burnetii RSA 493
guuucccacaaaa

SEQ ID NO: 567507 - RNA, 11 nt, Coxiella burnetii RSA 493
guuucuuucca

SEQ ID NO: 567508 - RNA, 14 nt, Coxiella burnetii RSA 493
guuugaaaaaauac

SEQ ID NO: 567509 - RNA, 15 nt, Coxiella burnetii RSA 493
guuguaaauuuugcc

SEQ ID NO: 567510 - RNA, 20 nt, Coxiella burnetii RSA 493
guugucaacaaaauuuuuca

SEQ ID NO: 567511 - RNA, 16 nt, Coxiella burnetii RSA 493
guuguuuuaaauccuu

SEQ ID NO: 567512 - RNA, 21 nt, Coxiella burnetii RSA 493
guuuaaagcugcuuuuuaaaa

SEQ ID NO: 567513 - RNA, 16 nt, Coxiella burnetii RSA 493
guuuaaauaacaaaug

SEQ ID NO: 567514 - RNA, 17 nt, Coxiella burnetii RSA 493
guuuaaauaacaaaugc

SEQ ID NO: 567515 - RNA, 15 nt, Coxiella burnetii RSA 493
uaaaauaacaguguu

SEQ ID NO: 567516 - RNA, 16 nt, Coxiella burnetii RSA 493
uaaaauaaugucucca

SEQ ID NO: 567517 - RNA, 16 nt, Coxiella burnetii RSA 493
uaaacaaacugcugga

SEQ ID NO: 567518 - RNA, 20 nt, Coxiella burnetii RSA 493
uaaacagacccccauuuuuu

SEQ ID NO: 567519 - RNA, 15 nt, Coxiella burnetii RSA 493
uaaaauuucuuucca

SEQ ID NO: 567520 - RNA, 15 nt, Coxiella burnetii RSA 493
uaaaauuuaauaagu

SEQ ID NO: 567521 - RNA, 18 nt, Coxiella burnetii RSA 493
uaaaauuuaauaagucuu

SEQ ID NO: 567522 - RNA, 23 nt, Coxiella burnetii RSA 493
uaaaauuuuauucucccaaacaa

SEQ ID NO: 567523 - RNA, 11 nt, Coxiella burnetii RSA 493
uaaaauuuuuu

SEQ ID NO: 567524 - RNA, 22 nt, Coxiella burnetii RSA 493
uaaaauuccgauuguuguggau

SEQ ID NO: 567525 - RNA, 13 nt, Coxiella burnetii RSA 493
uaaaauuacuauu

SEQ ID NO: 567526 - RNA, 15 nt, Coxiella burnetii RSA 493
uaaaacgccaaaacc

SEQ ID NO: 567527 - RNA, 14 nt, Coxiella burnetii RSA 493
uaaaagauuuaaug

SEQ ID NO: 567528 - RNA, 20 nt, Coxiella burnetii RSA 493
uaaaagacguaccauuaaaa

SEQ ID NO: 567529 - RNA, 19 nt, Coxiella burnetii RSA 493
uaaaacaagacaacaaaau

SEQ ID NO: 567530 - RNA, 18 nt, Coxiella burnetii RSA 493
uaaaaauuuuaaaaaaau

SEQ ID NO: 567531 - RNA, 23 nt, Coxiella burnetii RSA 493
guuugaucauuuugauuuuuuaa

SEQ ID NO: 567532 - RNA, 13 nt, Coxiella burnetii RSA 493
uaaaaauaaauua

SEQ ID NO: 567533 - RNA, 17 nt, Coxiella burnetii RSA 493
uaaaaauaaauuaauua

SEQ ID NO: 567534 - RNA, 15 nt, Coxiella burnetii RSA 493
uaaaaaugaaauccc

SEQ ID NO: 567535 - RNA, 13 nt, Coxiella burnetii RSA 493
uaaacuggaaaaa

SEQ ID NO: 567536 - RNA, 18 nt, Coxiella burnetii RSA 493
uaaacgcgauaucuccau

SEQ ID NO: 567537 - RNA, 20 nt, Coxiella burnetii RSA 493
uaaacccagaaaaguaaaaa

SEQ ID NO: 567538 - RNA, 18 nt, Coxiella burnetii RSA 493
uaaacagguccuaaaaaa

SEQ ID NO: 567539 - RNA, 17 nt, Coxiella burnetii RSA 493
uaaagcugcuuuuuaaa

SEQ ID NO: 567540 - RNA, 15 nt, Coxiella burnetii RSA 493
uaaagcuuauauaaa

SEQ ID NO: 567541 - RNA, 20 nt, Coxiella burnetii RSA 493
uaaagauaucgucacccaaa

SEQ ID NO: 567542 - RNA, 23 nt, Coxiella burnetii RSA 493
uaaagauaucgucacccaaauca

SEQ ID NO: 567543 - RNA, 13 nt, Coxiella burnetii RSA 493
uaaagaaagccua

SEQ ID NO: 567544 - RNA, 12 nt, Coxiella burnetii RSA 493
uaaagaaaaaau

SEQ ID NO: 567545 - RNA, 15 nt, Coxiella burnetii RSA 493
uaaauccuuaauuaa

SEQ ID NO: 567546 - RNA, 18 nt, Coxiella burnetii RSA 493
uaaauccuuaauuaacug

SEQ ID NO: 567547 - RNA, 22 nt, Coxiella burnetii RSA 493
uaaaucgguugaagaaauacga

SEQ ID NO: 567548 - RNA, 15 nt, Coxiella burnetii RSA 493
uaaauaguucacgaa

SEQ ID NO: 567549 - RNA, 16 nt, Coxiella burnetii RSA 493
uaaauaguucacgaau

SEQ ID NO: 567550 - RNA, 13 nt, Coxiella burnetii RSA 493
uaaaucauugguu

SEQ ID NO: 567551 - RNA, 18 nt, Coxiella burnetii RSA 493
uaaagugggggaaaacag

SEQ ID NO: 567552 - RNA, 14 nt, Coxiella burnetii RSA 493
uaaaguuauuucuu

SEQ ID NO: 567553 - RNA, 17 nt, Coxiella burnetii RSA 493
uaaaguuauuucuuuug

SEQ ID NO: 567554 - RNA, 20 nt, Coxiella burnetii RSA 493
uaaaguuauuucuuuugauu

SEQ ID NO: 567555 - RNA, 21 nt, Coxiella burnetii RSA 493
uaaaggcguaagcacaaaagu

SEQ ID NO: 567556 - RNA, 22 nt, Coxiella burnetii RSA 493
uaaaggcgaccaaaaaucgcca

SEQ ID NO: 567557 - RNA, 18 nt, Coxiella burnetii RSA 493
uaaagggccguuccuaua

SEQ ID NO: 567558 - RNA, 15 nt, Coxiella burnetii RSA 493
uaaauaacucaucga

SEQ ID NO: 567559 - RNA, 14 nt, Coxiella burnetii RSA 493
uaaauaacuuuacu

SEQ ID NO: 567560 - RNA, 23 nt, Coxiella burnetii RSA 493
uaaauaacuuuacuaaaaaacga

SEQ ID NO: 567561 - RNA, 16 nt, Coxiella burnetii RSA 493
uaacaguguuuaacuc

SEQ ID NO: 567562 - RNA, 22 nt, Coxiella burnetii RSA 493
uaacaucaguuuugauuugagu

SEQ ID NO: 567563 - RNA, 15 nt, Coxiella burnetii RSA 493
uaaccaaucaauaaa

SEQ ID NO: 567564 - RNA, 14 nt, Coxiella burnetii RSA 493
uaaauuuuuguaau

SEQ ID NO: 567565 - RNA, 17 nt, Coxiella burnetii RSA 493
uaaauuuuucauuuccu

SEQ ID NO: 567566 - RNA, 14 nt, Coxiella burnetii RSA 493
uaacaaaaacgaca

SEQ ID NO: 567567 - RNA, 12 nt, Coxiella burnetii RSA 493
uaacaacgaaac

SEQ ID NO: 567568 - RNA, 16 nt, Coxiella burnetii RSA 493
uaacaacgaaaccuug

SEQ ID NO: 567569 - RNA, 23 nt, Coxiella burnetii RSA 493
uaacaacgaaaccuuguuauaaa

SEQ ID NO: 567570 - RNA, 16 nt, Coxiella burnetii RSA 493
uaacaagguauugauu

SEQ ID NO: 567571 - RNA, 21 nt, Coxiella burnetii RSA 493
uaacaagguauugauuaacuu

SEQ ID NO: 567572 - RNA, 20 nt, Coxiella burnetii RSA 493
uaacaagguuuuauuuuuaa

SEQ ID NO: 567573 - RNA, 21 nt, Coxiella burnetii RSA 493
uaacaagcucccagacacaug

SEQ ID NO: 567574 - RNA, 23 nt, Coxiella burnetii RSA 493
uaacaagcuggcauugaaaauca

SEQ ID NO: 567575 - RNA, 16 nt, Coxiella burnetii RSA 493
uaacaagaucaauacc

SEQ ID NO: 567576 - RNA, 19 nt, Coxiella burnetii RSA 493
uaacgcgaucgaaaugucu

SEQ ID NO: 567577 - RNA, 20 nt, Coxiella burnetii RSA 493
uaacgggaauguuuuuuaau

SEQ ID NO: 567578 - RNA, 23 nt, Coxiella burnetii RSA 493
uaacgggaauguuuuuuaauaaa

SEQ ID NO: 567579 - RNA, 23 nt, Coxiella burnetii RSA 493
uaacccacagccgcuuuuuauug

SEQ ID NO: 567580 - RNA, 17 nt, Coxiella burnetii RSA 493
uaaccugagggaauuuu

SEQ ID NO: 567581 - RNA, 14 nt, Coxiella burnetii RSA 493
uaacgcauugguaa

SEQ ID NO: 567582 - RNA, 19 nt, Coxiella burnetii RSA 493
uaacgcauugguaacgccc

SEQ ID NO: 567583 - RNA, 15 nt, Coxiella burnetii RSA 493
uaacugauuagcuga

SEQ ID NO: 567584 - RNA, 21 nt, Coxiella burnetii RSA 493
uaacugauuagcugacaucuu

SEQ ID NO: 567585 - RNA, 14 nt, Coxiella burnetii RSA 493
uaacucuaauuuuc

SEQ ID NO: 567586 - RNA, 16 nt, Coxiella burnetii RSA 493
uaacucuaauuuuccu

SEQ ID NO: 567587 - RNA, 19 nt, Coxiella burnetii RSA 493
uaacuccuuguuuuaaccu

SEQ ID NO: 567588 - RNA, 21 nt, Coxiella burnetii RSA 493
uaacuccuuguuuuaaccuga

SEQ ID NO: 567589 - RNA, 14 nt, Coxiella burnetii RSA 493
uaacuauuauuaaa

SEQ ID NO: 567590 - RNA, 15 nt, Coxiella burnetii RSA 493
uaacuauuauuaaaa

SEQ ID NO: 567591 - RNA, 16 nt, Coxiella burnetii RSA 493
uaacuauuauuaaaag

SEQ ID NO: 567592 - RNA, 17 nt, Coxiella burnetii RSA 493
uaacuauuauuaaaaga

SEQ ID NO: 567593 - RNA, 19 nt, Coxiella burnetii RSA 493
uaacuucgacgggaaaaau

SEQ ID NO: 567594 - RNA, 14 nt, Coxiella burnetii RSA 493
uaacuucucuugaa

SEQ ID NO: 567595 - RNA, 17 nt, Coxiella burnetii RSA 493
uaacuucucuugaauaa

SEQ ID NO: 567596 - RNA, 21 nt, Coxiella burnetii RSA 493
uaacuuuagcuaauucuuuuu

SEQ ID NO: 567597 - RNA, 18 nt, Coxiella burnetii RSA 493
uaacuguguuccuuacuc

SEQ ID NO: 567598 - RNA, 13 nt, Coxiella burnetii RSA 493
uaacuucauuaga

SEQ ID NO: 567599 - RNA, 16 nt, Coxiella burnetii RSA 493
uaagaauaaacuuuau

SEQ ID NO: 567600 - RNA, 13 nt, Coxiella burnetii RSA 493
uaagagaaaaaac

SEQ ID NO: 567601 - RNA, 14 nt, Coxiella burnetii RSA 493
uaagagaaauuaaa

SEQ ID NO: 567602 - RNA, 22 nt, Coxiella burnetii RSA 493
uaagagaaauuaaauuuuuaaa

SEQ ID NO: 567603 - RNA, 23 nt, Coxiella burnetii RSA 493
uaagagaaauuaaauuuuuaaau

SEQ ID NO: 567604 - RNA, 18 nt, Coxiella burnetii RSA 493
uaagacacguucuggaau

SEQ ID NO: 567605 - RNA, 20 nt, Coxiella burnetii RSA 493
uaagaggaccugugagggau

SEQ ID NO: 567606 - RNA, 16 nt, Coxiella burnetii RSA 493
uaagauaauaauuaua

SEQ ID NO: 567607 - RNA, 14 nt, Coxiella burnetii RSA 493
uaagcacuucuuuu

SEQ ID NO: 567608 - RNA, 16 nt, Coxiella burnetii RSA 493
uaagcacuucuuuuau

SEQ ID NO: 567609 - RNA, 22 nt, Coxiella burnetii RSA 493
uaagcagacccgcauucuuuua

SEQ ID NO: 567610 - RNA, 23 nt, Coxiella burnetii RSA 493
uaagcaauuuuuuaucauacuua

SEQ ID NO: 567611 - RNA, 17 nt, Coxiella burnetii RSA 493
uaagccauuaaaagcag

SEQ ID NO: 567612 - RNA, 20 nt, Coxiella burnetii RSA 493
uaagccaguucucuauucuu

SEQ ID NO: 567613 - RNA, 17 nt, Coxiella burnetii RSA 493
uaagcugauacaccauc

SEQ ID NO: 567614 - RNA, 19 nt, Coxiella burnetii RSA 493
uaagcuaucagcagaaaag

SEQ ID NO: 567615 - RNA, 20 nt, Coxiella burnetii RSA 493
uaaggaaucacuccuaagca

SEQ ID NO: 567616 - RNA, 14 nt, Coxiella burnetii RSA 493
uaaggaaauugaug

SEQ ID NO: 567617 - RNA, 14 nt, Coxiella burnetii RSA 493
uaagcuugaaaaaa

SEQ ID NO: 567618 - RNA, 15 nt, Coxiella burnetii RSA 493
uaagcuugaaaaaau

SEQ ID NO: 567619 - RNA, 17 nt, Coxiella burnetii RSA 493
uaagcgccagagauuuu

SEQ ID NO: 567620 - RNA, 18 nt, Coxiella burnetii RSA 493
uaagcguaacgucacaaa

SEQ ID NO: 567621 - RNA, 17 nt, Coxiella burnetii RSA 493
uaagcgucaugaaaagc

SEQ ID NO: 567622 - RNA, 21 nt, Coxiella burnetii RSA 493
uaagcgucaugaaaagcggag

SEQ ID NO: 567623 - RNA, 22 nt, Coxiella burnetii RSA 493
uaagcgugcucuuuuucauuuc

SEQ ID NO: 567624 - RNA, 17 nt, Coxiella burnetii RSA 493
uaagccguccaguuggc

SEQ ID NO: 567625 - RNA, 14 nt, Coxiella burnetii RSA 493
uaagccuaaacgcu

SEQ ID NO: 567626 - RNA, 19 nt, Coxiella burnetii RSA 493
uaaucuggguuucuuucuu

SEQ ID NO: 567627 - RNA, 22 nt, Coxiella burnetii RSA 493
uaaucuggguuucuuucuucua

SEQ ID NO: 567628 - RNA, 20 nt, Coxiella burnetii RSA 493
uaaucucacuuggauuuuau

SEQ ID NO: 567629 - RNA, 13 nt, Coxiella burnetii RSA 493
uaaucucaucauc

SEQ ID NO: 567630 - RNA, 17 nt, Coxiella burnetii RSA 493
uaaucugcgcguauaau

SEQ ID NO: 567631 - RNA, 16 nt, Coxiella burnetii RSA 493
uaaucucaauagaggu

SEQ ID NO: 567632 - RNA, 18 nt, Coxiella burnetii RSA 493
uaaucguaucgauuucuu

SEQ ID NO: 567633 - RNA, 19 nt, Coxiella burnetii RSA 493
uaaucgcuaagcgaaaaau

SEQ ID NO: 567634 - RNA, 14 nt, Coxiella burnetii RSA 493
uaaucgcuguuaau

SEQ ID NO: 567635 - RNA, 19 nt, Coxiella burnetii RSA 493
uaaucgcuguuaauaauag

SEQ ID NO: 567636 - RNA, 16 nt, Coxiella burnetii RSA 493
uaaucgcuccuaaauu

SEQ ID NO: 567637 - RNA, 21 nt, Coxiella burnetii RSA 493
uaaucgcuccuaaauuuucuu

SEQ ID NO: 567638 - RNA, 22 nt, Coxiella burnetii RSA 493
uaaucgcugauacuucuucauu

SEQ ID NO: 567639 - RNA, 23 nt, Coxiella burnetii RSA 493
uaauagcaucaagggcaaaaaca

SEQ ID NO: 567640 - RNA, 19 nt, Coxiella burnetii RSA 493
uaauauguuuuuuauacau

SEQ ID NO: 567641 - RNA, 20 nt, Coxiella burnetii RSA 493
uaauauuaucguuuucauuc

SEQ ID NO: 567642 - RNA, 14 nt, Coxiella burnetii RSA 493
uaauauuaaaacaa

SEQ ID NO: 567643 - RNA, 11 nt, Coxiella burnetii RSA 493
uaaucaucaau

SEQ ID NO: 567644 - RNA, 23 nt, Coxiella burnetii RSA 493
uaauugcuucaaucguuuuaauu

SEQ ID NO: 567645 - RNA, 18 nt, Coxiella burnetii RSA 493
uaauugcuuccuuaaagc

SEQ ID NO: 567646 - RNA, 16 nt, Coxiella burnetii RSA 493
uaauugcugaacaaaa

SEQ ID NO: 567647 - RNA, 17 nt, Coxiella burnetii RSA 493
uaauugcugaacaaaag

SEQ ID NO: 567648 - RNA, 23 nt, Coxiella burnetii RSA 493
uaauugggaagcaauuucauuca

SEQ ID NO: 567649 - RNA, 18 nt, Coxiella burnetii RSA 493
uaauugguauauuucauu

SEQ ID NO: 567650 - RNA, 22 nt, Coxiella burnetii RSA 493
uaauugagcaucgcgguuagca

SEQ ID NO: 567651 - RNA, 16 nt, Coxiella burnetii RSA 493
uaauugaggaaaauaa

SEQ ID NO: 567652 - RNA, 22 nt, Coxiella burnetii RSA 493
uaauugaggugccgcuaaaauu

SEQ ID NO: 567653 - RNA, 17 nt, Coxiella burnetii RSA 493
uaauugagguuuuaauu

SEQ ID NO: 567654 - RNA, 21 nt, Coxiella burnetii RSA 493
uaauugagguuuuaauuugcc

SEQ ID NO: 567655 - RNA, 12 nt, Coxiella burnetii RSA 493
uaauucuuuuuu

SEQ ID NO: 567656 - RNA, 15 nt, Coxiella burnetii RSA 493
uaauucuuuuuuaau

SEQ ID NO: 567657 - RNA, 18 nt, Coxiella burnetii RSA 493
uaauucuuuuuuaauauu

SEQ ID NO: 567658 - RNA, 17 nt, Coxiella burnetii RSA 493
uaauugaagaauugauu

SEQ ID NO: 567659 - RNA, 14 nt, Coxiella burnetii RSA 493
uaauugaauuugcu

SEQ ID NO: 567660 - RNA, 21 nt, Coxiella burnetii RSA 493
uaauucgagcaucuuuuugca

SEQ ID NO: 567661 - RNA, 17 nt, Coxiella burnetii RSA 493
uaauuaagcuugaaaaa

SEQ ID NO: 567662 - RNA, 18 nt, Coxiella burnetii RSA 493
uaauuaagcuugaaaaaa

SEQ ID NO: 567663 - RNA, 13 nt, Coxiella burnetii RSA 493
uaauuaaauuacu

SEQ ID NO: 567664 - RNA, 21 nt, Coxiella burnetii RSA 493
uaaugucacguuaucauucuu

SEQ ID NO: 567665 - RNA, 17 nt, Coxiella burnetii RSA 493
uaaugcuucuaauuuga

SEQ ID NO: 567666 - RNA, 20 nt, Coxiella burnetii RSA 493
uaaggcaucuuuuucuccuu

SEQ ID NO: 567667 - RNA, 15 nt, Coxiella burnetii RSA 493
uaaggccucuuuaga

SEQ ID NO: 567668 - RNA, 13 nt, Coxiella burnetii RSA 493
uaaggucucaaca

SEQ ID NO: 567669 - RNA, 20 nt, Coxiella burnetii RSA 493
uaaguacugaugcaaaucau

SEQ ID NO: 567670 - RNA, 17 nt, Coxiella burnetii RSA 493
uaaguccuccuucaagg

SEQ ID NO: 567671 - RNA, 15 nt, Coxiella burnetii RSA 493
uaagucucugcuuca

SEQ ID NO: 567672 - RNA, 13 nt, Coxiella burnetii RSA 493
uaagucuauugaa

SEQ ID NO: 567673 - RNA, 20 nt, Coxiella burnetii RSA 493
uaagucuauugaaaaaaacg

SEQ ID NO: 567674 - RNA, 15 nt, Coxiella burnetii RSA 493
uaagucguuuuaaug

SEQ ID NO: 567675 - RNA, 12 nt, Coxiella burnetii RSA 493
uaaguuuuuagc

SEQ ID NO: 567676 - RNA, 12 nt, Coxiella burnetii RSA 493
uaauaaaaauau

SEQ ID NO: 567677 - RNA, 12 nt, Coxiella burnetii RSA 493
uaauaaaacaag

SEQ ID NO: 567678 - RNA, 12 nt, Coxiella burnetii RSA 493
uaauaaaauuaa

SEQ ID NO: 567679 - RNA, 13 nt, Coxiella burnetii RSA 493
uaauaaaauuaaa

SEQ ID NO: 567680 - RNA, 20 nt, Coxiella burnetii RSA 493
uaauaaaguaauuuuaaaaa

SEQ ID NO: 567681 - RNA, 16 nt, Coxiella burnetii RSA 493
uaauaacgcuaugaaa

SEQ ID NO: 567682 - RNA, 17 nt, Coxiella burnetii RSA 493
uaauaacgcuaugaaaa

SEQ ID NO: 567683 - RNA, 20 nt, Coxiella burnetii RSA 493
uaauaaggcuaauuuuccuu

SEQ ID NO: 567684 - RNA, 16 nt, Coxiella burnetii RSA 493
uaauaagucuuugcua

SEQ ID NO: 567685 - RNA, 19 nt, Coxiella burnetii RSA 493
uaauaauagcguauagagu

SEQ ID NO: 567686 - RNA, 13 nt, Coxiella burnetii RSA 493
uaauaauaacaaa

SEQ ID NO: 567687 - RNA, 21 nt, Coxiella burnetii RSA 493
uaauacggcuuuauuuuggau

SEQ ID NO: 567688 - RNA, 22 nt, Coxiella burnetii RSA 493
uaauacggcuuuauuuuggaua

SEQ ID NO: 567689 - RNA, 12 nt, Coxiella burnetii RSA 493
uaauacauucuu

SEQ ID NO: 567690 - RNA, 14 nt, Coxiella burnetii RSA 493
uaauacauucuuca

SEQ ID NO: 567691 - RNA, 18 nt, Coxiella burnetii RSA 493
uaauacauucuucaguaa

SEQ ID NO: 567692 - RNA, 14 nt, Coxiella burnetii RSA 493
uaauacuaaacaaa

SEQ ID NO: 567693 - RNA, 16 nt, Coxiella burnetii RSA 493
uaauaauuuuuuauca

SEQ ID NO: 567694 - RNA, 15 nt, Coxiella burnetii RSA 493
uaauacaaggaaaau

SEQ ID NO: 567695 - RNA, 18 nt, Coxiella burnetii RSA 493
uaauacaggaaaaagaua

SEQ ID NO: 567696 - RNA, 16 nt, Coxiella burnetii RSA 493
uaauacauaaaauuag

SEQ ID NO: 567697 - RNA, 20 nt, Coxiella burnetii RSA 493
uaauaauuauacugcccagc

SEQ ID NO: 567698 - RNA, 11 nt, Coxiella burnetii RSA 493
uaauaauucau

SEQ ID NO: 567699 - RNA, 13 nt, Coxiella burnetii RSA 493
uacaauaauccac

SEQ ID NO: 567700 - RNA, 18 nt, Coxiella burnetii RSA 493
uacaauaucccaugacga

SEQ ID NO: 567701 - RNA, 17 nt, Coxiella burnetii RSA 493
uacacuuuuaaucacau

SEQ ID NO: 567702 - RNA, 21 nt, Coxiella burnetii RSA 493
uacagaaugauagaaacagua

SEQ ID NO: 567703 - RNA, 14 nt, Coxiella burnetii RSA 493
uacagaacuuuuuu

SEQ ID NO: 567704 - RNA, 23 nt, Coxiella burnetii RSA 493
uacaaugcguagucauagcuaag

SEQ ID NO: 567705 - RNA, 16 nt, Coxiella burnetii RSA 493
uacauucuucaguaau

SEQ ID NO: 567706 - RNA, 16 nt, Coxiella burnetii RSA 493
uaccaagcucaugaaa

SEQ ID NO: 567707 - RNA, 18 nt, Coxiella burnetii RSA 493
uaccaagcucaugaaaag

SEQ ID NO: 567708 - RNA, 16 nt, Coxiella burnetii RSA 493
uaccaauuaaagaauc

SEQ ID NO: 567709 - RNA, 22 nt, Coxiella burnetii RSA 493
uacauauuucuuuucuguuuuc

SEQ ID NO: 567710 - RNA, 19 nt, Coxiella burnetii RSA 493
uacaucuaagcuaguaguc

SEQ ID NO: 567711 - RNA, 16 nt, Coxiella burnetii RSA 493
uacaucuucauuuucu

SEQ ID NO: 567712 - RNA, 14 nt, Coxiella burnetii RSA 493
uaccucuaaaaauu

SEQ ID NO: 567713 - RNA, 14 nt, Coxiella burnetii RSA 493
uaccugauaaaaua

SEQ ID NO: 567714 - RNA, 20 nt, Coxiella burnetii RSA 493
uaccguuucacgauuuuucu

SEQ ID NO: 567715 - RNA, 21 nt, Coxiella burnetii RSA 493
uaccguuucacgauuuuucuc

SEQ ID NO: 567716 - RNA, 15 nt, Coxiella burnetii RSA 493
uaccuccgucauuga

SEQ ID NO: 567717 - RNA, 17 nt, Coxiella burnetii RSA 493
uaccuccgucauugaaa

SEQ ID NO: 567718 - RNA, 14 nt, Coxiella burnetii RSA 493
uaccuccuccccau

SEQ ID NO: 567719 - RNA, 23 nt, Coxiella burnetii RSA 493
uaccagucuguuauacuguucuu

SEQ ID NO: 567720 - RNA, 14 nt, Coxiella burnetii RSA 493
uacgcugaaguaau

SEQ ID NO: 567721 - RNA, 17 nt, Coxiella burnetii RSA 493
uacguuauaauuucuuu

SEQ ID NO: 567722 - RNA, 15 nt, Coxiella burnetii RSA 493
uacguaauuauuaag

SEQ ID NO: 567723 - RNA, 20 nt, Coxiella burnetii RSA 493
uacuaaauuguccuuuucua

SEQ ID NO: 567724 - RNA, 12 nt, Coxiella burnetii RSA 493
uacuaauuucag

SEQ ID NO: 567725 - RNA, 17 nt, Coxiella burnetii RSA 493
uacgcgagcggcggaac

SEQ ID NO: 567726 - RNA, 16 nt, Coxiella burnetii RSA 493
uacgcccuuucucuuu

SEQ ID NO: 567727 - RNA, 14 nt, Coxiella burnetii RSA 493
uacgagcggccuca

SEQ ID NO: 567728 - RNA, 20 nt, Coxiella burnetii RSA 493
uaguuucccguauuucgcuu

SEQ ID NO: 567729 - RNA, 15 nt, Coxiella burnetii RSA 493
uaguuuuucccucua

SEQ ID NO: 567730 - RNA, 15 nt, Coxiella burnetii RSA 493
uaguuuuauuugaaa

SEQ ID NO: 567731 - RNA, 15 nt, Coxiella burnetii RSA 493
uaguuugcaauacca

SEQ ID NO: 567732 - RNA, 23 nt, Coxiella burnetii RSA 493
uauaaaucccgaguccguaauag

SEQ ID NO: 567733 - RNA, 15 nt, Coxiella burnetii RSA 493
uauaaaauuuaguug

SEQ ID NO: 567734 - RNA, 15 nt, Coxiella burnetii RSA 493
uauaaaauuuuauuc

SEQ ID NO: 567735 - RNA, 18 nt, Coxiella burnetii RSA 493
uagguaacuuaaaaucac

SEQ ID NO: 567736 - RNA, 14 nt, Coxiella burnetii RSA 493
uagguaauuuauaa

SEQ ID NO: 567737 - RNA, 15 nt, Coxiella burnetii RSA 493
uagugaaaguuucau

SEQ ID NO: 567738 - RNA, 18 nt, Coxiella burnetii RSA 493
uagucuuugguuuuccau

SEQ ID NO: 567739 - RNA, 14 nt, Coxiella burnetii RSA 493
uagucuuuuuauau

SEQ ID NO: 567740 - RNA, 18 nt, Coxiella burnetii RSA 493
uagucuuuuuauauuccu

SEQ ID NO: 567741 - RNA, 19 nt, Coxiella burnetii RSA 493
uagugcuuuuaaacagucu

SEQ ID NO: 567742 - RNA, 20 nt, Coxiella burnetii RSA 493
uagugcuuuuaaacagucuu

SEQ ID NO: 567743 - RNA, 14 nt, Coxiella burnetii RSA 493
uauacuuuuuugaa

SEQ ID NO: 567744 - RNA, 13 nt, Coxiella burnetii RSA 493
uauacucacccac

SEQ ID NO: 567745 - RNA, 13 nt, Coxiella burnetii RSA 493
uauacuccccuac

SEQ ID NO: 567746 - RNA, 13 nt, Coxiella burnetii RSA 493
uauaauucucuau

SEQ ID NO: 567747 - RNA, 17 nt, Coxiella burnetii RSA 493
uauaauuagauaaagac

SEQ ID NO: 567748 - RNA, 14 nt, Coxiella burnetii RSA 493
uauacacaucuuuu

SEQ ID NO: 567749 - RNA, 19 nt, Coxiella burnetii RSA 493
uauaauuucuuuuugaaua

SEQ ID NO: 567750 - RNA, 12 nt, Coxiella burnetii RSA 493
uauaauuuucca

SEQ ID NO: 567751 - RNA, 15 nt, Coxiella burnetii RSA 493
uaucaccaaaauaca

SEQ ID NO: 567752 - RNA, 16 nt, Coxiella burnetii RSA 493
uaucaaguuuauaaga

SEQ ID NO: 567753 - RNA, 15 nt, Coxiella burnetii RSA 493
uaucaaucaaauccu

SEQ ID NO: 567754 - RNA, 20 nt, Coxiella burnetii RSA 493
uauauugggguucauuuuuu

SEQ ID NO: 567755 - RNA, 15 nt, Coxiella burnetii RSA 493
uauauuuaauuuuau

SEQ ID NO: 567756 - RNA, 21 nt, Coxiella burnetii RSA 493
uaucaaguguucacaagucuc

SEQ ID NO: 567757 - RNA, 14 nt, Coxiella burnetii RSA 493
uauccuuacaaaaa

SEQ ID NO: 567758 - RNA, 15 nt, Coxiella burnetii RSA 493
uauccuuacaaaaau

SEQ ID NO: 567759 - RNA, 14 nt, Coxiella burnetii RSA 493
uaucccgaaaaccc

SEQ ID NO: 567760 - RNA, 21 nt, Coxiella burnetii RSA 493
uauccccgaaggcgccuaaua

SEQ ID NO: 567761 - RNA, 21 nt, Coxiella burnetii RSA 493
uaucaugcauuugauuuucug

SEQ ID NO: 567762 - RNA, 16 nt, Coxiella burnetii RSA 493
uaucaucaacagaaca

SEQ ID NO: 567763 - RNA, 19 nt, Coxiella burnetii RSA 493
uaucauggucagcccaacu

SEQ ID NO: 567764 - RNA, 20 nt, Coxiella burnetii RSA 493
uaucauggucagcccaacua

SEQ ID NO: 567765 - RNA, 15 nt, Coxiella burnetii RSA 493
uaucuagauuuaaaa

SEQ ID NO: 567766 - RNA, 12 nt, Coxiella burnetii RSA 493
uaucuguuuuau

SEQ ID NO: 567767 - RNA, 23 nt, Coxiella burnetii RSA 493
uaucuguuuuaucccaauaguaa

SEQ ID NO: 567768 - RNA, 21 nt, Coxiella burnetii RSA 493
uaucuuaaugaaauuucucau

SEQ ID NO: 567769 - RNA, 23 nt, Coxiella burnetii RSA 493
uaucugaucaaaaauaaugcuaa

SEQ ID NO: 567770 - RNA, 13 nt, Coxiella burnetii RSA 493
uagccuuaauuuc

SEQ ID NO: 567771 - RNA, 12 nt, Coxiella burnetii RSA 493
uagcauaucgcc

SEQ ID NO: 567772 - RNA, 14 nt, Coxiella burnetii RSA 493
uagcauuugucgcc

SEQ ID NO: 567773 - RNA, 21 nt, Coxiella burnetii RSA 493
uagcaucaagggcaaaaacau

SEQ ID NO: 567774 - RNA, 16 nt, Coxiella burnetii RSA 493
uagaucguuuuuugau

SEQ ID NO: 567775 - RNA, 16 nt, Coxiella burnetii RSA 493
uagcugccauuuucau

SEQ ID NO: 567776 - RNA, 16 nt, Coxiella burnetii RSA 493
uagcuuguuccuuuuu

SEQ ID NO: 567777 - RNA, 18 nt, Coxiella burnetii RSA 493
uagcuuuuuucaaaauuu

SEQ ID NO: 567778 - RNA, 21 nt, Coxiella burnetii RSA 493
uaggaaaaaauaauuauagaa

SEQ ID NO: 567779 - RNA, 20 nt, Coxiella burnetii RSA 493
uaggaaaaaugauuauagaa

SEQ ID NO: 567780 - RNA, 11 nt, Coxiella burnetii RSA 493
uagcuuuucuu

SEQ ID NO: 567781 - RNA, 19 nt, Coxiella burnetii RSA 493
uagcuuuucuuuaaacuga

SEQ ID NO: 567782 - RNA, 14 nt, Coxiella burnetii RSA 493
uagcgauuuccauc

SEQ ID NO: 567783 - RNA, 15 nt, Coxiella burnetii RSA 493
uagcguguaauugau

SEQ ID NO: 567784 - RNA, 19 nt, Coxiella burnetii RSA 493
uaggaguuggucaaagaga

SEQ ID NO: 567785 - RNA, 20 nt, Coxiella burnetii RSA 493
uaggaauucuuuuucauuua

SEQ ID NO: 567786 - RNA, 19 nt, Coxiella burnetii RSA 493
uaggagauuuuuaugaaaa

SEQ ID NO: 567787 - RNA, 21 nt, Coxiella burnetii RSA 493
uaggccuauccuauucuuuua

SEQ ID NO: 567788 - RNA, 18 nt, Coxiella burnetii RSA 493
uaggauauugcauuguuu

SEQ ID NO: 567789 - RNA, 18 nt, Coxiella burnetii RSA 493
uagggucuaguuauuuuu

SEQ ID NO: 567790 - RNA, 23 nt, Coxiella burnetii RSA 493
uagggugacggcggauuaaaaaa

SEQ ID NO: 567791 - RNA, 19 nt, Coxiella burnetii RSA 493
uagggcugaaaaaauuaaa

SEQ ID NO: 567792 - RNA, 18 nt, Coxiella burnetii RSA 493
uagagacgggauaagucg

SEQ ID NO: 567793 - RNA, 14 nt, Coxiella burnetii RSA 493
uagacuaccgagaa

SEQ ID NO: 567794 - RNA, 22 nt, Coxiella burnetii RSA 493
uagacuaccgagaaguuuugca

SEQ ID NO: 567795 - RNA, 15 nt, Coxiella burnetii RSA 493
uagacaguuuagaau

SEQ ID NO: 567796 - RNA, 14 nt, Coxiella burnetii RSA 493
uagacaauuuuuuu

SEQ ID NO: 567797 - RNA, 17 nt, Coxiella burnetii RSA 493
uagaccucuaaaaaauc

SEQ ID NO: 567798 - RNA, 20 nt, Coxiella burnetii RSA 493
uagaguaaauacucuaaguu

SEQ ID NO: 567799 - RNA, 21 nt, Coxiella burnetii RSA 493
uagaggucguaccuucaauuc

SEQ ID NO: 567800 - RNA, 18 nt, Coxiella burnetii RSA 493
uagaguaacgccagcgau

SEQ ID NO: 567801 - RNA, 19 nt, Coxiella burnetii RSA 493
uagagugaaccaaucuauu

SEQ ID NO: 567802 - RNA, 22 nt, Coxiella burnetii RSA 493
uagagucgggaaauaaaauuaa

SEQ ID NO: 567803 - RNA, 13 nt, Coxiella burnetii RSA 493
uagaaagaaaguu

SEQ ID NO: 567804 - RNA, 23 nt, Coxiella burnetii RSA 493
uagaaagaaaguuucccacaaaa

SEQ ID NO: 567805 - RNA, 11 nt, Coxiella burnetii RSA 493
uagaaauauua

SEQ ID NO: 567806 - RNA, 13 nt, Coxiella burnetii RSA 493
uagaaauauuaga

SEQ ID NO: 567807 - RNA, 18 nt, Coxiella burnetii RSA 493
uacuagcggauuguaaac

SEQ ID NO: 567808 - RNA, 21 nt, Coxiella burnetii RSA 493
uagaaugaauuuaaugucuuu

SEQ ID NO: 567809 - RNA, 16 nt, Coxiella burnetii RSA 493
uagacaaacgauuacc

SEQ ID NO: 567810 - RNA, 20 nt, Coxiella burnetii RSA 493
uagaaugccggcuaauuuuu

SEQ ID NO: 567811 - RNA, 13 nt, Coxiella burnetii RSA 493
uagaaugggaaga

SEQ ID NO: 567812 - RNA, 15 nt, Coxiella burnetii RSA 493
uagaauuccuuuuau

SEQ ID NO: 567813 - RNA, 21 nt, Coxiella burnetii RSA 493
uagaauuccuuuuaugaaaga

SEQ ID NO: 567814 - RNA, 14 nt, Coxiella burnetii RSA 493
uagaaguuuaaagu

SEQ ID NO: 567815 - RNA, 17 nt, Coxiella burnetii RSA 493
uagaagcaucagauacc

SEQ ID NO: 567816 - RNA, 19 nt, Coxiella burnetii RSA 493
uagaagaugccagccacaa

SEQ ID NO: 567817 - RNA, 23 nt, Coxiella burnetii RSA 493
uagaagaugccagccacaaagaa

SEQ ID NO: 567818 - RNA, 16 nt, Coxiella burnetii RSA 493
gccagauacacauaau

SEQ ID NO: 567819 - RNA, 17 nt, Coxiella burnetii RSA 493
gccagauacacauaaug

SEQ ID NO: 567820 - RNA, 18 nt, Coxiella burnetii RSA 493
gccagcgauuuauuucuu

SEQ ID NO: 567821 - RNA, 19 nt, Coxiella burnetii RSA 493
gccagugccugugcaacac

SEQ ID NO: 567822 - RNA, 19 nt, Coxiella burnetii RSA 493
gccauaguaauucaucauu

SEQ ID NO: 567823 - RNA, 14 nt, Coxiella burnetii RSA 493
gccauaucaggagc

SEQ ID NO: 567824 - RNA, 17 nt, Coxiella burnetii RSA 493
gccaucgcccaguacug

SEQ ID NO: 567825 - RNA, 18 nt, Coxiella burnetii RSA 493
gccccaugaguucuguca

SEQ ID NO: 567826 - RNA, 15 nt, Coxiella burnetii RSA 493
gcccauuuuuucguu

SEQ ID NO: 567827 - RNA, 17 nt, Coxiella burnetii RSA 493
gcccacuuggaaaucuu

SEQ ID NO: 567828 - RNA, 22 nt, Coxiella burnetii RSA 493
gcccauagcuggacucgauggg

SEQ ID NO: 567829 - RNA, 16 nt, Coxiella burnetii RSA 493
gcccaguaacuaagua

SEQ ID NO: 567830 - RNA, 23 nt, Coxiella burnetii RSA 493
gcccgcuauacugcuuguaccug

SEQ ID NO: 567831 - RNA, 22 nt, Coxiella burnetii RSA 493
gccuaaucggccuacuuuuucu

SEQ ID NO: 567832 - RNA, 12 nt, Coxiella burnetii RSA 493
gccuacaaauac

SEQ ID NO: 567833 - RNA, 19 nt, Coxiella burnetii RSA 493
gccuaaguuuaacagacag

SEQ ID NO: 567834 - RNA, 13 nt, Coxiella burnetii RSA 493
gccuacuuuuguu

SEQ ID NO: 567835 - RNA, 18 nt, Coxiella burnetii RSA 493
gccgguacacaaaauuuc

SEQ ID NO: 567836 - RNA, 23 nt, Coxiella burnetii RSA 493
gccgguacacaaaauuucaagua

SEQ ID NO: 567837 - RNA, 15 nt, Coxiella burnetii RSA 493
gccuccaucccuccu

SEQ ID NO: 567838 - RNA, 22 nt, Coxiella burnetii RSA 493
gccuccagggcuuguucacgca

SEQ ID NO: 567839 - RNA, 17 nt, Coxiella burnetii RSA 493
gccucuuuuuguaaauu

SEQ ID NO: 567840 - RNA, 21 nt, Coxiella burnetii RSA 493
gccugaaaaucaaauuuuccg

SEQ ID NO: 567841 - RNA, 19 nt, Coxiella burnetii RSA 493
gccgaugacaaauaaacaa

SEQ ID NO: 567842 - RNA, 19 nt, Coxiella burnetii RSA 493
gccgcuaacagagggagca

SEQ ID NO: 567843 - RNA, 20 nt, Coxiella burnetii RSA 493
gccuucaugaauauuuuucu

SEQ ID NO: 567844 - RNA, 15 nt, Coxiella burnetii RSA 493
gccuuaauaaccacc

SEQ ID NO: 567845 - RNA, 17 nt, Coxiella burnetii RSA 493
gccuugcaaacaaacga

SEQ ID NO: 567846 - RNA, 12 nt, Coxiella burnetii RSA 493
gccuuuuuugcg

SEQ ID NO: 567847 - RNA, 22 nt, Coxiella burnetii RSA 493
gcgaaauacggggacgauaacg

SEQ ID NO: 567848 - RNA, 22 nt, Coxiella burnetii RSA 493
gcgaaauuuaauaaaauuaaau

SEQ ID NO: 567849 - RNA, 18 nt, Coxiella burnetii RSA 493
gcgauuggcgcaucaaaa

SEQ ID NO: 567850 - RNA, 13 nt, Coxiella burnetii RSA 493
gcgcaaguuuuga

SEQ ID NO: 567851 - RNA, 18 nt, Coxiella burnetii RSA 493
gcgauuaaaaguguagua

SEQ ID NO: 567852 - RNA, 19 nt, Coxiella burnetii RSA 493
gcgauguagccuaaccaag

SEQ ID NO: 567853 - RNA, 16 nt, Coxiella burnetii RSA 493
gcgcacucaaccagaa

SEQ ID NO: 567854 - RNA, 15 nt, Coxiella burnetii RSA 493
gcgagguaaagaggg

SEQ ID NO: 567855 - RNA, 20 nt, Coxiella burnetii RSA 493
gcgagcaauaauuuccuguc

SEQ ID NO: 567856 - RNA, 15 nt, Coxiella burnetii RSA 493
gcgcuaaaagcgcgc

SEQ ID NO: 567857 - RNA, 20 nt, Coxiella burnetii RSA 493
gcgcuccauugagugguggu

SEQ ID NO: 567858 - RNA, 16 nt, Coxiella burnetii RSA 493
gcgcucauuuucacua

SEQ ID NO: 567859 - RNA, 17 nt, Coxiella burnetii RSA 493
gcgcucggguucuacaa

SEQ ID NO: 567860 - RNA, 17 nt, Coxiella burnetii RSA 493
gcgccccucaagcaaag

SEQ ID NO: 567861 - RNA, 20 nt, Coxiella burnetii RSA 493
gcguugauagggcuuugggu

SEQ ID NO: 567862 - RNA, 21 nt, Coxiella burnetii RSA 493
gcguugaaaacgcgaguguuu

SEQ ID NO: 567863 - RNA, 23 nt, Coxiella burnetii RSA 493
gcgucugcgacgacgcuuugguu

SEQ ID NO: 567864 - RNA, 13 nt, Coxiella burnetii RSA 493
gcuacguuuuuug

SEQ ID NO: 567865 - RNA, 15 nt, Coxiella burnetii RSA 493
gcuacguuuuuugca

SEQ ID NO: 567866 - RNA, 16 nt, Coxiella burnetii RSA 493
gcuacguuuuuugcau

SEQ ID NO: 567867 - RNA, 18 nt, Coxiella burnetii RSA 493
gcuaauuuagguguaagu

SEQ ID NO: 567868 - RNA, 13 nt, Coxiella burnetii RSA 493
gcuaauucuuuuu

SEQ ID NO: 567869 - RNA, 12 nt, Coxiella burnetii RSA 493
gcuacaucuaag

SEQ ID NO: 567870 - RNA, 16 nt, Coxiella burnetii RSA 493
gcuaagcgaaaaauga

SEQ ID NO: 567871 - RNA, 18 nt, Coxiella burnetii RSA 493
gcuaacuggauugauagu

SEQ ID NO: 567872 - RNA, 23 nt, Coxiella burnetii RSA 493
gcuaaacgugcgacuucuaguuu

SEQ ID NO: 567873 - RNA, 12 nt, Coxiella burnetii RSA 493
gcuaaaaucacg

SEQ ID NO: 567874 - RNA, 14 nt, Coxiella burnetii RSA 493
gcuccucuauauaa

SEQ ID NO: 567875 - RNA, 17 nt, Coxiella burnetii RSA 493
gcucgauucuuugucug

SEQ ID NO: 567876 - RNA, 14 nt, Coxiella burnetii RSA 493
gcuccuaaauuuuc

SEQ ID NO: 567877 - RNA, 19 nt, Coxiella burnetii RSA 493
gcuccuaaauuuucuuguu

SEQ ID NO: 567878 - RNA, 16 nt, Coxiella burnetii RSA 493
gcuccauagaugggug

SEQ ID NO: 567879 - RNA, 16 nt, Coxiella burnetii RSA 493
gcucauuuucacuauu

SEQ ID NO: 567880 - RNA, 21 nt, Coxiella burnetii RSA 493
gcuccagauuucuuauuuuua

SEQ ID NO: 567881 - RNA, 14 nt, Coxiella burnetii RSA 493
gcuacuuccuucuu

SEQ ID NO: 567882 - RNA, 14 nt, Coxiella burnetii RSA 493
gcuacucuuuuucu

SEQ ID NO: 567883 - RNA, 14 nt, Coxiella burnetii RSA 493
gcuaguaaauaaaa

SEQ ID NO: 567884 - RNA, 21 nt, Coxiella burnetii RSA 493
gcgguauuguucaacuugggu

SEQ ID NO: 567885 - RNA, 19 nt, Coxiella burnetii RSA 493
gcgguauggauaguuucaa

SEQ ID NO: 567886 - RNA, 16 nt, Coxiella burnetii RSA 493
gcguaaaguugccggu

SEQ ID NO: 567887 - RNA, 16 nt, Coxiella burnetii RSA 493
gcggcugaauucaaac

SEQ ID NO: 567888 - RNA, 15 nt, Coxiella burnetii RSA 493
gcaaaacuucccauu

SEQ ID NO: 567889 - RNA, 14 nt, Coxiella burnetii RSA 493
gcaacaagaaaaau

SEQ ID NO: 567890 - RNA, 15 nt, Coxiella burnetii RSA 493
gcaaggaucucaccu

SEQ ID NO: 567891 - RNA, 13 nt, Coxiella burnetii RSA 493
gcaaggaauugag

SEQ ID NO: 567892 - RNA, 18 nt, Coxiella burnetii RSA 493
gcaacguuugauuuucaa

SEQ ID NO: 567893 - RNA, 15 nt, Coxiella burnetii RSA 493
gcaauccucucucuc

SEQ ID NO: 567894 - RNA, 23 nt, Coxiella burnetii RSA 493
gcaauaccauuuuuaaauuaucu

SEQ ID NO: 567895 - RNA, 14 nt, Coxiella burnetii RSA 493
gcaccagggguuau

SEQ ID NO: 567896 - RNA, 15 nt, Coxiella burnetii RSA 493
gcacaaccuugccaa

SEQ ID NO: 567897 - RNA, 14 nt, Coxiella burnetii RSA 493
gcacgaugcacagu

SEQ ID NO: 567898 - RNA, 20 nt, Coxiella burnetii RSA 493
gcacuuuaaugaccaccacc

SEQ ID NO: 567899 - RNA, 21 nt, Coxiella burnetii RSA 493
gcacuuuaaugaccaccaccc

SEQ ID NO: 567900 - RNA, 20 nt, Coxiella burnetii RSA 493
gcagaauagcggauuagcau

SEQ ID NO: 567901 - RNA, 18 nt, Coxiella burnetii RSA 493
gcagauaaauguuuuuua

SEQ ID NO: 567902 - RNA, 15 nt, Coxiella burnetii RSA 493
gcagaggacagagga

SEQ ID NO: 567903 - RNA, 15 nt, Coxiella burnetii RSA 493
gcagaauuuguacaa

SEQ ID NO: 567904 - RNA, 20 nt, Coxiella burnetii RSA 493
gcagacaucgcaauuaauac

SEQ ID NO: 567905 - RNA, 14 nt, Coxiella burnetii RSA 493
gcagaugauuaaaa

SEQ ID NO: 567906 - RNA, 21 nt, Coxiella burnetii RSA 493
gcaggaaccaggaaaguuccc

SEQ ID NO: 567907 - RNA, 22 nt, Coxiella burnetii RSA 493
gcaggauaauguuugauaucaa

SEQ ID NO: 567908 - RNA, 21 nt, Coxiella burnetii RSA 493
gcaguuaaauuuuuaauggaa

SEQ ID NO: 567909 - RNA, 20 nt, Coxiella burnetii RSA 493
gauguucggcgaaugcgcuu

SEQ ID NO: 567910 - RNA, 15 nt, Coxiella burnetii RSA 493
gauuagaaaaagcga

SEQ ID NO: 567911 - RNA, 17 nt, Coxiella burnetii RSA 493
gauuaaucguuuuugcu

SEQ ID NO: 567912 - RNA, 20 nt, Coxiella burnetii RSA 493
gauuaaucguuuuugcuaga

SEQ ID NO: 567913 - RNA, 18 nt, Coxiella burnetii RSA 493
gaugugaaacaugcugcu

SEQ ID NO: 567914 - RNA, 16 nt, Coxiella burnetii RSA 493
gauucccaccaaaauu

SEQ ID NO: 567915 - RNA, 18 nt, Coxiella burnetii RSA 493
gauucaugaaaaucuaaa

SEQ ID NO: 567916 - RNA, 19 nt, Coxiella burnetii RSA 493
gauucauuaucaugcauuu

SEQ ID NO: 567917 - RNA, 13 nt, Coxiella burnetii RSA 493
gauucaaauucuu

SEQ ID NO: 567918 - RNA, 15 nt, Coxiella burnetii RSA 493
gauucaauaaucuca

SEQ ID NO: 567919 - RNA, 20 nt, Coxiella burnetii RSA 493
gauugauuuuguccuguucu

SEQ ID NO: 567920 - RNA, 23 nt, Coxiella burnetii RSA 493
gauugauuuuuuaaugaaaaaua

SEQ ID NO: 567921 - RNA, 18 nt, Coxiella burnetii RSA 493
gauucgacauaaggcugc

SEQ ID NO: 567922 - RNA, 17 nt, Coxiella burnetii RSA 493
gauuuacaauaucccau

SEQ ID NO: 567923 - RNA, 11 nt, Coxiella burnetii RSA 493
gauuuucucuu

SEQ ID NO: 567924 - RNA, 18 nt, Coxiella burnetii RSA 493
gcaaaaccaauagcuccc

SEQ ID NO: 567925 - RNA, 15 nt, Coxiella burnetii RSA 493
gcaaaaaaagaaaau

SEQ ID NO: 567926 - RNA, 14 nt, Coxiella burnetii RSA 493
gauuuuuuauccaa

SEQ ID NO: 567927 - RNA, 17 nt, Coxiella burnetii RSA 493
gauuuuuuaaugaaaaa

SEQ ID NO: 567928 - RNA, 19 nt, Coxiella burnetii RSA 493
gauuuuugaagcuauccaa

SEQ ID NO: 567929 - RNA, 19 nt, Coxiella burnetii RSA 493
gauuuuucuuuguuccuug

SEQ ID NO: 567930 - RNA, 14 nt, Coxiella burnetii RSA 493
gauuuuuuaaaucu

SEQ ID NO: 567931 - RNA, 20 nt, Coxiella burnetii RSA 493
gauuuccaucgaaaaugcuc

SEQ ID NO: 567932 - RNA, 14 nt, Coxiella burnetii RSA 493
gauuucucuuuuaa

SEQ ID NO: 567933 - RNA, 16 nt, Coxiella burnetii RSA 493
gauuucugguugaauc

SEQ ID NO: 567934 - RNA, 15 nt, Coxiella burnetii RSA 493
gaucuccccuucuuu

SEQ ID NO: 567935 - RNA, 13 nt, Coxiella burnetii RSA 493
gaucuaagucuau

SEQ ID NO: 567936 - RNA, 23 nt, Coxiella burnetii RSA 493
gaucuaagucuauugaaaaaaac

SEQ ID NO: 567937 - RNA, 16 nt, Coxiella burnetii RSA 493
gaucuccuugaggaau

SEQ ID NO: 567938 - RNA, 15 nt, Coxiella burnetii RSA 493
gaucuugggcaaaaa

SEQ ID NO: 567939 - RNA, 16 nt, Coxiella burnetii RSA 493
gaucuugggcaaaaaa

SEQ ID NO: 567940 - RNA, 18 nt, Coxiella burnetii RSA 493
gaugaaaucguuuuguuu

SEQ ID NO: 567941 - RNA, 23 nt, Coxiella burnetii RSA 493
gaucuuaagaagagacaaaguuu

SEQ ID NO: 567942 - RNA, 16 nt, Coxiella burnetii RSA 493
gauggccuuauccggg

SEQ ID NO: 567943 - RNA, 18 nt, Coxiella burnetii RSA 493
gaugcugcgcauauucga

SEQ ID NO: 567944 - RNA, 21 nt, Coxiella burnetii RSA 493
gaugcacucuuuaauuugcac

SEQ ID NO: 567945 - RNA, 21 nt, Coxiella burnetii RSA 493
gaugauuaagcguaaauuuug

SEQ ID NO: 567946 - RNA, 13 nt, Coxiella burnetii RSA 493
gaucacaccccuc

SEQ ID NO: 567947 - RNA, 15 nt, Coxiella burnetii RSA 493
gaucaaugaaacaaa

SEQ ID NO: 567948 - RNA, 12 nt, Coxiella burnetii RSA 493
gaucaaagcgcc

SEQ ID NO: 567949 - RNA, 15 nt, Coxiella burnetii RSA 493
gaucaaguuucuccc

SEQ ID NO: 567950 - RNA, 24 nt, Coxiella burnetii RSA 493
gauauuaucaaaacguagaaguuu

SEQ ID NO: 567951 - RNA, 14 nt, Coxiella burnetii RSA 493
gauauuuuaaggau

SEQ ID NO: 567952 - RNA, 17 nt, Coxiella burnetii RSA 493
gauauucuaucucaagu

SEQ ID NO: 567953 - RNA, 21 nt, Coxiella burnetii RSA 493
gauauucuaucucaaguggcu

SEQ ID NO: 567954 - RNA, 21 nt, Coxiella burnetii RSA 493
gauauucccucuuuaccuccu

SEQ ID NO: 567955 - RNA, 16 nt, Coxiella burnetii RSA 493
gaucaguuuguccuug

SEQ ID NO: 567956 - RNA, 17 nt, Coxiella burnetii RSA 493
gaucaucaucaaaauua

SEQ ID NO: 567957 - RNA, 15 nt, Coxiella burnetii RSA 493
gauaggugcugcaac

SEQ ID NO: 567958 - RNA, 16 nt, Coxiella burnetii RSA 493
gauaggugcugcaacg

SEQ ID NO: 567959 - RNA, 20 nt, Coxiella burnetii RSA 493
gauaggugcugcaacggcag

SEQ ID NO: 567960 - RNA, 22 nt, Coxiella burnetii RSA 493
gauauaaaagcaucaauaaugc

SEQ ID NO: 567961 - RNA, 21 nt, Coxiella burnetii RSA 493
gauagucucuauaucuuuuaa

SEQ ID NO: 567962 - RNA, 12 nt, Coxiella burnetii RSA 493
gauauaacaccc

SEQ ID NO: 567963 - RNA, 16 nt, Coxiella burnetii RSA 493
gauacggugcagaagg

SEQ ID NO: 567964 - RNA, 14 nt, Coxiella burnetii RSA 493
gauacuaaauuagu

SEQ ID NO: 567965 - RNA, 20 nt, Coxiella burnetii RSA 493
gauacuaaauuaguaauauu

SEQ ID NO: 567966 - RNA, 19 nt, Coxiella burnetii RSA 493
gauaagccauuaaaagcag

SEQ ID NO: 567967 - RNA, 16 nt, Coxiella burnetii RSA 493
gauaagcuguuucuuu

SEQ ID NO: 567968 - RNA, 18 nt, Coxiella burnetii RSA 493
gauaagcuguuucuuuua

SEQ ID NO: 567969 - RNA, 20 nt, Coxiella burnetii RSA 493
gauaagcauauugcaauaau

SEQ ID NO: 567970 - RNA, 19 nt, Coxiella burnetii RSA 493
gaggcugaguagggugcga

SEQ ID NO: 567971 - RNA, 14 nt, Coxiella burnetii RSA 493
gaggguaagaauaa

SEQ ID NO: 567972 - RNA, 15 nt, Coxiella burnetii RSA 493
gaguaaugucacguu

SEQ ID NO: 567973 - RNA, 15 nt, Coxiella burnetii RSA 493
gaguaaugacagaaa

SEQ ID NO: 567974 - RNA, 23 nt, Coxiella burnetii RSA 493
gagguucucuuuaucagaaaaag

SEQ ID NO: 567975 - RNA, 15 nt, Coxiella burnetii RSA 493
gaguaaaaaaccaau

SEQ ID NO: 567976 - RNA, 14 nt, Coxiella burnetii RSA 493
gagguuaauaaaaa

SEQ ID NO: 567977 - RNA, 23 nt, Coxiella burnetii RSA 493
gauaacuauuauuaaaagagcga

SEQ ID NO: 567978 - RNA, 16 nt, Coxiella burnetii RSA 493
gauaaauuuugaaucc

SEQ ID NO: 567979 - RNA, 17 nt, Coxiella burnetii RSA 493
gauaaauuuugaauccu

SEQ ID NO: 567980 - RNA, 14 nt, Coxiella burnetii RSA 493
gaguuguauaaagg

SEQ ID NO: 567981 - RNA, 23 nt, Coxiella burnetii RSA 493
gaguggugguagaauucucccau

SEQ ID NO: 567982 - RNA, 22 nt, Coxiella burnetii RSA 493
gagugagaaggguuuugugcau

SEQ ID NO: 567983 - RNA, 17 nt, Coxiella burnetii RSA 493
gagauccacuuucucgc

SEQ ID NO: 567984 - RNA, 17 nt, Coxiella burnetii RSA 493
gagauaggacuuuucuc

SEQ ID NO: 567985 - RNA, 14 nt, Coxiella burnetii RSA 493
gagaguagauaacg

SEQ ID NO: 567986 - RNA, 17 nt, Coxiella burnetii RSA 493
gagauugccagcaaugg

SEQ ID NO: 567987 - RNA, 13 nt, Coxiella burnetii RSA 493
gagcaaacagucc

SEQ ID NO: 567988 - RNA, 18 nt, Coxiella burnetii RSA 493
gagcaaucaaaacagcaa

SEQ ID NO: 567989 - RNA, 22 nt, Coxiella burnetii RSA 493
gagcaaucaaaacagcaauuaa

SEQ ID NO: 567990 - RNA, 14 nt, Coxiella burnetii RSA 493
gagcauauaaaagu

SEQ ID NO: 567991 - RNA, 21 nt, Coxiella burnetii RSA 493
gagccaucacaccaagaaauu

SEQ ID NO: 567992 - RNA, 15 nt, Coxiella burnetii RSA 493
gagccagcuaaguaa

SEQ ID NO: 567993 - RNA, 17 nt, Coxiella burnetii RSA 493
gagcccaauaacaagcu

SEQ ID NO: 567994 - RNA, 17 nt, Coxiella burnetii RSA 493
gagccgcuaauaacauu

SEQ ID NO: 567995 - RNA, 16 nt, Coxiella burnetii RSA 493
gagcgggauauuuuuu

SEQ ID NO: 567996 - RNA, 17 nt, Coxiella burnetii RSA 493
gagcgugacuaaaauaa

SEQ ID NO: 567997 - RNA, 19 nt, Coxiella burnetii RSA 493
gagcucauugccaaagaaa

SEQ ID NO: 567998 - RNA, 20 nt, Coxiella burnetii RSA 493
gagcucauugccaaagaaau

SEQ ID NO: 567999 - RNA, 14 nt, Coxiella burnetii RSA 493
gagcgauaaaauaa

SEQ ID NO: 568000 - RNA, 16 nt, Coxiella burnetii RSA 493
gagcgacuuuuuucuu

SEQ ID NO: 568001 - RNA, 21 nt, Coxiella burnetii RSA 493
gagcgacuucauugagcggga

SEQ ID NO: 568002 - RNA, 13 nt, Coxiella burnetii RSA 493
gagcuugcauuau

SEQ ID NO: 568003 - RNA, 12 nt, Coxiella burnetii RSA 493
gaggacagaagg

SEQ ID NO: 568004 - RNA, 19 nt, Coxiella burnetii RSA 493
gaggagccagauaaaucaa

SEQ ID NO: 568005 - RNA, 20 nt, Coxiella burnetii RSA 493
gaggaagcgcacggacguga

SEQ ID NO: 568006 - RNA, 19 nt, Coxiella burnetii RSA 493
gaggaggguaagaauaaac

SEQ ID NO: 568007 - RNA, 17 nt, Coxiella burnetii RSA 493
gacguuauagaguaaau

SEQ ID NO: 568008 - RNA, 23 nt, Coxiella burnetii RSA 493
gacguuaucacuugauaaucaau

SEQ ID NO: 568009 - RNA, 18 nt, Coxiella burnetii RSA 493
gacuaagaauaagaauaa

SEQ ID NO: 568010 - RNA, 13 nt, Coxiella burnetii RSA 493
gacuaaaauaaag

SEQ ID NO: 568011 - RNA, 23 nt, Coxiella burnetii RSA 493
gacguuucgucgauauccaaaac

SEQ ID NO: 568012 - RNA, 16 nt, Coxiella burnetii RSA 493
gacuaaaaccuccugc

SEQ ID NO: 568013 - RNA, 17 nt, Coxiella burnetii RSA 493
gacgggagguuaaaaug

SEQ ID NO: 568014 - RNA, 22 nt, Coxiella burnetii RSA 493
gacgggcuguacauuuuucaag

SEQ ID NO: 568015 - RNA, 20 nt, Coxiella burnetii RSA 493
gacgguuauguacucagcuu

SEQ ID NO: 568016 - RNA, 17 nt, Coxiella burnetii RSA 493
gacuacaucaaauagau

SEQ ID NO: 568017 - RNA, 21 nt, Coxiella burnetii RSA 493
gacuauaaaguaguugaaaaa

SEQ ID NO: 568018 - RNA, 23 nt, Coxiella burnetii RSA 493
gacucguuucggauuuugaacag

SEQ ID NO: 568019 - RNA, 20 nt, Coxiella burnetii RSA 493
gacucugcgauuguuuucuu

SEQ ID NO: 568020 - RNA, 21 nt, Coxiella burnetii RSA 493
gacucugcgauuguuuucuua

SEQ ID NO: 568021 - RNA, 20 nt, Coxiella burnetii RSA 493
gacuucucuuucugagcuug

SEQ ID NO: 568022 - RNA, 15 nt, Coxiella burnetii RSA 493
gacuucuaguuuuuc

SEQ ID NO: 568023 - RNA, 16 nt, Coxiella burnetii RSA 493
gacuucgcuaaauaac

SEQ ID NO: 568024 - RNA, 18 nt, Coxiella burnetii RSA 493
gacuucgcuaaauaacau

SEQ ID NO: 568025 - RNA, 21 nt, Coxiella burnetii RSA 493
gacuuauuuguugaacagagu

SEQ ID NO: 568026 - RNA, 12 nt, Coxiella burnetii RSA 493
gacuuauuuuua

SEQ ID NO: 568027 - RNA, 21 nt, Coxiella burnetii RSA 493
gagaaauugcgcguaaaauuc

SEQ ID NO: 568028 - RNA, 23 nt, Coxiella burnetii RSA 493
gagaaauugcgcguaaaauucca

SEQ ID NO: 568029 - RNA, 17 nt, Coxiella burnetii RSA 493
gagaaagcauuaccauu

SEQ ID NO: 568030 - RNA, 22 nt, Coxiella burnetii RSA 493
gagaaaacuuuucaucccccgc

SEQ ID NO: 568031 - RNA, 17 nt, Coxiella burnetii RSA 493
gacuuuaucuuuuuucu

SEQ ID NO: 568032 - RNA, 21 nt, Coxiella burnetii RSA 493
gagaacguuucccaaggaauc

SEQ ID NO: 568033 - RNA, 23 nt, Coxiella burnetii RSA 493
gagaaccauuaguguaaggcuga

SEQ ID NO: 568034 - RNA, 13 nt, Coxiella burnetii RSA 493
gagaacguaaaau

SEQ ID NO: 568035 - RNA, 19 nt, Coxiella burnetii RSA 493
gagaauagcauuagacauu

SEQ ID NO: 568036 - RNA, 18 nt, Coxiella burnetii RSA 493
gagaagauuuuuuuucuu

SEQ ID NO: 568037 - RNA, 13 nt, Coxiella burnetii RSA 493
gagaauuaaaaau

SEQ ID NO: 568038 - RNA, 24 nt, Coxiella burnetii RSA 493
gagaguaacgauuucucuuaccau

SEQ ID NO: 568039 - RNA, 18 nt, Coxiella burnetii RSA 493
gagaggaugcagcuucgu

SEQ ID NO: 568040 - RNA, 22 nt, Coxiella burnetii RSA 493
gagaggaugcagcuucgugcaa

SEQ ID NO: 568041 - RNA, 21 nt, Coxiella burnetii RSA 493
gagagaauuuucauggcauaa

SEQ ID NO: 568042 - RNA, 19 nt, Coxiella burnetii RSA 493
gaccugcugcccggguggu

SEQ ID NO: 568043 - RNA, 20 nt, Coxiella burnetii RSA 493
gaccuccaacgaggcacugc

SEQ ID NO: 568044 - RNA, 15 nt, Coxiella burnetii RSA 493
gaccgagaauuaaug

SEQ ID NO: 568045 - RNA, 21 nt, Coxiella burnetii RSA 493
gacccagccgaccaaggguau

SEQ ID NO: 568046 - RNA, 16 nt, Coxiella burnetii RSA 493
gaccuuugcgcuguca

SEQ ID NO: 568047 - RNA, 13 nt, Coxiella burnetii RSA 493
gaccuuuuccuua

SEQ ID NO: 568048 - RNA, 18 nt, Coxiella burnetii RSA 493
gacgacaucguuguuuuc

SEQ ID NO: 568049 - RNA, 16 nt, Coxiella burnetii RSA 493
gacgacauuaaaaaug

SEQ ID NO: 568050 - RNA, 20 nt, Coxiella burnetii RSA 493
gacgaauaacggaaaaugga

SEQ ID NO: 568051 - RNA, 20 nt, Coxiella burnetii RSA 493
gacgauuuuaauuuuuucuc

SEQ ID NO: 568052 - RNA, 16 nt, Coxiella burnetii RSA 493
gacgaggaaagauaag

SEQ ID NO: 568053 - RNA, 16 nt, Coxiella burnetii RSA 493
gacgauagaugacauc

SEQ ID NO: 568054 - RNA, 20 nt, Coxiella burnetii RSA 493
gacgcauggauuaaacccgc

SEQ ID NO: 568055 - RNA, 22 nt, Coxiella burnetii RSA 493
gacacccugaacauuaagaaag

SEQ ID NO: 568056 - RNA, 23 nt, Coxiella burnetii RSA 493
gacacccugaacauuaagaaagc

SEQ ID NO: 568057 - RNA, 20 nt, Coxiella burnetii RSA 493
gacagauaaaccguggugcc

SEQ ID NO: 568058 - RNA, 22 nt, Coxiella burnetii RSA 493
gacagaaaaagcggauaagcca

SEQ ID NO: 568059 - RNA, 20 nt, Coxiella burnetii RSA 493
gacagaaggcagaggacaga

SEQ ID NO: 568060 - RNA, 19 nt, Coxiella burnetii RSA 493
gacaaggcucacaauuaac

SEQ ID NO: 568061 - RNA, 16 nt, Coxiella burnetii RSA 493
gacaauagaauaauga

SEQ ID NO: 568062 - RNA, 19 nt, Coxiella burnetii RSA 493
gacaauagaauaaugaaca

SEQ ID NO: 568063 - RNA, 19 nt, Coxiella burnetii RSA 493
gacaaugcccgaaaaggaa

SEQ ID NO: 568064 - RNA, 16 nt, Coxiella burnetii RSA 493
gacaauucccccaaaa

SEQ ID NO: 568065 - RNA, 21 nt, Coxiella burnetii RSA 493
gacaagccccuuuaaugcauu

SEQ ID NO: 568066 - RNA, 19 nt, Coxiella burnetii RSA 493
gaauuuuaacaagcuggca

SEQ ID NO: 568067 - RNA, 15 nt, Coxiella burnetii RSA 493
gaauuugugauuuua

SEQ ID NO: 568068 - RNA, 13 nt, Coxiella burnetii RSA 493
cuuugguuaugga

SEQ ID NO: 568069 - RNA, 21 nt, Coxiella burnetii RSA 493
cuuuggguuggcuuuugacaa

SEQ ID NO: 568070 - RNA, 18 nt, Coxiella burnetii RSA 493
gacaaauaaacaaguuaa

SEQ ID NO: 568071 - RNA, 23 nt, Coxiella burnetii RSA 493
gacaaauaaagaauuugacaagc

SEQ ID NO: 568072 - RNA, 13 nt, Coxiella burnetii RSA 493
gacaaagaaggcg

SEQ ID NO: 568073 - RNA, 13 nt, Coxiella burnetii RSA 493
gacauuuuuucaa

SEQ ID NO: 568074 - RNA, 16 nt, Coxiella burnetii RSA 493
gaccaaggguauuuuu

SEQ ID NO: 568075 - RNA, 17 nt, Coxiella burnetii RSA 493
gaccaaggguauuuuuu

SEQ ID NO: 568076 - RNA, 14 nt, Coxiella burnetii RSA 493
gacaucguuguuuu

SEQ ID NO: 568077 - RNA, 17 nt, Coxiella burnetii RSA 493
gacaucggcuuuuucaa

SEQ ID NO: 568078 - RNA, 18 nt, Coxiella burnetii RSA 493
gacauuguucauaaaaua

SEQ ID NO: 568079 - RNA, 21 nt, Coxiella burnetii RSA 493
gacauggcgguaaugagaacc

SEQ ID NO: 568080 - RNA, 23 nt, Coxiella burnetii RSA 493
gacauauucgcuccauuguuucg

SEQ ID NO: 568081 - RNA, 18 nt, Coxiella burnetii RSA 493
gacaguuggcuaaaucca

SEQ ID NO: 568082 - RNA, 20 nt, Coxiella burnetii RSA 493
gacaguuggcuaaauccagc

SEQ ID NO: 568083 - RNA, 21 nt, Coxiella burnetii RSA 493
gacagguauuuuaaguaauuu

SEQ ID NO: 568084 - RNA, 19 nt, Coxiella burnetii RSA 493
cguugcaagcguuuuucau

SEQ ID NO: 568085 - RNA, 16 nt, Coxiella burnetii RSA 493
cguugccaguguuaau

SEQ ID NO: 568086 - RNA, 23 nt, Coxiella burnetii RSA 493
cguugaauagcaguuugccauua

SEQ ID NO: 568087 - RNA, 19 nt, Coxiella burnetii RSA 493
cguugauaaagauucugua

SEQ ID NO: 568088 - RNA, 15 nt, Coxiella burnetii RSA 493
cguugauuaauaaug

SEQ ID NO: 568089 - RNA, 15 nt, Coxiella burnetii RSA 493
cguuauccaugagca

SEQ ID NO: 568090 - RNA, 20 nt, Coxiella burnetii RSA 493
cguuauagccgcguucagcu

SEQ ID NO: 568091 - RNA, 16 nt, Coxiella burnetii RSA 493
cguuauagaguaaaua

SEQ ID NO: 568092 - RNA, 18 nt, Coxiella burnetii RSA 493
cgucauugaaaucuguaa

SEQ ID NO: 568093 - RNA, 18 nt, Coxiella burnetii RSA 493
cguuaugggaauuaaaca

SEQ ID NO: 568094 - RNA, 15 nt, Coxiella burnetii RSA 493
cguuccguauccauc

SEQ ID NO: 568095 - RNA, 22 nt, Coxiella burnetii RSA 493
cuaaagcggaagcagcuaauuu

SEQ ID NO: 568096 - RNA, 15 nt, Coxiella burnetii RSA 493
cuaaauaaggagcau

SEQ ID NO: 568097 - RNA, 17 nt, Coxiella burnetii RSA 493
cuaaaguacccaacaau

SEQ ID NO: 568098 - RNA, 17 nt, Coxiella burnetii RSA 493
cuaaagggggaacgaac

SEQ ID NO: 568099 - RNA, 13 nt, Coxiella burnetii RSA 493
cuaaagguaaaaa

SEQ ID NO: 568100 - RNA, 17 nt, Coxiella burnetii RSA 493
cuaaaauacuuaaaauu

SEQ ID NO: 568101 - RNA, 14 nt, Coxiella burnetii RSA 493
cuaaacaaaauaau

SEQ ID NO: 568102 - RNA, 16 nt, Coxiella burnetii RSA 493
cuaaacaaaauaauaa

SEQ ID NO: 568103 - RNA, 18 nt, Coxiella burnetii RSA 493
cuaaacaaaauaauaaug

SEQ ID NO: 568104 - RNA, 17 nt, Coxiella burnetii RSA 493
cuaaacgugcgacuucu

SEQ ID NO: 568105 - RNA, 15 nt, Coxiella burnetii RSA 493
cguuuugaaauuggu

SEQ ID NO: 568106 - RNA, 19 nt, Coxiella burnetii RSA 493
cguuuuccgcuaaauauuu

SEQ ID NO: 568107 - RNA, 16 nt, Coxiella burnetii RSA 493
cguuucugauuuuuga

SEQ ID NO: 568108 - RNA, 20 nt, Coxiella burnetii RSA 493
cguuucuuccauuagagccu

SEQ ID NO: 568109 - RNA, 18 nt, Coxiella burnetii RSA 493
cguuugagagguucagau

SEQ ID NO: 568110 - RNA, 19 nt, Coxiella burnetii RSA 493
cguuuauuuccgucaauuu

SEQ ID NO: 568111 - RNA, 20 nt, Coxiella burnetii RSA 493
cuacacguuaaauagccaac

SEQ ID NO: 568112 - RNA, 17 nt, Coxiella burnetii RSA 493
cuacauagcaaauaucu

SEQ ID NO: 568113 - RNA, 13 nt, Coxiella burnetii RSA 493
cuacaauaaacac

SEQ ID NO: 568114 - RNA, 15 nt, Coxiella burnetii RSA 493
cuaauuuuuuauccu

SEQ ID NO: 568115 - RNA, 20 nt, Coxiella burnetii RSA 493
cuaauuugauuuuuuuugcu

SEQ ID NO: 568116 - RNA, 23 nt, Coxiella burnetii RSA 493
cuaaauauuuagcaacuccgucu

SEQ ID NO: 568117 - RNA, 21 nt, Coxiella burnetii RSA 493
cuaaauccagcgauuguaauu

SEQ ID NO: 568118 - RNA, 18 nt, Coxiella burnetii RSA 493
cuaaaucgguugaagaaa

SEQ ID NO: 568119 - RNA, 22 nt, Coxiella burnetii RSA 493
cuaacguuacuccgccccccca

SEQ ID NO: 568120 - RNA, 14 nt, Coxiella burnetii RSA 493
cuaagauaugaaug

SEQ ID NO: 568121 - RNA, 13 nt, Coxiella burnetii RSA 493
cuaagagaaaaaa

SEQ ID NO: 568122 - RNA, 14 nt, Coxiella burnetii RSA 493
cuaagagaaaaaac

SEQ ID NO: 568123 - RNA, 18 nt, Coxiella burnetii RSA 493
cuaacucacuuuuuucag

SEQ ID NO: 568124 - RNA, 15 nt, Coxiella burnetii RSA 493
cuaagauagggaaag

SEQ ID NO: 568125 - RNA, 23 nt, Coxiella burnetii RSA 493
cuaauaacauugggauauauuaa

SEQ ID NO: 568126 - RNA, 20 nt, Coxiella burnetii RSA 493
cuaauaaucgauaauuacga

SEQ ID NO: 568127 - RNA, 12 nt, Coxiella burnetii RSA 493
cuaauaaaaaua

SEQ ID NO: 568128 - RNA, 15 nt, Coxiella burnetii RSA 493
cuaauaaaaauauua

SEQ ID NO: 568129 - RNA, 17 nt, Coxiella burnetii RSA 493
cuaauaaaacaagauac

SEQ ID NO: 568130 - RNA, 21 nt, Coxiella burnetii RSA 493
cuaaucggccuacuuuuucug

SEQ ID NO: 568131 - RNA, 20 nt, Coxiella burnetii RSA 493
cuaaucgucgacaaaaagac

SEQ ID NO: 568132 - RNA, 22 nt, Coxiella burnetii RSA 493
cuaaucgcaaugcuucuucaau

SEQ ID NO: 568133 - RNA, 17 nt, Coxiella burnetii RSA 493
cuaaugagaaacgugag

SEQ ID NO: 568134 - RNA, 13 nt, Coxiella burnetii RSA 493
cuaauucuuuuuu

SEQ ID NO: 568135 - RNA, 18 nt, Coxiella burnetii RSA 493
cuaauuauaagacgcuuu

SEQ ID NO: 568136 - RNA, 20 nt, Coxiella burnetii RSA 493
cuaaugauaauccacaauuu

SEQ ID NO: 568137 - RNA, 19 nt, Coxiella burnetii RSA 493
cuaaugcuuuuuuuacuuu

SEQ ID NO: 568138 - RNA, 14 nt, Coxiella burnetii RSA 493
cuacucuaauuuuc

SEQ ID NO: 568139 - RNA, 13 nt, Coxiella burnetii RSA 493
cuacucuuuuucu

SEQ ID NO: 568140 - RNA, 23 nt, Coxiella burnetii RSA 493
cuacucuuuuucuuagagagugg

SEQ ID NO: 568141 - RNA, 16 nt, Coxiella burnetii RSA 493
cuacuugauauucccu

SEQ ID NO: 568142 - RNA, 19 nt, Coxiella burnetii RSA 493
cuacuuagcugauuucucu

SEQ ID NO: 568143 - RNA, 18 nt, Coxiella burnetii RSA 493
cuacuuucucaauuucuc

SEQ ID NO: 568144 - RNA, 18 nt, Coxiella burnetii RSA 493
cuacuuguugaaaaccua

SEQ ID NO: 568145 - RNA, 15 nt, Coxiella burnetii RSA 493
cuacuuuacuuuuug

SEQ ID NO: 568146 - RNA, 12 nt, Coxiella burnetii RSA 493
cuacuuuauuua

SEQ ID NO: 568147 - RNA, 22 nt, Coxiella burnetii RSA 493
cuaggucugauaggaauucuuu

SEQ ID NO: 568148 - RNA, 20 nt, Coxiella burnetii RSA 493
cuagguuauuuuuuccuauu

SEQ ID NO: 568149 - RNA, 18 nt, Coxiella burnetii RSA 493
cuaguagucucagacucu

SEQ ID NO: 568150 - RNA, 18 nt, Coxiella burnetii RSA 493
cuaggcuucgucauuucc

SEQ ID NO: 568151 - RNA, 21 nt, Coxiella burnetii RSA 493
cuaggaaacgaaguucucaaa

SEQ ID NO: 568152 - RNA, 14 nt, Coxiella burnetii RSA 493
cuagcuauucuuuu

SEQ ID NO: 568153 - RNA, 14 nt, Coxiella burnetii RSA 493
cuagcguugaaaac

SEQ ID NO: 568154 - RNA, 14 nt, Coxiella burnetii RSA 493
cuagcuguuuuuuc

SEQ ID NO: 568155 - RNA, 16 nt, Coxiella burnetii RSA 493
cuagcuguuuuuucua

SEQ ID NO: 568156 - RNA, 14 nt, Coxiella burnetii RSA 493
cuagauuuuccugc

SEQ ID NO: 568157 - RNA, 13 nt, Coxiella burnetii RSA 493
cuauauuuucuuu

SEQ ID NO: 568158 - RNA, 17 nt, Coxiella burnetii RSA 493
cuauccagaaaccaaaa

SEQ ID NO: 568159 - RNA, 12 nt, Coxiella burnetii RSA 493
cuauccaaaaag

SEQ ID NO: 568160 - RNA, 16 nt, Coxiella burnetii RSA 493
cuauccaaaaagauaa

SEQ ID NO: 568161 - RNA, 22 nt, Coxiella burnetii RSA 493
cuauccaaaaagauaaucccaa

SEQ ID NO: 568162 - RNA, 20 nt, Coxiella burnetii RSA 493
cuaucagcaaucaaaugagc

SEQ ID NO: 568163 - RNA, 16 nt, Coxiella burnetii RSA 493
cuaguuauuuuucauc

SEQ ID NO: 568164 - RNA, 22 nt, Coxiella burnetii RSA 493
cuaucgugccaguauuuuucuu

SEQ ID NO: 568165 - RNA, 23 nt, Coxiella burnetii RSA 493
cuaucgugccaguauuuuucuuu

SEQ ID NO: 568166 - RNA, 19 nt, Coxiella burnetii RSA 493
cuauuccccuucuucaacu

SEQ ID NO: 568167 - RNA, 19 nt, Coxiella burnetii RSA 493
cuauuauuaauacaggaaa

SEQ ID NO: 568168 - RNA, 15 nt, Coxiella burnetii RSA 493
cuauuagcugccauu

SEQ ID NO: 568169 - RNA, 16 nt, Coxiella burnetii RSA 493
cuauuagcugccauuu

SEQ ID NO: 568170 - RNA, 13 nt, Coxiella burnetii RSA 493
cuauuagcuggca

SEQ ID NO: 568171 - RNA, 20 nt, Coxiella burnetii RSA 493
cuauuagucuuaauuuuaaa

SEQ ID NO: 568172 - RNA, 14 nt, Coxiella burnetii RSA 493
cuauuagccuuaau

SEQ ID NO: 568173 - RNA, 13 nt, Coxiella burnetii RSA 493
cucaacagccuuc

SEQ ID NO: 568174 - RNA, 21 nt, Coxiella burnetii RSA 493
cucaacgguaugucggauuuc

SEQ ID NO: 568175 - RNA, 13 nt, Coxiella burnetii RSA 493
cucaaauuuuccc

SEQ ID NO: 568176 - RNA, 22 nt, Coxiella burnetii RSA 493
cucaaauuuucccaggaaagaa

SEQ ID NO: 568177 - RNA, 18 nt, Coxiella burnetii RSA 493
cuauugaagucugguuaa

SEQ ID NO: 568178 - RNA, 16 nt, Coxiella burnetii RSA 493
cucaccccgauuuaau

SEQ ID NO: 568179 - RNA, 17 nt, Coxiella burnetii RSA 493
cucaauagaaaaaagaa

SEQ ID NO: 568180 - RNA, 21 nt, Coxiella burnetii RSA 493
cucaauagucuuuuuauauuc

SEQ ID NO: 568181 - RNA, 14 nt, Coxiella burnetii RSA 493
cucacacaacucca

SEQ ID NO: 568182 - RNA, 19 nt, Coxiella burnetii RSA 493
cucauuaggcuuuagaaga

SEQ ID NO: 568183 - RNA, 18 nt, Coxiella burnetii RSA 493
cuccaaagggaccuuuuu

SEQ ID NO: 568184 - RNA, 17 nt, Coxiella burnetii RSA 493
cucauugccaaagaaau

SEQ ID NO: 568185 - RNA, 18 nt, Coxiella burnetii RSA 493
cucauuggcgguuaaggu

SEQ ID NO: 568186 - RNA, 17 nt, Coxiella burnetii RSA 493
cucaguuguuagcuuuu

SEQ ID NO: 568187 - RNA, 15 nt, Coxiella burnetii RSA 493
cucagucugucguuu

SEQ ID NO: 568188 - RNA, 15 nt, Coxiella burnetii RSA 493
cucaguuaaaauaau

SEQ ID NO: 568189 - RNA, 18 nt, Coxiella burnetii RSA 493
cucauaaucgauaaucaa

SEQ ID NO: 568190 - RNA, 22 nt, Coxiella burnetii RSA 493
cucauacgggcuacuuuacuug

SEQ ID NO: 568191 - RNA, 15 nt, Coxiella burnetii RSA 493
cucagcgucuuuuuu

SEQ ID NO: 568192 - RNA, 12 nt, Coxiella burnetii RSA 493
cuccuuuugcua

SEQ ID NO: 568193 - RNA, 13 nt, Coxiella burnetii RSA 493
cuccuuuuaaagg

SEQ ID NO: 568194 - RNA, 16 nt, Coxiella burnetii RSA 493
cuccuuguuuuaaccu

SEQ ID NO: 568195 - RNA, 12 nt, Coxiella burnetii RSA 493
cucgaaugacaa

SEQ ID NO: 568196 - RNA, 13 nt, Coxiella burnetii RSA 493
cucgaaugacaac

SEQ ID NO: 568197 - RNA, 21 nt, Coxiella burnetii RSA 493
cucuaagcguaacgucacaaa

SEQ ID NO: 568198 - RNA, 18 nt, Coxiella burnetii RSA 493
cucguucuuuuauuucuu

SEQ ID NO: 568199 - RNA, 20 nt, Coxiella burnetii RSA 493
cucguugauaaagauucugu

SEQ ID NO: 568200 - RNA, 23 nt, Coxiella burnetii RSA 493
cucguagcaccacuacuucugac

SEQ ID NO: 568201 - RNA, 23 nt, Coxiella burnetii RSA 493
cucgcgaaauuuaauaaaauuaa

SEQ ID NO: 568202 - RNA, 14 nt, Coxiella burnetii RSA 493
cucggggacagcaa

SEQ ID NO: 568203 - RNA, 20 nt, Coxiella burnetii RSA 493
cucuauaucuuuuaaauuaa

SEQ ID NO: 568204 - RNA, 13 nt, Coxiella burnetii RSA 493
cucucaaagaaac

SEQ ID NO: 568205 - RNA, 20 nt, Coxiella burnetii RSA 493
cucucauaaucgauaaucaa

SEQ ID NO: 568206 - RNA, 21 nt, Coxiella burnetii RSA 493
cucucauaaucgauaaucaac

SEQ ID NO: 568207 - RNA, 19 nt, Coxiella burnetii RSA 493
cucucuagcuguuuuuucu

SEQ ID NO: 568208 - RNA, 21 nt, Coxiella burnetii RSA 493
cucucucauaaucgauaauca

SEQ ID NO: 568209 - RNA, 17 nt, Coxiella burnetii RSA 493
cucucuuuauuuuuucu

SEQ ID NO: 568210 - RNA, 13 nt, Coxiella burnetii RSA 493
cucuggugacauc

SEQ ID NO: 568211 - RNA, 18 nt, Coxiella burnetii RSA 493
cucuguuagauauugaac

SEQ ID NO: 568212 - RNA, 18 nt, Coxiella burnetii RSA 493
cucuguucccccacuuca

SEQ ID NO: 568213 - RNA, 22 nt, Coxiella burnetii RSA 493
cucuuaaaagacguaccauuaa

SEQ ID NO: 568214 - RNA, 22 nt, Coxiella burnetii RSA 493
cucuugucggccggauuuuaau

SEQ ID NO: 568215 - RNA, 18 nt, Coxiella burnetii RSA 493
cucuuuauuauaaaaaaa

SEQ ID NO: 568216 - RNA, 15 nt, Coxiella burnetii RSA 493
cucuuuaccuccucc

SEQ ID NO: 568217 - RNA, 20 nt, Coxiella burnetii RSA 493
cucuuuagauucaugaaaau

SEQ ID NO: 568218 - RNA, 16 nt, Coxiella burnetii RSA 493
cucuuuauuuuuucuu

SEQ ID NO: 568219 - RNA, 18 nt, Coxiella burnetii RSA 493
cucuuuauuuuuucuuug

SEQ ID NO: 568220 - RNA, 20 nt, Coxiella burnetii RSA 493
cucuugcccccauugauaau

SEQ ID NO: 568221 - RNA, 16 nt, Coxiella burnetii RSA 493
cucuucuuaaaccaaa

SEQ ID NO: 568222 - RNA, 14 nt, Coxiella burnetii RSA 493
cucuuuuucauuuc

SEQ ID NO: 568223 - RNA, 13 nt, Coxiella burnetii RSA 493
cucuuuuuuccaa

SEQ ID NO: 568224 - RNA, 20 nt, Coxiella burnetii RSA 493
cugaagaggcugaauaagcu

SEQ ID NO: 568225 - RNA, 21 nt, Coxiella burnetii RSA 493
cugaagaggcugaauaagcug

SEQ ID NO: 568226 - RNA, 14 nt, Coxiella burnetii RSA 493
cugaagaguaaaaa

SEQ ID NO: 568227 - RNA, 17 nt, Coxiella burnetii RSA 493
cugaacgcucuuccaac

SEQ ID NO: 568228 - RNA, 14 nt, Coxiella burnetii RSA 493
cugaaccuaaauua

SEQ ID NO: 568229 - RNA, 20 nt, Coxiella burnetii RSA 493
cugaaccuaaauuauaaaug

SEQ ID NO: 568230 - RNA, 22 nt, Coxiella burnetii RSA 493
cugaacauuaagaaagcgagca

SEQ ID NO: 568231 - RNA, 17 nt, Coxiella burnetii RSA 493
cugaacaggauuuucau

SEQ ID NO: 568232 - RNA, 16 nt, Coxiella burnetii RSA 493
cugaaugagauaacuc

SEQ ID NO: 568233 - RNA, 13 nt, Coxiella burnetii RSA 493
cugaauucccuuu

SEQ ID NO: 568234 - RNA, 20 nt, Coxiella burnetii RSA 493
cugaauugaugauguuuauu

SEQ ID NO: 568235 - RNA, 14 nt, Coxiella burnetii RSA 493
cugaaguccuuguu

SEQ ID NO: 568236 - RNA, 20 nt, Coxiella burnetii RSA 493
cugacaguuggcuaaaucca

SEQ ID NO: 568237 - RNA, 18 nt, Coxiella burnetii RSA 493
cugacgucccgugaugaa

SEQ ID NO: 568238 - RNA, 19 nt, Coxiella burnetii RSA 493
cugagaaaacuuuucaucc

SEQ ID NO: 568239 - RNA, 18 nt, Coxiella burnetii RSA 493
cugagcaaacagcuagcc

SEQ ID NO: 568240 - RNA, 21 nt, Coxiella burnetii RSA 493
cugauguaaggcaucuuuuuc

SEQ ID NO: 568241 - RNA, 16 nt, Coxiella burnetii RSA 493
cugcaccauaacuaaa

SEQ ID NO: 568242 - RNA, 21 nt, Coxiella burnetii RSA 493
cugccauuugcggaaaaggag

SEQ ID NO: 568243 - RNA, 22 nt, Coxiella burnetii RSA 493
cugccauuuguauggcgccuga

SEQ ID NO: 568244 - RNA, 20 nt, Coxiella burnetii RSA 493
cugccauuuucauuuucucu

SEQ ID NO: 568245 - RNA, 12 nt, Coxiella burnetii RSA 493
cugcaugccaaa

SEQ ID NO: 568246 - RNA, 21 nt, Coxiella burnetii RSA 493
cugcugauugagaaucucuuc

SEQ ID NO: 568247 - RNA, 14 nt, Coxiella burnetii RSA 493
cugcuccuuuucuu

SEQ ID NO: 568248 - RNA, 15 nt, Coxiella burnetii RSA 493
cugcggcgauucaug

SEQ ID NO: 568249 - RNA, 16 nt, Coxiella burnetii RSA 493
cugcgcuccagaugau

SEQ ID NO: 568250 - RNA, 15 nt, Coxiella burnetii RSA 493
cugccuucuguccuc

SEQ ID NO: 568251 - RNA, 19 nt, Coxiella burnetii RSA 493
cugcuuccucuucuacugu

SEQ ID NO: 568252 - RNA, 24 nt, Coxiella burnetii RSA 493
cugggaugguaaucucacuuggau

SEQ ID NO: 568253 - RNA, 16 nt, Coxiella burnetii RSA 493
cugggccaggaccaaa

SEQ ID NO: 568254 - RNA, 19 nt, Coxiella burnetii RSA 493
cugucaucaucgucaaaug

SEQ ID NO: 568255 - RNA, 19 nt, Coxiella burnetii RSA 493
cugugccacuuucgauaaa

SEQ ID NO: 568256 - RNA, 13 nt, Coxiella burnetii RSA 493
cugugccugccau

SEQ ID NO: 568257 - RNA, 14 nt, Coxiella burnetii RSA 493
cugugccugccauu

SEQ ID NO: 568258 - RNA, 15 nt, Coxiella burnetii RSA 493
cugugccugccauuu

SEQ ID NO: 568259 - RNA, 18 nt, Coxiella burnetii RSA 493
cugucgauacccaaucaa

SEQ ID NO: 568260 - RNA, 15 nt, Coxiella burnetii RSA 493
cuguccucugccuuc

SEQ ID NO: 568261 - RNA, 15 nt, Coxiella burnetii RSA 493
cuguccucuguuccc

SEQ ID NO: 568262 - RNA, 22 nt, Coxiella burnetii RSA 493
cuguguugggcucgaaaaacuu

SEQ ID NO: 568263 - RNA, 15 nt, Coxiella burnetii RSA 493
cuguuagauauugaa

SEQ ID NO: 568264 - RNA, 20 nt, Coxiella burnetii RSA 493
cuguggcaauuaugaaaacg

SEQ ID NO: 568265 - RNA, 18 nt, Coxiella burnetii RSA 493
cuguggauuaauucccaa

SEQ ID NO: 568266 - RNA, 14 nt, Coxiella burnetii RSA 493
cugugguuaauucu

SEQ ID NO: 568267 - RNA, 11 nt, Coxiella burnetii RSA 493
cuucuuuucua

SEQ ID NO: 568268 - RNA, 17 nt, Coxiella burnetii RSA 493
cuucuuuuaaagugauu

SEQ ID NO: 568269 - RNA, 15 nt, Coxiella burnetii RSA 493
cuucuuuuaagugga

SEQ ID NO: 568270 - RNA, 24 nt, Coxiella burnetii RSA 493
cuugaauaaacgccacauuuguuc

SEQ ID NO: 568271 - RNA, 15 nt, Coxiella burnetii RSA 493
cuugaaucauugaag

SEQ ID NO: 568272 - RNA, 20 nt, Coxiella burnetii RSA 493
cuugacgcucagauaaauga

SEQ ID NO: 568273 - RNA, 17 nt, Coxiella burnetii RSA 493
cuugauauucccucuuu

SEQ ID NO: 568274 - RNA, 22 nt, Coxiella burnetii RSA 493
cuugagaguaaauguuucuuuu

SEQ ID NO: 568275 - RNA, 21 nt, Coxiella burnetii RSA 493
cuugcaaacaaacgauaaucu

SEQ ID NO: 568276 - RNA, 20 nt, Coxiella burnetii RSA 493
cuugaucuugggcaaaaaaa

SEQ ID NO: 568277 - RNA, 23 nt, Coxiella burnetii RSA 493
cuugcaacguuugauuuucaagu

SEQ ID NO: 568278 - RNA, 21 nt, Coxiella burnetii RSA 493
cuugccgcugcgguauuguuc

SEQ ID NO: 568279 - RNA, 15 nt, Coxiella burnetii RSA 493
cuugccgauuuguuu

SEQ ID NO: 568280 - RNA, 12 nt, Coxiella burnetii RSA 493
cuuggauuuuaa

SEQ ID NO: 568281 - RNA, 14 nt, Coxiella burnetii RSA 493
cuugguugauucaa

SEQ ID NO: 568282 - RNA, 15 nt, Coxiella burnetii RSA 493
cuugggcaaaaaaag

SEQ ID NO: 568283 - RNA, 20 nt, Coxiella burnetii RSA 493
cuugggcaaaaaaagaaaau

SEQ ID NO: 568284 - RNA, 19 nt, Coxiella burnetii RSA 493
cuuuaacuuuagcuaauuc

SEQ ID NO: 568285 - RNA, 17 nt, Coxiella burnetii RSA 493
cuuuaagaucgcuguau

SEQ ID NO: 568286 - RNA, 18 nt, Coxiella burnetii RSA 493
cuuuaagauuucuucacg

SEQ ID NO: 568287 - RNA, 19 nt, Coxiella burnetii RSA 493
cuuuagauucaugaaaauc

SEQ ID NO: 568288 - RNA, 20 nt, Coxiella burnetii RSA 493
cuuuacuuuuuguagguuaa

SEQ ID NO: 568289 - RNA, 14 nt, Coxiella burnetii RSA 493
cuuuauuuuuucuu

SEQ ID NO: 568290 - RNA, 23 nt, Coxiella burnetii RSA 493
cuuucaauaaauaaaucaagugu

SEQ ID NO: 568291 - RNA, 23 nt, Coxiella burnetii RSA 493
cuuucaauuacuuuuauaaucaa

SEQ ID NO: 568292 - RNA, 15 nt, Coxiella burnetii RSA 493
cuuuaguuuuucccu

SEQ ID NO: 568293 - RNA, 13 nt, Coxiella burnetii RSA 493
cuuugaaccacua

SEQ ID NO: 568294 - RNA, 13 nt, Coxiella burnetii RSA 493
cuuucuucacuuu

SEQ ID NO: 568295 - RNA, 14 nt, Coxiella burnetii RSA 493
cuuucuucacuuuc

SEQ ID NO: 568296 - RNA, 23 nt, Coxiella burnetii RSA 493
cuuucugauuuuacgcuauuuuu

SEQ ID NO: 568297 - RNA, 16 nt, Coxiella burnetii RSA 493
cuuucguugugcucuc

SEQ ID NO: 568298 - RNA, 20 nt, Coxiella burnetii RSA 493
cuuucauuuaauuuuaaauc

SEQ ID NO: 568299 - RNA, 14 nt, Coxiella burnetii RSA 493
cuuucgucauuccc

SEQ ID NO: 568300 - RNA, 19 nt, Coxiella burnetii RSA 493
cuuugauaaauuaaaaaaa

SEQ ID NO: 568301 - RNA, 20 nt, Coxiella burnetii RSA 493
cuuugauaagcauaauucau

SEQ ID NO: 568302 - RNA, 22 nt, Coxiella burnetii RSA 493
cuuugccccguuccaauauuuu

SEQ ID NO: 568303 - RNA, 16 nt, Coxiella burnetii RSA 493
cuuugcugaccuuuuc

SEQ ID NO: 568304 - RNA, 15 nt, Coxiella burnetii RSA 493
cuuugcuaagauaau

SEQ ID NO: 568305 - RNA, 16 nt, Coxiella burnetii RSA 493
cuuugcuaagauaauu

SEQ ID NO: 568306 - RNA, 22 nt, Coxiella burnetii RSA 493
cuuugcuaagauaauuacaauc

SEQ ID NO: 568307 - RNA, 14 nt, Coxiella burnetii RSA 493
cuuugcucuaaauu

SEQ ID NO: 568308 - RNA, 20 nt, Coxiella burnetii RSA 493
cuuugcgcguucaauauguu

SEQ ID NO: 568309 - RNA, 16 nt, Coxiella burnetii RSA 493
cuuuggauaauuuuua

SEQ ID NO: 568310 - RNA, 16 nt, Coxiella burnetii RSA 493
cuuaaauuuugacauu

SEQ ID NO: 568311 - RNA, 12 nt, Coxiella burnetii RSA 493
cuuaacaguaac

SEQ ID NO: 568312 - RNA, 13 nt, Coxiella burnetii RSA 493
cuguucgccagaa

SEQ ID NO: 568313 - RNA, 23 nt, Coxiella burnetii RSA 493
cuuaagaaaguauccuccgaaua

SEQ ID NO: 568314 - RNA, 15 nt, Coxiella burnetii RSA 493
cuuaacgccuaucuu

SEQ ID NO: 568315 - RNA, 19 nt, Coxiella burnetii RSA 493
cuuaacgccuaucuuuuuc

SEQ ID NO: 568316 - RNA, 18 nt, Coxiella burnetii RSA 493
cuuaacuccuucgcuuuu

SEQ ID NO: 568317 - RNA, 20 nt, Coxiella burnetii RSA 493
cuuaacuccuucgcuuuuuc

SEQ ID NO: 568318 - RNA, 22 nt, Coxiella burnetii RSA 493
cuuaacuccuucgcuuuuucca

SEQ ID NO: 568319 - RNA, 23 nt, Coxiella burnetii RSA 493
cuuaagagauagugcuauuuuuc

SEQ ID NO: 568320 - RNA, 15 nt, Coxiella burnetii RSA 493
cuuaaggacaguugg

SEQ ID NO: 568321 - RNA, 22 nt, Coxiella burnetii RSA 493
cuuaaguugacgccuauugccc

SEQ ID NO: 568322 - RNA, 21 nt, Coxiella burnetii RSA 493
cuuaauacccguuucuuauuc

SEQ ID NO: 568323 - RNA, 17 nt, Coxiella burnetii RSA 493
cuuauugcccucguuuu

SEQ ID NO: 568324 - RNA, 17 nt, Coxiella burnetii RSA 493
cuuaucuuaaaccucaa

SEQ ID NO: 568325 - RNA, 18 nt, Coxiella burnetii RSA 493
cuuauaaauuaaauugcu

SEQ ID NO: 568326 - RNA, 14 nt, Coxiella burnetii RSA 493
cuucaaaaauaaaa

SEQ ID NO: 568327 - RNA, 23 nt, Coxiella burnetii RSA 493
cuuauuuuuauucuuaauuuuuc

SEQ ID NO: 568328 - RNA, 21 nt, Coxiella burnetii RSA 493
cuucaacuccugaaaaauaau

SEQ ID NO: 568329 - RNA, 17 nt, Coxiella burnetii RSA 493
cuucacgaaguugacga

SEQ ID NO: 568330 - RNA, 13 nt, Coxiella burnetii RSA 493
cuucaauucuuuu

SEQ ID NO: 568331 - RNA, 19 nt, Coxiella burnetii RSA 493
cuucggauugcccgguaac

SEQ ID NO: 568332 - RNA, 22 nt, Coxiella burnetii RSA 493
cuucgguaucgguaauuuguuu

SEQ ID NO: 568333 - RNA, 12 nt, Coxiella burnetii RSA 493
cuucgagaggaa

SEQ ID NO: 568334 - RNA, 22 nt, Coxiella burnetii RSA 493
cuucgcucauacgggcuacuuu

SEQ ID NO: 568335 - RNA, 17 nt, Coxiella burnetii RSA 493
cuucuaaguaaacagca

SEQ ID NO: 568336 - RNA, 20 nt, Coxiella burnetii RSA 493
cuucuaauuugaaaaaccca

SEQ ID NO: 568337 - RNA, 12 nt, Coxiella burnetii RSA 493
cuucuauucccu

SEQ ID NO: 568338 - RNA, 15 nt, Coxiella burnetii RSA 493
cuucuauucccuuuu

SEQ ID NO: 568339 - RNA, 18 nt, Coxiella burnetii RSA 493
cuucuauucccuuuugga

SEQ ID NO: 568340 - RNA, 15 nt, Coxiella burnetii RSA 493
cuucuagaaaaccca

SEQ ID NO: 568341 - RNA, 17 nt, Coxiella burnetii RSA 493
cuucguaggccgcuuuu

SEQ ID NO: 568342 - RNA, 15 nt, Coxiella burnetii RSA 493
cuucgucauuuccgu

SEQ ID NO: 568343 - RNA, 21 nt, Coxiella burnetii RSA 493
cuucaucuuuagcaauauaac

SEQ ID NO: 568344 - RNA, 17 nt, Coxiella burnetii RSA 493
cuucaugaauauuuuuc

SEQ ID NO: 568345 - RNA, 14 nt, Coxiella burnetii RSA 493
cuucaugcaaaaau

SEQ ID NO: 568346 - RNA, 13 nt, Coxiella burnetii RSA 493
cuuccaauaacau

SEQ ID NO: 568347 - RNA, 23 nt, Coxiella burnetii RSA 493
cuuccaauaacauaucuucaaca

SEQ ID NO: 568348 - RNA, 16 nt, Coxiella burnetii RSA 493
cuuccaauaaggcauu

SEQ ID NO: 568349 - RNA, 17 nt, Coxiella burnetii RSA 493
cuucaucgauugcuaaa

SEQ ID NO: 568350 - RNA, 15 nt, Coxiella burnetii RSA 493
cuucacuuuucuggc

SEQ ID NO: 568351 - RNA, 14 nt, Coxiella burnetii RSA 493
cuuccuuaaagcaa

SEQ ID NO: 568352 - RNA, 19 nt, Coxiella burnetii RSA 493
cuuccuaucaauauuucgu

SEQ ID NO: 568353 - RNA, 21 nt, Coxiella burnetii RSA 493
cuucccauucuauaaucauuu

SEQ ID NO: 568354 - RNA, 16 nt, Coxiella burnetii RSA 493
cgauucauaaaaaaug

SEQ ID NO: 568355 - RNA, 20 nt, Coxiella burnetii RSA 493
cgcaaaguaaaaaugaaauc

SEQ ID NO: 568356 - RNA, 22 nt, Coxiella burnetii RSA 493
cgcaagugaccgagauuuuucc

SEQ ID NO: 568357 - RNA, 20 nt, Coxiella burnetii RSA 493
cgcaauacgccgcugcucau

SEQ ID NO: 568358 - RNA, 13 nt, Coxiella burnetii RSA 493
cgcaauaugcagc

SEQ ID NO: 568359 - RNA, 18 nt, Coxiella burnetii RSA 493
cgcaaaucggaaaagcca

SEQ ID NO: 568360 - RNA, 19 nt, Coxiella burnetii RSA 493
cgcagcgacggauuuugcu

SEQ ID NO: 568361 - RNA, 13 nt, Coxiella burnetii RSA 493
cgauggcauucuu

SEQ ID NO: 568362 - RNA, 23 nt, Coxiella burnetii RSA 493
cgauguaguuuuguccauuuguu

SEQ ID NO: 568363 - RNA, 11 nt, Coxiella burnetii RSA 493
cgaugauaaag

SEQ ID NO: 568364 - RNA, 22 nt, Coxiella burnetii RSA 493
cgaugauuaaaucaacacccca

SEQ ID NO: 568365 - RNA, 15 nt, Coxiella burnetii RSA 493
cgaugacaaauaaac

SEQ ID NO: 568366 - RNA, 23 nt, Coxiella burnetii RSA 493
cgaugacccucuuuuuaaaaaau

SEQ ID NO: 568367 - RNA, 19 nt, Coxiella burnetii RSA 493
cgauacuuuguuuuuuuuc

SEQ ID NO: 568368 - RNA, 21 nt, Coxiella burnetii RSA 493
cgauccgagcccaauaacaag

SEQ ID NO: 568369 - RNA, 21 nt, Coxiella burnetii RSA 493
cgccauauuugcugaauuuua

SEQ ID NO: 568370 - RNA, 18 nt, Coxiella burnetii RSA 493
cgccauagggucgaauuc

SEQ ID NO: 568371 - RNA, 14 nt, Coxiella burnetii RSA 493
cgccaggcuaugau

SEQ ID NO: 568372 - RNA, 21 nt, Coxiella burnetii RSA 493
cgccauuucgcuuuuauuucc

SEQ ID NO: 568373 - RNA, 12 nt, Coxiella burnetii RSA 493
cgccauuuccca

SEQ ID NO: 568374 - RNA, 21 nt, Coxiella burnetii RSA 493
cgccauggggcgagcgcccau

SEQ ID NO: 568375 - RNA, 11 nt, Coxiella burnetii RSA 493
cgccuacaaau

SEQ ID NO: 568376 - RNA, 21 nt, Coxiella burnetii RSA 493
cgccucugaauugaaguccuu

SEQ ID NO: 568377 - RNA, 20 nt, Coxiella burnetii RSA 493
cgccugacaaagcggccgcu

SEQ ID NO: 568378 - RNA, 18 nt, Coxiella burnetii RSA 493
cgcgaacucagcccaaca

SEQ ID NO: 568379 - RNA, 12 nt, Coxiella burnetii RSA 493
cgccuuaauaug

SEQ ID NO: 568380 - RNA, 21 nt, Coxiella burnetii RSA 493
cgccuguaaggucucaacagc

SEQ ID NO: 568381 - RNA, 23 nt, Coxiella burnetii RSA 493
cgccugcuaaaauaagguuaaau

SEQ ID NO: 568382 - RNA, 23 nt, Coxiella burnetii RSA 493
cgcgacaagaauuuuuuuauaau

SEQ ID NO: 568383 - RNA, 13 nt, Coxiella burnetii RSA 493
cgcgcaccagggg

SEQ ID NO: 568384 - RNA, 16 nt, Coxiella burnetii RSA 493
cgcgccacaagcggcg

SEQ ID NO: 568385 - RNA, 17 nt, Coxiella burnetii RSA 493
cgcccuuucucuuuuuu

SEQ ID NO: 568386 - RNA, 23 nt, Coxiella burnetii RSA 493
cgccgagaguaacgauuucucuu

SEQ ID NO: 568387 - RNA, 18 nt, Coxiella burnetii RSA 493
cgguuaauagcaucaagg

SEQ ID NO: 568388 - RNA, 15 nt, Coxiella burnetii RSA 493
cgguuagugggaagc

SEQ ID NO: 568389 - RNA, 20 nt, Coxiella burnetii RSA 493
cguaacgauggucaaaccaa

SEQ ID NO: 568390 - RNA, 12 nt, Coxiella burnetii RSA 493
cguaaaauucca

SEQ ID NO: 568391 - RNA, 14 nt, Coxiella burnetii RSA 493
cgguuguaauaaug

SEQ ID NO: 568392 - RNA, 18 nt, Coxiella burnetii RSA 493
cguaacgucacaaauaaa

SEQ ID NO: 568393 - RNA, 17 nt, Coxiella burnetii RSA 493
cguaucgauuucuuuuu

SEQ ID NO: 568394 - RNA, 13 nt, Coxiella burnetii RSA 493
cguaugaauaauu

SEQ ID NO: 568395 - RNA, 14 nt, Coxiella burnetii RSA 493
cguaugaauaauuu

SEQ ID NO: 568396 - RNA, 18 nt, Coxiella burnetii RSA 493
cguaugaaucagcuuaau

SEQ ID NO: 568397 - RNA, 12 nt, Coxiella burnetii RSA 493
cguauuccaaau

SEQ ID NO: 568398 - RNA, 20 nt, Coxiella burnetii RSA 493
cguauugucaaaauuagaau

SEQ ID NO: 568399 - RNA, 11 nt, Coxiella burnetii RSA 493
cguauuuuuuc

SEQ ID NO: 568400 - RNA, 16 nt, Coxiella burnetii RSA 493
cguauuugcaauaguc

SEQ ID NO: 568401 - RNA, 23 nt, Coxiella burnetii RSA 493
cguauuuguucguaauaauaagc

SEQ ID NO: 568402 - RNA, 19 nt, Coxiella burnetii RSA 493
cgucacaaauaaagcagca

SEQ ID NO: 568403 - RNA, 19 nt, Coxiella burnetii RSA 493
cgggcggcaacucuacuuc

SEQ ID NO: 568404 - RNA, 23 nt, Coxiella burnetii RSA 493
cgggcuacucuaauuuucuuucc

SEQ ID NO: 568405 - RNA, 17 nt, Coxiella burnetii RSA 493
cgggcuacucuuuuucu

SEQ ID NO: 568406 - RNA, 20 nt, Coxiella burnetii RSA 493
cgggaagggcgaggguaaua

SEQ ID NO: 568407 - RNA, 17 nt, Coxiella burnetii RSA 493
cgcugaguggaaaacca

SEQ ID NO: 568408 - RNA, 17 nt, Coxiella burnetii RSA 493
cgcuuguuuuauaccuu

SEQ ID NO: 568409 - RNA, 21 nt, Coxiella burnetii RSA 493
cgcuugcacgggaaugacgaa

SEQ ID NO: 568410 - RNA, 17 nt, Coxiella burnetii RSA 493
cgcuuuuucccucucag

SEQ ID NO: 568411 - RNA, 21 nt, Coxiella burnetii RSA 493
cgcuuuuggcuacuuucucaa

SEQ ID NO: 568412 - RNA, 16 nt, Coxiella burnetii RSA 493
cggaaaauggaaacga

SEQ ID NO: 568413 - RNA, 19 nt, Coxiella burnetii RSA 493
cgcuuuuuugcuucuucca

SEQ ID NO: 568414 - RNA, 24 nt, Coxiella burnetii RSA 493
cggaaaaaggcucgugcauagcau

SEQ ID NO: 568415 - RNA, 18 nt, Coxiella burnetii RSA 493
cgcuguaaccgccuuuaa

SEQ ID NO: 568416 - RNA, 16 nt, Coxiella burnetii RSA 493
cgcuaaaaucacgcca

SEQ ID NO: 568417 - RNA, 10 nt, Coxiella burnetii RSA 493
cgcuaugaaa

SEQ ID NO: 568418 - RNA, 14 nt, Coxiella burnetii RSA 493
cgcuauuuuuuaaa

SEQ ID NO: 568419 - RNA, 14 nt, Coxiella burnetii RSA 493
cgcgguaaggaaca

SEQ ID NO: 568420 - RNA, 13 nt, Coxiella burnetii RSA 493
cgcggccgcggcu

SEQ ID NO: 568421 - RNA, 19 nt, Coxiella burnetii RSA 493
cggauguuuuuucacuucu

SEQ ID NO: 568422 - RNA, 12 nt, Coxiella burnetii RSA 493
cggauuaaaaaa

SEQ ID NO: 568423 - RNA, 18 nt, Coxiella burnetii RSA 493
cggauuuuaauugaauuu

SEQ ID NO: 568424 - RNA, 16 nt, Coxiella burnetii RSA 493
cggauuggcuuugccu

SEQ ID NO: 568425 - RNA, 16 nt, Coxiella burnetii RSA 493
cggaucuaagucuauu

SEQ ID NO: 568426 - RNA, 20 nt, Coxiella burnetii RSA 493
cggauaagccauuaaaagca

SEQ ID NO: 568427 - RNA, 19 nt, Coxiella burnetii RSA 493
cggccgcugugccugccau

SEQ ID NO: 568428 - RNA, 13 nt, Coxiella burnetii RSA 493
ccacgcauacgau

SEQ ID NO: 568429 - RNA, 22 nt, Coxiella burnetii RSA 493
ccacgauucaaccaacuguuua

SEQ ID NO: 568430 - RNA, 17 nt, Coxiella burnetii RSA 493
ccaaaaaacuuagccaa

SEQ ID NO: 568431 - RNA, 22 nt, Coxiella burnetii RSA 493
cauuuuuuugucgaauuuuugc

SEQ ID NO: 568432 - RNA, 14 nt, Coxiella burnetii RSA 493
cauuuuuuccucuu

SEQ ID NO: 568433 - RNA, 22 nt, Coxiella burnetii RSA 493
cauuuuuucguuauagccgcgu

SEQ ID NO: 568434 - RNA, 14 nt, Coxiella burnetii RSA 493
ccaccgauguggca

SEQ ID NO: 568435 - RNA, 20 nt, Coxiella burnetii RSA 493
ccaccgauguggcaaaucuc

SEQ ID NO: 568436 - RNA, 22 nt, Coxiella burnetii RSA 493
ccacguugcaauaacaaauaaa

SEQ ID NO: 568437 - RNA, 12 nt, Coxiella burnetii RSA 493
ccacuacuucug

SEQ ID NO: 568438 - RNA, 12 nt, Coxiella burnetii RSA 493
ccacucggaaag

SEQ ID NO: 568439 - RNA, 17 nt, Coxiella burnetii RSA 493
ccagaagcguaccaaug

SEQ ID NO: 568440 - RNA, 15 nt, Coxiella burnetii RSA 493
ccacuggaaucaauc

SEQ ID NO: 568441 - RNA, 21 nt, Coxiella burnetii RSA 493
ccacuggguuuuccccaucaa

SEQ ID NO: 568442 - RNA, 13 nt, Coxiella burnetii RSA 493
ccacuguccucug

SEQ ID NO: 568443 - RNA, 22 nt, Coxiella burnetii RSA 493
ccagcaguaaugagcaucuuuu

SEQ ID NO: 568444 - RNA, 13 nt, Coxiella burnetii RSA 493
ccagcagugaaau

SEQ ID NO: 568445 - RNA, 21 nt, Coxiella burnetii RSA 493
ccagcguuuccaauuguuuga

SEQ ID NO: 568446 - RNA, 21 nt, Coxiella burnetii RSA 493
ccauaauugccgauauucuuu

SEQ ID NO: 568447 - RNA, 17 nt, Coxiella burnetii RSA 493
ccauacagaauuucuuu

SEQ ID NO: 568448 - RNA, 19 nt, Coxiella burnetii RSA 493
ccauaucgccauauaaagu

SEQ ID NO: 568449 - RNA, 20 nt, Coxiella burnetii RSA 493
ccauaucgccauauaaaguc

SEQ ID NO: 568450 - RNA, 19 nt, Coxiella burnetii RSA 493
ccaucgccacucauuauuc

SEQ ID NO: 568451 - RNA, 17 nt, Coxiella burnetii RSA 493
ccauccgacauucuucu

SEQ ID NO: 568452 - RNA, 18 nt, Coxiella burnetii RSA 493
ccauaaauaacuucuacc

SEQ ID NO: 568453 - RNA, 20 nt, Coxiella burnetii RSA 493
ccauaaauggauagacaauu

SEQ ID NO: 568454 - RNA, 23 nt, Coxiella burnetii RSA 493
ccauaacaagguauugauuaacu

SEQ ID NO: 568455 - RNA, 12 nt, Coxiella burnetii RSA 493
ccauaaccguuu

SEQ ID NO: 568456 - RNA, 15 nt, Coxiella burnetii RSA 493
ccauaaccguuuaau

SEQ ID NO: 568457 - RNA, 23 nt, Coxiella burnetii RSA 493
ccaguucucuauucuuaaacccu

SEQ ID NO: 568458 - RNA, 19 nt, Coxiella burnetii RSA 493
ccagugccugugcaacacc

SEQ ID NO: 568459 - RNA, 23 nt, Coxiella burnetii RSA 493
ccagucuguuauacuguucuuuc

SEQ ID NO: 568460 - RNA, 16 nt, Coxiella burnetii RSA 493
ccaguauuuuucuuug

SEQ ID NO: 568461 - RNA, 19 nt, Coxiella burnetii RSA 493
cccacggcgccaucaacca

SEQ ID NO: 568462 - RNA, 19 nt, Coxiella burnetii RSA 493
cccacggcaaauaaaggcg

SEQ ID NO: 568463 - RNA, 15 nt, Coxiella burnetii RSA 493
cccacguuguuugau

SEQ ID NO: 568464 - RNA, 13 nt, Coxiella burnetii RSA 493
cccagcuauggag

SEQ ID NO: 568465 - RNA, 17 nt, Coxiella burnetii RSA 493
ccauuuuaagagagucu

SEQ ID NO: 568466 - RNA, 18 nt, Coxiella burnetii RSA 493
ccauuugcggaaaaggag

SEQ ID NO: 568467 - RNA, 15 nt, Coxiella burnetii RSA 493
ccauugauaauaauu

SEQ ID NO: 568468 - RNA, 15 nt, Coxiella burnetii RSA 493
ccaucuugccacaca

SEQ ID NO: 568469 - RNA, 21 nt, Coxiella burnetii RSA 493
ccauuguuuugcauccgaacu

SEQ ID NO: 568470 - RNA, 18 nt, Coxiella burnetii RSA 493
ccauuuagaaaaaauacc

SEQ ID NO: 568471 - RNA, 14 nt, Coxiella burnetii RSA 493
ccauuuaacaaaaa

SEQ ID NO: 568472 - RNA, 19 nt, Coxiella burnetii RSA 493
cccaaaucauggcggugau

SEQ ID NO: 568473 - RNA, 21 nt, Coxiella burnetii RSA 493
cccacaauuauccuggccuga

SEQ ID NO: 568474 - RNA, 23 nt, Coxiella burnetii RSA 493
cccauguccauccgcuaacgucu

SEQ ID NO: 568475 - RNA, 21 nt, Coxiella burnetii RSA 493
cccauucaaggaauuauuuua

SEQ ID NO: 568476 - RNA, 14 nt, Coxiella burnetii RSA 493
ccccaauuuauuca

SEQ ID NO: 568477 - RNA, 21 nt, Coxiella burnetii RSA 493
ccccaagagaacguaaaaugc

SEQ ID NO: 568478 - RNA, 11 nt, Coxiella burnetii RSA 493
cccauuuuuua

SEQ ID NO: 568479 - RNA, 11 nt, Coxiella burnetii RSA 493
cccauuuuuuu

SEQ ID NO: 568480 - RNA, 15 nt, Coxiella burnetii RSA 493
ccccaaaguuucacg

SEQ ID NO: 568481 - RNA, 14 nt, Coxiella burnetii RSA 493
cccgagccccaaaa

SEQ ID NO: 568482 - RNA, 14 nt, Coxiella burnetii RSA 493
cccgauggccggca

SEQ ID NO: 568483 - RNA, 12 nt, Coxiella burnetii RSA 493
ccccuccucuaa

SEQ ID NO: 568484 - RNA, 21 nt, Coxiella burnetii RSA 493
cccguugcaagcguuuuucau

SEQ ID NO: 568485 - RNA, 11 nt, Coxiella burnetii RSA 493
cccguaugagc

SEQ ID NO: 568486 - RNA, 22 nt, Coxiella burnetii RSA 493
cccguauuucgcuucgcucaua

SEQ ID NO: 568487 - RNA, 12 nt, Coxiella burnetii RSA 493
cccguaacugcu

SEQ ID NO: 568488 - RNA, 13 nt, Coxiella burnetii RSA 493
cccgcagcgccca

SEQ ID NO: 568489 - RNA, 16 nt, Coxiella burnetii RSA 493
cccgccugcgcgggaa

SEQ ID NO: 568490 - RNA, 22 nt, Coxiella burnetii RSA 493
cccgcgacgggcuguacauuuu

SEQ ID NO: 568491 - RNA, 18 nt, Coxiella burnetii RSA 493
ccgaccaaggguauuuuu

SEQ ID NO: 568492 - RNA, 23 nt, Coxiella burnetii RSA 493
ccgacaauucccccaaaaacuaa

SEQ ID NO: 568493 - RNA, 11 nt, Coxiella burnetii RSA 493
cccuuuaaccg

SEQ ID NO: 568494 - RNA, 17 nt, Coxiella burnetii RSA 493
cccuuugcggcuaaugc

SEQ ID NO: 568495 - RNA, 19 nt, Coxiella burnetii RSA 493
ccgaggaugaugaaaagcc

SEQ ID NO: 568496 - RNA, 22 nt, Coxiella burnetii RSA 493
ccgcagaagaaggcucuucaua

SEQ ID NO: 568497 - RNA, 18 nt, Coxiella burnetii RSA 493
ccgcacaaacgcgcccgc

SEQ ID NO: 568498 - RNA, 22 nt, Coxiella burnetii RSA 493
ccgcacaaacgcgcccgcccca

SEQ ID NO: 568499 - RNA, 22 nt, Coxiella burnetii RSA 493
ccgcaauccucgcguuuuauca

SEQ ID NO: 568500 - RNA, 22 nt, Coxiella burnetii RSA 493
ccgccgaaauuuaacacuuuaa

SEQ ID NO: 568501 - RNA, 20 nt, Coxiella burnetii RSA 493
ccgccgagcuuuucacccaa

SEQ ID NO: 568502 - RNA, 19 nt, Coxiella burnetii RSA 493
ccggaguccccaaaguuuc

SEQ ID NO: 568503 - RNA, 12 nt, Coxiella burnetii RSA 493
ccgcgcauuagu

SEQ ID NO: 568504 - RNA, 16 nt, Coxiella burnetii RSA 493
ccgcgcugaaguccuu

SEQ ID NO: 568505 - RNA, 23 nt, Coxiella burnetii RSA 493
ccgcugacgucagaaaacagccu

SEQ ID NO: 568506 - RNA, 15 nt, Coxiella burnetii RSA 493
ccgcucgcuugaaaa

SEQ ID NO: 568507 - RNA, 18 nt, Coxiella burnetii RSA 493
ccuaagccaguucucuau

SEQ ID NO: 568508 - RNA, 24 nt, Coxiella burnetii RSA 493
ccuaagagaaaaaaccucaccaga

SEQ ID NO: 568509 - RNA, 21 nt, Coxiella burnetii RSA 493
ccuaauuuaaugccgauaacu

SEQ ID NO: 568510 - RNA, 17 nt, Coxiella burnetii RSA 493
ccuacaaauagagaggg

SEQ ID NO: 568511 - RNA, 20 nt, Coxiella burnetii RSA 493
ccuaaguuuaacagacagac

SEQ ID NO: 568512 - RNA, 21 nt, Coxiella burnetii RSA 493
ccuaaggauaggaucuuaaga

SEQ ID NO: 568513 - RNA, 13 nt, Coxiella burnetii RSA 493
ccuaagcuuucuc

SEQ ID NO: 568514 - RNA, 12 nt, Coxiella burnetii RSA 493
ccuaaaaugaua

SEQ ID NO: 568515 - RNA, 13 nt, Coxiella burnetii RSA 493
ccguuuaauuucu

SEQ ID NO: 568516 - RNA, 14 nt, Coxiella burnetii RSA 493
ccguggcaguuaaa

SEQ ID NO: 568517 - RNA, 21 nt, Coxiella burnetii RSA 493
ccgugcagggcacccaggcgg

SEQ ID NO: 568518 - RNA, 21 nt, Coxiella burnetii RSA 493
ccuauuuggcggcgcucaugg

SEQ ID NO: 568519 - RNA, 21 nt, Coxiella burnetii RSA 493
ccuaugcgggguuuuuuguag

SEQ ID NO: 568520 - RNA, 22 nt, Coxiella burnetii RSA 493
ccuauuagucuuaauuuuaaaa

SEQ ID NO: 568521 - RNA, 23 nt, Coxiella burnetii RSA 493
ccucacgauagccagcaauauca

SEQ ID NO: 568522 - RNA, 18 nt, Coxiella burnetii RSA 493
ccuauagugucaaaggcc

SEQ ID NO: 568523 - RNA, 15 nt, Coxiella burnetii RSA 493
ccuaucaaucaaauc

SEQ ID NO: 568524 - RNA, 18 nt, Coxiella burnetii RSA 493
ccuagugaggcuucuucc

SEQ ID NO: 568525 - RNA, 13 nt, Coxiella burnetii RSA 493
ccuacuuuuucug

SEQ ID NO: 568526 - RNA, 18 nt, Coxiella burnetii RSA 493
ccuacuuucguaaagacc

SEQ ID NO: 568527 - RNA, 20 nt, Coxiella burnetii RSA 493
ccuacacuauugaagucugg

SEQ ID NO: 568528 - RNA, 14 nt, Coxiella burnetii RSA 493
ccuacacuuucaau

SEQ ID NO: 568529 - RNA, 14 nt, Coxiella burnetii RSA 493
ccuacacuuuuaau

SEQ ID NO: 568530 - RNA, 15 nt, Coxiella burnetii RSA 493
ccuacugcaugaaug

SEQ ID NO: 568531 - RNA, 17 nt, Coxiella burnetii RSA 493
ccguauuucgcuucgcu

SEQ ID NO: 568532 - RNA, 15 nt, Coxiella burnetii RSA 493
ccguaagccgcccgg

SEQ ID NO: 568533 - RNA, 14 nt, Coxiella burnetii RSA 493
ccgguccgccgcuu

SEQ ID NO: 568534 - RNA, 14 nt, Coxiella burnetii RSA 493
ccucgccuucuucg

SEQ ID NO: 568535 - RNA, 18 nt, Coxiella burnetii RSA 493
ccucgauagaccaaaucc

SEQ ID NO: 568536 - RNA, 23 nt, Coxiella burnetii RSA 493
ccucaguugucauguaaucaauu

SEQ ID NO: 568537 - RNA, 15 nt, Coxiella burnetii RSA 493
ccucagguuuuaccu

SEQ ID NO: 568538 - RNA, 15 nt, Coxiella burnetii RSA 493
ccucagaaguuuuag

SEQ ID NO: 568539 - RNA, 12 nt, Coxiella burnetii RSA 493
ccucuacaaaau

SEQ ID NO: 568540 - RNA, 14 nt, Coxiella burnetii RSA 493
ccucuacaaaauag

SEQ ID NO: 568541 - RNA, 16 nt, Coxiella burnetii RSA 493
ccucuacaucuucauu

SEQ ID NO: 568542 - RNA, 22 nt, Coxiella burnetii RSA 493
ccugagucggaaguucuauuuc

SEQ ID NO: 568543 - RNA, 13 nt, Coxiella burnetii RSA 493
ccugauaaaauaa

SEQ ID NO: 568544 - RNA, 15 nt, Coxiella burnetii RSA 493
ccugauaaaauaaca

SEQ ID NO: 568545 - RNA, 15 nt, Coxiella burnetii RSA 493
ccugacguuuuccac

SEQ ID NO: 568546 - RNA, 15 nt, Coxiella burnetii RSA 493
ccugaucauaaagcg

SEQ ID NO: 568547 - RNA, 22 nt, Coxiella burnetii RSA 493
ccugccauuugcggaaaaggag

SEQ ID NO: 568548 - RNA, 18 nt, Coxiella burnetii RSA 493
ccuguucuuuuuccaugu

SEQ ID NO: 568549 - RNA, 22 nt, Coxiella burnetii RSA 493
ccugucugccgcaaguaauuca

SEQ ID NO: 568550 - RNA, 20 nt, Coxiella burnetii RSA 493
ccuuaacgccuaucuuuuuc

SEQ ID NO: 568551 - RNA, 22 nt, Coxiella burnetii RSA 493
ccuuaacgccuaucuuuuucaa

SEQ ID NO: 568552 - RNA, 19 nt, Coxiella burnetii RSA 493
ccuucaacggcgcgcgugu

SEQ ID NO: 568553 - RNA, 17 nt, Coxiella burnetii RSA 493
ccuuagcguaaucauca

SEQ ID NO: 568554 - RNA, 14 nt, Coxiella burnetii RSA 493
ccuuauagcgugag

SEQ ID NO: 568555 - RNA, 11 nt, Coxiella burnetii RSA 493
ccuuaucacua

SEQ ID NO: 568556 - RNA, 21 nt, Coxiella burnetii RSA 493
cagcucguaagcgugcaacaa

SEQ ID NO: 568557 - RNA, 23 nt, Coxiella burnetii RSA 493
cagcucguaagcgugcaacaagc

SEQ ID NO: 568558 - RNA, 23 nt, Coxiella burnetii RSA 493
cagcuauggaguucuugcuccca

SEQ ID NO: 568559 - RNA, 11 nt, Coxiella burnetii RSA 493
caggaauugca

SEQ ID NO: 568560 - RNA, 17 nt, Coxiella burnetii RSA 493
caggagcgauaaaauaa

SEQ ID NO: 568561 - RNA, 17 nt, Coxiella burnetii RSA 493
caggauuauauuaguuu

SEQ ID NO: 568562 - RNA, 22 nt, Coxiella burnetii RSA 493
cagggcuuguucacgcaaacag

SEQ ID NO: 568563 - RNA, 13 nt, Coxiella burnetii RSA 493
cagggcuauuuua

SEQ ID NO: 568564 - RNA, 16 nt, Coxiella burnetii RSA 493
cagggguuauaaaauu

SEQ ID NO: 568565 - RNA, 11 nt, Coxiella burnetii RSA 493
caggcgccugc

SEQ ID NO: 568566 - RNA, 16 nt, Coxiella burnetii RSA 493
caggcaguagagacaa

SEQ ID NO: 568567 - RNA, 18 nt, Coxiella burnetii RSA 493
caguaccgucauaaggaa

SEQ ID NO: 568568 - RNA, 19 nt, Coxiella burnetii RSA 493
caguaccgucauaaggaau

SEQ ID NO: 568569 - RNA, 18 nt, Coxiella burnetii RSA 493
caguaacucuaauuuucc

SEQ ID NO: 568570 - RNA, 19 nt, Coxiella burnetii RSA 493
caguaacucuaauuuuccu

SEQ ID NO: 568571 - RNA, 19 nt, Coxiella burnetii RSA 493
caguaaaccgcuuucuaga

SEQ ID NO: 568572 - RNA, 15 nt, Coxiella burnetii RSA 493
cagguugcuuuugcu

SEQ ID NO: 568573 - RNA, 13 nt, Coxiella burnetii RSA 493
cagugaaaacccg

SEQ ID NO: 568574 - RNA, 19 nt, Coxiella burnetii RSA 493
cagugaaaacccgagcgga

SEQ ID NO: 568575 - RNA, 22 nt, Coxiella burnetii RSA 493
cagucugucguuucugauuuuu

SEQ ID NO: 568576 - RNA, 14 nt, Coxiella burnetii RSA 493
cagucgccguugcu

SEQ ID NO: 568577 - RNA, 16 nt, Coxiella burnetii RSA 493
caguuaaaauaaugag

SEQ ID NO: 568578 - RNA, 20 nt, Coxiella burnetii RSA 493
cagugugcacgauuuuauaa

SEQ ID NO: 568579 - RNA, 22 nt, Coxiella burnetii RSA 493
cauaaauagcauuaauaagacc

SEQ ID NO: 568580 - RNA, 14 nt, Coxiella burnetii RSA 493
caguuguuuuaaau

SEQ ID NO: 568581 - RNA, 18 nt, Coxiella burnetii RSA 493
cauaauccuucuuuuguc

SEQ ID NO: 568582 - RNA, 20 nt, Coxiella burnetii RSA 493
cauaaugaucgacaagcagg

SEQ ID NO: 568583 - RNA, 15 nt, Coxiella burnetii RSA 493
cauaaucuuuuuaga

SEQ ID NO: 568584 - RNA, 20 nt, Coxiella burnetii RSA 493
cauaacgggaauguuuuuua

SEQ ID NO: 568585 - RNA, 17 nt, Coxiella burnetii RSA 493
cauacagaauuucuuug

SEQ ID NO: 568586 - RNA, 21 nt, Coxiella burnetii RSA 493
cauacagccgaaugaucugcu

SEQ ID NO: 568587 - RNA, 21 nt, Coxiella burnetii RSA 493
cauacagcggaacaccauucg

SEQ ID NO: 568588 - RNA, 14 nt, Coxiella burnetii RSA 493
cauacgauauaaaa

SEQ ID NO: 568589 - RNA, 14 nt, Coxiella burnetii RSA 493
cauacgguacaggu

SEQ ID NO: 568590 - RNA, 19 nt, Coxiella burnetii RSA 493
cauauaaucgcaaaauuca

SEQ ID NO: 568591 - RNA, 19 nt, Coxiella burnetii RSA 493
cauauaacugcaaauaaua

SEQ ID NO: 568592 - RNA, 20 nt, Coxiella burnetii RSA 493
cauauaaagucgcauagcca

SEQ ID NO: 568593 - RNA, 17 nt, Coxiella burnetii RSA 493
cauaucgcuccccuugc

SEQ ID NO: 568594 - RNA, 19 nt, Coxiella burnetii RSA 493
cauauuaauauuaaaacaa

SEQ ID NO: 568595 - RNA, 19 nt, Coxiella burnetii RSA 493
cauaucgggauaaguaaau

SEQ ID NO: 568596 - RNA, 20 nt, Coxiella burnetii RSA 493
cauaucgggauaaguaaaug

SEQ ID NO: 568597 - RNA, 21 nt, Coxiella burnetii RSA 493
cauaugaauauuaguggaauu

SEQ ID NO: 568598 - RNA, 21 nt, Coxiella burnetii RSA 493
caucaagggcaaaaacauuau

SEQ ID NO: 568599 - RNA, 19 nt, Coxiella burnetii RSA 493
caucaacggaaaaacaaaa

SEQ ID NO: 568600 - RNA, 12 nt, Coxiella burnetii RSA 493
caucaauaaugc

SEQ ID NO: 568601 - RNA, 21 nt, Coxiella burnetii RSA 493
caucaauaccaagcucaugaa

SEQ ID NO: 568602 - RNA, 20 nt, Coxiella burnetii RSA 493
caucaaacuugccuugagaa

SEQ ID NO: 568603 - RNA, 14 nt, Coxiella burnetii RSA 493
caucaaaaaaaccu

SEQ ID NO: 568604 - RNA, 12 nt, Coxiella burnetii RSA 493
caucauuuugau

SEQ ID NO: 568605 - RNA, 18 nt, Coxiella burnetii RSA 493
caucauuuuccaaaaaau

SEQ ID NO: 568606 - RNA, 19 nt, Coxiella burnetii RSA 493
caucauuuuccaaaaaauu

SEQ ID NO: 568607 - RNA, 22 nt, Coxiella burnetii RSA 493
caucaucgccggauaaucacgc

SEQ ID NO: 568608 - RNA, 16 nt, Coxiella burnetii RSA 493
caucaguuuugauuug

SEQ ID NO: 568609 - RNA, 21 nt, Coxiella burnetii RSA 493
caucaguuuugauuugaguaa

SEQ ID NO: 568610 - RNA, 11 nt, Coxiella burnetii RSA 493
caucaccuuca

SEQ ID NO: 568611 - RNA, 15 nt, Coxiella burnetii RSA 493
caucagccugaucaa

SEQ ID NO: 568612 - RNA, 18 nt, Coxiella burnetii RSA 493
caucagccugaucaaguu

SEQ ID NO: 568613 - RNA, 14 nt, Coxiella burnetii RSA 493
caucgauaggcuuu

SEQ ID NO: 568614 - RNA, 12 nt, Coxiella burnetii RSA 493
cauccuccauua

SEQ ID NO: 568615 - RNA, 18 nt, Coxiella burnetii RSA 493
cauccgcucgucuugcac

SEQ ID NO: 568616 - RNA, 18 nt, Coxiella burnetii RSA 493
caucuccgcaggcgggga

SEQ ID NO: 568617 - RNA, 16 nt, Coxiella burnetii RSA 493
caucuccgucggcuuc

SEQ ID NO: 568618 - RNA, 22 nt, Coxiella burnetii RSA 493
caucugagauaucaauagcgca

SEQ ID NO: 568619 - RNA, 21 nt, Coxiella burnetii RSA 493
caucugcgggauuaauuuucc

SEQ ID NO: 568620 - RNA, 15 nt, Coxiella burnetii RSA 493
caucuucaaaaccua

SEQ ID NO: 568621 - RNA, 15 nt, Coxiella burnetii RSA 493
caucuugauccuuuu

SEQ ID NO: 568622 - RNA, 20 nt, Coxiella burnetii RSA 493
caugcaaaaauuguuuauca

SEQ ID NO: 568623 - RNA, 20 nt, Coxiella burnetii RSA 493
caugaaaggaauccuuuuuc

SEQ ID NO: 568624 - RNA, 22 nt, Coxiella burnetii RSA 493
caugaaaggaauccuuuuucua

SEQ ID NO: 568625 - RNA, 16 nt, Coxiella burnetii RSA 493
caucuuuucugaaaca

SEQ ID NO: 568626 - RNA, 18 nt, Coxiella burnetii RSA 493
caugcccauaaauaacuu

SEQ ID NO: 568627 - RNA, 14 nt, Coxiella burnetii RSA 493
caugccuaggcccu

SEQ ID NO: 568628 - RNA, 18 nt, Coxiella burnetii RSA 493
caugccuuuuuugcgcaa

SEQ ID NO: 568629 - RNA, 15 nt, Coxiella burnetii RSA 493
caugcgaaagcaaua

SEQ ID NO: 568630 - RNA, 17 nt, Coxiella burnetii RSA 493
cauuacauaauuuaaac

SEQ ID NO: 568631 - RNA, 19 nt, Coxiella burnetii RSA 493
cauuacauaauuuaaacuc

SEQ ID NO: 568632 - RNA, 16 nt, Coxiella burnetii RSA 493
cauuagagccuuaucu

SEQ ID NO: 568633 - RNA, 19 nt, Coxiella burnetii RSA 493
cauuagcuucguuuacuuu

SEQ ID NO: 568634 - RNA, 15 nt, Coxiella burnetii RSA 493
cauuaccauuuugac

SEQ ID NO: 568635 - RNA, 23 nt, Coxiella burnetii RSA 493
cauuaccauuuugacaaacaguu

SEQ ID NO: 568636 - RNA, 12 nt, Coxiella burnetii RSA 493
cauuaaauuuaa

SEQ ID NO: 568637 - RNA, 18 nt, Coxiella burnetii RSA 493
cauuaacgaaucgucuaa

SEQ ID NO: 568638 - RNA, 20 nt, Coxiella burnetii RSA 493
cauuaauaaagugccgcgaa

SEQ ID NO: 568639 - RNA, 23 nt, Coxiella burnetii RSA 493
caugucguuauugcucaucucua

SEQ ID NO: 568640 - RNA, 16 nt, Coxiella burnetii RSA 493
caugguccguuaauuu

SEQ ID NO: 568641 - RNA, 17 nt, Coxiella burnetii RSA 493
caugguccguuaauuua

SEQ ID NO: 568642 - RNA, 16 nt, Coxiella burnetii RSA 493
cauguuugcuggcaaa

SEQ ID NO: 568643 - RNA, 20 nt, Coxiella burnetii RSA 493
cauguuuacauuaaggccaa

SEQ ID NO: 568644 - RNA, 16 nt, Coxiella burnetii RSA 493
cauguuggauuucauc

SEQ ID NO: 568645 - RNA, 14 nt, Coxiella burnetii RSA 493
cauuaaaaaauaag

SEQ ID NO: 568646 - RNA, 16 nt, Coxiella burnetii RSA 493
cauuaaaagauuuaau

SEQ ID NO: 568647 - RNA, 17 nt, Coxiella burnetii RSA 493
cauuucuuucaauaaac

SEQ ID NO: 568648 - RNA, 17 nt, Coxiella burnetii RSA 493
cauuuaauaccccugca

SEQ ID NO: 568649 - RNA, 14 nt, Coxiella burnetii RSA 493
cauuuaauuuuaaa

SEQ ID NO: 568650 - RNA, 16 nt, Coxiella burnetii RSA 493
cauuuguuuaaagcug

SEQ ID NO: 568651 - RNA, 22 nt, Coxiella burnetii RSA 493
cauuuguucuaucaauauggaa

SEQ ID NO: 568652 - RNA, 16 nt, Coxiella burnetii RSA 493
cauuuggccaaacuaa

SEQ ID NO: 568653 - RNA, 20 nt, Coxiella burnetii RSA 493
cauuuggccaaacuaaucug

SEQ ID NO: 568654 - RNA, 16 nt, Coxiella burnetii RSA 493
cauuuuuaugcuucaa

SEQ ID NO: 568655 - RNA, 23 nt, Coxiella burnetii RSA 493
cauuuuuaugcuucaauaaaaaa

SEQ ID NO: 568656 - RNA, 13 nt, Coxiella burnetii RSA 493
cauuuuuguaaau

SEQ ID NO: 568657 - RNA, 11 nt, Coxiella burnetii RSA 493
cauuuuucgca

SEQ ID NO: 568658 - RNA, 19 nt, Coxiella burnetii RSA 493
cauuuuuuauaaaauuuaa

SEQ ID NO: 568659 - RNA, 14 nt, Coxiella burnetii RSA 493
cauuuugauuuuuu

SEQ ID NO: 568660 - RNA, 12 nt, Coxiella burnetii RSA 493
cauuuuguauug

SEQ ID NO: 568661 - RNA, 16 nt, Coxiella burnetii RSA 493
cauuguucauaaaaua

SEQ ID NO: 568662 - RNA, 18 nt, Coxiella burnetii RSA 493
cauuguucauaaaauaau

SEQ ID NO: 568663 - RNA, 16 nt, Coxiella burnetii RSA 493
cauugucucacaacau

SEQ ID NO: 568664 - RNA, 17 nt, Coxiella burnetii RSA 493
cauuggcaguguaaauu

SEQ ID NO: 568665 - RNA, 22 nt, Coxiella burnetii RSA 493
cauuaucggaugaugcauuaau

SEQ ID NO: 568666 - RNA, 17 nt, Coxiella burnetii RSA 493
cauucuagguuauuuuu

SEQ ID NO: 568667 - RNA, 19 nt, Coxiella burnetii RSA 493
cauucugaacgcucuucca

SEQ ID NO: 568668 - RNA, 13 nt, Coxiella burnetii RSA 493
cauugacagccag

SEQ ID NO: 568669 - RNA, 19 nt, Coxiella burnetii RSA 493
cagcaggaaccaggaaagu

SEQ ID NO: 568670 - RNA, 17 nt, Coxiella burnetii RSA 493
cagcaucccccaagaga

SEQ ID NO: 568671 - RNA, 18 nt, Coxiella burnetii RSA 493
cagcauuagcuucguuua

SEQ ID NO: 568672 - RNA, 15 nt, Coxiella burnetii RSA 493
cagccaccgcaugaa

SEQ ID NO: 568673 - RNA, 16 nt, Coxiella burnetii RSA 493
cagccacaaagaauuu

SEQ ID NO: 568674 - RNA, 19 nt, Coxiella burnetii RSA 493
cagccccaacuacggccua

SEQ ID NO: 568675 - RNA, 23 nt, Coxiella burnetii RSA 493
cagccuucaugaauauuuuucuc

SEQ ID NO: 568676 - RNA, 19 nt, Coxiella burnetii RSA 493
cagcgaauacgaauuucaa

SEQ ID NO: 568677 - RNA, 19 nt, Coxiella burnetii RSA 493
cagcgaacauccaauuacu

SEQ ID NO: 568678 - RNA, 21 nt, Coxiella burnetii RSA 493
cagcgaacauccaauuacucc

SEQ ID NO: 568679 - RNA, 18 nt, Coxiella burnetii RSA 493
cagccgauucuucauacu

SEQ ID NO: 568680 - RNA, 21 nt, Coxiella burnetii RSA 493
cagccgauucuucauacuaac

SEQ ID NO: 568681 - RNA, 22 nt, Coxiella burnetii RSA 493
cagccgaagugcuaaaaaauua

SEQ ID NO: 568682 - RNA, 20 nt, Coxiella burnetii RSA 493
cagccgaaugaucugcucuu

SEQ ID NO: 568683 - RNA, 22 nt, Coxiella burnetii RSA 493
cagccgaccaaggguauuuuuu

SEQ ID NO: 568684 - RNA, 13 nt, Coxiella burnetii RSA 493
cagcgaugaaaaa

SEQ ID NO: 568685 - RNA, 16 nt, Coxiella burnetii RSA 493
cagcgcccaauaagga

SEQ ID NO: 568686 - RNA, 15 nt, Coxiella burnetii RSA 493
cagcggaacaccauu

SEQ ID NO: 568687 - RNA, 22 nt, Coxiella burnetii RSA 493
caauguucuucgaguaacuuca

SEQ ID NO: 568688 - RNA, 16 nt, Coxiella burnetii RSA 493
caauguuuccaaauaa

SEQ ID NO: 568689 - RNA, 20 nt, Coxiella burnetii RSA 493
cacuguugagcaaagcguuu

SEQ ID NO: 568690 - RNA, 14 nt, Coxiella burnetii RSA 493
cacuguccucuguc

SEQ ID NO: 568691 - RNA, 16 nt, Coxiella burnetii RSA 493
cacuguccucuguccu

SEQ ID NO: 568692 - RNA, 11 nt, Coxiella burnetii RSA 493
cacuucuuuua

SEQ ID NO: 568693 - RNA, 18 nt, Coxiella burnetii RSA 493
cacuuuuuucagcguuua

SEQ ID NO: 568694 - RNA, 14 nt, Coxiella burnetii RSA 493
cacuugauaaucaa

SEQ ID NO: 568695 - RNA, 16 nt, Coxiella burnetii RSA 493
cagaaauucauuuuuc

SEQ ID NO: 568696 - RNA, 18 nt, Coxiella burnetii RSA 493
cagaacaccguuggaaaa

SEQ ID NO: 568697 - RNA, 16 nt, Coxiella burnetii RSA 493
cagaaauauuuucuca

SEQ ID NO: 568698 - RNA, 14 nt, Coxiella burnetii RSA 493
cagaaaaguaaaaa

SEQ ID NO: 568699 - RNA, 20 nt, Coxiella burnetii RSA 493
cagaaggcagaggacagagg

SEQ ID NO: 568700 - RNA, 18 nt, Coxiella burnetii RSA 493
cagacaagucguuuauau

SEQ ID NO: 568701 - RNA, 22 nt, Coxiella burnetii RSA 493
cagacagacgcuggaaaaauaa

SEQ ID NO: 568702 - RNA, 22 nt, Coxiella burnetii RSA 493
cagagaaguaugaucauuuucu

SEQ ID NO: 568703 - RNA, 22 nt, Coxiella burnetii RSA 493
cagaccuguuaaaaacgccuga

SEQ ID NO: 568704 - RNA, 15 nt, Coxiella burnetii RSA 493
cagacgcuggaaaaa

SEQ ID NO: 568705 - RNA, 13 nt, Coxiella burnetii RSA 493
cagacucuuuuua

SEQ ID NO: 568706 - RNA, 16 nt, Coxiella burnetii RSA 493
cagaucauacauauga

SEQ ID NO: 568707 - RNA, 17 nt, Coxiella burnetii RSA 493
cagauaaugaccuuaau

SEQ ID NO: 568708 - RNA, 20 nt, Coxiella burnetii RSA 493
cagauuuuagugaaaguuuc

SEQ ID NO: 568709 - RNA, 21 nt, Coxiella burnetii RSA 493
cagauuuuuuaucguugcugu

SEQ ID NO: 568710 - RNA, 15 nt, Coxiella burnetii RSA 493
cagauuguaaaucau

SEQ ID NO: 568711 - RNA, 18 nt, Coxiella burnetii RSA 493
cagaugcuccaucaugau

SEQ ID NO: 568712 - RNA, 18 nt, Coxiella burnetii RSA 493
cagcaauggugauuucuu

SEQ ID NO: 568713 - RNA, 17 nt, Coxiella burnetii RSA 493
cagcaaguugcagaguu

SEQ ID NO: 568714 - RNA, 17 nt, Coxiella burnetii RSA 493
caaaagguaaaaaacua

SEQ ID NO: 568715 - RNA, 21 nt, Coxiella burnetii RSA 493
caaagaaggcgaucaguuugu

SEQ ID NO: 568716 - RNA, 13 nt, Coxiella burnetii RSA 493
caaagcagauaaa

SEQ ID NO: 568717 - RNA, 14 nt, Coxiella burnetii RSA 493
caaagcagauaaau

SEQ ID NO: 568718 - RNA, 18 nt, Coxiella burnetii RSA 493
caaagcagauaaauguuu

SEQ ID NO: 568719 - RNA, 16 nt, Coxiella burnetii RSA 493
caaagccgcuauuucu

SEQ ID NO: 568720 - RNA, 17 nt, Coxiella burnetii RSA 493
caaaguaaaaaugaaau

SEQ ID NO: 568721 - RNA, 21 nt, Coxiella burnetii RSA 493
caaaguucauuaaguauauuu

SEQ ID NO: 568722 - RNA, 22 nt, Coxiella burnetii RSA 493
caaagucgcguaaagauaaaau

SEQ ID NO: 568723 - RNA, 15 nt, Coxiella burnetii RSA 493
caaaguuucuucaua

SEQ ID NO: 568724 - RNA, 16 nt, Coxiella burnetii RSA 493
caaaguuucuucauau

SEQ ID NO: 568725 - RNA, 23 nt, Coxiella burnetii RSA 493
caaauaaacaaguuaacaaaauc

SEQ ID NO: 568726 - RNA, 15 nt, Coxiella burnetii RSA 493
caaauaauaugaaua

SEQ ID NO: 568727 - RNA, 20 nt, Coxiella burnetii RSA 493
caaauaaucgggaauaaaau

SEQ ID NO: 568728 - RNA, 22 nt, Coxiella burnetii RSA 493
caaauaaaccuauccaaaaaga

SEQ ID NO: 568729 - RNA, 11 nt, Coxiella burnetii RSA 493
caaauagaugg

SEQ ID NO: 568730 - RNA, 16 nt, Coxiella burnetii RSA 493
caaaugaccaaauaau

SEQ ID NO: 568731 - RNA, 21 nt, Coxiella burnetii RSA 493
caaaugaugaauuuauuucug

SEQ ID NO: 568732 - RNA, 20 nt, Coxiella burnetii RSA 493
caaauuauaucauugggcca

SEQ ID NO: 568733 - RNA, 22 nt, Coxiella burnetii RSA 493
caaaucguugcauaauauuuuc

SEQ ID NO: 568734 - RNA, 15 nt, Coxiella burnetii RSA 493
caaaucggcaaauac

SEQ ID NO: 568735 - RNA, 18 nt, Coxiella burnetii RSA 493
caaaucgcagugcccaug

SEQ ID NO: 568736 - RNA, 16 nt, Coxiella burnetii RSA 493
caacacguauuuucau

SEQ ID NO: 568737 - RNA, 16 nt, Coxiella burnetii RSA 493
caaauugcuccaaaca

SEQ ID NO: 568738 - RNA, 18 nt, Coxiella burnetii RSA 493
caaauugcuccaaacaga

SEQ ID NO: 568739 - RNA, 15 nt, Coxiella burnetii RSA 493
caaauugggugcauu

SEQ ID NO: 568740 - RNA, 15 nt, Coxiella burnetii RSA 493
caaccacuguccucu

SEQ ID NO: 568741 - RNA, 15 nt, Coxiella burnetii RSA 493
caaccacugucuucu

SEQ ID NO: 568742 - RNA, 22 nt, Coxiella burnetii RSA 493
caaccagaaauauuuucucaau

SEQ ID NO: 568743 - RNA, 21 nt, Coxiella burnetii RSA 493
caaccgccauuucgcuuuuau

SEQ ID NO: 568744 - RNA, 21 nt, Coxiella burnetii RSA 493
caaccgacgaauaacggaaaa

SEQ ID NO: 568745 - RNA, 16 nt, Coxiella burnetii RSA 493
caaccgauagacugga

SEQ ID NO: 568746 - RNA, 21 nt, Coxiella burnetii RSA 493
caaccgguuuuucuucauuug

SEQ ID NO: 568747 - RNA, 20 nt, Coxiella burnetii RSA 493
caaccauaauccuucuuuug

SEQ ID NO: 568748 - RNA, 20 nt, Coxiella burnetii RSA 493
caacccggaccugcugcccg

SEQ ID NO: 568749 - RNA, 13 nt, Coxiella burnetii RSA 493
caacucuuuggcg

SEQ ID NO: 568750 - RNA, 23 nt, Coxiella burnetii RSA 493
caacucucuagcuguuuuuucua

SEQ ID NO: 568751 - RNA, 23 nt, Coxiella burnetii RSA 493
caacuaaaugacguaaugucuca

SEQ ID NO: 568752 - RNA, 13 nt, Coxiella burnetii RSA 493
caacuaacggcua

SEQ ID NO: 568753 - RNA, 20 nt, Coxiella burnetii RSA 493
caaccguugagcaagcagaa

SEQ ID NO: 568754 - RNA, 17 nt, Coxiella burnetii RSA 493
caaccguuguauaaacu

SEQ ID NO: 568755 - RNA, 20 nt, Coxiella burnetii RSA 493
caaucugggaauguguguca

SEQ ID NO: 568756 - RNA, 19 nt, Coxiella burnetii RSA 493
caaucguguagaaagaaag

SEQ ID NO: 568757 - RNA, 17 nt, Coxiella burnetii RSA 493
caaucuauuagcuggca

SEQ ID NO: 568758 - RNA, 22 nt, Coxiella burnetii RSA 493
caaucgauuaagcgucaugaaa

SEQ ID NO: 568759 - RNA, 14 nt, Coxiella burnetii RSA 493
caaucgaaaaaaau

SEQ ID NO: 568760 - RNA, 15 nt, Coxiella burnetii RSA 493
caaucgaaaaaaauc

SEQ ID NO: 568761 - RNA, 15 nt, Coxiella burnetii RSA 493
caaucgacaggacaa

SEQ ID NO: 568762 - RNA, 20 nt, Coxiella burnetii RSA 493
caaucgacaggacaaaccug

SEQ ID NO: 568763 - RNA, 19 nt, Coxiella burnetii RSA 493
caaucggauuaacgugcuc

SEQ ID NO: 568764 - RNA, 21 nt, Coxiella burnetii RSA 493
caaucauuuuuguacugcugu

SEQ ID NO: 568765 - RNA, 23 nt, Coxiella burnetii RSA 493
caaucaacgaacacauacagccg

SEQ ID NO: 568766 - RNA, 16 nt, Coxiella burnetii RSA 493
caauauuuagagaagg

SEQ ID NO: 568767 - RNA, 23 nt, Coxiella burnetii RSA 493
caauauuucgucagugaaugauc

SEQ ID NO: 568768 - RNA, 16 nt, Coxiella burnetii RSA 493
caaugcaguuaaccaa

SEQ ID NO: 568769 - RNA, 18 nt, Coxiella burnetii RSA 493
caaugaaacaaacaaaaa

SEQ ID NO: 568770 - RNA, 21 nt, Coxiella burnetii RSA 493
caaugaaacaaacaaaaaaua

SEQ ID NO: 568771 - RNA, 19 nt, Coxiella burnetii RSA 493
caaugaacacuugaguagg

SEQ ID NO: 568772 - RNA, 17 nt, Coxiella burnetii RSA 493
caaugaaauauauaaag

SEQ ID NO: 568773 - RNA, 20 nt, Coxiella burnetii RSA 493
caauggcgugacccuuaauu

SEQ ID NO: 568774 - RNA, 13 nt, Coxiella burnetii RSA 493
caauggcauuaca

SEQ ID NO: 568775 - RNA, 20 nt, Coxiella burnetii RSA 493
caauggguuagggugcaauu

SEQ ID NO: 568776 - RNA, 23 nt, Coxiella burnetii RSA 493
caaugguggucggcaccaaaauc

SEQ ID NO: 568777 - RNA, 20 nt, Coxiella burnetii RSA 493
caaugcgcucugccacauaa

SEQ ID NO: 568778 - RNA, 19 nt, Coxiella burnetii RSA 493
caaugcguuuuaaaugcuu

SEQ ID NO: 568779 - RNA, 19 nt, Coxiella burnetii RSA 493
caaugcuuucuuuuaauuc

SEQ ID NO: 568780 - RNA, 16 nt, Coxiella burnetii RSA 493
caaugcccgaaaagga

SEQ ID NO: 568781 - RNA, 15 nt, Coxiella burnetii RSA 493
caaugccagugcauc

SEQ ID NO: 568782 - RNA, 20 nt, Coxiella burnetii RSA 493
caauauccuuguaauucaaa

SEQ ID NO: 568783 - RNA, 15 nt, Coxiella burnetii RSA 493
caauagcgcaauugg

SEQ ID NO: 568784 - RNA, 15 nt, Coxiella burnetii RSA 493
caauaauaguuugca

SEQ ID NO: 568785 - RNA, 15 nt, Coxiella burnetii RSA 493
caauaaguguuugau

SEQ ID NO: 568786 - RNA, 18 nt, Coxiella burnetii RSA 493
caauaacagagauaaauu

SEQ ID NO: 568787 - RNA, 14 nt, Coxiella burnetii RSA 493
caauaacaaauaaa

SEQ ID NO: 568788 - RNA, 21 nt, Coxiella burnetii RSA 493
caauaacaagcucccagacac

SEQ ID NO: 568789 - RNA, 13 nt, Coxiella burnetii RSA 493
caauaaacccguu

SEQ ID NO: 568790 - RNA, 13 nt, Coxiella burnetii RSA 493
caauaaagaaagc

SEQ ID NO: 568791 - RNA, 15 nt, Coxiella burnetii RSA 493
caauaaauaaaucaa

SEQ ID NO: 568792 - RNA, 17 nt, Coxiella burnetii RSA 493
caaguuuuaagaaaaac

SEQ ID NO: 568793 - RNA, 18 nt, Coxiella burnetii RSA 493
caaguagccaaaauaaua

SEQ ID NO: 568794 - RNA, 14 nt, Coxiella burnetii RSA 493
caagcguucuuaaa

SEQ ID NO: 568795 - RNA, 20 nt, Coxiella burnetii RSA 493
caacuucgaacauuuguuua

SEQ ID NO: 568796 - RNA, 19 nt, Coxiella burnetii RSA 493
caacuuagcgaauuguaaa

SEQ ID NO: 568797 - RNA, 23 nt, Coxiella burnetii RSA 493
caagcccgcagcgcccacuuugc

SEQ ID NO: 568798 - RNA, 12 nt, Coxiella burnetii RSA 493
caagccccuuua

SEQ ID NO: 568799 - RNA, 21 nt, Coxiella burnetii RSA 493
caagccccuuuaaugcauuug

SEQ ID NO: 568800 - RNA, 13 nt, Coxiella burnetii RSA 493
caagcccuuuuuu

SEQ ID NO: 568801 - RNA, 14 nt, Coxiella burnetii RSA 493
auuuuuuaaugaaa

SEQ ID NO: 568802 - RNA, 12 nt, Coxiella burnetii RSA 493
auuuuuuaaauc

SEQ ID NO: 568803 - RNA, 17 nt, Coxiella burnetii RSA 493
auuuuucuuuuuuuucu

SEQ ID NO: 568804 - RNA, 18 nt, Coxiella burnetii RSA 493
auuuuugccaggacuuua

SEQ ID NO: 568805 - RNA, 22 nt, Coxiella burnetii RSA 493
auuuuugccaggacuuuaagau

SEQ ID NO: 568806 - RNA, 17 nt, Coxiella burnetii RSA 493
auuuuucgaugauuaag

SEQ ID NO: 568807 - RNA, 14 nt, Coxiella burnetii RSA 493
auuuuucucuucuu

SEQ ID NO: 568808 - RNA, 15 nt, Coxiella burnetii RSA 493
auuuuucucuuucau

SEQ ID NO: 568809 - RNA, 17 nt, Coxiella burnetii RSA 493
auuuuucucaucauuuu

SEQ ID NO: 568810 - RNA, 14 nt, Coxiella burnetii RSA 493
auuuuuaaauuauc

SEQ ID NO: 568811 - RNA, 17 nt, Coxiella burnetii RSA 493
auuuuuaaaagauuuua

SEQ ID NO: 568812 - RNA, 18 nt, Coxiella burnetii RSA 493
auuuuuaaaagauuuuau

SEQ ID NO: 568813 - RNA, 19 nt, Coxiella burnetii RSA 493
auuuuuucaaauugcugaa

SEQ ID NO: 568814 - RNA, 13 nt, Coxiella burnetii RSA 493
auuuuuucuuugc

SEQ ID NO: 568815 - RNA, 19 nt, Coxiella burnetii RSA 493
auuuuuugcugauccucau

SEQ ID NO: 568816 - RNA, 17 nt, Coxiella burnetii RSA 493
caaaaaaagaaaaucca

SEQ ID NO: 568817 - RNA, 15 nt, Coxiella burnetii RSA 493
auuuuuuucuuaaaa

SEQ ID NO: 568818 - RNA, 17 nt, Coxiella burnetii RSA 493
caaaacgaaaagcugaa

SEQ ID NO: 568819 - RNA, 19 nt, Coxiella burnetii RSA 493
caaaacgaaaagcugaaau

SEQ ID NO: 568820 - RNA, 15 nt, Coxiella burnetii RSA 493
caaaaauuucauuua

SEQ ID NO: 568821 - RNA, 22 nt, Coxiella burnetii RSA 493
caaaacaaucaaugcaguuaac

SEQ ID NO: 568822 - RNA, 16 nt, Coxiella burnetii RSA 493
caaaacucccaucaaa

SEQ ID NO: 568823 - RNA, 21 nt, Coxiella burnetii RSA 493
caaaacgggcauuggaaaaaa

SEQ ID NO: 568824 - RNA, 21 nt, Coxiella burnetii RSA 493
caaaacguagaaguuuaaagu

SEQ ID NO: 568825 - RNA, 18 nt, Coxiella burnetii RSA 493
caaaaaucgccauuuugu

SEQ ID NO: 568826 - RNA, 15 nt, Coxiella burnetii RSA 493
caaaaauaaaacgau

SEQ ID NO: 568827 - RNA, 16 nt, Coxiella burnetii RSA 493
caaaaauaaaacgauc

SEQ ID NO: 568828 - RNA, 16 nt, Coxiella burnetii RSA 493
caaaaaguuuauaaaa

SEQ ID NO: 568829 - RNA, 16 nt, Coxiella burnetii RSA 493
caaaaacagauuuaaa

SEQ ID NO: 568830 - RNA, 19 nt, Coxiella burnetii RSA 493
caaaaaaguuuagaaagcg

SEQ ID NO: 568831 - RNA, 17 nt, Coxiella burnetii RSA 493
caaaaacuucaugcaaa

SEQ ID NO: 568832 - RNA, 20 nt, Coxiella burnetii RSA 493
caaaaacccauaacgaaaau

SEQ ID NO: 568833 - RNA, 20 nt, Coxiella burnetii RSA 493
auuucucaucugucaucauc

SEQ ID NO: 568834 - RNA, 14 nt, Coxiella burnetii RSA 493
auuucuaaaaauca

SEQ ID NO: 568835 - RNA, 14 nt, Coxiella burnetii RSA 493
auuucuucacggau

SEQ ID NO: 568836 - RNA, 22 nt, Coxiella burnetii RSA 493
auuucuuccacgggguauugaa

SEQ ID NO: 568837 - RNA, 19 nt, Coxiella burnetii RSA 493
auuucucgaaccaccuggc

SEQ ID NO: 568838 - RNA, 13 nt, Coxiella burnetii RSA 493
auuucuuccucaa

SEQ ID NO: 568839 - RNA, 15 nt, Coxiella burnetii RSA 493
auuucuuuuuguguu

SEQ ID NO: 568840 - RNA, 13 nt, Coxiella burnetii RSA 493
auuugaaauaaac

SEQ ID NO: 568841 - RNA, 14 nt, Coxiella burnetii RSA 493
auuuggcuuuacau

SEQ ID NO: 568842 - RNA, 21 nt, Coxiella burnetii RSA 493
auuugcggaaaaggagaaagu

SEQ ID NO: 568843 - RNA, 14 nt, Coxiella burnetii RSA 493
auuugaucauuucc

SEQ ID NO: 568844 - RNA, 13 nt, Coxiella burnetii RSA 493
auuuguugagagu

SEQ ID NO: 568845 - RNA, 20 nt, Coxiella burnetii RSA 493
auuuguucguaauaauaagc

SEQ ID NO: 568846 - RNA, 18 nt, Coxiella burnetii RSA 493
auuuguucuuuaacaaga

SEQ ID NO: 568847 - RNA, 21 nt, Coxiella burnetii RSA 493
auuuguucuuuaacaagauca

SEQ ID NO: 568848 - RNA, 16 nt, Coxiella burnetii RSA 493
auuuguugaacagagu

SEQ ID NO: 568849 - RNA, 22 nt, Coxiella burnetii RSA 493
auuuguucgauacagccuucau

SEQ ID NO: 568850 - RNA, 21 nt, Coxiella burnetii RSA 493
auuuguauggcgccugacaaa

SEQ ID NO: 568851 - RNA, 23 nt, Coxiella burnetii RSA 493
auuuguauggcgccugacaaagc

SEQ ID NO: 568852 - RNA, 23 nt, Coxiella burnetii RSA 493
auuuguauccgcuuuaauacagu

SEQ ID NO: 568853 - RNA, 14 nt, Coxiella burnetii RSA 493
auuugugauuuuaa

SEQ ID NO: 568854 - RNA, 15 nt, Coxiella burnetii RSA 493
auuugugauuuuaaa

SEQ ID NO: 568855 - RNA, 17 nt, Coxiella burnetii RSA 493
auuugugauuuuaaaaa

SEQ ID NO: 568856 - RNA, 22 nt, Coxiella burnetii RSA 493
auuuucugggagauuuauuccu

SEQ ID NO: 568857 - RNA, 20 nt, Coxiella burnetii RSA 493
auuuucugugguuaauucuu

SEQ ID NO: 568858 - RNA, 22 nt, Coxiella burnetii RSA 493
auuuucugugguuaauucuucu

SEQ ID NO: 568859 - RNA, 19 nt, Coxiella burnetii RSA 493
auuuuccgcaggacuuaag

SEQ ID NO: 568860 - RNA, 21 nt, Coxiella burnetii RSA 493
auuuuccucacggcaauucuc

SEQ ID NO: 568861 - RNA, 13 nt, Coxiella burnetii RSA 493
auuuugugaugca

SEQ ID NO: 568862 - RNA, 16 nt, Coxiella burnetii RSA 493
auuuugacuuauuacc

SEQ ID NO: 568863 - RNA, 10 nt, Coxiella burnetii RSA 493
auuuugauuc

SEQ ID NO: 568864 - RNA, 13 nt, Coxiella burnetii RSA 493
auuuugauucucu

SEQ ID NO: 568865 - RNA, 15 nt, Coxiella burnetii RSA 493
auuuugauucucuau

SEQ ID NO: 568866 - RNA, 14 nt, Coxiella burnetii RSA 493
auuuugauuuuuua

SEQ ID NO: 568867 - RNA, 15 nt, Coxiella burnetii RSA 493
auuuugcaaaugaau

SEQ ID NO: 568868 - RNA, 18 nt, Coxiella burnetii RSA 493
auuuuguagauuagaaaa

SEQ ID NO: 568869 - RNA, 16 nt, Coxiella burnetii RSA 493
auuuucacuauuugua

SEQ ID NO: 568870 - RNA, 18 nt, Coxiella burnetii RSA 493
auuuuaucuuauuauuca

SEQ ID NO: 568871 - RNA, 14 nt, Coxiella burnetii RSA 493
auuuuauuauuuau

SEQ ID NO: 568872 - RNA, 16 nt, Coxiella burnetii RSA 493
auuuuauuauuuauca

SEQ ID NO: 568873 - RNA, 18 nt, Coxiella burnetii RSA 493
auuuuacgcuauuuuuua

SEQ ID NO: 568874 - RNA, 16 nt, Coxiella burnetii RSA 493
auuuuaaauaccauuu

SEQ ID NO: 568875 - RNA, 12 nt, Coxiella burnetii RSA 493
auucuauaauca

SEQ ID NO: 568876 - RNA, 19 nt, Coxiella burnetii RSA 493
auucuauaaucauuuuucc

SEQ ID NO: 568877 - RNA, 15 nt, Coxiella burnetii RSA 493
auucuauacuucauc

SEQ ID NO: 568878 - RNA, 16 nt, Coxiella burnetii RSA 493
auucaggggcaaucaa

SEQ ID NO: 568879 - RNA, 14 nt, Coxiella burnetii RSA 493
auucuauuagcugc

SEQ ID NO: 568880 - RNA, 22 nt, Coxiella burnetii RSA 493
auucuauuagcugccauuuuca

SEQ ID NO: 568881 - RNA, 14 nt, Coxiella burnetii RSA 493
auugacuucuuugu

SEQ ID NO: 568882 - RNA, 14 nt, Coxiella burnetii RSA 493
auucuucaauacua

SEQ ID NO: 568883 - RNA, 16 nt, Coxiella burnetii RSA 493
auugaagucugguuaa

SEQ ID NO: 568884 - RNA, 13 nt, Coxiella burnetii RSA 493
auucuuuuucuuu

SEQ ID NO: 568885 - RNA, 20 nt, Coxiella burnetii RSA 493
auucuuuuuuaauauuuuuu

SEQ ID NO: 568886 - RNA, 17 nt, Coxiella burnetii RSA 493
auugagcggcuuuuuca

SEQ ID NO: 568887 - RNA, 23 nt, Coxiella burnetii RSA 493
auugaguaaugguuuugaucaca

SEQ ID NO: 568888 - RNA, 19 nt, Coxiella burnetii RSA 493
auugauuuuuuaaugaaaa

SEQ ID NO: 568889 - RNA, 20 nt, Coxiella burnetii RSA 493
auugauuuuuuaaugaaaaa

SEQ ID NO: 568890 - RNA, 18 nt, Coxiella burnetii RSA 493
auuggagucgcuuucaau

SEQ ID NO: 568891 - RNA, 18 nt, Coxiella burnetii RSA 493
auugcucaauauugaaua

SEQ ID NO: 568892 - RNA, 23 nt, Coxiella burnetii RSA 493
auugcucugaccuaauuugauuu

SEQ ID NO: 568893 - RNA, 17 nt, Coxiella burnetii RSA 493
auuguuucaugaaguuc

SEQ ID NO: 568894 - RNA, 18 nt, Coxiella burnetii RSA 493
auuguuugaaaaaauacc

SEQ ID NO: 568895 - RNA, 17 nt, Coxiella burnetii RSA 493
auuguugauuuaacuuc

SEQ ID NO: 568896 - RNA, 12 nt, Coxiella burnetii RSA 493
auuguguuuuaa

SEQ ID NO: 568897 - RNA, 19 nt, Coxiella burnetii RSA 493
auuguuaacaccuuuuuca

SEQ ID NO: 568898 - RNA, 13 nt, Coxiella burnetii RSA 493
auuguuaauccac

SEQ ID NO: 568899 - RNA, 14 nt, Coxiella burnetii RSA 493
auuguaauugcuug

SEQ ID NO: 568900 - RNA, 22 nt, Coxiella burnetii RSA 493
auuguaaacagacccccauuuu

SEQ ID NO: 568901 - RNA, 12 nt, Coxiella burnetii RSA 493
auuuaaugaggu

SEQ ID NO: 568902 - RNA, 20 nt, Coxiella burnetii RSA 493
auuuauaacaaaccaucgcc

SEQ ID NO: 568903 - RNA, 21 nt, Coxiella burnetii RSA 493
auuucagauaaugaccuuaau

SEQ ID NO: 568904 - RNA, 19 nt, Coxiella burnetii RSA 493
auuucaauggauucuucuu

SEQ ID NO: 568905 - RNA, 18 nt, Coxiella burnetii RSA 493
auuucaacgucaaaaccc

SEQ ID NO: 568906 - RNA, 18 nt, Coxiella burnetii RSA 493
auuucaauauuucuugaa

SEQ ID NO: 568907 - RNA, 11 nt, Coxiella burnetii RSA 493
auuuauuucug

SEQ ID NO: 568908 - RNA, 15 nt, Coxiella burnetii RSA 493
auuuauuaaaaacua

SEQ ID NO: 568909 - RNA, 17 nt, Coxiella burnetii RSA 493
auuacuccaauuucauu

SEQ ID NO: 568910 - RNA, 14 nt, Coxiella burnetii RSA 493
auuacgauuaauca

SEQ ID NO: 568911 - RNA, 16 nt, Coxiella burnetii RSA 493
auuacgccaaacuucu

SEQ ID NO: 568912 - RNA, 17 nt, Coxiella burnetii RSA 493
auuacgcccuuucucuu

SEQ ID NO: 568913 - RNA, 23 nt, Coxiella burnetii RSA 493
auuacgcccuuucucuuuuuucc

SEQ ID NO: 568914 - RNA, 22 nt, Coxiella burnetii RSA 493
auuaccugaaugcuuuuaaagu

SEQ ID NO: 568915 - RNA, 16 nt, Coxiella burnetii RSA 493
auuacauauuucuuuu

SEQ ID NO: 568916 - RNA, 20 nt, Coxiella burnetii RSA 493
auuacauaauuuaaacucaa

SEQ ID NO: 568917 - RNA, 12 nt, Coxiella burnetii RSA 493
auuaauuuucca

SEQ ID NO: 568918 - RNA, 21 nt, Coxiella burnetii RSA 493
auuaauuguggcgaagccaca

SEQ ID NO: 568919 - RNA, 12 nt, Coxiella burnetii RSA 493
auuaauuucuuu

SEQ ID NO: 568920 - RNA, 23 nt, Coxiella burnetii RSA 493
auuaauucccaagcuuuugccuu

SEQ ID NO: 568921 - RNA, 13 nt, Coxiella burnetii RSA 493
auuaauugcugau

SEQ ID NO: 568922 - RNA, 18 nt, Coxiella burnetii RSA 493
auuaguuuaaauuuuuca

SEQ ID NO: 568923 - RNA, 17 nt, Coxiella burnetii RSA 493
auuaguaauauuuugca

SEQ ID NO: 568924 - RNA, 18 nt, Coxiella burnetii RSA 493
auuauaacuauuuuaaau

SEQ ID NO: 568925 - RNA, 15 nt, Coxiella burnetii RSA 493
auuauacugcccagc

SEQ ID NO: 568926 - RNA, 22 nt, Coxiella burnetii RSA 493
auuauagaaugggaaguuuuau

SEQ ID NO: 568927 - RNA, 14 nt, Coxiella burnetii RSA 493
auuauaguuaucca

SEQ ID NO: 568928 - RNA, 13 nt, Coxiella burnetii RSA 493
auuagaaauaaua

SEQ ID NO: 568929 - RNA, 16 nt, Coxiella burnetii RSA 493
auuacuucuuugagua

SEQ ID NO: 568930 - RNA, 15 nt, Coxiella burnetii RSA 493
auuagacauuuuucg

SEQ ID NO: 568931 - RNA, 17 nt, Coxiella burnetii RSA 493
auuagaauuacuguaaa

SEQ ID NO: 568932 - RNA, 15 nt, Coxiella burnetii RSA 493
auuagcugccauuuu

SEQ ID NO: 568933 - RNA, 14 nt, Coxiella burnetii RSA 493
auuagcuucguuac

SEQ ID NO: 568934 - RNA, 14 nt, Coxiella burnetii RSA 493
auuagcuucguuua

SEQ ID NO: 568935 - RNA, 18 nt, Coxiella burnetii RSA 493
auuagcuucguuuacuuu

SEQ ID NO: 568936 - RNA, 16 nt, Coxiella burnetii RSA 493
auucaauuuuuuugau

SEQ ID NO: 568937 - RNA, 17 nt, Coxiella burnetii RSA 493
auucacgauuuucguug

SEQ ID NO: 568938 - RNA, 16 nt, Coxiella burnetii RSA 493
auucaauacagauuuu

SEQ ID NO: 568939 - RNA, 17 nt, Coxiella burnetii RSA 493
auucaauacagauuuua

SEQ ID NO: 568940 - RNA, 22 nt, Coxiella burnetii RSA 493
auucaauagagcgggaauuuuc

SEQ ID NO: 568941 - RNA, 16 nt, Coxiella burnetii RSA 493
auucaacucuuaucuu

SEQ ID NO: 568942 - RNA, 15 nt, Coxiella burnetii RSA 493
auucaacacaauauc

SEQ ID NO: 568943 - RNA, 16 nt, Coxiella burnetii RSA 493
auucaaagaacgccag

SEQ ID NO: 568944 - RNA, 19 nt, Coxiella burnetii RSA 493
auuauugaauuauacuuuu

SEQ ID NO: 568945 - RNA, 19 nt, Coxiella burnetii RSA 493
auuauugaugucacaauua

SEQ ID NO: 568946 - RNA, 20 nt, Coxiella burnetii RSA 493
auuaugcgaaauagaauuuu

SEQ ID NO: 568947 - RNA, 18 nt, Coxiella burnetii RSA 493
auuauuaagccuuaauca

SEQ ID NO: 568948 - RNA, 20 nt, Coxiella burnetii RSA 493
auuauuaauacaggaaaaag

SEQ ID NO: 568949 - RNA, 12 nt, Coxiella burnetii RSA 493
auuaucaucgca

SEQ ID NO: 568950 - RNA, 20 nt, Coxiella burnetii RSA 493
auuauccaaaauccaggcug

SEQ ID NO: 568951 - RNA, 23 nt, Coxiella burnetii RSA 493
auuaucuuaaugaaauuucucau

SEQ ID NO: 568952 - RNA, 11 nt, Coxiella burnetii RSA 493
auuaugaaaac

SEQ ID NO: 568953 - RNA, 15 nt, Coxiella burnetii RSA 493
auguuugaauauuuu

SEQ ID NO: 568954 - RNA, 23 nt, Coxiella burnetii RSA 493
auguuuagcuaacugauuagcug

SEQ ID NO: 568955 - RNA, 21 nt, Coxiella burnetii RSA 493
auguuuagucggaaauuucuc

SEQ ID NO: 568956 - RNA, 19 nt, Coxiella burnetii RSA 493
auguugggcgaaaagcauu

SEQ ID NO: 568957 - RNA, 13 nt, Coxiella burnetii RSA 493
auuaaauauaauu

SEQ ID NO: 568958 - RNA, 17 nt, Coxiella burnetii RSA 493
auuaaauccucuuuaga

SEQ ID NO: 568959 - RNA, 23 nt, Coxiella burnetii RSA 493
auuaaauccagaccuguuaaaaa

SEQ ID NO: 568960 - RNA, 22 nt, Coxiella burnetii RSA 493
auuaaauauccgcaauaugcag

SEQ ID NO: 568961 - RNA, 17 nt, Coxiella burnetii RSA 493
auuaaauauuucuucca

SEQ ID NO: 568962 - RNA, 21 nt, Coxiella burnetii RSA 493
auuaaacgcgauaucuccauu

SEQ ID NO: 568963 - RNA, 16 nt, Coxiella burnetii RSA 493
auuaaaccauaagcaa

SEQ ID NO: 568964 - RNA, 12 nt, Coxiella burnetii RSA 493
auuaaaaacaau

SEQ ID NO: 568965 - RNA, 12 nt, Coxiella burnetii RSA 493
auguuuuuuaau

SEQ ID NO: 568966 - RNA, 19 nt, Coxiella burnetii RSA 493
auuaaaauaauccaaggga

SEQ ID NO: 568967 - RNA, 18 nt, Coxiella burnetii RSA 493
auuaaaaauuugauuaau

SEQ ID NO: 568968 - RNA, 16 nt, Coxiella burnetii RSA 493
auuaaaaauuuuaaaa

SEQ ID NO: 568969 - RNA, 17 nt, Coxiella burnetii RSA 493
auuaaaaauuuuaaaaa

SEQ ID NO: 568970 - RNA, 21 nt, Coxiella burnetii RSA 493
auuaaaacaagacaacaaaau

SEQ ID NO: 568971 - RNA, 19 nt, Coxiella burnetii RSA 493
auuaaaagagcgaauaaaa

SEQ ID NO: 568972 - RNA, 20 nt, Coxiella burnetii RSA 493
auuaaaagagcgaauaaaaa

SEQ ID NO: 568973 - RNA, 21 nt, Coxiella burnetii RSA 493
auuaacuucgccauugucuca

SEQ ID NO: 568974 - RNA, 22 nt, Coxiella burnetii RSA 493
auuaacuucgccauugucucac

SEQ ID NO: 568975 - RNA, 13 nt, Coxiella burnetii RSA 493
auuaagagaaauu

SEQ ID NO: 568976 - RNA, 19 nt, Coxiella burnetii RSA 493
auuaagagaaauuaaauuu

SEQ ID NO: 568977 - RNA, 15 nt, Coxiella burnetii RSA 493
auuaagcaauuuuuu

SEQ ID NO: 568978 - RNA, 19 nt, Coxiella burnetii RSA 493
auuaagcaauuuuuuauca

SEQ ID NO: 568979 - RNA, 21 nt, Coxiella burnetii RSA 493
auuaacauuuggauugccaau

SEQ ID NO: 568980 - RNA, 21 nt, Coxiella burnetii RSA 493
auuaaauuuaaucuuuaucca

SEQ ID NO: 568981 - RNA, 17 nt, Coxiella burnetii RSA 493
auuaaauuuacaauacg

SEQ ID NO: 568982 - RNA, 12 nt, Coxiella burnetii RSA 493
auuaaauuuuua

SEQ ID NO: 568983 - RNA, 18 nt, Coxiella burnetii RSA 493
auuaagacuaggaaaaaa

SEQ ID NO: 568984 - RNA, 19 nt, Coxiella burnetii RSA 493
auuaauacauucuucagua

SEQ ID NO: 568985 - RNA, 16 nt, Coxiella burnetii RSA 493
auuaauauuaaaacaa

SEQ ID NO: 568986 - RNA, 18 nt, Coxiella burnetii RSA 493
auuaauauuaaaacaaga

SEQ ID NO: 568987 - RNA, 20 nt, Coxiella burnetii RSA 493
auuaaucauucgaacgacuu

SEQ ID NO: 568988 - RNA, 12 nt, Coxiella burnetii RSA 493
auuaaucuucca

SEQ ID NO: 568989 - RNA, 15 nt, Coxiella burnetii RSA 493
augguaauaauuuuc

SEQ ID NO: 568990 - RNA, 23 nt, Coxiella burnetii RSA 493
augggaagauuuauaacaagguu

SEQ ID NO: 568991 - RNA, 22 nt, Coxiella burnetii RSA 493
augggaugucgcuuuauucauu

SEQ ID NO: 568992 - RNA, 16 nt, Coxiella burnetii RSA 493
auggcuccagccgaag

SEQ ID NO: 568993 - RNA, 21 nt, Coxiella burnetii RSA 493
auggcuaacucacuuuuuuca

SEQ ID NO: 568994 - RNA, 17 nt, Coxiella burnetii RSA 493
auggcccaauaaagaaa

SEQ ID NO: 568995 - RNA, 12 nt, Coxiella burnetii RSA 493
auggcauucuug

SEQ ID NO: 568996 - RNA, 15 nt, Coxiella burnetii RSA 493
auggcaucauuuccc

SEQ ID NO: 568997 - RNA, 16 nt, Coxiella burnetii RSA 493
auguaaucaauugcua

SEQ ID NO: 568998 - RNA, 22 nt, Coxiella burnetii RSA 493
auguaaggcaucuuuuucuccu

SEQ ID NO: 568999 - RNA, 15 nt, Coxiella burnetii RSA 493
auguaggugaaaacg

SEQ ID NO: 569000 - RNA, 18 nt, Coxiella burnetii RSA 493
auguauccuaauaaaaau

SEQ ID NO: 569001 - RNA, 18 nt, Coxiella burnetii RSA 493
auguccauccgcuaacgu

SEQ ID NO: 569002 - RNA, 17 nt, Coxiella burnetii RSA 493
auguggagcuugcauua

SEQ ID NO: 569003 - RNA, 12 nt, Coxiella burnetii RSA 493
auguuaaaacac

SEQ ID NO: 569004 - RNA, 21 nt, Coxiella burnetii RSA 493
auguuauuuuccucccauuga

SEQ ID NO: 569005 - RNA, 14 nt, Coxiella burnetii RSA 493
augugaucuacuuc

SEQ ID NO: 569006 - RNA, 13 nt, Coxiella burnetii RSA 493
aucugcuaaaaag

SEQ ID NO: 569007 - RNA, 24 nt, Coxiella burnetii RSA 493
aucugcuaaaaagcuagcgaaauu

SEQ ID NO: 569008 - RNA, 16 nt, Coxiella burnetii RSA 493
aucugcuaggauuuuu

SEQ ID NO: 569009 - RNA, 18 nt, Coxiella burnetii RSA 493
aucugcuaggauuuuuua

SEQ ID NO: 569010 - RNA, 22 nt, Coxiella burnetii RSA 493
aucugcuaggauuuuuuaucca

SEQ ID NO: 569011 - RNA, 12 nt, Coxiella burnetii RSA 493
aucuuguuuaag

SEQ ID NO: 569012 - RNA, 19 nt, Coxiella burnetii RSA 493
augaaaucccgagccccaa

SEQ ID NO: 569013 - RNA, 20 nt, Coxiella burnetii RSA 493
augaaaucccgagccccaaa

SEQ ID NO: 569014 - RNA, 20 nt, Coxiella burnetii RSA 493
augaaaucguuuuguuuuaa

SEQ ID NO: 569015 - RNA, 14 nt, Coxiella burnetii RSA 493
augaaacaaacaaa

SEQ ID NO: 569016 - RNA, 17 nt, Coxiella burnetii RSA 493
augaaacaaacaaaaaa

SEQ ID NO: 569017 - RNA, 16 nt, Coxiella burnetii RSA 493
aucuuucgaccaggac

SEQ ID NO: 569018 - RNA, 22 nt, Coxiella burnetii RSA 493
augagaugaucaucaucaaaau

SEQ ID NO: 569019 - RNA, 23 nt, Coxiella burnetii RSA 493
augaguauggcuauuauuaauac

SEQ ID NO: 569020 - RNA, 14 nt, Coxiella burnetii RSA 493
augagucccauuua

SEQ ID NO: 569021 - RNA, 13 nt, Coxiella burnetii RSA 493
augacgauuaaca

SEQ ID NO: 569022 - RNA, 13 nt, Coxiella burnetii RSA 493
augacgcagaaua

SEQ ID NO: 569023 - RNA, 17 nt, Coxiella burnetii RSA 493
augaaucagcuuaauca

SEQ ID NO: 569024 - RNA, 17 nt, Coxiella burnetii RSA 493
augaauauuaguggaau

SEQ ID NO: 569025 - RNA, 20 nt, Coxiella burnetii RSA 493
augaagguacugaagaguaa

SEQ ID NO: 569026 - RNA, 16 nt, Coxiella burnetii RSA 493
augaauaacaucaguu

SEQ ID NO: 569027 - RNA, 16 nt, Coxiella burnetii RSA 493
augaauaagcaaagau

SEQ ID NO: 569028 - RNA, 18 nt, Coxiella burnetii RSA 493
augaaugagcugcuuucg

SEQ ID NO: 569029 - RNA, 22 nt, Coxiella burnetii RSA 493
augaaugcuggagugagaaauu

SEQ ID NO: 569030 - RNA, 12 nt, Coxiella burnetii RSA 493
augaauuaaaua

SEQ ID NO: 569031 - RNA, 13 nt, Coxiella burnetii RSA 493
augaauuaaauau

SEQ ID NO: 569032 - RNA, 18 nt, Coxiella burnetii RSA 493
augacauuuaaaaaaacc

SEQ ID NO: 569033 - RNA, 13 nt, Coxiella burnetii RSA 493
augaccaaauaau

SEQ ID NO: 569034 - RNA, 23 nt, Coxiella burnetii RSA 493
augaauuuaaugucuuuuauuuu

SEQ ID NO: 569035 - RNA, 23 nt, Coxiella burnetii RSA 493
augauaaaaggcagcuuccagaa

SEQ ID NO: 569036 - RNA, 18 nt, Coxiella burnetii RSA 493
augaguucugucacuaau

SEQ ID NO: 569037 - RNA, 17 nt, Coxiella burnetii RSA 493
augauguucucuccauu

SEQ ID NO: 569038 - RNA, 15 nt, Coxiella burnetii RSA 493
augauguuuuaaaau

SEQ ID NO: 569039 - RNA, 16 nt, Coxiella burnetii RSA 493
augauguuuuaaaauu

SEQ ID NO: 569040 - RNA, 17 nt, Coxiella burnetii RSA 493
augauugggcucaaaaa

SEQ ID NO: 569041 - RNA, 22 nt, Coxiella burnetii RSA 493
augccaacccaaggaaccacca

SEQ ID NO: 569042 - RNA, 12 nt, Coxiella burnetii RSA 493
augcaguuaacc

SEQ ID NO: 569043 - RNA, 14 nt, Coxiella burnetii RSA 493
augcccgaaaagga

SEQ ID NO: 569044 - RNA, 17 nt, Coxiella burnetii RSA 493
augccuccuugcaagcu

SEQ ID NO: 569045 - RNA, 20 nt, Coxiella burnetii RSA 493
augccgcuugaaaaauugaa

SEQ ID NO: 569046 - RNA, 22 nt, Coxiella burnetii RSA 493
aucuacuucccgcaaaugaucg

SEQ ID NO: 569047 - RNA, 13 nt, Coxiella burnetii RSA 493
aucuauugucauc

SEQ ID NO: 569048 - RNA, 16 nt, Coxiella burnetii RSA 493
aucucacuuggauuuu

SEQ ID NO: 569049 - RNA, 14 nt, Coxiella burnetii RSA 493
aucucgaaauuauu

SEQ ID NO: 569050 - RNA, 15 nt, Coxiella burnetii RSA 493
aucucgaaauuauuu

SEQ ID NO: 569051 - RNA, 21 nt, Coxiella burnetii RSA 493
aucugcgggauuaauuuucca

SEQ ID NO: 569052 - RNA, 22 nt, Coxiella burnetii RSA 493
aucugauggaugaaagauuuuu

SEQ ID NO: 569053 - RNA, 23 nt, Coxiella burnetii RSA 493
aucugauggaugaaagauuuuuu

SEQ ID NO: 569054 - RNA, 20 nt, Coxiella burnetii RSA 493
aucugacaguuggcuaaauc

SEQ ID NO: 569055 - RNA, 22 nt, Coxiella burnetii RSA 493
aucguccagguaguuuguuuuu

SEQ ID NO: 569056 - RNA, 19 nt, Coxiella burnetii RSA 493
aucgugccaguauuuuucu

SEQ ID NO: 569057 - RNA, 19 nt, Coxiella burnetii RSA 493
aucguguagaaagaaaguu

SEQ ID NO: 569058 - RNA, 13 nt, Coxiella burnetii RSA 493
aucguuaaaucgg

SEQ ID NO: 569059 - RNA, 13 nt, Coxiella burnetii RSA 493
aucguucggcuuc

SEQ ID NO: 569060 - RNA, 17 nt, Coxiella burnetii RSA 493
aucuaaaggaauacaau

SEQ ID NO: 569061 - RNA, 18 nt, Coxiella burnetii RSA 493
aucggauaaugcuugcuc

SEQ ID NO: 569062 - RNA, 20 nt, Coxiella burnetii RSA 493
aucggaucaauuuugguugu

SEQ ID NO: 569063 - RNA, 20 nt, Coxiella burnetii RSA 493
aucggcaacgaaaauaccuu

SEQ ID NO: 569064 - RNA, 21 nt, Coxiella burnetii RSA 493
aucggcuucacagagccaccg

SEQ ID NO: 569065 - RNA, 16 nt, Coxiella burnetii RSA 493
aucgcaauuaauacau

SEQ ID NO: 569066 - RNA, 20 nt, Coxiella burnetii RSA 493
aucgauaaaaauaaugaucc

SEQ ID NO: 569067 - RNA, 21 nt, Coxiella burnetii RSA 493
aucagcuuaaucaaccucagg

SEQ ID NO: 569068 - RNA, 16 nt, Coxiella burnetii RSA 493
aucgccuaucuuuccc

SEQ ID NO: 569069 - RNA, 19 nt, Coxiella burnetii RSA 493
aucgccgucccuucugcug

SEQ ID NO: 569070 - RNA, 14 nt, Coxiella burnetii RSA 493
aucgccguuucugc

SEQ ID NO: 569071 - RNA, 16 nt, Coxiella burnetii RSA 493
aucgccguuucugcuu

SEQ ID NO: 569072 - RNA, 16 nt, Coxiella burnetii RSA 493
aucgcggacaauaaga

SEQ ID NO: 569073 - RNA, 14 nt, Coxiella burnetii RSA 493
aucgcccauauuca

SEQ ID NO: 569074 - RNA, 16 nt, Coxiella burnetii RSA 493
aucgcagcauuuuucg

SEQ ID NO: 569075 - RNA, 14 nt, Coxiella burnetii RSA 493
aucgcacuugcuuc

SEQ ID NO: 569076 - RNA, 20 nt, Coxiella burnetii RSA 493
aucgcaucauucgggcauuc

SEQ ID NO: 569077 - RNA, 18 nt, Coxiella burnetii RSA 493
auaaugcuugcucuucuu

SEQ ID NO: 569078 - RNA, 21 nt, Coxiella burnetii RSA 493
auaaucacaaaagguaaaaaa

SEQ ID NO: 569079 - RNA, 16 nt, Coxiella burnetii RSA 493
auaaucgcaaaauuca

SEQ ID NO: 569080 - RNA, 11 nt, Coxiella burnetii RSA 493
auaaucuuccc

SEQ ID NO: 569081 - RNA, 15 nt, Coxiella burnetii RSA 493
auaauaguuugcaau

SEQ ID NO: 569082 - RNA, 16 nt, Coxiella burnetii RSA 493
auaauaucuagauuua

SEQ ID NO: 569083 - RNA, 15 nt, Coxiella burnetii RSA 493
auaaucaaugcgcca

SEQ ID NO: 569084 - RNA, 22 nt, Coxiella burnetii RSA 493
auaaucaaugcgccauccgaca

SEQ ID NO: 569085 - RNA, 13 nt, Coxiella burnetii RSA 493
auaauauguccaa

SEQ ID NO: 569086 - RNA, 12 nt, Coxiella burnetii RSA 493
auaauaaauggc

SEQ ID NO: 569087 - RNA, 21 nt, Coxiella burnetii RSA 493
auaauaacgcuaugaaaacca

SEQ ID NO: 569088 - RNA, 13 nt, Coxiella burnetii RSA 493
auaauaacgcuug

SEQ ID NO: 569089 - RNA, 15 nt, Coxiella burnetii RSA 493
auaauaacgcuugca

SEQ ID NO: 569090 - RNA, 15 nt, Coxiella burnetii RSA 493
auaagacccgccaaa

SEQ ID NO: 569091 - RNA, 17 nt, Coxiella burnetii RSA 493
auaagcuguuucuuuua

SEQ ID NO: 569092 - RNA, 19 nt, Coxiella burnetii RSA 493
auaagcguuccuugaauaa

SEQ ID NO: 569093 - RNA, 23 nt, Coxiella burnetii RSA 493
auaagcguuugguugguuugcaa

SEQ ID NO: 569094 - RNA, 17 nt, Coxiella burnetii RSA 493
auaagcuagaaaauaac

SEQ ID NO: 569095 - RNA, 18 nt, Coxiella burnetii RSA 493
auaagcuaucagcagaaa

SEQ ID NO: 569096 - RNA, 19 nt, Coxiella burnetii RSA 493
auaagcuaucagcagaaaa

SEQ ID NO: 569097 - RNA, 13 nt, Coxiella burnetii RSA 493
auaagcgcuuuug

SEQ ID NO: 569098 - RNA, 11 nt, Coxiella burnetii RSA 493
auaagcggguu

SEQ ID NO: 569099 - RNA, 12 nt, Coxiella burnetii RSA 493
auaagcuuucaa

SEQ ID NO: 569100 - RNA, 17 nt, Coxiella burnetii RSA 493
auaagcuuucaauaaau

SEQ ID NO: 569101 - RNA, 17 nt, Coxiella burnetii RSA 493
auaaggauaaggaagac

SEQ ID NO: 569102 - RNA, 13 nt, Coxiella burnetii RSA 493
auaaggugggggg

SEQ ID NO: 569103 - RNA, 14 nt, Coxiella burnetii RSA 493
auaagguguuuuac

SEQ ID NO: 569104 - RNA, 21 nt, Coxiella burnetii RSA 493
auaaggucuuaauuucuaaaa

SEQ ID NO: 569105 - RNA, 16 nt, Coxiella burnetii RSA 493
auaaguugucgauaaa

SEQ ID NO: 569106 - RNA, 16 nt, Coxiella burnetii RSA 493
auaaagcguuucucga

SEQ ID NO: 569107 - RNA, 17 nt, Coxiella burnetii RSA 493
auaaagguuuuuccuuu

SEQ ID NO: 569108 - RNA, 14 nt, Coxiella burnetii RSA 493
auaaaguaauuuua

SEQ ID NO: 569109 - RNA, 9 nt, Coxiella burnetii RSA 493
auaaauccu

SEQ ID NO: 569110 - RNA, 16 nt, Coxiella burnetii RSA 493
auaaagcaaugaaaua

SEQ ID NO: 569111 - RNA, 17 nt, Coxiella burnetii RSA 493
auaaagauucuguaacu

SEQ ID NO: 569112 - RNA, 15 nt, Coxiella burnetii RSA 493
auaaacuggaaaaag

SEQ ID NO: 569113 - RNA, 20 nt, Coxiella burnetii RSA 493
auaaacucgcgcggcaagga

SEQ ID NO: 569114 - RNA, 22 nt, Coxiella burnetii RSA 493
auaaaaaggcaaauguugauaa

SEQ ID NO: 569115 - RNA, 12 nt, Coxiella burnetii RSA 493
auaaaaaacccc

SEQ ID NO: 569116 - RNA, 13 nt, Coxiella burnetii RSA 493
auaaauguuuuuu

SEQ ID NO: 569117 - RNA, 14 nt, Coxiella burnetii RSA 493
auaaauuaaaaaaa

SEQ ID NO: 569118 - RNA, 13 nt, Coxiella burnetii RSA 493
auaacuauuuuaa

SEQ ID NO: 569119 - RNA, 14 nt, Coxiella burnetii RSA 493
auaacuauuuuaaa

SEQ ID NO: 569120 - RNA, 15 nt, Coxiella burnetii RSA 493
auaacuauuuuaaau

SEQ ID NO: 569121 - RNA, 17 nt, Coxiella burnetii RSA 493
auaacuauuuuaaaucu

SEQ ID NO: 569122 - RNA, 14 nt, Coxiella burnetii RSA 493
auaacuaauugcca

SEQ ID NO: 569123 - RNA, 15 nt, Coxiella burnetii RSA 493
auaacuauuauuaaa

SEQ ID NO: 569124 - RNA, 15 nt, Coxiella burnetii RSA 493
auaacuuuacuaaaa

SEQ ID NO: 569125 - RNA, 13 nt, Coxiella burnetii RSA 493
auaagaaacguau

SEQ ID NO: 569126 - RNA, 19 nt, Coxiella burnetii RSA 493
agucuuuuuauauuccuga

SEQ ID NO: 569127 - RNA, 18 nt, Coxiella burnetii RSA 493
agucuuugacauaucauu

SEQ ID NO: 569128 - RNA, 16 nt, Coxiella burnetii RSA 493
agucuuugguuuucca

SEQ ID NO: 569129 - RNA, 18 nt, Coxiella burnetii RSA 493
agucuuaauuuuaaaaaa

SEQ ID NO: 569130 - RNA, 20 nt, Coxiella burnetii RSA 493
agucuggccugccacaauca

SEQ ID NO: 569131 - RNA, 18 nt, Coxiella burnetii RSA 493
agucugucguuucugauu

SEQ ID NO: 569132 - RNA, 21 nt, Coxiella burnetii RSA 493
agucugucguuucugauuuuu

SEQ ID NO: 569133 - RNA, 16 nt, Coxiella burnetii RSA 493
aguccuugcugaauuc

SEQ ID NO: 569134 - RNA, 20 nt, Coxiella burnetii RSA 493
aguccuugcugaauucccuu

SEQ ID NO: 569135 - RNA, 22 nt, Coxiella burnetii RSA 493
aguccuugcugaauucccuuuu

SEQ ID NO: 569136 - RNA, 21 nt, Coxiella burnetii RSA 493
aguccuugacgcucagauaaa

SEQ ID NO: 569137 - RNA, 12 nt, Coxiella burnetii RSA 493
aguccguuaaaa

SEQ ID NO: 569138 - RNA, 19 nt, Coxiella burnetii RSA 493
aguccguuaaaauuguaag

SEQ ID NO: 569139 - RNA, 22 nt, Coxiella burnetii RSA 493
aguccggccggauuuuuucuuc

SEQ ID NO: 569140 - RNA, 14 nt, Coxiella burnetii RSA 493
aguccgcuuuuccc

SEQ ID NO: 569141 - RNA, 19 nt, Coxiella burnetii RSA 493
agucguuuuuuaauauuug

SEQ ID NO: 569142 - RNA, 22 nt, Coxiella burnetii RSA 493
agucguguuuuuauuuugacuu

SEQ ID NO: 569143 - RNA, 20 nt, Coxiella burnetii RSA 493
agucguuccguauccaucac

SEQ ID NO: 569144 - RNA, 14 nt, Coxiella burnetii RSA 493
agucucuuagcaua

SEQ ID NO: 569145 - RNA, 16 nt, Coxiella burnetii RSA 493
agugacucaucuccuu

SEQ ID NO: 569146 - RNA, 22 nt, Coxiella burnetii RSA 493
agugcuauucccgccaucacca

SEQ ID NO: 569147 - RNA, 14 nt, Coxiella burnetii RSA 493
agugcuauuuuucc

SEQ ID NO: 569148 - RNA, 19 nt, Coxiella burnetii RSA 493
agugguaagcuugcuugcu

SEQ ID NO: 569149 - RNA, 15 nt, Coxiella burnetii RSA 493
agugggaagcgggua

SEQ ID NO: 569150 - RNA, 16 nt, Coxiella burnetii RSA 493
aguggggauaauugaa

SEQ ID NO: 569151 - RNA, 18 nt, Coxiella burnetii RSA 493
agugggggaacagaggac

SEQ ID NO: 569152 - RNA, 21 nt, Coxiella burnetii RSA 493
agugggggaacagaggacaga

SEQ ID NO: 569153 - RNA, 14 nt, Coxiella burnetii RSA 493
agugugggaaaaau

SEQ ID NO: 569154 - RNA, 15 nt, Coxiella burnetii RSA 493
agugugauucauuau

SEQ ID NO: 569155 - RNA, 13 nt, Coxiella burnetii RSA 493
aguguggucugaa

SEQ ID NO: 569156 - RNA, 21 nt, Coxiella burnetii RSA 493
aguuaggccuauccuauucuu

SEQ ID NO: 569157 - RNA, 12 nt, Coxiella burnetii RSA 493
aguuaaaauaau

SEQ ID NO: 569158 - RNA, 20 nt, Coxiella burnetii RSA 493
aguuaaaggcguaagcacaa

SEQ ID NO: 569159 - RNA, 19 nt, Coxiella burnetii RSA 493
aguucuuaacgaagguuuc

SEQ ID NO: 569160 - RNA, 17 nt, Coxiella burnetii RSA 493
aguucgggccuucacuu

SEQ ID NO: 569161 - RNA, 16 nt, Coxiella burnetii RSA 493
aguuggaggcgaaaac

SEQ ID NO: 569162 - RNA, 22 nt, Coxiella burnetii RSA 493
aguuguucggaauauaauucuc

SEQ ID NO: 569163 - RNA, 22 nt, Coxiella burnetii RSA 493
aguuucguggcuucgagaggaa

SEQ ID NO: 569164 - RNA, 14 nt, Coxiella burnetii RSA 493
aguuucccacaaaa

SEQ ID NO: 569165 - RNA, 16 nt, Coxiella burnetii RSA 493
aguuucccacaaaaua

SEQ ID NO: 569166 - RNA, 15 nt, Coxiella burnetii RSA 493
aguuugacccgaaaa

SEQ ID NO: 569167 - RNA, 19 nt, Coxiella burnetii RSA 493
auaaaaaaaaguuuagaaa

SEQ ID NO: 569168 - RNA, 13 nt, Coxiella burnetii RSA 493
aguuuuuugcucu

SEQ ID NO: 569169 - RNA, 14 nt, Coxiella burnetii RSA 493
aguuuuaagaaaaa

SEQ ID NO: 569170 - RNA, 16 nt, Coxiella burnetii RSA 493
aguuuuagcgccagau

SEQ ID NO: 569171 - RNA, 22 nt, Coxiella burnetii RSA 493
aguuuucuauauuuucuuucuu

SEQ ID NO: 569172 - RNA, 16 nt, Coxiella burnetii RSA 493
auacggcuuuauuuug

SEQ ID NO: 569173 - RNA, 13 nt, Coxiella burnetii RSA 493
auacgggcuacuu

SEQ ID NO: 569174 - RNA, 18 nt, Coxiella burnetii RSA 493
auacgggcuacuuuacuu

SEQ ID NO: 569175 - RNA, 22 nt, Coxiella burnetii RSA 493
auacgggcuacuuuacuuuuug

SEQ ID NO: 569176 - RNA, 22 nt, Coxiella burnetii RSA 493
auacggggaaauaaugacaauu

SEQ ID NO: 569177 - RNA, 16 nt, Coxiella burnetii RSA 493
auacggugcagaaggc

SEQ ID NO: 569178 - RNA, 17 nt, Coxiella burnetii RSA 493
auacggugcagaaggcc

SEQ ID NO: 569179 - RNA, 14 nt, Coxiella burnetii RSA 493
auacuguucuuuca

SEQ ID NO: 569180 - RNA, 22 nt, Coxiella burnetii RSA 493
auacuggcaauaaguguuugau

SEQ ID NO: 569181 - RNA, 22 nt, Coxiella burnetii RSA 493
auacugacaaugcguuuuaaau

SEQ ID NO: 569182 - RNA, 15 nt, Coxiella burnetii RSA 493
auagacuucgcuaaa

SEQ ID NO: 569183 - RNA, 23 nt, Coxiella burnetii RSA 493
auagagucgggaaauaaaauuaa

SEQ ID NO: 569184 - RNA, 19 nt, Coxiella burnetii RSA 493
auagaucgcaaaauccugu

SEQ ID NO: 569185 - RNA, 17 nt, Coxiella burnetii RSA 493
auagaugguaauaauuu

SEQ ID NO: 569186 - RNA, 16 nt, Coxiella burnetii RSA 493
auagauggcaucauuu

SEQ ID NO: 569187 - RNA, 16 nt, Coxiella burnetii RSA 493
auagccaauguuugcu

SEQ ID NO: 569188 - RNA, 23 nt, Coxiella burnetii RSA 493
auagcgucuuuuuuauuugaaau

SEQ ID NO: 569189 - RNA, 21 nt, Coxiella burnetii RSA 493
auagcuuguuccuuuuuauaa

SEQ ID NO: 569190 - RNA, 21 nt, Coxiella burnetii RSA 493
auagcuccccgcuccaauugu

SEQ ID NO: 569191 - RNA, 12 nt, Coxiella burnetii RSA 493
auaggcuuucuu

SEQ ID NO: 569192 - RNA, 20 nt, Coxiella burnetii RSA 493
auaggcgaaucaucuuuuuu

SEQ ID NO: 569193 - RNA, 18 nt, Coxiella burnetii RSA 493
auagggcggcaaucagaa

SEQ ID NO: 569194 - RNA, 16 nt, Coxiella burnetii RSA 493
auagggcuaguaugcu

SEQ ID NO: 569195 - RNA, 14 nt, Coxiella burnetii RSA 493
auaggacuuuucuc

SEQ ID NO: 569196 - RNA, 23 nt, Coxiella burnetii RSA 493
auaguacuguauugagcagcauu

SEQ ID NO: 569197 - RNA, 16 nt, Coxiella burnetii RSA 493
auagugcuauuuuucc

SEQ ID NO: 569198 - RNA, 18 nt, Coxiella burnetii RSA 493
auagugcuauuuuuccca

SEQ ID NO: 569199 - RNA, 16 nt, Coxiella burnetii RSA 493
auagugucaaaggccg

SEQ ID NO: 569200 - RNA, 19 nt, Coxiella burnetii RSA 493
auaguuugcaauaccauuu

SEQ ID NO: 569201 - RNA, 16 nt, Coxiella burnetii RSA 493
auaguuuuauuuaaaa

SEQ ID NO: 569202 - RNA, 18 nt, Coxiella burnetii RSA 493
auaguuuuauuuaaaaaa

SEQ ID NO: 569203 - RNA, 20 nt, Coxiella burnetii RSA 493
auaguuuuauuuaaaaaacu

SEQ ID NO: 569204 - RNA, 21 nt, Coxiella burnetii RSA 493
auaguuuuauuuaaaaaacua

SEQ ID NO: 569205 - RNA, 16 nt, Coxiella burnetii RSA 493
auauaauuuuugaguu

SEQ ID NO: 569206 - RNA, 24 nt, Coxiella burnetii RSA 493
auaucaaaaaaccauaaauggaua

SEQ ID NO: 569207 - RNA, 17 nt, Coxiella burnetii RSA 493
auaucaaucgaaaaaaa

SEQ ID NO: 569208 - RNA, 20 nt, Coxiella burnetii RSA 493
auauauuuaccucuaaaaau

SEQ ID NO: 569209 - RNA, 17 nt, Coxiella burnetii RSA 493
auaucgccauauaaagu

SEQ ID NO: 569210 - RNA, 13 nt, Coxiella burnetii RSA 493
auaucguuuucac

SEQ ID NO: 569211 - RNA, 14 nt, Coxiella burnetii RSA 493
auaucguuuucacg

SEQ ID NO: 569212 - RNA, 16 nt, Coxiella burnetii RSA 493
auaucguuuucacgaa

SEQ ID NO: 569213 - RNA, 19 nt, Coxiella burnetii RSA 493
auauccagcacccaauuaa

SEQ ID NO: 569214 - RNA, 23 nt, Coxiella burnetii RSA 493
auaucauugggccauuuaacaaa

SEQ ID NO: 569215 - RNA, 21 nt, Coxiella burnetii RSA 493
auaucuguuuucgauaaaugc

SEQ ID NO: 569216 - RNA, 15 nt, Coxiella burnetii RSA 493
auaucuagauuuaaa

SEQ ID NO: 569217 - RNA, 16 nt, Coxiella burnetii RSA 493
auaucuagauuuaaaa

SEQ ID NO: 569218 - RNA, 19 nt, Coxiella burnetii RSA 493
auaucuuuuucaauuauac

SEQ ID NO: 569219 - RNA, 12 nt, Coxiella burnetii RSA 493
auauuuuuuaac

SEQ ID NO: 569220 - RNA, 13 nt, Coxiella burnetii RSA 493
aucaaaaaaaccu

SEQ ID NO: 569221 - RNA, 21 nt, Coxiella burnetii RSA 493
auauuuucucaauagaaaaaa

SEQ ID NO: 569222 - RNA, 14 nt, Coxiella burnetii RSA 493
auauucuaucucaa

SEQ ID NO: 569223 - RNA, 17 nt, Coxiella burnetii RSA 493
auauucuaucucaagug

SEQ ID NO: 569224 - RNA, 13 nt, Coxiella burnetii RSA 493
auauugauuuaaa

SEQ ID NO: 569225 - RNA, 17 nt, Coxiella burnetii RSA 493
auauuauugagaaucuc

SEQ ID NO: 569226 - RNA, 21 nt, Coxiella burnetii RSA 493
aucaaccccagccgccacacc

SEQ ID NO: 569227 - RNA, 12 nt, Coxiella burnetii RSA 493
aucaaccaauaa

SEQ ID NO: 569228 - RNA, 17 nt, Coxiella burnetii RSA 493
aucaaguagccaaaaua

SEQ ID NO: 569229 - RNA, 17 nt, Coxiella burnetii RSA 493
aucaaguccaauuauaa

SEQ ID NO: 569230 - RNA, 20 nt, Coxiella burnetii RSA 493
aucaacgcgggcauggccag

SEQ ID NO: 569231 - RNA, 16 nt, Coxiella burnetii RSA 493
aucacaccaagaaauu

SEQ ID NO: 569232 - RNA, 18 nt, Coxiella burnetii RSA 493
aucacaaguucuucuaaa

SEQ ID NO: 569233 - RNA, 15 nt, Coxiella burnetii RSA 493
aucaauucgaaagaa

SEQ ID NO: 569234 - RNA, 18 nt, Coxiella burnetii RSA 493
aucaaugaaacaaacaaa

SEQ ID NO: 569235 - RNA, 18 nt, Coxiella burnetii RSA 493
aucaaguguucacaaguc

SEQ ID NO: 569236 - RNA, 21 nt, Coxiella burnetii RSA 493
aucaaguguucacaagucuca

SEQ ID NO: 569237 - RNA, 17 nt, Coxiella burnetii RSA 493
aucacagcaucuaaccu

SEQ ID NO: 569238 - RNA, 12 nt, Coxiella burnetii RSA 493
aucaccaaaaua

SEQ ID NO: 569239 - RNA, 13 nt, Coxiella burnetii RSA 493
aucaccaaaauac

SEQ ID NO: 569240 - RNA, 14 nt, Coxiella burnetii RSA 493
aucaccacaauuaa

SEQ ID NO: 569241 - RNA, 22 nt, Coxiella burnetii RSA 493
aucaccacaauuaaugcgccua

SEQ ID NO: 569242 - RNA, 16 nt, Coxiella burnetii RSA 493
aucacuacgaauagcc

SEQ ID NO: 569243 - RNA, 16 nt, Coxiella burnetii RSA 493
aucacuccaauaauaa

SEQ ID NO: 569244 - RNA, 13 nt, Coxiella burnetii RSA 493
aucacgcuuuuuu

SEQ ID NO: 569245 - RNA, 21 nt, Coxiella burnetii RSA 493
aucacgaggaggguaagaaua

SEQ ID NO: 569246 - RNA, 20 nt, Coxiella burnetii RSA 493
aucaccugcuccuuuucuuc

SEQ ID NO: 569247 - RNA, 12 nt, Coxiella burnetii RSA 493
aucagaaacggc

SEQ ID NO: 569248 - RNA, 14 nt, Coxiella burnetii RSA 493
aucagcccucauug

SEQ ID NO: 569249 - RNA, 22 nt, Coxiella burnetii RSA 493
aucagccugaucaaguuucucc

SEQ ID NO: 569250 - RNA, 20 nt, Coxiella burnetii RSA 493
aucagcggggagauuaaaaa

SEQ ID NO: 569251 - RNA, 15 nt, Coxiella burnetii RSA 493
agguauguugucauc

SEQ ID NO: 569252 - RNA, 13 nt, Coxiella burnetii RSA 493
agguaucccuucg

SEQ ID NO: 569253 - RNA, 15 nt, Coxiella burnetii RSA 493
agguaauuuauaacu

SEQ ID NO: 569254 - RNA, 13 nt, Coxiella burnetii RSA 493
agguaaaccuuuu

SEQ ID NO: 569255 - RNA, 23 nt, Coxiella burnetii RSA 493
agguaaagagggacuauaaagua

SEQ ID NO: 569256 - RNA, 18 nt, Coxiella burnetii RSA 493
agggucaauugcaaaaca

SEQ ID NO: 569257 - RNA, 23 nt, Coxiella burnetii RSA 493
agggucuaguuauuuuucaucuu

SEQ ID NO: 569258 - RNA, 14 nt, Coxiella burnetii RSA 493
aggucugauaggaa

SEQ ID NO: 569259 - RNA, 20 nt, Coxiella burnetii RSA 493
aggucugauaggaauucuuu

SEQ ID NO: 569260 - RNA, 20 nt, Coxiella burnetii RSA 493
aggucuuuuauuucacguaa

SEQ ID NO: 569261 - RNA, 15 nt, Coxiella burnetii RSA 493
aggucauccauucuu

SEQ ID NO: 569262 - RNA, 16 nt, Coxiella burnetii RSA 493
aggucaggcaauuuug

SEQ ID NO: 569263 - RNA, 19 nt, Coxiella burnetii RSA 493
aggugauucucucaaagaa

SEQ ID NO: 569264 - RNA, 20 nt, Coxiella burnetii RSA 493
aggugauucucucaaagaaa

SEQ ID NO: 569265 - RNA, 17 nt, Coxiella burnetii RSA 493
aggugacuguuaaucac

SEQ ID NO: 569266 - RNA, 12 nt, Coxiella burnetii RSA 493
agguuuuuccuu

SEQ ID NO: 569267 - RNA, 19 nt, Coxiella burnetii RSA 493
agguuuuuuuaaacguuuu

SEQ ID NO: 569268 - RNA, 17 nt, Coxiella burnetii RSA 493
agguuuucaacaaguaa

SEQ ID NO: 569269 - RNA, 18 nt, Coxiella burnetii RSA 493
agguuuucaacaaguaaa

SEQ ID NO: 569270 - RNA, 20 nt, Coxiella burnetii RSA 493
agguugucaacaaaauuuuu

SEQ ID NO: 569271 - RNA, 13 nt, Coxiella burnetii RSA 493
aguaaaaaaccaa

SEQ ID NO: 569272 - RNA, 21 nt, Coxiella burnetii RSA 493
aguaaaaacauccuccauuac

SEQ ID NO: 569273 - RNA, 14 nt, Coxiella burnetii RSA 493
aguaaauagaagca

SEQ ID NO: 569274 - RNA, 18 nt, Coxiella burnetii RSA 493
agguucggauuucacuuu

SEQ ID NO: 569275 - RNA, 20 nt, Coxiella burnetii RSA 493
agguuauuaagcguuccuuu

SEQ ID NO: 569276 - RNA, 17 nt, Coxiella burnetii RSA 493
agguuaccggcaaaccc

SEQ ID NO: 569277 - RNA, 17 nt, Coxiella burnetii RSA 493
aggugucaaaauuauuc

SEQ ID NO: 569278 - RNA, 14 nt, Coxiella burnetii RSA 493
aguaauuuuucgau

SEQ ID NO: 569279 - RNA, 18 nt, Coxiella burnetii RSA 493
aguaaucucaauagaggu

SEQ ID NO: 569280 - RNA, 17 nt, Coxiella burnetii RSA 493
aguaaugacagaaaaag

SEQ ID NO: 569281 - RNA, 13 nt, Coxiella burnetii RSA 493
aguaaugguuuug

SEQ ID NO: 569282 - RNA, 21 nt, Coxiella burnetii RSA 493
aguaauuuuaaaaaaaauacu

SEQ ID NO: 569283 - RNA, 15 nt, Coxiella burnetii RSA 493
aguaauuccagcacc

SEQ ID NO: 569284 - RNA, 19 nt, Coxiella burnetii RSA 493
aguaaguagcucuuaaaag

SEQ ID NO: 569285 - RNA, 23 nt, Coxiella burnetii RSA 493
aguaagccauaucaggagcaggg

SEQ ID NO: 569286 - RNA, 20 nt, Coxiella burnetii RSA 493
aguaacccuuucauuuaauu

SEQ ID NO: 569287 - RNA, 15 nt, Coxiella burnetii RSA 493
aguaaccucuccauc

SEQ ID NO: 569288 - RNA, 17 nt, Coxiella burnetii RSA 493
aguaaccucuccaucca

SEQ ID NO: 569289 - RNA, 16 nt, Coxiella burnetii RSA 493
aguaacgauuucucuu

SEQ ID NO: 569290 - RNA, 15 nt, Coxiella burnetii RSA 493
aguaaauguuucuuu

SEQ ID NO: 569291 - RNA, 12 nt, Coxiella burnetii RSA 493
aggcuaugauua

SEQ ID NO: 569292 - RNA, 15 nt, Coxiella burnetii RSA 493
aggcuauuccccuuc

SEQ ID NO: 569293 - RNA, 20 nt, Coxiella burnetii RSA 493
aggcuaauaggaaaaaugau

SEQ ID NO: 569294 - RNA, 17 nt, Coxiella burnetii RSA 493
aggcugagccagcuaag

SEQ ID NO: 569295 - RNA, 15 nt, Coxiella burnetii RSA 493
aggcgccugcaaaau

SEQ ID NO: 569296 - RNA, 21 nt, Coxiella burnetii RSA 493
aggcgcuccuacugcaugaau

SEQ ID NO: 569297 - RNA, 15 nt, Coxiella burnetii RSA 493
aggcgaaucaucuuu

SEQ ID NO: 569298 - RNA, 17 nt, Coxiella burnetii RSA 493
aggcgagcccauugaga

SEQ ID NO: 569299 - RNA, 21 nt, Coxiella burnetii RSA 493
aggccuuuagcaggauuuuca

SEQ ID NO: 569300 - RNA, 19 nt, Coxiella burnetii RSA 493
aggccgccucgugggccca

SEQ ID NO: 569301 - RNA, 18 nt, Coxiella burnetii RSA 493
agggcccgacucggagaa

SEQ ID NO: 569302 - RNA, 17 nt, Coxiella burnetii RSA 493
agggcggcaaucagaau

SEQ ID NO: 569303 - RNA, 22 nt, Coxiella burnetii RSA 493
agggcgaugugaaacaugcugc

SEQ ID NO: 569304 - RNA, 20 nt, Coxiella burnetii RSA 493
agggcgaaaagaucuccuug

SEQ ID NO: 569305 - RNA, 17 nt, Coxiella burnetii RSA 493
aggguagauaacgcaau

SEQ ID NO: 569306 - RNA, 22 nt, Coxiella burnetii RSA 493
aggguacuauuuccaacccagc

SEQ ID NO: 569307 - RNA, 15 nt, Coxiella burnetii RSA 493
agggcuguccucugc

SEQ ID NO: 569308 - RNA, 23 nt, Coxiella burnetii RSA 493
aggcugcuagaaguauuuccauu

SEQ ID NO: 569309 - RNA, 14 nt, Coxiella burnetii RSA 493
aggcuguaaaccaa

SEQ ID NO: 569310 - RNA, 15 nt, Coxiella burnetii RSA 493
aggcuuucuuuuucu

SEQ ID NO: 569311 - RNA, 16 nt, Coxiella burnetii RSA 493
aggcuucaaacaaagg

SEQ ID NO: 569312 - RNA, 19 nt, Coxiella burnetii RSA 493
aggcuguucgccagaaaca

SEQ ID NO: 569313 - RNA, 20 nt, Coxiella burnetii RSA 493
aggcuguucgccagaaacaa

SEQ ID NO: 569314 - RNA, 21 nt, Coxiella burnetii RSA 493
aggcuguucgccagaaacaac

SEQ ID NO: 569315 - RNA, 13 nt, Coxiella burnetii RSA 493
agggacuauaaag

SEQ ID NO: 569316 - RNA, 14 nt, Coxiella burnetii RSA 493
agggacuauaaagu

SEQ ID NO: 569317 - RNA, 18 nt, Coxiella burnetii RSA 493
agggaaagagcggauaua

SEQ ID NO: 569318 - RNA, 17 nt, Coxiella burnetii RSA 493
agggauuuugcagggga

SEQ ID NO: 569319 - RNA, 18 nt, Coxiella burnetii RSA 493
agggauuuugcaggggau

SEQ ID NO: 569320 - RNA, 21 nt, Coxiella burnetii RSA 493
agggaguaaucucaauagagg

SEQ ID NO: 569321 - RNA, 18 nt, Coxiella burnetii RSA 493
agauuggugaagaaccca

SEQ ID NO: 569322 - RNA, 20 nt, Coxiella burnetii RSA 493
agcuaagaucaagaaagaca

SEQ ID NO: 569323 - RNA, 13 nt, Coxiella burnetii RSA 493
agcuaacugauua

SEQ ID NO: 569324 - RNA, 22 nt, Coxiella burnetii RSA 493
agcuauggaguucuugcuccca

SEQ ID NO: 569325 - RNA, 13 nt, Coxiella burnetii RSA 493
agcguacaacaac

SEQ ID NO: 569326 - RNA, 15 nt, Coxiella burnetii RSA 493
agcggggacaaguuc

SEQ ID NO: 569327 - RNA, 12 nt, Coxiella burnetii RSA 493
agcugacaauag

SEQ ID NO: 569328 - RNA, 20 nt, Coxiella burnetii RSA 493
agcugcccucaguugucaug

SEQ ID NO: 569329 - RNA, 13 nt, Coxiella burnetii RSA 493
agcucagcccaac

SEQ ID NO: 569330 - RNA, 18 nt, Coxiella burnetii RSA 493
agcugcuuuuuaaaacgc

SEQ ID NO: 569331 - RNA, 19 nt, Coxiella burnetii RSA 493
agcuguucgggcacaaaaa

SEQ ID NO: 569332 - RNA, 21 nt, Coxiella burnetii RSA 493
agcuguucgggcacaaaaaaa

SEQ ID NO: 569333 - RNA, 23 nt, Coxiella burnetii RSA 493
agcuucuaaagccagugcuauuc

SEQ ID NO: 569334 - RNA, 22 nt, Coxiella burnetii RSA 493
agcuucggccgugaaaacgcuc

SEQ ID NO: 569335 - RNA, 15 nt, Coxiella burnetii RSA 493
agcuuccauugcuca

SEQ ID NO: 569336 - RNA, 19 nt, Coxiella burnetii RSA 493
agcuuaguacgugcuuugg

SEQ ID NO: 569337 - RNA, 22 nt, Coxiella burnetii RSA 493
agcuuauacugcccaagaaauu

SEQ ID NO: 569338 - RNA, 13 nt, Coxiella burnetii RSA 493
agcuuccagaaau

SEQ ID NO: 569339 - RNA, 21 nt, Coxiella burnetii RSA 493
agcuuucaauaaauaaaucaa

SEQ ID NO: 569340 - RNA, 17 nt, Coxiella burnetii RSA 493
agcuuuccccccaacua

SEQ ID NO: 569341 - RNA, 14 nt, Coxiella burnetii RSA 493
agcuugugcaauuc

SEQ ID NO: 569342 - RNA, 15 nt, Coxiella burnetii RSA 493
agcuugccuguaaaa

SEQ ID NO: 569343 - RNA, 17 nt, Coxiella burnetii RSA 493
agcuugcgaagcccaac

SEQ ID NO: 569344 - RNA, 20 nt, Coxiella burnetii RSA 493
agcuugcauuaucggaugau

SEQ ID NO: 569345 - RNA, 16 nt, Coxiella burnetii RSA 493
aggaugcgaauguaau

SEQ ID NO: 569346 - RNA, 15 nt, Coxiella burnetii RSA 493
aggauuauauuaguu

SEQ ID NO: 569347 - RNA, 13 nt, Coxiella burnetii RSA 493
aggcaaaauaaac

SEQ ID NO: 569348 - RNA, 22 nt, Coxiella burnetii RSA 493
aggcaaauguugauaauaaaug

SEQ ID NO: 569349 - RNA, 12 nt, Coxiella burnetii RSA 493
aggcacaaagau

SEQ ID NO: 569350 - RNA, 20 nt, Coxiella burnetii RSA 493
aggcaccucauuggcgguua

SEQ ID NO: 569351 - RNA, 23 nt, Coxiella burnetii RSA 493
aggcagaugauuaaaagcaacgg

SEQ ID NO: 569352 - RNA, 17 nt, Coxiella burnetii RSA 493
aggccaauuucuaaucu

SEQ ID NO: 569353 - RNA, 15 nt, Coxiella burnetii RSA 493
aggaccucuccaaau

SEQ ID NO: 569354 - RNA, 18 nt, Coxiella burnetii RSA 493
aggacguuauagaguaaa

SEQ ID NO: 569355 - RNA, 12 nt, Coxiella burnetii RSA 493
aggacagaaggc

SEQ ID NO: 569356 - RNA, 15 nt, Coxiella burnetii RSA 493
aggagauuuuuauga

SEQ ID NO: 569357 - RNA, 18 nt, Coxiella burnetii RSA 493
aggagauuuuuaugaaaa

SEQ ID NO: 569358 - RNA, 15 nt, Coxiella burnetii RSA 493
aggagcacgggauga

SEQ ID NO: 569359 - RNA, 12 nt, Coxiella burnetii RSA 493
aggacuuuucuc

SEQ ID NO: 569360 - RNA, 11 nt, Coxiella burnetii RSA 493
aggagaaagug

SEQ ID NO: 569361 - RNA, 15 nt, Coxiella burnetii RSA 493
aggaguucuaaaaaa

SEQ ID NO: 569362 - RNA, 18 nt, Coxiella burnetii RSA 493
aggaggguaagaauaaac

SEQ ID NO: 569363 - RNA, 21 nt, Coxiella burnetii RSA 493
aggauaauguuugauaucaau

SEQ ID NO: 569364 - RNA, 18 nt, Coxiella burnetii RSA 493
agcuuuuuucaaaauuua

SEQ ID NO: 569365 - RNA, 22 nt, Coxiella burnetii RSA 493
agcuuuuuucaaaauuuacuuu

SEQ ID NO: 569366 - RNA, 14 nt, Coxiella burnetii RSA 493
agcuuuucuuuaaa

SEQ ID NO: 569367 - RNA, 14 nt, Coxiella burnetii RSA 493
aggaaagaaaauga

SEQ ID NO: 569368 - RNA, 15 nt, Coxiella burnetii RSA 493
aggaaauauuuaauu

SEQ ID NO: 569369 - RNA, 17 nt, Coxiella burnetii RSA 493
aggaacauucuaauaaa

SEQ ID NO: 569370 - RNA, 18 nt, Coxiella burnetii RSA 493
aggaaccaccaaaucacg

SEQ ID NO: 569371 - RNA, 18 nt, Coxiella burnetii RSA 493
aggaauagggagaagaag

SEQ ID NO: 569372 - RNA, 20 nt, Coxiella burnetii RSA 493
aggaauaguggcauuaaaag

SEQ ID NO: 569373 - RNA, 21 nt, Coxiella burnetii RSA 493
aggaaucuauugucauccagc

SEQ ID NO: 569374 - RNA, 20 nt, Coxiella burnetii RSA 493
aggaaugucagguucggauu

SEQ ID NO: 569375 - RNA, 18 nt, Coxiella burnetii RSA 493
aggaauugcaguugguuu

SEQ ID NO: 569376 - RNA, 19 nt, Coxiella burnetii RSA 493
acgcaauugaguuagcaua

SEQ ID NO: 569377 - RNA, 16 nt, Coxiella burnetii RSA 493
acgcuggaaaaauaaa

SEQ ID NO: 569378 - RNA, 20 nt, Coxiella burnetii RSA 493
acggaauuugugauuuuaaa

SEQ ID NO: 569379 - RNA, 13 nt, Coxiella burnetii RSA 493
acgcuuauaggaa

SEQ ID NO: 569380 - RNA, 15 nt, Coxiella burnetii RSA 493
acggaaaaacaaaac

SEQ ID NO: 569381 - RNA, 12 nt, Coxiella burnetii RSA 493
acggcaaauaaa

SEQ ID NO: 569382 - RNA, 21 nt, Coxiella burnetii RSA 493
acggggucgcggaaaauuuaa

SEQ ID NO: 569383 - RNA, 18 nt, Coxiella burnetii RSA 493
acggggaaauaaugacaa

SEQ ID NO: 569384 - RNA, 16 nt, Coxiella burnetii RSA 493
acggcggauuaaaaaa

SEQ ID NO: 569385 - RNA, 18 nt, Coxiella burnetii RSA 493
acggugcgauuuuccgca

SEQ ID NO: 569386 - RNA, 14 nt, Coxiella burnetii RSA 493
acggugcagaaggc

SEQ ID NO: 569387 - RNA, 15 nt, Coxiella burnetii RSA 493
acguaccauuaaaag

SEQ ID NO: 569388 - RNA, 18 nt, Coxiella burnetii RSA 493
acguaauuauuaagccuu

SEQ ID NO: 569389 - RNA, 16 nt, Coxiella burnetii RSA 493
acgugcuugccgggcg

SEQ ID NO: 569390 - RNA, 13 nt, Coxiella burnetii RSA 493
acuaaacaaaaua

SEQ ID NO: 569391 - RNA, 23 nt, Coxiella burnetii RSA 493
acguuuuuugcauuuuuaaaagu

SEQ ID NO: 569392 - RNA, 20 nt, Coxiella burnetii RSA 493
acguuaucacuugauaauca

SEQ ID NO: 569393 - RNA, 15 nt, Coxiella burnetii RSA 493
acuauuauuaaaaga

SEQ ID NO: 569394 - RNA, 15 nt, Coxiella burnetii RSA 493
acuaguuauuuuuaa

SEQ ID NO: 569395 - RNA, 16 nt, Coxiella burnetii RSA 493
acuaguuauuuuuaaa

SEQ ID NO: 569396 - RNA, 21 nt, Coxiella burnetii RSA 493
acuaccuuccgucaauuuuuc

SEQ ID NO: 569397 - RNA, 23 nt, Coxiella burnetii RSA 493
acuaccuuccgucaauuuuucuu

SEQ ID NO: 569398 - RNA, 14 nt, Coxiella burnetii RSA 493
acuacgaauagcca

SEQ ID NO: 569399 - RNA, 16 nt, Coxiella burnetii RSA 493
acuacggacucuuuuc

SEQ ID NO: 569400 - RNA, 21 nt, Coxiella burnetii RSA 493
acuaauggugagucguauucc

SEQ ID NO: 569401 - RNA, 21 nt, Coxiella burnetii RSA 493
acuaaugguuggacuacauca

SEQ ID NO: 569402 - RNA, 13 nt, Coxiella burnetii RSA 493
acucgaauuuguu

SEQ ID NO: 569403 - RNA, 23 nt, Coxiella burnetii RSA 493
acucuaauuuucuuuccaucacc

SEQ ID NO: 569404 - RNA, 16 nt, Coxiella burnetii RSA 493
acucuaggauauugca

SEQ ID NO: 569405 - RNA, 13 nt, Coxiella burnetii RSA 493
acucuuuuucuua

SEQ ID NO: 569406 - RNA, 21 nt, Coxiella burnetii RSA 493
acucuguuagauauugaacag

SEQ ID NO: 569407 - RNA, 22 nt, Coxiella burnetii RSA 493
acugagucugccuuuuuuuacu

SEQ ID NO: 569408 - RNA, 21 nt, Coxiella burnetii RSA 493
acugauaacuauuauuaaaag

SEQ ID NO: 569409 - RNA, 13 nt, Coxiella burnetii RSA 493
acugagaaaacuu

SEQ ID NO: 569410 - RNA, 16 nt, Coxiella burnetii RSA 493
acugaugaauaacaau

SEQ ID NO: 569411 - RNA, 22 nt, Coxiella burnetii RSA 493
acugauguauccuaauaaaaau

SEQ ID NO: 569412 - RNA, 15 nt, Coxiella burnetii RSA 493
acugaugcaaaucau

SEQ ID NO: 569413 - RNA, 16 nt, Coxiella burnetii RSA 493
acugauuagcugacau

SEQ ID NO: 569414 - RNA, 17 nt, Coxiella burnetii RSA 493
acugcaccauaacuaaa

SEQ ID NO: 569415 - RNA, 15 nt, Coxiella burnetii RSA 493
acugcccaagaaauu

SEQ ID NO: 569416 - RNA, 20 nt, Coxiella burnetii RSA 493
acugcuuguaccugccauuu

SEQ ID NO: 569417 - RNA, 22 nt, Coxiella burnetii RSA 493
acugcucuuaauacccguuucu

SEQ ID NO: 569418 - RNA, 19 nt, Coxiella burnetii RSA 493
acugggccaggaccaaaga

SEQ ID NO: 569419 - RNA, 19 nt, Coxiella burnetii RSA 493
acuggguuuuccccaucaa

SEQ ID NO: 569420 - RNA, 15 nt, Coxiella burnetii RSA 493
acuguugagcaaagc

SEQ ID NO: 569421 - RNA, 12 nt, Coxiella burnetii RSA 493
acuuaagaaagu

SEQ ID NO: 569422 - RNA, 12 nt, Coxiella burnetii RSA 493
acuucccgcaaa

SEQ ID NO: 569423 - RNA, 16 nt, Coxiella burnetii RSA 493
acuucccgcaaaugau

SEQ ID NO: 569424 - RNA, 14 nt, Coxiella burnetii RSA 493
acuuccuaucaaua

SEQ ID NO: 569425 - RNA, 23 nt, Coxiella burnetii RSA 493
acuucaguuggcucauuguuaau

SEQ ID NO: 569426 - RNA, 12 nt, Coxiella burnetii RSA 493
acuuauccaugc

SEQ ID NO: 569427 - RNA, 19 nt, Coxiella burnetii RSA 493
agagauaagcuguuucuuu

SEQ ID NO: 569428 - RNA, 22 nt, Coxiella burnetii RSA 493
agagagcuugccuguaaaauaa

SEQ ID NO: 569429 - RNA, 16 nt, Coxiella burnetii RSA 493
agagagcgagguaaag

SEQ ID NO: 569430 - RNA, 19 nt, Coxiella burnetii RSA 493
agacucaaagaaauaauca

SEQ ID NO: 569431 - RNA, 18 nt, Coxiella burnetii RSA 493
agaggucaucauuuuugu

SEQ ID NO: 569432 - RNA, 22 nt, Coxiella burnetii RSA 493
agaggucguaccuucaauuccg

SEQ ID NO: 569433 - RNA, 16 nt, Coxiella burnetii RSA 493
agaguccuaaaauacu

SEQ ID NO: 569434 - RNA, 15 nt, Coxiella burnetii RSA 493
agaggugaaccaaaa

SEQ ID NO: 569435 - RNA, 13 nt, Coxiella burnetii RSA 493
agagucauuguau

SEQ ID NO: 569436 - RNA, 19 nt, Coxiella burnetii RSA 493
agagucucagcaucagccu

SEQ ID NO: 569437 - RNA, 18 nt, Coxiella burnetii RSA 493
agauacucgagguagacu

SEQ ID NO: 569438 - RNA, 18 nt, Coxiella burnetii RSA 493
agauaggacuuuucucga

SEQ ID NO: 569439 - RNA, 18 nt, Coxiella burnetii RSA 493
agauauaccaaaaaguug

SEQ ID NO: 569440 - RNA, 14 nt, Coxiella burnetii RSA 493
agaucacuggacca

SEQ ID NO: 569441 - RNA, 20 nt, Coxiella burnetii RSA 493
agaucaucaucgccggauaa

SEQ ID NO: 569442 - RNA, 20 nt, Coxiella burnetii RSA 493
agauccuugcgagcgcaaau

SEQ ID NO: 569443 - RNA, 19 nt, Coxiella burnetii RSA 493
agaucgcaaaauccugucu

SEQ ID NO: 569444 - RNA, 23 nt, Coxiella burnetii RSA 493
agaucguuuuuugauaaaacuug

SEQ ID NO: 569445 - RNA, 12 nt, Coxiella burnetii RSA 493
agaugauuaaaa

SEQ ID NO: 569446 - RNA, 13 nt, Coxiella burnetii RSA 493
agauuagaaaaag

SEQ ID NO: 569447 - RNA, 15 nt, Coxiella burnetii RSA 493
agauuagaaaaagcg

SEQ ID NO: 569448 - RNA, 18 nt, Coxiella burnetii RSA 493
agauugcauggucuucua

SEQ ID NO: 569449 - RNA, 17 nt, Coxiella burnetii RSA 493
agaugcuccaucaugau

SEQ ID NO: 569450 - RNA, 16 nt, Coxiella burnetii RSA 493
agauggcaucauuucc

SEQ ID NO: 569451 - RNA, 16 nt, Coxiella burnetii RSA 493
agaugguuggcgaagg

SEQ ID NO: 569452 - RNA, 10 nt, Coxiella burnetii RSA 493
agaagaauaa

SEQ ID NO: 569453 - RNA, 13 nt, Coxiella burnetii RSA 493
agaagcaucagau

SEQ ID NO: 569454 - RNA, 22 nt, Coxiella burnetii RSA 493
agaauaccccgcuguuuucaga

SEQ ID NO: 569455 - RNA, 14 nt, Coxiella burnetii RSA 493
agaaguauuuccau

SEQ ID NO: 569456 - RNA, 23 nt, Coxiella burnetii RSA 493
agaaucucacgugagguuacauu

SEQ ID NO: 569457 - RNA, 21 nt, Coxiella burnetii RSA 493
agaaucuccaccacuuugcca

SEQ ID NO: 569458 - RNA, 20 nt, Coxiella burnetii RSA 493
agaauggcgggaaaaaauag

SEQ ID NO: 569459 - RNA, 12 nt, Coxiella burnetii RSA 493
agaaugggaaga

SEQ ID NO: 569460 - RNA, 21 nt, Coxiella burnetii RSA 493
agaaucgucgucguauccaaa

SEQ ID NO: 569461 - RNA, 13 nt, Coxiella burnetii RSA 493
agaauuucuuugu

SEQ ID NO: 569462 - RNA, 15 nt, Coxiella burnetii RSA 493
agacaauagaauaau

SEQ ID NO: 569463 - RNA, 19 nt, Coxiella burnetii RSA 493
agacaacuuuauaguucau

SEQ ID NO: 569464 - RNA, 21 nt, Coxiella burnetii RSA 493
agacagacgcuggaaaaauaa

SEQ ID NO: 569465 - RNA, 23 nt, Coxiella burnetii RSA 493
agacagacgcuggaaaaauaaau

SEQ ID NO: 569466 - RNA, 15 nt, Coxiella burnetii RSA 493
agacaguuuagaauc

SEQ ID NO: 569467 - RNA, 18 nt, Coxiella burnetii RSA 493
agaaauugacaaauaaag

SEQ ID NO: 569468 - RNA, 21 nt, Coxiella burnetii RSA 493
agaaauugacaaauaaagaau

SEQ ID NO: 569469 - RNA, 21 nt, Coxiella burnetii RSA 493
agaaauugcggaaauuucaca

SEQ ID NO: 569470 - RNA, 19 nt, Coxiella burnetii RSA 493
agaacaacugcgccgcaaa

SEQ ID NO: 569471 - RNA, 23 nt, Coxiella burnetii RSA 493
agaacaacugcgccgcaaaguaa

SEQ ID NO: 569472 - RNA, 13 nt, Coxiella burnetii RSA 493
agaacaauuaacu

SEQ ID NO: 569473 - RNA, 22 nt, Coxiella burnetii RSA 493
agaacauccggcucgaugcaau

SEQ ID NO: 569474 - RNA, 23 nt, Coxiella burnetii RSA 493
agaacccaccgcuggugagacuc

SEQ ID NO: 569475 - RNA, 20 nt, Coxiella burnetii RSA 493
agaaccgcgacuaaaccaac

SEQ ID NO: 569476 - RNA, 23 nt, Coxiella burnetii RSA 493
agaacggauagucgcguauaaau

SEQ ID NO: 569477 - RNA, 21 nt, Coxiella burnetii RSA 493
acuuuucuggcuguacuuuca

SEQ ID NO: 569478 - RNA, 12 nt, Coxiella burnetii RSA 493
acuuccuucuug

SEQ ID NO: 569479 - RNA, 14 nt, Coxiella burnetii RSA 493
acuuccuucuuguc

SEQ ID NO: 569480 - RNA, 21 nt, Coxiella burnetii RSA 493
acuucgcacaucauugaaaac

SEQ ID NO: 569481 - RNA, 22 nt, Coxiella burnetii RSA 493
acuuuuucaaugccauuuuuau

SEQ ID NO: 569482 - RNA, 12 nt, Coxiella burnetii RSA 493
acuuuuuucuuu

SEQ ID NO: 569483 - RNA, 13 nt, Coxiella burnetii RSA 493
agaaaauuucacc

SEQ ID NO: 569484 - RNA, 15 nt, Coxiella burnetii RSA 493
agaaaaugauuucau

SEQ ID NO: 569485 - RNA, 20 nt, Coxiella burnetii RSA 493
agaaacguauugccaaaauu

SEQ ID NO: 569486 - RNA, 15 nt, Coxiella burnetii RSA 493
agaaacgauuaaaaa

SEQ ID NO: 569487 - RNA, 20 nt, Coxiella burnetii RSA 493
agaaagccuaaguuuaacag

SEQ ID NO: 569488 - RNA, 22 nt, Coxiella burnetii RSA 493
agaaagggugagguaacugucu

SEQ ID NO: 569489 - RNA, 14 nt, Coxiella burnetii RSA 493
accccuaucaauca

SEQ ID NO: 569490 - RNA, 20 nt, Coxiella burnetii RSA 493
accccuaucaaucaaauccu

SEQ ID NO: 569491 - RNA, 21 nt, Coxiella burnetii RSA 493
accgauucauaaaaaaugauu

SEQ ID NO: 569492 - RNA, 18 nt, Coxiella burnetii RSA 493
accgcaugguccaaaaaa

SEQ ID NO: 569493 - RNA, 20 nt, Coxiella burnetii RSA 493
accgcugacgucagaaaaca

SEQ ID NO: 569494 - RNA, 13 nt, Coxiella burnetii RSA 493
accgcuggugaga

SEQ ID NO: 569495 - RNA, 14 nt, Coxiella burnetii RSA 493
accgcgcugaaguc

SEQ ID NO: 569496 - RNA, 15 nt, Coxiella burnetii RSA 493
accgcgcugaagucc

SEQ ID NO: 569497 - RNA, 21 nt, Coxiella burnetii RSA 493
accgcgaaugguugaaagaaa

SEQ ID NO: 569498 - RNA, 16 nt, Coxiella burnetii RSA 493
accgguuuuucuucau

SEQ ID NO: 569499 - RNA, 19 nt, Coxiella burnetii RSA 493
accguaaaacgaaucuuua

SEQ ID NO: 569500 - RNA, 19 nt, Coxiella burnetii RSA 493
accggguuuacauaagaaa

SEQ ID NO: 569501 - RNA, 15 nt, Coxiella burnetii RSA 493
accguuuucuaucca

SEQ ID NO: 569502 - RNA, 13 nt, Coxiella burnetii RSA 493
accguuuugagua

SEQ ID NO: 569503 - RNA, 17 nt, Coxiella burnetii RSA 493
accuaaagaaagaagaa

SEQ ID NO: 569504 - RNA, 18 nt, Coxiella burnetii RSA 493
accguuaugaaaacauac

SEQ ID NO: 569505 - RNA, 20 nt, Coxiella burnetii RSA 493
accguuuaaaccaaaaccaa

SEQ ID NO: 569506 - RNA, 13 nt, Coxiella burnetii RSA 493
accuacuuuucua

SEQ ID NO: 569507 - RNA, 23 nt, Coxiella burnetii RSA 493
accuaauuugauuuuuuuugcuu

SEQ ID NO: 569508 - RNA, 14 nt, Coxiella burnetii RSA 493
accgucacuucuuc

SEQ ID NO: 569509 - RNA, 20 nt, Coxiella burnetii RSA 493
accucauuggcgguuaaggu

SEQ ID NO: 569510 - RNA, 21 nt, Coxiella burnetii RSA 493
accuccaaaacccauccaucc

SEQ ID NO: 569511 - RNA, 23 nt, Coxiella burnetii RSA 493
accuccaaaacccauccaucccg

SEQ ID NO: 569512 - RNA, 19 nt, Coxiella burnetii RSA 493
accugagggaauuuuuugc

SEQ ID NO: 569513 - RNA, 15 nt, Coxiella burnetii RSA 493
accucuucuaaagua

SEQ ID NO: 569514 - RNA, 19 nt, Coxiella burnetii RSA 493
accucuucgaagugugauu

SEQ ID NO: 569515 - RNA, 16 nt, Coxiella burnetii RSA 493
accucuaaaaauuaaa

SEQ ID NO: 569516 - RNA, 15 nt, Coxiella burnetii RSA 493
accuggcggcauuga

SEQ ID NO: 569517 - RNA, 14 nt, Coxiella burnetii RSA 493
accuggcuaguaaa

SEQ ID NO: 569518 - RNA, 18 nt, Coxiella burnetii RSA 493
accugcuucgcuucaucc

SEQ ID NO: 569519 - RNA, 13 nt, Coxiella burnetii RSA 493
accuguuaaaaac

SEQ ID NO: 569520 - RNA, 17 nt, Coxiella burnetii RSA 493
accuuaacgccuaucuu

SEQ ID NO: 569521 - RNA, 17 nt, Coxiella burnetii RSA 493
accuuaaucgugaaaua

SEQ ID NO: 569522 - RNA, 18 nt, Coxiella burnetii RSA 493
accuuccgucaauuuuuc

SEQ ID NO: 569523 - RNA, 23 nt, Coxiella burnetii RSA 493
accuuccgucaauuuuucuuuuu

SEQ ID NO: 569524 - RNA, 14 nt, Coxiella burnetii RSA 493
accuucuuuuuuau

SEQ ID NO: 569525 - RNA, 23 nt, Coxiella burnetii RSA 493
accuucuuuuuuauguuuggcca

SEQ ID NO: 569526 - RNA, 19 nt, Coxiella burnetii RSA 493
accuugccauccaaaugag

SEQ ID NO: 569527 - RNA, 22 nt, Coxiella burnetii RSA 493
acgaaauugacccuuuucaauu

SEQ ID NO: 569528 - RNA, 19 nt, Coxiella burnetii RSA 493
acgaaaauaccuuugcaaa

SEQ ID NO: 569529 - RNA, 21 nt, Coxiella burnetii RSA 493
accuuucgcuuguuuauauuu

SEQ ID NO: 569530 - RNA, 22 nt, Coxiella burnetii RSA 493
accuuucgcuuguuuauauuua

SEQ ID NO: 569531 - RNA, 21 nt, Coxiella burnetii RSA 493
accuuuuucguuuaacaauga

SEQ ID NO: 569532 - RNA, 14 nt, Coxiella burnetii RSA 493
accuuuguucgguu

SEQ ID NO: 569533 - RNA, 13 nt, Coxiella burnetii RSA 493
accuuuuaaauaa

SEQ ID NO: 569534 - RNA, 11 nt, Coxiella burnetii RSA 493
accuuugcaaa

SEQ ID NO: 569535 - RNA, 19 nt, Coxiella burnetii RSA 493
accuuugcgcaaaauuagg

SEQ ID NO: 569536 - RNA, 22 nt, Coxiella burnetii RSA 493
acgacggguuuuaaguuuuuag

SEQ ID NO: 569537 - RNA, 14 nt, Coxiella burnetii RSA 493
acgacgcuuugguu

SEQ ID NO: 569538 - RNA, 18 nt, Coxiella burnetii RSA 493
acgacuucauuucuacca

SEQ ID NO: 569539 - RNA, 17 nt, Coxiella burnetii RSA 493
acgaauagccaauguuu

SEQ ID NO: 569540 - RNA, 20 nt, Coxiella burnetii RSA 493
acgaauuucaagaacgauuu

SEQ ID NO: 569541 - RNA, 14 nt, Coxiella burnetii RSA 493
acgacagguauuuu

SEQ ID NO: 569542 - RNA, 19 nt, Coxiella burnetii RSA 493
acgaaccgacauuucaccc

SEQ ID NO: 569543 - RNA, 18 nt, Coxiella burnetii RSA 493
acgaaccgccggguuuuu

SEQ ID NO: 569544 - RNA, 22 nt, Coxiella burnetii RSA 493
acgaguuucgcuucaccguuuu

SEQ ID NO: 569545 - RNA, 14 nt, Coxiella burnetii RSA 493
acgagcggccucaa

SEQ ID NO: 569546 - RNA, 22 nt, Coxiella burnetii RSA 493
acgauaauccgccuaaauuaau

SEQ ID NO: 569547 - RNA, 23 nt, Coxiella burnetii RSA 493
acgauaauccgccuaaauuaaug

SEQ ID NO: 569548 - RNA, 17 nt, Coxiella burnetii RSA 493
acgauagucucuauauc

SEQ ID NO: 569549 - RNA, 18 nt, Coxiella burnetii RSA 493
acgauagccagcaauauc

SEQ ID NO: 569550 - RNA, 12 nt, Coxiella burnetii RSA 493
acgaucuauauu

SEQ ID NO: 569551 - RNA, 23 nt, Coxiella burnetii RSA 493
acgaucugagugucugagauggc

SEQ ID NO: 569552 - RNA, 14 nt, Coxiella burnetii RSA 493
acgaugauuaaauc

SEQ ID NO: 569553 - RNA, 21 nt, Coxiella burnetii RSA 493
acgaugauucccaccaaaauu

SEQ ID NO: 569554 - RNA, 17 nt, Coxiella burnetii RSA 493
acgauggucaaaccaau

SEQ ID NO: 569555 - RNA, 21 nt, Coxiella burnetii RSA 493
acgaugucuuuaaguggcaaa

SEQ ID NO: 569556 - RNA, 16 nt, Coxiella burnetii RSA 493
acgauguaguuuuguc

SEQ ID NO: 569557 - RNA, 14 nt, Coxiella burnetii RSA 493
acgaugccaaaauu

SEQ ID NO: 569558 - RNA, 12 nt, Coxiella burnetii RSA 493
acgauuucucuu

SEQ ID NO: 569559 - RNA, 20 nt, Coxiella burnetii RSA 493
acgauuucucuuaccauggu

SEQ ID NO: 569560 - RNA, 14 nt, Coxiella burnetii RSA 493
acgauuuaaacaaa

SEQ ID NO: 569561 - RNA, 18 nt, Coxiella burnetii RSA 493
acgauugcuaaaccacgc

SEQ ID NO: 569562 - RNA, 23 nt, Coxiella burnetii RSA 493
acgauuaacaacaaaaccgugcg

SEQ ID NO: 569563 - RNA, 22 nt, Coxiella burnetii RSA 493
acauggccuuugcgguuaaaaa

SEQ ID NO: 569564 - RNA, 12 nt, Coxiella burnetii RSA 493
accaaauaauug

SEQ ID NO: 569565 - RNA, 12 nt, Coxiella burnetii RSA 493
accaaaucacgc

SEQ ID NO: 569566 - RNA, 20 nt, Coxiella burnetii RSA 493
accaaagcggcgauggcugc

SEQ ID NO: 569567 - RNA, 15 nt, Coxiella burnetii RSA 493
accaauucaaauaau

SEQ ID NO: 569568 - RNA, 18 nt, Coxiella burnetii RSA 493
accaaucaauaaaaauau

SEQ ID NO: 569569 - RNA, 19 nt, Coxiella burnetii RSA 493
accacucacagcccuaaua

SEQ ID NO: 569570 - RNA, 11 nt, Coxiella burnetii RSA 493
accauaauccu

SEQ ID NO: 569571 - RNA, 15 nt, Coxiella burnetii RSA 493
accauaacuaaaucg

SEQ ID NO: 569572 - RNA, 16 nt, Coxiella burnetii RSA 493
accagggguuauaaaa

SEQ ID NO: 569573 - RNA, 18 nt, Coxiella burnetii RSA 493
accagggguuauaaaauu

SEQ ID NO: 569574 - RNA, 15 nt, Coxiella burnetii RSA 493
accccaaucgauuaa

SEQ ID NO: 569575 - RNA, 21 nt, Coxiella burnetii RSA 493
accccacaucguuucaaacac

SEQ ID NO: 569576 - RNA, 21 nt, Coxiella burnetii RSA 493
accauugucucguuagaaaag

SEQ ID NO: 569577 - RNA, 19 nt, Coxiella burnetii RSA 493
acacuuucaaucgcacccu

SEQ ID NO: 569578 - RNA, 14 nt, Coxiella burnetii RSA 493
acacuuugaugagu

SEQ ID NO: 569579 - RNA, 20 nt, Coxiella burnetii RSA 493
acacuuugaugagucccauu

SEQ ID NO: 569580 - RNA, 17 nt, Coxiella burnetii RSA 493
acagacagacgcuggaa

SEQ ID NO: 569581 - RNA, 16 nt, Coxiella burnetii RSA 493
acagaggacagaaggc

SEQ ID NO: 569582 - RNA, 14 nt, Coxiella burnetii RSA 493
acaggagcgauaaa

SEQ ID NO: 569583 - RNA, 12 nt, Coxiella burnetii RSA 493
acaggaaaaaga

SEQ ID NO: 569584 - RNA, 23 nt, Coxiella burnetii RSA 493
acaggcagaugauuaaaagcaac

SEQ ID NO: 569585 - RNA, 21 nt, Coxiella burnetii RSA 493
acagccgaugacaaauaaaca

SEQ ID NO: 569586 - RNA, 15 nt, Coxiella burnetii RSA 493
acagccuucaugaau

SEQ ID NO: 569587 - RNA, 14 nt, Coxiella burnetii RSA 493
acagcgaaaacaaa

SEQ ID NO: 569588 - RNA, 20 nt, Coxiella burnetii RSA 493
acagcggcaguuucuggcuc

SEQ ID NO: 569589 - RNA, 23 nt, Coxiella burnetii RSA 493
acaucagcggggagauuaaaaau

SEQ ID NO: 569590 - RNA, 21 nt, Coxiella burnetii RSA 493
acaucauugaaaaccuacuuu

SEQ ID NO: 569591 - RNA, 14 nt, Coxiella burnetii RSA 493
acaucauuguuuuc

SEQ ID NO: 569592 - RNA, 14 nt, Coxiella burnetii RSA 493
acauauuucuuguc

SEQ ID NO: 569593 - RNA, 14 nt, Coxiella burnetii RSA 493
acauauuuuuuggc

SEQ ID NO: 569594 - RNA, 13 nt, Coxiella burnetii RSA 493
acauaauuuaaac

SEQ ID NO: 569595 - RNA, 14 nt, Coxiella burnetii RSA 493
acauaauuuaaacu

SEQ ID NO: 569596 - RNA, 19 nt, Coxiella burnetii RSA 493
acaugcugcuaucugcaau

SEQ ID NO: 569597 - RNA, 19 nt, Coxiella burnetii RSA 493
acaucuguaauuuuucuug

SEQ ID NO: 569598 - RNA, 18 nt, Coxiella burnetii RSA 493
acaucucucguucuuuua

SEQ ID NO: 569599 - RNA, 14 nt, Coxiella burnetii RSA 493
acaucguuguuuuc

SEQ ID NO: 569600 - RNA, 17 nt, Coxiella burnetii RSA 493
acaucgcucccaaaucg

SEQ ID NO: 569601 - RNA, 12 nt, Coxiella burnetii RSA 493
acauaaaggcca

SEQ ID NO: 569602 - RNA, 17 nt, Coxiella burnetii RSA 493
acauaaagcuuauauaa

SEQ ID NO: 569603 - RNA, 23 nt, Coxiella burnetii RSA 493
acauaaaauuagguaauuuauaa

SEQ ID NO: 569604 - RNA, 12 nt, Coxiella burnetii RSA 493
acagucuucacg

SEQ ID NO: 569605 - RNA, 23 nt, Coxiella burnetii RSA 493
acagucuucacgaaguugacgaa

SEQ ID NO: 569606 - RNA, 17 nt, Coxiella burnetii RSA 493
acagugaaagucccauu

SEQ ID NO: 569607 - RNA, 23 nt, Coxiella burnetii RSA 493
acaguccuaccucgcuuaaagca

SEQ ID NO: 569608 - RNA, 23 nt, Coxiella burnetii RSA 493
acagugguuguguggcuucgcca

SEQ ID NO: 569609 - RNA, 19 nt, Coxiella burnetii RSA 493
acagugccccuccucuaau

SEQ ID NO: 569610 - RNA, 15 nt, Coxiella burnetii RSA 493
acaguauaaaauuuu

SEQ ID NO: 569611 - RNA, 20 nt, Coxiella burnetii RSA 493
acaguaccgucauaaggaau

SEQ ID NO: 569612 - RNA, 23 nt, Coxiella burnetii RSA 493
aacaagauacccuucaauugcuu

SEQ ID NO: 569613 - RNA, 16 nt, Coxiella burnetii RSA 493
aacaagacaacaaaau

SEQ ID NO: 569614 - RNA, 15 nt, Coxiella burnetii RSA 493
aacaagcucccagac

SEQ ID NO: 569615 - RNA, 23 nt, Coxiella burnetii RSA 493
aacaagcguuguaaauuuugccc

SEQ ID NO: 569616 - RNA, 14 nt, Coxiella burnetii RSA 493
aacaaguuaacaaa

SEQ ID NO: 569617 - RNA, 16 nt, Coxiella burnetii RSA 493
aacaaguuaacaaaau

SEQ ID NO: 569618 - RNA, 19 nt, Coxiella burnetii RSA 493
aacaagggaaucgacuuuc

SEQ ID NO: 569619 - RNA, 12 nt, Coxiella burnetii RSA 493
aacaagaaaaau

SEQ ID NO: 569620 - RNA, 17 nt, Coxiella burnetii RSA 493
aacaagaaaaauuccaa

SEQ ID NO: 569621 - RNA, 14 nt, Coxiella burnetii RSA 493
aacaacguuucgac

SEQ ID NO: 569622 - RNA, 12 nt, Coxiella burnetii RSA 493
aacaaaaucacc

SEQ ID NO: 569623 - RNA, 13 nt, Coxiella burnetii RSA 493
aacaaaauuuuuc

SEQ ID NO: 569624 - RNA, 15 nt, Coxiella burnetii RSA 493
aacaaacaaaaaaua

SEQ ID NO: 569625 - RNA, 12 nt, Coxiella burnetii RSA 493
aacaaaaaauag

SEQ ID NO: 569626 - RNA, 14 nt, Coxiella burnetii RSA 493
aaauuuuucauuuc

SEQ ID NO: 569627 - RNA, 20 nt, Coxiella burnetii RSA 493
aacaaagguuccaucgcaca

SEQ ID NO: 569628 - RNA, 14 nt, Coxiella burnetii RSA 493
aacaaauaaaccua

SEQ ID NO: 569629 - RNA, 21 nt, Coxiella burnetii RSA 493
aacaaauaaaccuauccaaaa

SEQ ID NO: 569630 - RNA, 11 nt, Coxiella burnetii RSA 493
aacaaagugaa

SEQ ID NO: 569631 - RNA, 17 nt, Coxiella burnetii RSA 493
aacaaagugaaauaugu

SEQ ID NO: 569632 - RNA, 14 nt, Coxiella burnetii RSA 493
aaauuuaauaaaau

SEQ ID NO: 569633 - RNA, 14 nt, Coxiella burnetii RSA 493
aaauuuaaucuuua

SEQ ID NO: 569634 - RNA, 13 nt, Coxiella burnetii RSA 493
aaauugcucuuuu

SEQ ID NO: 569635 - RNA, 19 nt, Coxiella burnetii RSA 493
aaauugcggaaauuucaca

SEQ ID NO: 569636 - RNA, 22 nt, Coxiella burnetii RSA 493
aaauugauuagcaucuugaauc

SEQ ID NO: 569637 - RNA, 15 nt, Coxiella burnetii RSA 493
aaauugcaaaacuuc

SEQ ID NO: 569638 - RNA, 22 nt, Coxiella burnetii RSA 493
aaauugauaaucuggguuucuu

SEQ ID NO: 569639 - RNA, 17 nt, Coxiella burnetii RSA 493
aaauugaucuucuugug

SEQ ID NO: 569640 - RNA, 20 nt, Coxiella burnetii RSA 493
aaauuucgauuuuacaauaa

SEQ ID NO: 569641 - RNA, 15 nt, Coxiella burnetii RSA 493
aaauuucauuuaaua

SEQ ID NO: 569642 - RNA, 14 nt, Coxiella burnetii RSA 493
aaauuucucucuca

SEQ ID NO: 569643 - RNA, 17 nt, Coxiella burnetii RSA 493
aaauuucguugauuaau

SEQ ID NO: 569644 - RNA, 21 nt, Coxiella burnetii RSA 493
aaauuuucccaggaaagaaaa

SEQ ID NO: 569645 - RNA, 22 nt, Coxiella burnetii RSA 493
aaauuuucccaggaaagaaaau

SEQ ID NO: 569646 - RNA, 14 nt, Coxiella burnetii RSA 493
aaauuuucucaauu

SEQ ID NO: 569647 - RNA, 20 nt, Coxiella burnetii RSA 493
aacaauuaacuuugcaaagc

SEQ ID NO: 569648 - RNA, 15 nt, Coxiella burnetii RSA 493
aacaaugcucccuuu

SEQ ID NO: 569649 - RNA, 16 nt, Coxiella burnetii RSA 493
aacacagcccccgaau

SEQ ID NO: 569650 - RNA, 13 nt, Coxiella burnetii RSA 493
aacacgaagcugc

SEQ ID NO: 569651 - RNA, 16 nt, Coxiella burnetii RSA 493
aacaccuaaaucaauu

SEQ ID NO: 569652 - RNA, 17 nt, Coxiella burnetii RSA 493
aacacgaucaacaaaau

SEQ ID NO: 569653 - RNA, 21 nt, Coxiella burnetii RSA 493
aacagagggagcagcagccuc

SEQ ID NO: 569654 - RNA, 22 nt, Coxiella burnetii RSA 493
aacagagggagcagcagccucu

SEQ ID NO: 569655 - RNA, 12 nt, Coxiella burnetii RSA 493
aacagcgaaaac

SEQ ID NO: 569656 - RNA, 21 nt, Coxiella burnetii RSA 493
aacagcgcccaauaaggauga

SEQ ID NO: 569657 - RNA, 17 nt, Coxiella burnetii RSA 493
aacauaucuucaacauc

SEQ ID NO: 569658 - RNA, 20 nt, Coxiella burnetii RSA 493
aacauaucuucaacaucaac

SEQ ID NO: 569659 - RNA, 20 nt, Coxiella burnetii RSA 493
aacauauggcccacuuggaa

SEQ ID NO: 569660 - RNA, 18 nt, Coxiella burnetii RSA 493
aacauacgacuucauuuc

SEQ ID NO: 569661 - RNA, 20 nt, Coxiella burnetii RSA 493
aacaucaaccccagccgcca

SEQ ID NO: 569662 - RNA, 17 nt, Coxiella burnetii RSA 493
aacaguaguuuaucaaa

SEQ ID NO: 569663 - RNA, 16 nt, Coxiella burnetii RSA 493
aacaguauaaaauuuu

SEQ ID NO: 569664 - RNA, 13 nt, Coxiella burnetii RSA 493
aaccaaaaggaau

SEQ ID NO: 569665 - RNA, 17 nt, Coxiella burnetii RSA 493
aaccaauugauuaauua

SEQ ID NO: 569666 - RNA, 13 nt, Coxiella burnetii RSA 493
aaccaauaccaau

SEQ ID NO: 569667 - RNA, 13 nt, Coxiella burnetii RSA 493
aaccaaucuauua

SEQ ID NO: 569668 - RNA, 20 nt, Coxiella burnetii RSA 493
aaccaaaaaguuuauaaaaa

SEQ ID NO: 569669 - RNA, 14 nt, Coxiella burnetii RSA 493
aacauuuguuuaaa

SEQ ID NO: 569670 - RNA, 20 nt, Coxiella burnetii RSA 493
aacauuuguuuaaagcugcu

SEQ ID NO: 569671 - RNA, 12 nt, Coxiella burnetii RSA 493
aacauuccuuuc

SEQ ID NO: 569672 - RNA, 21 nt, Coxiella burnetii RSA 493
aacauuauuacauauuucuuu

SEQ ID NO: 569673 - RNA, 12 nt, Coxiella burnetii RSA 493
aacauucaaaga

SEQ ID NO: 569674 - RNA, 15 nt, Coxiella burnetii RSA 493
aacaugcgaaagcaa

SEQ ID NO: 569675 - RNA, 18 nt, Coxiella burnetii RSA 493
aacauggccaguuagugc

SEQ ID NO: 569676 - RNA, 15 nt, Coxiella burnetii RSA 493
aacauuaucauguuc

SEQ ID NO: 569677 - RNA, 13 nt, Coxiella burnetii RSA 493
aacauccuccauu

SEQ ID NO: 569678 - RNA, 16 nt, Coxiella burnetii RSA 493
aacauccuccauuaca

SEQ ID NO: 569679 - RNA, 18 nt, Coxiella burnetii RSA 493
aacauccuccauuacaua

SEQ ID NO: 569680 - RNA, 22 nt, Coxiella burnetii RSA 493
aaccacuauuugcuuucuuuga

SEQ ID NO: 569681 - RNA, 14 nt, Coxiella burnetii RSA 493
aaccacucggaaag

SEQ ID NO: 569682 - RNA, 19 nt, Coxiella burnetii RSA 493
aaccacgcuauaauuuucc

SEQ ID NO: 569683 - RNA, 20 nt, Coxiella burnetii RSA 493
aaccacgauuuaaacaaacu

SEQ ID NO: 569684 - RNA, 14 nt, Coxiella burnetii RSA 493
aaccaccaaaucac

SEQ ID NO: 569685 - RNA, 16 nt, Coxiella burnetii RSA 493
aaccaccaaaucacgc

SEQ ID NO: 569686 - RNA, 21 nt, Coxiella burnetii RSA 493
aaccauugucucguuagaaaa

SEQ ID NO: 569687 - RNA, 19 nt, Coxiella burnetii RSA 493
aaccauuaguguaaggcug

SEQ ID NO: 569688 - RNA, 20 nt, Coxiella burnetii RSA 493
aaccauuaguguaaggcuga

SEQ ID NO: 569689 - RNA, 18 nt, Coxiella burnetii RSA 493
aacccagaaaaguaaaaa

SEQ ID NO: 569690 - RNA, 15 nt, Coxiella burnetii RSA 493
aacccacaacuuucu

SEQ ID NO: 569691 - RNA, 22 nt, Coxiella burnetii RSA 493
aacccaaggaaccaccaaauca

SEQ ID NO: 569692 - RNA, 22 nt, Coxiella burnetii RSA 493
aaccgacgaauaacggaaaaug

SEQ ID NO: 569693 - RNA, 15 nt, Coxiella burnetii RSA 493
aaccccggaaaaucu

SEQ ID NO: 569694 - RNA, 14 nt, Coxiella burnetii RSA 493
aaccgccuuuaaga

SEQ ID NO: 569695 - RNA, 16 nt, Coxiella burnetii RSA 493
aaccgccggguuuuuu

SEQ ID NO: 569696 - RNA, 18 nt, Coxiella burnetii RSA 493
aaccgcugacgucagaaa

SEQ ID NO: 569697 - RNA, 21 nt, Coxiella burnetii RSA 493
aaccgcugacgucagaaaaca

SEQ ID NO: 569698 - RNA, 18 nt, Coxiella burnetii RSA 493
aaccgauucauaaaaaau

SEQ ID NO: 569699 - RNA, 13 nt, Coxiella burnetii RSA 493
aaccuucucgugc

SEQ ID NO: 569700 - RNA, 15 nt, Coxiella burnetii RSA 493
aaccuucaaaaauaa

SEQ ID NO: 569701 - RNA, 22 nt, Coxiella burnetii RSA 493
aaccuuguuauaaaacuuccca

SEQ ID NO: 569702 - RNA, 13 nt, Coxiella burnetii RSA 493
aacgaacgccaag

SEQ ID NO: 569703 - RNA, 22 nt, Coxiella burnetii RSA 493
aacgaaaauugucgauaauaua

SEQ ID NO: 569704 - RNA, 18 nt, Coxiella burnetii RSA 493
aacgaaaccuuguuauaa

SEQ ID NO: 569705 - RNA, 17 nt, Coxiella burnetii RSA 493
aaccuacacguuaaaua

SEQ ID NO: 569706 - RNA, 17 nt, Coxiella burnetii RSA 493
aaccgucacuucuucuc

SEQ ID NO: 569707 - RNA, 18 nt, Coxiella burnetii RSA 493
aaccucagccguuaacuc

SEQ ID NO: 569708 - RNA, 15 nt, Coxiella burnetii RSA 493
aacgcaggaucaacg

SEQ ID NO: 569709 - RNA, 22 nt, Coxiella burnetii RSA 493
aacgauuucucuuaccaugguu

SEQ ID NO: 569710 - RNA, 15 nt, Coxiella burnetii RSA 493
aacgaugcgccggcg

SEQ ID NO: 569711 - RNA, 16 nt, Coxiella burnetii RSA 493
aacgaccgugccuucg

SEQ ID NO: 569712 - RNA, 15 nt, Coxiella burnetii RSA 493
aacgacgaucaccca

SEQ ID NO: 569713 - RNA, 16 nt, Coxiella burnetii RSA 493
aacgacuuauuuuaua

SEQ ID NO: 569714 - RNA, 17 nt, Coxiella burnetii RSA 493
aacgacuuauuuuauag

SEQ ID NO: 569715 - RNA, 16 nt, Coxiella burnetii RSA 493
aacgauaaugcacauc

SEQ ID NO: 569716 - RNA, 14 nt, Coxiella burnetii RSA 493
aacgauaaaucaaa

SEQ ID NO: 569717 - RNA, 16 nt, Coxiella burnetii RSA 493
aacgaggcacugcagc

SEQ ID NO: 569718 - RNA, 15 nt, Coxiella burnetii RSA 493
aacgaggugcaaacc

SEQ ID NO: 569719 - RNA, 13 nt, Coxiella burnetii RSA 493
aacgccaaaaccg

SEQ ID NO: 569720 - RNA, 23 nt, Coxiella burnetii RSA 493
aacgcaucggccuuuuucauuuc

SEQ ID NO: 569721 - RNA, 16 nt, Coxiella burnetii RSA 493
aacgccagucauuuuc

SEQ ID NO: 569722 - RNA, 19 nt, Coxiella burnetii RSA 493
aacgcgacaagaauuuuuu

SEQ ID NO: 569723 - RNA, 17 nt, Coxiella burnetii RSA 493
aacgccucucucauaau

SEQ ID NO: 569724 - RNA, 15 nt, Coxiella burnetii RSA 493
aacgcuaucaaggcc

SEQ ID NO: 569725 - RNA, 17 nt, Coxiella burnetii RSA 493
aacgcuaugaaaaccac

SEQ ID NO: 569726 - RNA, 21 nt, Coxiella burnetii RSA 493
aacgcugcguuaucgaaaauu

SEQ ID NO: 569727 - RNA, 20 nt, Coxiella burnetii RSA 493
aacggaaaugcuuucacuuc

SEQ ID NO: 569728 - RNA, 14 nt, Coxiella burnetii RSA 493
aacgcuuguuuuau

SEQ ID NO: 569729 - RNA, 23 nt, Coxiella burnetii RSA 493
aacggauagucgcguauaaauga

SEQ ID NO: 569730 - RNA, 14 nt, Coxiella burnetii RSA 493
aacggagaaaaucg

SEQ ID NO: 569731 - RNA, 17 nt, Coxiella burnetii RSA 493
aacggcagaaacgaggg

SEQ ID NO: 569732 - RNA, 20 nt, Coxiella burnetii RSA 493
aacggcaucaacggaaaaac

SEQ ID NO: 569733 - RNA, 23 nt, Coxiella burnetii RSA 493
aacggcaucaacggaaaaacaaa

SEQ ID NO: 569734 - RNA, 20 nt, Coxiella burnetii RSA 493
aacguaaaccuccaaaaacu

SEQ ID NO: 569735 - RNA, 19 nt, Coxiella burnetii RSA 493
aacgguaacagcaagagga

SEQ ID NO: 569736 - RNA, 16 nt, Coxiella burnetii RSA 493
aacgguauaaaauuuu

SEQ ID NO: 569737 - RNA, 16 nt, Coxiella burnetii RSA 493
aacuaaaucaauugcc

SEQ ID NO: 569738 - RNA, 19 nt, Coxiella burnetii RSA 493
aacuaaauuuuauaaauua

SEQ ID NO: 569739 - RNA, 16 nt, Coxiella burnetii RSA 493
aacuaagcauuaaaaa

SEQ ID NO: 569740 - RNA, 19 nt, Coxiella burnetii RSA 493
aacuaagcauuaaaaaaua

SEQ ID NO: 569741 - RNA, 15 nt, Coxiella burnetii RSA 493
aacuaauugccaaua

SEQ ID NO: 569742 - RNA, 16 nt, Coxiella burnetii RSA 493
aacguauaaauaacau

SEQ ID NO: 569743 - RNA, 21 nt, Coxiella burnetii RSA 493
aacguauugaguuuuugacaa

SEQ ID NO: 569744 - RNA, 11 nt, Coxiella burnetii RSA 493
aacgugagaga

SEQ ID NO: 569745 - RNA, 17 nt, Coxiella burnetii RSA 493
aacgugcuugccgggcg

SEQ ID NO: 569746 - RNA, 18 nt, Coxiella burnetii RSA 493
aacguuauuguuaacacc

SEQ ID NO: 569747 - RNA, 12 nt, Coxiella burnetii RSA 493
aacguuugauuu

SEQ ID NO: 569748 - RNA, 21 nt, Coxiella burnetii RSA 493
aacucuuuuagcucauugaaa

SEQ ID NO: 569749 - RNA, 23 nt, Coxiella burnetii RSA 493
aacucuguuagauauugaacagg

SEQ ID NO: 569750 - RNA, 15 nt, Coxiella burnetii RSA 493
aacucuaauuuuccu

SEQ ID NO: 569751 - RNA, 17 nt, Coxiella burnetii RSA 493
aacuccugaaaaauaau

SEQ ID NO: 569752 - RNA, 18 nt, Coxiella burnetii RSA 493
aacuccuuguuuuaaccu

SEQ ID NO: 569753 - RNA, 22 nt, Coxiella burnetii RSA 493
aacucccaucaaaguagcugca

SEQ ID NO: 569754 - RNA, 16 nt, Coxiella burnetii RSA 493
aacucagcccaacaua

SEQ ID NO: 569755 - RNA, 21 nt, Coxiella burnetii RSA 493
aacucaauucgcuuaaauuuu

SEQ ID NO: 569756 - RNA, 23 nt, Coxiella burnetii RSA 493
aacucaauucgcuuaaauuuuga

SEQ ID NO: 569757 - RNA, 17 nt, Coxiella burnetii RSA 493
aacuauccccaucguuu

SEQ ID NO: 569758 - RNA, 21 nt, Coxiella burnetii RSA 493
aacuaucguugccuuuuugaa

SEQ ID NO: 569759 - RNA, 24 nt, Coxiella burnetii RSA 493
aacuauucccugcgcuccagauga

SEQ ID NO: 569760 - RNA, 21 nt, Coxiella burnetii RSA 493
aacuauuauuaaaagagcgaa

SEQ ID NO: 569761 - RNA, 17 nt, Coxiella burnetii RSA 493
aacugaugaauaacaau

SEQ ID NO: 569762 - RNA, 19 nt, Coxiella burnetii RSA 493
aacugaugaauaacaaugc

SEQ ID NO: 569763 - RNA, 16 nt, Coxiella burnetii RSA 493
aacugauguauccuaa

SEQ ID NO: 569764 - RNA, 22 nt, Coxiella burnetii RSA 493
aacugauguauccuaauaaaaa

SEQ ID NO: 569765 - RNA, 22 nt, Coxiella burnetii RSA 493
aacugccugcuaggauuuccuu

SEQ ID NO: 569766 - RNA, 23 nt, Coxiella burnetii RSA 493
aacugcgccgcaaaguaaaaaug

SEQ ID NO: 569767 - RNA, 22 nt, Coxiella burnetii RSA 493
aacuguugguguucuucguuua

SEQ ID NO: 569768 - RNA, 13 nt, Coxiella burnetii RSA 493
aacuguuugcauu

SEQ ID NO: 569769 - RNA, 17 nt, Coxiella burnetii RSA 493
aacuuuauaguucauua

SEQ ID NO: 569770 - RNA, 18 nt, Coxiella burnetii RSA 493
aacuuugauaagcauaau

SEQ ID NO: 569771 - RNA, 17 nt, Coxiella burnetii RSA 493
aacuuuuccaucuccuu

SEQ ID NO: 569772 - RNA, 18 nt, Coxiella burnetii RSA 493
aacuucucuucaaauuca

SEQ ID NO: 569773 - RNA, 16 nt, Coxiella burnetii RSA 493
aacuucucuugaauaa

SEQ ID NO: 569774 - RNA, 22 nt, Coxiella burnetii RSA 493
aacuucaugcaaaaauuguuua

SEQ ID NO: 569775 - RNA, 19 nt, Coxiella burnetii RSA 493
aacuuccuaucaauauuuc

SEQ ID NO: 569776 - RNA, 15 nt, Coxiella burnetii RSA 493
aacuucccauucuau

SEQ ID NO: 569777 - RNA, 16 nt, Coxiella burnetii RSA 493
aacuucaccgcuguga

SEQ ID NO: 569778 - RNA, 15 nt, Coxiella burnetii RSA 493
aacuuacgcugaagu

SEQ ID NO: 569779 - RNA, 16 nt, Coxiella burnetii RSA 493
aacuuaagagagcgag

SEQ ID NO: 569780 - RNA, 18 nt, Coxiella burnetii RSA 493
aagaaauugcggaaauuu

SEQ ID NO: 569781 - RNA, 19 nt, Coxiella burnetii RSA 493
aagaacgccagucauuuuc

SEQ ID NO: 569782 - RNA, 19 nt, Coxiella burnetii RSA 493
aagaaccgcgacuaaacca

SEQ ID NO: 569783 - RNA, 18 nt, Coxiella burnetii RSA 493
aagaacccaccgcuggug

SEQ ID NO: 569784 - RNA, 19 nt, Coxiella burnetii RSA 493
aagaaaguuucccacaaaa

SEQ ID NO: 569785 - RNA, 12 nt, Coxiella burnetii RSA 493
aagaaagcagau

SEQ ID NO: 569786 - RNA, 19 nt, Coxiella burnetii RSA 493
aagaaagcgagcaaucaaa

SEQ ID NO: 569787 - RNA, 20 nt, Coxiella burnetii RSA 493
aagaaagcgagcaaucaaaa

SEQ ID NO: 569788 - RNA, 12 nt, Coxiella burnetii RSA 493
aagaaagccuaa

SEQ ID NO: 569789 - RNA, 16 nt, Coxiella burnetii RSA 493
aagaaagccuaaguuu

SEQ ID NO: 569790 - RNA, 15 nt, Coxiella burnetii RSA 493
aagaaacgauuaaaa

SEQ ID NO: 569791 - RNA, 19 nt, Coxiella burnetii RSA 493
aagaaacgauuaaaaauuu

SEQ ID NO: 569792 - RNA, 22 nt, Coxiella burnetii RSA 493
aagaaaaauuccaaaaacauug

SEQ ID NO: 569793 - RNA, 19 nt, Coxiella burnetii RSA 493
aagaaaaaccaguuuucag

SEQ ID NO: 569794 - RNA, 17 nt, Coxiella burnetii RSA 493
aagaaaaagaaauuguu

SEQ ID NO: 569795 - RNA, 13 nt, Coxiella burnetii RSA 493
aagaaaaaguuaa

SEQ ID NO: 569796 - RNA, 18 nt, Coxiella burnetii RSA 493
aaucauuuuuguacugcu

SEQ ID NO: 569797 - RNA, 21 nt, Coxiella burnetii RSA 493
aaucauuuuuguacugcugua

SEQ ID NO: 569798 - RNA, 13 nt, Coxiella burnetii RSA 493
aauccaguuuuuu

SEQ ID NO: 569799 - RNA, 17 nt, Coxiella burnetii RSA 493
aauccaggguugauuga

SEQ ID NO: 569800 - RNA, 14 nt, Coxiella burnetii RSA 493
aaucauuacagaca

SEQ ID NO: 569801 - RNA, 13 nt, Coxiella burnetii RSA 493
aaucauugaagaa

SEQ ID NO: 569802 - RNA, 19 nt, Coxiella burnetii RSA 493
aaucaugaucggauucuga

SEQ ID NO: 569803 - RNA, 14 nt, Coxiella burnetii RSA 493
aauauguccaauag

SEQ ID NO: 569804 - RNA, 14 nt, Coxiella burnetii RSA 493
aauauuaaaacaag

SEQ ID NO: 569805 - RNA, 15 nt, Coxiella burnetii RSA 493
aauccgaugagaaag

SEQ ID NO: 569806 - RNA, 18 nt, Coxiella burnetii RSA 493
aauccgccgguaccccau

SEQ ID NO: 569807 - RNA, 16 nt, Coxiella burnetii RSA 493
aaucccaauaaaacgc

SEQ ID NO: 569808 - RNA, 13 nt, Coxiella burnetii RSA 493
aauccucaguaaa

SEQ ID NO: 569809 - RNA, 21 nt, Coxiella burnetii RSA 493
aauccucaguaaaaacauccu

SEQ ID NO: 569810 - RNA, 15 nt, Coxiella burnetii RSA 493
aauccucucucucac

SEQ ID NO: 569811 - RNA, 21 nt, Coxiella burnetii RSA 493
aauccgcuuuauuuuucgcuc

SEQ ID NO: 569812 - RNA, 21 nt, Coxiella burnetii RSA 493
aauccguuuugaaaaauaaaa

SEQ ID NO: 569813 - RNA, 13 nt, Coxiella burnetii RSA 493
aauccuucuuuug

SEQ ID NO: 569814 - RNA, 17 nt, Coxiella burnetii RSA 493
aaucgcuaagcgaaaaa

SEQ ID NO: 569815 - RNA, 20 nt, Coxiella burnetii RSA 493
aaucgcuaagcgaaaaauga

SEQ ID NO: 569816 - RNA, 17 nt, Coxiella burnetii RSA 493
aaucgcuccuaaauuuu

SEQ ID NO: 569817 - RNA, 21 nt, Coxiella burnetii RSA 493
aaucugugccacuuucgauaa

SEQ ID NO: 569818 - RNA, 21 nt, Coxiella burnetii RSA 493
aaucugugggaauguucugau

SEQ ID NO: 569819 - RNA, 12 nt, Coxiella burnetii RSA 493
aaugaaaaauag

SEQ ID NO: 569820 - RNA, 15 nt, Coxiella burnetii RSA 493
aaugaaacgcagcga

SEQ ID NO: 569821 - RNA, 15 nt, Coxiella burnetii RSA 493
aaugaaauauauaaa

SEQ ID NO: 569822 - RNA, 15 nt, Coxiella burnetii RSA 493
aaugaauagaaaaac

SEQ ID NO: 569823 - RNA, 14 nt, Coxiella burnetii RSA 493
aaugagauaacucu

SEQ ID NO: 569824 - RNA, 13 nt, Coxiella burnetii RSA 493
aaugagaugauca

SEQ ID NO: 569825 - RNA, 18 nt, Coxiella burnetii RSA 493
aaugagcaucuuuucuga

SEQ ID NO: 569826 - RNA, 23 nt, Coxiella burnetii RSA 493
aaugaggaucaucgcacuugcuu

SEQ ID NO: 569827 - RNA, 14 nt, Coxiella burnetii RSA 493
aaugaucugcucuu

SEQ ID NO: 569828 - RNA, 18 nt, Coxiella burnetii RSA 493
aaugccggcuaauuuuuu

SEQ ID NO: 569829 - RNA, 13 nt, Coxiella burnetii RSA 493
aaugccgcuaaau

SEQ ID NO: 569830 - RNA, 15 nt, Coxiella burnetii RSA 493
aaugcgauucuuuuu

SEQ ID NO: 569831 - RNA, 20 nt, Coxiella burnetii RSA 493
aaugcgccuacaaauaccaa

SEQ ID NO: 569832 - RNA, 21 nt, Coxiella burnetii RSA 493
aaugcgcgauguguaucccaa

SEQ ID NO: 569833 - RNA, 22 nt, Coxiella burnetii RSA 493
aaugcaguuaaccaauugauua

SEQ ID NO: 569834 - RNA, 20 nt, Coxiella burnetii RSA 493
aaugccaacccaaggaacca

SEQ ID NO: 569835 - RNA, 16 nt, Coxiella burnetii RSA 493
aaugccagauugauug

SEQ ID NO: 569836 - RNA, 21 nt, Coxiella burnetii RSA 493
aaugccagauugauugcguaa

SEQ ID NO: 569837 - RNA, 17 nt, Coxiella burnetii RSA 493
aaugguugaaagaaaaa

SEQ ID NO: 569838 - RNA, 14 nt, Coxiella burnetii RSA 493
aaugcuuucuuuua

SEQ ID NO: 569839 - RNA, 18 nt, Coxiella burnetii RSA 493
aauugcugaacaaaagcc

SEQ ID NO: 569840 - RNA, 15 nt, Coxiella burnetii RSA 493
aauugcugauauuuu

SEQ ID NO: 569841 - RNA, 23 nt, Coxiella burnetii RSA 493
aauugcuaccugcuucgcuucau

SEQ ID NO: 569842 - RNA, 17 nt, Coxiella burnetii RSA 493
aauugcuaaauguuuag

SEQ ID NO: 569843 - RNA, 14 nt, Coxiella burnetii RSA 493
aauugcuccaaaca

SEQ ID NO: 569844 - RNA, 19 nt, Coxiella burnetii RSA 493
aauugcgcguaaaauucca

SEQ ID NO: 569845 - RNA, 11 nt, Coxiella burnetii RSA 493
aauugcuuucc

SEQ ID NO: 569846 - RNA, 18 nt, Coxiella burnetii RSA 493
aauuggaggacugcucuu

SEQ ID NO: 569847 - RNA, 19 nt, Coxiella burnetii RSA 493
aauugggaagcaauuucau

SEQ ID NO: 569848 - RNA, 18 nt, Coxiella burnetii RSA 493
aauugggaguuguauaaa

SEQ ID NO: 569849 - RNA, 21 nt, Coxiella burnetii RSA 493
aauugccgauauucuuuuucu

SEQ ID NO: 569850 - RNA, 16 nt, Coxiella burnetii RSA 493
aauugaagaauugauu

SEQ ID NO: 569851 - RNA, 22 nt, Coxiella burnetii RSA 493
aauugaaaaaccauucaaugcu

SEQ ID NO: 569852 - RNA, 13 nt, Coxiella burnetii RSA 493
aauugaaagaauu

SEQ ID NO: 569853 - RNA, 19 nt, Coxiella burnetii RSA 493
aauugaaguccuuaucacu

SEQ ID NO: 569854 - RNA, 13 nt, Coxiella burnetii RSA 493
aauugacuuauuu

SEQ ID NO: 569855 - RNA, 20 nt, Coxiella burnetii RSA 493
aauugacuuauuuuuauucu

SEQ ID NO: 569856 - RNA, 15 nt, Coxiella burnetii RSA 493
aauucuucuucauuu

SEQ ID NO: 569857 - RNA, 14 nt, Coxiella burnetii RSA 493
aauucuuuuuaaga

SEQ ID NO: 569858 - RNA, 17 nt, Coxiella burnetii RSA 493
aauucuggauaagcaua

SEQ ID NO: 569859 - RNA, 21 nt, Coxiella burnetii RSA 493
aauuuauccgcuuaaucccau

SEQ ID NO: 569860 - RNA, 10 nt, Coxiella burnetii RSA 493
aauuuauuca

SEQ ID NO: 569861 - RNA, 16 nt, Coxiella burnetii RSA 493
aauuuauuuucccauc

SEQ ID NO: 569862 - RNA, 18 nt, Coxiella burnetii RSA 493
aauuucaacgccucucuc

SEQ ID NO: 569863 - RNA, 20 nt, Coxiella burnetii RSA 493
aauuucaaguaaucuacgaa

SEQ ID NO: 569864 - RNA, 19 nt, Coxiella burnetii RSA 493
aauuucaaugacuuuaacu

SEQ ID NO: 569865 - RNA, 18 nt, Coxiella burnetii RSA 493
aauuuagguguaaguccu

SEQ ID NO: 569866 - RNA, 16 nt, Coxiella burnetii RSA 493
aauuuaaucuacucua

SEQ ID NO: 569867 - RNA, 20 nt, Coxiella burnetii RSA 493
aauuuaaacucaauucgcuu

SEQ ID NO: 569868 - RNA, 22 nt, Coxiella burnetii RSA 493
aauuuaaacucaauucgcuuaa

SEQ ID NO: 569869 - RNA, 15 nt, Coxiella burnetii RSA 493
aauuuaacacuuuaa

SEQ ID NO: 569870 - RNA, 17 nt, Coxiella burnetii RSA 493
aauuguugauuuaacuu

SEQ ID NO: 569871 - RNA, 12 nt, Coxiella burnetii RSA 493
aauuguuucaug

SEQ ID NO: 569872 - RNA, 22 nt, Coxiella burnetii RSA 493
aauuguuucaugaaguuccauu

SEQ ID NO: 569873 - RNA, 13 nt, Coxiella burnetii RSA 493
aauuguguuuuaa

SEQ ID NO: 569874 - RNA, 16 nt, Coxiella burnetii RSA 493
aauugguauauuucau

SEQ ID NO: 569875 - RNA, 16 nt, Coxiella burnetii RSA 493
aauuccauuaaaaaca

SEQ ID NO: 569876 - RNA, 15 nt, Coxiella burnetii RSA 493
aauucccuuuugaau

SEQ ID NO: 569877 - RNA, 23 nt, Coxiella burnetii RSA 493
aauucaugaaaaguaaauuuaua

SEQ ID NO: 569878 - RNA, 17 nt, Coxiella burnetii RSA 493
aauuccaauaauugcug

SEQ ID NO: 569879 - RNA, 20 nt, Coxiella burnetii RSA 493
aauucaucauuuuccaaaaa

SEQ ID NO: 569880 - RNA, 22 nt, Coxiella burnetii RSA 493
aauucaucauuuuccaaaaaau

SEQ ID NO: 569881 - RNA, 18 nt, Coxiella burnetii RSA 493
aauucaggacugaaauaa

SEQ ID NO: 569882 - RNA, 15 nt, Coxiella burnetii RSA 493
aauucauaaauaauu

SEQ ID NO: 569883 - RNA, 22 nt, Coxiella burnetii RSA 493
aauucacgauuuucguuguaag

SEQ ID NO: 569884 - RNA, 16 nt, Coxiella burnetii RSA 493
aauucagcauucccau

SEQ ID NO: 569885 - RNA, 22 nt, Coxiella burnetii RSA 493
aauuccgguuucaaaugaccaa

SEQ ID NO: 569886 - RNA, 19 nt, Coxiella burnetii RSA 493
aauucgcuuaaauuuugac

SEQ ID NO: 569887 - RNA, 20 nt, Coxiella burnetii RSA 493
aauucguugcauucaauaca

SEQ ID NO: 569888 - RNA, 23 nt, Coxiella burnetii RSA 493
aauucucccuuuuccugaacagg

SEQ ID NO: 569889 - RNA, 16 nt, Coxiella burnetii RSA 493
aauucucuauauagag

SEQ ID NO: 569890 - RNA, 13 nt, Coxiella burnetii RSA 493
aauuaauuguggc

SEQ ID NO: 569891 - RNA, 13 nt, Coxiella burnetii RSA 493
aauuaaauugcuc

SEQ ID NO: 569892 - RNA, 14 nt, Coxiella burnetii RSA 493
aauuaaauuuacaa

SEQ ID NO: 569893 - RNA, 14 nt, Coxiella burnetii RSA 493
aauuacaacuacua

SEQ ID NO: 569894 - RNA, 13 nt, Coxiella burnetii RSA 493
aauuacaauccaa

SEQ ID NO: 569895 - RNA, 13 nt, Coxiella burnetii RSA 493
aauuagcauuuuc

SEQ ID NO: 569896 - RNA, 14 nt, Coxiella burnetii RSA 493
aauucaaauuuuaa

SEQ ID NO: 569897 - RNA, 12 nt, Coxiella burnetii RSA 493
aauuauuuuuau

SEQ ID NO: 569898 - RNA, 20 nt, Coxiella burnetii RSA 493
aauuaugcaagguugaugcu

SEQ ID NO: 569899 - RNA, 13 nt, Coxiella burnetii RSA 493
aaguugacgccua

SEQ ID NO: 569900 - RNA, 13 nt, Coxiella burnetii RSA 493
aauaaauagcauu

SEQ ID NO: 569901 - RNA, 17 nt, Coxiella burnetii RSA 493
aauaaaucaauuaaauu

SEQ ID NO: 569902 - RNA, 14 nt, Coxiella burnetii RSA 493
aauaacaaugccaa

SEQ ID NO: 569903 - RNA, 13 nt, Coxiella burnetii RSA 493
aauaacaaauaaa

SEQ ID NO: 569904 - RNA, 11 nt, Coxiella burnetii RSA 493
aauaacaaaug

SEQ ID NO: 569905 - RNA, 11 nt, Coxiella burnetii RSA 493
aauaacaaaga

SEQ ID NO: 569906 - RNA, 14 nt, Coxiella burnetii RSA 493
aauaacaaagacuu

SEQ ID NO: 569907 - RNA, 13 nt, Coxiella burnetii RSA 493
aauaaauggcguu

SEQ ID NO: 569908 - RNA, 18 nt, Coxiella burnetii RSA 493
aauaaauuaauuauccaa

SEQ ID NO: 569909 - RNA, 19 nt, Coxiella burnetii RSA 493
aauaacgcuaugaaaacca

SEQ ID NO: 569910 - RNA, 14 nt, Coxiella burnetii RSA 493
aauaacggaaaaug

SEQ ID NO: 569911 - RNA, 21 nt, Coxiella burnetii RSA 493
aauaagacccgccaaagcaaa

SEQ ID NO: 569912 - RNA, 21 nt, Coxiella burnetii RSA 493
aauaagagcuccaaacggucc

SEQ ID NO: 569913 - RNA, 12 nt, Coxiella burnetii RSA 493
aauaagaauaag

SEQ ID NO: 569914 - RNA, 22 nt, Coxiella burnetii RSA 493
aauaacuuuacuaaaaaacgau

SEQ ID NO: 569915 - RNA, 23 nt, Coxiella burnetii RSA 493
aauaacuucuucuuuuaagugga

SEQ ID NO: 569916 - RNA, 13 nt, Coxiella burnetii RSA 493
aauaauaguuugc

SEQ ID NO: 569917 - RNA, 12 nt, Coxiella burnetii RSA 493
aauaauaaccca

SEQ ID NO: 569918 - RNA, 17 nt, Coxiella burnetii RSA 493
aauaaggauaaggauaa

SEQ ID NO: 569919 - RNA, 18 nt, Coxiella burnetii RSA 493
aauaagggauaaaacaca

SEQ ID NO: 569920 - RNA, 17 nt, Coxiella burnetii RSA 493
aauaagguuaaaucccu

SEQ ID NO: 569921 - RNA, 13 nt, Coxiella burnetii RSA 493
aauaauaaaaccc

SEQ ID NO: 569922 - RNA, 21 nt, Coxiella burnetii RSA 493
aauaauucguuuacuuguugc

SEQ ID NO: 569923 - RNA, 19 nt, Coxiella burnetii RSA 493
aauaauugcugaacaaaag

SEQ ID NO: 569924 - RNA, 21 nt, Coxiella burnetii RSA 493
aauaauugcugaacaaaagcc

SEQ ID NO: 569925 - RNA, 16 nt, Coxiella burnetii RSA 493
aauaaucuucccaggc

SEQ ID NO: 569926 - RNA, 21 nt, Coxiella burnetii RSA 493
aauaaugaauauucugagcgc

SEQ ID NO: 569927 - RNA, 18 nt, Coxiella burnetii RSA 493
aauaaugaguggcugcuu

SEQ ID NO: 569928 - RNA, 20 nt, Coxiella burnetii RSA 493
aauaaucucacacaacucca

SEQ ID NO: 569929 - RNA, 17 nt, Coxiella burnetii RSA 493
aauaccccgcuguuuuc

SEQ ID NO: 569930 - RNA, 20 nt, Coxiella burnetii RSA 493
aauaccccgcuguuuucaga

SEQ ID NO: 569931 - RNA, 17 nt, Coxiella burnetii RSA 493
aauaauuuuuuuaauuu

SEQ ID NO: 569932 - RNA, 23 nt, Coxiella burnetii RSA 493
aauaauuuuuuuaauuuuuucau

SEQ ID NO: 569933 - RNA, 12 nt, Coxiella burnetii RSA 493
aauaauuuuccg

SEQ ID NO: 569934 - RNA, 18 nt, Coxiella burnetii RSA 493
aauaauuuuagccacuug

SEQ ID NO: 569935 - RNA, 20 nt, Coxiella burnetii RSA 493
aauaccggaaacaaguauaa

SEQ ID NO: 569936 - RNA, 17 nt, Coxiella burnetii RSA 493
aauagcauuucguauaa

SEQ ID NO: 569937 - RNA, 23 nt, Coxiella burnetii RSA 493
aauagcaucaagggcaaaaacau

SEQ ID NO: 569938 - RNA, 20 nt, Coxiella burnetii RSA 493
aauagagucgggaaauaaaa

SEQ ID NO: 569939 - RNA, 21 nt, Coxiella burnetii RSA 493
aauagagucgggaaauaaaau

SEQ ID NO: 569940 - RNA, 22 nt, Coxiella burnetii RSA 493
aauagagucgggaaauaaaauu

SEQ ID NO: 569941 - RNA, 19 nt, Coxiella burnetii RSA 493
aauacggcuuuauuuugga

SEQ ID NO: 569942 - RNA, 14 nt, Coxiella burnetii RSA 493
aauacgggaaaaca

SEQ ID NO: 569943 - RNA, 15 nt, Coxiella burnetii RSA 493
aauacgggaaaacaa

SEQ ID NO: 569944 - RNA, 13 nt, Coxiella burnetii RSA 493
aauaucuagauuu

SEQ ID NO: 569945 - RNA, 16 nt, Coxiella burnetii RSA 493
aauaucuagauuuaaa

SEQ ID NO: 569946 - RNA, 16 nt, Coxiella burnetii RSA 493
aauaggcuuucuuuuu

SEQ ID NO: 569947 - RNA, 14 nt, Coxiella burnetii RSA 493
aauaggucauuuuu

SEQ ID NO: 569948 - RNA, 17 nt, Coxiella burnetii RSA 493
aauagcgaucagcggaa

SEQ ID NO: 569949 - RNA, 23 nt, Coxiella burnetii RSA 493
aauagccuucucaauuucaacgc

SEQ ID NO: 569950 - RNA, 21 nt, Coxiella burnetii RSA 493
aauauaggcgaaucaucuuuu

SEQ ID NO: 569951 - RNA, 22 nt, Coxiella burnetii RSA 493
aauauaauugagguuuuaauuu

SEQ ID NO: 569952 - RNA, 22 nt, Coxiella burnetii RSA 493
aagugugauucauuaucaugca

SEQ ID NO: 569953 - RNA, 17 nt, Coxiella burnetii RSA 493
aagugugggaaaaauag

SEQ ID NO: 569954 - RNA, 20 nt, Coxiella burnetii RSA 493
aagucugaacaggcagauga

SEQ ID NO: 569955 - RNA, 15 nt, Coxiella burnetii RSA 493
aagucgcguaaagau

SEQ ID NO: 569956 - RNA, 20 nt, Coxiella burnetii RSA 493
aaguccuugcugaauucccu

SEQ ID NO: 569957 - RNA, 19 nt, Coxiella burnetii RSA 493
aaguagcuaaaaaauucau

SEQ ID NO: 569958 - RNA, 17 nt, Coxiella burnetii RSA 493
aaguagcucuuaaaaga

SEQ ID NO: 569959 - RNA, 14 nt, Coxiella burnetii RSA 493
aaguagccaaaaua

SEQ ID NO: 569960 - RNA, 13 nt, Coxiella burnetii RSA 493
aaguaguugaaaa

SEQ ID NO: 569961 - RNA, 12 nt, Coxiella burnetii RSA 493
aaguauccaucc

SEQ ID NO: 569962 - RNA, 15 nt, Coxiella burnetii RSA 493
aaggcuaauuuuccu

SEQ ID NO: 569963 - RNA, 16 nt, Coxiella burnetii RSA 493
aaggcuaauuuuccuu

SEQ ID NO: 569964 - RNA, 21 nt, Coxiella burnetii RSA 493
aaggucauccauucuuucauu

SEQ ID NO: 569965 - RNA, 18 nt, Coxiella burnetii RSA 493
aaguacugaugcaaauca

SEQ ID NO: 569966 - RNA, 21 nt, Coxiella burnetii RSA 493
aaguacugaugcaaaucauga

SEQ ID NO: 569967 - RNA, 19 nt, Coxiella burnetii RSA 493
aaguagaaaacuuucagga

SEQ ID NO: 569968 - RNA, 15 nt, Coxiella burnetii RSA 493
aaguaauuuuaaaaa

SEQ ID NO: 569969 - RNA, 21 nt, Coxiella burnetii RSA 493
aagcccucaucuccgcaggcg

SEQ ID NO: 569970 - RNA, 23 nt, Coxiella burnetii RSA 493
aagcgauuccaaagcagauaaau

SEQ ID NO: 569971 - RNA, 15 nt, Coxiella burnetii RSA 493
aagcgcaauuuccag

SEQ ID NO: 569972 - RNA, 16 nt, Coxiella burnetii RSA 493
aagcgaaauacgggga

SEQ ID NO: 569973 - RNA, 21 nt, Coxiella burnetii RSA 493
aagccugaaaaucaaauuuuc

SEQ ID NO: 569974 - RNA, 15 nt, Coxiella burnetii RSA 493
aagccguucacccca

SEQ ID NO: 569975 - RNA, 16 nt, Coxiella burnetii RSA 493
aagccguucaccccau

SEQ ID NO: 569976 - RNA, 21 nt, Coxiella burnetii RSA 493
aaggacaguuggcuuguaaag

SEQ ID NO: 569977 - RNA, 22 nt, Coxiella burnetii RSA 493
aaggagaaauugacaaauaaag

SEQ ID NO: 569978 - RNA, 13 nt, Coxiella burnetii RSA 493
aagcuugaaaaaa

SEQ ID NO: 569979 - RNA, 18 nt, Coxiella burnetii RSA 493
aaggaaaggucaggcaau

SEQ ID NO: 569980 - RNA, 21 nt, Coxiella burnetii RSA 493
aaggaaaggucaggcaauuuu

SEQ ID NO: 569981 - RNA, 19 nt, Coxiella burnetii RSA 493
aagcugauuccgaucuugg

SEQ ID NO: 569982 - RNA, 15 nt, Coxiella burnetii RSA 493
aagcugauacaccau

SEQ ID NO: 569983 - RNA, 16 nt, Coxiella burnetii RSA 493
aagcugaaauugaauu

SEQ ID NO: 569984 - RNA, 12 nt, Coxiella burnetii RSA 493
aagcguuucucg

SEQ ID NO: 569985 - RNA, 20 nt, Coxiella burnetii RSA 493
aagcgccugucuaaucugcg

SEQ ID NO: 569986 - RNA, 16 nt, Coxiella burnetii RSA 493
aagcgcccaaaugauc

SEQ ID NO: 569987 - RNA, 18 nt, Coxiella burnetii RSA 493
uucuugggcaauuuguga

SEQ ID NO: 569988 - RNA, 23 nt, Coxiella burnetii RSA 493
uucuugaacaggagcgauaaaau

SEQ ID NO: 569989 - RNA, 13 nt, Coxiella burnetii RSA 493
uucuucuuuggcc

SEQ ID NO: 569990 - RNA, 14 nt, Coxiella burnetii RSA 493
uucuugaaaaacuu

SEQ ID NO: 569991 - RNA, 13 nt, Coxiella burnetii RSA 493
uugaggaaaauaa

SEQ ID NO: 569992 - RNA, 20 nt, Coxiella burnetii RSA 493
uugaggaaaauaagaugacg

SEQ ID NO: 569993 - RNA, 23 nt, Coxiella burnetii RSA 493
uugaggaaaauaagaugacgcag

SEQ ID NO: 569994 - RNA, 18 nt, Coxiella burnetii RSA 493
uugaggucguuaaaaaau

SEQ ID NO: 569995 - RNA, 18 nt, Coxiella burnetii RSA 493
uugaggugccgcuaaaau

SEQ ID NO: 569996 - RNA, 17 nt, Coxiella burnetii RSA 493
uugaguaagaaaugccg

SEQ ID NO: 569997 - RNA, 18 nt, Coxiella burnetii RSA 493
uugaguaggacucuagga

SEQ ID NO: 569998 - RNA, 23 nt, Coxiella burnetii RSA 493
uugaguggugguagaauucuccc

SEQ ID NO: 569999 - RNA, 16 nt, Coxiella burnetii RSA 493
uugaguuagcauaucg

SEQ ID NO: 570000 - RNA, 15 nt, Coxiella burnetii RSA 493
uugaucuaaucgucu

SEQ ID NO: 570001 - RNA, 22 nt, Coxiella burnetii RSA 493
uugaucuaaucgucuugaccaa

SEQ ID NO: 570002 - RNA, 19 nt, Coxiella burnetii RSA 493
uugaugcguuuuuuuauua

SEQ ID NO: 570003 - RNA, 13 nt, Coxiella burnetii RSA 493
uugauaguucaua

SEQ ID NO: 570004 - RNA, 17 nt, Coxiella burnetii RSA 493
uugauaggauuauuauc

SEQ ID NO: 570005 - RNA, 15 nt, Coxiella burnetii RSA 493
uugauuaauaauguu

SEQ ID NO: 570006 - RNA, 21 nt, Coxiella burnetii RSA 493
uugauuaauaauguuauuaaa

SEQ ID NO: 570007 - RNA, 21 nt, Coxiella burnetii RSA 493
uugauuuaaauuuaaaguuuc

SEQ ID NO: 570008 - RNA, 19 nt, Coxiella burnetii RSA 493
uugauuagcaucuugaauc

SEQ ID NO: 570009 - RNA, 15 nt, Coxiella burnetii RSA 493
uugccagaaauagcu

SEQ ID NO: 570010 - RNA, 21 nt, Coxiella burnetii RSA 493
uugccacucuuuauuauaaaa

SEQ ID NO: 570011 - RNA, 14 nt, Coxiella burnetii RSA 493
uugcagugaaauaa

SEQ ID NO: 570012 - RNA, 16 nt, Coxiella burnetii RSA 493
uugcauccgaacuaau

SEQ ID NO: 570013 - RNA, 15 nt, Coxiella burnetii RSA 493
uugcggaaauuucac

SEQ ID NO: 570014 - RNA, 21 nt, Coxiella burnetii RSA 493
uugccaggacuuuaagauuuc

SEQ ID NO: 570015 - RNA, 13 nt, Coxiella burnetii RSA 493
uuggcauccucau

SEQ ID NO: 570016 - RNA, 15 nt, Coxiella burnetii RSA 493
uuggcagaauuugua

SEQ ID NO: 570017 - RNA, 18 nt, Coxiella burnetii RSA 493
uuggaacaaaccauucaa

SEQ ID NO: 570018 - RNA, 23 nt, Coxiella burnetii RSA 493
uuggaaaaucgauggaagaacau

SEQ ID NO: 570019 - RNA, 21 nt, Coxiella burnetii RSA 493
uuggaaaaaaaccuaaagaaa

SEQ ID NO: 570020 - RNA, 14 nt, Coxiella burnetii RSA 493
uuggauaagauucg

SEQ ID NO: 570021 - RNA, 18 nt, Coxiella burnetii RSA 493
uuggauaagauucguaau

SEQ ID NO: 570022 - RNA, 13 nt, Coxiella burnetii RSA 493
uugcuauuuuccu

SEQ ID NO: 570023 - RNA, 21 nt, Coxiella burnetii RSA 493
uugcuggagaucacuggacca

SEQ ID NO: 570024 - RNA, 22 nt, Coxiella burnetii RSA 493
uugcuaacuccacgaucugagu

SEQ ID NO: 570025 - RNA, 13 nt, Coxiella burnetii RSA 493
uugcguaaauggu

SEQ ID NO: 570026 - RNA, 16 nt, Coxiella burnetii RSA 493
uugcuugguugauuca

SEQ ID NO: 570027 - RNA, 15 nt, Coxiella burnetii RSA 493
uugggcaaaaaaaga

SEQ ID NO: 570028 - RNA, 14 nt, Coxiella burnetii RSA 493
uugggcaauuugug

SEQ ID NO: 570029 - RNA, 20 nt, Coxiella burnetii RSA 493
uugggcaauuugugaaauau

SEQ ID NO: 570030 - RNA, 22 nt, Coxiella burnetii RSA 493
uuggcucccagcguuuccaauu

SEQ ID NO: 570031 - RNA, 20 nt, Coxiella burnetii RSA 493
uuggcuaaauccagcgauug

SEQ ID NO: 570032 - RNA, 22 nt, Coxiella burnetii RSA 493
uuggccgcggugguaaacaacg

SEQ ID NO: 570033 - RNA, 22 nt, Coxiella burnetii RSA 493
uuggucggaauugcuaaauguu

SEQ ID NO: 570034 - RNA, 16 nt, Coxiella burnetii RSA 493
uuggucaggaacaacg

SEQ ID NO: 570035 - RNA, 19 nt, Coxiella burnetii RSA 493
uugggugggugagaagaau

SEQ ID NO: 570036 - RNA, 17 nt, Coxiella burnetii RSA 493
uugggggucuuuuuuuc

SEQ ID NO: 570037 - RNA, 17 nt, Coxiella burnetii RSA 493
uuggguauaaauaacuu

SEQ ID NO: 570038 - RNA, 20 nt, Coxiella burnetii RSA 493
uugggcucgaaaaacuuuuu

SEQ ID NO: 570039 - RNA, 20 nt, Coxiella burnetii RSA 493
uugguagcccgaaaaaguag

SEQ ID NO: 570040 - RNA, 22 nt, Coxiella burnetii RSA 493
uuuaaucgcuccuaaauuuucu

SEQ ID NO: 570041 - RNA, 14 nt, Coxiella burnetii RSA 493
uuuaaugaaaaaua

SEQ ID NO: 570042 - RNA, 21 nt, Coxiella burnetii RSA 493
uuuaauaauucggguaacaaa

SEQ ID NO: 570043 - RNA, 11 nt, Coxiella burnetii RSA 493
uuuaauaauca

SEQ ID NO: 570044 - RNA, 13 nt, Coxiella burnetii RSA 493
uuuaauaucaaaa

SEQ ID NO: 570045 - RNA, 17 nt, Coxiella burnetii RSA 493
uuuaacuucucuugaau

SEQ ID NO: 570046 - RNA, 22 nt, Coxiella burnetii RSA 493
uuuaagaugccagugcucgcca

SEQ ID NO: 570047 - RNA, 15 nt, Coxiella burnetii RSA 493
uuuaacuuauaaauu

SEQ ID NO: 570048 - RNA, 17 nt, Coxiella burnetii RSA 493
uuuaagauuuuuauaau

SEQ ID NO: 570049 - RNA, 17 nt, Coxiella burnetii RSA 493
uuuaagucccaauuucu

SEQ ID NO: 570050 - RNA, 19 nt, Coxiella burnetii RSA 493
uuuaagucccaauuucuuu

SEQ ID NO: 570051 - RNA, 15 nt, Coxiella burnetii RSA 493
uuuacaguaauuacc

SEQ ID NO: 570052 - RNA, 22 nt, Coxiella burnetii RSA 493
uuuacauagccucuauaaauaa

SEQ ID NO: 570053 - RNA, 12 nt, Coxiella burnetii RSA 493
uuuacuuuuuca

SEQ ID NO: 570054 - RNA, 14 nt, Coxiella burnetii RSA 493
uuuagaaaaaugcu

SEQ ID NO: 570055 - RNA, 16 nt, Coxiella burnetii RSA 493
uuuacuugcuucaucg

SEQ ID NO: 570056 - RNA, 23 nt, Coxiella burnetii RSA 493
uuuagaaagcggaauaagaaauc

SEQ ID NO: 570057 - RNA, 14 nt, Coxiella burnetii RSA 493
uuuacgucuuuucu

SEQ ID NO: 570058 - RNA, 15 nt, Coxiella burnetii RSA 493
uuuacguuuaaauaa

SEQ ID NO: 570059 - RNA, 17 nt, Coxiella burnetii RSA 493
uuuacguuuaaauaaca

SEQ ID NO: 570060 - RNA, 22 nt, Coxiella burnetii RSA 493
uuuacguuuaaauaacaaaugc

SEQ ID NO: 570061 - RNA, 18 nt, Coxiella burnetii RSA 493
uuuauauguguaacaaaa

SEQ ID NO: 570062 - RNA, 16 nt, Coxiella burnetii RSA 493
uuuauacacaucuuuu

SEQ ID NO: 570063 - RNA, 20 nt, Coxiella burnetii RSA 493
uuuauacacaucuuuuaaaa

SEQ ID NO: 570064 - RNA, 21 nt, Coxiella burnetii RSA 493
uuuauccaaaucggcaaauac

SEQ ID NO: 570065 - RNA, 18 nt, Coxiella burnetii RSA 493
uuuauauuccugaaguaa

SEQ ID NO: 570066 - RNA, 18 nt, Coxiella burnetii RSA 493
uuuauauuuacugagaaa

SEQ ID NO: 570067 - RNA, 21 nt, Coxiella burnetii RSA 493
uuuauggaauggauauuuuaa

SEQ ID NO: 570068 - RNA, 23 nt, Coxiella burnetii RSA 493
uuuaugacgguuauguacucagc

SEQ ID NO: 570069 - RNA, 15 nt, Coxiella burnetii RSA 493
uuuauuaaaaacuau

SEQ ID NO: 570070 - RNA, 17 nt, Coxiella burnetii RSA 493
uuuauucuucugccuuu

SEQ ID NO: 570071 - RNA, 23 nt, Coxiella burnetii RSA 493
uugucggcgauacggugcagaag

SEQ ID NO: 570072 - RNA, 16 nt, Coxiella burnetii RSA 493
uugugaaauaugcacu

SEQ ID NO: 570073 - RNA, 21 nt, Coxiella burnetii RSA 493
uugugagucgccaauaauagu

SEQ ID NO: 570074 - RNA, 19 nt, Coxiella burnetii RSA 493
uuguggagacugcuuuaga

SEQ ID NO: 570075 - RNA, 19 nt, Coxiella burnetii RSA 493
uuguuaacaccuuuuucaa

SEQ ID NO: 570076 - RNA, 14 nt, Coxiella burnetii RSA 493
uuguucauaaaaua

SEQ ID NO: 570077 - RNA, 17 nt, Coxiella burnetii RSA 493
uuguuccaugucuugaa

SEQ ID NO: 570078 - RNA, 19 nt, Coxiella burnetii RSA 493
uuguuccgccauuucccag

SEQ ID NO: 570079 - RNA, 24 nt, Coxiella burnetii RSA 493
uuguucauccagccaaaucgcagu

SEQ ID NO: 570080 - RNA, 21 nt, Coxiella burnetii RSA 493
uuguugaaaaccuacacuuuu

SEQ ID NO: 570081 - RNA, 16 nt, Coxiella burnetii RSA 493
uuguucguaauaauaa

SEQ ID NO: 570082 - RNA, 17 nt, Coxiella burnetii RSA 493
uuguuuucuuacuguuu

SEQ ID NO: 570083 - RNA, 15 nt, Coxiella burnetii RSA 493
uuguuugcuugagua

SEQ ID NO: 570084 - RNA, 18 nt, Coxiella burnetii RSA 493
uuguuuuauaccuuuuuc

SEQ ID NO: 570085 - RNA, 20 nt, Coxiella burnetii RSA 493
uuguuuuauaccuuuuuccc

SEQ ID NO: 570086 - RNA, 21 nt, Coxiella burnetii RSA 493
uugguuugcaaaacuaaauca

SEQ ID NO: 570087 - RNA, 18 nt, Coxiella burnetii RSA 493
uugguuuuugauugccaa

SEQ ID NO: 570088 - RNA, 12 nt, Coxiella burnetii RSA 493
uuguaauuuggg

SEQ ID NO: 570089 - RNA, 13 nt, Coxiella burnetii RSA 493
uuguaauucaaau

SEQ ID NO: 570090 - RNA, 16 nt, Coxiella burnetii RSA 493
uuguagauuagaaaaa

SEQ ID NO: 570091 - RNA, 17 nt, Coxiella burnetii RSA 493
uuguagauuagaaaaag

SEQ ID NO: 570092 - RNA, 13 nt, Coxiella burnetii RSA 493
uuguauaaagguu

SEQ ID NO: 570093 - RNA, 19 nt, Coxiella burnetii RSA 493
uuguauaaagguuuuuccu

SEQ ID NO: 570094 - RNA, 17 nt, Coxiella burnetii RSA 493
uuguacaaaagcgccga

SEQ ID NO: 570095 - RNA, 17 nt, Coxiella burnetii RSA 493
uuguauucuucaauacu

SEQ ID NO: 570096 - RNA, 19 nt, Coxiella burnetii RSA 493
uuguauaguucuaauaauu

SEQ ID NO: 570097 - RNA, 15 nt, Coxiella burnetii RSA 493
uugucaacaaucagu

SEQ ID NO: 570098 - RNA, 15 nt, Coxiella burnetii RSA 493
uugucacaagugugg

SEQ ID NO: 570099 - RNA, 21 nt, Coxiella burnetii RSA 493
uuguccggcguugauuuuuua

SEQ ID NO: 570100 - RNA, 20 nt, Coxiella burnetii RSA 493
uuguccuguucuuuuuccau

SEQ ID NO: 570101 - RNA, 15 nt, Coxiella burnetii RSA 493
uuguccuuuucuauu

SEQ ID NO: 570102 - RNA, 14 nt, Coxiella burnetii RSA 493
uugucgccacuggg

SEQ ID NO: 570103 - RNA, 11 nt, Coxiella burnetii RSA 493
uuccaauaaca

SEQ ID NO: 570104 - RNA, 15 nt, Coxiella burnetii RSA 493
uucccgugcaauugu

SEQ ID NO: 570105 - RNA, 16 nt, Coxiella burnetii RSA 493
uuccgcagccuaaauc

SEQ ID NO: 570106 - RNA, 17 nt, Coxiella burnetii RSA 493
uuccuucaaacagugcg

SEQ ID NO: 570107 - RNA, 16 nt, Coxiella burnetii RSA 493
uuccgucaauuuuucu

SEQ ID NO: 570108 - RNA, 24 nt, Coxiella burnetii RSA 493
uuccugaacaggauuuucauuaau

SEQ ID NO: 570109 - RNA, 21 nt, Coxiella burnetii RSA 493
uuccugaaccuaaauuauaaa

SEQ ID NO: 570110 - RNA, 19 nt, Coxiella burnetii RSA 493
uuccucuucuacuguaagc

SEQ ID NO: 570111 - RNA, 16 nt, Coxiella burnetii RSA 493
uucgauuuuacaauaa

SEQ ID NO: 570112 - RNA, 20 nt, Coxiella burnetii RSA 493
uucgauuuuacaauaaucca

SEQ ID NO: 570113 - RNA, 11 nt, Coxiella burnetii RSA 493
uucgcaaagcu

SEQ ID NO: 570114 - RNA, 17 nt, Coxiella burnetii RSA 493
uucgcaauccucucucu

SEQ ID NO: 570115 - RNA, 15 nt, Coxiella burnetii RSA 493
uucgcaauugaaaaa

SEQ ID NO: 570116 - RNA, 21 nt, Coxiella burnetii RSA 493
uucgauacagccuucaugaau

SEQ ID NO: 570117 - RNA, 19 nt, Coxiella burnetii RSA 493
uucgagaauauauucauau

SEQ ID NO: 570118 - RNA, 21 nt, Coxiella burnetii RSA 493
uucguuucgaaaaauuauuaa

SEQ ID NO: 570119 - RNA, 16 nt, Coxiella burnetii RSA 493
uucggauucucucgcu

SEQ ID NO: 570120 - RNA, 17 nt, Coxiella burnetii RSA 493
uucggauuuugaacagu

SEQ ID NO: 570121 - RNA, 18 nt, Coxiella burnetii RSA 493
uucggcguuaacgguguc

SEQ ID NO: 570122 - RNA, 22 nt, Coxiella burnetii RSA 493
uucucuuucugagcuuguuuuu

SEQ ID NO: 570123 - RNA, 20 nt, Coxiella burnetii RSA 493
uucuccuuaauaaaguuuua

SEQ ID NO: 570124 - RNA, 11 nt, Coxiella burnetii RSA 493
uucuccuugua

SEQ ID NO: 570125 - RNA, 21 nt, Coxiella burnetii RSA 493
uucugcuuuuauuuaagugau

SEQ ID NO: 570126 - RNA, 22 nt, Coxiella burnetii RSA 493
uucuggaagagaguaagucucu

SEQ ID NO: 570127 - RNA, 17 nt, Coxiella burnetii RSA 493
uucugaauuaauuccca

SEQ ID NO: 570128 - RNA, 16 nt, Coxiella burnetii RSA 493
uucugagcuuguuuuu

SEQ ID NO: 570129 - RNA, 21 nt, Coxiella burnetii RSA 493
uucugagcuuguuuuuggcau

SEQ ID NO: 570130 - RNA, 21 nt, Coxiella burnetii RSA 493
uucuagagcaacgauuuuccc

SEQ ID NO: 570131 - RNA, 20 nt, Coxiella burnetii RSA 493
uucuauuuuggcccaacuua

SEQ ID NO: 570132 - RNA, 15 nt, Coxiella burnetii RSA 493
uucuauuuuuuugcc

SEQ ID NO: 570133 - RNA, 23 nt, Coxiella burnetii RSA 493
uucuaucgugccaguauuuuucu

SEQ ID NO: 570134 - RNA, 16 nt, Coxiella burnetii RSA 493
uucucaauagaaaaaa

SEQ ID NO: 570135 - RNA, 21 nt, Coxiella burnetii RSA 493
uucucaaauuuucccaggaaa

SEQ ID NO: 570136 - RNA, 21 nt, Coxiella burnetii RSA 493
uucuccaaagggaccuuuuuu

SEQ ID NO: 570137 - RNA, 16 nt, Coxiella burnetii RSA 493
uucuuauccuuacaaa

SEQ ID NO: 570138 - RNA, 18 nt, Coxiella burnetii RSA 493
uucuuauccuuacaaaaa

SEQ ID NO: 570139 - RNA, 20 nt, Coxiella burnetii RSA 493
uucuuaauuuuuccuuucuu

SEQ ID NO: 570140 - RNA, 11 nt, Coxiella burnetii RSA 493
uucuguaaguu

SEQ ID NO: 570141 - RNA, 14 nt, Coxiella burnetii RSA 493
uucugugaaauaaa

SEQ ID NO: 570142 - RNA, 16 nt, Coxiella burnetii RSA 493
uucugugaaauaaaca

SEQ ID NO: 570143 - RNA, 17 nt, Coxiella burnetii RSA 493
uucugugucauuuugga

SEQ ID NO: 570144 - RNA, 15 nt, Coxiella burnetii RSA 493
uucuucaucuaaauu

SEQ ID NO: 570145 - RNA, 16 nt, Coxiella burnetii RSA 493
uucuuauuuuuaacuc

SEQ ID NO: 570146 - RNA, 12 nt, Coxiella burnetii RSA 493
uucuucucccaa

SEQ ID NO: 570147 - RNA, 17 nt, Coxiella burnetii RSA 493
uucaguucgcuaaauaa

SEQ ID NO: 570148 - RNA, 20 nt, Coxiella burnetii RSA 493
uucaguucgggccuucacuu

SEQ ID NO: 570149 - RNA, 20 nt, Coxiella burnetii RSA 493
uucauaaguccgcuuuuccc

SEQ ID NO: 570150 - RNA, 16 nt, Coxiella burnetii RSA 493
uucauaauuuuauaaa

SEQ ID NO: 570151 - RNA, 15 nt, Coxiella burnetii RSA 493
uucagcuagccauug

SEQ ID NO: 570152 - RNA, 19 nt, Coxiella burnetii RSA 493
uucauauucuucauaggau

SEQ ID NO: 570153 - RNA, 18 nt, Coxiella burnetii RSA 493
uucauaucuuuuucaauu

SEQ ID NO: 570154 - RNA, 17 nt, Coxiella burnetii RSA 493
uucauccagugaaaacc

SEQ ID NO: 570155 - RNA, 18 nt, Coxiella burnetii RSA 493
uucauccaaaauaugaua

SEQ ID NO: 570156 - RNA, 16 nt, Coxiella burnetii RSA 493
uucauccaaaauuuga

SEQ ID NO: 570157 - RNA, 22 nt, Coxiella burnetii RSA 493
uuccaacgcuuguuuuauaccu

SEQ ID NO: 570158 - RNA, 20 nt, Coxiella burnetii RSA 493
uuccaaagcagauaaauguu

SEQ ID NO: 570159 - RNA, 23 nt, Coxiella burnetii RSA 493
uuccaaagcagauaaauguuuuu

SEQ ID NO: 570160 - RNA, 22 nt, Coxiella burnetii RSA 493
uuccaaacuacucucaaaauca

SEQ ID NO: 570161 - RNA, 11 nt, Coxiella burnetii RSA 493
uucauuuuuuu

SEQ ID NO: 570162 - RNA, 20 nt, Coxiella burnetii RSA 493
uuccaaaaacagauuuaaau

SEQ ID NO: 570163 - RNA, 20 nt, Coxiella burnetii RSA 493
uucauugagcgggauauuuu

SEQ ID NO: 570164 - RNA, 14 nt, Coxiella burnetii RSA 493
uucauuaguucuau

SEQ ID NO: 570165 - RNA, 21 nt, Coxiella burnetii RSA 493
uucauuaucaugcauuugauu

SEQ ID NO: 570166 - RNA, 15 nt, Coxiella burnetii RSA 493
uucauuuaauaaauc

SEQ ID NO: 570167 - RNA, 17 nt, Coxiella burnetii RSA 493
uucauuaaauauuucuu

SEQ ID NO: 570168 - RNA, 13 nt, Coxiella burnetii RSA 493
uucauuaaauccg

SEQ ID NO: 570169 - RNA, 16 nt, Coxiella burnetii RSA 493
uucaugagaggaugca

SEQ ID NO: 570170 - RNA, 16 nt, Coxiella burnetii RSA 493
uucaugaaaaagauaa

SEQ ID NO: 570171 - RNA, 20 nt, Coxiella burnetii RSA 493
uucaugacaauuuaauaauu

SEQ ID NO: 570172 - RNA, 18 nt, Coxiella burnetii RSA 493
uucaacacaguucuuaac

SEQ ID NO: 570173 - RNA, 21 nt, Coxiella burnetii RSA 493
uucaaauugcugaauugauaa

SEQ ID NO: 570174 - RNA, 17 nt, Coxiella burnetii RSA 493
uucaacuccugaaaaau

SEQ ID NO: 570175 - RNA, 21 nt, Coxiella burnetii RSA 493
uucaacuccugaaaaauaauu

SEQ ID NO: 570176 - RNA, 20 nt, Coxiella burnetii RSA 493
uucaacuacuugauauuccc

SEQ ID NO: 570177 - RNA, 12 nt, Coxiella burnetii RSA 493
uuauuuuggaua

SEQ ID NO: 570178 - RNA, 12 nt, Coxiella burnetii RSA 493
uuauuuuuaaaa

SEQ ID NO: 570179 - RNA, 14 nt, Coxiella burnetii RSA 493
uuauuuucaaauga

SEQ ID NO: 570180 - RNA, 19 nt, Coxiella burnetii RSA 493
uuauuuucaaaugaauaag

SEQ ID NO: 570181 - RNA, 13 nt, Coxiella burnetii RSA 493
uucaaagugauca

SEQ ID NO: 570182 - RNA, 20 nt, Coxiella burnetii RSA 493
uuaggcagccuaauuuaaug

SEQ ID NO: 570183 - RNA, 14 nt, Coxiella burnetii RSA 493
uuauucccagauaa

SEQ ID NO: 570184 - RNA, 22 nt, Coxiella burnetii RSA 493
uuauucaacaaccguuaucccc

SEQ ID NO: 570185 - RNA, 17 nt, Coxiella burnetii RSA 493
uuauucaacucuuaucu

SEQ ID NO: 570186 - RNA, 17 nt, Coxiella burnetii RSA 493
uuauuccuuuuuuuaau

SEQ ID NO: 570187 - RNA, 18 nt, Coxiella burnetii RSA 493
uuauuccuuuuuuuaaug

SEQ ID NO: 570188 - RNA, 15 nt, Coxiella burnetii RSA 493
uuauucggauucucu

SEQ ID NO: 570189 - RNA, 17 nt, Coxiella burnetii RSA 493
uuauugggauuuaccuu

SEQ ID NO: 570190 - RNA, 22 nt, Coxiella burnetii RSA 493
uucaauuucgggugauaauuga

SEQ ID NO: 570191 - RNA, 16 nt, Coxiella burnetii RSA 493
uucaauuacuuuuaua

SEQ ID NO: 570192 - RNA, 16 nt, Coxiella burnetii RSA 493
uucaauuagcauuuuc

SEQ ID NO: 570193 - RNA, 21 nt, Coxiella burnetii RSA 493
uucaauuagcauuuucuccaa

SEQ ID NO: 570194 - RNA, 17 nt, Coxiella burnetii RSA 493
uucaauggcauuacaaa

SEQ ID NO: 570195 - RNA, 15 nt, Coxiella burnetii RSA 493
uucaagugacguguc

SEQ ID NO: 570196 - RNA, 21 nt, Coxiella burnetii RSA 493
uucaaucgcacccuucuguuu

SEQ ID NO: 570197 - RNA, 22 nt, Coxiella burnetii RSA 493
uucaagguuauugcuauuuucc

SEQ ID NO: 570198 - RNA, 21 nt, Coxiella burnetii RSA 493
uucacucgcaaaaauuucauu

SEQ ID NO: 570199 - RNA, 15 nt, Coxiella burnetii RSA 493
uucacggauacgcuu

SEQ ID NO: 570200 - RNA, 18 nt, Coxiella burnetii RSA 493
uucacuuuucuggcugua

SEQ ID NO: 570201 - RNA, 13 nt, Coxiella burnetii RSA 493
ugggauaauaacu

SEQ ID NO: 570202 - RNA, 17 nt, Coxiella burnetii RSA 493
ugggagugguuauaauu

SEQ ID NO: 570203 - RNA, 23 nt, Coxiella burnetii RSA 493
uggcuuucccuuuccggaaaaag

SEQ ID NO: 570204 - RNA, 13 nt, Coxiella burnetii RSA 493
uggcuuuuuucuu

SEQ ID NO: 570205 - RNA, 17 nt, Coxiella burnetii RSA 493
ugggauuguuuucgaua

SEQ ID NO: 570206 - RNA, 20 nt, Coxiella burnetii RSA 493
ugggaugcgaagcaugcuga

SEQ ID NO: 570207 - RNA, 18 nt, Coxiella burnetii RSA 493
uggcuuuaucaggcgcuc

SEQ ID NO: 570208 - RNA, 15 nt, Coxiella burnetii RSA 493
ugggggaacagagga

SEQ ID NO: 570209 - RNA, 17 nt, Coxiella burnetii RSA 493
ugggcgcguauuuaagg

SEQ ID NO: 570210 - RNA, 18 nt, Coxiella burnetii RSA 493
uggguuuucuuuugaaua

SEQ ID NO: 570211 - RNA, 16 nt, Coxiella burnetii RSA 493
ugguaacaaacuggga

SEQ ID NO: 570212 - RNA, 13 nt, Coxiella burnetii RSA 493
ugguagcuaccag

SEQ ID NO: 570213 - RNA, 18 nt, Coxiella burnetii RSA 493
ugguccguggcaguuaaa

SEQ ID NO: 570214 - RNA, 23 nt, Coxiella burnetii RSA 493
uggucggccaaauggauuuccac

SEQ ID NO: 570215 - RNA, 19 nt, Coxiella burnetii RSA 493
uggucacaugauuuuucug

SEQ ID NO: 570216 - RNA, 14 nt, Coxiella burnetii RSA 493
uggucaaagagauu

SEQ ID NO: 570217 - RNA, 20 nt, Coxiella burnetii RSA 493
uggccguagaaccaaaagca

SEQ ID NO: 570218 - RNA, 20 nt, Coxiella burnetii RSA 493
uggccuuugcgguuaaaaaa

SEQ ID NO: 570219 - RNA, 17 nt, Coxiella burnetii RSA 493
uggccggcaaugcacca

SEQ ID NO: 570220 - RNA, 17 nt, Coxiella burnetii RSA 493
uggccaaacuaaucugc

SEQ ID NO: 570221 - RNA, 16 nt, Coxiella burnetii RSA 493
uggccagugccugugc

SEQ ID NO: 570222 - RNA, 16 nt, Coxiella burnetii RSA 493
uggauuucaucuugcu

SEQ ID NO: 570223 - RNA, 19 nt, Coxiella burnetii RSA 493
uguaaaauacuggcaauaa

SEQ ID NO: 570224 - RNA, 21 nt, Coxiella burnetii RSA 493
ugguuuaacggaaaugcuuuc

SEQ ID NO: 570225 - RNA, 13 nt, Coxiella burnetii RSA 493
uguacauuuuuca

SEQ ID NO: 570226 - RNA, 14 nt, Coxiella burnetii RSA 493
uguacauuuuucaa

SEQ ID NO: 570227 - RNA, 18 nt, Coxiella burnetii RSA 493
uguacuuucacuaauuau

SEQ ID NO: 570228 - RNA, 22 nt, Coxiella burnetii RSA 493
uguaauccuuguugaauuccuu

SEQ ID NO: 570229 - RNA, 16 nt, Coxiella burnetii RSA 493
uguaacuuuuccaucu

SEQ ID NO: 570230 - RNA, 24 nt, Coxiella burnetii RSA 493
uguauaaguguggucugaaaauaa

SEQ ID NO: 570231 - RNA, 14 nt, Coxiella burnetii RSA 493
uguauaaagguuuu

SEQ ID NO: 570232 - RNA, 18 nt, Coxiella burnetii RSA 493
uguauggcgccugacaaa

SEQ ID NO: 570233 - RNA, 13 nt, Coxiella burnetii RSA 493
ugucaaaauuauu

SEQ ID NO: 570234 - RNA, 21 nt, Coxiella burnetii RSA 493
ugucacguuaucauucuuauc

SEQ ID NO: 570235 - RNA, 16 nt, Coxiella burnetii RSA 493
ugucauaaucacaaaa

SEQ ID NO: 570236 - RNA, 14 nt, Coxiella burnetii RSA 493
ugucauauuaauau

SEQ ID NO: 570237 - RNA, 17 nt, Coxiella burnetii RSA 493
ugucauauuaauauuaa

SEQ ID NO: 570238 - RNA, 18 nt, Coxiella burnetii RSA 493
ugucauauuaauauuaaa

SEQ ID NO: 570239 - RNA, 14 nt, Coxiella burnetii RSA 493
ugucaucaauacca

SEQ ID NO: 570240 - RNA, 20 nt, Coxiella burnetii RSA 493
ugucucacaacauuccuuuc

SEQ ID NO: 570241 - RNA, 20 nt, Coxiella burnetii RSA 493
ugucauguucaaucgagucc

SEQ ID NO: 570242 - RNA, 20 nt, Coxiella burnetii RSA 493
ugugccacuuucgauaaauu

SEQ ID NO: 570243 - RNA, 13 nt, Coxiella burnetii RSA 493
ugugcggauuaaa

SEQ ID NO: 570244 - RNA, 16 nt, Coxiella burnetii RSA 493
ugugagucgccaauaa

SEQ ID NO: 570245 - RNA, 21 nt, Coxiella burnetii RSA 493
uguggcgaagccacacaacca

SEQ ID NO: 570246 - RNA, 18 nt, Coxiella burnetii RSA 493
ugugcgguauuuuuccug

SEQ ID NO: 570247 - RNA, 15 nt, Coxiella burnetii RSA 493
uguggaucauccgca

SEQ ID NO: 570248 - RNA, 13 nt, Coxiella burnetii RSA 493
uguggauuaugug

SEQ ID NO: 570249 - RNA, 18 nt, Coxiella burnetii RSA 493
uguuaauucuuuuuuuua

SEQ ID NO: 570250 - RNA, 17 nt, Coxiella burnetii RSA 493
uguuaauccacuuaaaa

SEQ ID NO: 570251 - RNA, 13 nt, Coxiella burnetii RSA 493
uguguuuuaauuc

SEQ ID NO: 570252 - RNA, 20 nt, Coxiella burnetii RSA 493
uguuaaaauccgcuuuauuu

SEQ ID NO: 570253 - RNA, 23 nt, Coxiella burnetii RSA 493
uuaccauuuugacaaacaguuag

SEQ ID NO: 570254 - RNA, 12 nt, Coxiella burnetii RSA 493
uuacauaagaaa

SEQ ID NO: 570255 - RNA, 13 nt, Coxiella burnetii RSA 493
uuacauauuucuu

SEQ ID NO: 570256 - RNA, 17 nt, Coxiella burnetii RSA 493
uuacauauuucuuuucu

SEQ ID NO: 570257 - RNA, 21 nt, Coxiella burnetii RSA 493
uuacauauuucuuuucuguuu

SEQ ID NO: 570258 - RNA, 16 nt, Coxiella burnetii RSA 493
uuaccuaacucaaccu

SEQ ID NO: 570259 - RNA, 19 nt, Coxiella burnetii RSA 493
uuaauugcugauauuuuuu

SEQ ID NO: 570260 - RNA, 21 nt, Coxiella burnetii RSA 493
uuaauugcuuccuuaaagcaa

SEQ ID NO: 570261 - RNA, 13 nt, Coxiella burnetii RSA 493
uuaauuucauaaa

SEQ ID NO: 570262 - RNA, 17 nt, Coxiella burnetii RSA 493
uuaaucucgauuuuggu

SEQ ID NO: 570263 - RNA, 13 nt, Coxiella burnetii RSA 493
uuaaugaaaaaua

SEQ ID NO: 570264 - RNA, 22 nt, Coxiella burnetii RSA 493
uuaaugaaaaauagggcuagua

SEQ ID NO: 570265 - RNA, 16 nt, Coxiella burnetii RSA 493
uuaaucuuccauuaau

SEQ ID NO: 570266 - RNA, 18 nt, Coxiella burnetii RSA 493
uuaaucuuccauuaauuu

SEQ ID NO: 570267 - RNA, 14 nt, Coxiella burnetii RSA 493
uuacaaaaauacuu

SEQ ID NO: 570268 - RNA, 21 nt, Coxiella burnetii RSA 493
uuacaccuaagagaaaaaacc

SEQ ID NO: 570269 - RNA, 18 nt, Coxiella burnetii RSA 493
uuagcaaagccagaagua

SEQ ID NO: 570270 - RNA, 17 nt, Coxiella burnetii RSA 493
uuagcguaaucaucaau

SEQ ID NO: 570271 - RNA, 18 nt, Coxiella burnetii RSA 493
uuagcguaaucaucaauc

SEQ ID NO: 570272 - RNA, 13 nt, Coxiella burnetii RSA 493
uuagacauuuuuc

SEQ ID NO: 570273 - RNA, 19 nt, Coxiella burnetii RSA 493
uuagaaugccggcuaauuu

SEQ ID NO: 570274 - RNA, 19 nt, Coxiella burnetii RSA 493
uuagaaaagcgcuuuaauc

SEQ ID NO: 570275 - RNA, 20 nt, Coxiella burnetii RSA 493
uuacgcuauuggauuuacuu

SEQ ID NO: 570276 - RNA, 19 nt, Coxiella burnetii RSA 493
uuaaagcugcuuuuuaaaa

SEQ ID NO: 570277 - RNA, 19 nt, Coxiella burnetii RSA 493
uuaaagugaugauuaaacg

SEQ ID NO: 570278 - RNA, 21 nt, Coxiella burnetii RSA 493
uuaaauaagggauaaaacaca

SEQ ID NO: 570279 - RNA, 18 nt, Coxiella burnetii RSA 493
uuaaauaacuuuacuaaa

SEQ ID NO: 570280 - RNA, 14 nt, Coxiella burnetii RSA 493
uuaaauauaauuga

SEQ ID NO: 570281 - RNA, 19 nt, Coxiella burnetii RSA 493
uuaaaucauaggggguuaa

SEQ ID NO: 570282 - RNA, 18 nt, Coxiella burnetii RSA 493
uuaaauccgagugggagc

SEQ ID NO: 570283 - RNA, 13 nt, Coxiella burnetii RSA 493
uuaaauuuaaucu

SEQ ID NO: 570284 - RNA, 12 nt, Coxiella burnetii RSA 493
uuaaauuuuuca

SEQ ID NO: 570285 - RNA, 17 nt, Coxiella burnetii RSA 493
uuaacaacgaaaccuug

SEQ ID NO: 570286 - RNA, 20 nt, Coxiella burnetii RSA 493
uuaaaugcgguacuuaagaa

SEQ ID NO: 570287 - RNA, 21 nt, Coxiella burnetii RSA 493
uuaaaugcgguacuuaagaaa

SEQ ID NO: 570288 - RNA, 13 nt, Coxiella burnetii RSA 493
uuaaaucuuccaa

SEQ ID NO: 570289 - RNA, 17 nt, Coxiella burnetii RSA 493
uuaaaucuuccaauuuu

SEQ ID NO: 570290 - RNA, 20 nt, Coxiella burnetii RSA 493
uuaaaucuuuggguauaaau

SEQ ID NO: 570291 - RNA, 16 nt, Coxiella burnetii RSA 493
uuaaaugaauuacuuu

SEQ ID NO: 570292 - RNA, 15 nt, Coxiella burnetii RSA 493
uuaaaugcaacgaug

SEQ ID NO: 570293 - RNA, 20 nt, Coxiella burnetii RSA 493
uuaauaauguuauuaaacaa

SEQ ID NO: 570294 - RNA, 18 nt, Coxiella burnetii RSA 493
uuaauacaggaaaaagau

SEQ ID NO: 570295 - RNA, 20 nt, Coxiella burnetii RSA 493
uuaauacaggaaaaagauaa

SEQ ID NO: 570296 - RNA, 18 nt, Coxiella burnetii RSA 493
uuaauacauucuucagua

SEQ ID NO: 570297 - RNA, 23 nt, Coxiella burnetii RSA 493
uuaaucaucugcgggauuaauuu

SEQ ID NO: 570298 - RNA, 15 nt, Coxiella burnetii RSA 493
uuaaucauauaauuu

SEQ ID NO: 570299 - RNA, 16 nt, Coxiella burnetii RSA 493
uuaaguagcuaaaaaa

SEQ ID NO: 570300 - RNA, 21 nt, Coxiella burnetii RSA 493
uuaaggccaauuccaauaauu

SEQ ID NO: 570301 - RNA, 23 nt, Coxiella burnetii RSA 493
uuaauaaagugccgcgaauacgc

SEQ ID NO: 570302 - RNA, 20 nt, Coxiella burnetii RSA 493
uuaauaaaucaauuaaauuu

SEQ ID NO: 570303 - RNA, 12 nt, Coxiella burnetii RSA 493
uuaacuuugcaa

SEQ ID NO: 570304 - RNA, 12 nt, Coxiella burnetii RSA 493
uuaagaaaaacc

SEQ ID NO: 570305 - RNA, 19 nt, Coxiella burnetii RSA 493
uuaacauuauuacauauuu

SEQ ID NO: 570306 - RNA, 22 nt, Coxiella burnetii RSA 493
uuaacggaaaugcuuucacuuc

SEQ ID NO: 570307 - RNA, 16 nt, Coxiella burnetii RSA 493
uguuuuacguuuaaau

SEQ ID NO: 570308 - RNA, 13 nt, Coxiella burnetii RSA 493
uguuuucagauuu

SEQ ID NO: 570309 - RNA, 17 nt, Coxiella burnetii RSA 493
uguuuggccggugguuu

SEQ ID NO: 570310 - RNA, 12 nt, Coxiella burnetii RSA 493
uguuuuaaaauu

SEQ ID NO: 570311 - RNA, 24 nt, Coxiella burnetii RSA 493
uguuuuggcaucgagaagucgcuc

SEQ ID NO: 570312 - RNA, 22 nt, Coxiella burnetii RSA 493
uguuuuguauaguucuaauaau

SEQ ID NO: 570313 - RNA, 15 nt, Coxiella burnetii RSA 493
uguuuugaucagaga

SEQ ID NO: 570314 - RNA, 23 nt, Coxiella burnetii RSA 493
uguuuugcauccgaacuaauggu

SEQ ID NO: 570315 - RNA, 12 nt, Coxiella burnetii RSA 493
uguuuuuuaaua

SEQ ID NO: 570316 - RNA, 15 nt, Coxiella burnetii RSA 493
uguuucgaaauauag

SEQ ID NO: 570317 - RNA, 14 nt, Coxiella burnetii RSA 493
uguuuauuuucaug

SEQ ID NO: 570318 - RNA, 21 nt, Coxiella burnetii RSA 493
uguuucaauuagcauuuucuc

SEQ ID NO: 570319 - RNA, 24 nt, Coxiella burnetii RSA 493
uguuugcuugaguaaccucuccau

SEQ ID NO: 570320 - RNA, 16 nt, Coxiella burnetii RSA 493
uguuugaaaaaauacc

SEQ ID NO: 570321 - RNA, 18 nt, Coxiella burnetii RSA 493
uguuugauuuguucuaaa

SEQ ID NO: 570322 - RNA, 19 nt, Coxiella burnetii RSA 493
uguuugauuuguucuaaau

SEQ ID NO: 570323 - RNA, 19 nt, Coxiella burnetii RSA 493
uguuucuagagcaacgauu

SEQ ID NO: 570324 - RNA, 13 nt, Coxiella burnetii RSA 493
uguuucuaauaug

SEQ ID NO: 570325 - RNA, 17 nt, Coxiella burnetii RSA 493
uuaaacgcuucaaagug

SEQ ID NO: 570326 - RNA, 17 nt, Coxiella burnetii RSA 493
uuaaaauuucuuuccag

SEQ ID NO: 570327 - RNA, 18 nt, Coxiella burnetii RSA 493
uuaaaauuucuuuccagc

SEQ ID NO: 570328 - RNA, 19 nt, Coxiella burnetii RSA 493
uuaaaauuacuuuauuacc

SEQ ID NO: 570329 - RNA, 13 nt, Coxiella burnetii RSA 493
uuaaacagucuuc

SEQ ID NO: 570330 - RNA, 13 nt, Coxiella burnetii RSA 493
uuaaaaaaaauac

SEQ ID NO: 570331 - RNA, 17 nt, Coxiella burnetii RSA 493
uguuuuuuuucagcaga

SEQ ID NO: 570332 - RNA, 19 nt, Coxiella burnetii RSA 493
uuaaaaaaccgacuuuuua

SEQ ID NO: 570333 - RNA, 11 nt, Coxiella burnetii RSA 493
uuaaaaaagaa

SEQ ID NO: 570334 - RNA, 14 nt, Coxiella burnetii RSA 493
uuaaaaaagaaaau

SEQ ID NO: 570335 - RNA, 15 nt, Coxiella burnetii RSA 493
uuaaaaaagaaaaua

SEQ ID NO: 570336 - RNA, 21 nt, Coxiella burnetii RSA 493
uuaaaaauaaauuaauuaucc

SEQ ID NO: 570337 - RNA, 12 nt, Coxiella burnetii RSA 493
uuaaaaacaauu

SEQ ID NO: 570338 - RNA, 15 nt, Coxiella burnetii RSA 493
uuaaaacaagacaac

SEQ ID NO: 570339 - RNA, 12 nt, Coxiella burnetii RSA 493
uuaaaaauauuu

SEQ ID NO: 570340 - RNA, 17 nt, Coxiella burnetii RSA 493
uuaaaaauuuuaaaaaa

SEQ ID NO: 570341 - RNA, 19 nt, Coxiella burnetii RSA 493
uuaaaaauuuuaaaaaaau

SEQ ID NO: 570342 - RNA, 19 nt, Coxiella burnetii RSA 493
uuaaaagacguaccauuaa

SEQ ID NO: 570343 - RNA, 21 nt, Coxiella burnetii RSA 493
uuaaaagacguaccauuaaaa

SEQ ID NO: 570344 - RNA, 17 nt, Coxiella burnetii RSA 493
uuaaaauaauccaaggg

SEQ ID NO: 570345 - RNA, 15 nt, Coxiella burnetii RSA 493
uguuauaaaacuucc

SEQ ID NO: 570346 - RNA, 14 nt, Coxiella burnetii RSA 493
uguuagcuuuucuu

SEQ ID NO: 570347 - RNA, 17 nt, Coxiella burnetii RSA 493
uguuauccgguuuuggu

SEQ ID NO: 570348 - RNA, 17 nt, Coxiella burnetii RSA 493
uguuccuuacucccgaa

SEQ ID NO: 570349 - RNA, 14 nt, Coxiella burnetii RSA 493
uguucggaauauaa

SEQ ID NO: 570350 - RNA, 18 nt, Coxiella burnetii RSA 493
uguucggaauauaauucu

SEQ ID NO: 570351 - RNA, 22 nt, Coxiella burnetii RSA 493
uguucuuuuuccauguuuacau

SEQ ID NO: 570352 - RNA, 17 nt, Coxiella burnetii RSA 493
uguucuugcgacagucu

SEQ ID NO: 570353 - RNA, 14 nt, Coxiella burnetii RSA 493
uguugaaaaccuac

SEQ ID NO: 570354 - RNA, 20 nt, Coxiella burnetii RSA 493
uguugaacagagugaugaca

SEQ ID NO: 570355 - RNA, 16 nt, Coxiella burnetii RSA 493
uguugaauuccuuguu

SEQ ID NO: 570356 - RNA, 21 nt, Coxiella burnetii RSA 493
uguugaauuccuuguugaauu

SEQ ID NO: 570357 - RNA, 13 nt, Coxiella burnetii RSA 493
uguugagcaaagc

SEQ ID NO: 570358 - RNA, 22 nt, Coxiella burnetii RSA 493
uguuuaaagcugcuuuuuaaaa

SEQ ID NO: 570359 - RNA, 22 nt, Coxiella burnetii RSA 493
uguuuaaucgcuccuaaauuuu

SEQ ID NO: 570360 - RNA, 15 nt, Coxiella burnetii RSA 493
uguuuacauuaaggc

SEQ ID NO: 570361 - RNA, 18 nt, Coxiella burnetii RSA 493
uguuuacauuaaggccaa

SEQ ID NO: 570362 - RNA, 21 nt, Coxiella burnetii RSA 493
uguugggcuucgcaaagcuca

SEQ ID NO: 570363 - RNA, 13 nt, Coxiella burnetii RSA 493
ugauuuuaaaaau

SEQ ID NO: 570364 - RNA, 15 nt, Coxiella burnetii RSA 493
ugauuucucuuuuaa

SEQ ID NO: 570365 - RNA, 13 nt, Coxiella burnetii RSA 493
ugcacgaaauaau

SEQ ID NO: 570366 - RNA, 16 nt, Coxiella burnetii RSA 493
ugcacgaugucuuuaa

SEQ ID NO: 570367 - RNA, 17 nt, Coxiella burnetii RSA 493
ugcacgauuuuauaaac

SEQ ID NO: 570368 - RNA, 22 nt, Coxiella burnetii RSA 493
ugcacgccuccagggcuuguuc

SEQ ID NO: 570369 - RNA, 12 nt, Coxiella burnetii RSA 493
ugcagaaacaau

SEQ ID NO: 570370 - RNA, 14 nt, Coxiella burnetii RSA 493
ugcagaguuauuau

SEQ ID NO: 570371 - RNA, 18 nt, Coxiella burnetii RSA 493
ugcagcgaagcgaaauac

SEQ ID NO: 570372 - RNA, 18 nt, Coxiella burnetii RSA 493
ugcauauauuccacaauu

SEQ ID NO: 570373 - RNA, 22 nt, Coxiella burnetii RSA 493
ugcauauauuccacaauuuucc

SEQ ID NO: 570374 - RNA, 14 nt, Coxiella burnetii RSA 493
ugcauuuuuaaaag

SEQ ID NO: 570375 - RNA, 16 nt, Coxiella burnetii RSA 493
ugcauuuuuaaaagug

SEQ ID NO: 570376 - RNA, 13 nt, Coxiella burnetii RSA 493
ugcauuaaucuuc

SEQ ID NO: 570377 - RNA, 20 nt, Coxiella burnetii RSA 493
ugccaauauaaauaaucuuc

SEQ ID NO: 570378 - RNA, 20 nt, Coxiella burnetii RSA 493
ugccacaauauacgcaauug

SEQ ID NO: 570379 - RNA, 22 nt, Coxiella burnetii RSA 493
ugccacuuucgauaaauuuuga

SEQ ID NO: 570380 - RNA, 23 nt, Coxiella burnetii RSA 493
ugccagccacaaagaauuuuucc

SEQ ID NO: 570381 - RNA, 20 nt, Coxiella burnetii RSA 493
ugccauuugcggaaaaggag

SEQ ID NO: 570382 - RNA, 21 nt, Coxiella burnetii RSA 493
ugccaucgccaugagugcauu

SEQ ID NO: 570383 - RNA, 21 nt, Coxiella burnetii RSA 493
ugccauaaugccuccuugcaa

SEQ ID NO: 570384 - RNA, 18 nt, Coxiella burnetii RSA 493
ugcccauucuuucauuaa

SEQ ID NO: 570385 - RNA, 22 nt, Coxiella burnetii RSA 493
ugcccgggugguuaacuucauu

SEQ ID NO: 570386 - RNA, 16 nt, Coxiella burnetii RSA 493
ugcccucaguugucau

SEQ ID NO: 570387 - RNA, 20 nt, Coxiella burnetii RSA 493
ugcccucaguugucauguaa

SEQ ID NO: 570388 - RNA, 18 nt, Coxiella burnetii RSA 493
ugccgcaacaagaaaaau

SEQ ID NO: 570389 - RNA, 20 nt, Coxiella burnetii RSA 493
ugccgcaacaagaaaaauuc

SEQ ID NO: 570390 - RNA, 13 nt, Coxiella burnetii RSA 493
ugccgccgaaauu

SEQ ID NO: 570391 - RNA, 19 nt, Coxiella burnetii RSA 493
ugccgccaggcuucauaca

SEQ ID NO: 570392 - RNA, 20 nt, Coxiella burnetii RSA 493
ugccgccaggcuucauacag

SEQ ID NO: 570393 - RNA, 17 nt, Coxiella burnetii RSA 493
ugccgccuguaaggucu

SEQ ID NO: 570394 - RNA, 17 nt, Coxiella burnetii RSA 493
ugccgcgguaaggaaca

SEQ ID NO: 570395 - RNA, 18 nt, Coxiella burnetii RSA 493
ugccgcgguaaggaacag

SEQ ID NO: 570396 - RNA, 16 nt, Coxiella burnetii RSA 493
ugcgauuguuuucuua

SEQ ID NO: 570397 - RNA, 12 nt, Coxiella burnetii RSA 493
ugcgauuaaaag

SEQ ID NO: 570398 - RNA, 13 nt, Coxiella burnetii RSA 493
ugcgauuaaaagu

SEQ ID NO: 570399 - RNA, 16 nt, Coxiella burnetii RSA 493
ugcgauucuuuuucgu

SEQ ID NO: 570400 - RNA, 23 nt, Coxiella burnetii RSA 493
ugcgacgaauaccccuuuuguua

SEQ ID NO: 570401 - RNA, 17 nt, Coxiella burnetii RSA 493
aaauggucggccaaaug

SEQ ID NO: 570402 - RNA, 16 nt, Coxiella burnetii RSA 493
aaauggugaaaagcca

SEQ ID NO: 570403 - RNA, 17 nt, Coxiella burnetii RSA 493
ugcgccuacaaauacca

SEQ ID NO: 570404 - RNA, 18 nt, Coxiella burnetii RSA 493
ugcgcauccgccccgaaa

SEQ ID NO: 570405 - RNA, 15 nt, Coxiella burnetii RSA 493
aaauggauuuccacu

SEQ ID NO: 570406 - RNA, 13 nt, Coxiella burnetii RSA 493
ugcgcguauaauu

SEQ ID NO: 570407 - RNA, 14 nt, Coxiella burnetii RSA 493
ugaccuugccaucc

SEQ ID NO: 570408 - RNA, 21 nt, Coxiella burnetii RSA 493
ugacuugucaauuuaccucca

SEQ ID NO: 570409 - RNA, 13 nt, Coxiella burnetii RSA 493
ugacuuuaacucg

SEQ ID NO: 570410 - RNA, 17 nt, Coxiella burnetii RSA 493
ugagaaacgugagagag

SEQ ID NO: 570411 - RNA, 23 nt, Coxiella burnetii RSA 493
ugagaaucucuuguauggcuggu

SEQ ID NO: 570412 - RNA, 18 nt, Coxiella burnetii RSA 493
ugagaaaacuuuucaucc

SEQ ID NO: 570413 - RNA, 16 nt, Coxiella burnetii RSA 493
ugagcaucuuuucuga

SEQ ID NO: 570414 - RNA, 23 nt, Coxiella burnetii RSA 493
ugagcaucuuuucugaaacauca

SEQ ID NO: 570415 - RNA, 13 nt, Coxiella burnetii RSA 493
ugagcaguugaac

SEQ ID NO: 570416 - RNA, 20 nt, Coxiella burnetii RSA 493
ugagguugcaugaggaguca

SEQ ID NO: 570417 - RNA, 18 nt, Coxiella burnetii RSA 493
ugagguuaauaaaaaggu

SEQ ID NO: 570418 - RNA, 21 nt, Coxiella burnetii RSA 493
ugagguuacauuaaauccaga

SEQ ID NO: 570419 - RNA, 16 nt, Coxiella burnetii RSA 493
ugaguaaucagcaucg

SEQ ID NO: 570420 - RNA, 21 nt, Coxiella burnetii RSA 493
ugaguagggugcgauugaaag

SEQ ID NO: 570421 - RNA, 21 nt, Coxiella burnetii RSA 493
ugagcuugcgaagcccaacag

SEQ ID NO: 570422 - RNA, 13 nt, Coxiella burnetii RSA 493
ugaggaaaauaag

SEQ ID NO: 570423 - RNA, 14 nt, Coxiella burnetii RSA 493
ugagcgccuuuuuu

SEQ ID NO: 570424 - RNA, 14 nt, Coxiella burnetii RSA 493
ugaguauucaucaa

SEQ ID NO: 570425 - RNA, 17 nt, Coxiella burnetii RSA 493
ugauaaagcguuucucg

SEQ ID NO: 570426 - RNA, 17 nt, Coxiella burnetii RSA 493
ugaguucugucacuaau

SEQ ID NO: 570427 - RNA, 22 nt, Coxiella burnetii RSA 493
ugaguugucauauuaauauuaa

SEQ ID NO: 570428 - RNA, 15 nt, Coxiella burnetii RSA 493
ugaucuaacguuuug

SEQ ID NO: 570429 - RNA, 16 nt, Coxiella burnetii RSA 493
ugaucaaguuucuccc

SEQ ID NO: 570430 - RNA, 16 nt, Coxiella burnetii RSA 493
ugaucaaaaauaaugc

SEQ ID NO: 570431 - RNA, 18 nt, Coxiella burnetii RSA 493
ugauauucccaugcgcau

SEQ ID NO: 570432 - RNA, 16 nt, Coxiella burnetii RSA 493
ugauauucccucuuua

SEQ ID NO: 570433 - RNA, 17 nt, Coxiella burnetii RSA 493
ugaugcguuuuuuuauu

SEQ ID NO: 570434 - RNA, 22 nt, Coxiella burnetii RSA 493
ugaugcauuaaucauuacagac

SEQ ID NO: 570435 - RNA, 17 nt, Coxiella burnetii RSA 493
ugaugaaaucguuuugu

SEQ ID NO: 570436 - RNA, 20 nt, Coxiella burnetii RSA 493
ugaucuugggcaaaaaaaga

SEQ ID NO: 570437 - RNA, 14 nt, Coxiella burnetii RSA 493
ugauugaaaauccc

SEQ ID NO: 570438 - RNA, 21 nt, Coxiella burnetii RSA 493
ugauugaaaaucccuuuuaau

SEQ ID NO: 570439 - RNA, 22 nt, Coxiella burnetii RSA 493
ugauugaaaaucccuuuuaauu

SEQ ID NO: 570440 - RNA, 21 nt, Coxiella burnetii RSA 493
ugauugcggcucaauuauuaa

SEQ ID NO: 570441 - RNA, 12 nt, Coxiella burnetii RSA 493
ugauuucguaaa

SEQ ID NO: 570442 - RNA, 13 nt, Coxiella burnetii RSA 493
ugauuucauccuc

SEQ ID NO: 570443 - RNA, 14 nt, Coxiella burnetii RSA 493
ugauucauuaucau

SEQ ID NO: 570444 - RNA, 11 nt, Coxiella burnetii RSA 493
ugauuauagaa

SEQ ID NO: 570445 - RNA, 15 nt, Coxiella burnetii RSA 493
ugauuaaauugcucu

SEQ ID NO: 570446 - RNA, 22 nt, Coxiella burnetii RSA 493
ugauguauccuaauaaaaauau

SEQ ID NO: 570447 - RNA, 18 nt, Coxiella burnetii RSA 493
ugaugucaucuaucgucc

SEQ ID NO: 570448 - RNA, 16 nt, Coxiella burnetii RSA 493
ugaugugaaaaauucu

SEQ ID NO: 570449 - RNA, 20 nt, Coxiella burnetii RSA 493
ugauguaaggcaucuuuuuc

SEQ ID NO: 570450 - RNA, 19 nt, Coxiella burnetii RSA 493
ugaauuaaccaaucaauaa

SEQ ID NO: 570451 - RNA, 13 nt, Coxiella burnetii RSA 493
ugaauuaaauaua

SEQ ID NO: 570452 - RNA, 14 nt, Coxiella burnetii RSA 493
ugaauuacuuucag

SEQ ID NO: 570453 - RNA, 20 nt, Coxiella burnetii RSA 493
ugaauucccuuuugaauucc

SEQ ID NO: 570454 - RNA, 20 nt, Coxiella burnetii RSA 493
ugaauuccuuguugaauucc

SEQ ID NO: 570455 - RNA, 14 nt, Coxiella burnetii RSA 493
ugaauuuauuucug

SEQ ID NO: 570456 - RNA, 22 nt, Coxiella burnetii RSA 493
ugaauuugcuuguuaaguagau

SEQ ID NO: 570457 - RNA, 17 nt, Coxiella burnetii RSA 493
ugaaugcuggagugaga

SEQ ID NO: 570458 - RNA, 16 nt, Coxiella burnetii RSA 493
ugaauccucaguaaaa

SEQ ID NO: 570459 - RNA, 16 nt, Coxiella burnetii RSA 493
ugaauuuuugccagga

SEQ ID NO: 570460 - RNA, 16 nt, Coxiella burnetii RSA 493
ugacagcucugaaagc

SEQ ID NO: 570461 - RNA, 22 nt, Coxiella burnetii RSA 493
ugacagcucugaaagcaauagg

SEQ ID NO: 570462 - RNA, 17 nt, Coxiella burnetii RSA 493
ugacaccuagccaaauc

SEQ ID NO: 570463 - RNA, 21 nt, Coxiella burnetii RSA 493
ugaccaucaaucaaaugaacu

SEQ ID NO: 570464 - RNA, 14 nt, Coxiella burnetii RSA 493
ugacauaucauucc

SEQ ID NO: 570465 - RNA, 16 nt, Coxiella burnetii RSA 493
ugaccaugguuucuuu

SEQ ID NO: 570466 - RNA, 15 nt, Coxiella burnetii RSA 493
ugaaagaauuucucg

SEQ ID NO: 570467 - RNA, 13 nt, Coxiella burnetii RSA 493
ugaaaguagaaaa

SEQ ID NO: 570468 - RNA, 20 nt, Coxiella burnetii RSA 493
ugaaauaggcuuucuuuuuc

SEQ ID NO: 570469 - RNA, 19 nt, Coxiella burnetii RSA 493
ugaaauaugcacuaaaccu

SEQ ID NO: 570470 - RNA, 19 nt, Coxiella burnetii RSA 493
ugaaccaaaaggaaugaau

SEQ ID NO: 570471 - RNA, 21 nt, Coxiella burnetii RSA 493
ugaaccaaaaggaaugaauag

SEQ ID NO: 570472 - RNA, 14 nt, Coxiella burnetii RSA 493
ugaaauuuuuuuuc

SEQ ID NO: 570473 - RNA, 23 nt, Coxiella burnetii RSA 493
ugaaauuuuuuuucuucuugcau

SEQ ID NO: 570474 - RNA, 16 nt, Coxiella burnetii RSA 493
ugaaaucaauuuucuu

SEQ ID NO: 570475 - RNA, 19 nt, Coxiella burnetii RSA 493
ugaaauggcgcuuucguua

SEQ ID NO: 570476 - RNA, 18 nt, Coxiella burnetii RSA 493
ugaaauuucucauauauu

SEQ ID NO: 570477 - RNA, 21 nt, Coxiella burnetii RSA 493
ugaagaguaaaaaaccaauac

SEQ ID NO: 570478 - RNA, 17 nt, Coxiella burnetii RSA 493
ugaagcuauccaaauaa

SEQ ID NO: 570479 - RNA, 23 nt, Coxiella burnetii RSA 493
ugaagcuauccaaauaaucggga

SEQ ID NO: 570480 - RNA, 19 nt, Coxiella burnetii RSA 493
ugaagcgcggcgaaauaca

SEQ ID NO: 570481 - RNA, 13 nt, Coxiella burnetii RSA 493
ugaauagaaaaac

SEQ ID NO: 570482 - RNA, 22 nt, Coxiella burnetii RSA 493
ugaauaccaugacggccauggc

SEQ ID NO: 570483 - RNA, 14 nt, Coxiella burnetii RSA 493
ugaauagccagcgc

SEQ ID NO: 570484 - RNA, 16 nt, Coxiella burnetii RSA 493
ugaauaauauuguaaa

SEQ ID NO: 570485 - RNA, 13 nt, Coxiella burnetii RSA 493
ugaauaagcugau

SEQ ID NO: 570486 - RNA, 16 nt, Coxiella burnetii RSA 493
ugaauaagcugauuaa

SEQ ID NO: 570487 - RNA, 22 nt, Coxiella burnetii RSA 493
ugaauaagcugauuaaggugga

SEQ ID NO: 570488 - RNA, 12 nt, Coxiella burnetii RSA 493
ugaauaagcaaa

SEQ ID NO: 570489 - RNA, 20 nt, Coxiella burnetii RSA 493
ucgccuucuugccgcccuug

SEQ ID NO: 570490 - RNA, 22 nt, Coxiella burnetii RSA 493
ucgccuucuugccgcccuugcu

SEQ ID NO: 570491 - RNA, 23 nt, Coxiella burnetii RSA 493
ucgcgaaauuuaauaaaauuaaa

SEQ ID NO: 570492 - RNA, 22 nt, Coxiella burnetii RSA 493
ucgccuguggcaauuaugaaaa

SEQ ID NO: 570493 - RNA, 23 nt, Coxiella burnetii RSA 493
ucgccuguggcaauuaugaaaac

SEQ ID NO: 570494 - RNA, 14 nt, Coxiella burnetii RSA 493
ucgcgcaaguuuug

SEQ ID NO: 570495 - RNA, 20 nt, Coxiella burnetii RSA 493
ucgccuccggcgcgcgcuug

SEQ ID NO: 570496 - RNA, 12 nt, Coxiella burnetii RSA 493
uccauacuaauu

SEQ ID NO: 570497 - RNA, 13 nt, Coxiella burnetii RSA 493
ucgccagaaacaa

SEQ ID NO: 570498 - RNA, 16 nt, Coxiella burnetii RSA 493
ucgcguuguauaagug

SEQ ID NO: 570499 - RNA, 19 nt, Coxiella burnetii RSA 493
ucgcguauaaaugaauaau

SEQ ID NO: 570500 - RNA, 20 nt, Coxiella burnetii RSA 493
ucgcguauaaaugaauaaua

SEQ ID NO: 570501 - RNA, 22 nt, Coxiella burnetii RSA 493
ucgcguauaaaugaauaauauu

SEQ ID NO: 570502 - RNA, 23 nt, Coxiella burnetii RSA 493
ucgcguauaaaugaauaauauug

SEQ ID NO: 570503 - RNA, 23 nt, Coxiella burnetii RSA 493
ucgcgguuagcacuuaacuccuu

SEQ ID NO: 570504 - RNA, 15 nt, Coxiella burnetii RSA 493
ucgcuaaauaacaua

SEQ ID NO: 570505 - RNA, 22 nt, Coxiella burnetii RSA 493
ucgcuccccuugccgaggcaaa

SEQ ID NO: 570506 - RNA, 16 nt, Coxiella burnetii RSA 493
ucgcuccuaaauuuuc

SEQ ID NO: 570507 - RNA, 22 nt, Coxiella burnetii RSA 493
ucgcuccuaaauuuucuuguuc

SEQ ID NO: 570508 - RNA, 17 nt, Coxiella burnetii RSA 493
ucgcucaauuguuucau

SEQ ID NO: 570509 - RNA, 17 nt, Coxiella burnetii RSA 493
ucgcugauacuucuuca

SEQ ID NO: 570510 - RNA, 20 nt, Coxiella burnetii RSA 493
ucgcugauacuucuucauua

SEQ ID NO: 570511 - RNA, 22 nt, Coxiella burnetii RSA 493
ucgcugauacuucuucauuaaa

SEQ ID NO: 570512 - RNA, 17 nt, Coxiella burnetii RSA 493
ucgcuggauuuuuuaau

SEQ ID NO: 570513 - RNA, 17 nt, Coxiella burnetii RSA 493
ucgcuucaauucuuuuu

SEQ ID NO: 570514 - RNA, 19 nt, Coxiella burnetii RSA 493
ucgcuucaauucuuuuuaa

SEQ ID NO: 570515 - RNA, 19 nt, Coxiella burnetii RSA 493
ucgcuuuuauuuccugucg

SEQ ID NO: 570516 - RNA, 18 nt, Coxiella burnetii RSA 493
ucggaaauuucucucuca

SEQ ID NO: 570517 - RNA, 22 nt, Coxiella burnetii RSA 493
ucggaaauuucucucucauaau

SEQ ID NO: 570518 - RNA, 14 nt, Coxiella burnetii RSA 493
ucggcaccaaaauc

SEQ ID NO: 570519 - RNA, 16 nt, Coxiella burnetii RSA 493
ucggauguuuuuucac

SEQ ID NO: 570520 - RNA, 21 nt, Coxiella burnetii RSA 493
ucggggcggcuuuuuucgcuu

SEQ ID NO: 570521 - RNA, 15 nt, Coxiella burnetii RSA 493
ucggguauuuucaug

SEQ ID NO: 570522 - RNA, 19 nt, Coxiella burnetii RSA 493
ucgggccuucacuuuucug

SEQ ID NO: 570523 - RNA, 16 nt, Coxiella burnetii RSA 493
ucgguugaagaaauac

SEQ ID NO: 570524 - RNA, 23 nt, Coxiella burnetii RSA 493
ucgguucaagcacuaguuuuacu

SEQ ID NO: 570525 - RNA, 21 nt, Coxiella burnetii RSA 493
ucguaaaacgauauuaucaaa

SEQ ID NO: 570526 - RNA, 19 nt, Coxiella burnetii RSA 493
ucgguuuuuuuaaaaaaga

SEQ ID NO: 570527 - RNA, 20 nt, Coxiella burnetii RSA 493
ucggugacgaggaaagauaa

SEQ ID NO: 570528 - RNA, 15 nt, Coxiella burnetii RSA 493
ucgggaaauaaaauu

SEQ ID NO: 570529 - RNA, 14 nt, Coxiella burnetii RSA 493
ucggcuaaaucuug

SEQ ID NO: 570530 - RNA, 22 nt, Coxiella burnetii RSA 493
ucggcucgccggauugaaaccg

SEQ ID NO: 570531 - RNA, 18 nt, Coxiella burnetii RSA 493
ucggccugggcaaggcau

SEQ ID NO: 570532 - RNA, 17 nt, Coxiella burnetii RSA 493
ucggcgcauuuuuauuc

SEQ ID NO: 570533 - RNA, 20 nt, Coxiella burnetii RSA 493
ucggccggauuuuaauugaa

SEQ ID NO: 570534 - RNA, 22 nt, Coxiella burnetii RSA 493
ucgucgacaaaaagacauuaau

SEQ ID NO: 570535 - RNA, 15 nt, Coxiella burnetii RSA 493
ucgucgcccucauuc

SEQ ID NO: 570536 - RNA, 20 nt, Coxiella burnetii RSA 493
ucgucggguauuuucaugca

SEQ ID NO: 570537 - RNA, 12 nt, Coxiella burnetii RSA 493
ucgucccaaaaa

SEQ ID NO: 570538 - RNA, 16 nt, Coxiella burnetii RSA 493
ucgucacccaaaucau

SEQ ID NO: 570539 - RNA, 21 nt, Coxiella burnetii RSA 493
ucguaugccgcuugaaaaauu

SEQ ID NO: 570540 - RNA, 17 nt, Coxiella burnetii RSA 493
ucguaggccgcuuuuug

SEQ ID NO: 570541 - RNA, 17 nt, Coxiella burnetii RSA 493
ucguauccaaauauuua

SEQ ID NO: 570542 - RNA, 23 nt, Coxiella burnetii RSA 493
ucguauauccggcaucacgauuu

SEQ ID NO: 570543 - RNA, 17 nt, Coxiella burnetii RSA 493
ucguaacaaaagauauu

SEQ ID NO: 570544 - RNA, 18 nt, Coxiella burnetii RSA 493
ucguaaauauuuuuauuu

SEQ ID NO: 570545 - RNA, 17 nt, Coxiella burnetii RSA 493
ucgugagguuuuaccuu

SEQ ID NO: 570546 - RNA, 21 nt, Coxiella burnetii RSA 493
ucgugaaauaccucuucuaaa

SEQ ID NO: 570547 - RNA, 19 nt, Coxiella burnetii RSA 493
ucgugccaguauuuuucuu

SEQ ID NO: 570548 - RNA, 22 nt, Coxiella burnetii RSA 493
ucguuuauuuccgucaauuuuu

SEQ ID NO: 570549 - RNA, 17 nt, Coxiella burnetii RSA 493
ucguugcauaauauuuu

SEQ ID NO: 570550 - RNA, 14 nt, Coxiella burnetii RSA 493
ucguugcauaggaa

SEQ ID NO: 570551 - RNA, 15 nt, Coxiella burnetii RSA 493
ucguucugaaauuuu

SEQ ID NO: 570552 - RNA, 21 nt, Coxiella burnetii RSA 493
ucguuaagccugaaaaucaaa

SEQ ID NO: 570553 - RNA, 21 nt, Coxiella burnetii RSA 493
ucguuaccuucuguaaugauu

SEQ ID NO: 570554 - RNA, 17 nt, Coxiella burnetii RSA 493
ucguuaugggaauuaaa

SEQ ID NO: 570555 - RNA, 22 nt, Coxiella burnetii RSA 493
ucguuccguauccaucacgggg

SEQ ID NO: 570556 - RNA, 16 nt, Coxiella burnetii RSA 493
ucuccaaauugggugc

SEQ ID NO: 570557 - RNA, 15 nt, Coxiella burnetii RSA 493
ucuccaccacuuugc

SEQ ID NO: 570558 - RNA, 13 nt, Coxiella burnetii RSA 493
ucuccauuuucaa

SEQ ID NO: 570559 - RNA, 13 nt, Coxiella burnetii RSA 493
ucuccauuuagaa

SEQ ID NO: 570560 - RNA, 22 nt, Coxiella burnetii RSA 493
ucucccuuaacuucucuucaaa

SEQ ID NO: 570561 - RNA, 20 nt, Coxiella burnetii RSA 493
ucucccuuuuccugaacagg

SEQ ID NO: 570562 - RNA, 20 nt, Coxiella burnetii RSA 493
ucucgauauucuaucucaaa

SEQ ID NO: 570563 - RNA, 16 nt, Coxiella burnetii RSA 493
ucucgaaauuauuuga

SEQ ID NO: 570564 - RNA, 20 nt, Coxiella burnetii RSA 493
ucuccuuaauaaaguuuuag

SEQ ID NO: 570565 - RNA, 22 nt, Coxiella burnetii RSA 493
ucuccuaccaaauaagccaaua

SEQ ID NO: 570566 - RNA, 19 nt, Coxiella burnetii RSA 493
ucugcacguaucugacagu

SEQ ID NO: 570567 - RNA, 15 nt, Coxiella burnetii RSA 493
ucugaccuaauuuga

SEQ ID NO: 570568 - RNA, 18 nt, Coxiella burnetii RSA 493
ucucuauaucuuuuaaau

SEQ ID NO: 570569 - RNA, 20 nt, Coxiella burnetii RSA 493
ucucucauaaucgauaauca

SEQ ID NO: 570570 - RNA, 15 nt, Coxiella burnetii RSA 493
ucucguugauaaaga

SEQ ID NO: 570571 - RNA, 14 nt, Coxiella burnetii RSA 493
ucucugcuucauug

SEQ ID NO: 570572 - RNA, 13 nt, Coxiella burnetii RSA 493
aaaugcuuuucuu

SEQ ID NO: 570573 - RNA, 16 nt, Coxiella burnetii RSA 493
aaaugcuuuuuaaaua

SEQ ID NO: 570574 - RNA, 13 nt, Coxiella burnetii RSA 493
ucucuucuuuuuu

SEQ ID NO: 570575 - RNA, 14 nt, Coxiella burnetii RSA 493
ucuuaucaccuuug

SEQ ID NO: 570576 - RNA, 18 nt, Coxiella burnetii RSA 493
ucuuauccuuacaaaaau

SEQ ID NO: 570577 - RNA, 21 nt, Coxiella burnetii RSA 493
ucuucaacuccugaaaaauaa

SEQ ID NO: 570578 - RNA, 18 nt, Coxiella burnetii RSA 493
ucuuaauuucuaaaaauc

SEQ ID NO: 570579 - RNA, 16 nt, Coxiella burnetii RSA 493
ucuuaauuuuaaaaaa

SEQ ID NO: 570580 - RNA, 16 nt, Coxiella burnetii RSA 493
ucuuaauuuuuccuuu

SEQ ID NO: 570581 - RNA, 20 nt, Coxiella burnetii RSA 493
ucuguuagauauugaacagg

SEQ ID NO: 570582 - RNA, 14 nt, Coxiella burnetii RSA 493
ucuguuauacuguu

SEQ ID NO: 570583 - RNA, 15 nt, Coxiella burnetii RSA 493
ucuguuauacuguuc

SEQ ID NO: 570584 - RNA, 17 nt, Coxiella burnetii RSA 493
ucuguuauacuguucuu

SEQ ID NO: 570585 - RNA, 18 nt, Coxiella burnetii RSA 493
ucuucgcuggauuuuuua

SEQ ID NO: 570586 - RNA, 21 nt, Coxiella burnetii RSA 493
ucuucgccuggccaagaagca

SEQ ID NO: 570587 - RNA, 18 nt, Coxiella burnetii RSA 493
ucuuccauuaauuucuuu

SEQ ID NO: 570588 - RNA, 23 nt, Coxiella burnetii RSA 493
ucuuccauuaauuucuuuuuuug

SEQ ID NO: 570589 - RNA, 16 nt, Coxiella burnetii RSA 493
ucuucacggauaauau

SEQ ID NO: 570590 - RNA, 15 nt, Coxiella burnetii RSA 493
ucuuccaauuuuuug

SEQ ID NO: 570591 - RNA, 13 nt, Coxiella burnetii RSA 493
ucuucacuuuccu

SEQ ID NO: 570592 - RNA, 22 nt, Coxiella burnetii RSA 493
ucuuccaacacguauuuucauu

SEQ ID NO: 570593 - RNA, 19 nt, Coxiella burnetii RSA 493
ucugugguuaauucuucuu

SEQ ID NO: 570594 - RNA, 19 nt, Coxiella burnetii RSA 493
ucuguccuaaggauaggau

SEQ ID NO: 570595 - RNA, 19 nt, Coxiella burnetii RSA 493
ucugguugaaucaaauuaa

SEQ ID NO: 570596 - RNA, 13 nt, Coxiella burnetii RSA 493
ucuguaacuuuuc

SEQ ID NO: 570597 - RNA, 18 nt, Coxiella burnetii RSA 493
ucuggcuguacuuucacu

SEQ ID NO: 570598 - RNA, 14 nt, Coxiella burnetii RSA 493
ucuggcuuucccuu

SEQ ID NO: 570599 - RNA, 14 nt, Coxiella burnetii RSA 493
ucugcauuuuuaau

SEQ ID NO: 570600 - RNA, 15 nt, Coxiella burnetii RSA 493
ucugcuugcacaucu

SEQ ID NO: 570601 - RNA, 18 nt, Coxiella burnetii RSA 493
aaaugauuauagaauggg

SEQ ID NO: 570602 - RNA, 21 nt, Coxiella burnetii RSA 493
aaaugauugggcucaaaaaga

SEQ ID NO: 570603 - RNA, 21 nt, Coxiella burnetii RSA 493
aaaugcaacgaugcgccggcg

SEQ ID NO: 570604 - RNA, 12 nt, Coxiella burnetii RSA 493
ucuaguagaacg

SEQ ID NO: 570605 - RNA, 15 nt, Coxiella burnetii RSA 493
ucuaguuauuuuuca

SEQ ID NO: 570606 - RNA, 24 nt, Coxiella burnetii RSA 493
ucuaguuauuuuucaucuuguaau

SEQ ID NO: 570607 - RNA, 13 nt, Coxiella burnetii RSA 493
ucuagauuuuccu

SEQ ID NO: 570608 - RNA, 16 nt, Coxiella burnetii RSA 493
ucuagauuuuccugcu

SEQ ID NO: 570609 - RNA, 13 nt, Coxiella burnetii RSA 493
ucuagauuuaaaa

SEQ ID NO: 570610 - RNA, 19 nt, Coxiella burnetii RSA 493
ucuaucgccguuucugcuu

SEQ ID NO: 570611 - RNA, 18 nt, Coxiella burnetii RSA 493
ucuauaucuuuuaaauua

SEQ ID NO: 570612 - RNA, 19 nt, Coxiella burnetii RSA 493
ucuauaucuuuuaaauuaa

SEQ ID NO: 570613 - RNA, 15 nt, Coxiella burnetii RSA 493
ucuauaaucauuuuu

SEQ ID NO: 570614 - RNA, 22 nt, Coxiella burnetii RSA 493
ucuauaccauacagaauuucuu

SEQ ID NO: 570615 - RNA, 13 nt, Coxiella burnetii RSA 493
ucuaguuuuucaa

SEQ ID NO: 570616 - RNA, 21 nt, Coxiella burnetii RSA 493
ucucaaagaaacgauuaaaaa

SEQ ID NO: 570617 - RNA, 23 nt, Coxiella burnetii RSA 493
ucucaacagccuucgcauaaaac

SEQ ID NO: 570618 - RNA, 14 nt, Coxiella burnetii RSA 493
ucuauugucaucca

SEQ ID NO: 570619 - RNA, 17 nt, Coxiella burnetii RSA 493
ucuauuucgagauuauu

SEQ ID NO: 570620 - RNA, 23 nt, Coxiella burnetii RSA 493
ucucaucugucaucaucgucaaa

SEQ ID NO: 570621 - RNA, 13 nt, Coxiella burnetii RSA 493
ucucagaaucugu

SEQ ID NO: 570622 - RNA, 20 nt, Coxiella burnetii RSA 493
aaaugcgguacuuaagaaag

SEQ ID NO: 570623 - RNA, 16 nt, Coxiella burnetii RSA 493
aaaugccaaauucgag

SEQ ID NO: 570624 - RNA, 17 nt, Coxiella burnetii RSA 493
aaaucuuccaauuuuuu

SEQ ID NO: 570625 - RNA, 20 nt, Coxiella burnetii RSA 493
aaaucuugcggcgauaauca

SEQ ID NO: 570626 - RNA, 17 nt, Coxiella burnetii RSA 493
ucuaagacuaagaauaa

SEQ ID NO: 570627 - RNA, 18 nt, Coxiella burnetii RSA 493
ucuaacuuugauaagcau

SEQ ID NO: 570628 - RNA, 20 nt, Coxiella burnetii RSA 493
ucuaacuccggcggaaugcu

SEQ ID NO: 570629 - RNA, 17 nt, Coxiella burnetii RSA 493
ucuaacgucgcaaauaa

SEQ ID NO: 570630 - RNA, 23 nt, Coxiella burnetii RSA 493
aaaugaaaucccgagccccaaaa

SEQ ID NO: 570631 - RNA, 20 nt, Coxiella burnetii RSA 493
ucuaagucuauugaaaaaaa

SEQ ID NO: 570632 - RNA, 21 nt, Coxiella burnetii RSA 493
ucuaagucuauugaaaaaaac

SEQ ID NO: 570633 - RNA, 22 nt, Coxiella burnetii RSA 493
ucuaaguuauggauaccggaaa

SEQ ID NO: 570634 - RNA, 12 nt, Coxiella burnetii RSA 493
ucuaauaaaaua

SEQ ID NO: 570635 - RNA, 22 nt, Coxiella burnetii RSA 493
aaaucuuuuuuuugaaauucuu

SEQ ID NO: 570636 - RNA, 13 nt, Coxiella burnetii RSA 493
ucguuuuuuaaua

SEQ ID NO: 570637 - RNA, 20 nt, Coxiella burnetii RSA 493
ucguuuguauucauuacgau

SEQ ID NO: 570638 - RNA, 18 nt, Coxiella burnetii RSA 493
ucguuugucuuuguagau

SEQ ID NO: 570639 - RNA, 22 nt, Coxiella burnetii RSA 493
ucuaaauuaaaugcuuuuuaaa

SEQ ID NO: 570640 - RNA, 13 nt, Coxiella burnetii RSA 493
ucuacgaaacgcu

SEQ ID NO: 570641 - RNA, 20 nt, Coxiella burnetii RSA 493
ucuacgaagcggcucuugcu

SEQ ID NO: 570642 - RNA, 20 nt, Coxiella burnetii RSA 493
aaaugagcguaaucaauaaa

SEQ ID NO: 570643 - RNA, 15 nt, Coxiella burnetii RSA 493
aaaugaguaaaaaag

SEQ ID NO: 570644 - RNA, 17 nt, Coxiella burnetii RSA 493
ucuacucuacucccuaa

SEQ ID NO: 570645 - RNA, 16 nt, Coxiella burnetii RSA 493
aaaugaccaaauaauu

SEQ ID NO: 570646 - RNA, 18 nt, Coxiella burnetii RSA 493
aaaugaccaaauaauuga

SEQ ID NO: 570647 - RNA, 19 nt, Coxiella burnetii RSA 493
aaaugaccaugguuucuuu

SEQ ID NO: 570648 - RNA, 23 nt, Coxiella burnetii RSA 493
aaaugaccuugccauccaaauga

SEQ ID NO: 570649 - RNA, 16 nt, Coxiella burnetii RSA 493
ucuaauuuucuuucca

SEQ ID NO: 570650 - RNA, 22 nt, Coxiella burnetii RSA 493
ucuaauuucuuagguuuuauua

SEQ ID NO: 570651 - RNA, 19 nt, Coxiella burnetii RSA 493
ucuaauuugaaaaacccau

SEQ ID NO: 570652 - RNA, 12 nt, Coxiella burnetii RSA 493
ucuaauuuuccu

SEQ ID NO: 570653 - RNA, 21 nt, Coxiella burnetii RSA 493
ucuaauugaguauccaacucu

SEQ ID NO: 570654 - RNA, 20 nt, Coxiella burnetii RSA 493
ucuaaucgucuugaccaaua

SEQ ID NO: 570655 - RNA, 15 nt, Coxiella burnetii RSA 493
uauugucaaaauuag

SEQ ID NO: 570656 - RNA, 15 nt, Coxiella burnetii RSA 493
uauugucauccagcg

SEQ ID NO: 570657 - RNA, 18 nt, Coxiella burnetii RSA 493
uauugagaaucucuugua

SEQ ID NO: 570658 - RNA, 20 nt, Coxiella burnetii RSA 493
uauuuaaauugaaucacagc

SEQ ID NO: 570659 - RNA, 13 nt, Coxiella burnetii RSA 493
uauuuagcaacuc

SEQ ID NO: 570660 - RNA, 19 nt, Coxiella burnetii RSA 493
uauuuaggggugaauuuuu

SEQ ID NO: 570661 - RNA, 22 nt, Coxiella burnetii RSA 493
uauuuaggggugaauuuuugcc

SEQ ID NO: 570662 - RNA, 17 nt, Coxiella burnetii RSA 493
uauuucaccuucuucuu

SEQ ID NO: 570663 - RNA, 12 nt, Coxiella burnetii RSA 493
uauuuauuuaca

SEQ ID NO: 570664 - RNA, 13 nt, Coxiella burnetii RSA 493
uauuuauuaaaaa

SEQ ID NO: 570665 - RNA, 15 nt, Coxiella burnetii RSA 493
uauuccuuuuucuuu

SEQ ID NO: 570666 - RNA, 21 nt, Coxiella burnetii RSA 493
uauuccugccccgacaauucc

SEQ ID NO: 570667 - RNA, 13 nt, Coxiella burnetii RSA 493
uauucauaucuuu

SEQ ID NO: 570668 - RNA, 19 nt, Coxiella burnetii RSA 493
uauucauuaaauauuucuu

SEQ ID NO: 570669 - RNA, 11 nt, Coxiella burnetii RSA 493
uauuauuuauc

SEQ ID NO: 570670 - RNA, 19 nt, Coxiella burnetii RSA 493
uauuauugagccauuaaga

SEQ ID NO: 570671 - RNA, 15 nt, Coxiella burnetii RSA 493
uauuauucauaucuu

SEQ ID NO: 570672 - RNA, 21 nt, Coxiella burnetii RSA 493
uauuauucauaucuuuuucaa

SEQ ID NO: 570673 - RNA, 15 nt, Coxiella burnetii RSA 493
uauuaucccuuuaac

SEQ ID NO: 570674 - RNA, 16 nt, Coxiella burnetii RSA 493
uauuaucaaaacguag

SEQ ID NO: 570675 - RNA, 21 nt, Coxiella burnetii RSA 493
uauuaucaaaacguagaaguu

SEQ ID NO: 570676 - RNA, 14 nt, Coxiella burnetii RSA 493
uaucccuuaaauca

SEQ ID NO: 570677 - RNA, 16 nt, Coxiella burnetii RSA 493
ucaaagauaucgucca

SEQ ID NO: 570678 - RNA, 13 nt, Coxiella burnetii RSA 493
ucaaaguagcugc

SEQ ID NO: 570679 - RNA, 22 nt, Coxiella burnetii RSA 493
ucaaagucaugaucgguuuuuu

SEQ ID NO: 570680 - RNA, 21 nt, Coxiella burnetii RSA 493
ucaaaguuuuuggcauaaaua

SEQ ID NO: 570681 - RNA, 18 nt, Coxiella burnetii RSA 493
ucaaaagugauuuuucuu

SEQ ID NO: 570682 - RNA, 15 nt, Coxiella burnetii RSA 493
ucaaaaucagaaacg

SEQ ID NO: 570683 - RNA, 16 nt, Coxiella burnetii RSA 493
ucaaaacagcaauuaa

SEQ ID NO: 570684 - RNA, 20 nt, Coxiella burnetii RSA 493
ucaaaacagcaauuaauccc

SEQ ID NO: 570685 - RNA, 21 nt, Coxiella burnetii RSA 493
ucaaaaacuucaugcaaaaau

SEQ ID NO: 570686 - RNA, 22 nt, Coxiella burnetii RSA 493
ucaaaaagggcgaugugaaaca

SEQ ID NO: 570687 - RNA, 15 nt, Coxiella burnetii RSA 493
ucaaaaauaaaaauu

SEQ ID NO: 570688 - RNA, 23 nt, Coxiella burnetii RSA 493
uauuuuuuacccguuuaaauuug

SEQ ID NO: 570689 - RNA, 15 nt, Coxiella burnetii RSA 493
uauuuuuuaaaucug

SEQ ID NO: 570690 - RNA, 11 nt, Coxiella burnetii RSA 493
uauuuuuuaac

SEQ ID NO: 570691 - RNA, 12 nt, Coxiella burnetii RSA 493
uauuuuucucuu

SEQ ID NO: 570692 - RNA, 12 nt, Coxiella burnetii RSA 493
uauuuuucuuug

SEQ ID NO: 570693 - RNA, 11 nt, Coxiella burnetii RSA 493
uauuuuuccca

SEQ ID NO: 570694 - RNA, 19 nt, Coxiella burnetii RSA 493
ucaaaaaaccuuaucaauc

SEQ ID NO: 570695 - RNA, 13 nt, Coxiella burnetii RSA 493
uauuuuuucuuug

SEQ ID NO: 570696 - RNA, 14 nt, Coxiella burnetii RSA 493
uauuucgcuucgcu

SEQ ID NO: 570697 - RNA, 20 nt, Coxiella burnetii RSA 493
uauuucgcuucgcuccauac

SEQ ID NO: 570698 - RNA, 22 nt, Coxiella burnetii RSA 493
uauuuccagcaguaaugagcau

SEQ ID NO: 570699 - RNA, 11 nt, Coxiella burnetii RSA 493
uauuucuuuuc

SEQ ID NO: 570700 - RNA, 13 nt, Coxiella burnetii RSA 493
uauuucuuuugau

SEQ ID NO: 570701 - RNA, 17 nt, Coxiella burnetii RSA 493
uauuugaaaguagaaaa

SEQ ID NO: 570702 - RNA, 17 nt, Coxiella burnetii RSA 493
uauuugaaauagccauu

SEQ ID NO: 570703 - RNA, 15 nt, Coxiella burnetii RSA 493
uauuugaaccaugag

SEQ ID NO: 570704 - RNA, 22 nt, Coxiella burnetii RSA 493
uauuugcggguggcggacuuuu

SEQ ID NO: 570705 - RNA, 16 nt, Coxiella burnetii RSA 493
uauuuguugaacagag

SEQ ID NO: 570706 - RNA, 14 nt, Coxiella burnetii RSA 493
uauuuguguaaaau

SEQ ID NO: 570707 - RNA, 15 nt, Coxiella burnetii RSA 493
uauuuguguaaaaua

SEQ ID NO: 570708 - RNA, 22 nt, Coxiella burnetii RSA 493
uauuuucaaaugaauaagcaaa

SEQ ID NO: 570709 - RNA, 12 nt, Coxiella burnetii RSA 493
uauuuucauucu

SEQ ID NO: 570710 - RNA, 12 nt, Coxiella burnetii RSA 493
uauuuucucaau

SEQ ID NO: 570711 - RNA, 22 nt, Coxiella burnetii RSA 493
uauuuucugccgcugauauucc

SEQ ID NO: 570712 - RNA, 13 nt, Coxiella burnetii RSA 493
ucaacuuaagaga

SEQ ID NO: 570713 - RNA, 17 nt, Coxiella burnetii RSA 493
ucaagaaagacauuguu

SEQ ID NO: 570714 - RNA, 17 nt, Coxiella burnetii RSA 493
ucaagagagguauugcu

SEQ ID NO: 570715 - RNA, 15 nt, Coxiella burnetii RSA 493
ucaaauccuuuaauu

SEQ ID NO: 570716 - RNA, 17 nt, Coxiella burnetii RSA 493
ucaaaugaauaagcaaa

SEQ ID NO: 570717 - RNA, 19 nt, Coxiella burnetii RSA 493
ucaaaugaauaagcaaaga

SEQ ID NO: 570718 - RNA, 16 nt, Coxiella burnetii RSA 493
ucaaguagccaaaaua

SEQ ID NO: 570719 - RNA, 19 nt, Coxiella burnetii RSA 493
ucaaggggaacugauuaaa

SEQ ID NO: 570720 - RNA, 23 nt, Coxiella burnetii RSA 493
ucaagggcaaaaacauuauugau

SEQ ID NO: 570721 - RNA, 13 nt, Coxiella burnetii RSA 493
ucaagaugcccag

SEQ ID NO: 570722 - RNA, 22 nt, Coxiella burnetii RSA 493
ucaagcacuaguuuuacuacau

SEQ ID NO: 570723 - RNA, 16 nt, Coxiella burnetii RSA 493
ucaaucaaauccuuua

SEQ ID NO: 570724 - RNA, 14 nt, Coxiella burnetii RSA 493
ucaauauugaauaa

SEQ ID NO: 570725 - RNA, 17 nt, Coxiella burnetii RSA 493
ucaauccggugaauagc

SEQ ID NO: 570726 - RNA, 14 nt, Coxiella burnetii RSA 493
ucaaucgaaaaaaa

SEQ ID NO: 570727 - RNA, 17 nt, Coxiella burnetii RSA 493
ucaaucgaguccgcccc

SEQ ID NO: 570728 - RNA, 20 nt, Coxiella burnetii RSA 493
ucaaguccuugcugaauucc

SEQ ID NO: 570729 - RNA, 20 nt, Coxiella burnetii RSA 493
ucaaguguucacaagucuca

SEQ ID NO: 570730 - RNA, 14 nt, Coxiella burnetii RSA 493
ucaaugaaacaaac

SEQ ID NO: 570731 - RNA, 22 nt, Coxiella burnetii RSA 493
ucaauggauucuucuuuugcca

SEQ ID NO: 570732 - RNA, 22 nt, Coxiella burnetii RSA 493
ucaaugcgccauccgacauucu

SEQ ID NO: 570733 - RNA, 21 nt, Coxiella burnetii RSA 493
ucaaucugggaauguguguca

SEQ ID NO: 570734 - RNA, 22 nt, Coxiella burnetii RSA 493
ucacaaguucuucuaaagaauu

SEQ ID NO: 570735 - RNA, 15 nt, Coxiella burnetii RSA 493
ucacaccaagaaauu

SEQ ID NO: 570736 - RNA, 15 nt, Coxiella burnetii RSA 493
ucacaaagauuuagg

SEQ ID NO: 570737 - RNA, 12 nt, Coxiella burnetii RSA 493
ucaauuuugguu

SEQ ID NO: 570738 - RNA, 21 nt, Coxiella burnetii RSA 493
ucaauuuuucagucuggccug

SEQ ID NO: 570739 - RNA, 23 nt, Coxiella burnetii RSA 493
ucaauuucucguugauaaagauu

SEQ ID NO: 570740 - RNA, 13 nt, Coxiella burnetii RSA 493
ucaauuuccuauu

SEQ ID NO: 570741 - RNA, 23 nt, Coxiella burnetii RSA 493
ucaauuucgggugauaauugaua

SEQ ID NO: 570742 - RNA, 13 nt, Coxiella burnetii RSA 493
ucaauuaaauuua

SEQ ID NO: 570743 - RNA, 20 nt, Coxiella burnetii RSA 493
ucacacguaucugcuaaaaa

SEQ ID NO: 570744 - RNA, 23 nt, Coxiella burnetii RSA 493
ucacauuggcaguguaaauugug

SEQ ID NO: 570745 - RNA, 12 nt, Coxiella burnetii RSA 493
ucacccaaauca

SEQ ID NO: 570746 - RNA, 14 nt, Coxiella burnetii RSA 493
ucacccaaaucaug

SEQ ID NO: 570747 - RNA, 20 nt, Coxiella burnetii RSA 493
ucacccacaucuggaaucaa

SEQ ID NO: 570748 - RNA, 19 nt, Coxiella burnetii RSA 493
ucacccagacuuuugcagc

SEQ ID NO: 570749 - RNA, 18 nt, Coxiella burnetii RSA 493
ucaccuuugcuaacaauu

SEQ ID NO: 570750 - RNA, 12 nt, Coxiella burnetii RSA 493
ucaccuuuuccc

SEQ ID NO: 570751 - RNA, 13 nt, Coxiella burnetii RSA 493
ucaccuuuucccu

SEQ ID NO: 570752 - RNA, 21 nt, Coxiella burnetii RSA 493
ucaccuuuucccuaggaaacg

SEQ ID NO: 570753 - RNA, 13 nt, Coxiella burnetii RSA 493
ucacgaauuaaaa

SEQ ID NO: 570754 - RNA, 15 nt, Coxiella burnetii RSA 493
ucacgaauuaaaaaa

SEQ ID NO: 570755 - RNA, 20 nt, Coxiella burnetii RSA 493
ucacgaauuaaaaaauucaa

SEQ ID NO: 570756 - RNA, 16 nt, Coxiella burnetii RSA 493
ucacgaauuuuuucag

SEQ ID NO: 570757 - RNA, 23 nt, Coxiella burnetii RSA 493
ucacgaugauucccaccaaaauu

SEQ ID NO: 570758 - RNA, 18 nt, Coxiella burnetii RSA 493
ucacgcucgagggaaacc

SEQ ID NO: 570759 - RNA, 15 nt, Coxiella burnetii RSA 493
ucacgauuuuucuca

SEQ ID NO: 570760 - RNA, 16 nt, Coxiella burnetii RSA 493
ucacgauuuuucucau

SEQ ID NO: 570761 - RNA, 18 nt, Coxiella burnetii RSA 493
ucacgauuuuucucauca

SEQ ID NO: 570762 - RNA, 18 nt, Coxiella burnetii RSA 493
ucacgcgcauaaaaccga

SEQ ID NO: 570763 - RNA, 14 nt, Coxiella burnetii RSA 493
ucacgcgaaaaaag

SEQ ID NO: 570764 - RNA, 19 nt, Coxiella burnetii RSA 493
ucacuacaaauucucccuu

SEQ ID NO: 570765 - RNA, 21 nt, Coxiella burnetii RSA 493
ucacuaugaucaugccuuuuu

SEQ ID NO: 570766 - RNA, 16 nt, Coxiella burnetii RSA 493
ucacucgcaaaaauuu

SEQ ID NO: 570767 - RNA, 17 nt, Coxiella burnetii RSA 493
uccagccuuuaguuuua

SEQ ID NO: 570768 - RNA, 17 nt, Coxiella burnetii RSA 493
uccagcaaacccauuuc

SEQ ID NO: 570769 - RNA, 14 nt, Coxiella burnetii RSA 493
uccaguuuuuuaac

SEQ ID NO: 570770 - RNA, 14 nt, Coxiella burnetii RSA 493
uccaguauuucauc

SEQ ID NO: 570771 - RNA, 15 nt, Coxiella burnetii RSA 493
uccagcucguaagcg

SEQ ID NO: 570772 - RNA, 16 nt, Coxiella burnetii RSA 493
uccagaccuguuaaaa

SEQ ID NO: 570773 - RNA, 18 nt, Coxiella burnetii RSA 493
uccagaccuguuaaaaac

SEQ ID NO: 570774 - RNA, 22 nt, Coxiella burnetii RSA 493
uccacucgucuggggauacacc

SEQ ID NO: 570775 - RNA, 13 nt, Coxiella burnetii RSA 493
uccaauuguucgg

SEQ ID NO: 570776 - RNA, 15 nt, Coxiella burnetii RSA 493
uccaauucuuuaagu

SEQ ID NO: 570777 - RNA, 23 nt, Coxiella burnetii RSA 493
uccaauucuuuaaguguuauuuc

SEQ ID NO: 570778 - RNA, 16 nt, Coxiella burnetii RSA 493
uccaaauauuuaaauu

SEQ ID NO: 570779 - RNA, 20 nt, Coxiella burnetii RSA 493
uccaaauauuuaaauugaau

SEQ ID NO: 570780 - RNA, 17 nt, Coxiella burnetii RSA 493
uccaaaucggcaaauac

SEQ ID NO: 570781 - RNA, 20 nt, Coxiella burnetii RSA 493
uccaaaauuugagguugaau

SEQ ID NO: 570782 - RNA, 13 nt, Coxiella burnetii RSA 493
uccaccacuuugc

SEQ ID NO: 570783 - RNA, 21 nt, Coxiella burnetii RSA 493
uccaccgauguggcaaaucuc

SEQ ID NO: 570784 - RNA, 18 nt, Coxiella burnetii RSA 493
ucauuaaauauuucuucc

SEQ ID NO: 570785 - RNA, 14 nt, Coxiella burnetii RSA 493
ucauuaaauuuaau

SEQ ID NO: 570786 - RNA, 13 nt, Coxiella burnetii RSA 493
ucauuaagcaauu

SEQ ID NO: 570787 - RNA, 14 nt, Coxiella burnetii RSA 493
ucauguaaucaauu

SEQ ID NO: 570788 - RNA, 23 nt, Coxiella burnetii RSA 493
ucauguaauuuaucccacguugu

SEQ ID NO: 570789 - RNA, 17 nt, Coxiella burnetii RSA 493
ucauuaucuagauuuuc

SEQ ID NO: 570790 - RNA, 17 nt, Coxiella burnetii RSA 493
uccaaaaagauaauccc

SEQ ID NO: 570791 - RNA, 19 nt, Coxiella burnetii RSA 493
uccaaaaacagauuuaaau

SEQ ID NO: 570792 - RNA, 20 nt, Coxiella burnetii RSA 493
uccaaaaacagauuuaaaua

SEQ ID NO: 570793 - RNA, 16 nt, Coxiella burnetii RSA 493
ucauuuguucuaucaa

SEQ ID NO: 570794 - RNA, 13 nt, Coxiella burnetii RSA 493
ucauuuuucaggg

SEQ ID NO: 570795 - RNA, 17 nt, Coxiella burnetii RSA 493
ucauuuuuuauaaaauu

SEQ ID NO: 570796 - RNA, 21 nt, Coxiella burnetii RSA 493
ucauuuuuuauaaaauuuaau

SEQ ID NO: 570797 - RNA, 22 nt, Coxiella burnetii RSA 493
ucauuuuuuauaaaauuuaaua

SEQ ID NO: 570798 - RNA, 21 nt, Coxiella burnetii RSA 493
ucauuucgagcgcgauuuucu

SEQ ID NO: 570799 - RNA, 16 nt, Coxiella burnetii RSA 493
ucauuucccguauuuc

SEQ ID NO: 570800 - RNA, 23 nt, Coxiella burnetii RSA 493
ucauucuuauccuuacaaaaaua

SEQ ID NO: 570801 - RNA, 15 nt, Coxiella burnetii RSA 493
ucaugagaggaugca

SEQ ID NO: 570802 - RNA, 19 nt, Coxiella burnetii RSA 493
ucaugaucgguuuuuugac

SEQ ID NO: 570803 - RNA, 19 nt, Coxiella burnetii RSA 493
ucaugcauuugauuuucug

SEQ ID NO: 570804 - RNA, 12 nt, Coxiella burnetii RSA 493
ucaucuccuuuu

SEQ ID NO: 570805 - RNA, 17 nt, Coxiella burnetii RSA 493
ucaucguuugauucauu

SEQ ID NO: 570806 - RNA, 20 nt, Coxiella burnetii RSA 493
ucaucguuugauucauuagu

SEQ ID NO: 570807 - RNA, 17 nt, Coxiella burnetii RSA 493
ucaucuaaauuaaaaau

SEQ ID NO: 570808 - RNA, 21 nt, Coxiella burnetii RSA 493
ucaucuaaauuaaaaaucggu

SEQ ID NO: 570809 - RNA, 19 nt, Coxiella burnetii RSA 493
ucaucgggagcgauaauga

SEQ ID NO: 570810 - RNA, 21 nt, Coxiella burnetii RSA 493
ucaucugcgggauuaauuuuc

SEQ ID NO: 570811 - RNA, 22 nt, Coxiella burnetii RSA 493
ucaucuucaaaaccuaacgcaa

SEQ ID NO: 570812 - RNA, 11 nt, Coxiella burnetii RSA 493
ucaugaaaaag

SEQ ID NO: 570813 - RNA, 13 nt, Coxiella burnetii RSA 493
ucaugaaaaagau

SEQ ID NO: 570814 - RNA, 22 nt, Coxiella burnetii RSA 493
ucaucaauccggugaauagcca

SEQ ID NO: 570815 - RNA, 21 nt, Coxiella burnetii RSA 493
ucaucaaaacggcaaaugauu

SEQ ID NO: 570816 - RNA, 19 nt, Coxiella burnetii RSA 493
ucaucaaaauuaaaaucuu

SEQ ID NO: 570817 - RNA, 23 nt, Coxiella burnetii RSA 493
ucaucaaaauucuccuuaauaaa

SEQ ID NO: 570818 - RNA, 17 nt, Coxiella burnetii RSA 493
ucauauuaauauuaaaa

SEQ ID NO: 570819 - RNA, 16 nt, Coxiella burnetii RSA 493
ucauauccuuucuaac

SEQ ID NO: 570820 - RNA, 16 nt, Coxiella burnetii RSA 493
ucauacgcuuuuaccc

SEQ ID NO: 570821 - RNA, 16 nt, Coxiella burnetii RSA 493
ucauacgggcuacuug

SEQ ID NO: 570822 - RNA, 18 nt, Coxiella burnetii RSA 493
ucauacauaugaauauua

SEQ ID NO: 570823 - RNA, 19 nt, Coxiella burnetii RSA 493
ucauaaucaaaaucagaaa

SEQ ID NO: 570824 - RNA, 18 nt, Coxiella burnetii RSA 493
ucaucagcccucauuguu

SEQ ID NO: 570825 - RNA, 20 nt, Coxiella burnetii RSA 493
ucaucauuuuccaaaaaauu

SEQ ID NO: 570826 - RNA, 19 nt, Coxiella burnetii RSA 493
ucauccaaacgcacgauaa

SEQ ID NO: 570827 - RNA, 12 nt, Coxiella burnetii RSA 493
ucaucauuuuug

SEQ ID NO: 570828 - RNA, 18 nt, Coxiella burnetii RSA 493
ucaucaucuucaaaaccu

SEQ ID NO: 570829 - RNA, 19 nt, Coxiella burnetii RSA 493
ucaucgccaaaagguaugu

SEQ ID NO: 570830 - RNA, 16 nt, Coxiella burnetii RSA 493
ucaucgaccucuguaa

SEQ ID NO: 570831 - RNA, 17 nt, Coxiella burnetii RSA 493
ucauccauucuuucauu

SEQ ID NO: 570832 - RNA, 19 nt, Coxiella burnetii RSA 493
ucauaaguccgcuuuuccc

SEQ ID NO: 570833 - RNA, 16 nt, Coxiella burnetii RSA 493
ucaguuuugaugaaaa

SEQ ID NO: 570834 - RNA, 19 nt, Coxiella burnetii RSA 493
ucaguucgggccuucacuu

SEQ ID NO: 570835 - RNA, 13 nt, Coxiella burnetii RSA 493
ucagucaccauug

SEQ ID NO: 570836 - RNA, 22 nt, Coxiella burnetii RSA 493
ucaguaccaaaagcaugcccau

SEQ ID NO: 570837 - RNA, 17 nt, Coxiella burnetii RSA 493
ucaggggcaaucaaucg

SEQ ID NO: 570838 - RNA, 14 nt, Coxiella burnetii RSA 493
ucagggaauuuaau

SEQ ID NO: 570839 - RNA, 15 nt, Coxiella burnetii RSA 493
ucagggaauuuaaua

SEQ ID NO: 570840 - RNA, 20 nt, Coxiella burnetii RSA 493
ucagcuuuggaaaaacauuc

SEQ ID NO: 570841 - RNA, 20 nt, Coxiella burnetii RSA 493
ucagcuuuccccccaacuac

SEQ ID NO: 570842 - RNA, 15 nt, Coxiella burnetii RSA 493
ucagcguuucuaugc

SEQ ID NO: 570843 - RNA, 15 nt, Coxiella burnetii RSA 493
ucacuguugagcaaa

SEQ ID NO: 570844 - RNA, 13 nt, Coxiella burnetii RSA 493
ucagcccaacuac

SEQ ID NO: 570845 - RNA, 17 nt, Coxiella burnetii RSA 493
ucagcccaacuacggac

SEQ ID NO: 570846 - RNA, 18 nt, Coxiella burnetii RSA 493
uagggagaaaaauuuauu

SEQ ID NO: 570847 - RNA, 14 nt, Coxiella burnetii RSA 493
uagggcugaaaaaa

SEQ ID NO: 570848 - RNA, 20 nt, Coxiella burnetii RSA 493
uagggcugaaaaaauuaaau

SEQ ID NO: 570849 - RNA, 21 nt, Coxiella burnetii RSA 493
uaggcugagccagcuaaguaa

SEQ ID NO: 570850 - RNA, 18 nt, Coxiella burnetii RSA 493
uaggguagucaggaagca

SEQ ID NO: 570851 - RNA, 17 nt, Coxiella burnetii RSA 493
uaggguacuauuuccaa

SEQ ID NO: 570852 - RNA, 15 nt, Coxiella burnetii RSA 493
uaggguagauaacgc

SEQ ID NO: 570853 - RNA, 22 nt, Coxiella burnetii RSA 493
uagggcuuuacaccuaagagaa

SEQ ID NO: 570854 - RNA, 15 nt, Coxiella burnetii RSA 493
uaguaaaagauccuu

SEQ ID NO: 570855 - RNA, 17 nt, Coxiella burnetii RSA 493
uaguuauuuuucaucuu

SEQ ID NO: 570856 - RNA, 15 nt, Coxiella burnetii RSA 493
uagugucaaaggccg

SEQ ID NO: 570857 - RNA, 19 nt, Coxiella burnetii RSA 493
uagugcuauuuuucccaca

SEQ ID NO: 570858 - RNA, 16 nt, Coxiella burnetii RSA 493
uauaaauuaaauugcu

SEQ ID NO: 570859 - RNA, 13 nt, Coxiella burnetii RSA 493
uauaaauuuuccc

SEQ ID NO: 570860 - RNA, 14 nt, Coxiella burnetii RSA 493
uauaaauuuuccca

SEQ ID NO: 570861 - RNA, 18 nt, Coxiella burnetii RSA 493
uauaacaaaauuaaaaaa

SEQ ID NO: 570862 - RNA, 23 nt, Coxiella burnetii RSA 493
uauaacaagguuuuauuguuaau

SEQ ID NO: 570863 - RNA, 16 nt, Coxiella burnetii RSA 493
uauaaaaauccucacg

SEQ ID NO: 570864 - RNA, 12 nt, Coxiella burnetii RSA 493
uauaaaaccugc

SEQ ID NO: 570865 - RNA, 13 nt, Coxiella burnetii RSA 493
uaguuuuccccca

SEQ ID NO: 570866 - RNA, 11 nt, Coxiella burnetii RSA 493
uaguuuuacua

SEQ ID NO: 570867 - RNA, 22 nt, Coxiella burnetii RSA 493
uaguuuuucccucuacaaaaua

SEQ ID NO: 570868 - RNA, 21 nt, Coxiella burnetii RSA 493
uauauaagcuuucaauaaaua

SEQ ID NO: 570869 - RNA, 23 nt, Coxiella burnetii RSA 493
uauauaagcuuucaauaaauaaa

SEQ ID NO: 570870 - RNA, 19 nt, Coxiella burnetii RSA 493
uauagacaaugcuuucuuu

SEQ ID NO: 570871 - RNA, 23 nt, Coxiella burnetii RSA 493
uauacugacaaugcguuuuaaau

SEQ ID NO: 570872 - RNA, 17 nt, Coxiella burnetii RSA 493
uauacugcccaagaaau

SEQ ID NO: 570873 - RNA, 18 nt, Coxiella burnetii RSA 493
uauacugcccaagaaauu

SEQ ID NO: 570874 - RNA, 21 nt, Coxiella burnetii RSA 493
uauacgggaaguugguuugaa

SEQ ID NO: 570875 - RNA, 16 nt, Coxiella burnetii RSA 493
uauacccaaaaaccca

SEQ ID NO: 570876 - RNA, 23 nt, Coxiella burnetii RSA 493
uauaccauacagaauuucuuugu

SEQ ID NO: 570877 - RNA, 13 nt, Coxiella burnetii RSA 493
uauaccuuuuucc

SEQ ID NO: 570878 - RNA, 14 nt, Coxiella burnetii RSA 493
uauaccaaaaaguu

SEQ ID NO: 570879 - RNA, 15 nt, Coxiella burnetii RSA 493
uauaccaaaaaguug

SEQ ID NO: 570880 - RNA, 19 nt, Coxiella burnetii RSA 493
uauaacuauuuuaaaucuu

SEQ ID NO: 570881 - RNA, 19 nt, Coxiella burnetii RSA 493
uaucacuccaauaauaaaa

SEQ ID NO: 570882 - RNA, 22 nt, Coxiella burnetii RSA 493
uaucaccuuugcuaacaauugu

SEQ ID NO: 570883 - RNA, 15 nt, Coxiella burnetii RSA 493
uaucaaucgaaaaaa

SEQ ID NO: 570884 - RNA, 17 nt, Coxiella burnetii RSA 493
uaucaaucgaaaaaaau

SEQ ID NO: 570885 - RNA, 19 nt, Coxiella burnetii RSA 493
uauauugggguucauuuuu

SEQ ID NO: 570886 - RNA, 23 nt, Coxiella burnetii RSA 493
uaucauugggccauuuaacaaaa

SEQ ID NO: 570887 - RNA, 15 nt, Coxiella burnetii RSA 493
uauccaacucucuag

SEQ ID NO: 570888 - RNA, 11 nt, Coxiella burnetii RSA 493
uauccaaauag

SEQ ID NO: 570889 - RNA, 13 nt, Coxiella burnetii RSA 493
uauccaaauagau

SEQ ID NO: 570890 - RNA, 22 nt, Coxiella burnetii RSA 493
uauccaaaauccaggcugcuag

SEQ ID NO: 570891 - RNA, 18 nt, Coxiella burnetii RSA 493
uauccaacauauggccca

SEQ ID NO: 570892 - RNA, 20 nt, Coxiella burnetii RSA 493
uagccccgggggcauaagua

SEQ ID NO: 570893 - RNA, 23 nt, Coxiella burnetii RSA 493
uagccauugguuuaaaaaguuca

SEQ ID NO: 570894 - RNA, 14 nt, Coxiella burnetii RSA 493
uagcccaacaaaau

SEQ ID NO: 570895 - RNA, 15 nt, Coxiella burnetii RSA 493
uagccauuaauaaag

SEQ ID NO: 570896 - RNA, 17 nt, Coxiella burnetii RSA 493
uagccgaauguuuaaau

SEQ ID NO: 570897 - RNA, 23 nt, Coxiella burnetii RSA 493
uagcgcuaaugagaaacgugaga

SEQ ID NO: 570898 - RNA, 14 nt, Coxiella burnetii RSA 493
uagcgcgcagcgca

SEQ ID NO: 570899 - RNA, 13 nt, Coxiella burnetii RSA 493
uagccuucucaau

SEQ ID NO: 570900 - RNA, 14 nt, Coxiella burnetii RSA 493
uagcgccagauaca

SEQ ID NO: 570901 - RNA, 13 nt, Coxiella burnetii RSA 493
uagcucuuaaaag

SEQ ID NO: 570902 - RNA, 17 nt, Coxiella burnetii RSA 493
uagcuccccgcuccaau

SEQ ID NO: 570903 - RNA, 20 nt, Coxiella burnetii RSA 493
uagcuuccauugcucaaagg

SEQ ID NO: 570904 - RNA, 15 nt, Coxiella burnetii RSA 493
uagcuaauucuuuuu

SEQ ID NO: 570905 - RNA, 19 nt, Coxiella burnetii RSA 493
uagcuauucuuuuggcauu

SEQ ID NO: 570906 - RNA, 14 nt, Coxiella burnetii RSA 493
uagcucauugaaau

SEQ ID NO: 570907 - RNA, 18 nt, Coxiella burnetii RSA 493
uagcucauugaaaucaau

SEQ ID NO: 570908 - RNA, 22 nt, Coxiella burnetii RSA 493
uagcuaagaucaagaaagacau

SEQ ID NO: 570909 - RNA, 16 nt, Coxiella burnetii RSA 493
uaggaucuuaagaaga

SEQ ID NO: 570910 - RNA, 21 nt, Coxiella burnetii RSA 493
uaggauuuuacgucuaaaaca

SEQ ID NO: 570911 - RNA, 20 nt, Coxiella burnetii RSA 493
uaggagauaacgcuucuuuu

SEQ ID NO: 570912 - RNA, 21 nt, Coxiella burnetii RSA 493
uaggagauaacgcuucuuuua

SEQ ID NO: 570913 - RNA, 14 nt, Coxiella burnetii RSA 493
uaggaaaaaauaau

SEQ ID NO: 570914 - RNA, 22 nt, Coxiella burnetii RSA 493
uagcuuuuuucaaaauuuacuu

SEQ ID NO: 570915 - RNA, 19 nt, Coxiella burnetii RSA 493
uaggaacauucuaauaaaa

SEQ ID NO: 570916 - RNA, 13 nt, Coxiella burnetii RSA 493
uagcaaauaucug

SEQ ID NO: 570917 - RNA, 16 nt, Coxiella burnetii RSA 493
uagauuuuccugcuga

SEQ ID NO: 570918 - RNA, 20 nt, Coxiella burnetii RSA 493
uagcauaaucuuuuuagagu

SEQ ID NO: 570919 - RNA, 19 nt, Coxiella burnetii RSA 493
uagcauuguuggaaauaau

SEQ ID NO: 570920 - RNA, 20 nt, Coxiella burnetii RSA 493
uagagucgggaaauaaaauu

SEQ ID NO: 570921 - RNA, 23 nt, Coxiella burnetii RSA 493
uagagucgggaaauaaaauuaau

SEQ ID NO: 570922 - RNA, 14 nt, Coxiella burnetii RSA 493
uagaguuaauuuca

SEQ ID NO: 570923 - RNA, 17 nt, Coxiella burnetii RSA 493
uagaguuaauuucauaa

SEQ ID NO: 570924 - RNA, 18 nt, Coxiella burnetii RSA 493
uagagcaacgauuuuccc

SEQ ID NO: 570925 - RNA, 17 nt, Coxiella burnetii RSA 493
uagagagauccucaaca

SEQ ID NO: 570926 - RNA, 23 nt, Coxiella burnetii RSA 493
uagaggagcguaggcacgaugca

SEQ ID NO: 570927 - RNA, 22 nt, Coxiella burnetii RSA 493
uagaggucguaccuucaauucc

SEQ ID NO: 570928 - RNA, 23 nt, Coxiella burnetii RSA 493
uagauagucuuugguuuuccaug

SEQ ID NO: 570929 - RNA, 19 nt, Coxiella burnetii RSA 493
uagauacucgagguagacu

SEQ ID NO: 570930 - RNA, 18 nt, Coxiella burnetii RSA 493
uagaugucgauaauggca

SEQ ID NO: 570931 - RNA, 15 nt, Coxiella burnetii RSA 493
uagaugcuaucgaug

SEQ ID NO: 570932 - RNA, 18 nt, Coxiella burnetii RSA 493
uagaugacuuugguaguc

SEQ ID NO: 570933 - RNA, 20 nt, Coxiella burnetii RSA 493
uagaugacuuugguaguccu

SEQ ID NO: 570934 - RNA, 16 nt, Coxiella burnetii RSA 493
uagauucuuucugauu

SEQ ID NO: 570935 - RNA, 13 nt, Coxiella burnetii RSA 493
uagauuagaaaaa

SEQ ID NO: 570936 - RNA, 18 nt, Coxiella burnetii RSA 493
uaccuucuguaaugauuu

SEQ ID NO: 570937 - RNA, 19 nt, Coxiella burnetii RSA 493
uaccuuuuucguuuaacaa

SEQ ID NO: 570938 - RNA, 20 nt, Coxiella burnetii RSA 493
uaccugcuucgcuucaucca

SEQ ID NO: 570939 - RNA, 13 nt, Coxiella burnetii RSA 493
uaccucuaaaaau

SEQ ID NO: 570940 - RNA, 18 nt, Coxiella burnetii RSA 493
uaccuccgucauugaaau

SEQ ID NO: 570941 - RNA, 17 nt, Coxiella burnetii RSA 493
uacgcuauuuuuuaaau

SEQ ID NO: 570942 - RNA, 13 nt, Coxiella burnetii RSA 493
uacgaagcggcuc

SEQ ID NO: 570943 - RNA, 12 nt, Coxiella burnetii RSA 493
uacgaauuucaa

SEQ ID NO: 570944 - RNA, 16 nt, Coxiella burnetii RSA 493
uacgauagaggcgcau

SEQ ID NO: 570945 - RNA, 16 nt, Coxiella burnetii RSA 493
uacggagaaaaugauu

SEQ ID NO: 570946 - RNA, 15 nt, Coxiella burnetii RSA 493
uacggugcagaaggc

SEQ ID NO: 570947 - RNA, 17 nt, Coxiella burnetii RSA 493
uacgugcgcugcgcgcu

SEQ ID NO: 570948 - RNA, 13 nt, Coxiella burnetii RSA 493
uacguuauaauuu

SEQ ID NO: 570949 - RNA, 15 nt, Coxiella burnetii RSA 493
uacgugcuuugggau

SEQ ID NO: 570950 - RNA, 14 nt, Coxiella burnetii RSA 493
uacuauaaucucgu

SEQ ID NO: 570951 - RNA, 14 nt, Coxiella burnetii RSA 493
uacguuuaaauaac

SEQ ID NO: 570952 - RNA, 20 nt, Coxiella burnetii RSA 493
uacuauuuacgaguuaacuu

SEQ ID NO: 570953 - RNA, 16 nt, Coxiella burnetii RSA 493
uagaaugauaccauca

SEQ ID NO: 570954 - RNA, 23 nt, Coxiella burnetii RSA 493
uagaaugggaaguuuuauaacaa

SEQ ID NO: 570955 - RNA, 17 nt, Coxiella burnetii RSA 493
uagaauuccuuuuauga

SEQ ID NO: 570956 - RNA, 19 nt, Coxiella burnetii RSA 493
uagaauuccuuuuaugaaa

SEQ ID NO: 570957 - RNA, 17 nt, Coxiella burnetii RSA 493
uagaauuacuguaaacu

SEQ ID NO: 570958 - RNA, 21 nt, Coxiella burnetii RSA 493
uagaaugccggcuaauuuuuu

SEQ ID NO: 570959 - RNA, 14 nt, Coxiella burnetii RSA 493
uagaauucucccau

SEQ ID NO: 570960 - RNA, 13 nt, Coxiella burnetii RSA 493
uagaauugcugac

SEQ ID NO: 570961 - RNA, 13 nt, Coxiella burnetii RSA 493
uagaaggggagcg

SEQ ID NO: 570962 - RNA, 17 nt, Coxiella burnetii RSA 493
uagaaguauuuccauuu

SEQ ID NO: 570963 - RNA, 16 nt, Coxiella burnetii RSA 493
uagaauuuuugacuaa

SEQ ID NO: 570964 - RNA, 17 nt, Coxiella burnetii RSA 493
uagacaaucaauuuacc

SEQ ID NO: 570965 - RNA, 14 nt, Coxiella burnetii RSA 493
uagacaguuuagaa

SEQ ID NO: 570966 - RNA, 14 nt, Coxiella burnetii RSA 493
uacuuuuauaauca

SEQ ID NO: 570967 - RNA, 20 nt, Coxiella burnetii RSA 493
uagaaagcggaauaagaaau

SEQ ID NO: 570968 - RNA, 21 nt, Coxiella burnetii RSA 493
uagaaagcggaauaagaaauc

SEQ ID NO: 570969 - RNA, 16 nt, Coxiella burnetii RSA 493
uacuuaaaauuucuuu

SEQ ID NO: 570970 - RNA, 21 nt, Coxiella burnetii RSA 493
uacuuuacgcucaauuuugcg

SEQ ID NO: 570971 - RNA, 19 nt, Coxiella burnetii RSA 493
uacuuucucaauuucucgu

SEQ ID NO: 570972 - RNA, 16 nt, Coxiella burnetii RSA 493
uacuuguugaaaaccu

SEQ ID NO: 570973 - RNA, 16 nt, Coxiella burnetii RSA 493
uacuuccuucuuguca

SEQ ID NO: 570974 - RNA, 19 nt, Coxiella burnetii RSA 493
uaaucucaucaucuucaaa

SEQ ID NO: 570975 - RNA, 16 nt, Coxiella burnetii RSA 493
uaaucgguuauuucuc

SEQ ID NO: 570976 - RNA, 18 nt, Coxiella burnetii RSA 493
uaaucgguuauuucucga

SEQ ID NO: 570977 - RNA, 23 nt, Coxiella burnetii RSA 493
uaauccguuuugaaaaauaaaag

SEQ ID NO: 570978 - RNA, 14 nt, Coxiella burnetii RSA 493
uaauccuucuuuug

SEQ ID NO: 570979 - RNA, 16 nt, Coxiella burnetii RSA 493
uaauccuuauacuaaa

SEQ ID NO: 570980 - RNA, 20 nt, Coxiella burnetii RSA 493
uaaucgcugauacuucuuca

SEQ ID NO: 570981 - RNA, 20 nt, Coxiella burnetii RSA 493
uaauccgcauugcauuucuu

SEQ ID NO: 570982 - RNA, 22 nt, Coxiella burnetii RSA 493
uaauccgcauugcauuucuuuc

SEQ ID NO: 570983 - RNA, 19 nt, Coxiella burnetii RSA 493
uaacgauggucaaaccaau

SEQ ID NO: 570984 - RNA, 21 nt, Coxiella burnetii RSA 493
uaaugaauauucugagcgccu

SEQ ID NO: 570985 - RNA, 14 nt, Coxiella burnetii RSA 493
uaaucuuuuggcau

SEQ ID NO: 570986 - RNA, 13 nt, Coxiella burnetii RSA 493
uaaugaaaaauag

SEQ ID NO: 570987 - RNA, 16 nt, Coxiella burnetii RSA 493
uaaugaaauuucucau

SEQ ID NO: 570988 - RNA, 11 nt, Coxiella burnetii RSA 493
uaaucuuccau

SEQ ID NO: 570989 - RNA, 17 nt, Coxiella burnetii RSA 493
uaaucuuaucaauggga

SEQ ID NO: 570990 - RNA, 11 nt, Coxiella burnetii RSA 493
uaaugcuuuuu

SEQ ID NO: 570991 - RNA, 20 nt, Coxiella burnetii RSA 493
uaauggacauucucgaaucc

SEQ ID NO: 570992 - RNA, 15 nt, Coxiella burnetii RSA 493
uaaugacuuugauau

SEQ ID NO: 570993 - RNA, 21 nt, Coxiella burnetii RSA 493
uaauuucuucuuauaaucuua

SEQ ID NO: 570994 - RNA, 14 nt, Coxiella burnetii RSA 493
uaauuguuuugcca

SEQ ID NO: 570995 - RNA, 13 nt, Coxiella burnetii RSA 493
uaauuuaaacuca

SEQ ID NO: 570996 - RNA, 20 nt, Coxiella burnetii RSA 493
uaauuguacggcaagucccu

SEQ ID NO: 570997 - RNA, 19 nt, Coxiella burnetii RSA 493
uaauuggaggacugcucuu

SEQ ID NO: 570998 - RNA, 20 nt, Coxiella burnetii RSA 493
uaauuggaggacugcucuua

SEQ ID NO: 570999 - RNA, 13 nt, Coxiella burnetii RSA 493
uaauugggaagca

SEQ ID NO: 571000 - RNA, 15 nt, Coxiella burnetii RSA 493
uaauucuucuucauu

SEQ ID NO: 571001 - RNA, 20 nt, Coxiella burnetii RSA 493
uaauucuugcagugaaauaa

SEQ ID NO: 571002 - RNA, 22 nt, Coxiella burnetii RSA 493
uaauucuugcagugaaauaacc

SEQ ID NO: 571003 - RNA, 20 nt, Coxiella burnetii RSA 493
uaauugcuugggaacaacga

SEQ ID NO: 571004 - RNA, 23 nt, Coxiella burnetii RSA 493
uaauugcuugguugauucaauaa

SEQ ID NO: 571005 - RNA, 16 nt, Coxiella burnetii RSA 493
uaauuaagcuugaaaa

SEQ ID NO: 571006 - RNA, 19 nt, Coxiella burnetii RSA 493
uaauuaagcuugaaaaaau

SEQ ID NO: 571007 - RNA, 17 nt, Coxiella burnetii RSA 493
uacaggaaaaagauaau

SEQ ID NO: 571008 - RNA, 22 nt, Coxiella burnetii RSA 493
uacagugugcacgauuuuauaa

SEQ ID NO: 571009 - RNA, 18 nt, Coxiella burnetii RSA 493
uacagcggaacaccauuc

SEQ ID NO: 571010 - RNA, 19 nt, Coxiella burnetii RSA 493
uacagcggaacaccauucg

SEQ ID NO: 571011 - RNA, 23 nt, Coxiella burnetii RSA 493
uacagcgagagaauuaaaaauau

SEQ ID NO: 571012 - RNA, 19 nt, Coxiella burnetii RSA 493
uaccaaaaagcguuuaaau

SEQ ID NO: 571013 - RNA, 17 nt, Coxiella burnetii RSA 493
uacauuggucaauguca

SEQ ID NO: 571014 - RNA, 18 nt, Coxiella burnetii RSA 493
uacauaaagcuuauauaa

SEQ ID NO: 571015 - RNA, 17 nt, Coxiella burnetii RSA 493
uacaacgcuguuaaaau

SEQ ID NO: 571016 - RNA, 18 nt, Coxiella burnetii RSA 493
uaauuuuaaaaaaaauac

SEQ ID NO: 571017 - RNA, 18 nt, Coxiella burnetii RSA 493
uaauuuuaaaaaacccuc

SEQ ID NO: 571018 - RNA, 13 nt, Coxiella burnetii RSA 493
uaauuuuauuauu

SEQ ID NO: 571019 - RNA, 19 nt, Coxiella burnetii RSA 493
uacagaacgcccuauuccc

SEQ ID NO: 571020 - RNA, 17 nt, Coxiella burnetii RSA 493
uacacguuaaauagcca

SEQ ID NO: 571021 - RNA, 16 nt, Coxiella burnetii RSA 493
gugccgguaaaaaaau

SEQ ID NO: 571022 - RNA, 15 nt, Coxiella burnetii RSA 493
gugccaguauuuuuc

SEQ ID NO: 571023 - RNA, 11 nt, Coxiella burnetii RSA 493
gugcccaagaa

SEQ ID NO: 571024 - RNA, 17 nt, Coxiella burnetii RSA 493
gugcauaaauuauuuua

SEQ ID NO: 571025 - RNA, 20 nt, Coxiella burnetii RSA 493
aaauaguuugaugucccccg

SEQ ID NO: 571026 - RNA, 22 nt, Coxiella burnetii RSA 493
gucuagucgaaucaccugcucc

SEQ ID NO: 571027 - RNA, 15 nt, Coxiella burnetii RSA 493
gucuaguuauuuuuc

SEQ ID NO: 571028 - RNA, 14 nt, Coxiella burnetii RSA 493
gugauaauuauaag

SEQ ID NO: 571029 - RNA, 15 nt, Coxiella burnetii RSA 493
gucucacaacauucc

SEQ ID NO: 571030 - RNA, 22 nt, Coxiella burnetii RSA 493
gugauaauugauaguucauaug

SEQ ID NO: 571031 - RNA, 15 nt, Coxiella burnetii RSA 493
gugcggauuaaauaa

SEQ ID NO: 571032 - RNA, 20 nt, Coxiella burnetii RSA 493
gugcugcaacggcagaaacg

SEQ ID NO: 571033 - RNA, 13 nt, Coxiella burnetii RSA 493
guguauucgccuu

SEQ ID NO: 571034 - RNA, 23 nt, Coxiella burnetii RSA 493
guggucucuuuuuuugcgcccgc

SEQ ID NO: 571035 - RNA, 22 nt, Coxiella burnetii RSA 493
guuaucgaaggaauagccuucu

SEQ ID NO: 571036 - RNA, 19 nt, Coxiella burnetii RSA 493
guuauuaucaaguuuauaa

SEQ ID NO: 571037 - RNA, 22 nt, Coxiella burnetii RSA 493
guuauuaagcguuccuuucauc

SEQ ID NO: 571038 - RNA, 21 nt, Coxiella burnetii RSA 493
guuagcaaugggaacuuuuaa

SEQ ID NO: 571039 - RNA, 16 nt, Coxiella burnetii RSA 493
guucacucgcaaaaau

SEQ ID NO: 571040 - RNA, 19 nt, Coxiella burnetii RSA 493
guucacucgcaaaaauuuc

SEQ ID NO: 571041 - RNA, 16 nt, Coxiella burnetii RSA 493
guugaaagaaaaaaaa

SEQ ID NO: 571042 - RNA, 23 nt, Coxiella burnetii RSA 493
guugaaaaccuacacuuuuaauc

SEQ ID NO: 571043 - RNA, 13 nt, Coxiella burnetii RSA 493
guugaaaacgcga

SEQ ID NO: 571044 - RNA, 15 nt, Coxiella burnetii RSA 493
guucuuuuauuucuu

SEQ ID NO: 571045 - RNA, 11 nt, Coxiella burnetii RSA 493
guucuuuucaa

SEQ ID NO: 571046 - RNA, 14 nt, Coxiella burnetii RSA 493
guucuuuaauccaa

SEQ ID NO: 571047 - RNA, 21 nt, Coxiella burnetii RSA 493
guucucuccauuuagaaaaaa

SEQ ID NO: 571048 - RNA, 18 nt, Coxiella burnetii RSA 493
guucugaaauuuuauaag

SEQ ID NO: 571049 - RNA, 19 nt, Coxiella burnetii RSA 493
guucugaaauuuuauaagg

SEQ ID NO: 571050 - RNA, 22 nt, Coxiella burnetii RSA 493
guucuuaaagucuucaaaagug

SEQ ID NO: 571051 - RNA, 23 nt, Coxiella burnetii RSA 493
guugaaucaaauuaaaauaaucc

SEQ ID NO: 571052 - RNA, 18 nt, Coxiella burnetii RSA 493
guugcaagcguuuuucau

SEQ ID NO: 571053 - RNA, 18 nt, Coxiella burnetii RSA 493
guugauucaauaaucuca

SEQ ID NO: 571054 - RNA, 14 nt, Coxiella burnetii RSA 493
guugauuuuuuaaa

SEQ ID NO: 571055 - RNA, 13 nt, Coxiella burnetii RSA 493
guuuaaaaaugua

SEQ ID NO: 571056 - RNA, 12 nt, Coxiella burnetii RSA 493
guuguuuuaaau

SEQ ID NO: 571057 - RNA, 11 nt, Coxiella burnetii RSA 493
guuuaaaguua

SEQ ID NO: 571058 - RNA, 14 nt, Coxiella burnetii RSA 493
guuuaaauaacaaa

SEQ ID NO: 571059 - RNA, 16 nt, Coxiella burnetii RSA 493
guuguggcugaaaagu

SEQ ID NO: 571060 - RNA, 16 nt, Coxiella burnetii RSA 493
guuguuagcuuuucuu

SEQ ID NO: 571061 - RNA, 20 nt, Coxiella burnetii RSA 493
guuuagcuaacugauuagcu

SEQ ID NO: 571062 - RNA, 22 nt, Coxiella burnetii RSA 493
guuguauccagucguuuuuuaa

SEQ ID NO: 571063 - RNA, 23 nt, Coxiella burnetii RSA 493
guuguauccagucguuuuuuaau

SEQ ID NO: 571064 - RNA, 13 nt, Coxiella burnetii RSA 493
guuggauuucauc

SEQ ID NO: 571065 - RNA, 14 nt, Coxiella burnetii RSA 493
uaaaccuuuaauug

SEQ ID NO: 571066 - RNA, 23 nt, Coxiella burnetii RSA 493
uaaacggggaguggaauuuuaac

SEQ ID NO: 571067 - RNA, 14 nt, Coxiella burnetii RSA 493
uaaacccauuugau

SEQ ID NO: 571068 - RNA, 13 nt, Coxiella burnetii RSA 493
uaaaccauaagca

SEQ ID NO: 571069 - RNA, 15 nt, Coxiella burnetii RSA 493
uaaacuuuauuccca

SEQ ID NO: 571070 - RNA, 11 nt, Coxiella burnetii RSA 493
uaaacuuuacc

SEQ ID NO: 571071 - RNA, 17 nt, Coxiella burnetii RSA 493
uaaacguauugaguuuu

SEQ ID NO: 571072 - RNA, 13 nt, Coxiella burnetii RSA 493
uaaacaaaauaau

SEQ ID NO: 571073 - RNA, 16 nt, Coxiella burnetii RSA 493
uaaacaaaauaauaau

SEQ ID NO: 571074 - RNA, 20 nt, Coxiella burnetii RSA 493
uaaacaaguuaacaaaauca

SEQ ID NO: 571075 - RNA, 12 nt, Coxiella burnetii RSA 493
uaaaauuuaaua

SEQ ID NO: 571076 - RNA, 18 nt, Coxiella burnetii RSA 493
uaaagagccgucauccaa

SEQ ID NO: 571077 - RNA, 19 nt, Coxiella burnetii RSA 493
uaaagcaaaaguaauauuu

SEQ ID NO: 571078 - RNA, 18 nt, Coxiella burnetii RSA 493
uaaagcagcgugcagcug

SEQ ID NO: 571079 - RNA, 18 nt, Coxiella burnetii RSA 493
uaaagccguuauccauga

SEQ ID NO: 571080 - RNA, 22 nt, Coxiella burnetii RSA 493
uaaagcguuucucgauauucua

SEQ ID NO: 571081 - RNA, 15 nt, Coxiella burnetii RSA 493
uaaagcgcuuacagc

SEQ ID NO: 571082 - RNA, 19 nt, Coxiella burnetii RSA 493
uaaaggcuaauaggaaaaa

SEQ ID NO: 571083 - RNA, 14 nt, Coxiella burnetii RSA 493
uaaauauuuagcaa

SEQ ID NO: 571084 - RNA, 16 nt, Coxiella burnetii RSA 493
uaaauacauacauaaa

SEQ ID NO: 571085 - RNA, 17 nt, Coxiella burnetii RSA 493
uaaauacauacauaaag

SEQ ID NO: 571086 - RNA, 17 nt, Coxiella burnetii RSA 493
uaaauaccauuuuccuu

SEQ ID NO: 571087 - RNA, 15 nt, Coxiella burnetii RSA 493
uaaauaaucuuccca

SEQ ID NO: 571088 - RNA, 15 nt, Coxiella burnetii RSA 493
uaaagguuuuuccuu

SEQ ID NO: 571089 - RNA, 20 nt, Coxiella burnetii RSA 493
uaacaaaugaugaauuuauu

SEQ ID NO: 571090 - RNA, 21 nt, Coxiella burnetii RSA 493
uaacaaaugaugaauuuauuu

SEQ ID NO: 571091 - RNA, 13 nt, Coxiella burnetii RSA 493
uaacaacaaaacc

SEQ ID NO: 571092 - RNA, 21 nt, Coxiella burnetii RSA 493
uaacaacagcgcccaauaagg

SEQ ID NO: 571093 - RNA, 19 nt, Coxiella burnetii RSA 493
uaaauuucucaucugucau

SEQ ID NO: 571094 - RNA, 22 nt, Coxiella burnetii RSA 493
uaaauuugccuugaucaaagac

SEQ ID NO: 571095 - RNA, 17 nt, Coxiella burnetii RSA 493
uaaauuuaaucuuuauc

SEQ ID NO: 571096 - RNA, 20 nt, Coxiella burnetii RSA 493
uaaauuuaaucuuuauccaa

SEQ ID NO: 571097 - RNA, 19 nt, Coxiella burnetii RSA 493
uaaauuguccuuuucuauu

SEQ ID NO: 571098 - RNA, 12 nt, Coxiella burnetii RSA 493
uaaauuauaaau

SEQ ID NO: 571099 - RNA, 16 nt, Coxiella burnetii RSA 493
uaaaucaacaccccaa

SEQ ID NO: 571100 - RNA, 18 nt, Coxiella burnetii RSA 493
uaaaucaauuaaauuuac

SEQ ID NO: 571101 - RNA, 13 nt, Coxiella burnetii RSA 493
uaaaucaauugcc

SEQ ID NO: 571102 - RNA, 14 nt, Coxiella burnetii RSA 493
uaaaugaauuacuu

SEQ ID NO: 571103 - RNA, 21 nt, Coxiella burnetii RSA 493
uaaaugcaccuuggcguccug

SEQ ID NO: 571104 - RNA, 17 nt, Coxiella burnetii RSA 493
uaacauacgacuucauu

SEQ ID NO: 571105 - RNA, 22 nt, Coxiella burnetii RSA 493
uaacauacgacuucauuucuac

SEQ ID NO: 571106 - RNA, 23 nt, Coxiella burnetii RSA 493
uaacauucaaagaacgccaguca

SEQ ID NO: 571107 - RNA, 21 nt, Coxiella burnetii RSA 493
uaacauuauuacauauuucuu

SEQ ID NO: 571108 - RNA, 22 nt, Coxiella burnetii RSA 493
uaacauuauuacauauuucuuu

SEQ ID NO: 571109 - RNA, 23 nt, Coxiella burnetii RSA 493
uaacagcaagaggaguucuaaaa

SEQ ID NO: 571110 - RNA, 21 nt, Coxiella burnetii RSA 493
uaacagcgaacauccaauuac

SEQ ID NO: 571111 - RNA, 22 nt, Coxiella burnetii RSA 493
uaacaguaacucuaauuuuccu

SEQ ID NO: 571112 - RNA, 17 nt, Coxiella burnetii RSA 493
uaacaguguuuaacucu

SEQ ID NO: 571113 - RNA, 22 nt, Coxiella burnetii RSA 493
uaacagugccgguucccgcuuc

SEQ ID NO: 571114 - RNA, 19 nt, Coxiella burnetii RSA 493
uaacaguugguuagcaaug

SEQ ID NO: 571115 - RNA, 15 nt, Coxiella burnetii RSA 493
uaacgacaaccauug

SEQ ID NO: 571116 - RNA, 19 nt, Coxiella burnetii RSA 493
uaacgaaucgauugaacuu

SEQ ID NO: 571117 - RNA, 17 nt, Coxiella burnetii RSA 493
uaaccucuccauccaua

SEQ ID NO: 571118 - RNA, 14 nt, Coxiella burnetii RSA 493
uaaccuugcauaau

SEQ ID NO: 571119 - RNA, 17 nt, Coxiella burnetii RSA 493
uaaccaaucaauaaaaa

SEQ ID NO: 571120 - RNA, 18 nt, Coxiella burnetii RSA 493
uaaccaauugauuaauua

SEQ ID NO: 571121 - RNA, 15 nt, Coxiella burnetii RSA 493
uaaaaauaaauuaau

SEQ ID NO: 571122 - RNA, 16 nt, Coxiella burnetii RSA 493
uaaaaauaaauuaauu

SEQ ID NO: 571123 - RNA, 15 nt, Coxiella burnetii RSA 493
uaaaaauaaugaucc

SEQ ID NO: 571124 - RNA, 17 nt, Coxiella burnetii RSA 493
uaaaaaauuacugaaag

SEQ ID NO: 571125 - RNA, 13 nt, Coxiella burnetii RSA 493
uaaaaaauucaau

SEQ ID NO: 571126 - RNA, 21 nt, Coxiella burnetii RSA 493
uaaaaaauucaucguagaugu

SEQ ID NO: 571127 - RNA, 23 nt, Coxiella burnetii RSA 493
uaaaaacaaagugaaauauguca

SEQ ID NO: 571128 - RNA, 15 nt, Coxiella burnetii RSA 493
uaaaaaaucuuugcu

SEQ ID NO: 571129 - RNA, 18 nt, Coxiella burnetii RSA 493
uaaaaaaucuuugcucua

SEQ ID NO: 571130 - RNA, 19 nt, Coxiella burnetii RSA 493
uaaaaaaucuuugcucuaa

SEQ ID NO: 571131 - RNA, 23 nt, Coxiella burnetii RSA 493
uaaaaaaucuuugcucuaaauua

SEQ ID NO: 571132 - RNA, 21 nt, Coxiella burnetii RSA 493
uaaaaaaaauacucuuucaua

SEQ ID NO: 571133 - RNA, 13 nt, Coxiella burnetii RSA 493
uaaaaaagaaaau

SEQ ID NO: 571134 - RNA, 12 nt, Coxiella burnetii RSA 493
uaaaaaacccca

SEQ ID NO: 571135 - RNA, 22 nt, Coxiella burnetii RSA 493
uaaaaaagcaagccgaauaaau

SEQ ID NO: 571136 - RNA, 16 nt, Coxiella burnetii RSA 493
guuuuugauugccaaa

SEQ ID NO: 571137 - RNA, 21 nt, Coxiella burnetii RSA 493
guuuuuaagucccaauuucuu

SEQ ID NO: 571138 - RNA, 13 nt, Coxiella burnetii RSA 493
guuuuuugauaaa

SEQ ID NO: 571139 - RNA, 15 nt, Coxiella burnetii RSA 493
guuuuuugggaugcg

SEQ ID NO: 571140 - RNA, 15 nt, Coxiella burnetii RSA 493
guuuuuuaauuuuug

SEQ ID NO: 571141 - RNA, 23 nt, Coxiella burnetii RSA 493
guuuuuggcaugauguucucucc

SEQ ID NO: 571142 - RNA, 11 nt, Coxiella burnetii RSA 493
guuuuuaaaug

SEQ ID NO: 571143 - RNA, 21 nt, Coxiella burnetii RSA 493
guuuuaucccaauaguaaaac

SEQ ID NO: 571144 - RNA, 21 nt, Coxiella burnetii RSA 493
guuuuaucguucgcaauugaa

SEQ ID NO: 571145 - RNA, 15 nt, Coxiella burnetii RSA 493
guuugaauauuuucg

SEQ ID NO: 571146 - RNA, 12 nt, Coxiella burnetii RSA 493
guuugaaaaaau

SEQ ID NO: 571147 - RNA, 14 nt, Coxiella burnetii RSA 493
guuucuuuuauaaa

SEQ ID NO: 571148 - RNA, 16 nt, Coxiella burnetii RSA 493
guuuuaagaaaaacca

SEQ ID NO: 571149 - RNA, 21 nt, Coxiella burnetii RSA 493
guuuuaaaauuagcgauguca

SEQ ID NO: 571150 - RNA, 18 nt, Coxiella burnetii RSA 493
guuuuaaaugcuuuucuu

SEQ ID NO: 571151 - RNA, 23 nt, Coxiella burnetii RSA 493
uaaaacucuugccggauugauaa

SEQ ID NO: 571152 - RNA, 18 nt, Coxiella burnetii RSA 493
uaaaacggcuugauuuca

SEQ ID NO: 571153 - RNA, 23 nt, Coxiella burnetii RSA 493
uaaaacgacagguauuuuaagua

SEQ ID NO: 571154 - RNA, 23 nt, Coxiella burnetii RSA 493
uaaaacgcaucggccuuuuucau

SEQ ID NO: 571155 - RNA, 23 nt, Coxiella burnetii RSA 493
uaaaacgauauuaucaaaacgua

SEQ ID NO: 571156 - RNA, 14 nt, Coxiella burnetii RSA 493
uaaaaccuccugca

SEQ ID NO: 571157 - RNA, 17 nt, Coxiella burnetii RSA 493
uaaaacuucccauucua

SEQ ID NO: 571158 - RNA, 19 nt, Coxiella burnetii RSA 493
uaaaagagcgaauaaaaaa

SEQ ID NO: 571159 - RNA, 16 nt, Coxiella burnetii RSA 493
uaaaagcgcaauuucc

SEQ ID NO: 571160 - RNA, 12 nt, Coxiella burnetii RSA 493
uaaaagcaucaa

SEQ ID NO: 571161 - RNA, 13 nt, Coxiella burnetii RSA 493
uaaaaauuugauu

SEQ ID NO: 571162 - RNA, 17 nt, Coxiella burnetii RSA 493
uaaaaauuuuaaaaaaa

SEQ ID NO: 571163 - RNA, 20 nt, Coxiella burnetii RSA 493
uaaaaggaauucuaauuaaa

SEQ ID NO: 571164 - RNA, 23 nt, Coxiella burnetii RSA 493
uaaaaggagaaauugacaaauaa

SEQ ID NO: 571165 - RNA, 21 nt, Coxiella burnetii RSA 493
uaaaauagcguguaauugaug

SEQ ID NO: 571166 - RNA, 20 nt, Coxiella burnetii RSA 493
uaaaauacuggcaauaagug

SEQ ID NO: 571167 - RNA, 21 nt, Coxiella burnetii RSA 493
uaaaaugaccaugguuucuuu

SEQ ID NO: 571168 - RNA, 17 nt, Coxiella burnetii RSA 493
uaaaauccgcuuuauuu

SEQ ID NO: 571169 - RNA, 22 nt, Coxiella burnetii RSA 493
uaaaauccgcuuuauuuuucgc

SEQ ID NO: 571170 - RNA, 12 nt, Coxiella burnetii RSA 493
guacuuucacua

SEQ ID NO: 571171 - RNA, 21 nt, Coxiella burnetii RSA 493
guacguuuuuagugcaaaaaa

SEQ ID NO: 571172 - RNA, 22 nt, Coxiella burnetii RSA 493
guacugugcggauuaaauaacu

SEQ ID NO: 571173 - RNA, 23 nt, Coxiella burnetii RSA 493
guagagacaauagaauaaugaac

SEQ ID NO: 571174 - RNA, 10 nt, Coxiella burnetii RSA 493
guagaaugga

SEQ ID NO: 571175 - RNA, 15 nt, Coxiella burnetii RSA 493
guagaauucucccau

SEQ ID NO: 571176 - RNA, 18 nt, Coxiella burnetii RSA 493
guagaauucucccaugag

SEQ ID NO: 571177 - RNA, 16 nt, Coxiella burnetii RSA 493
guagacaguuuagaau

SEQ ID NO: 571178 - RNA, 17 nt, Coxiella burnetii RSA 493
guagaugcuaucgauga

SEQ ID NO: 571179 - RNA, 17 nt, Coxiella burnetii RSA 493
guagccuucuuuuucaa

SEQ ID NO: 571180 - RNA, 17 nt, Coxiella burnetii RSA 493
guagcgacacaaccacu

SEQ ID NO: 571181 - RNA, 13 nt, Coxiella burnetii RSA 493
guagccuaaccaa

SEQ ID NO: 571182 - RNA, 12 nt, Coxiella burnetii RSA 493
guagcccuugcg

SEQ ID NO: 571183 - RNA, 23 nt, Coxiella burnetii RSA 493
guagcuaaguagcccguaugagc

SEQ ID NO: 571184 - RNA, 18 nt, Coxiella burnetii RSA 493
guagcuaauacuaaacaa

SEQ ID NO: 571185 - RNA, 20 nt, Coxiella burnetii RSA 493
guauaacaaaauuaaaaaac

SEQ ID NO: 571186 - RNA, 15 nt, Coxiella burnetii RSA 493
guauaaauaacuuua

SEQ ID NO: 571187 - RNA, 13 nt, Coxiella burnetii RSA 493
guauaaaugaucc

SEQ ID NO: 571188 - RNA, 16 nt, Coxiella burnetii RSA 493
guauaaagguuuuucc

SEQ ID NO: 571189 - RNA, 22 nt, Coxiella burnetii RSA 493
guauaggaacauucuaauaaaa

SEQ ID NO: 571190 - RNA, 11 nt, Coxiella burnetii RSA 493
guauaguucua

SEQ ID NO: 571191 - RNA, 15 nt, Coxiella burnetii RSA 493
guaugaaucagcuua

SEQ ID NO: 571192 - RNA, 16 nt, Coxiella burnetii RSA 493
guaucaccaaaauaca

SEQ ID NO: 571193 - RNA, 20 nt, Coxiella burnetii RSA 493
guauugaggucguuaaaaaa

SEQ ID NO: 571194 - RNA, 19 nt, Coxiella burnetii RSA 493
guauuccuuuuucuuuuaa

SEQ ID NO: 571195 - RNA, 15 nt, Coxiella burnetii RSA 493
guauucgccuucccg

SEQ ID NO: 571196 - RNA, 23 nt, Coxiella burnetii RSA 493
guauuauuauccgguuuugauuu

SEQ ID NO: 571197 - RNA, 17 nt, Coxiella burnetii RSA 493
guauugucaaaauuaga

SEQ ID NO: 571198 - RNA, 17 nt, Coxiella burnetii RSA 493
guauuuguguaaaauac

SEQ ID NO: 571199 - RNA, 20 nt, Coxiella burnetii RSA 493
guauuuguucguaauaauaa

SEQ ID NO: 571200 - RNA, 16 nt, Coxiella burnetii RSA 493
guauuucgcuucgcuc

SEQ ID NO: 571201 - RNA, 17 nt, Coxiella burnetii RSA 493
guauuuuuuuuaaaauu

SEQ ID NO: 571202 - RNA, 16 nt, Coxiella burnetii RSA 493
guauuuugcaaaugaa

SEQ ID NO: 571203 - RNA, 18 nt, Coxiella burnetii RSA 493
guauuuugcaaaugaaua

SEQ ID NO: 571204 - RNA, 12 nt, Coxiella burnetii RSA 493
guauuuugcaaa

SEQ ID NO: 571205 - RNA, 23 nt, Coxiella burnetii RSA 493
guauuuuucuuuggguuggcuuu

SEQ ID NO: 571206 - RNA, 13 nt, Coxiella burnetii RSA 493
gucaccgguuagg

SEQ ID NO: 571207 - RNA, 21 nt, Coxiella burnetii RSA 493
gucacaauuaucuuaaugaaa

SEQ ID NO: 571208 - RNA, 15 nt, Coxiella burnetii RSA 493
gucaagucuuugaca

SEQ ID NO: 571209 - RNA, 19 nt, Coxiella burnetii RSA 493
gucagacuugcuuuuuucu

SEQ ID NO: 571210 - RNA, 15 nt, Coxiella burnetii RSA 493
gucagcguuucuaug

SEQ ID NO: 571211 - RNA, 15 nt, Coxiella burnetii RSA 493
gucauaaauaaaagc

SEQ ID NO: 571212 - RNA, 16 nt, Coxiella burnetii RSA 493
guccccaaaguuucac

SEQ ID NO: 571213 - RNA, 19 nt, Coxiella burnetii RSA 493
guccuguugauacuaaauu

SEQ ID NO: 571214 - RNA, 17 nt, Coxiella burnetii RSA 493
guccuguucuuuuucca

SEQ ID NO: 571215 - RNA, 20 nt, Coxiella burnetii RSA 493
guccuguucuuuuuccaugu

SEQ ID NO: 571216 - RNA, 13 nt, Coxiella burnetii RSA 493
guccguaauaguc

SEQ ID NO: 571217 - RNA, 17 nt, Coxiella burnetii RSA 493
gucgaugauuuuuucga

SEQ ID NO: 571218 - RNA, 18 nt, Coxiella burnetii RSA 493
gucguauccaaauauuua

SEQ ID NO: 571219 - RNA, 21 nt, Coxiella burnetii RSA 493
gucguauccaaauauuuaaau

SEQ ID NO: 571220 - RNA, 16 nt, Coxiella burnetii RSA 493
gucguauuccuuuuuc

SEQ ID NO: 571221 - RNA, 23 nt, Coxiella burnetii RSA 493
gucguauuccuuuuucuuuuaau

SEQ ID NO: 571222 - RNA, 15 nt, Coxiella burnetii RSA 493
ggugcgaauaacaaa

SEQ ID NO: 571223 - RNA, 15 nt, Coxiella burnetii RSA 493
ggugagaagaauaag

SEQ ID NO: 571224 - RNA, 21 nt, Coxiella burnetii RSA 493
ggugagagcaggcugacucag

SEQ ID NO: 571225 - RNA, 21 nt, Coxiella burnetii RSA 493
ggugacgaggaaagauaaggu

SEQ ID NO: 571226 - RNA, 15 nt, Coxiella burnetii RSA 493
ggcucccuaauacug

SEQ ID NO: 571227 - RNA, 16 nt, Coxiella burnetii RSA 493
ggcucagugauuaaau

SEQ ID NO: 571228 - RNA, 20 nt, Coxiella burnetii RSA 493
ggugauucucucaaagaaac

SEQ ID NO: 571229 - RNA, 21 nt, Coxiella burnetii RSA 493
gguucuaacgcaaucggauua

SEQ ID NO: 571230 - RNA, 22 nt, Coxiella burnetii RSA 493
gguucucaaauugcuccaaaca

SEQ ID NO: 571231 - RNA, 18 nt, Coxiella burnetii RSA 493
gguucaugaaaaagauaa

SEQ ID NO: 571232 - RNA, 14 nt, Coxiella burnetii RSA 493
gguucaagucccuc

SEQ ID NO: 571233 - RNA, 14 nt, Coxiella burnetii RSA 493
ggugucaaaauuau

SEQ ID NO: 571234 - RNA, 12 nt, Coxiella burnetii RSA 493
guaaaacaaugc

SEQ ID NO: 571235 - RNA, 18 nt, Coxiella burnetii RSA 493
guaaaacgaaucuuuaca

SEQ ID NO: 571236 - RNA, 18 nt, Coxiella burnetii RSA 493
guaaaacgauauuaucaa

SEQ ID NO: 571237 - RNA, 12 nt, Coxiella burnetii RSA 493
gguuuucuuccg

SEQ ID NO: 571238 - RNA, 21 nt, Coxiella burnetii RSA 493
gguuuugaagaagagcggcuu

SEQ ID NO: 571239 - RNA, 18 nt, Coxiella burnetii RSA 493
guaaaaaaauaguuucaa

SEQ ID NO: 571240 - RNA, 22 nt, Coxiella burnetii RSA 493
guaaaaacauccuccauuacau

SEQ ID NO: 571241 - RNA, 12 nt, Coxiella burnetii RSA 493
gguuuuuuuaaa

SEQ ID NO: 571242 - RNA, 12 nt, Coxiella burnetii RSA 493
gguuuuccauga

SEQ ID NO: 571243 - RNA, 14 nt, Coxiella burnetii RSA 493
gguugucaacaaaa

SEQ ID NO: 571244 - RNA, 18 nt, Coxiella burnetii RSA 493
gguugucaacaaaauuuu

SEQ ID NO: 571245 - RNA, 14 nt, Coxiella burnetii RSA 493
gguuuacauaagaa

SEQ ID NO: 571246 - RNA, 17 nt, Coxiella burnetii RSA 493
gguuggacuacaucaaa

SEQ ID NO: 571247 - RNA, 15 nt, Coxiella burnetii RSA 493
gguugggcugagcuu

SEQ ID NO: 571248 - RNA, 22 nt, Coxiella burnetii RSA 493
gguugaaaacgauagucucuau

SEQ ID NO: 571249 - RNA, 17 nt, Coxiella burnetii RSA 493
gguugaaagaaaaaaaa

SEQ ID NO: 571250 - RNA, 21 nt, Coxiella burnetii RSA 493
gguugaaagccgagucucugu

SEQ ID NO: 571251 - RNA, 17 nt, Coxiella burnetii RSA 493
guacgccaaccauaauc

SEQ ID NO: 571252 - RNA, 12 nt, Coxiella burnetii RSA 493
guaccugccauu

SEQ ID NO: 571253 - RNA, 18 nt, Coxiella burnetii RSA 493
guaccaaugucuucccau

SEQ ID NO: 571254 - RNA, 21 nt, Coxiella burnetii RSA 493
guaccaaugucuucccauguc

SEQ ID NO: 571255 - RNA, 13 nt, Coxiella burnetii RSA 493
guacauuuuucaa

SEQ ID NO: 571256 - RNA, 22 nt, Coxiella burnetii RSA 493
guacagcgagagaauuaaaaau

SEQ ID NO: 571257 - RNA, 15 nt, Coxiella burnetii RSA 493
guaaucaauaaaacu

SEQ ID NO: 571258 - RNA, 22 nt, Coxiella burnetii RSA 493
guaaucgcuaagcgaaaaauga

SEQ ID NO: 571259 - RNA, 19 nt, Coxiella burnetii RSA 493
aaauagaauuuuugacuaa

SEQ ID NO: 571260 - RNA, 22 nt, Coxiella burnetii RSA 493
aaauagagucgggaaauaaaau

SEQ ID NO: 571261 - RNA, 18 nt, Coxiella burnetii RSA 493
guaaucucacuuggauuu

SEQ ID NO: 571262 - RNA, 21 nt, Coxiella burnetii RSA 493
guaaucguucggcuucauaua

SEQ ID NO: 571263 - RNA, 17 nt, Coxiella burnetii RSA 493
guaaugcaaugaauuca

SEQ ID NO: 571264 - RNA, 14 nt, Coxiella burnetii RSA 493
guaaugaugccuua

SEQ ID NO: 571265 - RNA, 21 nt, Coxiella burnetii RSA 493
guaauugcuugguugauucaa

SEQ ID NO: 571266 - RNA, 22 nt, Coxiella burnetii RSA 493
guaauuaccugaaugcuuuuaa

SEQ ID NO: 571267 - RNA, 19 nt, Coxiella burnetii RSA 493
guacacaaaauuucaagua

SEQ ID NO: 571268 - RNA, 19 nt, Coxiella burnetii RSA 493
guaauuuuaaaaaaaauac

SEQ ID NO: 571269 - RNA, 20 nt, Coxiella burnetii RSA 493
guaauuuuaaaaaaaauacu

SEQ ID NO: 571270 - RNA, 19 nt, Coxiella burnetii RSA 493
guaauuucucgaaugacaa

SEQ ID NO: 571271 - RNA, 14 nt, Coxiella burnetii RSA 493
guaauuucuuccuc

SEQ ID NO: 571272 - RNA, 20 nt, Coxiella burnetii RSA 493
guacaaaccacccuccagcc

SEQ ID NO: 571273 - RNA, 16 nt, Coxiella burnetii RSA 493
guaauaauauaauuga

SEQ ID NO: 571274 - RNA, 16 nt, Coxiella burnetii RSA 493
guaagcgugcaacaag

SEQ ID NO: 571275 - RNA, 18 nt, Coxiella burnetii RSA 493
guaagcuugcuugcuaau

SEQ ID NO: 571276 - RNA, 17 nt, Coxiella burnetii RSA 493
guaaggcaacucuuugg

SEQ ID NO: 571277 - RNA, 22 nt, Coxiella burnetii RSA 493
guaacugauguauccuaauaaa

SEQ ID NO: 571278 - RNA, 16 nt, Coxiella burnetii RSA 493
guaacucuaauuuucc

SEQ ID NO: 571279 - RNA, 19 nt, Coxiella burnetii RSA 493
guaagaauucuccugcgcc

SEQ ID NO: 571280 - RNA, 13 nt, Coxiella burnetii RSA 493
guaaccucuccau

SEQ ID NO: 571281 - RNA, 14 nt, Coxiella burnetii RSA 493
guaaaauaagaagg

SEQ ID NO: 571282 - RNA, 19 nt, Coxiella burnetii RSA 493
guaaagccguuauccauga

SEQ ID NO: 571283 - RNA, 22 nt, Coxiella burnetii RSA 493
guaaacuucgcacaucauugaa

SEQ ID NO: 571284 - RNA, 12 nt, Coxiella burnetii RSA 493
guaacaaaagau

SEQ ID NO: 571285 - RNA, 20 nt, Coxiella burnetii RSA 493
gcaacguuugauuuucaagu

SEQ ID NO: 571286 - RNA, 21 nt, Coxiella burnetii RSA 493
aaagcgagcaaucaaaacagc

SEQ ID NO: 571287 - RNA, 17 nt, Coxiella burnetii RSA 493
aaagcgcccaaaugauc

SEQ ID NO: 571288 - RNA, 19 nt, Coxiella burnetii RSA 493
gcaagaacauccggcucga

SEQ ID NO: 571289 - RNA, 17 nt, Coxiella burnetii RSA 493
gcaagacaauguuaaaa

SEQ ID NO: 571290 - RNA, 23 nt, Coxiella burnetii RSA 493
gcaagacaauguuaaaacacaua

SEQ ID NO: 571291 - RNA, 23 nt, Coxiella burnetii RSA 493
gcaacuuuaacauuaucauguuc

SEQ ID NO: 571292 - RNA, 23 nt, Coxiella burnetii RSA 493
aaagcggccgcugugccugccau

SEQ ID NO: 571293 - RNA, 16 nt, Coxiella burnetii RSA 493
aaagcgcguaagcagc

SEQ ID NO: 571294 - RNA, 18 nt, Coxiella burnetii RSA 493
aaagcggaauaagaaauc

SEQ ID NO: 571295 - RNA, 19 nt, Coxiella burnetii RSA 493
aaagcggaauaagaaaucu

SEQ ID NO: 571296 - RNA, 21 nt, Coxiella burnetii RSA 493
aaagcggaauuagccagcgaa

SEQ ID NO: 571297 - RNA, 22 nt, Coxiella burnetii RSA 493
aaagcggaauuagccagcgaau

SEQ ID NO: 571298 - RNA, 17 nt, Coxiella burnetii RSA 493
gcaacgaaaauaccuuu

SEQ ID NO: 571299 - RNA, 21 nt, Coxiella burnetii RSA 493
gcaacgaaaauaccuuugcaa

SEQ ID NO: 571300 - RNA, 16 nt, Coxiella burnetii RSA 493
gcaagcgucccaggaa

SEQ ID NO: 571301 - RNA, 19 nt, Coxiella burnetii RSA 493
gcaagcacugcaccauaac

SEQ ID NO: 571302 - RNA, 15 nt, Coxiella burnetii RSA 493
gcaagucccucugaa

SEQ ID NO: 571303 - RNA, 15 nt, Coxiella burnetii RSA 493
gcaauaacaaauaaa

SEQ ID NO: 571304 - RNA, 15 nt, Coxiella burnetii RSA 493
gcaauaagcuaucag

SEQ ID NO: 571305 - RNA, 21 nt, Coxiella burnetii RSA 493
gcaauacaucuugauccuuuu

SEQ ID NO: 571306 - RNA, 19 nt, Coxiella burnetii RSA 493
gcaauacccaauucagaau

SEQ ID NO: 571307 - RNA, 19 nt, Coxiella burnetii RSA 493
gcaauaccccaaucgauua

SEQ ID NO: 571308 - RNA, 22 nt, Coxiella burnetii RSA 493
gcaaucggauuaacgugcucgu

SEQ ID NO: 571309 - RNA, 15 nt, Coxiella burnetii RSA 493
gcaaugccaccuuuu

SEQ ID NO: 571310 - RNA, 21 nt, Coxiella burnetii RSA 493
gcaauauuuagagaagguuac

SEQ ID NO: 571311 - RNA, 19 nt, Coxiella burnetii RSA 493
gcaauucgaccuuugaaaa

SEQ ID NO: 571312 - RNA, 19 nt, Coxiella burnetii RSA 493
gcaauucgcggguaaauuu

SEQ ID NO: 571313 - RNA, 23 nt, Coxiella burnetii RSA 493
gcaauucgcggguaaauuuauca

SEQ ID NO: 571314 - RNA, 13 nt, Coxiella burnetii RSA 493
gcaauuugugaaa

SEQ ID NO: 571315 - RNA, 14 nt, Coxiella burnetii RSA 493
gcacagcgaaauac

SEQ ID NO: 571316 - RNA, 24 nt, Coxiella burnetii RSA 493
gcacagucacguacccaggcguag

SEQ ID NO: 571317 - RNA, 14 nt, Coxiella burnetii RSA 493
gcacaucuucacgc

SEQ ID NO: 571318 - RNA, 16 nt, Coxiella burnetii RSA 493
gcacaaugcuuuucuc

SEQ ID NO: 571319 - RNA, 18 nt, Coxiella burnetii RSA 493
gcacaaugcuuuucucaa

SEQ ID NO: 571320 - RNA, 15 nt, Coxiella burnetii RSA 493
gcacacuuugaugag

SEQ ID NO: 571321 - RNA, 21 nt, Coxiella burnetii RSA 493
gcaccguaaaacgaaucuuua

SEQ ID NO: 571322 - RNA, 12 nt, Coxiella burnetii RSA 493
gcaccagggguu

SEQ ID NO: 571323 - RNA, 18 nt, Coxiella burnetii RSA 493
gcaccuuggcguccuguu

SEQ ID NO: 571324 - RNA, 20 nt, Coxiella burnetii RSA 493
gcacgaaauaauuacaacua

SEQ ID NO: 571325 - RNA, 22 nt, Coxiella burnetii RSA 493
gcaccuuaacgccuaucuuuuu

SEQ ID NO: 571326 - RNA, 17 nt, Coxiella burnetii RSA 493
gcacgguaauaauauaa

SEQ ID NO: 571327 - RNA, 20 nt, Coxiella burnetii RSA 493
gcagaaacaauacucuuauu

SEQ ID NO: 571328 - RNA, 17 nt, Coxiella burnetii RSA 493
gcagaaaagaugguugg

SEQ ID NO: 571329 - RNA, 22 nt, Coxiella burnetii RSA 493
gcagacaucuguaauuuuucuu

SEQ ID NO: 571330 - RNA, 20 nt, Coxiella burnetii RSA 493
gcagacccgcauucuuuuau

SEQ ID NO: 571331 - RNA, 23 nt, Coxiella burnetii RSA 493
gcagaaggcccgcuaauuguuca

SEQ ID NO: 571332 - RNA, 14 nt, Coxiella burnetii RSA 493
gcagccaagucgag

SEQ ID NO: 571333 - RNA, 15 nt, Coxiella burnetii RSA 493
gcaggcauucaacac

SEQ ID NO: 571334 - RNA, 14 nt, Coxiella burnetii RSA 493
gcagcgaagcgaaa

SEQ ID NO: 571335 - RNA, 15 nt, Coxiella burnetii RSA 493
gcagcgaagcgaaau

SEQ ID NO: 571336 - RNA, 18 nt, Coxiella burnetii RSA 493
gcaugauacaaauuuuua

SEQ ID NO: 571337 - RNA, 19 nt, Coxiella burnetii RSA 493
gcaugaauuaaauauaauu

SEQ ID NO: 571338 - RNA, 13 nt, Coxiella burnetii RSA 493
gcaugaaauuuuu

SEQ ID NO: 571339 - RNA, 13 nt, Coxiella burnetii RSA 493
gcaucuuuuugca

SEQ ID NO: 571340 - RNA, 20 nt, Coxiella burnetii RSA 493
gcaucuuuucugaaacauca

SEQ ID NO: 571341 - RNA, 14 nt, Coxiella burnetii RSA 493
gcaucuuuuucucc

SEQ ID NO: 571342 - RNA, 14 nt, Coxiella burnetii RSA 493
gcauucuauuagcu

SEQ ID NO: 571343 - RNA, 15 nt, Coxiella burnetii RSA 493
gcauuaaaagauuua

SEQ ID NO: 571344 - RNA, 17 nt, Coxiella burnetii RSA 493
gcauuuuuaaaagugac

SEQ ID NO: 571345 - RNA, 14 nt, Coxiella burnetii RSA 493
gcaucccccaagag

SEQ ID NO: 571346 - RNA, 18 nt, Coxiella burnetii RSA 493
gcauauaacugcaaauaa

SEQ ID NO: 571347 - RNA, 19 nt, Coxiella burnetii RSA 493
gcauacagcggaacaccau

SEQ ID NO: 571348 - RNA, 15 nt, Coxiella burnetii RSA 493
gcauacgauauaaaa

SEQ ID NO: 571349 - RNA, 17 nt, Coxiella burnetii RSA 493
gcauacgauauaaaagc

SEQ ID NO: 571350 - RNA, 18 nt, Coxiella burnetii RSA 493
gcauacgauauaaaagca

SEQ ID NO: 571351 - RNA, 23 nt, Coxiella burnetii RSA 493
gccaacuuauagcccacacuaaa

SEQ ID NO: 571352 - RNA, 18 nt, Coxiella burnetii RSA 493
gccaaaauaauaacccac

SEQ ID NO: 571353 - RNA, 15 nt, Coxiella burnetii RSA 493
gccaaaaccgccggc

SEQ ID NO: 571354 - RNA, 12 nt, Coxiella burnetii RSA 493
gccaaccauaau

SEQ ID NO: 571355 - RNA, 16 nt, Coxiella burnetii RSA 493
gccaauguuugcucaa

SEQ ID NO: 571356 - RNA, 18 nt, Coxiella burnetii RSA 493
gccacaaagaauuuuucc

SEQ ID NO: 571357 - RNA, 20 nt, Coxiella burnetii RSA 493
gccaauacgaacaauuguuc

SEQ ID NO: 571358 - RNA, 21 nt, Coxiella burnetii RSA 493
gccaggugggggagaucgaaa

SEQ ID NO: 571359 - RNA, 13 nt, Coxiella burnetii RSA 493
gccauuucgcuuu

SEQ ID NO: 571360 - RNA, 18 nt, Coxiella burnetii RSA 493
gccauuuggucaaggcca

SEQ ID NO: 571361 - RNA, 15 nt, Coxiella burnetii RSA 493
gccauccaaaugagc

SEQ ID NO: 571362 - RNA, 18 nt, Coxiella burnetii RSA 493
gccaucaccacaauuaau

SEQ ID NO: 571363 - RNA, 12 nt, Coxiella burnetii RSA 493
gccccuccucua

SEQ ID NO: 571364 - RNA, 17 nt, Coxiella burnetii RSA 493
gcccccgaaacaggcgg

SEQ ID NO: 571365 - RNA, 17 nt, Coxiella burnetii RSA 493
gcccagcagcguauuug

SEQ ID NO: 571366 - RNA, 12 nt, Coxiella burnetii RSA 493
gcccaugacgac

SEQ ID NO: 571367 - RNA, 15 nt, Coxiella burnetii RSA 493
gcccucauuguuucg

SEQ ID NO: 571368 - RNA, 23 nt, Coxiella burnetii RSA 493
gcccuaacauucaaagaacgcca

SEQ ID NO: 571369 - RNA, 15 nt, Coxiella burnetii RSA 493
gcccuuucucuuuuu

SEQ ID NO: 571370 - RNA, 22 nt, Coxiella burnetii RSA 493
aaagcuaaaaaagaaauauuuu

SEQ ID NO: 571371 - RNA, 17 nt, Coxiella burnetii RSA 493
aaagcuagcgaaauuug

SEQ ID NO: 571372 - RNA, 14 nt, Coxiella burnetii RSA 493
gccgaccaaaagcc

SEQ ID NO: 571373 - RNA, 18 nt, Coxiella burnetii RSA 493
aaagcgguugcauucgua

SEQ ID NO: 571374 - RNA, 22 nt, Coxiella burnetii RSA 493
gcccuuuuuuuccauaauaacg

SEQ ID NO: 571375 - RNA, 12 nt, Coxiella burnetii RSA 493
gccgcccuugcu

SEQ ID NO: 571376 - RNA, 23 nt, Coxiella burnetii RSA 493
gccgcgccauggggcgagcgccc

SEQ ID NO: 571377 - RNA, 23 nt, Coxiella burnetii RSA 493
gccgucuaccgacagacaaagcu

SEQ ID NO: 571378 - RNA, 24 nt, Coxiella burnetii RSA 493
gccuaaguuuaacagacagacgcu

SEQ ID NO: 571379 - RNA, 14 nt, Coxiella burnetii RSA 493
gccggucagcguuu

SEQ ID NO: 571380 - RNA, 15 nt, Coxiella burnetii RSA 493
gccggcuaauuuuuu

SEQ ID NO: 571381 - RNA, 20 nt, Coxiella burnetii RSA 493
gccggaguuaacagcuguuc

SEQ ID NO: 571382 - RNA, 17 nt, Coxiella burnetii RSA 493
gccggaugauuugcgcu

SEQ ID NO: 571383 - RNA, 20 nt, Coxiella burnetii RSA 493
gccggauuuuaauugaauuu

SEQ ID NO: 571384 - RNA, 14 nt, Coxiella burnetii RSA 493
gcgagcgcgcgaga

SEQ ID NO: 571385 - RNA, 17 nt, Coxiella burnetii RSA 493
gcgagcaaucaaaacag

SEQ ID NO: 571386 - RNA, 17 nt, Coxiella burnetii RSA 493
gcgaaugguugaaagaa

SEQ ID NO: 571387 - RNA, 19 nt, Coxiella burnetii RSA 493
gcgacaaucauuuuuguac

SEQ ID NO: 571388 - RNA, 22 nt, Coxiella burnetii RSA 493
gcgacacaaccacuguccucug

SEQ ID NO: 571389 - RNA, 17 nt, Coxiella burnetii RSA 493
gcgacaguauuucuauc

SEQ ID NO: 571390 - RNA, 18 nt, Coxiella burnetii RSA 493
gcgacaguauuucuaucg

SEQ ID NO: 571391 - RNA, 21 nt, Coxiella burnetii RSA 493
gcgacgaauaccccuuuuguu

SEQ ID NO: 571392 - RNA, 12 nt, Coxiella burnetii RSA 493
gccuaucuuuuu

SEQ ID NO: 571393 - RNA, 13 nt, Coxiella burnetii RSA 493
gccugaaauauuu

SEQ ID NO: 571394 - RNA, 14 nt, Coxiella burnetii RSA 493
gccugaaauauuuu

SEQ ID NO: 571395 - RNA, 15 nt, Coxiella burnetii RSA 493
gccugacagcccggc

SEQ ID NO: 571396 - RNA, 23 nt, Coxiella burnetii RSA 493
gccuuacuuaccguuucacgauu

SEQ ID NO: 571397 - RNA, 22 nt, Coxiella burnetii RSA 493
gccuguggcaauuaugaaaacg

SEQ ID NO: 571398 - RNA, 22 nt, Coxiella burnetii RSA 493
gccuucuugccgcccuugcugc

SEQ ID NO: 571399 - RNA, 19 nt, Coxiella burnetii RSA 493
gcgaaaagauuccaauauu

SEQ ID NO: 571400 - RNA, 13 nt, Coxiella burnetii RSA 493
gccuuuuuuuacu

SEQ ID NO: 571401 - RNA, 21 nt, Coxiella burnetii RSA 493
gcgcguuuuuuuaucuggcca

SEQ ID NO: 571402 - RNA, 15 nt, Coxiella burnetii RSA 493
gcgcguauuuaaggu

SEQ ID NO: 571403 - RNA, 17 nt, Coxiella burnetii RSA 493
gcgcgcuaaagcgcgcu

SEQ ID NO: 571404 - RNA, 15 nt, Coxiella burnetii RSA 493
gcgcuccucuauaua

SEQ ID NO: 571405 - RNA, 14 nt, Coxiella burnetii RSA 493
gcgcugaaguccuu

SEQ ID NO: 571406 - RNA, 22 nt, Coxiella burnetii RSA 493
gcgcuuuuauuccuuuuuuuaa

SEQ ID NO: 571407 - RNA, 16 nt, Coxiella burnetii RSA 493
gcggacaauaagagcu

SEQ ID NO: 571408 - RNA, 14 nt, Coxiella burnetii RSA 493
gcggauuaaaaaac

SEQ ID NO: 571409 - RNA, 23 nt, Coxiella burnetii RSA 493
gcgucgucccaaaaaacuuagcc

SEQ ID NO: 571410 - RNA, 12 nt, Coxiella burnetii RSA 493
gcgugcuguccg

SEQ ID NO: 571411 - RNA, 14 nt, Coxiella burnetii RSA 493
gcgugagaggacca

SEQ ID NO: 571412 - RNA, 21 nt, Coxiella burnetii RSA 493
gcgucuuggagauuuagccaa

SEQ ID NO: 571413 - RNA, 14 nt, Coxiella burnetii RSA 493
gcguaccaaugucu

SEQ ID NO: 571414 - RNA, 17 nt, Coxiella burnetii RSA 493
gcguaaucaauaaaacu

SEQ ID NO: 571415 - RNA, 19 nt, Coxiella burnetii RSA 493
gcgguuguaauaaugucug

SEQ ID NO: 571416 - RNA, 18 nt, Coxiella burnetii RSA 493
gcguaacgucacaaauaa

SEQ ID NO: 571417 - RNA, 13 nt, Coxiella burnetii RSA 493
gcguaaaauucca

SEQ ID NO: 571418 - RNA, 20 nt, Coxiella burnetii RSA 493
gcgguguuuaggcgccacag

SEQ ID NO: 571419 - RNA, 15 nt, Coxiella burnetii RSA 493
gcgguacuuaagaaa

SEQ ID NO: 571420 - RNA, 13 nt, Coxiella burnetii RSA 493
gcggguuauguga

SEQ ID NO: 571421 - RNA, 18 nt, Coxiella burnetii RSA 493
gcgggauuaauuuuccac

SEQ ID NO: 571422 - RNA, 21 nt, Coxiella burnetii RSA 493
gcuaaugcuuuuuuuacuuuu

SEQ ID NO: 571423 - RNA, 16 nt, Coxiella burnetii RSA 493
gcuaauaggaaaaaug

SEQ ID NO: 571424 - RNA, 20 nt, Coxiella burnetii RSA 493
gcuaauacuaaacaaaauaa

SEQ ID NO: 571425 - RNA, 19 nt, Coxiella burnetii RSA 493
gcuaagaucaagaaagaca

SEQ ID NO: 571426 - RNA, 22 nt, Coxiella burnetii RSA 493
gcuaacaauuguugauuuaacu

SEQ ID NO: 571427 - RNA, 15 nt, Coxiella burnetii RSA 493
gcuaaaucucucggu

SEQ ID NO: 571428 - RNA, 12 nt, Coxiella burnetii RSA 493
gcuaaagguuuc

SEQ ID NO: 571429 - RNA, 16 nt, Coxiella burnetii RSA 493
gcuaaagcaaaaguaa

SEQ ID NO: 571430 - RNA, 20 nt, Coxiella burnetii RSA 493
gcuaaagcaaaaguaauauu

SEQ ID NO: 571431 - RNA, 20 nt, Coxiella burnetii RSA 493
gcuaauuuuccuuuucuauu

SEQ ID NO: 571432 - RNA, 15 nt, Coxiella burnetii RSA 493
gcuacgaucagccac

SEQ ID NO: 571433 - RNA, 15 nt, Coxiella burnetii RSA 493
gcuacucuuuuucuu

SEQ ID NO: 571434 - RNA, 17 nt, Coxiella burnetii RSA 493
gcuacucuuuuucuuag

SEQ ID NO: 571435 - RNA, 17 nt, Coxiella burnetii RSA 493
gcguuuccuccguaauu

SEQ ID NO: 571436 - RNA, 17 nt, Coxiella burnetii RSA 493
gcguuuccaauuguuug

SEQ ID NO: 571437 - RNA, 16 nt, Coxiella burnetii RSA 493
gcguuuaagaggaccu

SEQ ID NO: 571438 - RNA, 17 nt, Coxiella burnetii RSA 493
gcguuguggacuuguuc

SEQ ID NO: 571439 - RNA, 14 nt, Coxiella burnetii RSA 493
gcuaaaaaauuacg

SEQ ID NO: 571440 - RNA, 12 nt, Coxiella burnetii RSA 493
gcguuuuuaaau

SEQ ID NO: 571441 - RNA, 19 nt, Coxiella burnetii RSA 493
gcguucuuaaagucuucaa

SEQ ID NO: 571442 - RNA, 19 nt, Coxiella burnetii RSA 493
gcguuauugaucaaacgcc

SEQ ID NO: 571443 - RNA, 16 nt, Coxiella burnetii RSA 493
gcguuccuuucaucaa

SEQ ID NO: 571444 - RNA, 18 nt, Coxiella burnetii RSA 493
gcuagcuggaauucauaa

SEQ ID NO: 571445 - RNA, 22 nt, Coxiella burnetii RSA 493
gcuagcuggaauucauaaucaa

SEQ ID NO: 571446 - RNA, 12 nt, Coxiella burnetii RSA 493
gcuaguaaauaa

SEQ ID NO: 571447 - RNA, 13 nt, Coxiella burnetii RSA 493
gcuaguccuugac

SEQ ID NO: 571448 - RNA, 21 nt, Coxiella burnetii RSA 493
gcuagaaaauaaccuaaaaua

SEQ ID NO: 571449 - RNA, 17 nt, Coxiella burnetii RSA 493
gcuacuugaaaaccuac

SEQ ID NO: 571450 - RNA, 19 nt, Coxiella burnetii RSA 493
gcuacuuggcgacagcgcu

SEQ ID NO: 571451 - RNA, 12 nt, Coxiella burnetii RSA 493
gcucaaguccuu

SEQ ID NO: 571452 - RNA, 20 nt, Coxiella burnetii RSA 493
gcucaagcgaacgcggccuu

SEQ ID NO: 571453 - RNA, 15 nt, Coxiella burnetii RSA 493
gcucauugaaaucaa

SEQ ID NO: 571454 - RNA, 12 nt, Coxiella burnetii RSA 493
gcuccagaugau

SEQ ID NO: 571455 - RNA, 17 nt, Coxiella burnetii RSA 493
gcucaauuguuucauga

SEQ ID NO: 571456 - RNA, 15 nt, Coxiella burnetii RSA 493
gcucucucuaagaua

SEQ ID NO: 571457 - RNA, 17 nt, Coxiella burnetii RSA 493
gcucuuuuucauuucuu

SEQ ID NO: 571458 - RNA, 15 nt, Coxiella burnetii RSA 493
gcugacaucuuaucu

SEQ ID NO: 571459 - RNA, 13 nt, Coxiella burnetii RSA 493
gcugacaucuuua

SEQ ID NO: 571460 - RNA, 23 nt, Coxiella burnetii RSA 493
gcugagcucauugccaaagaaau

SEQ ID NO: 571461 - RNA, 16 nt, Coxiella burnetii RSA 493
gcugauacuucuucau

SEQ ID NO: 571462 - RNA, 23 nt, Coxiella burnetii RSA 493
gcugaugguccggcgaacagccg

SEQ ID NO: 571463 - RNA, 15 nt, Coxiella burnetii RSA 493
gcuguacauuuuuca

SEQ ID NO: 571464 - RNA, 17 nt, Coxiella burnetii RSA 493
gcugcgguauuguucaa

SEQ ID NO: 571465 - RNA, 15 nt, Coxiella burnetii RSA 493
gcugcuuuugaauuu

SEQ ID NO: 571466 - RNA, 18 nt, Coxiella burnetii RSA 493
gcuuuuggcuacuuucuc

SEQ ID NO: 571467 - RNA, 20 nt, Coxiella burnetii RSA 493
gcuuuugaagcgauugacuu

SEQ ID NO: 571468 - RNA, 11 nt, Coxiella burnetii RSA 493
gcuuuuuccac

SEQ ID NO: 571469 - RNA, 22 nt, Coxiella burnetii RSA 493
gcuuuuuuauaaggucuuaauu

SEQ ID NO: 571470 - RNA, 15 nt, Coxiella burnetii RSA 493
gcuuuuuucaaaauu

SEQ ID NO: 571471 - RNA, 14 nt, Coxiella burnetii RSA 493
ggaaaaauauccuu

SEQ ID NO: 571472 - RNA, 22 nt, Coxiella burnetii RSA 493
gcuuuuuuuacuuuuucaaaga

SEQ ID NO: 571473 - RNA, 14 nt, Coxiella burnetii RSA 493
gcuuucuuuuucuu

SEQ ID NO: 571474 - RNA, 12 nt, Coxiella burnetii RSA 493
gcugugauucac

SEQ ID NO: 571475 - RNA, 16 nt, Coxiella burnetii RSA 493
gcuuuuaaacagucuu

SEQ ID NO: 571476 - RNA, 12 nt, Coxiella burnetii RSA 493
ggaaauaaaauu

SEQ ID NO: 571477 - RNA, 14 nt, Coxiella burnetii RSA 493
ggaaagaaaaugag

SEQ ID NO: 571478 - RNA, 23 nt, Coxiella burnetii RSA 493
ggaaagauccaagauuuuuuuaa

SEQ ID NO: 571479 - RNA, 11 nt, Coxiella burnetii RSA 493
ggaaaaggaga

SEQ ID NO: 571480 - RNA, 16 nt, Coxiella burnetii RSA 493
ggaaggacaaaaauau

SEQ ID NO: 571481 - RNA, 16 nt, Coxiella burnetii RSA 493
ggaauagccuucucaa

SEQ ID NO: 571482 - RNA, 18 nt, Coxiella burnetii RSA 493
ggaaucacuccuaagcaa

SEQ ID NO: 571483 - RNA, 14 nt, Coxiella burnetii RSA 493
ggacauucucgaau

SEQ ID NO: 571484 - RNA, 22 nt, Coxiella burnetii RSA 493
aaagggacgucauaaagguuuu

SEQ ID NO: 571485 - RNA, 18 nt, Coxiella burnetii RSA 493
ggagaagaagccaguauu

SEQ ID NO: 571486 - RNA, 15 nt, Coxiella burnetii RSA 493
ggagaaauugacaaa

SEQ ID NO: 571487 - RNA, 20 nt, Coxiella burnetii RSA 493
ggagaaauugacaaauaaag

SEQ ID NO: 571488 - RNA, 22 nt, Coxiella burnetii RSA 493
ggagaaauugacaaauaaagaa

SEQ ID NO: 571489 - RNA, 15 nt, Coxiella burnetii RSA 493
aaaguaaauuuauau

SEQ ID NO: 571490 - RNA, 13 nt, Coxiella burnetii RSA 493
aaaguaaaaauga

SEQ ID NO: 571491 - RNA, 22 nt, Coxiella burnetii RSA 493
ggacuacaucaaauagaugacu

SEQ ID NO: 571492 - RNA, 19 nt, Coxiella burnetii RSA 493
aaagguuuucuuccgaaac

SEQ ID NO: 571493 - RNA, 14 nt, Coxiella burnetii RSA 493
aaagguuuuuccuu

SEQ ID NO: 571494 - RNA, 16 nt, Coxiella burnetii RSA 493
aaagguuuuuccuuuu

SEQ ID NO: 571495 - RNA, 19 nt, Coxiella burnetii RSA 493
aaagguuuuuccuuuuauu

SEQ ID NO: 571496 - RNA, 13 nt, Coxiella burnetii RSA 493
ggacgauagaugg

SEQ ID NO: 571497 - RNA, 12 nt, Coxiella burnetii RSA 493
ggacgugcaaau

SEQ ID NO: 571498 - RNA, 20 nt, Coxiella burnetii RSA 493
ggagauuaaaaauuugauua

SEQ ID NO: 571499 - RNA, 12 nt, Coxiella burnetii RSA 493
ggagcgagcaua

SEQ ID NO: 571500 - RNA, 12 nt, Coxiella burnetii RSA 493
ggagcgauaaug

SEQ ID NO: 571501 - RNA, 14 nt, Coxiella burnetii RSA 493
ggagcggcugaauu

SEQ ID NO: 571502 - RNA, 16 nt, Coxiella burnetii RSA 493
ggaggcauucugggca

SEQ ID NO: 571503 - RNA, 14 nt, Coxiella burnetii RSA 493
ggaguaaugacaga

SEQ ID NO: 571504 - RNA, 19 nt, Coxiella burnetii RSA 493
ggaguaaugacagaaaaag

SEQ ID NO: 571505 - RNA, 14 nt, Coxiella burnetii RSA 493
ggcaauuaugaaaa

SEQ ID NO: 571506 - RNA, 11 nt, Coxiella burnetii RSA 493
aaaguagaaaa

SEQ ID NO: 571507 - RNA, 11 nt, Coxiella burnetii RSA 493
ggccagcgaga

SEQ ID NO: 571508 - RNA, 11 nt, Coxiella burnetii RSA 493
ggcaguuaaau

SEQ ID NO: 571509 - RNA, 14 nt, Coxiella burnetii RSA 493
ggcaguggggucuu

SEQ ID NO: 571510 - RNA, 13 nt, Coxiella burnetii RSA 493
ggccaaagaaaau

SEQ ID NO: 571511 - RNA, 22 nt, Coxiella burnetii RSA 493
aaaguguagguuuucaacaagu

SEQ ID NO: 571512 - RNA, 24 nt, Coxiella burnetii RSA 493
aaaguguagguuuucaacaaguaa

SEQ ID NO: 571513 - RNA, 19 nt, Coxiella burnetii RSA 493
aaaguuauuucuuuugauu

SEQ ID NO: 571514 - RNA, 16 nt, Coxiella burnetii RSA 493
aaaguucuaagcuauc

SEQ ID NO: 571515 - RNA, 13 nt, Coxiella burnetii RSA 493
aaaguuucacgaa

SEQ ID NO: 571516 - RNA, 19 nt, Coxiella burnetii RSA 493
aaaguuucacgaauuaaaa

SEQ ID NO: 571517 - RNA, 21 nt, Coxiella burnetii RSA 493
aaaguuucccacaaaauaccc

SEQ ID NO: 571518 - RNA, 15 nt, Coxiella burnetii RSA 493
aaaguuuucccaaug

SEQ ID NO: 571519 - RNA, 21 nt, Coxiella burnetii RSA 493
aaaguuuuagcgccagauaca

SEQ ID NO: 571520 - RNA, 22 nt, Coxiella burnetii RSA 493
ggccucuuuagaaaauugauua

SEQ ID NO: 571521 - RNA, 14 nt, Coxiella burnetii RSA 493
aaauaaagcagcaa

SEQ ID NO: 571522 - RNA, 18 nt, Coxiella burnetii RSA 493
aaauaaacuggaaaaagg

SEQ ID NO: 571523 - RNA, 21 nt, Coxiella burnetii RSA 493
aaauaaauuaauuauccaaaa

SEQ ID NO: 571524 - RNA, 14 nt, Coxiella burnetii RSA 493
ggccuuaauguuuu

SEQ ID NO: 571525 - RNA, 14 nt, Coxiella burnetii RSA 493
aaauaaaauuaauu

SEQ ID NO: 571526 - RNA, 21 nt, Coxiella burnetii RSA 493
aaauaaaccuauccaaaaaga

SEQ ID NO: 571527 - RNA, 18 nt, Coxiella burnetii RSA 493
aaauacggggaaauaaug

SEQ ID NO: 571528 - RNA, 23 nt, Coxiella burnetii RSA 493
aaauacggggacgauagauggca

SEQ ID NO: 571529 - RNA, 20 nt, Coxiella burnetii RSA 493
ggcgcaucuucgccuggcca

SEQ ID NO: 571530 - RNA, 21 nt, Coxiella burnetii RSA 493
ggcgaugugaaacaugcugcu

SEQ ID NO: 571531 - RNA, 14 nt, Coxiella burnetii RSA 493
ggcgaucuauagcu

SEQ ID NO: 571532 - RNA, 13 nt, Coxiella burnetii RSA 493
aaauacucuuuca

SEQ ID NO: 571533 - RNA, 18 nt, Coxiella burnetii RSA 493
ggcuaaagguuucaaauu

SEQ ID NO: 571534 - RNA, 17 nt, Coxiella burnetii RSA 493
ggcuaaauaaggagcau

SEQ ID NO: 571535 - RNA, 22 nt, Coxiella burnetii RSA 493
ggcuaaaucuugcugcaaaaac

SEQ ID NO: 571536 - RNA, 20 nt, Coxiella burnetii RSA 493
ggcuaacuggauugauagua

SEQ ID NO: 571537 - RNA, 16 nt, Coxiella burnetii RSA 493
ggcuacucuuuuucuu

SEQ ID NO: 571538 - RNA, 12 nt, Coxiella burnetii RSA 493
ggcuaguaaaua

SEQ ID NO: 571539 - RNA, 16 nt, Coxiella burnetii RSA 493
ggcgguuguaauaaug

SEQ ID NO: 571540 - RNA, 18 nt, Coxiella burnetii RSA 493
gaagaagucguguuuuua

SEQ ID NO: 571541 - RNA, 15 nt, Coxiella burnetii RSA 493
gaagaauugauuagu

SEQ ID NO: 571542 - RNA, 15 nt, Coxiella burnetii RSA 493
gaagaagccaguauu

SEQ ID NO: 571543 - RNA, 22 nt, Coxiella burnetii RSA 493
gaagagacaaaguuucuucaua

SEQ ID NO: 571544 - RNA, 23 nt, Coxiella burnetii RSA 493
gaagcaucgcgcguuuuuuuauc

SEQ ID NO: 571545 - RNA, 19 nt, Coxiella burnetii RSA 493
gaagcaugcugauuuucac

SEQ ID NO: 571546 - RNA, 18 nt, Coxiella burnetii RSA 493
gaaguugacgaaugugcu

SEQ ID NO: 571547 - RNA, 16 nt, Coxiella burnetii RSA 493
aaagauaaucccaaua

SEQ ID NO: 571548 - RNA, 19 nt, Coxiella burnetii RSA 493
gaauacggagaaaaugauu

SEQ ID NO: 571549 - RNA, 15 nt, Coxiella burnetii RSA 493
gaaggcugcuugaag

SEQ ID NO: 571550 - RNA, 22 nt, Coxiella burnetii RSA 493
gaaggugauucucucaaagaaa

SEQ ID NO: 571551 - RNA, 19 nt, Coxiella burnetii RSA 493
gaagugggggaacagagga

SEQ ID NO: 571552 - RNA, 22 nt, Coxiella burnetii RSA 493
gaauauaaugggaguaaugaca

SEQ ID NO: 571553 - RNA, 12 nt, Coxiella burnetii RSA 493
gaauagaaaaac

SEQ ID NO: 571554 - RNA, 22 nt, Coxiella burnetii RSA 493
aaagaucuccccuucuuuaaua

SEQ ID NO: 571555 - RNA, 22 nt, Coxiella burnetii RSA 493
gaaucugaauuuaugaaugcug

SEQ ID NO: 571556 - RNA, 23 nt, Coxiella burnetii RSA 493
gaaugauucgacauaaggcugcg

SEQ ID NO: 571557 - RNA, 17 nt, Coxiella burnetii RSA 493
gaaucacuuguccuucu

SEQ ID NO: 571558 - RNA, 22 nt, Coxiella burnetii RSA 493
gaaucgggccgccuuaauaacc

SEQ ID NO: 571559 - RNA, 20 nt, Coxiella burnetii RSA 493
gacaauagggcggcaaucag

SEQ ID NO: 571560 - RNA, 23 nt, Coxiella burnetii RSA 493
gacaagcagggcaguaaauagaa

SEQ ID NO: 571561 - RNA, 21 nt, Coxiella burnetii RSA 493
gacaagaauuuuuuuauaauu

SEQ ID NO: 571562 - RNA, 13 nt, Coxiella burnetii RSA 493
gacaaauaaacaa

SEQ ID NO: 571563 - RNA, 14 nt, Coxiella burnetii RSA 493
gacaaauaaagaau

SEQ ID NO: 571564 - RNA, 15 nt, Coxiella burnetii RSA 493
gacaaaguuucuuca

SEQ ID NO: 571565 - RNA, 19 nt, Coxiella burnetii RSA 493
gacaaagguacgaaccacu

SEQ ID NO: 571566 - RNA, 21 nt, Coxiella burnetii RSA 493
gaauuuuauugucauguucaa

SEQ ID NO: 571567 - RNA, 19 nt, Coxiella burnetii RSA 493
gacaaauguauuuaucauc

SEQ ID NO: 571568 - RNA, 20 nt, Coxiella burnetii RSA 493
gaauuccuugcucaaguccu

SEQ ID NO: 571569 - RNA, 18 nt, Coxiella burnetii RSA 493
gaauuccuuguugaauuc

SEQ ID NO: 571570 - RNA, 17 nt, Coxiella burnetii RSA 493
gaauucuaauuaaauua

SEQ ID NO: 571571 - RNA, 19 nt, Coxiella burnetii RSA 493
gaauuugcgcuugcguaaa

SEQ ID NO: 571572 - RNA, 15 nt, Coxiella burnetii RSA 493
gaauuugaaauaaac

SEQ ID NO: 571573 - RNA, 21 nt, Coxiella burnetii RSA 493
gaauuugagaacguuucccaa

SEQ ID NO: 571574 - RNA, 14 nt, Coxiella burnetii RSA 493
gaauucauaaucaa

SEQ ID NO: 571575 - RNA, 18 nt, Coxiella burnetii RSA 493
gaauucauugaaagcgca

SEQ ID NO: 571576 - RNA, 19 nt, Coxiella burnetii RSA 493
gaauggacgugcaaaugag

SEQ ID NO: 571577 - RNA, 17 nt, Coxiella burnetii RSA 493
gacacaugggacaaggc

SEQ ID NO: 571578 - RNA, 24 nt, Coxiella burnetii RSA 493
gacagaaaaagcggauaagccauu

SEQ ID NO: 571579 - RNA, 15 nt, Coxiella burnetii RSA 493
gacagaaggcagagg

SEQ ID NO: 571580 - RNA, 14 nt, Coxiella burnetii RSA 493
gacauaaggcugcg

SEQ ID NO: 571581 - RNA, 16 nt, Coxiella burnetii RSA 493
gacaucguuguuuucc

SEQ ID NO: 571582 - RNA, 22 nt, Coxiella burnetii RSA 493
gaccaaauccgcauaaaaaccc

SEQ ID NO: 571583 - RNA, 18 nt, Coxiella burnetii RSA 493
gaccaaaugcgacaauca

SEQ ID NO: 571584 - RNA, 13 nt, Coxiella burnetii RSA 493
gacauucuucucc

SEQ ID NO: 571585 - RNA, 16 nt, Coxiella burnetii RSA 493
gacccgcauucuuuua

SEQ ID NO: 571586 - RNA, 17 nt, Coxiella burnetii RSA 493
gacgaccgcggcagcag

SEQ ID NO: 571587 - RNA, 21 nt, Coxiella burnetii RSA 493
gacgauuaacaacgaaaccuu

SEQ ID NO: 571588 - RNA, 17 nt, Coxiella burnetii RSA 493
gacgcagaugcccauuc

SEQ ID NO: 571589 - RNA, 18 nt, Coxiella burnetii RSA 493
gacgcucgguuccaaaaa

SEQ ID NO: 571590 - RNA, 23 nt, Coxiella burnetii RSA 493
gacgcguggcuuuaucaggcgcu

SEQ ID NO: 571591 - RNA, 15 nt, Coxiella burnetii RSA 493
gacgcuaguuuuuaa

SEQ ID NO: 571592 - RNA, 18 nt, Coxiella burnetii RSA 493
gacgucuugguuguuucu

SEQ ID NO: 571593 - RNA, 12 nt, Coxiella burnetii RSA 493
gacguuuuccac

SEQ ID NO: 571594 - RNA, 15 nt, Coxiella burnetii RSA 493
gacugugagcgcgaa

SEQ ID NO: 571595 - RNA, 20 nt, Coxiella burnetii RSA 493
gacugauaacuauuauuaaa

SEQ ID NO: 571596 - RNA, 22 nt, Coxiella burnetii RSA 493
gacugauaacuauuauuaaaag

SEQ ID NO: 571597 - RNA, 17 nt, Coxiella burnetii RSA 493
gacuucuaguuuuucaa

SEQ ID NO: 571598 - RNA, 17 nt, Coxiella burnetii RSA 493
gacuuauuuuuauucuu

SEQ ID NO: 571599 - RNA, 19 nt, Coxiella burnetii RSA 493
gacuuauuuuuauucuuaa

SEQ ID NO: 571600 - RNA, 23 nt, Coxiella burnetii RSA 493
gagaaaaccgcagcucaaacaaa

SEQ ID NO: 571601 - RNA, 16 nt, Coxiella burnetii RSA 493
gagaaauugacaaaua

SEQ ID NO: 571602 - RNA, 21 nt, Coxiella burnetii RSA 493
gagaaauugacaaauaaagaa

SEQ ID NO: 571603 - RNA, 18 nt, Coxiella burnetii RSA 493
aaagcaacgacuucucuu

SEQ ID NO: 571604 - RNA, 13 nt, Coxiella burnetii RSA 493
aaagcaaaaauac

SEQ ID NO: 571605 - RNA, 15 nt, Coxiella burnetii RSA 493
gagaauuaaaaauau

SEQ ID NO: 571606 - RNA, 18 nt, Coxiella burnetii RSA 493
gagacugcuuuagauacu

SEQ ID NO: 571607 - RNA, 18 nt, Coxiella burnetii RSA 493
aaagcagcaauuguuugu

SEQ ID NO: 571608 - RNA, 23 nt, Coxiella burnetii RSA 493
gagcacgggaugauuuuucccaa

SEQ ID NO: 571609 - RNA, 20 nt, Coxiella burnetii RSA 493
gagcaucuuuucugaaacau

SEQ ID NO: 571610 - RNA, 15 nt, Coxiella burnetii RSA 493
gagcauauaaaaguu

SEQ ID NO: 571611 - RNA, 15 nt, Coxiella burnetii RSA 493
aaagcagcuucuaaa

SEQ ID NO: 571612 - RNA, 19 nt, Coxiella burnetii RSA 493
gagccauuaagacaccauc

SEQ ID NO: 571613 - RNA, 22 nt, Coxiella burnetii RSA 493
gagccaucacaccaagaaauug

SEQ ID NO: 571614 - RNA, 15 nt, Coxiella burnetii RSA 493
gaggaugaugaaaag

SEQ ID NO: 571615 - RNA, 20 nt, Coxiella burnetii RSA 493
gaggacagaggacagugguu

SEQ ID NO: 571616 - RNA, 24 nt, Coxiella burnetii RSA 493
gagcuugccuguaaaauaagaagg

SEQ ID NO: 571617 - RNA, 19 nt, Coxiella burnetii RSA 493
gagcgaagaaaaagaaauu

SEQ ID NO: 571618 - RNA, 14 nt, Coxiella burnetii RSA 493
gagcgaagcgaaau

SEQ ID NO: 571619 - RNA, 14 nt, Coxiella burnetii RSA 493
gagggauuuugcag

SEQ ID NO: 571620 - RNA, 16 nt, Coxiella burnetii RSA 493
gaggucaucauuuuug

SEQ ID NO: 571621 - RNA, 22 nt, Coxiella burnetii RSA 493
gaggcaauacaucuugauccuu

SEQ ID NO: 571622 - RNA, 14 nt, Coxiella burnetii RSA 493
gaggcaccucauug

SEQ ID NO: 571623 - RNA, 16 nt, Coxiella burnetii RSA 493
gaggcugaauaagcug

SEQ ID NO: 571624 - RNA, 15 nt, Coxiella burnetii RSA 493
gagggagcagcagcc

SEQ ID NO: 571625 - RNA, 11 nt, Coxiella burnetii RSA 493
gagggaaaccu

SEQ ID NO: 571626 - RNA, 22 nt, Coxiella burnetii RSA 493
gagguucaucgccuugcaaaca

SEQ ID NO: 571627 - RNA, 13 nt, Coxiella burnetii RSA 493
gagguuaauaaaa

SEQ ID NO: 571628 - RNA, 16 nt, Coxiella burnetii RSA 493
gagguuucuuuccagc

SEQ ID NO: 571629 - RNA, 16 nt, Coxiella burnetii RSA 493
gaguagggaguugggc

SEQ ID NO: 571630 - RNA, 16 nt, Coxiella burnetii RSA 493
gagucguauuccuuuu

SEQ ID NO: 571631 - RNA, 13 nt, Coxiella burnetii RSA 493
gaguucauuaaug

SEQ ID NO: 571632 - RNA, 12 nt, Coxiella burnetii RSA 493
gauaaaucaaac

SEQ ID NO: 571633 - RNA, 17 nt, Coxiella burnetii RSA 493
gauaaaucgggaaacuu

SEQ ID NO: 571634 - RNA, 16 nt, Coxiella burnetii RSA 493
gaguuuuugacaagcu

SEQ ID NO: 571635 - RNA, 10 nt, Coxiella burnetii RSA 493
gauaauaauu

SEQ ID NO: 571636 - RNA, 20 nt, Coxiella burnetii RSA 493
gauaauaucuagauuuaaaa

SEQ ID NO: 571637 - RNA, 14 nt, Coxiella burnetii RSA 493
gauaagguguuuua

SEQ ID NO: 571638 - RNA, 10 nt, Coxiella burnetii RSA 493
gauaaucaac

SEQ ID NO: 571639 - RNA, 14 nt, Coxiella burnetii RSA 493
gauaaucucaucau

SEQ ID NO: 571640 - RNA, 15 nt, Coxiella burnetii RSA 493
gauaaucccaauaaa

SEQ ID NO: 571641 - RNA, 17 nt, Coxiella burnetii RSA 493
gauaauuacaauccaau

SEQ ID NO: 571642 - RNA, 21 nt, Coxiella burnetii RSA 493
aaagccaaguuuuaagaaaaa

SEQ ID NO: 571643 - RNA, 17 nt, Coxiella burnetii RSA 493
gauacacauaaugaucg

SEQ ID NO: 571644 - RNA, 23 nt, Coxiella burnetii RSA 493
aaagcauuuuucgcagcaaaaug

SEQ ID NO: 571645 - RNA, 13 nt, Coxiella burnetii RSA 493
gauacagccuuca

SEQ ID NO: 571646 - RNA, 17 nt, Coxiella burnetii RSA 493
gauacagccuucaugaa

SEQ ID NO: 571647 - RNA, 17 nt, Coxiella burnetii RSA 493
gauacaggagauauacc

SEQ ID NO: 571648 - RNA, 17 nt, Coxiella burnetii RSA 493
gauaccaucaggauaau

SEQ ID NO: 571649 - RNA, 19 nt, Coxiella burnetii RSA 493
gauaucaaucgaaaaaaau

SEQ ID NO: 571650 - RNA, 23 nt, Coxiella burnetii RSA 493
gauagcauuguuggaaauaaugg

SEQ ID NO: 571651 - RNA, 17 nt, Coxiella burnetii RSA 493
gauauugauuuaaauuu

SEQ ID NO: 571652 - RNA, 13 nt, Coxiella burnetii RSA 493
gauauugaacagg

SEQ ID NO: 571653 - RNA, 14 nt, Coxiella burnetii RSA 493
gaucaacaaaauau

SEQ ID NO: 571654 - RNA, 16 nt, Coxiella burnetii RSA 493
gaucaaugaaacaaac

SEQ ID NO: 571655 - RNA, 17 nt, Coxiella burnetii RSA 493
gaucaaugaaacaaaca

SEQ ID NO: 571656 - RNA, 19 nt, Coxiella burnetii RSA 493
gaucaaugaaacaaacaaa

SEQ ID NO: 571657 - RNA, 16 nt, Coxiella burnetii RSA 493
gauaucgccuaucuuu

SEQ ID NO: 571658 - RNA, 16 nt, Coxiella burnetii RSA 493
gauauccuucuuuuaa

SEQ ID NO: 571659 - RNA, 22 nt, Coxiella burnetii RSA 493
gauaucugacgauguaguuuug

SEQ ID NO: 571660 - RNA, 18 nt, Coxiella burnetii RSA 493
gauauucuaucucaaagg

SEQ ID NO: 571661 - RNA, 16 nt, Coxiella burnetii RSA 493
gaaauuuaauaaaauu

SEQ ID NO: 571662 - RNA, 18 nt, Coxiella burnetii RSA 493
gaaauuuaauaaaauuaa

SEQ ID NO: 571663 - RNA, 14 nt, Coxiella burnetii RSA 493
gaaauuucucucuc

SEQ ID NO: 571664 - RNA, 23 nt, Coxiella burnetii RSA 493
gaaauuucacacguaucugcuaa

SEQ ID NO: 571665 - RNA, 19 nt, Coxiella burnetii RSA 493
gaacaacacgaucaacaaa

SEQ ID NO: 571666 - RNA, 15 nt, Coxiella burnetii RSA 493
gaaauaggcuuucuu

SEQ ID NO: 571667 - RNA, 21 nt, Coxiella burnetii RSA 493
gaaauauaggcgaaucaucuu

SEQ ID NO: 571668 - RNA, 13 nt, Coxiella burnetii RSA 493
gaaaguuucauaa

SEQ ID NO: 571669 - RNA, 20 nt, Coxiella burnetii RSA 493
gaaaguuucccacaaaauac

SEQ ID NO: 571670 - RNA, 22 nt, Coxiella burnetii RSA 493
gaaaguuucccacaaaauaccc

SEQ ID NO: 571671 - RNA, 14 nt, Coxiella burnetii RSA 493
gaaaguuuucccaa

SEQ ID NO: 571672 - RNA, 18 nt, Coxiella burnetii RSA 493
gaaaguuuucccaauguu

SEQ ID NO: 571673 - RNA, 20 nt, Coxiella burnetii RSA 493
gaaaggaauccuuuuucuag

SEQ ID NO: 571674 - RNA, 23 nt, Coxiella burnetii RSA 493
gaaaggaauccuuuuucuaggga

SEQ ID NO: 571675 - RNA, 17 nt, Coxiella burnetii RSA 493
gaaagaaaaugaguugu

SEQ ID NO: 571676 - RNA, 14 nt, Coxiella burnetii RSA 493
gaaagaaaaaaaac

SEQ ID NO: 571677 - RNA, 15 nt, Coxiella burnetii RSA 493
gaaagaaaaaaaacc

SEQ ID NO: 571678 - RNA, 19 nt, Coxiella burnetii RSA 493
gaaacgcuuauaggaaucu

SEQ ID NO: 571679 - RNA, 16 nt, Coxiella burnetii RSA 493
gaaacgauuaaaaauu

SEQ ID NO: 571680 - RNA, 15 nt, Coxiella burnetii RSA 493
gaaagacauuguuca

SEQ ID NO: 571681 - RNA, 15 nt, Coxiella burnetii RSA 493
gaaagaguauuuuuu

SEQ ID NO: 571682 - RNA, 22 nt, Coxiella burnetii RSA 493
gaaagauauucuucuagaaaac

SEQ ID NO: 571683 - RNA, 22 nt, Coxiella burnetii RSA 493
gaaagccaaguuuuaagaaaaa

SEQ ID NO: 571684 - RNA, 23 nt, Coxiella burnetii RSA 493
gaaagccaaguuuuaagaaaaac

SEQ ID NO: 571685 - RNA, 22 nt, Coxiella burnetii RSA 493
gaaaauugucgauaauauaacu

SEQ ID NO: 571686 - RNA, 20 nt, Coxiella burnetii RSA 493
gaaaaaugaacaaaguagaa

SEQ ID NO: 571687 - RNA, 18 nt, Coxiella burnetii RSA 493
gaaaaauuccaaaaacau

SEQ ID NO: 571688 - RNA, 14 nt, Coxiella burnetii RSA 493
gaaaagcugaaauu

SEQ ID NO: 571689 - RNA, 18 nt, Coxiella burnetii RSA 493
gaaaagcugaaauugaau

SEQ ID NO: 571690 - RNA, 20 nt, Coxiella burnetii RSA 493
gaaacaaagguuccaucgca

SEQ ID NO: 571691 - RNA, 18 nt, Coxiella burnetii RSA 493
gaaacaauacucuuauuu

SEQ ID NO: 571692 - RNA, 20 nt, Coxiella burnetii RSA 493
gaaaccaaaagcaccccgug

SEQ ID NO: 571693 - RNA, 16 nt, Coxiella burnetii RSA 493
gaaaccuuguuauaaa

SEQ ID NO: 571694 - RNA, 16 nt, Coxiella burnetii RSA 493
cuuuuucauuuccgcu

SEQ ID NO: 571695 - RNA, 17 nt, Coxiella burnetii RSA 493
cuuuuucauuuccgcuu

SEQ ID NO: 571696 - RNA, 17 nt, Coxiella burnetii RSA 493
cuuuuuguaaauuuucc

SEQ ID NO: 571697 - RNA, 11 nt, Coxiella burnetii RSA 493
cuuuuuucuua

SEQ ID NO: 571698 - RNA, 15 nt, Coxiella burnetii RSA 493
cuuuuuugcaacuuc

SEQ ID NO: 571699 - RNA, 12 nt, Coxiella burnetii RSA 493
cuuuuuuucuug

SEQ ID NO: 571700 - RNA, 14 nt, Coxiella burnetii RSA 493
gaaaaaauuaaaua

SEQ ID NO: 571701 - RNA, 13 nt, Coxiella burnetii RSA 493
cuuuugcaaaccg

SEQ ID NO: 571702 - RNA, 16 nt, Coxiella burnetii RSA 493
cuuuuggcauuguucu

SEQ ID NO: 571703 - RNA, 18 nt, Coxiella burnetii RSA 493
cuuuugaauuccaaaccg

SEQ ID NO: 571704 - RNA, 15 nt, Coxiella burnetii RSA 493
cuuuuucaaagauau

SEQ ID NO: 571705 - RNA, 22 nt, Coxiella burnetii RSA 493
cuuuuucaaugccauuuuuaug

SEQ ID NO: 571706 - RNA, 16 nt, Coxiella burnetii RSA 493
cuuuuggcuacuuucu

SEQ ID NO: 571707 - RNA, 24 nt, Coxiella burnetii RSA 493
cuuuuuaaauaacuuuacuaaaaa

SEQ ID NO: 571708 - RNA, 15 nt, Coxiella burnetii RSA 493
aaagaaauaaucaug

SEQ ID NO: 571709 - RNA, 12 nt, Coxiella burnetii RSA 493
cuuguugcaauc

SEQ ID NO: 571710 - RNA, 19 nt, Coxiella burnetii RSA 493
cuuguugcaauccuuuuug

SEQ ID NO: 571711 - RNA, 18 nt, Coxiella burnetii RSA 493
cuuguugaauuccuugcu

SEQ ID NO: 571712 - RNA, 16 nt, Coxiella burnetii RSA 493
aaagaagaaggucguu

SEQ ID NO: 571713 - RNA, 22 nt, Coxiella burnetii RSA 493
aaagaacgccagucauuuucgu

SEQ ID NO: 571714 - RNA, 14 nt, Coxiella burnetii RSA 493
cuuguuuaucacuc

SEQ ID NO: 571715 - RNA, 22 nt, Coxiella burnetii RSA 493
cuuguuuuucgguuucuucaac

SEQ ID NO: 571716 - RNA, 22 nt, Coxiella burnetii RSA 493
cuuuaaaauaaguauccauccc

SEQ ID NO: 571717 - RNA, 19 nt, Coxiella burnetii RSA 493
cuuguuccgccauuuccca

SEQ ID NO: 571718 - RNA, 17 nt, Coxiella burnetii RSA 493
cuuguuccuuuuuauaa

SEQ ID NO: 571719 - RNA, 22 nt, Coxiella burnetii RSA 493
cuuguuaaguagauagucuuug

SEQ ID NO: 571720 - RNA, 21 nt, Coxiella burnetii RSA 493
cuugugcaauuccauuaaaaa

SEQ ID NO: 571721 - RNA, 22 nt, Coxiella burnetii RSA 493
cuugugcaauuccauuaaaaac

SEQ ID NO: 571722 - RNA, 19 nt, Coxiella burnetii RSA 493
aaagaaaguuucccacaaa

SEQ ID NO: 571723 - RNA, 16 nt, Coxiella burnetii RSA 493
aaagaaacgauuaaaa

SEQ ID NO: 571724 - RNA, 19 nt, Coxiella burnetii RSA 493
aaagaaacgauuaaaaauu

SEQ ID NO: 571725 - RNA, 22 nt, Coxiella burnetii RSA 493
aaagaaacgauuaaaaauuuua

SEQ ID NO: 571726 - RNA, 21 nt, Coxiella burnetii RSA 493
aaacuuuuuagggcugaaaaa

SEQ ID NO: 571727 - RNA, 16 nt, Coxiella burnetii RSA 493
cuugucauucccuuuu

SEQ ID NO: 571728 - RNA, 19 nt, Coxiella burnetii RSA 493
cuugucauucccuuuuucg

SEQ ID NO: 571729 - RNA, 20 nt, Coxiella burnetii RSA 493
cuuguaauucaaauuuuaaa

SEQ ID NO: 571730 - RNA, 18 nt, Coxiella burnetii RSA 493
cuugggcaaaaaaagaaa

SEQ ID NO: 571731 - RNA, 13 nt, Coxiella burnetii RSA 493
cuugggaacaacg

SEQ ID NO: 571732 - RNA, 16 nt, Coxiella burnetii RSA 493
cuuggaugaccgcuga

SEQ ID NO: 571733 - RNA, 16 nt, Coxiella burnetii RSA 493
cuuggaacaaaccauu

SEQ ID NO: 571734 - RNA, 12 nt, Coxiella burnetii RSA 493
cuuucgauaaau

SEQ ID NO: 571735 - RNA, 16 nt, Coxiella burnetii RSA 493
cuuucgauaaauuuug

SEQ ID NO: 571736 - RNA, 22 nt, Coxiella burnetii RSA 493
cuuugauaagcauaauucauca

SEQ ID NO: 571737 - RNA, 13 nt, Coxiella burnetii RSA 493
cuuugcuuuaacu

SEQ ID NO: 571738 - RNA, 14 nt, Coxiella burnetii RSA 493
cuuuggguuggcuu

SEQ ID NO: 571739 - RNA, 13 nt, Coxiella burnetii RSA 493
cuuugguggcuuu

SEQ ID NO: 571740 - RNA, 16 nt, Coxiella burnetii RSA 493
cuuugguuccacccgc

SEQ ID NO: 571741 - RNA, 17 nt, Coxiella burnetii RSA 493
cuuuggguauaaauaac

SEQ ID NO: 571742 - RNA, 16 nt, Coxiella burnetii RSA 493
cuuuacagguucacuc

SEQ ID NO: 571743 - RNA, 17 nt, Coxiella burnetii RSA 493
cuuuaagcacuucuuuu

SEQ ID NO: 571744 - RNA, 16 nt, Coxiella burnetii RSA 493
cuuuacuuguugaaaa

SEQ ID NO: 571745 - RNA, 14 nt, Coxiella burnetii RSA 493
cuuucaacauauuu

SEQ ID NO: 571746 - RNA, 16 nt, Coxiella burnetii RSA 493
cuuuauuuuucgcuca

SEQ ID NO: 571747 - RNA, 13 nt, Coxiella burnetii RSA 493
cuucucguaacaa

SEQ ID NO: 571748 - RNA, 16 nt, Coxiella burnetii RSA 493
cuucucaguuaaaaua

SEQ ID NO: 571749 - RNA, 21 nt, Coxiella burnetii RSA 493
cuucuaagagcugucgccagc

SEQ ID NO: 571750 - RNA, 22 nt, Coxiella burnetii RSA 493
cuucguuuauuuccgucaauuu

SEQ ID NO: 571751 - RNA, 21 nt, Coxiella burnetii RSA 493
cuucuuaaaccaaaucgaauc

SEQ ID NO: 571752 - RNA, 14 nt, Coxiella burnetii RSA 493
cuucuucaacuccu

SEQ ID NO: 571753 - RNA, 15 nt, Coxiella burnetii RSA 493
cuucuuguaaggauu

SEQ ID NO: 571754 - RNA, 13 nt, Coxiella burnetii RSA 493
cuucuucauuuau

SEQ ID NO: 571755 - RNA, 12 nt, Coxiella burnetii RSA 493
cuucuucauuaa

SEQ ID NO: 571756 - RNA, 14 nt, Coxiella burnetii RSA 493
cuugaaaaaauuga

SEQ ID NO: 571757 - RNA, 16 nt, Coxiella burnetii RSA 493
cuucuuuuucgauuuu

SEQ ID NO: 571758 - RNA, 13 nt, Coxiella burnetii RSA 493
cuucuuuaaaaua

SEQ ID NO: 571759 - RNA, 16 nt, Coxiella burnetii RSA 493
cuucuuuaauaucaaa

SEQ ID NO: 571760 - RNA, 19 nt, Coxiella burnetii RSA 493
cuucuuuaauaucaaaaaa

SEQ ID NO: 571761 - RNA, 17 nt, Coxiella burnetii RSA 493
cuucuuuuaaguggauu

SEQ ID NO: 571762 - RNA, 15 nt, Coxiella burnetii RSA 493
cuugaacuucaaauc

SEQ ID NO: 571763 - RNA, 18 nt, Coxiella burnetii RSA 493
cuugacgcucagauaaau

SEQ ID NO: 571764 - RNA, 14 nt, Coxiella burnetii RSA 493
cuugauaaucaaug

SEQ ID NO: 571765 - RNA, 14 nt, Coxiella burnetii RSA 493
cuugauauucccuc

SEQ ID NO: 571766 - RNA, 14 nt, Coxiella burnetii RSA 493
cuugaggaauugcu

SEQ ID NO: 571767 - RNA, 19 nt, Coxiella burnetii RSA 493
cuugaguaaccucuccauc

SEQ ID NO: 571768 - RNA, 22 nt, Coxiella burnetii RSA 493
cuugaucuugggcaaaaaaaga

SEQ ID NO: 571769 - RNA, 13 nt, Coxiella burnetii RSA 493
cuugcauaauagc

SEQ ID NO: 571770 - RNA, 13 nt, Coxiella burnetii RSA 493
cuugcauuucaau

SEQ ID NO: 571771 - RNA, 20 nt, Coxiella burnetii RSA 493
cuugccaccggacucuugcc

SEQ ID NO: 571772 - RNA, 14 nt, Coxiella burnetii RSA 493
cuugcgaagcccaa

SEQ ID NO: 571773 - RNA, 19 nt, Coxiella burnetii RSA 493
cuugccgaggcaaaauaaa

SEQ ID NO: 571774 - RNA, 22 nt, Coxiella burnetii RSA 493
cuugccgauuuguuuaggcgaa

SEQ ID NO: 571775 - RNA, 11 nt, Coxiella burnetii RSA 493
aaacuuuaccu

SEQ ID NO: 571776 - RNA, 22 nt, Coxiella burnetii RSA 493
aaacuuuaccuaacucaaccuc

SEQ ID NO: 571777 - RNA, 19 nt, Coxiella burnetii RSA 493
aaacuuugcagggcccacu

SEQ ID NO: 571778 - RNA, 14 nt, Coxiella burnetii RSA 493
cuugcucuucuuca

SEQ ID NO: 571779 - RNA, 12 nt, Coxiella burnetii RSA 493
cuugcugaauuc

SEQ ID NO: 571780 - RNA, 15 nt, Coxiella burnetii RSA 493
cuugcucaaguccuu

SEQ ID NO: 571781 - RNA, 14 nt, Coxiella burnetii RSA 493
cuugcuucaucgau

SEQ ID NO: 571782 - RNA, 23 nt, Coxiella burnetii RSA 493
cuugcuuucgcaggauaauguuu

SEQ ID NO: 571783 - RNA, 14 nt, Coxiella burnetii RSA 493
cuugcugcaagccc

SEQ ID NO: 571784 - RNA, 16 nt, Coxiella burnetii RSA 493
cuugcgccuuaauaug

SEQ ID NO: 571785 - RNA, 22 nt, Coxiella burnetii RSA 493
cuugcgguucaugaaaaagaua

SEQ ID NO: 571786 - RNA, 20 nt, Coxiella burnetii RSA 493
cuuaaaacaaaugcgccauu

SEQ ID NO: 571787 - RNA, 19 nt, Coxiella burnetii RSA 493
cuguuucuuuuagagccuc

SEQ ID NO: 571788 - RNA, 22 nt, Coxiella burnetii RSA 493
cuuaaauaguagcuauaagcaa

SEQ ID NO: 571789 - RNA, 21 nt, Coxiella burnetii RSA 493
aaacuggaaaaaggugcccaa

SEQ ID NO: 571790 - RNA, 18 nt, Coxiella burnetii RSA 493
cuuaacgccuaucuuuuu

SEQ ID NO: 571791 - RNA, 18 nt, Coxiella burnetii RSA 493
cuguucgccagaaacaac

SEQ ID NO: 571792 - RNA, 13 nt, Coxiella burnetii RSA 493
cuuaguaggccua

SEQ ID NO: 571793 - RNA, 19 nt, Coxiella burnetii RSA 493
cuuagcugauuucucuuuu

SEQ ID NO: 571794 - RNA, 23 nt, Coxiella burnetii RSA 493
cuuagcgcuaaugagaaacguga

SEQ ID NO: 571795 - RNA, 15 nt, Coxiella burnetii RSA 493
cuuauccuuacaaaa

SEQ ID NO: 571796 - RNA, 16 nt, Coxiella burnetii RSA 493
cuuauccuuacaaaaa

SEQ ID NO: 571797 - RNA, 14 nt, Coxiella burnetii RSA 493
cuuaauguuuuuuc

SEQ ID NO: 571798 - RNA, 22 nt, Coxiella burnetii RSA 493
cuuccaacacguauuuucauuc

SEQ ID NO: 571799 - RNA, 15 nt, Coxiella burnetii RSA 493
aaacuucaugcaaaa

SEQ ID NO: 571800 - RNA, 14 nt, Coxiella burnetii RSA 493
cuucgccuggccaa

SEQ ID NO: 571801 - RNA, 13 nt, Coxiella burnetii RSA 493
cuucaguuggcuc

SEQ ID NO: 571802 - RNA, 18 nt, Coxiella burnetii RSA 493
cuucaaaagugauuuuuc

SEQ ID NO: 571803 - RNA, 20 nt, Coxiella burnetii RSA 493
cuucaaaagugauuuuucuu

SEQ ID NO: 571804 - RNA, 19 nt, Coxiella burnetii RSA 493
cuuauuuugugaugcacgg

SEQ ID NO: 571805 - RNA, 22 nt, Coxiella burnetii RSA 493
cuuauuuuauaguccgcuacau

SEQ ID NO: 571806 - RNA, 23 nt, Coxiella burnetii RSA 493
cuuauuuucugggagauuuauuc

SEQ ID NO: 571807 - RNA, 13 nt, Coxiella burnetii RSA 493
cggcucucucuaa

SEQ ID NO: 571808 - RNA, 12 nt, Coxiella burnetii RSA 493
cggcuuuuucaa

SEQ ID NO: 571809 - RNA, 14 nt, Coxiella burnetii RSA 493
cggcuuuuuucgcu

SEQ ID NO: 571810 - RNA, 21 nt, Coxiella burnetii RSA 493
cggcuuuauauguguaacaaa

SEQ ID NO: 571811 - RNA, 14 nt, Coxiella burnetii RSA 493
cgggaaauaaaauu

SEQ ID NO: 571812 - RNA, 15 nt, Coxiella burnetii RSA 493
cgggaaauaaaauua

SEQ ID NO: 571813 - RNA, 13 nt, Coxiella burnetii RSA 493
cggcuucacagag

SEQ ID NO: 571814 - RNA, 14 nt, Coxiella burnetii RSA 493
cgggaauagcucag

SEQ ID NO: 571815 - RNA, 21 nt, Coxiella burnetii RSA 493
cgggaaugacggaauuuguga

SEQ ID NO: 571816 - RNA, 16 nt, Coxiella burnetii RSA 493
cgggaugauuuuuccc

SEQ ID NO: 571817 - RNA, 15 nt, Coxiella burnetii RSA 493
cgggcaucgaguuca

SEQ ID NO: 571818 - RNA, 13 nt, Coxiella burnetii RSA 493
cgguaaggaacag

SEQ ID NO: 571819 - RNA, 15 nt, Coxiella burnetii RSA 493
cgguaaggaacaggg

SEQ ID NO: 571820 - RNA, 11 nt, Coxiella burnetii RSA 493
cgguaauaaua

SEQ ID NO: 571821 - RNA, 13 nt, Coxiella burnetii RSA 493
cgguaaugagaac

SEQ ID NO: 571822 - RNA, 21 nt, Coxiella burnetii RSA 493
cgguagaaugauaccaucagg

SEQ ID NO: 571823 - RNA, 16 nt, Coxiella burnetii RSA 493
cgguacuuaagaaagu

SEQ ID NO: 571824 - RNA, 13 nt, Coxiella burnetii RSA 493
aaacuagaaauau

SEQ ID NO: 571825 - RNA, 19 nt, Coxiella burnetii RSA 493
aaacuaagcauuaaaaaau

SEQ ID NO: 571826 - RNA, 14 nt, Coxiella burnetii RSA 493
aaacuaaauuucca

SEQ ID NO: 571827 - RNA, 20 nt, Coxiella burnetii RSA 493
aaacguuucaucaaaauucu

SEQ ID NO: 571828 - RNA, 19 nt, Coxiella burnetii RSA 493
cggugaaccgauucauaaa

SEQ ID NO: 571829 - RNA, 18 nt, Coxiella burnetii RSA 493
cgguaacagcaagaggag

SEQ ID NO: 571830 - RNA, 18 nt, Coxiella burnetii RSA 493
cgggguguagcucagccu

SEQ ID NO: 571831 - RNA, 12 nt, Coxiella burnetii RSA 493
cgggguucugua

SEQ ID NO: 571832 - RNA, 16 nt, Coxiella burnetii RSA 493
cgggguucuguaaguu

SEQ ID NO: 571833 - RNA, 22 nt, Coxiella burnetii RSA 493
cgucccaaaaaacuuagccaau

SEQ ID NO: 571834 - RNA, 21 nt, Coxiella burnetii RSA 493
cguaugaagugggggaacaga

SEQ ID NO: 571835 - RNA, 17 nt, Coxiella burnetii RSA 493
cguagcgacacaaccac

SEQ ID NO: 571836 - RNA, 15 nt, Coxiella burnetii RSA 493
cguaagcguugaaag

SEQ ID NO: 571837 - RNA, 14 nt, Coxiella burnetii RSA 493
cguaauaauaagcg

SEQ ID NO: 571838 - RNA, 11 nt, Coxiella burnetii RSA 493
cgucaauuuuu

SEQ ID NO: 571839 - RNA, 22 nt, Coxiella burnetii RSA 493
cgguuagaguuaauuucauaaa

SEQ ID NO: 571840 - RNA, 12 nt, Coxiella burnetii RSA 493
cgguucaugaaa

SEQ ID NO: 571841 - RNA, 14 nt, Coxiella burnetii RSA 493
cgguucccgcuucc

SEQ ID NO: 571842 - RNA, 19 nt, Coxiella burnetii RSA 493
cgguucccgcuuccagcaa

SEQ ID NO: 571843 - RNA, 19 nt, Coxiella burnetii RSA 493
cguaacugauguauccuaa

SEQ ID NO: 571844 - RNA, 14 nt, Coxiella burnetii RSA 493
cguaagccgcccgg

SEQ ID NO: 571845 - RNA, 13 nt, Coxiella burnetii RSA 493
cguaacugcuaag

SEQ ID NO: 571846 - RNA, 18 nt, Coxiella burnetii RSA 493
cguaaaccuccaaaaacu

SEQ ID NO: 571847 - RNA, 15 nt, Coxiella burnetii RSA 493
cgguuuuucuucauu

SEQ ID NO: 571848 - RNA, 22 nt, Coxiella burnetii RSA 493
cgguuuuuuuaaaaaagaaaau

SEQ ID NO: 571849 - RNA, 18 nt, Coxiella burnetii RSA 493
cgugagguuuuaccuuga

SEQ ID NO: 571850 - RNA, 21 nt, Coxiella burnetii RSA 493
cgugcggauauucaagcccgc

SEQ ID NO: 571851 - RNA, 10 nt, Coxiella burnetii RSA 493
cgucugaaug

SEQ ID NO: 571852 - RNA, 17 nt, Coxiella burnetii RSA 493
cgugaaauaccucuucu

SEQ ID NO: 571853 - RNA, 20 nt, Coxiella burnetii RSA 493
cguggcuuuaucaggcgcuc

SEQ ID NO: 571854 - RNA, 21 nt, Coxiella burnetii RSA 493
cguuaaaaccuuuuuuuucaa

SEQ ID NO: 571855 - RNA, 13 nt, Coxiella burnetii RSA 493
cguucuuuuccug

SEQ ID NO: 571856 - RNA, 23 nt, Coxiella burnetii RSA 493
cguucuugacaccacgcuaaaug

SEQ ID NO: 571857 - RNA, 19 nt, Coxiella burnetii RSA 493
cguuaagccugaaaaucaa

SEQ ID NO: 571858 - RNA, 14 nt, Coxiella burnetii RSA 493
cguuccagcgggga

SEQ ID NO: 571859 - RNA, 16 nt, Coxiella burnetii RSA 493
cguugcuuuaaauccc

SEQ ID NO: 571860 - RNA, 23 nt, Coxiella burnetii RSA 493
cguuggcaaacagcgaaaacaaa

SEQ ID NO: 571861 - RNA, 14 nt, Coxiella burnetii RSA 493
cuaaaucaauuuuc

SEQ ID NO: 571862 - RNA, 17 nt, Coxiella burnetii RSA 493
cuaaauauuuagcaacu

SEQ ID NO: 571863 - RNA, 22 nt, Coxiella burnetii RSA 493
cuaaaguacccaacaauaaaac

SEQ ID NO: 571864 - RNA, 20 nt, Coxiella burnetii RSA 493
cuaaagcgcgcuggauuccc

SEQ ID NO: 571865 - RNA, 16 nt, Coxiella burnetii RSA 493
cuaaauguuuagcuaa

SEQ ID NO: 571866 - RNA, 15 nt, Coxiella burnetii RSA 493
cuaaauuaguaauau

SEQ ID NO: 571867 - RNA, 20 nt, Coxiella burnetii RSA 493
cuaaaugacguaaugucuca

SEQ ID NO: 571868 - RNA, 13 nt, Coxiella burnetii RSA 493
cguuuccaauugu

SEQ ID NO: 571869 - RNA, 16 nt, Coxiella burnetii RSA 493
cguuuccaauuguuug

SEQ ID NO: 571870 - RNA, 15 nt, Coxiella burnetii RSA 493
cguuucugauuuuug

SEQ ID NO: 571871 - RNA, 14 nt, Coxiella burnetii RSA 493
cguuugauuuucaa

SEQ ID NO: 571872 - RNA, 18 nt, Coxiella burnetii RSA 493
cuacuuagcugauuucuc

SEQ ID NO: 571873 - RNA, 12 nt, Coxiella burnetii RSA 493
cuacucuuuuuc

SEQ ID NO: 571874 - RNA, 22 nt, Coxiella burnetii RSA 493
cuacucuaauuuucuuuccauc

SEQ ID NO: 571875 - RNA, 14 nt, Coxiella burnetii RSA 493
cuaaccaagagugu

SEQ ID NO: 571876 - RNA, 15 nt, Coxiella burnetii RSA 493
cuaaccacccuguca

SEQ ID NO: 571877 - RNA, 17 nt, Coxiella burnetii RSA 493
cuaccuuccgucaauuu

SEQ ID NO: 571878 - RNA, 20 nt, Coxiella burnetii RSA 493
cuagcagagccgcaaucgac

SEQ ID NO: 571879 - RNA, 23 nt, Coxiella burnetii RSA 493
cuagauuuuggcucccuaauacu

SEQ ID NO: 571880 - RNA, 22 nt, Coxiella burnetii RSA 493
cuagaucguuuuuugauaaaac

SEQ ID NO: 571881 - RNA, 13 nt, Coxiella burnetii RSA 493
cuacuuuuucugc

SEQ ID NO: 571882 - RNA, 23 nt, Coxiella burnetii RSA 493
cuacuuuacuuguugaaaaccua

SEQ ID NO: 571883 - RNA, 15 nt, Coxiella burnetii RSA 493
cuacuugaaaaccua

SEQ ID NO: 571884 - RNA, 11 nt, Coxiella burnetii RSA 493
cuauccaaaaa

SEQ ID NO: 571885 - RNA, 14 nt, Coxiella burnetii RSA 493
cuauccaaaaagau

SEQ ID NO: 571886 - RNA, 19 nt, Coxiella burnetii RSA 493
cuauccagaaaccaaaagc

SEQ ID NO: 571887 - RNA, 11 nt, Coxiella burnetii RSA 493
cuaugccaaca

SEQ ID NO: 571888 - RNA, 20 nt, Coxiella burnetii RSA 493
cuaugaucaugccuuuuuug

SEQ ID NO: 571889 - RNA, 20 nt, Coxiella burnetii RSA 493
cuaucguccccguauuucgc

SEQ ID NO: 571890 - RNA, 21 nt, Coxiella burnetii RSA 493
cuaucguccccguauuucgcu

SEQ ID NO: 571891 - RNA, 16 nt, Coxiella burnetii RSA 493
cuaucaauauuucguc

SEQ ID NO: 571892 - RNA, 15 nt, Coxiella burnetii RSA 493
cuauaucuuuuaaau

SEQ ID NO: 571893 - RNA, 16 nt, Coxiella burnetii RSA 493
cucaaguggcuccgau

SEQ ID NO: 571894 - RNA, 21 nt, Coxiella burnetii RSA 493
cucacauuggcaguguaaauu

SEQ ID NO: 571895 - RNA, 20 nt, Coxiella burnetii RSA 493
cucaaauugcuccaaacaga

SEQ ID NO: 571896 - RNA, 18 nt, Coxiella burnetii RSA 493
cucaacaguaguuuauca

SEQ ID NO: 571897 - RNA, 12 nt, Coxiella burnetii RSA 493
cucauauauuua

SEQ ID NO: 571898 - RNA, 14 nt, Coxiella burnetii RSA 493
cucaugaaaagcag

SEQ ID NO: 571899 - RNA, 20 nt, Coxiella burnetii RSA 493
cucaguuguuagcuuuucuu

SEQ ID NO: 571900 - RNA, 21 nt, Coxiella burnetii RSA 493
cucaguuguuagcuuuucuuu

SEQ ID NO: 571901 - RNA, 22 nt, Coxiella burnetii RSA 493
cucaguggcagcuucuuuaaaa

SEQ ID NO: 571902 - RNA, 16 nt, Coxiella burnetii RSA 493
cucaguugucauguaa

SEQ ID NO: 571903 - RNA, 20 nt, Coxiella burnetii RSA 493
cuccauccauagcgaaaauu

SEQ ID NO: 571904 - RNA, 16 nt, Coxiella burnetii RSA 493
cuccagggcuuguuca

SEQ ID NO: 571905 - RNA, 19 nt, Coxiella burnetii RSA 493
cuccgccgcgacgggaggu

SEQ ID NO: 571906 - RNA, 22 nt, Coxiella burnetii RSA 493
cucccagcguuuccaauuguuu

SEQ ID NO: 571907 - RNA, 15 nt, Coxiella burnetii RSA 493
cucccgccuccugau

SEQ ID NO: 571908 - RNA, 22 nt, Coxiella burnetii RSA 493
cuccucuauauaagcuuucaau

SEQ ID NO: 571909 - RNA, 19 nt, Coxiella burnetii RSA 493
cuccugaaaaauaauuuua

SEQ ID NO: 571910 - RNA, 17 nt, Coxiella burnetii RSA 493
cuccuugcaagcugcug

SEQ ID NO: 571911 - RNA, 19 nt, Coxiella burnetii RSA 493
cuccuugaggaauuuuuca

SEQ ID NO: 571912 - RNA, 17 nt, Coxiella burnetii RSA 493
cuccuucgcuuuuucca

SEQ ID NO: 571913 - RNA, 21 nt, Coxiella burnetii RSA 493
cuccuuuuguuaauucuuuuu

SEQ ID NO: 571914 - RNA, 21 nt, Coxiella burnetii RSA 493
cucggccgcaagugaccgaga

SEQ ID NO: 571915 - RNA, 20 nt, Coxiella burnetii RSA 493
cucggccauuuggucaaggc

SEQ ID NO: 571916 - RNA, 17 nt, Coxiella burnetii RSA 493
cucuagcuguuuuuucu

SEQ ID NO: 571917 - RNA, 12 nt, Coxiella burnetii RSA 493
cucucaaagaaa

SEQ ID NO: 571918 - RNA, 19 nt, Coxiella burnetii RSA 493
cucucaaagaaacgauuaa

SEQ ID NO: 571919 - RNA, 23 nt, Coxiella burnetii RSA 493
cucucaaagaaacgauuaaaaau

SEQ ID NO: 571920 - RNA, 18 nt, Coxiella burnetii RSA 493
cucucaacaaagaggcaa

SEQ ID NO: 571921 - RNA, 16 nt, Coxiella burnetii RSA 493
cucuccuaccaaauaa

SEQ ID NO: 571922 - RNA, 21 nt, Coxiella burnetii RSA 493
cucugaaaaauauucuaacca

SEQ ID NO: 571923 - RNA, 17 nt, Coxiella burnetii RSA 493
cucugccacauaaggga

SEQ ID NO: 571924 - RNA, 18 nt, Coxiella burnetii RSA 493
cucugcgaggaccucucc

SEQ ID NO: 571925 - RNA, 21 nt, Coxiella burnetii RSA 493
cucuuaccaugguuccagaaa

SEQ ID NO: 571926 - RNA, 22 nt, Coxiella burnetii RSA 493
cucuguaaugggcguacaaaga

SEQ ID NO: 571927 - RNA, 21 nt, Coxiella burnetii RSA 493
cucugcuucauugacagccag

SEQ ID NO: 571928 - RNA, 10 nt, Coxiella burnetii RSA 493
cucuucuuuu

SEQ ID NO: 571929 - RNA, 15 nt, Coxiella burnetii RSA 493
cucuugcccccauug

SEQ ID NO: 571930 - RNA, 21 nt, Coxiella burnetii RSA 493
cucuuguuucuggcguaagcg

SEQ ID NO: 571931 - RNA, 14 nt, Coxiella burnetii RSA 493
cucuuuauuuuuuc

SEQ ID NO: 571932 - RNA, 14 nt, Coxiella burnetii RSA 493
cucuuuaucagaaa

SEQ ID NO: 571933 - RNA, 12 nt, Coxiella burnetii RSA 493
cucuuuuuucca

SEQ ID NO: 571934 - RNA, 13 nt, Coxiella burnetii RSA 493
cugaaaaaauuaa

SEQ ID NO: 571935 - RNA, 16 nt, Coxiella burnetii RSA 493
cugaaaaaauuaaaua

SEQ ID NO: 571936 - RNA, 17 nt, Coxiella burnetii RSA 493
cugaaaaaauuaauaua

SEQ ID NO: 571937 - RNA, 12 nt, Coxiella burnetii RSA 493
cugaaaaauaau

SEQ ID NO: 571938 - RNA, 12 nt, Coxiella burnetii RSA 493
cugaagaaucau

SEQ ID NO: 571939 - RNA, 17 nt, Coxiella burnetii RSA 493
cugaagacguauuugga

SEQ ID NO: 571940 - RNA, 17 nt, Coxiella burnetii RSA 493
cugaacaggcagaugau

SEQ ID NO: 571941 - RNA, 12 nt, Coxiella burnetii RSA 493
cugaaauuuuau

SEQ ID NO: 571942 - RNA, 22 nt, Coxiella burnetii RSA 493
cugacaaugcguuuuaaaugcu

SEQ ID NO: 571943 - RNA, 15 nt, Coxiella burnetii RSA 493
cugacacccugaaca

SEQ ID NO: 571944 - RNA, 23 nt, Coxiella burnetii RSA 493
cugacgcuuuuucccucucaguu

SEQ ID NO: 571945 - RNA, 14 nt, Coxiella burnetii RSA 493
cugagauggccuua

SEQ ID NO: 571946 - RNA, 18 nt, Coxiella burnetii RSA 493
cugcaacggcagaaacga

SEQ ID NO: 571947 - RNA, 14 nt, Coxiella burnetii RSA 493
cugaucgauaaaaa

SEQ ID NO: 571948 - RNA, 15 nt, Coxiella burnetii RSA 493
cugaucgauaaaaau

SEQ ID NO: 571949 - RNA, 18 nt, Coxiella burnetii RSA 493
cugaucgauaaaaauaau

SEQ ID NO: 571950 - RNA, 18 nt, Coxiella burnetii RSA 493
cugagugucugagauggc

SEQ ID NO: 571951 - RNA, 18 nt, Coxiella burnetii RSA 493
cuggaaacuuuccuguuu

SEQ ID NO: 571952 - RNA, 14 nt, Coxiella burnetii RSA 493
cuggaauucauaau

SEQ ID NO: 571953 - RNA, 16 nt, Coxiella burnetii RSA 493
cuggauuuuuuaauug

SEQ ID NO: 571954 - RNA, 23 nt, Coxiella burnetii RSA 493
cuggccagcgagaguacgccaac

SEQ ID NO: 571955 - RNA, 22 nt, Coxiella burnetii RSA 493
cugcuaaaauaagguuaaaucc

SEQ ID NO: 571956 - RNA, 17 nt, Coxiella burnetii RSA 493
cugcgcuccagaugaua

SEQ ID NO: 571957 - RNA, 19 nt, Coxiella burnetii RSA 493
cugcgcuccagaugauauc

SEQ ID NO: 571958 - RNA, 14 nt, Coxiella burnetii RSA 493
cugcgcuaauuaac

SEQ ID NO: 571959 - RNA, 16 nt, Coxiella burnetii RSA 493
cugcaaucgcaucugc

SEQ ID NO: 571960 - RNA, 23 nt, Coxiella burnetii RSA 493
cugcaguuguuagauuggugaag

SEQ ID NO: 571961 - RNA, 12 nt, Coxiella burnetii RSA 493
cugcccagccgg

SEQ ID NO: 571962 - RNA, 19 nt, Coxiella burnetii RSA 493
cugcgauuguuuucuuacu

SEQ ID NO: 571963 - RNA, 16 nt, Coxiella burnetii RSA 493
cugcgauuuuguuucu

SEQ ID NO: 571964 - RNA, 21 nt, Coxiella burnetii RSA 493
cugcgcgaaacgacgaaagag

SEQ ID NO: 571965 - RNA, 14 nt, Coxiella burnetii RSA 493
aaaaaagcggugga

SEQ ID NO: 571966 - RNA, 14 nt, Coxiella burnetii RSA 493
aaaaaaaucguuuu

SEQ ID NO: 571967 - RNA, 12 nt, Coxiella burnetii RSA 493
aaaaaaauuauu

SEQ ID NO: 571968 - RNA, 18 nt, Coxiella burnetii RSA 493
aaaaaauagcgagaaaac

SEQ ID NO: 571969 - RNA, 12 nt, Coxiella burnetii RSA 493
aaaaaaaucguu

SEQ ID NO: 571970 - RNA, 16 nt, Coxiella burnetii RSA 493
aaaaaaaccuuuuaaa

SEQ ID NO: 571971 - RNA, 13 nt, Coxiella burnetii RSA 493
aaaaaaagaaaau

SEQ ID NO: 571972 - RNA, 22 nt, Coxiella burnetii RSA 493
aaaaacauuauugaugucacaa

SEQ ID NO: 571973 - RNA, 18 nt, Coxiella burnetii RSA 493
aaaaacaaaacaaacguu

SEQ ID NO: 571974 - RNA, 21 nt, Coxiella burnetii RSA 493
aaaaacagauuuaaauagcuc

SEQ ID NO: 571975 - RNA, 12 nt, Coxiella burnetii RSA 493
aaaaaauaguuu

SEQ ID NO: 571976 - RNA, 15 nt, Coxiella burnetii RSA 493
aaaaaauaauuauag

SEQ ID NO: 571977 - RNA, 13 nt, Coxiella burnetii RSA 493
aaaaaaucaaaua

SEQ ID NO: 571978 - RNA, 22 nt, Coxiella burnetii RSA 493
aaaaaaucuuugcucuaaauua

SEQ ID NO: 571979 - RNA, 16 nt, Coxiella burnetii RSA 493
aaaauucaugaaaagu

SEQ ID NO: 571980 - RNA, 15 nt, Coxiella burnetii RSA 493
aaaauuccaaaaaca

SEQ ID NO: 571981 - RNA, 20 nt, Coxiella burnetii RSA 493
aaaauuucuuuccagccuuu

SEQ ID NO: 571982 - RNA, 19 nt, Coxiella burnetii RSA 493
aaaauuucauuuaauaaau

SEQ ID NO: 571983 - RNA, 14 nt, Coxiella burnetii RSA 493
aaaauuuaauaagu

SEQ ID NO: 571984 - RNA, 12 nt, Coxiella burnetii RSA 493
aaaauuucaagu

SEQ ID NO: 571985 - RNA, 13 nt, Coxiella burnetii RSA 493
aaaauuucaagua

SEQ ID NO: 571986 - RNA, 18 nt, Coxiella burnetii RSA 493
aaaauuugagguugaaua

SEQ ID NO: 571987 - RNA, 16 nt, Coxiella burnetii RSA 493
aaaauuuuaaaaaaau

SEQ ID NO: 571988 - RNA, 14 nt, Coxiella burnetii RSA 493
aaaauuagaauuac

SEQ ID NO: 571989 - RNA, 15 nt, Coxiella burnetii RSA 493
aaaauuagaauugcu

SEQ ID NO: 571990 - RNA, 22 nt, Coxiella burnetii RSA 493
aaaauagggcuaguaugcuaua

SEQ ID NO: 571991 - RNA, 17 nt, Coxiella burnetii RSA 493
aaaauagacuucgcuaa

SEQ ID NO: 571992 - RNA, 20 nt, Coxiella burnetii RSA 493
aaaauagacuucgcuaaaua

SEQ ID NO: 571993 - RNA, 16 nt, Coxiella burnetii RSA 493
aaaauagaauuguaaa

SEQ ID NO: 571994 - RNA, 16 nt, Coxiella burnetii RSA 493
aaaauacuuaaaauuu

SEQ ID NO: 571995 - RNA, 22 nt, Coxiella burnetii RSA 493
aaaauccaggcugcuagaagua

SEQ ID NO: 571996 - RNA, 20 nt, Coxiella burnetii RSA 493
aaaaguagcgauaaauuuuu

SEQ ID NO: 571997 - RNA, 23 nt, Coxiella burnetii RSA 493
aaaagugauuuuucuuuguuccu

SEQ ID NO: 571998 - RNA, 22 nt, Coxiella burnetii RSA 493
aaaagcauuuuucgcagcaaaa

SEQ ID NO: 571999 - RNA, 23 nt, Coxiella burnetii RSA 493
aaaagcauuuuucgcagcaaaau

SEQ ID NO: 572000 - RNA, 13 nt, Coxiella burnetii RSA 493
aaaagccaauuua

SEQ ID NO: 572001 - RNA, 19 nt, Coxiella burnetii RSA 493
aaaagcgauuccaaagcag

SEQ ID NO: 572002 - RNA, 24 nt, Coxiella burnetii RSA 493
aaaagcgauuccaaagcagauaaa

SEQ ID NO: 572003 - RNA, 19 nt, Coxiella burnetii RSA 493
aaaauaagguuaaaucccu

SEQ ID NO: 572004 - RNA, 14 nt, Coxiella burnetii RSA 493
aaaauaaguaucca

SEQ ID NO: 572005 - RNA, 20 nt, Coxiella burnetii RSA 493
aaaauaaguauccaucccaa

SEQ ID NO: 572006 - RNA, 14 nt, Coxiella burnetii RSA 493
aaaauaaugcuaag

SEQ ID NO: 572007 - RNA, 20 nt, Coxiella burnetii RSA 493
aaaauaauacggcuuuauuu

SEQ ID NO: 572008 - RNA, 19 nt, Coxiella burnetii RSA 493
aaaauaagucgcaauuuga

SEQ ID NO: 572009 - RNA, 14 nt, Coxiella burnetii RSA 493
aaaauaaaaggaga

SEQ ID NO: 572010 - RNA, 15 nt, Coxiella burnetii RSA 493
aaaauaaaaggagaa

SEQ ID NO: 572011 - RNA, 18 nt, Coxiella burnetii RSA 493
aaaauaaaaggagaaauu

SEQ ID NO: 572012 - RNA, 19 nt, Coxiella burnetii RSA 493
aaaaguuaaguauauacau

SEQ ID NO: 572013 - RNA, 16 nt, Coxiella burnetii RSA 493
aaaacggcgaaaggga

SEQ ID NO: 572014 - RNA, 17 nt, Coxiella burnetii RSA 493
aaaacggcguauuuuuu

SEQ ID NO: 572015 - RNA, 22 nt, Coxiella burnetii RSA 493
aaaacguagaaguuuaaaguua

SEQ ID NO: 572016 - RNA, 17 nt, Coxiella burnetii RSA 493
aaaacgucgccugcuaa

SEQ ID NO: 572017 - RNA, 17 nt, Coxiella burnetii RSA 493
aaaacuaguuauuuuua

SEQ ID NO: 572018 - RNA, 18 nt, Coxiella burnetii RSA 493
aaaacuaguuauuuuuaa

SEQ ID NO: 572019 - RNA, 19 nt, Coxiella burnetii RSA 493
aaaacuaguuauuuuuaaa

SEQ ID NO: 572020 - RNA, 23 nt, Coxiella burnetii RSA 493
aaaacgugccgccgaaauuuaac

SEQ ID NO: 572021 - RNA, 16 nt, Coxiella burnetii RSA 493
aaaacguuucaucaaa

SEQ ID NO: 572022 - RNA, 21 nt, Coxiella burnetii RSA 493
aaaacguuucaucaaaauucu

SEQ ID NO: 572023 - RNA, 13 nt, Coxiella burnetii RSA 493
aaaacuugauuau

SEQ ID NO: 572024 - RNA, 13 nt, Coxiella burnetii RSA 493
aaaacuuucagga

SEQ ID NO: 572025 - RNA, 23 nt, Coxiella burnetii RSA 493
aaaacuuuuuagggcugaaaaaa

SEQ ID NO: 572026 - RNA, 12 nt, Coxiella burnetii RSA 493
aaaagaaaaucc

SEQ ID NO: 572027 - RNA, 11 nt, Coxiella burnetii RSA 493
aaaagaaaaua

SEQ ID NO: 572028 - RNA, 20 nt, Coxiella burnetii RSA 493
aaaagacgcuaguuuuuaag

SEQ ID NO: 572029 - RNA, 12 nt, Coxiella burnetii RSA 493
aaaagauuccaa

SEQ ID NO: 572030 - RNA, 22 nt, Coxiella burnetii RSA 493
aaaagauuuaauggcuaacuca

SEQ ID NO: 572031 - RNA, 22 nt, Coxiella burnetii RSA 493
aaaagcacgcgauacuuguuga

SEQ ID NO: 572032 - RNA, 22 nt, Coxiella burnetii RSA 493
aaaagcaccgacgacauuaaaa

SEQ ID NO: 572033 - RNA, 23 nt, Coxiella burnetii RSA 493
aaaagcaccgacgacauuaaaaa

SEQ ID NO: 572034 - RNA, 15 nt, Coxiella burnetii RSA 493
aaaagauaaucccaa

SEQ ID NO: 572035 - RNA, 19 nt, Coxiella burnetii RSA 493
aaaagauaaucccaauaaa

SEQ ID NO: 572036 - RNA, 21 nt, Coxiella burnetii RSA 493
aaaagauaaucccaauaaaac

SEQ ID NO: 572037 - RNA, 19 nt, Coxiella burnetii RSA 493
aaaagagcgaauaaaaaau

SEQ ID NO: 572038 - RNA, 21 nt, Coxiella burnetii RSA 493
aaaaaccgacuuuuuacugca

SEQ ID NO: 572039 - RNA, 11 nt, Coxiella burnetii RSA 493
aaaaauaaaaa

SEQ ID NO: 572040 - RNA, 17 nt, Coxiella burnetii RSA 493
aaaaacauugguauggu

SEQ ID NO: 572041 - RNA, 18 nt, Coxiella burnetii RSA 493
aaaaaccccaacucuuca

SEQ ID NO: 572042 - RNA, 13 nt, Coxiella burnetii RSA 493
aaaaauaauuuua

SEQ ID NO: 572043 - RNA, 12 nt, Coxiella burnetii RSA 493
aaaaauaucccu

SEQ ID NO: 572044 - RNA, 14 nt, Coxiella burnetii RSA 493
aaaaauaucccuuu

SEQ ID NO: 572045 - RNA, 21 nt, Coxiella burnetii RSA 493
aaaaauuugauuaaucguuuu

SEQ ID NO: 572046 - RNA, 20 nt, Coxiella burnetii RSA 493
aaaaauuucauuuaauaaau

SEQ ID NO: 572047 - RNA, 14 nt, Coxiella burnetii RSA 493
aaaaauucaauaga

SEQ ID NO: 572048 - RNA, 14 nt, Coxiella burnetii RSA 493
aaaaauuaagagaa

SEQ ID NO: 572049 - RNA, 18 nt, Coxiella burnetii RSA 493
aaaaauuauuaaucauau

SEQ ID NO: 572050 - RNA, 20 nt, Coxiella burnetii RSA 493
aaaaccaaaaaguuuauaaa

SEQ ID NO: 572051 - RNA, 14 nt, Coxiella burnetii RSA 493
aaaacagcaauuaa

SEQ ID NO: 572052 - RNA, 14 nt, Coxiella burnetii RSA 493
aaaacagauuuaaa

SEQ ID NO: 572053 - RNA, 13 nt, Coxiella burnetii RSA 493
aaacuaaaucaau

SEQ ID NO: 572054 - RNA, 21 nt, Coxiella burnetii RSA 493
aaacguuauuguuaacaccuu

SEQ ID NO: 572055 - RNA, 19 nt, Coxiella burnetii RSA 493
aaacguuuacgucuuuucu

SEQ ID NO: 572056 - RNA, 15 nt, Coxiella burnetii RSA 493
aaacguuucaucaaa

SEQ ID NO: 572057 - RNA, 12 nt, Coxiella burnetii RSA 493
aaacguuucugu

SEQ ID NO: 572058 - RNA, 21 nt, Coxiella burnetii RSA 493
aaacguauuccaaauaaucgu

SEQ ID NO: 572059 - RNA, 18 nt, Coxiella burnetii RSA 493
aaacguauugccaaaauu

SEQ ID NO: 572060 - RNA, 18 nt, Coxiella burnetii RSA 493
aaacgggcuaaagguuuc

SEQ ID NO: 572061 - RNA, 19 nt, Coxiella burnetii RSA 493
aaacggggaguggaauuuu

SEQ ID NO: 572062 - RNA, 14 nt, Coxiella burnetii RSA 493
aaacgccguaacca

SEQ ID NO: 572063 - RNA, 21 nt, Coxiella burnetii RSA 493
aaacaacguaacugauguauc

SEQ ID NO: 572064 - RNA, 14 nt, Coxiella burnetii RSA 493
aaaccuuuuuuuuc

SEQ ID NO: 572065 - RNA, 14 nt, Coxiella burnetii RSA 493
aaacgaaguucuca

SEQ ID NO: 572066 - RNA, 19 nt, Coxiella burnetii RSA 493
aaacgaauggcccaauaaa

SEQ ID NO: 572067 - RNA, 13 nt, Coxiella burnetii RSA 493
aaacgauuaaaaa

SEQ ID NO: 572068 - RNA, 20 nt, Coxiella burnetii RSA 493
aaacgauuaaaaauuuuaaa

SEQ ID NO: 572069 - RNA, 19 nt, Coxiella burnetii RSA 493
aaacgauaaucucaucauc

SEQ ID NO: 572070 - RNA, 15 nt, Coxiella burnetii RSA 493
aaacgccugaaauau

SEQ ID NO: 572071 - RNA, 19 nt, Coxiella burnetii RSA 493
aaacuaguuauuuuuaaaa

SEQ ID NO: 572072 - RNA, 15 nt, Coxiella burnetii RSA 493
aaacucaauucgcuu

SEQ ID NO: 572073 - RNA, 18 nt, Coxiella burnetii RSA 493
aaacugcuggaaauaaug

SEQ ID NO: 572074 - RNA, 13 nt, Coxiella burnetii RSA 493
aaacuggaaaaag

SEQ ID NO: 572075 - RNA, 23 nt, Coxiella burnetii RSA 493
aaacuggaaaaaggugcccaaga

SEQ ID NO: 572076 - RNA, 19 nt, Coxiella burnetii RSA 493
aaacugagugcaagcguuc

SEQ ID NO: 572077 - RNA, 23 nt, Coxiella burnetii RSA 493
aaacuuacgcugaaguaauugca

SEQ ID NO: 572078 - RNA, 20 nt, Coxiella burnetii RSA 493
aaagagaagcaacuuuaaca

SEQ ID NO: 572079 - RNA, 17 nt, Coxiella burnetii RSA 493
aaacuuuucaucccccg

SEQ ID NO: 572080 - RNA, 17 nt, Coxiella burnetii RSA 493
aaagacgcuaguuuuua

SEQ ID NO: 572081 - RNA, 18 nt, Coxiella burnetii RSA 493
aaagacguaccauuaaaa

SEQ ID NO: 572082 - RNA, 19 nt, Coxiella burnetii RSA 493
aaagacguaccauuaaaag

SEQ ID NO: 572083 - RNA, 18 nt, Coxiella burnetii RSA 493
aaagauccaagauuuuuu

SEQ ID NO: 572084 - RNA, 23 nt, Coxiella burnetii RSA 493
aaagauuuuaucuuauuauucau

SEQ ID NO: 572085 - RNA, 16 nt, Coxiella burnetii RSA 493
aaagauuuuuuuauug

SEQ ID NO: 572086 - RNA, 14 nt, Coxiella burnetii RSA 493
aaagauauucgguu

SEQ ID NO: 572087 - RNA, 15 nt, Coxiella burnetii RSA 493
aaagauauucuucua

SEQ ID NO: 572088 - RNA, 14 nt, Coxiella burnetii RSA 493
aaagauaaucccaa

SEQ ID NO: 572089 - RNA, 14 nt, Coxiella burnetii RSA 493
aaagcaugauuuag

SEQ ID NO: 572090 - RNA, 17 nt, Coxiella burnetii RSA 493
aaagcaugauuuaggca

SEQ ID NO: 572091 - RNA, 21 nt, Coxiella burnetii RSA 493
aaagcaugcccauaaauaacu

SEQ ID NO: 572092 - RNA, 16 nt, Coxiella burnetii RSA 493
aaagccauagaauuaa

SEQ ID NO: 572093 - RNA, 20 nt, Coxiella burnetii RSA 493
aaagccaaguuuuaagaaaa

SEQ ID NO: 572094 - RNA, 19 nt, Coxiella burnetii RSA 493
aaagcauuuaauaccccug

SEQ ID NO: 572095 - RNA, 15 nt, Coxiella burnetii RSA 493
aaagcauuaccauuu

SEQ ID NO: 572096 - RNA, 16 nt, Coxiella burnetii RSA 493
aaagccaaagaccaau

SEQ ID NO: 572097 - RNA, 18 nt, Coxiella burnetii RSA 493
aaaggcaaauguugauaa

SEQ ID NO: 572098 - RNA, 22 nt, Coxiella burnetii RSA 493
aaaggcaaauguugauaauaaa

SEQ ID NO: 572099 - RNA, 19 nt, Coxiella burnetii RSA 493
aaaggaauucuaauuaaau

SEQ ID NO: 572100 - RNA, 22 nt, Coxiella burnetii RSA 493
aaagcccucaucuccgcaggcg

SEQ ID NO: 572101 - RNA, 22 nt, Coxiella burnetii RSA 493
aaaggcagcuuccagaaauuca

SEQ ID NO: 572102 - RNA, 15 nt, Coxiella burnetii RSA 493
aaaguaaaaaauaau

SEQ ID NO: 572103 - RNA, 20 nt, Coxiella burnetii RSA 493
aaagguucuggcuuucccuu

SEQ ID NO: 572104 - RNA, 22 nt, Coxiella burnetii RSA 493
aaagguguucgagauuauucaa

SEQ ID NO: 572105 - RNA, 22 nt, Coxiella burnetii RSA 493
aaagucagacuugcuuuuuucu

SEQ ID NO: 572106 - RNA, 13 nt, Coxiella burnetii RSA 493
aaaguaauuuuaa

SEQ ID NO: 572107 - RNA, 18 nt, Coxiella burnetii RSA 493
aaaguaauuuuaaaaaaa

SEQ ID NO: 572108 - RNA, 16 nt, Coxiella burnetii RSA 493
aaaguaaaaaugaaau

SEQ ID NO: 572109 - RNA, 19 nt, Coxiella burnetii RSA 493
aaaguacuagcaucaauaa

SEQ ID NO: 572110 - RNA, 13 nt, Coxiella burnetii RSA 493
aaaucaccagaaa

SEQ ID NO: 572111 - RNA, 22 nt, Coxiella burnetii RSA 493
aaauauucgcgcaaguuuugaa

SEQ ID NO: 572112 - RNA, 12 nt, Coxiella burnetii RSA 493
aaauauuuaaau

SEQ ID NO: 572113 - RNA, 19 nt, Coxiella burnetii RSA 493
aaauauuuauuuauugacu

SEQ ID NO: 572114 - RNA, 12 nt, Coxiella burnetii RSA 493
aaauauuuuuau

SEQ ID NO: 572115 - RNA, 16 nt, Coxiella burnetii RSA 493
aaauaguagcuauaag

SEQ ID NO: 572116 - RNA, 16 nt, Coxiella burnetii RSA 493
aaauaagggauaaaac

SEQ ID NO: 572117 - RNA, 11 nt, Coxiella burnetii RSA 493
aaauaauaaug

SEQ ID NO: 572118 - RNA, 16 nt, Coxiella burnetii RSA 493
aaauaauaaugaaacu

SEQ ID NO: 572119 - RNA, 23 nt, Coxiella burnetii RSA 493
aaauaacucaucgaccucuguaa

SEQ ID NO: 572120 - RNA, 18 nt, Coxiella burnetii RSA 493
aaauaacuuuacuaaaaa

SEQ ID NO: 572121 - RNA, 15 nt, Coxiella burnetii RSA 493
aaaguccuguucuuu

SEQ ID NO: 572122 - RNA, 13 nt, Coxiella burnetii RSA 493
aaauaaaaggaga

SEQ ID NO: 572123 - RNA, 23 nt, Coxiella burnetii RSA 493
aaauaaaaggagaaauugacaaa

SEQ ID NO: 572124 - RNA, 18 nt, Coxiella burnetii RSA 493
aaauaacaguugguuagc

SEQ ID NO: 572125 - RNA, 19 nt, Coxiella burnetii RSA 493
aaauaaaccuauccaaaaa

SEQ ID NO: 572126 - RNA, 18 nt, Coxiella burnetii RSA 493
aaauaaauccauccggau

SEQ ID NO: 572127 - RNA, 13 nt, Coxiella burnetii RSA 493
aaauaaauuaauu

SEQ ID NO: 572128 - RNA, 15 nt, Coxiella burnetii RSA 493
aaauaaauuaauuau

SEQ ID NO: 572129 - RNA, 16 nt, Coxiella burnetii RSA 493
aaauacuggcaauaag

SEQ ID NO: 572130 - RNA, 23 nt, Coxiella burnetii RSA 493
aaauagcuugacgauauugauuu

SEQ ID NO: 572131 - RNA, 17 nt, Coxiella burnetii RSA 493
aaauaaucguaucgauu

SEQ ID NO: 572132 - RNA, 13 nt, Coxiella burnetii RSA 493
aaauaauaugaau

SEQ ID NO: 572133 - RNA, 19 nt, Coxiella burnetii RSA 493
aaauacgggaaaacaauga

SEQ ID NO: 572134 - RNA, 17 nt, Coxiella burnetii RSA 493
aaauaaugaauauucug

SEQ ID NO: 572135 - RNA, 14 nt, Coxiella burnetii RSA 493
aaaucguuuugaaa

SEQ ID NO: 572136 - RNA, 21 nt, Coxiella burnetii RSA 493
aaaucaugagcggucaguaaa

SEQ ID NO: 572137 - RNA, 23 nt, Coxiella burnetii RSA 493
aaaucaugagcggucaguaaacc

SEQ ID NO: 572138 - RNA, 15 nt, Coxiella burnetii RSA 493
aaaucgccauuuugu

SEQ ID NO: 572139 - RNA, 14 nt, Coxiella burnetii RSA 493
aaaucgaugauaag

SEQ ID NO: 572140 - RNA, 18 nt, Coxiella burnetii RSA 493
aaaucgauggaagaacau

SEQ ID NO: 572141 - RNA, 19 nt, Coxiella burnetii RSA 493
aaaucgauggaagaacauu

SEQ ID NO: 572142 - RNA, 20 nt, Coxiella burnetii RSA 493
aaaucauugguuuuugauug

SEQ ID NO: 572143 - RNA, 17 nt, Coxiella burnetii RSA 493
aaaucuuuuuuuugaaa

SEQ ID NO: 572144 - RNA, 18 nt, Coxiella burnetii RSA 493
aaaugauugggcucaaaa

SEQ ID NO: 572145 - RNA, 23 nt, Coxiella burnetii RSA 493
aaaugauuguccggcguugauuu

SEQ ID NO: 572146 - RNA, 21 nt, Coxiella burnetii RSA 493
aaaugaaaucccgagccccaa

SEQ ID NO: 572147 - RNA, 19 nt, Coxiella burnetii RSA 493
aaaugaugaauuuauuucu

SEQ ID NO: 572148 - RNA, 16 nt, Coxiella burnetii RSA 493
aaaugaugcuucuuug

SEQ ID NO: 572149 - RNA, 21 nt, Coxiella burnetii RSA 493
aaaugaugcuucuuugauaaa

SEQ ID NO: 572150 - RNA, 17 nt, Coxiella burnetii RSA 493
aaaugcuaauuccuuug

SEQ ID NO: 572151 - RNA, 23 nt, Coxiella burnetii RSA 493
aaauuaauugauagcgauuucca

SEQ ID NO: 572152 - RNA, 14 nt, Coxiella burnetii RSA 493
aaauuaauuaucca

SEQ ID NO: 572153 - RNA, 18 nt, Coxiella burnetii RSA 493
aaaaagcuagcgaaauuu

SEQ ID NO: 572154 - RNA, 12 nt, Coxiella burnetii RSA 493
aaauuaaaaucu

SEQ ID NO: 572155 - RNA, 17 nt, Coxiella burnetii RSA 493
aaauguugauaauaaau

SEQ ID NO: 572156 - RNA, 19 nt, Coxiella burnetii RSA 493
aaauguugauaauaaaugg

SEQ ID NO: 572157 - RNA, 18 nt, Coxiella burnetii RSA 493
aaauggauagacaauuuu

SEQ ID NO: 572158 - RNA, 15 nt, Coxiella burnetii RSA 493
aaaugcuuucacuuc

SEQ ID NO: 572159 - RNA, 15 nt, Coxiella burnetii RSA 493
aaaugcuuuuuaaau

SEQ ID NO: 572160 - RNA, 15 nt, Coxiella burnetii RSA 493
aaauguuaggaagga

SEQ ID NO: 572161 - RNA, 17 nt, Coxiella burnetii RSA 493
aaauucuagugugauaa

SEQ ID NO: 572162 - RNA, 18 nt, Coxiella burnetii RSA 493
aaauucgggcaacgaggu

SEQ ID NO: 572163 - RNA, 12 nt, Coxiella burnetii RSA 493
aaauuaugcgaa

SEQ ID NO: 572164 - RNA, 19 nt, Coxiella burnetii RSA 493
aaauuauucggauucucuc

SEQ ID NO: 572165 - RNA, 16 nt, Coxiella burnetii RSA 493
augcaaugaauucaaa

SEQ ID NO: 572166 - RNA, 20 nt, Coxiella burnetii RSA 493
augcaaaaauuguuuaucau

SEQ ID NO: 572167 - RNA, 11 nt, Coxiella burnetii RSA 493
augauuuccaa

SEQ ID NO: 572168 - RNA, 17 nt, Coxiella burnetii RSA 493
augauugcucugaccua

SEQ ID NO: 572169 - RNA, 19 nt, Coxiella burnetii RSA 493
augauuaaacguauuccaa

SEQ ID NO: 572170 - RNA, 15 nt, Coxiella burnetii RSA 493
augauuaaaucaaca

SEQ ID NO: 572171 - RNA, 20 nt, Coxiella burnetii RSA 493
augauuaaaucaacacccca

SEQ ID NO: 572172 - RNA, 14 nt, Coxiella burnetii RSA 493
augaugucaucuau

SEQ ID NO: 572173 - RNA, 17 nt, Coxiella burnetii RSA 493
augaugccuuaaauagu

SEQ ID NO: 572174 - RNA, 12 nt, Coxiella burnetii RSA 493
augaugaaaagc

SEQ ID NO: 572175 - RNA, 17 nt, Coxiella burnetii RSA 493
augcgaaaaaugaacaa

SEQ ID NO: 572176 - RNA, 18 nt, Coxiella burnetii RSA 493
augcgaaaaaugaacaaa

SEQ ID NO: 572177 - RNA, 21 nt, Coxiella burnetii RSA 493
augcgaaauagaauuuuugac

SEQ ID NO: 572178 - RNA, 17 nt, Coxiella burnetii RSA 493
augcgaauguaaugcuu

SEQ ID NO: 572179 - RNA, 20 nt, Coxiella burnetii RSA 493
augcgacuuuuugcaaugcc

SEQ ID NO: 572180 - RNA, 14 nt, Coxiella burnetii RSA 493
augcgccuacaaau

SEQ ID NO: 572181 - RNA, 13 nt, Coxiella burnetii RSA 493
augccauaaugcc

SEQ ID NO: 572182 - RNA, 16 nt, Coxiella burnetii RSA 493
augcagcacaaagcug

SEQ ID NO: 572183 - RNA, 14 nt, Coxiella burnetii RSA 493
augcagccauucuc

SEQ ID NO: 572184 - RNA, 15 nt, Coxiella burnetii RSA 493
augcuugcucuucuu

SEQ ID NO: 572185 - RNA, 16 nt, Coxiella burnetii RSA 493
augcuugcucuucuuc

SEQ ID NO: 572186 - RNA, 12 nt, Coxiella burnetii RSA 493
augcuuuuaaag

SEQ ID NO: 572187 - RNA, 15 nt, Coxiella burnetii RSA 493
augcuucaauaaaaa

SEQ ID NO: 572188 - RNA, 16 nt, Coxiella burnetii RSA 493
augcuucaauaaaaaa

SEQ ID NO: 572189 - RNA, 20 nt, Coxiella burnetii RSA 493
augcgcggaggaugagaggu

SEQ ID NO: 572190 - RNA, 13 nt, Coxiella burnetii RSA 493
augcugauuuuca

SEQ ID NO: 572191 - RNA, 16 nt, Coxiella burnetii RSA 493
augcugccuuaagaga

SEQ ID NO: 572192 - RNA, 22 nt, Coxiella burnetii RSA 493
augcugcgaccuucuuuuuuau

SEQ ID NO: 572193 - RNA, 13 nt, Coxiella burnetii RSA 493
auggaaguucuau

SEQ ID NO: 572194 - RNA, 19 nt, Coxiella burnetii RSA 493
auggacaaauguauuuauc

SEQ ID NO: 572195 - RNA, 20 nt, Coxiella burnetii RSA 493
auggaaacgacgaucaccca

SEQ ID NO: 572196 - RNA, 16 nt, Coxiella burnetii RSA 493
augcuuuuuuauaagg

SEQ ID NO: 572197 - RNA, 20 nt, Coxiella burnetii RSA 493
auggacacuuaacuaggacu

SEQ ID NO: 572198 - RNA, 14 nt, Coxiella burnetii RSA 493
auggacuacacggu

SEQ ID NO: 572199 - RNA, 15 nt, Coxiella burnetii RSA 493
auggacuacacgguu

SEQ ID NO: 572200 - RNA, 17 nt, Coxiella burnetii RSA 493
auggaugcgacuuuuug

SEQ ID NO: 572201 - RNA, 15 nt, Coxiella burnetii RSA 493
auggaugaaagauuu

SEQ ID NO: 572202 - RNA, 14 nt, Coxiella burnetii RSA 493
auggcuaacucacu

SEQ ID NO: 572203 - RNA, 15 nt, Coxiella burnetii RSA 493
augggcguacaaaga

SEQ ID NO: 572204 - RNA, 20 nt, Coxiella burnetii RSA 493
augguggucggcaccaaaau

SEQ ID NO: 572205 - RNA, 20 nt, Coxiella burnetii RSA 493
augguugaaagaaaaaaaac

SEQ ID NO: 572206 - RNA, 21 nt, Coxiella burnetii RSA 493
augguuccagaaacauaacug

SEQ ID NO: 572207 - RNA, 23 nt, Coxiella burnetii RSA 493
auuauuaaaagagcgaauaaaaa

SEQ ID NO: 572208 - RNA, 14 nt, Coxiella burnetii RSA 493
auuaucuagauuuu

SEQ ID NO: 572209 - RNA, 19 nt, Coxiella burnetii RSA 493
auuaucucuuaaaauuccg

SEQ ID NO: 572210 - RNA, 14 nt, Coxiella burnetii RSA 493
auuaguaauauuuu

SEQ ID NO: 572211 - RNA, 18 nt, Coxiella burnetii RSA 493
auuagucuuaauuuuaaa

SEQ ID NO: 572212 - RNA, 19 nt, Coxiella burnetii RSA 493
auuagucuuaauuuuaaaa

SEQ ID NO: 572213 - RNA, 19 nt, Coxiella burnetii RSA 493
auuauaguuauccacuaau

SEQ ID NO: 572214 - RNA, 16 nt, Coxiella burnetii RSA 493
auucaaacgguaaucg

SEQ ID NO: 572215 - RNA, 23 nt, Coxiella burnetii RSA 493
auucaaagaacgccagucauuuu

SEQ ID NO: 572216 - RNA, 16 nt, Coxiella burnetii RSA 493
auucaauaaucucaca

SEQ ID NO: 572217 - RNA, 14 nt, Coxiella burnetii RSA 493
auucaagguuauuu

SEQ ID NO: 572218 - RNA, 17 nt, Coxiella burnetii RSA 493
auucaagguuauuuuuu

SEQ ID NO: 572219 - RNA, 14 nt, Coxiella burnetii RSA 493
auuacauaauuuaa

SEQ ID NO: 572220 - RNA, 15 nt, Coxiella burnetii RSA 493
auuacauauuucuuu

SEQ ID NO: 572221 - RNA, 19 nt, Coxiella burnetii RSA 493
aaaagcaagccgaauaaau

SEQ ID NO: 572222 - RNA, 16 nt, Coxiella burnetii RSA 493
auuaauacauucuuca

SEQ ID NO: 572223 - RNA, 18 nt, Coxiella burnetii RSA 493
auuaauacauucuucagu

SEQ ID NO: 572224 - RNA, 14 nt, Coxiella burnetii RSA 493
auuacuuuuauaau

SEQ ID NO: 572225 - RNA, 14 nt, Coxiella burnetii RSA 493
aaaagcgccaaaac

SEQ ID NO: 572226 - RNA, 22 nt, Coxiella burnetii RSA 493
aaaagcggauaagccauuaaaa

SEQ ID NO: 572227 - RNA, 16 nt, Coxiella burnetii RSA 493
auuagagccuuaucuc

SEQ ID NO: 572228 - RNA, 16 nt, Coxiella burnetii RSA 493
auuagagcgauuaugu

SEQ ID NO: 572229 - RNA, 15 nt, Coxiella burnetii RSA 493
auuagagguucaucg

SEQ ID NO: 572230 - RNA, 17 nt, Coxiella burnetii RSA 493
auuagauuucuggauga

SEQ ID NO: 572231 - RNA, 14 nt, Coxiella burnetii RSA 493
augucucaaggcuc

SEQ ID NO: 572232 - RNA, 18 nt, Coxiella burnetii RSA 493
augucguucaauucugga

SEQ ID NO: 572233 - RNA, 17 nt, Coxiella burnetii RSA 493
auguuaauuauaaagaa

SEQ ID NO: 572234 - RNA, 21 nt, Coxiella burnetii RSA 493
auguuaggaaggacaaaaaua

SEQ ID NO: 572235 - RNA, 17 nt, Coxiella burnetii RSA 493
auguucugauuggagua

SEQ ID NO: 572236 - RNA, 15 nt, Coxiella burnetii RSA 493
auguucuugaucuaa

SEQ ID NO: 572237 - RNA, 13 nt, Coxiella burnetii RSA 493
auuaaaaaugaua

SEQ ID NO: 572238 - RNA, 20 nt, Coxiella burnetii RSA 493
auuaaaacaagacaacaaaa

SEQ ID NO: 572239 - RNA, 16 nt, Coxiella burnetii RSA 493
auuaaaaauaaaaccu

SEQ ID NO: 572240 - RNA, 14 nt, Coxiella burnetii RSA 493
auuaacuuugcaaa

SEQ ID NO: 572241 - RNA, 18 nt, Coxiella burnetii RSA 493
auuaacguauaaauaaca

SEQ ID NO: 572242 - RNA, 17 nt, Coxiella burnetii RSA 493
auuaaaugcuuuuuaaa

SEQ ID NO: 572243 - RNA, 19 nt, Coxiella burnetii RSA 493
auuaaaugcuuuuuaaaua

SEQ ID NO: 572244 - RNA, 23 nt, Coxiella burnetii RSA 493
auuaaauuacuuggggguuuuga

SEQ ID NO: 572245 - RNA, 15 nt, Coxiella burnetii RSA 493
auuaacggacucaac

SEQ ID NO: 572246 - RNA, 14 nt, Coxiella burnetii RSA 493
auuaagcuugaaaa

SEQ ID NO: 572247 - RNA, 19 nt, Coxiella burnetii RSA 493
auuaagcuugaaaaaauug

SEQ ID NO: 572248 - RNA, 18 nt, Coxiella burnetii RSA 493
auuaauacaggaaaaaga

SEQ ID NO: 572249 - RNA, 22 nt, Coxiella burnetii RSA 493
auuaauacaggaaaaagauaau

SEQ ID NO: 572250 - RNA, 20 nt, Coxiella burnetii RSA 493
aaaaggaaugaauagaaaaa

SEQ ID NO: 572251 - RNA, 16 nt, Coxiella burnetii RSA 493
aaaaggagaaagugag

SEQ ID NO: 572252 - RNA, 13 nt, Coxiella burnetii RSA 493
aaaaggagaaauu

SEQ ID NO: 572253 - RNA, 18 nt, Coxiella burnetii RSA 493
auucauaucuuuuucaau

SEQ ID NO: 572254 - RNA, 21 nt, Coxiella burnetii RSA 493
auucauauugcgcguaaauuu

SEQ ID NO: 572255 - RNA, 16 nt, Coxiella burnetii RSA 493
auucaugaaaaguaaa

SEQ ID NO: 572256 - RNA, 19 nt, Coxiella burnetii RSA 493
auucaugaaaaguaaauuu

SEQ ID NO: 572257 - RNA, 21 nt, Coxiella burnetii RSA 493
auucaugaaaaguaaauuuau

SEQ ID NO: 572258 - RNA, 14 nt, Coxiella burnetii RSA 493
auucaucauuuucc

SEQ ID NO: 572259 - RNA, 15 nt, Coxiella burnetii RSA 493
auucaucauuuucca

SEQ ID NO: 572260 - RNA, 21 nt, Coxiella burnetii RSA 493
auucaucauuuuccaaaaaau

SEQ ID NO: 572261 - RNA, 13 nt, Coxiella burnetii RSA 493
auucccaaacuca

SEQ ID NO: 572262 - RNA, 13 nt, Coxiella burnetii RSA 493
auucccgcugccu

SEQ ID NO: 572263 - RNA, 15 nt, Coxiella burnetii RSA 493
auuccaaagcagaua

SEQ ID NO: 572264 - RNA, 12 nt, Coxiella burnetii RSA 493
auucauuuuuca

SEQ ID NO: 572265 - RNA, 16 nt, Coxiella burnetii RSA 493
auuccauuaaaaacaa

SEQ ID NO: 572266 - RNA, 16 nt, Coxiella burnetii RSA 493
auucuaacguuaguuu

SEQ ID NO: 572267 - RNA, 18 nt, Coxiella burnetii RSA 493
auucuaacguuaguuucu

SEQ ID NO: 572268 - RNA, 17 nt, Coxiella burnetii RSA 493
auucuauacuucaucuc

SEQ ID NO: 572269 - RNA, 18 nt, Coxiella burnetii RSA 493
auucucgccuacuuuugu

SEQ ID NO: 572270 - RNA, 17 nt, Coxiella burnetii RSA 493
auucuccuuaauaaagu

SEQ ID NO: 572271 - RNA, 13 nt, Coxiella burnetii RSA 493
auucuauuagcug

SEQ ID NO: 572272 - RNA, 15 nt, Coxiella burnetii RSA 493
auucuaucucaagug

SEQ ID NO: 572273 - RNA, 15 nt, Coxiella burnetii RSA 493
auuccuugcucaagu

SEQ ID NO: 572274 - RNA, 16 nt, Coxiella burnetii RSA 493
auuccuugcucaaguc

SEQ ID NO: 572275 - RNA, 18 nt, Coxiella burnetii RSA 493
auucgcggguaaauuuau

SEQ ID NO: 572276 - RNA, 14 nt, Coxiella burnetii RSA 493
auucgcgcaaguuu

SEQ ID NO: 572277 - RNA, 14 nt, Coxiella burnetii RSA 493
auuccuuuuucuuu

SEQ ID NO: 572278 - RNA, 22 nt, Coxiella burnetii RSA 493
auuccuuuuucuuuuaauugau

SEQ ID NO: 572279 - RNA, 13 nt, Coxiella burnetii RSA 493
auucgcuuaaauu

SEQ ID NO: 572280 - RNA, 13 nt, Coxiella burnetii RSA 493
auucgcuaagcuu

SEQ ID NO: 572281 - RNA, 20 nt, Coxiella burnetii RSA 493
auucgguuuuuuuaaaaaag

SEQ ID NO: 572282 - RNA, 14 nt, Coxiella burnetii RSA 493
auucguaauauuau

SEQ ID NO: 572283 - RNA, 22 nt, Coxiella burnetii RSA 493
auucguaauauuauugagaauc

SEQ ID NO: 572284 - RNA, 14 nt, Coxiella burnetii RSA 493
auucucucaaagaa

SEQ ID NO: 572285 - RNA, 21 nt, Coxiella burnetii RSA 493
auucucugcgaggaccucucc

SEQ ID NO: 572286 - RNA, 22 nt, Coxiella burnetii RSA 493
auucuguaacuuuuccaucucc

SEQ ID NO: 572287 - RNA, 13 nt, Coxiella burnetii RSA 493
auucuucugccuu

SEQ ID NO: 572288 - RNA, 15 nt, Coxiella burnetii RSA 493
auucuucuaaugagu

SEQ ID NO: 572289 - RNA, 15 nt, Coxiella burnetii RSA 493
auucuucuuuugcca

SEQ ID NO: 572290 - RNA, 21 nt, Coxiella burnetii RSA 493
auucuugaacaggagcgauaa

SEQ ID NO: 572291 - RNA, 17 nt, Coxiella burnetii RSA 493
auucuugcagugaaaua

SEQ ID NO: 572292 - RNA, 21 nt, Coxiella burnetii RSA 493
auucuugcagugaaauaaccu

SEQ ID NO: 572293 - RNA, 17 nt, Coxiella burnetii RSA 493
auugaaaccgacaauuu

SEQ ID NO: 572294 - RNA, 22 nt, Coxiella burnetii RSA 493
auucuuuagccauugguuuaaa

SEQ ID NO: 572295 - RNA, 18 nt, Coxiella burnetii RSA 493
auugauuuuuuaaugaaa

SEQ ID NO: 572296 - RNA, 15 nt, Coxiella burnetii RSA 493
auugcauguuugcug

SEQ ID NO: 572297 - RNA, 20 nt, Coxiella burnetii RSA 493
auugcaguugguuuaaaaau

SEQ ID NO: 572298 - RNA, 17 nt, Coxiella burnetii RSA 493
auugcugauauuuuuua

SEQ ID NO: 572299 - RNA, 13 nt, Coxiella burnetii RSA 493
auugccaaaauuu

SEQ ID NO: 572300 - RNA, 18 nt, Coxiella burnetii RSA 493
auugccaaaguucauuaa

SEQ ID NO: 572301 - RNA, 17 nt, Coxiella burnetii RSA 493
auugccaauugucuuug

SEQ ID NO: 572302 - RNA, 13 nt, Coxiella burnetii RSA 493
auugccacucuuu

SEQ ID NO: 572303 - RNA, 18 nt, Coxiella burnetii RSA 493
auugccgauauucuuuuu

SEQ ID NO: 572304 - RNA, 16 nt, Coxiella burnetii RSA 493
auugggauaauaacua

SEQ ID NO: 572305 - RNA, 21 nt, Coxiella burnetii RSA 493
auugggccauuuaacaaaaau

SEQ ID NO: 572306 - RNA, 21 nt, Coxiella burnetii RSA 493
auuguaauuugggcugucuuc

SEQ ID NO: 572307 - RNA, 12 nt, Coxiella burnetii RSA 493
auuguccuuuuc

SEQ ID NO: 572308 - RNA, 13 nt, Coxiella burnetii RSA 493
auuguccuuuucu

SEQ ID NO: 572309 - RNA, 16 nt, Coxiella burnetii RSA 493
auuguccuuuucuauu

SEQ ID NO: 572310 - RNA, 17 nt, Coxiella burnetii RSA 493
auugguuuaaaaaguuc

SEQ ID NO: 572311 - RNA, 12 nt, Coxiella burnetii RSA 493
auuguugauuua

SEQ ID NO: 572312 - RNA, 17 nt, Coxiella burnetii RSA 493
auuguucauaaaauaau

SEQ ID NO: 572313 - RNA, 19 nt, Coxiella burnetii RSA 493
auuguucggcugcgcauuc

SEQ ID NO: 572314 - RNA, 20 nt, Coxiella burnetii RSA 493
auugucucacaacauuccuu

SEQ ID NO: 572315 - RNA, 16 nt, Coxiella burnetii RSA 493
auugucuaacauuugg

SEQ ID NO: 572316 - RNA, 19 nt, Coxiella burnetii RSA 493
auuguuguggauaaaggag

SEQ ID NO: 572317 - RNA, 20 nt, Coxiella burnetii RSA 493
auuguuguggauaaaggaga

SEQ ID NO: 572318 - RNA, 18 nt, Coxiella burnetii RSA 493
auuguuucgaacucgguu

SEQ ID NO: 572319 - RNA, 15 nt, Coxiella burnetii RSA 493
auuguuugaaaaaau

SEQ ID NO: 572320 - RNA, 17 nt, Coxiella burnetii RSA 493
auuguuugaaaaaauac

SEQ ID NO: 572321 - RNA, 15 nt, Coxiella burnetii RSA 493
auuuaacacuuuaau

SEQ ID NO: 572322 - RNA, 18 nt, Coxiella burnetii RSA 493
auuuaacacuuuaauauc

SEQ ID NO: 572323 - RNA, 14 nt, Coxiella burnetii RSA 493
auuuaaauugaauc

SEQ ID NO: 572324 - RNA, 15 nt, Coxiella burnetii RSA 493
aaaaguagcgauaaa

SEQ ID NO: 572325 - RNA, 20 nt, Coxiella burnetii RSA 493
auuuaucauguggucucuuu

SEQ ID NO: 572326 - RNA, 15 nt, Coxiella burnetii RSA 493
auuuaucauuuuucc

SEQ ID NO: 572327 - RNA, 13 nt, Coxiella burnetii RSA 493
auuuauaauuuau

SEQ ID NO: 572328 - RNA, 20 nt, Coxiella burnetii RSA 493
auuuaauaagucuuugcuaa

SEQ ID NO: 572329 - RNA, 17 nt, Coxiella burnetii RSA 493
auuuaauaaucaauagc

SEQ ID NO: 572330 - RNA, 19 nt, Coxiella burnetii RSA 493
auuuaacgauuuuaaguaa

SEQ ID NO: 572331 - RNA, 16 nt, Coxiella burnetii RSA 493
auuuaauaaaauuaaa

SEQ ID NO: 572332 - RNA, 22 nt, Coxiella burnetii RSA 493
aaaaguccucccggcuuuaaaa

SEQ ID NO: 572333 - RNA, 14 nt, Coxiella burnetii RSA 493
aaaaguccuguucu

SEQ ID NO: 572334 - RNA, 24 nt, Coxiella burnetii RSA 493
aaaagugauuuuucuuuguuccuu

SEQ ID NO: 572335 - RNA, 15 nt, Coxiella burnetii RSA 493
auuuaugaaugcugg

SEQ ID NO: 572336 - RNA, 14 nt, Coxiella burnetii RSA 493
auuuauuaaaaacu

SEQ ID NO: 572337 - RNA, 18 nt, Coxiella burnetii RSA 493
auuuauuguguuguagaa

SEQ ID NO: 572338 - RNA, 19 nt, Coxiella burnetii RSA 493
auuuauucaacucuuaucu

SEQ ID NO: 572339 - RNA, 18 nt, Coxiella burnetii RSA 493
auuucaauggauucuucu

SEQ ID NO: 572340 - RNA, 15 nt, Coxiella burnetii RSA 493
auuuauuuuucucuu

SEQ ID NO: 572341 - RNA, 20 nt, Coxiella burnetii RSA 493
auuuauuuuucucuucuuuu

SEQ ID NO: 572342 - RNA, 13 nt, Coxiella burnetii RSA 493
auuucuuuuugaa

SEQ ID NO: 572343 - RNA, 14 nt, Coxiella burnetii RSA 493
auuucuuuuuuugu

SEQ ID NO: 572344 - RNA, 16 nt, Coxiella burnetii RSA 493
auuucuuuuuuugugc

SEQ ID NO: 572345 - RNA, 14 nt, Coxiella burnetii RSA 493
auuugaaaaaccca

SEQ ID NO: 572346 - RNA, 17 nt, Coxiella burnetii RSA 493
auuugaaaaacccauuu

SEQ ID NO: 572347 - RNA, 22 nt, Coxiella burnetii RSA 493
auuucugguugaaucaaauuaa

SEQ ID NO: 572348 - RNA, 13 nt, Coxiella burnetii RSA 493
auuucuaaaaauc

SEQ ID NO: 572349 - RNA, 16 nt, Coxiella burnetii RSA 493
auuucuaaaaaucauc

SEQ ID NO: 572350 - RNA, 16 nt, Coxiella burnetii RSA 493
auuucccguauuucgc

SEQ ID NO: 572351 - RNA, 15 nt, Coxiella burnetii RSA 493
auuucccaaaugacg

SEQ ID NO: 572352 - RNA, 17 nt, Coxiella burnetii RSA 493
auuuccgucaauuuuuc

SEQ ID NO: 572353 - RNA, 15 nt, Coxiella burnetii RSA 493
auuuccgcuucaaac

SEQ ID NO: 572354 - RNA, 18 nt, Coxiella burnetii RSA 493
auuucggauguuuuuuca

SEQ ID NO: 572355 - RNA, 19 nt, Coxiella burnetii RSA 493
auuucgcucgcaagaaucu

SEQ ID NO: 572356 - RNA, 16 nt, Coxiella burnetii RSA 493
auuucgcuucgcucau

SEQ ID NO: 572357 - RNA, 13 nt, Coxiella burnetii RSA 493
auuucggacaaca

SEQ ID NO: 572358 - RNA, 15 nt, Coxiella burnetii RSA 493
auuucggacaacaaa

SEQ ID NO: 572359 - RNA, 19 nt, Coxiella burnetii RSA 493
auuucggacaacaaauaaa

SEQ ID NO: 572360 - RNA, 19 nt, Coxiella burnetii RSA 493
auuucaccuucuucuuugg

SEQ ID NO: 572361 - RNA, 17 nt, Coxiella burnetii RSA 493
auuucacgcgaaaaaag

SEQ ID NO: 572362 - RNA, 14 nt, Coxiella burnetii RSA 493
auuucaccgaugcg

SEQ ID NO: 572363 - RNA, 22 nt, Coxiella burnetii RSA 493
auuuuacuaggucugauaggaa

SEQ ID NO: 572364 - RNA, 16 nt, Coxiella burnetii RSA 493
auuuuacaauaaucca

SEQ ID NO: 572365 - RNA, 21 nt, Coxiella burnetii RSA 493
auuuuacgcuauuuuuuaaau

SEQ ID NO: 572366 - RNA, 13 nt, Coxiella burnetii RSA 493
auuuuaauuuuuu

SEQ ID NO: 572367 - RNA, 16 nt, Coxiella burnetii RSA 493
auuuuaauuuuuucuc

SEQ ID NO: 572368 - RNA, 16 nt, Coxiella burnetii RSA 493
auuuuaauaugauaaa

SEQ ID NO: 572369 - RNA, 14 nt, Coxiella burnetii RSA 493
auuuuaaguaauuu

SEQ ID NO: 572370 - RNA, 21 nt, Coxiella burnetii RSA 493
auuuuaagauaaguucaaccu

SEQ ID NO: 572371 - RNA, 12 nt, Coxiella burnetii RSA 493
auuuuaaaaaua

SEQ ID NO: 572372 - RNA, 16 nt, Coxiella burnetii RSA 493
auuuuaaaaaaaauac

SEQ ID NO: 572373 - RNA, 18 nt, Coxiella burnetii RSA 493
auuuuaaaaaaaauacuc

SEQ ID NO: 572374 - RNA, 14 nt, Coxiella burnetii RSA 493
auuuuaaaaaaauc

SEQ ID NO: 572375 - RNA, 21 nt, Coxiella burnetii RSA 493
auuugauaucgaccauuaacc

SEQ ID NO: 572376 - RNA, 18 nt, Coxiella burnetii RSA 493
auuugagaacguuuccca

SEQ ID NO: 572377 - RNA, 19 nt, Coxiella burnetii RSA 493
auuugagaauaaaacggcu

SEQ ID NO: 572378 - RNA, 20 nt, Coxiella burnetii RSA 493
auuuuaguugcuaaugaaac

SEQ ID NO: 572379 - RNA, 14 nt, Coxiella burnetii RSA 493
auuuuauaaagcaa

SEQ ID NO: 572380 - RNA, 16 nt, Coxiella burnetii RSA 493
auuuucaugagaggau

SEQ ID NO: 572381 - RNA, 15 nt, Coxiella burnetii RSA 493
auuuucaaaagaggg

SEQ ID NO: 572382 - RNA, 14 nt, Coxiella burnetii RSA 493
auuuucaaaugaau

SEQ ID NO: 572383 - RNA, 20 nt, Coxiella burnetii RSA 493
auuuucaaaugaauaagcaa

SEQ ID NO: 572384 - RNA, 16 nt, Coxiella burnetii RSA 493
auuuuucuuuguuccu

SEQ ID NO: 572385 - RNA, 13 nt, Coxiella burnetii RSA 493
auuuuuuauccaa

SEQ ID NO: 572386 - RNA, 14 nt, Coxiella burnetii RSA 493
auuuuuuaauuggu

SEQ ID NO: 572387 - RNA, 21 nt, Coxiella burnetii RSA 493
auuuuucgcagcaaaaugagg

SEQ ID NO: 572388 - RNA, 16 nt, Coxiella burnetii RSA 493
auuuuucgcucaauug

SEQ ID NO: 572389 - RNA, 18 nt, Coxiella burnetii RSA 493
auuuuucgcucaauuguu

SEQ ID NO: 572390 - RNA, 13 nt, Coxiella burnetii RSA 493
auuuuuucgagug

SEQ ID NO: 572391 - RNA, 19 nt, Coxiella burnetii RSA 493
auuuuuuuuaaaauuacuu

SEQ ID NO: 572392 - RNA, 14 nt, Coxiella burnetii RSA 493
auuuuuuuucuucu

SEQ ID NO: 572393 - RNA, 13 nt, Coxiella burnetii RSA 493
auuuuuuuucuuu

SEQ ID NO: 572394 - RNA, 14 nt, Coxiella burnetii RSA 493
caaaaaaagaaaau

SEQ ID NO: 572395 - RNA, 22 nt, Coxiella burnetii RSA 493
auuuuguuuuagagugaaccaa

SEQ ID NO: 572396 - RNA, 12 nt, Coxiella burnetii RSA 493
auuuuuaaaagu

SEQ ID NO: 572397 - RNA, 14 nt, Coxiella burnetii RSA 493
auuuuucauuuccu

SEQ ID NO: 572398 - RNA, 16 nt, Coxiella burnetii RSA 493
auuuuucauuuccuga

SEQ ID NO: 572399 - RNA, 12 nt, Coxiella burnetii RSA 493
auuuucauucuc

SEQ ID NO: 572400 - RNA, 19 nt, Coxiella burnetii RSA 493
auuuucauucucaauaguc

SEQ ID NO: 572401 - RNA, 22 nt, Coxiella burnetii RSA 493
auuuuguccuguucuuuuucca

SEQ ID NO: 572402 - RNA, 22 nt, Coxiella burnetii RSA 493
caauuccgauaagcguuugguu

SEQ ID NO: 572403 - RNA, 17 nt, Coxiella burnetii RSA 493
caauucccccaaaaacu

SEQ ID NO: 572404 - RNA, 15 nt, Coxiella burnetii RSA 493
caauuccaauaauug

SEQ ID NO: 572405 - RNA, 18 nt, Coxiella burnetii RSA 493
caauucgcuuaaauuuug

SEQ ID NO: 572406 - RNA, 20 nt, Coxiella burnetii RSA 493
caauucgucgcuguaucagc

SEQ ID NO: 572407 - RNA, 20 nt, Coxiella burnetii RSA 493
caauuccgguuucaaaugac

SEQ ID NO: 572408 - RNA, 20 nt, Coxiella burnetii RSA 493
caauucuggauaagcauauu

SEQ ID NO: 572409 - RNA, 17 nt, Coxiella burnetii RSA 493
caauugcuuucccuuuu

SEQ ID NO: 572410 - RNA, 13 nt, Coxiella burnetii RSA 493
caaugacauuggc

SEQ ID NO: 572411 - RNA, 15 nt, Coxiella burnetii RSA 493
caaugcuuuucucaa

SEQ ID NO: 572412 - RNA, 16 nt, Coxiella burnetii RSA 493
caaugacgcagaauau

SEQ ID NO: 572413 - RNA, 18 nt, Coxiella burnetii RSA 493
caaugacgcagaauauaa

SEQ ID NO: 572414 - RNA, 15 nt, Coxiella burnetii RSA 493
caauguauccgggcc

SEQ ID NO: 572415 - RNA, 19 nt, Coxiella burnetii RSA 493
caaugguggucggcaccaa

SEQ ID NO: 572416 - RNA, 22 nt, Coxiella burnetii RSA 493
cacacguaucugcuaaaaagcu

SEQ ID NO: 572417 - RNA, 19 nt, Coxiella burnetii RSA 493
cacaagucucagaaucugu

SEQ ID NO: 572418 - RNA, 15 nt, Coxiella burnetii RSA 493
cacaacuuucuucca

SEQ ID NO: 572419 - RNA, 16 nt, Coxiella burnetii RSA 493
cacaaccuugccaagg

SEQ ID NO: 572420 - RNA, 13 nt, Coxiella burnetii RSA 493
caauuucuuuucu

SEQ ID NO: 572421 - RNA, 22 nt, Coxiella burnetii RSA 493
caauuucuuuucuaaauaauga

SEQ ID NO: 572422 - RNA, 13 nt, Coxiella burnetii RSA 493
cacauaucgcucc

SEQ ID NO: 572423 - RNA, 20 nt, Coxiella burnetii RSA 493
caccacaauuaaugcgccua

SEQ ID NO: 572424 - RNA, 13 nt, Coxiella burnetii RSA 493
cacauuuguucga

SEQ ID NO: 572425 - RNA, 18 nt, Coxiella burnetii RSA 493
aaaauaaaaccuuguuau

SEQ ID NO: 572426 - RNA, 22 nt, Coxiella burnetii RSA 493
aaaauaaaaccuuguuauaaaa

SEQ ID NO: 572427 - RNA, 18 nt, Coxiella burnetii RSA 493
aaaaguggggauaauuga

SEQ ID NO: 572428 - RNA, 14 nt, Coxiella burnetii RSA 493
caccacucacagcc

SEQ ID NO: 572429 - RNA, 13 nt, Coxiella burnetii RSA 493
caccuaaaucaau

SEQ ID NO: 572430 - RNA, 16 nt, Coxiella burnetii RSA 493
caccguuggaaaagga

SEQ ID NO: 572431 - RNA, 16 nt, Coxiella burnetii RSA 493
aaaauaaauacauaca

SEQ ID NO: 572432 - RNA, 17 nt, Coxiella burnetii RSA 493
cacccccccguuaccaa

SEQ ID NO: 572433 - RNA, 21 nt, Coxiella burnetii RSA 493
cacccacggcgccaucaacca

SEQ ID NO: 572434 - RNA, 17 nt, Coxiella burnetii RSA 493
cacccuucuguuuaaga

SEQ ID NO: 572435 - RNA, 15 nt, Coxiella burnetii RSA 493
aaaauaccuuugcaa

SEQ ID NO: 572436 - RNA, 13 nt, Coxiella burnetii RSA 493
aaaauaauuuuag

SEQ ID NO: 572437 - RNA, 17 nt, Coxiella burnetii RSA 493
caccuggcuaguaaaua

SEQ ID NO: 572438 - RNA, 11 nt, Coxiella burnetii RSA 493
cacgaugcaca

SEQ ID NO: 572439 - RNA, 15 nt, Coxiella burnetii RSA 493
cacgaccccaaugcu

SEQ ID NO: 572440 - RNA, 12 nt, Coxiella burnetii RSA 493
aaaauagcacua

SEQ ID NO: 572441 - RNA, 13 nt, Coxiella burnetii RSA 493
aaaauagcgugua

SEQ ID NO: 572442 - RNA, 16 nt, Coxiella burnetii RSA 493
cacgauuuucguugua

SEQ ID NO: 572443 - RNA, 20 nt, Coxiella burnetii RSA 493
cacgauuuucguuguaaguc

SEQ ID NO: 572444 - RNA, 18 nt, Coxiella burnetii RSA 493
cacgauuuuucucaucau

SEQ ID NO: 572445 - RNA, 13 nt, Coxiella burnetii RSA 493
cacggcaaauaaa

SEQ ID NO: 572446 - RNA, 19 nt, Coxiella burnetii RSA 493
cacggcaaauaaaggcgac

SEQ ID NO: 572447 - RNA, 18 nt, Coxiella burnetii RSA 493
cacggcgccaucaaccaa

SEQ ID NO: 572448 - RNA, 17 nt, Coxiella burnetii RSA 493
caauaagcuagaaaaua

SEQ ID NO: 572449 - RNA, 15 nt, Coxiella burnetii RSA 493
caaguuuaucguaaa

SEQ ID NO: 572450 - RNA, 14 nt, Coxiella burnetii RSA 493
caaguuuuaagaaa

SEQ ID NO: 572451 - RNA, 16 nt, Coxiella burnetii RSA 493
caaguuuuaagaaaaa

SEQ ID NO: 572452 - RNA, 20 nt, Coxiella burnetii RSA 493
caaguuuuaagaaaaaccag

SEQ ID NO: 572453 - RNA, 14 nt, Coxiella burnetii RSA 493
caaguuuauaagau

SEQ ID NO: 572454 - RNA, 17 nt, Coxiella burnetii RSA 493
caaguagccaaaauaau

SEQ ID NO: 572455 - RNA, 22 nt, Coxiella burnetii RSA 493
caagucgagguugucaacaaaa

SEQ ID NO: 572456 - RNA, 23 nt, Coxiella burnetii RSA 493
caagucgagguugucaacaaaau

SEQ ID NO: 572457 - RNA, 22 nt, Coxiella burnetii RSA 493
caagugcuuccaaguaagccau

SEQ ID NO: 572458 - RNA, 16 nt, Coxiella burnetii RSA 493
caagugugggaaaaau

SEQ ID NO: 572459 - RNA, 18 nt, Coxiella burnetii RSA 493
caagugugggaaaaauag

SEQ ID NO: 572460 - RNA, 22 nt, Coxiella burnetii RSA 493
caaucacaaguucuucuaaaga

SEQ ID NO: 572461 - RNA, 22 nt, Coxiella burnetii RSA 493
caaucaauuuaccaauuaaaga

SEQ ID NO: 572462 - RNA, 23 nt, Coxiella burnetii RSA 493
caaucaauuuaccaauuaaagaa

SEQ ID NO: 572463 - RNA, 14 nt, Coxiella burnetii RSA 493
caaucacuacaaau

SEQ ID NO: 572464 - RNA, 13 nt, Coxiella burnetii RSA 493
caaucaaaacagc

SEQ ID NO: 572465 - RNA, 20 nt, Coxiella burnetii RSA 493
caauauacgcaauuguucua

SEQ ID NO: 572466 - RNA, 17 nt, Coxiella burnetii RSA 493
caaucguguagaaagaa

SEQ ID NO: 572467 - RNA, 19 nt, Coxiella burnetii RSA 493
caaucgaccgagaauuaau

SEQ ID NO: 572468 - RNA, 18 nt, Coxiella burnetii RSA 493
caaucgcacccuucuguu

SEQ ID NO: 572469 - RNA, 19 nt, Coxiella burnetii RSA 493
caaucauuuuuguacugcu

SEQ ID NO: 572470 - RNA, 20 nt, Coxiella burnetii RSA 493
caagaauggcgggaaaaaau

SEQ ID NO: 572471 - RNA, 18 nt, Coxiella burnetii RSA 493
caagaccccuaucaauca

SEQ ID NO: 572472 - RNA, 14 nt, Coxiella burnetii RSA 493
caagccgaauaaau

SEQ ID NO: 572473 - RNA, 15 nt, Coxiella burnetii RSA 493
caagcgauuaaauau

SEQ ID NO: 572474 - RNA, 13 nt, Coxiella burnetii RSA 493
caagcguuguaaa

SEQ ID NO: 572475 - RNA, 16 nt, Coxiella burnetii RSA 493
caagcguuguaaauuu

SEQ ID NO: 572476 - RNA, 19 nt, Coxiella burnetii RSA 493
caacugcgccgcaaaguaa

SEQ ID NO: 572477 - RNA, 13 nt, Coxiella burnetii RSA 493
caacggucauuug

SEQ ID NO: 572478 - RNA, 14 nt, Coxiella burnetii RSA 493
caacgucaaaaccc

SEQ ID NO: 572479 - RNA, 19 nt, Coxiella burnetii RSA 493
caaccguuguauaaacucg

SEQ ID NO: 572480 - RNA, 15 nt, Coxiella burnetii RSA 493
caacgcgacaagaau

SEQ ID NO: 572481 - RNA, 16 nt, Coxiella burnetii RSA 493
caacgcuguuaaaauc

SEQ ID NO: 572482 - RNA, 15 nt, Coxiella burnetii RSA 493
caacggaaaaacaaa

SEQ ID NO: 572483 - RNA, 17 nt, Coxiella burnetii RSA 493
caacgcuuguuuuauac

SEQ ID NO: 572484 - RNA, 13 nt, Coxiella burnetii RSA 493
caacggcgcguga

SEQ ID NO: 572485 - RNA, 17 nt, Coxiella burnetii RSA 493
caaauguugauaauaaa

SEQ ID NO: 572486 - RNA, 14 nt, Coxiella burnetii RSA 493
caaauuaaaauaau

SEQ ID NO: 572487 - RNA, 15 nt, Coxiella burnetii RSA 493
caaauuaaaauaauc

SEQ ID NO: 572488 - RNA, 19 nt, Coxiella burnetii RSA 493
caaaugaugaauuuauuuc

SEQ ID NO: 572489 - RNA, 21 nt, Coxiella burnetii RSA 493
caaaugaucggcgcauuuuua

SEQ ID NO: 572490 - RNA, 16 nt, Coxiella burnetii RSA 493
caaaugaauaacauca

SEQ ID NO: 572491 - RNA, 16 nt, Coxiella burnetii RSA 493
caaaucacgcuuuuuu

SEQ ID NO: 572492 - RNA, 17 nt, Coxiella burnetii RSA 493
caaaucggaaaagccaa

SEQ ID NO: 572493 - RNA, 20 nt, Coxiella burnetii RSA 493
caaagucgcguaaagauaaa

SEQ ID NO: 572494 - RNA, 18 nt, Coxiella burnetii RSA 493
caaaguagggcaggaucu

SEQ ID NO: 572495 - RNA, 18 nt, Coxiella burnetii RSA 493
caacccaaggaaccacca

SEQ ID NO: 572496 - RNA, 12 nt, Coxiella burnetii RSA 493
caacauucuuug

SEQ ID NO: 572497 - RNA, 17 nt, Coxiella burnetii RSA 493
caacaaaauauacucac

SEQ ID NO: 572498 - RNA, 12 nt, Coxiella burnetii RSA 493
caacaacaaagu

SEQ ID NO: 572499 - RNA, 21 nt, Coxiella burnetii RSA 493
caacaguauaaaauuuuauuc

SEQ ID NO: 572500 - RNA, 16 nt, Coxiella burnetii RSA 493
caaaccgcgcugaagu

SEQ ID NO: 572501 - RNA, 16 nt, Coxiella burnetii RSA 493
caaaccggccgcaccu

SEQ ID NO: 572502 - RNA, 15 nt, Coxiella burnetii RSA 493
caaacuucauuaaau

SEQ ID NO: 572503 - RNA, 18 nt, Coxiella burnetii RSA 493
caaacuucauuaaauccg

SEQ ID NO: 572504 - RNA, 14 nt, Coxiella burnetii RSA 493
caaacguucaucgu

SEQ ID NO: 572505 - RNA, 18 nt, Coxiella burnetii RSA 493
caaacuguuugcauuuaa

SEQ ID NO: 572506 - RNA, 20 nt, Coxiella burnetii RSA 493
caaacgaauggcccaauaaa

SEQ ID NO: 572507 - RNA, 20 nt, Coxiella burnetii RSA 493
caaagaucuccccuucuuua

SEQ ID NO: 572508 - RNA, 13 nt, Coxiella burnetii RSA 493
caaagaccaaucg

SEQ ID NO: 572509 - RNA, 24 nt, Coxiella burnetii RSA 493
caaagacaucggauaaugcuugcu

SEQ ID NO: 572510 - RNA, 16 nt, Coxiella burnetii RSA 493
caaagcgcugcucgaa

SEQ ID NO: 572511 - RNA, 14 nt, Coxiella burnetii RSA 493
caaaggcauauuca

SEQ ID NO: 572512 - RNA, 21 nt, Coxiella burnetii RSA 493
caaaggccuuggguaagugaa

SEQ ID NO: 572513 - RNA, 22 nt, Coxiella burnetii RSA 493
caaagccucuucgcgcaagcac

SEQ ID NO: 572514 - RNA, 22 nt, Coxiella burnetii RSA 493
caaaaggaaugaauagaaaaac

SEQ ID NO: 572515 - RNA, 13 nt, Coxiella burnetii RSA 493
caaaagguaaaaa

SEQ ID NO: 572516 - RNA, 15 nt, Coxiella burnetii RSA 493
caaaagguaaaaaac

SEQ ID NO: 572517 - RNA, 16 nt, Coxiella burnetii RSA 493
caaaaguaauauuucg

SEQ ID NO: 572518 - RNA, 19 nt, Coxiella burnetii RSA 493
caaaagugauuuuucuuug

SEQ ID NO: 572519 - RNA, 19 nt, Coxiella burnetii RSA 493
caaaauacaguaaauaauc

SEQ ID NO: 572520 - RNA, 14 nt, Coxiella burnetii RSA 493
caaaauucuccuua

SEQ ID NO: 572521 - RNA, 23 nt, Coxiella burnetii RSA 493
caaaaacgugccgccgaaauuua

SEQ ID NO: 572522 - RNA, 15 nt, Coxiella burnetii RSA 493
caaaaacuaaauuuc

SEQ ID NO: 572523 - RNA, 19 nt, Coxiella burnetii RSA 493
caaaaacuucaugcaaaaa

SEQ ID NO: 572524 - RNA, 11 nt, Coxiella burnetii RSA 493
caaaaagauaa

SEQ ID NO: 572525 - RNA, 22 nt, Coxiella burnetii RSA 493
caaaacgggcauuggaaaaaac

SEQ ID NO: 572526 - RNA, 23 nt, Coxiella burnetii RSA 493
caaaacgggcauuggaaaaaacu

SEQ ID NO: 572527 - RNA, 17 nt, Coxiella burnetii RSA 493
caaaagaggguauuuug

SEQ ID NO: 572528 - RNA, 19 nt, Coxiella burnetii RSA 493
aucauacauaugaauauua

SEQ ID NO: 572529 - RNA, 18 nt, Coxiella burnetii RSA 493
aaaacgucgccugcuaaa

SEQ ID NO: 572530 - RNA, 24 nt, Coxiella burnetii RSA 493
aucauaaucgguuauuucucgaac

SEQ ID NO: 572531 - RNA, 13 nt, Coxiella burnetii RSA 493
aaaacucccauca

SEQ ID NO: 572532 - RNA, 15 nt, Coxiella burnetii RSA 493
aaaacucccaucaaa

SEQ ID NO: 572533 - RNA, 21 nt, Coxiella burnetii RSA 493
aucauguggucucuuuuuuug

SEQ ID NO: 572534 - RNA, 20 nt, Coxiella burnetii RSA 493
aaaacuggagcccauaaagc

SEQ ID NO: 572535 - RNA, 22 nt, Coxiella burnetii RSA 493
aaaacuggcuuggacaaaucau

SEQ ID NO: 572536 - RNA, 19 nt, Coxiella burnetii RSA 493
aucauuccuccguucauuc

SEQ ID NO: 572537 - RNA, 22 nt, Coxiella burnetii RSA 493
auccaaaccggcccguugcaag

SEQ ID NO: 572538 - RNA, 23 nt, Coxiella burnetii RSA 493
aucauugguuuuugauugccaaa

SEQ ID NO: 572539 - RNA, 20 nt, Coxiella burnetii RSA 493
aucauugggccauuuaacaa

SEQ ID NO: 572540 - RNA, 12 nt, Coxiella burnetii RSA 493
auccaaauagau

SEQ ID NO: 572541 - RNA, 16 nt, Coxiella burnetii RSA 493
auccaucccaauucuc

SEQ ID NO: 572542 - RNA, 21 nt, Coxiella burnetii RSA 493
auccaugaaaggaauccuuuu

SEQ ID NO: 572543 - RNA, 22 nt, Coxiella burnetii RSA 493
auccccaaaggugucaaaauua

SEQ ID NO: 572544 - RNA, 14 nt, Coxiella burnetii RSA 493
aucccacguuguuu

SEQ ID NO: 572545 - RNA, 22 nt, Coxiella burnetii RSA 493
auccgguuuugauuuuugcucu

SEQ ID NO: 572546 - RNA, 21 nt, Coxiella burnetii RSA 493
auccuacuuucguaaagaccu

SEQ ID NO: 572547 - RNA, 19 nt, Coxiella burnetii RSA 493
auccucacaaauuauauca

SEQ ID NO: 572548 - RNA, 14 nt, Coxiella burnetii RSA 493
auccuauucuuuua

SEQ ID NO: 572549 - RNA, 23 nt, Coxiella burnetii RSA 493
auccucuuuagauucaugaaaau

SEQ ID NO: 572550 - RNA, 12 nt, Coxiella burnetii RSA 493
auccucaucaaa

SEQ ID NO: 572551 - RNA, 15 nt, Coxiella burnetii RSA 493
auccucgcguuuuau

SEQ ID NO: 572552 - RNA, 19 nt, Coxiella burnetii RSA 493
auccuuucuaacgucgcaa

SEQ ID NO: 572553 - RNA, 16 nt, Coxiella burnetii RSA 493
auccuuaaugaguuca

SEQ ID NO: 572554 - RNA, 17 nt, Coxiella burnetii RSA 493
auccuuacaaaaauacu

SEQ ID NO: 572555 - RNA, 21 nt, Coxiella burnetii RSA 493
auccuuuuuguaauccuuguu

SEQ ID NO: 572556 - RNA, 22 nt, Coxiella burnetii RSA 493
aucgcaauuaauacauucuuca

SEQ ID NO: 572557 - RNA, 21 nt, Coxiella burnetii RSA 493
aucgcugauacuucuucauua

SEQ ID NO: 572558 - RNA, 19 nt, Coxiella burnetii RSA 493
aucgccguuucugcuuuua

SEQ ID NO: 572559 - RNA, 20 nt, Coxiella burnetii RSA 493
aucgccguuucugcuuuuau

SEQ ID NO: 572560 - RNA, 17 nt, Coxiella burnetii RSA 493
aucgucccaucaucuga

SEQ ID NO: 572561 - RNA, 21 nt, Coxiella burnetii RSA 493
aucgucuaaaacuuuguagac

SEQ ID NO: 572562 - RNA, 23 nt, Coxiella burnetii RSA 493
aucgucuaaaagcgcaauuucca

SEQ ID NO: 572563 - RNA, 16 nt, Coxiella burnetii RSA 493
aucggauuaacgugcu

SEQ ID NO: 572564 - RNA, 13 nt, Coxiella burnetii RSA 493
aucgcugugaaaa

SEQ ID NO: 572565 - RNA, 15 nt, Coxiella burnetii RSA 493
aucgcugugaaaaug

SEQ ID NO: 572566 - RNA, 23 nt, Coxiella burnetii RSA 493
aucguggguuuuuuaauuuuugc

SEQ ID NO: 572567 - RNA, 18 nt, Coxiella burnetii RSA 493
aucuaaaggaauacaauc

SEQ ID NO: 572568 - RNA, 20 nt, Coxiella burnetii RSA 493
aucguuucaaacacuuguuu

SEQ ID NO: 572569 - RNA, 19 nt, Coxiella burnetii RSA 493
aucguuucugguuuccuuu

SEQ ID NO: 572570 - RNA, 16 nt, Coxiella burnetii RSA 493
aucguugcugagcaaa

SEQ ID NO: 572571 - RNA, 18 nt, Coxiella burnetii RSA 493
aucguugccuuuuugaau

SEQ ID NO: 572572 - RNA, 19 nt, Coxiella burnetii RSA 493
aucguucggcuucauauaa

SEQ ID NO: 572573 - RNA, 21 nt, Coxiella burnetii RSA 493
aucuacuucagcguggauagc

SEQ ID NO: 572574 - RNA, 14 nt, Coxiella burnetii RSA 493
aucucguugagguu

SEQ ID NO: 572575 - RNA, 24 nt, Coxiella burnetii RSA 493
aucucguugagguucgcaaacgcu

SEQ ID NO: 572576 - RNA, 18 nt, Coxiella burnetii RSA 493
aucuccccuucuuuaaua

SEQ ID NO: 572577 - RNA, 15 nt, Coxiella burnetii RSA 493
aucugaucaaaaaua

SEQ ID NO: 572578 - RNA, 16 nt, Coxiella burnetii RSA 493
aucugaucaaaaauaa

SEQ ID NO: 572579 - RNA, 23 nt, Coxiella burnetii RSA 493
aucuugaucuugggcaaaaaaag

SEQ ID NO: 572580 - RNA, 21 nt, Coxiella burnetii RSA 493
aucuucugaucgauaaaaaua

SEQ ID NO: 572581 - RNA, 23 nt, Coxiella burnetii RSA 493
aucuucugaucgauaaaaauaau

SEQ ID NO: 572582 - RNA, 23 nt, Coxiella burnetii RSA 493
aucuuguaaucgcugauacuucu

SEQ ID NO: 572583 - RNA, 22 nt, Coxiella burnetii RSA 493
aucuugguccguggcaguuaaa

SEQ ID NO: 572584 - RNA, 20 nt, Coxiella burnetii RSA 493
aucuugggcaaaaaaagaaa

SEQ ID NO: 572585 - RNA, 14 nt, Coxiella burnetii RSA 493
augaauagaaaaac

SEQ ID NO: 572586 - RNA, 13 nt, Coxiella burnetii RSA 493
augaaugcuggag

SEQ ID NO: 572587 - RNA, 15 nt, Coxiella burnetii RSA 493
augaauaagcaaaga

SEQ ID NO: 572588 - RNA, 12 nt, Coxiella burnetii RSA 493
augacaaauaaa

SEQ ID NO: 572589 - RNA, 16 nt, Coxiella burnetii RSA 493
augacaaauaaacaag

SEQ ID NO: 572590 - RNA, 21 nt, Coxiella burnetii RSA 493
augacaaccccgccuuuaccu

SEQ ID NO: 572591 - RNA, 17 nt, Coxiella burnetii RSA 493
augaauggaauguuaaa

SEQ ID NO: 572592 - RNA, 17 nt, Coxiella burnetii RSA 493
augaaaggaauccuuuu

SEQ ID NO: 572593 - RNA, 13 nt, Coxiella burnetii RSA 493
augaaaaaaacag

SEQ ID NO: 572594 - RNA, 22 nt, Coxiella burnetii RSA 493
aucuuuuuuuugaaauucuugu

SEQ ID NO: 572595 - RNA, 16 nt, Coxiella burnetii RSA 493
augacaauuuaauaau

SEQ ID NO: 572596 - RNA, 22 nt, Coxiella burnetii RSA 493
augacguaaugucucaaggcuc

SEQ ID NO: 572597 - RNA, 16 nt, Coxiella burnetii RSA 493
augacgaaagcuaaaa

SEQ ID NO: 572598 - RNA, 19 nt, Coxiella burnetii RSA 493
augacgauuuuaauuuuuu

SEQ ID NO: 572599 - RNA, 13 nt, Coxiella burnetii RSA 493
augagacuuuaau

SEQ ID NO: 572600 - RNA, 21 nt, Coxiella burnetii RSA 493
auauuaaaacaagacaacaaa

SEQ ID NO: 572601 - RNA, 23 nt, Coxiella burnetii RSA 493
auauuaauuuugguauaaaugau

SEQ ID NO: 572602 - RNA, 13 nt, Coxiella burnetii RSA 493
auauuagaaauaa

SEQ ID NO: 572603 - RNA, 21 nt, Coxiella burnetii RSA 493
auauucgcgcaaguuuugaau

SEQ ID NO: 572604 - RNA, 22 nt, Coxiella burnetii RSA 493
auauucgcuccauuguuucgaa

SEQ ID NO: 572605 - RNA, 22 nt, Coxiella burnetii RSA 493
auauucgguuuuuuuaaaaaag

SEQ ID NO: 572606 - RNA, 15 nt, Coxiella burnetii RSA 493
aucaacggaaaaaca

SEQ ID NO: 572607 - RNA, 11 nt, Coxiella burnetii RSA 493
aucaaccaaua

SEQ ID NO: 572608 - RNA, 16 nt, Coxiella burnetii RSA 493
aucaaccaauccuacu

SEQ ID NO: 572609 - RNA, 17 nt, Coxiella burnetii RSA 493
aucaaccaauccuacuu

SEQ ID NO: 572610 - RNA, 14 nt, Coxiella burnetii RSA 493
aucaaaugaacuuu

SEQ ID NO: 572611 - RNA, 22 nt, Coxiella burnetii RSA 493
aucaaaugcuaauuccuuuggu

SEQ ID NO: 572612 - RNA, 13 nt, Coxiella burnetii RSA 493
aucaaauuaaaau

SEQ ID NO: 572613 - RNA, 19 nt, Coxiella burnetii RSA 493
aucaaauuaaaauaaucca

SEQ ID NO: 572614 - RNA, 20 nt, Coxiella burnetii RSA 493
aucaaauuaaaauaauccaa

SEQ ID NO: 572615 - RNA, 15 nt, Coxiella burnetii RSA 493
aucaaagacaucgga

SEQ ID NO: 572616 - RNA, 23 nt, Coxiella burnetii RSA 493
auauucugagcgccuuuuuuaaa

SEQ ID NO: 572617 - RNA, 23 nt, Coxiella burnetii RSA 493
auauuuaauuuuauuauuuauca

SEQ ID NO: 572618 - RNA, 18 nt, Coxiella burnetii RSA 493
auauuuaccucuaaaaau

SEQ ID NO: 572619 - RNA, 16 nt, Coxiella burnetii RSA 493
auauuuacugagaaaa

SEQ ID NO: 572620 - RNA, 22 nt, Coxiella burnetii RSA 493
auauuuagggucaauugcaaaa

SEQ ID NO: 572621 - RNA, 17 nt, Coxiella burnetii RSA 493
auauuucgucagugaau

SEQ ID NO: 572622 - RNA, 19 nt, Coxiella burnetii RSA 493
auauuucgucagugaauga

SEQ ID NO: 572623 - RNA, 15 nt, Coxiella burnetii RSA 493
auauuucguuccaug

SEQ ID NO: 572624 - RNA, 15 nt, Coxiella burnetii RSA 493
auauuuuucucuuuc

SEQ ID NO: 572625 - RNA, 17 nt, Coxiella burnetii RSA 493
aucagccugaucaaguu

SEQ ID NO: 572626 - RNA, 21 nt, Coxiella burnetii RSA 493
aaaacgggcauuggaaaaaac

SEQ ID NO: 572627 - RNA, 17 nt, Coxiella burnetii RSA 493
aaaacguagaaguuuaa

SEQ ID NO: 572628 - RNA, 14 nt, Coxiella burnetii RSA 493
aucacuaagucacu

SEQ ID NO: 572629 - RNA, 19 nt, Coxiella burnetii RSA 493
aucaccuuugcuaacaauu

SEQ ID NO: 572630 - RNA, 22 nt, Coxiella burnetii RSA 493
aucaccuuugcuaacaauuguu

SEQ ID NO: 572631 - RNA, 15 nt, Coxiella burnetii RSA 493
aucacagcaucuaac

SEQ ID NO: 572632 - RNA, 22 nt, Coxiella burnetii RSA 493
aucacaccaagaaauugaucuu

SEQ ID NO: 572633 - RNA, 14 nt, Coxiella burnetii RSA 493
aucaccaaaauaca

SEQ ID NO: 572634 - RNA, 17 nt, Coxiella burnetii RSA 493
aucacaucccuuuucau

SEQ ID NO: 572635 - RNA, 19 nt, Coxiella burnetii RSA 493
aucaauucgaaagaaauaa

SEQ ID NO: 572636 - RNA, 22 nt, Coxiella burnetii RSA 493
aucaauucgaaagaaauaacug

SEQ ID NO: 572637 - RNA, 16 nt, Coxiella burnetii RSA 493
auaauucguuagcauu

SEQ ID NO: 572638 - RNA, 21 nt, Coxiella burnetii RSA 493
auaauucggguaacaaaguua

SEQ ID NO: 572639 - RNA, 13 nt, Coxiella burnetii RSA 493
auacauacauaaa

SEQ ID NO: 572640 - RNA, 15 nt, Coxiella burnetii RSA 493
auacauaugaauauu

SEQ ID NO: 572641 - RNA, 15 nt, Coxiella burnetii RSA 493
auacaucgucggcag

SEQ ID NO: 572642 - RNA, 19 nt, Coxiella burnetii RSA 493
auacauucuucaguaauuu

SEQ ID NO: 572643 - RNA, 22 nt, Coxiella burnetii RSA 493
auacauucuucaguaauuuuua

SEQ ID NO: 572644 - RNA, 17 nt, Coxiella burnetii RSA 493
auaccaauucaaauaau

SEQ ID NO: 572645 - RNA, 22 nt, Coxiella burnetii RSA 493
auaccaauucaaauaauacugc

SEQ ID NO: 572646 - RNA, 13 nt, Coxiella burnetii RSA 493
auaccaucaggau

SEQ ID NO: 572647 - RNA, 14 nt, Coxiella burnetii RSA 493
auagaaugggaaga

SEQ ID NO: 572648 - RNA, 23 nt, Coxiella burnetii RSA 493
auagaccaaauccgcauaaaaac

SEQ ID NO: 572649 - RNA, 22 nt, Coxiella burnetii RSA 493
auagacaauuuuuuuuguugaa

SEQ ID NO: 572650 - RNA, 20 nt, Coxiella burnetii RSA 493
auagaccaucguuuuauaca

SEQ ID NO: 572651 - RNA, 13 nt, Coxiella burnetii RSA 493
auagaagaacaau

SEQ ID NO: 572652 - RNA, 11 nt, Coxiella burnetii RSA 493
auacuguucuu

SEQ ID NO: 572653 - RNA, 21 nt, Coxiella burnetii RSA 493
auaccguuuaaaccaaaacca

SEQ ID NO: 572654 - RNA, 17 nt, Coxiella burnetii RSA 493
auacgcuuuuacccagg

SEQ ID NO: 572655 - RNA, 18 nt, Coxiella burnetii RSA 493
auacgggaaaacaaugau

SEQ ID NO: 572656 - RNA, 16 nt, Coxiella burnetii RSA 493
auacgggcuacucuaa

SEQ ID NO: 572657 - RNA, 21 nt, Coxiella burnetii RSA 493
auacgggcuacucuuuuucuu

SEQ ID NO: 572658 - RNA, 15 nt, Coxiella burnetii RSA 493
auacgggcuacuucc

SEQ ID NO: 572659 - RNA, 15 nt, Coxiella burnetii RSA 493
auacggggacaauag

SEQ ID NO: 572660 - RNA, 23 nt, Coxiella burnetii RSA 493
auacggggacgauagauggcauc

SEQ ID NO: 572661 - RNA, 16 nt, Coxiella burnetii RSA 493
auacuaacugcaacug

SEQ ID NO: 572662 - RNA, 19 nt, Coxiella burnetii RSA 493
auacugacaaugcguuuua

SEQ ID NO: 572663 - RNA, 16 nt, Coxiella burnetii RSA 493
auacuaaacaaaauaa

SEQ ID NO: 572664 - RNA, 12 nt, Coxiella burnetii RSA 493
auauaauuuuug

SEQ ID NO: 572665 - RNA, 21 nt, Coxiella burnetii RSA 493
auauaauuuuugaguucuuua

SEQ ID NO: 572666 - RNA, 17 nt, Coxiella burnetii RSA 493
auauaaauaaucuuccc

SEQ ID NO: 572667 - RNA, 22 nt, Coxiella burnetii RSA 493
auauccggcaucacgauuuaaa

SEQ ID NO: 572668 - RNA, 20 nt, Coxiella burnetii RSA 493
auaucauugggccauuuaac

SEQ ID NO: 572669 - RNA, 18 nt, Coxiella burnetii RSA 493
auaucaccgcguuuaaga

SEQ ID NO: 572670 - RNA, 13 nt, Coxiella burnetii RSA 493
auaggcagccccg

SEQ ID NO: 572671 - RNA, 17 nt, Coxiella burnetii RSA 493
auaggaauucuuuuuca

SEQ ID NO: 572672 - RNA, 15 nt, Coxiella burnetii RSA 493
auaggaaaaaugauu

SEQ ID NO: 572673 - RNA, 22 nt, Coxiella burnetii RSA 493
auagcuggacucgaugggaauu

SEQ ID NO: 572674 - RNA, 15 nt, Coxiella burnetii RSA 493
auagcgcaauugguc

SEQ ID NO: 572675 - RNA, 19 nt, Coxiella burnetii RSA 493
auaguaaaacgugcuuaau

SEQ ID NO: 572676 - RNA, 21 nt, Coxiella burnetii RSA 493
auaguaaaacgugcuuaauaa

SEQ ID NO: 572677 - RNA, 13 nt, Coxiella burnetii RSA 493
agucagacuugcu

SEQ ID NO: 572678 - RNA, 24 nt, Coxiella burnetii RSA 493
agucagacuugcuuuuuucugcga

SEQ ID NO: 572679 - RNA, 13 nt, Coxiella burnetii RSA 493
agucauagcuaag

SEQ ID NO: 572680 - RNA, 19 nt, Coxiella burnetii RSA 493
agucgcaauuugaugccau

SEQ ID NO: 572681 - RNA, 15 nt, Coxiella burnetii RSA 493
aguccuguucuuuuc

SEQ ID NO: 572682 - RNA, 23 nt, Coxiella burnetii RSA 493
agucccucugaaaaauauucuaa

SEQ ID NO: 572683 - RNA, 19 nt, Coxiella burnetii RSA 493
aguccccaaaguuucacga

SEQ ID NO: 572684 - RNA, 18 nt, Coxiella burnetii RSA 493
agucgcccguaugcagcg

SEQ ID NO: 572685 - RNA, 16 nt, Coxiella burnetii RSA 493
agucuauugaaaaaaa

SEQ ID NO: 572686 - RNA, 14 nt, Coxiella burnetii RSA 493
agucguuuuuuaau

SEQ ID NO: 572687 - RNA, 19 nt, Coxiella burnetii RSA 493
agucucagacucucuuauu

SEQ ID NO: 572688 - RNA, 16 nt, Coxiella burnetii RSA 493
agucucagcaucagcc

SEQ ID NO: 572689 - RNA, 22 nt, Coxiella burnetii RSA 493
agucuggccugccacaaucacu

SEQ ID NO: 572690 - RNA, 18 nt, Coxiella burnetii RSA 493
agucugguuaaacccauu

SEQ ID NO: 572691 - RNA, 19 nt, Coxiella burnetii RSA 493
agucugguuaaacccauuu

SEQ ID NO: 572692 - RNA, 20 nt, Coxiella burnetii RSA 493
agucuucaaaagugauuuuu

SEQ ID NO: 572693 - RNA, 16 nt, Coxiella burnetii RSA 493
agugaccgagauuuuu

SEQ ID NO: 572694 - RNA, 20 nt, Coxiella burnetii RSA 493
agugaccgagauuuuuccga

SEQ ID NO: 572695 - RNA, 17 nt, Coxiella burnetii RSA 493
agugacucaucuccuuu

SEQ ID NO: 572696 - RNA, 22 nt, Coxiella burnetii RSA 493
agugacucaucuccuuuugcua

SEQ ID NO: 572697 - RNA, 18 nt, Coxiella burnetii RSA 493
agugaaaguuucauaagu

SEQ ID NO: 572698 - RNA, 21 nt, Coxiella burnetii RSA 493
aguggcuccgauaagugaauc

SEQ ID NO: 572699 - RNA, 22 nt, Coxiella burnetii RSA 493
aguggcggcuagguaacuuaaa

SEQ ID NO: 572700 - RNA, 14 nt, Coxiella burnetii RSA 493
aguguaaggcugaa

SEQ ID NO: 572701 - RNA, 13 nt, Coxiella burnetii RSA 493
agugggggaacag

SEQ ID NO: 572702 - RNA, 20 nt, Coxiella burnetii RSA 493
agugggggaacagaggacag

SEQ ID NO: 572703 - RNA, 13 nt, Coxiella burnetii RSA 493
aguuaaauuuuua

SEQ ID NO: 572704 - RNA, 20 nt, Coxiella burnetii RSA 493
aguuaacaaaaucaccagaa

SEQ ID NO: 572705 - RNA, 21 nt, Coxiella burnetii RSA 493
aguuaacaaaaucaccagaaa

SEQ ID NO: 572706 - RNA, 16 nt, Coxiella burnetii RSA 493
aguuaaccaauugauu

SEQ ID NO: 572707 - RNA, 22 nt, Coxiella burnetii RSA 493
aguguuuuggcaucgagaaguc

SEQ ID NO: 572708 - RNA, 13 nt, Coxiella burnetii RSA 493
aguuaaaauaaug

SEQ ID NO: 572709 - RNA, 15 nt, Coxiella burnetii RSA 493
aguguagguuuucaa

SEQ ID NO: 572710 - RNA, 14 nt, Coxiella burnetii RSA 493
agugugauucauua

SEQ ID NO: 572711 - RNA, 17 nt, Coxiella burnetii RSA 493
agugugcacgauuuuau

SEQ ID NO: 572712 - RNA, 23 nt, Coxiella burnetii RSA 493
aguugagcgaagaaaaagaaauu

SEQ ID NO: 572713 - RNA, 19 nt, Coxiella burnetii RSA 493
aguuccguucggaaacaaa

SEQ ID NO: 572714 - RNA, 18 nt, Coxiella burnetii RSA 493
aguuccauuccaaaaaca

SEQ ID NO: 572715 - RNA, 19 nt, Coxiella burnetii RSA 493
aguuccauuccaaaaacag

SEQ ID NO: 572716 - RNA, 12 nt, Coxiella burnetii RSA 493
aguuauuuuuca

SEQ ID NO: 572717 - RNA, 18 nt, Coxiella burnetii RSA 493
aguuauuuuucaucuugu

SEQ ID NO: 572718 - RNA, 14 nt, Coxiella burnetii RSA 493
aguuauuucuuuug

SEQ ID NO: 572719 - RNA, 22 nt, Coxiella burnetii RSA 493
auaaaggagauccacuuucucg

SEQ ID NO: 572720 - RNA, 21 nt, Coxiella burnetii RSA 493
auaaauggacccuguuuuuuu

SEQ ID NO: 572721 - RNA, 21 nt, Coxiella burnetii RSA 493
auaaaugcaauuuuuuagaaa

SEQ ID NO: 572722 - RNA, 16 nt, Coxiella burnetii RSA 493
auaaauguuuuuuaau

SEQ ID NO: 572723 - RNA, 16 nt, Coxiella burnetii RSA 493
auaaauuauuuuaaua

SEQ ID NO: 572724 - RNA, 17 nt, Coxiella burnetii RSA 493
auaaaggcuaauaggaa

SEQ ID NO: 572725 - RNA, 23 nt, Coxiella burnetii RSA 493
auaaaggcuaauaggaaaaauga

SEQ ID NO: 572726 - RNA, 22 nt, Coxiella burnetii RSA 493
auaaaggcgagcccauugagaa

SEQ ID NO: 572727 - RNA, 19 nt, Coxiella burnetii RSA 493
auaaagggccguuccuaua

SEQ ID NO: 572728 - RNA, 14 nt, Coxiella burnetii RSA 493
auaaaguguuuuuu

SEQ ID NO: 572729 - RNA, 14 nt, Coxiella burnetii RSA 493
auaaauaaaagccc

SEQ ID NO: 572730 - RNA, 14 nt, Coxiella burnetii RSA 493
auaaaugaauaaua

SEQ ID NO: 572731 - RNA, 22 nt, Coxiella burnetii RSA 493
aguuuugauuugaguaagaaau

SEQ ID NO: 572732 - RNA, 19 nt, Coxiella burnetii RSA 493
aguuuuucccucuacaaaa

SEQ ID NO: 572733 - RNA, 20 nt, Coxiella burnetii RSA 493
aguuuuucccucuacaaaau

SEQ ID NO: 572734 - RNA, 13 nt, Coxiella burnetii RSA 493
auaaaaaauuacu

SEQ ID NO: 572735 - RNA, 19 nt, Coxiella burnetii RSA 493
auaaaaacaaagugaaaua

SEQ ID NO: 572736 - RNA, 21 nt, Coxiella burnetii RSA 493
auaaaaacaaagugaaauaug

SEQ ID NO: 572737 - RNA, 13 nt, Coxiella burnetii RSA 493
auaaaaacccauu

SEQ ID NO: 572738 - RNA, 15 nt, Coxiella burnetii RSA 493
auaaaaggagaaauu

SEQ ID NO: 572739 - RNA, 19 nt, Coxiella burnetii RSA 493
auaaaaggagaaauugaca

SEQ ID NO: 572740 - RNA, 16 nt, Coxiella burnetii RSA 493
auaaaaccuucaaaaa

SEQ ID NO: 572741 - RNA, 19 nt, Coxiella burnetii RSA 493
auaaaacuucccauucuau

SEQ ID NO: 572742 - RNA, 18 nt, Coxiella burnetii RSA 493
auaauccgccuaaauuaa

SEQ ID NO: 572743 - RNA, 20 nt, Coxiella burnetii RSA 493
auaaugucuccaaccgauac

SEQ ID NO: 572744 - RNA, 13 nt, Coxiella burnetii RSA 493
auaaugucugcau

SEQ ID NO: 572745 - RNA, 19 nt, Coxiella burnetii RSA 493
auaaugugacucauuacua

SEQ ID NO: 572746 - RNA, 14 nt, Coxiella burnetii RSA 493
auaauuacaaucca

SEQ ID NO: 572747 - RNA, 22 nt, Coxiella burnetii RSA 493
auaaguccaagacugauaacua

SEQ ID NO: 572748 - RNA, 15 nt, Coxiella burnetii RSA 493
auaauacggcuuuau

SEQ ID NO: 572749 - RNA, 18 nt, Coxiella burnetii RSA 493
auaauacugcaaacccac

SEQ ID NO: 572750 - RNA, 20 nt, Coxiella burnetii RSA 493
auaauagcguauagaguagg

SEQ ID NO: 572751 - RNA, 11 nt, Coxiella burnetii RSA 493
auaaguaucca

SEQ ID NO: 572752 - RNA, 12 nt, Coxiella burnetii RSA 493
auaaucaugauc

SEQ ID NO: 572753 - RNA, 14 nt, Coxiella burnetii RSA 493
auaaucauuuuucc

SEQ ID NO: 572754 - RNA, 19 nt, Coxiella burnetii RSA 493
auaauaucuagauuuaaaa

SEQ ID NO: 572755 - RNA, 20 nt, Coxiella burnetii RSA 493
auaauaucuagauuuaaaac

SEQ ID NO: 572756 - RNA, 17 nt, Coxiella burnetii RSA 493
auaagauucguaauauu

SEQ ID NO: 572757 - RNA, 22 nt, Coxiella burnetii RSA 493
auaagcauaauucaucaaggua

SEQ ID NO: 572758 - RNA, 22 nt, Coxiella burnetii RSA 493
auaagccguucaccccauuuca

SEQ ID NO: 572759 - RNA, 15 nt, Coxiella burnetii RSA 493
auaagccauuaaaag

SEQ ID NO: 572760 - RNA, 15 nt, Coxiella burnetii RSA 493
auaagggauauauug

SEQ ID NO: 572761 - RNA, 22 nt, Coxiella burnetii RSA 493
auaaggagcggcugaauucaaa

SEQ ID NO: 572762 - RNA, 15 nt, Coxiella burnetii RSA 493
auaagcuguuucuuu

SEQ ID NO: 572763 - RNA, 19 nt, Coxiella burnetii RSA 493
auaagcguuugguugguuu

SEQ ID NO: 572764 - RNA, 20 nt, Coxiella burnetii RSA 493
auaaccuuucgcuuguuuau

SEQ ID NO: 572765 - RNA, 16 nt, Coxiella burnetii RSA 493
auaacgaagccuauuu

SEQ ID NO: 572766 - RNA, 17 nt, Coxiella burnetii RSA 493
auaacuuuaguuuuucc

SEQ ID NO: 572767 - RNA, 16 nt, Coxiella burnetii RSA 493
auaacuauuauuaaaa

SEQ ID NO: 572768 - RNA, 20 nt, Coxiella burnetii RSA 493
auaacucagcggcaagccag

SEQ ID NO: 572769 - RNA, 23 nt, Coxiella burnetii RSA 493
auaagaaacguauugccaaaauu

SEQ ID NO: 572770 - RNA, 15 nt, Coxiella burnetii RSA 493
agcugacaauagggc

SEQ ID NO: 572771 - RNA, 13 nt, Coxiella burnetii RSA 493
agcugaaauugaa

SEQ ID NO: 572772 - RNA, 15 nt, Coxiella burnetii RSA 493
agcuguuuuuucuag

SEQ ID NO: 572773 - RNA, 13 nt, Coxiella burnetii RSA 493
agcugauuucucu

SEQ ID NO: 572774 - RNA, 14 nt, Coxiella burnetii RSA 493
agcugauuucuggu

SEQ ID NO: 572775 - RNA, 20 nt, Coxiella burnetii RSA 493
agcuuaaucaaccucagguu

SEQ ID NO: 572776 - RNA, 13 nt, Coxiella burnetii RSA 493
agcuuuucuuuaa

SEQ ID NO: 572777 - RNA, 22 nt, Coxiella burnetii RSA 493
agcuuuaauccguuuugaaaaa

SEQ ID NO: 572778 - RNA, 23 nt, Coxiella burnetii RSA 493
aggaaacgaaguucucaaauuuu

SEQ ID NO: 572779 - RNA, 18 nt, Coxiella burnetii RSA 493
aggaaugaauagaaaaac

SEQ ID NO: 572780 - RNA, 17 nt, Coxiella burnetii RSA 493
aggaccagcucggggac

SEQ ID NO: 572781 - RNA, 18 nt, Coxiella burnetii RSA 493
aggaguuggucaaagaga

SEQ ID NO: 572782 - RNA, 19 nt, Coxiella burnetii RSA 493
aggaguuggucaaagagau

SEQ ID NO: 572783 - RNA, 17 nt, Coxiella burnetii RSA 493
aggaguucuaaaaaauu

SEQ ID NO: 572784 - RNA, 13 nt, Coxiella burnetii RSA 493
aggauaauguuug

SEQ ID NO: 572785 - RNA, 15 nt, Coxiella burnetii RSA 493
aggacguuauagagu

SEQ ID NO: 572786 - RNA, 20 nt, Coxiella burnetii RSA 493
aggacguuauagaguaaaua

SEQ ID NO: 572787 - RNA, 14 nt, Coxiella burnetii RSA 493
aggaucaagcgcca

SEQ ID NO: 572788 - RNA, 19 nt, Coxiella burnetii RSA 493
aggaugaacuaucguugcc

SEQ ID NO: 572789 - RNA, 22 nt, Coxiella burnetii RSA 493
aggaugaacuaucguugccuuu

SEQ ID NO: 572790 - RNA, 14 nt, Coxiella burnetii RSA 493
aggcagaggacaga

SEQ ID NO: 572791 - RNA, 18 nt, Coxiella burnetii RSA 493
aggcagaggacagaggac

SEQ ID NO: 572792 - RNA, 15 nt, Coxiella burnetii RSA 493
aggcaaugauaauuu

SEQ ID NO: 572793 - RNA, 15 nt, Coxiella burnetii RSA 493
aggcucguugcuuua

SEQ ID NO: 572794 - RNA, 14 nt, Coxiella burnetii RSA 493
aggcuaugauuauc

SEQ ID NO: 572795 - RNA, 20 nt, Coxiella burnetii RSA 493
aggcugcuagaaguauuucc

SEQ ID NO: 572796 - RNA, 19 nt, Coxiella burnetii RSA 493
aggcuaauuuuccuuuucu

SEQ ID NO: 572797 - RNA, 22 nt, Coxiella burnetii RSA 493
aggcuaauuuuccuuuucuauu

SEQ ID NO: 572798 - RNA, 14 nt, Coxiella burnetii RSA 493
aggcggggacccag

SEQ ID NO: 572799 - RNA, 19 nt, Coxiella burnetii RSA 493
aggcggggacccagcgcac

SEQ ID NO: 572800 - RNA, 12 nt, Coxiella burnetii RSA 493
aggcuucuucca

SEQ ID NO: 572801 - RNA, 16 nt, Coxiella burnetii RSA 493
aggcuucuuccagcag

SEQ ID NO: 572802 - RNA, 20 nt, Coxiella burnetii RSA 493
aggcuucuuccagcaguuuu

SEQ ID NO: 572803 - RNA, 22 nt, Coxiella burnetii RSA 493
aggggagcgagcauauaaaagu

SEQ ID NO: 572804 - RNA, 23 nt, Coxiella burnetii RSA 493
agggcuuuacaccuaagagaaaa

SEQ ID NO: 572805 - RNA, 20 nt, Coxiella burnetii RSA 493
aggguuuugugcauaaauua

SEQ ID NO: 572806 - RNA, 22 nt, Coxiella burnetii RSA 493
aggguuuugugcauaaauuauu

SEQ ID NO: 572807 - RNA, 22 nt, Coxiella burnetii RSA 493
agguguuuuacguuuaaauaac

SEQ ID NO: 572808 - RNA, 22 nt, Coxiella burnetii RSA 493
agguguucaaccgcaugaauua

SEQ ID NO: 572809 - RNA, 22 nt, Coxiella burnetii RSA 493
agguucagauucaggaaacguu

SEQ ID NO: 572810 - RNA, 19 nt, Coxiella burnetii RSA 493
agguuauuaagcguuccuu

SEQ ID NO: 572811 - RNA, 21 nt, Coxiella burnetii RSA 493
agguuaauaaaaagguaauga

SEQ ID NO: 572812 - RNA, 22 nt, Coxiella burnetii RSA 493
aggugcgucccgcuuaaaccca

SEQ ID NO: 572813 - RNA, 15 nt, Coxiella burnetii RSA 493
agguugaccacagcg

SEQ ID NO: 572814 - RNA, 15 nt, Coxiella burnetii RSA 493
agguuauuuuuuccu

SEQ ID NO: 572815 - RNA, 17 nt, Coxiella burnetii RSA 493
agguuauuuuuugcucu

SEQ ID NO: 572816 - RNA, 17 nt, Coxiella burnetii RSA 493
agguucuggcuuucccu

SEQ ID NO: 572817 - RNA, 18 nt, Coxiella burnetii RSA 493
agguucuggcuuucccuu

SEQ ID NO: 572818 - RNA, 20 nt, Coxiella burnetii RSA 493
agguucucuuuaucagaaaa

SEQ ID NO: 572819 - RNA, 19 nt, Coxiella burnetii RSA 493
aguaagcggcagaaugcuu

SEQ ID NO: 572820 - RNA, 20 nt, Coxiella burnetii RSA 493
aguaacucuaauuuuccuga

SEQ ID NO: 572821 - RNA, 21 nt, Coxiella burnetii RSA 493
aguaaauguuucuuuuauaaa

SEQ ID NO: 572822 - RNA, 16 nt, Coxiella burnetii RSA 493
aguacuagcaucaaua

SEQ ID NO: 572823 - RNA, 22 nt, Coxiella burnetii RSA 493
aguaaugagcaucuuuucugaa

SEQ ID NO: 572824 - RNA, 23 nt, Coxiella burnetii RSA 493
aguaaugagcaucuuuucugaaa

SEQ ID NO: 572825 - RNA, 18 nt, Coxiella burnetii RSA 493
aguacagguuguuugcuu

SEQ ID NO: 572826 - RNA, 19 nt, Coxiella burnetii RSA 493
aguaauucaucauuuucca

SEQ ID NO: 572827 - RNA, 24 nt, Coxiella burnetii RSA 493
aguaauuaccguuuauaucaaccu

SEQ ID NO: 572828 - RNA, 15 nt, Coxiella burnetii RSA 493
aguaaugguuuugau

SEQ ID NO: 572829 - RNA, 22 nt, Coxiella burnetii RSA 493
accaucgccaguuuuuugggau

SEQ ID NO: 572830 - RNA, 11 nt, Coxiella burnetii RSA 493
accaucgccac

SEQ ID NO: 572831 - RNA, 16 nt, Coxiella burnetii RSA 493
accauaggcagccccg

SEQ ID NO: 572832 - RNA, 16 nt, Coxiella burnetii RSA 493
accagucuguuauacu

SEQ ID NO: 572833 - RNA, 18 nt, Coxiella burnetii RSA 493
acccuuucauuuaauuuu

SEQ ID NO: 572834 - RNA, 20 nt, Coxiella burnetii RSA 493
acccuuucauuuaauuuuaa

SEQ ID NO: 572835 - RNA, 12 nt, Coxiella burnetii RSA 493
acccuggguucc

SEQ ID NO: 572836 - RNA, 17 nt, Coxiella burnetii RSA 493
acccugucauauccaua

SEQ ID NO: 572837 - RNA, 14 nt, Coxiella burnetii RSA 493
acccgcauucuuuu

SEQ ID NO: 572838 - RNA, 16 nt, Coxiella burnetii RSA 493
acccacggcaaauaaa

SEQ ID NO: 572839 - RNA, 19 nt, Coxiella burnetii RSA 493
acccacggcgccaucaacc

SEQ ID NO: 572840 - RNA, 17 nt, Coxiella burnetii RSA 493
accaugacggccauggc

SEQ ID NO: 572841 - RNA, 17 nt, Coxiella burnetii RSA 493
acccaguuguuuuaaau

SEQ ID NO: 572842 - RNA, 17 nt, Coxiella burnetii RSA 493
acccaggcguagauuuu

SEQ ID NO: 572843 - RNA, 19 nt, Coxiella burnetii RSA 493
acccaggcguagauuuuaa

SEQ ID NO: 572844 - RNA, 20 nt, Coxiella burnetii RSA 493
acccaggcguagauuuuaaa

SEQ ID NO: 572845 - RNA, 21 nt, Coxiella burnetii RSA 493
acccaggcguagauuuuaaau

SEQ ID NO: 572846 - RNA, 19 nt, Coxiella burnetii RSA 493
acccagggcuauuuuaagc

SEQ ID NO: 572847 - RNA, 15 nt, Coxiella burnetii RSA 493
acccauuuuuuugau

SEQ ID NO: 572848 - RNA, 18 nt, Coxiella burnetii RSA 493
acccauuuuuuugauucu

SEQ ID NO: 572849 - RNA, 16 nt, Coxiella burnetii RSA 493
acccccugucgauacc

SEQ ID NO: 572850 - RNA, 18 nt, Coxiella burnetii RSA 493
acccgaggaugaugaaaa

SEQ ID NO: 572851 - RNA, 15 nt, Coxiella burnetii RSA 493
accguaagccgcccg

SEQ ID NO: 572852 - RNA, 18 nt, Coxiella burnetii RSA 493
accguaaaacgaaucuuu

SEQ ID NO: 572853 - RNA, 21 nt, Coxiella burnetii RSA 493
accggcuucuaaguaaacagc

SEQ ID NO: 572854 - RNA, 14 nt, Coxiella burnetii RSA 493
accggaaauuuuuu

SEQ ID NO: 572855 - RNA, 21 nt, Coxiella burnetii RSA 493
accgcugacgucagaaaacag

SEQ ID NO: 572856 - RNA, 14 nt, Coxiella burnetii RSA 493
accgcuaaagcaaa

SEQ ID NO: 572857 - RNA, 17 nt, Coxiella burnetii RSA 493
accgcucgcuugaaaac

SEQ ID NO: 572858 - RNA, 15 nt, Coxiella burnetii RSA 493
accuaauuugauuuu

SEQ ID NO: 572859 - RNA, 16 nt, Coxiella burnetii RSA 493
accuaauuugauuuuu

SEQ ID NO: 572860 - RNA, 20 nt, Coxiella burnetii RSA 493
accuauugcggaauucagga

SEQ ID NO: 572861 - RNA, 23 nt, Coxiella burnetii RSA 493
accuacacguuaaauagccaacu

SEQ ID NO: 572862 - RNA, 22 nt, Coxiella burnetii RSA 493
accguucgaugguacugaugua

SEQ ID NO: 572863 - RNA, 18 nt, Coxiella burnetii RSA 493
accguuuaauuucugcuu

SEQ ID NO: 572864 - RNA, 11 nt, Coxiella burnetii RSA 493
accugugaggg

SEQ ID NO: 572865 - RNA, 15 nt, Coxiella burnetii RSA 493
accuggcuaguaaau

SEQ ID NO: 572866 - RNA, 15 nt, Coxiella burnetii RSA 493
accuugucacaagug

SEQ ID NO: 572867 - RNA, 21 nt, Coxiella burnetii RSA 493
accuugucacaaguguggauu

SEQ ID NO: 572868 - RNA, 19 nt, Coxiella burnetii RSA 493
accugcuccuuuucuucga

SEQ ID NO: 572869 - RNA, 16 nt, Coxiella burnetii RSA 493
acgaccgcggcagcag

SEQ ID NO: 572870 - RNA, 18 nt, Coxiella burnetii RSA 493
acgacgaaagaguaggga

SEQ ID NO: 572871 - RNA, 20 nt, Coxiella burnetii RSA 493
acgacuaauagcucauauuc

SEQ ID NO: 572872 - RNA, 14 nt, Coxiella burnetii RSA 493
acgacgaugccaaa

SEQ ID NO: 572873 - RNA, 20 nt, Coxiella burnetii RSA 493
acgauagucucuauaucuuu

SEQ ID NO: 572874 - RNA, 23 nt, Coxiella burnetii RSA 493
acgagugcgcccgucugggaugg

SEQ ID NO: 572875 - RNA, 16 nt, Coxiella burnetii RSA 493
acgagcucaaaaguug

SEQ ID NO: 572876 - RNA, 15 nt, Coxiella burnetii RSA 493
acgagcggccucaac

SEQ ID NO: 572877 - RNA, 23 nt, Coxiella burnetii RSA 493
acgaaagcuaaaaaagaaauauu

SEQ ID NO: 572878 - RNA, 21 nt, Coxiella burnetii RSA 493
acgaauacagggaaguuguuc

SEQ ID NO: 572879 - RNA, 18 nt, Coxiella burnetii RSA 493
acgaauaccccuuuuguu

SEQ ID NO: 572880 - RNA, 15 nt, Coxiella burnetii RSA 493
acgaaauaauuacaa

SEQ ID NO: 572881 - RNA, 23 nt, Coxiella burnetii RSA 493
accuuugcuaacaauuguugauu

SEQ ID NO: 572882 - RNA, 12 nt, Coxiella burnetii RSA 493
acgaauuaaaaa

SEQ ID NO: 572883 - RNA, 13 nt, Coxiella burnetii RSA 493
acgaauuaaaaaa

SEQ ID NO: 572884 - RNA, 19 nt, Coxiella burnetii RSA 493
acgaauggcccaauaaaga

SEQ ID NO: 572885 - RNA, 18 nt, Coxiella burnetii RSA 493
acgaaugugcucaucuuc

SEQ ID NO: 572886 - RNA, 18 nt, Coxiella burnetii RSA 493
acgacauuaaaaaugaua

SEQ ID NO: 572887 - RNA, 16 nt, Coxiella burnetii RSA 493
acgauauuaucaaaac

SEQ ID NO: 572888 - RNA, 14 nt, Coxiella burnetii RSA 493
acgcgaaaagauuc

SEQ ID NO: 572889 - RNA, 23 nt, Coxiella burnetii RSA 493
acgcguucuugcugcuuuugaau

SEQ ID NO: 572890 - RNA, 21 nt, Coxiella burnetii RSA 493
acgcguggcuuuaucaggcgc

SEQ ID NO: 572891 - RNA, 17 nt, Coxiella burnetii RSA 493
acgcucgagggaaaccu

SEQ ID NO: 572892 - RNA, 17 nt, Coxiella burnetii RSA 493
acgcuggaaaaauaaau

SEQ ID NO: 572893 - RNA, 20 nt, Coxiella burnetii RSA 493
acgcgccccucaagcaaagc

SEQ ID NO: 572894 - RNA, 13 nt, Coxiella burnetii RSA 493
acgcgcccgcccc

SEQ ID NO: 572895 - RNA, 16 nt, Coxiella burnetii RSA 493
acgucacgaauuuuuu

SEQ ID NO: 572896 - RNA, 13 nt, Coxiella burnetii RSA 493
acgucauaaaggu

SEQ ID NO: 572897 - RNA, 15 nt, Coxiella burnetii RSA 493
acguaucugacaguu

SEQ ID NO: 572898 - RNA, 15 nt, Coxiella burnetii RSA 493
acguauugaguuuuu

SEQ ID NO: 572899 - RNA, 16 nt, Coxiella burnetii RSA 493
acguauugccaaaauu

SEQ ID NO: 572900 - RNA, 12 nt, Coxiella burnetii RSA 493
acguuaaagccg

SEQ ID NO: 572901 - RNA, 20 nt, Coxiella burnetii RSA 493
acguuaaagccguugauguc

SEQ ID NO: 572902 - RNA, 10 nt, Coxiella burnetii RSA 493
acguggcugc

SEQ ID NO: 572903 - RNA, 16 nt, Coxiella burnetii RSA 493
acgugcacgaaauaau

SEQ ID NO: 572904 - RNA, 18 nt, Coxiella burnetii RSA 493
acgugcacgaaauaauua

SEQ ID NO: 572905 - RNA, 15 nt, Coxiella burnetii RSA 493
acgucgcaaauaaua

SEQ ID NO: 572906 - RNA, 19 nt, Coxiella burnetii RSA 493
acggggaaauaaugacaau

SEQ ID NO: 572907 - RNA, 15 nt, Coxiella burnetii RSA 493
acggcggauuaaaaa

SEQ ID NO: 572908 - RNA, 17 nt, Coxiella burnetii RSA 493
acgggagguuaaaaugg

SEQ ID NO: 572909 - RNA, 18 nt, Coxiella burnetii RSA 493
acggcaccguaaaacgaa

SEQ ID NO: 572910 - RNA, 17 nt, Coxiella burnetii RSA 493
acuacgaauagccaaug

SEQ ID NO: 572911 - RNA, 18 nt, Coxiella burnetii RSA 493
acuaggucugauaggaau

SEQ ID NO: 572912 - RNA, 18 nt, Coxiella burnetii RSA 493
acuaucgugauucuguuc

SEQ ID NO: 572913 - RNA, 16 nt, Coxiella burnetii RSA 493
acuagucaacaaacga

SEQ ID NO: 572914 - RNA, 20 nt, Coxiella burnetii RSA 493
acuaugguaauaauaacaaa

SEQ ID NO: 572915 - RNA, 15 nt, Coxiella burnetii RSA 493
acucaaagaaauaau

SEQ ID NO: 572916 - RNA, 16 nt, Coxiella burnetii RSA 493
acucaaagaaauaauc

SEQ ID NO: 572917 - RNA, 15 nt, Coxiella burnetii RSA 493
acucaaccagaaaua

SEQ ID NO: 572918 - RNA, 17 nt, Coxiella burnetii RSA 493
acucacagcccuaauaa

SEQ ID NO: 572919 - RNA, 23 nt, Coxiella burnetii RSA 493
acuccacgauauguuguuugcuu

SEQ ID NO: 572920 - RNA, 21 nt, Coxiella burnetii RSA 493
acucaguggcagcuucuuuaa

SEQ ID NO: 572921 - RNA, 23 nt, Coxiella burnetii RSA 493
acuccgcugcuccacaaugcauu

SEQ ID NO: 572922 - RNA, 17 nt, Coxiella burnetii RSA 493
acuccugggguaaugau

SEQ ID NO: 572923 - RNA, 18 nt, Coxiella burnetii RSA 493
acuccuucgcuuuuucca

SEQ ID NO: 572924 - RNA, 14 nt, Coxiella burnetii RSA 493
acugaccaucaauc

SEQ ID NO: 572925 - RNA, 20 nt, Coxiella burnetii RSA 493
acucgucuggggauacaccc

SEQ ID NO: 572926 - RNA, 17 nt, Coxiella burnetii RSA 493
acugaagaguaaaaaac

SEQ ID NO: 572927 - RNA, 20 nt, Coxiella burnetii RSA 493
acugaagaguaaaaaaccaa

SEQ ID NO: 572928 - RNA, 16 nt, Coxiella burnetii RSA 493
acuuaagagauaagcu

SEQ ID NO: 572929 - RNA, 16 nt, Coxiella burnetii RSA 493
agauuauucaagguua

SEQ ID NO: 572930 - RNA, 15 nt, Coxiella burnetii RSA 493
agcaacgccuuuccc

SEQ ID NO: 572931 - RNA, 22 nt, Coxiella burnetii RSA 493
agcaaguuuucuauauuuucuu

SEQ ID NO: 572932 - RNA, 19 nt, Coxiella burnetii RSA 493
agcaaggcgcuuuuauucc

SEQ ID NO: 572933 - RNA, 23 nt, Coxiella burnetii RSA 493
agcaaggaucucaccuggaugua

SEQ ID NO: 572934 - RNA, 14 nt, Coxiella burnetii RSA 493
agcaagcaaccguu

SEQ ID NO: 572935 - RNA, 11 nt, Coxiella burnetii RSA 493
agcaauguuuc

SEQ ID NO: 572936 - RNA, 11 nt, Coxiella burnetii RSA 493
agcaauuuuuu

SEQ ID NO: 572937 - RNA, 22 nt, Coxiella burnetii RSA 493
agcacaaaaguggggauaauug

SEQ ID NO: 572938 - RNA, 17 nt, Coxiella burnetii RSA 493
agcacaaccuugccaag

SEQ ID NO: 572939 - RNA, 21 nt, Coxiella burnetii RSA 493
agcacaaccuugccaagguug

SEQ ID NO: 572940 - RNA, 19 nt, Coxiella burnetii RSA 493
agcacgggaugauuuuucc

SEQ ID NO: 572941 - RNA, 20 nt, Coxiella burnetii RSA 493
aaaaccuuguuauaaaacuu

SEQ ID NO: 572942 - RNA, 17 nt, Coxiella burnetii RSA 493
aaaaccuaaagaaagaa

SEQ ID NO: 572943 - RNA, 21 nt, Coxiella burnetii RSA 493
aaaaccuacacuuuuaaucac

SEQ ID NO: 572944 - RNA, 17 nt, Coxiella burnetii RSA 493
agcagcuucuaaagcca

SEQ ID NO: 572945 - RNA, 14 nt, Coxiella burnetii RSA 493
agcaucccccaaga

SEQ ID NO: 572946 - RNA, 15 nt, Coxiella burnetii RSA 493
agcaucaauaagccg

SEQ ID NO: 572947 - RNA, 19 nt, Coxiella burnetii RSA 493
agcaucaauaagccguuca

SEQ ID NO: 572948 - RNA, 15 nt, Coxiella burnetii RSA 493
agcaucaauaaugcc

SEQ ID NO: 572949 - RNA, 15 nt, Coxiella burnetii RSA 493
agcagguugcuuuug

SEQ ID NO: 572950 - RNA, 16 nt, Coxiella burnetii RSA 493
agcaguuugccauuac

SEQ ID NO: 572951 - RNA, 18 nt, Coxiella burnetii RSA 493
agcauuucguauaauuca

SEQ ID NO: 572952 - RNA, 20 nt, Coxiella burnetii RSA 493
agcauuuucuccaaagggac

SEQ ID NO: 572953 - RNA, 23 nt, Coxiella burnetii RSA 493
agcauuuuuuugucgaauuuuug

SEQ ID NO: 572954 - RNA, 17 nt, Coxiella burnetii RSA 493
agcauucccauagaaga

SEQ ID NO: 572955 - RNA, 16 nt, Coxiella burnetii RSA 493
agcaucuugaaucauu

SEQ ID NO: 572956 - RNA, 15 nt, Coxiella burnetii RSA 493
agcauuaaaaaauaa

SEQ ID NO: 572957 - RNA, 18 nt, Coxiella burnetii RSA 493
agcauuaaaaaauaagaa

SEQ ID NO: 572958 - RNA, 19 nt, Coxiella burnetii RSA 493
agccacaaagaauuuuucc

SEQ ID NO: 572959 - RNA, 16 nt, Coxiella burnetii RSA 493
agccaauguuugcuca

SEQ ID NO: 572960 - RNA, 21 nt, Coxiella burnetii RSA 493
agccacauuucggacaacaaa

SEQ ID NO: 572961 - RNA, 15 nt, Coxiella burnetii RSA 493
agccgaauaaauccu

SEQ ID NO: 572962 - RNA, 14 nt, Coxiella burnetii RSA 493
agccgaauguuuaa

SEQ ID NO: 572963 - RNA, 13 nt, Coxiella burnetii RSA 493
agccgauucuuca

SEQ ID NO: 572964 - RNA, 18 nt, Coxiella burnetii RSA 493
agccgaugacaaauaaac

SEQ ID NO: 572965 - RNA, 23 nt, Coxiella burnetii RSA 493
agccuaucgauaagaucaauuac

SEQ ID NO: 572966 - RNA, 15 nt, Coxiella burnetii RSA 493
agccugaaaaucaaa

SEQ ID NO: 572967 - RNA, 20 nt, Coxiella burnetii RSA 493
agccucuucgcgcaagcacu

SEQ ID NO: 572968 - RNA, 15 nt, Coxiella burnetii RSA 493
agccuuuaguuuuau

SEQ ID NO: 572969 - RNA, 21 nt, Coxiella burnetii RSA 493
agcgaaauacgggaaaacaau

SEQ ID NO: 572970 - RNA, 13 nt, Coxiella burnetii RSA 493
agccuaaacgcuu

SEQ ID NO: 572971 - RNA, 14 nt, Coxiella burnetii RSA 493
agccguuauccaug

SEQ ID NO: 572972 - RNA, 16 nt, Coxiella burnetii RSA 493
agcggcagaaugcuuu

SEQ ID NO: 572973 - RNA, 16 nt, Coxiella burnetii RSA 493
agcggaauaagaaauc

SEQ ID NO: 572974 - RNA, 20 nt, Coxiella burnetii RSA 493
agcgcuuacagcaggaacca

SEQ ID NO: 572975 - RNA, 15 nt, Coxiella burnetii RSA 493
agcguacacuagggu

SEQ ID NO: 572976 - RNA, 18 nt, Coxiella burnetii RSA 493
agcguacaacaacaaagu

SEQ ID NO: 572977 - RNA, 14 nt, Coxiella burnetii RSA 493
agcggccucaacaa

SEQ ID NO: 572978 - RNA, 20 nt, Coxiella burnetii RSA 493
agcggcgauggcugcacagg

SEQ ID NO: 572979 - RNA, 22 nt, Coxiella burnetii RSA 493
agcgccaacgcgacaagaauuu

SEQ ID NO: 572980 - RNA, 16 nt, Coxiella burnetii RSA 493
agcgcgauuuucucuu

SEQ ID NO: 572981 - RNA, 13 nt, Coxiella burnetii RSA 493
agacucuuuuuau

SEQ ID NO: 572982 - RNA, 15 nt, Coxiella burnetii RSA 493
agacuucuuuaagcg

SEQ ID NO: 572983 - RNA, 17 nt, Coxiella burnetii RSA 493
agacuaggaaaaaauaa

SEQ ID NO: 572984 - RNA, 18 nt, Coxiella burnetii RSA 493
agacgcuggaaaaauaaa

SEQ ID NO: 572985 - RNA, 23 nt, Coxiella burnetii RSA 493
agacccccauuuuuuauccaaau

SEQ ID NO: 572986 - RNA, 21 nt, Coxiella burnetii RSA 493
agacccgccaaagcaaaaaua

SEQ ID NO: 572987 - RNA, 20 nt, Coxiella burnetii RSA 493
agaauuucucgauaaaaaca

SEQ ID NO: 572988 - RNA, 15 nt, Coxiella burnetii RSA 493
agacuuuugcagcua

SEQ ID NO: 572989 - RNA, 21 nt, Coxiella burnetii RSA 493
agagauucccgcugccuuuac

SEQ ID NO: 572990 - RNA, 13 nt, Coxiella burnetii RSA 493
aaaaccaauacca

SEQ ID NO: 572991 - RNA, 14 nt, Coxiella burnetii RSA 493
aaaaccaauaccaa

SEQ ID NO: 572992 - RNA, 15 nt, Coxiella burnetii RSA 493
agagccgaucgcugu

SEQ ID NO: 572993 - RNA, 19 nt, Coxiella burnetii RSA 493
agaucguuuuuugauaaaa

SEQ ID NO: 572994 - RNA, 22 nt, Coxiella burnetii RSA 493
agaucguuuuuugauaaaacuu

SEQ ID NO: 572995 - RNA, 14 nt, Coxiella burnetii RSA 493
agauuaaaaauuug

SEQ ID NO: 572996 - RNA, 18 nt, Coxiella burnetii RSA 493
agaugguaauaauuuucc

SEQ ID NO: 572997 - RNA, 17 nt, Coxiella burnetii RSA 493
agauaacgcuucuuuua

SEQ ID NO: 572998 - RNA, 23 nt, Coxiella burnetii RSA 493
agagugcguuaaggccucuuuag

SEQ ID NO: 572999 - RNA, 15 nt, Coxiella burnetii RSA 493
agagugcaauuaggg

SEQ ID NO: 573000 - RNA, 21 nt, Coxiella burnetii RSA 493
agagucgcaacaagcaacgau

SEQ ID NO: 573001 - RNA, 23 nt, Coxiella burnetii RSA 493
agagugaugacauuuaaaaaaac

SEQ ID NO: 573002 - RNA, 13 nt, Coxiella burnetii RSA 493
agauacacauaau

SEQ ID NO: 573003 - RNA, 14 nt, Coxiella burnetii RSA 493
agauaccagauacu

SEQ ID NO: 573004 - RNA, 18 nt, Coxiella burnetii RSA 493
agauaaucccaauaaaac

SEQ ID NO: 573005 - RNA, 14 nt, Coxiella burnetii RSA 493
agauaauuacaauc

SEQ ID NO: 573006 - RNA, 22 nt, Coxiella burnetii RSA 493
agaagaagucguguuuuuauuu

SEQ ID NO: 573007 - RNA, 23 nt, Coxiella burnetii RSA 493
agaaacguauugccaaaauuugg

SEQ ID NO: 573008 - RNA, 23 nt, Coxiella burnetii RSA 493
agaaacaacuaccugauaaaaua

SEQ ID NO: 573009 - RNA, 15 nt, Coxiella burnetii RSA 493
agaaaccguuucuac

SEQ ID NO: 573010 - RNA, 14 nt, Coxiella burnetii RSA 493
agaaacgauuaaaa

SEQ ID NO: 573011 - RNA, 16 nt, Coxiella burnetii RSA 493
agaaacgauuaaaaau

SEQ ID NO: 573012 - RNA, 15 nt, Coxiella burnetii RSA 493
agaauggauugcacu

SEQ ID NO: 573013 - RNA, 18 nt, Coxiella burnetii RSA 493
agaauggcgggaaaaaau

SEQ ID NO: 573014 - RNA, 18 nt, Coxiella burnetii RSA 493
agaauuaauguuauuuau

SEQ ID NO: 573015 - RNA, 16 nt, Coxiella burnetii RSA 493
agaauaagaauaagga

SEQ ID NO: 573016 - RNA, 23 nt, Coxiella burnetii RSA 493
agaauaaaacggcuugauuucag

SEQ ID NO: 573017 - RNA, 14 nt, Coxiella burnetii RSA 493
agaagcaucagaua

SEQ ID NO: 573018 - RNA, 12 nt, Coxiella burnetii RSA 493
acuuuuuuuaau

SEQ ID NO: 573019 - RNA, 22 nt, Coxiella burnetii RSA 493
acuuuuuuuaaugcgauucuuu

SEQ ID NO: 573020 - RNA, 23 nt, Coxiella burnetii RSA 493
acuuuuuuuaaugcgauucuuuu

SEQ ID NO: 573021 - RNA, 14 nt, Coxiella burnetii RSA 493
acuuuuuuccuucg

SEQ ID NO: 573022 - RNA, 19 nt, Coxiella burnetii RSA 493
agaaaaaccaguuuucagc

SEQ ID NO: 573023 - RNA, 16 nt, Coxiella burnetii RSA 493
acuuuuucaaagauau

SEQ ID NO: 573024 - RNA, 18 nt, Coxiella burnetii RSA 493
acuuuuucaaugccauuu

SEQ ID NO: 573025 - RNA, 18 nt, Coxiella burnetii RSA 493
acuuuuucgccugaauga

SEQ ID NO: 573026 - RNA, 16 nt, Coxiella burnetii RSA 493
acuuuucggagaaauc

SEQ ID NO: 573027 - RNA, 16 nt, Coxiella burnetii RSA 493
acuuuucguuguuugg

SEQ ID NO: 573028 - RNA, 17 nt, Coxiella burnetii RSA 493
acuuuuccaucuccuuu

SEQ ID NO: 573029 - RNA, 19 nt, Coxiella burnetii RSA 493
acuuuuccaucuccuuuuc

SEQ ID NO: 573030 - RNA, 13 nt, Coxiella burnetii RSA 493
acuuuuauaauca

SEQ ID NO: 573031 - RNA, 19 nt, Coxiella burnetii RSA 493
acuuucgauaaauuuugaa

SEQ ID NO: 573032 - RNA, 15 nt, Coxiella burnetii RSA 493
acuuuccuuauccuc

SEQ ID NO: 573033 - RNA, 12 nt, Coxiella burnetii RSA 493
acuuuguuuuau

SEQ ID NO: 573034 - RNA, 17 nt, Coxiella burnetii RSA 493
acuuucacuaauuauaa

SEQ ID NO: 573035 - RNA, 19 nt, Coxiella burnetii RSA 493
acuuucaguaccaaaagca

SEQ ID NO: 573036 - RNA, 19 nt, Coxiella burnetii RSA 493
acuuuagcuaauucuuuuu

SEQ ID NO: 573037 - RNA, 18 nt, Coxiella burnetii RSA 493
acuuuaguuuuucccucu

SEQ ID NO: 573038 - RNA, 15 nt, Coxiella burnetii RSA 493
acuuuacuuuuugua

SEQ ID NO: 573039 - RNA, 13 nt, Coxiella burnetii RSA 493
acuuuaagcacuu

SEQ ID NO: 573040 - RNA, 17 nt, Coxiella burnetii RSA 493
acuuuaagcacuucuuu

SEQ ID NO: 573041 - RNA, 18 nt, Coxiella burnetii RSA 493
acuuuaaugaccaccacc

SEQ ID NO: 573042 - RNA, 20 nt, Coxiella burnetii RSA 493
acuuguugcggauuggcuuu

SEQ ID NO: 573043 - RNA, 19 nt, Coxiella burnetii RSA 493
acuuguuuuucgguuucuu

SEQ ID NO: 573044 - RNA, 13 nt, Coxiella burnetii RSA 493
acuugccuugaga

SEQ ID NO: 573045 - RNA, 22 nt, Coxiella burnetii RSA 493
acuuagucgcguaccacgcuga

SEQ ID NO: 573046 - RNA, 20 nt, Coxiella burnetii RSA 493
acuuauaaauuaaauugcuc

SEQ ID NO: 573047 - RNA, 10 nt, Coxiella burnetii RSA 493
acuugggggu

SEQ ID NO: 573048 - RNA, 18 nt, Coxiella burnetii RSA 493
accaaaaaguuuauaaaa

SEQ ID NO: 573049 - RNA, 16 nt, Coxiella burnetii RSA 493
accaaaauccaaauuu

SEQ ID NO: 573050 - RNA, 18 nt, Coxiella burnetii RSA 493
accaaacguaagauugca

SEQ ID NO: 573051 - RNA, 20 nt, Coxiella burnetii RSA 493
accaaaugcgacaaucauuu

SEQ ID NO: 573052 - RNA, 20 nt, Coxiella burnetii RSA 493
accaaauccgcauaaaaacc

SEQ ID NO: 573053 - RNA, 23 nt, Coxiella burnetii RSA 493
accaaauccgcauaaaaacccau

SEQ ID NO: 573054 - RNA, 15 nt, Coxiella burnetii RSA 493
accaaauaauugauu

SEQ ID NO: 573055 - RNA, 11 nt, Coxiella burnetii RSA 493
acauucuuuga

SEQ ID NO: 573056 - RNA, 17 nt, Coxiella burnetii RSA 493
acauuguucauaaaaua

SEQ ID NO: 573057 - RNA, 16 nt, Coxiella burnetii RSA 493
acauaagcgaauaaua

SEQ ID NO: 573058 - RNA, 21 nt, Coxiella burnetii RSA 493
acaugaagguacugaagagua

SEQ ID NO: 573059 - RNA, 16 nt, Coxiella burnetii RSA 493
acaucucucguucuuu

SEQ ID NO: 573060 - RNA, 18 nt, Coxiella burnetii RSA 493
acaucguuucaaacacuu

SEQ ID NO: 573061 - RNA, 16 nt, Coxiella burnetii RSA 493
acagguccuaaaaaag

SEQ ID NO: 573062 - RNA, 21 nt, Coxiella burnetii RSA 493
acagguauuuuaaguaauuuu

SEQ ID NO: 573063 - RNA, 12 nt, Coxiella burnetii RSA 493
acaguauuucua

SEQ ID NO: 573064 - RNA, 23 nt, Coxiella burnetii RSA 493
acagguucacucgcaaaaauuuc

SEQ ID NO: 573065 - RNA, 19 nt, Coxiella burnetii RSA 493
acauaaaauuagguaauuu

SEQ ID NO: 573066 - RNA, 21 nt, Coxiella burnetii RSA 493
acauaaaauuagguaauuuau

SEQ ID NO: 573067 - RNA, 17 nt, Coxiella burnetii RSA 493
acaguuggcuaaaucca

SEQ ID NO: 573068 - RNA, 21 nt, Coxiella burnetii RSA 493
acagcgagagaauuaaaaaua

SEQ ID NO: 573069 - RNA, 16 nt, Coxiella burnetii RSA 493
acaggcuaggcggcuu

SEQ ID NO: 573070 - RNA, 14 nt, Coxiella burnetii RSA 493
acacguauuuucau

SEQ ID NO: 573071 - RNA, 23 nt, Coxiella burnetii RSA 493
acacgguuagugggaagcgggua

SEQ ID NO: 573072 - RNA, 20 nt, Coxiella burnetii RSA 493
acagcgaaaacaaaggcaca

SEQ ID NO: 573073 - RNA, 18 nt, Coxiella burnetii RSA 493
acagccaccccguguuga

SEQ ID NO: 573074 - RNA, 17 nt, Coxiella burnetii RSA 493
acaaugaugucaucuau

SEQ ID NO: 573075 - RNA, 19 nt, Coxiella burnetii RSA 493
acaaugaugucaucuaucg

SEQ ID NO: 573076 - RNA, 14 nt, Coxiella burnetii RSA 493
acaauuuuaaaaca

SEQ ID NO: 573077 - RNA, 17 nt, Coxiella burnetii RSA 493
acaauucccccaaaaac

SEQ ID NO: 573078 - RNA, 16 nt, Coxiella burnetii RSA 493
acaauucccguauuuc

SEQ ID NO: 573079 - RNA, 15 nt, Coxiella burnetii RSA 493
acaaucaguuuugau

SEQ ID NO: 573080 - RNA, 18 nt, Coxiella burnetii RSA 493
acaagguuuuauuuuuaa

SEQ ID NO: 573081 - RNA, 22 nt, Coxiella burnetii RSA 493
acaagcuggcauugaaaaucaa

SEQ ID NO: 573082 - RNA, 17 nt, Coxiella burnetii RSA 493
acaagcugacaauaggg

SEQ ID NO: 573083 - RNA, 13 nt, Coxiella burnetii RSA 493
acaaggaaaaucc

SEQ ID NO: 573084 - RNA, 16 nt, Coxiella burnetii RSA 493
acaaggccggcccuaa

SEQ ID NO: 573085 - RNA, 19 nt, Coxiella burnetii RSA 493
acaaggccggcccuaacau

SEQ ID NO: 573086 - RNA, 14 nt, Coxiella burnetii RSA 493
acaacgaaaucuac

SEQ ID NO: 573087 - RNA, 13 nt, Coxiella burnetii RSA 493
acacaaccacugu

SEQ ID NO: 573088 - RNA, 23 nt, Coxiella burnetii RSA 493
acacaaccacuguccucuguccu

SEQ ID NO: 573089 - RNA, 12 nt, Coxiella burnetii RSA 493
acaccaagaaau

SEQ ID NO: 573090 - RNA, 14 nt, Coxiella burnetii RSA 493
acacgaucaacaaa

SEQ ID NO: 573091 - RNA, 13 nt, Coxiella burnetii RSA 493
acaccuaagagaa

SEQ ID NO: 573092 - RNA, 19 nt, Coxiella burnetii RSA 493
acaccguuggaaaaggaca

SEQ ID NO: 573093 - RNA, 13 nt, Coxiella burnetii RSA 493
acaacaacaaagu

SEQ ID NO: 573094 - RNA, 13 nt, Coxiella burnetii RSA 493
acaaauuuuuaag

SEQ ID NO: 573095 - RNA, 16 nt, Coxiella burnetii RSA 493
acaaauuuuuaagacg

SEQ ID NO: 573096 - RNA, 23 nt, Coxiella burnetii RSA 493
acaaccauugucucguuagaaaa

SEQ ID NO: 573097 - RNA, 17 nt, Coxiella burnetii RSA 493
acaaaugaugaauuuau

SEQ ID NO: 573098 - RNA, 20 nt, Coxiella burnetii RSA 493
acaaauaaacaaguuaacaa

SEQ ID NO: 573099 - RNA, 19 nt, Coxiella burnetii RSA 493
acaaaccuggcggcauuga

SEQ ID NO: 573100 - RNA, 19 nt, Coxiella burnetii RSA 493
acaaacgauaaucucauca

SEQ ID NO: 573101 - RNA, 12 nt, Coxiella burnetii RSA 493
acaaaccauuca

SEQ ID NO: 573102 - RNA, 13 nt, Coxiella burnetii RSA 493
acaaaauuuuuca

SEQ ID NO: 573103 - RNA, 13 nt, Coxiella burnetii RSA 493
acaaacaaaaaau

SEQ ID NO: 573104 - RNA, 12 nt, Coxiella burnetii RSA 493
acaaagaggcaa

SEQ ID NO: 573105 - RNA, 14 nt, Coxiella burnetii RSA 493
acaaacugcuggaa

SEQ ID NO: 573106 - RNA, 23 nt, Coxiella burnetii RSA 493
acaaaggauuauuugaaccauga

SEQ ID NO: 573107 - RNA, 18 nt, Coxiella burnetii RSA 493
acaaaggcaaagccucuu

SEQ ID NO: 573108 - RNA, 16 nt, Coxiella burnetii RSA 493
acaaaggcacaaagau

SEQ ID NO: 573109 - RNA, 15 nt, Coxiella burnetii RSA 493
acaaaaucaccagaa

SEQ ID NO: 573110 - RNA, 21 nt, Coxiella burnetii RSA 493
acaaaaauaucccuuuggaua

SEQ ID NO: 573111 - RNA, 15 nt, Coxiella burnetii RSA 493
aauuuuuuuucuucu

SEQ ID NO: 573112 - RNA, 18 nt, Coxiella burnetii RSA 493
aaugcagcacaaagcuga

SEQ ID NO: 573113 - RNA, 13 nt, Coxiella burnetii RSA 493
aaugcaaaaccaa

SEQ ID NO: 573114 - RNA, 23 nt, Coxiella burnetii RSA 493
aaucuucugaucgauaaaaauaa

SEQ ID NO: 573115 - RNA, 14 nt, Coxiella burnetii RSA 493
aaugauuucauccu

SEQ ID NO: 573116 - RNA, 14 nt, Coxiella burnetii RSA 493
aaugauuuuaucga

SEQ ID NO: 573117 - RNA, 13 nt, Coxiella burnetii RSA 493
aauggaaauccag

SEQ ID NO: 573118 - RNA, 18 nt, Coxiella burnetii RSA 493
aaugcuuuuuaaauaacu

SEQ ID NO: 573119 - RNA, 14 nt, Coxiella burnetii RSA 493
aaugcuuuuuuaua

SEQ ID NO: 573120 - RNA, 18 nt, Coxiella burnetii RSA 493
aaugcuuucuuuuaauuc

SEQ ID NO: 573121 - RNA, 23 nt, Coxiella burnetii RSA 493
aaugcgcuuuuaaacgcuucaaa

SEQ ID NO: 573122 - RNA, 17 nt, Coxiella burnetii RSA 493
aaugcggcauucaaugg

SEQ ID NO: 573123 - RNA, 15 nt, Coxiella burnetii RSA 493
aaugcgcucugccac

SEQ ID NO: 573124 - RNA, 21 nt, Coxiella burnetii RSA 493
aaugcgccauccgacauucuu

SEQ ID NO: 573125 - RNA, 17 nt, Coxiella burnetii RSA 493
aaugcgccuacaaauac

SEQ ID NO: 573126 - RNA, 15 nt, Coxiella burnetii RSA 493
aauggauauuuuaag

SEQ ID NO: 573127 - RNA, 15 nt, Coxiella burnetii RSA 493
aaugguugaaagaaa

SEQ ID NO: 573128 - RNA, 21 nt, Coxiella burnetii RSA 493
aaugguugaaagaaaaaaaac

SEQ ID NO: 573129 - RNA, 21 nt, Coxiella burnetii RSA 493
aauguuaggaaggacaaaaau

SEQ ID NO: 573130 - RNA, 15 nt, Coxiella burnetii RSA 493
aauguuauccgguuu

SEQ ID NO: 573131 - RNA, 20 nt, Coxiella burnetii RSA 493
aauguuauuuauuuuucucu

SEQ ID NO: 573132 - RNA, 13 nt, Coxiella burnetii RSA 493
aauguuaaaacac

SEQ ID NO: 573133 - RNA, 14 nt, Coxiella burnetii RSA 493
aauguuaaaacaca

SEQ ID NO: 573134 - RNA, 18 nt, Coxiella burnetii RSA 493
aaugucagguucggauuu

SEQ ID NO: 573135 - RNA, 22 nt, Coxiella burnetii RSA 493
aaugucagguucggauuucacu

SEQ ID NO: 573136 - RNA, 23 nt, Coxiella burnetii RSA 493
aauuaaaugcuuuuuaaauaacu

SEQ ID NO: 573137 - RNA, 17 nt, Coxiella burnetii RSA 493
aauuaaccaaucaauaa

SEQ ID NO: 573138 - RNA, 15 nt, Coxiella burnetii RSA 493
aauguuucuuuuaua

SEQ ID NO: 573139 - RNA, 12 nt, Coxiella burnetii RSA 493
aauguuugauau

SEQ ID NO: 573140 - RNA, 22 nt, Coxiella burnetii RSA 493
aauguuugauccuugcaauaag

SEQ ID NO: 573141 - RNA, 16 nt, Coxiella burnetii RSA 493
aauguugggcgaaaag

SEQ ID NO: 573142 - RNA, 15 nt, Coxiella burnetii RSA 493
aauguugauaauaaa

SEQ ID NO: 573143 - RNA, 14 nt, Coxiella burnetii RSA 493
aauguuuuuuaaua

SEQ ID NO: 573144 - RNA, 15 nt, Coxiella burnetii RSA 493
aauuaaaaaauucaa

SEQ ID NO: 573145 - RNA, 13 nt, Coxiella burnetii RSA 493
aauugcugaacaa

SEQ ID NO: 573146 - RNA, 20 nt, Coxiella burnetii RSA 493
aauugcugaacaaaagccau

SEQ ID NO: 573147 - RNA, 22 nt, Coxiella burnetii RSA 493
aauugcugaacaaaagccaugc

SEQ ID NO: 573148 - RNA, 21 nt, Coxiella burnetii RSA 493
aauugcugacaccuagccaaa

SEQ ID NO: 573149 - RNA, 23 nt, Coxiella burnetii RSA 493
aauugcuugguugauucaauaau

SEQ ID NO: 573150 - RNA, 19 nt, Coxiella burnetii RSA 493
aauugcuuucccuuuuuga

SEQ ID NO: 573151 - RNA, 21 nt, Coxiella burnetii RSA 493
aauugcuuucccuuuuugauu

SEQ ID NO: 573152 - RNA, 22 nt, Coxiella burnetii RSA 493
aauugcuuucccuuuuugauuu

SEQ ID NO: 573153 - RNA, 19 nt, Coxiella burnetii RSA 493
aaaacaacgaguuucgcuu

SEQ ID NO: 573154 - RNA, 13 nt, Coxiella burnetii RSA 493
aauucuuuuuaag

SEQ ID NO: 573155 - RNA, 18 nt, Coxiella burnetii RSA 493
aauugaaaaaccauucaa

SEQ ID NO: 573156 - RNA, 18 nt, Coxiella burnetii RSA 493
aauuguguuuuaauuccc

SEQ ID NO: 573157 - RNA, 15 nt, Coxiella burnetii RSA 493
aauuguuugaaaaaa

SEQ ID NO: 573158 - RNA, 18 nt, Coxiella burnetii RSA 493
aauuguuugaaaaaauac

SEQ ID NO: 573159 - RNA, 14 nt, Coxiella burnetii RSA 493
aauuuaaaccacua

SEQ ID NO: 573160 - RNA, 15 nt, Coxiella burnetii RSA 493
aauuuaggccuuaau

SEQ ID NO: 573161 - RNA, 19 nt, Coxiella burnetii RSA 493
aauucaucauuuuccaaaa

SEQ ID NO: 573162 - RNA, 22 nt, Coxiella burnetii RSA 493
aauuccaucacuuggugaacgu

SEQ ID NO: 573163 - RNA, 18 nt, Coxiella burnetii RSA 493
aauuccauuaaaaacaau

SEQ ID NO: 573164 - RNA, 23 nt, Coxiella burnetii RSA 493
aauuccaauaauugcugaacaaa

SEQ ID NO: 573165 - RNA, 13 nt, Coxiella burnetii RSA 493
aauuccaaaaaca

SEQ ID NO: 573166 - RNA, 18 nt, Coxiella burnetii RSA 493
aauucuccuuaauaaagu

SEQ ID NO: 573167 - RNA, 20 nt, Coxiella burnetii RSA 493
aauucuccuuaauaaaguuu

SEQ ID NO: 573168 - RNA, 13 nt, Coxiella burnetii RSA 493
aauucugaaucac

SEQ ID NO: 573169 - RNA, 24 nt, Coxiella burnetii RSA 493
aauuccuugcucaaguccuugcug

SEQ ID NO: 573170 - RNA, 13 nt, Coxiella burnetii RSA 493
aauucgaaagaaa

SEQ ID NO: 573171 - RNA, 20 nt, Coxiella burnetii RSA 493
aauucacggauacgcuuuau

SEQ ID NO: 573172 - RNA, 16 nt, Coxiella burnetii RSA 493
aauuaucuuaaugaaa

SEQ ID NO: 573173 - RNA, 23 nt, Coxiella burnetii RSA 493
aauuauucggauucucucgcuca

SEQ ID NO: 573174 - RNA, 17 nt, Coxiella burnetii RSA 493
aauuauaacuauuuuaa

SEQ ID NO: 573175 - RNA, 20 nt, Coxiella burnetii RSA 493
aauuauaacuauuuuaaauc

SEQ ID NO: 573176 - RNA, 13 nt, Coxiella burnetii RSA 493
aauuaacuuugca

SEQ ID NO: 573177 - RNA, 14 nt, Coxiella burnetii RSA 493
aauuaagagaaauu

SEQ ID NO: 573178 - RNA, 19 nt, Coxiella burnetii RSA 493
aauuaucguacgaagauua

SEQ ID NO: 573179 - RNA, 22 nt, Coxiella burnetii RSA 493
aaucaaucgaccgagaauuaau

SEQ ID NO: 573180 - RNA, 19 nt, Coxiella burnetii RSA 493
aaucaaucgcagcauuuuu

SEQ ID NO: 573181 - RNA, 18 nt, Coxiella burnetii RSA 493
aaucaaugcaguuaacca

SEQ ID NO: 573182 - RNA, 23 nt, Coxiella burnetii RSA 493
aaucaauuuucuucgcuggauuu

SEQ ID NO: 573183 - RNA, 22 nt, Coxiella burnetii RSA 493
aaucacaaaagguaaaaaacua

SEQ ID NO: 573184 - RNA, 23 nt, Coxiella burnetii RSA 493
aaucaauuuaccaauuaaagaau

SEQ ID NO: 573185 - RNA, 18 nt, Coxiella burnetii RSA 493
aaucaacucgcccaugga

SEQ ID NO: 573186 - RNA, 18 nt, Coxiella burnetii RSA 493
aaucaaguagccaaaaua

SEQ ID NO: 573187 - RNA, 20 nt, Coxiella burnetii RSA 493
aaucaaguagccaaaauaau

SEQ ID NO: 573188 - RNA, 15 nt, Coxiella burnetii RSA 493
aaucaaguccaauua

SEQ ID NO: 573189 - RNA, 13 nt, Coxiella burnetii RSA 493
aaucaaaucggcu

SEQ ID NO: 573190 - RNA, 18 nt, Coxiella burnetii RSA 493
aaucaaaugcuaauuccu

SEQ ID NO: 573191 - RNA, 14 nt, Coxiella burnetii RSA 493
aaucaaauuuuccg

SEQ ID NO: 573192 - RNA, 13 nt, Coxiella burnetii RSA 493
aaucaaauuuucc

SEQ ID NO: 573193 - RNA, 19 nt, Coxiella burnetii RSA 493
aaucaaccucagguuuuac

SEQ ID NO: 573194 - RNA, 18 nt, Coxiella burnetii RSA 493
aauagccauuaauaaagu

SEQ ID NO: 573195 - RNA, 17 nt, Coxiella burnetii RSA 493
aauaugcacuaaaccuu

SEQ ID NO: 573196 - RNA, 18 nt, Coxiella burnetii RSA 493
aauauggcgaucuauagc

SEQ ID NO: 573197 - RNA, 15 nt, Coxiella burnetii RSA 493
aauauuaaaacaaga

SEQ ID NO: 573198 - RNA, 16 nt, Coxiella burnetii RSA 493
aauauuaguggaauua

SEQ ID NO: 573199 - RNA, 18 nt, Coxiella burnetii RSA 493
aauauuaucguuuucauu

SEQ ID NO: 573200 - RNA, 14 nt, Coxiella burnetii RSA 493
aauauuucuuccag

SEQ ID NO: 573201 - RNA, 17 nt, Coxiella burnetii RSA 493
aauauuucguuccauga

SEQ ID NO: 573202 - RNA, 18 nt, Coxiella burnetii RSA 493
aauauuuaaauugaauca

SEQ ID NO: 573203 - RNA, 22 nt, Coxiella burnetii RSA 493
aauauuuucucaauagaaaaaa

SEQ ID NO: 573204 - RNA, 20 nt, Coxiella burnetii RSA 493
aauauuuuuauucuucugcc

SEQ ID NO: 573205 - RNA, 16 nt, Coxiella burnetii RSA 493
aauauuuuuauuucca

SEQ ID NO: 573206 - RNA, 17 nt, Coxiella burnetii RSA 493
aauauuuuucucuuuca

SEQ ID NO: 573207 - RNA, 21 nt, Coxiella burnetii RSA 493
aauauuuuucucuuucauaau

SEQ ID NO: 573208 - RNA, 12 nt, Coxiella burnetii RSA 493
aauauugaauaa

SEQ ID NO: 573209 - RNA, 22 nt, Coxiella burnetii RSA 493
aauauucuaaccacccugucau

SEQ ID NO: 573210 - RNA, 14 nt, Coxiella burnetii RSA 493
aauauuauugagaa

SEQ ID NO: 573211 - RNA, 20 nt, Coxiella burnetii RSA 493
aaaaauuuauucuaacuuug

SEQ ID NO: 573212 - RNA, 13 nt, Coxiella burnetii RSA 493
aaucucaucaucu

SEQ ID NO: 573213 - RNA, 22 nt, Coxiella burnetii RSA 493
aaucucaucaucuucaaaaccu

SEQ ID NO: 573214 - RNA, 15 nt, Coxiella burnetii RSA 493
aaucguggccggcuu

SEQ ID NO: 573215 - RNA, 22 nt, Coxiella burnetii RSA 493
aaucuguaacgccaugaagcaa

SEQ ID NO: 573216 - RNA, 20 nt, Coxiella burnetii RSA 493
aaucuggguuucuuucuucu

SEQ ID NO: 573217 - RNA, 14 nt, Coxiella burnetii RSA 493
aaucugcuuccucu

SEQ ID NO: 573218 - RNA, 17 nt, Coxiella burnetii RSA 493
aaucugacguuaucacu

SEQ ID NO: 573219 - RNA, 20 nt, Coxiella burnetii RSA 493
aauccgcauaaaaacccauu

SEQ ID NO: 573220 - RNA, 17 nt, Coxiella burnetii RSA 493
aauccgcuuuauuuuuc

SEQ ID NO: 573221 - RNA, 17 nt, Coxiella burnetii RSA 493
aauccgccgguacccca

SEQ ID NO: 573222 - RNA, 18 nt, Coxiella burnetii RSA 493
aauccguuuugaaaaaua

SEQ ID NO: 573223 - RNA, 19 nt, Coxiella burnetii RSA 493
aauccguuuugaaaaauaa

SEQ ID NO: 573224 - RNA, 14 nt, Coxiella burnetii RSA 493
aaucgauggaagaa

SEQ ID NO: 573225 - RNA, 16 nt, Coxiella burnetii RSA 493
aauccuuguugaauuc

SEQ ID NO: 573226 - RNA, 17 nt, Coxiella burnetii RSA 493
aauccuuguugaauucc

SEQ ID NO: 573227 - RNA, 22 nt, Coxiella burnetii RSA 493
aauccagcgauuguaauugcuu

SEQ ID NO: 573228 - RNA, 12 nt, Coxiella burnetii RSA 493
aaucauuuuucc

SEQ ID NO: 573229 - RNA, 12 nt, Coxiella burnetii RSA 493
aaucauugguuu

SEQ ID NO: 573230 - RNA, 21 nt, Coxiella burnetii RSA 493
aaauucuccuuaauaaaguuu

SEQ ID NO: 573231 - RNA, 22 nt, Coxiella burnetii RSA 493
aaauucugaaucacuucuucca

SEQ ID NO: 573232 - RNA, 17 nt, Coxiella burnetii RSA 493
aacaaguauaacaaaau

SEQ ID NO: 573233 - RNA, 16 nt, Coxiella burnetii RSA 493
aaauucuuguccuuua

SEQ ID NO: 573234 - RNA, 20 nt, Coxiella burnetii RSA 493
aacaaguuaacaaaaucacc

SEQ ID NO: 573235 - RNA, 21 nt, Coxiella burnetii RSA 493
aacaaguuaacaaaaucacca

SEQ ID NO: 573236 - RNA, 15 nt, Coxiella burnetii RSA 493
aacaauuaacuuugc

SEQ ID NO: 573237 - RNA, 16 nt, Coxiella burnetii RSA 493
aacacgaucaacaaaa

SEQ ID NO: 573238 - RNA, 11 nt, Coxiella burnetii RSA 493
aacacggcagg

SEQ ID NO: 573239 - RNA, 16 nt, Coxiella burnetii RSA 493
aacaccguuggaaaag

SEQ ID NO: 573240 - RNA, 14 nt, Coxiella burnetii RSA 493
aacaccuaaaucaa

SEQ ID NO: 573241 - RNA, 19 nt, Coxiella burnetii RSA 493
aacaccuaaaucaauuuuc

SEQ ID NO: 573242 - RNA, 17 nt, Coxiella burnetii RSA 493
aacaccccaauuuuugg

SEQ ID NO: 573243 - RNA, 21 nt, Coxiella burnetii RSA 493
aacaccccaauuuuuggcuug

SEQ ID NO: 573244 - RNA, 13 nt, Coxiella burnetii RSA 493
aacagauuuaaau

SEQ ID NO: 573245 - RNA, 23 nt, Coxiella burnetii RSA 493
aacagacagacgcuggaaaaaua

SEQ ID NO: 573246 - RNA, 17 nt, Coxiella burnetii RSA 493
aacagaggacagaaggc

SEQ ID NO: 573247 - RNA, 12 nt, Coxiella burnetii RSA 493
aacauucuuuga

SEQ ID NO: 573248 - RNA, 16 nt, Coxiella burnetii RSA 493
aacauucuaauaaaau

SEQ ID NO: 573249 - RNA, 20 nt, Coxiella burnetii RSA 493
aacauucgauauguuucaau

SEQ ID NO: 573250 - RNA, 12 nt, Coxiella burnetii RSA 493
aacauuauuaca

SEQ ID NO: 573251 - RNA, 23 nt, Coxiella burnetii RSA 493
aacauuauuacauauuucuuuuc

SEQ ID NO: 573252 - RNA, 20 nt, Coxiella burnetii RSA 493
aaccaauagcuccccgcucc

SEQ ID NO: 573253 - RNA, 13 nt, Coxiella burnetii RSA 493
aacagcgaaaaca

SEQ ID NO: 573254 - RNA, 14 nt, Coxiella burnetii RSA 493
aacagcgaaaacaa

SEQ ID NO: 573255 - RNA, 18 nt, Coxiella burnetii RSA 493
aacagcgcccaauaagga

SEQ ID NO: 573256 - RNA, 19 nt, Coxiella burnetii RSA 493
aacagccgaugacaaauaa

SEQ ID NO: 573257 - RNA, 13 nt, Coxiella burnetii RSA 493
aacauacgacuuc

SEQ ID NO: 573258 - RNA, 21 nt, Coxiella burnetii RSA 493
aacauauggcccacuuggaaa

SEQ ID NO: 573259 - RNA, 19 nt, Coxiella burnetii RSA 493
aacccguuuuaauguugcc

SEQ ID NO: 573260 - RNA, 13 nt, Coxiella burnetii RSA 493
aacccuuucauuu

SEQ ID NO: 573261 - RNA, 22 nt, Coxiella burnetii RSA 493
aacccuuucauuuaauuuuaaa

SEQ ID NO: 573262 - RNA, 16 nt, Coxiella burnetii RSA 493
aaccgacaauuuuaua

SEQ ID NO: 573263 - RNA, 13 nt, Coxiella burnetii RSA 493
aaccgacgaauaa

SEQ ID NO: 573264 - RNA, 23 nt, Coxiella burnetii RSA 493
aaccgacgccauuuuuuagcacc

SEQ ID NO: 573265 - RNA, 23 nt, Coxiella burnetii RSA 493
aaccgauagucuguaugaagcgc

SEQ ID NO: 573266 - RNA, 14 nt, Coxiella burnetii RSA 493
aaccgcaugaauua

SEQ ID NO: 573267 - RNA, 17 nt, Coxiella burnetii RSA 493
aacccacggcaaauaaa

SEQ ID NO: 573268 - RNA, 17 nt, Coxiella burnetii RSA 493
aacccagaaaaguaaaa

SEQ ID NO: 573269 - RNA, 22 nt, Coxiella burnetii RSA 493
aaccacucggaaagcaucaacc

SEQ ID NO: 573270 - RNA, 18 nt, Coxiella burnetii RSA 493
aaccauucaaugcuaaau

SEQ ID NO: 573271 - RNA, 17 nt, Coxiella burnetii RSA 493
aacgauggucaaaccaa

SEQ ID NO: 573272 - RNA, 19 nt, Coxiella burnetii RSA 493
aacgauggucaaaccaauc

SEQ ID NO: 573273 - RNA, 17 nt, Coxiella burnetii RSA 493
aacgauugcuaaaccac

SEQ ID NO: 573274 - RNA, 20 nt, Coxiella burnetii RSA 493
aaccggcuucuaaguaaaca

SEQ ID NO: 573275 - RNA, 17 nt, Coxiella burnetii RSA 493
aacgccaucgauuuugu

SEQ ID NO: 573276 - RNA, 12 nt, Coxiella burnetii RSA 493
aacguaaaaugc

SEQ ID NO: 573277 - RNA, 17 nt, Coxiella burnetii RSA 493
aacggugcgauuuuccg

SEQ ID NO: 573278 - RNA, 21 nt, Coxiella burnetii RSA 493
aacgguuauaaacauaaaauu

SEQ ID NO: 573279 - RNA, 17 nt, Coxiella burnetii RSA 493
aacgguaugucggauuu

SEQ ID NO: 573280 - RNA, 21 nt, Coxiella burnetii RSA 493
aacgguaugucggauuucuuu

SEQ ID NO: 573281 - RNA, 18 nt, Coxiella burnetii RSA 493
aacgccugaaauauuuuc

SEQ ID NO: 573282 - RNA, 19 nt, Coxiella burnetii RSA 493
aacguuuugucguuuucau

SEQ ID NO: 573283 - RNA, 12 nt, Coxiella burnetii RSA 493
aacuaaaagagg

SEQ ID NO: 573284 - RNA, 17 nt, Coxiella burnetii RSA 493
aacuagaaauauuagaa

SEQ ID NO: 573285 - RNA, 18 nt, Coxiella burnetii RSA 493
aacuagaaauauuagaaa

SEQ ID NO: 573286 - RNA, 15 nt, Coxiella burnetii RSA 493
aacuaguuauuuuua

SEQ ID NO: 573287 - RNA, 17 nt, Coxiella burnetii RSA 493
aacuaccugauaaaaua

SEQ ID NO: 573288 - RNA, 19 nt, Coxiella burnetii RSA 493
aacuaccugauaaaauaac

SEQ ID NO: 573289 - RNA, 20 nt, Coxiella burnetii RSA 493
aacuaccugauaaaauaaca

SEQ ID NO: 573290 - RNA, 18 nt, Coxiella burnetii RSA 493
aacgucgccugcuaaaau

SEQ ID NO: 573291 - RNA, 12 nt, Coxiella burnetii RSA 493
aacgucuuugua

SEQ ID NO: 573292 - RNA, 20 nt, Coxiella burnetii RSA 493
aacguuugauuuucaaguuu

SEQ ID NO: 573293 - RNA, 18 nt, Coxiella burnetii RSA 493
aacugcuggaaauaaugu

SEQ ID NO: 573294 - RNA, 19 nt, Coxiella burnetii RSA 493
aacugcuggaaauaaugug

SEQ ID NO: 573295 - RNA, 15 nt, Coxiella burnetii RSA 493
aacucuugccggauu

SEQ ID NO: 573296 - RNA, 20 nt, Coxiella burnetii RSA 493
aacucuuuggcgccgcugga

SEQ ID NO: 573297 - RNA, 14 nt, Coxiella burnetii RSA 493
aacuauuuuaaauc

SEQ ID NO: 573298 - RNA, 22 nt, Coxiella burnetii RSA 493
aacuggcuuggacaaaucauca

SEQ ID NO: 573299 - RNA, 13 nt, Coxiella burnetii RSA 493
aacuuauccaugc

SEQ ID NO: 573300 - RNA, 14 nt, Coxiella burnetii RSA 493
aagaaaaagaaauu

SEQ ID NO: 573301 - RNA, 14 nt, Coxiella burnetii RSA 493
aagaaaaaaugauu

SEQ ID NO: 573302 - RNA, 12 nt, Coxiella burnetii RSA 493
aagaaagaagaa

SEQ ID NO: 573303 - RNA, 22 nt, Coxiella burnetii RSA 493
aagaaagacauuguucauaaaa

SEQ ID NO: 573304 - RNA, 13 nt, Coxiella burnetii RSA 493
aagaaccgcgacu

SEQ ID NO: 573305 - RNA, 19 nt, Coxiella burnetii RSA 493
aagaaagggugagguaacu

SEQ ID NO: 573306 - RNA, 18 nt, Coxiella burnetii RSA 493
aagaaagcgagcaaucaa

SEQ ID NO: 573307 - RNA, 17 nt, Coxiella burnetii RSA 493
aagaaggucguuuauuu

SEQ ID NO: 573308 - RNA, 16 nt, Coxiella burnetii RSA 493
aaguuuuuugcucuuu

SEQ ID NO: 573309 - RNA, 15 nt, Coxiella burnetii RSA 493
aaguuuuaagaaaaa

SEQ ID NO: 573310 - RNA, 16 nt, Coxiella burnetii RSA 493
aaguuuuaagaaaaac

SEQ ID NO: 573311 - RNA, 19 nt, Coxiella burnetii RSA 493
aaguuuuaagaaaaaccag

SEQ ID NO: 573312 - RNA, 13 nt, Coxiella burnetii RSA 493
aaguuuuagguuu

SEQ ID NO: 573313 - RNA, 13 nt, Coxiella burnetii RSA 493
aauaaaauuaaau

SEQ ID NO: 573314 - RNA, 14 nt, Coxiella burnetii RSA 493
aauaaaauuaaaua

SEQ ID NO: 573315 - RNA, 22 nt, Coxiella burnetii RSA 493
aauaaaaccuucaaaaauaaaa

SEQ ID NO: 573316 - RNA, 11 nt, Coxiella burnetii RSA 493
aauaaaagccc

SEQ ID NO: 573317 - RNA, 13 nt, Coxiella burnetii RSA 493
aauaaacuggaaa

SEQ ID NO: 573318 - RNA, 15 nt, Coxiella burnetii RSA 493
aauaaacuggaaaaa

SEQ ID NO: 573319 - RNA, 20 nt, Coxiella burnetii RSA 493
aauaaacgggcuaaagguuu

SEQ ID NO: 573320 - RNA, 11 nt, Coxiella burnetii RSA 493
aauaaaguaau

SEQ ID NO: 573321 - RNA, 17 nt, Coxiella burnetii RSA 493
aauaaaguaauuuuaaa

SEQ ID NO: 573322 - RNA, 12 nt, Coxiella burnetii RSA 493
aauaacagagau

SEQ ID NO: 573323 - RNA, 13 nt, Coxiella burnetii RSA 493
aauaacaaaguaa

SEQ ID NO: 573324 - RNA, 21 nt, Coxiella burnetii RSA 493
aaguucuucuaaagaauuuuu

SEQ ID NO: 573325 - RNA, 16 nt, Coxiella burnetii RSA 493
aaguugccgauaaaaa

SEQ ID NO: 573326 - RNA, 23 nt, Coxiella burnetii RSA 493
aaguugcgcccugaguucgcuaa

SEQ ID NO: 573327 - RNA, 19 nt, Coxiella burnetii RSA 493
aaguuucacgaauuaaaaa

SEQ ID NO: 573328 - RNA, 20 nt, Coxiella burnetii RSA 493
aaguuucacgaauuaaaaaa

SEQ ID NO: 573329 - RNA, 15 nt, Coxiella burnetii RSA 493
aaguuucccacaaaa

SEQ ID NO: 573330 - RNA, 15 nt, Coxiella burnetii RSA 493
aagucuuugacauau

SEQ ID NO: 573331 - RNA, 20 nt, Coxiella burnetii RSA 493
aaguaagccauaucaggagc

SEQ ID NO: 573332 - RNA, 23 nt, Coxiella burnetii RSA 493
aagucuucaaaagugauuuuucu

SEQ ID NO: 573333 - RNA, 20 nt, Coxiella burnetii RSA 493
aagucugguuaaacccauuu

SEQ ID NO: 573334 - RNA, 16 nt, Coxiella burnetii RSA 493
aauacgggaaaacaau

SEQ ID NO: 573335 - RNA, 17 nt, Coxiella burnetii RSA 493
aauacgggaaaacaaug

SEQ ID NO: 573336 - RNA, 20 nt, Coxiella burnetii RSA 493
aauacggggacgauagaugg

SEQ ID NO: 573337 - RNA, 18 nt, Coxiella burnetii RSA 493
aauacgauagcgucuuuu

SEQ ID NO: 573338 - RNA, 18 nt, Coxiella burnetii RSA 493
aauacggagaaaaugauu

SEQ ID NO: 573339 - RNA, 16 nt, Coxiella burnetii RSA 493
aauacaucuugauccu

SEQ ID NO: 573340 - RNA, 17 nt, Coxiella burnetii RSA 493
aauaccccuuuuguuaa

SEQ ID NO: 573341 - RNA, 20 nt, Coxiella burnetii RSA 493
aauaccgauuaauucuuuag

SEQ ID NO: 573342 - RNA, 16 nt, Coxiella burnetii RSA 493
aauaccuuugcaaaca

SEQ ID NO: 573343 - RNA, 19 nt, Coxiella burnetii RSA 493
aauaccuuugcaaacaugc

SEQ ID NO: 573344 - RNA, 23 nt, Coxiella burnetii RSA 493
aauaccuuuuucguuuaacaaug

SEQ ID NO: 573345 - RNA, 19 nt, Coxiella burnetii RSA 493
aauacgaauguuaauucga

SEQ ID NO: 573346 - RNA, 15 nt, Coxiella burnetii RSA 493
aauacucuuauuuuc

SEQ ID NO: 573347 - RNA, 14 nt, Coxiella burnetii RSA 493
aauagaaaaaagaa

SEQ ID NO: 573348 - RNA, 16 nt, Coxiella burnetii RSA 493
aauacaggauuauauu

SEQ ID NO: 573349 - RNA, 13 nt, Coxiella burnetii RSA 493
aauacaggaaaaa

SEQ ID NO: 573350 - RNA, 14 nt, Coxiella burnetii RSA 493
aauacaggaaaaag

SEQ ID NO: 573351 - RNA, 16 nt, Coxiella burnetii RSA 493
aauacaggaaaaagau

SEQ ID NO: 573352 - RNA, 21 nt, Coxiella burnetii RSA 493
aauacaacgcuguuaaaaucc

SEQ ID NO: 573353 - RNA, 19 nt, Coxiella burnetii RSA 493
aauacaagcugacaauagg

SEQ ID NO: 573354 - RNA, 22 nt, Coxiella burnetii RSA 493
aauaauugcugaacaaaagcca

SEQ ID NO: 573355 - RNA, 23 nt, Coxiella burnetii RSA 493
aauaauugcugaacaaaagccau

SEQ ID NO: 573356 - RNA, 14 nt, Coxiella burnetii RSA 493
aauaauuguaguuc

SEQ ID NO: 573357 - RNA, 16 nt, Coxiella burnetii RSA 493
aauaaugugacucauu

SEQ ID NO: 573358 - RNA, 22 nt, Coxiella burnetii RSA 493
aauaaucguaucgauuucuuuu

SEQ ID NO: 573359 - RNA, 14 nt, Coxiella burnetii RSA 493
aauaaucauuucga

SEQ ID NO: 573360 - RNA, 15 nt, Coxiella burnetii RSA 493
aauaaucauuuuuau

SEQ ID NO: 573361 - RNA, 13 nt, Coxiella burnetii RSA 493
aauaauaugaaua

SEQ ID NO: 573362 - RNA, 23 nt, Coxiella burnetii RSA 493
aaaaauauccuuacuauucgaau

SEQ ID NO: 573363 - RNA, 22 nt, Coxiella burnetii RSA 493
aaaaauacaagcugacaauagg

SEQ ID NO: 573364 - RNA, 23 nt, Coxiella burnetii RSA 493
aagaucuccccuucuuuaauauc

SEQ ID NO: 573365 - RNA, 15 nt, Coxiella burnetii RSA 493
aagauuucuucacgg

SEQ ID NO: 573366 - RNA, 22 nt, Coxiella burnetii RSA 493
aagcaacuuuaacauuaucaug

SEQ ID NO: 573367 - RNA, 12 nt, Coxiella burnetii RSA 493
aagcaauuuuuu

SEQ ID NO: 573368 - RNA, 12 nt, Coxiella burnetii RSA 493
aagcacaaaagu

SEQ ID NO: 573369 - RNA, 15 nt, Coxiella burnetii RSA 493
aagcaccccgugaau

SEQ ID NO: 573370 - RNA, 22 nt, Coxiella burnetii RSA 493
aagcaccccgugaauaauugcc

SEQ ID NO: 573371 - RNA, 22 nt, Coxiella burnetii RSA 493
aagcaccgacgacauuaaaaau

SEQ ID NO: 573372 - RNA, 18 nt, Coxiella burnetii RSA 493
aagcagcaauuguuuguu

SEQ ID NO: 573373 - RNA, 17 nt, Coxiella burnetii RSA 493
aagcauauugcaauaau

SEQ ID NO: 573374 - RNA, 20 nt, Coxiella burnetii RSA 493
aagcauauaacugcaaauaa

SEQ ID NO: 573375 - RNA, 21 nt, Coxiella burnetii RSA 493
aagcauauaacugcaaauaau

SEQ ID NO: 573376 - RNA, 15 nt, Coxiella burnetii RSA 493
aagcagggcaguaaa

SEQ ID NO: 573377 - RNA, 17 nt, Coxiella burnetii RSA 493
aagccauaucaggagca

SEQ ID NO: 573378 - RNA, 20 nt, Coxiella burnetii RSA 493
aagccauaucaggagcaggg

SEQ ID NO: 573379 - RNA, 17 nt, Coxiella burnetii RSA 493
aagccacacaaccacug

SEQ ID NO: 573380 - RNA, 21 nt, Coxiella burnetii RSA 493
aagccaaguuuuaagaaaaac

SEQ ID NO: 573381 - RNA, 17 nt, Coxiella burnetii RSA 493
aagcauuaaaaaauaag

SEQ ID NO: 573382 - RNA, 20 nt, Coxiella burnetii RSA 493
aagcauuaaaaaauaagaaa

SEQ ID NO: 573383 - RNA, 20 nt, Coxiella burnetii RSA 493
aagcaugcugauuuucacga

SEQ ID NO: 573384 - RNA, 15 nt, Coxiella burnetii RSA 493
aaggugggcucauga

SEQ ID NO: 573385 - RNA, 21 nt, Coxiella burnetii RSA 493
aagguguuuuacguuuaaaua

SEQ ID NO: 573386 - RNA, 22 nt, Coxiella burnetii RSA 493
aaggugauucucucaaagaaac

SEQ ID NO: 573387 - RNA, 11 nt, Coxiella burnetii RSA 493
aaggucaucca

SEQ ID NO: 573388 - RNA, 19 nt, Coxiella burnetii RSA 493
aaggucauccauucuuuca

SEQ ID NO: 573389 - RNA, 18 nt, Coxiella burnetii RSA 493
aagggaucauaaucgguu

SEQ ID NO: 573390 - RNA, 14 nt, Coxiella burnetii RSA 493
aagggugagguaac

SEQ ID NO: 573391 - RNA, 19 nt, Coxiella burnetii RSA 493
aaggcgagcccauugagaa

SEQ ID NO: 573392 - RNA, 22 nt, Coxiella burnetii RSA 493
aaggcaaauguugauaauaaau

SEQ ID NO: 573393 - RNA, 19 nt, Coxiella burnetii RSA 493
aagcucgauaucuguuuua

SEQ ID NO: 573394 - RNA, 17 nt, Coxiella burnetii RSA 493
aagcguucuuaaagucu

SEQ ID NO: 573395 - RNA, 23 nt, Coxiella burnetii RSA 493
aagcguucuuaaagucuucaaaa

SEQ ID NO: 573396 - RNA, 16 nt, Coxiella burnetii RSA 493
aagccgcuauuucuag

SEQ ID NO: 573397 - RNA, 19 nt, Coxiella burnetii RSA 493
aaggagaaauugacaaaua

SEQ ID NO: 573398 - RNA, 15 nt, Coxiella burnetii RSA 493
aaggaaaauccggau

SEQ ID NO: 573399 - RNA, 11 nt, Coxiella burnetii RSA 493
aagcugauucc

SEQ ID NO: 573400 - RNA, 15 nt, Coxiella burnetii RSA 493
cggccuacuuuuucu

SEQ ID NO: 573401 - RNA, 20 nt, Coxiella burnetii RSA 493
cggcgccaucgacaucucuc

SEQ ID NO: 573402 - RNA, 18 nt, Coxiella burnetii RSA 493
cgcuaauuaacuucgcca

SEQ ID NO: 573403 - RNA, 14 nt, Coxiella burnetii RSA 493
cgcuaacgccacac

SEQ ID NO: 573404 - RNA, 14 nt, Coxiella burnetii RSA 493
cgcuaauuguucag

SEQ ID NO: 573405 - RNA, 22 nt, Coxiella burnetii RSA 493
cgcguuuuuaaaugaauuacuu

SEQ ID NO: 573406 - RNA, 19 nt, Coxiella burnetii RSA 493
cgcuaaauaacauaacgaa

SEQ ID NO: 573407 - RNA, 17 nt, Coxiella burnetii RSA 493
cgcuaacagagggagca

SEQ ID NO: 573408 - RNA, 12 nt, Coxiella burnetii RSA 493
cggaaaaggaga

SEQ ID NO: 573409 - RNA, 20 nt, Coxiella burnetii RSA 493
cggaaaaucuuguuuaagcu

SEQ ID NO: 573410 - RNA, 13 nt, Coxiella burnetii RSA 493
cgcuuuuuugcuu

SEQ ID NO: 573411 - RNA, 23 nt, Coxiella burnetii RSA 493
cgcuuugggugggugagaagaau

SEQ ID NO: 573412 - RNA, 14 nt, Coxiella burnetii RSA 493
cgcuuuuauuuccu

SEQ ID NO: 573413 - RNA, 20 nt, Coxiella burnetii RSA 493
cgcuuucaacauauuucuug

SEQ ID NO: 573414 - RNA, 21 nt, Coxiella burnetii RSA 493
cgcuuucaacauauuucuugu

SEQ ID NO: 573415 - RNA, 15 nt, Coxiella burnetii RSA 493
cgcuuuccauuuuuu

SEQ ID NO: 573416 - RNA, 23 nt, Coxiella burnetii RSA 493
cggaaauuucgauuuuacaauaa

SEQ ID NO: 573417 - RNA, 15 nt, Coxiella burnetii RSA 493
cggacauuuuuucaa

SEQ ID NO: 573418 - RNA, 14 nt, Coxiella burnetii RSA 493
cggaccugcugccc

SEQ ID NO: 573419 - RNA, 20 nt, Coxiella burnetii RSA 493
cggaauacggagaaaaugau

SEQ ID NO: 573420 - RNA, 23 nt, Coxiella burnetii RSA 493
cggaauuugauaucgaccauuaa

SEQ ID NO: 573421 - RNA, 23 nt, Coxiella burnetii RSA 493
cggaauuugugauuuuaaaaaua

SEQ ID NO: 573422 - RNA, 21 nt, Coxiella burnetii RSA 493
cggacgugaucgagaugagca

SEQ ID NO: 573423 - RNA, 15 nt, Coxiella burnetii RSA 493
cggaggaugagaggu

SEQ ID NO: 573424 - RNA, 13 nt, Coxiella burnetii RSA 493
cggauaaucacgc

SEQ ID NO: 573425 - RNA, 15 nt, Coxiella burnetii RSA 493
cggcaaacccaucuc

SEQ ID NO: 573426 - RNA, 21 nt, Coxiella burnetii RSA 493
cggauuuuuucuucugaauua

SEQ ID NO: 573427 - RNA, 13 nt, Coxiella burnetii RSA 493
cggauuguaaaca

SEQ ID NO: 573428 - RNA, 21 nt, Coxiella burnetii RSA 493
cgccuuugcugaccuuuuccu

SEQ ID NO: 573429 - RNA, 18 nt, Coxiella burnetii RSA 493
cgcgauuuucucuucaac

SEQ ID NO: 573430 - RNA, 18 nt, Coxiella burnetii RSA 493
cgcgcacgguaauaauau

SEQ ID NO: 573431 - RNA, 13 nt, Coxiella burnetii RSA 493
cgcguaaaauucc

SEQ ID NO: 573432 - RNA, 21 nt, Coxiella burnetii RSA 493
cgccccaaaguuccgcugggg

SEQ ID NO: 573433 - RNA, 17 nt, Coxiella burnetii RSA 493
cgccgauaauggggccg

SEQ ID NO: 573434 - RNA, 20 nt, Coxiella burnetii RSA 493
aaacgugccgccgaaauuua

SEQ ID NO: 573435 - RNA, 16 nt, Coxiella burnetii RSA 493
aaacguuucaucaaaa

SEQ ID NO: 573436 - RNA, 21 nt, Coxiella burnetii RSA 493
aaacguagaaguuuaaaguua

SEQ ID NO: 573437 - RNA, 19 nt, Coxiella burnetii RSA 493
aaacguauuccaaauaauc

SEQ ID NO: 573438 - RNA, 20 nt, Coxiella burnetii RSA 493
cgauuucuuuuuguguugau

SEQ ID NO: 573439 - RNA, 12 nt, Coxiella burnetii RSA 493
cgauucuuuuuc

SEQ ID NO: 573440 - RNA, 19 nt, Coxiella burnetii RSA 493
cgauguucggcgaaugcgc

SEQ ID NO: 573441 - RNA, 18 nt, Coxiella burnetii RSA 493
cgaugugaaacaugcugc

SEQ ID NO: 573442 - RNA, 16 nt, Coxiella burnetii RSA 493
cgcaaacagugccccu

SEQ ID NO: 573443 - RNA, 13 nt, Coxiella burnetii RSA 493
cgauuuuucucau

SEQ ID NO: 573444 - RNA, 20 nt, Coxiella burnetii RSA 493
cgauuuucgucguagacaau

SEQ ID NO: 573445 - RNA, 18 nt, Coxiella burnetii RSA 493
cgauuuguuucaugcuca

SEQ ID NO: 573446 - RNA, 15 nt, Coxiella burnetii RSA 493
cgauuuuacaauaau

SEQ ID NO: 573447 - RNA, 19 nt, Coxiella burnetii RSA 493
cgauauguuguuugcuuga

SEQ ID NO: 573448 - RNA, 19 nt, Coxiella burnetii RSA 493
cgauauucuaucucaaagg

SEQ ID NO: 573449 - RNA, 16 nt, Coxiella burnetii RSA 493
cgaucaacaaaauaua

SEQ ID NO: 573450 - RNA, 23 nt, Coxiella burnetii RSA 493
cgaugcgccggcguuugcacaua

SEQ ID NO: 573451 - RNA, 15 nt, Coxiella burnetii RSA 493
cgauggggauacauc

SEQ ID NO: 573452 - RNA, 19 nt, Coxiella burnetii RSA 493
cgcacgccgaauccgccgg

SEQ ID NO: 573453 - RNA, 13 nt, Coxiella burnetii RSA 493
cgcaacuuuuuuc

SEQ ID NO: 573454 - RNA, 23 nt, Coxiella burnetii RSA 493
cgcaaaguaaaaaugaaaucccg

SEQ ID NO: 573455 - RNA, 22 nt, Coxiella burnetii RSA 493
cgcagaagaaggcucuucauau

SEQ ID NO: 573456 - RNA, 21 nt, Coxiella burnetii RSA 493
aaacgggcauuggaaaaaacu

SEQ ID NO: 573457 - RNA, 21 nt, Coxiella burnetii RSA 493
aaacggggaguggaauuuuaa

SEQ ID NO: 573458 - RNA, 22 nt, Coxiella burnetii RSA 493
aaacggggaguggaauuuuaac

SEQ ID NO: 573459 - RNA, 23 nt, Coxiella burnetii RSA 493
aaacggggaguggaauuuuaaca

SEQ ID NO: 573460 - RNA, 17 nt, Coxiella burnetii RSA 493
cgcauauucgccuucuu

SEQ ID NO: 573461 - RNA, 19 nt, Coxiella burnetii RSA 493
cgcaucacgcucgagggaa

SEQ ID NO: 573462 - RNA, 17 nt, Coxiella burnetii RSA 493
cgcauagccaaccgcca

SEQ ID NO: 573463 - RNA, 21 nt, Coxiella burnetii RSA 493
cgcaucggccuuuuucauuuc

SEQ ID NO: 573464 - RNA, 23 nt, Coxiella burnetii RSA 493
cgcauugcauuucuuucaauaaa

SEQ ID NO: 573465 - RNA, 20 nt, Coxiella burnetii RSA 493
cgcauucuauuagcugccau

SEQ ID NO: 573466 - RNA, 17 nt, Coxiella burnetii RSA 493
cgccacaauuaauuuau

SEQ ID NO: 573467 - RNA, 17 nt, Coxiella burnetii RSA 493
cgacuucucuuucugag

SEQ ID NO: 573468 - RNA, 16 nt, Coxiella burnetii RSA 493
cgacuuugauaaauua

SEQ ID NO: 573469 - RNA, 13 nt, Coxiella burnetii RSA 493
cgacuuuuuucuu

SEQ ID NO: 573470 - RNA, 14 nt, Coxiella burnetii RSA 493
cgaauacgaauuuc

SEQ ID NO: 573471 - RNA, 14 nt, Coxiella burnetii RSA 493
cgacuaaaccaacg

SEQ ID NO: 573472 - RNA, 12 nt, Coxiella burnetii RSA 493
cgagcgcccauu

SEQ ID NO: 573473 - RNA, 13 nt, Coxiella burnetii RSA 493
cgaguccuauuug

SEQ ID NO: 573474 - RNA, 14 nt, Coxiella burnetii RSA 493
cgagggguuuuuuu

SEQ ID NO: 573475 - RNA, 19 nt, Coxiella burnetii RSA 493
cgauagaccaucguuuuau

SEQ ID NO: 573476 - RNA, 16 nt, Coxiella burnetii RSA 493
cgauagcgucuuuuuu

SEQ ID NO: 573477 - RNA, 19 nt, Coxiella burnetii RSA 493
cgauacagccuucaugaau

SEQ ID NO: 573478 - RNA, 15 nt, Coxiella burnetii RSA 493
cgauaaucauuaacg

SEQ ID NO: 573479 - RNA, 13 nt, Coxiella burnetii RSA 493
cgauaaaaauaau

SEQ ID NO: 573480 - RNA, 15 nt, Coxiella burnetii RSA 493
cgauaaaaauaauga

SEQ ID NO: 573481 - RNA, 14 nt, Coxiella burnetii RSA 493
cgauaaauuuugaa

SEQ ID NO: 573482 - RNA, 22 nt, Coxiella burnetii RSA 493
aaacgcugccauaguaauucau

SEQ ID NO: 573483 - RNA, 22 nt, Coxiella burnetii RSA 493
cgagcgcgcgagaagauuuuuu

SEQ ID NO: 573484 - RNA, 23 nt, Coxiella burnetii RSA 493
aaacggaugagcaaugacauugg

SEQ ID NO: 573485 - RNA, 18 nt, Coxiella burnetii RSA 493
cgaggaggguaagaauaa

SEQ ID NO: 573486 - RNA, 15 nt, Coxiella burnetii RSA 493
cgaggcaaaauaaac

SEQ ID NO: 573487 - RNA, 13 nt, Coxiella burnetii RSA 493
cgaggaaagauaa

SEQ ID NO: 573488 - RNA, 22 nt, Coxiella burnetii RSA 493
ccagcucggggacagcaaaacu

SEQ ID NO: 573489 - RNA, 18 nt, Coxiella burnetii RSA 493
ccagcuugugcaauucca

SEQ ID NO: 573490 - RNA, 15 nt, Coxiella burnetii RSA 493
ccaggcgggccuucg

SEQ ID NO: 573491 - RNA, 16 nt, Coxiella burnetii RSA 493
ccacucggaaagcauc

SEQ ID NO: 573492 - RNA, 18 nt, Coxiella burnetii RSA 493
ccacucucuuuauuuuuu

SEQ ID NO: 573493 - RNA, 19 nt, Coxiella burnetii RSA 493
ccacucucuuuauuuuuuc

SEQ ID NO: 573494 - RNA, 15 nt, Coxiella burnetii RSA 493
ccauaucguuuucac

SEQ ID NO: 573495 - RNA, 15 nt, Coxiella burnetii RSA 493
ccaguuguuuuaaau

SEQ ID NO: 573496 - RNA, 15 nt, Coxiella burnetii RSA 493
aaacaaguuaacaaa

SEQ ID NO: 573497 - RNA, 16 nt, Coxiella burnetii RSA 493
aaacaaguuaacaaaa

SEQ ID NO: 573498 - RNA, 23 nt, Coxiella burnetii RSA 493
ccaucacggggucgguaaaacgc

SEQ ID NO: 573499 - RNA, 13 nt, Coxiella burnetii RSA 493
aaacaagaauggc

SEQ ID NO: 573500 - RNA, 16 nt, Coxiella burnetii RSA 493
aaacaagacaacaaaa

SEQ ID NO: 573501 - RNA, 18 nt, Coxiella burnetii RSA 493
aaacaagacaacaaaaug

SEQ ID NO: 573502 - RNA, 22 nt, Coxiella burnetii RSA 493
cccaaaggugucaaaauuauuc

SEQ ID NO: 573503 - RNA, 14 nt, Coxiella burnetii RSA 493
cccaacaaaauggu

SEQ ID NO: 573504 - RNA, 13 nt, Coxiella burnetii RSA 493
ccauucaaugcua

SEQ ID NO: 573505 - RNA, 15 nt, Coxiella burnetii RSA 493
ccauugcuuauuaau

SEQ ID NO: 573506 - RNA, 15 nt, Coxiella burnetii RSA 493
ccauuguuuugcauc

SEQ ID NO: 573507 - RNA, 16 nt, Coxiella burnetii RSA 493
cccacguugcaauaac

SEQ ID NO: 573508 - RNA, 18 nt, Coxiella burnetii RSA 493
cccacgaugauuaaauca

SEQ ID NO: 573509 - RNA, 17 nt, Coxiella burnetii RSA 493
cccacuuguaaugugag

SEQ ID NO: 573510 - RNA, 16 nt, Coxiella burnetii RSA 493
cccacccuuguuguca

SEQ ID NO: 573511 - RNA, 16 nt, Coxiella burnetii RSA 493
ccccaauuuuuggcuu

SEQ ID NO: 573512 - RNA, 23 nt, Coxiella burnetii RSA 493
cccauucuauaaucauuuuuccu

SEQ ID NO: 573513 - RNA, 12 nt, Coxiella burnetii RSA 493
ccccaagagaac

SEQ ID NO: 573514 - RNA, 21 nt, Coxiella burnetii RSA 493
cccccaauuccucgagucguu

SEQ ID NO: 573515 - RNA, 13 nt, Coxiella burnetii RSA 493
ccccccgccgcaa

SEQ ID NO: 573516 - RNA, 13 nt, Coxiella burnetii RSA 493
cccccaaaaacua

SEQ ID NO: 573517 - RNA, 13 nt, Coxiella burnetii RSA 493
ccccauuucaaca

SEQ ID NO: 573518 - RNA, 17 nt, Coxiella burnetii RSA 493
ccccugucgauacccaa

SEQ ID NO: 573519 - RNA, 14 nt, Coxiella burnetii RSA 493
cccgagcaaagcau

SEQ ID NO: 573520 - RNA, 22 nt, Coxiella burnetii RSA 493
cccgccccauuuuuguaaauua

SEQ ID NO: 573521 - RNA, 23 nt, Coxiella burnetii RSA 493
cccgcuaauuguucagcguugau

SEQ ID NO: 573522 - RNA, 15 nt, Coxiella burnetii RSA 493
cccuuuaaugcauuu

SEQ ID NO: 573523 - RNA, 22 nt, Coxiella burnetii RSA 493
cccuuugcggcuaaugcuuuuu

SEQ ID NO: 573524 - RNA, 20 nt, Coxiella burnetii RSA 493
cccuuuucauuaagcaauuu

SEQ ID NO: 573525 - RNA, 20 nt, Coxiella burnetii RSA 493
aaacagugccccuccucuaa

SEQ ID NO: 573526 - RNA, 14 nt, Coxiella burnetii RSA 493
aaaccacaauuuua

SEQ ID NO: 573527 - RNA, 17 nt, Coxiella burnetii RSA 493
aaaccaacgaacgccaa

SEQ ID NO: 573528 - RNA, 12 nt, Coxiella burnetii RSA 493
aaaccaauacca

SEQ ID NO: 573529 - RNA, 15 nt, Coxiella burnetii RSA 493
ccgacaaagaaggcg

SEQ ID NO: 573530 - RNA, 13 nt, Coxiella burnetii RSA 493
ccgagcaaagcau

SEQ ID NO: 573531 - RNA, 17 nt, Coxiella burnetii RSA 493
ccgagucaaaaauaaaa

SEQ ID NO: 573532 - RNA, 22 nt, Coxiella burnetii RSA 493
ccgaguccguaauagucuugau

SEQ ID NO: 573533 - RNA, 16 nt, Coxiella burnetii RSA 493
ccgauaaguuuuuaac

SEQ ID NO: 573534 - RNA, 14 nt, Coxiella burnetii RSA 493
ccgcaaaguaaaaa

SEQ ID NO: 573535 - RNA, 17 nt, Coxiella burnetii RSA 493
ccgaugacaaauaaaca

SEQ ID NO: 573536 - RNA, 18 nt, Coxiella burnetii RSA 493
ccgauaauggggccgccc

SEQ ID NO: 573537 - RNA, 23 nt, Coxiella burnetii RSA 493
ccgccuuaaaacauaaaggccaa

SEQ ID NO: 573538 - RNA, 17 nt, Coxiella burnetii RSA 493
ccggaagagcagucauu

SEQ ID NO: 573539 - RNA, 15 nt, Coxiella burnetii RSA 493
ccgcuggcuuugauu

SEQ ID NO: 573540 - RNA, 13 nt, Coxiella burnetii RSA 493
ccgcugccuuuac

SEQ ID NO: 573541 - RNA, 20 nt, Coxiella burnetii RSA 493
ccggcuugcgguucaugaaa

SEQ ID NO: 573542 - RNA, 18 nt, Coxiella burnetii RSA 493
ccggcuuuuuaggucguu

SEQ ID NO: 573543 - RNA, 16 nt, Coxiella burnetii RSA 493
aaaccuauccaaaaag

SEQ ID NO: 573544 - RNA, 18 nt, Coxiella burnetii RSA 493
aaaccuauccaaaaagau

SEQ ID NO: 573545 - RNA, 16 nt, Coxiella burnetii RSA 493
aaaccuacuuuucuaa

SEQ ID NO: 573546 - RNA, 22 nt, Coxiella burnetii RSA 493
aaaccuacacguuaaauagcca

SEQ ID NO: 573547 - RNA, 23 nt, Coxiella burnetii RSA 493
aaaccuacacguuaaauagccaa

SEQ ID NO: 573548 - RNA, 21 nt, Coxiella burnetii RSA 493
aaaccuacacuuuuaaucaca

SEQ ID NO: 573549 - RNA, 19 nt, Coxiella burnetii RSA 493
aaaccuaccgagucaaaaa

SEQ ID NO: 573550 - RNA, 16 nt, Coxiella burnetii RSA 493
ccggagucacuaugau

SEQ ID NO: 573551 - RNA, 16 nt, Coxiella burnetii RSA 493
ccguaaccaaaacuau

SEQ ID NO: 573552 - RNA, 19 nt, Coxiella burnetii RSA 493
ccgguuuugauuuuugcuc

SEQ ID NO: 573553 - RNA, 20 nt, Coxiella burnetii RSA 493
ccgucaauuuaggcucaauu

SEQ ID NO: 573554 - RNA, 14 nt, Coxiella burnetii RSA 493
ccgucaauuuuuca

SEQ ID NO: 573555 - RNA, 11 nt, Coxiella burnetii RSA 493
ccguauuugca

SEQ ID NO: 573556 - RNA, 13 nt, Coxiella burnetii RSA 493
ccguaucuauuug

SEQ ID NO: 573557 - RNA, 12 nt, Coxiella burnetii RSA 493
aaaccuucaaaa

SEQ ID NO: 573558 - RNA, 17 nt, Coxiella burnetii RSA 493
aaaccuucaaaaauaaa

SEQ ID NO: 573559 - RNA, 20 nt, Coxiella burnetii RSA 493
aaaccuuuuuuuucaaaaca

SEQ ID NO: 573560 - RNA, 14 nt, Coxiella burnetii RSA 493
aaacgaaucgccuc

SEQ ID NO: 573561 - RNA, 17 nt, Coxiella burnetii RSA 493
ccgucacuucuucucca

SEQ ID NO: 573562 - RNA, 12 nt, Coxiella burnetii RSA 493
ccgucuuuuucu

SEQ ID NO: 573563 - RNA, 13 nt, Coxiella burnetii RSA 493
ccgugaauaaaga

SEQ ID NO: 573564 - RNA, 20 nt, Coxiella burnetii RSA 493
ccucaacaguaguuuaucaa

SEQ ID NO: 573565 - RNA, 16 nt, Coxiella burnetii RSA 493
ccucccauugauaaac

SEQ ID NO: 573566 - RNA, 15 nt, Coxiella burnetii RSA 493
ccucuauaaauaaca

SEQ ID NO: 573567 - RNA, 21 nt, Coxiella burnetii RSA 493
ccucuacaucuucauuuucug

SEQ ID NO: 573568 - RNA, 17 nt, Coxiella burnetii RSA 493
ccucuauauaagcuuuc

SEQ ID NO: 573569 - RNA, 20 nt, Coxiella burnetii RSA 493
ccucucgucggguauuuuca

SEQ ID NO: 573570 - RNA, 18 nt, Coxiella burnetii RSA 493
ccucugaauguuaauuau

SEQ ID NO: 573571 - RNA, 23 nt, Coxiella burnetii RSA 493
ccucugaauugaaguccuuauca

SEQ ID NO: 573572 - RNA, 19 nt, Coxiella burnetii RSA 493
ccucuuuaccccgcucccu

SEQ ID NO: 573573 - RNA, 22 nt, Coxiella burnetii RSA 493
ccucuucuaaaguacuagcauc

SEQ ID NO: 573574 - RNA, 17 nt, Coxiella burnetii RSA 493
ccugaacauuaagaaag

SEQ ID NO: 573575 - RNA, 20 nt, Coxiella burnetii RSA 493
ccugaaccuaaauuauaaau

SEQ ID NO: 573576 - RNA, 17 nt, Coxiella burnetii RSA 493
ccugaucaaguuucucc

SEQ ID NO: 573577 - RNA, 19 nt, Coxiella burnetii RSA 493
ccugcaacggucauuuguu

SEQ ID NO: 573578 - RNA, 19 nt, Coxiella burnetii RSA 493
ccuguccgauauaacaccc

SEQ ID NO: 573579 - RNA, 19 nt, Coxiella burnetii RSA 493
ccuguggcaauuaugaaaa

SEQ ID NO: 573580 - RNA, 20 nt, Coxiella burnetii RSA 493
ccuguggcaauuaugaaaac

SEQ ID NO: 573581 - RNA, 19 nt, Coxiella burnetii RSA 493
ccuguggaagguugagaag

SEQ ID NO: 573582 - RNA, 15 nt, Coxiella burnetii RSA 493
ccuguucuuuucaac

SEQ ID NO: 573583 - RNA, 17 nt, Coxiella burnetii RSA 493
ccuguucuuuuuccaug

SEQ ID NO: 573584 - RNA, 21 nt, Coxiella burnetii RSA 493
ccuuaaauaguagcuauaagc

SEQ ID NO: 573585 - RNA, 15 nt, Coxiella burnetii RSA 493
ccuuagcguaaucau

SEQ ID NO: 573586 - RNA, 19 nt, Coxiella burnetii RSA 493
ccuuagcguaaucaucaau

SEQ ID NO: 573587 - RNA, 17 nt, Coxiella burnetii RSA 493
ccuucaugaauauuuuu

SEQ ID NO: 573588 - RNA, 21 nt, Coxiella burnetii RSA 493
ccuucucaguuaaaauaauga

SEQ ID NO: 573589 - RNA, 22 nt, Coxiella burnetii RSA 493
ccuugggaucgcugauuucggg

SEQ ID NO: 573590 - RNA, 16 nt, Coxiella burnetii RSA 493
ccuugccccaugaguu

SEQ ID NO: 573591 - RNA, 11 nt, Coxiella burnetii RSA 493
ccuugcaauaa

SEQ ID NO: 573592 - RNA, 13 nt, Coxiella burnetii RSA 493
ccuuuuuguaauc

SEQ ID NO: 573593 - RNA, 15 nt, Coxiella burnetii RSA 493
ccuuuuuuuucaaaa

SEQ ID NO: 573594 - RNA, 17 nt, Coxiella burnetii RSA 493
cgaaaagaucuccuuga

SEQ ID NO: 573595 - RNA, 17 nt, Coxiella burnetii RSA 493
ccuuucuuucuucacuu

SEQ ID NO: 573596 - RNA, 16 nt, Coxiella burnetii RSA 493
ccuuggguaagugaau

SEQ ID NO: 573597 - RNA, 18 nt, Coxiella burnetii RSA 493
cgaaaccuuguuauaaau

SEQ ID NO: 573598 - RNA, 16 nt, Coxiella burnetii RSA 493
cgaaacgacgaaagag

SEQ ID NO: 573599 - RNA, 21 nt, Coxiella burnetii RSA 493
cgaaaauaccuuugcaaacau

SEQ ID NO: 573600 - RNA, 15 nt, Coxiella burnetii RSA 493
cgaaaaucgaauucc

SEQ ID NO: 573601 - RNA, 22 nt, Coxiella burnetii RSA 493
cgaaaucuaccguauuuaaucu

SEQ ID NO: 573602 - RNA, 23 nt, Coxiella burnetii RSA 493
cgaaagccaaguuuuaagaaaaa

SEQ ID NO: 573603 - RNA, 16 nt, Coxiella burnetii RSA 493
cgaaauaauucgcaca

SEQ ID NO: 573604 - RNA, 18 nt, Coxiella burnetii RSA 493
cgaaauacgggaaaacaa

SEQ ID NO: 573605 - RNA, 22 nt, Coxiella burnetii RSA 493
cgaaauugacccuuuucaauuu

SEQ ID NO: 573606 - RNA, 18 nt, Coxiella burnetii RSA 493
cgaaauuuaauaaaauua

SEQ ID NO: 573607 - RNA, 22 nt, Coxiella burnetii RSA 493
cgaaauuuguuauugcuaaaau

SEQ ID NO: 573608 - RNA, 13 nt, Coxiella burnetii RSA 493
cgaaccacuggaa

SEQ ID NO: 573609 - RNA, 23 nt, Coxiella burnetii RSA 493
cgaaggugauucucucaaagaaa

SEQ ID NO: 573610 - RNA, 14 nt, Coxiella burnetii RSA 493
cgaacggcgauacg

SEQ ID NO: 573611 - RNA, 18 nt, Coxiella burnetii RSA 493
caugcuugaccucgaagc

SEQ ID NO: 573612 - RNA, 14 nt, Coxiella burnetii RSA 493
caucuucauuuucu

SEQ ID NO: 573613 - RNA, 15 nt, Coxiella burnetii RSA 493
caucuucauuuucug

SEQ ID NO: 573614 - RNA, 16 nt, Coxiella burnetii RSA 493
caucuucauuuucugu

SEQ ID NO: 573615 - RNA, 23 nt, Coxiella burnetii RSA 493
caugcugcacgccuccagggcuu

SEQ ID NO: 573616 - RNA, 16 nt, Coxiella burnetii RSA 493
cauguaaucaauugcu

SEQ ID NO: 573617 - RNA, 18 nt, Coxiella burnetii RSA 493
cauguacguuuuuagugc

SEQ ID NO: 573618 - RNA, 20 nt, Coxiella burnetii RSA 493
caugguaaauggcuuuuuuc

SEQ ID NO: 573619 - RNA, 17 nt, Coxiella burnetii RSA 493
caugugaauacggcccc

SEQ ID NO: 573620 - RNA, 18 nt, Coxiella burnetii RSA 493
cauuaauccaguuuuuua

SEQ ID NO: 573621 - RNA, 19 nt, Coxiella burnetii RSA 493
cauuaauccaguuuuuuaa

SEQ ID NO: 573622 - RNA, 12 nt, Coxiella burnetii RSA 493
cauuacauaauu

SEQ ID NO: 573623 - RNA, 22 nt, Coxiella burnetii RSA 493
cauucagggacuuuaagcacuu

SEQ ID NO: 573624 - RNA, 20 nt, Coxiella burnetii RSA 493
cauucaauacagauuuuagu

SEQ ID NO: 573625 - RNA, 17 nt, Coxiella burnetii RSA 493
cauucaaggaauuauuu

SEQ ID NO: 573626 - RNA, 20 nt, Coxiella burnetii RSA 493
cauucaaggaauuauuuuau

SEQ ID NO: 573627 - RNA, 13 nt, Coxiella burnetii RSA 493
cauucuaauaaaa

SEQ ID NO: 573628 - RNA, 21 nt, Coxiella burnetii RSA 493
cauucgcguuuuuaaaugaau

SEQ ID NO: 573629 - RNA, 21 nt, Coxiella burnetii RSA 493
cauucgggcauacgauauaaa

SEQ ID NO: 573630 - RNA, 17 nt, Coxiella burnetii RSA 493
cauugcuuauuaauccu

SEQ ID NO: 573631 - RNA, 23 nt, Coxiella burnetii RSA 493
cauuguuucgaaauauaggcgaa

SEQ ID NO: 573632 - RNA, 18 nt, Coxiella burnetii RSA 493
cauuguuggaaauaaugg

SEQ ID NO: 573633 - RNA, 13 nt, Coxiella burnetii RSA 493
cauuguuaaucca

SEQ ID NO: 573634 - RNA, 19 nt, Coxiella burnetii RSA 493
cauugucucacaacauucc

SEQ ID NO: 573635 - RNA, 20 nt, Coxiella burnetii RSA 493
cauugucucguuagaaaagc

SEQ ID NO: 573636 - RNA, 19 nt, Coxiella burnetii RSA 493
cauuguuuucccguauuuc

SEQ ID NO: 573637 - RNA, 14 nt, Coxiella burnetii RSA 493
cauuuaacaaaaau

SEQ ID NO: 573638 - RNA, 16 nt, Coxiella burnetii RSA 493
cauuuaauaaaucaau

SEQ ID NO: 573639 - RNA, 18 nt, Coxiella burnetii RSA 493
cauugguauggucacaug

SEQ ID NO: 573640 - RNA, 17 nt, Coxiella burnetii RSA 493
cauuggucaaugucagc

SEQ ID NO: 573641 - RNA, 19 nt, Coxiella burnetii RSA 493
cauuugcggaaaaggagaa

SEQ ID NO: 573642 - RNA, 12 nt, Coxiella burnetii RSA 493
cauuuggccaaa

SEQ ID NO: 573643 - RNA, 22 nt, Coxiella burnetii RSA 493
cauuugggucuccguaauaagg

SEQ ID NO: 573644 - RNA, 15 nt, Coxiella burnetii RSA 493
cauuuggucaaggcc

SEQ ID NO: 573645 - RNA, 15 nt, Coxiella burnetii RSA 493
cauuuguucuaucaa

SEQ ID NO: 573646 - RNA, 22 nt, Coxiella burnetii RSA 493
cauuucaauauuucuugaaaaa

SEQ ID NO: 573647 - RNA, 19 nt, Coxiella burnetii RSA 493
cauuucaacgucaaaaccc

SEQ ID NO: 573648 - RNA, 18 nt, Coxiella burnetii RSA 493
cauuuauuucugcagauu

SEQ ID NO: 573649 - RNA, 14 nt, Coxiella burnetii RSA 493
cauuucccaaauga

SEQ ID NO: 573650 - RNA, 19 nt, Coxiella burnetii RSA 493
cauuucgagcgcgauuuuc

SEQ ID NO: 573651 - RNA, 23 nt, Coxiella burnetii RSA 493
cauuucgagcgcgauuuucucuu

SEQ ID NO: 573652 - RNA, 19 nt, Coxiella burnetii RSA 493
cauuucgcuuuuauuuccu

SEQ ID NO: 573653 - RNA, 16 nt, Coxiella burnetii RSA 493
cauuucggacaacaaa

SEQ ID NO: 573654 - RNA, 17 nt, Coxiella burnetii RSA 493
cauuuccgcuucaaaca

SEQ ID NO: 573655 - RNA, 21 nt, Coxiella burnetii RSA 493
ccaaaggugucaaaauuauuc

SEQ ID NO: 573656 - RNA, 13 nt, Coxiella burnetii RSA 493
ccaacaauaaaac

SEQ ID NO: 573657 - RNA, 13 nt, Coxiella burnetii RSA 493
ccaaauccgcaua

SEQ ID NO: 573658 - RNA, 20 nt, Coxiella burnetii RSA 493
ccaaauccgcauaaaaaccc

SEQ ID NO: 573659 - RNA, 14 nt, Coxiella burnetii RSA 493
ccaacgaacgccaa

SEQ ID NO: 573660 - RNA, 15 nt, Coxiella burnetii RSA 493
ccaacgguaacccuc

SEQ ID NO: 573661 - RNA, 15 nt, Coxiella burnetii RSA 493
ccaacgguauaaaau

SEQ ID NO: 573662 - RNA, 20 nt, Coxiella burnetii RSA 493
ccaacgguauaaaauuuuau

SEQ ID NO: 573663 - RNA, 21 nt, Coxiella burnetii RSA 493
ccaacgguauaaaauuuuauu

SEQ ID NO: 573664 - RNA, 22 nt, Coxiella burnetii RSA 493
ccaagucgagguugucaacaaa

SEQ ID NO: 573665 - RNA, 14 nt, Coxiella burnetii RSA 493
ccaagucgcccgua

SEQ ID NO: 573666 - RNA, 17 nt, Coxiella burnetii RSA 493
ccaagugugggaaaaau

SEQ ID NO: 573667 - RNA, 19 nt, Coxiella burnetii RSA 493
ccaagugugggaaaaauag

SEQ ID NO: 573668 - RNA, 19 nt, Coxiella burnetii RSA 493
ccaaucaauucgaaagaaa

SEQ ID NO: 573669 - RNA, 20 nt, Coxiella burnetii RSA 493
ccaaucuagcauaaucuuuu

SEQ ID NO: 573670 - RNA, 12 nt, Coxiella burnetii RSA 493
ccaauuucuaau

SEQ ID NO: 573671 - RNA, 19 nt, Coxiella burnetii RSA 493
ccaauuucuuuucuaaaua

SEQ ID NO: 573672 - RNA, 13 nt, Coxiella burnetii RSA 493
ccaauuguuugaa

SEQ ID NO: 573673 - RNA, 18 nt, Coxiella burnetii RSA 493
ccaauuguuugaaaaaau

SEQ ID NO: 573674 - RNA, 19 nt, Coxiella burnetii RSA 493
ccaauuguuugaaaaaaua

SEQ ID NO: 573675 - RNA, 21 nt, Coxiella burnetii RSA 493
ccacagccgcuuuuuauugga

SEQ ID NO: 573676 - RNA, 20 nt, Coxiella burnetii RSA 493
ccacagacucuuuuuauccg

SEQ ID NO: 573677 - RNA, 12 nt, Coxiella burnetii RSA 493
ccacuaaaacgc

SEQ ID NO: 573678 - RNA, 22 nt, Coxiella burnetii RSA 493
ccacuacuucugacaagacccc

SEQ ID NO: 573679 - RNA, 14 nt, Coxiella burnetii RSA 493
ccacggcaaauaaa

SEQ ID NO: 573680 - RNA, 18 nt, Coxiella burnetii RSA 493
cagguaguuuguuuuuua

SEQ ID NO: 573681 - RNA, 12 nt, Coxiella burnetii RSA 493
caguuaaaauaa

SEQ ID NO: 573682 - RNA, 22 nt, Coxiella burnetii RSA 493
caguuaaccaauugauuaauua

SEQ ID NO: 573683 - RNA, 23 nt, Coxiella burnetii RSA 493
caguuacguaauuauuaagccuu

SEQ ID NO: 573684 - RNA, 13 nt, Coxiella burnetii RSA 493
caguuaaaauaau

SEQ ID NO: 573685 - RNA, 24 nt, Coxiella burnetii RSA 493
caguuaaaauaaugagaugaucau

SEQ ID NO: 573686 - RNA, 18 nt, Coxiella burnetii RSA 493
caguuuugaugaaaagaa

SEQ ID NO: 573687 - RNA, 24 nt, Coxiella burnetii RSA 493
caguuuuauuuauaauuuauaaca

SEQ ID NO: 573688 - RNA, 14 nt, Coxiella burnetii RSA 493
caguuuguccuugc

SEQ ID NO: 573689 - RNA, 23 nt, Coxiella burnetii RSA 493
caguuguuagcuuuucuuuaaac

SEQ ID NO: 573690 - RNA, 16 nt, Coxiella burnetii RSA 493
caguuggcuaaaucca

SEQ ID NO: 573691 - RNA, 14 nt, Coxiella burnetii RSA 493
caguucucuauucu

SEQ ID NO: 573692 - RNA, 22 nt, Coxiella burnetii RSA 493
caguucucuauucuuaaacccu

SEQ ID NO: 573693 - RNA, 15 nt, Coxiella burnetii RSA 493
caguuccugaaacgc

SEQ ID NO: 573694 - RNA, 17 nt, Coxiella burnetii RSA 493
cauaacaaugaauuguc

SEQ ID NO: 573695 - RNA, 19 nt, Coxiella burnetii RSA 493
cauaacaauggacacuuaa

SEQ ID NO: 573696 - RNA, 21 nt, Coxiella burnetii RSA 493
cauaaaaacccauuaaguacu

SEQ ID NO: 573697 - RNA, 21 nt, Coxiella burnetii RSA 493
cauaaaauugaauauaacuuu

SEQ ID NO: 573698 - RNA, 22 nt, Coxiella burnetii RSA 493
cauaaaggcuaauaggaaaaau

SEQ ID NO: 573699 - RNA, 15 nt, Coxiella burnetii RSA 493
cauaaagguuuucuu

SEQ ID NO: 573700 - RNA, 13 nt, Coxiella burnetii RSA 493
cauaaauaaaagc

SEQ ID NO: 573701 - RNA, 12 nt, Coxiella burnetii RSA 493
cauaaauaauuc

SEQ ID NO: 573702 - RNA, 15 nt, Coxiella burnetii RSA 493
cauaaauagcauuaa

SEQ ID NO: 573703 - RNA, 21 nt, Coxiella burnetii RSA 493
cauaaucgguuauuucucgaa

SEQ ID NO: 573704 - RNA, 17 nt, Coxiella burnetii RSA 493
cauaauucguuagcauu

SEQ ID NO: 573705 - RNA, 14 nt, Coxiella burnetii RSA 493
cauaauuuuauaaa

SEQ ID NO: 573706 - RNA, 21 nt, Coxiella burnetii RSA 493
cauaauaaggcuaauuuuccu

SEQ ID NO: 573707 - RNA, 22 nt, Coxiella burnetii RSA 493
cauaaucacaaaagguaaaaaa

SEQ ID NO: 573708 - RNA, 14 nt, Coxiella burnetii RSA 493
cauaauauuuucug

SEQ ID NO: 573709 - RNA, 14 nt, Coxiella burnetii RSA 493
cauacgacuucauu

SEQ ID NO: 573710 - RNA, 16 nt, Coxiella burnetii RSA 493
cauacgacuucauuuc

SEQ ID NO: 573711 - RNA, 15 nt, Coxiella burnetii RSA 493
cauacgauauaaaag

SEQ ID NO: 573712 - RNA, 14 nt, Coxiella burnetii RSA 493
cauacagaaugaua

SEQ ID NO: 573713 - RNA, 19 nt, Coxiella burnetii RSA 493
cauacagaauuucuuugua

SEQ ID NO: 573714 - RNA, 20 nt, Coxiella burnetii RSA 493
cauauaaucgcaaaauucag

SEQ ID NO: 573715 - RNA, 17 nt, Coxiella burnetii RSA 493
cauacgggcuacucuuu

SEQ ID NO: 573716 - RNA, 15 nt, Coxiella burnetii RSA 493
cauacggacgacuua

SEQ ID NO: 573717 - RNA, 13 nt, Coxiella burnetii RSA 493
cauacguggaacg

SEQ ID NO: 573718 - RNA, 22 nt, Coxiella burnetii RSA 493
cauaucuucaacaucaacccca

SEQ ID NO: 573719 - RNA, 16 nt, Coxiella burnetii RSA 493
cauauuaauauuaaaa

SEQ ID NO: 573720 - RNA, 13 nt, Coxiella burnetii RSA 493
caucaaaauuaaa

SEQ ID NO: 573721 - RNA, 16 nt, Coxiella burnetii RSA 493
caucaaaauuaaaauc

SEQ ID NO: 573722 - RNA, 16 nt, Coxiella burnetii RSA 493
caucaaucaaaugaac

SEQ ID NO: 573723 - RNA, 16 nt, Coxiella burnetii RSA 493
caucacgauuuaaauu

SEQ ID NO: 573724 - RNA, 13 nt, Coxiella burnetii RSA 493
caucaucuucaaa

SEQ ID NO: 573725 - RNA, 23 nt, Coxiella burnetii RSA 493
caucauugaaaaccuacuuuucu

SEQ ID NO: 573726 - RNA, 17 nt, Coxiella burnetii RSA 493
caucgcaagaugaggaa

SEQ ID NO: 573727 - RNA, 18 nt, Coxiella burnetii RSA 493
caucgcgcguuuuuuuau

SEQ ID NO: 573728 - RNA, 22 nt, Coxiella burnetii RSA 493
cauccuuaaugaguucauuaau

SEQ ID NO: 573729 - RNA, 22 nt, Coxiella burnetii RSA 493
caucguuucaaacacuuguuug

SEQ ID NO: 573730 - RNA, 21 nt, Coxiella burnetii RSA 493
caucguuugauucauuaguuu

SEQ ID NO: 573731 - RNA, 22 nt, Coxiella burnetii RSA 493
caucuggaaucaaguagccaaa

SEQ ID NO: 573732 - RNA, 17 nt, Coxiella burnetii RSA 493
caucuguaauuuuucuu

SEQ ID NO: 573733 - RNA, 22 nt, Coxiella burnetii RSA 493
caucucuaaccauaacaaugaa

SEQ ID NO: 573734 - RNA, 13 nt, Coxiella burnetii RSA 493
caucuccuuuucg

SEQ ID NO: 573735 - RNA, 20 nt, Coxiella burnetii RSA 493
cacuacgaauagccaauguu

SEQ ID NO: 573736 - RNA, 16 nt, Coxiella burnetii RSA 493
cacuaacguuacuccg

SEQ ID NO: 573737 - RNA, 21 nt, Coxiella burnetii RSA 493
cacuaaggugggcucaugaaa

SEQ ID NO: 573738 - RNA, 15 nt, Coxiella burnetii RSA 493
aaaauaguuugaugu

SEQ ID NO: 573739 - RNA, 19 nt, Coxiella burnetii RSA 493
cacguuaaauagccaacuu

SEQ ID NO: 573740 - RNA, 21 nt, Coxiella burnetii RSA 493
cacuauauacuccccuacuuu

SEQ ID NO: 573741 - RNA, 18 nt, Coxiella burnetii RSA 493
cacugucccuugcauuuc

SEQ ID NO: 573742 - RNA, 21 nt, Coxiella burnetii RSA 493
cacuguccucuguccucugcc

SEQ ID NO: 573743 - RNA, 19 nt, Coxiella burnetii RSA 493
cacuuaacuccuucgcuuu

SEQ ID NO: 573744 - RNA, 13 nt, Coxiella burnetii RSA 493
cacuucuuccaug

SEQ ID NO: 573745 - RNA, 18 nt, Coxiella burnetii RSA 493
aaaauaugauaaggaggc

SEQ ID NO: 573746 - RNA, 21 nt, Coxiella burnetii RSA 493
aaaauauuaucccgaaaaccc

SEQ ID NO: 573747 - RNA, 19 nt, Coxiella burnetii RSA 493
cacuuguccuucuucuaag

SEQ ID NO: 573748 - RNA, 21 nt, Coxiella burnetii RSA 493
cagaaaaaguaucacggcccc

SEQ ID NO: 573749 - RNA, 13 nt, Coxiella burnetii RSA 493
cagaaaacagccu

SEQ ID NO: 573750 - RNA, 15 nt, Coxiella burnetii RSA 493
cacuuuucuggcugu

SEQ ID NO: 573751 - RNA, 19 nt, Coxiella burnetii RSA 493
cagaagaaggcucuucaua

SEQ ID NO: 573752 - RNA, 20 nt, Coxiella burnetii RSA 493
cagaagaaggcucuucauau

SEQ ID NO: 573753 - RNA, 14 nt, Coxiella burnetii RSA 493
cagaaugcugauaa

SEQ ID NO: 573754 - RNA, 15 nt, Coxiella burnetii RSA 493
cagaaugcugauaau

SEQ ID NO: 573755 - RNA, 21 nt, Coxiella burnetii RSA 493
cagaaugcugauaauugaaug

SEQ ID NO: 573756 - RNA, 21 nt, Coxiella burnetii RSA 493
cagaaugcuuuuuuauaaggu

SEQ ID NO: 573757 - RNA, 18 nt, Coxiella burnetii RSA 493
cagacccgcauucuuuua

SEQ ID NO: 573758 - RNA, 19 nt, Coxiella burnetii RSA 493
cagagauuuuuuucuuaaa

SEQ ID NO: 573759 - RNA, 23 nt, Coxiella burnetii RSA 493
cagagauuuuuuucuuaaaauac

SEQ ID NO: 573760 - RNA, 15 nt, Coxiella burnetii RSA 493
cagauaaugaccuua

SEQ ID NO: 573761 - RNA, 19 nt, Coxiella burnetii RSA 493
cagauaaaucaaacgguua

SEQ ID NO: 573762 - RNA, 13 nt, Coxiella burnetii RSA 493
cagauacacauaa

SEQ ID NO: 573763 - RNA, 18 nt, Coxiella burnetii RSA 493
cagauacuguacuggaau

SEQ ID NO: 573764 - RNA, 21 nt, Coxiella burnetii RSA 493
aaaaucgauggaagaacauuu

SEQ ID NO: 573765 - RNA, 22 nt, Coxiella burnetii RSA 493
aaaaucgauggaagaacauuug

SEQ ID NO: 573766 - RNA, 18 nt, Coxiella burnetii RSA 493
aaaauccugucugccgca

SEQ ID NO: 573767 - RNA, 17 nt, Coxiella burnetii RSA 493
aaaaucccuuuuaauuu

SEQ ID NO: 573768 - RNA, 16 nt, Coxiella burnetii RSA 493
cagcaauaucagaaac

SEQ ID NO: 573769 - RNA, 21 nt, Coxiella burnetii RSA 493
cagcaauaucagaaaccguuu

SEQ ID NO: 573770 - RNA, 16 nt, Coxiella burnetii RSA 493
cagcaaguugcagagu

SEQ ID NO: 573771 - RNA, 20 nt, Coxiella burnetii RSA 493
aaaaugagggggagccugua

SEQ ID NO: 573772 - RNA, 13 nt, Coxiella burnetii RSA 493
aaaaugaguuguc

SEQ ID NO: 573773 - RNA, 13 nt, Coxiella burnetii RSA 493
cagcucuuucaau

SEQ ID NO: 573774 - RNA, 22 nt, Coxiella burnetii RSA 493
cagcuucgugcaauuucuggcu

SEQ ID NO: 573775 - RNA, 14 nt, Coxiella burnetii RSA 493
cagcuugugcaauu

SEQ ID NO: 573776 - RNA, 22 nt, Coxiella burnetii RSA 493
cagcuugugcaauuccauuaaa

SEQ ID NO: 573777 - RNA, 13 nt, Coxiella burnetii RSA 493
caggaaagaaaau

SEQ ID NO: 573778 - RNA, 21 nt, Coxiella burnetii RSA 493
caggagggugcgauuaaaagu

SEQ ID NO: 573779 - RNA, 18 nt, Coxiella burnetii RSA 493
aaaauuuauucuaacuuu

SEQ ID NO: 573780 - RNA, 19 nt, Coxiella burnetii RSA 493
aaaauuuauucuaacuuug

SEQ ID NO: 573781 - RNA, 17 nt, Coxiella burnetii RSA 493
aaaauuucauuuaauaa

SEQ ID NO: 573782 - RNA, 15 nt, Coxiella burnetii RSA 493
caggacaaaccuggc

SEQ ID NO: 573783 - RNA, 16 nt, Coxiella burnetii RSA 493
caggauuuucauuaau

SEQ ID NO: 573784 - RNA, 13 nt, Coxiella burnetii RSA 493
caggcagaugauu

SEQ ID NO: 573785 - RNA, 16 nt, Coxiella burnetii RSA 493
caggcagaugauuaaa

SEQ ID NO: 573786 - RNA, 12 nt, Coxiella burnetii RSA 493
aaacaaaauaau

SEQ ID NO: 573787 - RNA, 16 nt, Coxiella burnetii RSA 493
aaacaaaauaauaaug

SEQ ID NO: 573788 - RNA, 15 nt, Coxiella burnetii RSA 493
aaacaaacaaaaaau

SEQ ID NO: 573789 - RNA, 21 nt, Coxiella burnetii RSA 493
cagccuuuaguuuuauuugaa

SEQ ID NO: 573790 - RNA, 23 nt, Coxiella burnetii RSA 493
cagcgagagaauuaaaaauauuu

SEQ ID NO: 573791 - RNA, 15 nt, Coxiella burnetii RSA 493
cagcgauuuauuucu

SEQ ID NO: 573792 - RNA, 22 nt, Coxiella burnetii RSA 493
cagcgaugaaaaaguucuaagc

SEQ ID NO: 573793 - RNA, 19 nt, Coxiella burnetii RSA 493
cagcccaaccuacgggcua

SEQ ID NO: 573794 - RNA, 14 nt, Coxiella burnetii RSA 493
cagccaauuuauuu

SEQ ID NO: 573795 - RNA, 22 nt, Coxiella burnetii RSA 493
aaaauuauucggauucucucgc

SEQ ID NO: 573796 - RNA, 13 nt, Coxiella burnetii RSA 493
aaaauuacugaaa

SEQ ID NO: 573797 - RNA, 21 nt, Coxiella burnetii RSA 493
aaaauucgcuccucaauuucc

SEQ ID NO: 573798 - RNA, 15 nt, Human
uuaauaauuuuuaau

SEQ ID NO: 573799 - RNA, 19 nt, Human
uuacaaaugggaaacaaaa

SEQ ID NO: 573800 - RNA, 18 nt, Human
uuaaaguaacccuacaaa

SEQ ID NO: 573801 - RNA, 18 nt, Human
ugaguuuaaauuguaaua

SEQ ID NO: 573802 - RNA, 16 nt, Human
ugcaagccagauuuuc

SEQ ID NO: 573803 - RNA, 14 nt, Human
ugcuugauuguaug

SEQ ID NO: 573804 - RNA, 19 nt, Human
guuuuuuuuuaaaaaagaa

SEQ ID NO: 573805 - RNA, 15 nt, Human
uaacuaauuuuaacu

SEQ ID NO: 573806 - RNA, 20 nt, Human
uaacaaugcuguauuuuaaa

SEQ ID NO: 573807 - RNA, 15 nt, Human
guuuaugauuccacc

SEQ ID NO: 573808 - RNA, 18 nt, Human
gcucuaaacauguuuauc

SEQ ID NO: 573809 - RNA, 23 nt, Human
gcuaaaacaagcacuaaacaaag

SEQ ID NO: 573810 - RNA, 12 nt, Human
gcgacagugaga

SEQ ID NO: 573811 - RNA, 13 nt, Human
ccucaccccuugc

SEQ ID NO: 573812 - RNA, 21 nt, Human
ccucaguuuuugugaaaagcu

SEQ ID NO: 573813 - RNA, 14 nt, Human
cccugccccccagc

SEQ ID NO: 573814 - RNA, 12 nt, Human
cgagaaaacaau

SEQ ID NO: 573815 - RNA, 13 nt, Human
cgagaaaacaaua

SEQ ID NO: 573816 - RNA, 17 nt, Human
uuaaaauaugcucuaaa

SEQ ID NO: 573817 - RNA, 22 nt, Human
uuaaccaggggccaugaaucac

SEQ ID NO: 573818 - RNA, 18 nt, Human
uuagugaaauauuauuuu

SEQ ID NO: 573819 - RNA, 14 nt, Human
uuauagcuacuaau

SEQ ID NO: 573820 - RNA, 13 nt, Human
uucagauaaucac

SEQ ID NO: 573821 - RNA, 20 nt, Human
cugauuuguaacaagccucc

SEQ ID NO: 573822 - RNA, 12 nt, Human
cgggagccugau

SEQ ID NO: 573823 - RNA, 22 nt, Human
cgcaaugugacuuaaugccacu

SEQ ID NO: 573824 - RNA, 17 nt, Human
gaaaacaaggaugaauu

SEQ ID NO: 573825 - RNA, 22 nt, Human
gaagaagcaccaaucaugaauu

SEQ ID NO: 573826 - RNA, 18 nt, Human
gaaccacaagacugcaca

SEQ ID NO: 573827 - RNA, 13 nt, Human
gacagggaggacg

SEQ ID NO: 573828 - RNA, 14 nt, Human
gacucuuaagaaga

SEQ ID NO: 573829 - RNA, 16 nt, Human
cuguaauggaagcauc

SEQ ID NO: 573830 - RNA, 15 nt, Human
cuggccuucggccuc

SEQ ID NO: 573831 - RNA, 18 nt, Human
cuucacuguaaaauaaua

SEQ ID NO: 573832 - RNA, 18 nt, Human
cuuacuaguuucccuugc

SEQ ID NO: 573833 - RNA, 15 nt, Human
cuuguacuuuauuuu

SEQ ID NO: 573834 - RNA, 18 nt, Human
cuuguauuccuuuuucuc

SEQ ID NO: 573835 - RNA, 19 nt, Human
cuugccaaauauaaauaaa

SEQ ID NO: 573836 - RNA, 18 nt, Human
cuugagguaaaagcauca

SEQ ID NO: 573837 - RNA, 18 nt, Human
gcauagguuuaauaauuu

SEQ ID NO: 573838 - RNA, 18 nt, Human
gcacuaguauuucuauga

SEQ ID NO: 573839 - RNA, 15 nt, Human
gccacuaaauugaca

SEQ ID NO: 573840 - RNA, 16 nt, Human
gccccaguuguuucua

SEQ ID NO: 573841 - RNA, 19 nt, Human
gaggcauuuaggccauggg

SEQ ID NO: 573842 - RNA, 22 nt, Human
aaaugcauuucuaaagccauug

SEQ ID NO: 573843 - RNA, 14 nt, Human
aaaugggaaacaaa

SEQ ID NO: 573844 - RNA, 13 nt, Human
aacuucagacaua

SEQ ID NO: 573845 - RNA, 14 nt, Human
aagacaaggaaaaa

SEQ ID NO: 573846 - RNA, 21 nt, Human
aaguucugcagauaaacagua

SEQ ID NO: 573847 - RNA, 16 nt, Human
aaggcugauuaaacca

SEQ ID NO: 573848 - RNA, 12 nt, Human
aagcugaaaugg

SEQ ID NO: 573849 - RNA, 23 nt, Human
aagcuccauuuuuagugaaauau

SEQ ID NO: 573850 - RNA, 15 nt, Human
acaaaugggaaacaa

SEQ ID NO: 573851 - RNA, 17 nt, Human
aaauuuacagagacaga

SEQ ID NO: 573852 - RNA, 18 nt, Human
aacgaggauugggaaaaa

SEQ ID NO: 573853 - RNA, 17 nt, Human
aacgauaaaagacagug

SEQ ID NO: 573854 - RNA, 15 nt, Human
aacggggugaaaccc

SEQ ID NO: 573855 - RNA, 15 nt, Human
agugaaagaaaauaa

SEQ ID NO: 573856 - RNA, 16 nt, Human
agcaaaauuuuuucuc

SEQ ID NO: 573857 - RNA, 15 nt, Human
caauucuugccaaau

SEQ ID NO: 573858 - RNA, 18 nt, Human
caaccuggaguugaaaau

SEQ ID NO: 573859 - RNA, 14 nt, Human
auggcuaguaucaa

SEQ ID NO: 573860 - RNA, 19 nt, Human
augggacagggaggacgcu

SEQ ID NO: 573861 - RNA, 13 nt, Human
caggaaccacaag

SEQ ID NO: 573862 - RNA, 13 nt, Human
cauuuaggccaug

SEQ ID NO: 573863 - RNA, 20 nt, Human
cauuucuugagguaaaagca

SEQ ID NO: 573864 - RNA, 21 nt, Human
caugauguuuagaaacacaac

SEQ ID NO: 573865 - RNA, 14 nt, Human
ccgucccccucugg

SEQ ID NO: 573866 - RNA, 14 nt, Human
ccuugcaugguuua

SEQ ID NO: 573867 - RNA, 19 nt, Human
gaguuuagcuggaaaagua

SEQ ID NO: 573868 - RNA, 17 nt, Human
gccuccuuuuaaaguaa

SEQ ID NO: 573869 - RNA, 18 nt, Human
gcuuauugucuagugaaa

SEQ ID NO: 573870 - RNA, 15 nt, Human
gcuucuguuuuauaa

SEQ ID NO: 573871 - RNA, 13 nt, Human
ggaaaaaauaaca

SEQ ID NO: 573872 - RNA, 15 nt, Human
ggaaaaaauaacaau

SEQ ID NO: 573873 - RNA, 16 nt, Human
ggaaaaaauaacaaug

SEQ ID NO: 573874 - RNA, 20 nt, Human
ggaauaauccuaaacauaug

SEQ ID NO: 573875 - RNA, 17 nt, Human
cuacuaauuuuaaaaug

SEQ ID NO: 573876 - RNA, 17 nt, Human
cuagaacucccuuucaa

SEQ ID NO: 573877 - RNA, 19 nt, Human
cuucucacauuuauauuuu

SEQ ID NO: 573878 - RNA, 23 nt, Human
cuugccaaauauaaauaaaaaua

SEQ ID NO: 573879 - RNA, 18 nt, Human
cuucagcgguuuauauaa

SEQ ID NO: 573880 - RNA, 17 nt, Human
cugucuacacuaagaga

SEQ ID NO: 573881 - RNA, 16 nt, Human
cuuauaauuuaaaaua

SEQ ID NO: 573882 - RNA, 15 nt, Human
cuuaaaaaugguuua

SEQ ID NO: 573883 - RNA, 14 nt, Human
uccaaacugacucu

SEQ ID NO: 573884 - RNA, 19 nt, Human
uccaagagccuuuuuuuga

SEQ ID NO: 573885 - RNA, 16 nt, Human
uaaaacaagcacuaaa

SEQ ID NO: 573886 - RNA, 12 nt, Human
guuguauuauuu

SEQ ID NO: 573887 - RNA, 16 nt, Human
guauccuucagccuga

SEQ ID NO: 573888 - RNA, 18 nt, Human
ugacaagcucacagaccu

SEQ ID NO: 573889 - RNA, 17 nt, Human
ugaaaguugauaaguac

SEQ ID NO: 573890 - RNA, 13 nt, Human
ugaauuaguuuua

SEQ ID NO: 573891 - RNA, 19 nt, Human
ugcuacaggauuugaaauu

SEQ ID NO: 573892 - RNA, 17 nt, Human
ugagaugggagaaucac

SEQ ID NO: 573893 - RNA, 14 nt, Human
uccuugaagauuua

SEQ ID NO: 573894 - RNA, 15 nt, Human
ugaaagaaaauaacg

SEQ ID NO: 573895 - RNA, 15 nt, Human
ugaaagaaaauaaca

SEQ ID NO: 573896 - RNA, 15 nt, Human
uggaaaggcagcucu

SEQ ID NO: 573897 - RNA, 17 nt, Human
uuucuauaauuuaaaua

SEQ ID NO: 573898 - RNA, 13 nt, Human
uuucuaugaaaua

SEQ ID NO: 573899 - RNA, 15 nt, Human
ugaaagguacuucaa

SEQ ID NO: 573900 - RNA, 22 nt, Human
ucucacauuuauauuuuuguga

SEQ ID NO: 573901 - RNA, 16 nt, Human
ucugugagaugcuaga

SEQ ID NO: 573902 - RNA, 20 nt, Human
uucaauaucuuuuuuuuaau

SEQ ID NO: 573903 - RNA, 18 nt, Human
uugaguuuaaauuguaau

SEQ ID NO: 573904 - RNA, 21 nt, Human
gcuguauacugugugcuaaaa

SEQ ID NO: 573905 - RNA, 17 nt, Human
gcuguauuuuaaaagaa

SEQ ID NO: 573906 - RNA, 18 nt, Human
gugaaagaaaauaacaau

SEQ ID NO: 573907 - RNA, 14 nt, Human
guguuggagaagaa

SEQ ID NO: 573908 - RNA, 17 nt, Human
aaacaauaacgauaaaa

SEQ ID NO: 573909 - RNA, 22 nt, Human
acagugaaagaaaauaacaaua

SEQ ID NO: 573910 - RNA, 22 nt, Human
accaaccuggaguugaaaaucu

SEQ ID NO: 573911 - RNA, 14 nt, Human
acaaggaaaaaaua

SEQ ID NO: 573912 - RNA, 15 nt, Human
aauuguauuacaaau

SEQ ID NO: 573913 - RNA, 15 nt, Human
aauccaaugaaauga

SEQ ID NO: 573914 - RNA, 21 nt, Human
aauccuacuuucauaauaagu

SEQ ID NO: 573915 - RNA, 18 nt, Human
aauauuuauuuuaauaau

SEQ ID NO: 573916 - RNA, 20 nt, Human
aaagcagggacuugaaccca

SEQ ID NO: 573917 - RNA, 14 nt, Human
aaaauccauacauu

SEQ ID NO: 573918 - RNA, 19 nt, Human
aaaagaaugauuaugaauu

SEQ ID NO: 573919 - RNA, 19 nt, Human
aaucuuauaauuuaaaaua

SEQ ID NO: 573920 - RNA, 17 nt, Human
aauaggcguaacuaauu

SEQ ID NO: 573921 - RNA, 20 nt, Human
agaauaccacaggaaccaca

SEQ ID NO: 573922 - RNA, 17 nt, Human
agaaaauaacgauaaaa

SEQ ID NO: 573923 - RNA, 11 nt, Human
acgagaaaaca

SEQ ID NO: 573924 - RNA, 12 nt, Human
acgagaaaacaa

SEQ ID NO: 573925 - RNA, 14 nt, Human
acgagaaaacaaua

SEQ ID NO: 573926 - RNA, 17 nt, Human
acuuauaggaauugacc

SEQ ID NO: 573927 - RNA, 19 nt, Human
accacugcagaagacagua

SEQ ID NO: 573928 - RNA, 23 nt, Human
acaggacagcccuucuuuccaca

SEQ ID NO: 573929 - RNA, 15 nt, Human
acagugaaagaaaau

SEQ ID NO: 573930 - RNA, 15 nt, Human
auaauccuaaacaua

SEQ ID NO: 573931 - RNA, 16 nt, Human
auaaucuuucacaggg

SEQ ID NO: 573932 - RNA, 13 nt, Human
auaaauaaaaaua

SEQ ID NO: 573933 - RNA, 13 nt, Human
aggauugggaaaa

SEQ ID NO: 573934 - RNA, 12 nt, Human
agcuuuuuuuga

SEQ ID NO: 573935 - RNA, 19 nt, Human
auccugaggcuccacuugg

SEQ ID NO: 573936 - RNA, 15 nt, Human
auuacuguaagaaaa

SEQ ID NO: 573937 - RNA, 12 nt, Human
caaaugggaaac

SEQ ID NO: 573938 - RNA, 22 nt, Human
auuuguauaaaauaauuuuuau

SEQ ID NO: 573939 - RNA, 17 nt, Human
caaagagugaaggauuu

SEQ ID NO: 573940 - RNA, 23 nt, Human
auuuuggcaagcucuaucaccaa

SEQ ID NO: 573941 - RNA, 21 nt, Human
cauacuaauuauacccccugc

SEQ ID NO: 573942 - RNA, 21 nt, Human
caguuaccucugccucagaaa

SEQ ID NO: 573943 - RNA, 16 nt, Human
gaaaauaacgauaaaa

SEQ ID NO: 573944 - RNA, 22 nt, Human
gaaaaucuacacuccagugaga

SEQ ID NO: 573945 - RNA, 18 nt, Human
cuuucacauuuaaauaaa

SEQ ID NO: 573946 - RNA, 15 nt, Human
gaaagagaacuucca

SEQ ID NO: 573947 - RNA, 21 nt, Human
gaaagugacaagcucacagac

SEQ ID NO: 573948 - RNA, 16 nt, Human
gcaaauugucacagga

SEQ ID NO: 573949 - RNA, 17 nt, Human
gagcaugggaagugacg

SEQ ID NO: 573950 - RNA, 21 nt, Human
gcaucacaugaacuuguaaag

SEQ ID NO: 573951 - RNA, 22 nt, Human
gccaaauauaaauaaaaauaau

SEQ ID NO: 573952 - RNA, 18 nt, Human
gcagagguugcagugagc

SEQ ID NO: 573953 - RNA, 22 nt, Human
gugccccugcacuccagccuga

SEQ ID NO: 573954 - RNA, 15 nt, Human
ggcguaacuaauuuu

SEQ ID NO: 573955 - RNA, 20 nt, Human
gccuucggccuccauccuga

SEQ ID NO: 573956 - RNA, 11 nt, Human
gcuaaaacaag

SEQ ID NO: 573957 - RNA, 16 nt, Human
ucuaaaugucaaucag

SEQ ID NO: 573958 - RNA, 14 nt, Human
uagcuacuaauuuu

SEQ ID NO: 573959 - RNA, 13 nt, Human
uagaacucccuuu

SEQ ID NO: 573960 - RNA, 14 nt, Human
uacauuuguauaaa

SEQ ID NO: 573961 - RNA, 20 nt, Human
guuaugauuaaguaaugaua

SEQ ID NO: 573962 - RNA, 13 nt, Human
uuuuagugaaaua

SEQ ID NO: 573963 - RNA, 16 nt, Human
ugccaaauauaaauaa

SEQ ID NO: 573964 - RNA, 16 nt, Human
ugcagcucaugaguaa

SEQ ID NO: 573965 - RNA, 20 nt, Human
uuggugaacuugguuuuaau

SEQ ID NO: 573966 - RNA, 15 nt, Human
uuucacauuuaaaua

SEQ ID NO: 573967 - RNA, 15 nt, Human
uuuauauuugaaaua

SEQ ID NO: 573968 - RNA, 18 nt, Human
uuguuauguauauuuuau

SEQ ID NO: 573969 - RNA, 12 nt, Human
agguauuuuaau

SEQ ID NO: 573970 - RNA, 20 nt, Human
agcuacuaauuuuaaaaugu

SEQ ID NO: 573971 - RNA, 22 nt, Human
auuacauuuguauaaaauaauu

SEQ ID NO: 573972 - RNA, 18 nt, Human
augauguuuagaaacaca

SEQ ID NO: 573973 - RNA, 15 nt, Human
augcuguauuuuaaa

SEQ ID NO: 573974 - RNA, 14 nt, Human
auagguuuaauaau

SEQ ID NO: 573975 - RNA, 21 nt, Human
auagguuuaauaauuuuuaau

SEQ ID NO: 573976 - RNA, 17 nt, Human
auagugaggcaucgcaa

SEQ ID NO: 573977 - RNA, 16 nt, Human
auaagccagacaucaa

SEQ ID NO: 573978 - RNA, 20 nt, Human
aguugauaugccuuuuccca

SEQ ID NO: 573979 - RNA, 19 nt, Human
auauuggacaguaaaaucc

SEQ ID NO: 573980 - RNA, 23 nt, Human
auuugaaauauugacuuuuuaug

SEQ ID NO: 573981 - RNA, 16 nt, Human
auuucuaugaaauauu

SEQ ID NO: 573982 - RNA, 12 nt, Human
auuuauuuuaau

SEQ ID NO: 573983 - RNA, 17 nt, Human
auuuuaaaagaaugauu

SEQ ID NO: 573984 - RNA, 23 nt, Human
auuuuauagcuacuaauuuuaaa

SEQ ID NO: 573985 - RNA, 18 nt, Human
auuuucuauaauuuaaau

SEQ ID NO: 573986 - RNA, 19 nt, Human
cacuaguauuucuaugaaa

SEQ ID NO: 573987 - RNA, 20 nt, Human
cagagaugaggccgccaugu

SEQ ID NO: 573988 - RNA, 14 nt, Human
caauaacgauaaaa

SEQ ID NO: 573989 - RNA, 13 nt, Human
caugagguacuga

SEQ ID NO: 573990 - RNA, 20 nt, Human
caugauccugcaauuccacu

SEQ ID NO: 573991 - RNA, 21 nt, Human
caugaacuuguaaaggaauuu

SEQ ID NO: 573992 - RNA, 20 nt, Human
cagugauuaccagggacuga

SEQ ID NO: 573993 - RNA, 20 nt, Human
caguuuuugugaaaagcucc

SEQ ID NO: 573994 - RNA, 17 nt, Human
cuacacuccagugagac

SEQ ID NO: 573995 - RNA, 16 nt, Human
uugucaauaaaaucca

SEQ ID NO: 573996 - RNA, 14 nt, Human
accacaagacugca

SEQ ID NO: 573997 - RNA, 20 nt, Human
uauaugcuaagucuuauaua

SEQ ID NO: 573998 - RNA, 15 nt, Human
cagugaaagaaaaua

SEQ ID NO: 573999 - RNA, 21 nt, Human
ccccugcaaagcccagcuuga

SEQ ID NO: 574000 - RNA, 16 nt, Human
caggcugagccucagu

SEQ ID NO: 574001 - RNA, 14 nt, Human
ucaaugcagccccc

SEQ ID NO: 574002 - RNA, 23 nt, Human
cacaagaaaugaaagcagggacu

SEQ ID NO: 574003 - RNA, 14 nt, Human
uaugaauuacauuu

SEQ ID NO: 574004 - RNA, 20 nt, Human
gagccugaucaccugcccug

SEQ ID NO: 574005 - RNA, 20 nt, Human
ugauuauaugucacuuugcu

SEQ ID NO: 574006 - RNA, 20 nt, Human
auuuucaguuauuauauuua

SEQ ID NO: 574007 - RNA, 23 nt, Human
aagagccuuuuuuugaaaaaaag

SEQ ID NO: 574008 - RNA, 19 nt, Human
auaaaagacaaggaaaaaa

SEQ ID NO: 574009 - RNA, 20 nt, Human
cugcacacagcacgggggcc

SEQ ID NO: 574010 - RNA, 17 nt, Human
ccaaaagguauuuuaau

SEQ ID NO: 574011 - RNA, 18 nt, Human
agcugcucaauaaaguac

SEQ ID NO: 574012 - RNA, 19 nt, Human
agagccuuuuuuugaaaaa

SEQ ID NO: 574013 - RNA, 14 nt, Human
cacuuauaggaauu

SEQ ID NO: 574014 - RNA, 12 nt, Human
cuacaagacaca

SEQ ID NO: 574015 - RNA, 16 nt, Human
accucugccucagaaa

SEQ ID NO: 574016 - RNA, 18 nt, Human
cuuuccacagaagcucca

SEQ ID NO: 574017 - RNA, 23 nt, Human
auaucuuuuuuuuaauaaaccau

SEQ ID NO: 574018 - RNA, 14 nt, Human
ccuuaucaaaggac

SEQ ID NO: 574019 - RNA, 13 nt, Human
caccaaggagcca

SEQ ID NO: 574020 - RNA, 15 nt, Human
aaaagacaaggaaaa

SEQ ID NO: 574021 - RNA, 22 nt, Human
aggcuccacuuggucugugaga

SEQ ID NO: 574022 - RNA, 18 nt, Human
cccacuagacccacugga

SEQ ID NO: 574023 - RNA, 13 nt, Human
uguauauuuuaua

SEQ ID NO: 574024 - RNA, 15 nt, Human
gauccugcaauucca

SEQ ID NO: 574025 - RNA, 17 nt, Human
uccagcuggccgggagc

SEQ ID NO: 574026 - RNA, 21 nt, Human
aauaauguuucaaacauauau

SEQ ID NO: 574027 - RNA, 16 nt, Human
uucucuaggaaauauu

SEQ ID NO: 574028 - RNA, 23 nt, Human
auuauauggcuugaguuuaaauu

SEQ ID NO: 574029 - RNA, 17 nt, Human
guguccccuauccuacu

SEQ ID NO: 574030 - RNA, 20 nt, Human
ucaaaacuucagacauagaa

SEQ ID NO: 574031 - RNA, 12 nt, Human
ccaggcugagcc

SEQ ID NO: 574032 - RNA, 13 nt, Human
cuaugaaauauua

SEQ ID NO: 574033 - RNA, 15 nt, Human
uccaagccucauguc

SEQ ID NO: 574034 - RNA, 14 nt, Human
uaguuucccuugca

SEQ ID NO: 574035 - RNA, 19 nt, Human
cagaaagcagaacagugau

SEQ ID NO: 574036 - RNA, 14 nt, Human
ccuugaugaagaag

SEQ ID NO: 574037 - RNA, 19 nt, Human
uauacugugugcuaaaaca

SEQ ID NO: 574038 - RNA, 22 nt, Human
aagacccaaaaggcagaagcaa

SEQ ID NO: 574039 - RNA, 12 nt, Human
acucccugcccc

SEQ ID NO: 574040 - RNA, 17 nt, Human
ugaaaaucuuauaauuu

SEQ ID NO: 574041 - RNA, 22 nt, Human
acagauuugagcucagcccugg

SEQ ID NO: 574042 - RNA, 16 nt, Human
aaauaguuuaugauuc

SEQ ID NO: 574043 - RNA, 22 nt, Human
gaaaacaauaacgauaaaagac

SEQ ID NO: 574044 - RNA, 19 nt, Human
ggaaaaaauaacaaugaaa

SEQ ID NO: 574045 - RNA, 17 nt, Human
gccugagcgacagugag

SEQ ID NO: 574046 - RNA, 21 nt, Human
aagacucgggauuaguacaca

SEQ ID NO: 574047 - RNA, 19 nt, Human
cugagccucagucucccuc

SEQ ID NO: 574048 - RNA, 12 nt, Human
aaaagaaagaaa

SEQ ID NO: 574049 - RNA, 18 nt, Human
aaguugauaugccuuuuc

SEQ ID NO: 574050 - RNA, 23 nt, Human
auuucugagcauuuaauauggau

SEQ ID NO: 574051 - RNA, 21 nt, Human
caauuuuguuauguauauuuu

SEQ ID NO: 574052 - RNA, 12 nt, Human
uuuuuuuuaaaa

SEQ ID NO: 574053 - RNA, 22 nt, Human
ugggcacuguggguagacacac

SEQ ID NO: 574054 - RNA, 17 nt, Human
cucagucucccucccuu

SEQ ID NO: 574055 - RNA, 14 nt, Human
cccugccccccagc

SEQ ID NO: 574056 - RNA, 22 nt, Human
caagcacuaaacaaagagugaa

SEQ ID NO: 574057 - RNA, 14 nt, Human
aacgauaaaagaca

SEQ ID NO: 574058 - RNA, 18 nt, Human
acugugugcuaaaacaag

SEQ ID NO: 574059 - RNA, 17 nt, Human
cucuuuugggauuuuug

SEQ ID NO: 574060 - RNA, 22 nt, Human
uguucugauauuggacaguaaa

SEQ ID NO: 574061 - RNA, 19 nt, Human
ugaaauuguauuacaaauc

SEQ ID NO: 574062 - RNA, 21 nt, Human
accaaggagccaaacauccua

SEQ ID NO: 574063 - RNA, 21 nt, Human
caagacugcacaucaaaauau

SEQ ID NO: 574064 - RNA, 18 nt, Human
uacuuuauuuucuauaau

SEQ ID NO: 574065 - RNA, 22 nt, Human
cccccugcaaagcccagcuuga

SEQ ID NO: 574066 - RNA, 15 nt, Human
acucaacaaacauaa

SEQ ID NO: 574067 - RNA, 22 nt, Human
gaauuaaguuuuuuuuuaaaaa

SEQ ID NO: 574068 - RNA, 19 nt, Human
aauuuuguuauguauauuu

SEQ ID NO: 574069 - RNA, 13 nt, Human
agagguccacaac

SEQ ID NO: 574070 - RNA, 19 nt, Human
guacugagagugaacaaau

SEQ ID NO: 574071 - RNA, 18 nt, Human
gaugcaguucugaagaag

SEQ ID NO: 574072 - RNA, 21 nt, Human
aguuguugcccacagcuguau

SEQ ID NO: 574073 - RNA, 14 nt, Human
cacaacacacagau

SEQ ID NO: 574074 - RNA, 16 nt, Human
ugcauagguuuaauaa

SEQ ID NO: 574075 - RNA, 14 nt, Human
acacugaagaagca

SEQ ID NO: 574076 - RNA, 16 nt, Human
caauaacgauaaaaga

SEQ ID NO: 574077 - RNA, 17 nt, Human
cccacuagacccacugg

SEQ ID NO: 574078 - RNA, 17 nt, Human
uccucugagccuuggga

SEQ ID NO: 574079 - RNA, 16 nt, Human
uagcuacuaauuuuaa

SEQ ID NO: 574080 - RNA, 15 nt, Human
gaaaacaaggaugaa

SEQ ID NO: 574081 - RNA, 16 nt, Human
guucugcacacagcac

SEQ ID NO: 574082 - RNA, 20 nt, Human
aaagacaaggaaaaaauaac

SEQ ID NO: 574083 - RNA, 13 nt, Human
cuuaucaaaggac

SEQ ID NO: 574084 - RNA, 18 nt, Human
cuuccucugagccuuggg

SEQ ID NO: 574085 - RNA, 20 nt, Human
aaaaucuuauaauuuaaaau

SEQ ID NO: 574086 - RNA, 17 nt, Human
uccacaacacacagauu

SEQ ID NO: 574087 - RNA, 15 nt, Human
ccuggugggcagaga

SEQ ID NO: 574088 - RNA, 13 nt, Human
uuaugcuaaguga

SEQ ID NO: 574089 - RNA, 14 nt, Human
cuucucuucacagu

SEQ ID NO: 574090 - RNA, 18 nt, Human
cccaggcugagccucagu

SEQ ID NO: 574091 - RNA, 15 nt, Human
acgagauacagaauu

SEQ ID NO: 574092 - RNA, 15 nt, Human
ucugucucaguccau

SEQ ID NO: 574093 - RNA, 18 nt, Human
acaagccuccuuuuaaag

SEQ ID NO: 574094 - RNA, 21 nt, Human
auuuguauaaaauaauuuuua

SEQ ID NO: 574095 - RNA, 17 nt, Human
agaugggagaaucacuu

SEQ ID NO: 574096 - RNA, 21 nt, Human
gacagaaagcagaacagugau

SEQ ID NO: 574097 - RNA, 17 nt, Human
caauaacgauaaaagac

SEQ ID NO: 574098 - RNA, 15 nt, Human
ugucaauaaaaucca

SEQ ID NO: 574099 - RNA, 14 nt, Human
acuaauuuuaaaau

SEQ ID NO: 574100 - RNA, 23 nt, Human
ugcauagguuuaauaauuuuuaa

SEQ ID NO: 574101 - RNA, 23 nt, Human
agccuugggaccccugagcuugc

SEQ ID NO: 574102 - RNA, 21 nt, Human
aggacagcccuucuuuccaca

SEQ ID NO: 574103 - RNA, 13 nt, Human
ccugccccccagc

SEQ ID NO: 574104 - RNA, 18 nt, Human
auccccaagccuggcaag

SEQ ID NO: 574105 - RNA, 20 nt, Human
ucauucacucaacaaacaua

SEQ ID NO: 574106 - RNA, 22 nt, Human
auauauaacaaugcuguauuuu

SEQ ID NO: 574107 - RNA, 18 nt, Human
uguggucacaggaaguag

SEQ ID NO: 574108 - RNA, 20 nt, Human
aaauaauuuuuauauuugaa

SEQ ID NO: 574109 - RNA, 13 nt, Human
auccugaggcucc

SEQ ID NO: 574110 - RNA, 15 nt, Human
uguauuuuaaaagaa

SEQ ID NO: 574111 - RNA, 21 nt, Human
aaagcugaaauggacuuuugu

SEQ ID NO: 574112 - RNA, 17 nt, Human
cuauccuacuuccccuu

SEQ ID NO: 574113 - RNA, 14 nt, Human
auaaaauaauuuuu

SEQ ID NO: 574114 - RNA, 16 nt, Human
uucccaacuccagaaa

SEQ ID NO: 574115 - RNA, 22 nt, Human
uuuauggcacuaguauuucuau

SEQ ID NO: 574116 - RNA, 19 nt, Human
uacaaaaaaaaaaaaaaau

SEQ ID NO: 574117 - RNA, 12 nt, Human
aagagcuuaaca

SEQ ID NO: 574118 - RNA, 15 nt, Human
aauauaaauaaaaau

SEQ ID NO: 574119 - RNA, 15 nt, Human
uauaaauaaaaauaa

SEQ ID NO: 574120 - RNA, 15 nt, Human
cucaacaaacauaau

SEQ ID NO: 574121 - RNA, 14 nt, Human
ugaagauguagagg

SEQ ID NO: 574122 - RNA, 16 nt, Human
ucugcagauaaacagu

SEQ ID NO: 574123 - RNA, 16 nt, Human
uauuuuugugauuuug

SEQ ID NO: 574124 - RNA, 21 nt, Human
auuauauuuauuacuguaaga

SEQ ID NO: 574125 - RNA, 14 nt, Human
cuggagcucugccc

SEQ ID NO: 574126 - RNA, 20 nt, Human
aagcuucacuguaaaauaau

SEQ ID NO: 574127 - RNA, 21 nt, Human
uagggugauauuaaccagggg

SEQ ID NO: 574128 - RNA, 21 nt, Human
gaaauguuuacagauccccaa

SEQ ID NO: 574129 - RNA, 14 nt, Human
gcuggagcucugcc

SEQ ID NO: 574130 - RNA, 24 nt, Human
cauaugaaaaggcuaagcuucacu

SEQ ID NO: 574131 - RNA, 16 nt, Human
ccuggugggcagagag

SEQ ID NO: 574132 - RNA, 16 nt, Human
aauauaaauaaaaaua

SEQ ID NO: 574133 - RNA, 16 nt, Human
cuucuggguuccuucc

SEQ ID NO: 574134 - RNA, 15 nt, Human
auaaaguguuugaaa

SEQ ID NO: 574135 - RNA, 17 nt, Human
ucuuauaauuuaaaaua

SEQ ID NO: 574136 - RNA, 14 nt, Human
ccagcuggccggga

SEQ ID NO: 574137 - RNA, 13 nt, Human
cacacugaagaag

SEQ ID NO: 574138 - RNA, 15 nt, Human
ucaguuuuugugaaa

SEQ ID NO: 574139 - RNA, 15 nt, Human
guucugcagauaaac

SEQ ID NO: 574140 - RNA, 21 nt, Human
caaagcccagcuugaaaccuu

SEQ ID NO: 574141 - RNA, 16 nt, Human
cugcucucaguucacu

SEQ ID NO: 574142 - RNA, 21 nt, Human
cucaguccaugaagauguaga

SEQ ID NO: 574143 - RNA, 14 nt, Human
aauaguuuaugauu

SEQ ID NO: 574144 - RNA, 23 nt, Human
cugaaaucauacuucuuaggguu

SEQ ID NO: 574145 - RNA, 21 nt, Human
ucauucacucaacaaacauaa

SEQ ID NO: 574146 - RNA, 19 nt, Human
accauuuuggcaagcucua

SEQ ID NO: 574147 - RNA, 14 nt, Human
ccccugagcuugca

SEQ ID NO: 574148 - RNA, 16 nt, Human
cagucucccucccuug

SEQ ID NO: 574149 - RNA, 18 nt, Human
agugucaaugcagccccc

SEQ ID NO: 574150 - RNA, 14 nt, Human
acaaauccaaugaa

SEQ ID NO: 574151 - RNA, 14 nt, Human
ugagacucugucuc

SEQ ID NO: 574152 - RNA, 15 nt, Human
aaaauaacaaugaaa

SEQ ID NO: 574153 - RNA, 22 nt, Human
caccucccccaucucuucuggg

SEQ ID NO: 574154 - RNA, 16 nt, Human
auccaaugaaaugagu

SEQ ID NO: 574155 - RNA, 14 nt, Human
auauuugaaauauu

SEQ ID NO: 574156 - RNA, 16 nt, Human
gaaucacuugaacccg

SEQ ID NO: 574157 - RNA, 20 nt, Human
accucauggaauuggagcuc

SEQ ID NO: 574158 - RNA, 16 nt, Human
uacauuuguauaaaau

SEQ ID NO: 574159 - RNA, 14 nt, Human
cagauccccaagcc

SEQ ID NO: 574160 - RNA, 19 nt, Human
gccccccagcccuccuuau

SEQ ID NO: 574161 - RNA, 17 nt, Human
agacacacugaagaagc

SEQ ID NO: 574162 - RNA, 19 nt, Human
aguauuucuaugaaauauu

SEQ ID NO: 574163 - RNA, 13 nt, Human
uuuuaaaaaagaa

SEQ ID NO: 574164 - RNA, 19 nt, Human
aaguugcauagguuuaaua

SEQ ID NO: 574165 - RNA, 16 nt, Human
cuacacuccagugaga

SEQ ID NO: 574166 - RNA, 18 nt, Human
cauggaauuggagcucgu

SEQ ID NO: 574167 - RNA, 16 nt, Human
cuucaacucccugccc

SEQ ID NO: 574168 - RNA, 19 nt, Human
caauucuugccaaauauaa

SEQ ID NO: 574169 - RNA, 21 nt, Human
ugaaauggacuuuuguacaua

SEQ ID NO: 574170 - RNA, 20 nt, Human
auaaauggcuuccuggcaau

SEQ ID NO: 574171 - RNA, 16 nt, Human
uaggauguugaaaaag

SEQ ID NO: 574172 - RNA, 15 nt, Human
cuggguuccuuccuc

SEQ ID NO: 574173 - RNA, 12 nt, Human
ucaccccuugcc

SEQ ID NO: 574174 - RNA, 17 nt, Human
ucagacauagaauuaac

SEQ ID NO: 574175 - RNA, 21 nt, Human
gacagugaaagaaaauaacaa

SEQ ID NO: 574176 - RNA, 18 nt, Human
auccuucagccugaaaga

SEQ ID NO: 574177 - RNA, 17 nt, Human
uuauaucaauuuaaaaa

SEQ ID NO: 574178 - RNA, 17 nt, Human
caagaaaugaaagcagg

SEQ ID NO: 574179 - RNA, 15 nt, Human
uggacgagaaaacaa

SEQ ID NO: 574180 - RNA, 13 nt, Human
aaaauaacaauga

SEQ ID NO: 574181 - RNA, 21 nt, Human
auuccuuuuucucuccucucc

SEQ ID NO: 574182 - RNA, 19 nt, Human
uuccucccuucucuucaca

SEQ ID NO: 574183 - RNA, 22 nt, Human
accccugagcuugcagagauga

SEQ ID NO: 574184 - RNA, 15 nt, Human
augguuguauuauuu

SEQ ID NO: 574185 - RNA, 17 nt, Human
uuauauuugaaauauug

SEQ ID NO: 574186 - RNA, 16 nt, Human
ccuacaugagguacug

SEQ ID NO: 574187 - RNA, 20 nt, Human
ggagccugaucaccugcccu

SEQ ID NO: 574188 - RNA, 22 nt, Human
cucuggccuucggccuccaucc

SEQ ID NO: 574189 - RNA, 17 nt, Human
ggaaauauuuauuuuaa

SEQ ID NO: 574190 - RNA, 13 nt, Human
uaauuuuuauauu

SEQ ID NO: 574191 - RNA, 19 nt, Human
aagcauuccaacuaucuca

SEQ ID NO: 574192 - RNA, 12 nt, Human
cuucaacucccu

SEQ ID NO: 574193 - RNA, 23 nt, Human
uggcuugaguuuaaauuguaaua

SEQ ID NO: 574194 - RNA, 12 nt, Human
agugcagccccg

SEQ ID NO: 574195 - RNA, 21 nt, Human
aaaaaguucugcagauaaaca

SEQ ID NO: 574196 - RNA, 22 nt, Human
cuuccuaauuccacagcugcuc

SEQ ID NO: 574197 - RNA, 17 nt, Human
caaacauauauaacaau

SEQ ID NO: 574198 - RNA, 14 nt, Human
aagaagugaaaauc

SEQ ID NO: 574199 - RNA, 23 nt, Human
ucaauaucuuuuuuuuaauaaac

SEQ ID NO: 574200 - RNA, 17 nt, Human
cagugaaagaaaauaac

SEQ ID NO: 574201 - RNA, 18 nt, Human
aaauauuuauuuuaauaa

SEQ ID NO: 574202 - RNA, 14 nt, Human
cuaagucuuauaua

SEQ ID NO: 574203 - RNA, 18 nt, Human
uaguaucaaaagaaagaa

SEQ ID NO: 574204 - RNA, 14 nt, Human
agaaaauaacaaua

SEQ ID NO: 574205 - RNA, 21 nt, Human
uuauagcuacuaauuuuaaaa

SEQ ID NO: 574206 - RNA, 12 nt, Human
agggauggggcu

SEQ ID NO: 574207 - RNA, 18 nt, Human
gccccugcacuccagccu

SEQ ID NO: 574208 - RNA, 22 nt, Human
gugaacaaauuuacagagacag

SEQ ID NO: 574209 - RNA, 23 nt, Human
uguagguagaucuggucuuuaga

SEQ ID NO: 574210 - RNA, 22 nt, Human
caguauggcagcuuuccucaaa

SEQ ID NO: 574211 - RNA, 22 nt, Human
aauuuaaaaaaaaaccugagcc

SEQ ID NO: 574212 - RNA, 19 nt, Human
ggacucaccucccccaucu

SEQ ID NO: 574213 - RNA, 22 nt, Human
augcagagguccacaacacaca

SEQ ID NO: 574214 - RNA, 19 nt, Human
gucaaauugugugaaaggu

SEQ ID NO: 574215 - RNA, 19 nt, Human
ccccugcaaagcccagcuu

SEQ ID NO: 574216 - RNA, 18 nt, Human
ucuucaacucccugcccc

SEQ ID NO: 574217 - RNA, 19 nt, Human
uccccuauccuacuucccc

SEQ ID NO: 574218 - RNA, 21 nt, Human
ccugaucaccugcccugcuga

SEQ ID NO: 574219 - RNA, 19 nt, Human
uuggcaagcucuaucacca

SEQ ID NO: 574220 - RNA, 20 nt, Human
aauuuuuucucuaggaaaua

SEQ ID NO: 574221 - RNA, 13 nt, Human
auugucuagugaa

SEQ ID NO: 574222 - RNA, 13 nt, Human
aucuacacuccag

SEQ ID NO: 574223 - RNA, 18 nt, Human
cauagguuuaauaauuuu

SEQ ID NO: 574224 - RNA, 13 nt, Human
acacacaugaagu

SEQ ID NO: 574225 - RNA, 12 nt, Human
ggcugaugcagu

SEQ ID NO: 574226 - RNA, 18 nt, Human
gaaaauaacgauaaaaga

SEQ ID NO: 574227 - RNA, 21 nt, Human
gaaaugaguuuuucuuuucau

SEQ ID NO: 574228 - RNA, 18 nt, Human
aaggaugccccguccccc

SEQ ID NO: 574229 - RNA, 17 nt, Human
ccacugcagaagacagu

SEQ ID NO: 574230 - RNA, 15 nt, Human
auaauuuugugaagc

SEQ ID NO: 574231 - RNA, 18 nt, Human
ccuucggccuccauccug

SEQ ID NO: 574232 - RNA, 23 nt, Human
ugucaauucuugccaaauauaaa

SEQ ID NO: 574233 - RNA, 17 nt, Human
acuugaacccauauuug

SEQ ID NO: 574234 - RNA, 15 nt, Human
uaacaauaaaagaca

SEQ ID NO: 574235 - RNA, 22 nt, Human
cuccagccugagcgacagugag

SEQ ID NO: 574236 - RNA, 23 nt, Human
cuugauaaauggcuuccuggcaa

SEQ ID NO: 574237 - RNA, 14 nt, Human
uugaaauuguauua

SEQ ID NO: 574238 - RNA, 18 nt, Human
cuccauuuuuagugaaau

SEQ ID NO: 574239 - RNA, 13 nt, Human
cacauuuaaauaa

SEQ ID NO: 574240 - RNA, 18 nt, Human
uagugaaauauuauuuua

SEQ ID NO: 574241 - RNA, 17 nt, Human
ccuauccuacuuccccu

SEQ ID NO: 574242 - RNA, 15 nt, Human
cuaguaauuggaaag

SEQ ID NO: 574243 - RNA, 18 nt, Human
auucuugccaaauauaaa

SEQ ID NO: 574244 - RNA, 21 nt, Human
cuccagcuggccgggagccug

SEQ ID NO: 574245 - RNA, 20 nt, Human
cucccugccccccagcccuc

SEQ ID NO: 574246 - RNA, 13 nt, Human
uuuaaaaaagaaa

SEQ ID NO: 574247 - RNA, 19 nt, Human
ucugagcauuuaauaugga

SEQ ID NO: 574248 - RNA, 12 nt, Human
acugaaaucaua

SEQ ID NO: 574249 - RNA, 16 nt, Human
cugagcauuuaauaug

SEQ ID NO: 574250 - RNA, 19 nt, Human
agaugcuagaacucccuuu

SEQ ID NO: 574251 - RNA, 18 nt, Human
ugugaccacugcagaaga

SEQ ID NO: 574252 - RNA, 21 nt, Human
acgcucucuggccuucggccu

SEQ ID NO: 574253 - RNA, 11 nt, Human
caucuagugag

SEQ ID NO: 574254 - RNA, 20 nt, Human
aaucuuucacaggggacagg

SEQ ID NO: 574255 - RNA, 15 nt, Human
gccccugcacuccag

SEQ ID NO: 574256 - RNA, 20 nt, Human
ccaaauguucaucaaugaau

SEQ ID NO: 574257 - RNA, 17 nt, Human
agaaaugaaagcaggga

SEQ ID NO: 574258 - RNA, 18 nt, Human
aaaaguucugcagauaaa

SEQ ID NO: 574259 - RNA, 13 nt, Human
uccuacuuccccu

SEQ ID NO: 574260 - RNA, 19 nt, Human
ccgggcgugguggugagug

SEQ ID NO: 574261 - RNA, 21 nt, Human
uuuauauaagcuuguauuccu

SEQ ID NO: 574262 - RNA, 20 nt, Human
agccuaguugaucagcuuau

SEQ ID NO: 574263 - RNA, 13 nt, Human
ugagcgacaguga

SEQ ID NO: 574264 - RNA, 15 nt, Human
aaggaaaaaauaaca

SEQ ID NO: 574265 - RNA, 18 nt, Human
uauaacaaugcuguauuu

SEQ ID NO: 574266 - RNA, 17 nt, Human
uuccaagccucaugucc

SEQ ID NO: 574267 - RNA, 20 nt, Human
agcuacuaauuuuaaaaugu

SEQ ID NO: 574268 - RNA, 23 nt, Human
uuguaacaagccuccuuuuaaag

SEQ ID NO: 574269 - RNA, 20 nt, Human
cucuguucugcacacagcac

SEQ ID NO: 574270 - RNA, 16 nt, Human
ucuuauaauuuaaaau

SEQ ID NO: 574271 - RNA, 14 nt, Human
cucccuuggggccu

SEQ ID NO: 574272 - RNA, 15 nt, Human
ccagauccuggaaau

SEQ ID NO: 574273 - RNA, 12 nt, Human
acagagacagaa

SEQ ID NO: 574274 - RNA, 19 nt, Human
uugugccccugcacuccag

SEQ ID NO: 574275 - RNA, 12 nt, Human
gacagugaaaga

SEQ ID NO: 574276 - RNA, 13 nt, Human
augcuagaacucc

SEQ ID NO: 574277 - RNA, 21 nt, Human
gcacuguggguagacacacau

SEQ ID NO: 574278 - RNA, 17 nt, Human
auggcuaguaucaaaag

SEQ ID NO: 574279 - RNA, 23 nt, Human
ucuccauguacuggcaagaccug

SEQ ID NO: 574280 - RNA, 18 nt, Human
aucuacacuccagugaga

SEQ ID NO: 574281 - RNA, 20 nt, Human
gauugugccccugcacucca

SEQ ID NO: 574282 - RNA, 19 nt, Human
auuauuuuuuaaaaaaauu

SEQ ID NO: 574283 - RNA, 15 nt, Human
uugcucauggaauug

SEQ ID NO: 574284 - RNA, 19 nt, Human
gugacuuaaugccacuaaa

SEQ ID NO: 574285 - RNA, 14 nt, Human
cuguaaucacagcu

SEQ ID NO: 574286 - RNA, 18 nt, Human
uaauuuuaacucuauaau

SEQ ID NO: 574287 - RNA, 20 nt, Human
ccagcuugaaaccuucacuu

SEQ ID NO: 574288 - RNA, 18 nt, Human
uuuuaaaaaagaaacauu

SEQ ID NO: 574289 - RNA, 22 nt, Human
caccagucugacuguuuccauc

SEQ ID NO: 574290 - RNA, 18 nt, Human
uggucaauuuuguuaugu

SEQ ID NO: 574291 - RNA, 13 nt, Human
guaacuaauuuua

SEQ ID NO: 574292 - RNA, 23 nt, Human
uagauguauagguugaugguggu

SEQ ID NO: 574293 - RNA, 19 nt, Human
cugcaaagcccagcuugaa

SEQ ID NO: 574294 - RNA, 17 nt, Human
aaagcuccauuuuuagu

SEQ ID NO: 574295 - RNA, 12 nt, Human
aauuuuaaaaug

SEQ ID NO: 574296 - RNA, 18 nt, Human
ucaaggguacacugccuu

SEQ ID NO: 574297 - RNA, 19 nt, Human
guaguccuguaauggaagc

SEQ ID NO: 574298 - RNA, 23 nt, Human
ggccuccauccugaggcuccacu

SEQ ID NO: 574299 - RNA, 15 nt, Human
gugaccacugcagaa

SEQ ID NO: 574300 - RNA, 16 nt, Human
ucagucucccucccuu

SEQ ID NO: 574301 - RNA, 15 nt, Human
uucugcacacagcac

SEQ ID NO: 574302 - RNA, 21 nt, Human
acagcccuucuuuccacagaa

SEQ ID NO: 574303 - RNA, 18 nt, Human
cucccuuggggccuaugc

SEQ ID NO: 574304 - RNA, 12 nt, Human
cagaacagugau

SEQ ID NO: 574305 - RNA, 12 nt, Human
gaaaauaacaau

SEQ ID NO: 574306 - RNA, 17 nt, Human
ccucagucucccucccu

SEQ ID NO: 574307 - RNA, 14 nt, Human
agguugcagugagc

SEQ ID NO: 574308 - RNA, 13 nt, Human
ugauuauauguca

SEQ ID NO: 574309 - RNA, 15 nt, Human
cccugccccccagcc

SEQ ID NO: 574310 - RNA, 17 nt, Human
cuaagcuucacuguaaa

SEQ ID NO: 574311 - RNA, 16 nt, Human
auaaugaauacuuuau

SEQ ID NO: 574312 - RNA, 13 nt, Human
aacucuauaaugu

SEQ ID NO: 574313 - RNA, 18 nt, Human
uucucuaggaaauauuua

SEQ ID NO: 574314 - RNA, 14 nt, Human
ugagcuugcagaga

SEQ ID NO: 574315 - RNA, 20 nt, Human
uaggaauugacccacaagaa

SEQ ID NO: 574316 - RNA, 13 nt, Human
caguuauuauauu

SEQ ID NO: 574317 - RNA, 22 nt, Human
cugggacaggggagaaccuagg

SEQ ID NO: 574318 - RNA, 16 nt, Human
acuaguuucccuugca

SEQ ID NO: 574319 - RNA, 12 nt, Human
guagacacacau

SEQ ID NO: 574320 - RNA, 21 nt, Human
caaggaaaaaauaacaaugaa

SEQ ID NO: 574321 - RNA, 19 nt, Human
gcacuaguauuucuaugaa

SEQ ID NO: 574322 - RNA, 16 nt, Human
aagcuucacuguaaaa

SEQ ID NO: 574323 - RNA, 17 nt, Human
aaucuuucacaggggac

SEQ ID NO: 574324 - RNA, 18 nt, Human
uaaaagacagugaaagaa

SEQ ID NO: 574325 - RNA, 11 nt, Human
ccugagcccca

SEQ ID NO: 574326 - RNA, 22 nt, Human
ugaaaaaguucugcagauaaac

SEQ ID NO: 574327 - RNA, 16 nt, Human
uauccuacuuccccuu

SEQ ID NO: 574328 - RNA, 14 nt, Human
acaagagcuuaaca

SEQ ID NO: 574329 - RNA, 23 nt, Human
uuauagcuacuaauuuuaaaaug

SEQ ID NO: 574330 - RNA, 13 nt, Human
caacaucuaguga

SEQ ID NO: 574331 - RNA, 16 nt, Human
ucuuggucucaguguc

SEQ ID NO: 574332 - RNA, 12 nt, Human
cauuauauuuau

SEQ ID NO: 574333 - RNA, 13 nt, Human
agcccagcuugaa

SEQ ID NO: 574334 - RNA, 19 nt, Human
uuauggcacuaguauuucu

SEQ ID NO: 574335 - RNA, 22 nt, Human
ugaauggcuaagcaaaauguga

SEQ ID NO: 574336 - RNA, 16 nt, Human
uaucaaaagaaagaaa

SEQ ID NO: 574337 - RNA, 14 nt, Human
uugacccacaagaa

SEQ ID NO: 574338 - RNA, 18 nt, Human
uucugauauuggacagua

SEQ ID NO: 574339 - RNA, 12 nt, Human
acaugagguacu

SEQ ID NO: 574340 - RNA, 16 nt, Human
auccuacaagacacag

SEQ ID NO: 574341 - RNA, 20 nt, Human
uggaauaauccuaaacauau

SEQ ID NO: 574342 - RNA, 21 nt, Human
cauuucuugagguaaaagcau

SEQ ID NO: 574343 - RNA, 21 nt, Human
aaaauaugccccauucaacau

SEQ ID NO: 574344 - RNA, 18 nt, Human
aaaucuuauaauuuaaaa

SEQ ID NO: 574345 - RNA, 13 nt, Human
uuaaauuguaaua

SEQ ID NO: 574346 - RNA, 14 nt, Human
cauagaaguaaaaa

SEQ ID NO: 574347 - RNA, 20 nt, Human
gaaaauaacaauaaaagaca

SEQ ID NO: 574348 - RNA, 15 nt, Human
agcucuaucaccaag

SEQ ID NO: 574349 - RNA, 17 nt, Human
agucccaggcugagccu

SEQ ID NO: 574350 - RNA, 15 nt, Human
gcagagguugcagug

SEQ ID NO: 574351 - RNA, 20 nt, Human
gggaggcagagguugcagug

SEQ ID NO: 574352 - RNA, 16 nt, Human
uauguucuaagaagug

SEQ ID NO: 574353 - RNA, 19 nt, Human
cucugccucagaaaacaag

SEQ ID NO: 574354 - RNA, 13 nt, Human
agcucugcccauc

SEQ ID NO: 574355 - RNA, 18 nt, Human
auguuaaaacugggacag

SEQ ID NO: 574356 - RNA, 15 nt, Human
cccugcaaagcccag

SEQ ID NO: 574357 - RNA, 16 nt, Human
acaugaacuuguaaag

SEQ ID NO: 574358 - RNA, 17 nt, Human
guuuaauucugaaagca

SEQ ID NO: 574359 - RNA, 22 nt, Human
auauaaauaaaaauaauccuca

SEQ ID NO: 574360 - RNA, 14 nt, Human
guaacugauuugua

SEQ ID NO: 574361 - RNA, 22 nt, Human
ugucucuacuaaaaauacaaaa

SEQ ID NO: 574362 - RNA, 19 nt, Human
cagcacgggggccaaggau

SEQ ID NO: 574363 - RNA, 16 nt, Human
ugacaagcucacagac

SEQ ID NO: 574364 - RNA, 21 nt, Human
uguaaaauggugugaccacug

SEQ ID NO: 574365 - RNA, 12 nt, Human
ugagagacacac

SEQ ID NO: 574366 - RNA, 18 nt, Human
cacuccagugagacagcu

SEQ ID NO: 574367 - RNA, 16 nt, Human
acaaggaugaauuaag

SEQ ID NO: 574368 - RNA, 13 nt, Human
uuauguuuaauuc

SEQ ID NO: 574369 - RNA, 17 nt, Human
uucugagcauuuaauau

SEQ ID NO: 574370 - RNA, 19 nt, Human
ugagucccaggcugagccu

SEQ ID NO: 574371 - RNA, 12 nt, Human
gccccugagccc

SEQ ID NO: 574372 - RNA, 21 nt, Human
ugggaggcugagaugggagaa

SEQ ID NO: 574373 - RNA, 15 nt, Human
caaauccaaugaaau

SEQ ID NO: 574374 - RNA, 14 nt, Human
acagaauuuuaugc

SEQ ID NO: 574375 - RNA, 15 nt, Human
aagccuccuuuuaaa

SEQ ID NO: 574376 - RNA, 14 nt, Human
uugcuggagcucug

SEQ ID NO: 574377 - RNA, 15 nt, Human
gcacagccucuuaga

SEQ ID NO: 574378 - RNA, 16 nt, Human
uucacauuuaaauaaa

SEQ ID NO: 574379 - RNA, 16 nt, Human
caugggacagggagga

SEQ ID NO: 574380 - RNA, 23 nt, Human
acguaaucguguccccuauccua

SEQ ID NO: 574381 - RNA, 20 nt, Human
agccuuggggcugaugcagu

SEQ ID NO: 574382 - RNA, 16 nt, Human
agggaggacgcucucu

SEQ ID NO: 574383 - RNA, 13 nt, Human
cccaaaaggcaga

SEQ ID NO: 574384 - RNA, 23 nt, Human
ggaugaauuaaguuuuuuuuuaa

SEQ ID NO: 574385 - RNA, 22 nt, Human
uuccccuuccuaauuccacagc

SEQ ID NO: 574386 - RNA, 20 nt, Human
uaaaagacaaggaaaaaaua

SEQ ID NO: 574387 - RNA, 15 nt, Human
cuaucuuugagcgcc

SEQ ID NO: 574388 - RNA, 21 nt, Human
gucucagugucaaugcagccc

SEQ ID NO: 574389 - RNA, 12 nt, Human
acaagacacagu

SEQ ID NO: 574390 - RNA, 16 nt, Human
gccucagucucccucc

SEQ ID NO: 574391 - RNA, 22 nt, Human
uuuccaagcaaguauuagaaua

SEQ ID NO: 574392 - RNA, 15 nt, Human
auuuuaaaagaauga

SEQ ID NO: 574393 - RNA, 12 nt, Human
aaugcagccccc

SEQ ID NO: 574394 - RNA, 19 nt, Human
uuuccugaaaacccuugcc

SEQ ID NO: 574395 - RNA, 23 nt, Human
gaccccugagcuugcagagauga

SEQ ID NO: 574396 - RNA, 17 nt, Human
cuuccuaauuccacagc

SEQ ID NO: 574397 - RNA, 23 nt, Human
caugcugucuacacuaagagaga

SEQ ID NO: 574398 - RNA, 18 nt, Human
aaauauaaauaaaaauaa

SEQ ID NO: 574399 - RNA, 16 nt, Human
aggccaugggacaggg

SEQ ID NO: 574400 - RNA, 21 nt, Human
aaugaauggcuaagcaaaaug

SEQ ID NO: 574401 - RNA, 20 nt, Human
ugagcgcccacuagacccac

SEQ ID NO: 574402 - RNA, 13 nt, Human
aagacagugaaag

SEQ ID NO: 574403 - RNA, 14 nt, Human
ugcuagaacucccu

SEQ ID NO: 574404 - RNA, 19 nt, Human
augaauuacauuuguauaa

SEQ ID NO: 574405 - RNA, 20 nt, Human
aauuaaguuuuuuuuuaaaa

SEQ ID NO: 574406 - RNA, 22 nt, Human
aaagagugaaggauuuauguuu

SEQ ID NO: 574407 - RNA, 20 nt, Human
gagccucagucucccucccu

SEQ ID NO: 574408 - RNA, 21 nt, Human
ccucuguucugcacacagcac

SEQ ID NO: 574409 - RNA, 17 nt, Human
cugagcgacagugagac

SEQ ID NO: 574410 - RNA, 15 nt, Human
aguucugaagaagau

SEQ ID NO: 574411 - RNA, 19 nt, Human
cccugcaaagcccagcuug

SEQ ID NO: 574412 - RNA, 15 nt, Human
ugcuucuguuuuaua

SEQ ID NO: 574413 - RNA, 18 nt, Human
uuggggccuaugcagagg

SEQ ID NO: 574414 - RNA, 13 nt, Human
cccuccuuaucaa

SEQ ID NO: 574415 - RNA, 23 nt, Human
uuuccaucaaggguacacugccu

SEQ ID NO: 574416 - RNA, 22 nt, Human
gcacagccucuuagaugcaguu

SEQ ID NO: 574417 - RNA, 12 nt, Human
accccugagcuu

SEQ ID NO: 574418 - RNA, 19 nt, Human
gacagucaccucauggaau

SEQ ID NO: 574419 - RNA, 21 nt, Human
aagcuccauuuuuagugaaau

SEQ ID NO: 574420 - RNA, 19 nt, Human
ccuccauccugaggcucca

SEQ ID NO: 574421 - RNA, 19 nt, Human
uggcaagcucuaucaccaa

SEQ ID NO: 574422 - RNA, 16 nt, Human
ugcuguauuuuaaaag

SEQ ID NO: 574423 - RNA, 23 nt, Human
uaaguuuuuuuuuaaaaaagaaa

SEQ ID NO: 574424 - RNA, 14 nt, Human
cucugccucagaaa

SEQ ID NO: 574425 - RNA, 23 nt, Human
gaaaaucuuauaauuuaaaauau

SEQ ID NO: 574426 - RNA, 13 nt, Human
cucagaaaacaag

SEQ ID NO: 574427 - RNA, 19 nt, Human
agcagcuuauucacaagac

SEQ ID NO: 574428 - RNA, 18 nt, Human
auggcuugaguuuaaauu

SEQ ID NO: 574429 - RNA, 13 nt, Human
cacaacacacaga

SEQ ID NO: 574430 - RNA, 13 nt, Human
cucugagccuugg

SEQ ID NO: 574431 - RNA, 14 nt, Human
aauauaaauaaaaa

SEQ ID NO: 574432 - RNA, 15 nt, Human
cuuuucccaacucca

SEQ ID NO: 574433 - RNA, 20 nt, Human
uccaagccucauguccacug

SEQ ID NO: 574434 - RNA, 16 nt, Human
acuaaacaaagaguga

SEQ ID NO: 574435 - RNA, 22 nt, Human
cuucaacucccugccccccagc

SEQ ID NO: 574436 - RNA, 16 nt, Human
caaaaggauaaugaau

SEQ ID NO: 574437 - RNA, 22 nt, Human
agaaaacaauaacgauaaaaga

SEQ ID NO: 574438 - RNA, 11 nt, Human
aaccugagccc

SEQ ID NO: 574439 - RNA, 16 nt, Human
uuucuauaauuuaaau

SEQ ID NO: 574440 - RNA, 15 nt, Human
uucggccuccauccu

SEQ ID NO: 574441 - RNA, 14 nt, Human
guauuuuaaaagaa

SEQ ID NO: 574442 - RNA, 19 nt, Human
ccccugagcuugcagagau

SEQ ID NO: 574443 - RNA, 17 nt, Human
agcuucacuguaaaaua

SEQ ID NO: 574444 - RNA, 15 nt, Human
augauaacuggaaac

SEQ ID NO: 574445 - RNA, 17 nt, Human
uuacagagacagaaagc

SEQ ID NO: 574446 - RNA, 15 nt, Human
ucacaggacagcccu

SEQ ID NO: 574447 - RNA, 23 nt, Human
aggaugguucccuugaugaagaa

SEQ ID NO: 574448 - RNA, 15 nt, Human
caagcucacagaccu

SEQ ID NO: 574449 - RNA, 17 nt, Human
cugagaugggagaauca

SEQ ID NO: 574450 - RNA, 22 nt, Human
uagacacacaugaaguccaagc

SEQ ID NO: 574451 - RNA, 19 nt, Human
auuuugugaagcaaaauuu

SEQ ID NO: 574452 - RNA, 15 nt, Human
acuuuauaaaggauu

SEQ ID NO: 574453 - RNA, 11 nt, Human
accauuuuuac

SEQ ID NO: 574454 - RNA, 19 nt, Human
ugaaauggacuuuuguaca

SEQ ID NO: 574455 - RNA, 22 nt, Human
agcagcauaaauguugacaugg

SEQ ID NO: 574456 - RNA, 18 nt, Human
aacaaugcuguauuuuaa

SEQ ID NO: 574457 - RNA, 17 nt, Human
uauauuguagauaauac

SEQ ID NO: 574458 - RNA, 16 nt, Human
uuuucucuaggaaaua

SEQ ID NO: 574459 - RNA, 14 nt, Human
aaauauuauuuuau

SEQ ID NO: 574460 - RNA, 19 nt, Human
ugggacaggggagaaccua

SEQ ID NO: 574461 - RNA, 17 nt, Human
aacaguuaccucugccu

SEQ ID NO: 574462 - RNA, 24 nt, Human
uggccgggagccugaucaccugcc

SEQ ID NO: 574463 - RNA, 23 nt, Human
aucaccaaggcugauuaaaccaa

SEQ ID NO: 574464 - RNA, 18 nt, Human
cuucacuguaaaauaaua

SEQ ID NO: 574465 - RNA, 14 nt, Human
gucccaggcugagc

SEQ ID NO: 574466 - RNA, 16 nt, Human
gaauggcuaagcaaaa

SEQ ID NO: 574467 - RNA, 21 nt, Human
cagugagacagcucugcauac

SEQ ID NO: 574468 - RNA, 18 nt, Human
acaaaugggaaacaaaag

SEQ ID NO: 574469 - RNA, 19 nt, Human
cuggccuucggccuccauc

SEQ ID NO: 574470 - RNA, 22 nt, Human
acaccuuguacuuuauuuucua

SEQ ID NO: 574471 - RNA, 17 nt, Human
aauucuugccaaauaua

SEQ ID NO: 574472 - RNA, 18 nt, Human
cugcucaauaaaguacaa

SEQ ID NO: 574473 - RNA, 14 nt, Human
aaaagaaacauuug

SEQ ID NO: 574474 - RNA, 23 nt, Human
acugucuuguuggacgagaaaac

SEQ ID NO: 574475 - RNA, 22 nt, Human
gagccucagucucccucccuug

SEQ ID NO: 574476 - RNA, 19 nt, Human
agacagugaaagaaaauaa

SEQ ID NO: 574477 - RNA, 15 nt, Human
cucguggaacaguua

SEQ ID NO: 574478 - RNA, 15 nt, Human
augaauuaaguuuuu

SEQ ID NO: 574479 - RNA, 22 nt, Human
ucuacuaaaaauacaaaaaaaa

SEQ ID NO: 574480 - RNA, 12 nt, Human
uauucacaagac

SEQ ID NO: 574481 - RNA, 22 nt, Human
aauuuuuucucuaggaaauauu

SEQ ID NO: 574482 - RNA, 16 nt, Human
uuucacauuuaaauaa

SEQ ID NO: 574483 - RNA, 14 nt, Human
cucuggcuccagcu

SEQ ID NO: 574484 - RNA, 20 nt, Human
aauaucuuuuuuuuaauaaa

SEQ ID NO: 574485 - RNA, 13 nt, Human
aacucccugcccc

SEQ ID NO: 574486 - RNA, 15 nt, Human
gacaguauggcagcu

SEQ ID NO: 574487 - RNA, 15 nt, Human
ugagcucagcccugg

SEQ ID NO: 574488 - RNA, 14 nt, Human
aagcucuaucacca

SEQ ID NO: 574489 - RNA, 13 nt, Human
ccaggcugagccu

SEQ ID NO: 574490 - RNA, 15 nt, Human
aagcacuaaacaaag

SEQ ID NO: 574491 - RNA, 14 nt, Human
ugagaugcuagaac

SEQ ID NO: 574492 - RNA, 23 nt, Human
cuagacccacuggacucaccucc

SEQ ID NO: 574493 - RNA, 12 nt, Human
acaagaaaugaa

SEQ ID NO: 574494 - RNA, 13 nt, Human
ccaccugccuaua

SEQ ID NO: 574495 - RNA, 16 nt, Human
aaaagcuccauuuuua

SEQ ID NO: 574496 - RNA, 17 nt, Human
uaauuccacagcugcuc

SEQ ID NO: 574497 - RNA, 16 nt, Human
aucaaaagaaagaaaa

SEQ ID NO: 574498 - RNA, 21 nt, Human
cugagccucagucucccuccc

SEQ ID NO: 574499 - RNA, 15 nt, Human
auaaauaaaaauaau

SEQ ID NO: 574500 - RNA, 14 nt, Human
aaccugagccccaa

SEQ ID NO: 574501 - RNA, 16 nt, Human
ugcaaauugucacagg

SEQ ID NO: 574502 - RNA, 21 nt, Human
aauaauccucaguuuuuguga

SEQ ID NO: 574503 - RNA, 14 nt, Human
auacaaaaaaaaaa

SEQ ID NO: 574504 - RNA, 15 nt, Human
gaccacugcagaaga

SEQ ID NO: 574505 - RNA, 17 nt, Human
ucugugagaugcuagaa

SEQ ID NO: 574506 - RNA, 16 nt, Human
ccauuuuuagugaaau

SEQ ID NO: 574507 - RNA, 15 nt, Human
agggcucacagaauu

SEQ ID NO: 574508 - RNA, 21 nt, Human
aagucuuucacauuuaaauaa

SEQ ID NO: 574509 - RNA, 21 nt, Human
aaaauuuuuucucuaggaaau

SEQ ID NO: 574510 - RNA, 15 nt, Human
aagaaaauaacaaua

SEQ ID NO: 574511 - RNA, 16 nt, Human
auugucuagugaaacu

SEQ ID NO: 574512 - RNA, 23 nt, Human
ucuaccaaaaaucucaauauuuc

SEQ ID NO: 574513 - RNA, 18 nt, Human
cuuugagcgcccacuaga

SEQ ID NO: 574514 - RNA, 17 nt, Human
aaauaacaauaaaagac

SEQ ID NO: 574515 - RNA, 14 nt, Human
caaggcuagaacca

SEQ ID NO: 574516 - RNA, 14 nt, Human
uucacauuuaaaua

SEQ ID NO: 574517 - RNA, 22 nt, Human
aaacauccuacaagacacagug

SEQ ID NO: 574518 - RNA, 22 nt, Human
cagcccuggugggcagagaggu

SEQ ID NO: 574519 - RNA, 12 nt, Human
uucucuaggaaa

SEQ ID NO: 574520 - RNA, 14 nt, Human
aagagugaaggauu

SEQ ID NO: 574521 - RNA, 14 nt, Human
cagauuugagcuca

SEQ ID NO: 574522 - RNA, 16 nt, Human
agaugcuagaacuccc

SEQ ID NO: 574523 - RNA, 13 nt, Human
agccucagucucc

SEQ ID NO: 574524 - RNA, 21 nt, Human
acagugauuaccagggacuga

SEQ ID NO: 574525 - RNA, 22 nt, Human
aagagccuuuuuuugaaaaaaa

SEQ ID NO: 574526 - RNA, 14 nt, Human
uaaauaguuuauga

SEQ ID NO: 574527 - RNA, 13 nt, Human
uaaacauguuuau

SEQ ID NO: 574528 - RNA, 14 nt, Human
acauauauaacaau

SEQ ID NO: 574529 - RNA, 15 nt, Human
auauuuuuuguuaaa

SEQ ID NO: 574530 - RNA, 14 nt, Human
ccaaauauaaauaa

SEQ ID NO: 574531 - RNA, 13 nt, Human
uggacgagaaaac

SEQ ID NO: 574532 - RNA, 13 nt, Human
agaaguaaaaaca

SEQ ID NO: 574533 - RNA, 15 nt, Human
aucuuauaauuuaaa

SEQ ID NO: 574534 - RNA, 19 nt, Human
gaaagaaaauaacaauaaa

SEQ ID NO: 574535 - RNA, 18 nt, Human
gaagcaaaauuuuuucuc

SEQ ID NO: 574536 - RNA, 19 nt, Human
gagccugaucaccugcccu

SEQ ID NO: 574537 - RNA, 15 nt, Human
ccucagucucccucc

SEQ ID NO: 574538 - RNA, 18 nt, Human
cuuuucccaacuccagaa

SEQ ID NO: 574539 - RNA, 14 nt, Human
ccugccccugagcc

SEQ ID NO: 574540 - RNA, 13 nt, Human
aauuuuuauauuu

SEQ ID NO: 574541 - RNA, 17 nt, Human
aaagacaaggaaaaaau

SEQ ID NO: 574542 - RNA, 17 nt, Human
cuucacuguaaaauaau

SEQ ID NO: 574543 - RNA, 21 nt, Human
uauuauuuuauagcuacuaau

SEQ ID NO: 574544 - RNA, 18 nt, Human
auaauccuaaacauauga

SEQ ID NO: 574545 - RNA, 18 nt, Human
aaagaaaaucaggcuggc

SEQ ID NO: 574546 - RNA, 16 nt, Human
ccaggcugagccucag

SEQ ID NO: 574547 - RNA, 17 nt, Human
uugugaagcaaaauuuu

SEQ ID NO: 574548 - RNA, 19 nt, Human
uaguuuaugauuccaccua

SEQ ID NO: 574549 - RNA, 15 nt, Human
ugguuuagaaagcuu

SEQ ID NO: 574550 - RNA, 21 nt, Human
ccaaggaugccccgucccccu

SEQ ID NO: 574551 - RNA, 22 nt, Human
ggguuccuuccucugagccuug

SEQ ID NO: 574552 - RNA, 15 nt, Human
cucccuuggggccua

SEQ ID NO: 574553 - RNA, 23 nt, Human
agaguuuagcuggaaaaguaugu

SEQ ID NO: 574554 - RNA, 20 nt, Human
gacauuugcucauggaauug

SEQ ID NO: 574555 - RNA, 17 nt, Human
cuggagggaagccuugg

SEQ ID NO: 574556 - RNA, 16 nt, Human
cacuuaaaaaugguuu

SEQ ID NO: 574557 - RNA, 20 nt, Human
aacaagccuccuuuuaaagu

SEQ ID NO: 574558 - RNA, 15 nt, Human
cuacaagacacagug

SEQ ID NO: 574559 - RNA, 20 nt, Human
caagagccuuuuuuugaaaa

SEQ ID NO: 574560 - RNA, 13 nt, Human
gacaaggaaaaaa

SEQ ID NO: 574561 - RNA, 20 nt, Human
cccuuccuaauuccacagcu

SEQ ID NO: 574562 - RNA, 14 nt, Human
ccucagucucccuc

SEQ ID NO: 574563 - RNA, 16 nt, Human
cugcugagucccaggc

SEQ ID NO: 574564 - RNA, 16 nt, Human
cucaauaaaguacaag

SEQ ID NO: 574565 - RNA, 15 nt, Human
uacuaauuuuaaaau

SEQ ID NO: 574566 - RNA, 17 nt, Human
agaacucccuuucaaca

SEQ ID NO: 574567 - RNA, 21 nt, Human
aaugugacuuaaugccacuaa

SEQ ID NO: 574568 - RNA, 15 nt, Human
ucugcagauaaacag

SEQ ID NO: 574569 - RNA, 16 nt, Human
uucuauaauuuaaaua

SEQ ID NO: 574570 - RNA, 17 nt, Human
guugcugggggggauug

SEQ ID NO: 574571 - RNA, 22 nt, Human
uugacccacaagaaaugaaagc

SEQ ID NO: 574572 - RNA, 20 nt, Human
caaauauaaauaaaaauaau

SEQ ID NO: 574573 - RNA, 23 nt, Human
acgaggauugggaaaaaguaauu

SEQ ID NO: 574574 - RNA, 19 nt, Human
uggugagugccuguaauca

SEQ ID NO: 574575 - RNA, 23 nt, Human
guaauuccguagguuauuuucag

SEQ ID NO: 574576 - RNA, 22 nt, Human
uggaaaguuuaugguuguauua

SEQ ID NO: 574577 - RNA, 14 nt, Human
caugaacuuguaaa

SEQ ID NO: 574578 - RNA, 16 nt, Human
gaagauguagaggaga

SEQ ID NO: 574579 - RNA, 23 nt, Human
ugaaaaucuuauaauuuaaaaua

SEQ ID NO: 574580 - RNA, 12 nt, Human
cuuccucugagc

SEQ ID NO: 574581 - RNA, 23 nt, Human
gaaaaaguucugcagauaaacag

SEQ ID NO: 574582 - RNA, 18 nt, Human
auuauuuuuuaaaaaaau

SEQ ID NO: 574583 - RNA, 13 nt, Human
auugauuauaugu

SEQ ID NO: 574584 - RNA, 15 nt, Human
cugacucuuaagaag

SEQ ID NO: 574585 - RNA, 19 nt, Human
auacuaauuauacccccug

SEQ ID NO: 574586 - RNA, 20 nt, Human
uaauaaguugcauagguuua

SEQ ID NO: 574587 - RNA, 17 nt, Human
uuuuuaauuauauggcu

SEQ ID NO: 574588 - RNA, 22 nt, Human
gucacaggaaguagaggaggcc

SEQ ID NO: 574589 - RNA, 16 nt, Human
ugccucaccccuugcc

SEQ ID NO: 574590 - RNA, 22 nt, Human
ucuggguuccuuccucugagcc

SEQ ID NO: 574591 - RNA, 19 nt, Human
cucacauuuauauuuuugu

SEQ ID NO: 574592 - RNA, 19 nt, Human
aagucuuucacauuuaaau

SEQ ID NO: 574593 - RNA, 20 nt, Human
cugagccucagucucccucc

SEQ ID NO: 574594 - RNA, 22 nt, Human
uuguaacaagccuccuuuuaaa

SEQ ID NO: 574595 - RNA, 22 nt, Human
aucaccaaggcugauuaaacca

SEQ ID NO: 574596 - RNA, 18 nt, Human
cuccauccugaggcucca

SEQ ID NO: 574597 - RNA, 16 nt, Human
agugaaauauuauuuu

SEQ ID NO: 574598 - RNA, 23 nt, Human
ggucuaucuuugagcgcccacua

SEQ ID NO: 574599 - RNA, 12 nt, Human
auucugaaagca

SEQ ID NO: 574600 - RNA, 23 nt, Human
auucaauaucuuuuuuuuaauaa

SEQ ID NO: 574601 - RNA, 22 nt, Human
aggaugccccgucccccucugg

SEQ ID NO: 574602 - RNA, 15 nt, Human
aaauaauuuuuauau

SEQ ID NO: 574603 - RNA, 19 nt, Human
auaaaagacagugaaagaa

SEQ ID NO: 574604 - RNA, 16 nt, Human
ugcacaucaaaauaug

SEQ ID NO: 574605 - RNA, 12 nt, Human
aaggaugccccg

SEQ ID NO: 574606 - RNA, 19 nt, Human
auugaggacacugauaugg

SEQ ID NO: 574607 - RNA, 17 nt, Human
gucaaagcugaaaugga

SEQ ID NO: 574608 - RNA, 20 nt, Human
ccccuauccuacuuccccuu

SEQ ID NO: 574609 - RNA, 18 nt, Human
acugacucuuaagaagac

SEQ ID NO: 574610 - RNA, 22 nt, Human
ccacagcuguaugauucccagc

SEQ ID NO: 574611 - RNA, 22 nt, Human
ugaccauacuaauuauaccccc

SEQ ID NO: 574612 - RNA, 20 nt, Human
guuccuuccucugagccuug

SEQ ID NO: 574613 - RNA, 12 nt, Human
ccuucagccuga

SEQ ID NO: 574614 - RNA, 14 nt, Human
uacuaauuuuaaaa

SEQ ID NO: 574615 - RNA, 14 nt, Human
cugucucaguccau

SEQ ID NO: 574616 - RNA, 20 nt, Human
ugaaaaucuuauaauuuaaa

SEQ ID NO: 574617 - RNA, 16 nt, Human
ccugaucaccugcccu

SEQ ID NO: 574618 - RNA, 15 nt, Human
agccucagucucccu

SEQ ID NO: 574619 - RNA, 17 nt, Human
uaucaauuuaaaaaaaa

SEQ ID NO: 574620 - RNA, 21 nt, Human
agucucccucccuuggggccu

SEQ ID NO: 574621 - RNA, 17 nt, Human
aaucuuauaauuuaaaa

SEQ ID NO: 574622 - RNA, 18 nt, Human
auuuuuagugaaauauua

SEQ ID NO: 574623 - RNA, 22 nt, Human
caaauuuacagagacagaaagc

SEQ ID NO: 574624 - RNA, 13 nt, Human
ccagcacagccuc

SEQ ID NO: 574625 - RNA, 17 nt, Human
uaacgauaaaagacagu

SEQ ID NO: 574626 - RNA, 22 nt, Human
agucuuucacauuuaaauaaag

SEQ ID NO: 574627 - RNA, 23 nt, Human
gggagccugaucaccugcccugc

SEQ ID NO: 574628 - RNA, 23 nt, Human
cucauguccacugguucuucuug

SEQ ID NO: 574629 - RNA, 11 nt, Human
ggucacaggaa

SEQ ID NO: 574630 - RNA, 16 nt, Human
ccuaagugcagccccg

SEQ ID NO: 574631 - RNA, 22 nt, Human
gaugcaguucugaagaagaugg

SEQ ID NO: 574632 - RNA, 15 nt, Human
accucccccaucucu

SEQ ID NO: 574633 - RNA, 22 nt, Human
caaggaugccccgucccccucu

SEQ ID NO: 574634 - RNA, 17 nt, Human
auauuugaaauauugac

SEQ ID NO: 574635 - RNA, 12 nt, Human
aauaauuuuuaa

SEQ ID NO: 574636 - RNA, 13 nt, Human
ucuauaauuuaaa

SEQ ID NO: 574637 - RNA, 21 nt, Human
cugcccugcugagucccaggc

SEQ ID NO: 574638 - RNA, 14 nt, Human
ugagcucagcccug

SEQ ID NO: 574639 - RNA, 13 nt, Human
cacuguaaaauaa

SEQ ID NO: 574640 - RNA, 20 nt, Human
acggacgaaccuugaaaacu

SEQ ID NO: 574641 - RNA, 17 nt, Human
guuuaauaauuuuuaau

SEQ ID NO: 574642 - RNA, 15 nt, Human
aagugaaaaucuaca

SEQ ID NO: 574643 - RNA, 15 nt, Human
uuaauuuguaguguu

SEQ ID NO: 574644 - RNA, 14 nt, Human
cugaggcuccacuu

SEQ ID NO: 574645 - RNA, 16 nt, Human
auacauguuacaacac

SEQ ID NO: 574646 - RNA, 18 nt, Human
gaggcuccacuuggucug

SEQ ID NO: 574647 - RNA, 12 nt, Human
cagugaaagaaa

SEQ ID NO: 574648 - RNA, 13 nt, Human
gcuggagcucugc

SEQ ID NO: 574649 - RNA, 17 nt, Human
aaagcagggacuugaac

SEQ ID NO: 574650 - RNA, 20 nt, Human
ucacaugaacuuguaaagga

SEQ ID NO: 574651 - RNA, 16 nt, Human
cugagccucagucucc

SEQ ID NO: 574652 - RNA, 14 nt, Human
ggccuucggccucc

SEQ ID NO: 574653 - RNA, 23 nt, Human
caacggggugaaacccugucucu

SEQ ID NO: 574654 - RNA, 15 nt, Human
aaacauaugaauuau

SEQ ID NO: 574655 - RNA, 14 nt, Human
ugcuggagcucugc

SEQ ID NO: 574656 - RNA, 15 nt, Human
aaagaaagaaaauca

SEQ ID NO: 574657 - RNA, 20 nt, Human
cuucaacucccugcccccca

SEQ ID NO: 574658 - RNA, 18 nt, Human
aggaaaaaauaacaauga

SEQ ID NO: 574659 - RNA, 15 nt, Human
gcuguauuuuaaaag

SEQ ID NO: 574660 - RNA, 19 nt, Human
uggaaauguuuacagaucc

SEQ ID NO: 574661 - RNA, 22 nt, Human
caaaugggaaacaaaaggauaa

SEQ ID NO: 574662 - RNA, 15 nt, Human
auuauuuuuuaaaaa

SEQ ID NO: 574663 - RNA, 15 nt, Human
agccugaaagaggaa

SEQ ID NO: 574664 - RNA, 14 nt, Human
aaaacuucagacau

SEQ ID NO: 574665 - RNA, 18 nt, Human
acaaaugcauuucuaaag

SEQ ID NO: 574666 - RNA, 14 nt, Human
aauggcuaagcaaa

SEQ ID NO: 574667 - RNA, 20 nt, Human
aaagacagugaaagaaaaua

SEQ ID NO: 574668 - RNA, 19 nt, Human
auuuucaguuauuauauuu

SEQ ID NO: 574669 - RNA, 14 nt, Human
cuaagcauuccaac

SEQ ID NO: 574670 - RNA, 14 nt, Human
cugcugagucccag

SEQ ID NO: 574671 - RNA, 17 nt, Human
acacuaagagagaauga

SEQ ID NO: 574672 - RNA, 15 nt, Human
ucaaaggacaccauu

SEQ ID NO: 574673 - RNA, 19 nt, Human
cccauggcacucuauguuc

SEQ ID NO: 574674 - RNA, 16 nt, Human
cuuuaugcuaagugaa

SEQ ID NO: 574675 - RNA, 14 nt, Human
aaugauuaugaauu

SEQ ID NO: 574676 - RNA, 18 nt, Human
aaauaacgauaaaagaca

SEQ ID NO: 574677 - RNA, 17 nt, Human
gauaaaagacagugaaa

SEQ ID NO: 574678 - RNA, 15 nt, Human
ugccccgucccccuc

SEQ ID NO: 574679 - RNA, 17 nt, Human
aagacaaggaaaaaaua

SEQ ID NO: 574680 - RNA, 19 nt, Human
gagccucagucucccuccc

SEQ ID NO: 574681 - RNA, 18 nt, Human
ugagcucagcccuggugg

SEQ ID NO: 574682 - RNA, 21 nt, Human
acaugagguacugagagugaa

SEQ ID NO: 574683 - RNA, 16 nt, Human
auuugaugcuacagga

SEQ ID NO: 574684 - RNA, 12 nt, Human
uauaauuuaaaa

SEQ ID NO: 574685 - RNA, 22 nt, Human
cuggguuccuuccucugagccu

SEQ ID NO: 574686 - RNA, 19 nt, Human
auagcuacuaauuuuaaaa

SEQ ID NO: 574687 - RNA, 21 nt, Human
gccaaauauaaauaaaaauaa

SEQ ID NO: 574688 - RNA, 18 nt, Human
guuaguauuguccagguc

SEQ ID NO: 574689 - RNA, 15 nt, Human
auuucauucaauauc

SEQ ID NO: 574690 - RNA, 15 nt, Human
aagaagugaaaaucu

SEQ ID NO: 574691 - RNA, 18 nt, Human
gaaacaaaaggauaauga

SEQ ID NO: 574692 - RNA, 15 nt, Human
gucccaggcugagcc

SEQ ID NO: 574693 - RNA, 20 nt, Human
aauucuugccaaauauaaau

SEQ ID NO: 574694 - RNA, 22 nt, Human
gaugcaguuguugcccacagcu

SEQ ID NO: 574695 - RNA, 14 nt, Human
auccaaugaaauga

SEQ ID NO: 574696 - RNA, 14 nt, Human
gaaugauuaugaau

SEQ ID NO: 574697 - RNA, 19 nt, Human
acucugucucaguccauga

SEQ ID NO: 574698 - RNA, 20 nt, Human
acaagacccaaaaggcagaa

SEQ ID NO: 574699 - RNA, 22 nt, Human
aggauggcuaguaucaaaagaa

SEQ ID NO: 574700 - RNA, 18 nt, Human
uaucaaaagaaagaaaau

SEQ ID NO: 574701 - RNA, 17 nt, Human
ugaaauaagccagacau

SEQ ID NO: 574702 - RNA, 11 nt, Human
ugcagugagcc

SEQ ID NO: 574703 - RNA, 20 nt, Human
aagucuuucacauuuaaaua

SEQ ID NO: 574704 - RNA, 15 nt, Human
cacaggacagcccuu

SEQ ID NO: 574705 - RNA, 21 nt, Human
ugaugcuacaggauuugaaau

SEQ ID NO: 574706 - RNA, 20 nt, Human
caaacauccuacaagacaca

SEQ ID NO: 574707 - RNA, 15 nt, Human
uaggaaauauuuauu

SEQ ID NO: 574708 - RNA, 15 nt, Human
ugauuucauucaaua

SEQ ID NO: 574709 - RNA, 12 nt, Human
cuccauuuuuag

SEQ ID NO: 574710 - RNA, 19 nt, Human
ugcacacagcacgggggcc

SEQ ID NO: 574711 - RNA, 15 nt, Human
acaggguuuauguuu

SEQ ID NO: 574712 - RNA, 17 nt, Human
auuauuuuuuaaaaaaa

SEQ ID NO: 574713 - RNA, 15 nt, Human
cuacuaauuuuaaaa

SEQ ID NO: 574714 - RNA, 15 nt, Human
ucauaauaaguugca

SEQ ID NO: 574715 - RNA, 16 nt, Human
ugaaauuguauuacaa

SEQ ID NO: 574716 - RNA, 12 nt, Human
uauuauuuuuua

SEQ ID NO: 574717 - RNA, 16 nt, Human
ccuaugcagaggucca

SEQ ID NO: 574718 - RNA, 15 nt, Human
ccacaggaaccacaa

SEQ ID NO: 574719 - RNA, 14 nt, Human
aaagaggaaugaag

SEQ ID NO: 574720 - RNA, 17 nt, Human
uaugcuaagugaaauaa

SEQ ID NO: 574721 - RNA, 15 nt, Human
uccuacaagacacag

SEQ ID NO: 574722 - RNA, 21 nt, Human
auaguuguaccgcaaugugac

SEQ ID NO: 574723 - RNA, 22 nt, Human
gucucuacuaaaaauacaaaaa

SEQ ID NO: 574724 - RNA, 17 nt, Human
gccuaagugcagccccg

SEQ ID NO: 574725 - RNA, 16 nt, Human
aaauauuuauuuuaau

SEQ ID NO: 574726 - RNA, 17 nt, Human
ccaaaaaucucaauauu

SEQ ID NO: 574727 - RNA, 16 nt, Human
uacaaaugggaaacaa

SEQ ID NO: 574728 - RNA, 14 nt, Human
agacaucaacagau

SEQ ID NO: 574729 - RNA, 15 nt, Human
aaucucaauauuuca

SEQ ID NO: 574730 - RNA, 20 nt, Human
uuaacacaugauccugcaau

SEQ ID NO: 574731 - RNA, 18 nt, Human
guauuauuuuuuaaaaaa

SEQ ID NO: 574732 - RNA, 14 nt, Human
uggacucaccuccc

SEQ ID NO: 574733 - RNA, 20 nt, Human
aguuuuuuuuuaaaaaagaa

SEQ ID NO: 574734 - RNA, 18 nt, Human
gcacuccagccugagcga

SEQ ID NO: 574735 - RNA, 11 nt, Human
aauuuaaauau

SEQ ID NO: 574736 - RNA, 15 nt, Human
cagccagcacagccu

SEQ ID NO: 574737 - RNA, 21 nt, Human
gcccauccugccccugagccc

SEQ ID NO: 574738 - RNA, 14 nt, Human
agaaaugaaagcag

SEQ ID NO: 574739 - RNA, 14 nt, Human
aguuuuuuuuuaaa

SEQ ID NO: 574740 - RNA, 21 nt, Human
cgaaguauccuucagccugaa

SEQ ID NO: 574741 - RNA, 19 nt, Human
guuguauuauuuuuuaaaa

SEQ ID NO: 574742 - RNA, 15 nt, Human
gaagauguagaggag

SEQ ID NO: 574743 - RNA, 21 nt, Human
gcugagucccaggcugagccu

SEQ ID NO: 574744 - RNA, 22 nt, Human
agaaugagagacacacugaaga

SEQ ID NO: 574745 - RNA, 20 nt, Human
uuaaguuuuuuuuuaaaaaa

SEQ ID NO: 574746 - RNA, 19 nt, Human
acauuuguauaaaauaauu

SEQ ID NO: 574747 - RNA, 20 nt, Human
cuggccuucggccuccaucc

SEQ ID NO: 574748 - RNA, 21 nt, Human
auggcagcuuuccucaaaacu

SEQ ID NO: 574749 - RNA, 19 nt, Human
uauauuuuuuguuaaauga

SEQ ID NO: 574750 - RNA, 19 nt, Human
agaguuuagcuggaaaagu

SEQ ID NO: 574751 - RNA, 16 nt, Human
ugagaugcuagaacuc

SEQ ID NO: 574752 - RNA, 14 nt, Human
uccagauccuggaa

SEQ ID NO: 574753 - RNA, 18 nt, Human
gagccucagucucccucc

SEQ ID NO: 574754 - RNA, 22 nt, Human
aguauguuagugcaaauuguca

SEQ ID NO: 574755 - RNA, 16 nt, Human
gcuucacuguaaaaua

SEQ ID NO: 574756 - RNA, 14 nt, Human
auuguccaggucua

SEQ ID NO: 574757 - RNA, 22 nt, Human
uggacgagaaaacaauaacgau

SEQ ID NO: 574758 - RNA, 15 nt, Human
acagugaaagaaaau

SEQ ID NO: 574759 - RNA, 19 nt, Human
cucauggaauuggagcucg

SEQ ID NO: 574760 - RNA, 13 nt, Human
aacaagccuccuu

SEQ ID NO: 574761 - RNA, 15 nt, Human
uucacuguaaaauaa

SEQ ID NO: 574762 - RNA, 14 nt, Human
cuugagguaaaagc

SEQ ID NO: 574763 - RNA, 23 nt, Human
gaaaacaauaacgauaaaagaca

SEQ ID NO: 574764 - RNA, 18 nt, Human
acagagacagaaagcaga

SEQ ID NO: 574765 - RNA, 10 nt, Human
caacucccug

SEQ ID NO: 574766 - RNA, 12 nt, Human
acacugaagaag

SEQ ID NO: 574767 - RNA, 15 nt, Human
auaucaauuuaaaaa

SEQ ID NO: 574768 - RNA, 19 nt, Human
agccugaucaccugcccug

SEQ ID NO: 574769 - RNA, 12 nt, Human
cuaagaagugaa

SEQ ID NO: 574770 - RNA, 19 nt, Human
cucuguucugcacacagca

SEQ ID NO: 574771 - RNA, 16 nt, Human
uggcaagcucuaucac

SEQ ID NO: 574772 - RNA, 23 nt, Human
cuggccgggagccugaucaccug

SEQ ID NO: 574773 - RNA, 12 nt, Human
caggacagcccu

SEQ ID NO: 574774 - RNA, 24 nt, Human
cauucuggaauaauccuaaacaua

SEQ ID NO: 574775 - RNA, 17 nt, Human
cugccucagaaaacaag

SEQ ID NO: 574776 - RNA, 14 nt, Human
cuacaagacacagu

SEQ ID NO: 574777 - RNA, 14 nt, Human
cuuggucugugaga

SEQ ID NO: 574778 - RNA, 18 nt, Human
auagucaaauugugugaa

SEQ ID NO: 574779 - RNA, 16 nt, Human
cugaucaccugcccug

SEQ ID NO: 574780 - RNA, 15 nt, Human
aagccagauuuuccu

SEQ ID NO: 574781 - RNA, 21 nt, Human
uaaaagacagugaaagaaaau

SEQ ID NO: 574782 - RNA, 20 nt, Human
uuccacagaagcuccaggua

SEQ ID NO: 574783 - RNA, 18 nt, Human
uuuguuaaaugauuucau

SEQ ID NO: 574784 - RNA, 14 nt, Human
cuaaacauaugaau

SEQ ID NO: 574785 - RNA, 13 nt, Human
auaaauaaaaaua

SEQ ID NO: 574786 - RNA, 15 nt, Human
uguuaaaugauuuca

SEQ ID NO: 574787 - RNA, 12 nt, Human
cagauuuuccug

SEQ ID NO: 574788 - RNA, 14 nt, Human
uaaaggaauuuaaa

SEQ ID NO: 574789 - RNA, 12 nt, Human
ccccuugccaua

SEQ ID NO: 574790 - RNA, 18 nt, Human
uccuaauuccacagcugc

SEQ ID NO: 574791 - RNA, 23 nt, Human
cagagguugcagugagccgagau

SEQ ID NO: 574792 - RNA, 21 nt, Human
auaugcucuaaacauguuuau

SEQ ID NO: 574793 - RNA, 16 nt, Human
uguaguccuguaaugg

SEQ ID NO: 574794 - RNA, 14 nt, Human
aagcaucacaugaa

SEQ ID NO: 574795 - RNA, 20 nt, Human
uaugcuucuguuuuauaauu

SEQ ID NO: 574796 - RNA, 14 nt, Human
uuauuauauuuaca

SEQ ID NO: 574797 - RNA, 18 nt, Human
ccaagccuggcaagggaa

SEQ ID NO: 574798 - RNA, 21 nt, Human
aaacgaggauugggaaaaagu

SEQ ID NO: 574799 - RNA, 14 nt, Human
guaacuaauuuuaa

SEQ ID NO: 574800 - RNA, 18 nt, Human
uggagggaagccuugggg

SEQ ID NO: 574801 - RNA, 17 nt, Human
aauaacaauaaaagaca

SEQ ID NO: 574802 - RNA, 16 nt, Human
gccaugugcuaguaau

SEQ ID NO: 574803 - RNA, 18 nt, Human
guuucaaacauauauaac

SEQ ID NO: 574804 - RNA, 13 nt, Human
auuuuaaaagaau

SEQ ID NO: 574805 - RNA, 20 nt, Human
auuacauuuguauaaaauaa

SEQ ID NO: 574806 - RNA, 18 nt, Human
ugcauagguuuaauaauu

SEQ ID NO: 574807 - RNA, 16 nt, Human
uauaucaauuuaaaaa

SEQ ID NO: 574808 - RNA, 11 nt, Human
gagguaaaagc

SEQ ID NO: 574809 - RNA, 14 nt, Human
ggacucaccucccc

SEQ ID NO: 574810 - RNA, 17 nt, Human
cgauaaaagacagugaa

SEQ ID NO: 574811 - RNA, 11 nt, Human
cauaugaaaag

SEQ ID NO: 574812 - RNA, 15 nt, Human
ggcaagcucuaucac

SEQ ID NO: 574813 - RNA, 12 nt, Human
cauagaaguaaa

SEQ ID NO: 574814 - RNA, 19 nt, Human
uccagaaagugacaagcuc

SEQ ID NO: 574815 - RNA, 16 nt, Human
gagaaacuggaacucu

SEQ ID NO: 574816 - RNA, 23 nt, Human
uuuauaugcuucuguuuuauaau

SEQ ID NO: 574817 - RNA, 20 nt, Human
uacaucccuuaccugggaaa

SEQ ID NO: 574818 - RNA, 17 nt, Human
acuuccagauccuggaa

SEQ ID NO: 574819 - RNA, 17 nt, Human
auuuuaauaauguuuca

SEQ ID NO: 574820 - RNA, 14 nt, Human
uugggaaaaaguaa

SEQ ID NO: 574821 - RNA, 13 nt, Human
aaaguguuugaaa

SEQ ID NO: 574822 - RNA, 20 nt, Human
auaauccuaaacauaugaau

SEQ ID NO: 574823 - RNA, 16 nt, Human
aacuugguuuuaauua

SEQ ID NO: 574824 - RNA, 14 nt, Human
ugguauguuuucag

SEQ ID NO: 574825 - RNA, 17 nt, Human
aauaugcucuaaacaug

SEQ ID NO: 574826 - RNA, 16 nt, Human
uaaauaaaaauaaucc

SEQ ID NO: 574827 - RNA, 20 nt, Human
ccagcuggccgggagccuga

SEQ ID NO: 574828 - RNA, 19 nt, Human
cagauccccaagccuggca

SEQ ID NO: 574829 - RNA, 13 nt, Human
cugccuucucaac

SEQ ID NO: 574830 - RNA, 13 nt, Human
cauuuguauaaaa

SEQ ID NO: 574831 - RNA, 16 nt, Human
ugagcucagcccuggu

SEQ ID NO: 574832 - RNA, 15 nt, Human
ccucauguccacugg

SEQ ID NO: 574833 - RNA, 21 nt, Human
cccccucuggcuccagcuggc

SEQ ID NO: 574834 - RNA, 16 nt, Human
agccucagucucccuc

SEQ ID NO: 574835 - RNA, 15 nt, Human
gcccacuagacccac

SEQ ID NO: 574836 - RNA, 20 nt, Human
augucgucaaagcugaaaug

SEQ ID NO: 574837 - RNA, 14 nt, Human
ucuauaauuuaaau

SEQ ID NO: 574838 - RNA, 22 nt, Human
gaaaaucuuauaauuuaaaaua

SEQ ID NO: 574839 - RNA, 21 nt, Human
guccccuauccuacuuccccu

SEQ ID NO: 574840 - RNA, 23 nt, Human
aaagcccagcuugaaaccuucac

SEQ ID NO: 574841 - RNA, 16 nt, Human
aaauauaaauaaaaau

SEQ ID NO: 574842 - RNA, 20 nt, Human
uugaacccgggaggcagagg

SEQ ID NO: 574843 - RNA, 15 nt, Human
cuucucuucacaguc

SEQ ID NO: 574844 - RNA, 22 nt, Human
agugagcagucaggaaagagaa

SEQ ID NO: 574845 - RNA, 22 nt, Human
uguauacugugugcuaaaacaa

SEQ ID NO: 574846 - RNA, 11 nt, Human
auuuaaaaauc

SEQ ID NO: 574847 - RNA, 23 nt, Human
gauauuaaccaggggccaugaau

SEQ ID NO: 574848 - RNA, 18 nt, Human
gaugccccgucccccucu

SEQ ID NO: 574849 - RNA, 21 nt, Human
cagagguccacaacacacaga

SEQ ID NO: 574850 - RNA, 15 nt, Human
cagucucccucccuu

SEQ ID NO: 574851 - RNA, 14 nt, Human
cacuaaacaaagag

SEQ ID NO: 574852 - RNA, 21 nt, Human
cuaagcuucacuguaaaauaa

SEQ ID NO: 574853 - RNA, 23 nt, Human
aucucuucuggguuccuuccucu

SEQ ID NO: 574854 - RNA, 20 nt, Human
gaaacgaggauugggaaaaa

SEQ ID NO: 574855 - RNA, 19 nt, Human
uuuauaucaauuuaaaaaa

SEQ ID NO: 574856 - RNA, 23 nt, Human
ugaaaugaguuuuucuuuucauu

SEQ ID NO: 574857 - RNA, 21 nt, Human
ccuuuuuuugaaaaaaagcuu

SEQ ID NO: 574858 - RNA, 22 nt, Human
cacagauuugagcucagcccug

SEQ ID NO: 574859 - RNA, 15 nt, Human
aagccuggcaaggga

SEQ ID NO: 574860 - RNA, 18 nt, Human
gaaaauaucacuugucaa

SEQ ID NO: 574861 - RNA, 16 nt, Human
ucaucaaugaaugaau

SEQ ID NO: 574862 - RNA, 16 nt, Human
auuuuaauaauguuuc

SEQ ID NO: 574863 - RNA, 16 nt, Human
aauuacauuuguauaa

SEQ ID NO: 574864 - RNA, 20 nt, Human
gcagagaugaggccgccaug

SEQ ID NO: 574865 - RNA, 14 nt, Human
ccaugggacaggga

SEQ ID NO: 574866 - RNA, 19 nt, Human
cauggaauuggagcucgug

SEQ ID NO: 574867 - RNA, 23 nt, Human
gaaugagagacacacugaagaag

SEQ ID NO: 574868 - RNA, 15 nt, Human
agagacagaaagcag

SEQ ID NO: 574869 - RNA, 17 nt, Human
uaaaagacagugaaaga

SEQ ID NO: 574870 - RNA, 15 nt, Human
cucgugggacaguca

SEQ ID NO: 574871 - RNA, 22 nt, Human
aauaauccuaaacauaugaauu

SEQ ID NO: 574872 - RNA, 19 nt, Human
gaaaauaacgauaaaagac

SEQ ID NO: 574873 - RNA, 16 nt, Human
aagcauuuagauguau

SEQ ID NO: 574874 - RNA, 18 nt, Human
cccaagccuggcaaggga

SEQ ID NO: 574875 - RNA, 23 nt, Human
uccaacuaucucauuuccaagca

SEQ ID NO: 574876 - RNA, 18 nt, Human
ccauccugccccugagcc

SEQ ID NO: 574877 - RNA, 21 nt, Human
ugcucaauaaaguacaagagc

SEQ ID NO: 574878 - RNA, 19 nt, Human
guacaagagcuuaacagug

SEQ ID NO: 574879 - RNA, 14 nt, Human
uugugauugauuau

SEQ ID NO: 574880 - RNA, 20 nt, Human
gcuugcagagaugaggccgc

SEQ ID NO: 574881 - RNA, 17 nt, Human
uccuacaagacacagug

SEQ ID NO: 574882 - RNA, 17 nt, Human
augauuaaguaaugaua

SEQ ID NO: 574883 - RNA, 19 nt, Human
cccugccccccagcccucc

SEQ ID NO: 574884 - RNA, 14 nt, Human
caguucugaagaag

SEQ ID NO: 574885 - RNA, 20 nt, Human
uaaaacaagcacuaaacaaa

SEQ ID NO: 574886 - RNA, 16 nt, Human
aagaaaauaacaauaa

SEQ ID NO: 574887 - RNA, 22 nt, Human
ugaguuuuucuuuucauuuacc

SEQ ID NO: 574888 - RNA, 23 nt, Human
aauaauccucaguuuuugugaaa

SEQ ID NO: 574889 - RNA, 14 nt, Human
augggccauaugaa

SEQ ID NO: 574890 - RNA, 15 nt, Human
auaauccuaaacaua

SEQ ID NO: 574891 - RNA, 19 nt, Human
acuucagcgguuuauauaa

SEQ ID NO: 574892 - RNA, 11 nt, Human
ucaccuccccc

SEQ ID NO: 574893 - RNA, 16 nt, Human
ccugccccccagcccu

SEQ ID NO: 574894 - RNA, 18 nt, Human
cuccagccugagcgacag

SEQ ID NO: 574895 - RNA, 22 nt, Human
agaaagugacaagcucacagac

SEQ ID NO: 574896 - RNA, 17 nt, Human
ugaaauauuauuuuaua

SEQ ID NO: 574897 - RNA, 14 nt, Human
auauuuauuuuaau

SEQ ID NO: 574898 - RNA, 13 nt, Human
ucacuguaaaaua

SEQ ID NO: 574899 - RNA, 22 nt, Human
auuacuguaagaaaauaucacu

SEQ ID NO: 574900 - RNA, 20 nt, Human
guucugcagauaaacaguag

SEQ ID NO: 574901 - RNA, 20 nt, Human
cacuagacccacuggacuca

SEQ ID NO: 574902 - RNA, 22 nt, Human
ccgggaggcagagguugcagug

SEQ ID NO: 574903 - RNA, 17 nt, Human
cuuccucugagccuugg

SEQ ID NO: 574904 - RNA, 15 nt, Human
gccuaagugcagccc

SEQ ID NO: 574905 - RNA, 23 nt, Human
uagacacacaugaaguccaagca

SEQ ID NO: 574906 - RNA, 18 nt, Human
cugagucccaggcugagc

SEQ ID NO: 574907 - RNA, 22 nt, Human
auauuuacaaaugggaaacaaa

SEQ ID NO: 574908 - RNA, 18 nt, Human
auuugcuggagcucugcc

SEQ ID NO: 574909 - RNA, 21 nt, Human
caccagucugacuguuuccau

SEQ ID NO: 574910 - RNA, 16 nt, Human
ugacuuaaugccacua

SEQ ID NO: 574911 - RNA, 13 nt, Human
uuccucugagccu

SEQ ID NO: 574912 - RNA, 22 nt, Human
uauuccuuuuucucuccucucc

SEQ ID NO: 574913 - RNA, 22 nt, Human
ugaagcaaaauuuuuucucuag

SEQ ID NO: 574914 - RNA, 22 nt, Human
cagcacgggggccaaggaugcc

SEQ ID NO: 574915 - RNA, 14 nt, Human
cuccagugagacag

SEQ ID NO: 574916 - RNA, 17 nt, Human
aaauaacgauaaaagac

SEQ ID NO: 574917 - RNA, 19 nt, Human
ucagugucaaugcagcccc

SEQ ID NO: 574918 - RNA, 19 nt, Human
ucaauucuugccaaauaua

SEQ ID NO: 574919 - RNA, 14 nt, Human
uccacaacacacag

SEQ ID NO: 574920 - RNA, 18 nt, Human
caugaauuaguuuuauau

SEQ ID NO: 574921 - RNA, 18 nt, Human
auaaaguguuugaaagcu

SEQ ID NO: 574922 - RNA, 20 nt, Human
aaaagacagugaaagaaaau

SEQ ID NO: 574923 - RNA, 15 nt, Human
ugccccccagcccuc

SEQ ID NO: 574924 - RNA, 17 nt, Human
agcucugcccauccugc

SEQ ID NO: 574925 - RNA, 18 nt, Human
cucuggccuucggccucc

SEQ ID NO: 574926 - RNA, 11 nt, Human
caauaaaagac

SEQ ID NO: 574927 - RNA, 19 nt, Human
ucaguccaugaagauguag

SEQ ID NO: 574928 - RNA, 17 nt, Human
caaauccaaugaaauga

SEQ ID NO: 574929 - RNA, 15 nt, Human
aucaaaggacaccau

SEQ ID NO: 574930 - RNA, 23 nt, Human
gggccuaugcagagguccacaac

SEQ ID NO: 574931 - RNA, 14 nt, Human
uggcuugaguuuaa

SEQ ID NO: 574932 - RNA, 13 nt, Human
aucaggcuggcca

SEQ ID NO: 574933 - RNA, 13 nt, Human
cucaccuccccca

SEQ ID NO: 574934 - RNA, 13 nt, Human
ucuuauaauuuaa

SEQ ID NO: 574935 - RNA, 20 nt, Human
ugaggcuccacuuggucugu

SEQ ID NO: 574936 - RNA, 18 nt, Human
cagggaggacgcucucug

SEQ ID NO: 574937 - RNA, 15 nt, Human
ccccugagcuugcag

SEQ ID NO: 574938 - RNA, 12 nt, Human
cucccugccccc

SEQ ID NO: 574939 - RNA, 19 nt, Human
auuggagcucgugggacag

SEQ ID NO: 574940 - RNA, 17 nt, Human
aaauguucaucaaugaa

SEQ ID NO: 574941 - RNA, 14 nt, Human
acccaaaaggcaga

SEQ ID NO: 574942 - RNA, 14 nt, Human
uuaugauuaaguaa

SEQ ID NO: 574943 - RNA, 22 nt, Human
uuugaugcuacaggauuugaaa

SEQ ID NO: 574944 - RNA, 11 nt, Human
cgauaaaagac

SEQ ID NO: 574945 - RNA, 18 nt, Human
uuuauguuuaauucugaa

SEQ ID NO: 574946 - RNA, 13 nt, Human
aucaaugaaugaa

SEQ ID NO: 574947 - RNA, 13 nt, Human
uacagagacagaa

SEQ ID NO: 574948 - RNA, 18 nt, Human
acaaauccaaugaaauga

SEQ ID NO: 574949 - RNA, 12 nt, Human
agaaaacaauaa

SEQ ID NO: 574950 - RNA, 22 nt, Human
gcagagagguagggauggggcu

SEQ ID NO: 574951 - RNA, 14 nt, Human
caaggaaaaaauaa

SEQ ID NO: 574952 - RNA, 19 nt, Human
cucugcauacucauuagga

SEQ ID NO: 574953 - RNA, 18 nt, Human
acauuugcucauggaauu

SEQ ID NO: 574954 - RNA, 21 nt, Human
aucuuuuuuuuaauaaaccau

SEQ ID NO: 574955 - RNA, 20 nt, Human
cuuauucacaagacccaaaa

SEQ ID NO: 574956 - RNA, 19 nt, Human
ccaccugccuauauuuuuu

SEQ ID NO: 574957 - RNA, 13 nt, Human
cuucucaacucca

SEQ ID NO: 574958 - RNA, 20 nt, Human
guccccuauccuacuucccc

SEQ ID NO: 574959 - RNA, 15 nt, Human
acugaagaagcacca

SEQ ID NO: 574960 - RNA, 19 nt, Human
ugaucaccugcccugcuga

SEQ ID NO: 574961 - RNA, 23 nt, Human
caccucauggaauuggagcucgu

SEQ ID NO: 574962 - RNA, 20 nt, Human
gaauucauucacucaacaaa

SEQ ID NO: 574963 - RNA, 23 nt, Human
uccagguagaggguguguaagua

SEQ ID NO: 574964 - RNA, 21 nt, Human
cccccauuguggucacaggaa

SEQ ID NO: 574965 - RNA, 11 nt, Human
gcaugguuuag

SEQ ID NO: 574966 - RNA, 18 nt, Human
accaccugccuauauuuu

SEQ ID NO: 574967 - RNA, 22 nt, Human
caucgcaauguaagacucggga

SEQ ID NO: 574968 - RNA, 17 nt, Human
ucuuucacauuuaaaua

SEQ ID NO: 574969 - RNA, 18 nt, Human
caaggcuagaaccaccug

SEQ ID NO: 574970 - RNA, 18 nt, Human
agcaaaauuuuuucucua

SEQ ID NO: 574971 - RNA, 19 nt, Human
auguuuacagauccccaag

SEQ ID NO: 574972 - RNA, 21 nt, Human
auuuuccugaaaacccuugcc

SEQ ID NO: 574973 - RNA, 22 nt, Human
auggaaauguuuacagaucccc

SEQ ID NO: 574974 - RNA, 23 nt, Human
agcccuccuuaucaaaggacacc

SEQ ID NO: 574975 - RNA, 20 nt, Human
ccauacuaauuauacccccu

SEQ ID NO: 574976 - RNA, 13 nt, Human
ccaaaagguauuu

SEQ ID NO: 574977 - RNA, 21 nt, Human
ugcccauccugccccugagcc

SEQ ID NO: 574978 - RNA, 16 nt, Human
cagcuuuccucaaaac

SEQ ID NO: 574979 - RNA, 12 nt, Human
ucccccucuggc

SEQ ID NO: 574980 - RNA, 13 nt, Human
uaugaaauauuau

SEQ ID NO: 574981 - RNA, 20 nt, Human
gaacguaaucguguccccua

SEQ ID NO: 574982 - RNA, 14 nt, Human
ugugaaaagcucca

SEQ ID NO: 574983 - RNA, 16 nt, Human
uaaugaauacuuuaua

SEQ ID NO: 574984 - RNA, 16 nt, Human
ugaaguccaagcauuu

SEQ ID NO: 574985 - RNA, 19 nt, Human
ucaguuauuauauuuacaa

SEQ ID NO: 574986 - RNA, 15 nt, Human
auccugccccugagc

SEQ ID NO: 574987 - RNA, 16 nt, Human
uugccauaauuacuau

SEQ ID NO: 574988 - RNA, 23 nt, Human
agcucugcccauccugccccuga

SEQ ID NO: 574989 - RNA, 15 nt, Human
cuugaaaacuuuaug

SEQ ID NO: 574990 - RNA, 17 nt, Human
ccacuggacucaccucc

SEQ ID NO: 574991 - RNA, 14 nt, Human
ggccgggagccuga

SEQ ID NO: 574992 - RNA, 19 nt, Human
acagucaccucauggaauu

SEQ ID NO: 574993 - RNA, 13 nt, Human
uuaaaaaagaaac

SEQ ID NO: 574994 - RNA, 15 nt, Human
caggaaguagaggag

SEQ ID NO: 574995 - RNA, 15 nt, Human
uuauagcuacuaauu

SEQ ID NO: 574996 - RNA, 19 nt, Human
cuagaguuuagcuggaaaa

SEQ ID NO: 574997 - RNA, 12 nt, Human
gguuuauauaag

SEQ ID NO: 574998 - RNA, 19 nt, Human
ggaauuucuucaacucccu

SEQ ID NO: 574999 - RNA, 22 nt, Human
gagucccaggcugagccucagu

SEQ ID NO: 575000 - RNA, 23 nt, Human
uuuuauagcuacuaauuuuaaaa

SEQ ID NO: 575001 - RNA, 21 nt, Human
ugaaacgaggauugggaaaaa

SEQ ID NO: 575002 - RNA, 17 nt, Human
ucauacuucuuaggguu

SEQ ID NO: 575003 - RNA, 18 nt, Human
gaaaugaaagcagggacu

SEQ ID NO: 575004 - RNA, 23 nt, Human
aacuuguaaaggaauuuaaaaau

SEQ ID NO: 575005 - RNA, 20 nt, Human
cugauauuggacaguaaaau

SEQ ID NO: 575006 - RNA, 16 nt, Human
gacauagaauuaacac

SEQ ID NO: 575007 - RNA, 23 nt, Human
gucucccucccuuggggccuaug

SEQ ID NO: 575008 - RNA, 15 nt, Human
uuuaugguuguauua

SEQ ID NO: 575009 - RNA, 20 nt, Human
ucuucuggguuccuuccucu

SEQ ID NO: 575010 - RNA, 21 nt, Human
agcccuucuuuccacagaagc

SEQ ID NO: 575011 - RNA, 18 nt, Human
cugagggcauagaaguaa

SEQ ID NO: 575012 - RNA, 19 nt, Human
ccccucuggcuccagcugg

SEQ ID NO: 575013 - RNA, 16 nt, Human
acauuugcucauggaa

SEQ ID NO: 575014 - RNA, 20 nt, Human
acaagacacagugaccauac

SEQ ID NO: 575015 - RNA, 17 nt, Human
uaacugauuuguaacaa

SEQ ID NO: 575016 - RNA, 15 nt, Human
agacagcucugcaua

SEQ ID NO: 575017 - RNA, 13 nt, Human
ccucccccaucuc

SEQ ID NO: 575018 - RNA, 17 nt, Human
ccaaggaugccccgucc

SEQ ID NO: 575019 - RNA, 17 nt, Human
auaucaauuuaaaaaaa

SEQ ID NO: 575020 - RNA, 19 nt, Human
aauguuuacagauccccaa

SEQ ID NO: 575021 - RNA, 23 nt, Human
caccaaggagccaaacauccuac

SEQ ID NO: 575022 - RNA, 14 nt, Human
cuggaaaucagggu

SEQ ID NO: 575023 - RNA, 22 nt, Human
auaucuuuuuuuuaauaaacca

SEQ ID NO: 575024 - RNA, 23 nt, Human
gaggcauuuaggccaugggacag

SEQ ID NO: 575025 - RNA, 22 nt, Human
agcccuccuuaucaaaggacac

SEQ ID NO: 575026 - RNA, 12 nt, Human
aauuuaaauaua

SEQ ID NO: 575027 - RNA, 19 nt, Human
gcucauggaauuggagcuc

SEQ ID NO: 575028 - RNA, 14 nt, Human
cucccucccuuggg

SEQ ID NO: 575029 - RNA, 21 nt, Human
ucuuaggguuaugauuaagua

SEQ ID NO: 575030 - RNA, 22 nt, Human
uuuuauagcuacuaauuuuaaa

SEQ ID NO: 575031 - RNA, 14 nt, Human
acauagugaggagc

SEQ ID NO: 575032 - RNA, 17 nt, Human
ucuauaauuuaaauaua

SEQ ID NO: 575033 - RNA, 20 nt, Human
augguuuagaaagcuugccc

SEQ ID NO: 575034 - RNA, 20 nt, Human
auuuugugauugauuauaug

SEQ ID NO: 575035 - RNA, 16 nt, Human
gaaaaaauaacaauga

SEQ ID NO: 575036 - RNA, 16 nt, Human
acauuuauauuuuugu

SEQ ID NO: 575037 - RNA, 21 nt, Human
aaacaauaacgauaaaagaca

SEQ ID NO: 575038 - RNA, 16 nt, Human
ucuucaacucccugcc

SEQ ID NO: 575039 - RNA, 16 nt, Human
ccuccuuaucaaagga

SEQ ID NO: 575040 - RNA, 17 nt, Human
aguugauaaguacauga

SEQ ID NO: 575041 - RNA, 23 nt, Human
aguacucauacauguuacaacac

SEQ ID NO: 575042 - RNA, 14 nt, Human
agucucccucccuu

SEQ ID NO: 575043 - RNA, 15 nt, Human
ccgucccccucuggc

SEQ ID NO: 575044 - RNA, 22 nt, Human
guacacugccuucucaacucca

SEQ ID NO: 575045 - RNA, 16 nt, Human
aauaaaguguuugaaa

SEQ ID NO: 575046 - RNA, 21 nt, Human
aggguuaugauuaaguaauga

SEQ ID NO: 575047 - RNA, 13 nt, Human
ccaaggaugcccc

SEQ ID NO: 575048 - RNA, 14 nt, Human
ggcuccagcuggcc

SEQ ID NO: 575049 - RNA, 15 nt, Human
ggcaauagucaaauu

SEQ ID NO: 575050 - RNA, 18 nt, Human
uaaugaauacuuuauaaa

SEQ ID NO: 575051 - RNA, 22 nt, Human
ggacaguaaaauccacagacca

SEQ ID NO: 575052 - RNA, 15 nt, Human
aaauauuuauuuuaa

SEQ ID NO: 575053 - RNA, 22 nt, Human
auuuucuucucacauuuauauu

SEQ ID NO: 575054 - RNA, 12 nt, Human
aaaauaacaaua

SEQ ID NO: 575055 - RNA, 23 nt, Human
ggucucagugucaaugcagcccc

SEQ ID NO: 575056 - RNA, 21 nt, Human
augaauacuuuauaaaggauu

SEQ ID NO: 575057 - RNA, 21 nt, Human
ucuucaacucccugcccccca

SEQ ID NO: 575058 - RNA, 16 nt, Human
auuauacccccugcaa

SEQ ID NO: 575059 - RNA, 16 nt, Human
ccugagcuugcagaga

SEQ ID NO: 575060 - RNA, 16 nt, Human
aaaauaacaauaaaag

SEQ ID NO: 575061 - RNA, 17 nt, Human
auuuucuauaauuuaaa

SEQ ID NO: 575062 - RNA, 15 nt, Human
ccagcacagccucuu

SEQ ID NO: 575063 - RNA, 16 nt, Human
uccuguaauggaagca

SEQ ID NO: 575064 - RNA, 13 nt, Human
ccugagcuugcag

SEQ ID NO: 575065 - RNA, 17 nt, Human
cugaucaccugcccugc

SEQ ID NO: 575066 - RNA, 16 nt, Human
ucuugagguaaaagca

SEQ ID NO: 575067 - RNA, 13 nt, Human
gaaccuaggguga

SEQ ID NO: 575068 - RNA, 19 nt, Human
gccugaucaccugcccugc

SEQ ID NO: 575069 - RNA, 16 nt, Human
cauuucuaaagccauu

SEQ ID NO: 575070 - RNA, 14 nt, Human
gcugauuaaaccaa

SEQ ID NO: 575071 - RNA, 19 nt, Human
aaaaucuuauaauuuaaaa

SEQ ID NO: 575072 - RNA, 20 nt, Human
uaagugaaauaagccagaca

SEQ ID NO: 575073 - RNA, 20 nt, Human
ggccaugggacagggaggac

SEQ ID NO: 575074 - RNA, 23 nt, Human
acucuauguucuaagaagugaaa

SEQ ID NO: 575075 - RNA, 15 nt, Human
ccugcaaagcccagc

SEQ ID NO: 575076 - RNA, 18 nt, Human
uuuugugaagcaaaauuu

SEQ ID NO: 575077 - RNA, 22 nt, Human
ggcagcuuuccucaaaacuuca

SEQ ID NO: 575078 - RNA, 18 nt, Human
caugaagauguagaggag

SEQ ID NO: 575079 - RNA, 20 nt, Human
aaggagccaaacauccuaca

SEQ ID NO: 575080 - RNA, 17 nt, Human
augccccgucccccucu

SEQ ID NO: 575081 - RNA, 16 nt, Human
cagauccccaagccug

SEQ ID NO: 575082 - RNA, 23 nt, Human
ggaugguucccuugaugaagaag

SEQ ID NO: 575083 - RNA, 21 nt, Human
aaagaaaauaacgauaaaaga

SEQ ID NO: 575084 - RNA, 17 nt, Human
acucaccucccccaucu

SEQ ID NO: 575085 - RNA, 22 nt, Human
cucagcccuggugggcagagag

SEQ ID NO: 575086 - RNA, 15 nt, Human
uuuaauaauuuuuaa

SEQ ID NO: 575087 - RNA, 20 nt, Human
aagacagugaaagaaaauaa

SEQ ID NO: 575088 - RNA, 18 nt, Human
gaaaauaacaauaaaaga

SEQ ID NO: 575089 - RNA, 15 nt, Human
uaacgauaaaagaca

SEQ ID NO: 575090 - RNA, 14 nt, Human
gauaaaagacagug

SEQ ID NO: 575091 - RNA, 20 nt, Human
gcccauccugccccugagcc

SEQ ID NO: 575092 - RNA, 20 nt, Human
gaaacauuugguaaggggaa

SEQ ID NO: 575093 - RNA, 17 nt, Human
ucuauaauguguucauu

SEQ ID NO: 575094 - RNA, 12 nt, Human
cuggcuccagcu

SEQ ID NO: 575095 - RNA, 18 nt, Human
gcuccauuuuuagugaaa

SEQ ID NO: 575096 - RNA, 21 nt, Human
ugaacaaauuuacagagacag

SEQ ID NO: 575097 - RNA, 15 nt, Human
aaugauuaugaauua

SEQ ID NO: 575098 - RNA, 14 nt, Human
gaaaacaauaacga

SEQ ID NO: 575099 - RNA, 20 nt, Human
uuugcaagccagauuuuccu

SEQ ID NO: 575100 - RNA, 19 nt, Human
cuggacucaccucccccau

SEQ ID NO: 575101 - RNA, 16 nt, Human
uccugcaauuccacuu

SEQ ID NO: 575102 - RNA, 18 nt, Human
uaagcuucacuguaaaau

SEQ ID NO: 575103 - RNA, 20 nt, Human
agccuuuuuuugaaaaaaag

SEQ ID NO: 575104 - RNA, 20 nt, Human
cagugaaagaaaauaacgau

SEQ ID NO: 575105 - RNA, 23 nt, Human
cccagcccuccuuaucaaaggac

SEQ ID NO: 575106 - RNA, 21 nt, Human
gauaaaagacagugaaagaaa

SEQ ID NO: 575107 - RNA, 21 nt, Human
uccuucagccugaaagaggaa

SEQ ID NO: 575108 - RNA, 22 nt, Human
uaaaauaauuuuuauauuugaa

SEQ ID NO: 575109 - RNA, 18 nt, Human
guuuaugguuguauuauu

SEQ ID NO: 575110 - RNA, 21 nt, Human
cgacagugagacucugucuca

SEQ ID NO: 575111 - RNA, 23 nt, Human
cacuggacucaccucccccaucu

SEQ ID NO: 575112 - RNA, 21 nt, Human
cauuuucuucucacauuuaua

SEQ ID NO: 575113 - RNA, 16 nt, Human
ucucuaggaaauauuu

SEQ ID NO: 575114 - RNA, 18 nt, Human
caguuguugcccacagcu

SEQ ID NO: 575115 - RNA, 15 nt, Human
accaaggcugauuaa

SEQ ID NO: 575116 - RNA, 14 nt, Human
cuuucauaauaagu

SEQ ID NO: 575117 - RNA, 14 nt, Human
aaaggaauuuaaaa

SEQ ID NO: 575118 - RNA, 13 nt, Human
uauuuauuuuaau

SEQ ID NO: 575119 - RNA, 19 nt, Human
cuaguaucaaaagaaagaa

SEQ ID NO: 575120 - RNA, 14 nt, Human
uaguaucaaaagaa

SEQ ID NO: 575121 - RNA, 22 nt, Human
ugagacucugucucaguccaug

SEQ ID NO: 575122 - RNA, 15 nt, Human
gcaacccaaauguuc

SEQ ID NO: 575123 - RNA, 23 nt, Human
cucuacuaaaaauacaaaaaaaa

SEQ ID NO: 575124 - RNA, 19 nt, Human
cacaggaaccacaagacug

SEQ ID NO: 575125 - RNA, 20 nt, Human
ccauuguggucacaggaagu

SEQ ID NO: 575126 - RNA, 22 nt, Human
caaugcuguauuuuaaaagaau

SEQ ID NO: 575127 - RNA, 22 nt, Human
gaugguucccuugaugaagaag

SEQ ID NO: 575128 - RNA, 16 nt, Human
aaaauaauccucaguu

SEQ ID NO: 575129 - RNA, 16 nt, Human
uaaaggaauuuaaaaa

SEQ ID NO: 575130 - RNA, 18 nt, Human
auuaaguuuuuuuuuaaa

SEQ ID NO: 575131 - RNA, 18 nt, Human
cagcugcucaauaaagua

SEQ ID NO: 575132 - RNA, 22 nt, Human
gaagugaaaaucuacacuccag

SEQ ID NO: 575133 - RNA, 12 nt, Human
aagaaaauaacg

SEQ ID NO: 575134 - RNA, 22 nt, Human
caagcucuaucaccaaggagcc

SEQ ID NO: 575135 - RNA, 18 nt, Human
ccugaaagaggaaugaag

SEQ ID NO: 575136 - RNA, 17 nt, Human
caaauauaaauaaaaau

SEQ ID NO: 575137 - RNA, 22 nt, Human
uaaaacaagcacuaaacaaaga

SEQ ID NO: 575138 - RNA, 15 nt, Human
gacucaccuccccca

SEQ ID NO: 575139 - RNA, 16 nt, Human
cagaagcaacccaaau

SEQ ID NO: 575140 - RNA, 13 nt, Human
aguuaccucugcc

SEQ ID NO: 575141 - RNA, 16 nt, Human
uaaaauccauacauuu

SEQ ID NO: 575142 - RNA, 10 nt, Human
ccugagcccc

SEQ ID NO: 575143 - RNA, 17 nt, Human
aagacagugaaagaaaa

SEQ ID NO: 575144 - RNA, 16 nt, Human
guuccuuccucugagc

SEQ ID NO: 575145 - RNA, 16 nt, Human
auaauccuaaacauau

SEQ ID NO: 575146 - RNA, 22 nt, Human
agccaaacauccuacaagacac

SEQ ID NO: 575147 - RNA, 12 nt, Human
ucuacacuccag

SEQ ID NO: 575148 - RNA, 17 nt, Human
uuaauaauuuuuaauua

SEQ ID NO: 575149 - RNA, 14 nt, Human
ucagucucccuccc

SEQ ID NO: 575150 - RNA, 19 nt, Human
uggaacaguuaccucugcc

SEQ ID NO: 575151 - RNA, 17 nt, Human
gcaugguuuagaaagcu

SEQ ID NO: 575152 - RNA, 18 nt, Human
cagcuuauugucuaguga

SEQ ID NO: 575153 - RNA, 17 nt, Human
cucgugggacagucacc

SEQ ID NO: 575154 - RNA, 18 nt, Human
cuuucacauuuaaauaaa

SEQ ID NO: 575155 - RNA, 23 nt, Human
caucucuucuggguuccuuccuc

SEQ ID NO: 575156 - RNA, 11 nt, Human
augggacaggg

SEQ ID NO: 575157 - RNA, 21 nt, Human
gaaaaaaagcuuuuuuugaau

SEQ ID NO: 575158 - RNA, 12 nt, Human
cucauggaauug

SEQ ID NO: 575159 - RNA, 22 nt, Human
agaauuuuaugcggcauuuucu

SEQ ID NO: 575160 - RNA, 18 nt, Human
uauagcuacuaauuuuaa

SEQ ID NO: 575161 - RNA, 14 nt, Human
aaaagacagugaaa

SEQ ID NO: 575162 - RNA, 23 nt, Human
cauuguggucacaggaaguagag

SEQ ID NO: 575163 - RNA, 20 nt, Human
ccuccugccuaagugcagcc

SEQ ID NO: 575164 - RNA, 22 nt, Human
cacuaguauuucuaugaaauau

SEQ ID NO: 575165 - RNA, 18 nt, Human
cuggaaacuucagcgguu

SEQ ID NO: 575166 - RNA, 23 nt, Human
uaauuuguaguguuggagaagaa

SEQ ID NO: 575167 - RNA, 17 nt, Human
ccccaguuguuucuacu

SEQ ID NO: 575168 - RNA, 17 nt, Human
guauuauuuuuuaaaaa

SEQ ID NO: 575169 - RNA, 20 nt, Human
guaucaaaagaaagaaaauc

SEQ ID NO: 575170 - RNA, 16 nt, Human
gagcucgugggacagu

SEQ ID NO: 575171 - RNA, 17 nt, Human
aaaguacaagagcuuaa

SEQ ID NO: 575172 - RNA, 13 nt, Human
ucuacuaaaaaua

SEQ ID NO: 575173 - RNA, 20 nt, Human
aaagagugaaggauuuaugu

SEQ ID NO: 575174 - RNA, 15 nt, Human
auagaaguaaaaaca

SEQ ID NO: 575175 - RNA, 14 nt, Human
uucagccugaaaga

SEQ ID NO: 575176 - RNA, 12 nt, Human
cccccagcccuc

SEQ ID NO: 575177 - RNA, 14 nt, Human
ggaaguagaggagg

SEQ ID NO: 575178 - RNA, 15 nt, Human
cagaauucauucacu

SEQ ID NO: 575179 - RNA, 15 nt, Human
cauguccacugguuc

SEQ ID NO: 575180 - RNA, 15 nt, Human
ugagcgcccacuaga

SEQ ID NO: 575181 - RNA, 14 nt, Human
auuucuaugaaaua

SEQ ID NO: 575182 - RNA, 15 nt, Human
uuuagugaaauauua

SEQ ID NO: 575183 - RNA, 23 nt, Human
uagauaggucagugcaaauacuc

SEQ ID NO: 575184 - RNA, 20 nt, Human
uguuggugaacuugguuuua

SEQ ID NO: 575185 - RNA, 20 nt, Human
ugccccccagcccuccuuau

SEQ ID NO: 575186 - RNA, 15 nt, Human
cugcagauaaacagu

SEQ ID NO: 575187 - RNA, 16 nt, Human
aaagacaaggaaaaaa

SEQ ID NO: 575188 - RNA, 19 nt, Human
uucccuugaugaagaaguu

SEQ ID NO: 575189 - RNA, 21 nt, Human
ccuggugccucaccccuugcc

SEQ ID NO: 575190 - RNA, 17 nt, Human
agaaucacuugaacccg

SEQ ID NO: 575191 - RNA, 15 nt, Human
aauucugaaagcaac

SEQ ID NO: 575192 - RNA, 17 nt, Human
uuaaauggucaauuuug

SEQ ID NO: 575193 - RNA, 19 nt, Human
aggucuaccaaaaaucuca

SEQ ID NO: 575194 - RNA, 17 nt, Human
aauaaaguguuugaaag

SEQ ID NO: 575195 - RNA, 21 nt, Human
gccugaucaccugcccugcug

SEQ ID NO: 575196 - RNA, 21 nt, Human
aauucauucacucaacaaaca

SEQ ID NO: 575197 - RNA, 15 nt, Human
ccuugccaugugcua

SEQ ID NO: 575198 - RNA, 18 nt, Human
auuuauuacuguaagaaa

SEQ ID NO: 575199 - RNA, 17 nt, Human
gacagucaccucaugga

SEQ ID NO: 575200 - RNA, 16 nt, Human
uuguaaaggaauuuaa

SEQ ID NO: 575201 - RNA, 22 nt, Human
cacuuccaagagccuuuuuuug

SEQ ID NO: 575202 - RNA, 16 nt, Human
uaacaauaaaagacaa

SEQ ID NO: 575203 - RNA, 13 nt, Human
aaaaaugguuuaa

SEQ ID NO: 575204 - RNA, 20 nt, Human
uaugaaaaggcuaagcuuca

SEQ ID NO: 575205 - RNA, 15 nt, Human
cuggacucaccuccc

SEQ ID NO: 575206 - RNA, 20 nt, Human
aauaagccagacaucaacag

SEQ ID NO: 575207 - RNA, 17 nt, Human
uucucuaggaaauauuu

SEQ ID NO: 575208 - RNA, 19 nt, Human
guccaggucuaccaaaaau

SEQ ID NO: 575209 - RNA, 13 nt, Human
acacuuaaaaaug

SEQ ID NO: 575210 - RNA, 17 nt, Human
aaagaaacauuugguaa

SEQ ID NO: 575211 - RNA, 11 nt, Human
uucacagggga

SEQ ID NO: 575212 - RNA, 16 nt, Human
cauuuguauaaaauaa

SEQ ID NO: 575213 - RNA, 15 nt, Human
uuagugaaauauuau

SEQ ID NO: 575214 - RNA, 16 nt, Human
caggaaguagaggagg

SEQ ID NO: 575215 - RNA, 18 nt, Human
uguaaaggaauuuaaaaa

SEQ ID NO: 575216 - RNA, 22 nt, Human
agacccacuggacucaccuccc

SEQ ID NO: 575217 - RNA, 21 nt, Human
acagugaaagaaaauaacaau

SEQ ID NO: 575218 - RNA, 18 nt, Human
uauuuucaguuauuauau

SEQ ID NO: 575219 - RNA, 16 nt, Human
cccccagcccuccuua

SEQ ID NO: 575220 - RNA, 20 nt, Human
aauuuugugaagcaaaauuu

SEQ ID NO: 575221 - RNA, 18 nt, Human
acagaaagcagaacagug

SEQ ID NO: 575222 - RNA, 20 nt, Human
auaacaaugcuguauuuuaa

SEQ ID NO: 575223 - RNA, 17 nt, Human
gacucaccucccccauc

SEQ ID NO: 575224 - RNA, 21 nt, Human
auguuuaauucugaaagcaac

SEQ ID NO: 575225 - RNA, 17 nt, Human
acccacuggacucaccu

SEQ ID NO: 575226 - RNA, 13 nt, Human
cugagagugaaca

SEQ ID NO: 575227 - RNA, 18 nt, Human
ugaaaaaguucugcagau

SEQ ID NO: 575228 - RNA, 16 nt, Human
cuucacuguaaaauaa

SEQ ID NO: 575229 - RNA, 17 nt, Human
aucaaggguacacugcc

SEQ ID NO: 575230 - RNA, 20 nt, Human
accugauuucugagcauuua

SEQ ID NO: 575231 - RNA, 13 nt, Human
gcagaacagugau

SEQ ID NO: 575232 - RNA, 22 nt, Human
guguccccuauccuacuucccc

SEQ ID NO: 575233 - RNA, 16 nt, Human
aaauauuauguuaaaa

SEQ ID NO: 575234 - RNA, 21 nt, Human
ucacaugaacuuguaaaggaa

SEQ ID NO: 575235 - RNA, 14 nt, Human
gagcccauggcacu

SEQ ID NO: 575236 - RNA, 23 nt, Human
cuacacgagauacagaauuuuau

SEQ ID NO: 575237 - RNA, 23 nt, Human
cucagcccuggugggcagagagg

SEQ ID NO: 575238 - RNA, 18 nt, Human
uccagcuggccgggagcc

SEQ ID NO: 575239 - RNA, 19 nt, Human
ccauccugccccugagccc

SEQ ID NO: 575240 - RNA, 16 nt, Human
ucaguuuuugugaaaa

SEQ ID NO: 575241 - RNA, 13 nt, Human
aagcauuccaacu

SEQ ID NO: 575242 - RNA, 19 nt, Human
auucccagccagcacagcc

SEQ ID NO: 575243 - RNA, 15 nt, Human
gaaaugaaagcaggg

SEQ ID NO: 575244 - RNA, 20 nt, Human
uaacgauaaaagacagugaa

SEQ ID NO: 575245 - RNA, 15 nt, Human
auuugguaaggggaa

SEQ ID NO: 575246 - RNA, 17 nt, Human
agucugacuguuuccau

SEQ ID NO: 575247 - RNA, 21 nt, Human
aauuaaguuuuuuuuuaaaaa

SEQ ID NO: 575248 - RNA, 23 nt, Human
uccaaacugacucuuaagaagac

SEQ ID NO: 575249 - RNA, 16 nt, Human
uuuuagugaaauauua

SEQ ID NO: 575250 - RNA, 20 nt, Human
agaugcaguucugaagaaga

SEQ ID NO: 575251 - RNA, 15 nt, Human
uggacucaccucccc

SEQ ID NO: 575252 - RNA, 18 nt, Human
ggaggacgcucucuggcc

SEQ ID NO: 575253 - RNA, 12 nt, Human
auaacuggaaac

SEQ ID NO: 575254 - RNA, 19 nt, Human
uaucucauuuccaagcaag

SEQ ID NO: 575255 - RNA, 17 nt, Human
aaacauccuacaagaca

SEQ ID NO: 575256 - RNA, 15 nt, Human
guaaggggaauugag

SEQ ID NO: 575257 - RNA, 19 nt, Human
acaaauuuacagagacaga

SEQ ID NO: 575258 - RNA, 14 nt, Human
acuuggucugugag

SEQ ID NO: 575259 - RNA, 19 nt, Human
uagugagcagucaggaaag

SEQ ID NO: 575260 - RNA, 23 nt, Human
caauaacgauaaaagacagugaa

SEQ ID NO: 575261 - RNA, 11 nt, Human
aauuccacagc

SEQ ID NO: 575262 - RNA, 19 nt, Human
auaauuuuuauauuugaaa

SEQ ID NO: 575263 - RNA, 15 nt, Human
cugaaagaggaauga

SEQ ID NO: 575264 - RNA, 16 nt, Human
guuuuuuuuuaaaaaa

SEQ ID NO: 575265 - RNA, 16 nt, Human
aacaauaaaagacaag

SEQ ID NO: 575266 - RNA, 15 nt, Human
ucagucucccucccu

SEQ ID NO: 575267 - RNA, 14 nt, Human
cucccugcccccca

SEQ ID NO: 575268 - RNA, 18 nt, Human
ccuuccuaauuccacagc

SEQ ID NO: 575269 - RNA, 17 nt, Human
uccauccugaggcucca

SEQ ID NO: 575270 - RNA, 22 nt, Human
cauaaauguugacaugggacau

SEQ ID NO: 575271 - RNA, 21 nt, Human
uauuacuguaagaaaauauca

SEQ ID NO: 575272 - RNA, 18 nt, Human
aagggaauuucuucaacu

SEQ ID NO: 575273 - RNA, 15 nt, Human
acaaaugggaaacaa

SEQ ID NO: 575274 - RNA, 16 nt, Human
aaaugggaaacaaaag

SEQ ID NO: 575275 - RNA, 13 nt, Human
ccucuggcuccag

SEQ ID NO: 575276 - RNA, 22 nt, Human
gauaaaagacagugaaagaaaa

SEQ ID NO: 575277 - RNA, 21 nt, Human
uccuacaagacacagugacca

SEQ ID NO: 575278 - RNA, 16 nt, Human
cuuauaauuuaaaaua

SEQ ID NO: 575279 - RNA, 17 nt, Human
ccugagcuugcagagau

SEQ ID NO: 575280 - RNA, 17 nt, Human
aggcuagaaccaccugc

SEQ ID NO: 575281 - RNA, 18 nt, Human
gccugagcgacagugaga

SEQ ID NO: 575282 - RNA, 18 nt, Human
uauuuucuauaauuuaaa

SEQ ID NO: 575283 - RNA, 19 nt, Human
auagugaggagcuuugaaa

SEQ ID NO: 575284 - RNA, 18 nt, Human
uuauuacuguaagaaaau

SEQ ID NO: 575285 - RNA, 17 nt, Human
cccacuggacucaccuc

SEQ ID NO: 575286 - RNA, 15 nt, Human
aauugacccacaaga

SEQ ID NO: 575287 - RNA, 16 nt, Human
cccacuggacucaccu

SEQ ID NO: 575288 - RNA, 17 nt, Human
cccaggcugagccucag

SEQ ID NO: 575289 - RNA, 13 nt, Human
augauuccaccua

SEQ ID NO: 575290 - RNA, 18 nt, Human
ugccauaauuacuauguc

SEQ ID NO: 575291 - RNA, 16 nt, Human
augcuaagugaaauaa

SEQ ID NO: 575292 - RNA, 13 nt, Human
aaacauccuacaa

SEQ ID NO: 575293 - RNA, 16 nt, Human
caugguuuagaaagcu

SEQ ID NO: 575294 - RNA, 23 nt, Human
aucacagcuacuugggaggcuga

SEQ ID NO: 575295 - RNA, 13 nt, Human
aaauaaaaauaau

SEQ ID NO: 575296 - RNA, 16 nt, Human
uuauaauuuaaaauau

SEQ ID NO: 575297 - RNA, 14 nt, Human
ucuaggaaauauuu

SEQ ID NO: 575298 - RNA, 19 nt, Human
uguauacugugugcuaaaa

SEQ ID NO: 575299 - RNA, 18 nt, Human
uuuauggcacuaguauuu

SEQ ID NO: 575300 - RNA, 15 nt, Human
ccacaagaaaugaaa

SEQ ID NO: 575301 - RNA, 17 nt, Human
ugaacuugguuuuaauu

SEQ ID NO: 575302 - RNA, 13 nt, Human
uuuaaaaauccua

SEQ ID NO: 575303 - RNA, 13 nt, Human
ccacaacacacag

SEQ ID NO: 575304 - RNA, 16 nt, Human
cugagcgacagugaga

SEQ ID NO: 575305 - RNA, 19 nt, Human
agauuugagcucagcccug

SEQ ID NO: 575306 - RNA, 13 nt, Human
gcucucuggccuu

SEQ ID NO: 575307 - RNA, 17 nt, Human
augcagagguccacaac

SEQ ID NO: 575308 - RNA, 21 nt, Human
gccuuuucccaacuccagaaa

SEQ ID NO: 575309 - RNA, 20 nt, Human
guauuauuuuuuaaaaaaau

SEQ ID NO: 575310 - RNA, 16 nt, Human
acauccuacaagacac

SEQ ID NO: 575311 - RNA, 16 nt, Human
ugaauuaguuuuauau

SEQ ID NO: 575312 - RNA, 14 nt, Human
uauaauuuaaauau

SEQ ID NO: 575313 - RNA, 17 nt, Human
cauuuguauaaaauaau

SEQ ID NO: 575314 - RNA, 16 nt, Human
cucagcccuggugggc

SEQ ID NO: 575315 - RNA, 20 nt, Human
aagggcuguuauaaucuuuc

SEQ ID NO: 575316 - RNA, 15 nt, Human
agugacaagcucaca

SEQ ID NO: 575317 - RNA, 20 nt, Human
uuaaugccacuaaauugaca

SEQ ID NO: 575318 - RNA, 18 nt, Human
gagcgacagugagacucu

SEQ ID NO: 575319 - RNA, 13 nt, Human
cgggaggcagagg

SEQ ID NO: 575320 - RNA, 13 nt, Human
agacacagugacc

SEQ ID NO: 575321 - RNA, 12 nt, Human
caacccaaaugu

SEQ ID NO: 575322 - RNA, 14 nt, Human
agauguagaggaga

SEQ ID NO: 575323 - RNA, 16 nt, Human
aaauaacaaugaaagu

SEQ ID NO: 575324 - RNA, 17 nt, Human
gccccccagcccuccuu

SEQ ID NO: 575325 - RNA, 16 nt, Human
uaaaagacaaggaaaa

SEQ ID NO: 575326 - RNA, 12 nt, Human
ucugcacacagc

SEQ ID NO: 575327 - RNA, 18 nt, Human
agccugaucaccugcccu

SEQ ID NO: 575328 - RNA, 14 nt, Human
cucaacaaacauaa

SEQ ID NO: 575329 - RNA, 24 nt, Human
uaauuuaaaauaugcucuaaacau

SEQ ID NO: 575330 - RNA, 13 nt, Human
ggaaguagaggag

SEQ ID NO: 575331 - RNA, 17 nt, Human
ccugccccccagcccuc

SEQ ID NO: 575332 - RNA, 14 nt, Human
uuuuaaaaaagaaa

SEQ ID NO: 575333 - RNA, 21 nt, Human
uuccuaauuccacagcugcuc

SEQ ID NO: 575334 - RNA, 20 nt, Human
ucaagucuuucacauuuaaa

SEQ ID NO: 575335 - RNA, 21 nt, Human
guauacugugugcuaaaacaa

SEQ ID NO: 575336 - RNA, 15 nt, Human
aaaaaauaacaauga

SEQ ID NO: 575337 - RNA, 15 nt, Human
ugcaauuccacuuau

SEQ ID NO: 575338 - RNA, 13 nt, Human
ccagcccuccuua

SEQ ID NO: 575339 - RNA, 16 nt, Human
ucaaaagaaagaaaau

SEQ ID NO: 575340 - RNA, 23 nt, Human
uaggauggcuaguaucaaaagaa

SEQ ID NO: 575341 - RNA, 14 nt, Human
acuggacucaccuc

SEQ ID NO: 575342 - RNA, 15 nt, Human
acauccuacaagaca

SEQ ID NO: 575343 - RNA, 19 nt, Human
aauauuauguuaaaacugg

SEQ ID NO: 575344 - RNA, 16 nt, Human
acaaauccaaugaaau

SEQ ID NO: 575345 - RNA, 17 nt, Human
ggagcucguggaacagu

SEQ ID NO: 575346 - RNA, 22 nt, Human
accauuucuugagguaaaagca

SEQ ID NO: 575347 - RNA, 14 nt, Human
gaaaaaauaacaau

SEQ ID NO: 575348 - RNA, 15 nt, Human
aaaaaagaaacauuu

SEQ ID NO: 575349 - RNA, 15 nt, Human
gucaaugcagccccc

SEQ ID NO: 575350 - RNA, 13 nt, Human
aagaaaauaacga

SEQ ID NO: 575351 - RNA, 22 nt, Human
ccaaacauccuacaagacacag

SEQ ID NO: 575352 - RNA, 20 nt, Human
ucaauaaaauccauacauuu

SEQ ID NO: 575353 - RNA, 16 nt, Human
uuaauaauuuuuaauu

SEQ ID NO: 575354 - RNA, 13 nt, Human
uucuauaauuuaa

SEQ ID NO: 575355 - RNA, 15 nt, Human
cuuaagaagacugca

SEQ ID NO: 575356 - RNA, 14 nt, Human
uuucuaugaaauau

SEQ ID NO: 575357 - RNA, 19 nt, Human
accccugagcuugcagaga

SEQ ID NO: 575358 - RNA, 21 nt, Human
agggugauauuaaccaggggc

SEQ ID NO: 575359 - RNA, 14 nt, Human
gccucagucucccu

SEQ ID NO: 575360 - RNA, 14 nt, Human
cugccccccagccc

SEQ ID NO: 575361 - RNA, 19 nt, Human
agaaaauaacgauaaaaga

SEQ ID NO: 575362 - RNA, 20 nt, Human
gaccauacuaauuauacccc

SEQ ID NO: 575363 - RNA, 15 nt, Human
auuucuaugaaauau

SEQ ID NO: 575364 - RNA, 23 nt, Human
uuagaugcaguucugaagaagau

SEQ ID NO: 575365 - RNA, 21 nt, Human
caacacacagauuugagcuca

SEQ ID NO: 575366 - RNA, 19 nt, Human
auuaaguuuuuuuuuaaaa

SEQ ID NO: 575367 - RNA, 16 nt, Human
ggcugagccucagucu

SEQ ID NO: 575368 - RNA, 22 nt, Human
aggacaccauuuuggcaagcuc

SEQ ID NO: 575369 - RNA, 16 nt, Human
ccugcaaagcccagcu

SEQ ID NO: 575370 - RNA, 18 nt, Human
gaauaauccuaaacauau

SEQ ID NO: 575371 - RNA, 14 nt, Human
auuugaaauuguau

SEQ ID NO: 575372 - RNA, 21 nt, Human
cacaugaacuuguaaaggaau

SEQ ID NO: 575373 - RNA, 22 nt, Human
ccucccuuggggccuaugcaga

SEQ ID NO: 575374 - RNA, 19 nt, Human
cuuggggccuaugcagagg

SEQ ID NO: 575375 - RNA, 22 nt, Human
aucaucaagucuuucacauuua

SEQ ID NO: 575376 - RNA, 15 nt, Human
gccucuuagaugcag

SEQ ID NO: 575377 - RNA, 22 nt, Human
caucucuucuggguuccuuccu

SEQ ID NO: 575378 - RNA, 15 nt, Human
aucaauuuaaaaaaa

SEQ ID NO: 575379 - RNA, 13 nt, Human
ccucauggaauug

SEQ ID NO: 575380 - RNA, 22 nt, Human
ggacagcccuucuuuccacaga

SEQ ID NO: 575381 - RNA, 14 nt, Human
auuuauuuuaauaa

SEQ ID NO: 575382 - RNA, 23 nt, Human
auuuuauagcuacuaauuuuaaa

SEQ ID NO: 575383 - RNA, 14 nt, Human
acccgggaggcaga

SEQ ID NO: 575384 - RNA, 23 nt, Human
ugcagagguccacaacacacaga

SEQ ID NO: 575385 - RNA, 20 nt, Human
aagaugguaccaccagucug

SEQ ID NO: 575386 - RNA, 18 nt, Human
cagugaaagaaaauaaca

SEQ ID NO: 575387 - RNA, 21 nt, Human
gcaaaauuuuuucucuaggaa

SEQ ID NO: 575388 - RNA, 14 nt, Human
ccaaugaaaugagu

SEQ ID NO: 575389 - RNA, 19 nt, Human
cugccccccagcccuccuu

SEQ ID NO: 575390 - RNA, 22 nt, Human
cuaagcuucacuguaaaauaau

SEQ ID NO: 575391 - RNA, 20 nt, Human
auuacuguaagaaaauauca

SEQ ID NO: 575392 - RNA, 14 nt, Human
cguguccccuaucc

SEQ ID NO: 575393 - RNA, 13 nt, Human
auuuuuuaaaaaa

SEQ ID NO: 575394 - RNA, 16 nt, Human
ugugagaugcuagaac

SEQ ID NO: 575395 - RNA, 19 nt, Human
uguaguguuggagaagaac

SEQ ID NO: 575396 - RNA, 17 nt, Human
agggcauagaaguaaaa

SEQ ID NO: 575397 - RNA, 20 nt, Human
aaaacaagcacuaaacaaag

SEQ ID NO: 575398 - RNA, 13 nt, Human
uuuugaaucauca

SEQ ID NO: 575399 - RNA, 14 nt, Human
aucaaaagaaagaa

SEQ ID NO: 575400 - RNA, 22 nt, Human
cuccugccuaagugcagccccg

SEQ ID NO: 575401 - RNA, 19 nt, Human
uuugccaaguucuccacua

SEQ ID NO: 575402 - RNA, 14 nt, Human
gauuaguacacacu

SEQ ID NO: 575403 - RNA, 14 nt, Human
uucuggaauaaucc

SEQ ID NO: 575404 - RNA, 15 nt, Human
ggccuucggccucca

SEQ ID NO: 575405 - RNA, 19 nt, Human
aaagacagugaaagaaaau

SEQ ID NO: 575406 - RNA, 11 nt, Human
gccaugggaca

SEQ ID NO: 575407 - RNA, 18 nt, Human
uuacaaaugggaaacaaa

SEQ ID NO: 575408 - RNA, 17 nt, Human
agugauuaccagggacu

SEQ ID NO: 575409 - RNA, 23 nt, Human
caaagcugaaauggacuuuugua

SEQ ID NO: 575410 - RNA, 23 nt, Human
ugaauuacauuuguauaaaauaa

SEQ ID NO: 575411 - RNA, 20 nt, Human
caagcucuaucaccaaggag

SEQ ID NO: 575412 - RNA, 23 nt, Human
caucaacagauaaauaguuuaug

SEQ ID NO: 575413 - RNA, 10 nt, Human
accugagccc

SEQ ID NO: 575414 - RNA, 18 nt, Human
gaagcaccaaucaugaau

SEQ ID NO: 575415 - RNA, 18 nt, Human
cugagccuugggaccccu

SEQ ID NO: 575416 - RNA, 16 nt, Human
ugcaugguuuagaaag

SEQ ID NO: 575417 - RNA, 16 nt, Human
gugagacagcucugca

SEQ ID NO: 575418 - RNA, 14 nt, Human
agcaaguauuagaa

SEQ ID NO: 575419 - RNA, 17 nt, Human
uuauaaucuuucacagg

SEQ ID NO: 575420 - RNA, 23 nt, Human
aaguauccuucagccugaaagag

SEQ ID NO: 575421 - RNA, 16 nt, Human
acaugaaguccaagca

SEQ ID NO: 575422 - RNA, 19 nt, Human
ugaacaaauuuacagagac

SEQ ID NO: 575423 - RNA, 22 nt, Human
ccauuucuugagguaaaagcau

SEQ ID NO: 575424 - RNA, 16 nt, Human
auaacuggaaacuuca

SEQ ID NO: 575425 - RNA, 12 nt, Human
uaguacacacuu

SEQ ID NO: 575426 - RNA, 21 nt, Human
acaguuaccucugccucagaa

SEQ ID NO: 575427 - RNA, 14 nt, Human
aauauuauuuuaua

SEQ ID NO: 575428 - RNA, 16 nt, Human
agguacuucaaauccu

SEQ ID NO: 575429 - RNA, 21 nt, Human
caucuagcaugucgucaaagc

SEQ ID NO: 575430 - RNA, 22 nt, Human
uugaaaaucuuauaauuuaaaa

SEQ ID NO: 575431 - RNA, 19 nt, Human
auuuucuauaauuuaaaua

SEQ ID NO: 575432 - RNA, 16 nt, Human
ccacuuauaggaauug

SEQ ID NO: 575433 - RNA, 17 nt, Human
uguucuaagaagugaaa

SEQ ID NO: 575434 - RNA, 20 nt, Human
auacugugugcuaaaacaag

SEQ ID NO: 575435 - RNA, 15 nt, Human
aaugaauggcuaagc

SEQ ID NO: 575436 - RNA, 19 nt, Human
acagugauuaccagggacu

SEQ ID NO: 575437 - RNA, 14 nt, Human
uccacuuggucugu

SEQ ID NO: 575438 - RNA, 14 nt, Human
ugcuaagucuuaua

SEQ ID NO: 575439 - RNA, 18 nt, Human
aagucuuucacauuuaaa

SEQ ID NO: 575440 - RNA, 15 nt, Human
uccagauccuggaaa

SEQ ID NO: 575441 - RNA, 13 nt, Human
auaacgauaaaag

SEQ ID NO: 575442 - RNA, 13 nt, Human
ucucccucccuug

SEQ ID NO: 575443 - RNA, 14 nt, Human
uauaauuuaaaaua

SEQ ID NO: 575444 - RNA, 14 nt, Human
auuauuuuuuaaaa

SEQ ID NO: 575445 - RNA, 17 nt, Human
caccucccccaucucuu

SEQ ID NO: 575446 - RNA, 12 nt, Human
aaaugaaagcag

SEQ ID NO: 575447 - RNA, 18 nt, Human
uaaaauccauacauuugu

SEQ ID NO: 575448 - RNA, 19 nt, Human
agugaggagcuuugaaacg

SEQ ID NO: 575449 - RNA, 22 nt, Human
ucaacuccaaacugacucuuaa

SEQ ID NO: 575450 - RNA, 23 nt, Human
uaaaagacagugaaagaaaauaa

SEQ ID NO: 575451 - RNA, 17 nt, Human
agguccacaacacacag

SEQ ID NO: 575452 - RNA, 18 nt, Human
ccugcaaagcccagcuug

SEQ ID NO: 575453 - RNA, 22 nt, Human
agcuuguauuccuuuuucucuc

SEQ ID NO: 575454 - RNA, 22 nt, Human
aacucccugccccccagcccuc

SEQ ID NO: 575455 - RNA, 17 nt, Human
ugaaggauuuauguuua

SEQ ID NO: 575456 - RNA, 21 nt, Human
uauacugugugcuaaaacaag

SEQ ID NO: 575457 - RNA, 19 nt, Human
acuggacucaccuccccca

SEQ ID NO: 575458 - RNA, 20 nt, Human
agaggagaaacuggaacucu

SEQ ID NO: 575459 - RNA, 17 nt, Human
gccaugggacagggagg

SEQ ID NO: 575460 - RNA, 13 nt, Human
aaaugggaaacaa

SEQ ID NO: 575461 - RNA, 12 nt, Human
cuugguuuuaau

SEQ ID NO: 575462 - RNA, 18 nt, Human
aaagagugaaggauuuau

SEQ ID NO: 575463 - RNA, 14 nt, Human
uauaaauaaaaaua

SEQ ID NO: 575464 - RNA, 20 nt, Human
uuucuucaacucccugcccc

SEQ ID NO: 575465 - RNA, 19 nt, Human
cuccagcuggccgggagcc

SEQ ID NO: 575466 - RNA, 21 nt, Human
cuuguuggacgagaaaacaau

SEQ ID NO: 575467 - RNA, 19 nt, Human
uggugaacuugguuuuaau

SEQ ID NO: 575468 - RNA, 19 nt, Human
augaaguacucauacaugu

SEQ ID NO: 575469 - RNA, 17 nt, Human
agcgacagugagacucu

SEQ ID NO: 575470 - RNA, 17 nt, Human
gugccuguaaucacagc

SEQ ID NO: 575471 - RNA, 14 nt, Human
gugagcuacaaaug

SEQ ID NO: 575472 - RNA, 23 nt, Human
uauguuaaaacugggacagggga

SEQ ID NO: 575473 - RNA, 17 nt, Human
auaaguacaugauaagc

SEQ ID NO: 575474 - RNA, 15 nt, Human
ugaaauuguauuaca

SEQ ID NO: 575475 - RNA, 17 nt, Human
accugagccccaaaagg

SEQ ID NO: 575476 - RNA, 20 nt, Human
cacagcacgggggccaagga

SEQ ID NO: 575477 - RNA, 23 nt, Human
ugaauuauguuugcauguucacu

SEQ ID NO: 575478 - RNA, 22 nt, Human
auaacaaugcuguauuuuaaaa

SEQ ID NO: 575479 - RNA, 18 nt, Human
agaagcaacccaaauguu

SEQ ID NO: 575480 - RNA, 19 nt, Human
caaggaugccccguccccc

SEQ ID NO: 575481 - RNA, 17 nt, Human
ccucuggcuccagcugg

SEQ ID NO: 575482 - RNA, 22 nt, Human
gcuugcagagaugaggccgcca

SEQ ID NO: 575483 - RNA, 18 nt, Human
caaggcugauuaaaccaa

SEQ ID NO: 575484 - RNA, 22 nt, Human
aauuacauuuguauaaaauaau

SEQ ID NO: 575485 - RNA, 15 nt, Human
gccucagucucccuc

SEQ ID NO: 575486 - RNA, 13 nt, Human
uuauucacaagac

SEQ ID NO: 575487 - RNA, 23 nt, Human
uuuguauaaaauaauuuuuauau

SEQ ID NO: 575488 - RNA, 14 nt, Human
auuuauguuuaauu

SEQ ID NO: 575489 - RNA, 15 nt, Human
aaaauacaaaaaaaa

SEQ ID NO: 575490 - RNA, 19 nt, Human
ccccuauccuacuuccccu

SEQ ID NO: 575491 - RNA, 21 nt, Human
auaauuuuuauauuugaaaua

SEQ ID NO: 575492 - RNA, 12 nt, Human
gucccaggcuga

SEQ ID NO: 575493 - RNA, 22 nt, Human
uacugagagugaacaaauuuac

SEQ ID NO: 575494 - RNA, 12 nt, Human
auuuuaaaagaa

SEQ ID NO: 575495 - RNA, 23 nt, Human
aaaauaucacuugucaauaaaau

SEQ ID NO: 575496 - RNA, 15 nt, Human
agucaccucauggaa

SEQ ID NO: 575497 - RNA, 14 nt, Human
uugccaugugcuag

SEQ ID NO: 575498 - RNA, 22 nt, Human
uauccuacuuccccuuccuaau

SEQ ID NO: 575499 - RNA, 17 nt, Human
aguauuucuaugaaaua

SEQ ID NO: 575500 - RNA, 20 nt, Human
acuaaauugacacuuaaaaa

SEQ ID NO: 575501 - RNA, 18 nt, Human
auagaauuaacacaugau

SEQ ID NO: 575502 - RNA, 17 nt, Human
gaagaccucauuuugaa

SEQ ID NO: 575503 - RNA, 13 nt, Human
uaacgauaaaaga

SEQ ID NO: 575504 - RNA, 19 nt, Human
gucuuucacauuuaaauaa

SEQ ID NO: 575505 - RNA, 13 nt, Human
agacagcucugca

SEQ ID NO: 575506 - RNA, 12 nt, Human
aauaaaguacaa

SEQ ID NO: 575507 - RNA, 19 nt, Human
aaucuacacuccagugaga

SEQ ID NO: 575508 - RNA, 22 nt, Human
uaauaggcguaacuaauuuuaa

SEQ ID NO: 575509 - RNA, 20 nt, Human
augcuucuguuuuauaauuu

SEQ ID NO: 575510 - RNA, 21 nt, Human
aaucaccaaggcugauuaaac

SEQ ID NO: 575511 - RNA, 15 nt, Human
gcaagcucuaucacc

SEQ ID NO: 575512 - RNA, 21 nt, Human
cuaaauugacacuuaaaaaug

SEQ ID NO: 575513 - RNA, 18 nt, Human
ucuaugaaauauuauguu

SEQ ID NO: 575514 - RNA, 21 nt, Human
cucaaaacuucagacauagaa

SEQ ID NO: 575515 - RNA, 15 nt, Human
aauacuuuauaaagg

SEQ ID NO: 575516 - RNA, 18 nt, Human
acuggacucaccuccccc

SEQ ID NO: 575517 - RNA, 16 nt, Human
acagagacagaaagca

SEQ ID NO: 575518 - RNA, 21 nt, Human
cugauauuggacaguaaaauc

SEQ ID NO: 575519 - RNA, 15 nt, Human
acucaccucccccau

SEQ ID NO: 575520 - RNA, 16 nt, Human
agugaaagaaaauaac

SEQ ID NO: 575521 - RNA, 11 nt, Human
uuauauuuauu

SEQ ID NO: 575522 - RNA, 22 nt, Human
uuaccucugccucagaaaacaa

SEQ ID NO: 575523 - RNA, 21 nt, Human
cucagugucaaugcagccccc

SEQ ID NO: 575524 - RNA, 14 nt, Human
cugcaaagcccagc

SEQ ID NO: 575525 - RNA, 14 nt, Human
ggcaauagucaaau

SEQ ID NO: 575526 - RNA, 14 nt, Human
agagguccacaaca

SEQ ID NO: 575527 - RNA, 13 nt, Human
ccccagcccuccu

SEQ ID NO: 575528 - RNA, 21 nt, Human
uuauuuucuauaauuuaaaua

SEQ ID NO: 575529 - RNA, 20 nt, Human
augcaguuguugcccacagc

SEQ ID NO: 575530 - RNA, 20 nt, Human
agcccuggugggcagagagg

SEQ ID NO: 575531 - RNA, 20 nt, Human
ugagagacacacugaagaag

SEQ ID NO: 575532 - RNA, 20 nt, Human
uuaaauggucaauuuuguua

SEQ ID NO: 575533 - RNA, 17 nt, Human
acaagaaaugaaagcag

SEQ ID NO: 575534 - RNA, 19 nt, Human
uacuucuuaggguuaugau

SEQ ID NO: 575535 - RNA, 21 nt, Human
cuggccuucggccuccauccu

SEQ ID NO: 575536 - RNA, 20 nt, Human
uugauaaguacaugauaagc

SEQ ID NO: 575537 - RNA, 16 nt, Human
ggcagagagguaggga

SEQ ID NO: 575538 - RNA, 18 nt, Human
gccccgucccccucuggc

SEQ ID NO: 575539 - RNA, 23 nt, Human
ggaggcagagguugcagugagcc

SEQ ID NO: 575540 - RNA, 22 nt, Human
aaugggcacaggguuuauguuu

SEQ ID NO: 575541 - RNA, 17 nt, Human
cccccugcaaagcccag

SEQ ID NO: 575542 - RNA, 22 nt, Human
ccauacuaauuauacccccugc

SEQ ID NO: 575543 - RNA, 16 nt, Human
aauuccacagcugcuc

SEQ ID NO: 575544 - RNA, 18 nt, Human
aagaccucauuuugaagg

SEQ ID NO: 575545 - RNA, 19 nt, Human
caugaguaacugauuugua

SEQ ID NO: 575546 - RNA, 20 nt, Human
auucccagccagcacagccu

SEQ ID NO: 575547 - RNA, 23 nt, Human
cuaguaauuggaaaggcagcucu

SEQ ID NO: 575548 - RNA, 21 nt, Human
uuuuauggcacuaguauuucu

SEQ ID NO: 575549 - RNA, 12 nt, Human
gcaaagcccagc

SEQ ID NO: 575550 - RNA, 22 nt, Human
cauuuaaauaaaguguuugaaa

SEQ ID NO: 575551 - RNA, 21 nt, Human
agccucuuagaugcaguucug

SEQ ID NO: 575552 - RNA, 19 nt, Human
auuucuucaacucccugcc

SEQ ID NO: 575553 - RNA, 14 nt, Human
agucugacuguuuc

SEQ ID NO: 575554 - RNA, 20 nt, Human
ggccuaugcagagguccaca

SEQ ID NO: 575555 - RNA, 19 nt, Human
gucaaucagccuaguugau

SEQ ID NO: 575556 - RNA, 16 nt, Human
ugcuaagucuuauaua

SEQ ID NO: 575557 - RNA, 16 nt, Human
aaaagcaucacaugaa

SEQ ID NO: 575558 - RNA, 13 nt, Human
acaagagcuuaac

SEQ ID NO: 575559 - RNA, 17 nt, Human
auaaaguacaagagcuu

SEQ ID NO: 575560 - RNA, 15 nt, Human
ggccuccauccugag

SEQ ID NO: 575561 - RNA, 22 nt, Human
ggcuaagcuucacuguaaaaua

SEQ ID NO: 575562 - RNA, 22 nt, Human
uuuauagcuacuaauuuuaaaa

SEQ ID NO: 575563 - RNA, 18 nt, Human
aaaguaacccuacaaaac

SEQ ID NO: 575564 - RNA, 18 nt, Human
acaaaaggauaaugaaua

SEQ ID NO: 575565 - RNA, 22 nt, Human
uucaauaucuuuuuuuuaauaa

SEQ ID NO: 575566 - RNA, 13 nt, Human
aaauccuugaaga

SEQ ID NO: 575567 - RNA, 19 nt, Human
gguuuaauaauuuuuaauu

SEQ ID NO: 575568 - RNA, 13 nt, Human
uuuucuuuucauu

SEQ ID NO: 575569 - RNA, 23 nt, Human
gccccugcacuccagccugagcg

SEQ ID NO: 575570 - RNA, 17 nt, Human
agcuacuaauuuuaaaa

SEQ ID NO: 575571 - RNA, 17 nt, Human
ccuacuuccccuuccua

SEQ ID NO: 575572 - RNA, 21 nt, Human
gaaaaguauguuagugcaaau

SEQ ID NO: 575573 - RNA, 22 nt, Human
agacucugucucaguccaugaa

SEQ ID NO: 575574 - RNA, 14 nt, Human
cagauccuggaaau

SEQ ID NO: 575575 - RNA, 20 nt, Human
uagaugcaguucugaagaag

SEQ ID NO: 575576 - RNA, 20 nt, Human
cccugcacuccagccugagc

SEQ ID NO: 575577 - RNA, 13 nt, Human
cacaacuauauug

SEQ ID NO: 575578 - RNA, 23 nt, Human
augucaauucuugccaaauauaa

SEQ ID NO: 575579 - RNA, 12 nt, Human
gauaaaagacag

SEQ ID NO: 575580 - RNA, 14 nt, Human
ugaucaccugcccu

SEQ ID NO: 575581 - RNA, 18 nt, Human
caagccucauguccacug

SEQ ID NO: 575582 - RNA, 18 nt, Human
cucuauguucuaagaagu

SEQ ID NO: 575583 - RNA, 14 nt, Human
auuuucuauaauuu

SEQ ID NO: 575584 - RNA, 19 nt, Human
augaguaacugauuuguaa

SEQ ID NO: 575585 - RNA, 16 nt, Human
ccuccuuuuaaaguaa

SEQ ID NO: 575586 - RNA, 12 nt, Human
aguguuugaaag

SEQ ID NO: 575587 - RNA, 20 nt, Human
ugguuguauuauuuuuuaaa

SEQ ID NO: 575588 - RNA, 15 nt, Human
ugggacagggaggac

SEQ ID NO: 575589 - RNA, 19 nt, Human
auuguaguccuguaaugga

SEQ ID NO: 575590 - RNA, 18 nt, Human
ugggcacaggguuuaugu

SEQ ID NO: 575591 - RNA, 18 nt, Human
acucuuaagaagacugca

SEQ ID NO: 575592 - RNA, 18 nt, Human
ugaacuugguuuuaauua

SEQ ID NO: 575593 - RNA, 18 nt, Human
gcaaagcccagcuugaaa

SEQ ID NO: 575594 - RNA, 19 nt, Human
cagcuacuugggaggcuga

SEQ ID NO: 575595 - RNA, 22 nt, Human
gaaauaagccagacaucaacag

SEQ ID NO: 575596 - RNA, 20 nt, Human
auaagccagacaucaacaga

SEQ ID NO: 575597 - RNA, 13 nt, Human
aagugcagccccg

SEQ ID NO: 575598 - RNA, 16 nt, Human
aaugaaagcagggacu

SEQ ID NO: 575599 - RNA, 16 nt, Human
agugucaaugcagccc

SEQ ID NO: 575600 - RNA, 16 nt, Human
aauugacccacaagaa

SEQ ID NO: 575601 - RNA, 21 nt, Human
ccauccugccccugagcccau

SEQ ID NO: 575602 - RNA, 23 nt, Human
cuuaagaagacugcauuauauuu

SEQ ID NO: 575603 - RNA, 22 nt, Human
cugcucaauaaaguacaagagc

SEQ ID NO: 575604 - RNA, 14 nt, Human
auuuaaauauaugc

SEQ ID NO: 575605 - RNA, 15 nt, Human
cucccugccccccag

SEQ ID NO: 575606 - RNA, 13 nt, Human
gagacagcucugc

SEQ ID NO: 575607 - RNA, 22 nt, Human
auauaugcuaagucuuauauau

SEQ ID NO: 575608 - RNA, 17 nt, Human
gcaaauugucacaggac

SEQ ID NO: 575609 - RNA, 19 nt, Human
aauuuuuauauuugaaaua

SEQ ID NO: 575610 - RNA, 20 nt, Human
caagccuccuuuuaaaguaa

SEQ ID NO: 575611 - RNA, 21 nt, Human
cuaccaaaaaucucaauauuu

SEQ ID NO: 575612 - RNA, 14 nt, Human
aucaccaaggcuga

SEQ ID NO: 575613 - RNA, 18 nt, Human
ucucuaggaaauauuuau

SEQ ID NO: 575614 - RNA, 13 nt, Human
aggaaaaaauaac

SEQ ID NO: 575615 - RNA, 14 nt, Human
aaauauaaauaaaa

SEQ ID NO: 575616 - RNA, 23 nt, Human
ucuuagaugcaguucugaagaag

SEQ ID NO: 575617 - RNA, 18 nt, Human
cuucucacauuuauauuu

SEQ ID NO: 575618 - RNA, 14 nt, Human
auaaauaaaaauaa

SEQ ID NO: 575619 - RNA, 22 nt, Human
ugauaguuguaccgcaauguga

SEQ ID NO: 575620 - RNA, 16 nt, Human
uucaguuauuauauuu

SEQ ID NO: 575621 - RNA, 21 nt, Human
auuuuuucucuaggaaauauu

SEQ ID NO: 575622 - RNA, 21 nt, Human
cccuauccuacuuccccuucc

SEQ ID NO: 575623 - RNA, 17 nt, Human
caagacccaaaaggcag

SEQ ID NO: 575624 - RNA, 23 nt, Human
cucagucucccucccuuggggcc

SEQ ID NO: 575625 - RNA, 20 nt, Human
uauuuauuacuguaagaaaa

SEQ ID NO: 575626 - RNA, 20 nt, Human
uccagccugagcgacaguga

SEQ ID NO: 575627 - RNA, 12 nt, Human
gacgagaaaaca

SEQ ID NO: 575628 - RNA, 19 nt, Human
aaauaugccccauucaaca

SEQ ID NO: 575629 - RNA, 21 nt, Human
augcuacaggauuugaaauug

SEQ ID NO: 575630 - RNA, 16 nt, Human
ugaaguacucauacau

SEQ ID NO: 575631 - RNA, 22 nt, Human
aaagacagugaaagaaaauaac

SEQ ID NO: 575632 - RNA, 21 nt, Human
caagacccaaaaggcagaagc

SEQ ID NO: 575633 - RNA, 17 nt, Human
gacaaggaaaaaauaac

SEQ ID NO: 575634 - RNA, 15 nt, Human
ugcagauaaacagua

SEQ ID NO: 575635 - RNA, 20 nt, Human
uguaagaaaauaucacuugu

SEQ ID NO: 575636 - RNA, 21 nt, Human
ugccuguaaucacagcuacuu

SEQ ID NO: 575637 - RNA, 22 nt, Human
ugguuguauuauuuuuuaaaaa

SEQ ID NO: 575638 - RNA, 14 nt, Human
aaagagaacuucca

SEQ ID NO: 575639 - RNA, 18 nt, Human
uuuuauaucaauuuaaaa

SEQ ID NO: 575640 - RNA, 15 nt, Human
uucacauuuaaauaa

SEQ ID NO: 575641 - RNA, 18 nt, Human
uuacuguaagaaaauauc

SEQ ID NO: 575642 - RNA, 14 nt, Human
aaucucaauauuuc

SEQ ID NO: 575643 - RNA, 13 nt, Human
acuguaaaauaau

SEQ ID NO: 575644 - RNA, 22 nt, Human
uggguuccuuccucugagccuu

SEQ ID NO: 575645 - RNA, 20 nt, Human
ggguuccuuccucugagccu

SEQ ID NO: 575646 - RNA, 22 nt, Human
uuugaaacgaggauugggaaaa

SEQ ID NO: 575647 - RNA, 17 nt, Human
uaauuuuuauauuugaa

SEQ ID NO: 575648 - RNA, 17 nt, Human
uggcuaagcaaaaugug

SEQ ID NO: 575649 - RNA, 22 nt, Human
aaccuacacgagauacagaauu

SEQ ID NO: 575650 - RNA, 20 nt, Human
acagcccuucuuuccacaga

SEQ ID NO: 575651 - RNA, 22 nt, Human
uauuucagauaaucacaauaca

SEQ ID NO: 575652 - RNA, 22 nt, Human
ccccuuccuaauuccacagcug

SEQ ID NO: 575653 - RNA, 20 nt, Human
uuacaaauccaaugaaauga

SEQ ID NO: 575654 - RNA, 21 nt, Human
aaaagguauuuuaaucaccaa

SEQ ID NO: 575655 - RNA, 16 nt, Human
gacauuugcucaugga

SEQ ID NO: 575656 - RNA, 20 nt, Human
acaugagguacugagaguga

SEQ ID NO: 575657 - RNA, 12 nt, Human
aucguguccccu

SEQ ID NO: 575658 - RNA, 19 nt, Human
augcagagguccacaacac

SEQ ID NO: 575659 - RNA, 16 nt, Human
cauagaaguaaaaaca

SEQ ID NO: 575660 - RNA, 19 nt, Human
cucaccucccccaucucuu

SEQ ID NO: 575661 - RNA, 18 nt, Human
auagcuacuaauuuuaaa

SEQ ID NO: 575662 - RNA, 12 nt, Human
gcugaugcaguu

SEQ ID NO: 575663 - RNA, 19 nt, Human
agcuacuaauuuuaaaaug

SEQ ID NO: 575664 - RNA, 21 nt, Human
cacuugaacccgggaggcaga

SEQ ID NO: 575665 - RNA, 15 nt, Human
ucuggcuccagcugg

SEQ ID NO: 575666 - RNA, 13 nt, Human
gaagaacugaaau

SEQ ID NO: 575667 - RNA, 13 nt, Human
auaacuggaaacu

SEQ ID NO: 575668 - RNA, 17 nt, Human
aggguguguaaguagau

SEQ ID NO: 575669 - RNA, 13 nt, Human
uaacaauaaaaga

SEQ ID NO: 575670 - RNA, 12 nt, Human
agacagugaaag

SEQ ID NO: 575671 - RNA, 17 nt, Human
ugcacaucaaaauaugc

SEQ ID NO: 575672 - RNA, 15 nt, Human
agaauaccacaggaa

SEQ ID NO: 575673 - RNA, 12 nt, Human
cacaacacacag

SEQ ID NO: 575674 - RNA, 22 nt, Human
gcuaaaacaagcacuaaacaaa

SEQ ID NO: 575675 - RNA, 20 nt, Human
ugagagugaacaaauuuaca

SEQ ID NO: 575676 - RNA, 13 nt, Human
ugaaaaucuuaua

SEQ ID NO: 575677 - RNA, 16 nt, Human
cacuggacucaccucc

SEQ ID NO: 575678 - RNA, 14 nt, Human
ugacacuuaaaaau

SEQ ID NO: 575679 - RNA, 14 nt, Human
cagugaaagaaaau

SEQ ID NO: 575680 - RNA, 19 nt, Human
agaaaauaacaauaaaaga

SEQ ID NO: 575681 - RNA, 15 nt, Human
cuguaaaauaauaac

SEQ ID NO: 575682 - RNA, 12 nt, Human
uuaauaaaccau

SEQ ID NO: 575683 - RNA, 15 nt, Human
acaagacccaaaagg

SEQ ID NO: 575684 - RNA, 20 nt, Human
cacuguggguagacacacau

SEQ ID NO: 575685 - RNA, 22 nt, Human
caauaaaagacaaggaaaaaau

SEQ ID NO: 575686 - RNA, 16 nt, Human
ccacuuggucugugag

SEQ ID NO: 575687 - RNA, 16 nt, Human
cuagaacucccuuuca

SEQ ID NO: 575688 - RNA, 23 nt, Human
aaauuuacagagacagaaagcag

SEQ ID NO: 575689 - RNA, 16 nt, Human
agguugcagugagccg

SEQ ID NO: 575690 - RNA, 23 nt, Human
uguugcccacagcuguaugauuc

SEQ ID NO: 575691 - RNA, 18 nt, Human
aaaagacaaggaaaaaau

SEQ ID NO: 575692 - RNA, 17 nt, Human
cugcacuccagccugag

SEQ ID NO: 575693 - RNA, 15 nt, Human
caaggaaaaaauaac

SEQ ID NO: 575694 - RNA, 23 nt, Human
cacagauuugagcucagcccugg

SEQ ID NO: 575695 - RNA, 15 nt, Human
aaauauaaauaaaaa

SEQ ID NO: 575696 - RNA, 15 nt, Human
ucuuauaauuuaaaa

SEQ ID NO: 575697 - RNA, 20 nt, Human
aggcugagaugggagaauca

SEQ ID NO: 575698 - RNA, 21 nt, Human
aaauaauuuuuauauuugaaa

SEQ ID NO: 575699 - RNA, 18 nt, Human
gagucccaggcugagccu

SEQ ID NO: 575700 - RNA, 15 nt, Human
uauaauuuaaauaua

SEQ ID NO: 575701 - RNA, 20 nt, Human
aacaaugcuguauuuuaaaa

SEQ ID NO: 575702 - RNA, 18 nt, Human
auuuaggccaugggacag

SEQ ID NO: 575703 - RNA, 19 nt, Human
cgcccacuagacccacugg

SEQ ID NO: 575704 - RNA, 16 nt, Human
ggaugccccguccccc

SEQ ID NO: 575705 - RNA, 12 nt, Human
acacuuaaaaau

SEQ ID NO: 575706 - RNA, 17 nt, Human
auguugacaugggacau

SEQ ID NO: 575707 - RNA, 16 nt, Human
gacaaggaaaaaauaa

SEQ ID NO: 575708 - RNA, 13 nt, Human
gauuguaaaaugg

SEQ ID NO: 575709 - RNA, 22 nt, Human
cuuguaaaggaauuuaaaaauc

SEQ ID NO: 575710 - RNA, 22 nt, Human
agaagcaccaaucaugaauuag

SEQ ID NO: 575711 - RNA, 14 nt, Human
ugcuguauuuuaaa

SEQ ID NO: 575712 - RNA, 13 nt, Human
aaaaauccuacuu

SEQ ID NO: 575713 - RNA, 20 nt, Human
agcuuauugucuagugaaac

SEQ ID NO: 575714 - RNA, 12 nt, Human
uaagaagacugc

SEQ ID NO: 575715 - RNA, 17 nt, Human
agacagugaaagaaaau

SEQ ID NO: 575716 - RNA, 13 nt, Human
auuggacaguaaa

SEQ ID NO: 575717 - RNA, 23 nt, Human
uacaaaugggaaacaaaaggaua

SEQ ID NO: 575718 - RNA, 21 nt, Human
auucauagcagcuuauucaca

SEQ ID NO: 575719 - RNA, 16 nt, Human
uggucugugagaugcu

SEQ ID NO: 575720 - RNA, 17 nt, Human
cguaaucguguccccua

SEQ ID NO: 575721 - RNA, 16 nt, Human
aauuucuucaacuccc

SEQ ID NO: 575722 - RNA, 16 nt, Human
cuagaaccaccugccu

SEQ ID NO: 575723 - RNA, 21 nt, Human
ugaccauacuaauuauacccc

SEQ ID NO: 575724 - RNA, 17 nt, Human
gcaagcucuaucaccaa

SEQ ID NO: 575725 - RNA, 20 nt, Human
acuucuuaggguuaugauua

SEQ ID NO: 575726 - RNA, 21 nt, Human
uaauaggcguaacuaauuuua

SEQ ID NO: 575727 - RNA, 14 nt, Human
acgagaaaacaaua

SEQ ID NO: 575728 - RNA, 21 nt, Human
auauaugcuaagucuuauaua

SEQ ID NO: 575729 - RNA, 20 nt, Human
aaauccuugaagauuuacca

SEQ ID NO: 575730 - RNA, 18 nt, Human
uaaguuuuuuuuuaaaaa

SEQ ID NO: 575731 - RNA, 21 nt, Human
ugagcucagcccuggugggca

SEQ ID NO: 575732 - RNA, 16 nt, Human
uuaaauuguaauaggc

SEQ ID NO: 575733 - RNA, 16 nt, Human
cagggacuugaaccca

SEQ ID NO: 575734 - RNA, 20 nt, Human
aaggaugccccgucccccuc

SEQ ID NO: 575735 - RNA, 19 nt, Human
uauauuuuugugauuuugu

SEQ ID NO: 575736 - RNA, 15 nt, Human
ucccccaucucuucu

SEQ ID NO: 575737 - RNA, 15 nt, Human
agaaaacaauaacga

SEQ ID NO: 575738 - RNA, 16 nt, Human
agugaaggauuuaugu

SEQ ID NO: 575739 - RNA, 22 nt, Human
aaacaaggaugaauuaaguuuu

SEQ ID NO: 575740 - RNA, 21 nt, Human
ccaaauauaaauaaaaauaau

SEQ ID NO: 575741 - RNA, 15 nt, Human
cacuuggucugugag

SEQ ID NO: 575742 - RNA, 16 nt, Human
ccugagcgacagugag

SEQ ID NO: 575743 - RNA, 19 nt, Human
auuuacagagacagaaagc

SEQ ID NO: 575744 - RNA, 19 nt, Human
cuuccagauccuggaaauc

SEQ ID NO: 575745 - RNA, 19 nt, Human
gcuuguauuccuuuuucuc

SEQ ID NO: 575746 - RNA, 16 nt, Human
agugagacagcucugc

SEQ ID NO: 575747 - RNA, 21 nt, Human
auuuacaaaugggaaacaaaa

SEQ ID NO: 575748 - RNA, 15 nt, Human
cugcacuccagccug

SEQ ID NO: 575749 - RNA, 21 nt, Human
aauuuacagagacagaaagca

SEQ ID NO: 575750 - RNA, 21 nt, Human
gacagucaccucauggaauug

SEQ ID NO: 575751 - RNA, 13 nt, Human
agaaaugaaagca

SEQ ID NO: 575752 - RNA, 17 nt, Human
aaccuagggugauauua

SEQ ID NO: 575753 - RNA, 21 nt, Human
uuauguuuaauucugaaagca

SEQ ID NO: 575754 - RNA, 23 nt, Human
cuucaacucccugccccccagcc

SEQ ID NO: 575755 - RNA, 16 nt, Human
aaaaauuccaagugau

SEQ ID NO: 575756 - RNA, 20 nt, Human
aauaauuuuuauauuugaaa

SEQ ID NO: 575757 - RNA, 13 nt, Human
aguguuugaaagc

SEQ ID NO: 575758 - RNA, 17 nt, Human
cucguggaacaguuacc

SEQ ID NO: 575759 - RNA, 17 nt, Human
agugagacagcucugca

SEQ ID NO: 575760 - RNA, 21 nt, Human
gaagugaaaaucuacacucca

SEQ ID NO: 575761 - RNA, 15 nt, Human
agacaaggaaaaaau

SEQ ID NO: 575762 - RNA, 22 nt, Human
ggcauuuaggccaugggacagg

SEQ ID NO: 575763 - RNA, 23 nt, Human
gauagauaggucagugcaaauac

SEQ ID NO: 575764 - RNA, 14 nt, Human
ugcuucuguuuuau

SEQ ID NO: 575765 - RNA, 15 nt, Human
aacgauaaaagacag

SEQ ID NO: 575766 - RNA, 19 nt, Human
acuaucucauuuccaagca

SEQ ID NO: 575767 - RNA, 13 nt, Human
acagcccuucuuu

SEQ ID NO: 575768 - RNA, 16 nt, Human
gucuaucuuugagcgc

SEQ ID NO: 575769 - RNA, 17 nt, Human
ucucuggccuucggccu

SEQ ID NO: 575770 - RNA, 10 nt, Human
auguuuucag

SEQ ID NO: 575771 - RNA, 19 nt, Human
aaaauaacaauaaaagaca

SEQ ID NO: 575772 - RNA, 12 nt, Human
gaagaccucauu

SEQ ID NO: 575773 - RNA, 14 nt, Human
agaauucauucacu

SEQ ID NO: 575774 - RNA, 13 nt, Human
ucuaagaagugaa

SEQ ID NO: 575775 - RNA, 15 nt, Human
aaggguacacugccu

SEQ ID NO: 575776 - RNA, 19 nt, Human
uccauccugaggcuccacu

SEQ ID NO: 575777 - RNA, 16 nt, Human
ccccugcacuccagcc

SEQ ID NO: 575778 - RNA, 21 nt, Human
auguuuacagauccccaagcc

SEQ ID NO: 575779 - RNA, 19 nt, Human
gugaacuugguuuuaauua

SEQ ID NO: 575780 - RNA, 21 nt, Human
gcccugcugagucccaggcug

SEQ ID NO: 575781 - RNA, 23 nt, Human
ccccucuggcuccagcuggccgg

SEQ ID NO: 575782 - RNA, 19 nt, Human
uguuggacgagaaaacaau

SEQ ID NO: 575783 - RNA, 12 nt, Human
ggaggcugagau

SEQ ID NO: 575784 - RNA, 20 nt, Human
acuccagugagacagcucug

SEQ ID NO: 575785 - RNA, 16 nt, Human
cuggccuucggccucc

SEQ ID NO: 575786 - RNA, 16 nt, Human
aggguguguaaguaga

SEQ ID NO: 575787 - RNA, 23 nt, Human
agcaugucgucaaagcugaaaug

SEQ ID NO: 575788 - RNA, 18 nt, Human
uaaauugacacuuaaaaa

SEQ ID NO: 575789 - RNA, 15 nt, Human
uugacccacaagaaa

SEQ ID NO: 575790 - RNA, 11 nt, Human
auuuuugaagc

SEQ ID NO: 575791 - RNA, 18 nt, Human
cagauuugagcucagccc

SEQ ID NO: 575792 - RNA, 20 nt, Human
aaaaaccugagccccaaaag

SEQ ID NO: 575793 - RNA, 16 nt, Human
ggccuccauccugagg

SEQ ID NO: 575794 - RNA, 20 nt, Human
ccugccuaagugcagccccg

SEQ ID NO: 575795 - RNA, 16 nt, Human
gccuaagugcagcccc

SEQ ID NO: 575796 - RNA, 22 nt, Human
gugccucaccccuugccauaau

SEQ ID NO: 575797 - RNA, 13 nt, Human
caacucccugccc

SEQ ID NO: 575798 - RNA, 15 nt, Human
ugcuguauuuuaaaa

SEQ ID NO: 575799 - RNA, 20 nt, Human
uguaauaggcguaacuaauu

SEQ ID NO: 575800 - RNA, 11 nt, Human
auaauuuaaau

SEQ ID NO: 575801 - RNA, 11 nt, Human
ucaccugcccu

SEQ ID NO: 575802 - RNA, 19 nt, Human
cggccuccauccugaggcu

SEQ ID NO: 575803 - RNA, 20 nt, Human
acuuuauuuucuauaauuua

SEQ ID NO: 575804 - RNA, 13 nt, Human
uacuuuauuuucu

SEQ ID NO: 575805 - RNA, 20 nt, Human
auauuuuauaucaauuuaaa

SEQ ID NO: 575806 - RNA, 23 nt, Human
aguaauuggaaaggcagcucuaa

SEQ ID NO: 575807 - RNA, 13 nt, Human
aaaugaaagcagg

SEQ ID NO: 575808 - RNA, 14 nt, Human
gaaagcagaacagu

SEQ ID NO: 575809 - RNA, 14 nt, Human
aaaagaaagaaaau

SEQ ID NO: 575810 - RNA, 17 nt, Human
agagacagaaagcagaa

SEQ ID NO: 575811 - RNA, 20 nt, Human
acuagaguuuagcuggaaaa

SEQ ID NO: 575812 - RNA, 14 nt, Human
gcaaagcccagcuu

SEQ ID NO: 575813 - RNA, 21 nt, Human
gaaagcagggacuugaaccca

SEQ ID NO: 575814 - RNA, 13 nt, Human
uuggacgagaaaa

SEQ ID NO: 575815 - RNA, 14 nt, Human
uaaaauccauacau

SEQ ID NO: 575816 - RNA, 22 nt, Human
cuuuccacagaagcuccaggua

SEQ ID NO: 575817 - RNA, 22 nt, Human
gugugaccacugcagaagacag

SEQ ID NO: 575818 - RNA, 22 nt, Human
agcacagccucuuagaugcagu

SEQ ID NO: 575819 - RNA, 15 nt, Human
uauuuauuuuaauaa

SEQ ID NO: 575820 - RNA, 15 nt, Human
uaucaauuuaaaaaa

SEQ ID NO: 575821 - RNA, 12 nt, Human
uuuuauauuuga

SEQ ID NO: 575822 - RNA, 20 nt, Human
cuacuuccccuuccuaauuc

SEQ ID NO: 575823 - RNA, 14 nt, Human
ccugccccccagcc

SEQ ID NO: 575824 - RNA, 18 nt, Human
ccacuuggucugugagau

SEQ ID NO: 575825 - RNA, 19 nt, Human
ccugccuaagugcagcccc

SEQ ID NO: 575826 - RNA, 15 nt, Human
ccugccccccagccc

SEQ ID NO: 575827 - RNA, 16 nt, Human
uguucuaagaagugaa

SEQ ID NO: 575828 - RNA, 22 nt, Human
accaaucaugaauuaguuuuau

SEQ ID NO: 575829 - RNA, 19 nt, Human
aaaauaacgauaaaagaca

SEQ ID NO: 575830 - RNA, 18 nt, Human
ccucuggcuccagcuggc

SEQ ID NO: 575831 - RNA, 17 nt, Human
ugaucaccugcccugcu

SEQ ID NO: 575832 - RNA, 15 nt, Human
ggacucaccuccccc

SEQ ID NO: 575833 - RNA, 14 nt, Human
ucccuugaugaaga

SEQ ID NO: 575834 - RNA, 21 nt, Human
cucuucuggguuccuuccucu

SEQ ID NO: 575835 - RNA, 15 nt, Human
aauaacgauaaaaga

SEQ ID NO: 575836 - RNA, 22 nt, Human
gaggggagcaugggaagugacg

SEQ ID NO: 575837 - RNA, 14 nt, Human
ugcucauggaauug

SEQ ID NO: 575838 - RNA, 13 nt, Human
aaaauaacgauaa

SEQ ID NO: 575839 - RNA, 17 nt, Human
uacaaaugcauuucuaa

SEQ ID NO: 575840 - RNA, 21 nt, Human
ccucccuuggggccuaugcag

SEQ ID NO: 575841 - RNA, 22 nt, Human
ucuagcaugucgucaaagcuga

SEQ ID NO: 575842 - RNA, 20 nt, Human
uauacugugugcuaaaacaa

SEQ ID NO: 575843 - RNA, 13 nt, Human
acuaauuuuaaaa

SEQ ID NO: 575844 - RNA, 17 nt, Human
aaaaauccuacuuucau

SEQ ID NO: 575845 - RNA, 21 nt, Human
ucaagucuuucacauuuaaau

SEQ ID NO: 575846 - RNA, 18 nt, Human
uucaauaucuuuuuuuua

SEQ ID NO: 575847 - RNA, 15 nt, Human
auauaaauaaaaaua

SEQ ID NO: 575848 - RNA, 18 nt, Human
uuuuagugaaauauuauu

SEQ ID NO: 575849 - RNA, 20 nt, Human
agagacacacugaagaagca

SEQ ID NO: 575850 - RNA, 22 nt, Human
gaauuucuucaacucccugccc

SEQ ID NO: 575851 - RNA, 22 nt, Human
aaauguugacaugggacauuug

SEQ ID NO: 575852 - RNA, 18 nt, Human
ucuucuggguuccuuccu

SEQ ID NO: 575853 - RNA, 22 nt, Human
accuaacgaaguauccuucagc

SEQ ID NO: 575854 - RNA, 13 nt, Human
uuuaaaaaaaaac

SEQ ID NO: 575855 - RNA, 16 nt, Human
auccuugaagauuuac

SEQ ID NO: 575856 - RNA, 13 nt, Human
uuuagugaaauau

SEQ ID NO: 575857 - RNA, 16 nt, Human
cacuaguauuucuaug

SEQ ID NO: 575858 - RNA, 22 nt, Human
uuuaauaauguuucaaacauau

SEQ ID NO: 575859 - RNA, 16 nt, Human
agagguccacaacaca

SEQ ID NO: 575860 - RNA, 15 nt, Human
ucuaugaaauauuau

SEQ ID NO: 575861 - RNA, 20 nt, Human
uaacaagccuccuuuuaaag

SEQ ID NO: 575862 - RNA, 19 nt, Human
ucaccaaggcugauuaaac

SEQ ID NO: 575863 - RNA, 14 nt, Human
accauuuuuacuug

SEQ ID NO: 575864 - RNA, 20 nt, Human
ccagugagacagcucugcau

SEQ ID NO: 575865 - RNA, 18 nt, Human
gaccccugagcuugcaga

SEQ ID NO: 575866 - RNA, 21 nt, Human
uauaaaauaauuuuuauauuu

SEQ ID NO: 575867 - RNA, 22 nt, Human
uguugcccacagcuguaugauu

SEQ ID NO: 575868 - RNA, 13 nt, Human
cccugcacuccag

SEQ ID NO: 575869 - RNA, 14 nt, Human
uauuugaaauauug

SEQ ID NO: 575870 - RNA, 14 nt, Human
uaaaagacaaggaa

SEQ ID NO: 575871 - RNA, 19 nt, Human
cuuccuaauuccacagcug

SEQ ID NO: 575872 - RNA, 15 nt, Human
uacaaaugcauuucu

SEQ ID NO: 575873 - RNA, 18 nt, Human
aucuuauaauuuaaaaua

SEQ ID NO: 575874 - RNA, 13 nt, Human
uggcuccagcugg

SEQ ID NO: 575875 - RNA, 12 nt, Human
uucagccugaaa

SEQ ID NO: 575876 - RNA, 19 nt, Human
uaucacuugucaauaaaau

SEQ ID NO: 575877 - RNA, 23 nt, Human
uggaaauguuuacagauccccaa

SEQ ID NO: 575878 - RNA, 19 nt, Human
aaacaaaaggauaaugaau

SEQ ID NO: 575879 - RNA, 21 nt, Human
cccacuggacucaccuccccc

SEQ ID NO: 575880 - RNA, 18 nt, Human
aaaaucuuauaauuuaaa

SEQ ID NO: 575881 - RNA, 16 nt, Human
ccucagucucccuccc

SEQ ID NO: 575882 - RNA, 15 nt, Human
cuaagcaaaauguga

SEQ ID NO: 575883 - RNA, 19 nt, Human
augaaagcagggacuugaa

SEQ ID NO: 575884 - RNA, 17 nt, Human
uucacuguaaaauaaua

SEQ ID NO: 575885 - RNA, 12 nt, Human
uaauuccacagc

SEQ ID NO: 575886 - RNA, 14 nt, Human
agagacagaaagca

SEQ ID NO: 575887 - RNA, 22 nt, Human
aaauaacaaugaaaguugauaa

SEQ ID NO: 575888 - RNA, 14 nt, Human
gagagugaacaaau

SEQ ID NO: 575889 - RNA, 23 nt, Human
ucuagcaugucgucaaagcugaa

SEQ ID NO: 575890 - RNA, 21 nt, Human
gaaaacaauaacgauaaaaga

SEQ ID NO: 575891 - RNA, 22 nt, Human
aucucuucuggguuccuuccuc

SEQ ID NO: 575892 - RNA, 13 nt, Human
ugaaauuguauua

SEQ ID NO: 575893 - RNA, 13 nt, Human
aucucaauauuuc

SEQ ID NO: 575894 - RNA, 21 nt, Human
uuuguauaaaauaauuuuuau

SEQ ID NO: 575895 - RNA, 22 nt, Human
cugaggcuccacuuggucugug

SEQ ID NO: 575896 - RNA, 22 nt, Human
agacucgggauuaguacacacu

SEQ ID NO: 575897 - RNA, 20 nt, Human
cagccugagcgacagugaga

SEQ ID NO: 575898 - RNA, 18 nt, Human
uuguaaaggaauuuaaaa

SEQ ID NO: 575899 - RNA, 15 nt, Human
uaaaagacaaggaaa

SEQ ID NO: 575900 - RNA, 18 nt, Human
uguauuauuuuuuaaaaa

SEQ ID NO: 575901 - RNA, 17 nt, Human
uaucuuuuuuuuaauaa

SEQ ID NO: 575902 - RNA, 15 nt, Human
gugaacuugguuuua

SEQ ID NO: 575903 - RNA, 19 nt, Human
gcacacagcacgggggcca

SEQ ID NO: 575904 - RNA, 15 nt, Human
cgggagccugaucac

SEQ ID NO: 575905 - RNA, 21 nt, Human
uuacauuuguauaaaauaauu

SEQ ID NO: 575906 - RNA, 17 nt, Human
cagacaucaacagauaa

SEQ ID NO: 575907 - RNA, 13 nt, Human
aacacaacuauau

SEQ ID NO: 575908 - RNA, 14 nt, Human
gagcucagcccugg

SEQ ID NO: 575909 - RNA, 14 nt, Human
uucuaugaaauauu

SEQ ID NO: 575910 - RNA, 17 nt, Human
gacgagaaaacaauaac

SEQ ID NO: 575911 - RNA, 17 nt, Human
ugguucccuugaugaag

SEQ ID NO: 575912 - RNA, 16 nt, Human
aaaaugugauauguac

SEQ ID NO: 575913 - RNA, 19 nt, Human
cccccucuggcuccagcug

SEQ ID NO: 575914 - RNA, 18 nt, Human
agguccacaacacacaga

SEQ ID NO: 575915 - RNA, 20 nt, Human
cccugccccccagcccuccu

SEQ ID NO: 575916 - RNA, 22 nt, Human
ccgggagccugaucaccugccc

SEQ ID NO: 575917 - RNA, 15 nt, Human
auauugacuuuuuau

SEQ ID NO: 575918 - RNA, 19 nt, Human
gagguacugagagugaaca

SEQ ID NO: 575919 - RNA, 17 nt, Human
uuucacauuuaaauaaa

SEQ ID NO: 575920 - RNA, 18 nt, Human
uaaaagacaaggaaaaaa

SEQ ID NO: 575921 - RNA, 14 nt, Human
ucuuuuuuuuaaua

SEQ ID NO: 575922 - RNA, 14 nt, Human
cagucucccucccu

SEQ ID NO: 575923 - RNA, 16 nt, Human
cccuauccuacuuccc

SEQ ID NO: 575924 - RNA, 19 nt, Human
aaaagacagugaaagaaaa

SEQ ID NO: 575925 - RNA, 21 nt, Human
uaguauuucuaugaaauauua

SEQ ID NO: 575926 - RNA, 16 nt, Human
cugagcuugcagagau

SEQ ID NO: 575927 - RNA, 14 nt, Human
ccacuggacucacc

SEQ ID NO: 575928 - RNA, 13 nt, Human
acggggugaaacc

SEQ ID NO: 575929 - RNA, 20 nt, Human
ugauuucugagcauuuaaua

SEQ ID NO: 575930 - RNA, 17 nt, Human
ggccaugggacagggag

SEQ ID NO: 575931 - RNA, 16 nt, Human
ucccugccccccagcc

SEQ ID NO: 575932 - RNA, 21 nt, Human
cuaguaucaaaagaaagaaaa

SEQ ID NO: 575933 - RNA, 16 nt, Human
augccccgucccccuc

SEQ ID NO: 575934 - RNA, 22 nt, Human
acaugagguacugagagugaac

SEQ ID NO: 575935 - RNA, 19 nt, Human
gguuccuuccucugagccu

SEQ ID NO: 575936 - RNA, 22 nt, Human
uacaugagguacugagagugaa

SEQ ID NO: 575937 - RNA, 14 nt, Human
caaaugcauuucua

SEQ ID NO: 575938 - RNA, 22 nt, Human
cuucagccugaaagaggaauga

SEQ ID NO: 575939 - RNA, 18 nt, Human
gcccuggugggcagagag

SEQ ID NO: 575940 - RNA, 18 nt, Human
acuuuaugcuaagugaaa

SEQ ID NO: 575941 - RNA, 20 nt, Human
caggcugagccucagucucc

SEQ ID NO: 575942 - RNA, 18 nt, Human
cagccucuuagaugcagu

SEQ ID NO: 575943 - RNA, 18 nt, Human
gacauuugcucauggaau

SEQ ID NO: 575944 - RNA, 13 nt, Human
aacaauaaaagac

SEQ ID NO: 575945 - RNA, 16 nt, Human
auaucaauuuaaaaaa

SEQ ID NO: 575946 - RNA, 14 nt, Human
aauauuuauuuuaa

SEQ ID NO: 575947 - RNA, 17 nt, Human
caagccuccuuuuaaag

SEQ ID NO: 575948 - RNA, 18 nt, Human
acaugaacuuguaaagga

SEQ ID NO: 575949 - RNA, 18 nt, Human
auuuguauaaaauaauuu

SEQ ID NO: 575950 - RNA, 17 nt, Human
cuggacucaccuccccc

SEQ ID NO: 575951 - RNA, 21 nt, Human
uacaugagguacugagaguga

SEQ ID NO: 575952 - RNA, 15 nt, Human
cauuccaagccucau

SEQ ID NO: 575953 - RNA, 14 nt, Human
augauguuuagaaa

SEQ ID NO: 575954 - RNA, 18 nt, Human
gccuuggggcugaugcag

SEQ ID NO: 575955 - RNA, 16 nt, Human
ugacacuuaaaaaugg

SEQ ID NO: 575956 - RNA, 14 nt, Human
cgucccccucuggc

SEQ ID NO: 575957 - RNA, 18 nt, Human
agauccccaagccuggca

SEQ ID NO: 575958 - RNA, 16 nt, Human
aauuuuuaauuauaug

SEQ ID NO: 575959 - RNA, 23 nt, Human
augaauuaaguuuuuuuuuaaaa

SEQ ID NO: 575960 - RNA, 17 nt, Human
gaaugagagacacacug

SEQ ID NO: 575961 - RNA, 23 nt, Human
ucggccuccauccugaggcucca

SEQ ID NO: 575962 - RNA, 19 nt, Human
aaugaauggcuaagcaaaa

SEQ ID NO: 575963 - RNA, 19 nt, Human
gaggcagagguugcaguga

SEQ ID NO: 575964 - RNA, 17 nt, Human
uaaaagacaaggaaaaa

SEQ ID NO: 575965 - RNA, 11 nt, Human
caacucccugc

SEQ ID NO: 575966 - RNA, 15 nt, Human
gagaugcuagaacuc

SEQ ID NO: 575967 - RNA, 21 nt, Human
cuucucacauuuauauuuuug

SEQ ID NO: 575968 - RNA, 16 nt, Human
aaaguguuugaaagcu

SEQ ID NO: 575969 - RNA, 17 nt, Human
aagcuuuuuuugaauca

SEQ ID NO: 575970 - RNA, 15 nt, Human
gaaagaaaauaacga

SEQ ID NO: 575971 - RNA, 13 nt, Human
uaagugcagcccc

SEQ ID NO: 575972 - RNA, 17 nt, Human
aaauccuacuuucauaa

SEQ ID NO: 575973 - RNA, 18 nt, Human
acugccuucucaacucca

SEQ ID NO: 575974 - RNA, 15 nt, Human
augggacagggagga

SEQ ID NO: 575975 - RNA, 21 nt, Human
aggcucuuuugggauuuuuga

SEQ ID NO: 575976 - RNA, 20 nt, Human
accuacacgagauacagaau

SEQ ID NO: 575977 - RNA, 16 nt, Human
gccaaggaugccccgu

SEQ ID NO: 575978 - RNA, 13 nt, Human
acaauaaaagaca

SEQ ID NO: 575979 - RNA, 13 nt, Human
ugcauuucuaaag

SEQ ID NO: 575980 - RNA, 16 nt, Human
auuuuuagugaaauau

SEQ ID NO: 575981 - RNA, 13 nt, Human
aggauuugaaauu

SEQ ID NO: 575982 - RNA, 15 nt, Human
uacaggauuugaaau

SEQ ID NO: 575983 - RNA, 19 nt, Human
ugagcgcccacuagaccca

SEQ ID NO: 575984 - RNA, 20 nt, Human
cagcuggccgggagccugau

SEQ ID NO: 575985 - RNA, 18 nt, Human
gacccacuggacucaccu

SEQ ID NO: 575986 - RNA, 23 nt, Human
cccacuggacucaccucccccau

SEQ ID NO: 575987 - RNA, 21 nt, Human
uguauaaaauaauuuuuauau

SEQ ID NO: 575988 - RNA, 22 nt, Human
uucauucacucaacaaacauaa

SEQ ID NO: 575989 - RNA, 20 nt, Human
agaagaacugaaaucauacu

SEQ ID NO: 575990 - RNA, 17 nt, Human
gaagcaccaaucaugaa

SEQ ID NO: 575991 - RNA, 21 nt, Human
auuauauggcuugaguuuaaa

SEQ ID NO: 575992 - RNA, 16 nt, Human
augcuguauuuuaaaa

SEQ ID NO: 575993 - RNA, 18 nt, Human
gccuucggccuccauccu

SEQ ID NO: 575994 - RNA, 20 nt, Human
aguuguuucuacuacaugga

SEQ ID NO: 575995 - RNA, 14 nt, Human
uaaauaaaaauaau

SEQ ID NO: 575996 - RNA, 20 nt, Human
uaaaagacagugaaagaaaa

SEQ ID NO: 575997 - RNA, 14 nt, Human
cagagguugcagug

SEQ ID NO: 575998 - RNA, 18 nt, Human
cccacuggacucaccucc

SEQ ID NO: 575999 - RNA, 12 nt, Human
caugggaaguga

SEQ ID NO: 576000 - RNA, 13 nt, Human
uauuucuaugaaa

SEQ ID NO: 576001 - RNA, 21 nt, Human
gggagccugaucaccugcccu

SEQ ID NO: 576002 - RNA, 17 nt, Human
gacagugaaagaaaaua

SEQ ID NO: 576003 - RNA, 17 nt, Human
uuauuacuguaagaaaa

SEQ ID NO: 576004 - RNA, 18 nt, Human
uuuucucuccucucccca

SEQ ID NO: 576005 - RNA, 14 nt, Human
aauuguauuacaaa

SEQ ID NO: 576006 - RNA, 12 nt, Human
aauacuuuauaa

SEQ ID NO: 576007 - RNA, 22 nt, Human
gacucaccucccccaucucuuc

SEQ ID NO: 576008 - RNA, 22 nt, Human
aaaucaggguuaguauugucca

SEQ ID NO: 576009 - RNA, 17 nt, Human
acaaaugggaaacaaaa

SEQ ID NO: 576010 - RNA, 23 nt, Human
aauauuuauuuuaauaauguuuc

SEQ ID NO: 576011 - RNA, 22 nt, Human
cucugagccuugggaccccuga

SEQ ID NO: 576012 - RNA, 15 nt, Human
gccuugggaccccug

SEQ ID NO: 576013 - RNA, 17 nt, Human
auguuuacagaucccca

SEQ ID NO: 576014 - RNA, 16 nt, Human
uuuauauuugaaauau

SEQ ID NO: 576015 - RNA, 16 nt, Human
cagggcucacagaauu

SEQ ID NO: 576016 - RNA, 15 nt, Human
guuuuucuuuucauu

SEQ ID NO: 576017 - RNA, 11 nt, Human
cuguuuuauaa

SEQ ID NO: 576018 - RNA, 14 nt, Human
uaacuaauuuuaac

SEQ ID NO: 576019 - RNA, 13 nt, Human
acaaggaaaaaau

SEQ ID NO: 576020 - RNA, 18 nt, Human
uaauaauguuucaaacau

SEQ ID NO: 576021 - RNA, 16 nt, Human
uguccccuauccuacu

SEQ ID NO: 576022 - RNA, 15 nt, Human
cccccagcccuccuu

SEQ ID NO: 576023 - RNA, 22 nt, Human
cccaugauguuuagaaacacaa

SEQ ID NO: 576024 - RNA, 18 nt, Human
ccaaccuggaguugaaaa

SEQ ID NO: 576025 - RNA, 13 nt, Human
ugaaagaaaauaa

SEQ ID NO: 576026 - RNA, 16 nt, Human
ccccaucucuucuggg

SEQ ID NO: 576027 - RNA, 15 nt, Human
acaucaacagauaaa

SEQ ID NO: 576028 - RNA, 16 nt, Human
augaauacuuuauaaa

SEQ ID NO: 576029 - RNA, 14 nt, Human
cucagucucccucc

SEQ ID NO: 576030 - RNA, 20 nt, Human
cugcacuccagccugagcga

SEQ ID NO: 576031 - RNA, 12 nt, Human
auauaaauaaaa

SEQ ID NO: 576032 - RNA, 23 nt, Human
auguuaaaacugggacaggggag

SEQ ID NO: 576033 - RNA, 22 nt, Human
aaacauguuuaucguauuugau

SEQ ID NO: 576034 - RNA, 21 nt, Human
aauuuuuauauuugaaauauu

SEQ ID NO: 576035 - RNA, 23 nt, Human
gcccuggugccucaccccuugcc

SEQ ID NO: 576036 - RNA, 16 nt, Human
aaaauccauacauuug

SEQ ID NO: 576037 - RNA, 18 nt, Human
cagucucccucccuuggg

SEQ ID NO: 576038 - RNA, 15 nt, Human
ccaaggagccaaaca

SEQ ID NO: 576039 - RNA, 15 nt, Human
gacagggaggacgcu

SEQ ID NO: 576040 - RNA, 20 nt, Human
caaauguucaucaaugaaug

SEQ ID NO: 576041 - RNA, 14 nt, Human
uaauccuaaacaua

SEQ ID NO: 576042 - RNA, 17 nt, Human
auaauuuaaauauaugc

SEQ ID NO: 576043 - RNA, 23 nt, Human
auauaacaaugcuguauuuuaaa

SEQ ID NO: 576044 - RNA, 23 nt, Human
ggcuaagcuucacuguaaaauaa

SEQ ID NO: 576045 - RNA, 17 nt, Human
aaauauaaauaaaaaua

SEQ ID NO: 576046 - RNA, 13 nt, Human
cugcacuccagcc

SEQ ID NO: 576047 - RNA, 19 nt, Human
caucaaggguacacugccu

SEQ ID NO: 576048 - RNA, 13 nt, Human
ccuccuuuuaaag

SEQ ID NO: 576049 - RNA, 19 nt, Human
cuaagcuucacuguaaaau

SEQ ID NO: 576050 - RNA, 17 nt, Human
cuaucucauuuccaagc

SEQ ID NO: 576051 - RNA, 18 nt, Human
cagagacagaaagcagaa

SEQ ID NO: 576052 - RNA, 22 nt, Human
aauugacccacaagaaaugaaa

SEQ ID NO: 576053 - RNA, 21 nt, Human
aacuuguaaaggaauuuaaaa

SEQ ID NO: 576054 - RNA, 12 nt, Human
uguuugaaagcu

SEQ ID NO: 576055 - RNA, 23 nt, Human
gcuuuggucuaucuuugagcgcc

SEQ ID NO: 576056 - RNA, 14 nt, Human
cucaccccuugcca

SEQ ID NO: 576057 - RNA, 18 nt, Human
cagaaagcagaacaguga

SEQ ID NO: 576058 - RNA, 15 nt, Human
uuaauucugaaagca

SEQ ID NO: 576059 - RNA, 23 nt, Human
agaaugauuaugaauuacauuug

SEQ ID NO: 576060 - RNA, 17 nt, Human
acaaaugcauuucuaaa

SEQ ID NO: 576061 - RNA, 15 nt, Human
cuucaacucccugcc

SEQ ID NO: 576062 - RNA, 18 nt, Human
auuuuaacucuauaaugu

SEQ ID NO: 576063 - RNA, 13 nt, Human
aggcuagauguau

SEQ ID NO: 576064 - RNA, 19 nt, Human
cagagaugaggccgccaug

SEQ ID NO: 576065 - RNA, 15 nt, Human
uagauaggccauggg

SEQ ID NO: 576066 - RNA, 14 nt, Human
cuggccgggagccu

SEQ ID NO: 576067 - RNA, 20 nt, Human
ugagucccaggcugagccuc

SEQ ID NO: 576068 - RNA, 20 nt, Human
gccgggcgugguggugagug

SEQ ID NO: 576069 - RNA, 18 nt, Human
ccugccuaagugcagccc

SEQ ID NO: 576070 - RNA, 17 nt, Human
gaaaaucaggcuggcca

SEQ ID NO: 576071 - RNA, 17 nt, Human
uugccaaauauaaauaa

SEQ ID NO: 576072 - RNA, 19 nt, Human
caacucccugccccccagc

SEQ ID NO: 576073 - RNA, 19 nt, Human
auccuacaagacacaguga

SEQ ID NO: 576074 - RNA, 21 nt, Human
auccccaagccuggcaaggga

SEQ ID NO: 576075 - RNA, 18 nt, Human
agagaaugagagacacac

SEQ ID NO: 576076 - RNA, 18 nt, Human
uguacuuuauuuucuaua

SEQ ID NO: 576077 - RNA, 15 nt, Human
acaaggaaaaaauaa

SEQ ID NO: 576078 - RNA, 15 nt, Human
cuaagugcagccccg

SEQ ID NO: 576079 - RNA, 17 nt, Human
gccuccuuuuaaaguaa

SEQ ID NO: 576080 - RNA, 18 nt, Human
cccucuggcuccagcugg

SEQ ID NO: 576081 - RNA, 17 nt, Human
uguaaaggaauuuaaaa

SEQ ID NO: 576082 - RNA, 18 nt, Human
acauguuacaacacggac

SEQ ID NO: 576083 - RNA, 14 nt, Human
agcucguggaacag

SEQ ID NO: 576084 - RNA, 16 nt, Human
cacgggggccaaggau

SEQ ID NO: 576085 - RNA, 19 nt, Human
guuauuauauuuacaaaug

SEQ ID NO: 576086 - RNA, 14 nt, Human
aaaauacaaaaaaa

SEQ ID NO: 576087 - RNA, 14 nt, Human
agcucuaucaccaa

SEQ ID NO: 576088 - RNA, 21 nt, Human
cuauguucuaagaagugaaaa

SEQ ID NO: 576089 - RNA, 23 nt, Human
auaauguguucauucuggaauaa

SEQ ID NO: 576090 - RNA, 17 nt, Human
cuccuuaucaaaggaca

SEQ ID NO: 576091 - RNA, 18 nt, Human
aguucuccacuagcuaug

SEQ ID NO: 576092 - RNA, 14 nt, Human
cacaagaaaugaaa

SEQ ID NO: 576093 - RNA, 22 nt, Human
caugaguaacugauuuguaaca

SEQ ID NO: 576094 - RNA, 19 nt, Human
agcucugcccauccugccc

SEQ ID NO: 576095 - RNA, 12 nt, Human
gguauuuuaauc

SEQ ID NO: 576096 - RNA, 15 nt, Human
ugaaacccugucucu

SEQ ID NO: 576097 - RNA, 20 nt, Human
uuuaaauaaaguguuugaaa

SEQ ID NO: 576098 - RNA, 17 nt, Human
uccugccccugagccca

SEQ ID NO: 576099 - RNA, 22 nt, Human
augguuguauuauuuuuuaaaa

SEQ ID NO: 576100 - RNA, 14 nt, Human
aagcaacccaaaug

SEQ ID NO: 576101 - RNA, 12 nt, Human
gcucagcccugg

SEQ ID NO: 576102 - RNA, 14 nt, Human
cugagucccaggcu

SEQ ID NO: 576103 - RNA, 20 nt, Human
cuaaaugucaaucagccuag

SEQ ID NO: 576104 - RNA, 16 nt, Human
aagacugcacaucaaa

SEQ ID NO: 576105 - RNA, 15 nt, Human
aaaaauaacaaugaa

SEQ ID NO: 576106 - RNA, 20 nt, Human
accucugccucagaaaacaa

SEQ ID NO: 576107 - RNA, 21 nt, Human
aaaugucuugcuugauuguau

SEQ ID NO: 576108 - RNA, 16 nt, Human
ccucaaaacuucagac

SEQ ID NO: 576109 - RNA, 22 nt, Human
cccagcccuccuuaucaaagga

SEQ ID NO: 576110 - RNA, 18 nt, Human
uacauuuguauaaaauaa

SEQ ID NO: 576111 - RNA, 14 nt, Human
auccuugaagauuu

SEQ ID NO: 576112 - RNA, 20 nt, Human
aaugaauacuuuauaaagga

SEQ ID NO: 576113 - RNA, 16 nt, Human
uauaugucacuuugcu

SEQ ID NO: 576114 - RNA, 14 nt, Human
aauauuauguuaaa

SEQ ID NO: 576115 - RNA, 16 nt, Human
uggggauagugaggca

SEQ ID NO: 576116 - RNA, 17 nt, Human
aggccaugggacaggga

SEQ ID NO: 576117 - RNA, 13 nt, Human
gguccacaacaca

SEQ ID NO: 576118 - RNA, 19 nt, Human
agacucgggauuaguacac

SEQ ID NO: 576119 - RNA, 13 nt, Human
agcgacagugaga

SEQ ID NO: 576120 - RNA, 15 nt, Human
uagggugauauuaac

SEQ ID NO: 576121 - RNA, 19 nt, Human
aaacaauaacgauaaaaga

SEQ ID NO: 576122 - RNA, 21 nt, Human
aaguuuaugguuguauuauuu

SEQ ID NO: 576123 - RNA, 12 nt, Human
gaauuggagcuc

SEQ ID NO: 576124 - RNA, 19 nt, Human
agucaaauugugugaaagg

SEQ ID NO: 576125 - RNA, 18 nt, Human
acauuuauauuuuuguga

SEQ ID NO: 576126 - RNA, 22 nt, Human
cccuauccuacuuccccuuccu

SEQ ID NO: 576127 - RNA, 20 nt, Human
aaacuuuaugcuaagugaaa

SEQ ID NO: 576128 - RNA, 22 nt, Human
acauccuacaagacacagugac

SEQ ID NO: 576129 - RNA, 19 nt, Human
uauuuuaauaauguuucaa

SEQ ID NO: 576130 - RNA, 16 nt, Human
cuucggccuccauccu

SEQ ID NO: 576131 - RNA, 13 nt, Human
ugggaggcugaga

SEQ ID NO: 576132 - RNA, 17 nt, Human
ucgggauuaguacacac

SEQ ID NO: 576133 - RNA, 16 nt, Human
cugcacuccagccuga

SEQ ID NO: 576134 - RNA, 16 nt, Human
aucaauuuaaaaaaaa

SEQ ID NO: 576135 - RNA, 19 nt, Human
aagcuuguauuccuuuuuc

SEQ ID NO: 576136 - RNA, 13 nt, Human
aagacaaggaaaa

SEQ ID NO: 576137 - RNA, 19 nt, Human
cuucuggguuccuuccucu

SEQ ID NO: 576138 - RNA, 16 nt, Human
cuccauccugaggcuc

SEQ ID NO: 576139 - RNA, 17 nt, Human
ugaccacugcagaagac

SEQ ID NO: 576140 - RNA, 16 nt, Human
auuccaccuacaugag

SEQ ID NO: 576141 - RNA, 15 nt, Human
uugacacuuaaaaau

SEQ ID NO: 576142 - RNA, 14 nt, Human
uauguauauuuuau

SEQ ID NO: 576143 - RNA, 17 nt, Human
uuccaagugauugaaac

SEQ ID NO: 576144 - RNA, 19 nt, Human
acaauaacgauaaaagaca

SEQ ID NO: 576145 - RNA, 14 nt, Human
agaugcuagaacuc

SEQ ID NO: 576146 - RNA, 21 nt, Human
accaccugccuauauuuuuug

SEQ ID NO: 576147 - RNA, 15 nt, Human
aaggaauuuaaaaau

SEQ ID NO: 576148 - RNA, 12 nt, Human
aagaaaauaaca

SEQ ID NO: 576149 - RNA, 17 nt, Human
aauaacgauaaaagaca

SEQ ID NO: 576150 - RNA, 22 nt, Human
aaaaaaccugagccccaaaagg

SEQ ID NO: 576151 - RNA, 23 nt, Human
ggaacaguuaccucugccucaga

SEQ ID NO: 576152 - RNA, 11 nt, Human
acugggacagg

SEQ ID NO: 576153 - RNA, 20 nt, Human
uguaaaggaauuuaaaaauc

SEQ ID NO: 576154 - RNA, 19 nt, Human
ggagccugaucaccugccc

SEQ ID NO: 576155 - RNA, 12 nt, Human
ucuuaagaagac

SEQ ID NO: 576156 - RNA, 20 nt, Human
gaaaauaacgauaaaagaca

SEQ ID NO: 576157 - RNA, 21 nt, Human
uccauccugaggcuccacuug

SEQ ID NO: 576158 - RNA, 16 nt, Human
auuuguauaaaauaau

SEQ ID NO: 576159 - RNA, 21 nt, Human
augucauuugcuggagcucug

SEQ ID NO: 576160 - RNA, 14 nt, Human
auugucuagugaaa

SEQ ID NO: 576161 - RNA, 15 nt, Human
uccauccugaggcuc

SEQ ID NO: 576162 - RNA, 23 nt, Human
uaacgauaaaagacagugaaaga

SEQ ID NO: 576163 - RNA, 16 nt, Human
gacaagcucacagacc

SEQ ID NO: 576164 - RNA, 23 nt, Human
gggaaacaaaaggauaaugaaua

SEQ ID NO: 576165 - RNA, 22 nt, Human
aauaugccccauucaacaucua

SEQ ID NO: 576166 - RNA, 16 nt, Human
agcuugaaaccuucac

SEQ ID NO: 576167 - RNA, 14 nt, Human
uuuguauaaaauaa

SEQ ID NO: 576168 - RNA, 21 nt, Human
uuuucaggcuagauguaugua

SEQ ID NO: 576169 - RNA, 15 nt, Human
uuacagagacagaaa

SEQ ID NO: 576170 - RNA, 13 nt, Human
acaagaaaugaaa

SEQ ID NO: 576171 - RNA, 15 nt, Human
gccccauucaacauc

SEQ ID NO: 576172 - RNA, 19 nt, Human
cccacuggacucaccuccc

SEQ ID NO: 576173 - RNA, 22 nt, Human
uauuucuaugaaauauuauguu

SEQ ID NO: 576174 - RNA, 18 nt, Human
ccuugggaccccugagcu

SEQ ID NO: 576175 - RNA, 20 nt, Human
agcuucacuguaaaauaaua

SEQ ID NO: 576176 - RNA, 24 nt, Human
ccccugagcuugcagagaugaggc

SEQ ID NO: 576177 - RNA, 14 nt, Human
uauuuauuuuaaua

SEQ ID NO: 576178 - RNA, 20 nt, Human
cuugccauaauuacuauguc

SEQ ID NO: 576179 - RNA, 14 nt, Human
auuuguauaaaaua

SEQ ID NO: 576180 - RNA, 16 nt, Escherichia coli CFT073
uuuugaaggaaaaauc

SEQ ID NO: 576181 - RNA, 11 nt, Escherichia coli CFT073
uuuucugacca

SEQ ID NO: 576182 - RNA, 22 nt, Escherichia coli CFT073
uuuucuuauuaagcuaacgcgu

SEQ ID NO: 576183 - RNA, 13 nt, Escherichia coli CFT073
uuuucuugccgga

SEQ ID NO: 576184 - RNA, 17 nt, Escherichia coli CFT073
uuuugaacgaguugcgg

SEQ ID NO: 576185 - RNA, 23 nt, Escherichia coli CFT073
uuuuugcauuuccgcugauucaa

SEQ ID NO: 576186 - RNA, 17 nt, Escherichia coli CFT073
uuuuugaaacugguaac

SEQ ID NO: 576187 - RNA, 23 nt, Escherichia coli CFT073
uuuuucuccgagcauuuucagcg

SEQ ID NO: 576188 - RNA, 18 nt, Escherichia coli CFT073
uuuugcgagaacgucugc

SEQ ID NO: 576189 - RNA, 13 nt, Escherichia coli CFT073
uuuugcgccauca

SEQ ID NO: 576190 - RNA, 17 nt, Escherichia coli CFT073
uuugcaggccugauaag

SEQ ID NO: 576191 - RNA, 19 nt, Escherichia coli CFT073
uuugccgcccagucacggc

SEQ ID NO: 576192 - RNA, 24 nt, Escherichia coli CFT073
uuugccggaugcgaugcuggcgca

SEQ ID NO: 576193 - RNA, 14 nt, Escherichia coli CFT073
uuugcccuuccaua

SEQ ID NO: 576194 - RNA, 13 nt, Escherichia coli CFT073
uuucgcuuugccc

SEQ ID NO: 576195 - RNA, 10 nt, Escherichia coli CFT073
uuucgccagc

SEQ ID NO: 576196 - RNA, 14 nt, Escherichia coli CFT073
uuuuaauauuucau

SEQ ID NO: 576197 - RNA, 17 nt, Escherichia coli CFT073
uuuguaggccugauaag

SEQ ID NO: 576198 - RNA, 17 nt, Escherichia coli CFT073
uuuuacuaucuugccga

SEQ ID NO: 576199 - RNA, 12 nt, Escherichia coli CFT073
uuuuacaugcuc

SEQ ID NO: 576200 - RNA, 18 nt, Escherichia coli CFT073
uuuuaucccuucuccaca

SEQ ID NO: 576201 - RNA, 18 nt, Escherichia coli CFT073
uuuucaauggcgcugcaa

SEQ ID NO: 576202 - RNA, 19 nt, Escherichia coli CFT073
uuuucucgcgaaccgccug

SEQ ID NO: 576203 - RNA, 17 nt, Escherichia coli CFT073
uuuauagcguugcccga

SEQ ID NO: 576204 - RNA, 21 nt, Escherichia coli CFT073
uuuauaaaacgagcgauccaa

SEQ ID NO: 576205 - RNA, 15 nt, Escherichia coli CFT073
uuuaagcgaaagcgu

SEQ ID NO: 576206 - RNA, 22 nt, Escherichia coli CFT073
uuuaauaacagcuggauaucaa

SEQ ID NO: 576207 - RNA, 21 nt, Escherichia coli CFT073
uuuaggaaaguaagugccgga

SEQ ID NO: 576208 - RNA, 16 nt, Escherichia coli CFT073
uuuaacacgcaacacg

SEQ ID NO: 576209 - RNA, 12 nt, Escherichia coli CFT073
uuuaacgcauca

SEQ ID NO: 576210 - RNA, 20 nt, Escherichia coli CFT073
uuucaauaaccgcugccagg

SEQ ID NO: 576211 - RNA, 14 nt, Escherichia coli CFT073
uuucaguccgcggu

SEQ ID NO: 576212 - RNA, 17 nt, Escherichia coli CFT073
uuucaaauccagccagc

SEQ ID NO: 576213 - RNA, 15 nt, Escherichia coli CFT073
uuucaaacaggcggu

SEQ ID NO: 576214 - RNA, 13 nt, Escherichia coli CFT073
uuucauccagcgg

SEQ ID NO: 576215 - RNA, 14 nt, Escherichia coli CFT073
uuuccgucagcggc

SEQ ID NO: 576216 - RNA, 11 nt, Escherichia coli CFT073
uuucgacaccu

SEQ ID NO: 576217 - RNA, 15 nt, Escherichia coli CFT073
uuucgaaccgauagu

SEQ ID NO: 576218 - RNA, 18 nt, Escherichia coli CFT073
uuuccugggccagcacca

SEQ ID NO: 576219 - RNA, 18 nt, Escherichia coli CFT073
uuuccuguuucacgccca

SEQ ID NO: 576220 - RNA, 18 nt, Escherichia coli CFT073
uugucuuuuucaaaguca

SEQ ID NO: 576221 - RNA, 14 nt, Escherichia coli CFT073
uugugaaguucaug

SEQ ID NO: 576222 - RNA, 15 nt, Escherichia coli CFT073
uugucugccauuagc

SEQ ID NO: 576223 - RNA, 16 nt, Escherichia coli CFT073
uuguccaccguuguga

SEQ ID NO: 576224 - RNA, 18 nt, Escherichia coli CFT073
uugucaccguaaccacca

SEQ ID NO: 576225 - RNA, 13 nt, Escherichia coli CFT073
uugucaucgguca

SEQ ID NO: 576226 - RNA, 21 nt, Escherichia coli CFT073
uuguauuuuuccgcacauacu

SEQ ID NO: 576227 - RNA, 23 nt, Escherichia coli CFT073
uuguguaguuaaaaaaugcagca

SEQ ID NO: 576228 - RNA, 21 nt, Escherichia coli CFT073
uuguggcgguuuuucagcuua

SEQ ID NO: 576229 - RNA, 23 nt, Escherichia coli CFT073
uugggugcaaucaguacguuauc

SEQ ID NO: 576230 - RNA, 19 nt, Escherichia coli CFT073
uugguaaagcaauaaacca

SEQ ID NO: 576231 - RNA, 14 nt, Escherichia coli CFT073
uugguuucgucgug

SEQ ID NO: 576232 - RNA, 14 nt, Escherichia coli CFT073
uugguuauccagca

SEQ ID NO: 576233 - RNA, 16 nt, Escherichia coli CFT073
uugguuauccagcaac

SEQ ID NO: 576234 - RNA, 15 nt, Escherichia coli CFT073
uuggugauguauauc

SEQ ID NO: 576235 - RNA, 15 nt, Escherichia coli CFT073
uugcgcgcguaccug

SEQ ID NO: 576236 - RNA, 21 nt, Escherichia coli CFT073
uugcgccaaucccgucuucgu

SEQ ID NO: 576237 - RNA, 12 nt, Escherichia coli CFT073
uugcgccagcgc

SEQ ID NO: 576238 - RNA, 23 nt, Escherichia coli CFT073
uugcggcguauauugguaggcug

SEQ ID NO: 576239 - RNA, 17 nt, Escherichia coli CFT073
uugcggcaaacgguucg

SEQ ID NO: 576240 - RNA, 14 nt, Escherichia coli CFT073
uugcggcagaacgu

SEQ ID NO: 576241 - RNA, 14 nt, Escherichia coli CFT073
uugcggcagcaaug

SEQ ID NO: 576242 - RNA, 22 nt, Escherichia coli CFT073
uugcgguaacggcagaucggua

SEQ ID NO: 576243 - RNA, 20 nt, Escherichia coli CFT073
uugcggugcagcagcuucgu

SEQ ID NO: 576244 - RNA, 13 nt, Escherichia coli CFT073
uugcgguuuuucu

SEQ ID NO: 576245 - RNA, 20 nt, Escherichia coli CFT073
uugcguacaccaacaucacg

SEQ ID NO: 576246 - RNA, 13 nt, Escherichia coli CFT073
uugcguaucguuc

SEQ ID NO: 576247 - RNA, 23 nt, Escherichia coli CFT073
uugcguaucguucgccagcucca

SEQ ID NO: 576248 - RNA, 22 nt, Escherichia coli CFT073
uugcccgguuucgccgcggcgc

SEQ ID NO: 576249 - RNA, 21 nt, Escherichia coli CFT073
uugccgauauagaccaucggc

SEQ ID NO: 576250 - RNA, 13 nt, Escherichia coli CFT073
uugcgacagccau

SEQ ID NO: 576251 - RNA, 14 nt, Escherichia coli CFT073
uugcgaacucacca

SEQ ID NO: 576252 - RNA, 19 nt, Escherichia coli CFT073
uugccggaugcgacauaga

SEQ ID NO: 576253 - RNA, 22 nt, Escherichia coli CFT073
uugccgcugggccaucaggcga

SEQ ID NO: 576254 - RNA, 14 nt, Escherichia coli CFT073
uugcugacgaucgg

SEQ ID NO: 576255 - RNA, 21 nt, Escherichia coli CFT073
uugcucugcgcccacaucacg

SEQ ID NO: 576256 - RNA, 21 nt, Escherichia coli CFT073
uugcucgaucagacgaucgcg

SEQ ID NO: 576257 - RNA, 22 nt, Escherichia coli CFT073
uugcucggcaaucucuuccagc

SEQ ID NO: 576258 - RNA, 15 nt, Escherichia coli CFT073
uugcuaucaacaaua

SEQ ID NO: 576259 - RNA, 23 nt, Escherichia coli CFT073
uugcuaucggcgauguagcgcug

SEQ ID NO: 576260 - RNA, 16 nt, Escherichia coli CFT073
uugcgugcuggcugaa

SEQ ID NO: 576261 - RNA, 23 nt, Escherichia coli CFT073
uugcguucaucaguuccaguuca

SEQ ID NO: 576262 - RNA, 16 nt, Escherichia coli CFT073
uugcuuccaccaucac

SEQ ID NO: 576263 - RNA, 14 nt, Escherichia coli CFT073
uugcuguuccagca

SEQ ID NO: 576264 - RNA, 14 nt, Escherichia coli CFT073
uugcuuauaaccau

SEQ ID NO: 576265 - RNA, 14 nt, Escherichia coli CFT073
uugcugcacauccg

SEQ ID NO: 576266 - RNA, 16 nt, Escherichia coli CFT073
uugcuggugauugcaa

SEQ ID NO: 576267 - RNA, 15 nt, Escherichia coli CFT073
uuggaccguagacug

SEQ ID NO: 576268 - RNA, 22 nt, Escherichia coli CFT073
uuggcagcacccaaaucugcgu

SEQ ID NO: 576269 - RNA, 23 nt, Escherichia coli CFT073
uuggcauacacgucgucgccaau

SEQ ID NO: 576270 - RNA, 20 nt, Escherichia coli CFT073
uuggcauucccggucaccgg

SEQ ID NO: 576271 - RNA, 19 nt, Escherichia coli CFT073
uugaccgacccuucaucgg

SEQ ID NO: 576272 - RNA, 23 nt, Escherichia coli CFT073
uugacugcccaagugcagccauu

SEQ ID NO: 576273 - RNA, 19 nt, Escherichia coli CFT073
uugacgcguaaauccagca

SEQ ID NO: 576274 - RNA, 19 nt, Escherichia coli CFT073
uugacgcgucuuaucaggc

SEQ ID NO: 576275 - RNA, 15 nt, Escherichia coli CFT073
uugagauuucaccaa

SEQ ID NO: 576276 - RNA, 15 nt, Escherichia coli CFT073
uugaacagcagaaca

SEQ ID NO: 576277 - RNA, 14 nt, Escherichia coli CFT073
uugaacccggcauc

SEQ ID NO: 576278 - RNA, 16 nt, Escherichia coli CFT073
uuccgucagccgcccg

SEQ ID NO: 576279 - RNA, 13 nt, Escherichia coli CFT073
uuccggugcauca

SEQ ID NO: 576280 - RNA, 22 nt, Escherichia coli CFT073
uugaagcuguaucaccggcauu

SEQ ID NO: 576281 - RNA, 15 nt, Escherichia coli CFT073
uugaaggauaagacg

SEQ ID NO: 576282 - RNA, 18 nt, Escherichia coli CFT073
uugaaugguaucggcauc

SEQ ID NO: 576283 - RNA, 17 nt, Escherichia coli CFT073
uugacacaauauugcgg

SEQ ID NO: 576284 - RNA, 17 nt, Escherichia coli CFT073
uugacaucgucaggggc

SEQ ID NO: 576285 - RNA, 18 nt, Escherichia coli CFT073
uugaccgccagcgccauc

SEQ ID NO: 576286 - RNA, 19 nt, Escherichia coli CFT073
uugcauccacaacccguga

SEQ ID NO: 576287 - RNA, 15 nt, Escherichia coli CFT073
uugcagcauucauca

SEQ ID NO: 576288 - RNA, 16 nt, Escherichia coli CFT073
uugcacuauugcguga

SEQ ID NO: 576289 - RNA, 19 nt, Escherichia coli CFT073
uugcacauuccagaugcgc

SEQ ID NO: 576290 - RNA, 14 nt, Escherichia coli CFT073
uugcaccagcaaua

SEQ ID NO: 576291 - RNA, 18 nt, Escherichia coli CFT073
uugcccccagucgccagu

SEQ ID NO: 576292 - RNA, 21 nt, Escherichia coli CFT073
uugcccccagucgccaguaau

SEQ ID NO: 576293 - RNA, 13 nt, Escherichia coli CFT073
uugcccauacccg

SEQ ID NO: 576294 - RNA, 23 nt, Escherichia coli CFT073
uugccauuccacaaaaaccacua

SEQ ID NO: 576295 - RNA, 12 nt, Escherichia coli CFT073
uugccaggugcc

SEQ ID NO: 576296 - RNA, 13 nt, Escherichia coli CFT073
uugccaugaucgu

SEQ ID NO: 576297 - RNA, 13 nt, Escherichia coli CFT073
uugccagcagggu

SEQ ID NO: 576298 - RNA, 22 nt, Escherichia coli CFT073
uugccaccgggagauccagcau

SEQ ID NO: 576299 - RNA, 15 nt, Escherichia coli CFT073
uugauacucaguccg

SEQ ID NO: 576300 - RNA, 19 nt, Escherichia coli CFT073
uugauaaagcguugcggug

SEQ ID NO: 576301 - RNA, 17 nt, Escherichia coli CFT073
uugaucgccccggaagc

SEQ ID NO: 576302 - RNA, 15 nt, Escherichia coli CFT073
uugauccacgggauc

SEQ ID NO: 576303 - RNA, 23 nt, Escherichia coli CFT073
uugcaacaucaaacuguucggua

SEQ ID NO: 576304 - RNA, 16 nt, Escherichia coli CFT073
uugauucugcggguua

SEQ ID NO: 576305 - RNA, 20 nt, Escherichia coli CFT073
uugauuggcgcgaaccauca

SEQ ID NO: 576306 - RNA, 11 nt, Escherichia coli CFT073
uugauggcacu

SEQ ID NO: 576307 - RNA, 18 nt, Escherichia coli CFT073
uugaugguggucgcauca

SEQ ID NO: 576308 - RNA, 13 nt, Escherichia coli CFT073
uugaugcggguaa

SEQ ID NO: 576309 - RNA, 19 nt, Escherichia coli CFT073
uugaugcgucuuaucaggc

SEQ ID NO: 576310 - RNA, 19 nt, Escherichia coli CFT073
uugaugcgaguaaucaggc

SEQ ID NO: 576311 - RNA, 14 nt, Escherichia coli CFT073
uuccgcugauucaa

SEQ ID NO: 576312 - RNA, 15 nt, Escherichia coli CFT073
uuccggcaagcaaau

SEQ ID NO: 576313 - RNA, 16 nt, Escherichia coli CFT073
uuccggcaucgccagc

SEQ ID NO: 576314 - RNA, 13 nt, Escherichia coli CFT073
uuccggcuacgcc

SEQ ID NO: 576315 - RNA, 18 nt, Escherichia coli CFT073
uuccagccaugccacgcu

SEQ ID NO: 576316 - RNA, 14 nt, Escherichia coli CFT073
uuccagcucaaaga

SEQ ID NO: 576317 - RNA, 23 nt, Escherichia coli CFT073
uuccagcguagugaaggcaaacu

SEQ ID NO: 576318 - RNA, 18 nt, Escherichia coli CFT073
uuccccuaacucuuucaa

SEQ ID NO: 576319 - RNA, 21 nt, Escherichia coli CFT073
uucccgauaagggagcaggcc

SEQ ID NO: 576320 - RNA, 13 nt, Escherichia coli CFT073
uucauauccggca

SEQ ID NO: 576321 - RNA, 21 nt, Escherichia coli CFT073
uucauccaguagaauaaugau

SEQ ID NO: 576322 - RNA, 19 nt, Escherichia coli CFT073
uuccacauuuuccaucacg

SEQ ID NO: 576323 - RNA, 16 nt, Escherichia coli CFT073
uuccaccaucacgcca

SEQ ID NO: 576324 - RNA, 22 nt, Escherichia coli CFT073
uuccacgcggguaaguacgcca

SEQ ID NO: 576325 - RNA, 17 nt, Escherichia coli CFT073
uuccacgcuauacagca

SEQ ID NO: 576326 - RNA, 22 nt, Escherichia coli CFT073
uuccacggaauauuucaccggu

SEQ ID NO: 576327 - RNA, 15 nt, Escherichia coli CFT073
uuccagaaacuggug

SEQ ID NO: 576328 - RNA, 13 nt, Escherichia coli CFT073
uuccacuucauca

SEQ ID NO: 576329 - RNA, 21 nt, Escherichia coli CFT073
uuccacuuucacgcccauaac

SEQ ID NO: 576330 - RNA, 17 nt, Escherichia coli CFT073
uuccagcaacucgacgc

SEQ ID NO: 576331 - RNA, 23 nt, Escherichia coli CFT073
uuccagcaccacuuccggcaaca

SEQ ID NO: 576332 - RNA, 21 nt, Escherichia coli CFT073
uuccagcagcuugcgccgccc

SEQ ID NO: 576333 - RNA, 22 nt, Escherichia coli CFT073
uuauuacagccgggagugaauu

SEQ ID NO: 576334 - RNA, 23 nt, Escherichia coli CFT073
uuauguaaagacuucauuaucga

SEQ ID NO: 576335 - RNA, 18 nt, Escherichia coli CFT073
uuaugcugcuucauugcu

SEQ ID NO: 576336 - RNA, 21 nt, Escherichia coli CFT073
uuauggcgcaguugccggaug

SEQ ID NO: 576337 - RNA, 13 nt, Escherichia coli CFT073
uuaugcgaugaaa

SEQ ID NO: 576338 - RNA, 13 nt, Escherichia coli CFT073
uuaugcacacgcg

SEQ ID NO: 576339 - RNA, 19 nt, Escherichia coli CFT073
uuaugcagcagguccauca

SEQ ID NO: 576340 - RNA, 16 nt, Escherichia coli CFT073
uucaaccucuguucag

SEQ ID NO: 576341 - RNA, 17 nt, Escherichia coli CFT073
uucaaccaccggcacca

SEQ ID NO: 576342 - RNA, 14 nt, Escherichia coli CFT073
uucaacguagccug

SEQ ID NO: 576343 - RNA, 13 nt, Escherichia coli CFT073
uucaaccggaucg

SEQ ID NO: 576344 - RNA, 19 nt, Escherichia coli CFT073
uucaacuucccaaagauca

SEQ ID NO: 576345 - RNA, 15 nt, Escherichia coli CFT073
uucacaaccgccauc

SEQ ID NO: 576346 - RNA, 12 nt, Escherichia coli CFT073
uucacugaaaca

SEQ ID NO: 576347 - RNA, 15 nt, Escherichia coli CFT073
uucacugucaucgac

SEQ ID NO: 576348 - RNA, 19 nt, Escherichia coli CFT073
uucagaaagccgcaccugc

SEQ ID NO: 576349 - RNA, 15 nt, Escherichia coli CFT073
uucagaccgccgaua

SEQ ID NO: 576350 - RNA, 23 nt, Escherichia coli CFT073
uucagagugcccacguugcauca

SEQ ID NO: 576351 - RNA, 17 nt, Escherichia coli CFT073
uucagggagguuucgac

SEQ ID NO: 576352 - RNA, 20 nt, Escherichia coli CFT073
uucaguugauuacguacugc

SEQ ID NO: 576353 - RNA, 13 nt, Escherichia coli CFT073
uucagucgaucgg

SEQ ID NO: 576354 - RNA, 17 nt, Escherichia coli CFT073
uucaggucguucaguuu

SEQ ID NO: 576355 - RNA, 18 nt, Escherichia coli CFT073
uucacaucguugauauuu

SEQ ID NO: 576356 - RNA, 20 nt, Escherichia coli CFT073
uucaccacugccuuuaucaa

SEQ ID NO: 576357 - RNA, 16 nt, Escherichia coli CFT073
uucaccaucgcaaaca

SEQ ID NO: 576358 - RNA, 14 nt, Escherichia coli CFT073
uucacccaacucuc

SEQ ID NO: 576359 - RNA, 16 nt, Escherichia coli CFT073
uucacccaucgccaga

SEQ ID NO: 576360 - RNA, 14 nt, Escherichia coli CFT073
uucacggcaccagc

SEQ ID NO: 576361 - RNA, 15 nt, Escherichia coli CFT073
uucacggcgauacca

SEQ ID NO: 576362 - RNA, 17 nt, Escherichia coli CFT073
uucacccgcagcacggc

SEQ ID NO: 576363 - RNA, 15 nt, Escherichia coli CFT073
uucacggucggccag

SEQ ID NO: 576364 - RNA, 17 nt, Escherichia coli CFT073
uucacugccguacaggc

SEQ ID NO: 576365 - RNA, 16 nt, Escherichia coli CFT073
uguuucgggcgguuug

SEQ ID NO: 576366 - RNA, 20 nt, Escherichia coli CFT073
uguuucgcggcaaacugcau

SEQ ID NO: 576367 - RNA, 15 nt, Escherichia coli CFT073
uguuggcagcggcaa

SEQ ID NO: 576368 - RNA, 13 nt, Escherichia coli CFT073
uguugcuggcgag

SEQ ID NO: 576369 - RNA, 21 nt, Escherichia coli CFT073
uuaaugacaauuacaaaauga

SEQ ID NO: 576370 - RNA, 15 nt, Escherichia coli CFT073
uuaaugcccaucagu

SEQ ID NO: 576371 - RNA, 16 nt, Escherichia coli CFT073
uuaaugcccaucaguu

SEQ ID NO: 576372 - RNA, 22 nt, Escherichia coli CFT073
uuaaugcccaucucuucuucaa

SEQ ID NO: 576373 - RNA, 17 nt, Escherichia coli CFT073
uuacacgugagccacgg

SEQ ID NO: 576374 - RNA, 19 nt, Escherichia coli CFT073
uuacacugaaaaaaagugc

SEQ ID NO: 576375 - RNA, 22 nt, Escherichia coli CFT073
uuaaucagauaaucaaccccca

SEQ ID NO: 576376 - RNA, 17 nt, Escherichia coli CFT073
uuaaucccuuaaaaccg

SEQ ID NO: 576377 - RNA, 14 nt, Escherichia coli CFT073
uuaacuccaguagc

SEQ ID NO: 576378 - RNA, 17 nt, Escherichia coli CFT073
uuaacugugccagcguu

SEQ ID NO: 576379 - RNA, 15 nt, Escherichia coli CFT073
uuaagccaucaucaa

SEQ ID NO: 576380 - RNA, 22 nt, Escherichia coli CFT073
uuaagccaaagcgccguagcug

SEQ ID NO: 576381 - RNA, 18 nt, Escherichia coli CFT073
uuaacgaaacccgaacca

SEQ ID NO: 576382 - RNA, 16 nt, Escherichia coli CFT073
uuaacgccucguuugc

SEQ ID NO: 576383 - RNA, 20 nt, Escherichia coli CFT073
uuaacggcguuuccuucguu

SEQ ID NO: 576384 - RNA, 23 nt, Escherichia coli CFT073
uuaacggucauucgacgcgcgca

SEQ ID NO: 576385 - RNA, 13 nt, Escherichia coli CFT073
uuaaccaauaagu

SEQ ID NO: 576386 - RNA, 23 nt, Escherichia coli CFT073
uuaacccguaaaaaucggcaaca

SEQ ID NO: 576387 - RNA, 17 nt, Escherichia coli CFT073
uuaggcuucguccccag

SEQ ID NO: 576388 - RNA, 16 nt, Escherichia coli CFT073
uuaucaguuguauguc

SEQ ID NO: 576389 - RNA, 23 nt, Escherichia coli CFT073
uuaucaaucucugcaagagauaa

SEQ ID NO: 576390 - RNA, 19 nt, Escherichia coli CFT073
uuaucuccauccgggauca

SEQ ID NO: 576391 - RNA, 12 nt, Escherichia coli CFT073
uuagcuaaucaa

SEQ ID NO: 576392 - RNA, 15 nt, Escherichia coli CFT073
uuacccagcagcagc

SEQ ID NO: 576393 - RNA, 11 nt, Escherichia coli CFT073
uuaccgcccau

SEQ ID NO: 576394 - RNA, 22 nt, Escherichia coli CFT073
uuaccgcgccauguugccuggg

SEQ ID NO: 576395 - RNA, 12 nt, Escherichia coli CFT073
uuacugccgcga

SEQ ID NO: 576396 - RNA, 13 nt, Escherichia coli CFT073
uuacuucgcaucc

SEQ ID NO: 576397 - RNA, 16 nt, Escherichia coli CFT073
uuaccaaacuggaacu

SEQ ID NO: 576398 - RNA, 21 nt, Escherichia coli CFT073
uuacauaccagcagcaucacg

SEQ ID NO: 576399 - RNA, 21 nt, Escherichia coli CFT073
uuacauaguucuucaacacca

SEQ ID NO: 576400 - RNA, 18 nt, Escherichia coli CFT073
uuacagccagccgcuaac

SEQ ID NO: 576401 - RNA, 15 nt, Escherichia coli CFT073
uuacagccgggugag

SEQ ID NO: 576402 - RNA, 16 nt, Escherichia coli CFT073
uuaccagagaaaagau

SEQ ID NO: 576403 - RNA, 14 nt, Escherichia coli CFT073
uuaccagcaucacc

SEQ ID NO: 576404 - RNA, 17 nt, Escherichia coli CFT073
uuaccagcgccgccacu

SEQ ID NO: 576405 - RNA, 21 nt, Escherichia coli CFT073
uuaccaucaaccacuacguga

SEQ ID NO: 576406 - RNA, 13 nt, Escherichia coli CFT073
uuacccaacucuu

SEQ ID NO: 576407 - RNA, 18 nt, Escherichia coli CFT073
uuacccggugccgccguc

SEQ ID NO: 576408 - RNA, 14 nt, Escherichia coli CFT073
uuacccuggcgcga

SEQ ID NO: 576409 - RNA, 14 nt, Escherichia coli CFT073
uguaaugacaacau

SEQ ID NO: 576410 - RNA, 18 nt, Escherichia coli CFT073
uguaauuaaauuaucaac

SEQ ID NO: 576411 - RNA, 14 nt, Escherichia coli CFT073
uguacaacacagua

SEQ ID NO: 576412 - RNA, 22 nt, Escherichia coli CFT073
uguaaucgccuuuuuucaccgg

SEQ ID NO: 576413 - RNA, 17 nt, Escherichia coli CFT073
uguaaucaacaaaagug

SEQ ID NO: 576414 - RNA, 20 nt, Escherichia coli CFT073
uguaccugguugauucaugg

SEQ ID NO: 576415 - RNA, 21 nt, Escherichia coli CFT073
uguaccaccagaaucgccagc

SEQ ID NO: 576416 - RNA, 21 nt, Escherichia coli CFT073
ugguggucugguaacgaucgu

SEQ ID NO: 576417 - RNA, 16 nt, Escherichia coli CFT073
ugguguaaccuucacc

SEQ ID NO: 576418 - RNA, 17 nt, Escherichia coli CFT073
ugguuugcauccacaac

SEQ ID NO: 576419 - RNA, 16 nt, Escherichia coli CFT073
ugguaaacacaacgac

SEQ ID NO: 576420 - RNA, 13 nt, Escherichia coli CFT073
uggguugccagcg

SEQ ID NO: 576421 - RNA, 13 nt, Escherichia coli CFT073
uggguuguugcac

SEQ ID NO: 576422 - RNA, 12 nt, Escherichia coli CFT073
ugguaacaccag

SEQ ID NO: 576423 - RNA, 21 nt, Escherichia coli CFT073
ugguaagcaaagcaaaggcga

SEQ ID NO: 576424 - RNA, 15 nt, Escherichia coli CFT073
ugguaauggcgaucg

SEQ ID NO: 576425 - RNA, 20 nt, Escherichia coli CFT073
ugguacgaucagaguuggua

SEQ ID NO: 576426 - RNA, 15 nt, Escherichia coli CFT073
uggugguaacgcuca

SEQ ID NO: 576427 - RNA, 18 nt, Escherichia coli CFT073
uguagauauccacaacaa

SEQ ID NO: 576428 - RNA, 14 nt, Escherichia coli CFT073
uguagacagcaucg

SEQ ID NO: 576429 - RNA, 15 nt, Escherichia coli CFT073
uguagcccaucaggu

SEQ ID NO: 576430 - RNA, 20 nt, Escherichia coli CFT073
uguagauugcacaugcuaaa

SEQ ID NO: 576431 - RNA, 16 nt, Escherichia coli CFT073
ugucacuggccagcgg

SEQ ID NO: 576432 - RNA, 14 nt, Escherichia coli CFT073
ugucagaugcggca

SEQ ID NO: 576433 - RNA, 15 nt, Escherichia coli CFT073
ugucagaugcggcgu

SEQ ID NO: 576434 - RNA, 21 nt, Escherichia coli CFT073
ugucagcaucgcauccggcac

SEQ ID NO: 576435 - RNA, 20 nt, Escherichia coli CFT073
uguaggccgaauaaggcggu

SEQ ID NO: 576436 - RNA, 20 nt, Escherichia coli CFT073
uguaggccggacaaggcgcu

SEQ ID NO: 576437 - RNA, 20 nt, Escherichia coli CFT073
uguaggccagauaagacgcg

SEQ ID NO: 576438 - RNA, 19 nt, Escherichia coli CFT073
uguaggccggauaaggcgu

SEQ ID NO: 576439 - RNA, 20 nt, Escherichia coli CFT073
uguaggccggaugaggcguu

SEQ ID NO: 576440 - RNA, 16 nt, Escherichia coli CFT073
ugucauacgagucgcc

SEQ ID NO: 576441 - RNA, 17 nt, Escherichia coli CFT073
ugucaucagucagagcc

SEQ ID NO: 576442 - RNA, 18 nt, Escherichia coli CFT073
uguccagaugcuguacca

SEQ ID NO: 576443 - RNA, 12 nt, Escherichia coli CFT073
uguccacgccgc

SEQ ID NO: 576444 - RNA, 18 nt, Escherichia coli CFT073
uguccggcaccauuggaa

SEQ ID NO: 576445 - RNA, 17 nt, Escherichia coli CFT073
ugucgcugcacuuucuc

SEQ ID NO: 576446 - RNA, 23 nt, Escherichia coli CFT073
ugucgcgaugaugcgacgcgauc

SEQ ID NO: 576447 - RNA, 12 nt, Escherichia coli CFT073
ugugauuacagc

SEQ ID NO: 576448 - RNA, 13 nt, Escherichia coli CFT073
ugugacguugucc

SEQ ID NO: 576449 - RNA, 18 nt, Escherichia coli CFT073
ugugacagcagcggcaga

SEQ ID NO: 576450 - RNA, 16 nt, Escherichia coli CFT073
ugucgcuggucgaugg

SEQ ID NO: 576451 - RNA, 15 nt, Escherichia coli CFT073
ugucgcuucacgcag

SEQ ID NO: 576452 - RNA, 20 nt, Escherichia coli CFT073
uguggcguaaacgccuuauc

SEQ ID NO: 576453 - RNA, 23 nt, Escherichia coli CFT073
uguggcggaauaccgacaucacg

SEQ ID NO: 576454 - RNA, 21 nt, Escherichia coli CFT073
uguggcguguuguaaaacgcg

SEQ ID NO: 576455 - RNA, 18 nt, Escherichia coli CFT073
ugugaucgaauauaucag

SEQ ID NO: 576456 - RNA, 22 nt, Escherichia coli CFT073
ugugcaauguggugaaaugccu

SEQ ID NO: 576457 - RNA, 22 nt, Escherichia coli CFT073
uguggugaaaugccucgcugau

SEQ ID NO: 576458 - RNA, 20 nt, Escherichia coli CFT073
ugugggccggauaaggcguu

SEQ ID NO: 576459 - RNA, 21 nt, Escherichia coli CFT073
ugugguauaugcguugcgguc

SEQ ID NO: 576460 - RNA, 14 nt, Escherichia coli CFT073
ugugguaucaaaaa

SEQ ID NO: 576461 - RNA, 12 nt, Escherichia coli CFT073
ugugucgccagc

SEQ ID NO: 576462 - RNA, 16 nt, Escherichia coli CFT073
ugugugcuggccauca

SEQ ID NO: 576463 - RNA, 13 nt, Escherichia coli CFT073
uguugauaaaaca

SEQ ID NO: 576464 - RNA, 17 nt, Escherichia coli CFT073
uguugcaguacucgcac

SEQ ID NO: 576465 - RNA, 13 nt, Escherichia coli CFT073
uguugauugcguu

SEQ ID NO: 576466 - RNA, 17 nt, Escherichia coli CFT073
uguugauuuaacagcaa

SEQ ID NO: 576467 - RNA, 14 nt, Escherichia coli CFT073
uguugccuguuuca

SEQ ID NO: 576468 - RNA, 14 nt, Escherichia coli CFT073
uguucuuacccacu

SEQ ID NO: 576469 - RNA, 11 nt, Escherichia coli CFT073
uguucgccaga

SEQ ID NO: 576470 - RNA, 19 nt, Escherichia coli CFT073
uguucaaccaccggcacca

SEQ ID NO: 576471 - RNA, 14 nt, Escherichia coli CFT073
uguucacucaucag

SEQ ID NO: 576472 - RNA, 15 nt, Escherichia coli CFT073
uguucagagugccca

SEQ ID NO: 576473 - RNA, 12 nt, Escherichia coli CFT073
uguuccaguacg

SEQ ID NO: 576474 - RNA, 15 nt, Escherichia coli CFT073
uguuccagcaucaca

SEQ ID NO: 576475 - RNA, 17 nt, Escherichia coli CFT073
uguuccgucagccgccc

SEQ ID NO: 576476 - RNA, 16 nt, Escherichia coli CFT073
uguucauaugcuuguu

SEQ ID NO: 576477 - RNA, 21 nt, Escherichia coli CFT073
uguuaaagcccugcucgcgca

SEQ ID NO: 576478 - RNA, 19 nt, Escherichia coli CFT073
uguuaaauugccugugaag

SEQ ID NO: 576479 - RNA, 13 nt, Escherichia coli CFT073
uguuaugcacacg

SEQ ID NO: 576480 - RNA, 16 nt, Escherichia coli CFT073
uggcugaugcuggcac

SEQ ID NO: 576481 - RNA, 14 nt, Escherichia coli CFT073
uggcugauuaacgu

SEQ ID NO: 576482 - RNA, 16 nt, Escherichia coli CFT073
uggcugcauccagaaa

SEQ ID NO: 576483 - RNA, 19 nt, Escherichia coli CFT073
ugggaauuugcuccgccac

SEQ ID NO: 576484 - RNA, 15 nt, Escherichia coli CFT073
uggcuuuugccgccc

SEQ ID NO: 576485 - RNA, 21 nt, Escherichia coli CFT073
uggcuggcccuuuuuuugucu

SEQ ID NO: 576486 - RNA, 17 nt, Escherichia coli CFT073
uggcgucacaggccuca

SEQ ID NO: 576487 - RNA, 14 nt, Escherichia coli CFT073
uggcgucacgccga

SEQ ID NO: 576488 - RNA, 13 nt, Escherichia coli CFT073
uggcgucgcaucu

SEQ ID NO: 576489 - RNA, 23 nt, Escherichia coli CFT073
uggccgcaagaguauuacgaucg

SEQ ID NO: 576490 - RNA, 20 nt, Escherichia coli CFT073
uggccuuccggcacaucgcc

SEQ ID NO: 576491 - RNA, 21 nt, Escherichia coli CFT073
uggcgcaucuuaucaggccua

SEQ ID NO: 576492 - RNA, 19 nt, Escherichia coli CFT073
uggcgcagcgcagcgccaa

SEQ ID NO: 576493 - RNA, 23 nt, Escherichia coli CFT073
uggcgaaauguguuggcaccauc

SEQ ID NO: 576494 - RNA, 15 nt, Escherichia coli CFT073
uggcggauuacgcuc

SEQ ID NO: 576495 - RNA, 18 nt, Escherichia coli CFT073
uggcgcaggggcagaaac

SEQ ID NO: 576496 - RNA, 18 nt, Escherichia coli CFT073
uggacauguuccggcgac

SEQ ID NO: 576497 - RNA, 18 nt, Escherichia coli CFT073
uggacaccauugccggau

SEQ ID NO: 576498 - RNA, 21 nt, Escherichia coli CFT073
uggacgcagaccgaagucaaa

SEQ ID NO: 576499 - RNA, 19 nt, Escherichia coli CFT073
uggaacgauauuaucgaaa

SEQ ID NO: 576500 - RNA, 19 nt, Escherichia coli CFT073
uggaauggaaacagcacca

SEQ ID NO: 576501 - RNA, 16 nt, Escherichia coli CFT073
uggaauggucaauggu

SEQ ID NO: 576502 - RNA, 15 nt, Escherichia coli CFT073
uggaaucaccgccac

SEQ ID NO: 576503 - RNA, 15 nt, Escherichia coli CFT073
ugcggguaaccagcc

SEQ ID NO: 576504 - RNA, 13 nt, Escherichia coli CFT073
uggaacaucagga

SEQ ID NO: 576505 - RNA, 20 nt, Escherichia coli CFT073
uggaucgcggcuauucacca

SEQ ID NO: 576506 - RNA, 20 nt, Escherichia coli CFT073
uggauccccgcagcaaacag

SEQ ID NO: 576507 - RNA, 18 nt, Escherichia coli CFT073
uggaugaucccuucgcug

SEQ ID NO: 576508 - RNA, 12 nt, Escherichia coli CFT073
uggcaacgcaaa

SEQ ID NO: 576509 - RNA, 19 nt, Escherichia coli CFT073
uggcaaaugcauagcguuc

SEQ ID NO: 576510 - RNA, 21 nt, Escherichia coli CFT073
uggcaaaucaaaucacgaugg

SEQ ID NO: 576511 - RNA, 15 nt, Escherichia coli CFT073
uggcaacacuuuauc

SEQ ID NO: 576512 - RNA, 14 nt, Escherichia coli CFT073
uggcaacagcagcc

SEQ ID NO: 576513 - RNA, 14 nt, Escherichia coli CFT073
uggauguuggcggc

SEQ ID NO: 576514 - RNA, 17 nt, Escherichia coli CFT073
uggauguuucaugaagc

SEQ ID NO: 576515 - RNA, 22 nt, Escherichia coli CFT073
uggauaagaaagauacaaaaca

SEQ ID NO: 576516 - RNA, 22 nt, Escherichia coli CFT073
uggaguaguugaucgccccgga

SEQ ID NO: 576517 - RNA, 14 nt, Escherichia coli CFT073
uggauaucaaugua

SEQ ID NO: 576518 - RNA, 20 nt, Escherichia coli CFT073
uggauauugccggaugugau

SEQ ID NO: 576519 - RNA, 22 nt, Escherichia coli CFT073
uggauaaugggaauuggcguca

SEQ ID NO: 576520 - RNA, 19 nt, Escherichia coli CFT073
uggagcgugauaugcccac

SEQ ID NO: 576521 - RNA, 19 nt, Escherichia coli CFT073
uggagagaaccagcgcaca

SEQ ID NO: 576522 - RNA, 15 nt, Escherichia coli CFT073
uggcaaugcccggug

SEQ ID NO: 576523 - RNA, 21 nt, Escherichia coli CFT073
uggcaagaaacgcuccaccac

SEQ ID NO: 576524 - RNA, 15 nt, Escherichia coli CFT073
uggcaccaucagcuc

SEQ ID NO: 576525 - RNA, 24 nt, Escherichia coli CFT073
uggcaccccugcauaauuacgcca

SEQ ID NO: 576526 - RNA, 17 nt, Escherichia coli CFT073
uggcagccauuuguugg

SEQ ID NO: 576527 - RNA, 18 nt, Escherichia coli CFT073
uggcagcgugcguugacc

SEQ ID NO: 576528 - RNA, 22 nt, Escherichia coli CFT073
uggcagauugucgguuaauacg

SEQ ID NO: 576529 - RNA, 18 nt, Escherichia coli CFT073
uggcagcaagugcggcgc

SEQ ID NO: 576530 - RNA, 15 nt, Escherichia coli CFT073
uggcagauaaccacu

SEQ ID NO: 576531 - RNA, 17 nt, Escherichia coli CFT073
uggcagaugaucaacga

SEQ ID NO: 576532 - RNA, 21 nt, Escherichia coli CFT073
uggcacgcuucaucugccauu

SEQ ID NO: 576533 - RNA, 18 nt, Escherichia coli CFT073
uggcagucacuuccugau

SEQ ID NO: 576534 - RNA, 17 nt, Escherichia coli CFT073
uggcagugguaucaaua

SEQ ID NO: 576535 - RNA, 16 nt, Escherichia coli CFT073
uggcagugugccugau

SEQ ID NO: 576536 - RNA, 17 nt, Escherichia coli CFT073
uggcaguuacugcccgc

SEQ ID NO: 576537 - RNA, 17 nt, Escherichia coli CFT073
uggcagguaauccgcau

SEQ ID NO: 576538 - RNA, 19 nt, Escherichia coli CFT073
uggcaucggcgcacaaccg

SEQ ID NO: 576539 - RNA, 14 nt, Escherichia coli CFT073
uggcaucguccguc

SEQ ID NO: 576540 - RNA, 15 nt, Escherichia coli CFT073
uggcaucuucugccg

SEQ ID NO: 576541 - RNA, 16 nt, Escherichia coli CFT073
uggcauaacguugcag

SEQ ID NO: 576542 - RNA, 22 nt, Escherichia coli CFT073
uggcauaacguugcagcguuuc

SEQ ID NO: 576543 - RNA, 15 nt, Escherichia coli CFT073
uggcauauuccgcca

SEQ ID NO: 576544 - RNA, 16 nt, Escherichia coli CFT073
uggcauauuccgccac

SEQ ID NO: 576545 - RNA, 17 nt, Escherichia coli CFT073
uggcaucgcuucacgcg

SEQ ID NO: 576546 - RNA, 12 nt, Escherichia coli CFT073
uggccacagcaa

SEQ ID NO: 576547 - RNA, 18 nt, Escherichia coli CFT073
uggcauuugcaacaccgu

SEQ ID NO: 576548 - RNA, 22 nt, Escherichia coli CFT073
uggccaaauucagugugccacu

SEQ ID NO: 576549 - RNA, 17 nt, Escherichia coli CFT073
uggccccaggcauagaa

SEQ ID NO: 576550 - RNA, 20 nt, Escherichia coli CFT073
uggccccagguaucguugau

SEQ ID NO: 576551 - RNA, 12 nt, Escherichia coli CFT073
uggcccaucauc

SEQ ID NO: 576552 - RNA, 18 nt, Escherichia coli CFT073
uggccauaccaugacgau

SEQ ID NO: 576553 - RNA, 21 nt, Escherichia coli CFT073
ugccgcuacugcuugccaccg

SEQ ID NO: 576554 - RNA, 23 nt, Escherichia coli CFT073
ugccgcuaguucucgggcggcag

SEQ ID NO: 576555 - RNA, 14 nt, Escherichia coli CFT073
ugccgcguucgcca

SEQ ID NO: 576556 - RNA, 19 nt, Escherichia coli CFT073
ugccgcguucgccagcguc

SEQ ID NO: 576557 - RNA, 18 nt, Escherichia coli CFT073
ugccgcucguuugcagau

SEQ ID NO: 576558 - RNA, 14 nt, Escherichia coli CFT073
ugccggaacgccgc

SEQ ID NO: 576559 - RNA, 12 nt, Escherichia coli CFT073
ugccgcuggcau

SEQ ID NO: 576560 - RNA, 19 nt, Escherichia coli CFT073
ugccgcuuuaugugcuucu

SEQ ID NO: 576561 - RNA, 21 nt, Escherichia coli CFT073
ugccggauaaauuaaacgccu

SEQ ID NO: 576562 - RNA, 16 nt, Escherichia coli CFT073
ugccggaugcgacgca

SEQ ID NO: 576563 - RNA, 23 nt, Escherichia coli CFT073
ugccggaugcggcgaaaacgccu

SEQ ID NO: 576564 - RNA, 15 nt, Escherichia coli CFT073
ugccggaugcggcgc

SEQ ID NO: 576565 - RNA, 15 nt, Escherichia coli CFT073
ugccggaugcggcgu

SEQ ID NO: 576566 - RNA, 13 nt, Escherichia coli CFT073
ugccgacgguuug

SEQ ID NO: 576567 - RNA, 13 nt, Escherichia coli CFT073
ugccgauaucgau

SEQ ID NO: 576568 - RNA, 16 nt, Escherichia coli CFT073
ugccgccgacaguuau

SEQ ID NO: 576569 - RNA, 20 nt, Escherichia coli CFT073
ugcaguaugaaacgccugau

SEQ ID NO: 576570 - RNA, 15 nt, Escherichia coli CFT073
ugcagguuaggcuga

SEQ ID NO: 576571 - RNA, 19 nt, Escherichia coli CFT073
ugcauaaaaacgaucgccg

SEQ ID NO: 576572 - RNA, 19 nt, Escherichia coli CFT073
ugcaccggcgauaucccag

SEQ ID NO: 576573 - RNA, 17 nt, Escherichia coli CFT073
ugcaccugauccagcuc

SEQ ID NO: 576574 - RNA, 21 nt, Escherichia coli CFT073
ugcacgcgauggcuuuccacc

SEQ ID NO: 576575 - RNA, 14 nt, Escherichia coli CFT073
ugcacgaugccuca

SEQ ID NO: 576576 - RNA, 19 nt, Escherichia coli CFT073
ugcauaucgguaaaugcuu

SEQ ID NO: 576577 - RNA, 14 nt, Escherichia coli CFT073
ugcaucucuuugcu

SEQ ID NO: 576578 - RNA, 17 nt, Escherichia coli CFT073
ugcauccggcacgccgu

SEQ ID NO: 576579 - RNA, 23 nt, Escherichia coli CFT073
ugcaucggggaauugugcuuuca

SEQ ID NO: 576580 - RNA, 23 nt, Escherichia coli CFT073
ugcaucgagcgcagcaacaucac

SEQ ID NO: 576581 - RNA, 13 nt, Escherichia coli CFT073
ugcauccguucuu

SEQ ID NO: 576582 - RNA, 20 nt, Escherichia coli CFT073
ugccagauucuccagcaucg

SEQ ID NO: 576583 - RNA, 22 nt, Escherichia coli CFT073
ugccagcaaaaaauagaacuga

SEQ ID NO: 576584 - RNA, 18 nt, Escherichia coli CFT073
ugccacaguaaaaccggu

SEQ ID NO: 576585 - RNA, 19 nt, Escherichia coli CFT073
ugccagcaacuguaacgca

SEQ ID NO: 576586 - RNA, 21 nt, Escherichia coli CFT073
ugccagcaacuguaacgcaga

SEQ ID NO: 576587 - RNA, 15 nt, Escherichia coli CFT073
ugccagcagcaacca

SEQ ID NO: 576588 - RNA, 16 nt, Escherichia coli CFT073
ugccagcguaccauga

SEQ ID NO: 576589 - RNA, 20 nt, Escherichia coli CFT073
ugccagccacacugcggcca

SEQ ID NO: 576590 - RNA, 18 nt, Escherichia coli CFT073
ugccagccacaggccggu

SEQ ID NO: 576591 - RNA, 12 nt, Escherichia coli CFT073
ugccagccccuc

SEQ ID NO: 576592 - RNA, 23 nt, Escherichia coli CFT073
ugcccacgcaaaccaccuggcag

SEQ ID NO: 576593 - RNA, 23 nt, Escherichia coli CFT073
ugcccacaaucuuaggggacauu

SEQ ID NO: 576594 - RNA, 13 nt, Escherichia coli CFT073
ugccauuuucacg

SEQ ID NO: 576595 - RNA, 14 nt, Escherichia coli CFT073
ugccccucacgcuu

SEQ ID NO: 576596 - RNA, 19 nt, Escherichia coli CFT073
ugccccagcguuagcaucg

SEQ ID NO: 576597 - RNA, 13 nt, Escherichia coli CFT073
ugcccaugccaau

SEQ ID NO: 576598 - RNA, 14 nt, Escherichia coli CFT073
ugcccaggcaaaaa

SEQ ID NO: 576599 - RNA, 21 nt, Escherichia coli CFT073
ugcgcguuauuuguugccgga

SEQ ID NO: 576600 - RNA, 15 nt, Escherichia coli CFT073
ugcgcuaccagaaag

SEQ ID NO: 576601 - RNA, 22 nt, Escherichia coli CFT073
ugcgcucgcauccugccaggac

SEQ ID NO: 576602 - RNA, 20 nt, Escherichia coli CFT073
ugcggauccugagcaaacag

SEQ ID NO: 576603 - RNA, 17 nt, Escherichia coli CFT073
ugcggaucauaugcaca

SEQ ID NO: 576604 - RNA, 20 nt, Escherichia coli CFT073
ugcggcauaaacgccuuauc

SEQ ID NO: 576605 - RNA, 17 nt, Escherichia coli CFT073
ugcggcagcuccagcag

SEQ ID NO: 576606 - RNA, 16 nt, Escherichia coli CFT073
ugcggcaucauacacg

SEQ ID NO: 576607 - RNA, 16 nt, Escherichia coli CFT073
ugcggcauuucgccga

SEQ ID NO: 576608 - RNA, 20 nt, Escherichia coli CFT073
ugcggcguaaacgccuuauc

SEQ ID NO: 576609 - RNA, 11 nt, Escherichia coli CFT073
ugcggcguaau

SEQ ID NO: 576610 - RNA, 22 nt, Escherichia coli CFT073
ugcggcguaaugccugugcgau

SEQ ID NO: 576611 - RNA, 18 nt, Escherichia coli CFT073
ugcggcugauaaucuucu

SEQ ID NO: 576612 - RNA, 17 nt, Escherichia coli CFT073
ugcggcguucgguuuug

SEQ ID NO: 576613 - RNA, 16 nt, Escherichia coli CFT073
ugcggcgugaacgccu

SEQ ID NO: 576614 - RNA, 20 nt, Escherichia coli CFT073
ugcggcgugaccgccuuauc

SEQ ID NO: 576615 - RNA, 21 nt, Escherichia coli CFT073
ugcggcguucaucgcaaagga

SEQ ID NO: 576616 - RNA, 15 nt, Escherichia coli CFT073
ugcgccgcccgccgg

SEQ ID NO: 576617 - RNA, 22 nt, Escherichia coli CFT073
ugcgccgccgacaucugccagu

SEQ ID NO: 576618 - RNA, 15 nt, Escherichia coli CFT073
ugcgccgccgcccau

SEQ ID NO: 576619 - RNA, 17 nt, Escherichia coli CFT073
ugcgccgauugccugau

SEQ ID NO: 576620 - RNA, 12 nt, Escherichia coli CFT073
ugcgcggcagcu

SEQ ID NO: 576621 - RNA, 23 nt, Escherichia coli CFT073
ugcgcggauggccucugccagcu

SEQ ID NO: 576622 - RNA, 14 nt, Escherichia coli CFT073
ugcgcgguuuugga

SEQ ID NO: 576623 - RNA, 22 nt, Escherichia coli CFT073
ugcgcgcgaaaacaucguugau

SEQ ID NO: 576624 - RNA, 21 nt, Escherichia coli CFT073
ugcgcgaagaaacgaccucca

SEQ ID NO: 576625 - RNA, 14 nt, Escherichia coli CFT073
ugcgccuuccccgu

SEQ ID NO: 576626 - RNA, 19 nt, Escherichia coli CFT073
ugccggugaugagcagguu

SEQ ID NO: 576627 - RNA, 22 nt, Escherichia coli CFT073
ugccggugauggccgcgccgac

SEQ ID NO: 576628 - RNA, 21 nt, Escherichia coli CFT073
ugccugcgugcauaucgcugu

SEQ ID NO: 576629 - RNA, 18 nt, Escherichia coli CFT073
ugccugaugcgcuucgcu

SEQ ID NO: 576630 - RNA, 20 nt, Escherichia coli CFT073
ugccugauucagcaacucgu

SEQ ID NO: 576631 - RNA, 23 nt, Escherichia coli CFT073
ugccugacgaaugguuucacgcu

SEQ ID NO: 576632 - RNA, 17 nt, Escherichia coli CFT073
ugccugaugcgacgcug

SEQ ID NO: 576633 - RNA, 15 nt, Escherichia coli CFT073
ugccucgcugauacg

SEQ ID NO: 576634 - RNA, 14 nt, Escherichia coli CFT073
ugccguaaucgccu

SEQ ID NO: 576635 - RNA, 16 nt, Escherichia coli CFT073
ugccgguuucacguug

SEQ ID NO: 576636 - RNA, 23 nt, Escherichia coli CFT073
ugccguaaccagcgcagacacca

SEQ ID NO: 576637 - RNA, 16 nt, Escherichia coli CFT073
ugccguaagcaacgcc

SEQ ID NO: 576638 - RNA, 14 nt, Escherichia coli CFT073
ugcgauugccggau

SEQ ID NO: 576639 - RNA, 12 nt, Escherichia coli CFT073
ugcgaugaucgc

SEQ ID NO: 576640 - RNA, 17 nt, Escherichia coli CFT073
ugcgaugcugacgcauc

SEQ ID NO: 576641 - RNA, 17 nt, Escherichia coli CFT073
ugcgauguucccccagc

SEQ ID NO: 576642 - RNA, 15 nt, Escherichia coli CFT073
ugcgaucgcccgcaa

SEQ ID NO: 576643 - RNA, 12 nt, Escherichia coli CFT073
ugcgccagcgag

SEQ ID NO: 576644 - RNA, 13 nt, Escherichia coli CFT073
ugcgcaugacaca

SEQ ID NO: 576645 - RNA, 16 nt, Escherichia coli CFT073
ugcgcaguugccggau

SEQ ID NO: 576646 - RNA, 15 nt, Escherichia coli CFT073
ugcgacgcuugccgc

SEQ ID NO: 576647 - RNA, 18 nt, Escherichia coli CFT073
ugcgacggacgcccgccg

SEQ ID NO: 576648 - RNA, 16 nt, Escherichia coli CFT073
ugcgacgcauccggca

SEQ ID NO: 576649 - RNA, 23 nt, Escherichia coli CFT073
ugcgacgcugguugcgucuuauc

SEQ ID NO: 576650 - RNA, 22 nt, Escherichia coli CFT073
ugcgacgcugucgcgucuuauc

SEQ ID NO: 576651 - RNA, 15 nt, Escherichia coli CFT073
ugcgaccagugaaaa

SEQ ID NO: 576652 - RNA, 18 nt, Escherichia coli CFT073
ugcgaccagugaaaaugg

SEQ ID NO: 576653 - RNA, 14 nt, Escherichia coli CFT073
ugcgacagccaucc

SEQ ID NO: 576654 - RNA, 22 nt, Escherichia coli CFT073
ugcgacagccauccccacgguc

SEQ ID NO: 576655 - RNA, 20 nt, Escherichia coli CFT073
ugcgacaaacauugcugcca

SEQ ID NO: 576656 - RNA, 16 nt, Escherichia coli CFT073
ugccuguccucuucag

SEQ ID NO: 576657 - RNA, 16 nt, Escherichia coli CFT073
ugccuggcgaauugcc

SEQ ID NO: 576658 - RNA, 19 nt, Escherichia coli CFT073
ugacgaucauuccgcccag

SEQ ID NO: 576659 - RNA, 20 nt, Escherichia coli CFT073
ugacgaucauuccgcccaga

SEQ ID NO: 576660 - RNA, 18 nt, Escherichia coli CFT073
ugacgaucggcaucgggc

SEQ ID NO: 576661 - RNA, 22 nt, Escherichia coli CFT073
ugacgcagaucccacucaucaa

SEQ ID NO: 576662 - RNA, 17 nt, Escherichia coli CFT073
ugacgcauacagccaga

SEQ ID NO: 576663 - RNA, 19 nt, Escherichia coli CFT073
ugacgcaucuuauccagcc

SEQ ID NO: 576664 - RNA, 15 nt, Escherichia coli CFT073
ugacgcccaguuucg

SEQ ID NO: 576665 - RNA, 22 nt, Escherichia coli CFT073
ugacgccgcuggugucgcaccu

SEQ ID NO: 576666 - RNA, 16 nt, Escherichia coli CFT073
ugacgccugccagcuc

SEQ ID NO: 576667 - RNA, 20 nt, Escherichia coli CFT073
ugacgcgucuuaucaggccu

SEQ ID NO: 576668 - RNA, 17 nt, Escherichia coli CFT073
ugacgcugucuuaucag

SEQ ID NO: 576669 - RNA, 14 nt, Escherichia coli CFT073
ugacgcugcaaggc

SEQ ID NO: 576670 - RNA, 17 nt, Escherichia coli CFT073
ugacgcuauuacgauga

SEQ ID NO: 576671 - RNA, 20 nt, Escherichia coli CFT073
ugacgcgucuuauccggccu

SEQ ID NO: 576672 - RNA, 21 nt, Escherichia coli CFT073
ugacggucgaugcgcaacgca

SEQ ID NO: 576673 - RNA, 23 nt, Escherichia coli CFT073
ugacggucgaugcgcaacgcaau

SEQ ID NO: 576674 - RNA, 19 nt, Escherichia coli CFT073
ugacgguuuccacuuccac

SEQ ID NO: 576675 - RNA, 15 nt, Escherichia coli CFT073
ugacugaaucaggaa

SEQ ID NO: 576676 - RNA, 23 nt, Escherichia coli CFT073
ugacucgguaaaaucaacgccgc

SEQ ID NO: 576677 - RNA, 20 nt, Escherichia coli CFT073
ugacugguaacguggcagca

SEQ ID NO: 576678 - RNA, 21 nt, Escherichia coli CFT073
ugacuccgauauuugccgcga

SEQ ID NO: 576679 - RNA, 23 nt, Escherichia coli CFT073
ugagcauaucaccucuguucagg

SEQ ID NO: 576680 - RNA, 12 nt, Escherichia coli CFT073
ugacuucgccga

SEQ ID NO: 576681 - RNA, 14 nt, Escherichia coli CFT073
ugagcaggaugaca

SEQ ID NO: 576682 - RNA, 15 nt, Escherichia coli CFT073
ugaggcgcugaaugu

SEQ ID NO: 576683 - RNA, 15 nt, Escherichia coli CFT073
ugaggcuaauaaaca

SEQ ID NO: 576684 - RNA, 20 nt, Escherichia coli CFT073
ugagcuucuucaaaaaaguc

SEQ ID NO: 576685 - RNA, 18 nt, Escherichia coli CFT073
ugagcugaauuucaucac

SEQ ID NO: 576686 - RNA, 13 nt, Escherichia coli CFT073
ugagcgugcgcgc

SEQ ID NO: 576687 - RNA, 22 nt, Escherichia coli CFT073
ugagcguuucaaaaacaaagaa

SEQ ID NO: 576688 - RNA, 17 nt, Escherichia coli CFT073
ugagcggagcacaucag

SEQ ID NO: 576689 - RNA, 21 nt, Escherichia coli CFT073
ugagcgccgauuucucaucaa

SEQ ID NO: 576690 - RNA, 22 nt, Escherichia coli CFT073
ugagcgcgagguggaacaucag

SEQ ID NO: 576691 - RNA, 17 nt, Escherichia coli CFT073
ugauuuuugcugaacgc

SEQ ID NO: 576692 - RNA, 18 nt, Escherichia coli CFT073
ugauuuuuguaggucgga

SEQ ID NO: 576693 - RNA, 17 nt, Escherichia coli CFT073
ugauuuuuuugauaaac

SEQ ID NO: 576694 - RNA, 15 nt, Escherichia coli CFT073
ugcaaacaacgcuuc

SEQ ID NO: 576695 - RNA, 17 nt, Escherichia coli CFT073
ugcaaacaguaacccag

SEQ ID NO: 576696 - RNA, 19 nt, Escherichia coli CFT073
ugcaaagcugauaaucauc

SEQ ID NO: 576697 - RNA, 17 nt, Escherichia coli CFT073
ugauuuuguaggucgga

SEQ ID NO: 576698 - RNA, 19 nt, Escherichia coli CFT073
ugauucacauccugccagu

SEQ ID NO: 576699 - RNA, 22 nt, Escherichia coli CFT073
ugauucacgcugacaacuccug

SEQ ID NO: 576700 - RNA, 20 nt, Escherichia coli CFT073
ugauuaaauucaggccgucg

SEQ ID NO: 576701 - RNA, 15 nt, Escherichia coli CFT073
ugauuacaggaugcg

SEQ ID NO: 576702 - RNA, 17 nt, Escherichia coli CFT073
ugauuaccagcaucacc

SEQ ID NO: 576703 - RNA, 20 nt, Escherichia coli CFT073
ugauuaccuaccaacgcacc

SEQ ID NO: 576704 - RNA, 20 nt, Escherichia coli CFT073
ugaugcguugccguaugacc

SEQ ID NO: 576705 - RNA, 15 nt, Escherichia coli CFT073
ugaugcuccgccagc

SEQ ID NO: 576706 - RNA, 18 nt, Escherichia coli CFT073
ugaugcuccgccagcgcc

SEQ ID NO: 576707 - RNA, 21 nt, Escherichia coli CFT073
ugaugcgguaacuccggcaua

SEQ ID NO: 576708 - RNA, 20 nt, Escherichia coli CFT073
ugaugcgcuccgcuuaucag

SEQ ID NO: 576709 - RNA, 19 nt, Escherichia coli CFT073
ugcaaggccaucggcagcg

SEQ ID NO: 576710 - RNA, 20 nt, Escherichia coli CFT073
ugcaaucagcggugccgcga

SEQ ID NO: 576711 - RNA, 13 nt, Escherichia coli CFT073
ugcaaucuuuccu

SEQ ID NO: 576712 - RNA, 13 nt, Escherichia coli CFT073
ugcaauuuaucgc

SEQ ID NO: 576713 - RNA, 15 nt, Escherichia coli CFT073
ugcaauuugcgguga

SEQ ID NO: 576714 - RNA, 16 nt, Escherichia coli CFT073
ugcaauuugugcguca

SEQ ID NO: 576715 - RNA, 18 nt, Escherichia coli CFT073
ugcaccgccuccagcgac

SEQ ID NO: 576716 - RNA, 22 nt, Escherichia coli CFT073
ugcacccaguacgggcagcgca

SEQ ID NO: 576717 - RNA, 15 nt, Escherichia coli CFT073
ugcacaaauuugccg

SEQ ID NO: 576718 - RNA, 20 nt, Escherichia coli CFT073
ugcacaaccggaaccagcgc

SEQ ID NO: 576719 - RNA, 14 nt, Escherichia coli CFT073
ugcacaagcggcag

SEQ ID NO: 576720 - RNA, 24 nt, Escherichia coli CFT073
ugcacaaucagcguuugcgacagu

SEQ ID NO: 576721 - RNA, 22 nt, Escherichia coli CFT073
ugcacacgcggagccaguucgu

SEQ ID NO: 576722 - RNA, 22 nt, Escherichia coli CFT073
ugcacagcauccgaacgcugac

SEQ ID NO: 576723 - RNA, 18 nt, Escherichia coli CFT073
ugcacagcuuaaaaugcu

SEQ ID NO: 576724 - RNA, 21 nt, Escherichia coli CFT073
ugauaaacaaacagcgcgcca

SEQ ID NO: 576725 - RNA, 22 nt, Escherichia coli CFT073
ugaucgacaaaaucccggcgca

SEQ ID NO: 576726 - RNA, 16 nt, Escherichia coli CFT073
ugaucgaagauuacgc

SEQ ID NO: 576727 - RNA, 22 nt, Escherichia coli CFT073
ugaucauccgccucuaacagau

SEQ ID NO: 576728 - RNA, 18 nt, Escherichia coli CFT073
ugauccacgguucuccac

SEQ ID NO: 576729 - RNA, 13 nt, Escherichia coli CFT073
ugaucccgccauc

SEQ ID NO: 576730 - RNA, 15 nt, Escherichia coli CFT073
ugaucugcacagcau

SEQ ID NO: 576731 - RNA, 20 nt, Escherichia coli CFT073
ugaucgucuucaaccgcagu

SEQ ID NO: 576732 - RNA, 18 nt, Escherichia coli CFT073
ugaucgugcgcgccguga

SEQ ID NO: 576733 - RNA, 12 nt, Escherichia coli CFT073
ugaugaaaaaac

SEQ ID NO: 576734 - RNA, 22 nt, Escherichia coli CFT073
ugaugaaaaacguugccggaua

SEQ ID NO: 576735 - RNA, 16 nt, Escherichia coli CFT073
ugaucgcgcaaguucg

SEQ ID NO: 576736 - RNA, 21 nt, Escherichia coli CFT073
ugaucgccgccagugccacca

SEQ ID NO: 576737 - RNA, 11 nt, Escherichia coli CFT073
ugaucgcccau

SEQ ID NO: 576738 - RNA, 20 nt, Escherichia coli CFT073
ugacauugaugcgccauaug

SEQ ID NO: 576739 - RNA, 18 nt, Escherichia coli CFT073
ugacauguuaaccaacca

SEQ ID NO: 576740 - RNA, 18 nt, Escherichia coli CFT073
ugacaucgucaggggcau

SEQ ID NO: 576741 - RNA, 20 nt, Escherichia coli CFT073
ugacauucacgcugucggca

SEQ ID NO: 576742 - RNA, 17 nt, Escherichia coli CFT073
ugacauagagauaacug

SEQ ID NO: 576743 - RNA, 19 nt, Escherichia coli CFT073
ugacauuuuuucaucuguu

SEQ ID NO: 576744 - RNA, 13 nt, Escherichia coli CFT073
ugaccaccagcac

SEQ ID NO: 576745 - RNA, 19 nt, Escherichia coli CFT073
ugaccaccgcagcaaccgu

SEQ ID NO: 576746 - RNA, 14 nt, Escherichia coli CFT073
ugaccaauaacccg

SEQ ID NO: 576747 - RNA, 14 nt, Escherichia coli CFT073
ugaccacccgcugg

SEQ ID NO: 576748 - RNA, 13 nt, Escherichia coli CFT073
ugacacgcgcgca

SEQ ID NO: 576749 - RNA, 22 nt, Escherichia coli CFT073
ugacacuaacagcaguacgcca

SEQ ID NO: 576750 - RNA, 19 nt, Escherichia coli CFT073
ugacaauaauucccagcac

SEQ ID NO: 576751 - RNA, 12 nt, Escherichia coli CFT073
ugacaccagcau

SEQ ID NO: 576752 - RNA, 23 nt, Escherichia coli CFT073
ugacacugucaccuuuuaccgua

SEQ ID NO: 576753 - RNA, 14 nt, Escherichia coli CFT073
ugacagaaucagca

SEQ ID NO: 576754 - RNA, 19 nt, Escherichia coli CFT073
ugacagcgcccgacaagau

SEQ ID NO: 576755 - RNA, 23 nt, Escherichia coli CFT073
ugacaggcgggaagaacggcaac

SEQ ID NO: 576756 - RNA, 16 nt, Escherichia coli CFT073
ugacagguaugguguu

SEQ ID NO: 576757 - RNA, 17 nt, Escherichia coli CFT073
ugacccgcagccagcac

SEQ ID NO: 576758 - RNA, 14 nt, Escherichia coli CFT073
ugaccaucgcccac

SEQ ID NO: 576759 - RNA, 22 nt, Escherichia coli CFT073
ugaccaucuuccagcaucagca

SEQ ID NO: 576760 - RNA, 14 nt, Escherichia coli CFT073
ugaccauucgccgu

SEQ ID NO: 576761 - RNA, 15 nt, Escherichia coli CFT073
ugaccauaacccgcu

SEQ ID NO: 576762 - RNA, 13 nt, Escherichia coli CFT073
ugaccauauuaac

SEQ ID NO: 576763 - RNA, 20 nt, Escherichia coli CFT073
ugaccagugcagacucaccu

SEQ ID NO: 576764 - RNA, 21 nt, Escherichia coli CFT073
ugaccagugcagauaccacca

SEQ ID NO: 576765 - RNA, 21 nt, Escherichia coli CFT073
ugaccagcgccgcgagcaucg

SEQ ID NO: 576766 - RNA, 22 nt, Escherichia coli CFT073
ugaccagcgccgcgagcaucgc

SEQ ID NO: 576767 - RNA, 16 nt, Escherichia coli CFT073
ugaccacuuugcgcuc

SEQ ID NO: 576768 - RNA, 16 nt, Escherichia coli CFT073
ugaccagacuggagca

SEQ ID NO: 576769 - RNA, 15 nt, Escherichia coli CFT073
ugaccuuaauaaacu

SEQ ID NO: 576770 - RNA, 17 nt, Escherichia coli CFT073
ugaccguucgccccaua

SEQ ID NO: 576771 - RNA, 23 nt, Escherichia coli CFT073
ugaccguccgggcuaauacccuc

SEQ ID NO: 576772 - RNA, 20 nt, Escherichia coli CFT073
ugaccgucgccuucaacgua

SEQ ID NO: 576773 - RNA, 17 nt, Escherichia coli CFT073
ugaccucucaacgugcg

SEQ ID NO: 576774 - RNA, 18 nt, Escherichia coli CFT073
ugacgaggaaaacgccuu

SEQ ID NO: 576775 - RNA, 21 nt, Escherichia coli CFT073
ugacgaggaaaacgccuuuca

SEQ ID NO: 576776 - RNA, 19 nt, Escherichia coli CFT073
ugacgacuucaguacccag

SEQ ID NO: 576777 - RNA, 23 nt, Escherichia coli CFT073
ugacgaauaccguauucaacgaa

SEQ ID NO: 576778 - RNA, 11 nt, Escherichia coli CFT073
ugaccgccugc

SEQ ID NO: 576779 - RNA, 14 nt, Escherichia coli CFT073
ugaccgcuccgcca

SEQ ID NO: 576780 - RNA, 16 nt, Escherichia coli CFT073
ugaccgcuccgccauc

SEQ ID NO: 576781 - RNA, 13 nt, Escherichia coli CFT073
ugaccgccugcgg

SEQ ID NO: 576782 - RNA, 16 nt, Escherichia coli CFT073
ugaccgccugcggaga

SEQ ID NO: 576783 - RNA, 13 nt, Escherichia coli CFT073
ugaccgccagcgc

SEQ ID NO: 576784 - RNA, 17 nt, Escherichia coli CFT073
ugaccgccagcgccauc

SEQ ID NO: 576785 - RNA, 22 nt, Escherichia coli CFT073
ugaccgacguuaugcucggcag

SEQ ID NO: 576786 - RNA, 18 nt, Escherichia coli CFT073
ugaccgagcgcccgccaa

SEQ ID NO: 576787 - RNA, 23 nt, Escherichia coli CFT073
ugaagaaccgcaccaggcaguuu

SEQ ID NO: 576788 - RNA, 14 nt, Escherichia coli CFT073
ugaagagauaaacg

SEQ ID NO: 576789 - RNA, 15 nt, Escherichia coli CFT073
ugaagagauaaacga

SEQ ID NO: 576790 - RNA, 23 nt, Escherichia coli CFT073
ugaagcucguuguuuacgccgga

SEQ ID NO: 576791 - RNA, 16 nt, Escherichia coli CFT073
ugaaggauaagacgag

SEQ ID NO: 576792 - RNA, 13 nt, Escherichia coli CFT073
ugaaggaaaaauc

SEQ ID NO: 576793 - RNA, 13 nt, Escherichia coli CFT073
ugaauaaacgcca

SEQ ID NO: 576794 - RNA, 21 nt, Escherichia coli CFT073
ugaaguuacugacaucgcuua

SEQ ID NO: 576795 - RNA, 22 nt, Escherichia coli CFT073
ugaaggggcgcaauuaauugaa

SEQ ID NO: 576796 - RNA, 21 nt, Escherichia coli CFT073
ugaaguaaauacuaaaaagcg

SEQ ID NO: 576797 - RNA, 13 nt, Escherichia coli CFT073
ugaaguaauaauc

SEQ ID NO: 576798 - RNA, 17 nt, Escherichia coli CFT073
ugaaguaauaaucaacg

SEQ ID NO: 576799 - RNA, 18 nt, Escherichia coli CFT073
ugaaguaugacgaguaua

SEQ ID NO: 576800 - RNA, 18 nt, Escherichia coli CFT073
ugaauggugaccugcaau

SEQ ID NO: 576801 - RNA, 18 nt, Escherichia coli CFT073
ugaaugucggcggcgauc

SEQ ID NO: 576802 - RNA, 22 nt, Escherichia coli CFT073
ugaaugugaccgacccggcauc

SEQ ID NO: 576803 - RNA, 17 nt, Escherichia coli CFT073
ugaaugguuucgcccac

SEQ ID NO: 576804 - RNA, 18 nt, Escherichia coli CFT073
ugaauguucaauaagcuu

SEQ ID NO: 576805 - RNA, 18 nt, Escherichia coli CFT073
ugaauugcuuaacagcau

SEQ ID NO: 576806 - RNA, 15 nt, Escherichia coli CFT073
ugaauuguugauggu

SEQ ID NO: 576807 - RNA, 19 nt, Escherichia coli CFT073
ugaauuucaaaucaccaaa

SEQ ID NO: 576808 - RNA, 20 nt, Escherichia coli CFT073
ugacaacuccuguugcaaua

SEQ ID NO: 576809 - RNA, 21 nt, Escherichia coli CFT073
ugaauuuucgcccgcuggcga

SEQ ID NO: 576810 - RNA, 15 nt, Escherichia coli CFT073
ugacaaaaaagccaa

SEQ ID NO: 576811 - RNA, 23 nt, Escherichia coli CFT073
ugacaaacgcaaaacugccugau

SEQ ID NO: 576812 - RNA, 23 nt, Escherichia coli CFT073
ugacaaacgcaaaauugccugau

SEQ ID NO: 576813 - RNA, 15 nt, Escherichia coli CFT073
ugaauacccgccaga

SEQ ID NO: 576814 - RNA, 23 nt, Escherichia coli CFT073
ugaauaucuuucucgcggcagua

SEQ ID NO: 576815 - RNA, 13 nt, Escherichia coli CFT073
ugaauaucaucac

SEQ ID NO: 576816 - RNA, 13 nt, Escherichia coli CFT073
ugaaucagccagu

SEQ ID NO: 576817 - RNA, 18 nt, Escherichia coli CFT073
ugaauccacuggcuguua

SEQ ID NO: 576818 - RNA, 18 nt, Escherichia coli CFT073
ugaaucggacgugauucc

SEQ ID NO: 576819 - RNA, 14 nt, Escherichia coli CFT073
ugaaucgccacgcc

SEQ ID NO: 576820 - RNA, 16 nt, Escherichia coli CFT073
ugaaugccgcgcccca

SEQ ID NO: 576821 - RNA, 23 nt, Escherichia coli CFT073
ugaaaucaaaaucaccgaugaca

SEQ ID NO: 576822 - RNA, 13 nt, Escherichia coli CFT073
ugaaaugcggcga

SEQ ID NO: 576823 - RNA, 15 nt, Escherichia coli CFT073
ugaaauaaugcagcg

SEQ ID NO: 576824 - RNA, 22 nt, Escherichia coli CFT073
ugaaauaccacucagcuuaaga

SEQ ID NO: 576825 - RNA, 14 nt, Escherichia coli CFT073
ugaaauaguugcau

SEQ ID NO: 576826 - RNA, 13 nt, Escherichia coli CFT073
ugaaauugcuggu

SEQ ID NO: 576827 - RNA, 17 nt, Escherichia coli CFT073
ugaacaaaagcuggcag

SEQ ID NO: 576828 - RNA, 17 nt, Escherichia coli CFT073
ugaaauugcaaacgcgu

SEQ ID NO: 576829 - RNA, 20 nt, Escherichia coli CFT073
ugaacgcaccuuccaguuug

SEQ ID NO: 576830 - RNA, 14 nt, Escherichia coli CFT073
ugaacgacacacag

SEQ ID NO: 576831 - RNA, 13 nt, Escherichia coli CFT073
ugaaccgccaacc

SEQ ID NO: 576832 - RNA, 22 nt, Escherichia coli CFT073
ugaacccggcaucaaccagcac

SEQ ID NO: 576833 - RNA, 21 nt, Escherichia coli CFT073
ugaaccgucacuguugcugua

SEQ ID NO: 576834 - RNA, 19 nt, Escherichia coli CFT073
ucuuugaacaguuuucgca

SEQ ID NO: 576835 - RNA, 17 nt, Escherichia coli CFT073
ucuuucucggccaccgu

SEQ ID NO: 576836 - RNA, 14 nt, Escherichia coli CFT073
ucuuucaccucuuc

SEQ ID NO: 576837 - RNA, 23 nt, Escherichia coli CFT073
ucuuucaggaacagcgacagauu

SEQ ID NO: 576838 - RNA, 14 nt, Escherichia coli CFT073
ucuccccggcgcag

SEQ ID NO: 576839 - RNA, 22 nt, Escherichia coli CFT073
ugaaacgccugaugacgcagau

SEQ ID NO: 576840 - RNA, 21 nt, Escherichia coli CFT073
ugaaacgcggcguaaccaccc

SEQ ID NO: 576841 - RNA, 19 nt, Escherichia coli CFT073
ucuuugauugaagaaauca

SEQ ID NO: 576842 - RNA, 18 nt, Escherichia coli CFT073
ucuuugcccauacccggu

SEQ ID NO: 576843 - RNA, 19 nt, Escherichia coli CFT073
ucuuuguaggccugauaag

SEQ ID NO: 576844 - RNA, 13 nt, Escherichia coli CFT073
ugaaaguuggcga

SEQ ID NO: 576845 - RNA, 11 nt, Escherichia coli CFT073
ugaaauaaacc

SEQ ID NO: 576846 - RNA, 17 nt, Escherichia coli CFT073
ugaaagcucauaacgga

SEQ ID NO: 576847 - RNA, 13 nt, Escherichia coli CFT073
ugaaagcggccuu

SEQ ID NO: 576848 - RNA, 18 nt, Escherichia coli CFT073
ugaaacuuuccaugccau

SEQ ID NO: 576849 - RNA, 19 nt, Escherichia coli CFT073
ugaaagcaaaaaaagaauc

SEQ ID NO: 576850 - RNA, 19 nt, Escherichia coli CFT073
ugaaacucgaccaguagcu

SEQ ID NO: 576851 - RNA, 19 nt, Escherichia coli CFT073
ucgaucgccgcacccgcca

SEQ ID NO: 576852 - RNA, 15 nt, Escherichia coli CFT073
ucgagugcaauaacg

SEQ ID NO: 576853 - RNA, 14 nt, Escherichia coli CFT073
ucgauaaacucaau

SEQ ID NO: 576854 - RNA, 19 nt, Escherichia coli CFT073
ucgauaaacucaaucaggc

SEQ ID NO: 576855 - RNA, 14 nt, Escherichia coli CFT073
ucgauaaagcgauc

SEQ ID NO: 576856 - RNA, 22 nt, Escherichia coli CFT073
ucgauaaauggcgcauccagcc

SEQ ID NO: 576857 - RNA, 11 nt, Escherichia coli CFT073
ucgauaccaga

SEQ ID NO: 576858 - RNA, 13 nt, Escherichia coli CFT073
ucgaucagcaauu

SEQ ID NO: 576859 - RNA, 16 nt, Escherichia coli CFT073
ucgaucagacgaucgc

SEQ ID NO: 576860 - RNA, 14 nt, Escherichia coli CFT073
ucgaucaccgcaga

SEQ ID NO: 576861 - RNA, 16 nt, Escherichia coli CFT073
ucgauacugccuuucc

SEQ ID NO: 576862 - RNA, 13 nt, Escherichia coli CFT073
ucgcacccgccau

SEQ ID NO: 576863 - RNA, 15 nt, Escherichia coli CFT073
ucgcaaauccacuca

SEQ ID NO: 576864 - RNA, 20 nt, Escherichia coli CFT073
ucgauuucauucagcguauc

SEQ ID NO: 576865 - RNA, 23 nt, Escherichia coli CFT073
ucgauugucgcggcuaacuccug

SEQ ID NO: 576866 - RNA, 17 nt, Escherichia coli CFT073
ucgcaaaccagacgcgc

SEQ ID NO: 576867 - RNA, 20 nt, Escherichia coli CFT073
ucgauuuuuuccagcgcaug

SEQ ID NO: 576868 - RNA, 21 nt, Escherichia coli CFT073
ucgauuaccgccagcaacaau

SEQ ID NO: 576869 - RNA, 17 nt, Escherichia coli CFT073
ucgaugcgcaacgcaau

SEQ ID NO: 576870 - RNA, 15 nt, Escherichia coli CFT073
ucgaggcaaccagca

SEQ ID NO: 576871 - RNA, 22 nt, Escherichia coli CFT073
ucgagcagaaucgguccgccac

SEQ ID NO: 576872 - RNA, 22 nt, Escherichia coli CFT073
ucgagaaucgggauauugcccu

SEQ ID NO: 576873 - RNA, 19 nt, Escherichia coli CFT073
ucgacuuccaccagcggcu

SEQ ID NO: 576874 - RNA, 22 nt, Escherichia coli CFT073
ucgacucggugcgcccgccagu

SEQ ID NO: 576875 - RNA, 16 nt, Escherichia coli CFT073
ucgacucaccacggug

SEQ ID NO: 576876 - RNA, 17 nt, Escherichia coli CFT073
ucgacguccaaucagca

SEQ ID NO: 576877 - RNA, 15 nt, Escherichia coli CFT073
ucgacggaauaaacc

SEQ ID NO: 576878 - RNA, 15 nt, Escherichia coli CFT073
uccgguaacccuuca

SEQ ID NO: 576879 - RNA, 12 nt, Escherichia coli CFT073
uccgggcuauac

SEQ ID NO: 576880 - RNA, 16 nt, Escherichia coli CFT073
ucgccguggcuguuga

SEQ ID NO: 576881 - RNA, 21 nt, Escherichia coli CFT073
ucgccggucaggauguugcca

SEQ ID NO: 576882 - RNA, 18 nt, Escherichia coli CFT073
ucgccguuccggcgguga

SEQ ID NO: 576883 - RNA, 22 nt, Escherichia coli CFT073
ucgccuaccaucaacgugaauc

SEQ ID NO: 576884 - RNA, 22 nt, Escherichia coli CFT073
ucgcgcagcgguuuuacaggaa

SEQ ID NO: 576885 - RNA, 22 nt, Escherichia coli CFT073
ucgcgcacgcccaucagcggua

SEQ ID NO: 576886 - RNA, 19 nt, Escherichia coli CFT073
ucgccuuucaguucaacgg

SEQ ID NO: 576887 - RNA, 17 nt, Escherichia coli CFT073
ucgcgaaaccacgguga

SEQ ID NO: 576888 - RNA, 17 nt, Escherichia coli CFT073
ucgccuucauacgacga

SEQ ID NO: 576889 - RNA, 13 nt, Escherichia coli CFT073
ucgccugcggcgc

SEQ ID NO: 576890 - RNA, 21 nt, Escherichia coli CFT073
ucgcagaaauaccccgccagc

SEQ ID NO: 576891 - RNA, 17 nt, Escherichia coli CFT073
ucgcaucagacaccggc

SEQ ID NO: 576892 - RNA, 19 nt, Escherichia coli CFT073
ucgcauauuucaacgacgc

SEQ ID NO: 576893 - RNA, 19 nt, Escherichia coli CFT073
ucgcaucaggcaacccgca

SEQ ID NO: 576894 - RNA, 20 nt, Escherichia coli CFT073
ucgcaucaggcaacccgcac

SEQ ID NO: 576895 - RNA, 14 nt, Escherichia coli CFT073
ucgcauccggcauc

SEQ ID NO: 576896 - RNA, 16 nt, Escherichia coli CFT073
ucgcauccggcaucaa

SEQ ID NO: 576897 - RNA, 19 nt, Escherichia coli CFT073
ucgccaagaagaacgccgg

SEQ ID NO: 576898 - RNA, 16 nt, Escherichia coli CFT073
ucgccaacgccugcgg

SEQ ID NO: 576899 - RNA, 19 nt, Escherichia coli CFT073
ucgccaauggcugccgcca

SEQ ID NO: 576900 - RNA, 21 nt, Escherichia coli CFT073
ucgccaauggcugccgccagg

SEQ ID NO: 576901 - RNA, 20 nt, Escherichia coli CFT073
ucgccaccaacuuaucggga

SEQ ID NO: 576902 - RNA, 17 nt, Escherichia coli CFT073
ucgccacguugaagcgc

SEQ ID NO: 576903 - RNA, 17 nt, Escherichia coli CFT073
ucgccacugccagcaaa

SEQ ID NO: 576904 - RNA, 21 nt, Escherichia coli CFT073
ucgccacugcgacaccagcau

SEQ ID NO: 576905 - RNA, 22 nt, Escherichia coli CFT073
ucgccacugcgacaccagcaug

SEQ ID NO: 576906 - RNA, 14 nt, Escherichia coli CFT073
ucgccacuuuauga

SEQ ID NO: 576907 - RNA, 11 nt, Escherichia coli CFT073
ucgccagcaaa

SEQ ID NO: 576908 - RNA, 20 nt, Escherichia coli CFT073
ucgccagcacuaccgcccga

SEQ ID NO: 576909 - RNA, 14 nt, Escherichia coli CFT073
ucgccagcagccau

SEQ ID NO: 576910 - RNA, 20 nt, Escherichia coli CFT073
ucgccgagaucaacagcaua

SEQ ID NO: 576911 - RNA, 14 nt, Escherichia coli CFT073
ucgccgcauugccc

SEQ ID NO: 576912 - RNA, 16 nt, Escherichia coli CFT073
ucgccgcauaauaucu

SEQ ID NO: 576913 - RNA, 19 nt, Escherichia coli CFT073
ucgccgcacccgccagaau

SEQ ID NO: 576914 - RNA, 22 nt, Escherichia coli CFT073
ucgccagccuaugcagguuggc

SEQ ID NO: 576915 - RNA, 19 nt, Escherichia coli CFT073
ucgccaucaauaaccagcg

SEQ ID NO: 576916 - RNA, 14 nt, Escherichia coli CFT073
ucgccccggucauc

SEQ ID NO: 576917 - RNA, 13 nt, Escherichia coli CFT073
ucgggaccaacgc

SEQ ID NO: 576918 - RNA, 22 nt, Escherichia coli CFT073
ucggcuuuauuuuccagcguua

SEQ ID NO: 576919 - RNA, 22 nt, Escherichia coli CFT073
ucggcugcguaccuucgaugaa

SEQ ID NO: 576920 - RNA, 23 nt, Escherichia coli CFT073
ucgggaugagcaucgugccggaa

SEQ ID NO: 576921 - RNA, 19 nt, Escherichia coli CFT073
ucggcgucuuguugaacag

SEQ ID NO: 576922 - RNA, 15 nt, Escherichia coli CFT073
ucggcgcacaaccgc

SEQ ID NO: 576923 - RNA, 20 nt, Escherichia coli CFT073
ucggcaguuuuaccgccgga

SEQ ID NO: 576924 - RNA, 16 nt, Escherichia coli CFT073
ucggcagauaccacca

SEQ ID NO: 576925 - RNA, 21 nt, Escherichia coli CFT073
ucggcagcagaccaaucugga

SEQ ID NO: 576926 - RNA, 14 nt, Escherichia coli CFT073
ucggcaccgccagc

SEQ ID NO: 576927 - RNA, 16 nt, Escherichia coli CFT073
ucggcaccgccgccaa

SEQ ID NO: 576928 - RNA, 20 nt, Escherichia coli CFT073
ucggacguuugccaugcaua

SEQ ID NO: 576929 - RNA, 15 nt, Escherichia coli CFT073
ucggaccaaugccca

SEQ ID NO: 576930 - RNA, 18 nt, Escherichia coli CFT073
ucggacaaacacgcaauc

SEQ ID NO: 576931 - RNA, 16 nt, Escherichia coli CFT073
ucgcggaccaacaaaa

SEQ ID NO: 576932 - RNA, 21 nt, Escherichia coli CFT073
ucgcgcuucguuuuccgccac

SEQ ID NO: 576933 - RNA, 21 nt, Escherichia coli CFT073
ucgcuaucaguccauggcaga

SEQ ID NO: 576934 - RNA, 22 nt, Escherichia coli CFT073
ucgcugacgaucauuccgccca

SEQ ID NO: 576935 - RNA, 12 nt, Escherichia coli CFT073
ucgcugauauca

SEQ ID NO: 576936 - RNA, 22 nt, Escherichia coli CFT073
ucgguaaugcacuccgccgcac

SEQ ID NO: 576937 - RNA, 16 nt, Escherichia coli CFT073
ucgguaaauugcccca

SEQ ID NO: 576938 - RNA, 13 nt, Escherichia coli CFT073
ucggguuaccgga

SEQ ID NO: 576939 - RNA, 23 nt, Escherichia coli CFT073
ucgggcgguauuuaaacucgcug

SEQ ID NO: 576940 - RNA, 17 nt, Escherichia coli CFT073
ucgggcaggcuucaaca

SEQ ID NO: 576941 - RNA, 18 nt, Escherichia coli CFT073
ucguagauuucauccggc

SEQ ID NO: 576942 - RNA, 23 nt, Escherichia coli CFT073
ucgguuacuauccugaaagcuga

SEQ ID NO: 576943 - RNA, 21 nt, Escherichia coli CFT073
ucgguucaaccaucagcguac

SEQ ID NO: 576944 - RNA, 21 nt, Escherichia coli CFT073
ucguaguuuuugcccaucaug

SEQ ID NO: 576945 - RNA, 12 nt, Escherichia coli CFT073
ucguauccagcg

SEQ ID NO: 576946 - RNA, 18 nt, Escherichia coli CFT073
ucgucacggcgacggcug

SEQ ID NO: 576947 - RNA, 16 nt, Escherichia coli CFT073
ucggugucguuacgcc

SEQ ID NO: 576948 - RNA, 16 nt, Escherichia coli CFT073
ucgguaucaauaccag

SEQ ID NO: 576949 - RNA, 23 nt, Escherichia coli CFT073
ucgucauaagcgauaccgguacg

SEQ ID NO: 576950 - RNA, 19 nt, Escherichia coli CFT073
ucgucaucagcgccaaccc

SEQ ID NO: 576951 - RNA, 15 nt, Escherichia coli CFT073
ucgucaucccagucc

SEQ ID NO: 576952 - RNA, 13 nt, Escherichia coli CFT073
ucgucauggccca

SEQ ID NO: 576953 - RNA, 22 nt, Escherichia coli CFT073
ucgugauuaaacuucaccagca

SEQ ID NO: 576954 - RNA, 17 nt, Escherichia coli CFT073
ucgugcgguaucaccac

SEQ ID NO: 576955 - RNA, 13 nt, Escherichia coli CFT073
ucgugccgccagu

SEQ ID NO: 576956 - RNA, 20 nt, Escherichia coli CFT073
ucgugccagaaaaucacggc

SEQ ID NO: 576957 - RNA, 11 nt, Escherichia coli CFT073
ucgugccagag

SEQ ID NO: 576958 - RNA, 14 nt, Escherichia coli CFT073
ucgugcccaacugc

SEQ ID NO: 576959 - RNA, 13 nt, Escherichia coli CFT073
ucgucuggcgcgu

SEQ ID NO: 576960 - RNA, 14 nt, Escherichia coli CFT073
ucgucuucaaccgc

SEQ ID NO: 576961 - RNA, 16 nt, Escherichia coli CFT073
ucgugaaacucaacgu

SEQ ID NO: 576962 - RNA, 16 nt, Escherichia coli CFT073
ucgugaaauucacgca

SEQ ID NO: 576963 - RNA, 11 nt, Escherichia coli CFT073
ucgugauaaac

SEQ ID NO: 576964 - RNA, 15 nt, Escherichia coli CFT073
ucguggcccgccagc

SEQ ID NO: 576965 - RNA, 18 nt, Escherichia coli CFT073
ucguggguucaucgagca

SEQ ID NO: 576966 - RNA, 18 nt, Escherichia coli CFT073
ucguuugcauccggcacg

SEQ ID NO: 576967 - RNA, 14 nt, Escherichia coli CFT073
ucguuuauuucgcg

SEQ ID NO: 576968 - RNA, 17 nt, Escherichia coli CFT073
ucuaucacuauaaauau

SEQ ID NO: 576969 - RNA, 14 nt, Escherichia coli CFT073
ucuccagacugcug

SEQ ID NO: 576970 - RNA, 19 nt, Escherichia coli CFT073
ucuccacgcaggcguuuca

SEQ ID NO: 576971 - RNA, 21 nt, Escherichia coli CFT073
ucucaucuuucagaaucagau

SEQ ID NO: 576972 - RNA, 18 nt, Escherichia coli CFT073
uccgccagaauacccgaa

SEQ ID NO: 576973 - RNA, 20 nt, Escherichia coli CFT073
uccgcccagaccgugcgcag

SEQ ID NO: 576974 - RNA, 20 nt, Escherichia coli CFT073
uccgccguugcgcccgacaa

SEQ ID NO: 576975 - RNA, 21 nt, Escherichia coli CFT073
uccgaccuacguucggcacua

SEQ ID NO: 576976 - RNA, 14 nt, Escherichia coli CFT073
uccgauuaccggca

SEQ ID NO: 576977 - RNA, 22 nt, Escherichia coli CFT073
ucccggugaauucaguaccagc

SEQ ID NO: 576978 - RNA, 16 nt, Escherichia coli CFT073
ucccgguuaacugcau

SEQ ID NO: 576979 - RNA, 23 nt, Escherichia coli CFT073
uccgacaaaaugaugucaaccau

SEQ ID NO: 576980 - RNA, 18 nt, Escherichia coli CFT073
uccgacaaauguguucag

SEQ ID NO: 576981 - RNA, 16 nt, Escherichia coli CFT073
uccgcguaguugcgcu

SEQ ID NO: 576982 - RNA, 14 nt, Escherichia coli CFT073
uccggcgucgaaaa

SEQ ID NO: 576983 - RNA, 16 nt, Escherichia coli CFT073
uccggccuacugguga

SEQ ID NO: 576984 - RNA, 22 nt, Escherichia coli CFT073
uccggccugcacugcaggccgg

SEQ ID NO: 576985 - RNA, 21 nt, Escherichia coli CFT073
uccggcgaaaaucccggcaac

SEQ ID NO: 576986 - RNA, 13 nt, Escherichia coli CFT073
uccggcggcggaa

SEQ ID NO: 576987 - RNA, 14 nt, Escherichia coli CFT073
uccggccuacggga

SEQ ID NO: 576988 - RNA, 16 nt, Escherichia coli CFT073
uccggccuacggguga

SEQ ID NO: 576989 - RNA, 17 nt, Escherichia coli CFT073
uccggcaacccuugacc

SEQ ID NO: 576990 - RNA, 13 nt, Escherichia coli CFT073
uccggcaaggcgc

SEQ ID NO: 576991 - RNA, 19 nt, Escherichia coli CFT073
uccccguaggccagauaag

SEQ ID NO: 576992 - RNA, 14 nt, Escherichia coli CFT073
uccccggcagcauc

SEQ ID NO: 576993 - RNA, 20 nt, Escherichia coli CFT073
uccccgcgccaaccaugccg

SEQ ID NO: 576994 - RNA, 15 nt, Escherichia coli CFT073
uccccaucgccgcac

SEQ ID NO: 576995 - RNA, 21 nt, Escherichia coli CFT073
ucccccauuauuaacaagaug

SEQ ID NO: 576996 - RNA, 13 nt, Escherichia coli CFT073
ucccccgguuuua

SEQ ID NO: 576997 - RNA, 19 nt, Escherichia coli CFT073
uccccgcaggucggauaag

SEQ ID NO: 576998 - RNA, 21 nt, Escherichia coli CFT073
uccccugagcauacauugccg

SEQ ID NO: 576999 - RNA, 13 nt, Escherichia coli CFT073
uccccugccagaa

SEQ ID NO: 577000 - RNA, 21 nt, Escherichia coli CFT073
uccccugcccgcgauccagcg

SEQ ID NO: 577001 - RNA, 14 nt, Escherichia coli CFT073
ucccggcaaucacc

SEQ ID NO: 577002 - RNA, 21 nt, Escherichia coli CFT073
uccccacugcauggcggcguc

SEQ ID NO: 577003 - RNA, 23 nt, Escherichia coli CFT073
uccccaagaaucgucgcccgaug

SEQ ID NO: 577004 - RNA, 18 nt, Escherichia coli CFT073
ucccauuuacuggcauca

SEQ ID NO: 577005 - RNA, 22 nt, Escherichia coli CFT073
ucccaugucagaccaaaacgcg

SEQ ID NO: 577006 - RNA, 14 nt, Escherichia coli CFT073
ucccauuccacuca

SEQ ID NO: 577007 - RNA, 19 nt, Escherichia coli CFT073
ucccaucuucugaaucaga

SEQ ID NO: 577008 - RNA, 23 nt, Escherichia coli CFT073
ucccauaaacccggauacgcuca

SEQ ID NO: 577009 - RNA, 16 nt, Escherichia coli CFT073
ucccagugcagcaucg

SEQ ID NO: 577010 - RNA, 17 nt, Escherichia coli CFT073
ucccagcuuuugaccag

SEQ ID NO: 577011 - RNA, 23 nt, Escherichia coli CFT073
ucccagccgggaaguaccauuga

SEQ ID NO: 577012 - RNA, 17 nt, Escherichia coli CFT073
ucccagcgcgaaagaua

SEQ ID NO: 577013 - RNA, 19 nt, Escherichia coli CFT073
uccauagugaagugauccg

SEQ ID NO: 577014 - RNA, 19 nt, Escherichia coli CFT073
uccaguuucacaggauggc

SEQ ID NO: 577015 - RNA, 15 nt, Escherichia coli CFT073
uccauaagacggaac

SEQ ID NO: 577016 - RNA, 24 nt, Escherichia coli CFT073
uccauaaucgacucccgcgccgca

SEQ ID NO: 577017 - RNA, 19 nt, Escherichia coli CFT073
ucccagcgcaguucgucgu

SEQ ID NO: 577018 - RNA, 12 nt, Escherichia coli CFT073
ucccagcgcauu

SEQ ID NO: 577019 - RNA, 20 nt, Escherichia coli CFT073
ucccagccaaugcaggcauc

SEQ ID NO: 577020 - RNA, 20 nt, Escherichia coli CFT073
ucccagagaaugaauuucac

SEQ ID NO: 577021 - RNA, 15 nt, Escherichia coli CFT073
ucccagcaccgcaga

SEQ ID NO: 577022 - RNA, 16 nt, Escherichia coli CFT073
ucccacuuuucaguua

SEQ ID NO: 577023 - RNA, 22 nt, Escherichia coli CFT073
ucccacgagagaaccagccgua

SEQ ID NO: 577024 - RNA, 20 nt, Escherichia coli CFT073
ucccacggcggugucgccag

SEQ ID NO: 577025 - RNA, 18 nt, Escherichia coli CFT073
ucauauaauguaucugaa

SEQ ID NO: 577026 - RNA, 18 nt, Escherichia coli CFT073
ucauauacccugccagaa

SEQ ID NO: 577027 - RNA, 13 nt, Escherichia coli CFT073
ucauaucaccguu

SEQ ID NO: 577028 - RNA, 15 nt, Escherichia coli CFT073
ucauauccggcacuu

SEQ ID NO: 577029 - RNA, 21 nt, Escherichia coli CFT073
ucauagccucugccccgccaa

SEQ ID NO: 577030 - RNA, 16 nt, Escherichia coli CFT073
ucauagcggcaacaau

SEQ ID NO: 577031 - RNA, 16 nt, Escherichia coli CFT073
ucauagucucgcccac

SEQ ID NO: 577032 - RNA, 18 nt, Escherichia coli CFT073
ucaguacccgcguucugg

SEQ ID NO: 577033 - RNA, 16 nt, Escherichia coli CFT073
ucauacaaucgguaac

SEQ ID NO: 577034 - RNA, 17 nt, Escherichia coli CFT073
ucauaaugcccagcguu

SEQ ID NO: 577035 - RNA, 20 nt, Escherichia coli CFT073
ucagguggcgguauuugaua

SEQ ID NO: 577036 - RNA, 15 nt, Escherichia coli CFT073
ucagcgaaaucacgc

SEQ ID NO: 577037 - RNA, 14 nt, Escherichia coli CFT073
ucagcgaacaccag

SEQ ID NO: 577038 - RNA, 16 nt, Escherichia coli CFT073
ucagcgaacaccagca

SEQ ID NO: 577039 - RNA, 20 nt, Escherichia coli CFT073
ucagcgaacgacauccgcca

SEQ ID NO: 577040 - RNA, 17 nt, Escherichia coli CFT073
ucaggcggcucaccugc

SEQ ID NO: 577041 - RNA, 23 nt, Escherichia coli CFT073
ucagcgagggcuaugcgcaucaa

SEQ ID NO: 577042 - RNA, 18 nt, Escherichia coli CFT073
ucaggcugaaaaucuucu

SEQ ID NO: 577043 - RNA, 13 nt, Escherichia coli CFT073
ucagggccugcgu

SEQ ID NO: 577044 - RNA, 17 nt, Escherichia coli CFT073
ucagggcgaacuuccau

SEQ ID NO: 577045 - RNA, 18 nt, Escherichia coli CFT073
ucaugcccgccgaccgua

SEQ ID NO: 577046 - RNA, 17 nt, Escherichia coli CFT073
ucaugccuacgaguucg

SEQ ID NO: 577047 - RNA, 13 nt, Escherichia coli CFT073
ucaucucaacaaa

SEQ ID NO: 577048 - RNA, 13 nt, Escherichia coli CFT073
ucaucucaucaau

SEQ ID NO: 577049 - RNA, 13 nt, Escherichia coli CFT073
ucaucucuccuuu

SEQ ID NO: 577050 - RNA, 21 nt, Escherichia coli CFT073
ucaucuggcgguaacgcgcuu

SEQ ID NO: 577051 - RNA, 18 nt, Escherichia coli CFT073
ucaucuaccagcauuacg

SEQ ID NO: 577052 - RNA, 13 nt, Escherichia coli CFT073
ucauguuuauuca

SEQ ID NO: 577053 - RNA, 20 nt, Escherichia coli CFT073
ucauguuuauucacauagau

SEQ ID NO: 577054 - RNA, 18 nt, Escherichia coli CFT073
ucauuaaaccaucagcca

SEQ ID NO: 577055 - RNA, 20 nt, Escherichia coli CFT073
ucauuaacgccccaaucaga

SEQ ID NO: 577056 - RNA, 16 nt, Escherichia coli CFT073
ucauuaagaacuccug

SEQ ID NO: 577057 - RNA, 15 nt, Escherichia coli CFT073
ucauuaagccgaucg

SEQ ID NO: 577058 - RNA, 13 nt, Escherichia coli CFT073
ucauuacaacgca

SEQ ID NO: 577059 - RNA, 19 nt, Escherichia coli CFT073
ucauuacgccagucgcgau

SEQ ID NO: 577060 - RNA, 14 nt, Escherichia coli CFT073
ucaucgccaccgcg

SEQ ID NO: 577061 - RNA, 16 nt, Escherichia coli CFT073
ucaucgcccacaucau

SEQ ID NO: 577062 - RNA, 14 nt, Escherichia coli CFT073
ucaucgaugcugcu

SEQ ID NO: 577063 - RNA, 20 nt, Escherichia coli CFT073
ucaucgaacgggugauuucc

SEQ ID NO: 577064 - RNA, 23 nt, Escherichia coli CFT073
ucauaugauaggcuucaaccguu

SEQ ID NO: 577065 - RNA, 12 nt, Escherichia coli CFT073
ucauccaucaaa

SEQ ID NO: 577066 - RNA, 16 nt, Escherichia coli CFT073
ucauccggcacgcuac

SEQ ID NO: 577067 - RNA, 20 nt, Escherichia coli CFT073
ucaucccgguuauuaaaacg

SEQ ID NO: 577068 - RNA, 16 nt, Escherichia coli CFT073
ucauccgguaacggac

SEQ ID NO: 577069 - RNA, 20 nt, Escherichia coli CFT073
ucauccgguaacggaccgca

SEQ ID NO: 577070 - RNA, 14 nt, Escherichia coli CFT073
ucauccucuucacc

SEQ ID NO: 577071 - RNA, 20 nt, Escherichia coli CFT073
ucauccucuucaccgguacg

SEQ ID NO: 577072 - RNA, 11 nt, Escherichia coli CFT073
ucauccugcca

SEQ ID NO: 577073 - RNA, 17 nt, Escherichia coli CFT073
uccagcgaaauaaaagu

SEQ ID NO: 577074 - RNA, 14 nt, Escherichia coli CFT073
uccagcagcaaugc

SEQ ID NO: 577075 - RNA, 19 nt, Escherichia coli CFT073
uccagcagaucgaucuugu

SEQ ID NO: 577076 - RNA, 18 nt, Escherichia coli CFT073
uccagcagaugcugugcc

SEQ ID NO: 577077 - RNA, 16 nt, Escherichia coli CFT073
uccagcagauggcagu

SEQ ID NO: 577078 - RNA, 13 nt, Escherichia coli CFT073
uccagcgcaucgc

SEQ ID NO: 577079 - RNA, 16 nt, Escherichia coli CFT073
uccagcgccuggcgaa

SEQ ID NO: 577080 - RNA, 18 nt, Escherichia coli CFT073
uccaguagcgagccgucg

SEQ ID NO: 577081 - RNA, 14 nt, Escherichia coli CFT073
uccaguauauugcu

SEQ ID NO: 577082 - RNA, 22 nt, Escherichia coli CFT073
uccagucagcaccagacgcaac

SEQ ID NO: 577083 - RNA, 14 nt, Escherichia coli CFT073
uccagucuuucgcc

SEQ ID NO: 577084 - RNA, 18 nt, Escherichia coli CFT073
uccagugcggaagcgagu

SEQ ID NO: 577085 - RNA, 18 nt, Escherichia coli CFT073
uccaguucuuccgccaga

SEQ ID NO: 577086 - RNA, 10 nt, Escherichia coli CFT073
uccaguugac

SEQ ID NO: 577087 - RNA, 22 nt, Escherichia coli CFT073
uccaguugcgccgcauugagau

SEQ ID NO: 577088 - RNA, 17 nt, Escherichia coli CFT073
uccaguuaacgccgcgc

SEQ ID NO: 577089 - RNA, 23 nt, Escherichia coli CFT073
uccaguuccuucaagccaucaag

SEQ ID NO: 577090 - RNA, 16 nt, Escherichia coli CFT073
uccaguucgcuggcau

SEQ ID NO: 577091 - RNA, 18 nt, Escherichia coli CFT073
uccagcuguaccagcaac

SEQ ID NO: 577092 - RNA, 13 nt, Escherichia coli CFT073
uccagcucggcgc

SEQ ID NO: 577093 - RNA, 20 nt, Escherichia coli CFT073
uccagcucggcgcuaaucau

SEQ ID NO: 577094 - RNA, 15 nt, Escherichia coli CFT073
uccaggccaaaagcu

SEQ ID NO: 577095 - RNA, 13 nt, Escherichia coli CFT073
uccaccaucacgc

SEQ ID NO: 577096 - RNA, 14 nt, Escherichia coli CFT073
uccaaucaggcgaa

SEQ ID NO: 577097 - RNA, 20 nt, Escherichia coli CFT073
uccaaucaggcgaauaaauu

SEQ ID NO: 577098 - RNA, 17 nt, Escherichia coli CFT073
uccaauaaaaaucagau

SEQ ID NO: 577099 - RNA, 19 nt, Escherichia coli CFT073
ucauuuuguaugcggcgaa

SEQ ID NO: 577100 - RNA, 20 nt, Escherichia coli CFT073
ucauuuuuagugaucacgau

SEQ ID NO: 577101 - RNA, 15 nt, Escherichia coli CFT073
ucauuuuuugcaaac

SEQ ID NO: 577102 - RNA, 17 nt, Escherichia coli CFT073
ucauuuggucggagauu

SEQ ID NO: 577103 - RNA, 18 nt, Escherichia coli CFT073
ucauuguaaauugcagua

SEQ ID NO: 577104 - RNA, 16 nt, Escherichia coli CFT073
ucauuguuauaauguu

SEQ ID NO: 577105 - RNA, 14 nt, Escherichia coli CFT073
ucauuuaagccacu

SEQ ID NO: 577106 - RNA, 18 nt, Escherichia coli CFT073
uccacgccagcguuggua

SEQ ID NO: 577107 - RNA, 15 nt, Escherichia coli CFT073
uccaccuggccugcg

SEQ ID NO: 577108 - RNA, 18 nt, Escherichia coli CFT073
uccacccuugauuaacga

SEQ ID NO: 577109 - RNA, 23 nt, Escherichia coli CFT073
uccagacggagcugccaggccgc

SEQ ID NO: 577110 - RNA, 18 nt, Escherichia coli CFT073
uccagauauguaucuacc

SEQ ID NO: 577111 - RNA, 19 nt, Escherichia coli CFT073
uccagauaauuaugccgau

SEQ ID NO: 577112 - RNA, 16 nt, Escherichia coli CFT073
uccagaacugcgagau

SEQ ID NO: 577113 - RNA, 19 nt, Escherichia coli CFT073
uccagaccgcgcuugccgc

SEQ ID NO: 577114 - RNA, 23 nt, Escherichia coli CFT073
uccagaccgcgcuugccgccgga

SEQ ID NO: 577115 - RNA, 16 nt, Escherichia coli CFT073
ucagccaaauccagcg

SEQ ID NO: 577116 - RNA, 13 nt, Escherichia coli CFT073
ucagccccagcac

SEQ ID NO: 577117 - RNA, 13 nt, Escherichia coli CFT073
ucagcagcggcac

SEQ ID NO: 577118 - RNA, 20 nt, Escherichia coli CFT073
ucagcagcggcacguucgau

SEQ ID NO: 577119 - RNA, 15 nt, Escherichia coli CFT073
ucagcaucaaugacc

SEQ ID NO: 577120 - RNA, 14 nt, Escherichia coli CFT073
ucagcauacgccac

SEQ ID NO: 577121 - RNA, 12 nt, Escherichia coli CFT073
ucagcaguucgu

SEQ ID NO: 577122 - RNA, 20 nt, Escherichia coli CFT073
ucagcaguuuuaccgaugcg

SEQ ID NO: 577123 - RNA, 23 nt, Escherichia coli CFT073
ucagaaugcagaauccggcgcuc

SEQ ID NO: 577124 - RNA, 22 nt, Escherichia coli CFT073
ucagagccgcgguauccggcuc

SEQ ID NO: 577125 - RNA, 21 nt, Escherichia coli CFT073
ucagagccugccaauggcagg

SEQ ID NO: 577126 - RNA, 16 nt, Escherichia coli CFT073
ucagaguuugccacca

SEQ ID NO: 577127 - RNA, 22 nt, Escherichia coli CFT073
ucagaugaccaauaacccguug

SEQ ID NO: 577128 - RNA, 23 nt, Escherichia coli CFT073
ucagaugcggcaugaacgccuga

SEQ ID NO: 577129 - RNA, 21 nt, Escherichia coli CFT073
ucagaugcggcgugaacgccu

SEQ ID NO: 577130 - RNA, 18 nt, Escherichia coli CFT073
ucagauccgcacccgcac

SEQ ID NO: 577131 - RNA, 15 nt, Escherichia coli CFT073
ucagauggggauggc

SEQ ID NO: 577132 - RNA, 15 nt, Escherichia coli CFT073
ucagauuuacggugu

SEQ ID NO: 577133 - RNA, 22 nt, Escherichia coli CFT073
ucagcacguuuaacacgcucug

SEQ ID NO: 577134 - RNA, 14 nt, Escherichia coli CFT073
ucagcacuggcggc

SEQ ID NO: 577135 - RNA, 22 nt, Escherichia coli CFT073
ucagcacuucacccaucgccag

SEQ ID NO: 577136 - RNA, 17 nt, Escherichia coli CFT073
ucagcacgacauaagcg

SEQ ID NO: 577137 - RNA, 21 nt, Escherichia coli CFT073
ucagcacgacauaagcgcaug

SEQ ID NO: 577138 - RNA, 15 nt, Escherichia coli CFT073
ucacgggcaaccaca

SEQ ID NO: 577139 - RNA, 17 nt, Escherichia coli CFT073
ucacggcuguagccagc

SEQ ID NO: 577140 - RNA, 18 nt, Escherichia coli CFT073
ucacucaucaugcacucc

SEQ ID NO: 577141 - RNA, 16 nt, Escherichia coli CFT073
ucacucugaaaacgcu

SEQ ID NO: 577142 - RNA, 11 nt, Escherichia coli CFT073
ucacuuucgcc

SEQ ID NO: 577143 - RNA, 12 nt, Escherichia coli CFT073
ucacuuucgcca

SEQ ID NO: 577144 - RNA, 15 nt, Escherichia coli CFT073
ucacuuugauuuaua

SEQ ID NO: 577145 - RNA, 17 nt, Escherichia coli CFT073
ucacuuugauuuauagu

SEQ ID NO: 577146 - RNA, 13 nt, Escherichia coli CFT073
ucacuuugcgcuc

SEQ ID NO: 577147 - RNA, 21 nt, Escherichia coli CFT073
ucacuuuguaggccugauaag

SEQ ID NO: 577148 - RNA, 15 nt, Escherichia coli CFT073
ucagaaauuaaacug

SEQ ID NO: 577149 - RNA, 13 nt, Escherichia coli CFT073
ucagaacuucgcu

SEQ ID NO: 577150 - RNA, 19 nt, Escherichia coli CFT073
ucaccucaauggcagcauc

SEQ ID NO: 577151 - RNA, 18 nt, Escherichia coli CFT073
ucacgccgcauccggcca

SEQ ID NO: 577152 - RNA, 12 nt, Escherichia coli CFT073
ucacgccgccaa

SEQ ID NO: 577153 - RNA, 19 nt, Escherichia coli CFT073
ucacgccgcauccggcaua

SEQ ID NO: 577154 - RNA, 14 nt, Escherichia coli CFT073
ucaauuccuggaac

SEQ ID NO: 577155 - RNA, 18 nt, Escherichia coli CFT073
ucaauugagacaacucau

SEQ ID NO: 577156 - RNA, 22 nt, Escherichia coli CFT073
ucaauugcucacucccggggcg

SEQ ID NO: 577157 - RNA, 14 nt, Escherichia coli CFT073
ucaauggucagcgc

SEQ ID NO: 577158 - RNA, 21 nt, Escherichia coli CFT073
ucaaugcugaaagcagcaaga

SEQ ID NO: 577159 - RNA, 16 nt, Escherichia coli CFT073
ucaauguugacgcgug

SEQ ID NO: 577160 - RNA, 15 nt, Escherichia coli CFT073
ucaauggaugcaucu

SEQ ID NO: 577161 - RNA, 15 nt, Escherichia coli CFT073
ucacacaaauauacg

SEQ ID NO: 577162 - RNA, 13 nt, Escherichia coli CFT073
ucacacacaucaa

SEQ ID NO: 577163 - RNA, 18 nt, Escherichia coli CFT073
ucacaccaucaacaaacg

SEQ ID NO: 577164 - RNA, 17 nt, Escherichia coli CFT073
ucacaccgaccaccgca

SEQ ID NO: 577165 - RNA, 17 nt, Escherichia coli CFT073
ucacacggccaucacgg

SEQ ID NO: 577166 - RNA, 19 nt, Escherichia coli CFT073
ucacaacaauaucaaagcg

SEQ ID NO: 577167 - RNA, 18 nt, Escherichia coli CFT073
ucacaagcccaggccauc

SEQ ID NO: 577168 - RNA, 16 nt, Escherichia coli CFT073
ucaauuuccgucgcau

SEQ ID NO: 577169 - RNA, 19 nt, Escherichia coli CFT073
ucaauuugcaggcuaaaaa

SEQ ID NO: 577170 - RNA, 18 nt, Escherichia coli CFT073
ucaauuugcuccgccagu

SEQ ID NO: 577171 - RNA, 18 nt, Escherichia coli CFT073
ucaauuuugaugauauca

SEQ ID NO: 577172 - RNA, 21 nt, Escherichia coli CFT073
ucacacuccagucccaguuca

SEQ ID NO: 577173 - RNA, 12 nt, Escherichia coli CFT073
ucacaggccauc

SEQ ID NO: 577174 - RNA, 17 nt, Escherichia coli CFT073
ucacagaguauuuccag

SEQ ID NO: 577175 - RNA, 10 nt, Escherichia coli CFT073
ucacaucgcu

SEQ ID NO: 577176 - RNA, 13 nt, Escherichia coli CFT073
ucacauccugcca

SEQ ID NO: 577177 - RNA, 16 nt, Escherichia coli CFT073
ucacaugauaauaaaa

SEQ ID NO: 577178 - RNA, 23 nt, Escherichia coli CFT073
ucaccaccgcaaagaaacgcgcg

SEQ ID NO: 577179 - RNA, 16 nt, Escherichia coli CFT073
ucaccaccgcaaucgc

SEQ ID NO: 577180 - RNA, 21 nt, Escherichia coli CFT073
ucaccaccgcaaucgcggcag

SEQ ID NO: 577181 - RNA, 15 nt, Escherichia coli CFT073
ucacauucuccgccg

SEQ ID NO: 577182 - RNA, 20 nt, Escherichia coli CFT073
ucacaugcggcgugccuuca

SEQ ID NO: 577183 - RNA, 18 nt, Escherichia coli CFT073
ucaccaaauuguuuugcu

SEQ ID NO: 577184 - RNA, 13 nt, Escherichia coli CFT073
ucaccaacgauuu

SEQ ID NO: 577185 - RNA, 14 nt, Escherichia coli CFT073
ucaccaacuggcgc

SEQ ID NO: 577186 - RNA, 20 nt, Escherichia coli CFT073
ucaccauccugaucgccauc

SEQ ID NO: 577187 - RNA, 22 nt, Escherichia coli CFT073
ucaccaguaacuuccccuuuca

SEQ ID NO: 577188 - RNA, 16 nt, Escherichia coli CFT073
ucaccaguaaggcauc

SEQ ID NO: 577189 - RNA, 17 nt, Escherichia coli CFT073
ucaccaucaaguagcag

SEQ ID NO: 577190 - RNA, 18 nt, Escherichia coli CFT073
ucaccagcauuagcauua

SEQ ID NO: 577191 - RNA, 15 nt, Escherichia coli CFT073
ucaccagguucgcca

SEQ ID NO: 577192 - RNA, 18 nt, Escherichia coli CFT073
ucaccagguucgccaaca

SEQ ID NO: 577193 - RNA, 18 nt, Escherichia coli CFT073
ucacccgguacaucaaua

SEQ ID NO: 577194 - RNA, 19 nt, Escherichia coli CFT073
ucacccgcauaugcggcgc

SEQ ID NO: 577195 - RNA, 19 nt, Escherichia coli CFT073
ucacccgcguuacgccauc

SEQ ID NO: 577196 - RNA, 12 nt, Escherichia coli CFT073
ucaccgccgccu

SEQ ID NO: 577197 - RNA, 13 nt, Escherichia coli CFT073
ucaccggucagac

SEQ ID NO: 577198 - RNA, 21 nt, Escherichia coli CFT073
ucaccgguucaucacgaaaau

SEQ ID NO: 577199 - RNA, 13 nt, Escherichia coli CFT073
ucaauacuggcaa

SEQ ID NO: 577200 - RNA, 21 nt, Escherichia coli CFT073
ucaaggcugauguugauaaag

SEQ ID NO: 577201 - RNA, 20 nt, Escherichia coli CFT073
ucaauagcguugcagauggc

SEQ ID NO: 577202 - RNA, 14 nt, Escherichia coli CFT073
ucaauauccugacc

SEQ ID NO: 577203 - RNA, 17 nt, Escherichia coli CFT073
ucaauaugaauuaacgu

SEQ ID NO: 577204 - RNA, 15 nt, Escherichia coli CFT073
ucaauaugggcacgc

SEQ ID NO: 577205 - RNA, 17 nt, Escherichia coli CFT073
ucaaucacuuucugcgc

SEQ ID NO: 577206 - RNA, 19 nt, Escherichia coli CFT073
ucaaucacuuucugcgcca

SEQ ID NO: 577207 - RNA, 19 nt, Escherichia coli CFT073
ucaaucccuucgacuuuca

SEQ ID NO: 577208 - RNA, 19 nt, Escherichia coli CFT073
ucaaucgcacccgccauca

SEQ ID NO: 577209 - RNA, 12 nt, Escherichia coli CFT073
ucaaucgccaaa

SEQ ID NO: 577210 - RNA, 21 nt, Escherichia coli CFT073
ucaaucucugcaagagauaaa

SEQ ID NO: 577211 - RNA, 14 nt, Escherichia coli CFT073
ucaaugauaacguc

SEQ ID NO: 577212 - RNA, 21 nt, Escherichia coli CFT073
ucaaugauaauucaacagauu

SEQ ID NO: 577213 - RNA, 15 nt, Escherichia coli CFT073
ucaaugaugccgcca

SEQ ID NO: 577214 - RNA, 16 nt, Escherichia coli CFT073
ucaacguuaggcggaa

SEQ ID NO: 577215 - RNA, 12 nt, Escherichia coli CFT073
ucaacucacugu

SEQ ID NO: 577216 - RNA, 16 nt, Escherichia coli CFT073
ucaacgccgcacagcg

SEQ ID NO: 577217 - RNA, 16 nt, Escherichia coli CFT073
ucaacgccgcgugcca

SEQ ID NO: 577218 - RNA, 15 nt, Escherichia coli CFT073
ucaacgcgccgccaa

SEQ ID NO: 577219 - RNA, 18 nt, Escherichia coli CFT073
ucaacggaccaauaaacg

SEQ ID NO: 577220 - RNA, 18 nt, Escherichia coli CFT073
ucaagaacggcaauaaag

SEQ ID NO: 577221 - RNA, 23 nt, Escherichia coli CFT073
ucaacuucgcuuaaccggcuucg

SEQ ID NO: 577222 - RNA, 23 nt, Escherichia coli CFT073
ucaacuuuaaaaucuuugaaaua

SEQ ID NO: 577223 - RNA, 14 nt, Escherichia coli CFT073
ucaagauuaaagca

SEQ ID NO: 577224 - RNA, 22 nt, Escherichia coli CFT073
ucaagcgaaaucaacacgccug

SEQ ID NO: 577225 - RNA, 23 nt, Escherichia coli CFT073
ucaagcugcugacggugauaauc

SEQ ID NO: 577226 - RNA, 22 nt, Escherichia coli CFT073
ucaagcugugccugaauauacg

SEQ ID NO: 577227 - RNA, 19 nt, Escherichia coli CFT073
ucaagcacccgccgcuauu

SEQ ID NO: 577228 - RNA, 13 nt, Escherichia coli CFT073
ucaagcgccgcca

SEQ ID NO: 577229 - RNA, 21 nt, Escherichia coli CFT073
ucaaaucacagcaccuuaugc

SEQ ID NO: 577230 - RNA, 19 nt, Escherichia coli CFT073
ucaaagucucuguuggcga

SEQ ID NO: 577231 - RNA, 22 nt, Escherichia coli CFT073
ucaaaguuaguaaaacuauugu

SEQ ID NO: 577232 - RNA, 18 nt, Escherichia coli CFT073
ucaaauuugccagcgauc

SEQ ID NO: 577233 - RNA, 17 nt, Escherichia coli CFT073
ucaaauuugucgccaac

SEQ ID NO: 577234 - RNA, 16 nt, Escherichia coli CFT073
ucaacaacuggcguuu

SEQ ID NO: 577235 - RNA, 15 nt, Escherichia coli CFT073
ucaacaagccacgca

SEQ ID NO: 577236 - RNA, 15 nt, Escherichia coli CFT073
ucaacacaggccggc

SEQ ID NO: 577237 - RNA, 19 nt, Escherichia coli CFT073
ucaacaccacgcgguagcg

SEQ ID NO: 577238 - RNA, 15 nt, Escherichia coli CFT073
ucaaacggucagucg

SEQ ID NO: 577239 - RNA, 17 nt, Escherichia coli CFT073
ucaaacgguugauaaau

SEQ ID NO: 577240 - RNA, 17 nt, Escherichia coli CFT073
ucaaacguaccgccaga

SEQ ID NO: 577241 - RNA, 20 nt, Escherichia coli CFT073
ucaaaccaauggcguuggca

SEQ ID NO: 577242 - RNA, 14 nt, Escherichia coli CFT073
ucaaacucauaaac

SEQ ID NO: 577243 - RNA, 15 nt, Escherichia coli CFT073
ucaaagaaucaacga

SEQ ID NO: 577244 - RNA, 15 nt, Escherichia coli CFT073
ucaaagcgccagcgc

SEQ ID NO: 577245 - RNA, 20 nt, Escherichia coli CFT073
ucaaccacuacgugaucguc

SEQ ID NO: 577246 - RNA, 21 nt, Escherichia coli CFT073
ucaaccacgccaaccaucggu

SEQ ID NO: 577247 - RNA, 11 nt, Escherichia coli CFT073
ucaaccagcag

SEQ ID NO: 577248 - RNA, 18 nt, Escherichia coli CFT073
ucaacauuaaagcagcuu

SEQ ID NO: 577249 - RNA, 17 nt, Escherichia coli CFT073
ucaacaucuucaccaau

SEQ ID NO: 577250 - RNA, 16 nt, Escherichia coli CFT073
ucaacaccgugacaaa

SEQ ID NO: 577251 - RNA, 14 nt, Escherichia coli CFT073
ucaacacgccugca

SEQ ID NO: 577252 - RNA, 16 nt, Escherichia coli CFT073
ucaacagaaugauauu

SEQ ID NO: 577253 - RNA, 22 nt, Escherichia coli CFT073
ucaacagauuuugcaggccuga

SEQ ID NO: 577254 - RNA, 21 nt, Escherichia coli CFT073
ucaacaguggcgacaagcaua

SEQ ID NO: 577255 - RNA, 14 nt, Escherichia coli CFT073
ucaacauauuacga

SEQ ID NO: 577256 - RNA, 19 nt, Escherichia coli CFT073
ucaaccucuuuuucugccu

SEQ ID NO: 577257 - RNA, 18 nt, Escherichia coli CFT073
ucaaccgcgacauacuua

SEQ ID NO: 577258 - RNA, 15 nt, Escherichia coli CFT073
ucaaccgcgccugac

SEQ ID NO: 577259 - RNA, 16 nt, Escherichia coli CFT073
ucaacccaaccugcca

SEQ ID NO: 577260 - RNA, 20 nt, Escherichia coli CFT073
ucaacccagaaacaggcggc

SEQ ID NO: 577261 - RNA, 12 nt, Escherichia coli CFT073
ucaacccaguug

SEQ ID NO: 577262 - RNA, 13 nt, Escherichia coli CFT073
ucaacccauuucg

SEQ ID NO: 577263 - RNA, 22 nt, Escherichia coli CFT073
ucaaccagcggcgcauccgcca

SEQ ID NO: 577264 - RNA, 16 nt, Escherichia coli CFT073
ucaacgccaccaucac

SEQ ID NO: 577265 - RNA, 21 nt, Escherichia coli CFT073
ucaacgccagauaaauucgac

SEQ ID NO: 577266 - RNA, 21 nt, Escherichia coli CFT073
ucaacgaugcgaccgccgcuc

SEQ ID NO: 577267 - RNA, 17 nt, Escherichia coli CFT073
ucaacgcacuggcgcgc

SEQ ID NO: 577268 - RNA, 20 nt, Escherichia coli CFT073
ucaacgacauaugcguagca

SEQ ID NO: 577269 - RNA, 12 nt, Escherichia coli CFT073
uauuucaccggu

SEQ ID NO: 577270 - RNA, 19 nt, Escherichia coli CFT073
uauugcgacgauaaccggu

SEQ ID NO: 577271 - RNA, 23 nt, Escherichia coli CFT073
uauuuaccagagucuuugcuugc

SEQ ID NO: 577272 - RNA, 18 nt, Escherichia coli CFT073
uauuuugcuuccggcaag

SEQ ID NO: 577273 - RNA, 16 nt, Escherichia coli CFT073
uauuuuguaccguaca

SEQ ID NO: 577274 - RNA, 18 nt, Escherichia coli CFT073
ucaaaagcguaccgccaa

SEQ ID NO: 577275 - RNA, 17 nt, Escherichia coli CFT073
uauuaauuugccagcgu

SEQ ID NO: 577276 - RNA, 23 nt, Escherichia coli CFT073
uauuacauaccagcagcaucacg

SEQ ID NO: 577277 - RNA, 22 nt, Escherichia coli CFT073
uauuacgggucacaaacaucau

SEQ ID NO: 577278 - RNA, 21 nt, Escherichia coli CFT073
uauuacgguaaggauauucau

SEQ ID NO: 577279 - RNA, 15 nt, Escherichia coli CFT073
uaugcugcgccaguu

SEQ ID NO: 577280 - RNA, 18 nt, Escherichia coli CFT073
uaugcgguacugaccauc

SEQ ID NO: 577281 - RNA, 11 nt, Escherichia coli CFT073
uaugccggaug

SEQ ID NO: 577282 - RNA, 18 nt, Escherichia coli CFT073
uauucuuuuuugauucca

SEQ ID NO: 577283 - RNA, 15 nt, Escherichia coli CFT073
uauugaugcucgcug

SEQ ID NO: 577284 - RNA, 16 nt, Escherichia coli CFT073
uauugaguaaauucau

SEQ ID NO: 577285 - RNA, 21 nt, Escherichia coli CFT073
uauugccccggagaaauccgg

SEQ ID NO: 577286 - RNA, 13 nt, Escherichia coli CFT073
uauuacuggcgau

SEQ ID NO: 577287 - RNA, 17 nt, Escherichia coli CFT073
uaucgcccugccagcga

SEQ ID NO: 577288 - RNA, 12 nt, Escherichia coli CFT073
uaucgccagcgc

SEQ ID NO: 577289 - RNA, 16 nt, Escherichia coli CFT073
uaucugcccguaccca

SEQ ID NO: 577290 - RNA, 18 nt, Escherichia coli CFT073
uaucugccggaagacaca

SEQ ID NO: 577291 - RNA, 22 nt, Escherichia coli CFT073
uaucuguguaaugaauggaguu

SEQ ID NO: 577292 - RNA, 23 nt, Escherichia coli CFT073
uaucucgccuuugagcaguuucg

SEQ ID NO: 577293 - RNA, 20 nt, Escherichia coli CFT073
uaucgcggggauaugguggu

SEQ ID NO: 577294 - RNA, 14 nt, Escherichia coli CFT073
uaugcaggcgcuca

SEQ ID NO: 577295 - RNA, 13 nt, Escherichia coli CFT073
uaugccaucgcca

SEQ ID NO: 577296 - RNA, 14 nt, Escherichia coli CFT073
uaugccaucgccag

SEQ ID NO: 577297 - RNA, 19 nt, Escherichia coli CFT073
uaugcccauguucgcggcu

SEQ ID NO: 577298 - RNA, 18 nt, Escherichia coli CFT073
uaugcaaaugagaaucua

SEQ ID NO: 577299 - RNA, 13 nt, Escherichia coli CFT073
uaugcagccuuca

SEQ ID NO: 577300 - RNA, 14 nt, Escherichia coli CFT073
uaucuuuaucugcc

SEQ ID NO: 577301 - RNA, 16 nt, Escherichia coli CFT073
uacuuuuuccagcaga

SEQ ID NO: 577302 - RNA, 13 nt, Escherichia coli CFT073
uagaaugcagcag

SEQ ID NO: 577303 - RNA, 17 nt, Escherichia coli CFT073
uacuugucgauaaacgg

SEQ ID NO: 577304 - RNA, 23 nt, Escherichia coli CFT073
uagagagcagucagguucagcgu

SEQ ID NO: 577305 - RNA, 12 nt, Escherichia coli CFT073
uagagcagcacg

SEQ ID NO: 577306 - RNA, 22 nt, Escherichia coli CFT073
uagacaauguaucuuucaucau

SEQ ID NO: 577307 - RNA, 23 nt, Escherichia coli CFT073
uacucaacuccccgcauuuacuc

SEQ ID NO: 577308 - RNA, 14 nt, Escherichia coli CFT073
uacgccucagccga

SEQ ID NO: 577309 - RNA, 19 nt, Escherichia coli CFT073
uacgccgcacccggcacua

SEQ ID NO: 577310 - RNA, 15 nt, Escherichia coli CFT073
uacgcccucacccgu

SEQ ID NO: 577311 - RNA, 15 nt, Escherichia coli CFT073
uacugcccuuucgcc

SEQ ID NO: 577312 - RNA, 16 nt, Escherichia coli CFT073
uacugccgaccagagc

SEQ ID NO: 577313 - RNA, 19 nt, Escherichia coli CFT073
uacugccguagugaugcau

SEQ ID NO: 577314 - RNA, 17 nt, Escherichia coli CFT073
uacugcagccagcguua

SEQ ID NO: 577315 - RNA, 14 nt, Escherichia coli CFT073
uacugcaauuucau

SEQ ID NO: 577316 - RNA, 14 nt, Escherichia coli CFT073
uacucaagcaacca

SEQ ID NO: 577317 - RNA, 21 nt, Escherichia coli CFT073
uacucaauaguguugccgcca

SEQ ID NO: 577318 - RNA, 21 nt, Escherichia coli CFT073
uacucauccaucucgguuuuc

SEQ ID NO: 577319 - RNA, 13 nt, Escherichia coli CFT073
uacugaucaucau

SEQ ID NO: 577320 - RNA, 16 nt, Escherichia coli CFT073
uagccacauccaugcu

SEQ ID NO: 577321 - RNA, 12 nt, Escherichia coli CFT073
uagccaccaucu

SEQ ID NO: 577322 - RNA, 14 nt, Escherichia coli CFT073
uagcauccaguucc

SEQ ID NO: 577323 - RNA, 24 nt, Escherichia coli CFT073
uagcagugauuuauuuuuacucuu

SEQ ID NO: 577324 - RNA, 23 nt, Escherichia coli CFT073
uagcaguuccagcaucuguucuu

SEQ ID NO: 577325 - RNA, 18 nt, Escherichia coli CFT073
uagcauccccggcaacca

SEQ ID NO: 577326 - RNA, 19 nt, Escherichia coli CFT073
uagcaugaacauugcugcu

SEQ ID NO: 577327 - RNA, 17 nt, Escherichia coli CFT073
uagccccggccaguacg

SEQ ID NO: 577328 - RNA, 16 nt, Escherichia coli CFT073
uagcgcaugacaugcg

SEQ ID NO: 577329 - RNA, 23 nt, Escherichia coli CFT073
uagcgcaaucgcuguacucacca

SEQ ID NO: 577330 - RNA, 18 nt, Escherichia coli CFT073
uagcgaucuguucaucag

SEQ ID NO: 577331 - RNA, 22 nt, Escherichia coli CFT073
uagccgccugcgaguuuuaccu

SEQ ID NO: 577332 - RNA, 19 nt, Escherichia coli CFT073
uagccgccaucguugagca

SEQ ID NO: 577333 - RNA, 16 nt, Escherichia coli CFT073
uacauaccagcagcau

SEQ ID NO: 577334 - RNA, 12 nt, Escherichia coli CFT073
uacaguuuccuu

SEQ ID NO: 577335 - RNA, 13 nt, Escherichia coli CFT073
uacauauauuacu

SEQ ID NO: 577336 - RNA, 21 nt, Escherichia coli CFT073
uaccaccaaaugcagcaacca

SEQ ID NO: 577337 - RNA, 15 nt, Escherichia coli CFT073
uaccacagcaaaacg

SEQ ID NO: 577338 - RNA, 14 nt, Escherichia coli CFT073
uaccacgcaaagca

SEQ ID NO: 577339 - RNA, 22 nt, Escherichia coli CFT073
uaccacuucauccggauacagc

SEQ ID NO: 577340 - RNA, 16 nt, Escherichia coli CFT073
uaccagcggacggcug

SEQ ID NO: 577341 - RNA, 14 nt, Escherichia coli CFT073
uacccacuguaucg

SEQ ID NO: 577342 - RNA, 12 nt, Escherichia coli CFT073
uacccagcaaug

SEQ ID NO: 577343 - RNA, 19 nt, Escherichia coli CFT073
uacccagcacggauaccgc

SEQ ID NO: 577344 - RNA, 15 nt, Escherichia coli CFT073
uaccccaucagcgua

SEQ ID NO: 577345 - RNA, 21 nt, Escherichia coli CFT073
uaccaggugugcgcgguaaag

SEQ ID NO: 577346 - RNA, 18 nt, Escherichia coli CFT073
uaccagucgauauuacgg

SEQ ID NO: 577347 - RNA, 14 nt, Escherichia coli CFT073
uaccagugccagaa

SEQ ID NO: 577348 - RNA, 14 nt, Escherichia coli CFT073
uaccaucgacacca

SEQ ID NO: 577349 - RNA, 20 nt, Escherichia coli CFT073
uaccaugcaccaacccuaac

SEQ ID NO: 577350 - RNA, 23 nt, Escherichia coli CFT073
uaccaugggaaauggcuggucag

SEQ ID NO: 577351 - RNA, 19 nt, Escherichia coli CFT073
uaccauugaucgauaagcc

SEQ ID NO: 577352 - RNA, 18 nt, Escherichia coli CFT073
uaccauuugcgcggaucc

SEQ ID NO: 577353 - RNA, 21 nt, Escherichia coli CFT073
uaccaguuuggugacgccaca

SEQ ID NO: 577354 - RNA, 19 nt, Escherichia coli CFT073
uacccaaugaccacuccgg

SEQ ID NO: 577355 - RNA, 13 nt, Escherichia coli CFT073
uaccgaauccagc

SEQ ID NO: 577356 - RNA, 15 nt, Escherichia coli CFT073
uacccugguuagcaa

SEQ ID NO: 577357 - RNA, 18 nt, Escherichia coli CFT073
uacccgcgcuuuuucgga

SEQ ID NO: 577358 - RNA, 14 nt, Escherichia coli CFT073
uaccccgccagcag

SEQ ID NO: 577359 - RNA, 15 nt, Escherichia coli CFT073
uaccccgccagcaga

SEQ ID NO: 577360 - RNA, 14 nt, Escherichia coli CFT073
uaccguaggccagc

SEQ ID NO: 577361 - RNA, 21 nt, Escherichia coli CFT073
uaccgggcgcgaggccagcgg

SEQ ID NO: 577362 - RNA, 17 nt, Escherichia coli CFT073
uaccggugccagcaacu

SEQ ID NO: 577363 - RNA, 20 nt, Escherichia coli CFT073
uacgauggugcacgaugcau

SEQ ID NO: 577364 - RNA, 15 nt, Escherichia coli CFT073
uacgccauucgcugu

SEQ ID NO: 577365 - RNA, 20 nt, Escherichia coli CFT073
uacgcccauauggucggcua

SEQ ID NO: 577366 - RNA, 15 nt, Escherichia coli CFT073
uacgccauccccgaa

SEQ ID NO: 577367 - RNA, 17 nt, Escherichia coli CFT073
uaccgcccacuaccagc

SEQ ID NO: 577368 - RNA, 15 nt, Escherichia coli CFT073
uaccgcaccaccagc

SEQ ID NO: 577369 - RNA, 16 nt, Escherichia coli CFT073
uaccgacgaucaacag

SEQ ID NO: 577370 - RNA, 21 nt, Escherichia coli CFT073
uaccgagcguucaaaacggcu

SEQ ID NO: 577371 - RNA, 17 nt, Escherichia coli CFT073
uaccgaucaguaccagc

SEQ ID NO: 577372 - RNA, 18 nt, Escherichia coli CFT073
uaccggcccaccaaagaa

SEQ ID NO: 577373 - RNA, 18 nt, Escherichia coli CFT073
uaccggcgucccaucggc

SEQ ID NO: 577374 - RNA, 20 nt, Escherichia coli CFT073
uaccggaaaaggccacggug

SEQ ID NO: 577375 - RNA, 18 nt, Escherichia coli CFT073
uaccggaugcucacagag

SEQ ID NO: 577376 - RNA, 16 nt, Escherichia coli CFT073
uaccgccugcaaauaa

SEQ ID NO: 577377 - RNA, 15 nt, Escherichia coli CFT073
uaacuccugauucca

SEQ ID NO: 577378 - RNA, 17 nt, Escherichia coli CFT073
uaacucugaugacugau

SEQ ID NO: 577379 - RNA, 21 nt, Escherichia coli CFT073
uaacucugaugacugaugcuu

SEQ ID NO: 577380 - RNA, 15 nt, Escherichia coli CFT073
uaacucuugccagau

SEQ ID NO: 577381 - RNA, 16 nt, Escherichia coli CFT073
uaacucacuggcgcgc

SEQ ID NO: 577382 - RNA, 16 nt, Escherichia coli CFT073
uaacucaggaugagaa

SEQ ID NO: 577383 - RNA, 18 nt, Escherichia coli CFT073
uaacucagguggcgguau

SEQ ID NO: 577384 - RNA, 13 nt, Escherichia coli CFT073
uaacugcccgcau

SEQ ID NO: 577385 - RNA, 22 nt, Escherichia coli CFT073
uaacuguucgagguaauccagc

SEQ ID NO: 577386 - RNA, 14 nt, Escherichia coli CFT073
uaagccgccgccau

SEQ ID NO: 577387 - RNA, 15 nt, Escherichia coli CFT073
uaagccgccgccauc

SEQ ID NO: 577388 - RNA, 13 nt, Escherichia coli CFT073
uaagcccaguuca

SEQ ID NO: 577389 - RNA, 15 nt, Escherichia coli CFT073
uaaguggaacuaaca

SEQ ID NO: 577390 - RNA, 17 nt, Escherichia coli CFT073
uaaguguuguauuauau

SEQ ID NO: 577391 - RNA, 18 nt, Escherichia coli CFT073
uaagcgacgggcgacaaa

SEQ ID NO: 577392 - RNA, 22 nt, Escherichia coli CFT073
uaagcgagaacugccuuaaacu

SEQ ID NO: 577393 - RNA, 15 nt, Escherichia coli CFT073
uaagcgcaugaacgu

SEQ ID NO: 577394 - RNA, 21 nt, Escherichia coli CFT073
uaagcggcaaaccggacgauc

SEQ ID NO: 577395 - RNA, 17 nt, Escherichia coli CFT073
uaaugacagcggcguuu

SEQ ID NO: 577396 - RNA, 17 nt, Escherichia coli CFT073
uaaugacgauaaaagug

SEQ ID NO: 577397 - RNA, 21 nt, Escherichia coli CFT073
uaaucgccuuacccugaccgu

SEQ ID NO: 577398 - RNA, 18 nt, Escherichia coli CFT073
uaaucggcgcggcgguug

SEQ ID NO: 577399 - RNA, 15 nt, Escherichia coli CFT073
uaaucgucaucagcg

SEQ ID NO: 577400 - RNA, 19 nt, Escherichia coli CFT073
uaaugaucccuucacuucu

SEQ ID NO: 577401 - RNA, 16 nt, Escherichia coli CFT073
uaauccugaaagcgug

SEQ ID NO: 577402 - RNA, 11 nt, Escherichia coli CFT073
uaauccgcugu

SEQ ID NO: 577403 - RNA, 20 nt, Escherichia coli CFT073
uaauccagcgucgccagcag

SEQ ID NO: 577404 - RNA, 23 nt, Escherichia coli CFT073
uaauccagugccggaugauucac

SEQ ID NO: 577405 - RNA, 21 nt, Escherichia coli CFT073
uaaucgaacuccaguagcgag

SEQ ID NO: 577406 - RNA, 15 nt, Escherichia coli CFT073
uaaucgacgaggaaa

SEQ ID NO: 577407 - RNA, 22 nt, Escherichia coli CFT073
uaaucgccgcauaauaucuuuc

SEQ ID NO: 577408 - RNA, 22 nt, Escherichia coli CFT073
uaaucaucuguugugccacauc

SEQ ID NO: 577409 - RNA, 13 nt, Escherichia coli CFT073
uaauucaaaaacc

SEQ ID NO: 577410 - RNA, 11 nt, Escherichia coli CFT073
uaauucaacgc

SEQ ID NO: 577411 - RNA, 20 nt, Escherichia coli CFT073
uaauucccugugccagcggc

SEQ ID NO: 577412 - RNA, 19 nt, Escherichia coli CFT073
uaauuaccagcgcaggaac

SEQ ID NO: 577413 - RNA, 16 nt, Escherichia coli CFT073
uaauuagcuguuggca

SEQ ID NO: 577414 - RNA, 20 nt, Escherichia coli CFT073
uaauuaucaaucuccgccuc

SEQ ID NO: 577415 - RNA, 11 nt, Escherichia coli CFT073
uaauuugccag

SEQ ID NO: 577416 - RNA, 13 nt, Escherichia coli CFT073
uaaugccaguuca

SEQ ID NO: 577417 - RNA, 14 nt, Escherichia coli CFT073
uaaugcccaucagu

SEQ ID NO: 577418 - RNA, 19 nt, Escherichia coli CFT073
uaauguguucaacuucgag

SEQ ID NO: 577419 - RNA, 18 nt, Escherichia coli CFT073
uaaugauucauaaacaau

SEQ ID NO: 577420 - RNA, 17 nt, Escherichia coli CFT073
uaaugcacuuccagcgg

SEQ ID NO: 577421 - RNA, 23 nt, Escherichia coli CFT073
uacacaaccgccggaugcggcgu

SEQ ID NO: 577422 - RNA, 22 nt, Escherichia coli CFT073
uacacaaugccugaugcgcuuc

SEQ ID NO: 577423 - RNA, 21 nt, Escherichia coli CFT073
uacaccaccaccgacaccgca

SEQ ID NO: 577424 - RNA, 13 nt, Escherichia coli CFT073
uacaccgcagccg

SEQ ID NO: 577425 - RNA, 18 nt, Escherichia coli CFT073
uacaccgcagccgccaca

SEQ ID NO: 577426 - RNA, 14 nt, Escherichia coli CFT073
uacagcccgccgga

SEQ ID NO: 577427 - RNA, 13 nt, Escherichia coli CFT073
uacagccgccaga

SEQ ID NO: 577428 - RNA, 14 nt, Escherichia coli CFT073
uacagccagcaaua

SEQ ID NO: 577429 - RNA, 15 nt, Escherichia coli CFT073
uaacgaugccagcgc

SEQ ID NO: 577430 - RNA, 13 nt, Escherichia coli CFT073
uaacguuuaagau

SEQ ID NO: 577431 - RNA, 18 nt, Escherichia coli CFT073
uaacguuugccagccaca

SEQ ID NO: 577432 - RNA, 15 nt, Escherichia coli CFT073
uaacgccagugaugu

SEQ ID NO: 577433 - RNA, 21 nt, Escherichia coli CFT073
uaacgccccacaagcccgcca

SEQ ID NO: 577434 - RNA, 17 nt, Escherichia coli CFT073
uaacgccgcgcccgcua

SEQ ID NO: 577435 - RNA, 18 nt, Escherichia coli CFT073
uaacgauaccaacgcauu

SEQ ID NO: 577436 - RNA, 15 nt, Escherichia coli CFT073
uaacgaucacggcga

SEQ ID NO: 577437 - RNA, 18 nt, Escherichia coli CFT073
uaacgcacaguacgcgcc

SEQ ID NO: 577438 - RNA, 19 nt, Escherichia coli CFT073
uaaccaaccaccaaagaug

SEQ ID NO: 577439 - RNA, 22 nt, Escherichia coli CFT073
uaaccaaacguggucgccagca

SEQ ID NO: 577440 - RNA, 14 nt, Escherichia coli CFT073
uaacaccaucagug

SEQ ID NO: 577441 - RNA, 15 nt, Escherichia coli CFT073
uaacaccaccagcgc

SEQ ID NO: 577442 - RNA, 13 nt, Escherichia coli CFT073
uaacaaucaucaa

SEQ ID NO: 577443 - RNA, 20 nt, Escherichia coli CFT073
uaacacauaacgccaauuca

SEQ ID NO: 577444 - RNA, 22 nt, Escherichia coli CFT073
uaaccaccuccacgcccagcgc

SEQ ID NO: 577445 - RNA, 21 nt, Escherichia coli CFT073
uaaccacgcucagcaaucgca

SEQ ID NO: 577446 - RNA, 18 nt, Escherichia coli CFT073
uaaccacuucagaaccgu

SEQ ID NO: 577447 - RNA, 21 nt, Escherichia coli CFT073
uaaccagacgccccaguaaac

SEQ ID NO: 577448 - RNA, 10 nt, Escherichia coli CFT073
uaaccagcac

SEQ ID NO: 577449 - RNA, 15 nt, Escherichia coli CFT073
uaaccaggcaguucg

SEQ ID NO: 577450 - RNA, 16 nt, Escherichia coli CFT073
uaaccauggcuggcac

SEQ ID NO: 577451 - RNA, 15 nt, Escherichia coli CFT073
uaaaugcacccgcca

SEQ ID NO: 577452 - RNA, 16 nt, Escherichia coli CFT073
uaaaugcuuuauacga

SEQ ID NO: 577453 - RNA, 12 nt, Escherichia coli CFT073
uaacaaacggcg

SEQ ID NO: 577454 - RNA, 18 nt, Escherichia coli CFT073
uaaagucauucaggcgua

SEQ ID NO: 577455 - RNA, 19 nt, Escherichia coli CFT073
uaaauaacagugccgcgca

SEQ ID NO: 577456 - RNA, 12 nt, Escherichia coli CFT073
uaaauaaugcuu

SEQ ID NO: 577457 - RNA, 16 nt, Escherichia coli CFT073
uaaaguguuccggcug

SEQ ID NO: 577458 - RNA, 17 nt, Escherichia coli CFT073
uaaauaccggcauguuu

SEQ ID NO: 577459 - RNA, 14 nt, Escherichia coli CFT073
uaaauccgccgcca

SEQ ID NO: 577460 - RNA, 15 nt, Escherichia coli CFT073
uaaauccgccgccac

SEQ ID NO: 577461 - RNA, 17 nt, Escherichia coli CFT073
uaaaucccgucuggcga

SEQ ID NO: 577462 - RNA, 18 nt, Escherichia coli CFT073
uaaaucgacguucugcca

SEQ ID NO: 577463 - RNA, 17 nt, Escherichia coli CFT073
uaaaucgcccacggcgg

SEQ ID NO: 577464 - RNA, 19 nt, Escherichia coli CFT073
uaaaccacccaccagcgcc

SEQ ID NO: 577465 - RNA, 23 nt, Escherichia coli CFT073
uaaaccacugacacaggcagcaa

SEQ ID NO: 577466 - RNA, 13 nt, Escherichia coli CFT073
uaaacccggccug

SEQ ID NO: 577467 - RNA, 13 nt, Escherichia coli CFT073
uaaaauauaaggu

SEQ ID NO: 577468 - RNA, 14 nt, Escherichia coli CFT073
uaaaauaucacucg

SEQ ID NO: 577469 - RNA, 15 nt, Escherichia coli CFT073
uaaacccuuucugcu

SEQ ID NO: 577470 - RNA, 15 nt, Escherichia coli CFT073
uaaaccgugauauug

SEQ ID NO: 577471 - RNA, 21 nt, Escherichia coli CFT073
uaaacuucaacgcugcggcgu

SEQ ID NO: 577472 - RNA, 16 nt, Escherichia coli CFT073
uaaacugucaacacca

SEQ ID NO: 577473 - RNA, 16 nt, Escherichia coli CFT073
uaaaguacaauaucgc

SEQ ID NO: 577474 - RNA, 19 nt, Escherichia coli CFT073
uaaagauguuuugccugaa

SEQ ID NO: 577475 - RNA, 17 nt, Escherichia coli CFT073
uaaagauauugucgccc

SEQ ID NO: 577476 - RNA, 18 nt, Escherichia coli CFT073
uaaagaacgcaccgacca

SEQ ID NO: 577477 - RNA, 15 nt, Escherichia coli CFT073
guuucagccccauca

SEQ ID NO: 577478 - RNA, 18 nt, Escherichia coli CFT073
guuucaccgaugcacaga

SEQ ID NO: 577479 - RNA, 20 nt, Escherichia coli CFT073
guuucaccgaugcacagaac

SEQ ID NO: 577480 - RNA, 20 nt, Escherichia coli CFT073
guuucagagcgaauuaagaa

SEQ ID NO: 577481 - RNA, 15 nt, Escherichia coli CFT073
guuuauucacauaga

SEQ ID NO: 577482 - RNA, 13 nt, Escherichia coli CFT073
guuuaaugccggc

SEQ ID NO: 577483 - RNA, 20 nt, Escherichia coli CFT073
guuucaauauccgguucacu

SEQ ID NO: 577484 - RNA, 14 nt, Escherichia coli CFT073
guuucacacugaca

SEQ ID NO: 577485 - RNA, 17 nt, Escherichia coli CFT073
uaaaacaagcagcugcc

SEQ ID NO: 577486 - RNA, 18 nt, Escherichia coli CFT073
uaaaaauaccgagcagcc

SEQ ID NO: 577487 - RNA, 23 nt, Escherichia coli CFT073
uaaaacacaucagugauacaucu

SEQ ID NO: 577488 - RNA, 15 nt, Escherichia coli CFT073
uaaaacagccaaugc

SEQ ID NO: 577489 - RNA, 22 nt, Escherichia coli CFT073
uaaaagcuguacaucgcgccaa

SEQ ID NO: 577490 - RNA, 13 nt, Escherichia coli CFT073
uaaaagcaaacug

SEQ ID NO: 577491 - RNA, 20 nt, Escherichia coli CFT073
uaaaagccauucuggcgcaa

SEQ ID NO: 577492 - RNA, 15 nt, Escherichia coli CFT073
uaaaagcccaucauu

SEQ ID NO: 577493 - RNA, 16 nt, Escherichia coli CFT073
uaaaagcccggaugcg

SEQ ID NO: 577494 - RNA, 22 nt, Escherichia coli CFT073
guucccguccgcacgcuggaga

SEQ ID NO: 577495 - RNA, 15 nt, Escherichia coli CFT073
guucccccugccaga

SEQ ID NO: 577496 - RNA, 20 nt, Escherichia coli CFT073
guuccugccagucuuccgcc

SEQ ID NO: 577497 - RNA, 11 nt, Escherichia coli CFT073
guucgccauca

SEQ ID NO: 577498 - RNA, 15 nt, Escherichia coli CFT073
guucgcaaucgcgcc

SEQ ID NO: 577499 - RNA, 18 nt, Escherichia coli CFT073
guucgcaccaaauccaac

SEQ ID NO: 577500 - RNA, 23 nt, Escherichia coli CFT073
guucgaugcgauaaccaggcagu

SEQ ID NO: 577501 - RNA, 15 nt, Escherichia coli CFT073
guuccugaucgauaa

SEQ ID NO: 577502 - RNA, 21 nt, Escherichia coli CFT073
guucgguaaguuaccggcaau

SEQ ID NO: 577503 - RNA, 14 nt, Escherichia coli CFT073
guucggcggaugca

SEQ ID NO: 577504 - RNA, 22 nt, Escherichia coli CFT073
guucuggucgcggaccaacaaa

SEQ ID NO: 577505 - RNA, 16 nt, Escherichia coli CFT073
guucuggaaaaaauuc

SEQ ID NO: 577506 - RNA, 16 nt, Escherichia coli CFT073
guucuguggcagggca

SEQ ID NO: 577507 - RNA, 13 nt, Escherichia coli CFT073
guucugugguugg

SEQ ID NO: 577508 - RNA, 24 nt, Escherichia coli CFT073
guucuucgagugucacuggccagc

SEQ ID NO: 577509 - RNA, 22 nt, Escherichia coli CFT073
guucuucgccauaacaaauauc

SEQ ID NO: 577510 - RNA, 13 nt, Escherichia coli CFT073
guucuucggcgcu

SEQ ID NO: 577511 - RNA, 14 nt, Escherichia coli CFT073
guucuuucggugca

SEQ ID NO: 577512 - RNA, 15 nt, Escherichia coli CFT073
guucuuucucgccuu

SEQ ID NO: 577513 - RNA, 11 nt, Escherichia coli CFT073
guucgcugccu

SEQ ID NO: 577514 - RNA, 18 nt, Escherichia coli CFT073
guucgccuuugauuuuca

SEQ ID NO: 577515 - RNA, 17 nt, Escherichia coli CFT073
guucgccuuccagcagc

SEQ ID NO: 577516 - RNA, 18 nt, Escherichia coli CFT073
guucgccuuccagcagcu

SEQ ID NO: 577517 - RNA, 20 nt, Escherichia coli CFT073
guucgccuuccagcagcuug

SEQ ID NO: 577518 - RNA, 17 nt, Escherichia coli CFT073
guuuaauaaucgcauca

SEQ ID NO: 577519 - RNA, 19 nt, Escherichia coli CFT073
guuuaagcacuuuaucgau

SEQ ID NO: 577520 - RNA, 18 nt, Escherichia coli CFT073
guuguugauaagccccag

SEQ ID NO: 577521 - RNA, 17 nt, Escherichia coli CFT073
guuguuuaccaacgccg

SEQ ID NO: 577522 - RNA, 12 nt, Escherichia coli CFT073
guuguucugcga

SEQ ID NO: 577523 - RNA, 22 nt, Escherichia coli CFT073
guugucgguaauugcgccguug

SEQ ID NO: 577524 - RNA, 18 nt, Escherichia coli CFT073
guugguccacacgcgccc

SEQ ID NO: 577525 - RNA, 23 nt, Escherichia coli CFT073
guugcucuucguuaauuucugcu

SEQ ID NO: 577526 - RNA, 19 nt, Escherichia coli CFT073
guuggcgauaaaacccaga

SEQ ID NO: 577527 - RNA, 23 nt, Escherichia coli CFT073
guuggcgacgucgguuuccagca

SEQ ID NO: 577528 - RNA, 17 nt, Escherichia coli CFT073
guugcugacgaucggca

SEQ ID NO: 577529 - RNA, 17 nt, Escherichia coli CFT073
guuggcgucagaccggc

SEQ ID NO: 577530 - RNA, 15 nt, Escherichia coli CFT073
guuggcgauugcaua

SEQ ID NO: 577531 - RNA, 18 nt, Escherichia coli CFT073
guugcccuuugcuggcau

SEQ ID NO: 577532 - RNA, 13 nt, Escherichia coli CFT073
guugcgaacuuca

SEQ ID NO: 577533 - RNA, 15 nt, Escherichia coli CFT073
guugcguucaucagu

SEQ ID NO: 577534 - RNA, 12 nt, Escherichia coli CFT073
guugaucgccac

SEQ ID NO: 577535 - RNA, 19 nt, Escherichia coli CFT073
guugaucccugcaccaaug

SEQ ID NO: 577536 - RNA, 17 nt, Escherichia coli CFT073
guugaccugcgaccggc

SEQ ID NO: 577537 - RNA, 19 nt, Escherichia coli CFT073
guugccauugccgcacucu

SEQ ID NO: 577538 - RNA, 18 nt, Escherichia coli CFT073
guugaugccggaugcggc

SEQ ID NO: 577539 - RNA, 12 nt, Escherichia coli CFT073
guuauaacucuu

SEQ ID NO: 577540 - RNA, 18 nt, Escherichia coli CFT073
guuauaugaauacgcgau

SEQ ID NO: 577541 - RNA, 14 nt, Escherichia coli CFT073
guuaucagacacca

SEQ ID NO: 577542 - RNA, 15 nt, Escherichia coli CFT073
guuauccagcaacca

SEQ ID NO: 577543 - RNA, 18 nt, Escherichia coli CFT073
guuaucgcccugccagcg

SEQ ID NO: 577544 - RNA, 21 nt, Escherichia coli CFT073
guuaucgcccugccagcgaua

SEQ ID NO: 577545 - RNA, 19 nt, Escherichia coli CFT073
guuaucgccugcgccacca

SEQ ID NO: 577546 - RNA, 23 nt, Escherichia coli CFT073
guuaucgcucgucgcgacgacca

SEQ ID NO: 577547 - RNA, 21 nt, Escherichia coli CFT073
guuaucgcugagccgacgcca

SEQ ID NO: 577548 - RNA, 14 nt, Escherichia coli CFT073
guuaucugaccguu

SEQ ID NO: 577549 - RNA, 21 nt, Escherichia coli CFT073
guuauguacgcguaaaauauu

SEQ ID NO: 577550 - RNA, 16 nt, Escherichia coli CFT073
guuauggcaaucuucc

SEQ ID NO: 577551 - RNA, 22 nt, Escherichia coli CFT073
guuauuauuacguccaccagaa

SEQ ID NO: 577552 - RNA, 15 nt, Escherichia coli CFT073
guuauuauucauaaa

SEQ ID NO: 577553 - RNA, 12 nt, Escherichia coli CFT073
guuauucaauua

SEQ ID NO: 577554 - RNA, 12 nt, Escherichia coli CFT073
guuauucaucgc

SEQ ID NO: 577555 - RNA, 23 nt, Escherichia coli CFT073
guucaaucaaauagccugccagu

SEQ ID NO: 577556 - RNA, 21 nt, Escherichia coli CFT073
guucaaucauuugcaccaggc

SEQ ID NO: 577557 - RNA, 23 nt, Escherichia coli CFT073
guucaaugcgccggcgcaccggu

SEQ ID NO: 577558 - RNA, 17 nt, Escherichia coli CFT073
guucaagacgaauaccu

SEQ ID NO: 577559 - RNA, 20 nt, Escherichia coli CFT073
guuauuuguugccggaugcg

SEQ ID NO: 577560 - RNA, 18 nt, Escherichia coli CFT073
guuagcgugcaggacggu

SEQ ID NO: 577561 - RNA, 12 nt, Escherichia coli CFT073
guuagucucuuc

SEQ ID NO: 577562 - RNA, 17 nt, Escherichia coli CFT073
guuagccggauaagcaa

SEQ ID NO: 577563 - RNA, 22 nt, Escherichia coli CFT073
guuagcggacucaccgagcagc

SEQ ID NO: 577564 - RNA, 15 nt, Escherichia coli CFT073
guuacgccgcauccg

SEQ ID NO: 577565 - RNA, 18 nt, Escherichia coli CFT073
guuacuaccggcgugcgu

SEQ ID NO: 577566 - RNA, 16 nt, Escherichia coli CFT073
guuacugacaucgcuu

SEQ ID NO: 577567 - RNA, 15 nt, Escherichia coli CFT073
guuacuucgcauccg

SEQ ID NO: 577568 - RNA, 19 nt, Escherichia coli CFT073
guuacuugucgauaaacgg

SEQ ID NO: 577569 - RNA, 15 nt, Escherichia coli CFT073
guuagaaaacgccug

SEQ ID NO: 577570 - RNA, 19 nt, Escherichia coli CFT073
guuagaacccaacagauga

SEQ ID NO: 577571 - RNA, 19 nt, Escherichia coli CFT073
guuaauucuuaacaccggc

SEQ ID NO: 577572 - RNA, 15 nt, Escherichia coli CFT073
guuaauugacaaggu

SEQ ID NO: 577573 - RNA, 20 nt, Escherichia coli CFT073
guuaaugcuccccuuucuua

SEQ ID NO: 577574 - RNA, 15 nt, Escherichia coli CFT073
guuaccagcaccguc

SEQ ID NO: 577575 - RNA, 14 nt, Escherichia coli CFT073
guuacaaccacaua

SEQ ID NO: 577576 - RNA, 16 nt, Escherichia coli CFT073
guuacccgacgcgcca

SEQ ID NO: 577577 - RNA, 19 nt, Escherichia coli CFT073
guuaccgccagcaccgggc

SEQ ID NO: 577578 - RNA, 19 nt, Escherichia coli CFT073
guuaccgccuuaacgcggc

SEQ ID NO: 577579 - RNA, 22 nt, Escherichia coli CFT073
guuaccgccuuaacgcggcggu

SEQ ID NO: 577580 - RNA, 18 nt, Escherichia coli CFT073
guuaccgcgucuucaucu

SEQ ID NO: 577581 - RNA, 17 nt, Escherichia coli CFT073
guuacgccccgguuucu

SEQ ID NO: 577582 - RNA, 22 nt, Escherichia coli CFT073
guuccagcuucagauucagcgu

SEQ ID NO: 577583 - RNA, 17 nt, Escherichia coli CFT073
guuccaguucacgaacg

SEQ ID NO: 577584 - RNA, 17 nt, Escherichia coli CFT073
guuccagcagcuccggc

SEQ ID NO: 577585 - RNA, 18 nt, Escherichia coli CFT073
guuccacgucacaggcca

SEQ ID NO: 577586 - RNA, 20 nt, Escherichia coli CFT073
guuccacauaaaguagccaa

SEQ ID NO: 577587 - RNA, 19 nt, Escherichia coli CFT073
guucauuucacgcagcgga

SEQ ID NO: 577588 - RNA, 18 nt, Escherichia coli CFT073
guucauuuuguaggccug

SEQ ID NO: 577589 - RNA, 12 nt, Escherichia coli CFT073
guucaucaugaa

SEQ ID NO: 577590 - RNA, 17 nt, Escherichia coli CFT073
guucaucgauagaacgg

SEQ ID NO: 577591 - RNA, 18 nt, Escherichia coli CFT073
guucacgccgcauccggc

SEQ ID NO: 577592 - RNA, 19 nt, Escherichia coli CFT073
guucaccugguucagucgu

SEQ ID NO: 577593 - RNA, 18 nt, Escherichia coli CFT073
guucacccgguccgcgaa

SEQ ID NO: 577594 - RNA, 18 nt, Escherichia coli CFT073
guucagcaguucugccag

SEQ ID NO: 577595 - RNA, 16 nt, Escherichia coli CFT073
guucacugcgaccagc

SEQ ID NO: 577596 - RNA, 20 nt, Escherichia coli CFT073
guucagaaagcgccagcaag

SEQ ID NO: 577597 - RNA, 15 nt, Escherichia coli CFT073
guucagugaccgaac

SEQ ID NO: 577598 - RNA, 23 nt, Escherichia coli CFT073
gugcgugcgcccaucauugcgcc

SEQ ID NO: 577599 - RNA, 14 nt, Escherichia coli CFT073
gugcguugaccgcc

SEQ ID NO: 577600 - RNA, 23 nt, Escherichia coli CFT073
guggugccagugcacuaccguaa

SEQ ID NO: 577601 - RNA, 18 nt, Escherichia coli CFT073
gugcuaauugcaccaucc

SEQ ID NO: 577602 - RNA, 18 nt, Escherichia coli CFT073
gugguguaaccuucaccc

SEQ ID NO: 577603 - RNA, 15 nt, Escherichia coli CFT073
gugguggcuucacgc

SEQ ID NO: 577604 - RNA, 21 nt, Escherichia coli CFT073
guguagcggguguaggccgga

SEQ ID NO: 577605 - RNA, 18 nt, Escherichia coli CFT073
guguaggccggauaaggu

SEQ ID NO: 577606 - RNA, 14 nt, Escherichia coli CFT073
guguaccgguagca

SEQ ID NO: 577607 - RNA, 15 nt, Escherichia coli CFT073
guguaacccgccuga

SEQ ID NO: 577608 - RNA, 18 nt, Escherichia coli CFT073
guguaagaaaggcagaga

SEQ ID NO: 577609 - RNA, 12 nt, Escherichia coli CFT073
guguaucagguc

SEQ ID NO: 577610 - RNA, 18 nt, Escherichia coli CFT073
guguauguuggcuuuaua

SEQ ID NO: 577611 - RNA, 22 nt, Escherichia coli CFT073
gugucaauaauauuuguacugu

SEQ ID NO: 577612 - RNA, 18 nt, Escherichia coli CFT073
gugucacggugucgguau

SEQ ID NO: 577613 - RNA, 19 nt, Escherichia coli CFT073
gugucgauaccgaagugga

SEQ ID NO: 577614 - RNA, 15 nt, Escherichia coli CFT073
gugucuuuucaggcc

SEQ ID NO: 577615 - RNA, 12 nt, Escherichia coli CFT073
guguucaugacc

SEQ ID NO: 577616 - RNA, 16 nt, Escherichia coli CFT073
guguucccgcgccagc

SEQ ID NO: 577617 - RNA, 18 nt, Escherichia coli CFT073
guguuaaugcccaucagu

SEQ ID NO: 577618 - RNA, 13 nt, Escherichia coli CFT073
guguuauccgccg

SEQ ID NO: 577619 - RNA, 22 nt, Escherichia coli CFT073
guguucacgccgcauccggcau

SEQ ID NO: 577620 - RNA, 14 nt, Escherichia coli CFT073
guguggaugccuga

SEQ ID NO: 577621 - RNA, 13 nt, Escherichia coli CFT073
guuaaaauuucac

SEQ ID NO: 577622 - RNA, 22 nt, Escherichia coli CFT073
guuaaauaacggccuggcacgu

SEQ ID NO: 577623 - RNA, 17 nt, Escherichia coli CFT073
guuaaaucaggaaaacg

SEQ ID NO: 577624 - RNA, 15 nt, Escherichia coli CFT073
guuaacagcgcacca

SEQ ID NO: 577625 - RNA, 23 nt, Escherichia coli CFT073
guuaacccacagcgcaccaacgg

SEQ ID NO: 577626 - RNA, 15 nt, Escherichia coli CFT073
guuaacgccgcgccc

SEQ ID NO: 577627 - RNA, 16 nt, Escherichia coli CFT073
guuaacggauaacguu

SEQ ID NO: 577628 - RNA, 16 nt, Escherichia coli CFT073
guuaagcgucgcauca

SEQ ID NO: 577629 - RNA, 23 nt, Escherichia coli CFT073
guuaaucaaaucaacaaccugca

SEQ ID NO: 577630 - RNA, 18 nt, Escherichia coli CFT073
guuaaucgccugcugaau

SEQ ID NO: 577631 - RNA, 13 nt, Escherichia coli CFT073
guuaaucggauga

SEQ ID NO: 577632 - RNA, 12 nt, Escherichia coli CFT073
guguugagcaau

SEQ ID NO: 577633 - RNA, 16 nt, Escherichia coli CFT073
guguugaucacauaau

SEQ ID NO: 577634 - RNA, 16 nt, Escherichia coli CFT073
guguugcaccaucagg

SEQ ID NO: 577635 - RNA, 14 nt, Escherichia coli CFT073
guguugcauccggc

SEQ ID NO: 577636 - RNA, 15 nt, Escherichia coli CFT073
guguugcuccacgcc

SEQ ID NO: 577637 - RNA, 15 nt, Escherichia coli CFT073
guguuggcggcagau

SEQ ID NO: 577638 - RNA, 18 nt, Escherichia coli CFT073
guguuguaaaacgcgccc

SEQ ID NO: 577639 - RNA, 16 nt, Escherichia coli CFT073
guguuuaucuuccagc

SEQ ID NO: 577640 - RNA, 19 nt, Escherichia coli CFT073
guguuucgacaauaaucaa

SEQ ID NO: 577641 - RNA, 18 nt, Escherichia coli CFT073
guguuucggcugaggcgu

SEQ ID NO: 577642 - RNA, 22 nt, Escherichia coli CFT073
guuaaaaacagccagcagcgaa

SEQ ID NO: 577643 - RNA, 19 nt, Escherichia coli CFT073
gucgcgguccgggccgcaa

SEQ ID NO: 577644 - RNA, 23 nt, Escherichia coli CFT073
gucgcggucgccgucaggcaagc

SEQ ID NO: 577645 - RNA, 21 nt, Escherichia coli CFT073
gucgcguuugcccgcaacggc

SEQ ID NO: 577646 - RNA, 13 nt, Escherichia coli CFT073
gucgcgcagcacu

SEQ ID NO: 577647 - RNA, 12 nt, Escherichia coli CFT073
gucgccagcgcc

SEQ ID NO: 577648 - RNA, 12 nt, Escherichia coli CFT073
gucgccagcaau

SEQ ID NO: 577649 - RNA, 14 nt, Escherichia coli CFT073
gucgccagaaauca

SEQ ID NO: 577650 - RNA, 15 nt, Escherichia coli CFT073
gucgccagaaaucag

SEQ ID NO: 577651 - RNA, 15 nt, Escherichia coli CFT073
gucgccgaagcagcu

SEQ ID NO: 577652 - RNA, 21 nt, Escherichia coli CFT073
gucgccgaagcagcugcuggu

SEQ ID NO: 577653 - RNA, 19 nt, Escherichia coli CFT073
gucgccucgccgagcagcu

SEQ ID NO: 577654 - RNA, 19 nt, Escherichia coli CFT073
gucgccggcggauucagua

SEQ ID NO: 577655 - RNA, 12 nt, Escherichia coli CFT073
gucgacaaccag

SEQ ID NO: 577656 - RNA, 14 nt, Escherichia coli CFT073
gucgacaaccagca

SEQ ID NO: 577657 - RNA, 18 nt, Escherichia coli CFT073
gucgacauagccaucccu

SEQ ID NO: 577658 - RNA, 14 nt, Escherichia coli CFT073
gucgacauaaucaa

SEQ ID NO: 577659 - RNA, 20 nt, Escherichia coli CFT073
gucgagaauauacagcgucu

SEQ ID NO: 577660 - RNA, 15 nt, Escherichia coli CFT073
gucgauaucaaccag

SEQ ID NO: 577661 - RNA, 15 nt, Escherichia coli CFT073
gucgauacgcgcuaa

SEQ ID NO: 577662 - RNA, 23 nt, Escherichia coli CFT073
gucgcaucaggcacacugccagu

SEQ ID NO: 577663 - RNA, 15 nt, Escherichia coli CFT073
gucgcauccaacaau

SEQ ID NO: 577664 - RNA, 12 nt, Escherichia coli CFT073
gucgcauccggc

SEQ ID NO: 577665 - RNA, 20 nt, Escherichia coli CFT073
guccuuccaguaaccagccg

SEQ ID NO: 577666 - RNA, 20 nt, Escherichia coli CFT073
guccguugaaauugcugguu

SEQ ID NO: 577667 - RNA, 22 nt, Escherichia coli CFT073
guccucggcacgcgcaucauua

SEQ ID NO: 577668 - RNA, 20 nt, Escherichia coli CFT073
guccugauaagugaagaccg

SEQ ID NO: 577669 - RNA, 14 nt, Escherichia coli CFT073
guccgucgacggca

SEQ ID NO: 577670 - RNA, 16 nt, Escherichia coli CFT073
gucccgauaaccgcaa

SEQ ID NO: 577671 - RNA, 14 nt, Escherichia coli CFT073
guccaggauuuucu

SEQ ID NO: 577672 - RNA, 13 nt, Escherichia coli CFT073
gucagcaaacuga

SEQ ID NO: 577673 - RNA, 22 nt, Escherichia coli CFT073
guccagcugccugcggcgaucu

SEQ ID NO: 577674 - RNA, 14 nt, Escherichia coli CFT073
gucagauccgccag

SEQ ID NO: 577675 - RNA, 15 nt, Escherichia coli CFT073
gucagauccgccagu

SEQ ID NO: 577676 - RNA, 19 nt, Escherichia coli CFT073
gucagacggccccgcgcca

SEQ ID NO: 577677 - RNA, 18 nt, Escherichia coli CFT073
gucagauuagaacugaua

SEQ ID NO: 577678 - RNA, 18 nt, Escherichia coli CFT073
gucagauucggauccagc

SEQ ID NO: 577679 - RNA, 18 nt, Escherichia coli CFT073
gucacgcggucaucggua

SEQ ID NO: 577680 - RNA, 21 nt, Escherichia coli CFT073
guccgcgauuuuguccucggc

SEQ ID NO: 577681 - RNA, 17 nt, Escherichia coli CFT073
guccgcgcagccgcuga

SEQ ID NO: 577682 - RNA, 15 nt, Escherichia coli CFT073
guccgcgaacagccg

SEQ ID NO: 577683 - RNA, 14 nt, Escherichia coli CFT073
gucuucuucguaac

SEQ ID NO: 577684 - RNA, 14 nt, Escherichia coli CFT073
gucuucuuccgcgc

SEQ ID NO: 577685 - RNA, 15 nt, Escherichia coli CFT073
gucuucguacuacgc

SEQ ID NO: 577686 - RNA, 22 nt, Escherichia coli CFT073
gucuucguacuacgcgccgcca

SEQ ID NO: 577687 - RNA, 14 nt, Escherichia coli CFT073
gucugguaucgcgc

SEQ ID NO: 577688 - RNA, 15 nt, Escherichia coli CFT073
gugaagugcaaccgg

SEQ ID NO: 577689 - RNA, 18 nt, Escherichia coli CFT073
gugaaugccguaggccca

SEQ ID NO: 577690 - RNA, 14 nt, Escherichia coli CFT073
gugaagugcugcaa

SEQ ID NO: 577691 - RNA, 21 nt, Escherichia coli CFT073
gugaauaauugugcaauuacu

SEQ ID NO: 577692 - RNA, 17 nt, Escherichia coli CFT073
gugacaaacuaaccaga

SEQ ID NO: 577693 - RNA, 16 nt, Escherichia coli CFT073
gugacaccaugcccgu

SEQ ID NO: 577694 - RNA, 23 nt, Escherichia coli CFT073
gugacagcauaccuucacaaaau

SEQ ID NO: 577695 - RNA, 22 nt, Escherichia coli CFT073
gugacauagagauaacuggcaa

SEQ ID NO: 577696 - RNA, 14 nt, Escherichia coli CFT073
gucgucuucguccc

SEQ ID NO: 577697 - RNA, 14 nt, Escherichia coli CFT073
gucgugaaacgcgu

SEQ ID NO: 577698 - RNA, 22 nt, Escherichia coli CFT073
gucgugaaugccguaggcccag

SEQ ID NO: 577699 - RNA, 20 nt, Escherichia coli CFT073
gucguggguucaucgagcag

SEQ ID NO: 577700 - RNA, 14 nt, Escherichia coli CFT073
gucguuagaaagcu

SEQ ID NO: 577701 - RNA, 14 nt, Escherichia coli CFT073
gucguuaugcacgc

SEQ ID NO: 577702 - RNA, 22 nt, Escherichia coli CFT073
gucuggcacgaccgccuuucac

SEQ ID NO: 577703 - RNA, 17 nt, Escherichia coli CFT073
gucuggcagauccugaa

SEQ ID NO: 577704 - RNA, 16 nt, Escherichia coli CFT073
gucgucaguuccauaa

SEQ ID NO: 577705 - RNA, 14 nt, Escherichia coli CFT073
gucguauuucagcc

SEQ ID NO: 577706 - RNA, 15 nt, Escherichia coli CFT073
gucgguuaccaguac

SEQ ID NO: 577707 - RNA, 22 nt, Escherichia coli CFT073
gucggugcucauuagcccggca

SEQ ID NO: 577708 - RNA, 22 nt, Escherichia coli CFT073
gucgguggcaucuggugccagc

SEQ ID NO: 577709 - RNA, 21 nt, Escherichia coli CFT073
gucgguauuaucacuaucggu

SEQ ID NO: 577710 - RNA, 19 nt, Escherichia coli CFT073
gucggggccagcgcaucca

SEQ ID NO: 577711 - RNA, 14 nt, Escherichia coli CFT073
gucggcuucacgcc

SEQ ID NO: 577712 - RNA, 22 nt, Escherichia coli CFT073
gucggcagauaccaccacagca

SEQ ID NO: 577713 - RNA, 20 nt, Escherichia coli CFT073
gucggauaagacgcgccagc

SEQ ID NO: 577714 - RNA, 20 nt, Escherichia coli CFT073
gucggauaagacgcgucagc

SEQ ID NO: 577715 - RNA, 22 nt, Escherichia coli CFT073
gugauuacagccaggcgcugcu

SEQ ID NO: 577716 - RNA, 19 nt, Escherichia coli CFT073
gugauucagggcagcaaua

SEQ ID NO: 577717 - RNA, 13 nt, Escherichia coli CFT073
gugauucaguuuu

SEQ ID NO: 577718 - RNA, 18 nt, Escherichia coli CFT073
gugauuccagucggucga

SEQ ID NO: 577719 - RNA, 18 nt, Escherichia coli CFT073
gugauuguuuaaaaauac

SEQ ID NO: 577720 - RNA, 19 nt, Escherichia coli CFT073
gugauuuccccuaacucuu

SEQ ID NO: 577721 - RNA, 18 nt, Escherichia coli CFT073
gugauuuccgccgccagc

SEQ ID NO: 577722 - RNA, 20 nt, Escherichia coli CFT073
gugaucgugguggugaucgu

SEQ ID NO: 577723 - RNA, 15 nt, Escherichia coli CFT073
gugauaauaauucag

SEQ ID NO: 577724 - RNA, 16 nt, Escherichia coli CFT073
gugagguuaucgcccu

SEQ ID NO: 577725 - RNA, 20 nt, Escherichia coli CFT073
gugaguauauuucaggccaa

SEQ ID NO: 577726 - RNA, 15 nt, Escherichia coli CFT073
gugcacaaugccuga

SEQ ID NO: 577727 - RNA, 13 nt, Escherichia coli CFT073
gugauuucaaccg

SEQ ID NO: 577728 - RNA, 22 nt, Escherichia coli CFT073
gugauuuugccugugcaaccuu

SEQ ID NO: 577729 - RNA, 20 nt, Escherichia coli CFT073
gugauuuuugcugaacgcca

SEQ ID NO: 577730 - RNA, 14 nt, Escherichia coli CFT073
gugcaccuuguuuc

SEQ ID NO: 577731 - RNA, 17 nt, Escherichia coli CFT073
gugcagauaccaccagc

SEQ ID NO: 577732 - RNA, 22 nt, Escherichia coli CFT073
gugcagauaccaccagcgccau

SEQ ID NO: 577733 - RNA, 17 nt, Escherichia coli CFT073
gugacguuucaucgcag

SEQ ID NO: 577734 - RNA, 14 nt, Escherichia coli CFT073
gugagaccagacca

SEQ ID NO: 577735 - RNA, 23 nt, Escherichia coli CFT073
gugaggaugcgagucaggccagg

SEQ ID NO: 577736 - RNA, 12 nt, Escherichia coli CFT073
gugacgcuggca

SEQ ID NO: 577737 - RNA, 14 nt, Escherichia coli CFT073
gugacgcuggcagc

SEQ ID NO: 577738 - RNA, 16 nt, Escherichia coli CFT073
gugaccgucgagcaga

SEQ ID NO: 577739 - RNA, 14 nt, Escherichia coli CFT073
gugaccucuucggc

SEQ ID NO: 577740 - RNA, 20 nt, Escherichia coli CFT073
gugccagcaccaaacuggaa

SEQ ID NO: 577741 - RNA, 18 nt, Escherichia coli CFT073
gugccagaauuaacgcug

SEQ ID NO: 577742 - RNA, 13 nt, Escherichia coli CFT073
gugcccuuccagc

SEQ ID NO: 577743 - RNA, 22 nt, Escherichia coli CFT073
gugccgggaauauuuaccggau

SEQ ID NO: 577744 - RNA, 18 nt, Escherichia coli CFT073
gugcggcgcaccagcagg

SEQ ID NO: 577745 - RNA, 22 nt, Escherichia coli CFT073
gugcggcgcaccagcaggccgu

SEQ ID NO: 577746 - RNA, 21 nt, Escherichia coli CFT073
gugcgagugcauccaguugcg

SEQ ID NO: 577747 - RNA, 16 nt, Escherichia coli CFT073
gugccgguaacugcuu

SEQ ID NO: 577748 - RNA, 22 nt, Escherichia coli CFT073
ggugauuaagccaaagcgccgu

SEQ ID NO: 577749 - RNA, 13 nt, Escherichia coli CFT073
ggugauucccagc

SEQ ID NO: 577750 - RNA, 19 nt, Escherichia coli CFT073
ggugagacgccagaaccga

SEQ ID NO: 577751 - RNA, 22 nt, Escherichia coli CFT073
ggugagugcgguuuugucggca

SEQ ID NO: 577752 - RNA, 15 nt, Escherichia coli CFT073
ggugaucagcgucag

SEQ ID NO: 577753 - RNA, 22 nt, Escherichia coli CFT073
ggugaauaucgaauggcguuaa

SEQ ID NO: 577754 - RNA, 17 nt, Escherichia coli CFT073
ggugaaugccugaucaa

SEQ ID NO: 577755 - RNA, 15 nt, Escherichia coli CFT073
ggugacuggcagaau

SEQ ID NO: 577756 - RNA, 14 nt, Escherichia coli CFT073
ggucguuuauuucg

SEQ ID NO: 577757 - RNA, 16 nt, Escherichia coli CFT073
ggucggauaaggcguu

SEQ ID NO: 577758 - RNA, 13 nt, Escherichia coli CFT073
ggucagcgcacca

SEQ ID NO: 577759 - RNA, 18 nt, Escherichia coli CFT073
gguccacacgcgcccagc

SEQ ID NO: 577760 - RNA, 21 nt, Escherichia coli CFT073
ggucaguucaggcugaggcgu

SEQ ID NO: 577761 - RNA, 22 nt, Escherichia coli CFT073
ggucaguuuaaacagaauaccc

SEQ ID NO: 577762 - RNA, 20 nt, Escherichia coli CFT073
ggucgaaaauaucgguuccg

SEQ ID NO: 577763 - RNA, 15 nt, Escherichia coli CFT073
ggucccuugcugguc

SEQ ID NO: 577764 - RNA, 18 nt, Escherichia coli CFT073
ggucgcucgagccgcauc

SEQ ID NO: 577765 - RNA, 17 nt, Escherichia coli CFT073
ggucgaggcaaccagca

SEQ ID NO: 577766 - RNA, 24 nt, Escherichia coli CFT073
gguaagcgauaaaaauaccgagca

SEQ ID NO: 577767 - RNA, 12 nt, Escherichia coli CFT073
gguaauaaacca

SEQ ID NO: 577768 - RNA, 13 nt, Escherichia coli CFT073
gguaauaucgcgc

SEQ ID NO: 577769 - RNA, 13 nt, Escherichia coli CFT073
gguaaucaccagc

SEQ ID NO: 577770 - RNA, 22 nt, Escherichia coli CFT073
gguaacugccagggcuuuuuua

SEQ ID NO: 577771 - RNA, 21 nt, Escherichia coli CFT073
gguacacaaccgccggaugcg

SEQ ID NO: 577772 - RNA, 16 nt, Escherichia coli CFT073
gguaauugacgccauc

SEQ ID NO: 577773 - RNA, 17 nt, Escherichia coli CFT073
gguacaaagccaacagc

SEQ ID NO: 577774 - RNA, 23 nt, Escherichia coli CFT073
gguacaaaucuccagaugacugg

SEQ ID NO: 577775 - RNA, 19 nt, Escherichia coli CFT073
gguaaucgucauugaugcu

SEQ ID NO: 577776 - RNA, 16 nt, Escherichia coli CFT073
gguaaucgccagcaaa

SEQ ID NO: 577777 - RNA, 20 nt, Escherichia coli CFT073
gguaaaaguagggcgcugcc

SEQ ID NO: 577778 - RNA, 19 nt, Escherichia coli CFT073
gguaaacccggccugauau

SEQ ID NO: 577779 - RNA, 15 nt, Escherichia coli CFT073
ggguguuaagcgcag

SEQ ID NO: 577780 - RNA, 17 nt, Escherichia coli CFT073
gggugugacgacaccug

SEQ ID NO: 577781 - RNA, 17 nt, Escherichia coli CFT073
gguauuuaaacucgcug

SEQ ID NO: 577782 - RNA, 23 nt, Escherichia coli CFT073
gguauuuaaacucgcugcggaca

SEQ ID NO: 577783 - RNA, 15 nt, Escherichia coli CFT073
gguaugcuccggcag

SEQ ID NO: 577784 - RNA, 17 nt, Escherichia coli CFT073
ggucacugacaccagca

SEQ ID NO: 577785 - RNA, 17 nt, Escherichia coli CFT073
ggucaccaugaacacca

SEQ ID NO: 577786 - RNA, 13 nt, Escherichia coli CFT073
gguauagaaacca

SEQ ID NO: 577787 - RNA, 17 nt, Escherichia coli CFT073
gguauagaaugcagcag

SEQ ID NO: 577788 - RNA, 13 nt, Escherichia coli CFT073
gguaucaauacca

SEQ ID NO: 577789 - RNA, 23 nt, Escherichia coli CFT073
gguagugaggcauagacuuaugc

SEQ ID NO: 577790 - RNA, 22 nt, Escherichia coli CFT073
gguaggcgacucguugugugag

SEQ ID NO: 577791 - RNA, 14 nt, Escherichia coli CFT073
gguagcgauagaaa

SEQ ID NO: 577792 - RNA, 18 nt, Escherichia coli CFT073
gguacguuucgccugcaa

SEQ ID NO: 577793 - RNA, 13 nt, Escherichia coli CFT073
guaugcccagcgc

SEQ ID NO: 577794 - RNA, 16 nt, Escherichia coli CFT073
guaugcagccaggcca

SEQ ID NO: 577795 - RNA, 23 nt, Escherichia coli CFT073
guauggccuuucuggcggccaaa

SEQ ID NO: 577796 - RNA, 14 nt, Escherichia coli CFT073
guauguuauagagu

SEQ ID NO: 577797 - RNA, 13 nt, Escherichia coli CFT073
guauguucagaaa

SEQ ID NO: 577798 - RNA, 22 nt, Escherichia coli CFT073
gucaaacgcacgucugauguaa

SEQ ID NO: 577799 - RNA, 12 nt, Escherichia coli CFT073
gucaaacugaua

SEQ ID NO: 577800 - RNA, 14 nt, Escherichia coli CFT073
gucacaucgcugac

SEQ ID NO: 577801 - RNA, 18 nt, Escherichia coli CFT073
gucaaccacucaccgcug

SEQ ID NO: 577802 - RNA, 15 nt, Escherichia coli CFT073
gucaaccugaccaaa

SEQ ID NO: 577803 - RNA, 21 nt, Escherichia coli CFT073
gucaccggaucuuccacaaua

SEQ ID NO: 577804 - RNA, 20 nt, Escherichia coli CFT073
gucacgcagucagcacuggc

SEQ ID NO: 577805 - RNA, 16 nt, Escherichia coli CFT073
gucacgcaucacgaca

SEQ ID NO: 577806 - RNA, 23 nt, Escherichia coli CFT073
gucacgccgaccagaccggcaau

SEQ ID NO: 577807 - RNA, 23 nt, Escherichia coli CFT073
guauccagacccagcuucagcgu

SEQ ID NO: 577808 - RNA, 23 nt, Escherichia coli CFT073
guauccgcuauugaccagcgccg

SEQ ID NO: 577809 - RNA, 22 nt, Escherichia coli CFT073
guauccggcaugaacaaaacau

SEQ ID NO: 577810 - RNA, 18 nt, Escherichia coli CFT073
guaucgaacguuuucacc

SEQ ID NO: 577811 - RNA, 15 nt, Escherichia coli CFT073
guauaggauuaucau

SEQ ID NO: 577812 - RNA, 13 nt, Escherichia coli CFT073
guauaggcaugua

SEQ ID NO: 577813 - RNA, 15 nt, Escherichia coli CFT073
guauaguccgccaga

SEQ ID NO: 577814 - RNA, 19 nt, Escherichia coli CFT073
guauauaacgcauaaaccg

SEQ ID NO: 577815 - RNA, 15 nt, Escherichia coli CFT073
guauaugauuucgau

SEQ ID NO: 577816 - RNA, 17 nt, Escherichia coli CFT073
guauagaaugcagcagc

SEQ ID NO: 577817 - RNA, 20 nt, Escherichia coli CFT073
guaucaaacacaggcagaac

SEQ ID NO: 577818 - RNA, 21 nt, Escherichia coli CFT073
guaucaucgcugaacgggcca

SEQ ID NO: 577819 - RNA, 20 nt, Escherichia coli CFT073
guaguuugaugagaacacca

SEQ ID NO: 577820 - RNA, 16 nt, Escherichia coli CFT073
guauaacucgccuuca

SEQ ID NO: 577821 - RNA, 14 nt, Escherichia coli CFT073
guauaauauacagc

SEQ ID NO: 577822 - RNA, 23 nt, Escherichia coli CFT073
guaguuaauaccugcaccaacgu

SEQ ID NO: 577823 - RNA, 16 nt, Escherichia coli CFT073
guaguccggauaaggc

SEQ ID NO: 577824 - RNA, 19 nt, Escherichia coli CFT073
guaguccggauaaggcguu

SEQ ID NO: 577825 - RNA, 17 nt, Escherichia coli CFT073
guaguccaggccugauu

SEQ ID NO: 577826 - RNA, 19 nt, Escherichia coli CFT073
guaguccaggccugauuaa

SEQ ID NO: 577827 - RNA, 18 nt, Escherichia coli CFT073
guaccuucguccauccca

SEQ ID NO: 577828 - RNA, 15 nt, Escherichia coli CFT073
guaccuucagcggca

SEQ ID NO: 577829 - RNA, 19 nt, Escherichia coli CFT073
guacguguuguuccaguaa

SEQ ID NO: 577830 - RNA, 16 nt, Escherichia coli CFT073
guacguuaucaccgau

SEQ ID NO: 577831 - RNA, 18 nt, Escherichia coli CFT073
guacguucacgcagcuca

SEQ ID NO: 577832 - RNA, 15 nt, Escherichia coli CFT073
guacuacgcgccgcc

SEQ ID NO: 577833 - RNA, 16 nt, Escherichia coli CFT073
guacucaccaacgcag

SEQ ID NO: 577834 - RNA, 22 nt, Escherichia coli CFT073
guacucaucgcccgcaacaaac

SEQ ID NO: 577835 - RNA, 23 nt, Escherichia coli CFT073
guacgcgaauugcguuaacgcug

SEQ ID NO: 577836 - RNA, 13 nt, Escherichia coli CFT073
guacguaaaacaa

SEQ ID NO: 577837 - RNA, 21 nt, Escherichia coli CFT073
guaccgauaccuaacgccagc

SEQ ID NO: 577838 - RNA, 20 nt, Escherichia coli CFT073
guaccgggcgcgaggccagc

SEQ ID NO: 577839 - RNA, 21 nt, Escherichia coli CFT073
guaccgguuagcucaacgcau

SEQ ID NO: 577840 - RNA, 13 nt, Escherichia coli CFT073
guaccaucgccag

SEQ ID NO: 577841 - RNA, 15 nt, Escherichia coli CFT073
guaccaggaucagca

SEQ ID NO: 577842 - RNA, 20 nt, Escherichia coli CFT073
guaccaggcauauucaccgu

SEQ ID NO: 577843 - RNA, 20 nt, Escherichia coli CFT073
guaccaucaaucuucacgcg

SEQ ID NO: 577844 - RNA, 17 nt, Escherichia coli CFT073
guaccauugaagcaauc

SEQ ID NO: 577845 - RNA, 19 nt, Escherichia coli CFT073
guaccauugaagcaaucca

SEQ ID NO: 577846 - RNA, 19 nt, Escherichia coli CFT073
guagaauuuguaggccgga

SEQ ID NO: 577847 - RNA, 17 nt, Escherichia coli CFT073
guagacagcaucgacca

SEQ ID NO: 577848 - RNA, 22 nt, Escherichia coli CFT073
guagauuucguugugucgccag

SEQ ID NO: 577849 - RNA, 18 nt, Escherichia coli CFT073
guacuccuguucaccgau

SEQ ID NO: 577850 - RNA, 15 nt, Escherichia coli CFT073
guagcaccaguuggu

SEQ ID NO: 577851 - RNA, 19 nt, Escherichia coli CFT073
guagcaggccggagacgac

SEQ ID NO: 577852 - RNA, 23 nt, Escherichia coli CFT073
guagcgcgcuuuaccaucgcgca

SEQ ID NO: 577853 - RNA, 15 nt, Escherichia coli CFT073
guagcgccagacuga

SEQ ID NO: 577854 - RNA, 15 nt, Escherichia coli CFT073
guagcgcagcagaua

SEQ ID NO: 577855 - RNA, 21 nt, Escherichia coli CFT073
guagccuuuuuuaauauuuca

SEQ ID NO: 577856 - RNA, 22 nt, Escherichia coli CFT073
gguuaaccagcacguugaacug

SEQ ID NO: 577857 - RNA, 12 nt, Escherichia coli CFT073
gguuaacgcagg

SEQ ID NO: 577858 - RNA, 15 nt, Escherichia coli CFT073
gguuacucuguucau

SEQ ID NO: 577859 - RNA, 18 nt, Escherichia coli CFT073
gguuacaccgcgcgucau

SEQ ID NO: 577860 - RNA, 12 nt, Escherichia coli CFT073
gguuagcguuug

SEQ ID NO: 577861 - RNA, 18 nt, Escherichia coli CFT073
ggugucacggugucggua

SEQ ID NO: 577862 - RNA, 14 nt, Escherichia coli CFT073
gguggcuacgacgg

SEQ ID NO: 577863 - RNA, 16 nt, Escherichia coli CFT073
gguggcaaagaaauca

SEQ ID NO: 577864 - RNA, 15 nt, Escherichia coli CFT073
ggugcguuaccagcu

SEQ ID NO: 577865 - RNA, 17 nt, Escherichia coli CFT073
ggugcaggcgcucacca

SEQ ID NO: 577866 - RNA, 14 nt, Escherichia coli CFT073
gguuguuaagggau

SEQ ID NO: 577867 - RNA, 14 nt, Escherichia coli CFT073
gguuguuauuuccg

SEQ ID NO: 577868 - RNA, 15 nt, Escherichia coli CFT073
gguuugccagcagag

SEQ ID NO: 577869 - RNA, 22 nt, Escherichia coli CFT073
guaacggcucacccccaucagc

SEQ ID NO: 577870 - RNA, 20 nt, Escherichia coli CFT073
guaacgcgcuuucuucgcag

SEQ ID NO: 577871 - RNA, 22 nt, Escherichia coli CFT073
guaaauuccccaccccaguucg

SEQ ID NO: 577872 - RNA, 16 nt, Escherichia coli CFT073
guaaaugcgaauagcg

SEQ ID NO: 577873 - RNA, 17 nt, Escherichia coli CFT073
guaaauugcaguacgau

SEQ ID NO: 577874 - RNA, 23 nt, Escherichia coli CFT073
guaacgagacaaugcaaacggcg

SEQ ID NO: 577875 - RNA, 23 nt, Escherichia coli CFT073
guaaaggacagaguguucgccau

SEQ ID NO: 577876 - RNA, 19 nt, Escherichia coli CFT073
guaaaguacguguggucuu

SEQ ID NO: 577877 - RNA, 22 nt, Escherichia coli CFT073
guaaaucggacuggguccggug

SEQ ID NO: 577878 - RNA, 21 nt, Escherichia coli CFT073
guaaaucuucaagcaucggcg

SEQ ID NO: 577879 - RNA, 13 nt, Escherichia coli CFT073
gguucccugaccu

SEQ ID NO: 577880 - RNA, 21 nt, Escherichia coli CFT073
gguucgagguaguagccgucu

SEQ ID NO: 577881 - RNA, 15 nt, Escherichia coli CFT073
gguugcucucgccag

SEQ ID NO: 577882 - RNA, 11 nt, Escherichia coli CFT073
gguugcuggau

SEQ ID NO: 577883 - RNA, 21 nt, Escherichia coli CFT073
gguugucgaaguacgcaguaa

SEQ ID NO: 577884 - RNA, 24 nt, Escherichia coli CFT073
gguuguaacgucgcaucuggucag

SEQ ID NO: 577885 - RNA, 17 nt, Escherichia coli CFT073
gguuguacuucgcuuca

SEQ ID NO: 577886 - RNA, 18 nt, Escherichia coli CFT073
guaauugccgcguucgcc

SEQ ID NO: 577887 - RNA, 21 nt, Escherichia coli CFT073
guaauuucacaccaucaacaa

SEQ ID NO: 577888 - RNA, 16 nt, Escherichia coli CFT073
guaauugacgccauca

SEQ ID NO: 577889 - RNA, 20 nt, Escherichia coli CFT073
guaauugacgccaucaacga

SEQ ID NO: 577890 - RNA, 22 nt, Escherichia coli CFT073
guaauugauucacauccugcca

SEQ ID NO: 577891 - RNA, 18 nt, Escherichia coli CFT073
guaauuuccugccagcgu

SEQ ID NO: 577892 - RNA, 16 nt, Escherichia coli CFT073
guacaaagccaacagc

SEQ ID NO: 577893 - RNA, 14 nt, Escherichia coli CFT073
guacacccgccaga

SEQ ID NO: 577894 - RNA, 12 nt, Escherichia coli CFT073
guacaccgcagc

SEQ ID NO: 577895 - RNA, 22 nt, Escherichia coli CFT073
guaagaaccacagcccgccaca

SEQ ID NO: 577896 - RNA, 14 nt, Escherichia coli CFT073
guaacuucgcugau

SEQ ID NO: 577897 - RNA, 14 nt, Escherichia coli CFT073
guaacuggcgcagu

SEQ ID NO: 577898 - RNA, 17 nt, Escherichia coli CFT073
guaacgugccauagcgg

SEQ ID NO: 577899 - RNA, 22 nt, Escherichia coli CFT073
guaauggggcgaucucacgucc

SEQ ID NO: 577900 - RNA, 14 nt, Escherichia coli CFT073
guaaugcgacgcga

SEQ ID NO: 577901 - RNA, 20 nt, Escherichia coli CFT073
guaaugcgccgguuggucau

SEQ ID NO: 577902 - RNA, 22 nt, Escherichia coli CFT073
guaauuaaauuaucaacuauca

SEQ ID NO: 577903 - RNA, 20 nt, Escherichia coli CFT073
guaauuauucccgcgcuacc

SEQ ID NO: 577904 - RNA, 20 nt, Escherichia coli CFT073
guaauucaccguucaauucc

SEQ ID NO: 577905 - RNA, 20 nt, Escherichia coli CFT073
guacaggauauauuucauca

SEQ ID NO: 577906 - RNA, 16 nt, Escherichia coli CFT073
guacagcccgccggaa

SEQ ID NO: 577907 - RNA, 15 nt, Escherichia coli CFT073
guacauuaagcgcau

SEQ ID NO: 577908 - RNA, 20 nt, Escherichia coli CFT073
guaccaaagccucaaugcug

SEQ ID NO: 577909 - RNA, 19 nt, Escherichia coli CFT073
guaccaccagaaucgccag

SEQ ID NO: 577910 - RNA, 16 nt, Escherichia coli CFT073
guaccaccgcgaaaac

SEQ ID NO: 577911 - RNA, 16 nt, Escherichia coli CFT073
guacaguaccgaacgg

SEQ ID NO: 577912 - RNA, 21 nt, Escherichia coli CFT073
guacaguacugggauucacgu

SEQ ID NO: 577913 - RNA, 18 nt, Escherichia coli CFT073
ggcguuuugauuuucacc

SEQ ID NO: 577914 - RNA, 22 nt, Escherichia coli CFT073
ggcguuuuggcugugaauuacu

SEQ ID NO: 577915 - RNA, 19 nt, Escherichia coli CFT073
ggcuaaaaacgccgccagc

SEQ ID NO: 577916 - RNA, 14 nt, Escherichia coli CFT073
ggcguuucacuuuc

SEQ ID NO: 577917 - RNA, 17 nt, Escherichia coli CFT073
ggcguuuacgccgcauc

SEQ ID NO: 577918 - RNA, 16 nt, Escherichia coli CFT073
ggcuauauacagcgcc

SEQ ID NO: 577919 - RNA, 14 nt, Escherichia coli CFT073
ggcucaaacugcuc

SEQ ID NO: 577920 - RNA, 21 nt, Escherichia coli CFT073
ggcgugaacaccuuauccggc

SEQ ID NO: 577921 - RNA, 21 nt, Escherichia coli CFT073
ggcgugaacgccuuauccgac

SEQ ID NO: 577922 - RNA, 21 nt, Escherichia coli CFT073
ggcgugaacgccuuauccggc

SEQ ID NO: 577923 - RNA, 21 nt, Escherichia coli CFT073
ggcgucuuguugaacagacgc

SEQ ID NO: 577924 - RNA, 22 nt, Escherichia coli CFT073
ggcugagucccccaagacugag

SEQ ID NO: 577925 - RNA, 22 nt, Escherichia coli CFT073
ggcugaguuaccagcggccaga

SEQ ID NO: 577926 - RNA, 22 nt, Escherichia coli CFT073
ggcugcaugccuaaagugcugg

SEQ ID NO: 577927 - RNA, 12 nt, Escherichia coli CFT073
ggcugauaaucu

SEQ ID NO: 577928 - RNA, 15 nt, Escherichia coli CFT073
ggcugcaaacccuga

SEQ ID NO: 577929 - RNA, 12 nt, Escherichia coli CFT073
ggcugaugcugg

SEQ ID NO: 577930 - RNA, 19 nt, Escherichia coli CFT073
ggcugauggagauuuuccg

SEQ ID NO: 577931 - RNA, 17 nt, Escherichia coli CFT073
ggcuggcaacaacgcaa

SEQ ID NO: 577932 - RNA, 20 nt, Escherichia coli CFT073
ggcuggaaacgcgaucgcca

SEQ ID NO: 577933 - RNA, 18 nt, Escherichia coli CFT073
ggcugcguaauucgccac

SEQ ID NO: 577934 - RNA, 18 nt, Escherichia coli CFT073
ggcugcccggauagggaa

SEQ ID NO: 577935 - RNA, 16 nt, Escherichia coli CFT073
ggcuuucaccgccuga

SEQ ID NO: 577936 - RNA, 13 nt, Escherichia coli CFT073
ggcuuuauaaauu

SEQ ID NO: 577937 - RNA, 12 nt, Escherichia coli CFT073
ggcuuuaucaug

SEQ ID NO: 577938 - RNA, 14 nt, Escherichia coli CFT073
ggcuuucgcuucaa

SEQ ID NO: 577939 - RNA, 23 nt, Escherichia coli CFT073
gggaauucguucagacgcucugc

SEQ ID NO: 577940 - RNA, 14 nt, Escherichia coli CFT073
gggaauaacccgga

SEQ ID NO: 577941 - RNA, 18 nt, Escherichia coli CFT073
gggaaucgauaacugcuc

SEQ ID NO: 577942 - RNA, 14 nt, Escherichia coli CFT073
gggaagugcgccca

SEQ ID NO: 577943 - RNA, 20 nt, Escherichia coli CFT073
gggaaaacaucgcccggcga

SEQ ID NO: 577944 - RNA, 19 nt, Escherichia coli CFT073
ggcuuuuuuauugcugcac

SEQ ID NO: 577945 - RNA, 18 nt, Escherichia coli CFT073
ggcuuuuuucauuucccg

SEQ ID NO: 577946 - RNA, 15 nt, Escherichia coli CFT073
ggcuucuucugccgc

SEQ ID NO: 577947 - RNA, 21 nt, Escherichia coli CFT073
ggcuggugccugcacuggugg

SEQ ID NO: 577948 - RNA, 22 nt, Escherichia coli CFT073
gggaucccgugggcugauccgu

SEQ ID NO: 577949 - RNA, 18 nt, Escherichia coli CFT073
gggaucgacgcccagcgc

SEQ ID NO: 577950 - RNA, 18 nt, Escherichia coli CFT073
gggaucggcguacuggca

SEQ ID NO: 577951 - RNA, 19 nt, Escherichia coli CFT073
gggauguaauuaagcgcaa

SEQ ID NO: 577952 - RNA, 13 nt, Escherichia coli CFT073
gggcaaaaucauc

SEQ ID NO: 577953 - RNA, 21 nt, Escherichia coli CFT073
gggcacgcagguaaucaaugc

SEQ ID NO: 577954 - RNA, 16 nt, Escherichia coli CFT073
gggcaaagucuucacg

SEQ ID NO: 577955 - RNA, 18 nt, Escherichia coli CFT073
gggcaaaugcuccccugc

SEQ ID NO: 577956 - RNA, 16 nt, Escherichia coli CFT073
gggcaccgccgccacu

SEQ ID NO: 577957 - RNA, 17 nt, Escherichia coli CFT073
gggcagacaugaccaca

SEQ ID NO: 577958 - RNA, 18 nt, Escherichia coli CFT073
gggcagcaauagcaaagc

SEQ ID NO: 577959 - RNA, 22 nt, Escherichia coli CFT073
gggccgcgucgcccguggagug

SEQ ID NO: 577960 - RNA, 19 nt, Escherichia coli CFT073
gggcgggaaaagaaauauc

SEQ ID NO: 577961 - RNA, 18 nt, Escherichia coli CFT073
gggcgcggaaagcaccug

SEQ ID NO: 577962 - RNA, 18 nt, Escherichia coli CFT073
gggcgagaggaauuuauc

SEQ ID NO: 577963 - RNA, 18 nt, Escherichia coli CFT073
ggcgcaaucgccagaggc

SEQ ID NO: 577964 - RNA, 19 nt, Escherichia coli CFT073
ggcgauucauaugcgccag

SEQ ID NO: 577965 - RNA, 16 nt, Escherichia coli CFT073
ggcgaauggcguugcc

SEQ ID NO: 577966 - RNA, 15 nt, Escherichia coli CFT073
ggcgaauuccugacu

SEQ ID NO: 577967 - RNA, 23 nt, Escherichia coli CFT073
ggcgaaucaacuccagaauaccg

SEQ ID NO: 577968 - RNA, 21 nt, Escherichia coli CFT073
ggcgcauucgaucaccgcaga

SEQ ID NO: 577969 - RNA, 11 nt, Escherichia coli CFT073
ggcgcauugcc

SEQ ID NO: 577970 - RNA, 22 nt, Escherichia coli CFT073
ggcgccuuuuucaguuugcuga

SEQ ID NO: 577971 - RNA, 15 nt, Escherichia coli CFT073
ggcgcgaccagacgc

SEQ ID NO: 577972 - RNA, 19 nt, Escherichia coli CFT073
ggcgcugugagcaggcgua

SEQ ID NO: 577973 - RNA, 18 nt, Escherichia coli CFT073
ggcgcuguugcuaucggc

SEQ ID NO: 577974 - RNA, 18 nt, Escherichia coli CFT073
ggcgcuggccaugauuac

SEQ ID NO: 577975 - RNA, 23 nt, Escherichia coli CFT073
ggcggaucgucacgucuacagua

SEQ ID NO: 577976 - RNA, 13 nt, Escherichia coli CFT073
ggcggucagguaa

SEQ ID NO: 577977 - RNA, 17 nt, Escherichia coli CFT073
ggcgguacgaccgcaaa

SEQ ID NO: 577978 - RNA, 14 nt, Escherichia coli CFT073
ggcggcugacaugc

SEQ ID NO: 577979 - RNA, 19 nt, Escherichia coli CFT073
ggcgaacgagauaauggca

SEQ ID NO: 577980 - RNA, 22 nt, Escherichia coli CFT073
ggcgaaaaaccuaauacucugg

SEQ ID NO: 577981 - RNA, 19 nt, Escherichia coli CFT073
ggccuuaaccgccgccaga

SEQ ID NO: 577982 - RNA, 13 nt, Escherichia coli CFT073
ggcgaauaaccgc

SEQ ID NO: 577983 - RNA, 22 nt, Escherichia coli CFT073
ggcgaauacguuucagccacgc

SEQ ID NO: 577984 - RNA, 21 nt, Escherichia coli CFT073
ggcgaacuuccauacggcguu

SEQ ID NO: 577985 - RNA, 20 nt, Escherichia coli CFT073
ggccgcuuucagagcggccu

SEQ ID NO: 577986 - RNA, 17 nt, Escherichia coli CFT073
ggccguacccagcgguc

SEQ ID NO: 577987 - RNA, 13 nt, Escherichia coli CFT073
ggcccaugacaaa

SEQ ID NO: 577988 - RNA, 20 nt, Escherichia coli CFT073
ggcccauaacccacaccaua

SEQ ID NO: 577989 - RNA, 22 nt, Escherichia coli CFT073
ggccgccagugauuuuugcuga

SEQ ID NO: 577990 - RNA, 17 nt, Escherichia coli CFT073
ggauguucgcauccggc

SEQ ID NO: 577991 - RNA, 18 nt, Escherichia coli CFT073
ggauuaaauugcgccaga

SEQ ID NO: 577992 - RNA, 22 nt, Escherichia coli CFT073
ggauuauacgcggccugcacug

SEQ ID NO: 577993 - RNA, 19 nt, Escherichia coli CFT073
ggagagcaacaucaacaga

SEQ ID NO: 577994 - RNA, 19 nt, Escherichia coli CFT073
ggauuuccggcaucgccag

SEQ ID NO: 577995 - RNA, 19 nt, Escherichia coli CFT073
ggauuuucaccaucgccau

SEQ ID NO: 577996 - RNA, 17 nt, Escherichia coli CFT073
ggauuuugacuuuuaau

SEQ ID NO: 577997 - RNA, 15 nt, Escherichia coli CFT073
ggcaaaaucaucaca

SEQ ID NO: 577998 - RNA, 16 nt, Escherichia coli CFT073
ggcaaaauccuuccag

SEQ ID NO: 577999 - RNA, 14 nt, Escherichia coli CFT073
ggcaaacaucgacu

SEQ ID NO: 578000 - RNA, 20 nt, Escherichia coli CFT073
ggcaaagccguccaccaccg

SEQ ID NO: 578001 - RNA, 19 nt, Escherichia coli CFT073
ggcaacagaacgcgccuua

SEQ ID NO: 578002 - RNA, 15 nt, Escherichia coli CFT073
ggcaacagccaucgc

SEQ ID NO: 578003 - RNA, 13 nt, Escherichia coli CFT073
ggcaacaucgcca

SEQ ID NO: 578004 - RNA, 18 nt, Escherichia coli CFT073
ggcaaccgguagcuggug

SEQ ID NO: 578005 - RNA, 18 nt, Escherichia coli CFT073
ggcaaucugaauccccgg

SEQ ID NO: 578006 - RNA, 17 nt, Escherichia coli CFT073
ggcaaugacaucgcccu

SEQ ID NO: 578007 - RNA, 21 nt, Escherichia coli CFT073
ggcaaucaacgccugaugcga

SEQ ID NO: 578008 - RNA, 16 nt, Escherichia coli CFT073
ggcaauccccgccagc

SEQ ID NO: 578009 - RNA, 22 nt, Escherichia coli CFT073
ggcaauaaucucaauauccgga

SEQ ID NO: 578010 - RNA, 21 nt, Escherichia coli CFT073
ggcaaucacauccaccagcgc

SEQ ID NO: 578011 - RNA, 13 nt, Escherichia coli CFT073
ggcaaucgccaga

SEQ ID NO: 578012 - RNA, 14 nt, Escherichia coli CFT073
ggcaaucgcgccag

SEQ ID NO: 578013 - RNA, 13 nt, Escherichia coli CFT073
ggcaaugcgccga

SEQ ID NO: 578014 - RNA, 21 nt, Escherichia coli CFT073
ggcaaugcgcacggaguaaca

SEQ ID NO: 578015 - RNA, 14 nt, Escherichia coli CFT073
ggcaaugggcaacg

SEQ ID NO: 578016 - RNA, 15 nt, Escherichia coli CFT073
ggcaauggugaacug

SEQ ID NO: 578017 - RNA, 19 nt, Escherichia coli CFT073
ggcaauucucacugauuac

SEQ ID NO: 578018 - RNA, 18 nt, Escherichia coli CFT073
ggcaauuucagugcugac

SEQ ID NO: 578019 - RNA, 16 nt, Escherichia coli CFT073
ggcacacaaauaauuc

SEQ ID NO: 578020 - RNA, 12 nt, Escherichia coli CFT073
ggcaacguucca

SEQ ID NO: 578021 - RNA, 12 nt, Escherichia coli CFT073
ggcaacugcugc

SEQ ID NO: 578022 - RNA, 17 nt, Escherichia coli CFT073
ggcaagcgucgcaucag

SEQ ID NO: 578023 - RNA, 19 nt, Escherichia coli CFT073
ggcacauuucauucacgcc

SEQ ID NO: 578024 - RNA, 12 nt, Escherichia coli CFT073
ggcaccgccagc

SEQ ID NO: 578025 - RNA, 19 nt, Escherichia coli CFT073
ggcaccgccagcaggaacg

SEQ ID NO: 578026 - RNA, 13 nt, Escherichia coli CFT073
ggcaccgccgcca

SEQ ID NO: 578027 - RNA, 14 nt, Escherichia coli CFT073
ggcaccgccgccac

SEQ ID NO: 578028 - RNA, 19 nt, Escherichia coli CFT073
ggcacucuuggcaccgccu

SEQ ID NO: 578029 - RNA, 13 nt, Escherichia coli CFT073
ggcacuccgccac

SEQ ID NO: 578030 - RNA, 15 nt, Escherichia coli CFT073
ggcacgcccgcgcca

SEQ ID NO: 578031 - RNA, 18 nt, Escherichia coli CFT073
ggcaccuaucgcgucgcc

SEQ ID NO: 578032 - RNA, 21 nt, Escherichia coli CFT073
ggcagaauaacggcugauaac

SEQ ID NO: 578033 - RNA, 21 nt, Escherichia coli CFT073
ggcagaaaucaacggcgucag

SEQ ID NO: 578034 - RNA, 15 nt, Escherichia coli CFT073
ggcacuugucaccaa

SEQ ID NO: 578035 - RNA, 18 nt, Escherichia coli CFT073
ggcacuggccuuuucaca

SEQ ID NO: 578036 - RNA, 23 nt, Escherichia coli CFT073
ggcacugacgcgcuuuucaccga

SEQ ID NO: 578037 - RNA, 19 nt, Escherichia coli CFT073
ggcacugcggaagcuaccg

SEQ ID NO: 578038 - RNA, 19 nt, Escherichia coli CFT073
ggcacuggauuauuacugg

SEQ ID NO: 578039 - RNA, 12 nt, Escherichia coli CFT073
ggcaucgugcac

SEQ ID NO: 578040 - RNA, 17 nt, Escherichia coli CFT073
ggcauugggugcuugag

SEQ ID NO: 578041 - RNA, 19 nt, Escherichia coli CFT073
ggcaugauaagacgcguag

SEQ ID NO: 578042 - RNA, 18 nt, Escherichia coli CFT073
ggcaucugauacggucag

SEQ ID NO: 578043 - RNA, 19 nt, Escherichia coli CFT073
ggcaucuggugccagcgcc

SEQ ID NO: 578044 - RNA, 18 nt, Escherichia coli CFT073
ggcaugaaucauggcgug

SEQ ID NO: 578045 - RNA, 17 nt, Escherichia coli CFT073
ggcaugaauggucauaa

SEQ ID NO: 578046 - RNA, 20 nt, Escherichia coli CFT073
ggcaucgccaaccaucgccg

SEQ ID NO: 578047 - RNA, 23 nt, Escherichia coli CFT073
ggcaucgccagaacuacccgguu

SEQ ID NO: 578048 - RNA, 19 nt, Escherichia coli CFT073
ggcauccugaucguccugc

SEQ ID NO: 578049 - RNA, 19 nt, Escherichia coli CFT073
ggcauccagaccgcuguaa

SEQ ID NO: 578050 - RNA, 22 nt, Escherichia coli CFT073
ggcauccccugccccaucugcc

SEQ ID NO: 578051 - RNA, 23 nt, Escherichia coli CFT073
ggcagucacuuccugauccgcuu

SEQ ID NO: 578052 - RNA, 13 nt, Escherichia coli CFT073
ggcaguagcgccu

SEQ ID NO: 578053 - RNA, 13 nt, Escherichia coli CFT073
ggcaggucaucgu

SEQ ID NO: 578054 - RNA, 23 nt, Escherichia coli CFT073
ggccaggaacgggauugccagca

SEQ ID NO: 578055 - RNA, 13 nt, Escherichia coli CFT073
ggccagcggcgaa

SEQ ID NO: 578056 - RNA, 22 nt, Escherichia coli CFT073
ggcauuuccagaccuaaaaauu

SEQ ID NO: 578057 - RNA, 14 nt, Escherichia coli CFT073
ggcauuuccgccaa

SEQ ID NO: 578058 - RNA, 21 nt, Escherichia coli CFT073
ggcauuuuuaucucaaaaauu

SEQ ID NO: 578059 - RNA, 15 nt, Escherichia coli CFT073
ggcauuuuuuuaacc

SEQ ID NO: 578060 - RNA, 19 nt, Escherichia coli CFT073
ggccaaaaccuuucaccuc

SEQ ID NO: 578061 - RNA, 22 nt, Escherichia coli CFT073
ggccaaacuacgcugcggcgaa

SEQ ID NO: 578062 - RNA, 14 nt, Escherichia coli CFT073
ggccaaagccgccg

SEQ ID NO: 578063 - RNA, 14 nt, Escherichia coli CFT073
ggccaaagcguuca

SEQ ID NO: 578064 - RNA, 18 nt, Escherichia coli CFT073
ggccaaagggagcagacu

SEQ ID NO: 578065 - RNA, 13 nt, Escherichia coli CFT073
gcgcccaacagua

SEQ ID NO: 578066 - RNA, 13 nt, Escherichia coli CFT073
gcgcccagcaacg

SEQ ID NO: 578067 - RNA, 20 nt, Escherichia coli CFT073
gcgccauaaaacucgauggc

SEQ ID NO: 578068 - RNA, 15 nt, Escherichia coli CFT073
gcgccauaaucagcg

SEQ ID NO: 578069 - RNA, 19 nt, Escherichia coli CFT073
gcgcccgacaauaugcagc

SEQ ID NO: 578070 - RNA, 19 nt, Escherichia coli CFT073
gcgcccaucauugcgccga

SEQ ID NO: 578071 - RNA, 13 nt, Escherichia coli CFT073
gcgcccagccuga

SEQ ID NO: 578072 - RNA, 21 nt, Escherichia coli CFT073
gcgcaucugggauuuuguuua

SEQ ID NO: 578073 - RNA, 12 nt, Escherichia coli CFT073
gcgccagcaaga

SEQ ID NO: 578074 - RNA, 11 nt, Escherichia coli CFT073
gcgccagacug

SEQ ID NO: 578075 - RNA, 15 nt, Escherichia coli CFT073
gcgccacguacauua

SEQ ID NO: 578076 - RNA, 11 nt, Escherichia coli CFT073
gcgccagacgu

SEQ ID NO: 578077 - RNA, 20 nt, Escherichia coli CFT073
gcgccaggcacaccagcaau

SEQ ID NO: 578078 - RNA, 17 nt, Escherichia coli CFT073
gcgccgcugagaaaaag

SEQ ID NO: 578079 - RNA, 14 nt, Escherichia coli CFT073
gcgccgcgcggagc

SEQ ID NO: 578080 - RNA, 13 nt, Escherichia coli CFT073
gcgccgccucagc

SEQ ID NO: 578081 - RNA, 13 nt, Escherichia coli CFT073
gcgccgcauccga

SEQ ID NO: 578082 - RNA, 20 nt, Escherichia coli CFT073
gcgccgauuccaauauuaaa

SEQ ID NO: 578083 - RNA, 22 nt, Escherichia coli CFT073
gcgccgaagcugaccagacagu

SEQ ID NO: 578084 - RNA, 22 nt, Escherichia coli CFT073
gcgcccgccaagcaguuggcag

SEQ ID NO: 578085 - RNA, 15 nt, Escherichia coli CFT073
gcgcauaacauucag

SEQ ID NO: 578086 - RNA, 16 nt, Escherichia coli CFT073
gcgcauaagaccguga

SEQ ID NO: 578087 - RNA, 12 nt, Escherichia coli CFT073
gcgcauccgcca

SEQ ID NO: 578088 - RNA, 17 nt, Escherichia coli CFT073
gcgcauccgccagcagc

SEQ ID NO: 578089 - RNA, 18 nt, Escherichia coli CFT073
gcgcaggggcaaucagca

SEQ ID NO: 578090 - RNA, 13 nt, Escherichia coli CFT073
gcgcaguguaaac

SEQ ID NO: 578091 - RNA, 22 nt, Escherichia coli CFT073
gcgcagugccugccaugccaaa

SEQ ID NO: 578092 - RNA, 21 nt, Escherichia coli CFT073
gcgcaguucgcacaccgcuga

SEQ ID NO: 578093 - RNA, 11 nt, Escherichia coli CFT073
gcgcaguugcc

SEQ ID NO: 578094 - RNA, 22 nt, Escherichia coli CFT073
gcgcaguaccacuucauccgga

SEQ ID NO: 578095 - RNA, 22 nt, Escherichia coli CFT073
gcgcagcucuuuauccagcagc

SEQ ID NO: 578096 - RNA, 19 nt, Escherichia coli CFT073
gcgauauuccagaccuacg

SEQ ID NO: 578097 - RNA, 16 nt, Escherichia coli CFT073
gcgauauugccgcgau

SEQ ID NO: 578098 - RNA, 20 nt, Escherichia coli CFT073
gcgauauugccgcgauagca

SEQ ID NO: 578099 - RNA, 16 nt, Escherichia coli CFT073
gcgcacgcccaucagc

SEQ ID NO: 578100 - RNA, 20 nt, Escherichia coli CFT073
gcgcagcacuugcagccgaa

SEQ ID NO: 578101 - RNA, 18 nt, Escherichia coli CFT073
gcgcagauuuuugcgcca

SEQ ID NO: 578102 - RNA, 19 nt, Escherichia coli CFT073
gcgcagauuagccgguaaa

SEQ ID NO: 578103 - RNA, 23 nt, Escherichia coli CFT073
gcgcagagccugaauaaacgcca

SEQ ID NO: 578104 - RNA, 16 nt, Escherichia coli CFT073
gcgcagaucauccggc

SEQ ID NO: 578105 - RNA, 18 nt, Escherichia coli CFT073
gcgcagaagcauaccgau

SEQ ID NO: 578106 - RNA, 14 nt, Escherichia coli CFT073
gcgccucuuccagg

SEQ ID NO: 578107 - RNA, 12 nt, Escherichia coli CFT073
gcgccucuuuau

SEQ ID NO: 578108 - RNA, 12 nt, Escherichia coli CFT073
gcgccucaguuu

SEQ ID NO: 578109 - RNA, 20 nt, Escherichia coli CFT073
gcgccguugcgcccaucauc

SEQ ID NO: 578110 - RNA, 13 nt, Escherichia coli CFT073
gcgccggaaacca

SEQ ID NO: 578111 - RNA, 18 nt, Escherichia coli CFT073
gcgcgcaccguccagcgu

SEQ ID NO: 578112 - RNA, 21 nt, Escherichia coli CFT073
gcgcgcagguaguuaucugcc

SEQ ID NO: 578113 - RNA, 16 nt, Escherichia coli CFT073
gcgcgccgauaaaggu

SEQ ID NO: 578114 - RNA, 23 nt, Escherichia coli CFT073
gcgcgcggauuucggcggcuuau

SEQ ID NO: 578115 - RNA, 15 nt, Escherichia coli CFT073
gcgcggauuucggcg

SEQ ID NO: 578116 - RNA, 13 nt, Escherichia coli CFT073
gcgcggcuggcac

SEQ ID NO: 578117 - RNA, 14 nt, Escherichia coli CFT073
gcgcggcagcuuca

SEQ ID NO: 578118 - RNA, 21 nt, Escherichia coli CFT073
gcgcgguuuuggagagcggcg

SEQ ID NO: 578119 - RNA, 21 nt, Escherichia coli CFT073
gcgcguccccugcccgcgauc

SEQ ID NO: 578120 - RNA, 22 nt, Escherichia coli CFT073
gcgcguuuucaaccggaucggu

SEQ ID NO: 578121 - RNA, 16 nt, Escherichia coli CFT073
gcgcguuguucaugcc

SEQ ID NO: 578122 - RNA, 13 nt, Escherichia coli CFT073
gcgcgucuuaucc

SEQ ID NO: 578123 - RNA, 20 nt, Escherichia coli CFT073
gcgcugaccuucuucagcaa

SEQ ID NO: 578124 - RNA, 17 nt, Escherichia coli CFT073
gcgcugacucuacugaa

SEQ ID NO: 578125 - RNA, 22 nt, Escherichia coli CFT073
gcgcugcaaagcugauaaucau

SEQ ID NO: 578126 - RNA, 19 nt, Escherichia coli CFT073
gcgcugggcuucaccacca

SEQ ID NO: 578127 - RNA, 23 nt, Escherichia coli CFT073
gcgcuggccaugauuaccagcau

SEQ ID NO: 578128 - RNA, 16 nt, Escherichia coli CFT073
gcgcuugcgcggcagc

SEQ ID NO: 578129 - RNA, 14 nt, Escherichia coli CFT073
gcgcuuucagcacg

SEQ ID NO: 578130 - RNA, 15 nt, Escherichia coli CFT073
gcgcuuuaccaucgc

SEQ ID NO: 578131 - RNA, 12 nt, Escherichia coli CFT073
gcgcuuguugau

SEQ ID NO: 578132 - RNA, 13 nt, Escherichia coli CFT073
gcgcuucugccac

SEQ ID NO: 578133 - RNA, 14 nt, Escherichia coli CFT073
gcgcuucuuccagc

SEQ ID NO: 578134 - RNA, 15 nt, Escherichia coli CFT073
gcgcuucucaggccu

SEQ ID NO: 578135 - RNA, 19 nt, Escherichia coli CFT073
gcgcuuacacacccggccu

SEQ ID NO: 578136 - RNA, 21 nt, Escherichia coli CFT073
gcgaagcuggucagcaucguc

SEQ ID NO: 578137 - RNA, 19 nt, Escherichia coli CFT073
gcgacaauaaucaccacac

SEQ ID NO: 578138 - RNA, 20 nt, Escherichia coli CFT073
gcgacaaucgcccccaucac

SEQ ID NO: 578139 - RNA, 22 nt, Escherichia coli CFT073
gcgacaggaaccaaaugccgga

SEQ ID NO: 578140 - RNA, 15 nt, Escherichia coli CFT073
gcgaccaaacugcuc

SEQ ID NO: 578141 - RNA, 18 nt, Escherichia coli CFT073
gcgacauaaacguauuau

SEQ ID NO: 578142 - RNA, 15 nt, Escherichia coli CFT073
gcgacgcuggcgcgu

SEQ ID NO: 578143 - RNA, 20 nt, Escherichia coli CFT073
gcgacgcuggcgcgucuuau

SEQ ID NO: 578144 - RNA, 19 nt, Escherichia coli CFT073
gcgacgcugcgcguuuuau

SEQ ID NO: 578145 - RNA, 21 nt, Escherichia coli CFT073
gcgacgcuggccgcgucuuau

SEQ ID NO: 578146 - RNA, 20 nt, Escherichia coli CFT073
gcgacgcugaagcgucuuau

SEQ ID NO: 578147 - RNA, 20 nt, Escherichia coli CFT073
gcgacgcugacgcgucuuau

SEQ ID NO: 578148 - RNA, 21 nt, Escherichia coli CFT073
gcgacgcuagccgcgucuuau

SEQ ID NO: 578149 - RNA, 14 nt, Escherichia coli CFT073
gcgacgcgcuggca

SEQ ID NO: 578150 - RNA, 14 nt, Escherichia coli CFT073
gcgacgccauugcu

SEQ ID NO: 578151 - RNA, 18 nt, Escherichia coli CFT073
gcgacgcaaacgccuuau

SEQ ID NO: 578152 - RNA, 19 nt, Escherichia coli CFT073
gcgacgaccacccaccgca

SEQ ID NO: 578153 - RNA, 22 nt, Escherichia coli CFT073
gcgaccgaagccuuuaccgcgc

SEQ ID NO: 578154 - RNA, 20 nt, Escherichia coli CFT073
gcgaggaauucagcguggcg

SEQ ID NO: 578155 - RNA, 17 nt, Escherichia coli CFT073
gcgagcuguaucacuga

SEQ ID NO: 578156 - RNA, 19 nt, Escherichia coli CFT073
gcgagucgagaucccuucc

SEQ ID NO: 578157 - RNA, 14 nt, Escherichia coli CFT073
gcgauaaaacgccg

SEQ ID NO: 578158 - RNA, 15 nt, Escherichia coli CFT073
gcgauaaaacuucug

SEQ ID NO: 578159 - RNA, 14 nt, Escherichia coli CFT073
gcgauaaacagcac

SEQ ID NO: 578160 - RNA, 15 nt, Escherichia coli CFT073
gcgaguaucguuggc

SEQ ID NO: 578161 - RNA, 21 nt, Escherichia coli CFT073
gcgagugcauccagugccgga

SEQ ID NO: 578162 - RNA, 21 nt, Escherichia coli CFT073
gcgauagcuucugcguucucu

SEQ ID NO: 578163 - RNA, 13 nt, Escherichia coli CFT073
gcgauacgccaga

SEQ ID NO: 578164 - RNA, 22 nt, Escherichia coli CFT073
gcgauacuuuguaggccggaua

SEQ ID NO: 578165 - RNA, 21 nt, Escherichia coli CFT073
gcgauaaucagcgccagcgcg

SEQ ID NO: 578166 - RNA, 19 nt, Escherichia coli CFT073
gcgauaauuuuucgauaac

SEQ ID NO: 578167 - RNA, 12 nt, Escherichia coli CFT073
gcgauacgcagu

SEQ ID NO: 578168 - RNA, 20 nt, Escherichia coli CFT073
gcgauaagucgcccaaacgc

SEQ ID NO: 578169 - RNA, 18 nt, Escherichia coli CFT073
gcgagaaauacgcccuga

SEQ ID NO: 578170 - RNA, 13 nt, Escherichia coli CFT073
gcgagaacgccuu

SEQ ID NO: 578171 - RNA, 15 nt, Escherichia coli CFT073
gcgagaacgccuuau

SEQ ID NO: 578172 - RNA, 15 nt, Escherichia coli CFT073
gcgagaacaccgaac

SEQ ID NO: 578173 - RNA, 15 nt, Escherichia coli CFT073
gcgacuuuaaucacc

SEQ ID NO: 578174 - RNA, 17 nt, Escherichia coli CFT073
gcgacugaaccagcgcc

SEQ ID NO: 578175 - RNA, 14 nt, Escherichia coli CFT073
gcgaaauagcgcca

SEQ ID NO: 578176 - RNA, 20 nt, Escherichia coli CFT073
gcgaacacgccuuugacguu

SEQ ID NO: 578177 - RNA, 12 nt, Escherichia coli CFT073
gcgaaaccagca

SEQ ID NO: 578178 - RNA, 20 nt, Escherichia coli CFT073
gcgaaaccagcagccaucgc

SEQ ID NO: 578179 - RNA, 18 nt, Escherichia coli CFT073
gcgaaagcgugagugccc

SEQ ID NO: 578180 - RNA, 22 nt, Escherichia coli CFT073
gcgaaacugacaggucaucgca

SEQ ID NO: 578181 - RNA, 19 nt, Escherichia coli CFT073
gccuuucagccccagcgca

SEQ ID NO: 578182 - RNA, 23 nt, Escherichia coli CFT073
gccuuucaggugguuagccgcgu

SEQ ID NO: 578183 - RNA, 15 nt, Escherichia coli CFT073
gccuuuccagcaauc

SEQ ID NO: 578184 - RNA, 21 nt, Escherichia coli CFT073
gccuuugagcgugcgcgcugc

SEQ ID NO: 578185 - RNA, 16 nt, Escherichia coli CFT073
gccuuucuuaccgauu

SEQ ID NO: 578186 - RNA, 16 nt, Escherichia coli CFT073
gccuuucgcuccggca

SEQ ID NO: 578187 - RNA, 16 nt, Escherichia coli CFT073
gccuuucagaucaaaa

SEQ ID NO: 578188 - RNA, 19 nt, Escherichia coli CFT073
gcgaaaacaauuacgccga

SEQ ID NO: 578189 - RNA, 18 nt, Escherichia coli CFT073
gcgaaaacgcugaccguc

SEQ ID NO: 578190 - RNA, 15 nt, Escherichia coli CFT073
gcgaaaaucagccau

SEQ ID NO: 578191 - RNA, 23 nt, Escherichia coli CFT073
gcgaaaaucagccauacggucug

SEQ ID NO: 578192 - RNA, 18 nt, Escherichia coli CFT073
gcgaaaaucccggcaaca

SEQ ID NO: 578193 - RNA, 15 nt, Escherichia coli CFT073
gcgaaaaugcucgcc

SEQ ID NO: 578194 - RNA, 20 nt, Escherichia coli CFT073
gccuuuuuaggucgcccugu

SEQ ID NO: 578195 - RNA, 18 nt, Escherichia coli CFT073
gccuuuuuuaauauuuca

SEQ ID NO: 578196 - RNA, 20 nt, Escherichia coli CFT073
gccuuuuuucgccgcagcau

SEQ ID NO: 578197 - RNA, 12 nt, Escherichia coli CFT073
gcgaacgacauc

SEQ ID NO: 578198 - RNA, 19 nt, Escherichia coli CFT073
gcgaacgacauccgccagc

SEQ ID NO: 578199 - RNA, 15 nt, Escherichia coli CFT073
gcgaaccgcaggugg

SEQ ID NO: 578200 - RNA, 21 nt, Escherichia coli CFT073
gcgaaccauaguauuuaucca

SEQ ID NO: 578201 - RNA, 13 nt, Escherichia coli CFT073
gcgaacagguagu

SEQ ID NO: 578202 - RNA, 14 nt, Escherichia coli CFT073
gcgaagccagcucc

SEQ ID NO: 578203 - RNA, 23 nt, Escherichia coli CFT073
gcgaagaccgcaucacgacagca

SEQ ID NO: 578204 - RNA, 21 nt, Escherichia coli CFT073
gcgaacuaaacaacgccgcca

SEQ ID NO: 578205 - RNA, 17 nt, Escherichia coli CFT073
gccuguaaugccuuuuc

SEQ ID NO: 578206 - RNA, 20 nt, Escherichia coli CFT073
gccuguccucuucagcauca

SEQ ID NO: 578207 - RNA, 14 nt, Escherichia coli CFT073
gccuggcgcugcuc

SEQ ID NO: 578208 - RNA, 17 nt, Escherichia coli CFT073
gccuggcugcgugaggc

SEQ ID NO: 578209 - RNA, 17 nt, Escherichia coli CFT073
gccugucugcaaaaaua

SEQ ID NO: 578210 - RNA, 15 nt, Escherichia coli CFT073
gccuguguuuaugcc

SEQ ID NO: 578211 - RNA, 18 nt, Escherichia coli CFT073
gccuucaauauggaacgc

SEQ ID NO: 578212 - RNA, 17 nt, Escherichia coli CFT073
gccuucacaggccgcca

SEQ ID NO: 578213 - RNA, 19 nt, Escherichia coli CFT073
gccuucuucauccagcgca

SEQ ID NO: 578214 - RNA, 21 nt, Escherichia coli CFT073
gccuucuucauccagcgcacg

SEQ ID NO: 578215 - RNA, 14 nt, Escherichia coli CFT073
gccuucuucuuuca

SEQ ID NO: 578216 - RNA, 16 nt, Escherichia coli CFT073
gccuucuuccagcgca

SEQ ID NO: 578217 - RNA, 15 nt, Escherichia coli CFT073
gccuugauuauuucc

SEQ ID NO: 578218 - RNA, 14 nt, Escherichia coli CFT073
gccuugaugaaaaa

SEQ ID NO: 578219 - RNA, 22 nt, Escherichia coli CFT073
gccuugaugaaaaaaccagaaa

SEQ ID NO: 578220 - RNA, 17 nt, Escherichia coli CFT073
gccugcugcacaccaua

SEQ ID NO: 578221 - RNA, 16 nt, Escherichia coli CFT073
gccugcuuaucgcccu

SEQ ID NO: 578222 - RNA, 13 nt, Escherichia coli CFT073
gccugcuggcagc

SEQ ID NO: 578223 - RNA, 14 nt, Escherichia coli CFT073
gccucgccgagcag

SEQ ID NO: 578224 - RNA, 12 nt, Escherichia coli CFT073
gccucgcagcgg

SEQ ID NO: 578225 - RNA, 22 nt, Escherichia coli CFT073
gccguugcuggcaaucaccucu

SEQ ID NO: 578226 - RNA, 14 nt, Escherichia coli CFT073
gccguugugcugau

SEQ ID NO: 578227 - RNA, 21 nt, Escherichia coli CFT073
gccguuuaacacgcucuggau

SEQ ID NO: 578228 - RNA, 13 nt, Escherichia coli CFT073
gccucaacgccua

SEQ ID NO: 578229 - RNA, 19 nt, Escherichia coli CFT073
gccucaacgccuaaugcca

SEQ ID NO: 578230 - RNA, 14 nt, Escherichia coli CFT073
gccuauuauccggc

SEQ ID NO: 578231 - RNA, 23 nt, Escherichia coli CFT073
gccguucuucagcguccgggaaa

SEQ ID NO: 578232 - RNA, 16 nt, Escherichia coli CFT073
gccguugaucagcgca

SEQ ID NO: 578233 - RNA, 13 nt, Escherichia coli CFT073
gccguccagcgcc

SEQ ID NO: 578234 - RNA, 17 nt, Escherichia coli CFT073
gccgucaauuuuaagca

SEQ ID NO: 578235 - RNA, 17 nt, Escherichia coli CFT073
gccguauacgcuucgga

SEQ ID NO: 578236 - RNA, 23 nt, Escherichia coli CFT073
gccgugaaugguaacuuucugcc

SEQ ID NO: 578237 - RNA, 14 nt, Escherichia coli CFT073
gccgucucuuucau

SEQ ID NO: 578238 - RNA, 23 nt, Escherichia coli CFT073
gccgugaguauauuucaggccaa

SEQ ID NO: 578239 - RNA, 15 nt, Escherichia coli CFT073
gccgggcgaugcagc

SEQ ID NO: 578240 - RNA, 18 nt, Escherichia coli CFT073
gccgggcgaugcagcgca

SEQ ID NO: 578241 - RNA, 14 nt, Escherichia coli CFT073
gccgggcugauacc

SEQ ID NO: 578242 - RNA, 16 nt, Escherichia coli CFT073
gccgggcuaaccgcuu

SEQ ID NO: 578243 - RNA, 19 nt, Escherichia coli CFT073
gccggguaguaucgcucaa

SEQ ID NO: 578244 - RNA, 17 nt, Escherichia coli CFT073
gccggucaucccuaaca

SEQ ID NO: 578245 - RNA, 15 nt, Escherichia coli CFT073
gccggugauggccgc

SEQ ID NO: 578246 - RNA, 20 nt, Escherichia coli CFT073
gccggugauggccgcgccga

SEQ ID NO: 578247 - RNA, 20 nt, Escherichia coli CFT073
gccggucuuguuaccggcau

SEQ ID NO: 578248 - RNA, 21 nt, Escherichia coli CFT073
gcggaaacuuaaucgccaguu

SEQ ID NO: 578249 - RNA, 14 nt, Escherichia coli CFT073
gcggaaauaacgcu

SEQ ID NO: 578250 - RNA, 15 nt, Escherichia coli CFT073
gcggaaauaacgcug

SEQ ID NO: 578251 - RNA, 15 nt, Escherichia coli CFT073
gcggcaguauagcgg

SEQ ID NO: 578252 - RNA, 18 nt, Escherichia coli CFT073
gcggcagucgcgcuucgu

SEQ ID NO: 578253 - RNA, 17 nt, Escherichia coli CFT073
gcggcagugacagcccc

SEQ ID NO: 578254 - RNA, 19 nt, Escherichia coli CFT073
gcgcuuuuuccugccgcua

SEQ ID NO: 578255 - RNA, 23 nt, Escherichia coli CFT073
gcgcuuuuugguccgaucccugc

SEQ ID NO: 578256 - RNA, 13 nt, Escherichia coli CFT073
gcgcuuuugcauc

SEQ ID NO: 578257 - RNA, 20 nt, Escherichia coli CFT073
gcgcuuuguuuaugccagau

SEQ ID NO: 578258 - RNA, 19 nt, Escherichia coli CFT073
gcgcuuuuauccugucagu

SEQ ID NO: 578259 - RNA, 18 nt, Escherichia coli CFT073
gcggcauaaacgccuuau

SEQ ID NO: 578260 - RNA, 20 nt, Escherichia coli CFT073
gcggcauaaacgccuuaucc

SEQ ID NO: 578261 - RNA, 18 nt, Escherichia coli CFT073
gcggcaguggcuaagcag

SEQ ID NO: 578262 - RNA, 22 nt, Escherichia coli CFT073
gcggcaguugcccgguuucgcc

SEQ ID NO: 578263 - RNA, 15 nt, Escherichia coli CFT073
gcggcaguuucagcc

SEQ ID NO: 578264 - RNA, 13 nt, Escherichia coli CFT073
gcggcauuucgcc

SEQ ID NO: 578265 - RNA, 15 nt, Escherichia coli CFT073
gcggccaaagggagc

SEQ ID NO: 578266 - RNA, 20 nt, Escherichia coli CFT073
gcggcaugugaugccgcauc

SEQ ID NO: 578267 - RNA, 15 nt, Escherichia coli CFT073
gcggccaaugccuga

SEQ ID NO: 578268 - RNA, 15 nt, Escherichia coli CFT073
gcggccagcgcaccu

SEQ ID NO: 578269 - RNA, 21 nt, Escherichia coli CFT073
gcggccauuacacguuguuua

SEQ ID NO: 578270 - RNA, 23 nt, Escherichia coli CFT073
gcggccauuuuuuuacccagcgu

SEQ ID NO: 578271 - RNA, 13 nt, Escherichia coli CFT073
gcggccaguuucg

SEQ ID NO: 578272 - RNA, 16 nt, Escherichia coli CFT073
gcggcgcaccagcagg

SEQ ID NO: 578273 - RNA, 15 nt, Escherichia coli CFT073
gcggcgcaaccauca

SEQ ID NO: 578274 - RNA, 14 nt, Escherichia coli CFT073
gcggcguuccugcc

SEQ ID NO: 578275 - RNA, 19 nt, Escherichia coli CFT073
gcggcguuaacgccuuauc

SEQ ID NO: 578276 - RNA, 19 nt, Escherichia coli CFT073
gcggcgugaccgccuuauc

SEQ ID NO: 578277 - RNA, 19 nt, Escherichia coli CFT073
gcggcgugaacgccuuauc

SEQ ID NO: 578278 - RNA, 20 nt, Escherichia coli CFT073
gcggcgugaacgccuucucc

SEQ ID NO: 578279 - RNA, 15 nt, Escherichia coli CFT073
gcggcggcgcaacca

SEQ ID NO: 578280 - RNA, 18 nt, Escherichia coli CFT073
gcggcuucaucuuuauca

SEQ ID NO: 578281 - RNA, 22 nt, Escherichia coli CFT073
gcggcuucaucuuuaucaauca

SEQ ID NO: 578282 - RNA, 20 nt, Escherichia coli CFT073
gcgggaauagcucaguuggu

SEQ ID NO: 578283 - RNA, 16 nt, Escherichia coli CFT073
gcgggacaacaaacgc

SEQ ID NO: 578284 - RNA, 14 nt, Escherichia coli CFT073
gcgggcgcaaugcc

SEQ ID NO: 578285 - RNA, 20 nt, Escherichia coli CFT073
gcgggcgaucauauccagca

SEQ ID NO: 578286 - RNA, 20 nt, Escherichia coli CFT073
gcuaaccuuauggugucuau

SEQ ID NO: 578287 - RNA, 20 nt, Escherichia coli CFT073
gcuaacuucgccaucagcgc

SEQ ID NO: 578288 - RNA, 21 nt, Escherichia coli CFT073
gcuaacuucgccaucagcgcc

SEQ ID NO: 578289 - RNA, 19 nt, Escherichia coli CFT073
gcuaacggagaauccagcc

SEQ ID NO: 578290 - RNA, 18 nt, Escherichia coli CFT073
gcuaacucauugauuuuc

SEQ ID NO: 578291 - RNA, 13 nt, Escherichia coli CFT073
gcuaacugcugcg

SEQ ID NO: 578292 - RNA, 22 nt, Escherichia coli CFT073
gcuaacugcugcggaauagcaa

SEQ ID NO: 578293 - RNA, 23 nt, Escherichia coli CFT073
gcuaacugcugcggaauagcaau

SEQ ID NO: 578294 - RNA, 19 nt, Escherichia coli CFT073
gcguuuucuuuuucagcaa

SEQ ID NO: 578295 - RNA, 20 nt, Escherichia coli CFT073
gcguuuuguagagcagcacg

SEQ ID NO: 578296 - RNA, 22 nt, Escherichia coli CFT073
gcguuuuucaucuuccggagcu

SEQ ID NO: 578297 - RNA, 14 nt, Escherichia coli CFT073
gcuaaaccgcugcc

SEQ ID NO: 578298 - RNA, 15 nt, Escherichia coli CFT073
gcuaaaccgcugccu

SEQ ID NO: 578299 - RNA, 21 nt, Escherichia coli CFT073
gcguuugaacugaaccccaaa

SEQ ID NO: 578300 - RNA, 22 nt, Escherichia coli CFT073
gcguuuuagccgcauccggcau

SEQ ID NO: 578301 - RNA, 22 nt, Escherichia coli CFT073
gcguuuuaucacgcaucugcug

SEQ ID NO: 578302 - RNA, 21 nt, Escherichia coli CFT073
gcguuuucgaaaaagcgcuga

SEQ ID NO: 578303 - RNA, 23 nt, Escherichia coli CFT073
gcguuucaccaccacuucuuuca

SEQ ID NO: 578304 - RNA, 18 nt, Escherichia coli CFT073
gcguuuacagagccgccg

SEQ ID NO: 578305 - RNA, 22 nt, Escherichia coli CFT073
gcguuuacgccgcauccggcau

SEQ ID NO: 578306 - RNA, 13 nt, Escherichia coli CFT073
gcguuuaucaaua

SEQ ID NO: 578307 - RNA, 21 nt, Escherichia coli CFT073
gcguuguaauuacgcagcgcg

SEQ ID NO: 578308 - RNA, 17 nt, Escherichia coli CFT073
gcguuguucaugccgga

SEQ ID NO: 578309 - RNA, 18 nt, Escherichia coli CFT073
gcguugcggaaaguuuac

SEQ ID NO: 578310 - RNA, 15 nt, Escherichia coli CFT073
gcguugcuggcguga

SEQ ID NO: 578311 - RNA, 22 nt, Escherichia coli CFT073
gcguugccugaauacacugcug

SEQ ID NO: 578312 - RNA, 20 nt, Escherichia coli CFT073
gcgugcgccagagcccguua

SEQ ID NO: 578313 - RNA, 21 nt, Escherichia coli CFT073
gcgugcgcccaucauugcgcc

SEQ ID NO: 578314 - RNA, 22 nt, Escherichia coli CFT073
gcguggagcaacacgccagcgu

SEQ ID NO: 578315 - RNA, 17 nt, Escherichia coli CFT073
gcguuauaaaacacauu

SEQ ID NO: 578316 - RNA, 19 nt, Escherichia coli CFT073
gcgugugccgguaaagcaa

SEQ ID NO: 578317 - RNA, 20 nt, Escherichia coli CFT073
gcguucaagccgcauccggc

SEQ ID NO: 578318 - RNA, 16 nt, Escherichia coli CFT073
gcguucaaucuguccu

SEQ ID NO: 578319 - RNA, 18 nt, Escherichia coli CFT073
gcguuauuuguugccgga

SEQ ID NO: 578320 - RNA, 22 nt, Escherichia coli CFT073
gcguuauuuguugccggaugcg

SEQ ID NO: 578321 - RNA, 20 nt, Escherichia coli CFT073
gcguucaaaacggcugguga

SEQ ID NO: 578322 - RNA, 20 nt, Escherichia coli CFT073
gcguucacgccgcauccggc

SEQ ID NO: 578323 - RNA, 21 nt, Escherichia coli CFT073
gcguucacugccguacaggca

SEQ ID NO: 578324 - RNA, 22 nt, Escherichia coli CFT073
gcguuccggcggcacagccagc

SEQ ID NO: 578325 - RNA, 19 nt, Escherichia coli CFT073
gcguuccugccgcgacugc

SEQ ID NO: 578326 - RNA, 16 nt, Escherichia coli CFT073
gcguucugucagcacg

SEQ ID NO: 578327 - RNA, 20 nt, Escherichia coli CFT073
gcguucgauagcgcgccagc

SEQ ID NO: 578328 - RNA, 17 nt, Escherichia coli CFT073
gcguucgcaccaccgga

SEQ ID NO: 578329 - RNA, 19 nt, Escherichia coli CFT073
gcgucuuaucaggccuaca

SEQ ID NO: 578330 - RNA, 17 nt, Escherichia coli CFT073
gcgucuuaucaugccua

SEQ ID NO: 578331 - RNA, 19 nt, Escherichia coli CFT073
gcgucuuauccgaccuaca

SEQ ID NO: 578332 - RNA, 20 nt, Escherichia coli CFT073
gcgucuuauccgaccuacag

SEQ ID NO: 578333 - RNA, 14 nt, Escherichia coli CFT073
gcgugaacgccuua

SEQ ID NO: 578334 - RNA, 15 nt, Escherichia coli CFT073
gcgugaaacgcguuu

SEQ ID NO: 578335 - RNA, 16 nt, Escherichia coli CFT073
gcgucuuauccggccu

SEQ ID NO: 578336 - RNA, 20 nt, Escherichia coli CFT073
gcgucuuauccggccuacua

SEQ ID NO: 578337 - RNA, 19 nt, Escherichia coli CFT073
gcgucuuaucuggccuaca

SEQ ID NO: 578338 - RNA, 18 nt, Escherichia coli CFT073
gcgugagaacacgaccug

SEQ ID NO: 578339 - RNA, 18 nt, Escherichia coli CFT073
gcgugagaaccgcaccga

SEQ ID NO: 578340 - RNA, 23 nt, Escherichia coli CFT073
gcgugauauuacauaccagcagc

SEQ ID NO: 578341 - RNA, 12 nt, Escherichia coli CFT073
gcgucgguuucg

SEQ ID NO: 578342 - RNA, 13 nt, Escherichia coli CFT073
gcgucgguaaaga

SEQ ID NO: 578343 - RNA, 13 nt, Escherichia coli CFT073
gcgucccaucggc

SEQ ID NO: 578344 - RNA, 14 nt, Escherichia coli CFT073
gcgucaacagggca

SEQ ID NO: 578345 - RNA, 16 nt, Escherichia coli CFT073
gcgucaaacuuuuaaa

SEQ ID NO: 578346 - RNA, 14 nt, Escherichia coli CFT073
gcguaguugcugcg

SEQ ID NO: 578347 - RNA, 17 nt, Escherichia coli CFT073
gcguaguuuaugccgga

SEQ ID NO: 578348 - RNA, 22 nt, Escherichia coli CFT073
gcguauaaaccauaucaccgug

SEQ ID NO: 578349 - RNA, 15 nt, Escherichia coli CFT073
gcguagggcaggcgu

SEQ ID NO: 578350 - RNA, 16 nt, Escherichia coli CFT073
gcguacccaucaacaa

SEQ ID NO: 578351 - RNA, 19 nt, Escherichia coli CFT073
gcguaccaugauccugcaa

SEQ ID NO: 578352 - RNA, 15 nt, Escherichia coli CFT073
gcguacgauuacagg

SEQ ID NO: 578353 - RNA, 15 nt, Escherichia coli CFT073
gcguacaccaacauc

SEQ ID NO: 578354 - RNA, 14 nt, Escherichia coli CFT073
gcgucacgguuuca

SEQ ID NO: 578355 - RNA, 20 nt, Escherichia coli CFT073
gcgucagaccggcaaccagc

SEQ ID NO: 578356 - RNA, 15 nt, Escherichia coli CFT073
gcgucaaucacuuuc

SEQ ID NO: 578357 - RNA, 19 nt, Escherichia coli CFT073
gcgucaaucacuuucugcg

SEQ ID NO: 578358 - RNA, 22 nt, Escherichia coli CFT073
gcgucaaucacuuucugcgcca

SEQ ID NO: 578359 - RNA, 14 nt, Escherichia coli CFT073
gcgucaucuuacug

SEQ ID NO: 578360 - RNA, 17 nt, Escherichia coli CFT073
gcgucaucuuacugcaa

SEQ ID NO: 578361 - RNA, 15 nt, Escherichia coli CFT073
gcgucaucggcagca

SEQ ID NO: 578362 - RNA, 17 nt, Escherichia coli CFT073
gcgucauuuccagacgc

SEQ ID NO: 578363 - RNA, 13 nt, Escherichia coli CFT073
gcguaaucgccga

SEQ ID NO: 578364 - RNA, 20 nt, Escherichia coli CFT073
gcguaaucgccgaaccagug

SEQ ID NO: 578365 - RNA, 15 nt, Escherichia coli CFT073
gcguaauauccagcg

SEQ ID NO: 578366 - RNA, 22 nt, Escherichia coli CFT073
gcggugucggaacgguaggccg

SEQ ID NO: 578367 - RNA, 13 nt, Escherichia coli CFT073
gcggugaugcgga

SEQ ID NO: 578368 - RNA, 15 nt, Escherichia coli CFT073
gcggugagucuggaa

SEQ ID NO: 578369 - RNA, 20 nt, Escherichia coli CFT073
gcgggcuggcguacccauca

SEQ ID NO: 578370 - RNA, 14 nt, Escherichia coli CFT073
gcggucaugacgau

SEQ ID NO: 578371 - RNA, 12 nt, Escherichia coli CFT073
gcggucagcgca

SEQ ID NO: 578372 - RNA, 18 nt, Escherichia coli CFT073
gcggucagcgcaauguug

SEQ ID NO: 578373 - RNA, 15 nt, Escherichia coli CFT073
gcucgccuugcugcc

SEQ ID NO: 578374 - RNA, 13 nt, Escherichia coli CFT073
gcucgcgauacgc

SEQ ID NO: 578375 - RNA, 18 nt, Escherichia coli CFT073
gcucgcgccgcauccggc

SEQ ID NO: 578376 - RNA, 14 nt, Escherichia coli CFT073
gcucgcuaucauuc

SEQ ID NO: 578377 - RNA, 19 nt, Escherichia coli CFT073
gcucggaaauauucaacac

SEQ ID NO: 578378 - RNA, 15 nt, Escherichia coli CFT073
gcucgccauccagug

SEQ ID NO: 578379 - RNA, 17 nt, Escherichia coli CFT073
gcucgccgcagagauca

SEQ ID NO: 578380 - RNA, 21 nt, Escherichia coli CFT073
gcucgcagaaauaccccgcca

SEQ ID NO: 578381 - RNA, 20 nt, Escherichia coli CFT073
gcuccggcagcagcacccgc

SEQ ID NO: 578382 - RNA, 12 nt, Escherichia coli CFT073
gcuccgcgaccc

SEQ ID NO: 578383 - RNA, 15 nt, Escherichia coli CFT073
gcuaauugcaccauc

SEQ ID NO: 578384 - RNA, 21 nt, Escherichia coli CFT073
gcuacagugccccaaaugucg

SEQ ID NO: 578385 - RNA, 13 nt, Escherichia coli CFT073
gcuacauaacgca

SEQ ID NO: 578386 - RNA, 17 nt, Escherichia coli CFT073
gcuacauaacgcagcgg

SEQ ID NO: 578387 - RNA, 20 nt, Escherichia coli CFT073
gcuaauaauguaauaugcag

SEQ ID NO: 578388 - RNA, 12 nt, Escherichia coli CFT073
gcuaauaaacag

SEQ ID NO: 578389 - RNA, 14 nt, Escherichia coli CFT073
gcuaauagcgcagc

SEQ ID NO: 578390 - RNA, 16 nt, Escherichia coli CFT073
gcuaauagcgcagcgg

SEQ ID NO: 578391 - RNA, 13 nt, Escherichia coli CFT073
gcuaauauuuucg

SEQ ID NO: 578392 - RNA, 21 nt, Escherichia coli CFT073
gcuaaucgucaucagcgccaa

SEQ ID NO: 578393 - RNA, 19 nt, Escherichia coli CFT073
gcuaaucgucaucgacagc

SEQ ID NO: 578394 - RNA, 20 nt, Escherichia coli CFT073
gcuaaugcgacccacgcccc

SEQ ID NO: 578395 - RNA, 20 nt, Escherichia coli CFT073
gcuaccaucgacaccaucgc

SEQ ID NO: 578396 - RNA, 17 nt, Escherichia coli CFT073
gcuaccaugcuaauaau

SEQ ID NO: 578397 - RNA, 18 nt, Escherichia coli CFT073
gcucccaaaccgcccagc

SEQ ID NO: 578398 - RNA, 17 nt, Escherichia coli CFT073
gcuccccagaccaauug

SEQ ID NO: 578399 - RNA, 14 nt, Escherichia coli CFT073
gcuccauuccgugc

SEQ ID NO: 578400 - RNA, 20 nt, Escherichia coli CFT073
gcuccguccagccaccgcgu

SEQ ID NO: 578401 - RNA, 21 nt, Escherichia coli CFT073
gcucgaauuaaaggauauucg

SEQ ID NO: 578402 - RNA, 18 nt, Escherichia coli CFT073
gcucgaagaguuccagcg

SEQ ID NO: 578403 - RNA, 20 nt, Escherichia coli CFT073
gcucgaagaguuccagcgcc

SEQ ID NO: 578404 - RNA, 22 nt, Escherichia coli CFT073
gcucuauugccguaaucgccuc

SEQ ID NO: 578405 - RNA, 19 nt, Escherichia coli CFT073
gcucucauccaauaacgug

SEQ ID NO: 578406 - RNA, 24 nt, Escherichia coli CFT073
gcugaauuuccugcgcuuucugcu

SEQ ID NO: 578407 - RNA, 14 nt, Escherichia coli CFT073
gcugacaaacugcg

SEQ ID NO: 578408 - RNA, 20 nt, Escherichia coli CFT073
gcugacauaaacaccagcaa

SEQ ID NO: 578409 - RNA, 19 nt, Escherichia coli CFT073
gcugaauuucaucaccagc

SEQ ID NO: 578410 - RNA, 12 nt, Escherichia coli CFT073
gcugaacgcagg

SEQ ID NO: 578411 - RNA, 22 nt, Escherichia coli CFT073
gcugaacgccugcaccagccuu

SEQ ID NO: 578412 - RNA, 15 nt, Escherichia coli CFT073
gcucucgccgcgcuc

SEQ ID NO: 578413 - RNA, 14 nt, Escherichia coli CFT073
gcugaugcuggcac

SEQ ID NO: 578414 - RNA, 14 nt, Escherichia coli CFT073
gcugauaaaucccg

SEQ ID NO: 578415 - RNA, 18 nt, Escherichia coli CFT073
gcugauaccgcguuggcg

SEQ ID NO: 578416 - RNA, 13 nt, Escherichia coli CFT073
gcugauacgcgca

SEQ ID NO: 578417 - RNA, 17 nt, Escherichia coli CFT073
gcugauauuucggcacu

SEQ ID NO: 578418 - RNA, 15 nt, Escherichia coli CFT073
gcugcaccaguaagc

SEQ ID NO: 578419 - RNA, 11 nt, Escherichia coli CFT073
gcugcaccagc

SEQ ID NO: 578420 - RNA, 20 nt, Escherichia coli CFT073
gcugcacauacugcaucagc

SEQ ID NO: 578421 - RNA, 22 nt, Escherichia coli CFT073
gcugcaauugcggcaggucauc

SEQ ID NO: 578422 - RNA, 21 nt, Escherichia coli CFT073
gcugcaaggcucuauacgcau

SEQ ID NO: 578423 - RNA, 20 nt, Escherichia coli CFT073
gcugaguauuaaccgguugu

SEQ ID NO: 578424 - RNA, 21 nt, Escherichia coli CFT073
gcugaccgucaaagcgccagc

SEQ ID NO: 578425 - RNA, 15 nt, Escherichia coli CFT073
gcugaccgucgcagc

SEQ ID NO: 578426 - RNA, 19 nt, Escherichia coli CFT073
gcugacucggcugcugcca

SEQ ID NO: 578427 - RNA, 15 nt, Escherichia coli CFT073
gcugacugacuucaa

SEQ ID NO: 578428 - RNA, 22 nt, Escherichia coli CFT073
gcugaccgcuucaucugcacgc

SEQ ID NO: 578429 - RNA, 12 nt, Escherichia coli CFT073
gcugaccgcuug

SEQ ID NO: 578430 - RNA, 16 nt, Escherichia coli CFT073
gcugcgaaguuuuucc

SEQ ID NO: 578431 - RNA, 19 nt, Escherichia coli CFT073
gcugcgaaguuuuuccgcc

SEQ ID NO: 578432 - RNA, 15 nt, Escherichia coli CFT073
gcugccugcgccgau

SEQ ID NO: 578433 - RNA, 20 nt, Escherichia coli CFT073
gcugccugcggcgaucuuca

SEQ ID NO: 578434 - RNA, 22 nt, Escherichia coli CFT073
gcugccugccaguaaauggcgc

SEQ ID NO: 578435 - RNA, 12 nt, Escherichia coli CFT073
gcugccagcggu

SEQ ID NO: 578436 - RNA, 17 nt, Escherichia coli CFT073
gcugccaggcaccgcgu

SEQ ID NO: 578437 - RNA, 19 nt, Escherichia coli CFT073
gcugcugaagcaacaguaa

SEQ ID NO: 578438 - RNA, 15 nt, Escherichia coli CFT073
gcugcucacaccaug

SEQ ID NO: 578439 - RNA, 15 nt, Escherichia coli CFT073
gcugcuauggcgcgu

SEQ ID NO: 578440 - RNA, 21 nt, Escherichia coli CFT073
gcugcguaauucgccaccggc

SEQ ID NO: 578441 - RNA, 15 nt, Escherichia coli CFT073
gcugcguacagcgcg

SEQ ID NO: 578442 - RNA, 18 nt, Escherichia coli CFT073
gcugcgucuuccacuuca

SEQ ID NO: 578443 - RNA, 20 nt, Escherichia coli CFT073
gcugcgucuuccacuucauc

SEQ ID NO: 578444 - RNA, 17 nt, Escherichia coli CFT073
gcugcgucuuccgcaau

SEQ ID NO: 578445 - RNA, 19 nt, Escherichia coli CFT073
gcugcgcuucuuccagcau

SEQ ID NO: 578446 - RNA, 13 nt, Escherichia coli CFT073
gcugcgcccaguu

SEQ ID NO: 578447 - RNA, 16 nt, Escherichia coli CFT073
gcugcgccauauaccg

SEQ ID NO: 578448 - RNA, 19 nt, Escherichia coli CFT073
gcugcgcaggcaauagucg

SEQ ID NO: 578449 - RNA, 15 nt, Escherichia coli CFT073
ggaaauuccagcggc

SEQ ID NO: 578450 - RNA, 18 nt, Escherichia coli CFT073
ggaacaauccucccuuac

SEQ ID NO: 578451 - RNA, 19 nt, Escherichia coli CFT073
ggaaaguuuacgucgccag

SEQ ID NO: 578452 - RNA, 20 nt, Escherichia coli CFT073
ggaaauacccuggcguuuga

SEQ ID NO: 578453 - RNA, 21 nt, Escherichia coli CFT073
ggaaaugggugacaucgcccu

SEQ ID NO: 578454 - RNA, 16 nt, Escherichia coli CFT073
ggaacaucgaugccgc

SEQ ID NO: 578455 - RNA, 14 nt, Escherichia coli CFT073
ggaagugaucuuuc

SEQ ID NO: 578456 - RNA, 20 nt, Escherichia coli CFT073
ggaauaaaugucacgucauc

SEQ ID NO: 578457 - RNA, 14 nt, Escherichia coli CFT073
ggaauaauaauguc

SEQ ID NO: 578458 - RNA, 17 nt, Escherichia coli CFT073
ggaagcgugcaucggca

SEQ ID NO: 578459 - RNA, 17 nt, Escherichia coli CFT073
ggaagcuaccgaccaga

SEQ ID NO: 578460 - RNA, 19 nt, Escherichia coli CFT073
ggaagaacaucacugcaaa

SEQ ID NO: 578461 - RNA, 15 nt, Escherichia coli CFT073
ggaagcaauaagcac

SEQ ID NO: 578462 - RNA, 20 nt, Escherichia coli CFT073
gcuuuuaauucacuucuguu

SEQ ID NO: 578463 - RNA, 20 nt, Escherichia coli CFT073
gcuuuggcaaauggcgcuaa

SEQ ID NO: 578464 - RNA, 15 nt, Escherichia coli CFT073
gcuuugucauuaaau

SEQ ID NO: 578465 - RNA, 14 nt, Escherichia coli CFT073
gcuuugaccucccg

SEQ ID NO: 578466 - RNA, 18 nt, Escherichia coli CFT073
ggaaaaucugcgggaaca

SEQ ID NO: 578467 - RNA, 17 nt, Escherichia coli CFT073
ggaaacagccacccauc

SEQ ID NO: 578468 - RNA, 19 nt, Escherichia coli CFT073
ggaaacgagccauaaaauc

SEQ ID NO: 578469 - RNA, 17 nt, Escherichia coli CFT073
gcuuuagaaucggugau

SEQ ID NO: 578470 - RNA, 15 nt, Escherichia coli CFT073
gcuuuaacgcccuga

SEQ ID NO: 578471 - RNA, 19 nt, Escherichia coli CFT073
gcuuuaccaccgucaauaa

SEQ ID NO: 578472 - RNA, 19 nt, Escherichia coli CFT073
gcuuuaccgcugcgccaua

SEQ ID NO: 578473 - RNA, 19 nt, Escherichia coli CFT073
gcuuucucuuccagcagcg

SEQ ID NO: 578474 - RNA, 21 nt, Escherichia coli CFT073
gcuuucugcaaccagaaaguc

SEQ ID NO: 578475 - RNA, 13 nt, Escherichia coli CFT073
gcuuucgaccagc

SEQ ID NO: 578476 - RNA, 15 nt, Escherichia coli CFT073
gcuuuccugaucaau

SEQ ID NO: 578477 - RNA, 19 nt, Escherichia coli CFT073
gcuuuccgucagcggcagc

SEQ ID NO: 578478 - RNA, 14 nt, Escherichia coli CFT073
gcuugaaagcgggc

SEQ ID NO: 578479 - RNA, 14 nt, Escherichia coli CFT073
gcuucuucuccagc

SEQ ID NO: 578480 - RNA, 16 nt, Escherichia coli CFT073
gcuuguugauucugau

SEQ ID NO: 578481 - RNA, 14 nt, Escherichia coli CFT073
gcuugugcaccagc

SEQ ID NO: 578482 - RNA, 16 nt, Escherichia coli CFT073
gcuugugccaccagca

SEQ ID NO: 578483 - RNA, 14 nt, Escherichia coli CFT073
ggagaauagcgcca

SEQ ID NO: 578484 - RNA, 16 nt, Escherichia coli CFT073
ggagacauuacgucca

SEQ ID NO: 578485 - RNA, 23 nt, Escherichia coli CFT073
ggacuguucauuuuguaggccug

SEQ ID NO: 578486 - RNA, 22 nt, Escherichia coli CFT073
ggaauagcgaagaauacgcccc

SEQ ID NO: 578487 - RNA, 18 nt, Escherichia coli CFT073
ggaauggaaacagcacca

SEQ ID NO: 578488 - RNA, 18 nt, Escherichia coli CFT073
ggaaugcagucacgccag

SEQ ID NO: 578489 - RNA, 16 nt, Escherichia coli CFT073
ggaauuucuuucagca

SEQ ID NO: 578490 - RNA, 16 nt, Escherichia coli CFT073
ggaauuugcuccgcca

SEQ ID NO: 578491 - RNA, 19 nt, Escherichia coli CFT073
ggaauuguucgacugucgu

SEQ ID NO: 578492 - RNA, 18 nt, Escherichia coli CFT073
gcuuccaggcaaucagua

SEQ ID NO: 578493 - RNA, 21 nt, Escherichia coli CFT073
gcuuccagcgucgcggucaga

SEQ ID NO: 578494 - RNA, 22 nt, Escherichia coli CFT073
gcuucauuuacaucacgcagcu

SEQ ID NO: 578495 - RNA, 19 nt, Escherichia coli CFT073
gcuucaucuuuaucaauca

SEQ ID NO: 578496 - RNA, 23 nt, Escherichia coli CFT073
gcuucaucuuuaucaaucagccc

SEQ ID NO: 578497 - RNA, 17 nt, Escherichia coli CFT073
gcuucagcguaucccag

SEQ ID NO: 578498 - RNA, 18 nt, Escherichia coli CFT073
gcuucagcuaaacagccc

SEQ ID NO: 578499 - RNA, 17 nt, Escherichia coli CFT073
gcuucaaagacgcuuuc

SEQ ID NO: 578500 - RNA, 17 nt, Escherichia coli CFT073
gcuuauugccggaugcg

SEQ ID NO: 578501 - RNA, 22 nt, Escherichia coli CFT073
gcuuauugcuucaagaugccau

SEQ ID NO: 578502 - RNA, 17 nt, Escherichia coli CFT073
gcuuauucaucaauucg

SEQ ID NO: 578503 - RNA, 21 nt, Escherichia coli CFT073
gcuucaacagcggcauuacgc

SEQ ID NO: 578504 - RNA, 13 nt, Escherichia coli CFT073
gcuucaaccagug

SEQ ID NO: 578505 - RNA, 20 nt, Escherichia coli CFT073
gcuucaaccagugcaccagc

SEQ ID NO: 578506 - RNA, 16 nt, Escherichia coli CFT073
gcuucaacacaggccg

SEQ ID NO: 578507 - RNA, 13 nt, Escherichia coli CFT073
gcuucaauaucau

SEQ ID NO: 578508 - RNA, 19 nt, Escherichia coli CFT073
gcuucaaucagcgucgcgu

SEQ ID NO: 578509 - RNA, 19 nt, Escherichia coli CFT073
gcuucacgcggguugccac

SEQ ID NO: 578510 - RNA, 16 nt, Escherichia coli CFT073
gcuucacgcacugacu

SEQ ID NO: 578511 - RNA, 16 nt, Escherichia coli CFT073
gcuuaagccaucauca

SEQ ID NO: 578512 - RNA, 15 nt, Escherichia coli CFT073
gcuuaaucaauugca

SEQ ID NO: 578513 - RNA, 17 nt, Escherichia coli CFT073
gcuuaaucaccagcgca

SEQ ID NO: 578514 - RNA, 18 nt, Escherichia coli CFT073
gcuuaaugagauaaucaa

SEQ ID NO: 578515 - RNA, 12 nt, Escherichia coli CFT073
gcuuaacaacgg

SEQ ID NO: 578516 - RNA, 21 nt, Escherichia coli CFT073
gcuuacucuuucaauuugcag

SEQ ID NO: 578517 - RNA, 18 nt, Escherichia coli CFT073
gcuuacugagauagugau

SEQ ID NO: 578518 - RNA, 16 nt, Escherichia coli CFT073
gcuuaguaagcccagg

SEQ ID NO: 578519 - RNA, 19 nt, Escherichia coli CFT073
gcuuaucagaccuacggau

SEQ ID NO: 578520 - RNA, 16 nt, Escherichia coli CFT073
gcuuaucaggccuaaa

SEQ ID NO: 578521 - RNA, 23 nt, Escherichia coli CFT073
gcuuaucaggccuacaauuucag

SEQ ID NO: 578522 - RNA, 20 nt, Escherichia coli CFT073
gcuuaucaggccuacaugau

SEQ ID NO: 578523 - RNA, 20 nt, Escherichia coli CFT073
gcuuaucaggccuacgugau

SEQ ID NO: 578524 - RNA, 19 nt, Escherichia coli CFT073
gcuuaucaggccuacgugu

SEQ ID NO: 578525 - RNA, 17 nt, Escherichia coli CFT073
gcuuaucaggccugcaa

SEQ ID NO: 578526 - RNA, 13 nt, Escherichia coli CFT073
gcuuaucagggcc

SEQ ID NO: 578527 - RNA, 22 nt, Escherichia coli CFT073
gcuuccaguaacacuuccgggu

SEQ ID NO: 578528 - RNA, 18 nt, Escherichia coli CFT073
gcuuccauauuggcgcgg

SEQ ID NO: 578529 - RNA, 17 nt, Escherichia coli CFT073
gcuuccauugccugcaa

SEQ ID NO: 578530 - RNA, 22 nt, Escherichia coli CFT073
gcuuccggcguggugccgauau

SEQ ID NO: 578531 - RNA, 23 nt, Escherichia coli CFT073
gcuucgaaacagaaauaccagcc

SEQ ID NO: 578532 - RNA, 16 nt, Escherichia coli CFT073
gcuuccuuaagccgcu

SEQ ID NO: 578533 - RNA, 21 nt, Escherichia coli CFT073
gcuucgagcuggaagccacaa

SEQ ID NO: 578534 - RNA, 20 nt, Escherichia coli CFT073
gcuucgccagugacgaccuu

SEQ ID NO: 578535 - RNA, 19 nt, Escherichia coli CFT073
gcuucgccaaugaucccgc

SEQ ID NO: 578536 - RNA, 21 nt, Escherichia coli CFT073
gcuucgcucucuuucaccagc

SEQ ID NO: 578537 - RNA, 17 nt, Escherichia coli CFT073
gcuucguuuuccgccac

SEQ ID NO: 578538 - RNA, 15 nt, Escherichia coli CFT073
gcuucgucgccagcu

SEQ ID NO: 578539 - RNA, 22 nt, Escherichia coli CFT073
gcuucuaccuuauccagcagau

SEQ ID NO: 578540 - RNA, 23 nt, Escherichia coli CFT073
gcuucuggcgacaucuucucuac

SEQ ID NO: 578541 - RNA, 16 nt, Escherichia coli CFT073
gcuguaauuaccagcg

SEQ ID NO: 578542 - RNA, 22 nt, Escherichia coli CFT073
gcuguaauuaccagcgcaggaa

SEQ ID NO: 578543 - RNA, 16 nt, Escherichia coli CFT073
gcugguuucuggcggu

SEQ ID NO: 578544 - RNA, 14 nt, Escherichia coli CFT073
gcugguuuucagcg

SEQ ID NO: 578545 - RNA, 19 nt, Escherichia coli CFT073
gcugguuuucagcgaaaca

SEQ ID NO: 578546 - RNA, 13 nt, Escherichia coli CFT073
gcuguacucacca

SEQ ID NO: 578547 - RNA, 17 nt, Escherichia coli CFT073
gcuguacucaccaacgc

SEQ ID NO: 578548 - RNA, 14 nt, Escherichia coli CFT073
gcugguugaugcgc

SEQ ID NO: 578549 - RNA, 22 nt, Escherichia coli CFT073
gcugguguaaaaacugccaggc

SEQ ID NO: 578550 - RNA, 18 nt, Escherichia coli CFT073
gcugguguaacugcgcca

SEQ ID NO: 578551 - RNA, 18 nt, Escherichia coli CFT073
gcugguggaguaaacacc

SEQ ID NO: 578552 - RNA, 19 nt, Escherichia coli CFT073
gcugguggcaagaccugcc

SEQ ID NO: 578553 - RNA, 18 nt, Escherichia coli CFT073
gcuguggcagucacuucc

SEQ ID NO: 578554 - RNA, 14 nt, Escherichia coli CFT073
gcugucgaaaagau

SEQ ID NO: 578555 - RNA, 20 nt, Escherichia coli CFT073
gcuguuccggcacaccuuca

SEQ ID NO: 578556 - RNA, 17 nt, Escherichia coli CFT073
gcuguuccggcggcagg

SEQ ID NO: 578557 - RNA, 19 nt, Escherichia coli CFT073
gcuguuaaacgccgguucc

SEQ ID NO: 578558 - RNA, 24 nt, Escherichia coli CFT073
gcuguuacuuucacaaugcccgga

SEQ ID NO: 578559 - RNA, 14 nt, Escherichia coli CFT073
gcuggcgcuggcga

SEQ ID NO: 578560 - RNA, 18 nt, Escherichia coli CFT073
gcuggucagcaucgucaa

SEQ ID NO: 578561 - RNA, 20 nt, Escherichia coli CFT073
gcugguaccugucgcuuuug

SEQ ID NO: 578562 - RNA, 12 nt, Escherichia coli CFT073
uuccaacgaauc

SEQ ID NO: 578563 - RNA, 22 nt, Escherichia coli CFT073
uucauugccacgucaucuguaa

SEQ ID NO: 578564 - RNA, 15 nt, Escherichia coli CFT073
uucauguaacgcugc

SEQ ID NO: 578565 - RNA, 20 nt, Escherichia coli CFT073
uucauuaacccguuuacaua

SEQ ID NO: 578566 - RNA, 18 nt, Escherichia coli CFT073
uucauuacuauaacccac

SEQ ID NO: 578567 - RNA, 18 nt, Escherichia coli CFT073
uuccagcgcaucgccaaa

SEQ ID NO: 578568 - RNA, 16 nt, Escherichia coli CFT073
uuccagcgccaguaau

SEQ ID NO: 578569 - RNA, 16 nt, Escherichia coli CFT073
uuccagcaucgaccag

SEQ ID NO: 578570 - RNA, 14 nt, Escherichia coli CFT073
uuccagcgacaccu

SEQ ID NO: 578571 - RNA, 14 nt, Escherichia coli CFT073
uuccagacggguca

SEQ ID NO: 578572 - RNA, 22 nt, Escherichia coli CFT073
uuccagacugaugugcuccauc

SEQ ID NO: 578573 - RNA, 17 nt, Escherichia coli CFT073
uuccagaucaccgcaga

SEQ ID NO: 578574 - RNA, 22 nt, Escherichia coli CFT073
uuccagcagcuuaagcgaccag

SEQ ID NO: 578575 - RNA, 14 nt, Escherichia coli CFT073
uuccagcaucagca

SEQ ID NO: 578576 - RNA, 23 nt, Escherichia coli CFT073
uuccacgccguuuuuacccagca

SEQ ID NO: 578577 - RNA, 12 nt, Escherichia coli CFT073
uuccacgcuaua

SEQ ID NO: 578578 - RNA, 14 nt, Escherichia coli CFT073
uuccacuuccacca

SEQ ID NO: 578579 - RNA, 20 nt, Escherichia coli CFT073
uucccggcaaucgccagauc

SEQ ID NO: 578580 - RNA, 21 nt, Escherichia coli CFT073
uuccgccacauccguccgcaa

SEQ ID NO: 578581 - RNA, 23 nt, Escherichia coli CFT073
uuccgcaccugccagcgccgaca

SEQ ID NO: 578582 - RNA, 19 nt, Escherichia coli CFT073
uuccgagaugguuguaauc

SEQ ID NO: 578583 - RNA, 20 nt, Escherichia coli CFT073
uucccacuaacugcgcgcug

SEQ ID NO: 578584 - RNA, 17 nt, Escherichia coli CFT073
uucccuuuuucacauca

SEQ ID NO: 578585 - RNA, 14 nt, Escherichia coli CFT073
uuccauaccggcug

SEQ ID NO: 578586 - RNA, 14 nt, Escherichia coli CFT073
uuccauaucaagca

SEQ ID NO: 578587 - RNA, 12 nt, Escherichia coli CFT073
uuccaucgacca

SEQ ID NO: 578588 - RNA, 13 nt, Escherichia coli CFT073
uuccaucgcaucu

SEQ ID NO: 578589 - RNA, 23 nt, Escherichia coli CFT073
uucccaaagaucaacugccgccu

SEQ ID NO: 578590 - RNA, 13 nt, Escherichia coli CFT073
uuccagcgucgcg

SEQ ID NO: 578591 - RNA, 21 nt, Escherichia coli CFT073
uuccagcuuccaggcaaucag

SEQ ID NO: 578592 - RNA, 17 nt, Escherichia coli CFT073
uuccaguaaccagccgu

SEQ ID NO: 578593 - RNA, 14 nt, Escherichia coli CFT073
uucacuuucugacc

SEQ ID NO: 578594 - RNA, 21 nt, Escherichia coli CFT073
uucagacaggcgaaaccagca

SEQ ID NO: 578595 - RNA, 16 nt, Escherichia coli CFT073
uucacugcgaccagca

SEQ ID NO: 578596 - RNA, 23 nt, Escherichia coli CFT073
uucacuucuguuuuaucaauucu

SEQ ID NO: 578597 - RNA, 20 nt, Escherichia coli CFT073
uucagcaaugacauacagca

SEQ ID NO: 578598 - RNA, 12 nt, Escherichia coli CFT073
uucagcaccaga

SEQ ID NO: 578599 - RNA, 16 nt, Escherichia coli CFT073
uucagcgugccgaaga

SEQ ID NO: 578600 - RNA, 17 nt, Escherichia coli CFT073
uucagcguuucgucggu

SEQ ID NO: 578601 - RNA, 16 nt, Escherichia coli CFT073
uucagcuuauccagcg

SEQ ID NO: 578602 - RNA, 17 nt, Escherichia coli CFT073
uucagcuuauucaucaa

SEQ ID NO: 578603 - RNA, 14 nt, Escherichia coli CFT073
uucacgccgcauca

SEQ ID NO: 578604 - RNA, 15 nt, Escherichia coli CFT073
uucaccucagugacc

SEQ ID NO: 578605 - RNA, 21 nt, Escherichia coli CFT073
uuauccgacuugucaggcgga

SEQ ID NO: 578606 - RNA, 18 nt, Escherichia coli CFT073
uucacgcuuacucuucgu

SEQ ID NO: 578607 - RNA, 16 nt, Escherichia coli CFT073
uucacggcgauaccag

SEQ ID NO: 578608 - RNA, 13 nt, Escherichia coli CFT073
uucacucugcugu

SEQ ID NO: 578609 - RNA, 22 nt, Escherichia coli CFT073
uucagguaauauugcguaccug

SEQ ID NO: 578610 - RNA, 20 nt, Escherichia coli CFT073
uucagggagguuucgaccac

SEQ ID NO: 578611 - RNA, 23 nt, Escherichia coli CFT073
uucaucaacgguuuuacaauguc

SEQ ID NO: 578612 - RNA, 20 nt, Escherichia coli CFT073
uucaucagcguuuccgcugg

SEQ ID NO: 578613 - RNA, 12 nt, Escherichia coli CFT073
uucaucacgcca

SEQ ID NO: 578614 - RNA, 13 nt, Escherichia coli CFT073
uucaucaucaggc

SEQ ID NO: 578615 - RNA, 19 nt, Escherichia coli CFT073
uucaucaucaguccguugu

SEQ ID NO: 578616 - RNA, 11 nt, Escherichia coli CFT073
uucauccagca

SEQ ID NO: 578617 - RNA, 14 nt, Escherichia coli CFT073
uucaucuuccagcu

SEQ ID NO: 578618 - RNA, 14 nt, Escherichia coli CFT073
uucaucuucgucaa

SEQ ID NO: 578619 - RNA, 21 nt, Escherichia coli CFT073
uucaucucgaauacgccgaua

SEQ ID NO: 578620 - RNA, 17 nt, Escherichia coli CFT073
uucaucuguuugccgga

SEQ ID NO: 578621 - RNA, 21 nt, Escherichia coli CFT073
uucaugguacgggacagcagg

SEQ ID NO: 578622 - RNA, 15 nt, Escherichia coli CFT073
uucaugccauccgca

SEQ ID NO: 578623 - RNA, 11 nt, Escherichia coli CFT073
uucauccagcu

SEQ ID NO: 578624 - RNA, 14 nt, Escherichia coli CFT073
uucaucccugaaau

SEQ ID NO: 578625 - RNA, 14 nt, Escherichia coli CFT073
uucaucgccaaaau

SEQ ID NO: 578626 - RNA, 19 nt, Escherichia coli CFT073
uucaucgccauuaccacca

SEQ ID NO: 578627 - RNA, 20 nt, Escherichia coli CFT073
uucggacauguuuuccagca

SEQ ID NO: 578628 - RNA, 19 nt, Escherichia coli CFT073
uucgcuuuucaccgccuua

SEQ ID NO: 578629 - RNA, 20 nt, Escherichia coli CFT073
uucgcuuaacaguuccagca

SEQ ID NO: 578630 - RNA, 23 nt, Escherichia coli CFT073
uucgcuuaacucaccguaggcaa

SEQ ID NO: 578631 - RNA, 21 nt, Escherichia coli CFT073
uucgcuuccuguauaucugac

SEQ ID NO: 578632 - RNA, 21 nt, Escherichia coli CFT073
uucgccgcagguagcagcagc

SEQ ID NO: 578633 - RNA, 18 nt, Escherichia coli CFT073
uucgccgcaucgucacug

SEQ ID NO: 578634 - RNA, 16 nt, Escherichia coli CFT073
uucgcgccaauccaga

SEQ ID NO: 578635 - RNA, 18 nt, Escherichia coli CFT073
uucgcgccgcauccggca

SEQ ID NO: 578636 - RNA, 24 nt, Escherichia coli CFT073
uucgcggauguugcugcaccaggc

SEQ ID NO: 578637 - RNA, 12 nt, Escherichia coli CFT073
uuccgcuuucaa

SEQ ID NO: 578638 - RNA, 23 nt, Escherichia coli CFT073
uuccuuguuuaaggaaaaacgaa

SEQ ID NO: 578639 - RNA, 12 nt, Escherichia coli CFT073
uucgaacgccgc

SEQ ID NO: 578640 - RNA, 13 nt, Escherichia coli CFT073
uucgaagaaaaac

SEQ ID NO: 578641 - RNA, 18 nt, Escherichia coli CFT073
uuccgcgaccugauccau

SEQ ID NO: 578642 - RNA, 20 nt, Escherichia coli CFT073
uuccgccagacaauccagcg

SEQ ID NO: 578643 - RNA, 19 nt, Escherichia coli CFT073
uuccgccgucaucaucggc

SEQ ID NO: 578644 - RNA, 20 nt, Escherichia coli CFT073
uucgccagaauauugccauu

SEQ ID NO: 578645 - RNA, 22 nt, Escherichia coli CFT073
uucgccagacggaaugccaucu

SEQ ID NO: 578646 - RNA, 9 nt, Escherichia coli CFT073
uucgccaga

SEQ ID NO: 578647 - RNA, 23 nt, Escherichia coli CFT073
uucgccagcacggcgcagacggu

SEQ ID NO: 578648 - RNA, 11 nt, Escherichia coli CFT073
uucgcccgccg

SEQ ID NO: 578649 - RNA, 17 nt, Escherichia coli CFT073
uucgcccgccgcuaaca

SEQ ID NO: 578650 - RNA, 23 nt, Escherichia coli CFT073
uucgacagcguuucgccgcccag

SEQ ID NO: 578651 - RNA, 16 nt, Escherichia coli CFT073
uucgacagcaccccga

SEQ ID NO: 578652 - RNA, 19 nt, Escherichia coli CFT073
aaucagaucguugaccugg

SEQ ID NO: 578653 - RNA, 22 nt, Escherichia coli CFT073
aaucagcagcguucccagccag

SEQ ID NO: 578654 - RNA, 19 nt, Escherichia coli CFT073
aaucagcauacuccagccg

SEQ ID NO: 578655 - RNA, 19 nt, Escherichia coli CFT073
aaucagccccuucgccagu

SEQ ID NO: 578656 - RNA, 17 nt, Escherichia coli CFT073
uucuccauuucaaugcg

SEQ ID NO: 578657 - RNA, 16 nt, Escherichia coli CFT073
aaucacgucauauucg

SEQ ID NO: 578658 - RNA, 15 nt, Escherichia coli CFT073
aaucacugccagaau

SEQ ID NO: 578659 - RNA, 12 nt, Escherichia coli CFT073
aaucacggcaaa

SEQ ID NO: 578660 - RNA, 17 nt, Escherichia coli CFT073
aaucacuucaucgccgc

SEQ ID NO: 578661 - RNA, 20 nt, Escherichia coli CFT073
uucuccgcacuccaacucuu

SEQ ID NO: 578662 - RNA, 20 nt, Escherichia coli CFT073
uucugcggcguaacgcacca

SEQ ID NO: 578663 - RNA, 17 nt, Escherichia coli CFT073
uucguuagcaaacgaca

SEQ ID NO: 578664 - RNA, 16 nt, Escherichia coli CFT073
uucguuaaacgccaaa

SEQ ID NO: 578665 - RNA, 16 nt, Escherichia coli CFT073
uucgucgcguuugccc

SEQ ID NO: 578666 - RNA, 14 nt, Escherichia coli CFT073
uucgucuuuggguu

SEQ ID NO: 578667 - RNA, 11 nt, Escherichia coli CFT073
uucguugcauu

SEQ ID NO: 578668 - RNA, 16 nt, Escherichia coli CFT073
uucggcgucacauccg

SEQ ID NO: 578669 - RNA, 16 nt, Escherichia coli CFT073
uucgucgccagcucuu

SEQ ID NO: 578670 - RNA, 12 nt, Escherichia coli CFT073
uucgucgccagc

SEQ ID NO: 578671 - RNA, 18 nt, Escherichia coli CFT073
uucguccgagcggcacca

SEQ ID NO: 578672 - RNA, 20 nt, Escherichia coli CFT073
uucguccaccaggaacucag

SEQ ID NO: 578673 - RNA, 22 nt, Escherichia coli CFT073
uucgggcgcauauugccaucac

SEQ ID NO: 578674 - RNA, 23 nt, Escherichia coli CFT073
uuagccggauaaugcgccagauc

SEQ ID NO: 578675 - RNA, 13 nt, Escherichia coli CFT073
uuagccuguauua

SEQ ID NO: 578676 - RNA, 18 nt, Escherichia coli CFT073
uuagcgauaaaacgccgc

SEQ ID NO: 578677 - RNA, 15 nt, Escherichia coli CFT073
uuagcgccagccaga

SEQ ID NO: 578678 - RNA, 13 nt, Escherichia coli CFT073
uuagcguuugccc

SEQ ID NO: 578679 - RNA, 14 nt, Escherichia coli CFT073
uuacgggucacaaa

SEQ ID NO: 578680 - RNA, 16 nt, Escherichia coli CFT073
uuacgguauaacccag

SEQ ID NO: 578681 - RNA, 14 nt, Escherichia coli CFT073
uuacgcguuuuuca

SEQ ID NO: 578682 - RNA, 22 nt, Escherichia coli CFT073
uuacgcccggacuagcgcuuuu

SEQ ID NO: 578683 - RNA, 22 nt, Escherichia coli CFT073
uuaguauggucgugaucaaugu

SEQ ID NO: 578684 - RNA, 21 nt, Escherichia coli CFT073
uuagugcgcaguugccggaug

SEQ ID NO: 578685 - RNA, 15 nt, Escherichia coli CFT073
uuaguaggccggaua

SEQ ID NO: 578686 - RNA, 17 nt, Escherichia coli CFT073
uuagcuggagaguuaga

SEQ ID NO: 578687 - RNA, 14 nt, Escherichia coli CFT073
uuaggcgcaggaua

SEQ ID NO: 578688 - RNA, 18 nt, Escherichia coli CFT073
uuaucaccaaugauaagu

SEQ ID NO: 578689 - RNA, 23 nt, Escherichia coli CFT073
uuaucacgcaucugcuguaaagu

SEQ ID NO: 578690 - RNA, 19 nt, Escherichia coli CFT073
uuaaucgccaguuucugcc

SEQ ID NO: 578691 - RNA, 19 nt, Escherichia coli CFT073
uuaaugccggacuccagca

SEQ ID NO: 578692 - RNA, 12 nt, Escherichia coli CFT073
uuacauauauua

SEQ ID NO: 578693 - RNA, 16 nt, Escherichia coli CFT073
uuacagcaucggcuug

SEQ ID NO: 578694 - RNA, 13 nt, Escherichia coli CFT073
uuaauauauauua

SEQ ID NO: 578695 - RNA, 17 nt, Escherichia coli CFT073
uuaauauuaaaccaccc

SEQ ID NO: 578696 - RNA, 22 nt, Escherichia coli CFT073
uuaauaaugccgcaacgccaua

SEQ ID NO: 578697 - RNA, 20 nt, Escherichia coli CFT073
uuaaccacaaacgauccugg

SEQ ID NO: 578698 - RNA, 19 nt, Escherichia coli CFT073
uuaacccaaauccgccauc

SEQ ID NO: 578699 - RNA, 19 nt, Escherichia coli CFT073
uuaacccauuuaaaaauca

SEQ ID NO: 578700 - RNA, 17 nt, Escherichia coli CFT073
uuaaccccagaggcgau

SEQ ID NO: 578701 - RNA, 13 nt, Escherichia coli CFT073
uuaacccgcaaca

SEQ ID NO: 578702 - RNA, 13 nt, Escherichia coli CFT073
uuaaaauugauaa

SEQ ID NO: 578703 - RNA, 12 nt, Escherichia coli CFT073
uuaaacaaccca

SEQ ID NO: 578704 - RNA, 17 nt, Escherichia coli CFT073
uuaaaccagaucugacg

SEQ ID NO: 578705 - RNA, 19 nt, Escherichia coli CFT073
uuaaagccgcgaaacugcg

SEQ ID NO: 578706 - RNA, 12 nt, Escherichia coli CFT073
uuaaauacgccu

SEQ ID NO: 578707 - RNA, 19 nt, Escherichia coli CFT073
uguugaagaugcgguuuuc

SEQ ID NO: 578708 - RNA, 16 nt, Escherichia coli CFT073
uguucuggaaaaaauu

SEQ ID NO: 578709 - RNA, 17 nt, Escherichia coli CFT073
uguucuggccguaccca

SEQ ID NO: 578710 - RNA, 22 nt, Escherichia coli CFT073
uguugcaguacucgcacuuuuc

SEQ ID NO: 578711 - RNA, 16 nt, Escherichia coli CFT073
uguugaggaagcgcaa

SEQ ID NO: 578712 - RNA, 19 nt, Escherichia coli CFT073
ugugaagaauaaauuuggg

SEQ ID NO: 578713 - RNA, 21 nt, Escherichia coli CFT073
ugugaaaccuuuaugcagcuc

SEQ ID NO: 578714 - RNA, 15 nt, Escherichia coli CFT073
ugucugcugugugau

SEQ ID NO: 578715 - RNA, 13 nt, Escherichia coli CFT073
ugucuucccggcu

SEQ ID NO: 578716 - RNA, 14 nt, Escherichia coli CFT073
ugucuaaccgccug

SEQ ID NO: 578717 - RNA, 20 nt, Escherichia coli CFT073
ugucuccagggcggaaauag

SEQ ID NO: 578718 - RNA, 22 nt, Escherichia coli CFT073
ugucugaugcgacgcggcagcg

SEQ ID NO: 578719 - RNA, 12 nt, Escherichia coli CFT073
ugugauauucac

SEQ ID NO: 578720 - RNA, 23 nt, Escherichia coli CFT073
ugugaaugaucagcgguuuugcc

SEQ ID NO: 578721 - RNA, 14 nt, Escherichia coli CFT073
ugugacauccagau

SEQ ID NO: 578722 - RNA, 18 nt, Escherichia coli CFT073
ugugacauccagaucacg

SEQ ID NO: 578723 - RNA, 19 nt, Escherichia coli CFT073
ugugacauccagaucacgc

SEQ ID NO: 578724 - RNA, 18 nt, Escherichia coli CFT073
ugugauccacugcagaau

SEQ ID NO: 578725 - RNA, 14 nt, Escherichia coli CFT073
ugugaucgaauaua

SEQ ID NO: 578726 - RNA, 14 nt, Escherichia coli CFT073
ugugcaaaaaaagc

SEQ ID NO: 578727 - RNA, 14 nt, Escherichia coli CFT073
ugugcaaaaaaauu

SEQ ID NO: 578728 - RNA, 15 nt, Escherichia coli CFT073
ugucaccagccgguc

SEQ ID NO: 578729 - RNA, 20 nt, Escherichia coli CFT073
uguaguccggauaaggcguu

SEQ ID NO: 578730 - RNA, 17 nt, Escherichia coli CFT073
ugucagaaagaaauuuc

SEQ ID NO: 578731 - RNA, 15 nt, Escherichia coli CFT073
ugucgguguagacag

SEQ ID NO: 578732 - RNA, 16 nt, Escherichia coli CFT073
ugucguacauagcguu

SEQ ID NO: 578733 - RNA, 23 nt, Escherichia coli CFT073
ugucguccgguacgacaaucuca

SEQ ID NO: 578734 - RNA, 17 nt, Escherichia coli CFT073
ugucgucgguaucaaua

SEQ ID NO: 578735 - RNA, 22 nt, Escherichia coli CFT073
uguucgcgucuuaucaggccua

SEQ ID NO: 578736 - RNA, 13 nt, Escherichia coli CFT073
uguucgcugguga

SEQ ID NO: 578737 - RNA, 23 nt, Escherichia coli CFT073
uguucgauaaccaucccuucacc

SEQ ID NO: 578738 - RNA, 22 nt, Escherichia coli CFT073
uguuauucacagagauaaucag

SEQ ID NO: 578739 - RNA, 13 nt, Escherichia coli CFT073
uguuagcgugcag

SEQ ID NO: 578740 - RNA, 13 nt, Escherichia coli CFT073
uguuaggaucacg

SEQ ID NO: 578741 - RNA, 17 nt, Escherichia coli CFT073
uguuauaccaguccacc

SEQ ID NO: 578742 - RNA, 14 nt, Escherichia coli CFT073
uguuaugcgaaaua

SEQ ID NO: 578743 - RNA, 13 nt, Escherichia coli CFT073
ugugggccggaua

SEQ ID NO: 578744 - RNA, 20 nt, Escherichia coli CFT073
ugugggccugauaagaugcg

SEQ ID NO: 578745 - RNA, 18 nt, Escherichia coli CFT073
uguggggauuuccaacga

SEQ ID NO: 578746 - RNA, 20 nt, Escherichia coli CFT073
ugugggucaccgcaaaaccg

SEQ ID NO: 578747 - RNA, 22 nt, Escherichia coli CFT073
ugugggucuaaaaacaauucuu

SEQ ID NO: 578748 - RNA, 15 nt, Escherichia coli CFT073
uguggcgcgaccaga

SEQ ID NO: 578749 - RNA, 22 nt, Escherichia coli CFT073
uguggcgguuuuucagcuuauc

SEQ ID NO: 578750 - RNA, 16 nt, Escherichia coli CFT073
ugugccaauugccugg

SEQ ID NO: 578751 - RNA, 13 nt, Escherichia coli CFT073
ugugccaguuuca

SEQ ID NO: 578752 - RNA, 18 nt, Escherichia coli CFT073
ugugcggaagucgcugcu

SEQ ID NO: 578753 - RNA, 18 nt, Escherichia coli CFT073
ugugcuuauuuuagcauu

SEQ ID NO: 578754 - RNA, 15 nt, Escherichia coli CFT073
aaucgcuucaucgcc

SEQ ID NO: 578755 - RNA, 17 nt, Escherichia coli CFT073
aaucggacgugauucca

SEQ ID NO: 578756 - RNA, 18 nt, Escherichia coli CFT073
aaucggaucaauccccag

SEQ ID NO: 578757 - RNA, 18 nt, Escherichia coli CFT073
aaucggcaccgccgccaa

SEQ ID NO: 578758 - RNA, 13 nt, Escherichia coli CFT073
aaucggcugcacc

SEQ ID NO: 578759 - RNA, 22 nt, Escherichia coli CFT073
aaucggcgaagagagcgccagu

SEQ ID NO: 578760 - RNA, 21 nt, Escherichia coli CFT073
aaucgccugcugaauauugcc

SEQ ID NO: 578761 - RNA, 18 nt, Escherichia coli CFT073
aaucgcuaucagcgccac

SEQ ID NO: 578762 - RNA, 19 nt, Escherichia coli CFT073
uuuuuagcguguuccagcg

SEQ ID NO: 578763 - RNA, 23 nt, Escherichia coli CFT073
uuuuuaauaaaaaggugauuuau

SEQ ID NO: 578764 - RNA, 13 nt, Escherichia coli CFT073
uuuuuacgccugc

SEQ ID NO: 578765 - RNA, 13 nt, Escherichia coli CFT073
uuuuuacgccugu

SEQ ID NO: 578766 - RNA, 15 nt, Escherichia coli CFT073
aaucgugcaucuccu

SEQ ID NO: 578767 - RNA, 19 nt, Escherichia coli CFT073
aaucgucaucagcgccaac

SEQ ID NO: 578768 - RNA, 20 nt, Escherichia coli CFT073
aaucgucagacgaugcgucu

SEQ ID NO: 578769 - RNA, 14 nt, Escherichia coli CFT073
aaucgucagcucgc

SEQ ID NO: 578770 - RNA, 19 nt, Escherichia coli CFT073
aaucgucagcucgcugcca

SEQ ID NO: 578771 - RNA, 22 nt, Escherichia coli CFT073
aaucgucagcucgcugccaucg

SEQ ID NO: 578772 - RNA, 18 nt, Escherichia coli CFT073
aaucgucaggaucagcca

SEQ ID NO: 578773 - RNA, 18 nt, Escherichia coli CFT073
aaucguaccagcgaaacg

SEQ ID NO: 578774 - RNA, 16 nt, Escherichia coli CFT073
aaucguaggccggaua

SEQ ID NO: 578775 - RNA, 14 nt, Escherichia coli CFT073
aaucgguccgccac

SEQ ID NO: 578776 - RNA, 13 nt, Escherichia coli CFT073
aaucggugauaaa

SEQ ID NO: 578777 - RNA, 15 nt, Escherichia coli CFT073
aaugaacucaacgcc

SEQ ID NO: 578778 - RNA, 14 nt, Escherichia coli CFT073
aaugacagccccac

SEQ ID NO: 578779 - RNA, 19 nt, Escherichia coli CFT073
aaugacagccccaccagca

SEQ ID NO: 578780 - RNA, 14 nt, Escherichia coli CFT073
uuuuuguugccuga

SEQ ID NO: 578781 - RNA, 14 nt, Escherichia coli CFT073
aaugggcgcgggca

SEQ ID NO: 578782 - RNA, 21 nt, Escherichia coli CFT073
aauggcuguuaaacgccgguu

SEQ ID NO: 578783 - RNA, 18 nt, Escherichia coli CFT073
aaugggggagagccagca

SEQ ID NO: 578784 - RNA, 15 nt, Escherichia coli CFT073
aaugguaaucagcga

SEQ ID NO: 578785 - RNA, 14 nt, Escherichia coli CFT073
aaugguagccgccc

SEQ ID NO: 578786 - RNA, 16 nt, Escherichia coli CFT073
aaugguaucggcaucg

SEQ ID NO: 578787 - RNA, 16 nt, Escherichia coli CFT073
aauggucuggcgacgg

SEQ ID NO: 578788 - RNA, 14 nt, Escherichia coli CFT073
aauggucaguuucg

SEQ ID NO: 578789 - RNA, 21 nt, Escherichia coli CFT073
aauggcgucaacaacacucuc

SEQ ID NO: 578790 - RNA, 18 nt, Escherichia coli CFT073
aauggcuaucgaaaucaa

SEQ ID NO: 578791 - RNA, 20 nt, Escherichia coli CFT073
aauggcgcuaacucauccgg

SEQ ID NO: 578792 - RNA, 20 nt, Escherichia coli CFT073
aauggccucuggugcaauuu

SEQ ID NO: 578793 - RNA, 17 nt, Escherichia coli CFT073
aaugguucugcacagcu

SEQ ID NO: 578794 - RNA, 15 nt, Escherichia coli CFT073
aaugguuugccagca

SEQ ID NO: 578795 - RNA, 21 nt, Escherichia coli CFT073
aaugucgccaugcgguaaguu

SEQ ID NO: 578796 - RNA, 15 nt, Escherichia coli CFT073
aaugucaccagccgg

SEQ ID NO: 578797 - RNA, 22 nt, Escherichia coli CFT073
aaugucagggacguaccaauga

SEQ ID NO: 578798 - RNA, 19 nt, Escherichia coli CFT073
aaugucagggccaucgcgg

SEQ ID NO: 578799 - RNA, 23 nt, Escherichia coli CFT073
aaugugaaaacccugcgcauggu

SEQ ID NO: 578800 - RNA, 16 nt, Escherichia coli CFT073
aaugucggaugcggcg

SEQ ID NO: 578801 - RNA, 23 nt, Escherichia coli CFT073
aaugucggcggcgaucgccugcu

SEQ ID NO: 578802 - RNA, 14 nt, Escherichia coli CFT073
aaugaguauuacgg

SEQ ID NO: 578803 - RNA, 15 nt, Escherichia coli CFT073
aaugacuuccgccac

SEQ ID NO: 578804 - RNA, 15 nt, Escherichia coli CFT073
aaugacccauuuucu

SEQ ID NO: 578805 - RNA, 22 nt, Escherichia coli CFT073
aaugaucacuuguucagcgaug

SEQ ID NO: 578806 - RNA, 16 nt, Escherichia coli CFT073
aaugccguuugcugca

SEQ ID NO: 578807 - RNA, 15 nt, Escherichia coli CFT073
aaugauuaacagccc

SEQ ID NO: 578808 - RNA, 22 nt, Escherichia coli CFT073
aaugccugcuguugcggggaau

SEQ ID NO: 578809 - RNA, 23 nt, Escherichia coli CFT073
aaugcgccaccacugacacggaa

SEQ ID NO: 578810 - RNA, 12 nt, Escherichia coli CFT073
aaugcgccagac

SEQ ID NO: 578811 - RNA, 12 nt, Escherichia coli CFT073
aaugcgccgcca

SEQ ID NO: 578812 - RNA, 16 nt, Escherichia coli CFT073
aaugcgccgccaaacg

SEQ ID NO: 578813 - RNA, 19 nt, Escherichia coli CFT073
aaugcgccgccaaacgcgg

SEQ ID NO: 578814 - RNA, 19 nt, Escherichia coli CFT073
aauggaugcaucuucauua

SEQ ID NO: 578815 - RNA, 22 nt, Escherichia coli CFT073
aauggauucagucuuaaaaagc

SEQ ID NO: 578816 - RNA, 22 nt, Escherichia coli CFT073
aauggcauccuugcuaaccaac

SEQ ID NO: 578817 - RNA, 21 nt, Escherichia coli CFT073
uuugaugguggucgcaucauc

SEQ ID NO: 578818 - RNA, 20 nt, Escherichia coli CFT073
uuugcagaaauagaaaguga

SEQ ID NO: 578819 - RNA, 18 nt, Escherichia coli CFT073
uuugcagcuuacgcgcca

SEQ ID NO: 578820 - RNA, 17 nt, Escherichia coli CFT073
uuugcaagcguuccaua

SEQ ID NO: 578821 - RNA, 15 nt, Escherichia coli CFT073
uuugccaucucacuu

SEQ ID NO: 578822 - RNA, 20 nt, Escherichia coli CFT073
uuugcgccacgcucugguga

SEQ ID NO: 578823 - RNA, 16 nt, Escherichia coli CFT073
uuugcgcuccuguucc

SEQ ID NO: 578824 - RNA, 16 nt, Escherichia coli CFT073
uuugccuuacgcaccg

SEQ ID NO: 578825 - RNA, 19 nt, Escherichia coli CFT073
uuugccgggcggcggcaca

SEQ ID NO: 578826 - RNA, 15 nt, Escherichia coli CFT073
uuugcccgucugcug

SEQ ID NO: 578827 - RNA, 14 nt, Escherichia coli CFT073
uuugcccuaaagcg

SEQ ID NO: 578828 - RNA, 19 nt, Escherichia coli CFT073
uuugacagcucacgcgcca

SEQ ID NO: 578829 - RNA, 20 nt, Escherichia coli CFT073
uuugaguucacugccguaca

SEQ ID NO: 578830 - RNA, 15 nt, Escherichia coli CFT073
uuugagaacauucau

SEQ ID NO: 578831 - RNA, 14 nt, Escherichia coli CFT073
uuuggcaucggcaa

SEQ ID NO: 578832 - RNA, 22 nt, Escherichia coli CFT073
uuugcugaauuggguucuuucc

SEQ ID NO: 578833 - RNA, 16 nt, Escherichia coli CFT073
uuugcuggucuguucc

SEQ ID NO: 578834 - RNA, 12 nt, Escherichia coli CFT073
uuugcugugaag

SEQ ID NO: 578835 - RNA, 14 nt, Escherichia coli CFT073
uuugcgucgcaucc

SEQ ID NO: 578836 - RNA, 15 nt, Escherichia coli CFT073
uuugucuauuccgcg

SEQ ID NO: 578837 - RNA, 21 nt, Escherichia coli CFT073
uuugucgccaacuucaugacc

SEQ ID NO: 578838 - RNA, 11 nt, Escherichia coli CFT073
uuugucggcau

SEQ ID NO: 578839 - RNA, 19 nt, Escherichia coli CFT073
uuuguaccagacgcgggca

SEQ ID NO: 578840 - RNA, 12 nt, Escherichia coli CFT073
uuuguaggccug

SEQ ID NO: 578841 - RNA, 17 nt, Escherichia coli CFT073
uuugugggccugauaag

SEQ ID NO: 578842 - RNA, 15 nt, Escherichia coli CFT073
uuuguccgcaguggc

SEQ ID NO: 578843 - RNA, 22 nt, Escherichia coli CFT073
uuugugaacagccugugccuga

SEQ ID NO: 578844 - RNA, 12 nt, Escherichia coli CFT073
uuuuaauuucau

SEQ ID NO: 578845 - RNA, 14 nt, Escherichia coli CFT073
uuuaaaccaacuuc

SEQ ID NO: 578846 - RNA, 15 nt, Escherichia coli CFT073
uuuaacacgcucugg

SEQ ID NO: 578847 - RNA, 11 nt, Escherichia coli CFT073
uuuaaccaccu

SEQ ID NO: 578848 - RNA, 14 nt, Escherichia coli CFT073
uuuaaccguggugc

SEQ ID NO: 578849 - RNA, 16 nt, Escherichia coli CFT073
uuuaauuggcgucacg

SEQ ID NO: 578850 - RNA, 18 nt, Escherichia coli CFT073
uuucccggcaaucaccgc

SEQ ID NO: 578851 - RNA, 23 nt, Escherichia coli CFT073
uuucccagcgcgaaagauaaggu

SEQ ID NO: 578852 - RNA, 22 nt, Escherichia coli CFT073
uuuccagcacauauucacgggc

SEQ ID NO: 578853 - RNA, 13 nt, Escherichia coli CFT073
uuuaccugccuga

SEQ ID NO: 578854 - RNA, 14 nt, Escherichia coli CFT073
uuuaccgaaaauca

SEQ ID NO: 578855 - RNA, 15 nt, Escherichia coli CFT073
uuuaccucgucacca

SEQ ID NO: 578856 - RNA, 16 nt, Escherichia coli CFT073
uuuaccauauaaacau

SEQ ID NO: 578857 - RNA, 13 nt, Escherichia coli CFT073
uuuaccaggcggu

SEQ ID NO: 578858 - RNA, 17 nt, Escherichia coli CFT073
uuucgcuucuucagccu

SEQ ID NO: 578859 - RNA, 19 nt, Escherichia coli CFT073
uuucgcuugaucuuccuga

SEQ ID NO: 578860 - RNA, 20 nt, Escherichia coli CFT073
uuucgcuuucaauuccugga

SEQ ID NO: 578861 - RNA, 15 nt, Escherichia coli CFT073
uuucguaccagugca

SEQ ID NO: 578862 - RNA, 14 nt, Escherichia coli CFT073
uuuccgggucggaa

SEQ ID NO: 578863 - RNA, 23 nt, Escherichia coli CFT073
uuuccggaucgccaaagcggcag

SEQ ID NO: 578864 - RNA, 20 nt, Escherichia coli CFT073
uuuccggugccaucuccagu

SEQ ID NO: 578865 - RNA, 11 nt, Escherichia coli CFT073
uuucgccgccc

SEQ ID NO: 578866 - RNA, 20 nt, Escherichia coli CFT073
uuucgccugcaaaucggcaa

SEQ ID NO: 578867 - RNA, 14 nt, Escherichia coli CFT073
uuucugccacgcca

SEQ ID NO: 578868 - RNA, 22 nt, Escherichia coli CFT073
uuucugcguuagaaaacgccug

SEQ ID NO: 578869 - RNA, 21 nt, Escherichia coli CFT073
uuucugaccaauagauauuca

SEQ ID NO: 578870 - RNA, 12 nt, Escherichia coli CFT073
uuucuugccgga

SEQ ID NO: 578871 - RNA, 15 nt, Escherichia coli CFT073
uuucuucucuacgca

SEQ ID NO: 578872 - RNA, 15 nt, Escherichia coli CFT073
aaucgaucaucaccu

SEQ ID NO: 578873 - RNA, 18 nt, Escherichia coli CFT073
aaucgauuuucucaccau

SEQ ID NO: 578874 - RNA, 22 nt, Escherichia coli CFT073
aaucgcacccgccaucaucccu

SEQ ID NO: 578875 - RNA, 18 nt, Escherichia coli CFT073
aaucgcacguugccagca

SEQ ID NO: 578876 - RNA, 19 nt, Escherichia coli CFT073
aaucgcacguugucagcaa

SEQ ID NO: 578877 - RNA, 18 nt, Escherichia coli CFT073
aaucgcauauuucaacga

SEQ ID NO: 578878 - RNA, 12 nt, Escherichia coli CFT073
aaucgcaucaau

SEQ ID NO: 578879 - RNA, 14 nt, Escherichia coli CFT073
aaucgcacugguaa

SEQ ID NO: 578880 - RNA, 21 nt, Escherichia coli CFT073
aaucgcaggcgagaacaugcg

SEQ ID NO: 578881 - RNA, 21 nt, Escherichia coli CFT073
uuggugcccugacaccaucac

SEQ ID NO: 578882 - RNA, 20 nt, Escherichia coli CFT073
uuggugcgaacuucguggua

SEQ ID NO: 578883 - RNA, 23 nt, Escherichia coli CFT073
uugucggaucgcugaacgcaccu

SEQ ID NO: 578884 - RNA, 15 nt, Escherichia coli CFT073
uugucguugggauca

SEQ ID NO: 578885 - RNA, 22 nt, Escherichia coli CFT073
uugucagcaugucuugccuccc

SEQ ID NO: 578886 - RNA, 13 nt, Escherichia coli CFT073
uugucauaaccaa

SEQ ID NO: 578887 - RNA, 21 nt, Escherichia coli CFT073
uugugggcaggaaaaucagca

SEQ ID NO: 578888 - RNA, 14 nt, Escherichia coli CFT073
uugugggccugaua

SEQ ID NO: 578889 - RNA, 16 nt, Escherichia coli CFT073
uugugcaaugugguga

SEQ ID NO: 578890 - RNA, 17 nt, Escherichia coli CFT073
uugugccagaccgaaca

SEQ ID NO: 578891 - RNA, 19 nt, Escherichia coli CFT073
uugugcgccacauccggca

SEQ ID NO: 578892 - RNA, 21 nt, Escherichia coli CFT073
uugugcgccaguucauccaga

SEQ ID NO: 578893 - RNA, 18 nt, Escherichia coli CFT073
aaucccaaacaguguuuu

SEQ ID NO: 578894 - RNA, 11 nt, Escherichia coli CFT073
uugcgccgccc

SEQ ID NO: 578895 - RNA, 17 nt, Escherichia coli CFT073
aauccagaaaaaaagca

SEQ ID NO: 578896 - RNA, 22 nt, Escherichia coli CFT073
aauccaccauauacuccgcacc

SEQ ID NO: 578897 - RNA, 15 nt, Escherichia coli CFT073
aauccagucuuucgc

SEQ ID NO: 578898 - RNA, 21 nt, Escherichia coli CFT073
aauccagugccggaugauuca

SEQ ID NO: 578899 - RNA, 16 nt, Escherichia coli CFT073
aauccauaccagcaca

SEQ ID NO: 578900 - RNA, 14 nt, Escherichia coli CFT073
uuggcaucaccgga

SEQ ID NO: 578901 - RNA, 12 nt, Escherichia coli CFT073
uuggcaucaggc

SEQ ID NO: 578902 - RNA, 22 nt, Escherichia coli CFT073
uuggcacacaccagauccagca

SEQ ID NO: 578903 - RNA, 13 nt, Escherichia coli CFT073
aaucccggcacca

SEQ ID NO: 578904 - RNA, 19 nt, Escherichia coli CFT073
aaucccggcaccaaucacc

SEQ ID NO: 578905 - RNA, 22 nt, Escherichia coli CFT073
aaucccggcgcagcgcgcgaau

SEQ ID NO: 578906 - RNA, 18 nt, Escherichia coli CFT073
aaucccggucaugauaca

SEQ ID NO: 578907 - RNA, 18 nt, Escherichia coli CFT073
aaucccguaauccguaaa

SEQ ID NO: 578908 - RNA, 21 nt, Escherichia coli CFT073
uugguaauacuaaucucaccc

SEQ ID NO: 578909 - RNA, 23 nt, Escherichia coli CFT073
uuggcgcauaacucaccaucaag

SEQ ID NO: 578910 - RNA, 21 nt, Escherichia coli CFT073
uuggcgauaccccaacaaauu

SEQ ID NO: 578911 - RNA, 14 nt, Escherichia coli CFT073
aauccggcagcgaa

SEQ ID NO: 578912 - RNA, 17 nt, Escherichia coli CFT073
aauccggcagcgaaccg

SEQ ID NO: 578913 - RNA, 11 nt, Escherichia coli CFT073
aauccgccgcc

SEQ ID NO: 578914 - RNA, 18 nt, Escherichia coli CFT073
aauccgccaggacaucag

SEQ ID NO: 578915 - RNA, 17 nt, Escherichia coli CFT073
aauccgccaucaacacu

SEQ ID NO: 578916 - RNA, 19 nt, Escherichia coli CFT073
aauccgcgauaacgcccca

SEQ ID NO: 578917 - RNA, 15 nt, Escherichia coli CFT073
aaucccugccgccau

SEQ ID NO: 578918 - RNA, 23 nt, Escherichia coli CFT073
aaucccuuccaccgagccaaacu

SEQ ID NO: 578919 - RNA, 18 nt, Escherichia coli CFT073
aaucccuugagugacaug

SEQ ID NO: 578920 - RNA, 18 nt, Escherichia coli CFT073
aauccgaaguucauccau

SEQ ID NO: 578921 - RNA, 23 nt, Escherichia coli CFT073
uugcagaggugcgaccagcaaua

SEQ ID NO: 578922 - RNA, 14 nt, Escherichia coli CFT073
uugcaccacaucgg

SEQ ID NO: 578923 - RNA, 14 nt, Escherichia coli CFT073
uugcaccagcaauu

SEQ ID NO: 578924 - RNA, 18 nt, Escherichia coli CFT073
uugcacuggcaccgcaga

SEQ ID NO: 578925 - RNA, 11 nt, Escherichia coli CFT073
uugauugucau

SEQ ID NO: 578926 - RNA, 20 nt, Escherichia coli CFT073
uugauuacacaaguccagca

SEQ ID NO: 578927 - RNA, 21 nt, Escherichia coli CFT073
uugcaauaauggaaccuaacg

SEQ ID NO: 578928 - RNA, 21 nt, Escherichia coli CFT073
uugcaaucagcggugccgcga

SEQ ID NO: 578929 - RNA, 20 nt, Escherichia coli CFT073
uugcaaucuccuguugugau

SEQ ID NO: 578930 - RNA, 21 nt, Escherichia coli CFT073
uugcauccggcaugauaccga

SEQ ID NO: 578931 - RNA, 21 nt, Escherichia coli CFT073
uugcaucgccaugaugagcgc

SEQ ID NO: 578932 - RNA, 21 nt, Escherichia coli CFT073
uugccaccgguacaaacauca

SEQ ID NO: 578933 - RNA, 20 nt, Escherichia coli CFT073
aaucaguccacggcugcggc

SEQ ID NO: 578934 - RNA, 20 nt, Escherichia coli CFT073
aaucagucccugaaucgcca

SEQ ID NO: 578935 - RNA, 15 nt, Escherichia coli CFT073
uugcaguugauccau

SEQ ID NO: 578936 - RNA, 21 nt, Escherichia coli CFT073
uugcagcuccccacaccacca

SEQ ID NO: 578937 - RNA, 20 nt, Escherichia coli CFT073
uugcaggccauaugacacca

SEQ ID NO: 578938 - RNA, 18 nt, Escherichia coli CFT073
uugcaggccugauaagcg

SEQ ID NO: 578939 - RNA, 22 nt, Escherichia coli CFT073
uucugcuucauguugcagaugc

SEQ ID NO: 578940 - RNA, 14 nt, Escherichia coli CFT073
uucuggcggccaaa

SEQ ID NO: 578941 - RNA, 14 nt, Escherichia coli CFT073
uucugucgcucugc

SEQ ID NO: 578942 - RNA, 16 nt, Escherichia coli CFT073
uucuguugccagcagu

SEQ ID NO: 578943 - RNA, 23 nt, Escherichia coli CFT073
uugaugugcuucagcuugagguu

SEQ ID NO: 578944 - RNA, 15 nt, Escherichia coli CFT073
uugauggcaaaaucc

SEQ ID NO: 578945 - RNA, 18 nt, Escherichia coli CFT073
uugauggcaaaauccaga

SEQ ID NO: 578946 - RNA, 23 nt, Escherichia coli CFT073
uugauggauauaauucaucacgc

SEQ ID NO: 578947 - RNA, 17 nt, Escherichia coli CFT073
uugaucugcugccagga

SEQ ID NO: 578948 - RNA, 22 nt, Escherichia coli CFT073
uucuuccugccagcacuuugua

SEQ ID NO: 578949 - RNA, 22 nt, Escherichia coli CFT073
uugaugccuucaguuuccagca

SEQ ID NO: 578950 - RNA, 11 nt, Escherichia coli CFT073
uugccaguacc

SEQ ID NO: 578951 - RNA, 16 nt, Escherichia coli CFT073
uugccauguugauccc

SEQ ID NO: 578952 - RNA, 19 nt, Escherichia coli CFT073
uugcccaagaugccagaau

SEQ ID NO: 578953 - RNA, 22 nt, Escherichia coli CFT073
uugccgacuggcaucuguuauc

SEQ ID NO: 578954 - RNA, 14 nt, Escherichia coli CFT073
uugcccgcagaugu

SEQ ID NO: 578955 - RNA, 18 nt, Escherichia coli CFT073
uugccagcauaaucacca

SEQ ID NO: 578956 - RNA, 15 nt, Escherichia coli CFT073
aaucauucgcccgcc

SEQ ID NO: 578957 - RNA, 13 nt, Escherichia coli CFT073
aaucaguuuauca

SEQ ID NO: 578958 - RNA, 16 nt, Escherichia coli CFT073
aaucauccgucgggcg

SEQ ID NO: 578959 - RNA, 14 nt, Escherichia coli CFT073
aaucauccugcggc

SEQ ID NO: 578960 - RNA, 20 nt, Escherichia coli CFT073
aaucaucgcauccagcgugu

SEQ ID NO: 578961 - RNA, 21 nt, Escherichia coli CFT073
uugccgccacugugcgcguua

SEQ ID NO: 578962 - RNA, 21 nt, Escherichia coli CFT073
uugccgaugucuuugcguuug

SEQ ID NO: 578963 - RNA, 17 nt, Escherichia coli CFT073
uugccggaugugaugca

SEQ ID NO: 578964 - RNA, 21 nt, Escherichia coli CFT073
uugccggacgucaggccgcca

SEQ ID NO: 578965 - RNA, 16 nt, Escherichia coli CFT073
uugcgcaugacacacu

SEQ ID NO: 578966 - RNA, 20 nt, Escherichia coli CFT073
uugcgcauaacauucagcaa

SEQ ID NO: 578967 - RNA, 12 nt, Escherichia coli CFT073
aaucauugauaa

SEQ ID NO: 578968 - RNA, 16 nt, Escherichia coli CFT073
uugcgcccauggcacu

SEQ ID NO: 578969 - RNA, 13 nt, Escherichia coli CFT073
uugccguuggcgg

SEQ ID NO: 578970 - RNA, 14 nt, Escherichia coli CFT073
uugccugaucgcgc

SEQ ID NO: 578971 - RNA, 12 nt, Escherichia coli CFT073
aauauuugcuua

SEQ ID NO: 578972 - RNA, 14 nt, Escherichia coli CFT073
ugguccgauuguac

SEQ ID NO: 578973 - RNA, 13 nt, Escherichia coli CFT073
uggucaucaucag

SEQ ID NO: 578974 - RNA, 13 nt, Escherichia coli CFT073
uggucaaacugag

SEQ ID NO: 578975 - RNA, 21 nt, Escherichia coli CFT073
ugguauuaagccaguucucac

SEQ ID NO: 578976 - RNA, 15 nt, Escherichia coli CFT073
uguacggcuccgccc

SEQ ID NO: 578977 - RNA, 19 nt, Escherichia coli CFT073
uguacggagcggauacccc

SEQ ID NO: 578978 - RNA, 13 nt, Escherichia coli CFT073
uguaauccugcca

SEQ ID NO: 578979 - RNA, 17 nt, Escherichia coli CFT073
uguaagcagggccaaac

SEQ ID NO: 578980 - RNA, 16 nt, Escherichia coli CFT073
uguaagucugaaucag

SEQ ID NO: 578981 - RNA, 23 nt, Escherichia coli CFT073
ugguugaucaauucgagcaucau

SEQ ID NO: 578982 - RNA, 18 nt, Escherichia coli CFT073
ugguggggcauugaaaau

SEQ ID NO: 578983 - RNA, 18 nt, Escherichia coli CFT073
ugguugcgucuuaucagg

SEQ ID NO: 578984 - RNA, 16 nt, Escherichia coli CFT073
ugguugguuucaaaga

SEQ ID NO: 578985 - RNA, 24 nt, Escherichia coli CFT073
ugguugucgaaguacgcaguaaau

SEQ ID NO: 578986 - RNA, 19 nt, Escherichia coli CFT073
ugguuuccagcaucgacca

SEQ ID NO: 578987 - RNA, 21 nt, Escherichia coli CFT073
ugguuuggaucuguugcuggc

SEQ ID NO: 578988 - RNA, 20 nt, Escherichia coli CFT073
uguagaccugauaagacgcg

SEQ ID NO: 578989 - RNA, 12 nt, Escherichia coli CFT073
uguagccgccau

SEQ ID NO: 578990 - RNA, 16 nt, Escherichia coli CFT073
uguagauuuugcagau

SEQ ID NO: 578991 - RNA, 17 nt, Escherichia coli CFT073
uguagcgugcggcggcu

SEQ ID NO: 578992 - RNA, 13 nt, Escherichia coli CFT073
uguagcuaaacug

SEQ ID NO: 578993 - RNA, 22 nt, Escherichia coli CFT073
uguagcuaaacugaucuuuauc

SEQ ID NO: 578994 - RNA, 19 nt, Escherichia coli CFT073
uguaggcaggauaaggcgu

SEQ ID NO: 578995 - RNA, 14 nt, Escherichia coli CFT073
uguaggucggauaa

SEQ ID NO: 578996 - RNA, 20 nt, Escherichia coli CFT073
uguaggucggauaagacgcg

SEQ ID NO: 578997 - RNA, 19 nt, Escherichia coli CFT073
uguaggcuggauaaggcgu

SEQ ID NO: 578998 - RNA, 14 nt, Escherichia coli CFT073
aaucaccgccacgc

SEQ ID NO: 578999 - RNA, 17 nt, Escherichia coli CFT073
aaucacccgagcuaaca

SEQ ID NO: 579000 - RNA, 20 nt, Escherichia coli CFT073
uguaggccggauaaggcauu

SEQ ID NO: 579001 - RNA, 20 nt, Escherichia coli CFT073
uguaggccggauaaggcgcg

SEQ ID NO: 579002 - RNA, 14 nt, Escherichia coli CFT073
aaucaccgcuucac

SEQ ID NO: 579003 - RNA, 21 nt, Escherichia coli CFT073
uguaggccgaauaaggcgguu

SEQ ID NO: 579004 - RNA, 13 nt, Escherichia coli CFT073
uguaggccggaua

SEQ ID NO: 579005 - RNA, 13 nt, Escherichia coli CFT073
ugggcggaucugg

SEQ ID NO: 579006 - RNA, 17 nt, Escherichia coli CFT073
ugggcggaucuggaacg

SEQ ID NO: 579007 - RNA, 23 nt, Escherichia coli CFT073
aauauucuuuugcagcagcguga

SEQ ID NO: 579008 - RNA, 16 nt, Escherichia coli CFT073
aauauugccauuacgg

SEQ ID NO: 579009 - RNA, 12 nt, Escherichia coli CFT073
aauauggcgcgc

SEQ ID NO: 579010 - RNA, 18 nt, Escherichia coli CFT073
aauauucaagauaacgcc

SEQ ID NO: 579011 - RNA, 16 nt, Escherichia coli CFT073
aauaucuuucuugcgc

SEQ ID NO: 579012 - RNA, 15 nt, Escherichia coli CFT073
aauaugcauaaaccg

SEQ ID NO: 579013 - RNA, 15 nt, Escherichia coli CFT073
aauaucggcgaagug

SEQ ID NO: 579014 - RNA, 21 nt, Escherichia coli CFT073
aauauccuugcagauauugca

SEQ ID NO: 579015 - RNA, 20 nt, Escherichia coli CFT073
ugggccauagacgagugguu

SEQ ID NO: 579016 - RNA, 19 nt, Escherichia coli CFT073
ugguaucgcgccagccagu

SEQ ID NO: 579017 - RNA, 15 nt, Escherichia coli CFT073
uggguugccagcgac

SEQ ID NO: 579018 - RNA, 18 nt, Escherichia coli CFT073
uggggcguggaaacgccc

SEQ ID NO: 579019 - RNA, 18 nt, Escherichia coli CFT073
uggggauuuacgauggca

SEQ ID NO: 579020 - RNA, 16 nt, Escherichia coli CFT073
uggggauuuccaacga

SEQ ID NO: 579021 - RNA, 17 nt, Escherichia coli CFT073
uggggacaucaaagaaa

SEQ ID NO: 579022 - RNA, 15 nt, Escherichia coli CFT073
uggggaaguggcgau

SEQ ID NO: 579023 - RNA, 20 nt, Escherichia coli CFT073
ugggcugguugguaccguaa

SEQ ID NO: 579024 - RNA, 15 nt, Escherichia coli CFT073
ugggcuccacaaaau

SEQ ID NO: 579025 - RNA, 13 nt, Escherichia coli CFT073
uggcgaaucguau

SEQ ID NO: 579026 - RNA, 16 nt, Escherichia coli CFT073
uggcgauacucugcca

SEQ ID NO: 579027 - RNA, 19 nt, Escherichia coli CFT073
uggcgauaucaauauuaag

SEQ ID NO: 579028 - RNA, 16 nt, Escherichia coli CFT073
uggccgguuugccaua

SEQ ID NO: 579029 - RNA, 17 nt, Escherichia coli CFT073
uggcgcaacugcgccgc

SEQ ID NO: 579030 - RNA, 14 nt, Escherichia coli CFT073
uggcgguaacgcgc

SEQ ID NO: 579031 - RNA, 15 nt, Escherichia coli CFT073
uggcgggaucgccgg

SEQ ID NO: 579032 - RNA, 13 nt, Escherichia coli CFT073
uggcggcuggcac

SEQ ID NO: 579033 - RNA, 16 nt, Escherichia coli CFT073
uggcgcuaucaauacu

SEQ ID NO: 579034 - RNA, 18 nt, Escherichia coli CFT073
uggcgcgucuuaucaggc

SEQ ID NO: 579035 - RNA, 20 nt, Escherichia coli CFT073
uggaauuucugcuucaucgu

SEQ ID NO: 579036 - RNA, 15 nt, Escherichia coli CFT073
uggacaauccgcgag

SEQ ID NO: 579037 - RNA, 21 nt, Escherichia coli CFT073
uggacaugugcgacaguugcc

SEQ ID NO: 579038 - RNA, 18 nt, Escherichia coli CFT073
uggacauagcucugccac

SEQ ID NO: 579039 - RNA, 22 nt, Escherichia coli CFT073
uggcauugauucgccgccgcau

SEQ ID NO: 579040 - RNA, 21 nt, Escherichia coli CFT073
uggcauugggugcuugaggcu

SEQ ID NO: 579041 - RNA, 22 nt, Escherichia coli CFT073
uggcauugguauuccaguucag

SEQ ID NO: 579042 - RNA, 23 nt, Escherichia coli CFT073
uggcauuuucucgugccgccagu

SEQ ID NO: 579043 - RNA, 15 nt, Escherichia coli CFT073
uggccacagcaagca

SEQ ID NO: 579044 - RNA, 22 nt, Escherichia coli CFT073
uggccagcggugaaaacggcaa

SEQ ID NO: 579045 - RNA, 18 nt, Escherichia coli CFT073
uggccagcacauuaaaau

SEQ ID NO: 579046 - RNA, 12 nt, Escherichia coli CFT073
uggcccaugcca

SEQ ID NO: 579047 - RNA, 17 nt, Escherichia coli CFT073
uggcccauugccagcgc

SEQ ID NO: 579048 - RNA, 19 nt, Escherichia coli CFT073
uggccaugauuaccagcau

SEQ ID NO: 579049 - RNA, 17 nt, Escherichia coli CFT073
uggccaugaccaccgca

SEQ ID NO: 579050 - RNA, 18 nt, Escherichia coli CFT073
uggccaugaccaccgcag

SEQ ID NO: 579051 - RNA, 14 nt, Escherichia coli CFT073
ugcuuuuucaauuu

SEQ ID NO: 579052 - RNA, 11 nt, Escherichia coli CFT073
ugcuuuuucgc

SEQ ID NO: 579053 - RNA, 22 nt, Escherichia coli CFT073
uggaaaacagcgccugcaaaau

SEQ ID NO: 579054 - RNA, 20 nt, Escherichia coli CFT073
uggaaacagcaccauccgcc

SEQ ID NO: 579055 - RNA, 21 nt, Escherichia coli CFT073
uggaaacagcaccauccgccc

SEQ ID NO: 579056 - RNA, 11 nt, Escherichia coli CFT073
uggaaaaaaug

SEQ ID NO: 579057 - RNA, 21 nt, Escherichia coli CFT073
uggaacaagucagcgcgaaau

SEQ ID NO: 579058 - RNA, 23 nt, Escherichia coli CFT073
uggaacaaaauuuucagcgugcc

SEQ ID NO: 579059 - RNA, 23 nt, Escherichia coli CFT073
uggaacacuuugccgucugccac

SEQ ID NO: 579060 - RNA, 20 nt, Escherichia coli CFT073
uggaaauagaacguuuaucu

SEQ ID NO: 579061 - RNA, 21 nt, Escherichia coli CFT073
uggaaaucacccagcgaagca

SEQ ID NO: 579062 - RNA, 16 nt, Escherichia coli CFT073
uggaaaucacgccgca

SEQ ID NO: 579063 - RNA, 19 nt, Escherichia coli CFT073
uggaaaguauaugagaaga

SEQ ID NO: 579064 - RNA, 20 nt, Escherichia coli CFT073
ugcuugagcuaauuauuacu

SEQ ID NO: 579065 - RNA, 16 nt, Escherichia coli CFT073
ugcuucggucagcacg

SEQ ID NO: 579066 - RNA, 19 nt, Escherichia coli CFT073
ugcuucggucagcacgcga

SEQ ID NO: 579067 - RNA, 11 nt, Escherichia coli CFT073
ugcuucucuug

SEQ ID NO: 579068 - RNA, 17 nt, Escherichia coli CFT073
ugcuucuuccugccagc

SEQ ID NO: 579069 - RNA, 23 nt, Escherichia coli CFT073
ugcuuucgccgcgaucucgucag

SEQ ID NO: 579070 - RNA, 13 nt, Escherichia coli CFT073
ugcuucgccgcau

SEQ ID NO: 579071 - RNA, 19 nt, Escherichia coli CFT073
ugcuucgcucucuuucacc

SEQ ID NO: 579072 - RNA, 22 nt, Escherichia coli CFT073
ugcuguuuagugguaguugauu

SEQ ID NO: 579073 - RNA, 21 nt, Escherichia coli CFT073
ugcuuaaaagcacagaaucua

SEQ ID NO: 579074 - RNA, 16 nt, Escherichia coli CFT073
ugcuuauaaccauuua

SEQ ID NO: 579075 - RNA, 21 nt, Escherichia coli CFT073
ugcuuaucgcccugcuccagc

SEQ ID NO: 579076 - RNA, 21 nt, Escherichia coli CFT073
ugcuuaucgcgauauucucgc

SEQ ID NO: 579077 - RNA, 14 nt, Escherichia coli CFT073
ugcuguucuucugc

SEQ ID NO: 579078 - RNA, 15 nt, Escherichia coli CFT073
ugcugugugccgcga

SEQ ID NO: 579079 - RNA, 21 nt, Escherichia coli CFT073
ugcugcuuuaucagcucauag

SEQ ID NO: 579080 - RNA, 22 nt, Escherichia coli CFT073
ugcugcugaagcaacaguaaua

SEQ ID NO: 579081 - RNA, 12 nt, Escherichia coli CFT073
ugcugcuaccgg

SEQ ID NO: 579082 - RNA, 14 nt, Escherichia coli CFT073
ugcugcucacggug

SEQ ID NO: 579083 - RNA, 14 nt, Escherichia coli CFT073
ugcucauuccgccg

SEQ ID NO: 579084 - RNA, 23 nt, Escherichia coli CFT073
ugcucaucagcgguaaaacgccc

SEQ ID NO: 579085 - RNA, 20 nt, Escherichia coli CFT073
ugcucauccccaucaacgca

SEQ ID NO: 579086 - RNA, 14 nt, Escherichia coli CFT073
ugcuccacgccagc

SEQ ID NO: 579087 - RNA, 15 nt, Escherichia coli CFT073
ugcuccgcucaucag

SEQ ID NO: 579088 - RNA, 20 nt, Escherichia coli CFT073
ugcuccagcguaccugccgc

SEQ ID NO: 579089 - RNA, 18 nt, Escherichia coli CFT073
ugcuccauaauugccagc

SEQ ID NO: 579090 - RNA, 19 nt, Escherichia coli CFT073
ugcuccaucgcaugccagc

SEQ ID NO: 579091 - RNA, 21 nt, Escherichia coli CFT073
ugcuccaucgcaugccagcgc

SEQ ID NO: 579092 - RNA, 20 nt, Escherichia coli CFT073
ugcucauagcggcugcgcag

SEQ ID NO: 579093 - RNA, 16 nt, Escherichia coli CFT073
ugcguuagaaaacgcc

SEQ ID NO: 579094 - RNA, 22 nt, Escherichia coli CFT073
ugcguuagaaaacgccugcucc

SEQ ID NO: 579095 - RNA, 17 nt, Escherichia coli CFT073
ugcguuaucgccaucca

SEQ ID NO: 579096 - RNA, 13 nt, Escherichia coli CFT073
ugcucgcagaaau

SEQ ID NO: 579097 - RNA, 24 nt, Escherichia coli CFT073
ugcugaguuaccugaugcgacgcc

SEQ ID NO: 579098 - RNA, 17 nt, Escherichia coli CFT073
ugcugauaaccgccgcc

SEQ ID NO: 579099 - RNA, 15 nt, Escherichia coli CFT073
ugcugauacgcgcac

SEQ ID NO: 579100 - RNA, 17 nt, Escherichia coli CFT073
ugcucgaucagacgauc

SEQ ID NO: 579101 - RNA, 20 nt, Escherichia coli CFT073
ugcggcguuaacgccuuauc

SEQ ID NO: 579102 - RNA, 18 nt, Escherichia coli CFT073
ugcggcggugcuugcuca

SEQ ID NO: 579103 - RNA, 16 nt, Escherichia coli CFT073
ugcggcguaaugccug

SEQ ID NO: 579104 - RNA, 20 nt, Escherichia coli CFT073
ugcggcgugaacaccuuauc

SEQ ID NO: 579105 - RNA, 20 nt, Escherichia coli CFT073
ugcggcgugaacgccuuauc

SEQ ID NO: 579106 - RNA, 20 nt, Escherichia coli CFT073
ugcggcgugaacgccuucuc

SEQ ID NO: 579107 - RNA, 15 nt, Escherichia coli CFT073
ugcggcgugauaaaa

SEQ ID NO: 579108 - RNA, 18 nt, Escherichia coli CFT073
ugcgggaaaaugccggau

SEQ ID NO: 579109 - RNA, 18 nt, Escherichia coli CFT073
ugcgggaacauaugcaca

SEQ ID NO: 579110 - RNA, 20 nt, Escherichia coli CFT073
ugcggcuguagagcuaccgg

SEQ ID NO: 579111 - RNA, 18 nt, Escherichia coli CFT073
ugcggcugaacugauacu

SEQ ID NO: 579112 - RNA, 22 nt, Escherichia coli CFT073
ugcggcgcugacgcgucuuauc

SEQ ID NO: 579113 - RNA, 20 nt, Escherichia coli CFT073
ugcggcaaacgguucgcggu

SEQ ID NO: 579114 - RNA, 18 nt, Escherichia coli CFT073
ugcggcaauguucgccgg

SEQ ID NO: 579115 - RNA, 16 nt, Escherichia coli CFT073
ugcgcuugcugccagu

SEQ ID NO: 579116 - RNA, 21 nt, Escherichia coli CFT073
ugcggaaacugucaauaaacg

SEQ ID NO: 579117 - RNA, 13 nt, Escherichia coli CFT073
ugcggaugcgccg

SEQ ID NO: 579118 - RNA, 22 nt, Escherichia coli CFT073
ugcgcuucgcuuaccaugccaa

SEQ ID NO: 579119 - RNA, 12 nt, Escherichia coli CFT073
ugcgcuucccga

SEQ ID NO: 579120 - RNA, 20 nt, Escherichia coli CFT073
ugcgcuucuuuaaagcguuc

SEQ ID NO: 579121 - RNA, 20 nt, Escherichia coli CFT073
ugcgccgucagaguggcgua

SEQ ID NO: 579122 - RNA, 19 nt, Escherichia coli CFT073
ugcgggaguugaucgccag

SEQ ID NO: 579123 - RNA, 21 nt, Escherichia coli CFT073
ugcgggagaauugccaaccga

SEQ ID NO: 579124 - RNA, 14 nt, Escherichia coli CFT073
ugcgguaucaccac

SEQ ID NO: 579125 - RNA, 21 nt, Escherichia coli CFT073
ugcggguaggcaccugaaucu

SEQ ID NO: 579126 - RNA, 20 nt, Escherichia coli CFT073
ugcgucuuaucaggccuaca

SEQ ID NO: 579127 - RNA, 17 nt, Escherichia coli CFT073
ugcgucggaacaucgau

SEQ ID NO: 579128 - RNA, 16 nt, Escherichia coli CFT073
ugcguaacugaucgua

SEQ ID NO: 579129 - RNA, 15 nt, Escherichia coli CFT073
ugcgguugaacgcca

SEQ ID NO: 579130 - RNA, 15 nt, Escherichia coli CFT073
ugcggugacagagga

SEQ ID NO: 579131 - RNA, 23 nt, Escherichia coli CFT073
ugccggauggcguuuaaucgccu

SEQ ID NO: 579132 - RNA, 23 nt, Escherichia coli CFT073
ugccggauguggcguaaacgccu

SEQ ID NO: 579133 - RNA, 14 nt, Escherichia coli CFT073
ugccgcuucccgca

SEQ ID NO: 579134 - RNA, 17 nt, Escherichia coli CFT073
ugccgcuuuaugugcuu

SEQ ID NO: 579135 - RNA, 20 nt, Escherichia coli CFT073
ugccggaacgccgcuggugg

SEQ ID NO: 579136 - RNA, 16 nt, Escherichia coli CFT073
ugccggauggcacgca

SEQ ID NO: 579137 - RNA, 23 nt, Escherichia coli CFT073
ugccggaugcgacgcaaacgccu

SEQ ID NO: 579138 - RNA, 23 nt, Escherichia coli CFT073
ugccggaugcggcguaaacgccu

SEQ ID NO: 579139 - RNA, 23 nt, Escherichia coli CFT073
ugccggaugcggcgugaacgccu

SEQ ID NO: 579140 - RNA, 22 nt, Escherichia coli CFT073
ugccggaugcggcgugauaaaa

SEQ ID NO: 579141 - RNA, 16 nt, Escherichia coli CFT073
ugccggauccagcggu

SEQ ID NO: 579142 - RNA, 19 nt, Escherichia coli CFT073
ugccgcguuuugacagcuc

SEQ ID NO: 579143 - RNA, 12 nt, Escherichia coli CFT073
ugccgcuaucag

SEQ ID NO: 579144 - RNA, 16 nt, Escherichia coli CFT073
ugcccuuugcuggcau

SEQ ID NO: 579145 - RNA, 15 nt, Escherichia coli CFT073
ugcccuuuuaauaca

SEQ ID NO: 579146 - RNA, 22 nt, Escherichia coli CFT073
ugcccuuccauacgaauugccg

SEQ ID NO: 579147 - RNA, 19 nt, Escherichia coli CFT073
ugccgucugccccgccgcc

SEQ ID NO: 579148 - RNA, 15 nt, Escherichia coli CFT073
aauagccaggcagau

SEQ ID NO: 579149 - RNA, 22 nt, Escherichia coli CFT073
aauagcccgauggcaucaccau

SEQ ID NO: 579150 - RNA, 19 nt, Escherichia coli CFT073
ugccggucagacagcgauu

SEQ ID NO: 579151 - RNA, 19 nt, Escherichia coli CFT073
ugccgguaucacucgugau

SEQ ID NO: 579152 - RNA, 13 nt, Escherichia coli CFT073
ugccgggggcgac

SEQ ID NO: 579153 - RNA, 14 nt, Escherichia coli CFT073
ugcgccagagcgcg

SEQ ID NO: 579154 - RNA, 18 nt, Escherichia coli CFT073
ugcgccacauccggcaua

SEQ ID NO: 579155 - RNA, 18 nt, Escherichia coli CFT073
ugcgccagcgggaucgcc

SEQ ID NO: 579156 - RNA, 22 nt, Escherichia coli CFT073
ugcgcacgaguuucuaucccuu

SEQ ID NO: 579157 - RNA, 14 nt, Escherichia coli CFT073
ugcgcaccuuuacc

SEQ ID NO: 579158 - RNA, 17 nt, Escherichia coli CFT073
ugcgccaauguacggaa

SEQ ID NO: 579159 - RNA, 19 nt, Escherichia coli CFT073
ugcgcagaguuuccaggcu

SEQ ID NO: 579160 - RNA, 16 nt, Escherichia coli CFT073
ugcgccaacaucaaug

SEQ ID NO: 579161 - RNA, 14 nt, Escherichia coli CFT073
ugcgcccugcauca

SEQ ID NO: 579162 - RNA, 16 nt, Escherichia coli CFT073
ugcgcccuggcccauu

SEQ ID NO: 579163 - RNA, 20 nt, Escherichia coli CFT073
ugcgcccgcuuuucgccagu

SEQ ID NO: 579164 - RNA, 11 nt, Escherichia coli CFT073
ugcgcccgcca

SEQ ID NO: 579165 - RNA, 15 nt, Escherichia coli CFT073
ugccuuaccgcuugg

SEQ ID NO: 579166 - RNA, 21 nt, Escherichia coli CFT073
ugcgacgcgacauccagccgu

SEQ ID NO: 579167 - RNA, 15 nt, Escherichia coli CFT073
ugcgacgcgauccgc

SEQ ID NO: 579168 - RNA, 15 nt, Escherichia coli CFT073
ugcgacgcgggccgc

SEQ ID NO: 579169 - RNA, 16 nt, Escherichia coli CFT073
ugcgaugcauccggca

SEQ ID NO: 579170 - RNA, 17 nt, Escherichia coli CFT073
ugcgagaugaccgacag

SEQ ID NO: 579171 - RNA, 23 nt, Escherichia coli CFT073
ugcgacgcuugaugcgucuuauc

SEQ ID NO: 579172 - RNA, 23 nt, Escherichia coli CFT073
ugcgacgcuugccgcgucuuauc

SEQ ID NO: 579173 - RNA, 17 nt, Escherichia coli CFT073
ugcgacgucugaucggc

SEQ ID NO: 579174 - RNA, 22 nt, Escherichia coli CFT073
ugcgacgugcccuuucaguggg

SEQ ID NO: 579175 - RNA, 21 nt, Escherichia coli CFT073
ugcgcaauaaccguaacgcau

SEQ ID NO: 579176 - RNA, 13 nt, Escherichia coli CFT073
ugcgcaacuuuuu

SEQ ID NO: 579177 - RNA, 23 nt, Escherichia coli CFT073
aauauaagcgcuaugcgcauccu

SEQ ID NO: 579178 - RNA, 21 nt, Escherichia coli CFT073
ugcgauuguaauuucacgcuu

SEQ ID NO: 579179 - RNA, 18 nt, Escherichia coli CFT073
acuaacgguagccugcaa

SEQ ID NO: 579180 - RNA, 17 nt, Escherichia coli CFT073
acuaacuguuucgcggc

SEQ ID NO: 579181 - RNA, 15 nt, Escherichia coli CFT073
acuacggcucagcaa

SEQ ID NO: 579182 - RNA, 23 nt, Escherichia coli CFT073
acuaaaacugaagcgcgccuggc

SEQ ID NO: 579183 - RNA, 13 nt, Escherichia coli CFT073
acguuuggcacgc

SEQ ID NO: 579184 - RNA, 14 nt, Escherichia coli CFT073
acguuuugccaguu

SEQ ID NO: 579185 - RNA, 20 nt, Escherichia coli CFT073
acguuuuucuuccggcagca

SEQ ID NO: 579186 - RNA, 23 nt, Escherichia coli CFT073
acguucucuuucaggccgcgcag

SEQ ID NO: 579187 - RNA, 15 nt, Escherichia coli CFT073
acguuuaccgcaucc

SEQ ID NO: 579188 - RNA, 15 nt, Escherichia coli CFT073
acguuuacuucgcuu

SEQ ID NO: 579189 - RNA, 17 nt, Escherichia coli CFT073
acguuucgcgccauccg

SEQ ID NO: 579190 - RNA, 18 nt, Escherichia coli CFT073
acguuugauuaacgccag

SEQ ID NO: 579191 - RNA, 20 nt, Escherichia coli CFT073
acgugcuuauaacugcccgc

SEQ ID NO: 579192 - RNA, 13 nt, Escherichia coli CFT073
acguucagccaua

SEQ ID NO: 579193 - RNA, 16 nt, Escherichia coli CFT073
acguucagccauacgu

SEQ ID NO: 579194 - RNA, 16 nt, Escherichia coli CFT073
acguucagccgcuuua

SEQ ID NO: 579195 - RNA, 14 nt, Escherichia coli CFT073
acguucgcccacuu

SEQ ID NO: 579196 - RNA, 13 nt, Escherichia coli CFT073
acguaggccggau

SEQ ID NO: 579197 - RNA, 20 nt, Escherichia coli CFT073
acguagcaagcaucccgccg

SEQ ID NO: 579198 - RNA, 17 nt, Escherichia coli CFT073
acggugauaaucauccc

SEQ ID NO: 579199 - RNA, 14 nt, Escherichia coli CFT073
acggugaaaaacca

SEQ ID NO: 579200 - RNA, 17 nt, Escherichia coli CFT073
acgguaugacccagcgc

SEQ ID NO: 579201 - RNA, 18 nt, Escherichia coli CFT073
acgguaucaagcccgccg

SEQ ID NO: 579202 - RNA, 21 nt, Escherichia coli CFT073
acgguaguggcaaccagcagg

SEQ ID NO: 579203 - RNA, 14 nt, Escherichia coli CFT073
acggucgccguaaa

SEQ ID NO: 579204 - RNA, 19 nt, Escherichia coli CFT073
acgucauauucgccaucag

SEQ ID NO: 579205 - RNA, 15 nt, Escherichia coli CFT073
acuaucaaccacggc

SEQ ID NO: 579206 - RNA, 16 nt, Escherichia coli CFT073
acuaucaaccacggca

SEQ ID NO: 579207 - RNA, 12 nt, Escherichia coli CFT073
acucauccaucu

SEQ ID NO: 579208 - RNA, 15 nt, Escherichia coli CFT073
acucauuaaaccacu

SEQ ID NO: 579209 - RNA, 18 nt, Escherichia coli CFT073
acucauuguuaucagcaa

SEQ ID NO: 579210 - RNA, 14 nt, Escherichia coli CFT073
acuccacuucaccg

SEQ ID NO: 579211 - RNA, 15 nt, Escherichia coli CFT073
acucccaccgcguga

SEQ ID NO: 579212 - RNA, 20 nt, Escherichia coli CFT073
acuccagcuuaacaucccca

SEQ ID NO: 579213 - RNA, 17 nt, Escherichia coli CFT073
acuccaguccaccccca

SEQ ID NO: 579214 - RNA, 20 nt, Escherichia coli CFT073
acuccggauucaagcauuau

SEQ ID NO: 579215 - RNA, 18 nt, Escherichia coli CFT073
acucccugcugauaguaa

SEQ ID NO: 579216 - RNA, 19 nt, Escherichia coli CFT073
acucccuguuccuguauuu

SEQ ID NO: 579217 - RNA, 19 nt, Escherichia coli CFT073
acuccgcuuaccauccaca

SEQ ID NO: 579218 - RNA, 21 nt, Escherichia coli CFT073
acuccgguaauaucgcgcaga

SEQ ID NO: 579219 - RNA, 22 nt, Escherichia coli CFT073
acuccuucguguauuuugcauc

SEQ ID NO: 579220 - RNA, 14 nt, Escherichia coli CFT073
acucgaaaauauug

SEQ ID NO: 579221 - RNA, 14 nt, Escherichia coli CFT073
acucuuucccggca

SEQ ID NO: 579222 - RNA, 20 nt, Escherichia coli CFT073
acucuuucccggcaaucacc

SEQ ID NO: 579223 - RNA, 17 nt, Escherichia coli CFT073
acucuuucgacggcaua

SEQ ID NO: 579224 - RNA, 15 nt, Escherichia coli CFT073
acugaucaccugcga

SEQ ID NO: 579225 - RNA, 20 nt, Escherichia coli CFT073
acugauauuuaaacggugua

SEQ ID NO: 579226 - RNA, 22 nt, Escherichia coli CFT073
acugaagauugaacagcagaac

SEQ ID NO: 579227 - RNA, 11 nt, Escherichia coli CFT073
acucuuccggg

SEQ ID NO: 579228 - RNA, 14 nt, Escherichia coli CFT073
acucgcggcuaaca

SEQ ID NO: 579229 - RNA, 18 nt, Escherichia coli CFT073
acucgcuggcggcuggca

SEQ ID NO: 579230 - RNA, 17 nt, Escherichia coli CFT073
acucgccuauacgcacg

SEQ ID NO: 579231 - RNA, 22 nt, Escherichia coli CFT073
acucgccgaaccaaacgaggua

SEQ ID NO: 579232 - RNA, 19 nt, Escherichia coli CFT073
acugauggcaaaugcaaca

SEQ ID NO: 579233 - RNA, 16 nt, Escherichia coli CFT073
acugauggcccaucgu

SEQ ID NO: 579234 - RNA, 14 nt, Escherichia coli CFT073
acugaugacaaacg

SEQ ID NO: 579235 - RNA, 15 nt, Escherichia coli CFT073
acugaugaucuccau

SEQ ID NO: 579236 - RNA, 22 nt, Escherichia coli CFT073
acugaugaucuccauugccggc

SEQ ID NO: 579237 - RNA, 11 nt, Escherichia coli CFT073
acugccagcca

SEQ ID NO: 579238 - RNA, 22 nt, Escherichia coli CFT073
acugauuaacuugcgacagcca

SEQ ID NO: 579239 - RNA, 14 nt, Escherichia coli CFT073
acugcccgcaucaa

SEQ ID NO: 579240 - RNA, 17 nt, Escherichia coli CFT073
acugccagugucggaug

SEQ ID NO: 579241 - RNA, 17 nt, Escherichia coli CFT073
acugcccccggcguuau

SEQ ID NO: 579242 - RNA, 15 nt, Escherichia coli CFT073
acugccccgccagug

SEQ ID NO: 579243 - RNA, 23 nt, Escherichia coli CFT073
acugccgcgauggguuguugagg

SEQ ID NO: 579244 - RNA, 15 nt, Escherichia coli CFT073
acugccuugcgauau

SEQ ID NO: 579245 - RNA, 15 nt, Escherichia coli CFT073
acugccuuucccuua

SEQ ID NO: 579246 - RNA, 18 nt, Escherichia coli CFT073
acugcgccacucgauacc

SEQ ID NO: 579247 - RNA, 13 nt, Escherichia coli CFT073
acugcgccagacc

SEQ ID NO: 579248 - RNA, 17 nt, Escherichia coli CFT073
acgcuugauucuguuca

SEQ ID NO: 579249 - RNA, 23 nt, Escherichia coli CFT073
acgcuugccgcgucuuaucaggc

SEQ ID NO: 579250 - RNA, 13 nt, Escherichia coli CFT073
acgcuucaaccag

SEQ ID NO: 579251 - RNA, 12 nt, Escherichia coli CFT073
acgcuucagcug

SEQ ID NO: 579252 - RNA, 19 nt, Escherichia coli CFT073
acgcuuaucaggccugcaa

SEQ ID NO: 579253 - RNA, 13 nt, Escherichia coli CFT073
acgcuuaaucgaa

SEQ ID NO: 579254 - RNA, 13 nt, Escherichia coli CFT073
acgcuuaucaggc

SEQ ID NO: 579255 - RNA, 14 nt, Escherichia coli CFT073
acggauucaaugca

SEQ ID NO: 579256 - RNA, 16 nt, Escherichia coli CFT073
acggauucacaauugg

SEQ ID NO: 579257 - RNA, 19 nt, Escherichia coli CFT073
acgcgcuacugaaucccug

SEQ ID NO: 579258 - RNA, 20 nt, Escherichia coli CFT073
acgcggcacgcccugcucgu

SEQ ID NO: 579259 - RNA, 23 nt, Escherichia coli CFT073
acgcggcagcaaccgcuuccggu

SEQ ID NO: 579260 - RNA, 19 nt, Escherichia coli CFT073
acgcuggacguggugcgcc

SEQ ID NO: 579261 - RNA, 23 nt, Escherichia coli CFT073
acgcuggauuucaauaucguuau

SEQ ID NO: 579262 - RNA, 22 nt, Escherichia coli CFT073
acggcccguacugaacccgggu

SEQ ID NO: 579263 - RNA, 22 nt, Escherichia coli CFT073
acggcccagcaugcgaaugccg

SEQ ID NO: 579264 - RNA, 19 nt, Escherichia coli CFT073
acggcccauaacccacacc

SEQ ID NO: 579265 - RNA, 14 nt, Escherichia coli CFT073
acggccaucacgga

SEQ ID NO: 579266 - RNA, 16 nt, Escherichia coli CFT073
acggcauaaauuucag

SEQ ID NO: 579267 - RNA, 14 nt, Escherichia coli CFT073
acggcagcaugaua

SEQ ID NO: 579268 - RNA, 16 nt, Escherichia coli CFT073
acggcagaguaaaccg

SEQ ID NO: 579269 - RNA, 19 nt, Escherichia coli CFT073
acggcagaguaaaccgccu

SEQ ID NO: 579270 - RNA, 14 nt, Escherichia coli CFT073
acggcagauaaaca

SEQ ID NO: 579271 - RNA, 23 nt, Escherichia coli CFT073
acggcagcaaggcuauucagcag

SEQ ID NO: 579272 - RNA, 21 nt, Escherichia coli CFT073
acggccaaaucgccauauccg

SEQ ID NO: 579273 - RNA, 23 nt, Escherichia coli CFT073
acggcauuucuggcggcgugaug

SEQ ID NO: 579274 - RNA, 16 nt, Escherichia coli CFT073
acggcaucgccaacca

SEQ ID NO: 579275 - RNA, 15 nt, Escherichia coli CFT073
acggcgaaagcguca

SEQ ID NO: 579276 - RNA, 16 nt, Escherichia coli CFT073
acggcgagccagcgca

SEQ ID NO: 579277 - RNA, 16 nt, Escherichia coli CFT073
acggcgacggcuggca

SEQ ID NO: 579278 - RNA, 19 nt, Escherichia coli CFT073
acggcgcacaggcaaucca

SEQ ID NO: 579279 - RNA, 13 nt, Escherichia coli CFT073
acggcgagcguuc

SEQ ID NO: 579280 - RNA, 18 nt, Escherichia coli CFT073
acgggcaguugcgcgcgu

SEQ ID NO: 579281 - RNA, 22 nt, Escherichia coli CFT073
acggcuucugacauagccacuc

SEQ ID NO: 579282 - RNA, 18 nt, Escherichia coli CFT073
acggcuuugucauuaaau

SEQ ID NO: 579283 - RNA, 18 nt, Escherichia coli CFT073
acggcuucgccaaaucgu

SEQ ID NO: 579284 - RNA, 22 nt, Escherichia coli CFT073
acgggugauaggguacgaccca

SEQ ID NO: 579285 - RNA, 16 nt, Escherichia coli CFT073
accugauccagcucuu

SEQ ID NO: 579286 - RNA, 16 nt, Escherichia coli CFT073
accugauaacggccgu

SEQ ID NO: 579287 - RNA, 14 nt, Escherichia coli CFT073
accugauuaccuac

SEQ ID NO: 579288 - RNA, 20 nt, Escherichia coli CFT073
accugauugaccgccagcgc

SEQ ID NO: 579289 - RNA, 24 nt, Escherichia coli CFT073
accugauugcugcugccgcgccag

SEQ ID NO: 579290 - RNA, 23 nt, Escherichia coli CFT073
accugccagagcugaauaucacg

SEQ ID NO: 579291 - RNA, 21 nt, Escherichia coli CFT073
accugcauuagcaaugcccug

SEQ ID NO: 579292 - RNA, 16 nt, Escherichia coli CFT073
accugcauuuacggcc

SEQ ID NO: 579293 - RNA, 12 nt, Escherichia coli CFT073
accucuucauua

SEQ ID NO: 579294 - RNA, 20 nt, Escherichia coli CFT073
accucgucaccaccucaccc

SEQ ID NO: 579295 - RNA, 22 nt, Escherichia coli CFT073
accucgcaacaaugucaucgcg

SEQ ID NO: 579296 - RNA, 14 nt, Escherichia coli CFT073
accucccgucgccc

SEQ ID NO: 579297 - RNA, 19 nt, Escherichia coli CFT073
accuccgucuggccaguuc

SEQ ID NO: 579298 - RNA, 14 nt, Escherichia coli CFT073
accuccaucgcacc

SEQ ID NO: 579299 - RNA, 14 nt, Escherichia coli CFT073
accuccagcaucag

SEQ ID NO: 579300 - RNA, 11 nt, Escherichia coli CFT073
accucaacccg

SEQ ID NO: 579301 - RNA, 19 nt, Escherichia coli CFT073
accucagguucaaccgcag

SEQ ID NO: 579302 - RNA, 12 nt, Escherichia coli CFT073
accucagaaauc

SEQ ID NO: 579303 - RNA, 16 nt, Escherichia coli CFT073
accucagcaguuucgg

SEQ ID NO: 579304 - RNA, 17 nt, Escherichia coli CFT073
accuaauuuauuaccgc

SEQ ID NO: 579305 - RNA, 13 nt, Escherichia coli CFT073
accgguacgccgc

SEQ ID NO: 579306 - RNA, 15 nt, Escherichia coli CFT073
accgguacgccgcgu

SEQ ID NO: 579307 - RNA, 22 nt, Escherichia coli CFT073
accuucauagguaaacaucaca

SEQ ID NO: 579308 - RNA, 21 nt, Escherichia coli CFT073
accuucaucccuuucgcuuca

SEQ ID NO: 579309 - RNA, 12 nt, Escherichia coli CFT073
accuugcguuuu

SEQ ID NO: 579310 - RNA, 16 nt, Escherichia coli CFT073
accuuaccaaccgcaa

SEQ ID NO: 579311 - RNA, 15 nt, Escherichia coli CFT073
accuuauccagcaga

SEQ ID NO: 579312 - RNA, 16 nt, Escherichia coli CFT073
accuuauccagcagau

SEQ ID NO: 579313 - RNA, 22 nt, Escherichia coli CFT073
accuuauccagcagaucgaucu

SEQ ID NO: 579314 - RNA, 16 nt, Escherichia coli CFT073
accuucaaaauuuaac

SEQ ID NO: 579315 - RNA, 16 nt, Escherichia coli CFT073
accuggcgcaaaagag

SEQ ID NO: 579316 - RNA, 20 nt, Escherichia coli CFT073
accuggcgcauuaacggcaa

SEQ ID NO: 579317 - RNA, 19 nt, Escherichia coli CFT073
accugcgcggccagugcca

SEQ ID NO: 579318 - RNA, 16 nt, Escherichia coli CFT073
accugcucgaacguga

SEQ ID NO: 579319 - RNA, 20 nt, Escherichia coli CFT073
accugcuauucccgcaaaau

SEQ ID NO: 579320 - RNA, 16 nt, Escherichia coli CFT073
accugcucaaucgcau

SEQ ID NO: 579321 - RNA, 20 nt, Escherichia coli CFT073
accugcucagcacgccacuc

SEQ ID NO: 579322 - RNA, 19 nt, Escherichia coli CFT073
accuggccccuggcugguc

SEQ ID NO: 579323 - RNA, 13 nt, Escherichia coli CFT073
accugcuguguaa

SEQ ID NO: 579324 - RNA, 23 nt, Escherichia coli CFT073
accugcuguguaauuugcguuuu

SEQ ID NO: 579325 - RNA, 15 nt, Escherichia coli CFT073
accugcuucgauaga

SEQ ID NO: 579326 - RNA, 22 nt, Escherichia coli CFT073
accuuguggaaauuccagcggc

SEQ ID NO: 579327 - RNA, 16 nt, Escherichia coli CFT073
accuuguuucagcgca

SEQ ID NO: 579328 - RNA, 18 nt, Escherichia coli CFT073
accuuguuucagcgcauc

SEQ ID NO: 579329 - RNA, 15 nt, Escherichia coli CFT073
acgaauaauccagcg

SEQ ID NO: 579330 - RNA, 14 nt, Escherichia coli CFT073
acgaauaauugccu

SEQ ID NO: 579331 - RNA, 15 nt, Escherichia coli CFT073
acgaaucacuggugu

SEQ ID NO: 579332 - RNA, 11 nt, Escherichia coli CFT073
acgaaucgccu

SEQ ID NO: 579333 - RNA, 17 nt, Escherichia coli CFT073
acgacccgauucgguca

SEQ ID NO: 579334 - RNA, 23 nt, Escherichia coli CFT073
acgaccagcggcaacaucaucac

SEQ ID NO: 579335 - RNA, 16 nt, Escherichia coli CFT073
acgacaaaauccccuu

SEQ ID NO: 579336 - RNA, 23 nt, Escherichia coli CFT073
acgaaugacuaagcgaucgcuaa

SEQ ID NO: 579337 - RNA, 13 nt, Escherichia coli CFT073
acgaauugcugcg

SEQ ID NO: 579338 - RNA, 18 nt, Escherichia coli CFT073
acgaccacccaccgcagc

SEQ ID NO: 579339 - RNA, 15 nt, Escherichia coli CFT073
acgaccacucuuucg

SEQ ID NO: 579340 - RNA, 17 nt, Escherichia coli CFT073
acgaccaggaacgccau

SEQ ID NO: 579341 - RNA, 19 nt, Escherichia coli CFT073
acgacguuuuccaucgacc

SEQ ID NO: 579342 - RNA, 19 nt, Escherichia coli CFT073
acgacucaaaucacgcagu

SEQ ID NO: 579343 - RNA, 20 nt, Escherichia coli CFT073
acgacgcugaagucagcaca

SEQ ID NO: 579344 - RNA, 22 nt, Escherichia coli CFT073
acgacgaccaccgaaugcgccu

SEQ ID NO: 579345 - RNA, 21 nt, Escherichia coli CFT073
acgaccgccauuaaacgcagu

SEQ ID NO: 579346 - RNA, 15 nt, Escherichia coli CFT073
acgcagaccaaccgu

SEQ ID NO: 579347 - RNA, 21 nt, Escherichia coli CFT073
acgcagcacaugcaacuugaa

SEQ ID NO: 579348 - RNA, 13 nt, Escherichia coli CFT073
acgcagacgccgu

SEQ ID NO: 579349 - RNA, 22 nt, Escherichia coli CFT073
acgcagaaucuucuucucagcc

SEQ ID NO: 579350 - RNA, 17 nt, Escherichia coli CFT073
acgcagcagauuaaccg

SEQ ID NO: 579351 - RNA, 14 nt, Escherichia coli CFT073
acgcacauaacauc

SEQ ID NO: 579352 - RNA, 13 nt, Escherichia coli CFT073
acgcaaggcacaa

SEQ ID NO: 579353 - RNA, 17 nt, Escherichia coli CFT073
acgcaauccccucuuca

SEQ ID NO: 579354 - RNA, 16 nt, Escherichia coli CFT073
acgauucggcaaucac

SEQ ID NO: 579355 - RNA, 17 nt, Escherichia coli CFT073
acgauucggcaaucaca

SEQ ID NO: 579356 - RNA, 13 nt, Escherichia coli CFT073
acgaugaaugcaa

SEQ ID NO: 579357 - RNA, 14 nt, Escherichia coli CFT073
acgaucuucacgga

SEQ ID NO: 579358 - RNA, 14 nt, Escherichia coli CFT073
acgaggaacauucg

SEQ ID NO: 579359 - RNA, 18 nt, Escherichia coli CFT073
acgacugaugcgacgcag

SEQ ID NO: 579360 - RNA, 14 nt, Escherichia coli CFT073
acgagccauaaaau

SEQ ID NO: 579361 - RNA, 22 nt, Escherichia coli CFT073
acgccccuggugcuugccagag

SEQ ID NO: 579362 - RNA, 18 nt, Escherichia coli CFT073
acgcccggcauucaccuc

SEQ ID NO: 579363 - RNA, 12 nt, Escherichia coli CFT073
acgcccgccagu

SEQ ID NO: 579364 - RNA, 12 nt, Escherichia coli CFT073
acgccaccauca

SEQ ID NO: 579365 - RNA, 12 nt, Escherichia coli CFT073
acgccacauccg

SEQ ID NO: 579366 - RNA, 13 nt, Escherichia coli CFT073
acgccaccagcgu

SEQ ID NO: 579367 - RNA, 14 nt, Escherichia coli CFT073
acgccaccagcguc

SEQ ID NO: 579368 - RNA, 17 nt, Escherichia coli CFT073
acgccaccuguuucuua

SEQ ID NO: 579369 - RNA, 22 nt, Escherichia coli CFT073
acgcauccggcacgucgcguua

SEQ ID NO: 579370 - RNA, 14 nt, Escherichia coli CFT073
acgcaucaacgcgg

SEQ ID NO: 579371 - RNA, 16 nt, Escherichia coli CFT073
acgcaucacccgcaua

SEQ ID NO: 579372 - RNA, 17 nt, Escherichia coli CFT073
acgccaauaccgaucag

SEQ ID NO: 579373 - RNA, 18 nt, Escherichia coli CFT073
acgccaauacgugaucgc

SEQ ID NO: 579374 - RNA, 23 nt, Escherichia coli CFT073
acgccacaacgauaauccagcag

SEQ ID NO: 579375 - RNA, 23 nt, Escherichia coli CFT073
acgcaguuuauccaucucuugcg

SEQ ID NO: 579376 - RNA, 17 nt, Escherichia coli CFT073
acgcauaaaacggcgca

SEQ ID NO: 579377 - RNA, 15 nt, Escherichia coli CFT073
acgcauaaccgguac

SEQ ID NO: 579378 - RNA, 22 nt, Escherichia coli CFT073
acgcagguucucaauuaccguu

SEQ ID NO: 579379 - RNA, 16 nt, Escherichia coli CFT073
acgcaguaaacgccag

SEQ ID NO: 579380 - RNA, 13 nt, Escherichia coli CFT073
acgcagugauaac

SEQ ID NO: 579381 - RNA, 17 nt, Escherichia coli CFT073
acgcagugauaacucaa

SEQ ID NO: 579382 - RNA, 22 nt, Escherichia coli CFT073
acgccuuaucaggccaaccgcc

SEQ ID NO: 579383 - RNA, 21 nt, Escherichia coli CFT073
acgccuuauccgaccuacaaa

SEQ ID NO: 579384 - RNA, 23 nt, Escherichia coli CFT073
acgccuuauccggccuacgggaa

SEQ ID NO: 579385 - RNA, 21 nt, Escherichia coli CFT073
acgccuuauccggccugcaaa

SEQ ID NO: 579386 - RNA, 19 nt, Escherichia coli CFT073
acgccuaaugccagcgaua

SEQ ID NO: 579387 - RNA, 21 nt, Escherichia coli CFT073
acgccguuuuuacccagcagc

SEQ ID NO: 579388 - RNA, 16 nt, Escherichia coli CFT073
acgccucagccgaaac

SEQ ID NO: 579389 - RNA, 17 nt, Escherichia coli CFT073
acgcgaucgcgaaacca

SEQ ID NO: 579390 - RNA, 21 nt, Escherichia coli CFT073
acgccuuccagacucaucuuc

SEQ ID NO: 579391 - RNA, 19 nt, Escherichia coli CFT073
acgcgcagcgucgcaucag

SEQ ID NO: 579392 - RNA, 12 nt, Escherichia coli CFT073
acgcgcauauug

SEQ ID NO: 579393 - RNA, 19 nt, Escherichia coli CFT073
acgcgccaagauagaacca

SEQ ID NO: 579394 - RNA, 22 nt, Escherichia coli CFT073
acgcgccacgcacgccugcauc

SEQ ID NO: 579395 - RNA, 19 nt, Escherichia coli CFT073
acgcgccgacgaauuucau

SEQ ID NO: 579396 - RNA, 20 nt, Escherichia coli CFT073
acgcgccagcgccguauccg

SEQ ID NO: 579397 - RNA, 20 nt, Escherichia coli CFT073
acgcgccagcgucgcauccg

SEQ ID NO: 579398 - RNA, 23 nt, Escherichia coli CFT073
acgcgcggugguacggcauuuug

SEQ ID NO: 579399 - RNA, 14 nt, Escherichia coli CFT073
acgcgccgccaccg

SEQ ID NO: 579400 - RNA, 15 nt, Escherichia coli CFT073
acgcgccgccagcca

SEQ ID NO: 579401 - RNA, 16 nt, Escherichia coli CFT073
acgccgcauccggcaa

SEQ ID NO: 579402 - RNA, 17 nt, Escherichia coli CFT073
acgccgcauccggcaau

SEQ ID NO: 579403 - RNA, 13 nt, Escherichia coli CFT073
acgccgccagacc

SEQ ID NO: 579404 - RNA, 14 nt, Escherichia coli CFT073
acgccgcacccggc

SEQ ID NO: 579405 - RNA, 21 nt, Escherichia coli CFT073
acgccgauaaucaacgcgccg

SEQ ID NO: 579406 - RNA, 23 nt, Escherichia coli CFT073
acgccgauaaucaacgcgccgcc

SEQ ID NO: 579407 - RNA, 22 nt, Escherichia coli CFT073
acgccgagacguuuugccaguu

SEQ ID NO: 579408 - RNA, 14 nt, Escherichia coli CFT073
acgccgagagaagc

SEQ ID NO: 579409 - RNA, 21 nt, Escherichia coli CFT073
acgccgaauaacgcgcagcgu

SEQ ID NO: 579410 - RNA, 16 nt, Escherichia coli CFT073
acgccgaccagaccgg

SEQ ID NO: 579411 - RNA, 15 nt, Escherichia coli CFT073
acgccggauggcaca

SEQ ID NO: 579412 - RNA, 20 nt, Escherichia coli CFT073
acgccgcugucuaccagcac

SEQ ID NO: 579413 - RNA, 22 nt, Escherichia coli CFT073
acgccgcugcucuauacgcuca

SEQ ID NO: 579414 - RNA, 13 nt, Escherichia coli CFT073
acgccgcugguga

SEQ ID NO: 579415 - RNA, 20 nt, Escherichia coli CFT073
acgccgccgccaaucgcccg

SEQ ID NO: 579416 - RNA, 20 nt, Escherichia coli CFT073
accgcguuuuuuaacagucc

SEQ ID NO: 579417 - RNA, 14 nt, Escherichia coli CFT073
accgcuaccgcccu

SEQ ID NO: 579418 - RNA, 14 nt, Escherichia coli CFT073
accgcuacuggcaa

SEQ ID NO: 579419 - RNA, 19 nt, Escherichia coli CFT073
accgcucgucacaucacca

SEQ ID NO: 579420 - RNA, 15 nt, Escherichia coli CFT073
accgcggaacgcacu

SEQ ID NO: 579421 - RNA, 22 nt, Escherichia coli CFT073
accggcaacagaacgcgccuua

SEQ ID NO: 579422 - RNA, 18 nt, Escherichia coli CFT073
accggauuuucaccaucg

SEQ ID NO: 579423 - RNA, 18 nt, Escherichia coli CFT073
accggaugcguucgcacc

SEQ ID NO: 579424 - RNA, 16 nt, Escherichia coli CFT073
accggaucugccauau

SEQ ID NO: 579425 - RNA, 22 nt, Escherichia coli CFT073
accggagucugugcuccgguuu

SEQ ID NO: 579426 - RNA, 19 nt, Escherichia coli CFT073
accggauaaucggcaauac

SEQ ID NO: 579427 - RNA, 21 nt, Escherichia coli CFT073
accgcuucgcguaaaauugca

SEQ ID NO: 579428 - RNA, 22 nt, Escherichia coli CFT073
accgcuucgcguaaaauugcag

SEQ ID NO: 579429 - RNA, 11 nt, Escherichia coli CFT073
accgcugaccg

SEQ ID NO: 579430 - RNA, 15 nt, Escherichia coli CFT073
accgcuucccaaaga

SEQ ID NO: 579431 - RNA, 19 nt, Escherichia coli CFT073
accggguguucuuucucgc

SEQ ID NO: 579432 - RNA, 18 nt, Escherichia coli CFT073
accggguagggcgaaacc

SEQ ID NO: 579433 - RNA, 15 nt, Escherichia coli CFT073
accggcuggcgcaua

SEQ ID NO: 579434 - RNA, 12 nt, Escherichia coli CFT073
accgggcgcaga

SEQ ID NO: 579435 - RNA, 16 nt, Escherichia coli CFT073
accggcucuaucugga

SEQ ID NO: 579436 - RNA, 15 nt, Escherichia coli CFT073
accggcgauauccca

SEQ ID NO: 579437 - RNA, 14 nt, Escherichia coli CFT073
accggaaauugcug

SEQ ID NO: 579438 - RNA, 13 nt, Escherichia coli CFT073
accgcacucacgc

SEQ ID NO: 579439 - RNA, 17 nt, Escherichia coli CFT073
accgcagcaaccgucgu

SEQ ID NO: 579440 - RNA, 19 nt, Escherichia coli CFT073
accgcagcaucgucaucag

SEQ ID NO: 579441 - RNA, 20 nt, Escherichia coli CFT073
accgcaggcaguggaauauc

SEQ ID NO: 579442 - RNA, 21 nt, Escherichia coli CFT073
accgcaucacgacagcaccac

SEQ ID NO: 579443 - RNA, 10 nt, Escherichia coli CFT073
accgcaucag

SEQ ID NO: 579444 - RNA, 18 nt, Escherichia coli CFT073
accgcauccggcaucagu

SEQ ID NO: 579445 - RNA, 17 nt, Escherichia coli CFT073
accgcaucggcaucaaa

SEQ ID NO: 579446 - RNA, 14 nt, Escherichia coli CFT073
accgccagcagcag

SEQ ID NO: 579447 - RNA, 13 nt, Escherichia coli CFT073
accgccaacaagg

SEQ ID NO: 579448 - RNA, 21 nt, Escherichia coli CFT073
accgccaacagcagccacggc

SEQ ID NO: 579449 - RNA, 23 nt, Escherichia coli CFT073
accgccagaagaaccgccaccuc

SEQ ID NO: 579450 - RNA, 19 nt, Escherichia coli CFT073
accgccugcggagaucacc

SEQ ID NO: 579451 - RNA, 17 nt, Escherichia coli CFT073
accgccguugauuucac

SEQ ID NO: 579452 - RNA, 16 nt, Escherichia coli CFT073
accgcgaauauaagcg

SEQ ID NO: 579453 - RNA, 17 nt, Escherichia coli CFT073
accgccuguaaacggau

SEQ ID NO: 579454 - RNA, 22 nt, Escherichia coli CFT073
accgcgagauauccacauuaac

SEQ ID NO: 579455 - RNA, 14 nt, Escherichia coli CFT073
accgcgagcaaaau

SEQ ID NO: 579456 - RNA, 16 nt, Escherichia coli CFT073
accgcgagcaaaaucg

SEQ ID NO: 579457 - RNA, 18 nt, Escherichia coli CFT073
accgcgcaguaccacuuc

SEQ ID NO: 579458 - RNA, 17 nt, Escherichia coli CFT073
acccgccagaaucaccg

SEQ ID NO: 579459 - RNA, 21 nt, Escherichia coli CFT073
accccugacgcuuaucuuccg

SEQ ID NO: 579460 - RNA, 15 nt, Escherichia coli CFT073
acccgccuucacuuc

SEQ ID NO: 579461 - RNA, 15 nt, Escherichia coli CFT073
acccgccaucgcccg

SEQ ID NO: 579462 - RNA, 13 nt, Escherichia coli CFT073
acccgccagugua

SEQ ID NO: 579463 - RNA, 16 nt, Escherichia coli CFT073
acccgcguuacgccau

SEQ ID NO: 579464 - RNA, 19 nt, Escherichia coli CFT073
acccggccacagcgccaga

SEQ ID NO: 579465 - RNA, 22 nt, Escherichia coli CFT073
acccggacaaauaacccgccau

SEQ ID NO: 579466 - RNA, 20 nt, Escherichia coli CFT073
acccugcgccagcgcaucau

SEQ ID NO: 579467 - RNA, 15 nt, Escherichia coli CFT073
acccugcaucagaac

SEQ ID NO: 579468 - RNA, 23 nt, Escherichia coli CFT073
acccugacuguuuuuccagcuua

SEQ ID NO: 579469 - RNA, 13 nt, Escherichia coli CFT073
accgaccaaucac

SEQ ID NO: 579470 - RNA, 15 nt, Escherichia coli CFT073
accgaacaaaacagc

SEQ ID NO: 579471 - RNA, 16 nt, Escherichia coli CFT073
accgaacaugccgcca

SEQ ID NO: 579472 - RNA, 16 nt, Escherichia coli CFT073
acccguguuuugcauc

SEQ ID NO: 579473 - RNA, 19 nt, Escherichia coli CFT073
acccgucguugcaaucagc

SEQ ID NO: 579474 - RNA, 15 nt, Escherichia coli CFT073
acccgucgcggcaaa

SEQ ID NO: 579475 - RNA, 16 nt, Escherichia coli CFT073
acccggcguuuucaga

SEQ ID NO: 579476 - RNA, 22 nt, Escherichia coli CFT073
acccccauaauccaugccaacg

SEQ ID NO: 579477 - RNA, 12 nt, Escherichia coli CFT073
accccauuaaua

SEQ ID NO: 579478 - RNA, 18 nt, Escherichia coli CFT073
accccauuaauaccgcca

SEQ ID NO: 579479 - RNA, 17 nt, Escherichia coli CFT073
accccgagaugcccgcu

SEQ ID NO: 579480 - RNA, 14 nt, Escherichia coli CFT073
accccagcuggcgc

SEQ ID NO: 579481 - RNA, 15 nt, Escherichia coli CFT073
acccauuuauccagc

SEQ ID NO: 579482 - RNA, 23 nt, Escherichia coli CFT073
acccauuuauccagcggcagcca

SEQ ID NO: 579483 - RNA, 22 nt, Escherichia coli CFT073
acccauuuucagccggcaggau

SEQ ID NO: 579484 - RNA, 12 nt, Escherichia coli CFT073
accccaaccacu

SEQ ID NO: 579485 - RNA, 19 nt, Escherichia coli CFT073
accccaaguuuaugcaaua

SEQ ID NO: 579486 - RNA, 15 nt, Escherichia coli CFT073
accccagaugaguaa

SEQ ID NO: 579487 - RNA, 23 nt, Escherichia coli CFT073
accccgcgcucacaccacaacag

SEQ ID NO: 579488 - RNA, 14 nt, Escherichia coli CFT073
accccgccagcaga

SEQ ID NO: 579489 - RNA, 14 nt, Escherichia coli CFT073
acccaucgccagca

SEQ ID NO: 579490 - RNA, 20 nt, Escherichia coli CFT073
acccaucaaccuugaaccga

SEQ ID NO: 579491 - RNA, 17 nt, Escherichia coli CFT073
acccaucuugucauugu

SEQ ID NO: 579492 - RNA, 17 nt, Escherichia coli CFT073
acccaucacuaccugau

SEQ ID NO: 579493 - RNA, 15 nt, Escherichia coli CFT073
acccaguuuaccgaa

SEQ ID NO: 579494 - RNA, 13 nt, Escherichia coli CFT073
acccaguuucaug

SEQ ID NO: 579495 - RNA, 16 nt, Escherichia coli CFT073
acccaguacgggcagc

SEQ ID NO: 579496 - RNA, 18 nt, Escherichia coli CFT073
acccagucccaccaucag

SEQ ID NO: 579497 - RNA, 16 nt, Escherichia coli CFT073
acccagcgccagcaua

SEQ ID NO: 579498 - RNA, 19 nt, Escherichia coli CFT073
acccagcgcgauacgcagu

SEQ ID NO: 579499 - RNA, 13 nt, Escherichia coli CFT073
acccagcgccaug

SEQ ID NO: 579500 - RNA, 18 nt, Escherichia coli CFT073
acccagcggaugacccag

SEQ ID NO: 579501 - RNA, 22 nt, Escherichia coli CFT073
acccagccccgguuuuucuggc

SEQ ID NO: 579502 - RNA, 15 nt, Escherichia coli CFT073
acccagcagcagcgg

SEQ ID NO: 579503 - RNA, 17 nt, Escherichia coli CFT073
accaggaucagcaaaau

SEQ ID NO: 579504 - RNA, 14 nt, Escherichia coli CFT073
accaggaacgccau

SEQ ID NO: 579505 - RNA, 16 nt, Escherichia coli CFT073
accaggaacgcgccaa

SEQ ID NO: 579506 - RNA, 18 nt, Escherichia coli CFT073
accaggaaaaagaucagc

SEQ ID NO: 579507 - RNA, 19 nt, Escherichia coli CFT073
accaggaaacccaacgcaa

SEQ ID NO: 579508 - RNA, 15 nt, Escherichia coli CFT073
accacuaauuccugc

SEQ ID NO: 579509 - RNA, 17 nt, Escherichia coli CFT073
accacuacgugaucguc

SEQ ID NO: 579510 - RNA, 23 nt, Escherichia coli CFT073
accacguucggugauauacgcca

SEQ ID NO: 579511 - RNA, 15 nt, Escherichia coli CFT073
accacuauuguugaa

SEQ ID NO: 579512 - RNA, 12 nt, Escherichia coli CFT073
accacugauaag

SEQ ID NO: 579513 - RNA, 18 nt, Escherichia coli CFT073
accacugcgccaacgucu

SEQ ID NO: 579514 - RNA, 16 nt, Escherichia coli CFT073
accacuucagaaccgu

SEQ ID NO: 579515 - RNA, 16 nt, Escherichia coli CFT073
accacuucauacuccg

SEQ ID NO: 579516 - RNA, 14 nt, Escherichia coli CFT073
accacuucauuggu

SEQ ID NO: 579517 - RNA, 16 nt, Escherichia coli CFT073
accacuuuaccgcuca

SEQ ID NO: 579518 - RNA, 18 nt, Escherichia coli CFT073
accacuuuaucggcaccc

SEQ ID NO: 579519 - RNA, 16 nt, Escherichia coli CFT073
accagcaggccgucgc

SEQ ID NO: 579520 - RNA, 20 nt, Escherichia coli CFT073
accagcagcgucagcacuuc

SEQ ID NO: 579521 - RNA, 13 nt, Escherichia coli CFT073
accagcagccauc

SEQ ID NO: 579522 - RNA, 17 nt, Escherichia coli CFT073
accagcaggaaucccau

SEQ ID NO: 579523 - RNA, 12 nt, Escherichia coli CFT073
accacuugcugg

SEQ ID NO: 579524 - RNA, 22 nt, Escherichia coli CFT073
accacuuuggugaaugccugau

SEQ ID NO: 579525 - RNA, 21 nt, Escherichia coli CFT073
accagaaagacugaauugcca

SEQ ID NO: 579526 - RNA, 23 nt, Escherichia coli CFT073
accagaaccgccgcugucugaau

SEQ ID NO: 579527 - RNA, 22 nt, Escherichia coli CFT073
accagaaucaucauaucgucau

SEQ ID NO: 579528 - RNA, 14 nt, Escherichia coli CFT073
accagaaucgccag

SEQ ID NO: 579529 - RNA, 14 nt, Escherichia coli CFT073
accagcagcaucac

SEQ ID NO: 579530 - RNA, 15 nt, Escherichia coli CFT073
accagcagcaucacc

SEQ ID NO: 579531 - RNA, 17 nt, Escherichia coli CFT073
accagcagcaucaccac

SEQ ID NO: 579532 - RNA, 16 nt, Escherichia coli CFT073
accagcugaaaucacc

SEQ ID NO: 579533 - RNA, 17 nt, Escherichia coli CFT073
accagcuccggcacuuc

SEQ ID NO: 579534 - RNA, 17 nt, Escherichia coli CFT073
accagcuaagcgcgcgg

SEQ ID NO: 579535 - RNA, 15 nt, Escherichia coli CFT073
accagcuaccacgcc

SEQ ID NO: 579536 - RNA, 16 nt, Escherichia coli CFT073
accagcgucagaaaca

SEQ ID NO: 579537 - RNA, 18 nt, Escherichia coli CFT073
accagcgucgcaucaggc

SEQ ID NO: 579538 - RNA, 15 nt, Escherichia coli CFT073
accagcagggugcua

SEQ ID NO: 579539 - RNA, 15 nt, Escherichia coli CFT073
accagcaggucgaua

SEQ ID NO: 579540 - RNA, 12 nt, Escherichia coli CFT073
accagccgccaa

SEQ ID NO: 579541 - RNA, 18 nt, Escherichia coli CFT073
accagccguuauguugau

SEQ ID NO: 579542 - RNA, 14 nt, Escherichia coli CFT073
accagcgaaaccug

SEQ ID NO: 579543 - RNA, 19 nt, Escherichia coli CFT073
accagcggcgcauccgcca

SEQ ID NO: 579544 - RNA, 14 nt, Escherichia coli CFT073
accacacucaauga

SEQ ID NO: 579545 - RNA, 19 nt, Escherichia coli CFT073
accacauauuacgggcgau

SEQ ID NO: 579546 - RNA, 18 nt, Escherichia coli CFT073
accaaugacagccccacc

SEQ ID NO: 579547 - RNA, 12 nt, Escherichia coli CFT073
accaaucaccac

SEQ ID NO: 579548 - RNA, 19 nt, Escherichia coli CFT073
accaaucaucgacauugac

SEQ ID NO: 579549 - RNA, 20 nt, Escherichia coli CFT073
accacaucagcgaacgacau

SEQ ID NO: 579550 - RNA, 19 nt, Escherichia coli CFT073
accaccaaaugcagcaacc

SEQ ID NO: 579551 - RNA, 15 nt, Escherichia coli CFT073
accacauucagccgu

SEQ ID NO: 579552 - RNA, 14 nt, Escherichia coli CFT073
accacccugcccgu

SEQ ID NO: 579553 - RNA, 16 nt, Escherichia coli CFT073
accacgguacgccaga

SEQ ID NO: 579554 - RNA, 18 nt, Escherichia coli CFT073
accacggaucgaagacau

SEQ ID NO: 579555 - RNA, 16 nt, Escherichia coli CFT073
accacggcaacgccgu

SEQ ID NO: 579556 - RNA, 14 nt, Escherichia coli CFT073
accaccucuuccag

SEQ ID NO: 579557 - RNA, 16 nt, Escherichia coli CFT073
accaccgucaauaaaa

SEQ ID NO: 579558 - RNA, 13 nt, Escherichia coli CFT073
acauagccgaaaa

SEQ ID NO: 579559 - RNA, 16 nt, Escherichia coli CFT073
acauagccgaaaaugc

SEQ ID NO: 579560 - RNA, 20 nt, Escherichia coli CFT073
acauacaggggaucgacgcc

SEQ ID NO: 579561 - RNA, 19 nt, Escherichia coli CFT073
acauaccacggcauuuccg

SEQ ID NO: 579562 - RNA, 21 nt, Escherichia coli CFT073
acauaccuaaaagcacgccag

SEQ ID NO: 579563 - RNA, 22 nt, Escherichia coli CFT073
acauaccuaaaagcacgccaga

SEQ ID NO: 579564 - RNA, 20 nt, Escherichia coli CFT073
acauaaucgaaaacaucaug

SEQ ID NO: 579565 - RNA, 14 nt, Escherichia coli CFT073
acaucccagcagag

SEQ ID NO: 579566 - RNA, 14 nt, Escherichia coli CFT073
acauccauauccag

SEQ ID NO: 579567 - RNA, 20 nt, Escherichia coli CFT073
acauccaucgccaguucaaa

SEQ ID NO: 579568 - RNA, 20 nt, Escherichia coli CFT073
acauccaugcuuguuuauua

SEQ ID NO: 579569 - RNA, 22 nt, Escherichia coli CFT073
acauauuccgcaccugccagcg

SEQ ID NO: 579570 - RNA, 13 nt, Escherichia coli CFT073
acauauucauccc

SEQ ID NO: 579571 - RNA, 16 nt, Escherichia coli CFT073
acauauucauuacuua

SEQ ID NO: 579572 - RNA, 19 nt, Escherichia coli CFT073
acauagcgugacaccagca

SEQ ID NO: 579573 - RNA, 21 nt, Escherichia coli CFT073
acauagcgugacaccagcaca

SEQ ID NO: 579574 - RNA, 13 nt, Escherichia coli CFT073
acaucgucgccag

SEQ ID NO: 579575 - RNA, 14 nt, Escherichia coli CFT073
acaucucaauccgc

SEQ ID NO: 579576 - RNA, 22 nt, Escherichia coli CFT073
acauccugaguuaaucgccgca

SEQ ID NO: 579577 - RNA, 23 nt, Escherichia coli CFT073
acauccugaguuaaucgccgcau

SEQ ID NO: 579578 - RNA, 15 nt, Escherichia coli CFT073
acaucccggcagaga

SEQ ID NO: 579579 - RNA, 21 nt, Escherichia coli CFT073
acauccggcacgucuucgaua

SEQ ID NO: 579580 - RNA, 22 nt, Escherichia coli CFT073
acaguugcugcgugaccgccag

SEQ ID NO: 579581 - RNA, 18 nt, Escherichia coli CFT073
acaguuucagccccauca

SEQ ID NO: 579582 - RNA, 16 nt, Escherichia coli CFT073
acaguuugaucaguuc

SEQ ID NO: 579583 - RNA, 16 nt, Escherichia coli CFT073
acaguuugccaaacca

SEQ ID NO: 579584 - RNA, 21 nt, Escherichia coli CFT073
acaguuuuaucuccauccggg

SEQ ID NO: 579585 - RNA, 17 nt, Escherichia coli CFT073
acagugacccgcagcca

SEQ ID NO: 579586 - RNA, 19 nt, Escherichia coli CFT073
acagugacccgcagccagc

SEQ ID NO: 579587 - RNA, 19 nt, Escherichia coli CFT073
acagugaugacgccagccg

SEQ ID NO: 579588 - RNA, 17 nt, Escherichia coli CFT073
acagugccgcgcauagc

SEQ ID NO: 579589 - RNA, 21 nt, Escherichia coli CFT073
acaguuccgcaaagcccauca

SEQ ID NO: 579590 - RNA, 23 nt, Escherichia coli CFT073
acaguccauugcgcaaccgcccg

SEQ ID NO: 579591 - RNA, 20 nt, Escherichia coli CFT073
acaguauucagaucagcggc

SEQ ID NO: 579592 - RNA, 13 nt, Escherichia coli CFT073
acaguagagaucu

SEQ ID NO: 579593 - RNA, 13 nt, Escherichia coli CFT073
acaguaucaccaa

SEQ ID NO: 579594 - RNA, 17 nt, Escherichia coli CFT073
acagucugcuccaucgc

SEQ ID NO: 579595 - RNA, 22 nt, Escherichia coli CFT073
acagucgaugcagccccacggc

SEQ ID NO: 579596 - RNA, 15 nt, Escherichia coli CFT073
acagucgcucggcga

SEQ ID NO: 579597 - RNA, 19 nt, Escherichia coli CFT073
acagcguaauagccugaug

SEQ ID NO: 579598 - RNA, 14 nt, Escherichia coli CFT073
acagcgucacauca

SEQ ID NO: 579599 - RNA, 15 nt, Escherichia coli CFT073
accaaaauaacgauc

SEQ ID NO: 579600 - RNA, 15 nt, Escherichia coli CFT073
accaaaacagcgaca

SEQ ID NO: 579601 - RNA, 22 nt, Escherichia coli CFT073
accaaaacagcgacaccagcca

SEQ ID NO: 579602 - RNA, 12 nt, Escherichia coli CFT073
accaaaacggac

SEQ ID NO: 579603 - RNA, 16 nt, Escherichia coli CFT073
accaaacagcgccaga

SEQ ID NO: 579604 - RNA, 17 nt, Escherichia coli CFT073
accaaacgggcaagcca

SEQ ID NO: 579605 - RNA, 14 nt, Escherichia coli CFT073
accaacauauugcu

SEQ ID NO: 579606 - RNA, 20 nt, Escherichia coli CFT073
accaacgaugaagagauaaa

SEQ ID NO: 579607 - RNA, 21 nt, Escherichia coli CFT073
accaacuuucacgcgcugacc

SEQ ID NO: 579608 - RNA, 15 nt, Escherichia coli CFT073
accaacggcgagcca

SEQ ID NO: 579609 - RNA, 15 nt, Escherichia coli CFT073
accaauaaacgccag

SEQ ID NO: 579610 - RNA, 22 nt, Escherichia coli CFT073
accaauaccgcccacuaccagc

SEQ ID NO: 579611 - RNA, 19 nt, Escherichia coli CFT073
acaugcagcuucgccauuu

SEQ ID NO: 579612 - RNA, 19 nt, Escherichia coli CFT073
acaugacgcgcaucacgac

SEQ ID NO: 579613 - RNA, 23 nt, Escherichia coli CFT073
acaucugcaaugcgaauaucaac

SEQ ID NO: 579614 - RNA, 12 nt, Escherichia coli CFT073
acaucuguaucg

SEQ ID NO: 579615 - RNA, 14 nt, Escherichia coli CFT073
acaugaacaucaag

SEQ ID NO: 579616 - RNA, 14 nt, Escherichia coli CFT073
acaugaagcacggc

SEQ ID NO: 579617 - RNA, 19 nt, Escherichia coli CFT073
acaugacaccaagcaccau

SEQ ID NO: 579618 - RNA, 16 nt, Escherichia coli CFT073
acauugaugcgccaua

SEQ ID NO: 579619 - RNA, 19 nt, Escherichia coli CFT073
acauugccaccaccagcgu

SEQ ID NO: 579620 - RNA, 23 nt, Escherichia coli CFT073
acauugccaccaccagcguaccg

SEQ ID NO: 579621 - RNA, 22 nt, Escherichia coli CFT073
acauugccgaauggcugcacuu

SEQ ID NO: 579622 - RNA, 18 nt, Escherichia coli CFT073
acauugcucauuccgccg

SEQ ID NO: 579623 - RNA, 21 nt, Escherichia coli CFT073
acauuggcucaucaaacaacg

SEQ ID NO: 579624 - RNA, 21 nt, Escherichia coli CFT073
acauugguacagagaacaccc

SEQ ID NO: 579625 - RNA, 18 nt, Escherichia coli CFT073
acauugugauguaagcgc

SEQ ID NO: 579626 - RNA, 19 nt, Escherichia coli CFT073
acauugugguucguugaua

SEQ ID NO: 579627 - RNA, 22 nt, Escherichia coli CFT073
acauuuauuucaacgacauaug

SEQ ID NO: 579628 - RNA, 20 nt, Escherichia coli CFT073
acauuucuucuuucagguga

SEQ ID NO: 579629 - RNA, 17 nt, Escherichia coli CFT073
acauuugcguggcgcgc

SEQ ID NO: 579630 - RNA, 16 nt, Escherichia coli CFT073
acagccccaccagcaa

SEQ ID NO: 579631 - RNA, 22 nt, Escherichia coli CFT073
acagccucaagcacccaaugcc

SEQ ID NO: 579632 - RNA, 22 nt, Escherichia coli CFT073
acagccuaccagaccgcacacc

SEQ ID NO: 579633 - RNA, 13 nt, Escherichia coli CFT073
acagcgacaucaa

SEQ ID NO: 579634 - RNA, 17 nt, Escherichia coli CFT073
acagccugauaacgaau

SEQ ID NO: 579635 - RNA, 13 nt, Escherichia coli CFT073
acagcggcaucaa

SEQ ID NO: 579636 - RNA, 21 nt, Escherichia coli CFT073
acagcgccgcgauaaaauccc

SEQ ID NO: 579637 - RNA, 20 nt, Escherichia coli CFT073
acagcgccugcacaaagcgc

SEQ ID NO: 579638 - RNA, 18 nt, Escherichia coli CFT073
acagccagaagcccggau

SEQ ID NO: 579639 - RNA, 14 nt, Escherichia coli CFT073
acagccagcgcagg

SEQ ID NO: 579640 - RNA, 16 nt, Escherichia coli CFT073
acagccagcgcaggca

SEQ ID NO: 579641 - RNA, 19 nt, Escherichia coli CFT073
acagccauaaagaaaucac

SEQ ID NO: 579642 - RNA, 23 nt, Escherichia coli CFT073
acagcagaacgaccagcgccgca

SEQ ID NO: 579643 - RNA, 12 nt, Escherichia coli CFT073
acagcaccaucc

SEQ ID NO: 579644 - RNA, 12 nt, Escherichia coli CFT073
acacuauaucuc

SEQ ID NO: 579645 - RNA, 12 nt, Escherichia coli CFT073
acacucacaucc

SEQ ID NO: 579646 - RNA, 16 nt, Escherichia coli CFT073
acacucacgcauacag

SEQ ID NO: 579647 - RNA, 17 nt, Escherichia coli CFT073
acacuccagucccaguu

SEQ ID NO: 579648 - RNA, 22 nt, Escherichia coli CFT073
acacugagguaacucucaugcu

SEQ ID NO: 579649 - RNA, 20 nt, Escherichia coli CFT073
acacugccagcccggcagcu

SEQ ID NO: 579650 - RNA, 14 nt, Escherichia coli CFT073
acacugcgccgcca

SEQ ID NO: 579651 - RNA, 21 nt, Escherichia coli CFT073
acacuuccgcguaguugcgcu

SEQ ID NO: 579652 - RNA, 16 nt, Escherichia coli CFT073
acacgcggagccaguu

SEQ ID NO: 579653 - RNA, 16 nt, Escherichia coli CFT073
acacgcccgucauacc

SEQ ID NO: 579654 - RNA, 17 nt, Escherichia coli CFT073
acacgcaucacgcgcau

SEQ ID NO: 579655 - RNA, 13 nt, Escherichia coli CFT073
acacgccagcguu

SEQ ID NO: 579656 - RNA, 14 nt, Escherichia coli CFT073
acacgcaacaccag

SEQ ID NO: 579657 - RNA, 18 nt, Escherichia coli CFT073
acacgcaggagauugaag

SEQ ID NO: 579658 - RNA, 13 nt, Escherichia coli CFT073
acacgaucagcca

SEQ ID NO: 579659 - RNA, 22 nt, Escherichia coli CFT073
acaccguuuccauaucgcuggc

SEQ ID NO: 579660 - RNA, 16 nt, Escherichia coli CFT073
acaccguuuuaccauc

SEQ ID NO: 579661 - RNA, 23 nt, Escherichia coli CFT073
acacgacgcgccagcagcgcaaa

SEQ ID NO: 579662 - RNA, 21 nt, Escherichia coli CFT073
acacaauuuguggcccuugcg

SEQ ID NO: 579663 - RNA, 21 nt, Escherichia coli CFT073
acacacuuuccaguuccggca

SEQ ID NO: 579664 - RNA, 18 nt, Escherichia coli CFT073
acacccgacacggcucgc

SEQ ID NO: 579665 - RNA, 14 nt, Escherichia coli CFT073
acaccgcccagcga

SEQ ID NO: 579666 - RNA, 20 nt, Escherichia coli CFT073
acaccgcccagcgagcuggc

SEQ ID NO: 579667 - RNA, 11 nt, Escherichia coli CFT073
acaauaacgcc

SEQ ID NO: 579668 - RNA, 17 nt, Escherichia coli CFT073
acaauaaucaacgcgaa

SEQ ID NO: 579669 - RNA, 21 nt, Escherichia coli CFT073
acaauacaaaauaggcaaaaa

SEQ ID NO: 579670 - RNA, 19 nt, Escherichia coli CFT073
acaauccccgcgccaacca

SEQ ID NO: 579671 - RNA, 11 nt, Escherichia coli CFT073
acaaucgccgc

SEQ ID NO: 579672 - RNA, 18 nt, Escherichia coli CFT073
acaaucgggaaaaucugc

SEQ ID NO: 579673 - RNA, 11 nt, Escherichia coli CFT073
acaaucgguaa

SEQ ID NO: 579674 - RNA, 20 nt, Escherichia coli CFT073
acaaucaacgccaccaucac

SEQ ID NO: 579675 - RNA, 19 nt, Escherichia coli CFT073
acaaucaucaacccgcgcg

SEQ ID NO: 579676 - RNA, 17 nt, Escherichia coli CFT073
acaaucaucacgaucac

SEQ ID NO: 579677 - RNA, 19 nt, Escherichia coli CFT073
acaauggcauauuccgcca

SEQ ID NO: 579678 - RNA, 23 nt, Escherichia coli CFT073
acaaugccgaauagaacauaaug

SEQ ID NO: 579679 - RNA, 12 nt, Escherichia coli CFT073
acaaugccgcca

SEQ ID NO: 579680 - RNA, 15 nt, Escherichia coli CFT073
acaauggcgcggcua

SEQ ID NO: 579681 - RNA, 14 nt, Escherichia coli CFT073
acaauguaaaucau

SEQ ID NO: 579682 - RNA, 20 nt, Escherichia coli CFT073
acaaugucuucacaaccgcc

SEQ ID NO: 579683 - RNA, 23 nt, Escherichia coli CFT073
acaauuccugugccucgccauua

SEQ ID NO: 579684 - RNA, 18 nt, Escherichia coli CFT073
acaauugcgggccaaaga

SEQ ID NO: 579685 - RNA, 16 nt, Escherichia coli CFT073
acacaauaccuucugc

SEQ ID NO: 579686 - RNA, 13 nt, Escherichia coli CFT073
acacaaccgccgg

SEQ ID NO: 579687 - RNA, 22 nt, Escherichia coli CFT073
acaagcauaacaaaaugccgua

SEQ ID NO: 579688 - RNA, 17 nt, Escherichia coli CFT073
acaagcccaggccaucg

SEQ ID NO: 579689 - RNA, 13 nt, Escherichia coli CFT073
acaagcggcaguu

SEQ ID NO: 579690 - RNA, 13 nt, Escherichia coli CFT073
acaagcgucauau

SEQ ID NO: 579691 - RNA, 21 nt, Escherichia coli CFT073
acaagcgucauauccgacacu

SEQ ID NO: 579692 - RNA, 18 nt, Escherichia coli CFT073
acaagccacaucgccaua

SEQ ID NO: 579693 - RNA, 17 nt, Escherichia coli CFT073
acaagaaauaugaauau

SEQ ID NO: 579694 - RNA, 21 nt, Escherichia coli CFT073
acaaggguaugcuguaaacaa

SEQ ID NO: 579695 - RNA, 20 nt, Escherichia coli CFT073
acaaggcgcucgcgccgcau

SEQ ID NO: 579696 - RNA, 21 nt, Escherichia coli CFT073
acaacggcaaacacgccgccg

SEQ ID NO: 579697 - RNA, 13 nt, Escherichia coli CFT073
acaacgauaaucc

SEQ ID NO: 579698 - RNA, 15 nt, Escherichia coli CFT073
acaacgaaugccgcc

SEQ ID NO: 579699 - RNA, 16 nt, Escherichia coli CFT073
acaacgccgauuaaua

SEQ ID NO: 579700 - RNA, 13 nt, Escherichia coli CFT073
acaaauaacccgc

SEQ ID NO: 579701 - RNA, 16 nt, Escherichia coli CFT073
acaaauaccccaccgc

SEQ ID NO: 579702 - RNA, 17 nt, Escherichia coli CFT073
acaaauagaucgccaga

SEQ ID NO: 579703 - RNA, 14 nt, Escherichia coli CFT073
acaaauagccagca

SEQ ID NO: 579704 - RNA, 20 nt, Escherichia coli CFT073
acaacaauaccguaccaugu

SEQ ID NO: 579705 - RNA, 18 nt, Escherichia coli CFT073
acaacaugcuauuacgcc

SEQ ID NO: 579706 - RNA, 17 nt, Escherichia coli CFT073
acaacauuuugcggcua

SEQ ID NO: 579707 - RNA, 18 nt, Escherichia coli CFT073
acaacauagcuuggcaga

SEQ ID NO: 579708 - RNA, 19 nt, Escherichia coli CFT073
acaaccgccagaugcggcg

SEQ ID NO: 579709 - RNA, 20 nt, Escherichia coli CFT073
acaaccgccagaugcggcgu

SEQ ID NO: 579710 - RNA, 19 nt, Escherichia coli CFT073
acaaccgccggaugcggcg

SEQ ID NO: 579711 - RNA, 20 nt, Escherichia coli CFT073
acaaccgccggaugcggcgu

SEQ ID NO: 579712 - RNA, 22 nt, Escherichia coli CFT073
acaaccguucgcguaccgcuga

SEQ ID NO: 579713 - RNA, 20 nt, Escherichia coli CFT073
acaaaaaagccggagcgaca

SEQ ID NO: 579714 - RNA, 20 nt, Escherichia coli CFT073
acaaaauaaccgccaccagg

SEQ ID NO: 579715 - RNA, 15 nt, Escherichia coli CFT073
acaaacaaugccaga

SEQ ID NO: 579716 - RNA, 23 nt, Escherichia coli CFT073
acaaacacagcagucggaaccgg

SEQ ID NO: 579717 - RNA, 19 nt, Escherichia coli CFT073
acaaaauuuauccagcgca

SEQ ID NO: 579718 - RNA, 11 nt, Escherichia coli CFT073
acaaaccaccg

SEQ ID NO: 579719 - RNA, 18 nt, Escherichia coli CFT073
acaaacucacugccagca

SEQ ID NO: 579720 - RNA, 22 nt, Escherichia coli CFT073
acaaacagcucgacaccaaaca

SEQ ID NO: 579721 - RNA, 23 nt, Escherichia coli CFT073
aaugugcggcgcauucaccagcg

SEQ ID NO: 579722 - RNA, 21 nt, Escherichia coli CFT073
aaugugcuccauuguuagcaa

SEQ ID NO: 579723 - RNA, 17 nt, Escherichia coli CFT073
ugaccgagcgcccgcca

SEQ ID NO: 579724 - RNA, 20 nt, Escherichia coli CFT073
ugaccgauaaccugccgcgc

SEQ ID NO: 579725 - RNA, 19 nt, Escherichia coli CFT073
ugaacgccuuauccgaccu

SEQ ID NO: 579726 - RNA, 20 nt, Escherichia coli CFT073
ugaacgccuuauccgaccua

SEQ ID NO: 579727 - RNA, 20 nt, Escherichia coli CFT073
ugaccgccuuauccggccua

SEQ ID NO: 579728 - RNA, 19 nt, Escherichia coli CFT073
ugaccgucgcagccagcgc

SEQ ID NO: 579729 - RNA, 22 nt, Escherichia coli CFT073
ugacgaauaccguauucaacga

SEQ ID NO: 579730 - RNA, 16 nt, Escherichia coli CFT073
ugacgaacaauaucgc

SEQ ID NO: 579731 - RNA, 16 nt, Escherichia coli CFT073
ugacgccugcagcauc

SEQ ID NO: 579732 - RNA, 21 nt, Escherichia coli CFT073
ugacgccagccgauccggaug

SEQ ID NO: 579733 - RNA, 15 nt, Escherichia coli CFT073
ugacgccaccauucg

SEQ ID NO: 579734 - RNA, 21 nt, Escherichia coli CFT073
ugacgaugguguuuauuccgc

SEQ ID NO: 579735 - RNA, 13 nt, Escherichia coli CFT073
ugacggcuucucg

SEQ ID NO: 579736 - RNA, 15 nt, Escherichia coli CFT073
ugacgggccaagcag

SEQ ID NO: 579737 - RNA, 22 nt, Escherichia coli CFT073
ugacggaucuuccagcgcaucg

SEQ ID NO: 579738 - RNA, 22 nt, Escherichia coli CFT073
ugacggccaguugcgcaacgua

SEQ ID NO: 579739 - RNA, 22 nt, Escherichia coli CFT073
ugacggcguucuuuacacagcg

SEQ ID NO: 579740 - RNA, 16 nt, Escherichia coli CFT073
ugacgcuggcagaaag

SEQ ID NO: 579741 - RNA, 15 nt, Escherichia coli CFT073
ugacgcuggcagcag

SEQ ID NO: 579742 - RNA, 19 nt, Escherichia coli CFT073
ugacggaaaucauccagca

SEQ ID NO: 579743 - RNA, 19 nt, Escherichia coli CFT073
ugacggagaaaauccgcca

SEQ ID NO: 579744 - RNA, 20 nt, Escherichia coli CFT073
ugacggagaaaauccgccaa

SEQ ID NO: 579745 - RNA, 21 nt, Escherichia coli CFT073
ugacgcgcauacucuccucca

SEQ ID NO: 579746 - RNA, 16 nt, Escherichia coli CFT073
ugacgcgucuuaucag

SEQ ID NO: 579747 - RNA, 21 nt, Escherichia coli CFT073
ugacgcgucuuaucaggccua

SEQ ID NO: 579748 - RNA, 17 nt, Escherichia coli CFT073
ugacgcgucuuauccga

SEQ ID NO: 579749 - RNA, 21 nt, Escherichia coli CFT073
ugacgcgucuuauccggccua

SEQ ID NO: 579750 - RNA, 17 nt, Escherichia coli CFT073
ugagcgcaaauugcugg

SEQ ID NO: 579751 - RNA, 17 nt, Escherichia coli CFT073
ugagcuucucuggcugc

SEQ ID NO: 579752 - RNA, 22 nt, Escherichia coli CFT073
ugaggaagcgcaacagcgcgcc

SEQ ID NO: 579753 - RNA, 22 nt, Escherichia coli CFT073
ugacuccgauauuugccgcgac

SEQ ID NO: 579754 - RNA, 21 nt, Escherichia coli CFT073
ugacucgccgcaaaacccagg

SEQ ID NO: 579755 - RNA, 21 nt, Escherichia coli CFT073
ugacucuacugaaggcgcauu

SEQ ID NO: 579756 - RNA, 15 nt, Escherichia coli CFT073
ugacuaaugccgcca

SEQ ID NO: 579757 - RNA, 16 nt, Escherichia coli CFT073
ugacguuaagaucaaa

SEQ ID NO: 579758 - RNA, 23 nt, Escherichia coli CFT073
ugacggucgguaaacccggccug

SEQ ID NO: 579759 - RNA, 17 nt, Escherichia coli CFT073
ugacggugauacagcaa

SEQ ID NO: 579760 - RNA, 21 nt, Escherichia coli CFT073
ugaguucgucgaguuuauagc

SEQ ID NO: 579761 - RNA, 17 nt, Escherichia coli CFT073
ugauaaacggcacugua

SEQ ID NO: 579762 - RNA, 22 nt, Escherichia coli CFT073
ugauaaaugcacgcugccuggu

SEQ ID NO: 579763 - RNA, 15 nt, Escherichia coli CFT073
ugauaaauugccugc

SEQ ID NO: 579764 - RNA, 19 nt, Escherichia coli CFT073
ugauaaccggauggcgcga

SEQ ID NO: 579765 - RNA, 23 nt, Escherichia coli CFT073
ugauaacgaaucgggcaaaguca

SEQ ID NO: 579766 - RNA, 21 nt, Escherichia coli CFT073
ugauaagcugagcacaaaaca

SEQ ID NO: 579767 - RNA, 21 nt, Escherichia coli CFT073
ugauaaggcguuuacgccgca

SEQ ID NO: 579768 - RNA, 23 nt, Escherichia coli CFT073
ugauaaggcguuuacgccgcauc

SEQ ID NO: 579769 - RNA, 16 nt, Escherichia coli CFT073
ugauaauucaacagau

SEQ ID NO: 579770 - RNA, 21 nt, Escherichia coli CFT073
ugauacaaaacagauacacgg

SEQ ID NO: 579771 - RNA, 17 nt, Escherichia coli CFT073
ugauaccgugcagcacg

SEQ ID NO: 579772 - RNA, 16 nt, Escherichia coli CFT073
ugauacgccugcuggc

SEQ ID NO: 579773 - RNA, 22 nt, Escherichia coli CFT073
ugauaucggcucauaaaaacuc

SEQ ID NO: 579774 - RNA, 23 nt, Escherichia coli CFT073
ugaucguaacggguacgguaaag

SEQ ID NO: 579775 - RNA, 14 nt, Escherichia coli CFT073
ugaucugccccaua

SEQ ID NO: 579776 - RNA, 19 nt, Escherichia coli CFT073
ugaucugcacagcauucag

SEQ ID NO: 579777 - RNA, 15 nt, Escherichia coli CFT073
ugaucugcaaauuca

SEQ ID NO: 579778 - RNA, 22 nt, Escherichia coli CFT073
ugaucuuacguuuaauauuacc

SEQ ID NO: 579779 - RNA, 17 nt, Escherichia coli CFT073
ugaugaaaaaaccagaa

SEQ ID NO: 579780 - RNA, 18 nt, Escherichia coli CFT073
ugaugcgcacacgcgcug

SEQ ID NO: 579781 - RNA, 15 nt, Escherichia coli CFT073
ugaugcgacgcggca

SEQ ID NO: 579782 - RNA, 19 nt, Escherichia coli CFT073
ugaugcgacgcuggcgcgu

SEQ ID NO: 579783 - RNA, 12 nt, Escherichia coli CFT073
ugaugccuggca

SEQ ID NO: 579784 - RNA, 13 nt, Escherichia coli CFT073
ugaugaccagugc

SEQ ID NO: 579785 - RNA, 16 nt, Escherichia coli CFT073
ugaugacgcagauccc

SEQ ID NO: 579786 - RNA, 22 nt, Escherichia coli CFT073
ugaugaaaagauuaacgugacc

SEQ ID NO: 579787 - RNA, 21 nt, Escherichia coli CFT073
ugaucugcuaaacguaacaca

SEQ ID NO: 579788 - RNA, 18 nt, Escherichia coli CFT073
ugaugacaaacgcaaaac

SEQ ID NO: 579789 - RNA, 22 nt, Escherichia coli CFT073
ugaugacaaacgcaaaacugcc

SEQ ID NO: 579790 - RNA, 19 nt, Escherichia coli CFT073
ugaucacccacaucaacgg

SEQ ID NO: 579791 - RNA, 16 nt, Escherichia coli CFT073
ugaucaauaagcgucg

SEQ ID NO: 579792 - RNA, 22 nt, Escherichia coli CFT073
ugaucaauuucugcgcggauag

SEQ ID NO: 579793 - RNA, 20 nt, Escherichia coli CFT073
ugauauuuauuuccuucgcu

SEQ ID NO: 579794 - RNA, 23 nt, Escherichia coli CFT073
ugaucaacgaccagaaagacuga

SEQ ID NO: 579795 - RNA, 19 nt, Escherichia coli CFT073
ugaucgacaguugcugcgu

SEQ ID NO: 579796 - RNA, 14 nt, Escherichia coli CFT073
ugaucagcaacgcc

SEQ ID NO: 579797 - RNA, 14 nt, Escherichia coli CFT073
ugaucgccgccagu

SEQ ID NO: 579798 - RNA, 22 nt, Escherichia coli CFT073
ugaucgcgcgccuuacgggcgu

SEQ ID NO: 579799 - RNA, 23 nt, Escherichia coli CFT073
ugaucggagaacaggaauaaauc

SEQ ID NO: 579800 - RNA, 15 nt, Escherichia coli CFT073
ugcccgaucaacgga

SEQ ID NO: 579801 - RNA, 12 nt, Escherichia coli CFT073
ugcccgcccgac

SEQ ID NO: 579802 - RNA, 18 nt, Escherichia coli CFT073
ugcccgcuuuuacgcggg

SEQ ID NO: 579803 - RNA, 20 nt, Escherichia coli CFT073
ugcccggcaauacacgccgg

SEQ ID NO: 579804 - RNA, 17 nt, Escherichia coli CFT073
ugcccguagcccaucag

SEQ ID NO: 579805 - RNA, 19 nt, Escherichia coli CFT073
ugcccgguugcuuuucaca

SEQ ID NO: 579806 - RNA, 19 nt, Escherichia coli CFT073
ugcccggugccgcguuuug

SEQ ID NO: 579807 - RNA, 18 nt, Escherichia coli CFT073
ugcccggucgggugcuca

SEQ ID NO: 579808 - RNA, 19 nt, Escherichia coli CFT073
ugccagcacagaucgcacu

SEQ ID NO: 579809 - RNA, 22 nt, Escherichia coli CFT073
ugccagaucaaacaaccguuca

SEQ ID NO: 579810 - RNA, 13 nt, Escherichia coli CFT073
ugccagcaccauc

SEQ ID NO: 579811 - RNA, 17 nt, Escherichia coli CFT073
ugccagaucggccaucg

SEQ ID NO: 579812 - RNA, 20 nt, Escherichia coli CFT073
ugccagaugcggugcgccac

SEQ ID NO: 579813 - RNA, 16 nt, Escherichia coli CFT073
ugccagcaacuggcuu

SEQ ID NO: 579814 - RNA, 23 nt, Escherichia coli CFT073
ugccagagcacugcauucggcga

SEQ ID NO: 579815 - RNA, 14 nt, Escherichia coli CFT073
ugccagaauuaacg

SEQ ID NO: 579816 - RNA, 19 nt, Escherichia coli CFT073
ugccagaccuuaucacaau

SEQ ID NO: 579817 - RNA, 15 nt, Escherichia coli CFT073
ugccacgcuggacgc

SEQ ID NO: 579818 - RNA, 19 nt, Escherichia coli CFT073
ugccacuucuuccagcggc

SEQ ID NO: 579819 - RNA, 21 nt, Escherichia coli CFT073
ugcauauaagaugcgccaaca

SEQ ID NO: 579820 - RNA, 15 nt, Escherichia coli CFT073
ugcaucaacauauau

SEQ ID NO: 579821 - RNA, 19 nt, Escherichia coli CFT073
ugcaucaaguucuuucgcu

SEQ ID NO: 579822 - RNA, 19 nt, Escherichia coli CFT073
ugccacgccacgcugccgc

SEQ ID NO: 579823 - RNA, 15 nt, Escherichia coli CFT073
ugcauaauccgccgc

SEQ ID NO: 579824 - RNA, 17 nt, Escherichia coli CFT073
ugcauaauccgccgcug

SEQ ID NO: 579825 - RNA, 19 nt, Escherichia coli CFT073
ugcauaaugucgcuggccg

SEQ ID NO: 579826 - RNA, 17 nt, Escherichia coli CFT073
ugcauaauuucuucguu

SEQ ID NO: 579827 - RNA, 14 nt, Escherichia coli CFT073
ugcauaacacaaua

SEQ ID NO: 579828 - RNA, 21 nt, Escherichia coli CFT073
ugcccagcguuccggcgucca

SEQ ID NO: 579829 - RNA, 19 nt, Escherichia coli CFT073
ugcccacugcggcgcaaca

SEQ ID NO: 579830 - RNA, 18 nt, Escherichia coli CFT073
ugcccagaaucgccaacg

SEQ ID NO: 579831 - RNA, 21 nt, Escherichia coli CFT073
ugcccagaaucgccaacgccu

SEQ ID NO: 579832 - RNA, 13 nt, Escherichia coli CFT073
ugccauucaguuu

SEQ ID NO: 579833 - RNA, 19 nt, Escherichia coli CFT073
ugccaugccguuuaacacg

SEQ ID NO: 579834 - RNA, 14 nt, Escherichia coli CFT073
ugccauuaaaccaa

SEQ ID NO: 579835 - RNA, 17 nt, Escherichia coli CFT073
ugccaucgacuucucgc

SEQ ID NO: 579836 - RNA, 21 nt, Escherichia coli CFT073
ugccaucgugcuucacuucag

SEQ ID NO: 579837 - RNA, 14 nt, Escherichia coli CFT073
ugccaucucugcaa

SEQ ID NO: 579838 - RNA, 14 nt, Escherichia coli CFT073
ugccaucugccagc

SEQ ID NO: 579839 - RNA, 15 nt, Escherichia coli CFT073
ugccaugcacgcaaa

SEQ ID NO: 579840 - RNA, 17 nt, Escherichia coli CFT073
ugccagccgucgucgcg

SEQ ID NO: 579841 - RNA, 19 nt, Escherichia coli CFT073
ugccagcgccagcgcaccu

SEQ ID NO: 579842 - RNA, 18 nt, Escherichia coli CFT073
ugccagcgccccuggcgc

SEQ ID NO: 579843 - RNA, 13 nt, Escherichia coli CFT073
ugccagcagcacc

SEQ ID NO: 579844 - RNA, 16 nt, Escherichia coli CFT073
ugccagcagcacccga

SEQ ID NO: 579845 - RNA, 24 nt, Escherichia coli CFT073
ugccagcauaaucaccaucagcag

SEQ ID NO: 579846 - RNA, 17 nt, Escherichia coli CFT073
ugccagccagucagucu

SEQ ID NO: 579847 - RNA, 17 nt, Escherichia coli CFT073
ugcagaaguugugaaac

SEQ ID NO: 579848 - RNA, 16 nt, Escherichia coli CFT073
ugcagauggaugagca

SEQ ID NO: 579849 - RNA, 18 nt, Escherichia coli CFT073
ugcagauggcauccagcg

SEQ ID NO: 579850 - RNA, 19 nt, Escherichia coli CFT073
ugcagauuugccaguaccg

SEQ ID NO: 579851 - RNA, 13 nt, Escherichia coli CFT073
ugcagcaaccaga

SEQ ID NO: 579852 - RNA, 13 nt, Escherichia coli CFT073
ugcagcaacucug

SEQ ID NO: 579853 - RNA, 12 nt, Escherichia coli CFT073
ugcagccccaua

SEQ ID NO: 579854 - RNA, 21 nt, Escherichia coli CFT073
ugcagccccauaugcagcacu

SEQ ID NO: 579855 - RNA, 16 nt, Escherichia coli CFT073
ugcagcauauucgccg

SEQ ID NO: 579856 - RNA, 15 nt, Escherichia coli CFT073
ugcagcacugauaau

SEQ ID NO: 579857 - RNA, 22 nt, Escherichia coli CFT073
ugcagcuucgccauuucgucgu

SEQ ID NO: 579858 - RNA, 20 nt, Escherichia coli CFT073
ugcaggccagauaaggcguu

SEQ ID NO: 579859 - RNA, 20 nt, Escherichia coli CFT073
ugcaggcaacgaccagaaau

SEQ ID NO: 579860 - RNA, 19 nt, Escherichia coli CFT073
ugcagcgucugcuguucca

SEQ ID NO: 579861 - RNA, 13 nt, Escherichia coli CFT073
ugcacuccgccgc

SEQ ID NO: 579862 - RNA, 17 nt, Escherichia coli CFT073
ugcacuccgccgcacaa

SEQ ID NO: 579863 - RNA, 16 nt, Escherichia coli CFT073
ugcagaaaauccagcg

SEQ ID NO: 579864 - RNA, 18 nt, Escherichia coli CFT073
ugcacgaugcauugucag

SEQ ID NO: 579865 - RNA, 19 nt, Escherichia coli CFT073
ugauggaacauucgccgcu

SEQ ID NO: 579866 - RNA, 12 nt, Escherichia coli CFT073
ugauggcaaaau

SEQ ID NO: 579867 - RNA, 15 nt, Escherichia coli CFT073
ugauggcacuauauc

SEQ ID NO: 579868 - RNA, 14 nt, Escherichia coli CFT073
ugaugcuccgccag

SEQ ID NO: 579869 - RNA, 21 nt, Escherichia coli CFT073
ugauggcccaucgucacaccu

SEQ ID NO: 579870 - RNA, 19 nt, Escherichia coli CFT073
ugaugcgcgagguaacaau

SEQ ID NO: 579871 - RNA, 16 nt, Escherichia coli CFT073
ugaugcggucgcugcc

SEQ ID NO: 579872 - RNA, 16 nt, Escherichia coli CFT073
ugaugcgucuuaucag

SEQ ID NO: 579873 - RNA, 14 nt, Escherichia coli CFT073
ugauggcguacuca

SEQ ID NO: 579874 - RNA, 14 nt, Escherichia coli CFT073
ugauggcgcgccac

SEQ ID NO: 579875 - RNA, 15 nt, Escherichia coli CFT073
ugauggguuacgcga

SEQ ID NO: 579876 - RNA, 16 nt, Escherichia coli CFT073
ugaugggcuccacaaa

SEQ ID NO: 579877 - RNA, 20 nt, Escherichia coli CFT073
ugauguaaaaaagccggaug

SEQ ID NO: 579878 - RNA, 16 nt, Escherichia coli CFT073
ugcaccaaguucuuca

SEQ ID NO: 579879 - RNA, 17 nt, Escherichia coli CFT073
ugcaccagguuuucguc

SEQ ID NO: 579880 - RNA, 19 nt, Escherichia coli CFT073
ugcaccagguuuucgucgu

SEQ ID NO: 579881 - RNA, 20 nt, Escherichia coli CFT073
ugcaccauccccuuuucacg

SEQ ID NO: 579882 - RNA, 15 nt, Escherichia coli CFT073
ugcaccagcuggcug

SEQ ID NO: 579883 - RNA, 19 nt, Escherichia coli CFT073
ucuuucaguucgccuucca

SEQ ID NO: 579884 - RNA, 14 nt, Escherichia coli CFT073
ucuuucaacacaug

SEQ ID NO: 579885 - RNA, 14 nt, Escherichia coli CFT073
ucuuucaccagugg

SEQ ID NO: 579886 - RNA, 11 nt, Escherichia coli CFT073
ucuuucacgcc

SEQ ID NO: 579887 - RNA, 16 nt, Escherichia coli CFT073
ucuuucagcaccgcga

SEQ ID NO: 579888 - RNA, 14 nt, Escherichia coli CFT073
ugaaacgauggcgu

SEQ ID NO: 579889 - RNA, 11 nt, Escherichia coli CFT073
ugaaacgcaaa

SEQ ID NO: 579890 - RNA, 16 nt, Escherichia coli CFT073
ugaaagagucgccagc

SEQ ID NO: 579891 - RNA, 15 nt, Escherichia coli CFT073
ugaaagauauucaag

SEQ ID NO: 579892 - RNA, 13 nt, Escherichia coli CFT073
ugaaagaucacaa

SEQ ID NO: 579893 - RNA, 20 nt, Escherichia coli CFT073
ugaaagaugaagaguggaac

SEQ ID NO: 579894 - RNA, 14 nt, Escherichia coli CFT073
ugaaacgcucgcag

SEQ ID NO: 579895 - RNA, 15 nt, Escherichia coli CFT073
ugaaacucgaugaca

SEQ ID NO: 579896 - RNA, 22 nt, Escherichia coli CFT073
ugaaagcgggcuuuuuuaugca

SEQ ID NO: 579897 - RNA, 14 nt, Escherichia coli CFT073
ugaaagagaucaaa

SEQ ID NO: 579898 - RNA, 22 nt, Escherichia coli CFT073
ugaaagagccgauaaacaccgu

SEQ ID NO: 579899 - RNA, 13 nt, Escherichia coli CFT073
ugaaagcauggca

SEQ ID NO: 579900 - RNA, 18 nt, Escherichia coli CFT073
ugaaaggucaucaucacu

SEQ ID NO: 579901 - RNA, 20 nt, Escherichia coli CFT073
ugaaaguuuaacuaccgugu

SEQ ID NO: 579902 - RNA, 13 nt, Escherichia coli CFT073
ugaacaacaguuu

SEQ ID NO: 579903 - RNA, 18 nt, Escherichia coli CFT073
ugaaauugcggcaaacgg

SEQ ID NO: 579904 - RNA, 20 nt, Escherichia coli CFT073
ugaacaccuuauccggccua

SEQ ID NO: 579905 - RNA, 20 nt, Escherichia coli CFT073
ugaacacgcaacaccagcag

SEQ ID NO: 579906 - RNA, 17 nt, Escherichia coli CFT073
ugaaauauugcuaacug

SEQ ID NO: 579907 - RNA, 23 nt, Escherichia coli CFT073
ugaaauguaggguuacgcgcagu

SEQ ID NO: 579908 - RNA, 20 nt, Escherichia coli CFT073
ugaaauguugccggauggca

SEQ ID NO: 579909 - RNA, 14 nt, Escherichia coli CFT073
ugaaauucacuguc

SEQ ID NO: 579910 - RNA, 21 nt, Escherichia coli CFT073
ugaaauucagugaacuguggu

SEQ ID NO: 579911 - RNA, 20 nt, Escherichia coli CFT073
ugaaauuccugagaggauga

SEQ ID NO: 579912 - RNA, 19 nt, Escherichia coli CFT073
ugaaccagaccgccuuuga

SEQ ID NO: 579913 - RNA, 14 nt, Escherichia coli CFT073
ucuucaucguccag

SEQ ID NO: 579914 - RNA, 19 nt, Escherichia coli CFT073
ucuucauuguguaucaggu

SEQ ID NO: 579915 - RNA, 13 nt, Escherichia coli CFT073
ucuucagcaguuc

SEQ ID NO: 579916 - RNA, 12 nt, Escherichia coli CFT073
ucuucaccgucc

SEQ ID NO: 579917 - RNA, 13 nt, Escherichia coli CFT073
ucuuccagcgcau

SEQ ID NO: 579918 - RNA, 19 nt, Escherichia coli CFT073
ucuuccaggucccagcgau

SEQ ID NO: 579919 - RNA, 13 nt, Escherichia coli CFT073
ucuugcugcgcuu

SEQ ID NO: 579920 - RNA, 20 nt, Escherichia coli CFT073
ucuugcuggcauuacaagaa

SEQ ID NO: 579921 - RNA, 15 nt, Escherichia coli CFT073
ucuugccgcucaguc

SEQ ID NO: 579922 - RNA, 14 nt, Escherichia coli CFT073
ucuucuacauuucu

SEQ ID NO: 579923 - RNA, 18 nt, Escherichia coli CFT073
ucuucguggcccgccagc

SEQ ID NO: 579924 - RNA, 15 nt, Escherichia coli CFT073
ucuucguacauggua

SEQ ID NO: 579925 - RNA, 19 nt, Escherichia coli CFT073
ucuucaauggcaucacgca

SEQ ID NO: 579926 - RNA, 14 nt, Escherichia coli CFT073
ucuuaucuggccua

SEQ ID NO: 579927 - RNA, 12 nt, Escherichia coli CFT073
ucuuaucaccaa

SEQ ID NO: 579928 - RNA, 22 nt, Escherichia coli CFT073
ucuggcaccgguacacaaccgc

SEQ ID NO: 579929 - RNA, 22 nt, Escherichia coli CFT073
ucuggcauaaaagggcagcagg

SEQ ID NO: 579930 - RNA, 14 nt, Escherichia coli CFT073
ucuggcauucagaa

SEQ ID NO: 579931 - RNA, 15 nt, Escherichia coli CFT073
ucuggccaguucgga

SEQ ID NO: 579932 - RNA, 18 nt, Escherichia coli CFT073
ucugcugucaccgaagcg

SEQ ID NO: 579933 - RNA, 17 nt, Escherichia coli CFT073
ucuggauuggcaauacg

SEQ ID NO: 579934 - RNA, 21 nt, Escherichia coli CFT073
ucugcgcauuucccagcaaga

SEQ ID NO: 579935 - RNA, 13 nt, Escherichia coli CFT073
ucugcgacgcgcg

SEQ ID NO: 579936 - RNA, 23 nt, Escherichia coli CFT073
ucugcgcccacaucacgccgcug

SEQ ID NO: 579937 - RNA, 18 nt, Escherichia coli CFT073
ucugcgcccgcccgcugu

SEQ ID NO: 579938 - RNA, 19 nt, Escherichia coli CFT073
ucugcgccgaucgucgcuc

SEQ ID NO: 579939 - RNA, 13 nt, Escherichia coli CFT073
ucugcugccgcua

SEQ ID NO: 579940 - RNA, 20 nt, Escherichia coli CFT073
ucugccguaccaucgccagc

SEQ ID NO: 579941 - RNA, 15 nt, Escherichia coli CFT073
ucugccgucaucgac

SEQ ID NO: 579942 - RNA, 23 nt, Escherichia coli CFT073
ucugccagacaaaacugacgcca

SEQ ID NO: 579943 - RNA, 20 nt, Escherichia coli CFT073
ucugccccgccaacagugcc

SEQ ID NO: 579944 - RNA, 15 nt, Escherichia coli CFT073
ucugccccgccgccg

SEQ ID NO: 579945 - RNA, 20 nt, Escherichia coli CFT073
ucugccagccagucagucuc

SEQ ID NO: 579946 - RNA, 23 nt, Escherichia coli CFT073
ucugcagcuuuaacgaucacggc

SEQ ID NO: 579947 - RNA, 18 nt, Escherichia coli CFT073
ucugccaaacgcucccag

SEQ ID NO: 579948 - RNA, 14 nt, Escherichia coli CFT073
ucugaucggcaauc

SEQ ID NO: 579949 - RNA, 21 nt, Escherichia coli CFT073
ucugaugcgacgcggcagcgu

SEQ ID NO: 579950 - RNA, 12 nt, Escherichia coli CFT073
ucugauauucag

SEQ ID NO: 579951 - RNA, 16 nt, Escherichia coli CFT073
ucugcaaaauaccaau

SEQ ID NO: 579952 - RNA, 15 nt, Escherichia coli CFT073
ucugcacgcgauggc

SEQ ID NO: 579953 - RNA, 16 nt, Escherichia coli CFT073
ucucugaaaauuaacg

SEQ ID NO: 579954 - RNA, 22 nt, Escherichia coli CFT073
ucugaaucagucccugaaucgc

SEQ ID NO: 579955 - RNA, 19 nt, Escherichia coli CFT073
ucugacuggucaguugcgg

SEQ ID NO: 579956 - RNA, 22 nt, Escherichia coli CFT073
ucucucgaaaaaccugacgcug

SEQ ID NO: 579957 - RNA, 20 nt, Escherichia coli CFT073
ucucugagacgguauucagg

SEQ ID NO: 579958 - RNA, 12 nt, Escherichia coli CFT073
ucucugccgccg

SEQ ID NO: 579959 - RNA, 22 nt, Escherichia coli CFT073
ucucgguuuucagguuaucgga

SEQ ID NO: 579960 - RNA, 14 nt, Escherichia coli CFT073
ucucgugccgccag

SEQ ID NO: 579961 - RNA, 13 nt, Escherichia coli CFT073
ucucacucuuucc

SEQ ID NO: 579962 - RNA, 16 nt, Escherichia coli CFT073
ucucaccgcaggcggc

SEQ ID NO: 579963 - RNA, 15 nt, Escherichia coli CFT073
ucucauccggccugg

SEQ ID NO: 579964 - RNA, 13 nt, Escherichia coli CFT073
ucucaucggcguc

SEQ ID NO: 579965 - RNA, 23 nt, Escherichia coli CFT073
ucuccgcccagcguacguaacuu

SEQ ID NO: 579966 - RNA, 13 nt, Escherichia coli CFT073
ucucaauuaccgu

SEQ ID NO: 579967 - RNA, 14 nt, Escherichia coli CFT073
ucucaauuuucacu

SEQ ID NO: 579968 - RNA, 14 nt, Escherichia coli CFT073
ucguguauuuugca

SEQ ID NO: 579969 - RNA, 14 nt, Escherichia coli CFT073
ucguggccaugacc

SEQ ID NO: 579970 - RNA, 19 nt, Escherichia coli CFT073
ucguggccaugaccaccgc

SEQ ID NO: 579971 - RNA, 20 nt, Escherichia coli CFT073
ucuccgcguucaauacgcag

SEQ ID NO: 579972 - RNA, 18 nt, Escherichia coli CFT073
ucucgcaaaacgucgcca

SEQ ID NO: 579973 - RNA, 17 nt, Escherichia coli CFT073
ucucgccguggcuguug

SEQ ID NO: 579974 - RNA, 13 nt, Escherichia coli CFT073
ucggcuuuuuacu

SEQ ID NO: 579975 - RNA, 21 nt, Escherichia coli CFT073
ucgggauaucgccgguaguca

SEQ ID NO: 579976 - RNA, 20 nt, Escherichia coli CFT073
ucggucaccaugaacaccaa

SEQ ID NO: 579977 - RNA, 17 nt, Escherichia coli CFT073
ucgggugguaugcccca

SEQ ID NO: 579978 - RNA, 22 nt, Escherichia coli CFT073
ucgguauagccguagcuggcaa

SEQ ID NO: 579979 - RNA, 22 nt, Escherichia coli CFT073
ucgucgauuguuauaccagucc

SEQ ID NO: 579980 - RNA, 18 nt, Escherichia coli CFT073
ucgucgcagacaaggcga

SEQ ID NO: 579981 - RNA, 15 nt, Escherichia coli CFT073
ucgucuuuauccugg

SEQ ID NO: 579982 - RNA, 15 nt, Escherichia coli CFT073
ucgucugguucgcca

SEQ ID NO: 579983 - RNA, 23 nt, Escherichia coli CFT073
ucgucugguucgccaaaugucac

SEQ ID NO: 579984 - RNA, 13 nt, Escherichia coli CFT073
ucguauuccaucu

SEQ ID NO: 579985 - RNA, 23 nt, Escherichia coli CFT073
ucguauuucagaccuguugccca

SEQ ID NO: 579986 - RNA, 15 nt, Escherichia coli CFT073
ucgucaacguaauga

SEQ ID NO: 579987 - RNA, 15 nt, Escherichia coli CFT073
ucgguucauaaacac

SEQ ID NO: 579988 - RNA, 16 nt, Escherichia coli CFT073
ucgguuacuauccuga

SEQ ID NO: 579989 - RNA, 23 nt, Escherichia coli CFT073
ucguagccccagucuuccugcgg

SEQ ID NO: 579990 - RNA, 16 nt, Escherichia coli CFT073
ucguaggccugauaag

SEQ ID NO: 579991 - RNA, 20 nt, Escherichia coli CFT073
ucggugucaucgacaucaac

SEQ ID NO: 579992 - RNA, 16 nt, Escherichia coli CFT073
ucgguguuaaaacgca

SEQ ID NO: 579993 - RNA, 21 nt, Escherichia coli CFT073
ucgcuucgcuaacauuuuagu

SEQ ID NO: 579994 - RNA, 13 nt, Escherichia coli CFT073
ucgcuucugguga

SEQ ID NO: 579995 - RNA, 17 nt, Escherichia coli CFT073
ucgcuuugccaguaaua

SEQ ID NO: 579996 - RNA, 22 nt, Escherichia coli CFT073
ucggacggaagacguucaguuc

SEQ ID NO: 579997 - RNA, 19 nt, Escherichia coli CFT073
ucggacgcggcacgcccug

SEQ ID NO: 579998 - RNA, 17 nt, Escherichia coli CFT073
ucgcuguuggcgauaag

SEQ ID NO: 579999 - RNA, 23 nt, Escherichia coli CFT073
ucgcuguuuuucggaucgaggcg

SEQ ID NO: 580000 - RNA, 17 nt, Escherichia coli CFT073
ucgcuuaagccaucauc

SEQ ID NO: 580001 - RNA, 15 nt, Escherichia coli CFT073
ucgcuggaauaaucg

SEQ ID NO: 580002 - RNA, 15 nt, Escherichia coli CFT073
ucgcugaaccgccaa

SEQ ID NO: 580003 - RNA, 20 nt, Escherichia coli CFT073
ucgcuaaggaaaucgauaaa

SEQ ID NO: 580004 - RNA, 17 nt, Escherichia coli CFT073
ucgcuacauaacgcagc

SEQ ID NO: 580005 - RNA, 18 nt, Escherichia coli CFT073
ucgcuagauauauauuau

SEQ ID NO: 580006 - RNA, 22 nt, Escherichia coli CFT073
ucgcuaaagcauucucccgccu

SEQ ID NO: 580007 - RNA, 14 nt, Escherichia coli CFT073
ucgcuauucaacgu

SEQ ID NO: 580008 - RNA, 16 nt, Escherichia coli CFT073
ucgcucaauauccuga

SEQ ID NO: 580009 - RNA, 12 nt, Escherichia coli CFT073
ucgcucacauca

SEQ ID NO: 580010 - RNA, 16 nt, Escherichia coli CFT073
ucgcucacggcggcag

SEQ ID NO: 580011 - RNA, 14 nt, Escherichia coli CFT073
ucgcucauagaaua

SEQ ID NO: 580012 - RNA, 15 nt, Escherichia coli CFT073
ucgcucguccgcgag

SEQ ID NO: 580013 - RNA, 18 nt, Escherichia coli CFT073
ucgcucuucacauccugc

SEQ ID NO: 580014 - RNA, 14 nt, Escherichia coli CFT073
ucgcguaaggcuuc

SEQ ID NO: 580015 - RNA, 18 nt, Escherichia coli CFT073
ucgcgguuaugccgccga

SEQ ID NO: 580016 - RNA, 15 nt, Escherichia coli CFT073
ucgcggucagcugcu

SEQ ID NO: 580017 - RNA, 13 nt, Escherichia coli CFT073
aauaccaucggca

SEQ ID NO: 580018 - RNA, 12 nt, Escherichia coli CFT073
aauaccagccuu

SEQ ID NO: 580019 - RNA, 22 nt, Escherichia coli CFT073
aauaccagccuucuucauccag

SEQ ID NO: 580020 - RNA, 16 nt, Escherichia coli CFT073
aauaccacugcgccau

SEQ ID NO: 580021 - RNA, 19 nt, Escherichia coli CFT073
aauaccaauaaucaauuua

SEQ ID NO: 580022 - RNA, 19 nt, Escherichia coli CFT073
aauaccaaugaauuuucgc

SEQ ID NO: 580023 - RNA, 15 nt, Escherichia coli CFT073
aauacccugacccag

SEQ ID NO: 580024 - RNA, 18 nt, Escherichia coli CFT073
aauaccgacuucagccag

SEQ ID NO: 580025 - RNA, 20 nt, Escherichia coli CFT073
aauaccgauaaguacguuuu

SEQ ID NO: 580026 - RNA, 19 nt, Escherichia coli CFT073
aauaccgccugcaaauaaa

SEQ ID NO: 580027 - RNA, 15 nt, Escherichia coli CFT073
aauaccggcauccag

SEQ ID NO: 580028 - RNA, 16 nt, Escherichia coli CFT073
aauaccggcauguuua

SEQ ID NO: 580029 - RNA, 21 nt, Escherichia coli CFT073
aauaccggcgucccaucggca

SEQ ID NO: 580030 - RNA, 23 nt, Escherichia coli CFT073
aauaccuggagcaguauugauag

SEQ ID NO: 580031 - RNA, 21 nt, Escherichia coli CFT073
aauaccguuccaacgccacca

SEQ ID NO: 580032 - RNA, 18 nt, Escherichia coli CFT073
aauacgacauaaucgccg

SEQ ID NO: 580033 - RNA, 17 nt, Escherichia coli CFT073
aauacgccgauaucgcu

SEQ ID NO: 580034 - RNA, 22 nt, Escherichia coli CFT073
aauacgccggguuaaugccgga

SEQ ID NO: 580035 - RNA, 18 nt, Escherichia coli CFT073
ucgcgcgggcagaugcca

SEQ ID NO: 580036 - RNA, 16 nt, Escherichia coli CFT073
ucgcgcgcgccugcgg

SEQ ID NO: 580037 - RNA, 17 nt, Escherichia coli CFT073
ucggcaauacuucaaca

SEQ ID NO: 580038 - RNA, 18 nt, Escherichia coli CFT073
ucggcaauuuaccgccga

SEQ ID NO: 580039 - RNA, 20 nt, Escherichia coli CFT073
ucggcauggaucgccgcggu

SEQ ID NO: 580040 - RNA, 15 nt, Escherichia coli CFT073
ucggcgaccaguucg

SEQ ID NO: 580041 - RNA, 23 nt, Escherichia coli CFT073
ucgcaucaaaguuaauagucaag

SEQ ID NO: 580042 - RNA, 16 nt, Escherichia coli CFT073
ucgcauaccauccagg

SEQ ID NO: 580043 - RNA, 19 nt, Escherichia coli CFT073
ucgcaucaggccuacaugc

SEQ ID NO: 580044 - RNA, 17 nt, Escherichia coli CFT073
ucgcaucuggcaccggu

SEQ ID NO: 580045 - RNA, 17 nt, Escherichia coli CFT073
ucgccaaacaggcgauc

SEQ ID NO: 580046 - RNA, 20 nt, Escherichia coli CFT073
ucgccaaaugucaccagccg

SEQ ID NO: 580047 - RNA, 13 nt, Escherichia coli CFT073
ucgccaccggcac

SEQ ID NO: 580048 - RNA, 20 nt, Escherichia coli CFT073
ucgcagauuucuucuggcua

SEQ ID NO: 580049 - RNA, 13 nt, Escherichia coli CFT073
ucgcagccagcgc

SEQ ID NO: 580050 - RNA, 18 nt, Escherichia coli CFT073
ucgcagcccguggcgcga

SEQ ID NO: 580051 - RNA, 13 nt, Escherichia coli CFT073
ucgaucgccgcac

SEQ ID NO: 580052 - RNA, 13 nt, Escherichia coli CFT073
ucgccagcgcuuc

SEQ ID NO: 580053 - RNA, 13 nt, Escherichia coli CFT073
ucgccacgccaaa

SEQ ID NO: 580054 - RNA, 19 nt, Escherichia coli CFT073
ucgccagacguugauaacc

SEQ ID NO: 580055 - RNA, 14 nt, Escherichia coli CFT073
ucgccagaauaacg

SEQ ID NO: 580056 - RNA, 11 nt, Escherichia coli CFT073
ucgccagcaau

SEQ ID NO: 580057 - RNA, 18 nt, Escherichia coli CFT073
ucgccauugcagccgcga

SEQ ID NO: 580058 - RNA, 16 nt, Escherichia coli CFT073
ucgccauugcugguga

SEQ ID NO: 580059 - RNA, 13 nt, Escherichia coli CFT073
ucgccagcggcag

SEQ ID NO: 580060 - RNA, 18 nt, Escherichia coli CFT073
ucgccagcagcucacgca

SEQ ID NO: 580061 - RNA, 16 nt, Escherichia coli CFT073
ucgcccugcgucgcac

SEQ ID NO: 580062 - RNA, 16 nt, Escherichia coli CFT073
ucgcccugccagcgau

SEQ ID NO: 580063 - RNA, 17 nt, Escherichia coli CFT073
ucgcccgaccaucgcca

SEQ ID NO: 580064 - RNA, 16 nt, Escherichia coli CFT073
ucgcccguuucaauga

SEQ ID NO: 580065 - RNA, 20 nt, Escherichia coli CFT073
ucgccccggcaagaaauacc

SEQ ID NO: 580066 - RNA, 21 nt, Escherichia coli CFT073
ucgcgaaugcuuaacgccaga

SEQ ID NO: 580067 - RNA, 15 nt, Escherichia coli CFT073
ucgccugccacaucc

SEQ ID NO: 580068 - RNA, 13 nt, Escherichia coli CFT073
ucgccugccagau

SEQ ID NO: 580069 - RNA, 18 nt, Escherichia coli CFT073
ucgccuuccagcagcuug

SEQ ID NO: 580070 - RNA, 19 nt, Escherichia coli CFT073
ucgcgaugagucgccgcaa

SEQ ID NO: 580071 - RNA, 14 nt, Escherichia coli CFT073
ucgccgccgaggcg

SEQ ID NO: 580072 - RNA, 13 nt, Escherichia coli CFT073
ucgccgccgcaga

SEQ ID NO: 580073 - RNA, 12 nt, Escherichia coli CFT073
ucgccgcugcgg

SEQ ID NO: 580074 - RNA, 17 nt, Escherichia coli CFT073
ucgccguuggugauguu

SEQ ID NO: 580075 - RNA, 15 nt, Escherichia coli CFT073
ucgagugcggcgagc

SEQ ID NO: 580076 - RNA, 17 nt, Escherichia coli CFT073
ucgauaaacaucgccau

SEQ ID NO: 580077 - RNA, 16 nt, Escherichia coli CFT073
ucgauccagugauucc

SEQ ID NO: 580078 - RNA, 22 nt, Escherichia coli CFT073
ucgauaaacaguuccgcaaagc

SEQ ID NO: 580079 - RNA, 16 nt, Escherichia coli CFT073
ucgaucauguagucgg

SEQ ID NO: 580080 - RNA, 21 nt, Escherichia coli CFT073
ucgaucccgguuaacugcaug

SEQ ID NO: 580081 - RNA, 14 nt, Escherichia coli CFT073
ucgagaucgccaaa

SEQ ID NO: 580082 - RNA, 15 nt, Escherichia coli CFT073
ucgagaucgacaccg

SEQ ID NO: 580083 - RNA, 18 nt, Escherichia coli CFT073
ucgagccgcauccgacac

SEQ ID NO: 580084 - RNA, 15 nt, Escherichia coli CFT073
ucgagcguugccgcu

SEQ ID NO: 580085 - RNA, 19 nt, Escherichia coli CFT073
ucgaggauccaugacaucu

SEQ ID NO: 580086 - RNA, 14 nt, Escherichia coli CFT073
ucgagcugccugcg

SEQ ID NO: 580087 - RNA, 18 nt, Escherichia coli CFT073
ucgacuuccaccagcggc

SEQ ID NO: 580088 - RNA, 17 nt, Escherichia coli CFT073
ucgacugcgccuuccag

SEQ ID NO: 580089 - RNA, 23 nt, Escherichia coli CFT073
ucgagaagacaauccccgccagc

SEQ ID NO: 580090 - RNA, 12 nt, Escherichia coli CFT073
ucgacuuucgca

SEQ ID NO: 580091 - RNA, 14 nt, Escherichia coli CFT073
ucgagaaacgcgcg

SEQ ID NO: 580092 - RNA, 16 nt, Escherichia coli CFT073
ucgacguccaaucagc

SEQ ID NO: 580093 - RNA, 21 nt, Escherichia coli CFT073
ucgaccagcgcacugccgcca

SEQ ID NO: 580094 - RNA, 16 nt, Escherichia coli CFT073
uccgguacucaucaga

SEQ ID NO: 580095 - RNA, 14 nt, Escherichia coli CFT073
uccgguacgugcgu

SEQ ID NO: 580096 - RNA, 19 nt, Escherichia coli CFT073
uccugaaagcgaaccauag

SEQ ID NO: 580097 - RNA, 23 nt, Escherichia coli CFT073
uccugagcagcaaccacuugcag

SEQ ID NO: 580098 - RNA, 21 nt, Escherichia coli CFT073
uccugcacggucacaucgcug

SEQ ID NO: 580099 - RNA, 17 nt, Escherichia coli CFT073
uccugccaggaccgcug

SEQ ID NO: 580100 - RNA, 14 nt, Escherichia coli CFT073
uccugcgcuuccag

SEQ ID NO: 580101 - RNA, 12 nt, Escherichia coli CFT073
uccuuuauaacu

SEQ ID NO: 580102 - RNA, 16 nt, Escherichia coli CFT073
uccuguagcggaaaau

SEQ ID NO: 580103 - RNA, 21 nt, Escherichia coli CFT073
uccuggcgggaauaaaagcca

SEQ ID NO: 580104 - RNA, 14 nt, Escherichia coli CFT073
uccuggcaccauca

SEQ ID NO: 580105 - RNA, 16 nt, Escherichia coli CFT073
ucgaacauuucccgca

SEQ ID NO: 580106 - RNA, 21 nt, Escherichia coli CFT073
ucgaacauuugcguggcgcgc

SEQ ID NO: 580107 - RNA, 18 nt, Escherichia coli CFT073
ucgaacagguuauugacg

SEQ ID NO: 580108 - RNA, 13 nt, Escherichia coli CFT073
ucgacauugacca

SEQ ID NO: 580109 - RNA, 21 nt, Escherichia coli CFT073
ucccguugaggugucgcgcac

SEQ ID NO: 580110 - RNA, 18 nt, Escherichia coli CFT073
ucccucuucaauuaacaa

SEQ ID NO: 580111 - RNA, 20 nt, Escherichia coli CFT073
ucccugcaacacccgguacc

SEQ ID NO: 580112 - RNA, 20 nt, Escherichia coli CFT073
ucccuacugcuccuaacgau

SEQ ID NO: 580113 - RNA, 16 nt, Escherichia coli CFT073
ucccucagguauagga

SEQ ID NO: 580114 - RNA, 21 nt, Escherichia coli CFT073
ucccguaauccguaaagccca

SEQ ID NO: 580115 - RNA, 16 nt, Escherichia coli CFT073
ucccgcuaccugccgc

SEQ ID NO: 580116 - RNA, 12 nt, Escherichia coli CFT073
ucccgcggcgca

SEQ ID NO: 580117 - RNA, 14 nt, Escherichia coli CFT073
ucccgcuccaaaau

SEQ ID NO: 580118 - RNA, 16 nt, Escherichia coli CFT073
ucccgccguaccggca

SEQ ID NO: 580119 - RNA, 21 nt, Escherichia coli CFT073
uccccggucugauauucagga

SEQ ID NO: 580120 - RNA, 17 nt, Escherichia coli CFT073
uccccggagcccuacaa

SEQ ID NO: 580121 - RNA, 23 nt, Escherichia coli CFT073
uccccgccagcguugccaguccg

SEQ ID NO: 580122 - RNA, 22 nt, Escherichia coli CFT073
uccccaagaaucgucgcccgau

SEQ ID NO: 580123 - RNA, 19 nt, Escherichia coli CFT073
uccccacuauuggaugaca

SEQ ID NO: 580124 - RNA, 13 nt, Escherichia coli CFT073
uccccaccaguga

SEQ ID NO: 580125 - RNA, 17 nt, Escherichia coli CFT073
ucccauaggaugagguu

SEQ ID NO: 580126 - RNA, 17 nt, Escherichia coli CFT073
ucccaguagugcuuuca

SEQ ID NO: 580127 - RNA, 16 nt, Escherichia coli CFT073
ucccauaagugcguca

SEQ ID NO: 580128 - RNA, 23 nt, Escherichia coli CFT073
ucccccacugugcaccgcgcugg

SEQ ID NO: 580129 - RNA, 11 nt, Escherichia coli CFT073
uccccaucagg

SEQ ID NO: 580130 - RNA, 21 nt, Escherichia coli CFT073
uccccagcgucagcagcaaua

SEQ ID NO: 580131 - RNA, 20 nt, Escherichia coli CFT073
ucccccuuaccccgcccgau

SEQ ID NO: 580132 - RNA, 17 nt, Escherichia coli CFT073
uccccccggcagcugcc

SEQ ID NO: 580133 - RNA, 16 nt, Escherichia coli CFT073
ucccagcgccugcagu

SEQ ID NO: 580134 - RNA, 18 nt, Escherichia coli CFT073
ucccagauagcuguccca

SEQ ID NO: 580135 - RNA, 14 nt, Escherichia coli CFT073
ucccagaccuucau

SEQ ID NO: 580136 - RNA, 21 nt, Escherichia coli CFT073
uccagggaucaacauucagau

SEQ ID NO: 580137 - RNA, 20 nt, Escherichia coli CFT073
uccgcgguugguuuuaucca

SEQ ID NO: 580138 - RNA, 20 nt, Escherichia coli CFT073
uccgcguaguugcgcuggug

SEQ ID NO: 580139 - RNA, 14 nt, Escherichia coli CFT073
ucccuugcugguca

SEQ ID NO: 580140 - RNA, 14 nt, Escherichia coli CFT073
ucccuuccggugcg

SEQ ID NO: 580141 - RNA, 16 nt, Escherichia coli CFT073
ucccuucgacuuucag

SEQ ID NO: 580142 - RNA, 15 nt, Escherichia coli CFT073
ucccuucccagccgg

SEQ ID NO: 580143 - RNA, 15 nt, Escherichia coli CFT073
ucccuugucgcagca

SEQ ID NO: 580144 - RNA, 14 nt, Escherichia coli CFT073
ucccuuucagcaaa

SEQ ID NO: 580145 - RNA, 15 nt, Escherichia coli CFT073
ucccuguaggucgga

SEQ ID NO: 580146 - RNA, 19 nt, Escherichia coli CFT073
ucccuguaggucggauaag

SEQ ID NO: 580147 - RNA, 16 nt, Escherichia coli CFT073
ucccugcauaaucagg

SEQ ID NO: 580148 - RNA, 20 nt, Escherichia coli CFT073
uccgccgcacaagucagcaa

SEQ ID NO: 580149 - RNA, 14 nt, Escherichia coli CFT073
uccgccccggcaau

SEQ ID NO: 580150 - RNA, 22 nt, Escherichia coli CFT073
uccgacaaauguguucagcgac

SEQ ID NO: 580151 - RNA, 21 nt, Escherichia coli CFT073
uccgaaguucauccauaccac

SEQ ID NO: 580152 - RNA, 20 nt, Escherichia coli CFT073
uccgggugugacaacaacau

SEQ ID NO: 580153 - RNA, 13 nt, Escherichia coli CFT073
uccggguuuucga

SEQ ID NO: 580154 - RNA, 15 nt, Escherichia coli CFT073
uccggguaauaaacc

SEQ ID NO: 580155 - RNA, 19 nt, Escherichia coli CFT073
uccggcacuuuuucaucag

SEQ ID NO: 580156 - RNA, 13 nt, Escherichia coli CFT073
uccggaucgccaa

SEQ ID NO: 580157 - RNA, 15 nt, Escherichia coli CFT073
uccggauuauccagc

SEQ ID NO: 580158 - RNA, 12 nt, Escherichia coli CFT073
uccggcaauggc

SEQ ID NO: 580159 - RNA, 19 nt, Escherichia coli CFT073
uccgcuacccgaacaccaa

SEQ ID NO: 580160 - RNA, 18 nt, Escherichia coli CFT073
uccgcgucauugacgcug

SEQ ID NO: 580161 - RNA, 14 nt, Escherichia coli CFT073
uccgcgugacgcug

SEQ ID NO: 580162 - RNA, 23 nt, Escherichia coli CFT073
uccgcucggucacugacaccagc

SEQ ID NO: 580163 - RNA, 12 nt, Escherichia coli CFT073
uccgcuggccgg

SEQ ID NO: 580164 - RNA, 16 nt, Escherichia coli CFT073
uccgcuguaauugccg

SEQ ID NO: 580165 - RNA, 19 nt, Escherichia coli CFT073
uccgcuguaauugccgcuc

SEQ ID NO: 580166 - RNA, 21 nt, Escherichia coli CFT073
uccgcuguaauugccgcucca

SEQ ID NO: 580167 - RNA, 20 nt, Escherichia coli CFT073
uccgcuguuauugucggcag

SEQ ID NO: 580168 - RNA, 15 nt, Escherichia coli CFT073
aauacagagcacgca

SEQ ID NO: 580169 - RNA, 12 nt, Escherichia coli CFT073
ucagcggcagcu

SEQ ID NO: 580170 - RNA, 20 nt, Escherichia coli CFT073
ucagcggcacuguuucgcca

SEQ ID NO: 580171 - RNA, 16 nt, Escherichia coli CFT073
ucagcgccaucgccag

SEQ ID NO: 580172 - RNA, 17 nt, Escherichia coli CFT073
ucagcgccaucgccagg

SEQ ID NO: 580173 - RNA, 16 nt, Escherichia coli CFT073
ucagcgccacggaaac

SEQ ID NO: 580174 - RNA, 16 nt, Escherichia coli CFT073
ucagcgcagcgcgagu

SEQ ID NO: 580175 - RNA, 17 nt, Escherichia coli CFT073
ucagccgcuuuaucuga

SEQ ID NO: 580176 - RNA, 17 nt, Escherichia coli CFT073
ucagcaggcugcgcgcu

SEQ ID NO: 580177 - RNA, 22 nt, Escherichia coli CFT073
ucagcccggcaacguugccagu

SEQ ID NO: 580178 - RNA, 14 nt, Escherichia coli CFT073
ucagcagauaccaa

SEQ ID NO: 580179 - RNA, 20 nt, Escherichia coli CFT073
ucagcagauaucccgccagc

SEQ ID NO: 580180 - RNA, 22 nt, Escherichia coli CFT073
ucagcagcccggcaaccacgcg

SEQ ID NO: 580181 - RNA, 19 nt, Escherichia coli CFT073
ucagcacgguguuaccgua

SEQ ID NO: 580182 - RNA, 18 nt, Escherichia coli CFT073
ucagcacuacugccagau

SEQ ID NO: 580183 - RNA, 17 nt, Escherichia coli CFT073
ucagcaccugcaucacg

SEQ ID NO: 580184 - RNA, 22 nt, Escherichia coli CFT073
ucagcaccgaaguuaugccagu

SEQ ID NO: 580185 - RNA, 17 nt, Escherichia coli CFT073
ucagaaucacgccaaca

SEQ ID NO: 580186 - RNA, 15 nt, Escherichia coli CFT073
ucagacaggcgaaac

SEQ ID NO: 580187 - RNA, 17 nt, Escherichia coli CFT073
ucagaccaaaacgcgcc

SEQ ID NO: 580188 - RNA, 21 nt, Escherichia coli CFT073
ucagacgacccacgauaacgu

SEQ ID NO: 580189 - RNA, 22 nt, Escherichia coli CFT073
ucagacggccccgcgccagcgg

SEQ ID NO: 580190 - RNA, 19 nt, Escherichia coli CFT073
ucacuuacgauuuuaauag

SEQ ID NO: 580191 - RNA, 20 nt, Escherichia coli CFT073
ucacuuacgauuuuaauagc

SEQ ID NO: 580192 - RNA, 22 nt, Escherichia coli CFT073
ucacuguggagcagcgguuucu

SEQ ID NO: 580193 - RNA, 19 nt, Escherichia coli CFT073
ucacuggcgacacgcauca

SEQ ID NO: 580194 - RNA, 20 nt, Escherichia coli CFT073
ucacuggcgacacgcaucac

SEQ ID NO: 580195 - RNA, 13 nt, Escherichia coli CFT073
ucagagauuaagu

SEQ ID NO: 580196 - RNA, 20 nt, Escherichia coli CFT073
ucagacucauuaaaacggau

SEQ ID NO: 580197 - RNA, 16 nt, Escherichia coli CFT073
ucagcaacagguaacc

SEQ ID NO: 580198 - RNA, 18 nt, Escherichia coli CFT073
ucagcaacagguaaccca

SEQ ID NO: 580199 - RNA, 21 nt, Escherichia coli CFT073
ucagcaauauaggccgccgau

SEQ ID NO: 580200 - RNA, 15 nt, Escherichia coli CFT073
ucagcaagagguaaa

SEQ ID NO: 580201 - RNA, 21 nt, Escherichia coli CFT073
ucagcaaggaagcugauuuua

SEQ ID NO: 580202 - RNA, 14 nt, Escherichia coli CFT073
ucagcacagagaua

SEQ ID NO: 580203 - RNA, 19 nt, Escherichia coli CFT073
ucacgcgauuuuucaucga

SEQ ID NO: 580204 - RNA, 22 nt, Escherichia coli CFT073
ucacgacaaaugcgccgccaaa

SEQ ID NO: 580205 - RNA, 14 nt, Escherichia coli CFT073
ucacgcccgccaga

SEQ ID NO: 580206 - RNA, 11 nt, Escherichia coli CFT073
ucacgccgcau

SEQ ID NO: 580207 - RNA, 14 nt, Escherichia coli CFT073
ucacgccgcaucag

SEQ ID NO: 580208 - RNA, 20 nt, Escherichia coli CFT073
ucacgccgcauccggccauc

SEQ ID NO: 580209 - RNA, 23 nt, Escherichia coli CFT073
ucacgccgcauccggccaucagu

SEQ ID NO: 580210 - RNA, 15 nt, Escherichia coli CFT073
ucacgccgcuggcau

SEQ ID NO: 580211 - RNA, 19 nt, Escherichia coli CFT073
ucacucuguuuuaacgcag

SEQ ID NO: 580212 - RNA, 15 nt, Escherichia coli CFT073
ucaaccagcggcgca

SEQ ID NO: 580213 - RNA, 22 nt, Escherichia coli CFT073
ucaaccaccucaguacccgcgu

SEQ ID NO: 580214 - RNA, 16 nt, Escherichia coli CFT073
ucaacgccgcuaucag

SEQ ID NO: 580215 - RNA, 17 nt, Escherichia coli CFT073
ucaacgucugcgccuuu

SEQ ID NO: 580216 - RNA, 22 nt, Escherichia coli CFT073
ucaacguguaggccugauaaga

SEQ ID NO: 580217 - RNA, 16 nt, Escherichia coli CFT073
ucacaccaucaacaaa

SEQ ID NO: 580218 - RNA, 15 nt, Escherichia coli CFT073
ucacacucugccagc

SEQ ID NO: 580219 - RNA, 19 nt, Escherichia coli CFT073
ucacagcuauaccgccagg

SEQ ID NO: 580220 - RNA, 16 nt, Escherichia coli CFT073
ucacaggcacaccgcc

SEQ ID NO: 580221 - RNA, 14 nt, Escherichia coli CFT073
ucacauauucgccg

SEQ ID NO: 580222 - RNA, 15 nt, Escherichia coli CFT073
ucacaucagcgcauu

SEQ ID NO: 580223 - RNA, 15 nt, Escherichia coli CFT073
ucacaucaggccauc

SEQ ID NO: 580224 - RNA, 19 nt, Escherichia coli CFT073
ucacauucuguccugaaaa

SEQ ID NO: 580225 - RNA, 20 nt, Escherichia coli CFT073
ucaccaaaggcacaacugcg

SEQ ID NO: 580226 - RNA, 12 nt, Escherichia coli CFT073
ucaccaacuggc

SEQ ID NO: 580227 - RNA, 20 nt, Escherichia coli CFT073
ucaccaacuuucacgcgcug

SEQ ID NO: 580228 - RNA, 20 nt, Escherichia coli CFT073
ucaccaaggaagcuuucgca

SEQ ID NO: 580229 - RNA, 15 nt, Escherichia coli CFT073
ucaccacaaaugcgc

SEQ ID NO: 580230 - RNA, 19 nt, Escherichia coli CFT073
ucaccacccagcgguaaaa

SEQ ID NO: 580231 - RNA, 16 nt, Escherichia coli CFT073
ucaccaccgugaccag

SEQ ID NO: 580232 - RNA, 22 nt, Escherichia coli CFT073
ucaccacugacgggaaacucug

SEQ ID NO: 580233 - RNA, 20 nt, Escherichia coli CFT073
ucaccagacaucaaguaacc

SEQ ID NO: 580234 - RNA, 23 nt, Escherichia coli CFT073
ucaccagguucgccaacaacgca

SEQ ID NO: 580235 - RNA, 12 nt, Escherichia coli CFT073
ucaccaguaccg

SEQ ID NO: 580236 - RNA, 23 nt, Escherichia coli CFT073
ucaccaguaccgccaccaccaga

SEQ ID NO: 580237 - RNA, 16 nt, Escherichia coli CFT073
ucaccaguccaucggc

SEQ ID NO: 580238 - RNA, 15 nt, Escherichia coli CFT073
ucaccagucccugaa

SEQ ID NO: 580239 - RNA, 21 nt, Escherichia coli CFT073
ucaccaguugugaugccacuu

SEQ ID NO: 580240 - RNA, 12 nt, Escherichia coli CFT073
ucaccagcguca

SEQ ID NO: 580241 - RNA, 22 nt, Escherichia coli CFT073
ucacgacagcaccacuggcgau

SEQ ID NO: 580242 - RNA, 22 nt, Escherichia coli CFT073
ucaccggcauuuuuuagcgcca

SEQ ID NO: 580243 - RNA, 14 nt, Escherichia coli CFT073
ucaccgguguuccc

SEQ ID NO: 580244 - RNA, 19 nt, Escherichia coli CFT073
ucaccguccauccacagag

SEQ ID NO: 580245 - RNA, 15 nt, Escherichia coli CFT073
ucaccgccuccaccu

SEQ ID NO: 580246 - RNA, 12 nt, Escherichia coli CFT073
ucacccgccagc

SEQ ID NO: 580247 - RNA, 19 nt, Escherichia coli CFT073
ucacccgccgguggcguuu

SEQ ID NO: 580248 - RNA, 20 nt, Escherichia coli CFT073
ucaccccguugcuucgccgc

SEQ ID NO: 580249 - RNA, 16 nt, Escherichia coli CFT073
ucaucaaugccagcau

SEQ ID NO: 580250 - RNA, 22 nt, Escherichia coli CFT073
ucaucacaaaauuuauccagcg

SEQ ID NO: 580251 - RNA, 15 nt, Escherichia coli CFT073
ucauauggaagaaac

SEQ ID NO: 580252 - RNA, 18 nt, Escherichia coli CFT073
ucauauugccgugcccca

SEQ ID NO: 580253 - RNA, 22 nt, Escherichia coli CFT073
ucauauugccgugccccauaug

SEQ ID NO: 580254 - RNA, 14 nt, Escherichia coli CFT073
ucaguuccaguuca

SEQ ID NO: 580255 - RNA, 21 nt, Escherichia coli CFT073
ucaguuauugacgccguaaac

SEQ ID NO: 580256 - RNA, 13 nt, Escherichia coli CFT073
ucaguaaaaccau

SEQ ID NO: 580257 - RNA, 17 nt, Escherichia coli CFT073
ucaguacggcaaagaua

SEQ ID NO: 580258 - RNA, 17 nt, Escherichia coli CFT073
ucagugaccagcggcag

SEQ ID NO: 580259 - RNA, 16 nt, Escherichia coli CFT073
ucauccaucggcgcuu

SEQ ID NO: 580260 - RNA, 16 nt, Escherichia coli CFT073
ucauccaggcacuggc

SEQ ID NO: 580261 - RNA, 13 nt, Escherichia coli CFT073
ucauccgacacca

SEQ ID NO: 580262 - RNA, 18 nt, Escherichia coli CFT073
ucauccggcacgcuacca

SEQ ID NO: 580263 - RNA, 15 nt, Escherichia coli CFT073
ucauccccucuucca

SEQ ID NO: 580264 - RNA, 14 nt, Escherichia coli CFT073
ucauccgaugguuu

SEQ ID NO: 580265 - RNA, 13 nt, Escherichia coli CFT073
ucaucuuuauuca

SEQ ID NO: 580266 - RNA, 18 nt, Escherichia coli CFT073
ucaucggcuuuugguccg

SEQ ID NO: 580267 - RNA, 21 nt, Escherichia coli CFT073
ucaucgggcaucgcaaccaca

SEQ ID NO: 580268 - RNA, 14 nt, Escherichia coli CFT073
ucaucggcaaaggc

SEQ ID NO: 580269 - RNA, 19 nt, Escherichia coli CFT073
ucaucggaaugcacagccu

SEQ ID NO: 580270 - RNA, 23 nt, Escherichia coli CFT073
ucaucgcggucaaccaucgcaua

SEQ ID NO: 580271 - RNA, 20 nt, Escherichia coli CFT073
ucaucgccccgcucacgcag

SEQ ID NO: 580272 - RNA, 23 nt, Escherichia coli CFT073
ucagcggcggcgcaaccaucagu

SEQ ID NO: 580273 - RNA, 13 nt, Escherichia coli CFT073
ucagcggcuguuc

SEQ ID NO: 580274 - RNA, 19 nt, Escherichia coli CFT073
ucaggccuacgugauuccu

SEQ ID NO: 580275 - RNA, 16 nt, Escherichia coli CFT073
ucaggccuccggugau

SEQ ID NO: 580276 - RNA, 19 nt, Escherichia coli CFT073
ucaggcgcgugaaugccug

SEQ ID NO: 580277 - RNA, 21 nt, Escherichia coli CFT073
ucaggcuuuauucugacgcca

SEQ ID NO: 580278 - RNA, 19 nt, Escherichia coli CFT073
ucagggguaggaaaagucg

SEQ ID NO: 580279 - RNA, 15 nt, Escherichia coli CFT073
ucaggucuuucugaa

SEQ ID NO: 580280 - RNA, 20 nt, Escherichia coli CFT073
ucagguugaggaacuuccag

SEQ ID NO: 580281 - RNA, 18 nt, Escherichia coli CFT073
ucagguuuuucagcugcc

SEQ ID NO: 580282 - RNA, 19 nt, Escherichia coli CFT073
uccacgcggguaaguacgc

SEQ ID NO: 580283 - RNA, 17 nt, Escherichia coli CFT073
uccagcgcaucgaucuu

SEQ ID NO: 580284 - RNA, 19 nt, Escherichia coli CFT073
uccagcagcucaaucgccu

SEQ ID NO: 580285 - RNA, 23 nt, Escherichia coli CFT073
uccagcauaacuaauuccgcuga

SEQ ID NO: 580286 - RNA, 16 nt, Escherichia coli CFT073
uccagcauccgcgcac

SEQ ID NO: 580287 - RNA, 14 nt, Escherichia coli CFT073
uccagcaucgaaaa

SEQ ID NO: 580288 - RNA, 14 nt, Escherichia coli CFT073
uccagcaucgccac

SEQ ID NO: 580289 - RNA, 22 nt, Escherichia coli CFT073
uccagcaucgcccccaucgcca

SEQ ID NO: 580290 - RNA, 19 nt, Escherichia coli CFT073
uccagcauucccgccacca

SEQ ID NO: 580291 - RNA, 18 nt, Escherichia coli CFT073
uccagcuuccaggcaauc

SEQ ID NO: 580292 - RNA, 17 nt, Escherichia coli CFT073
uccagcuuagcggcgcg

SEQ ID NO: 580293 - RNA, 15 nt, Escherichia coli CFT073
uccagcugccugcgg

SEQ ID NO: 580294 - RNA, 15 nt, Escherichia coli CFT073
uccagcggcaacggc

SEQ ID NO: 580295 - RNA, 21 nt, Escherichia coli CFT073
uccagcgcguuugucagcaaa

SEQ ID NO: 580296 - RNA, 19 nt, Escherichia coli CFT073
uccaggagauauugcugcg

SEQ ID NO: 580297 - RNA, 13 nt, Escherichia coli CFT073
uccaggcuggcag

SEQ ID NO: 580298 - RNA, 15 nt, Escherichia coli CFT073
uccaccagccccaga

SEQ ID NO: 580299 - RNA, 17 nt, Escherichia coli CFT073
uccaccacaaaagcaaa

SEQ ID NO: 580300 - RNA, 19 nt, Escherichia coli CFT073
uccacauuuuccaucacga

SEQ ID NO: 580301 - RNA, 19 nt, Escherichia coli CFT073
uccaccauauacuccgcac

SEQ ID NO: 580302 - RNA, 15 nt, Escherichia coli CFT073
uccaccugcggcacc

SEQ ID NO: 580303 - RNA, 18 nt, Escherichia coli CFT073
uccaaauagcucaaugaa

SEQ ID NO: 580304 - RNA, 11 nt, Escherichia coli CFT073
uccaaccagcu

SEQ ID NO: 580305 - RNA, 23 nt, Escherichia coli CFT073
ucauggcauuaauaugcucaaca

SEQ ID NO: 580306 - RNA, 20 nt, Escherichia coli CFT073
ucauggcgaaaagcuuuaca

SEQ ID NO: 580307 - RNA, 20 nt, Escherichia coli CFT073
ucaugcgggcgaggggagac

SEQ ID NO: 580308 - RNA, 22 nt, Escherichia coli CFT073
ucaugccuacgaguucgaugcu

SEQ ID NO: 580309 - RNA, 14 nt, Escherichia coli CFT073
ucaugcucaccaau

SEQ ID NO: 580310 - RNA, 16 nt, Escherichia coli CFT073
ucaugcgucaccagca

SEQ ID NO: 580311 - RNA, 18 nt, Escherichia coli CFT073
ucaugcuggauggcgcaa

SEQ ID NO: 580312 - RNA, 21 nt, Escherichia coli CFT073
ucaugcuggauggcgcaaugc

SEQ ID NO: 580313 - RNA, 17 nt, Escherichia coli CFT073
ucaugcccacgcaaacc

SEQ ID NO: 580314 - RNA, 18 nt, Escherichia coli CFT073
ucaugcaucgguuuugcg

SEQ ID NO: 580315 - RNA, 21 nt, Escherichia coli CFT073
ucaugauauguuuuaaagcga

SEQ ID NO: 580316 - RNA, 19 nt, Escherichia coli CFT073
ucaugaccuuccagcgcug

SEQ ID NO: 580317 - RNA, 15 nt, Escherichia coli CFT073
uaccguauucaacga

SEQ ID NO: 580318 - RNA, 16 nt, Escherichia coli CFT073
uaccgucaucgcccac

SEQ ID NO: 580319 - RNA, 21 nt, Escherichia coli CFT073
uaccgucgccuuucacuuccg

SEQ ID NO: 580320 - RNA, 18 nt, Escherichia coli CFT073
uaccguuccgacaccgcc

SEQ ID NO: 580321 - RNA, 21 nt, Escherichia coli CFT073
uaccguugaccauaucaucaa

SEQ ID NO: 580322 - RNA, 14 nt, Escherichia coli CFT073
uaccguugcggcgu

SEQ ID NO: 580323 - RNA, 20 nt, Escherichia coli CFT073
uaccgggccugaacaagcaa

SEQ ID NO: 580324 - RNA, 17 nt, Escherichia coli CFT073
uaccggucaugucggca

SEQ ID NO: 580325 - RNA, 15 nt, Escherichia coli CFT073
uaccggcuucgucgc

SEQ ID NO: 580326 - RNA, 17 nt, Escherichia coli CFT073
uaccggcuucgucgcca

SEQ ID NO: 580327 - RNA, 22 nt, Escherichia coli CFT073
uaccggaucugccauauccagc

SEQ ID NO: 580328 - RNA, 19 nt, Escherichia coli CFT073
uaccggcaaaaucaaugcc

SEQ ID NO: 580329 - RNA, 13 nt, Escherichia coli CFT073
uaccggcaauggu

SEQ ID NO: 580330 - RNA, 15 nt, Escherichia coli CFT073
uaccggcaaugguuu

SEQ ID NO: 580331 - RNA, 20 nt, Escherichia coli CFT073
uaccgcgguucccagcgucg

SEQ ID NO: 580332 - RNA, 13 nt, Escherichia coli CFT073
uaccgcuuggcga

SEQ ID NO: 580333 - RNA, 21 nt, Escherichia coli CFT073
uaccgauuuucucaccgauag

SEQ ID NO: 580334 - RNA, 13 nt, Escherichia coli CFT073
uacgcugcaaaaa

SEQ ID NO: 580335 - RNA, 18 nt, Escherichia coli CFT073
uacgccgccgcaaccgua

SEQ ID NO: 580336 - RNA, 17 nt, Escherichia coli CFT073
uacgccggucacgccgg

SEQ ID NO: 580337 - RNA, 18 nt, Escherichia coli CFT073
uacgccauuucgggugua

SEQ ID NO: 580338 - RNA, 16 nt, Escherichia coli CFT073
uacgcccacgcuucac

SEQ ID NO: 580339 - RNA, 22 nt, Escherichia coli CFT073
uacgcccacgcuucacugccgg

SEQ ID NO: 580340 - RNA, 20 nt, Escherichia coli CFT073
uacgcccgcugcgcccaguu

SEQ ID NO: 580341 - RNA, 17 nt, Escherichia coli CFT073
uaccugcguuuuuaacg

SEQ ID NO: 580342 - RNA, 16 nt, Escherichia coli CFT073
uaccuuauccagcaga

SEQ ID NO: 580343 - RNA, 19 nt, Escherichia coli CFT073
uaccuuccacuuucacgcc

SEQ ID NO: 580344 - RNA, 16 nt, Escherichia coli CFT073
uaccuucggccccauc

SEQ ID NO: 580345 - RNA, 17 nt, Escherichia coli CFT073
uaccugaaacucgauga

SEQ ID NO: 580346 - RNA, 13 nt, Escherichia coli CFT073
uaccguugugcuu

SEQ ID NO: 580347 - RNA, 18 nt, Escherichia coli CFT073
uaccuaaaagcacgccag

SEQ ID NO: 580348 - RNA, 19 nt, Escherichia coli CFT073
uaccuaacaguucacccgg

SEQ ID NO: 580349 - RNA, 16 nt, Escherichia coli CFT073
uaccguugcggcucca

SEQ ID NO: 580350 - RNA, 23 nt, Escherichia coli CFT073
uaccguugcggcuccagacgccc

SEQ ID NO: 580351 - RNA, 14 nt, Escherichia coli CFT073
uaccuacgcuugcu

SEQ ID NO: 580352 - RNA, 15 nt, Escherichia coli CFT073
uaccgccaauuacca

SEQ ID NO: 580353 - RNA, 14 nt, Escherichia coli CFT073
uaccgccacagcag

SEQ ID NO: 580354 - RNA, 15 nt, Escherichia coli CFT073
uaccgccacagcagc

SEQ ID NO: 580355 - RNA, 17 nt, Escherichia coli CFT073
uaccgcaccaccagcag

SEQ ID NO: 580356 - RNA, 22 nt, Escherichia coli CFT073
uaccgaugagcugcaacuggcg

SEQ ID NO: 580357 - RNA, 16 nt, Escherichia coli CFT073
uaccgauggcaaacaa

SEQ ID NO: 580358 - RNA, 14 nt, Escherichia coli CFT073
uaccgaguccgcca

SEQ ID NO: 580359 - RNA, 20 nt, Escherichia coli CFT073
uaccgaacaugccgccaacg

SEQ ID NO: 580360 - RNA, 21 nt, Escherichia coli CFT073
uacccuucgauaaaggccauc

SEQ ID NO: 580361 - RNA, 19 nt, Escherichia coli CFT073
uacccuuguggauaacgcc

SEQ ID NO: 580362 - RNA, 15 nt, Escherichia coli CFT073
uacccugaccgucuu

SEQ ID NO: 580363 - RNA, 17 nt, Escherichia coli CFT073
uaccccugccgccgcaa

SEQ ID NO: 580364 - RNA, 15 nt, Escherichia coli CFT073
uacccccauccacgc

SEQ ID NO: 580365 - RNA, 22 nt, Escherichia coli CFT073
uaccaucgacaccaucgcuuca

SEQ ID NO: 580366 - RNA, 13 nt, Escherichia coli CFT073
uaccaucgcgcac

SEQ ID NO: 580367 - RNA, 16 nt, Escherichia coli CFT073
uaccaucaaccacuac

SEQ ID NO: 580368 - RNA, 11 nt, Escherichia coli CFT073
uaccaucaggu

SEQ ID NO: 580369 - RNA, 12 nt, Escherichia coli CFT073
uaccccaccgcc

SEQ ID NO: 580370 - RNA, 18 nt, Escherichia coli CFT073
uacccaggucgcccgguu

SEQ ID NO: 580371 - RNA, 15 nt, Escherichia coli CFT073
uaccauuucuucugc

SEQ ID NO: 580372 - RNA, 17 nt, Escherichia coli CFT073
uacccagacuuuucaga

SEQ ID NO: 580373 - RNA, 18 nt, Escherichia coli CFT073
uacccagcguguugagga

SEQ ID NO: 580374 - RNA, 21 nt, Escherichia coli CFT073
uacaaagggcuaacgugcagg

SEQ ID NO: 580375 - RNA, 15 nt, Escherichia coli CFT073
uaccagugcagcgca

SEQ ID NO: 580376 - RNA, 15 nt, Escherichia coli CFT073
uaauucguaacggcc

SEQ ID NO: 580377 - RNA, 17 nt, Escherichia coli CFT073
uaauuuugugcagcaca

SEQ ID NO: 580378 - RNA, 16 nt, Escherichia coli CFT073
uagaaccuuccacguu

SEQ ID NO: 580379 - RNA, 17 nt, Escherichia coli CFT073
uagaaccuugcuggcga

SEQ ID NO: 580380 - RNA, 14 nt, Escherichia coli CFT073
uagaacggcagaga

SEQ ID NO: 580381 - RNA, 19 nt, Escherichia coli CFT073
uagaagccaguacacgcug

SEQ ID NO: 580382 - RNA, 17 nt, Escherichia coli CFT073
uagaauaaucuguuucu

SEQ ID NO: 580383 - RNA, 17 nt, Escherichia coli CFT073
uagaucaggaaaaacgg

SEQ ID NO: 580384 - RNA, 21 nt, Escherichia coli CFT073
uagaucguacagguaagcaca

SEQ ID NO: 580385 - RNA, 17 nt, Escherichia coli CFT073
uagaucuaugucgcauc

SEQ ID NO: 580386 - RNA, 22 nt, Escherichia coli CFT073
uagaucacucacccgccagcgc

SEQ ID NO: 580387 - RNA, 17 nt, Escherichia coli CFT073
uagauaauaaaacgcgg

SEQ ID NO: 580388 - RNA, 14 nt, Escherichia coli CFT073
uagauagcguucuu

SEQ ID NO: 580389 - RNA, 23 nt, Escherichia coli CFT073
uacuuaacacccccugcaaaacu

SEQ ID NO: 580390 - RNA, 16 nt, Escherichia coli CFT073
uacuguccugcggcgu

SEQ ID NO: 580391 - RNA, 13 nt, Escherichia coli CFT073
uacugguauucgc

SEQ ID NO: 580392 - RNA, 14 nt, Escherichia coli CFT073
uacuuacacaucau

SEQ ID NO: 580393 - RNA, 20 nt, Escherichia coli CFT073
uacucgcgcaguucgcacac

SEQ ID NO: 580394 - RNA, 14 nt, Escherichia coli CFT073
uacucgcuguugau

SEQ ID NO: 580395 - RNA, 19 nt, Escherichia coli CFT073
uacuggcauacaucaacgc

SEQ ID NO: 580396 - RNA, 22 nt, Escherichia coli CFT073
uacugguaagcaaagcaaaggc

SEQ ID NO: 580397 - RNA, 21 nt, Escherichia coli CFT073
uacuggcguuacccagcgcca

SEQ ID NO: 580398 - RNA, 17 nt, Escherichia coli CFT073
uacuccagccgacgacc

SEQ ID NO: 580399 - RNA, 21 nt, Escherichia coli CFT073
uacucgcauaauucuggauca

SEQ ID NO: 580400 - RNA, 13 nt, Escherichia coli CFT073
uacucauuaaugu

SEQ ID NO: 580401 - RNA, 14 nt, Escherichia coli CFT073
uacucaccaacgca

SEQ ID NO: 580402 - RNA, 18 nt, Escherichia coli CFT073
uacggcagcaaucgacca

SEQ ID NO: 580403 - RNA, 19 nt, Escherichia coli CFT073
uacggauaugucgguuauc

SEQ ID NO: 580404 - RNA, 19 nt, Escherichia coli CFT073
uacgcuuaucaggccuaca

SEQ ID NO: 580405 - RNA, 12 nt, Escherichia coli CFT073
uacgcuucucac

SEQ ID NO: 580406 - RNA, 16 nt, Escherichia coli CFT073
uacgcuuuauccagca

SEQ ID NO: 580407 - RNA, 21 nt, Escherichia coli CFT073
uacgcuuuuccacucacacag

SEQ ID NO: 580408 - RNA, 22 nt, Escherichia coli CFT073
uagcgcaaagacggaugauguu

SEQ ID NO: 580409 - RNA, 17 nt, Escherichia coli CFT073
uagcgcaauaaccacca

SEQ ID NO: 580410 - RNA, 11 nt, Escherichia coli CFT073
uagcgauggcc

SEQ ID NO: 580411 - RNA, 13 nt, Escherichia coli CFT073
uagcgcaccggau

SEQ ID NO: 580412 - RNA, 14 nt, Escherichia coli CFT073
uagccggauaagca

SEQ ID NO: 580413 - RNA, 14 nt, Escherichia coli CFT073
uagcggcuuaagaa

SEQ ID NO: 580414 - RNA, 19 nt, Escherichia coli CFT073
uagcggcguuaaugauauc

SEQ ID NO: 580415 - RNA, 23 nt, Escherichia coli CFT073
uagcgccacgccaaccaccggaa

SEQ ID NO: 580416 - RNA, 12 nt, Escherichia coli CFT073
uagcgccugcug

SEQ ID NO: 580417 - RNA, 23 nt, Escherichia coli CFT073
uagccaggcagauaauagucagc

SEQ ID NO: 580418 - RNA, 14 nt, Escherichia coli CFT073
uagccaccuggcug

SEQ ID NO: 580419 - RNA, 12 nt, Escherichia coli CFT073
uagccacgccga

SEQ ID NO: 580420 - RNA, 20 nt, Escherichia coli CFT073
uagccaucccuaauauaaac

SEQ ID NO: 580421 - RNA, 13 nt, Escherichia coli CFT073
uagccgcgcaguu

SEQ ID NO: 580422 - RNA, 23 nt, Escherichia coli CFT073
uagcaugaugauaucacugguga

SEQ ID NO: 580423 - RNA, 20 nt, Escherichia coli CFT073
uagcaugaaguaacagaaga

SEQ ID NO: 580424 - RNA, 15 nt, Escherichia coli CFT073
uagcaucugguaacc

SEQ ID NO: 580425 - RNA, 16 nt, Escherichia coli CFT073
uagcaucaagaaaaau

SEQ ID NO: 580426 - RNA, 21 nt, Escherichia coli CFT073
uagaugugccaauugccuggu

SEQ ID NO: 580427 - RNA, 18 nt, Escherichia coli CFT073
uagauuaccagagaaaag

SEQ ID NO: 580428 - RNA, 17 nt, Escherichia coli CFT073
uagauuucauccggcug

SEQ ID NO: 580429 - RNA, 20 nt, Escherichia coli CFT073
uagcagguaaucugccauau

SEQ ID NO: 580430 - RNA, 17 nt, Escherichia coli CFT073
uaucgacuaacuucuga

SEQ ID NO: 580431 - RNA, 18 nt, Escherichia coli CFT073
uaucgacuaacuucugau

SEQ ID NO: 580432 - RNA, 14 nt, Escherichia coli CFT073
uaucgaauaaagau

SEQ ID NO: 580433 - RNA, 15 nt, Escherichia coli CFT073
uaucgcguaaugcuu

SEQ ID NO: 580434 - RNA, 20 nt, Escherichia coli CFT073
uaucgcgucaacagggcaga

SEQ ID NO: 580435 - RNA, 20 nt, Escherichia coli CFT073
uaucgccucuauucgaccac

SEQ ID NO: 580436 - RNA, 20 nt, Escherichia coli CFT073
uaucgcgacauccacuuuuc

SEQ ID NO: 580437 - RNA, 15 nt, Escherichia coli CFT073
uaucgcgcaaccaca

SEQ ID NO: 580438 - RNA, 17 nt, Escherichia coli CFT073
uaucgcgccagccagua

SEQ ID NO: 580439 - RNA, 14 nt, Escherichia coli CFT073
uaugccggauggcu

SEQ ID NO: 580440 - RNA, 13 nt, Escherichia coli CFT073
uaugccuggcgaa

SEQ ID NO: 580441 - RNA, 18 nt, Escherichia coli CFT073
uaugccggauaagacgcg

SEQ ID NO: 580442 - RNA, 20 nt, Escherichia coli CFT073
uaugcgccgcgauuaaccgu

SEQ ID NO: 580443 - RNA, 19 nt, Escherichia coli CFT073
uaugcgucaacgccgcguc

SEQ ID NO: 580444 - RNA, 13 nt, Escherichia coli CFT073
uaugcugcuuaca

SEQ ID NO: 580445 - RNA, 21 nt, Escherichia coli CFT073
uauggaaaaguuguuuuggga

SEQ ID NO: 580446 - RNA, 22 nt, Escherichia coli CFT073
uauggaacaacaccacuugcug

SEQ ID NO: 580447 - RNA, 20 nt, Escherichia coli CFT073
uauuccgcaccugccagcgc

SEQ ID NO: 580448 - RNA, 21 nt, Escherichia coli CFT073
uauucccuugcucugguuccc

SEQ ID NO: 580449 - RNA, 15 nt, Escherichia coli CFT073
uauucccccaccgcc

SEQ ID NO: 580450 - RNA, 21 nt, Escherichia coli CFT073
uauuccccggucagcagcacc

SEQ ID NO: 580451 - RNA, 16 nt, Escherichia coli CFT073
uaugguacuuucugau

SEQ ID NO: 580452 - RNA, 21 nt, Escherichia coli CFT073
uaugguuuuguaggccggaua

SEQ ID NO: 580453 - RNA, 12 nt, Escherichia coli CFT073
uauguaauuaaa

SEQ ID NO: 580454 - RNA, 16 nt, Escherichia coli CFT073
uaugucauugccugau

SEQ ID NO: 580455 - RNA, 16 nt, Escherichia coli CFT073
uauucacuacugguug

SEQ ID NO: 580456 - RNA, 16 nt, Escherichia coli CFT073
uauuucccggauggca

SEQ ID NO: 580457 - RNA, 15 nt, Escherichia coli CFT073
uauuuuauauuacgc

SEQ ID NO: 580458 - RNA, 19 nt, Escherichia coli CFT073
uauuuucgccauuguuggc

SEQ ID NO: 580459 - RNA, 13 nt, Escherichia coli CFT073
uauugauaaccgu

SEQ ID NO: 580460 - RNA, 14 nt, Escherichia coli CFT073
uauucuuccggcuu

SEQ ID NO: 580461 - RNA, 21 nt, Escherichia coli CFT073
uauugagcgcaaauugcuggu

SEQ ID NO: 580462 - RNA, 13 nt, Escherichia coli CFT073
uauuuaacaucau

SEQ ID NO: 580463 - RNA, 20 nt, Escherichia coli CFT073
uauuuacgguauaacccagu

SEQ ID NO: 580464 - RNA, 15 nt, Escherichia coli CFT073
ucaacaaacgccaga

SEQ ID NO: 580465 - RNA, 16 nt, Escherichia coli CFT073
ucaacaaacgccagau

SEQ ID NO: 580466 - RNA, 19 nt, Escherichia coli CFT073
ucaacaaccaggccagcgc

SEQ ID NO: 580467 - RNA, 17 nt, Escherichia coli CFT073
ucaacaauaaaaggugc

SEQ ID NO: 580468 - RNA, 14 nt, Escherichia coli CFT073
ucaacaauaaacug

SEQ ID NO: 580469 - RNA, 17 nt, Escherichia coli CFT073
ucaaauucaaugacagu

SEQ ID NO: 580470 - RNA, 15 nt, Escherichia coli CFT073
ucaacagauuucgaa

SEQ ID NO: 580471 - RNA, 15 nt, Escherichia coli CFT073
ucaacagauuuugca

SEQ ID NO: 580472 - RNA, 15 nt, Escherichia coli CFT073
ucaacaggcgcugau

SEQ ID NO: 580473 - RNA, 12 nt, Escherichia coli CFT073
uauauaacagaa

SEQ ID NO: 580474 - RNA, 19 nt, Escherichia coli CFT073
uauagguggcaaagaaauc

SEQ ID NO: 580475 - RNA, 13 nt, Escherichia coli CFT073
uauagagcagcgg

SEQ ID NO: 580476 - RNA, 18 nt, Escherichia coli CFT073
uauagaguacuugcuaca

SEQ ID NO: 580477 - RNA, 15 nt, Escherichia coli CFT073
uauaaaaagaagauc

SEQ ID NO: 580478 - RNA, 15 nt, Escherichia coli CFT073
uauaaaacucaccgc

SEQ ID NO: 580479 - RNA, 16 nt, Escherichia coli CFT073
uauaaacucgccaaac

SEQ ID NO: 580480 - RNA, 20 nt, Escherichia coli CFT073
uaucauucgguugccagcgc

SEQ ID NO: 580481 - RNA, 19 nt, Escherichia coli CFT073
uaucauugccgguuggcga

SEQ ID NO: 580482 - RNA, 19 nt, Escherichia coli CFT073
uaucaugcucugccagcgu

SEQ ID NO: 580483 - RNA, 15 nt, Escherichia coli CFT073
uauccaacugugaau

SEQ ID NO: 580484 - RNA, 20 nt, Escherichia coli CFT073
uaucgaacguuuucaccacu

SEQ ID NO: 580485 - RNA, 21 nt, Escherichia coli CFT073
uauccagcgccugagcagcga

SEQ ID NO: 580486 - RNA, 15 nt, Escherichia coli CFT073
uauccugacgcuguu

SEQ ID NO: 580487 - RNA, 16 nt, Escherichia coli CFT073
uaucaacaauaaacug

SEQ ID NO: 580488 - RNA, 20 nt, Escherichia coli CFT073
uaucaaacgugacauucuga

SEQ ID NO: 580489 - RNA, 16 nt, Escherichia coli CFT073
uaucaauugaugcuuu

SEQ ID NO: 580490 - RNA, 22 nt, Escherichia coli CFT073
uaucaucaagacccggcgcacg

SEQ ID NO: 580491 - RNA, 19 nt, Escherichia coli CFT073
uaucaccacugaugccacu

SEQ ID NO: 580492 - RNA, 23 nt, Escherichia coli CFT073
uaucaccaggagccaguuggcgu

SEQ ID NO: 580493 - RNA, 19 nt, Escherichia coli CFT073
uaguccgccagaauacccg

SEQ ID NO: 580494 - RNA, 17 nt, Escherichia coli CFT073
uaguuaaucaguacgca

SEQ ID NO: 580495 - RNA, 17 nt, Escherichia coli CFT073
uagugaucguucaccgu

SEQ ID NO: 580496 - RNA, 14 nt, Escherichia coli CFT073
uagugcgcaguugc

SEQ ID NO: 580497 - RNA, 23 nt, Escherichia coli CFT073
uaguuagcagauuaauuuaacga

SEQ ID NO: 580498 - RNA, 17 nt, Escherichia coli CFT073
uaguucgcaaucgcgcc

SEQ ID NO: 580499 - RNA, 20 nt, Escherichia coli CFT073
uaguuucaaugccuuucuuu

SEQ ID NO: 580500 - RNA, 11 nt, Escherichia coli CFT073
uaguugcugcg

SEQ ID NO: 580501 - RNA, 21 nt, Escherichia coli CFT073
aaguugaagcugaacagucgc

SEQ ID NO: 580502 - RNA, 15 nt, Escherichia coli CFT073
uagcuuccacggcgu

SEQ ID NO: 580503 - RNA, 20 nt, Escherichia coli CFT073
uaggucggauaagacgcguc

SEQ ID NO: 580504 - RNA, 20 nt, Escherichia coli CFT073
uaggucggauaaggcguuua

SEQ ID NO: 580505 - RNA, 14 nt, Escherichia coli CFT073
uagcuuaacggcag

SEQ ID NO: 580506 - RNA, 15 nt, Escherichia coli CFT073
uagcuuaacggcagc

SEQ ID NO: 580507 - RNA, 17 nt, Escherichia coli CFT073
uaguaagaaccacagcc

SEQ ID NO: 580508 - RNA, 17 nt, Escherichia coli CFT073
uagguugugaucauccg

SEQ ID NO: 580509 - RNA, 12 nt, Escherichia coli CFT073
uagguuucacgu

SEQ ID NO: 580510 - RNA, 14 nt, Escherichia coli CFT073
uaguacauuucuuc

SEQ ID NO: 580511 - RNA, 17 nt, Escherichia coli CFT073
uaguacccucugcacca

SEQ ID NO: 580512 - RNA, 14 nt, Escherichia coli CFT073
uaguaccgcuacgu

SEQ ID NO: 580513 - RNA, 22 nt, Escherichia coli CFT073
uaguacgccaaucugcaaaaua

SEQ ID NO: 580514 - RNA, 11 nt, Escherichia coli CFT073
uaguauccugg

SEQ ID NO: 580515 - RNA, 22 nt, Escherichia coli CFT073
gugggcaggaaaaucagcauca

SEQ ID NO: 580516 - RNA, 21 nt, Escherichia coli CFT073
guguacgaacgguccccucgc

SEQ ID NO: 580517 - RNA, 14 nt, Escherichia coli CFT073
guguacccagcagc

SEQ ID NO: 580518 - RNA, 17 nt, Escherichia coli CFT073
guguaaaaacugccagg

SEQ ID NO: 580519 - RNA, 14 nt, Escherichia coli CFT073
guguaaaugccggu

SEQ ID NO: 580520 - RNA, 18 nt, Escherichia coli CFT073
guguaaccgcaacggcga

SEQ ID NO: 580521 - RNA, 19 nt, Escherichia coli CFT073
guggugccgacauuaucac

SEQ ID NO: 580522 - RNA, 18 nt, Escherichia coli CFT073
guggugcaggcuuccggc

SEQ ID NO: 580523 - RNA, 15 nt, Escherichia coli CFT073
guguucaugaccgug

SEQ ID NO: 580524 - RNA, 20 nt, Escherichia coli CFT073
guguucaugaccgugaucgu

SEQ ID NO: 580525 - RNA, 21 nt, Escherichia coli CFT073
guguauucaugcccugcccgc

SEQ ID NO: 580526 - RNA, 21 nt, Escherichia coli CFT073
aaguuaccggaagcgccaccc

SEQ ID NO: 580527 - RNA, 17 nt, Escherichia coli CFT073
aaguuacugacaucgcu

SEQ ID NO: 580528 - RNA, 14 nt, Escherichia coli CFT073
aaguuauuggcacu

SEQ ID NO: 580529 - RNA, 23 nt, Escherichia coli CFT073
aaguuccgggauauaaaccgccg

SEQ ID NO: 580530 - RNA, 16 nt, Escherichia coli CFT073
guuaugcucaacggug

SEQ ID NO: 580531 - RNA, 17 nt, Escherichia coli CFT073
guuauucauugccacgu

SEQ ID NO: 580532 - RNA, 23 nt, Escherichia coli CFT073
guuauuuguugccggaugcggcg

SEQ ID NO: 580533 - RNA, 14 nt, Escherichia coli CFT073
guuacgaccuacaa

SEQ ID NO: 580534 - RNA, 12 nt, Escherichia coli CFT073
guuacgccaucu

SEQ ID NO: 580535 - RNA, 21 nt, Escherichia coli CFT073
guuacgccccgguuucucuuc

SEQ ID NO: 580536 - RNA, 13 nt, Escherichia coli CFT073
guuacgcaccggg

SEQ ID NO: 580537 - RNA, 13 nt, Escherichia coli CFT073
guuacgcaccggu

SEQ ID NO: 580538 - RNA, 17 nt, Escherichia coli CFT073
guuacgcacuucuucgu

SEQ ID NO: 580539 - RNA, 16 nt, Escherichia coli CFT073
guuacgcgcaguuucc

SEQ ID NO: 580540 - RNA, 13 nt, Escherichia coli CFT073
guuacuccgccac

SEQ ID NO: 580541 - RNA, 21 nt, Escherichia coli CFT073
guuacuccgccacacucucgc

SEQ ID NO: 580542 - RNA, 18 nt, Escherichia coli CFT073
aaguguuggcgacaucga

SEQ ID NO: 580543 - RNA, 19 nt, Escherichia coli CFT073
guuaccagcaccgucgcac

SEQ ID NO: 580544 - RNA, 14 nt, Escherichia coli CFT073
guuaccaguacacc

SEQ ID NO: 580545 - RNA, 13 nt, Escherichia coli CFT073
guuaccccugcgg

SEQ ID NO: 580546 - RNA, 15 nt, Escherichia coli CFT073
guuaccgaucgccag

SEQ ID NO: 580547 - RNA, 13 nt, Escherichia coli CFT073
guuaauuucucgc

SEQ ID NO: 580548 - RNA, 20 nt, Escherichia coli CFT073
guuaaucgccgcauaauauc

SEQ ID NO: 580549 - RNA, 20 nt, Escherichia coli CFT073
guuaaucugcccguagccca

SEQ ID NO: 580550 - RNA, 14 nt, Escherichia coli CFT073
guuaaugcccauca

SEQ ID NO: 580551 - RNA, 14 nt, Escherichia coli CFT073
guuaagcgucgcau

SEQ ID NO: 580552 - RNA, 21 nt, Escherichia coli CFT073
guuaagcauuggcaugcacgu

SEQ ID NO: 580553 - RNA, 18 nt, Escherichia coli CFT073
guuaacgccgcauccggc

SEQ ID NO: 580554 - RNA, 19 nt, Escherichia coli CFT073
guuaacgccgcugcucuau

SEQ ID NO: 580555 - RNA, 20 nt, Escherichia coli CFT073
guuaacgccuuauccggccu

SEQ ID NO: 580556 - RNA, 20 nt, Escherichia coli CFT073
guuaacugcaugucaggcgu

SEQ ID NO: 580557 - RNA, 17 nt, Escherichia coli CFT073
guuaacgcugucuacaa

SEQ ID NO: 580558 - RNA, 14 nt, Escherichia coli CFT073
guuaaaaacagcca

SEQ ID NO: 580559 - RNA, 21 nt, Escherichia coli CFT073
guuaaaacaauuaacccgcga

SEQ ID NO: 580560 - RNA, 19 nt, Escherichia coli CFT073
guguuccuugggcucgaca

SEQ ID NO: 580561 - RNA, 13 nt, Escherichia coli CFT073
guuaaaauacgcg

SEQ ID NO: 580562 - RNA, 16 nt, Escherichia coli CFT073
guuaaaggcuuuguua

SEQ ID NO: 580563 - RNA, 23 nt, Escherichia coli CFT073
guuaaauugaggcuuugcccaau

SEQ ID NO: 580564 - RNA, 17 nt, Escherichia coli CFT073
guuaacaauauuaacaa

SEQ ID NO: 580565 - RNA, 20 nt, Escherichia coli CFT073
guuaacaauauuaacaacau

SEQ ID NO: 580566 - RNA, 17 nt, Escherichia coli CFT073
guuaacagcgcaccaga

SEQ ID NO: 580567 - RNA, 16 nt, Escherichia coli CFT073
guuaaccagcaccagc

SEQ ID NO: 580568 - RNA, 19 nt, Escherichia coli CFT073
guuaacccacagcgcacca

SEQ ID NO: 580569 - RNA, 20 nt, Escherichia coli CFT073
gugcuguaaagcacagacca

SEQ ID NO: 580570 - RNA, 21 nt, Escherichia coli CFT073
guggccagcaacagcgcguca

SEQ ID NO: 580571 - RNA, 16 nt, Escherichia coli CFT073
gugcugcgaucgauau

SEQ ID NO: 580572 - RNA, 16 nt, Escherichia coli CFT073
guggccugcuuuugcc

SEQ ID NO: 580573 - RNA, 12 nt, Escherichia coli CFT073
guggccgagagg

SEQ ID NO: 580574 - RNA, 20 nt, Escherichia coli CFT073
guggcguaaacgccuuaucc

SEQ ID NO: 580575 - RNA, 21 nt, Escherichia coli CFT073
guggcucagccagacgcguca

SEQ ID NO: 580576 - RNA, 16 nt, Escherichia coli CFT073
guggcgucaaaaagcu

SEQ ID NO: 580577 - RNA, 14 nt, Escherichia coli CFT073
guggcguacagcug

SEQ ID NO: 580578 - RNA, 12 nt, Escherichia coli CFT073
guggcgguagcg

SEQ ID NO: 580579 - RNA, 16 nt, Escherichia coli CFT073
guggcgauaaucagcg

SEQ ID NO: 580580 - RNA, 13 nt, Escherichia coli CFT073
gugcuccaucagg

SEQ ID NO: 580581 - RNA, 18 nt, Escherichia coli CFT073
gugcuccauuguuagcaa

SEQ ID NO: 580582 - RNA, 14 nt, Escherichia coli CFT073
gugcucauccuuca

SEQ ID NO: 580583 - RNA, 21 nt, Escherichia coli CFT073
gugcguugucaucgcggcauu

SEQ ID NO: 580584 - RNA, 14 nt, Escherichia coli CFT073
gugcgcaucgccag

SEQ ID NO: 580585 - RNA, 16 nt, Escherichia coli CFT073
gugcgccaaacugccg

SEQ ID NO: 580586 - RNA, 12 nt, Escherichia coli CFT073
gugcgcagcauc

SEQ ID NO: 580587 - RNA, 17 nt, Escherichia coli CFT073
gugcgcagcaucggccu

SEQ ID NO: 580588 - RNA, 13 nt, Escherichia coli CFT073
aagugcugcaacc

SEQ ID NO: 580589 - RNA, 23 nt, Escherichia coli CFT073
aaguggcgauucauaugcgccag

SEQ ID NO: 580590 - RNA, 16 nt, Escherichia coli CFT073
aagugcgcguuguuca

SEQ ID NO: 580591 - RNA, 23 nt, Escherichia coli CFT073
aagugaaucggaucaauccccag

SEQ ID NO: 580592 - RNA, 14 nt, Escherichia coli CFT073
gugccucccgguga

SEQ ID NO: 580593 - RNA, 16 nt, Escherichia coli CFT073
gugccugacggacgcg

SEQ ID NO: 580594 - RNA, 19 nt, Escherichia coli CFT073
gugccguggcaggcaaacc

SEQ ID NO: 580595 - RNA, 13 nt, Escherichia coli CFT073
gugccggauuuca

SEQ ID NO: 580596 - RNA, 17 nt, Escherichia coli CFT073
gugccggaugcaaacga

SEQ ID NO: 580597 - RNA, 21 nt, Escherichia coli CFT073
gugccgcguuuugacagcuca

SEQ ID NO: 580598 - RNA, 19 nt, Escherichia coli CFT073
gugauauuacauaccagca

SEQ ID NO: 580599 - RNA, 18 nt, Escherichia coli CFT073
gugaucgccugcauguug

SEQ ID NO: 580600 - RNA, 15 nt, Escherichia coli CFT073
gugauccacgguucu

SEQ ID NO: 580601 - RNA, 17 nt, Escherichia coli CFT073
gugaucccuaacuggcg

SEQ ID NO: 580602 - RNA, 20 nt, Escherichia coli CFT073
gugauucagcguaacgccca

SEQ ID NO: 580603 - RNA, 12 nt, Escherichia coli CFT073
gugauucauagu

SEQ ID NO: 580604 - RNA, 22 nt, Escherichia coli CFT073
gugauuccggugccgcaaccuu

SEQ ID NO: 580605 - RNA, 14 nt, Escherichia coli CFT073
gugauuaaauucag

SEQ ID NO: 580606 - RNA, 21 nt, Escherichia coli CFT073
gugauuaccgcaaaucaccaa

SEQ ID NO: 580607 - RNA, 17 nt, Escherichia coli CFT073
gugaugguaacgcgcca

SEQ ID NO: 580608 - RNA, 19 nt, Escherichia coli CFT073
gugaugcggucgcugccgc

SEQ ID NO: 580609 - RNA, 17 nt, Escherichia coli CFT073
gugaugccgcauccggc

SEQ ID NO: 580610 - RNA, 16 nt, Escherichia coli CFT073
gugaugccaaucggcg

SEQ ID NO: 580611 - RNA, 22 nt, Escherichia coli CFT073
gugaugccagcacucugugcgu

SEQ ID NO: 580612 - RNA, 21 nt, Escherichia coli CFT073
gugaugaaaaacguugccgga

SEQ ID NO: 580613 - RNA, 21 nt, Escherichia coli CFT073
gugaucgggucaccugccagg

SEQ ID NO: 580614 - RNA, 12 nt, Escherichia coli CFT073
gugcaaaaaauc

SEQ ID NO: 580615 - RNA, 12 nt, Escherichia coli CFT073
gugauuucugac

SEQ ID NO: 580616 - RNA, 13 nt, Escherichia coli CFT073
gugcaauaacguu

SEQ ID NO: 580617 - RNA, 12 nt, Escherichia coli CFT073
gugcaaucagcg

SEQ ID NO: 580618 - RNA, 21 nt, Escherichia coli CFT073
gugcacaaacuucuucaguuu

SEQ ID NO: 580619 - RNA, 22 nt, Escherichia coli CFT073
gugcagcagacgcugcaccugc

SEQ ID NO: 580620 - RNA, 15 nt, Escherichia coli CFT073
gugcagauaccacca

SEQ ID NO: 580621 - RNA, 19 nt, Escherichia coli CFT073
gugcagauaccaccagcgc

SEQ ID NO: 580622 - RNA, 23 nt, Escherichia coli CFT073
gugcagaucaucguaaccgacga

SEQ ID NO: 580623 - RNA, 20 nt, Escherichia coli CFT073
gugcacuuguuuaugccaga

SEQ ID NO: 580624 - RNA, 13 nt, Escherichia coli CFT073
gugccaccagcau

SEQ ID NO: 580625 - RNA, 14 nt, Escherichia coli CFT073
gugccacgccccgc

SEQ ID NO: 580626 - RNA, 23 nt, Escherichia coli CFT073
gugccagcaccaaacuggaauag

SEQ ID NO: 580627 - RNA, 21 nt, Escherichia coli CFT073
gugcccacguucaugccgacg

SEQ ID NO: 580628 - RNA, 14 nt, Escherichia coli CFT073
gugcccccugcaau

SEQ ID NO: 580629 - RNA, 18 nt, Escherichia coli CFT073
uaaucgcuucaaucagcg

SEQ ID NO: 580630 - RNA, 17 nt, Escherichia coli CFT073
uaaucgcccucgccuuu

SEQ ID NO: 580631 - RNA, 12 nt, Escherichia coli CFT073
uaaucgccgcau

SEQ ID NO: 580632 - RNA, 18 nt, Escherichia coli CFT073
uaaucucucaacaccgcu

SEQ ID NO: 580633 - RNA, 13 nt, Escherichia coli CFT073
uaaucauucgccc

SEQ ID NO: 580634 - RNA, 16 nt, Escherichia coli CFT073
uaauccaugccaacgg

SEQ ID NO: 580635 - RNA, 14 nt, Escherichia coli CFT073
uaauccgcugcacg

SEQ ID NO: 580636 - RNA, 21 nt, Escherichia coli CFT073
uaaucgaaaacaucaugguuu

SEQ ID NO: 580637 - RNA, 16 nt, Escherichia coli CFT073
uaauccguaaagccca

SEQ ID NO: 580638 - RNA, 13 nt, Escherichia coli CFT073
uaauccuguaucu

SEQ ID NO: 580639 - RNA, 18 nt, Escherichia coli CFT073
uaaucgccagcaaaauca

SEQ ID NO: 580640 - RNA, 14 nt, Escherichia coli CFT073
uaaucgccaguuca

SEQ ID NO: 580641 - RNA, 17 nt, Escherichia coli CFT073
uaauggcgauaaucgaa

SEQ ID NO: 580642 - RNA, 15 nt, Escherichia coli CFT073
uaaugccaccagugc

SEQ ID NO: 580643 - RNA, 14 nt, Escherichia coli CFT073
uaaugccagcgaua

SEQ ID NO: 580644 - RNA, 20 nt, Escherichia coli CFT073
uaaugcuauaaaaauaaaca

SEQ ID NO: 580645 - RNA, 16 nt, Escherichia coli CFT073
uaaugaugagauccgc

SEQ ID NO: 580646 - RNA, 18 nt, Escherichia coli CFT073
uaaugcacuccgccgcac

SEQ ID NO: 580647 - RNA, 17 nt, Escherichia coli CFT073
uaaugauaucccugcug

SEQ ID NO: 580648 - RNA, 19 nt, Escherichia coli CFT073
uaauucccagcaccgcaga

SEQ ID NO: 580649 - RNA, 18 nt, Escherichia coli CFT073
uaauucaccucagaaauc

SEQ ID NO: 580650 - RNA, 21 nt, Escherichia coli CFT073
uaaugggcgguuggccugaua

SEQ ID NO: 580651 - RNA, 18 nt, Escherichia coli CFT073
uaaugguaacgccagcca

SEQ ID NO: 580652 - RNA, 21 nt, Escherichia coli CFT073
uaauuaaucaucaugcuuaaa

SEQ ID NO: 580653 - RNA, 23 nt, Escherichia coli CFT073
uaauuagugagacucaccaaucg

SEQ ID NO: 580654 - RNA, 23 nt, Escherichia coli CFT073
uaauaagguaauuauuguaagcu

SEQ ID NO: 580655 - RNA, 16 nt, Escherichia coli CFT073
uaauacaaacucacug

SEQ ID NO: 580656 - RNA, 24 nt, Escherichia coli CFT073
uaauacacacaguaaaauauucga

SEQ ID NO: 580657 - RNA, 13 nt, Escherichia coli CFT073
uaauaccaucggc

SEQ ID NO: 580658 - RNA, 18 nt, Escherichia coli CFT073
uaagcguggaggggcgac

SEQ ID NO: 580659 - RNA, 22 nt, Escherichia coli CFT073
uaagcugccgcuccuucaccuu

SEQ ID NO: 580660 - RNA, 23 nt, Escherichia coli CFT073
uaagcugaauguucuucuucugc

SEQ ID NO: 580661 - RNA, 15 nt, Escherichia coli CFT073
uaagcguagcgcauc

SEQ ID NO: 580662 - RNA, 19 nt, Escherichia coli CFT073
uaagcguagcgcaucaggc

SEQ ID NO: 580663 - RNA, 16 nt, Escherichia coli CFT073
uaagcgucgcaucagg

SEQ ID NO: 580664 - RNA, 20 nt, Escherichia coli CFT073
uaagcguuaauggcgauaau

SEQ ID NO: 580665 - RNA, 15 nt, Escherichia coli CFT073
uaagcguuuucugcc

SEQ ID NO: 580666 - RNA, 21 nt, Escherichia coli CFT073
uaaguuuuccguacucaaugc

SEQ ID NO: 580667 - RNA, 22 nt, Escherichia coli CFT073
uaaguuucccagcuuauuaaca

SEQ ID NO: 580668 - RNA, 24 nt, Escherichia coli CFT073
uaaguuucccagcuuauuaacagu

SEQ ID NO: 580669 - RNA, 17 nt, Escherichia coli CFT073
uaaggccaccagcggca

SEQ ID NO: 580670 - RNA, 20 nt, Escherichia coli CFT073
uaaggacggaauuugcugcu

SEQ ID NO: 580671 - RNA, 16 nt, Escherichia coli CFT073
uaaggaaaucgauaaa

SEQ ID NO: 580672 - RNA, 21 nt, Escherichia coli CFT073
uaagcaaucacuuuuuaccgu

SEQ ID NO: 580673 - RNA, 17 nt, Escherichia coli CFT073
uaagcaauguuauccgg

SEQ ID NO: 580674 - RNA, 20 nt, Escherichia coli CFT073
uaagcaauguuauccggcua

SEQ ID NO: 580675 - RNA, 19 nt, Escherichia coli CFT073
uaagcaggguugcagcgga

SEQ ID NO: 580676 - RNA, 16 nt, Escherichia coli CFT073
uaagcacucuggcgaa

SEQ ID NO: 580677 - RNA, 16 nt, Escherichia coli CFT073
uaagaucgugcagcac

SEQ ID NO: 580678 - RNA, 16 nt, Escherichia coli CFT073
uaagagguuaaucccu

SEQ ID NO: 580679 - RNA, 17 nt, Escherichia coli CFT073
uaagaaugcuccccaga

SEQ ID NO: 580680 - RNA, 16 nt, Escherichia coli CFT073
uaagacgcgccagcgu

SEQ ID NO: 580681 - RNA, 21 nt, Escherichia coli CFT073
uaagacgcguggcgucgcauc

SEQ ID NO: 580682 - RNA, 15 nt, Escherichia coli CFT073
uaagacgcguuagcg

SEQ ID NO: 580683 - RNA, 21 nt, Escherichia coli CFT073
uaagaaaaaaggugaguuuug

SEQ ID NO: 580684 - RNA, 19 nt, Escherichia coli CFT073
uaacgaacgcagugauaac

SEQ ID NO: 580685 - RNA, 17 nt, Escherichia coli CFT073
uaaccuguuuauuaugc

SEQ ID NO: 580686 - RNA, 15 nt, Escherichia coli CFT073
uaacgauaauuuaca

SEQ ID NO: 580687 - RNA, 13 nt, Escherichia coli CFT073
uaacgauacggcg

SEQ ID NO: 580688 - RNA, 15 nt, Escherichia coli CFT073
uaaagccagcggcac

SEQ ID NO: 580689 - RNA, 16 nt, Escherichia coli CFT073
uaaagacauuagugau

SEQ ID NO: 580690 - RNA, 20 nt, Escherichia coli CFT073
uaaagauuguucuuuauccg

SEQ ID NO: 580691 - RNA, 14 nt, Escherichia coli CFT073
uaaagcaauaaacc

SEQ ID NO: 580692 - RNA, 18 nt, Escherichia coli CFT073
uaaagccuguaaugccuu

SEQ ID NO: 580693 - RNA, 23 nt, Escherichia coli CFT073
uaaacuacgcucgcgguagccca

SEQ ID NO: 580694 - RNA, 14 nt, Escherichia coli CFT073
uaaacaccagcagc

SEQ ID NO: 580695 - RNA, 16 nt, Escherichia coli CFT073
uaaacaccagcagcag

SEQ ID NO: 580696 - RNA, 14 nt, Escherichia coli CFT073
uaaacaccagcagu

SEQ ID NO: 580697 - RNA, 22 nt, Escherichia coli CFT073
uaaacaccguuuuaccaucgau

SEQ ID NO: 580698 - RNA, 16 nt, Escherichia coli CFT073
uaaacagcagauggca

SEQ ID NO: 580699 - RNA, 20 nt, Escherichia coli CFT073
uaaagaaacggagccuuucg

SEQ ID NO: 580700 - RNA, 22 nt, Escherichia coli CFT073
uaaagaaaacgaauugcagaac

SEQ ID NO: 580701 - RNA, 18 nt, Escherichia coli CFT073
uaaagacuauccgccaua

SEQ ID NO: 580702 - RNA, 19 nt, Escherichia coli CFT073
uaaagacuuuaucgugcgg

SEQ ID NO: 580703 - RNA, 16 nt, Escherichia coli CFT073
guuuccaguugaacaa

SEQ ID NO: 580704 - RNA, 20 nt, Escherichia coli CFT073
guuuccccugguucaauaaa

SEQ ID NO: 580705 - RNA, 21 nt, Escherichia coli CFT073
guuucauaucugccagauaau

SEQ ID NO: 580706 - RNA, 12 nt, Escherichia coli CFT073
guuucaucuuca

SEQ ID NO: 580707 - RNA, 17 nt, Escherichia coli CFT073
guuucagauuggugaca

SEQ ID NO: 580708 - RNA, 17 nt, Escherichia coli CFT073
guuucagccacgcguuc

SEQ ID NO: 580709 - RNA, 21 nt, Escherichia coli CFT073
guuucagccagucauaauuca

SEQ ID NO: 580710 - RNA, 21 nt, Escherichia coli CFT073
uaaaagcuuuccggaaaaauc

SEQ ID NO: 580711 - RNA, 13 nt, Escherichia coli CFT073
uaaacaacgccgc

SEQ ID NO: 580712 - RNA, 14 nt, Escherichia coli CFT073
uaaauacagagcac

SEQ ID NO: 580713 - RNA, 21 nt, Escherichia coli CFT073
uaaauaaaugucgauuaucga

SEQ ID NO: 580714 - RNA, 23 nt, Escherichia coli CFT073
uaaaucgauaacgcgcugccaga

SEQ ID NO: 580715 - RNA, 12 nt, Escherichia coli CFT073
uaaaucggcgaa

SEQ ID NO: 580716 - RNA, 15 nt, Escherichia coli CFT073
uaaaucguaccagga

SEQ ID NO: 580717 - RNA, 15 nt, Escherichia coli CFT073
uaaaugaagaaaaac

SEQ ID NO: 580718 - RNA, 17 nt, Escherichia coli CFT073
uaaaugccgcaaugugc

SEQ ID NO: 580719 - RNA, 15 nt, Escherichia coli CFT073
uaaauggugauauca

SEQ ID NO: 580720 - RNA, 15 nt, Escherichia coli CFT073
uaacaccaaucagcg

SEQ ID NO: 580721 - RNA, 14 nt, Escherichia coli CFT073
uaacaccaccagcg

SEQ ID NO: 580722 - RNA, 19 nt, Escherichia coli CFT073
uaacagaaugcgcgcgaaa

SEQ ID NO: 580723 - RNA, 19 nt, Escherichia coli CFT073
uaaccggcuuuuugauacu

SEQ ID NO: 580724 - RNA, 14 nt, Escherichia coli CFT073
uaaccguccaguug

SEQ ID NO: 580725 - RNA, 15 nt, Escherichia coli CFT073
uaaauuacugagcaa

SEQ ID NO: 580726 - RNA, 17 nt, Escherichia coli CFT073
uaaauuauagaugcagc

SEQ ID NO: 580727 - RNA, 17 nt, Escherichia coli CFT073
uaaauucgccagacagu

SEQ ID NO: 580728 - RNA, 21 nt, Escherichia coli CFT073
uaaauucucccgcccccgcca

SEQ ID NO: 580729 - RNA, 17 nt, Escherichia coli CFT073
uaaauuguucauauuaa

SEQ ID NO: 580730 - RNA, 21 nt, Escherichia coli CFT073
guucggcagccugcgucgcca

SEQ ID NO: 580731 - RNA, 15 nt, Escherichia coli CFT073
guucgcguaccgcug

SEQ ID NO: 580732 - RNA, 15 nt, Escherichia coli CFT073
guucgcgccaacagc

SEQ ID NO: 580733 - RNA, 22 nt, Escherichia coli CFT073
guucgcgaaaguuaccgcgcca

SEQ ID NO: 580734 - RNA, 20 nt, Escherichia coli CFT073
guucgccccauacagcgucg

SEQ ID NO: 580735 - RNA, 14 nt, Escherichia coli CFT073
guucgccagcguca

SEQ ID NO: 580736 - RNA, 13 nt, Escherichia coli CFT073
guucgccagguca

SEQ ID NO: 580737 - RNA, 22 nt, Escherichia coli CFT073
guucgccgcagguagcagcagc

SEQ ID NO: 580738 - RNA, 17 nt, Escherichia coli CFT073
guucgagguaguagccg

SEQ ID NO: 580739 - RNA, 17 nt, Escherichia coli CFT073
guucgauaaccaucccu

SEQ ID NO: 580740 - RNA, 15 nt, Escherichia coli CFT073
guucaauaccgucug

SEQ ID NO: 580741 - RNA, 17 nt, Escherichia coli CFT073
guuauuuguucagcaaa

SEQ ID NO: 580742 - RNA, 19 nt, Escherichia coli CFT073
guucaaccucaagcacagc

SEQ ID NO: 580743 - RNA, 23 nt, Escherichia coli CFT073
guucuccucaacgaugcgaccgc

SEQ ID NO: 580744 - RNA, 14 nt, Escherichia coli CFT073
guucugaacguugc

SEQ ID NO: 580745 - RNA, 16 nt, Escherichia coli CFT073
guucuggcgcagcgca

SEQ ID NO: 580746 - RNA, 18 nt, Escherichia coli CFT073
guucugcgacgcgcggug

SEQ ID NO: 580747 - RNA, 18 nt, Escherichia coli CFT073
guugacucaaagaugaaa

SEQ ID NO: 580748 - RNA, 15 nt, Escherichia coli CFT073
guugaagcgcgauca

SEQ ID NO: 580749 - RNA, 14 nt, Escherichia coli CFT073
guucggucagcgca

SEQ ID NO: 580750 - RNA, 16 nt, Escherichia coli CFT073
guucggugcgcgcugg

SEQ ID NO: 580751 - RNA, 15 nt, Escherichia coli CFT073
guucgucuuccgggu

SEQ ID NO: 580752 - RNA, 16 nt, Escherichia coli CFT073
guugucggucgccaua

SEQ ID NO: 580753 - RNA, 14 nt, Escherichia coli CFT073
guugugcaccacca

SEQ ID NO: 580754 - RNA, 12 nt, Escherichia coli CFT073
guuguccgccag

SEQ ID NO: 580755 - RNA, 21 nt, Escherichia coli CFT073
guuggcgcugaaucccgcaau

SEQ ID NO: 580756 - RNA, 18 nt, Escherichia coli CFT073
guuuaucgucacgcauca

SEQ ID NO: 580757 - RNA, 17 nt, Escherichia coli CFT073
guuuaugaaucaaauca

SEQ ID NO: 580758 - RNA, 20 nt, Escherichia coli CFT073
guuuaucaauauccagucgg

SEQ ID NO: 580759 - RNA, 23 nt, Escherichia coli CFT073
guuuaccggugauuucgccauca

SEQ ID NO: 580760 - RNA, 18 nt, Escherichia coli CFT073
guuuaccgucuuucgcca

SEQ ID NO: 580761 - RNA, 22 nt, Escherichia coli CFT073
guuuacccagugaauccagcau

SEQ ID NO: 580762 - RNA, 22 nt, Escherichia coli CFT073
guuuacgccgcauccgacauca

SEQ ID NO: 580763 - RNA, 15 nt, Escherichia coli CFT073
guuuacgcgcgcagg

SEQ ID NO: 580764 - RNA, 20 nt, Escherichia coli CFT073
guuuaacgguuucaaccagc

SEQ ID NO: 580765 - RNA, 21 nt, Escherichia coli CFT073
guuuaacgguuucaaccagca

SEQ ID NO: 580766 - RNA, 15 nt, Escherichia coli CFT073
guuguuuaccaacgc

SEQ ID NO: 580767 - RNA, 16 nt, Escherichia coli CFT073
guuguuuaccaacgcc

SEQ ID NO: 580768 - RNA, 15 nt, Escherichia coli CFT073
guuguggcaacauaa

SEQ ID NO: 580769 - RNA, 22 nt, Escherichia coli CFT073
guugcgacagagauauucagcc

SEQ ID NO: 580770 - RNA, 17 nt, Escherichia coli CFT073
guugccugaauacacug

SEQ ID NO: 580771 - RNA, 19 nt, Escherichia coli CFT073
guugccugaauacacugcu

SEQ ID NO: 580772 - RNA, 22 nt, Escherichia coli CFT073
guugccggaucuuucaggaaca

SEQ ID NO: 580773 - RNA, 24 nt, Escherichia coli CFT073
guugccggauggcacgcauccggc

SEQ ID NO: 580774 - RNA, 20 nt, Escherichia coli CFT073
guuggacggucuaccaguuu

SEQ ID NO: 580775 - RNA, 13 nt, Escherichia coli CFT073
guugcuuuggcuu

SEQ ID NO: 580776 - RNA, 20 nt, Escherichia coli CFT073
guugcuuauugccggaugcg

SEQ ID NO: 580777 - RNA, 13 nt, Escherichia coli CFT073
agcgacugugaag

SEQ ID NO: 580778 - RNA, 21 nt, Escherichia coli CFT073
agcgacggaguugacacugaa

SEQ ID NO: 580779 - RNA, 16 nt, Escherichia coli CFT073
agcgaaaucuuccggc

SEQ ID NO: 580780 - RNA, 15 nt, Escherichia coli CFT073
agcgaacaccagcag

SEQ ID NO: 580781 - RNA, 18 nt, Escherichia coli CFT073
agcgaagguaacaccagu

SEQ ID NO: 580782 - RNA, 16 nt, Escherichia coli CFT073
agcgaacgacauccgc

SEQ ID NO: 580783 - RNA, 22 nt, Escherichia coli CFT073
agccucacagcuaaucaucauc

SEQ ID NO: 580784 - RNA, 18 nt, Escherichia coli CFT073
agccguaggugaaacggu

SEQ ID NO: 580785 - RNA, 20 nt, Escherichia coli CFT073
agccgguuuugguuuucugu

SEQ ID NO: 580786 - RNA, 15 nt, Escherichia coli CFT073
agccucgcugcucac

SEQ ID NO: 580787 - RNA, 18 nt, Escherichia coli CFT073
agccugaauaaacgccau

SEQ ID NO: 580788 - RNA, 22 nt, Escherichia coli CFT073
agccuggcugcgugaggcgguc

SEQ ID NO: 580789 - RNA, 13 nt, Escherichia coli CFT073
agccugugccuga

SEQ ID NO: 580790 - RNA, 23 nt, Escherichia coli CFT073
agccugaugcgacgcuugccgcg

SEQ ID NO: 580791 - RNA, 17 nt, Escherichia coli CFT073
agccggugcccgccagu

SEQ ID NO: 580792 - RNA, 16 nt, Escherichia coli CFT073
agccgguaaucaccag

SEQ ID NO: 580793 - RNA, 16 nt, Escherichia coli CFT073
agcccuuucgacgcgu

SEQ ID NO: 580794 - RNA, 15 nt, Escherichia coli CFT073
agccgauuaaaauca

SEQ ID NO: 580795 - RNA, 24 nt, Escherichia coli CFT073
agccgauuaaucuuccagaucacc

SEQ ID NO: 580796 - RNA, 20 nt, Escherichia coli CFT073
agccgagcgcuaccaucgac

SEQ ID NO: 580797 - RNA, 17 nt, Escherichia coli CFT073
agcccguucuucgccau

SEQ ID NO: 580798 - RNA, 22 nt, Escherichia coli CFT073
agcccguuacccugguggccau

SEQ ID NO: 580799 - RNA, 16 nt, Escherichia coli CFT073
agcccgggcacaucac

SEQ ID NO: 580800 - RNA, 19 nt, Escherichia coli CFT073
agccgcagcuaucagcgag

SEQ ID NO: 580801 - RNA, 14 nt, Escherichia coli CFT073
agccgccaccagaa

SEQ ID NO: 580802 - RNA, 19 nt, Escherichia coli CFT073
agccgcuccggcagcagca

SEQ ID NO: 580803 - RNA, 17 nt, Escherichia coli CFT073
agccgcgguauccggcu

SEQ ID NO: 580804 - RNA, 13 nt, Escherichia coli CFT073
agccgcgugcugc

SEQ ID NO: 580805 - RNA, 22 nt, Escherichia coli CFT073
agccggauagaguguuguggau

SEQ ID NO: 580806 - RNA, 17 nt, Escherichia coli CFT073
agccggaugaucauccg

SEQ ID NO: 580807 - RNA, 15 nt, Escherichia coli CFT073
agccggagcuggcgc

SEQ ID NO: 580808 - RNA, 18 nt, Escherichia coli CFT073
agcggcaccacgagcggc

SEQ ID NO: 580809 - RNA, 22 nt, Escherichia coli CFT073
agcggcagaucaaauucaauga

SEQ ID NO: 580810 - RNA, 18 nt, Escherichia coli CFT073
agcggcagcuuaacgguu

SEQ ID NO: 580811 - RNA, 12 nt, Escherichia coli CFT073
agcggccagaca

SEQ ID NO: 580812 - RNA, 14 nt, Escherichia coli CFT073
agcggcgaaacggu

SEQ ID NO: 580813 - RNA, 24 nt, Escherichia coli CFT073
agcggcgguuucuuuauccgcuuc

SEQ ID NO: 580814 - RNA, 21 nt, Escherichia coli CFT073
agcggcggcagauugagcguc

SEQ ID NO: 580815 - RNA, 17 nt, Escherichia coli CFT073
agcggucauguaccguu

SEQ ID NO: 580816 - RNA, 21 nt, Escherichia coli CFT073
agcggucacauguuccagggc

SEQ ID NO: 580817 - RNA, 22 nt, Escherichia coli CFT073
agcgguaaaauggucagccagc

SEQ ID NO: 580818 - RNA, 21 nt, Escherichia coli CFT073
agcgguaaaccaaccagcgug

SEQ ID NO: 580819 - RNA, 22 nt, Escherichia coli CFT073
agcgguaaaccguuaucaccag

SEQ ID NO: 580820 - RNA, 20 nt, Escherichia coli CFT073
agcgucaaacuuuuaaauug

SEQ ID NO: 580821 - RNA, 20 nt, Escherichia coli CFT073
agcguauagagcagcggcgu

SEQ ID NO: 580822 - RNA, 13 nt, Escherichia coli CFT073
agcguauccauca

SEQ ID NO: 580823 - RNA, 17 nt, Escherichia coli CFT073
agcguaaagccagcggc

SEQ ID NO: 580824 - RNA, 20 nt, Escherichia coli CFT073
agcguaacgaucgcccggca

SEQ ID NO: 580825 - RNA, 18 nt, Escherichia coli CFT073
agcguaauaggcgcgaca

SEQ ID NO: 580826 - RNA, 14 nt, Escherichia coli CFT073
agcguaaugccaaa

SEQ ID NO: 580827 - RNA, 20 nt, Escherichia coli CFT073
agcguaaugccaaauccuuc

SEQ ID NO: 580828 - RNA, 13 nt, Escherichia coli CFT073
agcguacaaccgc

SEQ ID NO: 580829 - RNA, 14 nt, Escherichia coli CFT073
agcgucagcagcaa

SEQ ID NO: 580830 - RNA, 22 nt, Escherichia coli CFT073
agcgucaagauggcucucaucc

SEQ ID NO: 580831 - RNA, 13 nt, Escherichia coli CFT073
agcgucacaucag

SEQ ID NO: 580832 - RNA, 12 nt, Escherichia coli CFT073
agcgucaccgga

SEQ ID NO: 580833 - RNA, 23 nt, Escherichia coli CFT073
agcgauuucacgcucagcaacau

SEQ ID NO: 580834 - RNA, 23 nt, Escherichia coli CFT073
agcgauuuuucaucacugccgac

SEQ ID NO: 580835 - RNA, 22 nt, Escherichia coli CFT073
agcgauucgucacuuugcuguc

SEQ ID NO: 580836 - RNA, 23 nt, Escherichia coli CFT073
agcgaugguacuucaaucgccac

SEQ ID NO: 580837 - RNA, 23 nt, Escherichia coli CFT073
agcgccauuacccggugccgccg

SEQ ID NO: 580838 - RNA, 17 nt, Escherichia coli CFT073
agcgccauaaucagcgc

SEQ ID NO: 580839 - RNA, 16 nt, Escherichia coli CFT073
agcgccauaucggcau

SEQ ID NO: 580840 - RNA, 16 nt, Escherichia coli CFT073
agcgccgccagaauca

SEQ ID NO: 580841 - RNA, 15 nt, Escherichia coli CFT073
agcgccuuaucccac

SEQ ID NO: 580842 - RNA, 20 nt, Escherichia coli CFT073
agcgccuuauccggccuacc

SEQ ID NO: 580843 - RNA, 19 nt, Escherichia coli CFT073
agcgccugucugcaaaaau

SEQ ID NO: 580844 - RNA, 14 nt, Escherichia coli CFT073
agcgcggcagugac

SEQ ID NO: 580845 - RNA, 15 nt, Escherichia coli CFT073
agcgcguucauccca

SEQ ID NO: 580846 - RNA, 20 nt, Escherichia coli CFT073
agcgcggggaucacuggcag

SEQ ID NO: 580847 - RNA, 18 nt, Escherichia coli CFT073
agauaauagguaaacauc

SEQ ID NO: 580848 - RNA, 15 nt, Escherichia coli CFT073
agauaaucacacagc

SEQ ID NO: 580849 - RNA, 18 nt, Escherichia coli CFT073
agauaaucacacagcggu

SEQ ID NO: 580850 - RNA, 14 nt, Escherichia coli CFT073
agauaacccagcag

SEQ ID NO: 580851 - RNA, 18 nt, Escherichia coli CFT073
agauaagaggcgcgcggg

SEQ ID NO: 580852 - RNA, 18 nt, Escherichia coli CFT073
agauaagcaacaaacuca

SEQ ID NO: 580853 - RNA, 21 nt, Escherichia coli CFT073
agauacacggugcgaugcaaa

SEQ ID NO: 580854 - RNA, 18 nt, Escherichia coli CFT073
agauaaugacuuccgcca

SEQ ID NO: 580855 - RNA, 12 nt, Escherichia coli CFT073
agauaaugccag

SEQ ID NO: 580856 - RNA, 18 nt, Escherichia coli CFT073
agauacugaugaacgcgc

SEQ ID NO: 580857 - RNA, 19 nt, Escherichia coli CFT073
agauacugccgaccagagc

SEQ ID NO: 580858 - RNA, 19 nt, Escherichia coli CFT073
agauacccgacagauaaau

SEQ ID NO: 580859 - RNA, 21 nt, Escherichia coli CFT073
agauacggcggacgugcaccg

SEQ ID NO: 580860 - RNA, 19 nt, Escherichia coli CFT073
agauagccuauaccuaaca

SEQ ID NO: 580861 - RNA, 18 nt, Escherichia coli CFT073
agauagcguggaaauaau

SEQ ID NO: 580862 - RNA, 13 nt, Escherichia coli CFT073
agagugcgccagu

SEQ ID NO: 580863 - RNA, 19 nt, Escherichia coli CFT073
agagugugaauauucagaa

SEQ ID NO: 580864 - RNA, 11 nt, Escherichia coli CFT073
agagugcccac

SEQ ID NO: 580865 - RNA, 19 nt, Escherichia coli CFT073
agagugcccacguugcauc

SEQ ID NO: 580866 - RNA, 16 nt, Escherichia coli CFT073
agauaaacgauacgcu

SEQ ID NO: 580867 - RNA, 15 nt, Escherichia coli CFT073
agauaaaaugcgaaa

SEQ ID NO: 580868 - RNA, 13 nt, Escherichia coli CFT073
agauaaacaaccc

SEQ ID NO: 580869 - RNA, 18 nt, Escherichia coli CFT073
agaguugaaaaucucacg

SEQ ID NO: 580870 - RNA, 13 nt, Escherichia coli CFT073
agaguuugaacuc

SEQ ID NO: 580871 - RNA, 21 nt, Escherichia coli CFT073
agagccugaauaaacgccaua

SEQ ID NO: 580872 - RNA, 12 nt, Escherichia coli CFT073
agagcgccagua

SEQ ID NO: 580873 - RNA, 15 nt, Escherichia coli CFT073
agagcggagcaauga

SEQ ID NO: 580874 - RNA, 16 nt, Escherichia coli CFT073
agacugaugacaaacg

SEQ ID NO: 580875 - RNA, 14 nt, Escherichia coli CFT073
agacugaucaucgc

SEQ ID NO: 580876 - RNA, 16 nt, Escherichia coli CFT073
agacugaucaucgccc

SEQ ID NO: 580877 - RNA, 17 nt, Escherichia coli CFT073
agacuuuuugcggcagc

SEQ ID NO: 580878 - RNA, 22 nt, Escherichia coli CFT073
agagaaccagcgcacagagcac

SEQ ID NO: 580879 - RNA, 17 nt, Escherichia coli CFT073
agagaacugagcgauca

SEQ ID NO: 580880 - RNA, 15 nt, Escherichia coli CFT073
agagaagaaaaccga

SEQ ID NO: 580881 - RNA, 15 nt, Escherichia coli CFT073
agagaagagugacca

SEQ ID NO: 580882 - RNA, 17 nt, Escherichia coli CFT073
agacggugccaugcuga

SEQ ID NO: 580883 - RNA, 14 nt, Escherichia coli CFT073
agacguccggcgcu

SEQ ID NO: 580884 - RNA, 18 nt, Escherichia coli CFT073
agacucauuaaaacggau

SEQ ID NO: 580885 - RNA, 19 nt, Escherichia coli CFT073
agacucggugaccauccau

SEQ ID NO: 580886 - RNA, 21 nt, Escherichia coli CFT073
agacggcagaaguaguugcug

SEQ ID NO: 580887 - RNA, 16 nt, Escherichia coli CFT073
agacggcgcaacaucc

SEQ ID NO: 580888 - RNA, 16 nt, Escherichia coli CFT073
agacgcuugucaccgu

SEQ ID NO: 580889 - RNA, 21 nt, Escherichia coli CFT073
agacgcguuagcgucgcauca

SEQ ID NO: 580890 - RNA, 18 nt, Escherichia coli CFT073
agacgcucugcgguaucg

SEQ ID NO: 580891 - RNA, 23 nt, Escherichia coli CFT073
agacgcucugcgguaucggccau

SEQ ID NO: 580892 - RNA, 22 nt, Escherichia coli CFT073
agaccugcgcaucggucgcguu

SEQ ID NO: 580893 - RNA, 14 nt, Escherichia coli CFT073
agaccgcgcuugcc

SEQ ID NO: 580894 - RNA, 19 nt, Escherichia coli CFT073
agaccggagaaaagaccag

SEQ ID NO: 580895 - RNA, 20 nt, Escherichia coli CFT073
agaccggcaaucgcgccaga

SEQ ID NO: 580896 - RNA, 17 nt, Escherichia coli CFT073
agaccagcgaaaccuga

SEQ ID NO: 580897 - RNA, 16 nt, Escherichia coli CFT073
agaccaauccgccagc

SEQ ID NO: 580898 - RNA, 16 nt, Escherichia coli CFT073
agaccacauuccaggc

SEQ ID NO: 580899 - RNA, 19 nt, Escherichia coli CFT073
agacccacccaacaugguc

SEQ ID NO: 580900 - RNA, 19 nt, Escherichia coli CFT073
agaccgauagcagcccaga

SEQ ID NO: 580901 - RNA, 21 nt, Escherichia coli CFT073
agacgcgucaagcgucgcauc

SEQ ID NO: 580902 - RNA, 21 nt, Escherichia coli CFT073
agacgcggcaggcgucgcauc

SEQ ID NO: 580903 - RNA, 20 nt, Escherichia coli CFT073
agacgcgggcaaucggcugc

SEQ ID NO: 580904 - RNA, 22 nt, Escherichia coli CFT073
agacgcgucaagcgucgcaucc

SEQ ID NO: 580905 - RNA, 21 nt, Escherichia coli CFT073
agacgcgucagcgccgcaucc

SEQ ID NO: 580906 - RNA, 20 nt, Escherichia coli CFT073
agacgcgucugcgucgcauc

SEQ ID NO: 580907 - RNA, 21 nt, Escherichia coli CFT073
agacgcguuaagcgucgcauc

SEQ ID NO: 580908 - RNA, 14 nt, Escherichia coli CFT073
agacgcggcaagcg

SEQ ID NO: 580909 - RNA, 21 nt, Escherichia coli CFT073
agacgcggcaagcgucgcauc

SEQ ID NO: 580910 - RNA, 20 nt, Escherichia coli CFT073
agacgcggcagcgucgcauc

SEQ ID NO: 580911 - RNA, 21 nt, Escherichia coli CFT073
agacgcgccagcgucgcaucc

SEQ ID NO: 580912 - RNA, 14 nt, Escherichia coli CFT073
agacgcgccgccac

SEQ ID NO: 580913 - RNA, 17 nt, Escherichia coli CFT073
agacgcgccgccaccgc

SEQ ID NO: 580914 - RNA, 21 nt, Escherichia coli CFT073
agacgcggcagcgucgcauca

SEQ ID NO: 580915 - RNA, 21 nt, Escherichia coli CFT073
agacgcggcagcgucgcaucc

SEQ ID NO: 580916 - RNA, 20 nt, Escherichia coli CFT073
agacgcgccagcaucgcauc

SEQ ID NO: 580917 - RNA, 13 nt, Escherichia coli CFT073
agacgcgccagcg

SEQ ID NO: 580918 - RNA, 20 nt, Escherichia coli CFT073
agacgcgccagcgucgcauc

SEQ ID NO: 580919 - RNA, 21 nt, Escherichia coli CFT073
agacgcccgcgcccaggccau

SEQ ID NO: 580920 - RNA, 15 nt, Escherichia coli CFT073
agacgcaguacgcca

SEQ ID NO: 580921 - RNA, 20 nt, Escherichia coli CFT073
agacgcaucgcccagccauc

SEQ ID NO: 580922 - RNA, 13 nt, Escherichia coli CFT073
agacgacggcugc

SEQ ID NO: 580923 - RNA, 12 nt, Escherichia coli CFT073
agacgauuuucc

SEQ ID NO: 580924 - RNA, 21 nt, Escherichia coli CFT073
agacgcaaccagcgucgcauc

SEQ ID NO: 580925 - RNA, 12 nt, Escherichia coli CFT073
agaagccaccgc

SEQ ID NO: 580926 - RNA, 15 nt, Escherichia coli CFT073
agaagaucaugccga

SEQ ID NO: 580927 - RNA, 15 nt, Escherichia coli CFT073
agaagcgacugacgu

SEQ ID NO: 580928 - RNA, 15 nt, Escherichia coli CFT073
agaagcccaucagug

SEQ ID NO: 580929 - RNA, 12 nt, Escherichia coli CFT073
agaacugcugcg

SEQ ID NO: 580930 - RNA, 15 nt, Escherichia coli CFT073
agaagaaaacgcuau

SEQ ID NO: 580931 - RNA, 20 nt, Escherichia coli CFT073
agaagacaauccccgccagc

SEQ ID NO: 580932 - RNA, 15 nt, Escherichia coli CFT073
agaacgacgaccgcc

SEQ ID NO: 580933 - RNA, 20 nt, Escherichia coli CFT073
agaaccgguugccgguagcu

SEQ ID NO: 580934 - RNA, 18 nt, Escherichia coli CFT073
agaaccuaagaaccagaa

SEQ ID NO: 580935 - RNA, 22 nt, Escherichia coli CFT073
agaacguccgcaggaugagcgc

SEQ ID NO: 580936 - RNA, 14 nt, Escherichia coli CFT073
agaacuacccgguu

SEQ ID NO: 580937 - RNA, 12 nt, Escherichia coli CFT073
agaacgcugcaa

SEQ ID NO: 580938 - RNA, 16 nt, Escherichia coli CFT073
agaacguaaucaacgc

SEQ ID NO: 580939 - RNA, 17 nt, Escherichia coli CFT073
agaacagccccaacggu

SEQ ID NO: 580940 - RNA, 19 nt, Escherichia coli CFT073
agaacaugucauagcaaua

SEQ ID NO: 580941 - RNA, 13 nt, Escherichia coli CFT073
agaacauucauca

SEQ ID NO: 580942 - RNA, 18 nt, Escherichia coli CFT073
agaacauucaucauuuca

SEQ ID NO: 580943 - RNA, 13 nt, Escherichia coli CFT073
agaaaugaugggg

SEQ ID NO: 580944 - RNA, 15 nt, Escherichia coli CFT073
agaaauaccccgcca

SEQ ID NO: 580945 - RNA, 14 nt, Escherichia coli CFT073
agaaauauaaagaa

SEQ ID NO: 580946 - RNA, 18 nt, Escherichia coli CFT073
agaaauauugcagcgaug

SEQ ID NO: 580947 - RNA, 13 nt, Escherichia coli CFT073
agaaaucaacaaa

SEQ ID NO: 580948 - RNA, 14 nt, Escherichia coli CFT073
acuggaagacgcug

SEQ ID NO: 580949 - RNA, 18 nt, Escherichia coli CFT073
acugcuuuuugcucucgg

SEQ ID NO: 580950 - RNA, 13 nt, Escherichia coli CFT073
acuggaacaagcc

SEQ ID NO: 580951 - RNA, 12 nt, Escherichia coli CFT073
acugcugcgcca

SEQ ID NO: 580952 - RNA, 23 nt, Escherichia coli CFT073
agaccaaucccgccauaacggcu

SEQ ID NO: 580953 - RNA, 18 nt, Escherichia coli CFT073
agacaugcugacaaaaua

SEQ ID NO: 580954 - RNA, 23 nt, Escherichia coli CFT073
agacauacuggcuucgauaccgu

SEQ ID NO: 580955 - RNA, 19 nt, Escherichia coli CFT073
agacaucacucacgacaca

SEQ ID NO: 580956 - RNA, 17 nt, Escherichia coli CFT073
agacaucccuuuauuca

SEQ ID NO: 580957 - RNA, 21 nt, Escherichia coli CFT073
agacagaccaaaacgugcagc

SEQ ID NO: 580958 - RNA, 14 nt, Escherichia coli CFT073
agacagcgccaggc

SEQ ID NO: 580959 - RNA, 15 nt, Escherichia coli CFT073
agacagcgucacauc

SEQ ID NO: 580960 - RNA, 17 nt, Escherichia coli CFT073
agacacugcgaucgccc

SEQ ID NO: 580961 - RNA, 13 nt, Escherichia coli CFT073
agacaacauugau

SEQ ID NO: 580962 - RNA, 23 nt, Escherichia coli CFT073
agacaauccccgccagcguugcc

SEQ ID NO: 580963 - RNA, 19 nt, Escherichia coli CFT073
agacaaugcaaacggcgcg

SEQ ID NO: 580964 - RNA, 22 nt, Escherichia coli CFT073
agacacacugucaaucgcacgc

SEQ ID NO: 580965 - RNA, 14 nt, Escherichia coli CFT073
agaauuccggcaga

SEQ ID NO: 580966 - RNA, 21 nt, Escherichia coli CFT073
agaauuccgugccagcaccaa

SEQ ID NO: 580967 - RNA, 17 nt, Escherichia coli CFT073
agaauugaccaguaaua

SEQ ID NO: 580968 - RNA, 20 nt, Escherichia coli CFT073
agaauaguguuaaccgguac

SEQ ID NO: 580969 - RNA, 20 nt, Escherichia coli CFT073
agaauauuuuucaguaacgg

SEQ ID NO: 580970 - RNA, 23 nt, Escherichia coli CFT073
agaauauuuuucaguaacggcgc

SEQ ID NO: 580971 - RNA, 16 nt, Escherichia coli CFT073
agaaucaacgauguca

SEQ ID NO: 580972 - RNA, 16 nt, Escherichia coli CFT073
agaaucaaucucagcg

SEQ ID NO: 580973 - RNA, 18 nt, Escherichia coli CFT073
agaauccgcccucuucca

SEQ ID NO: 580974 - RNA, 22 nt, Escherichia coli CFT073
agaaucgagcaauaaacacugc

SEQ ID NO: 580975 - RNA, 21 nt, Escherichia coli CFT073
agaaucgccagcaucggcaac

SEQ ID NO: 580976 - RNA, 22 nt, Escherichia coli CFT073
agaaugaaugauacagaaagua

SEQ ID NO: 580977 - RNA, 16 nt, Escherichia coli CFT073
agaaugacgccguuaa

SEQ ID NO: 580978 - RNA, 19 nt, Escherichia coli CFT073
agaaugacgccguuaacag

SEQ ID NO: 580979 - RNA, 15 nt, Escherichia coli CFT073
agaaugccagcagca

SEQ ID NO: 580980 - RNA, 18 nt, Escherichia coli CFT073
agaaugacaucaucgccc

SEQ ID NO: 580981 - RNA, 18 nt, Escherichia coli CFT073
agaaucugccgcaguacg

SEQ ID NO: 580982 - RNA, 17 nt, Escherichia coli CFT073
agaauaaugaucccuuc

SEQ ID NO: 580983 - RNA, 15 nt, Escherichia coli CFT073
agaauaaugccuuua

SEQ ID NO: 580984 - RNA, 20 nt, Escherichia coli CFT073
agaauaagcuauaaaaaaac

SEQ ID NO: 580985 - RNA, 23 nt, Escherichia coli CFT073
agaagcuccgguacucaucagag

SEQ ID NO: 580986 - RNA, 15 nt, Escherichia coli CFT073
agaaguaaaacaguc

SEQ ID NO: 580987 - RNA, 19 nt, Escherichia coli CFT073
agauugucaauauccagca

SEQ ID NO: 580988 - RNA, 21 nt, Escherichia coli CFT073
agauugucaauauccagcagg

SEQ ID NO: 580989 - RNA, 18 nt, Escherichia coli CFT073
agauuuugcagaucacca

SEQ ID NO: 580990 - RNA, 17 nt, Escherichia coli CFT073
agauuuggugcgaaacg

SEQ ID NO: 580991 - RNA, 19 nt, Escherichia coli CFT073
agauaguuucacggcacca

SEQ ID NO: 580992 - RNA, 19 nt, Escherichia coli CFT073
agaucaggaaaaacggaau

SEQ ID NO: 580993 - RNA, 23 nt, Escherichia coli CFT073
agaucaugccgacaaacagcgua

SEQ ID NO: 580994 - RNA, 18 nt, Escherichia coli CFT073
agauccagcuucgccagc

SEQ ID NO: 580995 - RNA, 22 nt, Escherichia coli CFT073
agauugaugcgaguaaucaggc

SEQ ID NO: 580996 - RNA, 21 nt, Escherichia coli CFT073
agauccuggcgaaaacgcccg

SEQ ID NO: 580997 - RNA, 18 nt, Escherichia coli CFT073
agcaagccgucgugaaug

SEQ ID NO: 580998 - RNA, 15 nt, Escherichia coli CFT073
agcaagcgcaccgau

SEQ ID NO: 580999 - RNA, 14 nt, Escherichia coli CFT073
agcaaguaguccgc

SEQ ID NO: 581000 - RNA, 14 nt, Escherichia coli CFT073
agcaauaaaccaua

SEQ ID NO: 581001 - RNA, 22 nt, Escherichia coli CFT073
agcaauaaucagugccgcgccg

SEQ ID NO: 581002 - RNA, 14 nt, Escherichia coli CFT073
agcaauaauuucaa

SEQ ID NO: 581003 - RNA, 21 nt, Escherichia coli CFT073
agcaaagugugugcgggcauu

SEQ ID NO: 581004 - RNA, 21 nt, Escherichia coli CFT073
agcaagaguuuuaaaaccauu

SEQ ID NO: 581005 - RNA, 18 nt, Escherichia coli CFT073
agcaaaccgccgauggcc

SEQ ID NO: 581006 - RNA, 16 nt, Escherichia coli CFT073
agcaaacgccgaggca

SEQ ID NO: 581007 - RNA, 23 nt, Escherichia coli CFT073
agcacaucaccuuguuucagcgc

SEQ ID NO: 581008 - RNA, 11 nt, Escherichia coli CFT073
agcacaucagc

SEQ ID NO: 581009 - RNA, 20 nt, Escherichia coli CFT073
agcacagccagugauuccgg

SEQ ID NO: 581010 - RNA, 15 nt, Escherichia coli CFT073
agcaauagcgcaauc

SEQ ID NO: 581011 - RNA, 16 nt, Escherichia coli CFT073
agcaauacguuucaua

SEQ ID NO: 581012 - RNA, 15 nt, Escherichia coli CFT073
agcacaaacaauuug

SEQ ID NO: 581013 - RNA, 20 nt, Escherichia coli CFT073
agcacaccugcaacggcauc

SEQ ID NO: 581014 - RNA, 15 nt, Escherichia coli CFT073
agcagaaccagggaa

SEQ ID NO: 581015 - RNA, 23 nt, Escherichia coli CFT073
agcacuguucgccgcagccagau

SEQ ID NO: 581016 - RNA, 20 nt, Escherichia coli CFT073
agcacuucacccaucgccag

SEQ ID NO: 581017 - RNA, 15 nt, Escherichia coli CFT073
agcacuggcggcagc

SEQ ID NO: 581018 - RNA, 21 nt, Escherichia coli CFT073
agcacgcuuagcuuuggugcc

SEQ ID NO: 581019 - RNA, 13 nt, Escherichia coli CFT073
agcacggcagcaa

SEQ ID NO: 581020 - RNA, 20 nt, Escherichia coli CFT073
agcacugacauuauccggcu

SEQ ID NO: 581021 - RNA, 13 nt, Escherichia coli CFT073
agcacgccagaca

SEQ ID NO: 581022 - RNA, 19 nt, Escherichia coli CFT073
agcacgaagaggccgccgu

SEQ ID NO: 581023 - RNA, 21 nt, Escherichia coli CFT073
agcacgaccgccauuaaacgc

SEQ ID NO: 581024 - RNA, 16 nt, Escherichia coli CFT073
agcaccugcaucacgc

SEQ ID NO: 581025 - RNA, 21 nt, Escherichia coli CFT073
agcaccugcuugaacgcaccg

SEQ ID NO: 581026 - RNA, 13 nt, Escherichia coli CFT073
agcaccugaaucc

SEQ ID NO: 581027 - RNA, 18 nt, Escherichia coli CFT073
agcaccacggaguaaccu

SEQ ID NO: 581028 - RNA, 14 nt, Escherichia coli CFT073
agcaccaccgcccg

SEQ ID NO: 581029 - RNA, 16 nt, Escherichia coli CFT073
agcaucgcaucaggcu

SEQ ID NO: 581030 - RNA, 18 nt, Escherichia coli CFT073
agcaucggcaacgccagc

SEQ ID NO: 581031 - RNA, 15 nt, Escherichia coli CFT073
agcaucggccugcaa

SEQ ID NO: 581032 - RNA, 13 nt, Escherichia coli CFT073
agcaucucaucca

SEQ ID NO: 581033 - RNA, 22 nt, Escherichia coli CFT073
agcaucuguucuuucaacacau

SEQ ID NO: 581034 - RNA, 15 nt, Escherichia coli CFT073
agcaugugcaauuuc

SEQ ID NO: 581035 - RNA, 16 nt, Escherichia coli CFT073
agcaugguaacgcccc

SEQ ID NO: 581036 - RNA, 24 nt, Escherichia coli CFT073
agcauucaucacaaaauagaaauu

SEQ ID NO: 581037 - RNA, 16 nt, Escherichia coli CFT073
agcauucccgccacca

SEQ ID NO: 581038 - RNA, 20 nt, Escherichia coli CFT073
agccacacugcggccagcau

SEQ ID NO: 581039 - RNA, 22 nt, Escherichia coli CFT073
agccacauccaugcuuguuuau

SEQ ID NO: 581040 - RNA, 14 nt, Escherichia coli CFT073
agccacaucgccau

SEQ ID NO: 581041 - RNA, 17 nt, Escherichia coli CFT073
agcauaacguggcgcga

SEQ ID NO: 581042 - RNA, 13 nt, Escherichia coli CFT073
agcauaccuucac

SEQ ID NO: 581043 - RNA, 14 nt, Escherichia coli CFT073
agcauaaucaccag

SEQ ID NO: 581044 - RNA, 17 nt, Escherichia coli CFT073
agcaguggaucgaacuc

SEQ ID NO: 581045 - RNA, 14 nt, Escherichia coli CFT073
agcaggcauccuga

SEQ ID NO: 581046 - RNA, 18 nt, Escherichia coli CFT073
agcaggaugacauaaccu

SEQ ID NO: 581047 - RNA, 21 nt, Escherichia coli CFT073
agcagcguuuuguagaccuga

SEQ ID NO: 581048 - RNA, 14 nt, Escherichia coli CFT073
agcagcuccggcuc

SEQ ID NO: 581049 - RNA, 16 nt, Escherichia coli CFT073
agcagauccaucgccu

SEQ ID NO: 581050 - RNA, 19 nt, Escherichia coli CFT073
agcagauccaucgccuggg

SEQ ID NO: 581051 - RNA, 17 nt, Escherichia coli CFT073
agcagcaauauguugau

SEQ ID NO: 581052 - RNA, 18 nt, Escherichia coli CFT073
agcagcaauauguugaua

SEQ ID NO: 581053 - RNA, 15 nt, Escherichia coli CFT073
agcagcacagccaga

SEQ ID NO: 581054 - RNA, 22 nt, Escherichia coli CFT073
agcagcaaacgccgaggcaaug

SEQ ID NO: 581055 - RNA, 23 nt, Escherichia coli CFT073
agcagauucaacauaaucggcgc

SEQ ID NO: 581056 - RNA, 13 nt, Escherichia coli CFT073
agcagcacccgau

SEQ ID NO: 581057 - RNA, 12 nt, Escherichia coli CFT073
agcagcgcaauu

SEQ ID NO: 581058 - RNA, 22 nt, Escherichia coli CFT073
agcagcgacucacgaaucgccu

SEQ ID NO: 581059 - RNA, 23 nt, Escherichia coli CFT073
aguagaacgggaagugcgcccag

SEQ ID NO: 581060 - RNA, 14 nt, Escherichia coli CFT073
aguagagcgaaacg

SEQ ID NO: 581061 - RNA, 12 nt, Escherichia coli CFT073
aguacgggcaau

SEQ ID NO: 581062 - RNA, 22 nt, Escherichia coli CFT073
aguacguaaaacaagaucgccc

SEQ ID NO: 581063 - RNA, 21 nt, Escherichia coli CFT073
aguacguucacgcagcucacg

SEQ ID NO: 581064 - RNA, 20 nt, Escherichia coli CFT073
aguagcgcagcagauaaaag

SEQ ID NO: 581065 - RNA, 21 nt, Escherichia coli CFT073
aguagcaaaacucaccauccu

SEQ ID NO: 581066 - RNA, 23 nt, Escherichia coli CFT073
aguagcaaccggauuuuuaugac

SEQ ID NO: 581067 - RNA, 17 nt, Escherichia coli CFT073
aguagcagcaggaauaa

SEQ ID NO: 581068 - RNA, 18 nt, Escherichia coli CFT073
aguacgcaguugcugacg

SEQ ID NO: 581069 - RNA, 19 nt, Escherichia coli CFT073
aguacgauacaaaagcacc

SEQ ID NO: 581070 - RNA, 20 nt, Escherichia coli CFT073
agucacaggggaggaacaau

SEQ ID NO: 581071 - RNA, 21 nt, Escherichia coli CFT073
agucacugccaccauccccac

SEQ ID NO: 581072 - RNA, 17 nt, Escherichia coli CFT073
agucccaaacagcagaa

SEQ ID NO: 581073 - RNA, 15 nt, Escherichia coli CFT073
aguccaucggcauua

SEQ ID NO: 581074 - RNA, 20 nt, Escherichia coli CFT073
aguccagcaccgucaccggu

SEQ ID NO: 581075 - RNA, 15 nt, Escherichia coli CFT073
agucacuuccugauc

SEQ ID NO: 581076 - RNA, 16 nt, Escherichia coli CFT073
agucagcgcgaaaucg

SEQ ID NO: 581077 - RNA, 19 nt, Escherichia coli CFT073
agucagcgcgaaaucgccc

SEQ ID NO: 581078 - RNA, 13 nt, Escherichia coli CFT073
agucgucauccca

SEQ ID NO: 581079 - RNA, 14 nt, Escherichia coli CFT073
agucgucaucccag

SEQ ID NO: 581080 - RNA, 21 nt, Escherichia coli CFT073
agucguaaugaaucagcagau

SEQ ID NO: 581081 - RNA, 22 nt, Escherichia coli CFT073
agucgggucgccguaagcaaac

SEQ ID NO: 581082 - RNA, 23 nt, Escherichia coli CFT073
agucggcuucuggccucgcuuug

SEQ ID NO: 581083 - RNA, 22 nt, Escherichia coli CFT073
agugaaaacgcauaccagucga

SEQ ID NO: 581084 - RNA, 13 nt, Escherichia coli CFT073
agugaaguaauaa

SEQ ID NO: 581085 - RNA, 20 nt, Escherichia coli CFT073
agugaaguaauaaucaacgc

SEQ ID NO: 581086 - RNA, 19 nt, Escherichia coli CFT073
agucuggugcugcgcuucg

SEQ ID NO: 581087 - RNA, 18 nt, Escherichia coli CFT073
agucuggaagaccagcga

SEQ ID NO: 581088 - RNA, 23 nt, Escherichia coli CFT073
agucugcauuuucucgcgaaccg

SEQ ID NO: 581089 - RNA, 21 nt, Escherichia coli CFT073
agucucaagagugaacacgua

SEQ ID NO: 581090 - RNA, 21 nt, Escherichia coli CFT073
  misc_feature (8)..(8): n is a, c, g or u
agucucangagugaacacgua

SEQ ID NO: 581091 - RNA, 21 nt, Escherichia coli CFT073
agucucuucuuugcagggagg

SEQ ID NO: 581092 - RNA, 15 nt, Escherichia coli CFT073
aguccucaucauccu

SEQ ID NO: 581093 - RNA, 16 nt, Escherichia coli CFT073
agucgccuaccaucaa

SEQ ID NO: 581094 - RNA, 20 nt, Escherichia coli CFT073
agucgcccgaccaucgccag

SEQ ID NO: 581095 - RNA, 18 nt, Escherichia coli CFT073
agucgcuuucauucagaa

SEQ ID NO: 581096 - RNA, 14 nt, Escherichia coli CFT073
agucgcgcgcggug

SEQ ID NO: 581097 - RNA, 19 nt, Escherichia coli CFT073
agucgcgcucaucagcggc

SEQ ID NO: 581098 - RNA, 23 nt, Escherichia coli CFT073
agucgcgcuucguuuuccgccac

SEQ ID NO: 581099 - RNA, 19 nt, Escherichia coli CFT073
aguuaaagcaauuccagcg

SEQ ID NO: 581100 - RNA, 20 nt, Escherichia coli CFT073
aguuaacuggucgauauuga

SEQ ID NO: 581101 - RNA, 23 nt, Escherichia coli CFT073
aguuaacuggucgauauugaccu

SEQ ID NO: 581102 - RNA, 16 nt, Escherichia coli CFT073
aguuacauuuuuaucg

SEQ ID NO: 581103 - RNA, 14 nt, Escherichia coli CFT073
aguuacccagcgga

SEQ ID NO: 581104 - RNA, 14 nt, Escherichia coli CFT073
aguuacgaaaagga

SEQ ID NO: 581105 - RNA, 17 nt, Escherichia coli CFT073
aguuacgaaaaggauaa

SEQ ID NO: 581106 - RNA, 23 nt, Escherichia coli CFT073
aguuacgaaaaggauaaauaaaa

SEQ ID NO: 581107 - RNA, 17 nt, Escherichia coli CFT073
aguuacguuuaugccac

SEQ ID NO: 581108 - RNA, 14 nt, Escherichia coli CFT073
aguuagcguccggc

SEQ ID NO: 581109 - RNA, 19 nt, Escherichia coli CFT073
aguuaucaaauucauugcg

SEQ ID NO: 581110 - RNA, 21 nt, Escherichia coli CFT073
aguuauucccguggccugcau

SEQ ID NO: 581111 - RNA, 15 nt, Escherichia coli CFT073
aguucaaacggcguu

SEQ ID NO: 581112 - RNA, 17 nt, Escherichia coli CFT073
aguguuuuauaccaaca

SEQ ID NO: 581113 - RNA, 14 nt, Escherichia coli CFT073
aguguggccgccag

SEQ ID NO: 581114 - RNA, 17 nt, Escherichia coli CFT073
aguguucgaccaccggu

SEQ ID NO: 581115 - RNA, 21 nt, Escherichia coli CFT073
aguggcgcagagccugaauaa

SEQ ID NO: 581116 - RNA, 20 nt, Escherichia coli CFT073
aguggcggcauugacaucag

SEQ ID NO: 581117 - RNA, 23 nt, Escherichia coli CFT073
aguggcuaagcaggcuggcgacg

SEQ ID NO: 581118 - RNA, 20 nt, Escherichia coli CFT073
aguggcuuaucuuccuguuc

SEQ ID NO: 581119 - RNA, 16 nt, Escherichia coli CFT073
aguggcuuugccguuc

SEQ ID NO: 581120 - RNA, 13 nt, Escherichia coli CFT073
aguuucgacauca

SEQ ID NO: 581121 - RNA, 17 nt, Escherichia coli CFT073
aguuucgaucagcaauu

SEQ ID NO: 581122 - RNA, 13 nt, Escherichia coli CFT073
aguuucgggauca

SEQ ID NO: 581123 - RNA, 15 nt, Escherichia coli CFT073
aguuucgggaucauc

SEQ ID NO: 581124 - RNA, 16 nt, Escherichia coli CFT073
aguuucgugcccgcgu

SEQ ID NO: 581125 - RNA, 21 nt, Escherichia coli CFT073
aguuucguuaaacgccaaacu

SEQ ID NO: 581126 - RNA, 22 nt, Escherichia coli CFT073
aguuggcugugguacugccgac

SEQ ID NO: 581127 - RNA, 19 nt, Escherichia coli CFT073
aguugguagagcacgaccu

SEQ ID NO: 581128 - RNA, 21 nt, Escherichia coli CFT073
aguugcugacgaucggcaucg

SEQ ID NO: 581129 - RNA, 22 nt, Escherichia coli CFT073
aguucacacaagguauccagac

SEQ ID NO: 581130 - RNA, 14 nt, Escherichia coli CFT073
aguucgcaaucgcg

SEQ ID NO: 581131 - RNA, 15 nt, Escherichia coli CFT073
aguucgcaaucgcgc

SEQ ID NO: 581132 - RNA, 22 nt, Escherichia coli CFT073
aguggcacuaauuaagacugau

SEQ ID NO: 581133 - RNA, 18 nt, Escherichia coli CFT073
agugcggugccgcgaacg

SEQ ID NO: 581134 - RNA, 20 nt, Escherichia coli CFT073
agugcugaguuucagaccaa

SEQ ID NO: 581135 - RNA, 15 nt, Escherichia coli CFT073
agugcgaggaucauc

SEQ ID NO: 581136 - RNA, 17 nt, Escherichia coli CFT073
agugccguggcaggcaa

SEQ ID NO: 581137 - RNA, 19 nt, Escherichia coli CFT073
agugccugcacaaccggaa

SEQ ID NO: 581138 - RNA, 12 nt, Escherichia coli CFT073
agugcgccaguc

SEQ ID NO: 581139 - RNA, 19 nt, Escherichia coli CFT073
agugcggcgagcaucgccc

SEQ ID NO: 581140 - RNA, 21 nt, Escherichia coli CFT073
agugcggcuguuggugccaga

SEQ ID NO: 581141 - RNA, 19 nt, Escherichia coli CFT073
agugccgccugcgccagug

SEQ ID NO: 581142 - RNA, 22 nt, Escherichia coli CFT073
agugccgcagcggcgguuucuu

SEQ ID NO: 581143 - RNA, 20 nt, Escherichia coli CFT073
agugccgccagcuucgcuuc

SEQ ID NO: 581144 - RNA, 21 nt, Escherichia coli CFT073
agugccccucacgcuuuauuu

SEQ ID NO: 581145 - RNA, 15 nt, Escherichia coli CFT073
agugcccguccccug

SEQ ID NO: 581146 - RNA, 17 nt, Escherichia coli CFT073
agugccccaaaugucgg

SEQ ID NO: 581147 - RNA, 20 nt, Escherichia coli CFT073
agugccccaaaugucggaug

SEQ ID NO: 581148 - RNA, 13 nt, Escherichia coli CFT073
agugccacgcccc

SEQ ID NO: 581149 - RNA, 16 nt, Escherichia coli CFT073
agugcagauaccacca

SEQ ID NO: 581150 - RNA, 14 nt, Escherichia coli CFT073
agugcagaucgcca

SEQ ID NO: 581151 - RNA, 14 nt, Escherichia coli CFT073
agugcagccauuuu

SEQ ID NO: 581152 - RNA, 15 nt, Escherichia coli CFT073
agugaucgccugcau

SEQ ID NO: 581153 - RNA, 12 nt, Escherichia coli CFT073
agugaucagcca

SEQ ID NO: 581154 - RNA, 14 nt, Escherichia coli CFT073
agugauaaccacgc

SEQ ID NO: 581155 - RNA, 13 nt, Escherichia coli CFT073
agugauuccguuc

SEQ ID NO: 581156 - RNA, 15 nt, Escherichia coli CFT073
agugaauuucuacgu

SEQ ID NO: 581157 - RNA, 21 nt, Escherichia coli CFT073
agugacaugaaugucauacca

SEQ ID NO: 581158 - RNA, 13 nt, Escherichia coli CFT073
agugacgccgcca

SEQ ID NO: 581159 - RNA, 13 nt, Escherichia coli CFT073
agugagaucauua

SEQ ID NO: 581160 - RNA, 20 nt, Escherichia coli CFT073
auaucuaaugccauuaacau

SEQ ID NO: 581161 - RNA, 21 nt, Escherichia coli CFT073
auaucuaaugccauuaacauc

SEQ ID NO: 581162 - RNA, 12 nt, Escherichia coli CFT073
auaucucgccuu

SEQ ID NO: 581163 - RNA, 12 nt, Escherichia coli CFT073
auaucggcagcg

SEQ ID NO: 581164 - RNA, 15 nt, Escherichia coli CFT073
auaucuucacgauua

SEQ ID NO: 581165 - RNA, 12 nt, Escherichia coli CFT073
auaucugugcuu

SEQ ID NO: 581166 - RNA, 14 nt, Escherichia coli CFT073
auaugaaauccggc

SEQ ID NO: 581167 - RNA, 15 nt, Escherichia coli CFT073
auaugaacuugcuca

SEQ ID NO: 581168 - RNA, 20 nt, Escherichia coli CFT073
auauucaucaaaaugaacau

SEQ ID NO: 581169 - RNA, 16 nt, Escherichia coli CFT073
auauucaucagcauca

SEQ ID NO: 581170 - RNA, 20 nt, Escherichia coli CFT073
auauucccccaccgccgccg

SEQ ID NO: 581171 - RNA, 19 nt, Escherichia coli CFT073
auauucaauucgucuauca

SEQ ID NO: 581172 - RNA, 23 nt, Escherichia coli CFT073
auauucacguuuuucauccagcg

SEQ ID NO: 581173 - RNA, 16 nt, Escherichia coli CFT073
auauucguuaucguac

SEQ ID NO: 581174 - RNA, 18 nt, Escherichia coli CFT073
auauucggcuccagauua

SEQ ID NO: 581175 - RNA, 20 nt, Escherichia coli CFT073
auauucugcggcuucagcga

SEQ ID NO: 581176 - RNA, 19 nt, Escherichia coli CFT073
auauugagauccauuauga

SEQ ID NO: 581177 - RNA, 17 nt, Escherichia coli CFT073
auauaaaccgccgacgc

SEQ ID NO: 581178 - RNA, 13 nt, Escherichia coli CFT073
auauaaacgacag

SEQ ID NO: 581179 - RNA, 13 nt, Escherichia coli CFT073
auauaggcaccgu

SEQ ID NO: 581180 - RNA, 15 nt, Escherichia coli CFT073
auauagaucauaucg

SEQ ID NO: 581181 - RNA, 14 nt, Escherichia coli CFT073
auauacaaccaaua

SEQ ID NO: 581182 - RNA, 14 nt, Escherichia coli CFT073
auauaccgcaucag

SEQ ID NO: 581183 - RNA, 18 nt, Escherichia coli CFT073
auauauuuaguucauaua

SEQ ID NO: 581184 - RNA, 14 nt, Escherichia coli CFT073
auaucgaauggcgu

SEQ ID NO: 581185 - RNA, 20 nt, Escherichia coli CFT073
auauccuccggcauagccgg

SEQ ID NO: 581186 - RNA, 19 nt, Escherichia coli CFT073
auauccugagucggaacuu

SEQ ID NO: 581187 - RNA, 21 nt, Escherichia coli CFT073
auaucgauaaagaacgcaccg

SEQ ID NO: 581188 - RNA, 23 nt, Escherichia coli CFT073
auaucgacgccaguuugaccaua

SEQ ID NO: 581189 - RNA, 23 nt, Escherichia coli CFT073
auaucgccuuuugcccggcaaca

SEQ ID NO: 581190 - RNA, 14 nt, Escherichia coli CFT073
auaucgcggcacag

SEQ ID NO: 581191 - RNA, 16 nt, Escherichia coli CFT073
auaucgcugucgccac

SEQ ID NO: 581192 - RNA, 15 nt, Escherichia coli CFT073
auaguguugccgcca

SEQ ID NO: 581193 - RNA, 14 nt, Escherichia coli CFT073
auaguggaguauga

SEQ ID NO: 581194 - RNA, 17 nt, Escherichia coli CFT073
auagucagugaagccau

SEQ ID NO: 581195 - RNA, 17 nt, Escherichia coli CFT073
auaguccggcaccagcg

SEQ ID NO: 581196 - RNA, 22 nt, Escherichia coli CFT073
auaguaaaaggcaccauaacua

SEQ ID NO: 581197 - RNA, 14 nt, Escherichia coli CFT073
auaguacgggcaau

SEQ ID NO: 581198 - RNA, 15 nt, Escherichia coli CFT073
auagucaaauacgcc

SEQ ID NO: 581199 - RNA, 17 nt, Escherichia coli CFT073
auaggcaggcaucauca

SEQ ID NO: 581200 - RNA, 17 nt, Escherichia coli CFT073
auaggcaaaaaaaugcc

SEQ ID NO: 581201 - RNA, 16 nt, Escherichia coli CFT073
auacggcaacagccga

SEQ ID NO: 581202 - RNA, 21 nt, Escherichia coli CFT073
auacgguuuuuugaacagacc

SEQ ID NO: 581203 - RNA, 20 nt, Escherichia coli CFT073
auagaaccuaagaaccagaa

SEQ ID NO: 581204 - RNA, 12 nt, Escherichia coli CFT073
auagacagccac

SEQ ID NO: 581205 - RNA, 14 nt, Escherichia coli CFT073
auagaccaucggcg

SEQ ID NO: 581206 - RNA, 19 nt, Escherichia coli CFT073
auagcuucuuccacauugu

SEQ ID NO: 581207 - RNA, 15 nt, Escherichia coli CFT073
auagcuuuggcggca

SEQ ID NO: 581208 - RNA, 21 nt, Escherichia coli CFT073
auagcuuuugcggucgccuuu

SEQ ID NO: 581209 - RNA, 13 nt, Escherichia coli CFT073
auagcucaacagu

SEQ ID NO: 581210 - RNA, 21 nt, Escherichia coli CFT073
auagcugccagccccucagcg

SEQ ID NO: 581211 - RNA, 23 nt, Escherichia coli CFT073
auagcugccagccccucagcggu

SEQ ID NO: 581212 - RNA, 22 nt, Escherichia coli CFT073
auagcgguaaaugacgggccaa

SEQ ID NO: 581213 - RNA, 15 nt, Escherichia coli CFT073
auagcguaaagccag

SEQ ID NO: 581214 - RNA, 20 nt, Escherichia coli CFT073
auacgggaggucaucagcgc

SEQ ID NO: 581215 - RNA, 22 nt, Escherichia coli CFT073
auacgggccuagugcgguaaau

SEQ ID NO: 581216 - RNA, 23 nt, Escherichia coli CFT073
auacgggucgcaaacaacgccac

SEQ ID NO: 581217 - RNA, 18 nt, Escherichia coli CFT073
auacgcuguggcgcuggc

SEQ ID NO: 581218 - RNA, 17 nt, Escherichia coli CFT073
auacgcuuucagcacuu

SEQ ID NO: 581219 - RNA, 22 nt, Escherichia coli CFT073
auacgccucacagagcgcuuau

SEQ ID NO: 581220 - RNA, 22 nt, Escherichia coli CFT073
auacgcggcaacaagauuagcc

SEQ ID NO: 581221 - RNA, 14 nt, Escherichia coli CFT073
auacgcccgguggc

SEQ ID NO: 581222 - RNA, 23 nt, Escherichia coli CFT073
auacgcaccacaccgucgccuuu

SEQ ID NO: 581223 - RNA, 13 nt, Escherichia coli CFT073
auaccgucagcga

SEQ ID NO: 581224 - RNA, 18 nt, Escherichia coli CFT073
auaccguucauuaacgcc

SEQ ID NO: 581225 - RNA, 12 nt, Escherichia coli CFT073
auaccggcaucc

SEQ ID NO: 581226 - RNA, 22 nt, Escherichia coli CFT073
auaccguaaaacucacaaccag

SEQ ID NO: 581227 - RNA, 20 nt, Escherichia coli CFT073
auaccguaacgacugcggau

SEQ ID NO: 581228 - RNA, 14 nt, Escherichia coli CFT073
auaccuaccugcag

SEQ ID NO: 581229 - RNA, 12 nt, Escherichia coli CFT073
auaccugaaacu

SEQ ID NO: 581230 - RNA, 20 nt, Escherichia coli CFT073
auaccuuccggcguuucgcc

SEQ ID NO: 581231 - RNA, 19 nt, Escherichia coli CFT073
auaccuucuuccugcgcca

SEQ ID NO: 581232 - RNA, 18 nt, Escherichia coli CFT073
auaaucaaauacaccaca

SEQ ID NO: 581233 - RNA, 21 nt, Escherichia coli CFT073
auaauauuuaucuucccagcc

SEQ ID NO: 581234 - RNA, 21 nt, Escherichia coli CFT073
auaauuucuucguucgccgca

SEQ ID NO: 581235 - RNA, 20 nt, Escherichia coli CFT073
auaauuuuucuuuaacaucg

SEQ ID NO: 581236 - RNA, 12 nt, Escherichia coli CFT073
auaccaaaauca

SEQ ID NO: 581237 - RNA, 19 nt, Escherichia coli CFT073
auaccaaaaucuaccagcg

SEQ ID NO: 581238 - RNA, 19 nt, Escherichia coli CFT073
auacauugcggaccagcgg

SEQ ID NO: 581239 - RNA, 13 nt, Escherichia coli CFT073
auacauguauaaa

SEQ ID NO: 581240 - RNA, 21 nt, Escherichia coli CFT073
auacauuuauuucaacgacau

SEQ ID NO: 581241 - RNA, 21 nt, Escherichia coli CFT073
auaccaagcccgaugaucauc

SEQ ID NO: 581242 - RNA, 14 nt, Escherichia coli CFT073
auaccaaucgcagg

SEQ ID NO: 581243 - RNA, 20 nt, Escherichia coli CFT073
auaccaaugaauuuucgccc

SEQ ID NO: 581244 - RNA, 13 nt, Escherichia coli CFT073
auaccacccgcag

SEQ ID NO: 581245 - RNA, 14 nt, Escherichia coli CFT073
auaccacccgcagu

SEQ ID NO: 581246 - RNA, 23 nt, Escherichia coli CFT073
auaccacccuugcccaccagccg

SEQ ID NO: 581247 - RNA, 20 nt, Escherichia coli CFT073
auaccacguucucugauacu

SEQ ID NO: 581248 - RNA, 18 nt, Escherichia coli CFT073
auaccagauaaacaucgg

SEQ ID NO: 581249 - RNA, 14 nt, Escherichia coli CFT073
auaccagcagcauc

SEQ ID NO: 581250 - RNA, 19 nt, Escherichia coli CFT073
auaccggacgacggcaucg

SEQ ID NO: 581251 - RNA, 23 nt, Escherichia coli CFT073
auaccagccuucuucauccagcg

SEQ ID NO: 581252 - RNA, 16 nt, Escherichia coli CFT073
auaccaguaauaagcc

SEQ ID NO: 581253 - RNA, 19 nt, Escherichia coli CFT073
auaaccuguuaaugcgaau

SEQ ID NO: 581254 - RNA, 17 nt, Escherichia coli CFT073
auaaccuguugaccaag

SEQ ID NO: 581255 - RNA, 22 nt, Escherichia coli CFT073
auaaccgguuacggauuucccg

SEQ ID NO: 581256 - RNA, 13 nt, Escherichia coli CFT073
auaaccggcaagc

SEQ ID NO: 581257 - RNA, 22 nt, Escherichia coli CFT073
auaaccgaagaagcuuuucggg

SEQ ID NO: 581258 - RNA, 23 nt, Escherichia coli CFT073
auaaccgagcagauacugaugaa

SEQ ID NO: 581259 - RNA, 17 nt, Escherichia coli CFT073
auaacgguauugcuuuc

SEQ ID NO: 581260 - RNA, 12 nt, Escherichia coli CFT073
auaacgcgcgcg

SEQ ID NO: 581261 - RNA, 14 nt, Escherichia coli CFT073
auaacgcggcagga

SEQ ID NO: 581262 - RNA, 16 nt, Escherichia coli CFT073
auaacgcguucacccg

SEQ ID NO: 581263 - RNA, 17 nt, Escherichia coli CFT073
auaacaggcuaccgcag

SEQ ID NO: 581264 - RNA, 18 nt, Escherichia coli CFT073
auaacagugauugcuuuu

SEQ ID NO: 581265 - RNA, 21 nt, Escherichia coli CFT073
auaaccaucgcuacauaacgc

SEQ ID NO: 581266 - RNA, 20 nt, Escherichia coli CFT073
auaaccaugcagcgccgcgu

SEQ ID NO: 581267 - RNA, 16 nt, Escherichia coli CFT073
auaaccauggcuggca

SEQ ID NO: 581268 - RNA, 20 nt, Escherichia coli CFT073
auaaccauggcuggcaccug

SEQ ID NO: 581269 - RNA, 10 nt, Escherichia coli CFT073
auaacccagc

SEQ ID NO: 581270 - RNA, 22 nt, Escherichia coli CFT073
aguuucucgcggguaucgguga

SEQ ID NO: 581271 - RNA, 20 nt, Escherichia coli CFT073
aguuugggcguuacagcugg

SEQ ID NO: 581272 - RNA, 13 nt, Escherichia coli CFT073
auaaggguacgaa

SEQ ID NO: 581273 - RNA, 13 nt, Escherichia coli CFT073
auaagugaagacc

SEQ ID NO: 581274 - RNA, 14 nt, Escherichia coli CFT073
auaauacccagcaa

SEQ ID NO: 581275 - RNA, 17 nt, Escherichia coli CFT073
auaauacccagcaacga

SEQ ID NO: 581276 - RNA, 19 nt, Escherichia coli CFT073
auaauacugacaaaaccga

SEQ ID NO: 581277 - RNA, 19 nt, Escherichia coli CFT073
auaauagagcuugugcacc

SEQ ID NO: 581278 - RNA, 16 nt, Escherichia coli CFT073
auaauagauuugcgaa

SEQ ID NO: 581279 - RNA, 13 nt, Escherichia coli CFT073
auaagacgcgcca

SEQ ID NO: 581280 - RNA, 16 nt, Escherichia coli CFT073
auaagacgcgccagca

SEQ ID NO: 581281 - RNA, 16 nt, Escherichia coli CFT073
auaagacgcggcagcg

SEQ ID NO: 581282 - RNA, 23 nt, Escherichia coli CFT073
auaagacgcggcccgcgucgcau

SEQ ID NO: 581283 - RNA, 23 nt, Escherichia coli CFT073
auaagacgcguuaagcgucgcau

SEQ ID NO: 581284 - RNA, 17 nt, Escherichia coli CFT073
auaagauaacccugcau

SEQ ID NO: 581285 - RNA, 22 nt, Escherichia coli CFT073
auaagguacggcccguacugaa

SEQ ID NO: 581286 - RNA, 20 nt, Escherichia coli CFT073
auaagguguucacgccgcau

SEQ ID NO: 581287 - RNA, 15 nt, Escherichia coli CFT073
auaacguccaguuga

SEQ ID NO: 581288 - RNA, 18 nt, Escherichia coli CFT073
auaacgucgccagaaauc

SEQ ID NO: 581289 - RNA, 21 nt, Escherichia coli CFT073
auaacuauaugacucauaaaa

SEQ ID NO: 581290 - RNA, 19 nt, Escherichia coli CFT073
auaacucuccuguuuaaua

SEQ ID NO: 581291 - RNA, 14 nt, Escherichia coli CFT073
auaacugcccgcau

SEQ ID NO: 581292 - RNA, 17 nt, Escherichia coli CFT073
auaacuuugaucgcguu

SEQ ID NO: 581293 - RNA, 22 nt, Escherichia coli CFT073
aggcgucagccaaucacaucag

SEQ ID NO: 581294 - RNA, 21 nt, Escherichia coli CFT073
aggcugaaaaucuucucucau

SEQ ID NO: 581295 - RNA, 14 nt, Escherichia coli CFT073
aggcuggcugaccc

SEQ ID NO: 581296 - RNA, 14 nt, Escherichia coli CFT073
aggcgcgacacggc

SEQ ID NO: 581297 - RNA, 22 nt, Escherichia coli CFT073
aggcggcucuggcggcgcgaua

SEQ ID NO: 581298 - RNA, 18 nt, Escherichia coli CFT073
aggccugauaagacgcaa

SEQ ID NO: 581299 - RNA, 12 nt, Escherichia coli CFT073
aggccucuccuc

SEQ ID NO: 581300 - RNA, 21 nt, Escherichia coli CFT073
aggccugauuaaacgccugau

SEQ ID NO: 581301 - RNA, 18 nt, Escherichia coli CFT073
aggcgaagacaaaaccaa

SEQ ID NO: 581302 - RNA, 18 nt, Escherichia coli CFT073
aggcgcaggguuugcauc

SEQ ID NO: 581303 - RNA, 19 nt, Escherichia coli CFT073
aggcgcagaacuucacucu

SEQ ID NO: 581304 - RNA, 22 nt, Escherichia coli CFT073
agggcgaucuuccgaccgcccu

SEQ ID NO: 581305 - RNA, 20 nt, Escherichia coli CFT073
agggcgugaagacugcgacg

SEQ ID NO: 581306 - RNA, 17 nt, Escherichia coli CFT073
agguauuuagcgaauaa

SEQ ID NO: 581307 - RNA, 17 nt, Escherichia coli CFT073
agguaacccaguaacgg

SEQ ID NO: 581308 - RNA, 17 nt, Escherichia coli CFT073
aggguuuaauaaucgca

SEQ ID NO: 581309 - RNA, 21 nt, Escherichia coli CFT073
aggguuuaauaaucgcaucaa

SEQ ID NO: 581310 - RNA, 14 nt, Escherichia coli CFT073
aggguuacgcgcag

SEQ ID NO: 581311 - RNA, 15 nt, Escherichia coli CFT073
agguaaggauaaaaa

SEQ ID NO: 581312 - RNA, 20 nt, Escherichia coli CFT073
agggugacaucaaucagcgg

SEQ ID NO: 581313 - RNA, 16 nt, Escherichia coli CFT073
agggugauaagcgagg

SEQ ID NO: 581314 - RNA, 18 nt, Escherichia coli CFT073
aggggcaaucagcacuac

SEQ ID NO: 581315 - RNA, 18 nt, Escherichia coli CFT073
aggacggaauuugcugcu

SEQ ID NO: 581316 - RNA, 13 nt, Escherichia coli CFT073
aggacaucagcgc

SEQ ID NO: 581317 - RNA, 16 nt, Escherichia coli CFT073
aggacaucccggcaga

SEQ ID NO: 581318 - RNA, 16 nt, Escherichia coli CFT073
aggagagauuuuacaa

SEQ ID NO: 581319 - RNA, 20 nt, Escherichia coli CFT073
aggacugacgcagcagaccg

SEQ ID NO: 581320 - RNA, 19 nt, Escherichia coli CFT073
aggacuucaucacgaugca

SEQ ID NO: 581321 - RNA, 22 nt, Escherichia coli CFT073
aggacuauuuacagauuuccca

SEQ ID NO: 581322 - RNA, 21 nt, Escherichia coli CFT073
aggauaugcauguucauauca

SEQ ID NO: 581323 - RNA, 15 nt, Escherichia coli CFT073
aggaucaccaauacc

SEQ ID NO: 581324 - RNA, 13 nt, Escherichia coli CFT073
aggaucagaccgc

SEQ ID NO: 581325 - RNA, 20 nt, Escherichia coli CFT073
aggauccaugacaucuccag

SEQ ID NO: 581326 - RNA, 16 nt, Escherichia coli CFT073
aggaucggugcugcca

SEQ ID NO: 581327 - RNA, 15 nt, Escherichia coli CFT073
aggaucuccaguucc

SEQ ID NO: 581328 - RNA, 23 nt, Escherichia coli CFT073
aggagcugagugcgaaaaucaau

SEQ ID NO: 581329 - RNA, 14 nt, Escherichia coli CFT073
aggcaaguuuccuc

SEQ ID NO: 581330 - RNA, 16 nt, Escherichia coli CFT073
aggcaaguuuccuccg

SEQ ID NO: 581331 - RNA, 18 nt, Escherichia coli CFT073
aggcaaauucuguuucau

SEQ ID NO: 581332 - RNA, 13 nt, Escherichia coli CFT073
aggcaaccagcac

SEQ ID NO: 581333 - RNA, 19 nt, Escherichia coli CFT073
aggcacaauggccagcaca

SEQ ID NO: 581334 - RNA, 15 nt, Escherichia coli CFT073
aggcacaucaacacc

SEQ ID NO: 581335 - RNA, 14 nt, Escherichia coli CFT073
aggcacaccgccgc

SEQ ID NO: 581336 - RNA, 19 nt, Escherichia coli CFT073
aggcaaguaauuguuucau

SEQ ID NO: 581337 - RNA, 21 nt, Escherichia coli CFT073
aggcagaaacaucauccccau

SEQ ID NO: 581338 - RNA, 16 nt, Escherichia coli CFT073
aggcagaacgccaugc

SEQ ID NO: 581339 - RNA, 22 nt, Escherichia coli CFT073
aggcagacuggauacgcugacg

SEQ ID NO: 581340 - RNA, 20 nt, Escherichia coli CFT073
aggcagauacaaccaaucgc

SEQ ID NO: 581341 - RNA, 21 nt, Escherichia coli CFT073
aggcacguacaugcagggcaa

SEQ ID NO: 581342 - RNA, 19 nt, Escherichia coli CFT073
aggccagauaaggcguuca

SEQ ID NO: 581343 - RNA, 12 nt, Escherichia coli CFT073
aggccagcaauc

SEQ ID NO: 581344 - RNA, 16 nt, Escherichia coli CFT073
aggccagccagaagaa

SEQ ID NO: 581345 - RNA, 16 nt, Escherichia coli CFT073
aggccccgucagcaaa

SEQ ID NO: 581346 - RNA, 18 nt, Escherichia coli CFT073
aggcccgcguagagaaaa

SEQ ID NO: 581347 - RNA, 15 nt, Escherichia coli CFT073
aggcagggcgaaacg

SEQ ID NO: 581348 - RNA, 14 nt, Escherichia coli CFT073
aggcaguggaauau

SEQ ID NO: 581349 - RNA, 18 nt, Escherichia coli CFT073
  misc_feature (5)..(5): n is a, c, g or u
agcungcaggauaaacgc

SEQ ID NO: 581350 - RNA, 22 nt, Escherichia coli CFT073
agcuguuucaguaacuggcgca

SEQ ID NO: 581351 - RNA, 14 nt, Escherichia coli CFT073
agcuguuggcaacg

SEQ ID NO: 581352 - RNA, 17 nt, Escherichia coli CFT073
agcuguuggcaacgcaa

SEQ ID NO: 581353 - RNA, 23 nt, Escherichia coli CFT073
agcugugccaggacuucaucacg

SEQ ID NO: 581354 - RNA, 15 nt, Escherichia coli CFT073
agcuuauccagcaaa

SEQ ID NO: 581355 - RNA, 15 nt, Escherichia coli CFT073
agcuuacguauuucg

SEQ ID NO: 581356 - RNA, 15 nt, Escherichia coli CFT073
agcuuagcggcgcga

SEQ ID NO: 581357 - RNA, 20 nt, Escherichia coli CFT073
agcuucacuuuccaguucaa

SEQ ID NO: 581358 - RNA, 22 nt, Escherichia coli CFT073
agcuucagaauauccggcacgu

SEQ ID NO: 581359 - RNA, 15 nt, Escherichia coli CFT073
agcuguacaucgcgc

SEQ ID NO: 581360 - RNA, 15 nt, Escherichia coli CFT073
agcuguaccuggccc

SEQ ID NO: 581361 - RNA, 13 nt, Escherichia coli CFT073
agcuggugauaac

SEQ ID NO: 581362 - RNA, 15 nt, Escherichia coli CFT073
agcuguagaggcguu

SEQ ID NO: 581363 - RNA, 23 nt, Escherichia coli CFT073
agcuggguuaauaccgagcguuc

SEQ ID NO: 581364 - RNA, 11 nt, Escherichia coli CFT073
agcuggcggac

SEQ ID NO: 581365 - RNA, 20 nt, Escherichia coli CFT073
agcugcugcucaaucugcgc

SEQ ID NO: 581366 - RNA, 17 nt, Escherichia coli CFT073
agcugcucggcaauuug

SEQ ID NO: 581367 - RNA, 23 nt, Escherichia coli CFT073
agcuggaagccacaaucgcagcg

SEQ ID NO: 581368 - RNA, 16 nt, Escherichia coli CFT073
agcuggcgcaggagcc

SEQ ID NO: 581369 - RNA, 20 nt, Escherichia coli CFT073
agcuggcaccgcaucaaaga

SEQ ID NO: 581370 - RNA, 23 nt, Escherichia coli CFT073
agcugcuacaccgucauuagcgc

SEQ ID NO: 581371 - RNA, 18 nt, Escherichia coli CFT073
agcgucucuucaauccgc

SEQ ID NO: 581372 - RNA, 20 nt, Escherichia coli CFT073
agcgucccuaauaccguucc

SEQ ID NO: 581373 - RNA, 23 nt, Escherichia coli CFT073
agcgucggugucaucgacaucaa

SEQ ID NO: 581374 - RNA, 14 nt, Escherichia coli CFT073
agcgucguucgcgc

SEQ ID NO: 581375 - RNA, 19 nt, Escherichia coli CFT073
agcuuuuucagcguuuucu

SEQ ID NO: 581376 - RNA, 13 nt, Escherichia coli CFT073
aggaaaucagcac

SEQ ID NO: 581377 - RNA, 18 nt, Escherichia coli CFT073
aggaacuucguaagccug

SEQ ID NO: 581378 - RNA, 21 nt, Escherichia coli CFT073
aggaacgagaacucggaagca

SEQ ID NO: 581379 - RNA, 16 nt, Escherichia coli CFT073
aggaauuaaucccuua

SEQ ID NO: 581380 - RNA, 13 nt, Escherichia coli CFT073
agcuuggcagagc

SEQ ID NO: 581381 - RNA, 17 nt, Escherichia coli CFT073
agcuuguuauccaucag

SEQ ID NO: 581382 - RNA, 15 nt, Escherichia coli CFT073
agcuuuucgcccagg

SEQ ID NO: 581383 - RNA, 22 nt, Escherichia coli CFT073
agcuuuguugaccuaacuccug

SEQ ID NO: 581384 - RNA, 22 nt, Escherichia coli CFT073
aggaaaacgugccacugacauc

SEQ ID NO: 581385 - RNA, 14 nt, Escherichia coli CFT073
aggaaacccaacgc

SEQ ID NO: 581386 - RNA, 14 nt, Escherichia coli CFT073
agcuuucgcaucag

SEQ ID NO: 581387 - RNA, 20 nt, Escherichia coli CFT073
agcuugagguuggagauccc

SEQ ID NO: 581388 - RNA, 14 nt, Escherichia coli CFT073
agcuugagaaaauc

SEQ ID NO: 581389 - RNA, 13 nt, Escherichia coli CFT073
agcuucucuggcu

SEQ ID NO: 581390 - RNA, 19 nt, Escherichia coli CFT073
agcuucgccauuucgucgu

SEQ ID NO: 581391 - RNA, 22 nt, Escherichia coli CFT073
cacauaacagcgggacaacaaa

SEQ ID NO: 581392 - RNA, 21 nt, Escherichia coli CFT073
cacauaauugagcagcaaaau

SEQ ID NO: 581393 - RNA, 21 nt, Escherichia coli CFT073
cacaguuucauaucugccaga

SEQ ID NO: 581394 - RNA, 21 nt, Escherichia coli CFT073
cacauaaaguagccaaucccg

SEQ ID NO: 581395 - RNA, 18 nt, Escherichia coli CFT073
cacauacugcaucagcgc

SEQ ID NO: 581396 - RNA, 12 nt, Escherichia coli CFT073
cacaucaacccg

SEQ ID NO: 581397 - RNA, 16 nt, Escherichia coli CFT073
cacaucaucaucgcgg

SEQ ID NO: 581398 - RNA, 22 nt, Escherichia coli CFT073
cacaucauugagacguuugaga

SEQ ID NO: 581399 - RNA, 16 nt, Escherichia coli CFT073
cacauccaccagcgcc

SEQ ID NO: 581400 - RNA, 21 nt, Escherichia coli CFT073
cacaucaggcacaucggcuaa

SEQ ID NO: 581401 - RNA, 16 nt, Escherichia coli CFT073
cacaucauaaauaaga

SEQ ID NO: 581402 - RNA, 11 nt, Escherichia coli CFT073
cacaucugaca

SEQ ID NO: 581403 - RNA, 15 nt, Escherichia coli CFT073
cacaucugacaaaau

SEQ ID NO: 581404 - RNA, 17 nt, Escherichia coli CFT073
cacaugcagcuucgcca

SEQ ID NO: 581405 - RNA, 20 nt, Escherichia coli CFT073
cacaucgcugacacgggaaa

SEQ ID NO: 581406 - RNA, 14 nt, Escherichia coli CFT073
cacaucccagcaga

SEQ ID NO: 581407 - RNA, 14 nt, Escherichia coli CFT073
cacauccugccagu

SEQ ID NO: 581408 - RNA, 23 nt, Escherichia coli CFT073
cacagcuacgcaucaugccgccc

SEQ ID NO: 581409 - RNA, 14 nt, Escherichia coli CFT073
cacaggcaucguga

SEQ ID NO: 581410 - RNA, 17 nt, Escherichia coli CFT073
cacaggagacaccagcg

SEQ ID NO: 581411 - RNA, 21 nt, Escherichia coli CFT073
cacagcuuucggguggccagc

SEQ ID NO: 581412 - RNA, 23 nt, Escherichia coli CFT073
cacaggcuggcgucacgccgacc

SEQ ID NO: 581413 - RNA, 22 nt, Escherichia coli CFT073
cacagggcugcugaugcgccgc

SEQ ID NO: 581414 - RNA, 13 nt, Escherichia coli CFT073
cacagucgaugca

SEQ ID NO: 581415 - RNA, 21 nt, Escherichia coli CFT073
cacaggucgcccccggcagug

SEQ ID NO: 581416 - RNA, 14 nt, Escherichia coli CFT073
cacauucagcagcc

SEQ ID NO: 581417 - RNA, 21 nt, Escherichia coli CFT073
cacauucagcagcccggcaac

SEQ ID NO: 581418 - RNA, 15 nt, Escherichia coli CFT073
cacauuaucaaacgu

SEQ ID NO: 581419 - RNA, 15 nt, Escherichia coli CFT073
cacauucccuaugcu

SEQ ID NO: 581420 - RNA, 16 nt, Escherichia coli CFT073
cacauuucccggccac

SEQ ID NO: 581421 - RNA, 18 nt, Escherichia coli CFT073
cacauuuuccaucacgau

SEQ ID NO: 581422 - RNA, 17 nt, Escherichia coli CFT073
caccaaaaccgaggagc

SEQ ID NO: 581423 - RNA, 21 nt, Escherichia coli CFT073
caccaaacgggcaagccagca

SEQ ID NO: 581424 - RNA, 17 nt, Escherichia coli CFT073
caccaaacugcgcccgc

SEQ ID NO: 581425 - RNA, 14 nt, Escherichia coli CFT073
caccaaucacaaug

SEQ ID NO: 581426 - RNA, 18 nt, Escherichia coli CFT073
caccaaucaccgccaaca

SEQ ID NO: 581427 - RNA, 23 nt, Escherichia coli CFT073
caccaauaaugucgcugguaaca

SEQ ID NO: 581428 - RNA, 12 nt, Escherichia coli CFT073
caccaauaccag

SEQ ID NO: 581429 - RNA, 21 nt, Escherichia coli CFT073
caccaaucgucaaugccguca

SEQ ID NO: 581430 - RNA, 22 nt, Escherichia coli CFT073
caccaaaugccugcuguugcgg

SEQ ID NO: 581431 - RNA, 19 nt, Escherichia coli CFT073
caccaacgauuuuuuccgc

SEQ ID NO: 581432 - RNA, 19 nt, Escherichia coli CFT073
caccacgccagccgccagc

SEQ ID NO: 581433 - RNA, 17 nt, Escherichia coli CFT073
caccacgcgggguaaaa

SEQ ID NO: 581434 - RNA, 23 nt, Escherichia coli CFT073
caccaaugacuauuugcgccgca

SEQ ID NO: 581435 - RNA, 19 nt, Escherichia coli CFT073
caccaauguaggccugaua

SEQ ID NO: 581436 - RNA, 23 nt, Escherichia coli CFT073
caccaauguggaaagccccagcc

SEQ ID NO: 581437 - RNA, 22 nt, Escherichia coli CFT073
caccacaaaagcggugauaaac

SEQ ID NO: 581438 - RNA, 19 nt, Escherichia coli CFT073
caccaaucuucaacacuuc

SEQ ID NO: 581439 - RNA, 14 nt, Escherichia coli CFT073
cacaacauugcgcc

SEQ ID NO: 581440 - RNA, 15 nt, Escherichia coli CFT073
cacaacauugcgccu

SEQ ID NO: 581441 - RNA, 18 nt, Escherichia coli CFT073
cacaaaggcuugcugcau

SEQ ID NO: 581442 - RNA, 15 nt, Escherichia coli CFT073
cacaacagaccagaa

SEQ ID NO: 581443 - RNA, 14 nt, Escherichia coli CFT073
caauuuuuugcgcc

SEQ ID NO: 581444 - RNA, 17 nt, Escherichia coli CFT073
cacaaaaacaccgcugu

SEQ ID NO: 581445 - RNA, 13 nt, Escherichia coli CFT073
cacaaaagcaaag

SEQ ID NO: 581446 - RNA, 18 nt, Escherichia coli CFT073
cacaaacggcgcauagcc

SEQ ID NO: 581447 - RNA, 13 nt, Escherichia coli CFT073
cacaccauaucca

SEQ ID NO: 581448 - RNA, 13 nt, Escherichia coli CFT073
cacaccaucaucg

SEQ ID NO: 581449 - RNA, 14 nt, Escherichia coli CFT073
cacacaucggcagg

SEQ ID NO: 581450 - RNA, 15 nt, Escherichia coli CFT073
cacaccaaccgcuuc

SEQ ID NO: 581451 - RNA, 13 nt, Escherichia coli CFT073
cacaccacgcgcc

SEQ ID NO: 581452 - RNA, 15 nt, Escherichia coli CFT073
cacaccguaauugcc

SEQ ID NO: 581453 - RNA, 19 nt, Escherichia coli CFT073
cacaccguaauugccagac

SEQ ID NO: 581454 - RNA, 16 nt, Escherichia coli CFT073
cacaccgucagccagc

SEQ ID NO: 581455 - RNA, 15 nt, Escherichia coli CFT073
cacaccuacgcccgc

SEQ ID NO: 581456 - RNA, 17 nt, Escherichia coli CFT073
cacaccuacgcccgcca

SEQ ID NO: 581457 - RNA, 14 nt, Escherichia coli CFT073
cacacgacgccagc

SEQ ID NO: 581458 - RNA, 14 nt, Escherichia coli CFT073
cacacgacgcgcca

SEQ ID NO: 581459 - RNA, 13 nt, Escherichia coli CFT073
cacagcgccagac

SEQ ID NO: 581460 - RNA, 14 nt, Escherichia coli CFT073
cacagcgcaccaac

SEQ ID NO: 581461 - RNA, 18 nt, Escherichia coli CFT073
cacagaacaaaauguuua

SEQ ID NO: 581462 - RNA, 20 nt, Escherichia coli CFT073
cacacgaucugacauuugca

SEQ ID NO: 581463 - RNA, 21 nt, Escherichia coli CFT073
cacagcaaaacgcccgcaacu

SEQ ID NO: 581464 - RNA, 20 nt, Escherichia coli CFT073
cacagcaauuuugcccagcc

SEQ ID NO: 581465 - RNA, 22 nt, Escherichia coli CFT073
cacagcaauuuugcccagccga

SEQ ID NO: 581466 - RNA, 18 nt, Escherichia coli CFT073
cacagcaccccauagcca

SEQ ID NO: 581467 - RNA, 13 nt, Escherichia coli CFT073
cacagcauccgaa

SEQ ID NO: 581468 - RNA, 14 nt, Escherichia coli CFT073
caauuaccacugag

SEQ ID NO: 581469 - RNA, 13 nt, Escherichia coli CFT073
caauguugcuggc

SEQ ID NO: 581470 - RNA, 21 nt, Escherichia coli CFT073
caauguuuuucucugccgccg

SEQ ID NO: 581471 - RNA, 19 nt, Escherichia coli CFT073
caauggcauauuccgccac

SEQ ID NO: 581472 - RNA, 18 nt, Escherichia coli CFT073
caauggauaucggucauu

SEQ ID NO: 581473 - RNA, 15 nt, Escherichia coli CFT073
caauggcccgccgca

SEQ ID NO: 581474 - RNA, 19 nt, Escherichia coli CFT073
caaugcguucguagccacg

SEQ ID NO: 581475 - RNA, 14 nt, Escherichia coli CFT073
caaugcucacccgc

SEQ ID NO: 581476 - RNA, 15 nt, Escherichia coli CFT073
caauucuuuuucuga

SEQ ID NO: 581477 - RNA, 22 nt, Escherichia coli CFT073
caauucgcgucggcgucagcgc

SEQ ID NO: 581478 - RNA, 16 nt, Escherichia coli CFT073
caauucccgacaaugg

SEQ ID NO: 581479 - RNA, 18 nt, Escherichia coli CFT073
caauuagcggccagcggg

SEQ ID NO: 581480 - RNA, 22 nt, Escherichia coli CFT073
caauucaauuaauucuccgcac

SEQ ID NO: 581481 - RNA, 20 nt, Escherichia coli CFT073
caauucacacucugccagcg

SEQ ID NO: 581482 - RNA, 19 nt, Escherichia coli CFT073
caaugacagccccaccagc

SEQ ID NO: 581483 - RNA, 16 nt, Escherichia coli CFT073
caaugacauacagcac

SEQ ID NO: 581484 - RNA, 17 nt, Escherichia coli CFT073
caaugacuauuugcgcc

SEQ ID NO: 581485 - RNA, 18 nt, Escherichia coli CFT073
caaugagcuauguuugaa

SEQ ID NO: 581486 - RNA, 20 nt, Escherichia coli CFT073
caaugauuguaggccggaua

SEQ ID NO: 581487 - RNA, 19 nt, Escherichia coli CFT073
caaugcgggacauauugau

SEQ ID NO: 581488 - RNA, 17 nt, Escherichia coli CFT073
caaugcggccuccggca

SEQ ID NO: 581489 - RNA, 15 nt, Escherichia coli CFT073
caccaucgcgaucca

SEQ ID NO: 581490 - RNA, 12 nt, Escherichia coli CFT073
caccaucgcgcc

SEQ ID NO: 581491 - RNA, 23 nt, Escherichia coli CFT073
caccauauacuccgcaccgcggu

SEQ ID NO: 581492 - RNA, 20 nt, Escherichia coli CFT073
caccaucaccucucacgacg

SEQ ID NO: 581493 - RNA, 14 nt, Escherichia coli CFT073
caccaucagcagca

SEQ ID NO: 581494 - RNA, 13 nt, Escherichia coli CFT073
caccaucaucggc

SEQ ID NO: 581495 - RNA, 15 nt, Escherichia coli CFT073
caccauccagcaaca

SEQ ID NO: 581496 - RNA, 14 nt, Escherichia coli CFT073
caccagugccggaa

SEQ ID NO: 581497 - RNA, 16 nt, Escherichia coli CFT073
caccaguucaccaccu

SEQ ID NO: 581498 - RNA, 18 nt, Escherichia coli CFT073
caccaguucagugaccga

SEQ ID NO: 581499 - RNA, 18 nt, Escherichia coli CFT073
caccaguucgccuucauu

SEQ ID NO: 581500 - RNA, 15 nt, Escherichia coli CFT073
caccauaaucagcgu

SEQ ID NO: 581501 - RNA, 21 nt, Escherichia coli CFT073
caccauacgccuguuuuugcg

SEQ ID NO: 581502 - RNA, 18 nt, Escherichia coli CFT073
caccaguaccauuuucgc

SEQ ID NO: 581503 - RNA, 15 nt, Escherichia coli CFT073
caccaguaccgccac

SEQ ID NO: 581504 - RNA, 15 nt, Escherichia coli CFT073
caccaguaaaacggg

SEQ ID NO: 581505 - RNA, 16 nt, Escherichia coli CFT073
caccaguacacugguu

SEQ ID NO: 581506 - RNA, 22 nt, Escherichia coli CFT073
caccagggaaauaaucgggaau

SEQ ID NO: 581507 - RNA, 19 nt, Escherichia coli CFT073
cacccgcaaucaucgacgc

SEQ ID NO: 581508 - RNA, 13 nt, Escherichia coli CFT073
cacccgcagccau

SEQ ID NO: 581509 - RNA, 14 nt, Escherichia coli CFT073
cacccaucgccagc

SEQ ID NO: 581510 - RNA, 13 nt, Escherichia coli CFT073
cacccauguugau

SEQ ID NO: 581511 - RNA, 17 nt, Escherichia coli CFT073
cacccauuuauccagcg

SEQ ID NO: 581512 - RNA, 23 nt, Escherichia coli CFT073
cacccauuuauccagcggcagcc

SEQ ID NO: 581513 - RNA, 18 nt, Escherichia coli CFT073
caccauuggcauacacgu

SEQ ID NO: 581514 - RNA, 15 nt, Escherichia coli CFT073
caccauucugggcuc

SEQ ID NO: 581515 - RNA, 12 nt, Escherichia coli CFT073
cacccaauccag

SEQ ID NO: 581516 - RNA, 14 nt, Escherichia coli CFT073
caccgcaaacugcu

SEQ ID NO: 581517 - RNA, 21 nt, Escherichia coli CFT073
caccgcaaagaaacgcgcggc

SEQ ID NO: 581518 - RNA, 19 nt, Escherichia coli CFT073
caccgauucuuugacagaa

SEQ ID NO: 581519 - RNA, 15 nt, Escherichia coli CFT073
caccgcaaucgcggc

SEQ ID NO: 581520 - RNA, 20 nt, Escherichia coli CFT073
caccgcacggcgaguaucgu

SEQ ID NO: 581521 - RNA, 17 nt, Escherichia coli CFT073
caccgcagagaucgccc

SEQ ID NO: 581522 - RNA, 15 nt, Escherichia coli CFT073
caccgcagcaaccgu

SEQ ID NO: 581523 - RNA, 13 nt, Escherichia coli CFT073
caccgcaggcggc

SEQ ID NO: 581524 - RNA, 14 nt, Escherichia coli CFT073
caccgccagcagca

SEQ ID NO: 581525 - RNA, 16 nt, Escherichia coli CFT073
caccgcauguugcucu

SEQ ID NO: 581526 - RNA, 17 nt, Escherichia coli CFT073
caccgcauuggacaggu

SEQ ID NO: 581527 - RNA, 14 nt, Escherichia coli CFT073
caccgccaccagcg

SEQ ID NO: 581528 - RNA, 17 nt, Escherichia coli CFT073
caccgcauccggcauca

SEQ ID NO: 581529 - RNA, 15 nt, Escherichia coli CFT073
caccgagcguggcga

SEQ ID NO: 581530 - RNA, 17 nt, Escherichia coli CFT073
caccgagcguggcgaua

SEQ ID NO: 581531 - RNA, 20 nt, Escherichia coli CFT073
caccgcccugcaucaugcgc

SEQ ID NO: 581532 - RNA, 21 nt, Escherichia coli CFT073
caccgcccagcgagcuggcgg

SEQ ID NO: 581533 - RNA, 12 nt, Escherichia coli CFT073
caccgccgccaa

SEQ ID NO: 581534 - RNA, 19 nt, Escherichia coli CFT073
caccgcgcggcugguaaca

SEQ ID NO: 581535 - RNA, 19 nt, Escherichia coli CFT073
caccgcgcuaaggccgcca

SEQ ID NO: 581536 - RNA, 15 nt, Escherichia coli CFT073
caccgcgcuggcuga

SEQ ID NO: 581537 - RNA, 18 nt, Escherichia coli CFT073
caccgcgaauauaagcgc

SEQ ID NO: 581538 - RNA, 15 nt, Escherichia coli CFT073
caagauaaaucgcac

SEQ ID NO: 581539 - RNA, 17 nt, Escherichia coli CFT073
caagauacgcaucgcgc

SEQ ID NO: 581540 - RNA, 23 nt, Escherichia coli CFT073
caagauacgcaucgcgcaccagc

SEQ ID NO: 581541 - RNA, 17 nt, Escherichia coli CFT073
caagauacggaacugcg

SEQ ID NO: 581542 - RNA, 17 nt, Escherichia coli CFT073
caagaucgcgaugaguc

SEQ ID NO: 581543 - RNA, 21 nt, Escherichia coli CFT073
caagaugcggggauuuucgca

SEQ ID NO: 581544 - RNA, 16 nt, Escherichia coli CFT073
caagcaagagugguua

SEQ ID NO: 581545 - RNA, 16 nt, Escherichia coli CFT073
caagcacagccgcauu

SEQ ID NO: 581546 - RNA, 16 nt, Escherichia coli CFT073
caagcaccaacucgcc

SEQ ID NO: 581547 - RNA, 22 nt, Escherichia coli CFT073
caagcauugauuuuaauaaauc

SEQ ID NO: 581548 - RNA, 12 nt, Escherichia coli CFT073
caagcagcugcc

SEQ ID NO: 581549 - RNA, 15 nt, Escherichia coli CFT073
caagcauaacaaaau

SEQ ID NO: 581550 - RNA, 22 nt, Escherichia coli CFT073
caagccaccaucccgccgacca

SEQ ID NO: 581551 - RNA, 21 nt, Escherichia coli CFT073
caagcgucgcauccggcauca

SEQ ID NO: 581552 - RNA, 18 nt, Escherichia coli CFT073
caagcgucgcaucaggca

SEQ ID NO: 581553 - RNA, 15 nt, Escherichia coli CFT073
caagcgucauauccg

SEQ ID NO: 581554 - RNA, 21 nt, Escherichia coli CFT073
caagcgucauauccgacacua

SEQ ID NO: 581555 - RNA, 16 nt, Escherichia coli CFT073
caaggcauauaccaca

SEQ ID NO: 581556 - RNA, 14 nt, Escherichia coli CFT073
caagcccgccagac

SEQ ID NO: 581557 - RNA, 21 nt, Escherichia coli CFT073
caacuuaagucuccauuuuuu

SEQ ID NO: 581558 - RNA, 16 nt, Escherichia coli CFT073
caacuucacggcugua

SEQ ID NO: 581559 - RNA, 13 nt, Escherichia coli CFT073
caacuucaugacc

SEQ ID NO: 581560 - RNA, 23 nt, Escherichia coli CFT073
caacugcugcgguugaacgccaa

SEQ ID NO: 581561 - RNA, 15 nt, Escherichia coli CFT073
caacuggcggcggcg

SEQ ID NO: 581562 - RNA, 14 nt, Escherichia coli CFT073
caacuggcugccgu

SEQ ID NO: 581563 - RNA, 14 nt, Escherichia coli CFT073
caagaaucgucgcc

SEQ ID NO: 581564 - RNA, 14 nt, Escherichia coli CFT073
caagaccgcgacca

SEQ ID NO: 581565 - RNA, 20 nt, Escherichia coli CFT073
caagaaugcucgcuggcagg

SEQ ID NO: 581566 - RNA, 22 nt, Escherichia coli CFT073
caagaaggauauaaaaauaaca

SEQ ID NO: 581567 - RNA, 21 nt, Escherichia coli CFT073
caagaagaacgccgguugcga

SEQ ID NO: 581568 - RNA, 12 nt, Escherichia coli CFT073
caagaaagcuuu

SEQ ID NO: 581569 - RNA, 22 nt, Escherichia coli CFT073
caagaaacaccagaaugcccca

SEQ ID NO: 581570 - RNA, 17 nt, Escherichia coli CFT073
caacuuuucccagcgcg

SEQ ID NO: 581571 - RNA, 18 nt, Escherichia coli CFT073
caacuuuugcaggaagcu

SEQ ID NO: 581572 - RNA, 23 nt, Escherichia coli CFT073
caacugcgcuauaucgcugauau

SEQ ID NO: 581573 - RNA, 23 nt, Escherichia coli CFT073
caacugcaaggccaucggcagcg

SEQ ID NO: 581574 - RNA, 20 nt, Escherichia coli CFT073
caacggugcuuuaauuucau

SEQ ID NO: 581575 - RNA, 18 nt, Escherichia coli CFT073
caacgguucugcugccgc

SEQ ID NO: 581576 - RNA, 16 nt, Escherichia coli CFT073
caacguacaccgcagc

SEQ ID NO: 581577 - RNA, 18 nt, Escherichia coli CFT073
caacgguccaauggucau

SEQ ID NO: 581578 - RNA, 17 nt, Escherichia coli CFT073
caacggucgauucgccg

SEQ ID NO: 581579 - RNA, 16 nt, Escherichia coli CFT073
caacgggcaccgccgc

SEQ ID NO: 581580 - RNA, 17 nt, Escherichia coli CFT073
caacggguaaggcgcga

SEQ ID NO: 581581 - RNA, 16 nt, Escherichia coli CFT073
caacggcaucgccaac

SEQ ID NO: 581582 - RNA, 16 nt, Escherichia coli CFT073
caacggccaaauaucc

SEQ ID NO: 581583 - RNA, 16 nt, Escherichia coli CFT073
caaaguggcggcuacc

SEQ ID NO: 581584 - RNA, 15 nt, Escherichia coli CFT073
caaaguuaaucagcg

SEQ ID NO: 581585 - RNA, 17 nt, Escherichia coli CFT073
caaagucaucaauugca

SEQ ID NO: 581586 - RNA, 14 nt, Escherichia coli CFT073
caaagucaaacugg

SEQ ID NO: 581587 - RNA, 19 nt, Escherichia coli CFT073
caaaguaauggaaggcguu

SEQ ID NO: 581588 - RNA, 18 nt, Escherichia coli CFT073
caaaguagagcgaaacga

SEQ ID NO: 581589 - RNA, 19 nt, Escherichia coli CFT073
caacacuucauuaucuucu

SEQ ID NO: 581590 - RNA, 15 nt, Escherichia coli CFT073
caacacuuccgcuuc

SEQ ID NO: 581591 - RNA, 13 nt, Escherichia coli CFT073
caacagcggcgcg

SEQ ID NO: 581592 - RNA, 18 nt, Escherichia coli CFT073
caacagauaaauggcaca

SEQ ID NO: 581593 - RNA, 20 nt, Escherichia coli CFT073
caacagauuuugcaggccug

SEQ ID NO: 581594 - RNA, 22 nt, Escherichia coli CFT073
caacaguaaggccugguucauc

SEQ ID NO: 581595 - RNA, 20 nt, Escherichia coli CFT073
caacagugccgaugccgcua

SEQ ID NO: 581596 - RNA, 19 nt, Escherichia coli CFT073
caacauagcuuggcagagc

SEQ ID NO: 581597 - RNA, 15 nt, Escherichia coli CFT073
caacauauccagcgc

SEQ ID NO: 581598 - RNA, 14 nt, Escherichia coli CFT073
caacaucacaccug

SEQ ID NO: 581599 - RNA, 20 nt, Escherichia coli CFT073
caacauauuccgcaccugcc

SEQ ID NO: 581600 - RNA, 23 nt, Escherichia coli CFT073
caacauauuccgcaccugccagc

SEQ ID NO: 581601 - RNA, 21 nt, Escherichia coli CFT073
caacaucaaaucacagcaccu

SEQ ID NO: 581602 - RNA, 14 nt, Escherichia coli CFT073
caacaucaucacgc

SEQ ID NO: 581603 - RNA, 17 nt, Escherichia coli CFT073
caacaucgcauucggca

SEQ ID NO: 581604 - RNA, 20 nt, Escherichia coli CFT073
caaccaguugugcaccacca

SEQ ID NO: 581605 - RNA, 18 nt, Escherichia coli CFT073
caaccagcgucgcaucag

SEQ ID NO: 581606 - RNA, 14 nt, Escherichia coli CFT073
caaccaggaugaua

SEQ ID NO: 581607 - RNA, 15 nt, Escherichia coli CFT073
caaccacucaccgcu

SEQ ID NO: 581608 - RNA, 12 nt, Escherichia coli CFT073
caaccagaaagu

SEQ ID NO: 581609 - RNA, 19 nt, Escherichia coli CFT073
caaccagauuaccgccuuc

SEQ ID NO: 581610 - RNA, 20 nt, Escherichia coli CFT073
caaccagauucggcgcaaug

SEQ ID NO: 581611 - RNA, 12 nt, Escherichia coli CFT073
caaccagcaaug

SEQ ID NO: 581612 - RNA, 17 nt, Escherichia coli CFT073
caaccagcacaugcuuu

SEQ ID NO: 581613 - RNA, 18 nt, Escherichia coli CFT073
caaccgagcgccccagac

SEQ ID NO: 581614 - RNA, 17 nt, Escherichia coli CFT073
caacgaacuaaccgcac

SEQ ID NO: 581615 - RNA, 22 nt, Escherichia coli CFT073
caacgaaccaaucaccccgauc

SEQ ID NO: 581616 - RNA, 21 nt, Escherichia coli CFT073
caacccgguugcuuucgucga

SEQ ID NO: 581617 - RNA, 20 nt, Escherichia coli CFT073
caacgcccauaaauacgucu

SEQ ID NO: 581618 - RNA, 22 nt, Escherichia coli CFT073
caacgcccauacucaucuucca

SEQ ID NO: 581619 - RNA, 20 nt, Escherichia coli CFT073
caacgccagcgaagccagcu

SEQ ID NO: 581620 - RNA, 23 nt, Escherichia coli CFT073
caacgccagcgaagccagcuccc

SEQ ID NO: 581621 - RNA, 14 nt, Escherichia coli CFT073
caacgcaucuuuuu

SEQ ID NO: 581622 - RNA, 15 nt, Escherichia coli CFT073
caacgccaccacuca

SEQ ID NO: 581623 - RNA, 17 nt, Escherichia coli CFT073
caacgccaccaucacua

SEQ ID NO: 581624 - RNA, 22 nt, Escherichia coli CFT073
caacgacgguaaaccacgccag

SEQ ID NO: 581625 - RNA, 17 nt, Escherichia coli CFT073
caacgcaauauccgcca

SEQ ID NO: 581626 - RNA, 12 nt, Escherichia coli CFT073
caacgcaccaaa

SEQ ID NO: 581627 - RNA, 21 nt, Escherichia coli CFT073
caacgccgauaagguaucgcg

SEQ ID NO: 581628 - RNA, 14 nt, Escherichia coli CFT073
caacgccgccagac

SEQ ID NO: 581629 - RNA, 18 nt, Escherichia coli CFT073
caacgccccuucugccgc

SEQ ID NO: 581630 - RNA, 15 nt, Escherichia coli CFT073
caacgcccugcaacu

SEQ ID NO: 581631 - RNA, 13 nt, Escherichia coli CFT073
caacgccgccaac

SEQ ID NO: 581632 - RNA, 15 nt, Escherichia coli CFT073
caacgccuaaacuga

SEQ ID NO: 581633 - RNA, 15 nt, Escherichia coli CFT073
caacgccugcggcug

SEQ ID NO: 581634 - RNA, 16 nt, Escherichia coli CFT073
caacgccuuucgcugu

SEQ ID NO: 581635 - RNA, 18 nt, Escherichia coli CFT073
caacgcgaaaaugcccca

SEQ ID NO: 581636 - RNA, 12 nt, Escherichia coli CFT073
caacgcgccgac

SEQ ID NO: 581637 - RNA, 17 nt, Escherichia coli CFT073
auuuucucgugccgcca

SEQ ID NO: 581638 - RNA, 14 nt, Escherichia coli CFT073
auuuucucacuggc

SEQ ID NO: 581639 - RNA, 21 nt, Escherichia coli CFT073
auuuucugcccguuuaacguu

SEQ ID NO: 581640 - RNA, 14 nt, Escherichia coli CFT073
auuuuguuuaacgg

SEQ ID NO: 581641 - RNA, 15 nt, Escherichia coli CFT073
auuuuuacgaaacag

SEQ ID NO: 581642 - RNA, 22 nt, Escherichia coli CFT073
auuuuccaucacgaucagcgga

SEQ ID NO: 581643 - RNA, 19 nt, Escherichia coli CFT073
auuuuacuguuuaagcgaa

SEQ ID NO: 581644 - RNA, 19 nt, Escherichia coli CFT073
auuuuuguuucacacugac

SEQ ID NO: 581645 - RNA, 17 nt, Escherichia coli CFT073
auuuuuuccagcgcaug

SEQ ID NO: 581646 - RNA, 23 nt, Escherichia coli CFT073
auuuuucgcgcgggcagaugcca

SEQ ID NO: 581647 - RNA, 19 nt, Escherichia coli CFT073
caaaaaagaaggaaaauac

SEQ ID NO: 581648 - RNA, 13 nt, Escherichia coli CFT073
caaaaaauagcaa

SEQ ID NO: 581649 - RNA, 18 nt, Escherichia coli CFT073
caaaaaccggagucugug

SEQ ID NO: 581650 - RNA, 17 nt, Escherichia coli CFT073
caaaaacgcauacccca

SEQ ID NO: 581651 - RNA, 16 nt, Escherichia coli CFT073
caaaaaggccuaaugu

SEQ ID NO: 581652 - RNA, 15 nt, Escherichia coli CFT073
caaaaacuuucgcca

SEQ ID NO: 581653 - RNA, 19 nt, Escherichia coli CFT073
caaaaacuggucaaacuga

SEQ ID NO: 581654 - RNA, 16 nt, Escherichia coli CFT073
caaaaauaccaccaau

SEQ ID NO: 581655 - RNA, 22 nt, Escherichia coli CFT073
caaaaauugcccccagucgcca

SEQ ID NO: 581656 - RNA, 13 nt, Escherichia coli CFT073
caaaaccugccgc

SEQ ID NO: 581657 - RNA, 20 nt, Escherichia coli CFT073
caaaaccaacgcauagacag

SEQ ID NO: 581658 - RNA, 22 nt, Escherichia coli CFT073
caaaaccgauuaauugccgcca

SEQ ID NO: 581659 - RNA, 17 nt, Escherichia coli CFT073
caaaacaggucgccagu

SEQ ID NO: 581660 - RNA, 20 nt, Escherichia coli CFT073
caaaacccgcuucuuccagc

SEQ ID NO: 581661 - RNA, 14 nt, Escherichia coli CFT073
caaaacccugcgcc

SEQ ID NO: 581662 - RNA, 17 nt, Escherichia coli CFT073
caaaacccugcgccagc

SEQ ID NO: 581663 - RNA, 14 nt, Escherichia coli CFT073
caaaagucaccagu

SEQ ID NO: 581664 - RNA, 17 nt, Escherichia coli CFT073
caaaacgugcagcugcc

SEQ ID NO: 581665 - RNA, 19 nt, Escherichia coli CFT073
caaaaucaauucaucgcuc

SEQ ID NO: 581666 - RNA, 15 nt, Escherichia coli CFT073
caaaaucagaaacaa

SEQ ID NO: 581667 - RNA, 14 nt, Escherichia coli CFT073
caaaauaccagcaa

SEQ ID NO: 581668 - RNA, 19 nt, Escherichia coli CFT073
caaaauagaguguuccucu

SEQ ID NO: 581669 - RNA, 17 nt, Escherichia coli CFT073
caaaauagguaucguaa

SEQ ID NO: 581670 - RNA, 18 nt, Escherichia coli CFT073
caaaauaucgacauucaa

SEQ ID NO: 581671 - RNA, 11 nt, Escherichia coli CFT073
caaacagacca

SEQ ID NO: 581672 - RNA, 16 nt, Escherichia coli CFT073
caaacagcacggucag

SEQ ID NO: 581673 - RNA, 20 nt, Escherichia coli CFT073
caaacagcacggucaggcua

SEQ ID NO: 581674 - RNA, 19 nt, Escherichia coli CFT073
caaaaucaucacaacuucg

SEQ ID NO: 581675 - RNA, 16 nt, Escherichia coli CFT073
caaaaucucacacuga

SEQ ID NO: 581676 - RNA, 15 nt, Escherichia coli CFT073
caaacaccgaaccag

SEQ ID NO: 581677 - RNA, 20 nt, Escherichia coli CFT073
caaacggugagacgccagaa

SEQ ID NO: 581678 - RNA, 23 nt, Escherichia coli CFT073
caaacggcguuuuuucaucacug

SEQ ID NO: 581679 - RNA, 21 nt, Escherichia coli CFT073
caaacgcuucuggcgacaucu

SEQ ID NO: 581680 - RNA, 14 nt, Escherichia coli CFT073
caaagagauaacgc

SEQ ID NO: 581681 - RNA, 22 nt, Escherichia coli CFT073
caaagauaaugacuuccgccac

SEQ ID NO: 581682 - RNA, 18 nt, Escherichia coli CFT073
caaagcaaaggcgacaau

SEQ ID NO: 581683 - RNA, 14 nt, Escherichia coli CFT073
caaagcaaauaaug

SEQ ID NO: 581684 - RNA, 17 nt, Escherichia coli CFT073
caaagccucuauggaag

SEQ ID NO: 581685 - RNA, 23 nt, Escherichia coli CFT073
caaaggucuuaauuuugguaauu

SEQ ID NO: 581686 - RNA, 14 nt, Escherichia coli CFT073
caaagccgccgagc

SEQ ID NO: 581687 - RNA, 21 nt, Escherichia coli CFT073
caaagcagugaauacccagaa

SEQ ID NO: 581688 - RNA, 20 nt, Escherichia coli CFT073
caaagccacccacaccgcag

SEQ ID NO: 581689 - RNA, 20 nt, Escherichia coli CFT073
caaagcccaucaccgccagg

SEQ ID NO: 581690 - RNA, 20 nt, Escherichia coli CFT073
caaagcccgaugcgcgacca

SEQ ID NO: 581691 - RNA, 20 nt, Escherichia coli CFT073
caaaccaaaaccgcucgcgc

SEQ ID NO: 581692 - RNA, 22 nt, Escherichia coli CFT073
caaacauggcacugcgaucccg

SEQ ID NO: 581693 - RNA, 18 nt, Escherichia coli CFT073
caaacauugcugccagaa

SEQ ID NO: 581694 - RNA, 20 nt, Escherichia coli CFT073
caaacgacacaugcugacua

SEQ ID NO: 581695 - RNA, 20 nt, Escherichia coli CFT073
caaacaucaugccggccagc

SEQ ID NO: 581696 - RNA, 21 nt, Escherichia coli CFT073
caaacaucaugccggccagcg

SEQ ID NO: 581697 - RNA, 14 nt, Escherichia coli CFT073
caaacaucgacuca

SEQ ID NO: 581698 - RNA, 23 nt, Escherichia coli CFT073
caaacaugacgcgcaucacgaca

SEQ ID NO: 581699 - RNA, 19 nt, Escherichia coli CFT073
caaacgauuaucaacacau

SEQ ID NO: 581700 - RNA, 17 nt, Escherichia coli CFT073
caaacgauucggcaauc

SEQ ID NO: 581701 - RNA, 17 nt, Escherichia coli CFT073
caaacgcaaaacugccu

SEQ ID NO: 581702 - RNA, 17 nt, Escherichia coli CFT073
caaacgcaucgccaaac

SEQ ID NO: 581703 - RNA, 13 nt, Escherichia coli CFT073
caaacgcccagcu

SEQ ID NO: 581704 - RNA, 13 nt, Escherichia coli CFT073
caaacgccggaug

SEQ ID NO: 581705 - RNA, 18 nt, Escherichia coli CFT073
caaacgcguccaucacua

SEQ ID NO: 581706 - RNA, 12 nt, Escherichia coli CFT073
auuuccgccgcc

SEQ ID NO: 581707 - RNA, 15 nt, Escherichia coli CFT073
auuuccgcugauuca

SEQ ID NO: 581708 - RNA, 22 nt, Escherichia coli CFT073
auuuccgcugauucaagauugg

SEQ ID NO: 581709 - RNA, 18 nt, Escherichia coli CFT073
auuuccagaugcguauug

SEQ ID NO: 581710 - RNA, 15 nt, Escherichia coli CFT073
auuucagcgccgcgc

SEQ ID NO: 581711 - RNA, 14 nt, Escherichia coli CFT073
auuucaaauugcuc

SEQ ID NO: 581712 - RNA, 20 nt, Escherichia coli CFT073
auuucaaacgcgcccaaacg

SEQ ID NO: 581713 - RNA, 15 nt, Escherichia coli CFT073
auuuaugggguggaa

SEQ ID NO: 581714 - RNA, 21 nt, Escherichia coli CFT073
auuuaucgccugaugcgacac

SEQ ID NO: 581715 - RNA, 14 nt, Escherichia coli CFT073
auuuaucuucacca

SEQ ID NO: 581716 - RNA, 20 nt, Escherichia coli CFT073
auuuaucuucccagcccagc

SEQ ID NO: 581717 - RNA, 22 nt, Escherichia coli CFT073
auucccaucaguagcauccccg

SEQ ID NO: 581718 - RNA, 18 nt, Escherichia coli CFT073
auucccccaccgccgccg

SEQ ID NO: 581719 - RNA, 23 nt, Escherichia coli CFT073
auuccagucggucgauugucgcg

SEQ ID NO: 581720 - RNA, 16 nt, Escherichia coli CFT073
auucccagcaccgcag

SEQ ID NO: 581721 - RNA, 13 nt, Escherichia coli CFT073
auucccgccagau

SEQ ID NO: 581722 - RNA, 20 nt, Escherichia coli CFT073
auuuaacacgaacuuuaucu

SEQ ID NO: 581723 - RNA, 13 nt, Escherichia coli CFT073
auuuaacaucauu

SEQ ID NO: 581724 - RNA, 14 nt, Escherichia coli CFT073
auuuaaccgcuuuc

SEQ ID NO: 581725 - RNA, 19 nt, Escherichia coli CFT073
auuuaguauuuuauggcag

SEQ ID NO: 581726 - RNA, 20 nt, Escherichia coli CFT073
auuuagcguuaaaauuucac

SEQ ID NO: 581727 - RNA, 22 nt, Escherichia coli CFT073
auuugcucuaccagccccauca

SEQ ID NO: 581728 - RNA, 14 nt, Escherichia coli CFT073
auuugcgccgccga

SEQ ID NO: 581729 - RNA, 13 nt, Escherichia coli CFT073
auuugccagcgua

SEQ ID NO: 581730 - RNA, 18 nt, Escherichia coli CFT073
auuugcccaucaggccag

SEQ ID NO: 581731 - RNA, 17 nt, Escherichia coli CFT073
auuugucgccaacuuca

SEQ ID NO: 581732 - RNA, 13 nt, Escherichia coli CFT073
auuuguucagcaa

SEQ ID NO: 581733 - RNA, 13 nt, Escherichia coli CFT073
auuuguuggcgcu

SEQ ID NO: 581734 - RNA, 12 nt, Escherichia coli CFT073
auuuguuuucau

SEQ ID NO: 581735 - RNA, 12 nt, Escherichia coli CFT073
auuucggcggcu

SEQ ID NO: 581736 - RNA, 13 nt, Escherichia coli CFT073
auuucguuagcaa

SEQ ID NO: 581737 - RNA, 21 nt, Escherichia coli CFT073
auuucugcgcggauagccagc

SEQ ID NO: 581738 - RNA, 17 nt, Escherichia coli CFT073
auuucucuggagaaaua

SEQ ID NO: 581739 - RNA, 17 nt, Escherichia coli CFT073
auguccgccaccgccaa

SEQ ID NO: 581740 - RNA, 14 nt, Escherichia coli CFT073
auguacuaaccaug

SEQ ID NO: 581741 - RNA, 16 nt, Escherichia coli CFT073
auguacuaaccaugcg

SEQ ID NO: 581742 - RNA, 23 nt, Escherichia coli CFT073
auguacgcguaaaauauugcugc

SEQ ID NO: 581743 - RNA, 15 nt, Escherichia coli CFT073
auguaccagacugac

SEQ ID NO: 581744 - RNA, 16 nt, Escherichia coli CFT073
augucgcauccggcaa

SEQ ID NO: 581745 - RNA, 22 nt, Escherichia coli CFT073
auguccguaacauaacagccau

SEQ ID NO: 581746 - RNA, 17 nt, Escherichia coli CFT073
auggucgccccggaacg

SEQ ID NO: 581747 - RNA, 20 nt, Escherichia coli CFT073
auggcuccggaagcuuauuu

SEQ ID NO: 581748 - RNA, 23 nt, Escherichia coli CFT073
auggcugacacuauucgccagca

SEQ ID NO: 581749 - RNA, 18 nt, Escherichia coli CFT073
auggcuuaaccccguauc

SEQ ID NO: 581750 - RNA, 13 nt, Escherichia coli CFT073
auggucgcuugcg

SEQ ID NO: 581751 - RNA, 18 nt, Escherichia coli CFT073
auggugacaaacacagca

SEQ ID NO: 581752 - RNA, 13 nt, Escherichia coli CFT073
auggcguuuccuu

SEQ ID NO: 581753 - RNA, 15 nt, Escherichia coli CFT073
auggcgugcacggca

SEQ ID NO: 581754 - RNA, 22 nt, Escherichia coli CFT073
auggcgucaucaccuugcucga

SEQ ID NO: 581755 - RNA, 16 nt, Escherichia coli CFT073
auggcgguauucccga

SEQ ID NO: 581756 - RNA, 15 nt, Escherichia coli CFT073
auggcgcuaaaaccg

SEQ ID NO: 581757 - RNA, 23 nt, Escherichia coli CFT073
auggcgcggaacucgcugcgcgg

SEQ ID NO: 581758 - RNA, 14 nt, Escherichia coli CFT073
auuaucacaucagc

SEQ ID NO: 581759 - RNA, 16 nt, Escherichia coli CFT073
auuaucacaucagcgc

SEQ ID NO: 581760 - RNA, 15 nt, Escherichia coli CFT073
auuagcuuaucaauc

SEQ ID NO: 581761 - RNA, 20 nt, Escherichia coli CFT073
auuagcgauaaaacgccgcu

SEQ ID NO: 581762 - RNA, 16 nt, Escherichia coli CFT073
auuagcgucaccaucc

SEQ ID NO: 581763 - RNA, 15 nt, Escherichia coli CFT073
auuagcaaugcccug

SEQ ID NO: 581764 - RNA, 20 nt, Escherichia coli CFT073
auuacuggcuguauauaaua

SEQ ID NO: 581765 - RNA, 14 nt, Escherichia coli CFT073
auuacuucuggcac

SEQ ID NO: 581766 - RNA, 16 nt, Escherichia coli CFT073
auuacgcgaucgcgaa

SEQ ID NO: 581767 - RNA, 22 nt, Escherichia coli CFT073
auuacgcgaucgcgaaaccacg

SEQ ID NO: 581768 - RNA, 11 nt, Escherichia coli CFT073
auuacgcgccu

SEQ ID NO: 581769 - RNA, 21 nt, Escherichia coli CFT073
auuacgggucacaaacaucau

SEQ ID NO: 581770 - RNA, 16 nt, Escherichia coli CFT073
auuacguacugcaacg

SEQ ID NO: 581771 - RNA, 15 nt, Escherichia coli CFT073
auuacguccaccaga

SEQ ID NO: 581772 - RNA, 19 nt, Escherichia coli CFT073
auuacgugccgcguuaaug

SEQ ID NO: 581773 - RNA, 14 nt, Escherichia coli CFT073
auuacucauuaauc

SEQ ID NO: 581774 - RNA, 22 nt, Escherichia coli CFT073
auuacugacgccgacauuaaga

SEQ ID NO: 581775 - RNA, 21 nt, Escherichia coli CFT073
auuccaccacuucauacuccg

SEQ ID NO: 581776 - RNA, 21 nt, Escherichia coli CFT073
auucacauuuuuaagccgcgc

SEQ ID NO: 581777 - RNA, 15 nt, Escherichia coli CFT073
auuccagaugcgcca

SEQ ID NO: 581778 - RNA, 20 nt, Escherichia coli CFT073
auuccaccguacgccagcgu

SEQ ID NO: 581779 - RNA, 19 nt, Escherichia coli CFT073
auuaucggagaaauucugc

SEQ ID NO: 581780 - RNA, 16 nt, Escherichia coli CFT073
auucaaaauccgccac

SEQ ID NO: 581781 - RNA, 13 nt, Escherichia coli CFT073
auucaaaaacaga

SEQ ID NO: 581782 - RNA, 16 nt, Escherichia coli CFT073
auucaaccucuguuca

SEQ ID NO: 581783 - RNA, 15 nt, Escherichia coli CFT073
auuaauuugccagcg

SEQ ID NO: 581784 - RNA, 23 nt, Escherichia coli CFT073
auuaauuaccagcgguaaucaug

SEQ ID NO: 581785 - RNA, 17 nt, Escherichia coli CFT073
auuaaugccuucaaauc

SEQ ID NO: 581786 - RNA, 23 nt, Escherichia coli CFT073
auuaauccagggaucaacauuca

SEQ ID NO: 581787 - RNA, 14 nt, Escherichia coli CFT073
auuaaucccggauc

SEQ ID NO: 581788 - RNA, 18 nt, Escherichia coli CFT073
auuaaggcauaagcgcgu

SEQ ID NO: 581789 - RNA, 23 nt, Escherichia coli CFT073
auuacagguuguugaagaugcgg

SEQ ID NO: 581790 - RNA, 22 nt, Escherichia coli CFT073
auuacaacgcaauauccgccac

SEQ ID NO: 581791 - RNA, 17 nt, Escherichia coli CFT073
auuacacacaacacauc

SEQ ID NO: 581792 - RNA, 14 nt, Escherichia coli CFT073
auuacaccaucacg

SEQ ID NO: 581793 - RNA, 21 nt, Escherichia coli CFT073
auuaccgccguacgucagcgc

SEQ ID NO: 581794 - RNA, 14 nt, Escherichia coli CFT073
auuacauaccagca

SEQ ID NO: 581795 - RNA, 17 nt, Escherichia coli CFT073
auuaccgauaucaauaa

SEQ ID NO: 581796 - RNA, 14 nt, Escherichia coli CFT073
auuaagcggcacca

SEQ ID NO: 581797 - RNA, 14 nt, Escherichia coli CFT073
auuaagaaugcgaa

SEQ ID NO: 581798 - RNA, 18 nt, Escherichia coli CFT073
auuaacgugaccgcuuuu

SEQ ID NO: 581799 - RNA, 13 nt, Escherichia coli CFT073
auuaacucacugg

SEQ ID NO: 581800 - RNA, 16 nt, Escherichia coli CFT073
auuaacucacuggcgc

SEQ ID NO: 581801 - RNA, 13 nt, Escherichia coli CFT073
auguuuccauccg

SEQ ID NO: 581802 - RNA, 15 nt, Escherichia coli CFT073
augucgcgccaggcg

SEQ ID NO: 581803 - RNA, 13 nt, Escherichia coli CFT073
augucgcugcacu

SEQ ID NO: 581804 - RNA, 18 nt, Escherichia coli CFT073
auguuguacaugcugcuu

SEQ ID NO: 581805 - RNA, 16 nt, Escherichia coli CFT073
auguugucccagucga

SEQ ID NO: 581806 - RNA, 20 nt, Escherichia coli CFT073
augccggaggagugcgccag

SEQ ID NO: 581807 - RNA, 15 nt, Escherichia coli CFT073
augccggaugcgacg

SEQ ID NO: 581808 - RNA, 16 nt, Escherichia coli CFT073
augccggcaucaaacg

SEQ ID NO: 581809 - RNA, 16 nt, Escherichia coli CFT073
augccgucaccagcau

SEQ ID NO: 581810 - RNA, 15 nt, Escherichia coli CFT073
augccguaaccagcg

SEQ ID NO: 581811 - RNA, 16 nt, Escherichia coli CFT073
augccguaaccagcgc

SEQ ID NO: 581812 - RNA, 21 nt, Escherichia coli CFT073
augccggucuuguuaccggca

SEQ ID NO: 581813 - RNA, 15 nt, Escherichia coli CFT073
augccgaugccgacg

SEQ ID NO: 581814 - RNA, 18 nt, Escherichia coli CFT073
augccgcuacaaaaugcg

SEQ ID NO: 581815 - RNA, 13 nt, Escherichia coli CFT073
augccgcuauccg

SEQ ID NO: 581816 - RNA, 14 nt, Escherichia coli CFT073
augccgcccagcag

SEQ ID NO: 581817 - RNA, 14 nt, Escherichia coli CFT073
augccgcacaucac

SEQ ID NO: 581818 - RNA, 22 nt, Escherichia coli CFT073
augcguuggccaaaguuccggg

SEQ ID NO: 581819 - RNA, 16 nt, Escherichia coli CFT073
augcguuccagcagaa

SEQ ID NO: 581820 - RNA, 22 nt, Escherichia coli CFT073
augcguuccaguucgcuggcau

SEQ ID NO: 581821 - RNA, 14 nt, Escherichia coli CFT073
augcgcucaucggc

SEQ ID NO: 581822 - RNA, 21 nt, Escherichia coli CFT073
augcgcuucgcuuaccaugcc

SEQ ID NO: 581823 - RNA, 15 nt, Escherichia coli CFT073
augcgcuaucgccug

SEQ ID NO: 581824 - RNA, 18 nt, Escherichia coli CFT073
augccuuuugacuccuga

SEQ ID NO: 581825 - RNA, 23 nt, Escherichia coli CFT073
augccugauuguuuguagccgcc

SEQ ID NO: 581826 - RNA, 19 nt, Escherichia coli CFT073
augccugcaaugccguuug

SEQ ID NO: 581827 - RNA, 18 nt, Escherichia coli CFT073
augcgaagaccgcaucac

SEQ ID NO: 581828 - RNA, 14 nt, Escherichia coli CFT073
augcgacgcugaua

SEQ ID NO: 581829 - RNA, 14 nt, Escherichia coli CFT073
augcgacgcuugcc

SEQ ID NO: 581830 - RNA, 19 nt, Escherichia coli CFT073
augcgacgcuugccgcguc

SEQ ID NO: 581831 - RNA, 15 nt, Escherichia coli CFT073
augcgacguuuaccg

SEQ ID NO: 581832 - RNA, 14 nt, Escherichia coli CFT073
augacucgccgcaa

SEQ ID NO: 581833 - RNA, 17 nt, Escherichia coli CFT073
aucugccuuugccggau

SEQ ID NO: 581834 - RNA, 11 nt, Escherichia coli CFT073
aucugcgccau

SEQ ID NO: 581835 - RNA, 13 nt, Escherichia coli CFT073
augacggacgcaa

SEQ ID NO: 581836 - RNA, 21 nt, Escherichia coli CFT073
augacggaucuuccagcgcau

SEQ ID NO: 581837 - RNA, 17 nt, Escherichia coli CFT073
augacggccaguugcgc

SEQ ID NO: 581838 - RNA, 15 nt, Escherichia coli CFT073
aucugcccguagccc

SEQ ID NO: 581839 - RNA, 18 nt, Escherichia coli CFT073
aucucuuuuguuucccga

SEQ ID NO: 581840 - RNA, 21 nt, Escherichia coli CFT073
aucugaauauucggcuccaga

SEQ ID NO: 581841 - RNA, 14 nt, Escherichia coli CFT073
aucugacacagcgc

SEQ ID NO: 581842 - RNA, 18 nt, Escherichia coli CFT073
aucugaccuauuucauuc

SEQ ID NO: 581843 - RNA, 17 nt, Escherichia coli CFT073
aucugacuuccugccuc

SEQ ID NO: 581844 - RNA, 13 nt, Escherichia coli CFT073
aucugauuccggg

SEQ ID NO: 581845 - RNA, 23 nt, Escherichia coli CFT073
aucugauuccgggccaccaugcc

SEQ ID NO: 581846 - RNA, 18 nt, Escherichia coli CFT073
aucugauuuaaaaaugcc

SEQ ID NO: 581847 - RNA, 22 nt, Escherichia coli CFT073
aucugauuuaaaaaugccagcc

SEQ ID NO: 581848 - RNA, 19 nt, Escherichia coli CFT073
augagcuauguuugaacca

SEQ ID NO: 581849 - RNA, 23 nt, Escherichia coli CFT073
augagcugcaacuggcggcggcg

SEQ ID NO: 581850 - RNA, 15 nt, Escherichia coli CFT073
augagauacauuggu

SEQ ID NO: 581851 - RNA, 19 nt, Escherichia coli CFT073
augagcaagagcaccgcug

SEQ ID NO: 581852 - RNA, 14 nt, Escherichia coli CFT073
augagcacaacaua

SEQ ID NO: 581853 - RNA, 17 nt, Escherichia coli CFT073
augagacaaaacgacca

SEQ ID NO: 581854 - RNA, 14 nt, Escherichia coli CFT073
augacuuccaacga

SEQ ID NO: 581855 - RNA, 14 nt, Escherichia coli CFT073
augaugauugacca

SEQ ID NO: 581856 - RNA, 16 nt, Escherichia coli CFT073
augaugauugaccaua

SEQ ID NO: 581857 - RNA, 13 nt, Escherichia coli CFT073
augaugauaucac

SEQ ID NO: 581858 - RNA, 13 nt, Escherichia coli CFT073
augaugagcgcca

SEQ ID NO: 581859 - RNA, 16 nt, Escherichia coli CFT073
augauucccagucagg

SEQ ID NO: 581860 - RNA, 18 nt, Escherichia coli CFT073
augaugccacaaacuggc

SEQ ID NO: 581861 - RNA, 15 nt, Escherichia coli CFT073
augaugccggaauca

SEQ ID NO: 581862 - RNA, 22 nt, Escherichia coli CFT073
augcaauucacacagugaaucu

SEQ ID NO: 581863 - RNA, 14 nt, Escherichia coli CFT073
augcaacugcccag

SEQ ID NO: 581864 - RNA, 20 nt, Escherichia coli CFT073
augcacaggagacaccagcg

SEQ ID NO: 581865 - RNA, 22 nt, Escherichia coli CFT073
augcacaggagacaccagcguc

SEQ ID NO: 581866 - RNA, 13 nt, Escherichia coli CFT073
augauuuugcgcc

SEQ ID NO: 581867 - RNA, 17 nt, Escherichia coli CFT073
augauuuugcgccagug

SEQ ID NO: 581868 - RNA, 20 nt, Escherichia coli CFT073
augccaccagaaacagagua

SEQ ID NO: 581869 - RNA, 21 nt, Escherichia coli CFT073
augccagcacagaucgcacuu

SEQ ID NO: 581870 - RNA, 15 nt, Escherichia coli CFT073
augccaguucaguaa

SEQ ID NO: 581871 - RNA, 18 nt, Escherichia coli CFT073
augcaccuuuaccagacg

SEQ ID NO: 581872 - RNA, 17 nt, Escherichia coli CFT073
augccacaaucucgccc

SEQ ID NO: 581873 - RNA, 23 nt, Escherichia coli CFT073
augcacguuccguauaccgucag

SEQ ID NO: 581874 - RNA, 23 nt, Escherichia coli CFT073
augcacgauauaccgugcugacu

SEQ ID NO: 581875 - RNA, 17 nt, Escherichia coli CFT073
augccccgggaagucac

SEQ ID NO: 581876 - RNA, 20 nt, Escherichia coli CFT073
augccauuuugcaccuucag

SEQ ID NO: 581877 - RNA, 21 nt, Escherichia coli CFT073
augcccaaugagcugaacguc

SEQ ID NO: 581878 - RNA, 13 nt, Escherichia coli CFT073
augccaucaccaa

SEQ ID NO: 581879 - RNA, 22 nt, Escherichia coli CFT073
augccaucgcaugacgcaacaa

SEQ ID NO: 581880 - RNA, 15 nt, Escherichia coli CFT073
augccaucgccagca

SEQ ID NO: 581881 - RNA, 21 nt, Escherichia coli CFT073
augcccugaugcgugcgccag

SEQ ID NO: 581882 - RNA, 12 nt, Escherichia coli CFT073
augcccgcagua

SEQ ID NO: 581883 - RNA, 23 nt, Escherichia coli CFT073
augcccgcaguaauauuugcuua

SEQ ID NO: 581884 - RNA, 20 nt, Escherichia coli CFT073
aucgauaaacaguuccgcaa

SEQ ID NO: 581885 - RNA, 18 nt, Escherichia coli CFT073
aucgagugcaauaacguu

SEQ ID NO: 581886 - RNA, 15 nt, Escherichia coli CFT073
aucgauaaucaguaa

SEQ ID NO: 581887 - RNA, 18 nt, Escherichia coli CFT073
aucgauaaagaacgcacc

SEQ ID NO: 581888 - RNA, 14 nt, Escherichia coli CFT073
aucgauaacugcuc

SEQ ID NO: 581889 - RNA, 18 nt, Escherichia coli CFT073
aucgauagaacggauauc

SEQ ID NO: 581890 - RNA, 19 nt, Escherichia coli CFT073
aucgaggccauauuucaca

SEQ ID NO: 581891 - RNA, 23 nt, Escherichia coli CFT073
aucgaggccauauuucacauaac

SEQ ID NO: 581892 - RNA, 18 nt, Escherichia coli CFT073
aucgauaugaccauuggu

SEQ ID NO: 581893 - RNA, 17 nt, Escherichia coli CFT073
aucgaucacguaauaaa

SEQ ID NO: 581894 - RNA, 17 nt, Escherichia coli CFT073
aucgauuaccgccagca

SEQ ID NO: 581895 - RNA, 21 nt, Escherichia coli CFT073
aucgcaaauccacucaucgcc

SEQ ID NO: 581896 - RNA, 20 nt, Escherichia coli CFT073
aucgcaaucggguuaccgga

SEQ ID NO: 581897 - RNA, 20 nt, Escherichia coli CFT073
aucgcagccuuaccggagaa

SEQ ID NO: 581898 - RNA, 18 nt, Escherichia coli CFT073
aucgcagucuuugccguu

SEQ ID NO: 581899 - RNA, 22 nt, Escherichia coli CFT073
aucgcagucuuugccguuggcg

SEQ ID NO: 581900 - RNA, 15 nt, Escherichia coli CFT073
aucgcaucguacauc

SEQ ID NO: 581901 - RNA, 17 nt, Escherichia coli CFT073
aucgcaucguacaucac

SEQ ID NO: 581902 - RNA, 17 nt, Escherichia coli CFT073
aucgcauauuucaacga

SEQ ID NO: 581903 - RNA, 19 nt, Escherichia coli CFT073
aucgcaucaaucuuuuuca

SEQ ID NO: 581904 - RNA, 15 nt, Escherichia coli CFT073
aucgcaugccagcgc

SEQ ID NO: 581905 - RNA, 14 nt, Escherichia coli CFT073
aucgcauugcgcca

SEQ ID NO: 581906 - RNA, 19 nt, Escherichia coli CFT073
aucgccaaucugguugccc

SEQ ID NO: 581907 - RNA, 17 nt, Escherichia coli CFT073
aucgccacauugcugca

SEQ ID NO: 581908 - RNA, 16 nt, Escherichia coli CFT073
aucgccaccgcgggca

SEQ ID NO: 581909 - RNA, 20 nt, Escherichia coli CFT073
aucgccagacucaccagcau

SEQ ID NO: 581910 - RNA, 22 nt, Escherichia coli CFT073
aucgccagcaaaaucaccauca

SEQ ID NO: 581911 - RNA, 18 nt, Escherichia coli CFT073
aucgccagcuugcagccg

SEQ ID NO: 581912 - RNA, 19 nt, Escherichia coli CFT073
aucgccaucacacccugau

SEQ ID NO: 581913 - RNA, 17 nt, Escherichia coli CFT073
aucgcgacaaaauacag

SEQ ID NO: 581914 - RNA, 18 nt, Escherichia coli CFT073
aucgcgaaaccacgguga

SEQ ID NO: 581915 - RNA, 21 nt, Escherichia coli CFT073
aucgccuuccggcaguuucau

SEQ ID NO: 581916 - RNA, 12 nt, Escherichia coli CFT073
aucgcgaaaaaa

SEQ ID NO: 581917 - RNA, 13 nt, Escherichia coli CFT073
aucgccgagauac

SEQ ID NO: 581918 - RNA, 15 nt, Escherichia coli CFT073
aucgcccugccagcg

SEQ ID NO: 581919 - RNA, 12 nt, Escherichia coli CFT073
aucgcuucaauc

SEQ ID NO: 581920 - RNA, 16 nt, Escherichia coli CFT073
aucgcuucaucgccca

SEQ ID NO: 581921 - RNA, 21 nt, Escherichia coli CFT073
aucgcuuccauauuggcgcgg

SEQ ID NO: 581922 - RNA, 22 nt, Escherichia coli CFT073
aucgcuuuaggguucgcgagau

SEQ ID NO: 581923 - RNA, 23 nt, Escherichia coli CFT073
aucgcuuuuacaucgauuucgcu

SEQ ID NO: 581924 - RNA, 19 nt, Escherichia coli CFT073
aucggaaaacaaccgccau

SEQ ID NO: 581925 - RNA, 19 nt, Escherichia coli CFT073
aucgcgucgccggucagga

SEQ ID NO: 581926 - RNA, 22 nt, Escherichia coli CFT073
aucgcggcugacguaaucauga

SEQ ID NO: 581927 - RNA, 20 nt, Escherichia coli CFT073
aucgcgguaauaaacgcccg

SEQ ID NO: 581928 - RNA, 21 nt, Escherichia coli CFT073
aucgucccaggcaaaucccau

SEQ ID NO: 581929 - RNA, 14 nt, Escherichia coli CFT073
aucgucaucagcgc

SEQ ID NO: 581930 - RNA, 22 nt, Escherichia coli CFT073
aucgucaucauucaucgccuuc

SEQ ID NO: 581931 - RNA, 22 nt, Escherichia coli CFT073
aucguccgucgaaagcccauca

SEQ ID NO: 581932 - RNA, 17 nt, Escherichia coli CFT073
aucgucagccaaaucgc

SEQ ID NO: 581933 - RNA, 22 nt, Escherichia coli CFT073
aucgucaaugccgucaccagca

SEQ ID NO: 581934 - RNA, 15 nt, Escherichia coli CFT073
aucgucacaccauga

SEQ ID NO: 581935 - RNA, 14 nt, Escherichia coli CFT073
aucgucacgcauca

SEQ ID NO: 581936 - RNA, 18 nt, Escherichia coli CFT073
aucgucacgcaucacgac

SEQ ID NO: 581937 - RNA, 16 nt, Escherichia coli CFT073
aucguaguaguucauc

SEQ ID NO: 581938 - RNA, 20 nt, Escherichia coli CFT073
aucguaguuuuugcccauca

SEQ ID NO: 581939 - RNA, 15 nt, Escherichia coli CFT073
aucguguccggcaau

SEQ ID NO: 581940 - RNA, 20 nt, Escherichia coli CFT073
aucgugcuucacuucagcga

SEQ ID NO: 581941 - RNA, 17 nt, Escherichia coli CFT073
aucgugcucgacagcgc

SEQ ID NO: 581942 - RNA, 15 nt, Escherichia coli CFT073
aucgugcucgcuuuc

SEQ ID NO: 581943 - RNA, 19 nt, Escherichia coli CFT073
aucguggccugcucacgca

SEQ ID NO: 581944 - RNA, 15 nt, Escherichia coli CFT073
aucgucgugcgguga

SEQ ID NO: 581945 - RNA, 21 nt, Escherichia coli CFT073
aucucaaccgcuucuuucuca

SEQ ID NO: 581946 - RNA, 19 nt, Escherichia coli CFT073
aucucaauguauucccgua

SEQ ID NO: 581947 - RNA, 23 nt, Escherichia coli CFT073
aucucaucaauggauucaugaua

SEQ ID NO: 581948 - RNA, 20 nt, Escherichia coli CFT073
aucguucucgcgauaaaacu

SEQ ID NO: 581949 - RNA, 24 nt, Escherichia coli CFT073
aucguugaaaaaauuuuauccaua

SEQ ID NO: 581950 - RNA, 17 nt, Escherichia coli CFT073
aucguugauuucaccau

SEQ ID NO: 581951 - RNA, 15 nt, Escherichia coli CFT073
aucguucauaccacg

SEQ ID NO: 581952 - RNA, 23 nt, Escherichia coli CFT073
aucucugcgcuauccagcgcaua

SEQ ID NO: 581953 - RNA, 20 nt, Escherichia coli CFT073
aucucuucaccauaaaacgc

SEQ ID NO: 581954 - RNA, 16 nt, Escherichia coli CFT073
aucucguugaucaccc

SEQ ID NO: 581955 - RNA, 18 nt, Escherichia coli CFT073
aucucgucacuuuucuua

SEQ ID NO: 581956 - RNA, 13 nt, Escherichia coli CFT073
aucucgucagcau

SEQ ID NO: 581957 - RNA, 15 nt, Escherichia coli CFT073
aucgguuuuuuucga

SEQ ID NO: 581958 - RNA, 21 nt, Escherichia coli CFT073
aucgguuuguaagcgggcaau

SEQ ID NO: 581959 - RNA, 17 nt, Escherichia coli CFT073
aucggugaggaucacca

SEQ ID NO: 581960 - RNA, 18 nt, Escherichia coli CFT073
aucggugaggaucaccag

SEQ ID NO: 581961 - RNA, 20 nt, Escherichia coli CFT073
aucggugagacgcacccuca

SEQ ID NO: 581962 - RNA, 12 nt, Escherichia coli CFT073
aucggugauaaa

SEQ ID NO: 581963 - RNA, 13 nt, Escherichia coli CFT073
aucgggcgauucg

SEQ ID NO: 581964 - RNA, 14 nt, Escherichia coli CFT073
aucgguagcaccag

SEQ ID NO: 581965 - RNA, 14 nt, Escherichia coli CFT073
aucgguauaaccaa

SEQ ID NO: 581966 - RNA, 13 nt, Escherichia coli CFT073
aucggucagcgca

SEQ ID NO: 581967 - RNA, 23 nt, Escherichia coli CFT073
aucgguccgccacauaccacggc

SEQ ID NO: 581968 - RNA, 21 nt, Escherichia coli CFT073
aucggucgaugcggauacggc

SEQ ID NO: 581969 - RNA, 23 nt, Escherichia coli CFT073
aucggaagaucuguuuauugagg

SEQ ID NO: 581970 - RNA, 23 nt, Escherichia coli CFT073
aucggaagacugucagugaccag

SEQ ID NO: 581971 - RNA, 22 nt, Escherichia coli CFT073
aucggagaacugcaacucaccu

SEQ ID NO: 581972 - RNA, 12 nt, Escherichia coli CFT073
aucggcagcaug

SEQ ID NO: 581973 - RNA, 13 nt, Escherichia coli CFT073
aucggcauucaca

SEQ ID NO: 581974 - RNA, 18 nt, Escherichia coli CFT073
aucggcaguuugagauug

SEQ ID NO: 581975 - RNA, 16 nt, Escherichia coli CFT073
aucgggaccaacgcgu

SEQ ID NO: 581976 - RNA, 22 nt, Escherichia coli CFT073
auccccaccaaaacagcgacac

SEQ ID NO: 581977 - RNA, 21 nt, Escherichia coli CFT073
aucccauuuacuggcaucaau

SEQ ID NO: 581978 - RNA, 21 nt, Escherichia coli CFT073
aucccccgauaaaacauuacu

SEQ ID NO: 581979 - RNA, 22 nt, Escherichia coli CFT073
auccauugaaaucaaaaucacc

SEQ ID NO: 581980 - RNA, 12 nt, Escherichia coli CFT073
auccauuuucga

SEQ ID NO: 581981 - RNA, 18 nt, Escherichia coli CFT073
aucccacgggucgccuug

SEQ ID NO: 581982 - RNA, 16 nt, Escherichia coli CFT073
aucccagcagagaucu

SEQ ID NO: 581983 - RNA, 19 nt, Escherichia coli CFT073
aucccagcguuuaucaaua

SEQ ID NO: 581984 - RNA, 20 nt, Escherichia coli CFT073
auccauauuuuuugaaaaau

SEQ ID NO: 581985 - RNA, 16 nt, Escherichia coli CFT073
auccaucagaccuucg

SEQ ID NO: 581986 - RNA, 12 nt, Escherichia coli CFT073
auccaugcggca

SEQ ID NO: 581987 - RNA, 14 nt, Escherichia coli CFT073
auccauuacaucac

SEQ ID NO: 581988 - RNA, 21 nt, Escherichia coli CFT073
auccaguauauugcugauuuu

SEQ ID NO: 581989 - RNA, 14 nt, Escherichia coli CFT073
auccaggugaaaaa

SEQ ID NO: 581990 - RNA, 13 nt, Escherichia coli CFT073
auccagucagcgg

SEQ ID NO: 581991 - RNA, 22 nt, Escherichia coli CFT073
auccaggcaaugacaucgcccu

SEQ ID NO: 581992 - RNA, 17 nt, Escherichia coli CFT073
auccaguugcgccgcau

SEQ ID NO: 581993 - RNA, 14 nt, Escherichia coli CFT073
auccauaccagcac

SEQ ID NO: 581994 - RNA, 17 nt, Escherichia coli CFT073
auccagccccaccagca

SEQ ID NO: 581995 - RNA, 18 nt, Escherichia coli CFT073
auccagccccaccagcaa

SEQ ID NO: 581996 - RNA, 13 nt, Escherichia coli CFT073
auccagccaaaca

SEQ ID NO: 581997 - RNA, 16 nt, Escherichia coli CFT073
auccagccagcgccgc

SEQ ID NO: 581998 - RNA, 21 nt, Escherichia coli CFT073
auccagauaaaacaucucuuc

SEQ ID NO: 581999 - RNA, 17 nt, Escherichia coli CFT073
auccagauuuuucagua

SEQ ID NO: 582000 - RNA, 15 nt, Escherichia coli CFT073
auccagcaacaacag

SEQ ID NO: 582001 - RNA, 19 nt, Escherichia coli CFT073
auccagcaccacuacagcg

SEQ ID NO: 582002 - RNA, 24 nt, Escherichia coli CFT073
auccagcagaauaacaucguccau

SEQ ID NO: 582003 - RNA, 23 nt, Escherichia coli CFT073
auccaggccacucaugccuuuca

SEQ ID NO: 582004 - RNA, 15 nt, Escherichia coli CFT073
auccagcguuaccgg

SEQ ID NO: 582005 - RNA, 20 nt, Escherichia coli CFT073
auccagcgcggcgaaggugc

SEQ ID NO: 582006 - RNA, 22 nt, Escherichia coli CFT073
auccccuccagcgagcuggcgc

SEQ ID NO: 582007 - RNA, 16 nt, Escherichia coli CFT073
aucccgcgauaugccg

SEQ ID NO: 582008 - RNA, 22 nt, Escherichia coli CFT073
aucccgccgggaucauaaccaa

SEQ ID NO: 582009 - RNA, 14 nt, Escherichia coli CFT073
aucccgccagccgc

SEQ ID NO: 582010 - RNA, 22 nt, Escherichia coli CFT073
aucccgguaucaaagcgccaga

SEQ ID NO: 582011 - RNA, 14 nt, Escherichia coli CFT073
aucccguacaguuu

SEQ ID NO: 582012 - RNA, 21 nt, Escherichia coli CFT073
aucccuaaugucgacauaauc

SEQ ID NO: 582013 - RNA, 15 nt, Escherichia coli CFT073
aucccugcaacauca

SEQ ID NO: 582014 - RNA, 16 nt, Escherichia coli CFT073
aucccugcaccaauga

SEQ ID NO: 582015 - RNA, 13 nt, Escherichia coli CFT073
aucccugccgcca

SEQ ID NO: 582016 - RNA, 11 nt, Escherichia coli CFT073
auccgccgcau

SEQ ID NO: 582017 - RNA, 15 nt, Escherichia coli CFT073
auccguaaaauacug

SEQ ID NO: 582018 - RNA, 14 nt, Escherichia coli CFT073
auccgguuucauca

SEQ ID NO: 582019 - RNA, 18 nt, Escherichia coli CFT073
auccggcauuaucacauc

SEQ ID NO: 582020 - RNA, 17 nt, Escherichia coli CFT073
auccggcgacaggaacc

SEQ ID NO: 582021 - RNA, 16 nt, Escherichia coli CFT073
auccggccuaccggac

SEQ ID NO: 582022 - RNA, 17 nt, Escherichia coli CFT073
auccggccuacggguga

SEQ ID NO: 582023 - RNA, 17 nt, Escherichia coli CFT073
auccggccuacugguga

SEQ ID NO: 582024 - RNA, 19 nt, Escherichia coli CFT073
auccggcacuuuuucauca

SEQ ID NO: 582025 - RNA, 17 nt, Escherichia coli CFT073
auccgcgauuaucccau

SEQ ID NO: 582026 - RNA, 17 nt, Escherichia coli CFT073
aucccugaaaugugcgc

SEQ ID NO: 582027 - RNA, 20 nt, Escherichia coli CFT073
aucccugaccuuaauaaacu

SEQ ID NO: 582028 - RNA, 21 nt, Escherichia coli CFT073
aucaucuguugugccacaucc

SEQ ID NO: 582029 - RNA, 14 nt, Escherichia coli CFT073
aucaucugcgccac

SEQ ID NO: 582030 - RNA, 22 nt, Escherichia coli CFT073
aucaucucacgcaguuuaucca

SEQ ID NO: 582031 - RNA, 22 nt, Escherichia coli CFT073
aucaugccggccagcgccacca

SEQ ID NO: 582032 - RNA, 17 nt, Escherichia coli CFT073
aucaugcucugccagcg

SEQ ID NO: 582033 - RNA, 17 nt, Escherichia coli CFT073
aucauccgcacaauccc

SEQ ID NO: 582034 - RNA, 13 nt, Escherichia coli CFT073
aucauccgugaau

SEQ ID NO: 582035 - RNA, 13 nt, Escherichia coli CFT073
aucauccucuuca

SEQ ID NO: 582036 - RNA, 17 nt, Escherichia coli CFT073
aucauccucuucagcaa

SEQ ID NO: 582037 - RNA, 18 nt, Escherichia coli CFT073
aucaucgacauugaccag

SEQ ID NO: 582038 - RNA, 16 nt, Escherichia coli CFT073
aucaucgauuuucugc

SEQ ID NO: 582039 - RNA, 16 nt, Escherichia coli CFT073
aucaucggcugcgcuu

SEQ ID NO: 582040 - RNA, 19 nt, Escherichia coli CFT073
aucaucgccuuaugcugcu

SEQ ID NO: 582041 - RNA, 22 nt, Escherichia coli CFT073
aucaucccuaaugucgacauaa

SEQ ID NO: 582042 - RNA, 23 nt, Escherichia coli CFT073
aucaucauucccuacgcgauaaa

SEQ ID NO: 582043 - RNA, 15 nt, Escherichia coli CFT073
aucaucauuguuggu

SEQ ID NO: 582044 - RNA, 21 nt, Escherichia coli CFT073
aucauccagacguuucacggu

SEQ ID NO: 582045 - RNA, 18 nt, Escherichia coli CFT073
aucaucaugcuuaaauau

SEQ ID NO: 582046 - RNA, 13 nt, Escherichia coli CFT073
aucaucagaaaug

SEQ ID NO: 582047 - RNA, 20 nt, Escherichia coli CFT073
aucauuuucagcuuucgcau

SEQ ID NO: 582048 - RNA, 14 nt, Escherichia coli CFT073
auccaacugugaau

SEQ ID NO: 582049 - RNA, 12 nt, Escherichia coli CFT073
auccacaccuga

SEQ ID NO: 582050 - RNA, 13 nt, Escherichia coli CFT073
auccacccgcagc

SEQ ID NO: 582051 - RNA, 21 nt, Escherichia coli CFT073
auccaccguuggcagauaacc

SEQ ID NO: 582052 - RNA, 12 nt, Escherichia coli CFT073
aucauugcucuu

SEQ ID NO: 582053 - RNA, 16 nt, Escherichia coli CFT073
aucauugguuaacucc

SEQ ID NO: 582054 - RNA, 23 nt, Escherichia coli CFT073
aucauuagcccuauaaucaccgu

SEQ ID NO: 582055 - RNA, 21 nt, Escherichia coli CFT073
aucauggcauccuguuuucug

SEQ ID NO: 582056 - RNA, 13 nt, Escherichia coli CFT073
aucauacuggcuc

SEQ ID NO: 582057 - RNA, 18 nt, Escherichia coli CFT073
aucauagcgaauaauccc

SEQ ID NO: 582058 - RNA, 13 nt, Escherichia coli CFT073
aucaucacgauca

SEQ ID NO: 582059 - RNA, 22 nt, Escherichia coli CFT073
aucaguccauggcagaugauca

SEQ ID NO: 582060 - RNA, 18 nt, Escherichia coli CFT073
aucagucuuaagcggcua

SEQ ID NO: 582061 - RNA, 24 nt, Escherichia coli CFT073
aucagucccugaaucgccacgcca

SEQ ID NO: 582062 - RNA, 15 nt, Escherichia coli CFT073
aucaguuuaucaauc

SEQ ID NO: 582063 - RNA, 16 nt, Escherichia coli CFT073
aucaggucuuucugaa

SEQ ID NO: 582064 - RNA, 18 nt, Escherichia coli CFT073
aucagucagagccugcca

SEQ ID NO: 582065 - RNA, 16 nt, Escherichia coli CFT073
aucaguaaucgcgcca

SEQ ID NO: 582066 - RNA, 18 nt, Escherichia coli CFT073
aucaguacccaaucagcg

SEQ ID NO: 582067 - RNA, 16 nt, Escherichia coli CFT073
aucaguagcauccccg

SEQ ID NO: 582068 - RNA, 13 nt, Escherichia coli CFT073
aucaggucgaaaa

SEQ ID NO: 582069 - RNA, 14 nt, Escherichia coli CFT073
aucaggucgaaaau

SEQ ID NO: 582070 - RNA, 22 nt, Escherichia coli CFT073
aucagguauaccgaaaucgcca

SEQ ID NO: 582071 - RNA, 23 nt, Escherichia coli CFT073
aucagguauaccgaaaucgccau

SEQ ID NO: 582072 - RNA, 21 nt, Escherichia coli CFT073
aucagcuuuuccauaucaagc

SEQ ID NO: 582073 - RNA, 22 nt, Escherichia coli CFT073
aucagcuucugcacgaugcugc

SEQ ID NO: 582074 - RNA, 23 nt, Escherichia coli CFT073
aucagcuucugcacgaugcugcg

SEQ ID NO: 582075 - RNA, 22 nt, Escherichia coli CFT073
auauugcucuaccgcuucgcgu

SEQ ID NO: 582076 - RNA, 23 nt, Escherichia coli CFT073
auauugcaccagaucuuccagcg

SEQ ID NO: 582077 - RNA, 16 nt, Escherichia coli CFT073
auauugccaucacggc

SEQ ID NO: 582078 - RNA, 22 nt, Escherichia coli CFT073
aucaggccuacaugauuucugc

SEQ ID NO: 582079 - RNA, 16 nt, Escherichia coli CFT073
aucaggccuccgguga

SEQ ID NO: 582080 - RNA, 13 nt, Escherichia coli CFT073
aucaggccugcaa

SEQ ID NO: 582081 - RNA, 20 nt, Escherichia coli CFT073
aucaggcuaucuucgauaaa

SEQ ID NO: 582082 - RNA, 13 nt, Escherichia coli CFT073
aucaggcuggugu

SEQ ID NO: 582083 - RNA, 17 nt, Escherichia coli CFT073
aucaggcuuuauucuga

SEQ ID NO: 582084 - RNA, 22 nt, Escherichia coli CFT073
aucaggcauuauggcgcaguug

SEQ ID NO: 582085 - RNA, 18 nt, Escherichia coli CFT073
aucaggccaaccgcccau

SEQ ID NO: 582086 - RNA, 17 nt, Escherichia coli CFT073
aucaggcaacaucgcca

SEQ ID NO: 582087 - RNA, 17 nt, Escherichia coli CFT073
aucaggcagaacgccau

SEQ ID NO: 582088 - RNA, 13 nt, Escherichia coli CFT073
aucaggcauauuc

SEQ ID NO: 582089 - RNA, 17 nt, Escherichia coli CFT073
cccgcuucaaacgcuga

SEQ ID NO: 582090 - RNA, 13 nt, Escherichia coli CFT073
cccgaugccagca

SEQ ID NO: 582091 - RNA, 20 nt, Escherichia coli CFT073
cccgauguuaauuucuuugc

SEQ ID NO: 582092 - RNA, 15 nt, Escherichia coli CFT073
cccgcauaugcggcg

SEQ ID NO: 582093 - RNA, 22 nt, Escherichia coli CFT073
cccaugcguuaucgccauccag

SEQ ID NO: 582094 - RNA, 14 nt, Escherichia coli CFT073
cccauuaauaccgc

SEQ ID NO: 582095 - RNA, 13 nt, Escherichia coli CFT073
cccauucgccgaa

SEQ ID NO: 582096 - RNA, 22 nt, Escherichia coli CFT073
cccaugucagaccaaaacgcgc

SEQ ID NO: 582097 - RNA, 22 nt, Escherichia coli CFT073
ccccguaaaucgucaguagcgc

SEQ ID NO: 582098 - RNA, 20 nt, Escherichia coli CFT073
ccccugugccagcucgugca

SEQ ID NO: 582099 - RNA, 12 nt, Escherichia coli CFT073
ccccugcccgcg

SEQ ID NO: 582100 - RNA, 19 nt, Escherichia coli CFT073
ccccucuucagccgcaaac

SEQ ID NO: 582101 - RNA, 19 nt, Escherichia coli CFT073
cccgaccaucgccagcuca

SEQ ID NO: 582102 - RNA, 19 nt, Escherichia coli CFT073
cccgacgauaccgccgcac

SEQ ID NO: 582103 - RNA, 20 nt, Escherichia coli CFT073
cccgaccgagcuggugauaa

SEQ ID NO: 582104 - RNA, 18 nt, Escherichia coli CFT073
cccggucugauauucagg

SEQ ID NO: 582105 - RNA, 21 nt, Escherichia coli CFT073
cccggguaaacaccaccgaaa

SEQ ID NO: 582106 - RNA, 11 nt, Escherichia coli CFT073
cccgcuucggc

SEQ ID NO: 582107 - RNA, 14 nt, Escherichia coli CFT073
cccugccagcguca

SEQ ID NO: 582108 - RNA, 21 nt, Escherichia coli CFT073
cccugccccaucugccccauu

SEQ ID NO: 582109 - RNA, 22 nt, Escherichia coli CFT073
cccugaccgucuuuuuuuacgg

SEQ ID NO: 582110 - RNA, 15 nt, Escherichia coli CFT073
cccugcgccagcgca

SEQ ID NO: 582111 - RNA, 15 nt, Escherichia coli CFT073
cccugccugacagac

SEQ ID NO: 582112 - RNA, 11 nt, Escherichia coli CFT073
cccugccgcca

SEQ ID NO: 582113 - RNA, 18 nt, Escherichia coli CFT073
cccugugccagcggcagu

SEQ ID NO: 582114 - RNA, 22 nt, Escherichia coli CFT073
ccgaaagcacuguucgccgcag

SEQ ID NO: 582115 - RNA, 19 nt, Escherichia coli CFT073
ccgaaacuugcgugauauu

SEQ ID NO: 582116 - RNA, 14 nt, Escherichia coli CFT073
ccgaaaucgccauu

SEQ ID NO: 582117 - RNA, 22 nt, Escherichia coli CFT073
cccugggcuucauccagcagcg

SEQ ID NO: 582118 - RNA, 23 nt, Escherichia coli CFT073
ccgaauaaggcguuugcgucgca

SEQ ID NO: 582119 - RNA, 16 nt, Escherichia coli CFT073
ccgaagcgccaauacc

SEQ ID NO: 582120 - RNA, 20 nt, Escherichia coli CFT073
ccgaagccuuuaccgcgcuc

SEQ ID NO: 582121 - RNA, 18 nt, Escherichia coli CFT073
ccgaagcagcugcuggug

SEQ ID NO: 582122 - RNA, 15 nt, Escherichia coli CFT073
ccagucagcaccaga

SEQ ID NO: 582123 - RNA, 20 nt, Escherichia coli CFT073
ccagucagcgaacaccagca

SEQ ID NO: 582124 - RNA, 21 nt, Escherichia coli CFT073
ccaguagugcuuucagcgaaa

SEQ ID NO: 582125 - RNA, 17 nt, Escherichia coli CFT073
ccaguccaucggcauua

SEQ ID NO: 582126 - RNA, 12 nt, Escherichia coli CFT073
ccagugccgccu

SEQ ID NO: 582127 - RNA, 12 nt, Escherichia coli CFT073
ccagugccggaa

SEQ ID NO: 582128 - RNA, 23 nt, Escherichia coli CFT073
ccaguucggcguucaccagcgca

SEQ ID NO: 582129 - RNA, 20 nt, Escherichia coli CFT073
ccaguucgcuggcauugcca

SEQ ID NO: 582130 - RNA, 23 nt, Escherichia coli CFT073
ccaguucacgcgauuuuucaucg

SEQ ID NO: 582131 - RNA, 14 nt, Escherichia coli CFT073
ccauaaauuugugc

SEQ ID NO: 582132 - RNA, 14 nt, Escherichia coli CFT073
ccauaacaaauauc

SEQ ID NO: 582133 - RNA, 16 nt, Escherichia coli CFT073
ccauaaccgccagcac

SEQ ID NO: 582134 - RNA, 17 nt, Escherichia coli CFT073
ccauaaccgccagcaca

SEQ ID NO: 582135 - RNA, 18 nt, Escherichia coli CFT073
ccauaaccgccagcacag

SEQ ID NO: 582136 - RNA, 22 nt, Escherichia coli CFT073
ccauaaccgccagcacagccag

SEQ ID NO: 582137 - RNA, 14 nt, Escherichia coli CFT073
ccauaauccggguu

SEQ ID NO: 582138 - RNA, 11 nt, Escherichia coli CFT073
ccauaaucugc

SEQ ID NO: 582139 - RNA, 13 nt, Escherichia coli CFT073
ccaguuucgccag

SEQ ID NO: 582140 - RNA, 20 nt, Escherichia coli CFT073
ccaguuuggugacgccacaa

SEQ ID NO: 582141 - RNA, 20 nt, Escherichia coli CFT073
ccaguuucuuuuaacaaacu

SEQ ID NO: 582142 - RNA, 15 nt, Escherichia coli CFT073
ccauaaaaacgauaa

SEQ ID NO: 582143 - RNA, 16 nt, Escherichia coli CFT073
ccauaaagauguaauc

SEQ ID NO: 582144 - RNA, 22 nt, Escherichia coli CFT073
ccauaaagguaccgacgaucaa

SEQ ID NO: 582145 - RNA, 21 nt, Escherichia coli CFT073
ccauauaugccaucgccagca

SEQ ID NO: 582146 - RNA, 15 nt, Escherichia coli CFT073
ccauagggcgugaag

SEQ ID NO: 582147 - RNA, 12 nt, Escherichia coli CFT073
ccauauaaacau

SEQ ID NO: 582148 - RNA, 23 nt, Escherichia coli CFT073
ccauauaccgcgguucccagcgu

SEQ ID NO: 582149 - RNA, 19 nt, Escherichia coli CFT073
ccaucaauagcccggcaau

SEQ ID NO: 582150 - RNA, 19 nt, Escherichia coli CFT073
ccaucaaccuucacaaucu

SEQ ID NO: 582151 - RNA, 13 nt, Escherichia coli CFT073
ccauaucgcuggc

SEQ ID NO: 582152 - RNA, 15 nt, Escherichia coli CFT073
ccauauugaacggca

SEQ ID NO: 582153 - RNA, 21 nt, Escherichia coli CFT073
ccaucaacaacuggcguuucu

SEQ ID NO: 582154 - RNA, 17 nt, Escherichia coli CFT073
ccauaugacaccaacgc

SEQ ID NO: 582155 - RNA, 22 nt, Escherichia coli CFT073
ccauaugcagccacugcugcgc

SEQ ID NO: 582156 - RNA, 20 nt, Escherichia coli CFT073
ccaguagcgagccgucgcua

SEQ ID NO: 582157 - RNA, 12 nt, Escherichia coli CFT073
ccaguacgcgca

SEQ ID NO: 582158 - RNA, 16 nt, Escherichia coli CFT073
ccaguaccugagcgau

SEQ ID NO: 582159 - RNA, 12 nt, Escherichia coli CFT073
ccaguaccagca

SEQ ID NO: 582160 - RNA, 15 nt, Escherichia coli CFT073
ccaguaccgccgcag

SEQ ID NO: 582161 - RNA, 22 nt, Escherichia coli CFT073
ccaguaccgccgccauaaacag

SEQ ID NO: 582162 - RNA, 19 nt, Escherichia coli CFT073
ccaguaaauuguugccgga

SEQ ID NO: 582163 - RNA, 21 nt, Escherichia coli CFT073
ccaguaagguaacgcugcccg

SEQ ID NO: 582164 - RNA, 19 nt, Escherichia coli CFT073
ccaguaagcaguccagcgc

SEQ ID NO: 582165 - RNA, 18 nt, Escherichia coli CFT073
ccagguggauaaggcaac

SEQ ID NO: 582166 - RNA, 22 nt, Escherichia coli CFT073
ccagguguuuaaccaacacaau

SEQ ID NO: 582167 - RNA, 14 nt, Escherichia coli CFT073
ccaggugccggucu

SEQ ID NO: 582168 - RNA, 22 nt, Escherichia coli CFT073
ccaggucggauaaggcguuuau

SEQ ID NO: 582169 - RNA, 18 nt, Escherichia coli CFT073
ccaggucgcuugccgcca

SEQ ID NO: 582170 - RNA, 23 nt, Escherichia coli CFT073
ccagguaaagaccauaaugaugg

SEQ ID NO: 582171 - RNA, 20 nt, Escherichia coli CFT073
ccaggcuggucgcgcggaag

SEQ ID NO: 582172 - RNA, 23 nt, Escherichia coli CFT073
ccaggcuuacacuuccuuuacuu

SEQ ID NO: 582173 - RNA, 13 nt, Escherichia coli CFT073
ccaggcuuuccgu

SEQ ID NO: 582174 - RNA, 17 nt, Escherichia coli CFT073
ccaggcagcgauuaacu

SEQ ID NO: 582175 - RNA, 13 nt, Escherichia coli CFT073
ccaggcagccaua

SEQ ID NO: 582176 - RNA, 22 nt, Escherichia coli CFT073
ccaggcaaguagcgccagacug

SEQ ID NO: 582177 - RNA, 13 nt, Escherichia coli CFT073
ccaggcaccaaaa

SEQ ID NO: 582178 - RNA, 14 nt, Escherichia coli CFT073
ccaggccaucgcca

SEQ ID NO: 582179 - RNA, 13 nt, Escherichia coli CFT073
ccaggccaucagc

SEQ ID NO: 582180 - RNA, 16 nt, Escherichia coli CFT073
ccaggcuacgccagau

SEQ ID NO: 582181 - RNA, 22 nt, Escherichia coli CFT073
ccaggcggguacguuucgccug

SEQ ID NO: 582182 - RNA, 14 nt, Escherichia coli CFT073
ccaggcguggauac

SEQ ID NO: 582183 - RNA, 13 nt, Escherichia coli CFT073
cccaaaccgccca

SEQ ID NO: 582184 - RNA, 13 nt, Escherichia coli CFT073
cccaaagccaauc

SEQ ID NO: 582185 - RNA, 17 nt, Escherichia coli CFT073
cccaaaugucggaugcg

SEQ ID NO: 582186 - RNA, 23 nt, Escherichia coli CFT073
cccaagcgggaauagcucaguug

SEQ ID NO: 582187 - RNA, 17 nt, Escherichia coli CFT073
cccaaguuuaugcaaua

SEQ ID NO: 582188 - RNA, 18 nt, Escherichia coli CFT073
cccaacgcgccaccgacc

SEQ ID NO: 582189 - RNA, 18 nt, Escherichia coli CFT073
ccauuucguuagcaaacg

SEQ ID NO: 582190 - RNA, 12 nt, Escherichia coli CFT073
ccauuucugcga

SEQ ID NO: 582191 - RNA, 19 nt, Escherichia coli CFT073
ccauuuacccgauccacug

SEQ ID NO: 582192 - RNA, 13 nt, Escherichia coli CFT073
ccauuucaaugcg

SEQ ID NO: 582193 - RNA, 11 nt, Escherichia coli CFT073
ccauuucgucg

SEQ ID NO: 582194 - RNA, 17 nt, Escherichia coli CFT073
ccauuugggcggcuuuu

SEQ ID NO: 582195 - RNA, 15 nt, Escherichia coli CFT073
cccaaaauaucacgc

SEQ ID NO: 582196 - RNA, 17 nt, Escherichia coli CFT073
ccauuguucggcgggua

SEQ ID NO: 582197 - RNA, 16 nt, Escherichia coli CFT073
ccauguugcgcagagu

SEQ ID NO: 582198 - RNA, 22 nt, Escherichia coli CFT073
ccauugcgggcuggaaacgcga

SEQ ID NO: 582199 - RNA, 16 nt, Escherichia coli CFT073
ccaucucaacuuucuu

SEQ ID NO: 582200 - RNA, 22 nt, Escherichia coli CFT073
ccaucguuaccuuugcagucaa

SEQ ID NO: 582201 - RNA, 15 nt, Escherichia coli CFT073
ccaucguugagagau

SEQ ID NO: 582202 - RNA, 18 nt, Escherichia coli CFT073
ccaucguugaugcauacg

SEQ ID NO: 582203 - RNA, 15 nt, Escherichia coli CFT073
ccaucuccagcugcu

SEQ ID NO: 582204 - RNA, 20 nt, Escherichia coli CFT073
ccaucugaauaaacggcuca

SEQ ID NO: 582205 - RNA, 21 nt, Escherichia coli CFT073
ccaugcgaagaccgcaucacg

SEQ ID NO: 582206 - RNA, 15 nt, Escherichia coli CFT073
ccaucggcgcuggcg

SEQ ID NO: 582207 - RNA, 18 nt, Escherichia coli CFT073
ccaucggcagcgguaagg

SEQ ID NO: 582208 - RNA, 19 nt, Escherichia coli CFT073
ccaucggcauuaaucugcu

SEQ ID NO: 582209 - RNA, 17 nt, Escherichia coli CFT073
ccaucaggaugauggcg

SEQ ID NO: 582210 - RNA, 12 nt, Escherichia coli CFT073
ccaucaggcaua

SEQ ID NO: 582211 - RNA, 22 nt, Escherichia coli CFT073
ccaucaggccaggcgugaauca

SEQ ID NO: 582212 - RNA, 20 nt, Escherichia coli CFT073
ccaucagcucuguagcaacg

SEQ ID NO: 582213 - RNA, 12 nt, Escherichia coli CFT073
ccaucagcgcua

SEQ ID NO: 582214 - RNA, 23 nt, Escherichia coli CFT073
ccaucaaugugcugagaacaaga

SEQ ID NO: 582215 - RNA, 17 nt, Escherichia coli CFT073
ccaucacaauuccggua

SEQ ID NO: 582216 - RNA, 13 nt, Escherichia coli CFT073
ccaucaccggcau

SEQ ID NO: 582217 - RNA, 13 nt, Escherichia coli CFT073
ccaucaccucuuc

SEQ ID NO: 582218 - RNA, 16 nt, Escherichia coli CFT073
ccaucaccuuaccgcc

SEQ ID NO: 582219 - RNA, 14 nt, Escherichia coli CFT073
ccaucacggcagcc

SEQ ID NO: 582220 - RNA, 18 nt, Escherichia coli CFT073
ccaucacuaaggguaaaa

SEQ ID NO: 582221 - RNA, 17 nt, Escherichia coli CFT073
ccaucacuauucagauc

SEQ ID NO: 582222 - RNA, 18 nt, Escherichia coli CFT073
ccaucagacuuugcgcca

SEQ ID NO: 582223 - RNA, 14 nt, Escherichia coli CFT073
ccaucagcaguacg

SEQ ID NO: 582224 - RNA, 23 nt, Escherichia coli CFT073
ccaucagccaugguuuaaucgcc

SEQ ID NO: 582225 - RNA, 14 nt, Escherichia coli CFT073
cccauacauaccag

SEQ ID NO: 582226 - RNA, 14 nt, Escherichia coli CFT073
cccauaccacagca

SEQ ID NO: 582227 - RNA, 17 nt, Escherichia coli CFT073
cccauaaugccccagcg

SEQ ID NO: 582228 - RNA, 16 nt, Escherichia coli CFT073
cccauaaacccggaua

SEQ ID NO: 582229 - RNA, 22 nt, Escherichia coli CFT073
cccauacuuaaugccaguucag

SEQ ID NO: 582230 - RNA, 22 nt, Escherichia coli CFT073
cccauagagagauguugcugcu

SEQ ID NO: 582231 - RNA, 22 nt, Escherichia coli CFT073
cccaugaugcgcggcuccagaa

SEQ ID NO: 582232 - RNA, 15 nt, Escherichia coli CFT073
cccaucggcgccauu

SEQ ID NO: 582233 - RNA, 19 nt, Escherichia coli CFT073
cccaggucaauaauuucuc

SEQ ID NO: 582234 - RNA, 13 nt, Escherichia coli CFT073
cccagacccaguu

SEQ ID NO: 582235 - RNA, 16 nt, Escherichia coli CFT073
cccagacacaguucuu

SEQ ID NO: 582236 - RNA, 20 nt, Escherichia coli CFT073
cccagaacgccgaauaacgc

SEQ ID NO: 582237 - RNA, 14 nt, Escherichia coli CFT073
cccagcgaaccguu

SEQ ID NO: 582238 - RNA, 18 nt, Escherichia coli CFT073
cccagcgaagcaaaccag

SEQ ID NO: 582239 - RNA, 17 nt, Escherichia coli CFT073
cccagaacucacgcacu

SEQ ID NO: 582240 - RNA, 22 nt, Escherichia coli CFT073
cccacuucauauggcacuuuca

SEQ ID NO: 582241 - RNA, 14 nt, Escherichia coli CFT073
cccacuucauccga

SEQ ID NO: 582242 - RNA, 15 nt, Escherichia coli CFT073
cccacugccgccuuc

SEQ ID NO: 582243 - RNA, 16 nt, Escherichia coli CFT073
cccacauguugcgcuu

SEQ ID NO: 582244 - RNA, 18 nt, Escherichia coli CFT073
cccaccaaaacagcgaca

SEQ ID NO: 582245 - RNA, 15 nt, Escherichia coli CFT073
cccacaucaauucag

SEQ ID NO: 582246 - RNA, 16 nt, Escherichia coli CFT073
cccacaucacauccag

SEQ ID NO: 582247 - RNA, 12 nt, Escherichia coli CFT073
cccacagcucug

SEQ ID NO: 582248 - RNA, 13 nt, Escherichia coli CFT073
ccacuaccagcug

SEQ ID NO: 582249 - RNA, 21 nt, Escherichia coli CFT073
ccacguucggugauauacgcc

SEQ ID NO: 582250 - RNA, 16 nt, Escherichia coli CFT073
ccacguucaugccgac

SEQ ID NO: 582251 - RNA, 22 nt, Escherichia coli CFT073
ccacguuccuggaaccagugaa

SEQ ID NO: 582252 - RNA, 16 nt, Escherichia coli CFT073
ccacuaacugcgcgcu

SEQ ID NO: 582253 - RNA, 13 nt, Escherichia coli CFT073
ccacucccgcgcu

SEQ ID NO: 582254 - RNA, 20 nt, Escherichia coli CFT073
ccacgucugccacggcagaa

SEQ ID NO: 582255 - RNA, 18 nt, Escherichia coli CFT073
ccacgucguuucgugcuc

SEQ ID NO: 582256 - RNA, 24 nt, Escherichia coli CFT073
ccacgccguuuuuacccagcagca

SEQ ID NO: 582257 - RNA, 17 nt, Escherichia coli CFT073
ccacgcuauacagcagc

SEQ ID NO: 582258 - RNA, 21 nt, Escherichia coli CFT073
ccacgcuauacagcagccauu

SEQ ID NO: 582259 - RNA, 19 nt, Escherichia coli CFT073
ccacgcuaugugcuucauc

SEQ ID NO: 582260 - RNA, 20 nt, Escherichia coli CFT073
ccacgcuaugugcuucauca

SEQ ID NO: 582261 - RNA, 20 nt, Escherichia coli CFT073
ccagaucuuucgccagucca

SEQ ID NO: 582262 - RNA, 20 nt, Escherichia coli CFT073
ccagaucuaucuggcgcgcu

SEQ ID NO: 582263 - RNA, 12 nt, Escherichia coli CFT073
ccagauccgcca

SEQ ID NO: 582264 - RNA, 18 nt, Escherichia coli CFT073
ccagaucaucguuuccga

SEQ ID NO: 582265 - RNA, 19 nt, Escherichia coli CFT073
ccagaucagacccagaacc

SEQ ID NO: 582266 - RNA, 14 nt, Escherichia coli CFT073
ccagauagccgacc

SEQ ID NO: 582267 - RNA, 14 nt, Escherichia coli CFT073
ccagauagccgcca

SEQ ID NO: 582268 - RNA, 18 nt, Escherichia coli CFT073
ccagauaguucgcaaucg

SEQ ID NO: 582269 - RNA, 15 nt, Escherichia coli CFT073
ccagauaaggcguuc

SEQ ID NO: 582270 - RNA, 23 nt, Escherichia coli CFT073
ccagauaaggcguucacgccgca

SEQ ID NO: 582271 - RNA, 23 nt, Escherichia coli CFT073
ccagauaaggcguuuacgccgca

SEQ ID NO: 582272 - RNA, 15 nt, Escherichia coli CFT073
ccagagucuuugcuu

SEQ ID NO: 582273 - RNA, 17 nt, Escherichia coli CFT073
ccagauacugccgacca

SEQ ID NO: 582274 - RNA, 15 nt, Escherichia coli CFT073
ccagauagccagguu

SEQ ID NO: 582275 - RNA, 15 nt, Escherichia coli CFT073
ccagaccuuaucaca

SEQ ID NO: 582276 - RNA, 23 nt, Escherichia coli CFT073
ccagacgacgcgcuuguccugcc

SEQ ID NO: 582277 - RNA, 20 nt, Escherichia coli CFT073
ccagaccgugcgcagcaucg

SEQ ID NO: 582278 - RNA, 18 nt, Escherichia coli CFT073
ccagaccagcuaccacgc

SEQ ID NO: 582279 - RNA, 16 nt, Escherichia coli CFT073
ccagacauuacaaaau

SEQ ID NO: 582280 - RNA, 18 nt, Escherichia coli CFT073
ccagaccacugcgccgcu

SEQ ID NO: 582281 - RNA, 17 nt, Escherichia coli CFT073
ccagacacaacaauacc

SEQ ID NO: 582282 - RNA, 16 nt, Escherichia coli CFT073
ccagacaccggcuuuc

SEQ ID NO: 582283 - RNA, 19 nt, Escherichia coli CFT073
ccacuggcuccaccgcuac

SEQ ID NO: 582284 - RNA, 16 nt, Escherichia coli CFT073
ccacugccuuuaucaa

SEQ ID NO: 582285 - RNA, 17 nt, Escherichia coli CFT073
ccacugcgacaccagca

SEQ ID NO: 582286 - RNA, 19 nt, Escherichia coli CFT073
ccacugcgccaacgucugc

SEQ ID NO: 582287 - RNA, 21 nt, Escherichia coli CFT073
ccacgaaaucuuccaguggca

SEQ ID NO: 582288 - RNA, 21 nt, Escherichia coli CFT073
ccaccuggggcgggauggucg

SEQ ID NO: 582289 - RNA, 15 nt, Escherichia coli CFT073
ccaccuggccugcga

SEQ ID NO: 582290 - RNA, 15 nt, Escherichia coli CFT073
ccaccguugugaaaa

SEQ ID NO: 582291 - RNA, 16 nt, Escherichia coli CFT073
ccaccguguauuucug

SEQ ID NO: 582292 - RNA, 19 nt, Escherichia coli CFT073
ccaccguguucaugaccgu

SEQ ID NO: 582293 - RNA, 13 nt, Escherichia coli CFT073
ccacccaccagcg

SEQ ID NO: 582294 - RNA, 17 nt, Escherichia coli CFT073
ccaccauucgccaagaa

SEQ ID NO: 582295 - RNA, 15 nt, Escherichia coli CFT073
ccaccauuuuacgcc

SEQ ID NO: 582296 - RNA, 17 nt, Escherichia coli CFT073
ccacgagagaaccagcc

SEQ ID NO: 582297 - RNA, 12 nt, Escherichia coli CFT073
ccacgauauccg

SEQ ID NO: 582298 - RNA, 20 nt, Escherichia coli CFT073
ccacgcaaagcacgccaggu

SEQ ID NO: 582299 - RNA, 13 nt, Escherichia coli CFT073
ccacgcaccacca

SEQ ID NO: 582300 - RNA, 18 nt, Escherichia coli CFT073
ccacgauucagcgucggu

SEQ ID NO: 582301 - RNA, 12 nt, Escherichia coli CFT073
ccacgagcggcg

SEQ ID NO: 582302 - RNA, 12 nt, Escherichia coli CFT073
ccacgcccagcg

SEQ ID NO: 582303 - RNA, 13 nt, Escherichia coli CFT073
ccacgcccagcga

SEQ ID NO: 582304 - RNA, 14 nt, Escherichia coli CFT073
ccacgcccagcgca

SEQ ID NO: 582305 - RNA, 11 nt, Escherichia coli CFT073
ccacgccagug

SEQ ID NO: 582306 - RNA, 16 nt, Escherichia coli CFT073
ccacgccaagaaacac

SEQ ID NO: 582307 - RNA, 21 nt, Escherichia coli CFT073
ccacgccaagaaacaccagaa

SEQ ID NO: 582308 - RNA, 15 nt, Escherichia coli CFT073
ccagcgccaaagcca

SEQ ID NO: 582309 - RNA, 12 nt, Escherichia coli CFT073
ccagcgcaccug

SEQ ID NO: 582310 - RNA, 14 nt, Escherichia coli CFT073
ccagcgagcuggcg

SEQ ID NO: 582311 - RNA, 15 nt, Escherichia coli CFT073
ccagccgccgcuccu

SEQ ID NO: 582312 - RNA, 14 nt, Escherichia coli CFT073
ccagccgccagcau

SEQ ID NO: 582313 - RNA, 17 nt, Escherichia coli CFT073
ccagccgcaaacgacac

SEQ ID NO: 582314 - RNA, 12 nt, Escherichia coli CFT073
ccagcguaauaa

SEQ ID NO: 582315 - RNA, 18 nt, Escherichia coli CFT073
ccagcgguuguagccacg

SEQ ID NO: 582316 - RNA, 19 nt, Escherichia coli CFT073
ccagcgucucuucaauccg

SEQ ID NO: 582317 - RNA, 16 nt, Escherichia coli CFT073
ccagcgggaucggcgu

SEQ ID NO: 582318 - RNA, 17 nt, Escherichia coli CFT073
ccagcggcaccgaggau

SEQ ID NO: 582319 - RNA, 17 nt, Escherichia coli CFT073
ccagauggaucagcguu

SEQ ID NO: 582320 - RNA, 19 nt, Escherichia coli CFT073
ccagaugcgcuuuuaccgu

SEQ ID NO: 582321 - RNA, 18 nt, Escherichia coli CFT073
ccagaugcggcgugaacg

SEQ ID NO: 582322 - RNA, 20 nt, Escherichia coli CFT073
ccagaugucuuuacccggac

SEQ ID NO: 582323 - RNA, 19 nt, Escherichia coli CFT073
ccagauguucuucaauggu

SEQ ID NO: 582324 - RNA, 14 nt, Escherichia coli CFT073
ccagcagcaaccau

SEQ ID NO: 582325 - RNA, 17 nt, Escherichia coli CFT073
ccagcacgaccgccauu

SEQ ID NO: 582326 - RNA, 18 nt, Escherichia coli CFT073
ccagcauggcaccugcgg

SEQ ID NO: 582327 - RNA, 22 nt, Escherichia coli CFT073
ccagcauauguuuacgcuggcg

SEQ ID NO: 582328 - RNA, 12 nt, Escherichia coli CFT073
ccagcaguugcu

SEQ ID NO: 582329 - RNA, 17 nt, Escherichia coli CFT073
ccagcaguucaauccac

SEQ ID NO: 582330 - RNA, 18 nt, Escherichia coli CFT073
ccagcauucccgccacca

SEQ ID NO: 582331 - RNA, 12 nt, Escherichia coli CFT073
ccagcaguguuu

SEQ ID NO: 582332 - RNA, 13 nt, Escherichia coli CFT073
ccagccaauuucc

SEQ ID NO: 582333 - RNA, 11 nt, Escherichia coli CFT073
ccagcccagcg

SEQ ID NO: 582334 - RNA, 12 nt, Escherichia coli CFT073
ccagccaugcca

SEQ ID NO: 582335 - RNA, 13 nt, Escherichia coli CFT073
ccagcccgcuggu

SEQ ID NO: 582336 - RNA, 19 nt, Escherichia coli CFT073
ccagcccggcaagugucgc

SEQ ID NO: 582337 - RNA, 15 nt, Escherichia coli CFT073
ccagccccgcgcggc

SEQ ID NO: 582338 - RNA, 20 nt, Escherichia coli CFT073
ccagccccauaauauaagga

SEQ ID NO: 582339 - RNA, 14 nt, Escherichia coli CFT073
caucguuacgccca

SEQ ID NO: 582340 - RNA, 16 nt, Escherichia coli CFT073
caucguuagauagcgg

SEQ ID NO: 582341 - RNA, 21 nt, Escherichia coli CFT073
caucgucugcggugcgccaaa

SEQ ID NO: 582342 - RNA, 13 nt, Escherichia coli CFT073
caucgugauaaac

SEQ ID NO: 582343 - RNA, 12 nt, Escherichia coli CFT073
caucgugcacca

SEQ ID NO: 582344 - RNA, 14 nt, Escherichia coli CFT073
caucgucgccagac

SEQ ID NO: 582345 - RNA, 13 nt, Escherichia coli CFT073
caucgucagacgc

SEQ ID NO: 582346 - RNA, 21 nt, Escherichia coli CFT073
caucgucagccaaaucgcccc

SEQ ID NO: 582347 - RNA, 19 nt, Escherichia coli CFT073
caucggugcgagagcggag

SEQ ID NO: 582348 - RNA, 19 nt, Escherichia coli CFT073
caucgguucgaugauaugc

SEQ ID NO: 582349 - RNA, 21 nt, Escherichia coli CFT073
caucgguuguuuucaguagca

SEQ ID NO: 582350 - RNA, 22 nt, Escherichia coli CFT073
caucggcuuauucauaucaaac

SEQ ID NO: 582351 - RNA, 16 nt, Escherichia coli CFT073
cauccuaaaggcaaaa

SEQ ID NO: 582352 - RNA, 19 nt, Escherichia coli CFT073
caucggcuggccuuccggc

SEQ ID NO: 582353 - RNA, 15 nt, Escherichia coli CFT073
caucgggauaucgcc

SEQ ID NO: 582354 - RNA, 14 nt, Escherichia coli CFT073
caucgggcaauggc

SEQ ID NO: 582355 - RNA, 16 nt, Escherichia coli CFT073
caucggggaauugugc

SEQ ID NO: 582356 - RNA, 13 nt, Escherichia coli CFT073
cauccgcgcaaua

SEQ ID NO: 582357 - RNA, 17 nt, Escherichia coli CFT073
cauccggcucgcaucaa

SEQ ID NO: 582358 - RNA, 18 nt, Escherichia coli CFT073
cauccggcucgcaucaau

SEQ ID NO: 582359 - RNA, 19 nt, Escherichia coli CFT073
cauccggcuuaaauccaaa

SEQ ID NO: 582360 - RNA, 22 nt, Escherichia coli CFT073
cauccggcuuuuuuacaucauc

SEQ ID NO: 582361 - RNA, 14 nt, Escherichia coli CFT073
cauccguccgcaaa

SEQ ID NO: 582362 - RNA, 15 nt, Escherichia coli CFT073
cauccgucggcuuca

SEQ ID NO: 582363 - RNA, 20 nt, Escherichia coli CFT073
cauccgguguggcauggcga

SEQ ID NO: 582364 - RNA, 22 nt, Escherichia coli CFT073
caugacaaacucaccuggcuga

SEQ ID NO: 582365 - RNA, 14 nt, Escherichia coli CFT073
caugaauucgacuu

SEQ ID NO: 582366 - RNA, 19 nt, Escherichia coli CFT073
caugaauucgacuuucucu

SEQ ID NO: 582367 - RNA, 22 nt, Escherichia coli CFT073
caugaacaaaacauacuuucuc

SEQ ID NO: 582368 - RNA, 23 nt, Escherichia coli CFT073
caucuuuuucaaugcauaucauu

SEQ ID NO: 582369 - RNA, 17 nt, Escherichia coli CFT073
caugaacgcuaucggca

SEQ ID NO: 582370 - RNA, 14 nt, Escherichia coli CFT073
caucuucguaccaa

SEQ ID NO: 582371 - RNA, 21 nt, Escherichia coli CFT073
caucuuucugcgcaucuuccc

SEQ ID NO: 582372 - RNA, 18 nt, Escherichia coli CFT073
caucuucaucaucugcgc

SEQ ID NO: 582373 - RNA, 12 nt, Escherichia coli CFT073
caucuuccagca

SEQ ID NO: 582374 - RNA, 14 nt, Escherichia coli CFT073
caucuuauccagcc

SEQ ID NO: 582375 - RNA, 15 nt, Escherichia coli CFT073
caucuuaauagcugc

SEQ ID NO: 582376 - RNA, 18 nt, Escherichia coli CFT073
caucugguuccuaaauaa

SEQ ID NO: 582377 - RNA, 21 nt, Escherichia coli CFT073
caucuggugccagcgccagca

SEQ ID NO: 582378 - RNA, 21 nt, Escherichia coli CFT073
caucugguaacccauccagca

SEQ ID NO: 582379 - RNA, 20 nt, Escherichia coli CFT073
caucugcguuuugguggcga

SEQ ID NO: 582380 - RNA, 16 nt, Escherichia coli CFT073
caucugccugauccug

SEQ ID NO: 582381 - RNA, 20 nt, Escherichia coli CFT073
caucugcaaugcgaauauca

SEQ ID NO: 582382 - RNA, 19 nt, Escherichia coli CFT073
caucugcacgcggagggcg

SEQ ID NO: 582383 - RNA, 15 nt, Escherichia coli CFT073
caucucgccauccuu

SEQ ID NO: 582384 - RNA, 23 nt, Escherichia coli CFT073
caucucgccauccuuaugcagcg

SEQ ID NO: 582385 - RNA, 11 nt, Escherichia coli CFT073
caucuccagug

SEQ ID NO: 582386 - RNA, 24 nt, Escherichia coli CFT073
caucuccauacagaacaggcgcga

SEQ ID NO: 582387 - RNA, 13 nt, Escherichia coli CFT073
caucucaaaacgu

SEQ ID NO: 582388 - RNA, 18 nt, Escherichia coli CFT073
caucuacgcucucuucaa

SEQ ID NO: 582389 - RNA, 12 nt, Escherichia coli CFT073
caucucaauccg

SEQ ID NO: 582390 - RNA, 22 nt, Escherichia coli CFT073
caugaugacuugccuccagcga

SEQ ID NO: 582391 - RNA, 14 nt, Escherichia coli CFT073
caugaugaggccga

SEQ ID NO: 582392 - RNA, 16 nt, Escherichia coli CFT073
caugaugaggccgaua

SEQ ID NO: 582393 - RNA, 18 nt, Escherichia coli CFT073
caugaugacaacauagcu

SEQ ID NO: 582394 - RNA, 19 nt, Escherichia coli CFT073
caugaugcuccgccagcgc

SEQ ID NO: 582395 - RNA, 22 nt, Escherichia coli CFT073
caugaugcuccgccagcgccac

SEQ ID NO: 582396 - RNA, 19 nt, Escherichia coli CFT073
caugauaagacgcguggcg

SEQ ID NO: 582397 - RNA, 14 nt, Escherichia coli CFT073
caugauaaauaaua

SEQ ID NO: 582398 - RNA, 15 nt, Escherichia coli CFT073
caugauaccgauuac

SEQ ID NO: 582399 - RNA, 15 nt, Escherichia coli CFT073
caugauacucagcac

SEQ ID NO: 582400 - RNA, 21 nt, Escherichia coli CFT073
caugaguaauuuuucuuucgu

SEQ ID NO: 582401 - RNA, 18 nt, Escherichia coli CFT073
caugacgaugauuguccc

SEQ ID NO: 582402 - RNA, 17 nt, Escherichia coli CFT073
caugacgcacuuucgcu

SEQ ID NO: 582403 - RNA, 20 nt, Escherichia coli CFT073
caugacgcacuuucgcuuua

SEQ ID NO: 582404 - RNA, 17 nt, Escherichia coli CFT073
caugaccgugaucgugg

SEQ ID NO: 582405 - RNA, 18 nt, Escherichia coli CFT073
caugaccgugaucguggc

SEQ ID NO: 582406 - RNA, 22 nt, Escherichia coli CFT073
caugaccgaggcgcggcgaucu

SEQ ID NO: 582407 - RNA, 18 nt, Escherichia coli CFT073
caugcauuuuuguccuca

SEQ ID NO: 582408 - RNA, 19 nt, Escherichia coli CFT073
caugcaggcaugcaauauu

SEQ ID NO: 582409 - RNA, 18 nt, Escherichia coli CFT073
caugccgaugccgacgau

SEQ ID NO: 582410 - RNA, 20 nt, Escherichia coli CFT073
caugccgccaccaccagcgc

SEQ ID NO: 582411 - RNA, 15 nt, Escherichia coli CFT073
caugccgaugccgac

SEQ ID NO: 582412 - RNA, 15 nt, Escherichia coli CFT073
caugcgaagaccgca

SEQ ID NO: 582413 - RNA, 22 nt, Escherichia coli CFT073
caugcuuaccaaaaugcugcaa

SEQ ID NO: 582414 - RNA, 23 nt, Escherichia coli CFT073
caugcuucugcacgcuugccugu

SEQ ID NO: 582415 - RNA, 22 nt, Escherichia coli CFT073
cauggcacuucaagauaaacga

SEQ ID NO: 582416 - RNA, 16 nt, Escherichia coli CFT073
cauggaguaaugacgu

SEQ ID NO: 582417 - RNA, 15 nt, Escherichia coli CFT073
cauggcggauccguu

SEQ ID NO: 582418 - RNA, 18 nt, Escherichia coli CFT073
cauggcggcagcgugcca

SEQ ID NO: 582419 - RNA, 22 nt, Escherichia coli CFT073
cauggucugcgccgcauucagg

SEQ ID NO: 582420 - RNA, 18 nt, Escherichia coli CFT073
cauggugaugaucgccgu

SEQ ID NO: 582421 - RNA, 17 nt, Escherichia coli CFT073
cauggugaaaccgcagc

SEQ ID NO: 582422 - RNA, 16 nt, Escherichia coli CFT073
caugguaggccgaaua

SEQ ID NO: 582423 - RNA, 20 nt, Escherichia coli CFT073
cauuccacucaucgcaucgc

SEQ ID NO: 582424 - RNA, 23 nt, Escherichia coli CFT073
cauucccagcccccuguguugau

SEQ ID NO: 582425 - RNA, 18 nt, Escherichia coli CFT073
cauucaucacgcacugca

SEQ ID NO: 582426 - RNA, 12 nt, Escherichia coli CFT073
cauucauucaga

SEQ ID NO: 582427 - RNA, 13 nt, Escherichia coli CFT073
cauucauucagau

SEQ ID NO: 582428 - RNA, 12 nt, Escherichia coli CFT073
cauucuccggca

SEQ ID NO: 582429 - RNA, 12 nt, Escherichia coli CFT073
cauuccgccgcc

SEQ ID NO: 582430 - RNA, 12 nt, Escherichia coli CFT073
caugucaggcgu

SEQ ID NO: 582431 - RNA, 17 nt, Escherichia coli CFT073
caugucaggcgucgcgc

SEQ ID NO: 582432 - RNA, 18 nt, Escherichia coli CFT073
cauguccauuuccggaua

SEQ ID NO: 582433 - RNA, 21 nt, Escherichia coli CFT073
cauucaggcguaacaguaguu

SEQ ID NO: 582434 - RNA, 22 nt, Escherichia coli CFT073
cauugcuggaugcaugccaacc

SEQ ID NO: 582435 - RNA, 16 nt, Escherichia coli CFT073
cauuggcaauugccau

SEQ ID NO: 582436 - RNA, 14 nt, Escherichia coli CFT073
cauugccugcaacg

SEQ ID NO: 582437 - RNA, 21 nt, Escherichia coli CFT073
cauugcgaauaagaauaugaa

SEQ ID NO: 582438 - RNA, 20 nt, Escherichia coli CFT073
cauugguaacguuugccagc

SEQ ID NO: 582439 - RNA, 20 nt, Escherichia coli CFT073
cauugguaaugggaucgaaa

SEQ ID NO: 582440 - RNA, 23 nt, Escherichia coli CFT073
cauuggcaggcucugacugauga

SEQ ID NO: 582441 - RNA, 16 nt, Escherichia coli CFT073
cauugaaaauuacuca

SEQ ID NO: 582442 - RNA, 16 nt, Escherichia coli CFT073
cauugccagcauuggc

SEQ ID NO: 582443 - RNA, 14 nt, Escherichia coli CFT073
cauucuuucccagc

SEQ ID NO: 582444 - RNA, 15 nt, Escherichia coli CFT073
cauugccauguugau

SEQ ID NO: 582445 - RNA, 23 nt, Escherichia coli CFT073
cauugccggaugcgacgcuggcc

SEQ ID NO: 582446 - RNA, 16 nt, Escherichia coli CFT073
cauugccggaugcggc

SEQ ID NO: 582447 - RNA, 17 nt, Escherichia coli CFT073
cauuugucggaugcggc

SEQ ID NO: 582448 - RNA, 17 nt, Escherichia coli CFT073
cauuugcauccaacuuc

SEQ ID NO: 582449 - RNA, 15 nt, Escherichia coli CFT073
cauuguuaauuacga

SEQ ID NO: 582450 - RNA, 22 nt, Escherichia coli CFT073
cauuggccccauaaucaaugcc

SEQ ID NO: 582451 - RNA, 18 nt, Escherichia coli CFT073
cauugucuccagggcgga

SEQ ID NO: 582452 - RNA, 18 nt, Escherichia coli CFT073
ccaaacucuucgacaauc

SEQ ID NO: 582453 - RNA, 19 nt, Escherichia coli CFT073
ccaaagccccccacguuua

SEQ ID NO: 582454 - RNA, 12 nt, Escherichia coli CFT073
ccaaaccagcua

SEQ ID NO: 582455 - RNA, 18 nt, Escherichia coli CFT073
cauuuucugcccguuuaa

SEQ ID NO: 582456 - RNA, 20 nt, Escherichia coli CFT073
ccaaaauuugaaagugcugu

SEQ ID NO: 582457 - RNA, 12 nt, Escherichia coli CFT073
cauuuuccagug

SEQ ID NO: 582458 - RNA, 11 nt, Escherichia coli CFT073
cauuuucucgc

SEQ ID NO: 582459 - RNA, 19 nt, Escherichia coli CFT073
cauuuucucgugccgccag

SEQ ID NO: 582460 - RNA, 21 nt, Escherichia coli CFT073
ccaaccgcaauaaccaucagc

SEQ ID NO: 582461 - RNA, 23 nt, Escherichia coli CFT073
ccaacccuggugcaauuacgcua

SEQ ID NO: 582462 - RNA, 17 nt, Escherichia coli CFT073
ccaacgacaacaccgau

SEQ ID NO: 582463 - RNA, 22 nt, Escherichia coli CFT073
ccaaagcgacacaaucaaaucc

SEQ ID NO: 582464 - RNA, 20 nt, Escherichia coli CFT073
ccaaagcguucagugaucgc

SEQ ID NO: 582465 - RNA, 18 nt, Escherichia coli CFT073
ccaaagggggcgacauuu

SEQ ID NO: 582466 - RNA, 21 nt, Escherichia coli CFT073
ccaaaguuuuuaaauaacaua

SEQ ID NO: 582467 - RNA, 12 nt, Escherichia coli CFT073
ccaaauauccgc

SEQ ID NO: 582468 - RNA, 17 nt, Escherichia coli CFT073
ccaaaucaaaucauccu

SEQ ID NO: 582469 - RNA, 23 nt, Escherichia coli CFT073
ccaaaucgccccgcagccgauuu

SEQ ID NO: 582470 - RNA, 19 nt, Escherichia coli CFT073
ccaaaugcagcaaccagag

SEQ ID NO: 582471 - RNA, 22 nt, Escherichia coli CFT073
ccaacgugaccaguaccaccgc

SEQ ID NO: 582472 - RNA, 21 nt, Escherichia coli CFT073
ccaacgugguuuaccaccagc

SEQ ID NO: 582473 - RNA, 23 nt, Escherichia coli CFT073
ccaacggugaaaaaccaaucucc

SEQ ID NO: 582474 - RNA, 13 nt, Escherichia coli CFT073
ccaacgcgguuuc

SEQ ID NO: 582475 - RNA, 21 nt, Escherichia coli CFT073
ccaacgcguuguaaaaacgga

SEQ ID NO: 582476 - RNA, 17 nt, Escherichia coli CFT073
ccaacggacgggucgcu

SEQ ID NO: 582477 - RNA, 20 nt, Escherichia coli CFT073
ccaacgccuuuaccaccagu

SEQ ID NO: 582478 - RNA, 13 nt, Escherichia coli CFT073
ccaauaccagcau

SEQ ID NO: 582479 - RNA, 17 nt, Escherichia coli CFT073
ccaaguuuaugcaauag

SEQ ID NO: 582480 - RNA, 16 nt, Escherichia coli CFT073
ccaauaaacgccaggu

SEQ ID NO: 582481 - RNA, 14 nt, Escherichia coli CFT073
ccaaguccugccag

SEQ ID NO: 582482 - RNA, 14 nt, Escherichia coli CFT073
ccaagccaagccag

SEQ ID NO: 582483 - RNA, 20 nt, Escherichia coli CFT073
ccaacugcccgaacagcaac

SEQ ID NO: 582484 - RNA, 18 nt, Escherichia coli CFT073
ccaacuggguuaacguca

SEQ ID NO: 582485 - RNA, 18 nt, Escherichia coli CFT073
ccaccagcaccgcgacaa

SEQ ID NO: 582486 - RNA, 13 nt, Escherichia coli CFT073
ccaccagaaucgc

SEQ ID NO: 582487 - RNA, 14 nt, Escherichia coli CFT073
ccaccacuuccugc

SEQ ID NO: 582488 - RNA, 20 nt, Escherichia coli CFT073
ccaccaaaugcagcaaccag

SEQ ID NO: 582489 - RNA, 23 nt, Escherichia coli CFT073
ccaccaaaacagcgacaccagcc

SEQ ID NO: 582490 - RNA, 23 nt, Escherichia coli CFT073
ccaccagugguuaccgaauccag

SEQ ID NO: 582491 - RNA, 16 nt, Escherichia coli CFT073
ccaccaguacacuggu

SEQ ID NO: 582492 - RNA, 13 nt, Escherichia coli CFT073
ccacacgcgccca

SEQ ID NO: 582493 - RNA, 16 nt, Escherichia coli CFT073
ccacaguuuuccgcca

SEQ ID NO: 582494 - RNA, 14 nt, Escherichia coli CFT073
ccacacgacgccag

SEQ ID NO: 582495 - RNA, 17 nt, Escherichia coli CFT073
ccaauaacucgcacguu

SEQ ID NO: 582496 - RNA, 13 nt, Escherichia coli CFT073
ccaauaccgcacu

SEQ ID NO: 582497 - RNA, 18 nt, Escherichia coli CFT073
ccacaccgccuaccgcca

SEQ ID NO: 582498 - RNA, 14 nt, Escherichia coli CFT073
ccacaucaacggca

SEQ ID NO: 582499 - RNA, 12 nt, Escherichia coli CFT073
ccacaucagcga

SEQ ID NO: 582500 - RNA, 12 nt, Escherichia coli CFT073
ccacauguugcg

SEQ ID NO: 582501 - RNA, 23 nt, Escherichia coli CFT073
ccacauguugcgcuucaccaguu

SEQ ID NO: 582502 - RNA, 19 nt, Escherichia coli CFT073
ccacauuaacgaaccgcua

SEQ ID NO: 582503 - RNA, 23 nt, Escherichia coli CFT073
ccacaugaucauucaccagccca

SEQ ID NO: 582504 - RNA, 16 nt, Escherichia coli CFT073
cagugccuggcauaac

SEQ ID NO: 582505 - RNA, 13 nt, Escherichia coli CFT073
caguggcgggaca

SEQ ID NO: 582506 - RNA, 16 nt, Escherichia coli CFT073
cagucgcugaucaccg

SEQ ID NO: 582507 - RNA, 21 nt, Escherichia coli CFT073
cagucgcugaucaccguagaa

SEQ ID NO: 582508 - RNA, 22 nt, Escherichia coli CFT073
cagucgcugaucaccguagaag

SEQ ID NO: 582509 - RNA, 16 nt, Escherichia coli CFT073
cagucgcgcaauugcc

SEQ ID NO: 582510 - RNA, 15 nt, Escherichia coli CFT073
cagucgccgcuucgu

SEQ ID NO: 582511 - RNA, 13 nt, Escherichia coli CFT073
caguugccggaug

SEQ ID NO: 582512 - RNA, 17 nt, Escherichia coli CFT073
caguugcugacgaucgg

SEQ ID NO: 582513 - RNA, 14 nt, Escherichia coli CFT073
caguugcucggcaa

SEQ ID NO: 582514 - RNA, 18 nt, Escherichia coli CFT073
caguugccauauccaccg

SEQ ID NO: 582515 - RNA, 21 nt, Escherichia coli CFT073
caguugccauauccaccggaa

SEQ ID NO: 582516 - RNA, 19 nt, Escherichia coli CFT073
caguuccacuucugcacgg

SEQ ID NO: 582517 - RNA, 17 nt, Escherichia coli CFT073
cagugguaucaauaucc

SEQ ID NO: 582518 - RNA, 13 nt, Escherichia coli CFT073
cagugguuaccga

SEQ ID NO: 582519 - RNA, 21 nt, Escherichia coli CFT073
cagugguuaccgaauccagca

SEQ ID NO: 582520 - RNA, 24 nt, Escherichia coli CFT073
cagugguuaccgaauccagcaagc

SEQ ID NO: 582521 - RNA, 20 nt, Escherichia coli CFT073
caguucaaucauuugcacca

SEQ ID NO: 582522 - RNA, 20 nt, Escherichia coli CFT073
caguucaggcugaggcguuu

SEQ ID NO: 582523 - RNA, 12 nt, Escherichia coli CFT073
caguucauccag

SEQ ID NO: 582524 - RNA, 15 nt, Escherichia coli CFT073
caguucauccagacg

SEQ ID NO: 582525 - RNA, 18 nt, Escherichia coli CFT073
cauagaauacgccacgac

SEQ ID NO: 582526 - RNA, 14 nt, Escherichia coli CFT073
cauaggccugcuga

SEQ ID NO: 582527 - RNA, 15 nt, Escherichia coli CFT073
cauauaaaccugaua

SEQ ID NO: 582528 - RNA, 17 nt, Escherichia coli CFT073
cauauaaaugccgguua

SEQ ID NO: 582529 - RNA, 17 nt, Escherichia coli CFT073
cauauaccgcaucagca

SEQ ID NO: 582530 - RNA, 20 nt, Escherichia coli CFT073
cauauaccgcaucagcaucg

SEQ ID NO: 582531 - RNA, 18 nt, Escherichia coli CFT073
cauacucacaucaacaac

SEQ ID NO: 582532 - RNA, 16 nt, Escherichia coli CFT073
cauacucaucuuccau

SEQ ID NO: 582533 - RNA, 22 nt, Escherichia coli CFT073
cauacccacgaaaucuuccagu

SEQ ID NO: 582534 - RNA, 16 nt, Escherichia coli CFT073
cauacccauauugaac

SEQ ID NO: 582535 - RNA, 19 nt, Escherichia coli CFT073
cauaccagcacauaacuca

SEQ ID NO: 582536 - RNA, 15 nt, Escherichia coli CFT073
cauacagcgacagac

SEQ ID NO: 582537 - RNA, 20 nt, Escherichia coli CFT073
cauacagcuuuuacagccaa

SEQ ID NO: 582538 - RNA, 14 nt, Escherichia coli CFT073
cauacauaccagca

SEQ ID NO: 582539 - RNA, 17 nt, Escherichia coli CFT073
cauacauggcauccccu

SEQ ID NO: 582540 - RNA, 22 nt, Escherichia coli CFT073
cauaccaaaaucuaccagcgga

SEQ ID NO: 582541 - RNA, 22 nt, Escherichia coli CFT073
cauaccacagcaaaacgcccgc

SEQ ID NO: 582542 - RNA, 20 nt, Escherichia coli CFT073
cauaacagaaugcgcgcgaa

SEQ ID NO: 582543 - RNA, 23 nt, Escherichia coli CFT073
cauaacgcugauauuucggcacu

SEQ ID NO: 582544 - RNA, 21 nt, Escherichia coli CFT073
cauaacggcauuaucgagcug

SEQ ID NO: 582545 - RNA, 19 nt, Escherichia coli CFT073
cauaacuagcaacaaaaaa

SEQ ID NO: 582546 - RNA, 17 nt, Escherichia coli CFT073
caguuucgagaaauucu

SEQ ID NO: 582547 - RNA, 17 nt, Escherichia coli CFT073
caguuucgcauccagag

SEQ ID NO: 582548 - RNA, 19 nt, Escherichia coli CFT073
caguuucgucaacuucuuu

SEQ ID NO: 582549 - RNA, 15 nt, Escherichia coli CFT073
caguuugccaaacca

SEQ ID NO: 582550 - RNA, 21 nt, Escherichia coli CFT073
caguuuuacugcagccagcgu

SEQ ID NO: 582551 - RNA, 13 nt, Escherichia coli CFT073
caguuuucgcccc

SEQ ID NO: 582552 - RNA, 22 nt, Escherichia coli CFT073
caguuguaugucauaaaaauga

SEQ ID NO: 582553 - RNA, 16 nt, Escherichia coli CFT073
caguugugcugccagc

SEQ ID NO: 582554 - RNA, 17 nt, Escherichia coli CFT073
caguugugcugccagcc

SEQ ID NO: 582555 - RNA, 15 nt, Escherichia coli CFT073
caguuguuccugaua

SEQ ID NO: 582556 - RNA, 20 nt, Escherichia coli CFT073
caguugugcacgcgauuuac

SEQ ID NO: 582557 - RNA, 14 nt, Escherichia coli CFT073
caguuuauggaaca

SEQ ID NO: 582558 - RNA, 16 nt, Escherichia coli CFT073
caguuucaccagcagu

SEQ ID NO: 582559 - RNA, 18 nt, Escherichia coli CFT073
cauaucgccauugcuggu

SEQ ID NO: 582560 - RNA, 17 nt, Escherichia coli CFT073
cauauccggugccaaag

SEQ ID NO: 582561 - RNA, 17 nt, Escherichia coli CFT073
cauaugaccauucgccg

SEQ ID NO: 582562 - RNA, 15 nt, Escherichia coli CFT073
cauaucgcuggcugc

SEQ ID NO: 582563 - RNA, 14 nt, Escherichia coli CFT073
cauaucggauugcg

SEQ ID NO: 582564 - RNA, 15 nt, Escherichia coli CFT073
cauaucaucaaggcu

SEQ ID NO: 582565 - RNA, 18 nt, Escherichia coli CFT073
cauaucauuuugcugcca

SEQ ID NO: 582566 - RNA, 14 nt, Escherichia coli CFT073
cauaucacuuuuau

SEQ ID NO: 582567 - RNA, 11 nt, Escherichia coli CFT073
cauaucagcgc

SEQ ID NO: 582568 - RNA, 22 nt, Escherichia coli CFT073
cauauugaccguuucgccagac

SEQ ID NO: 582569 - RNA, 20 nt, Escherichia coli CFT073
cauauuccgccaccugcgaa

SEQ ID NO: 582570 - RNA, 14 nt, Escherichia coli CFT073
cauauuccggugcc

SEQ ID NO: 582571 - RNA, 20 nt, Escherichia coli CFT073
cauauucauagcacauccug

SEQ ID NO: 582572 - RNA, 18 nt, Escherichia coli CFT073
cauauuaaccucucagaa

SEQ ID NO: 582573 - RNA, 16 nt, Escherichia coli CFT073
cauauuaacgcagcaa

SEQ ID NO: 582574 - RNA, 20 nt, Escherichia coli CFT073
cauauuauucauaaugccca

SEQ ID NO: 582575 - RNA, 15 nt, Escherichia coli CFT073
cauauuuaaaaacga

SEQ ID NO: 582576 - RNA, 22 nt, Escherichia coli CFT073
cauauuucuguuugcgucagcu

SEQ ID NO: 582577 - RNA, 17 nt, Escherichia coli CFT073
cauauugccaucacggc

SEQ ID NO: 582578 - RNA, 13 nt, Escherichia coli CFT073
cauauuggcgcgg

SEQ ID NO: 582579 - RNA, 14 nt, Escherichia coli CFT073
cauaugcgccagac

SEQ ID NO: 582580 - RNA, 13 nt, Escherichia coli CFT073
cauaugcgccagc

SEQ ID NO: 582581 - RNA, 14 nt, Escherichia coli CFT073
cauaugcaaugcau

SEQ ID NO: 582582 - RNA, 15 nt, Escherichia coli CFT073
cauaugcacacgcag

SEQ ID NO: 582583 - RNA, 17 nt, Escherichia coli CFT073
cauaugcacacgcagcu

SEQ ID NO: 582584 - RNA, 24 nt, Escherichia coli CFT073
cauaugcagccacugcugcgcgaa

SEQ ID NO: 582585 - RNA, 18 nt, Escherichia coli CFT073
cauauguuuaaccggcag

SEQ ID NO: 582586 - RNA, 20 nt, Escherichia coli CFT073
cauauguuuacgcuggcgga

SEQ ID NO: 582587 - RNA, 20 nt, Escherichia coli CFT073
caucacauaaucgaaaacau

SEQ ID NO: 582588 - RNA, 14 nt, Escherichia coli CFT073
caucacauccagcg

SEQ ID NO: 582589 - RNA, 22 nt, Escherichia coli CFT073
caucacaugcuggaaccacagc

SEQ ID NO: 582590 - RNA, 12 nt, Escherichia coli CFT073
caucaaccagca

SEQ ID NO: 582591 - RNA, 13 nt, Escherichia coli CFT073
caucaacccgccc

SEQ ID NO: 582592 - RNA, 16 nt, Escherichia coli CFT073
caucaaccgccggaua

SEQ ID NO: 582593 - RNA, 21 nt, Escherichia coli CFT073
caucaaaucugccguaacugc

SEQ ID NO: 582594 - RNA, 14 nt, Escherichia coli CFT073
cauauuuuuugaaa

SEQ ID NO: 582595 - RNA, 16 nt, Escherichia coli CFT073
caucaacgcgcaacug

SEQ ID NO: 582596 - RNA, 23 nt, Escherichia coli CFT073
caucaacgcggcaaaacccugcg

SEQ ID NO: 582597 - RNA, 21 nt, Escherichia coli CFT073
caucacaaaauuuauccagcg

SEQ ID NO: 582598 - RNA, 16 nt, Escherichia coli CFT073
caucacaauucaguac

SEQ ID NO: 582599 - RNA, 15 nt, Escherichia coli CFT073
caucaccgccaggcc

SEQ ID NO: 582600 - RNA, 19 nt, Escherichia coli CFT073
caucaccggcaucugcugu

SEQ ID NO: 582601 - RNA, 21 nt, Escherichia coli CFT073
caucacuaaggguaaaacgac

SEQ ID NO: 582602 - RNA, 14 nt, Escherichia coli CFT073
caucacuauucaga

SEQ ID NO: 582603 - RNA, 14 nt, Escherichia coli CFT073
caucacucacgaca

SEQ ID NO: 582604 - RNA, 21 nt, Escherichia coli CFT073
caucacccaacgccuuucgcu

SEQ ID NO: 582605 - RNA, 16 nt, Escherichia coli CFT073
caucaccccuuccuga

SEQ ID NO: 582606 - RNA, 20 nt, Escherichia coli CFT073
caucauuaacgccucaagua

SEQ ID NO: 582607 - RNA, 13 nt, Escherichia coli CFT073
caucauuaacugc

SEQ ID NO: 582608 - RNA, 21 nt, Escherichia coli CFT073
caucauucaaugcucacccgc

SEQ ID NO: 582609 - RNA, 14 nt, Escherichia coli CFT073
caucauugacagac

SEQ ID NO: 582610 - RNA, 16 nt, Escherichia coli CFT073
caucauggaagcaaug

SEQ ID NO: 582611 - RNA, 12 nt, Escherichia coli CFT073
caucauguggcu

SEQ ID NO: 582612 - RNA, 13 nt, Escherichia coli CFT073
cauccaauaacgu

SEQ ID NO: 582613 - RNA, 15 nt, Escherichia coli CFT073
cauccaacaauaaaa

SEQ ID NO: 582614 - RNA, 19 nt, Escherichia coli CFT073
cauccgacaaaaugauguc

SEQ ID NO: 582615 - RNA, 22 nt, Escherichia coli CFT073
caucccuucaccuacgcuggca

SEQ ID NO: 582616 - RNA, 17 nt, Escherichia coli CFT073
cauccgacaucaacgcc

SEQ ID NO: 582617 - RNA, 14 nt, Escherichia coli CFT073
cauccgacauuuug

SEQ ID NO: 582618 - RNA, 20 nt, Escherichia coli CFT073
cauccgaugguuuagccugu

SEQ ID NO: 582619 - RNA, 12 nt, Escherichia coli CFT073
cauccgcaauuu

SEQ ID NO: 582620 - RNA, 23 nt, Escherichia coli CFT073
cauccacgccuuuuuucacgaug

SEQ ID NO: 582621 - RNA, 14 nt, Escherichia coli CFT073
caucccggcaggaa

SEQ ID NO: 582622 - RNA, 21 nt, Escherichia coli CFT073
caucccggcaggaauaucgau

SEQ ID NO: 582623 - RNA, 19 nt, Escherichia coli CFT073
caucacuugauccauaucg

SEQ ID NO: 582624 - RNA, 15 nt, Escherichia coli CFT073
caucagaaaugccag

SEQ ID NO: 582625 - RNA, 17 nt, Escherichia coli CFT073
caucacuccccgcaaca

SEQ ID NO: 582626 - RNA, 16 nt, Escherichia coli CFT073
caucacugacaucacg

SEQ ID NO: 582627 - RNA, 13 nt, Escherichia coli CFT073
caucacugccgac

SEQ ID NO: 582628 - RNA, 12 nt, Escherichia coli CFT073
caucacugcgcu

SEQ ID NO: 582629 - RNA, 15 nt, Escherichia coli CFT073
caucagaguacagau

SEQ ID NO: 582630 - RNA, 14 nt, Escherichia coli CFT073
caucagaucgcgac

SEQ ID NO: 582631 - RNA, 14 nt, Escherichia coli CFT073
caucagaugaagau

SEQ ID NO: 582632 - RNA, 20 nt, Escherichia coli CFT073
caucaucggcaccgccagca

SEQ ID NO: 582633 - RNA, 14 nt, Escherichia coli CFT073
caucaucaucggca

SEQ ID NO: 582634 - RNA, 12 nt, Escherichia coli CFT073
caucaucacgaa

SEQ ID NO: 582635 - RNA, 17 nt, Escherichia coli CFT073
caucagucagguuggca

SEQ ID NO: 582636 - RNA, 19 nt, Escherichia coli CFT073
caucagucucaaaccggcu

SEQ ID NO: 582637 - RNA, 17 nt, Escherichia coli CFT073
caguacagccgccagac

SEQ ID NO: 582638 - RNA, 17 nt, Escherichia coli CFT073
caguaccagcagcgccg

SEQ ID NO: 582639 - RNA, 16 nt, Escherichia coli CFT073
caguaccagcccgccg

SEQ ID NO: 582640 - RNA, 17 nt, Escherichia coli CFT073
caguacccaaucagcga

SEQ ID NO: 582641 - RNA, 20 nt, Escherichia coli CFT073
caguaccgccaccaccagac

SEQ ID NO: 582642 - RNA, 21 nt, Escherichia coli CFT073
caguaccgccagugcagcgaa

SEQ ID NO: 582643 - RNA, 16 nt, Escherichia coli CFT073
caguaccgcgucgauc

SEQ ID NO: 582644 - RNA, 23 nt, Escherichia coli CFT073
caguacgagcaucaucuuccggu

SEQ ID NO: 582645 - RNA, 20 nt, Escherichia coli CFT073
caguacgaugauugccacaa

SEQ ID NO: 582646 - RNA, 16 nt, Escherichia coli CFT073
cagguuguuuucuggc

SEQ ID NO: 582647 - RNA, 18 nt, Escherichia coli CFT073
cagucaggcgauuguuua

SEQ ID NO: 582648 - RNA, 19 nt, Escherichia coli CFT073
caguagcccuugugcugcg

SEQ ID NO: 582649 - RNA, 20 nt, Escherichia coli CFT073
caguagcguaaaggcugcca

SEQ ID NO: 582650 - RNA, 13 nt, Escherichia coli CFT073
caguagcgucgcc

SEQ ID NO: 582651 - RNA, 18 nt, Escherichia coli CFT073
caguagcgcaauaaccac

SEQ ID NO: 582652 - RNA, 18 nt, Escherichia coli CFT073
caguacgcccacgccagc

SEQ ID NO: 582653 - RNA, 23 nt, Escherichia coli CFT073
caguacggauaauggagccagau

SEQ ID NO: 582654 - RNA, 20 nt, Escherichia coli CFT073
cagucccugaaucgccacgc

SEQ ID NO: 582655 - RNA, 21 nt, Escherichia coli CFT073
caguccccucgccccuccggg

SEQ ID NO: 582656 - RNA, 14 nt, Escherichia coli CFT073
cagucccaccauca

SEQ ID NO: 582657 - RNA, 14 nt, Escherichia coli CFT073
caggucaucgugcg

SEQ ID NO: 582658 - RNA, 21 nt, Escherichia coli CFT073
cagguauaccgaaaucgccau

SEQ ID NO: 582659 - RNA, 18 nt, Escherichia coli CFT073
cagguccacgaccagcgc

SEQ ID NO: 582660 - RNA, 20 nt, Escherichia coli CFT073
cagguccguauagaucagcg

SEQ ID NO: 582661 - RNA, 16 nt, Escherichia coli CFT073
caggugccggauuuca

SEQ ID NO: 582662 - RNA, 13 nt, Escherichia coli CFT073
caggugcccgcgu

SEQ ID NO: 582663 - RNA, 20 nt, Escherichia coli CFT073
caggugcccgcguuucgcug

SEQ ID NO: 582664 - RNA, 17 nt, Escherichia coli CFT073
caggucguuuuccugca

SEQ ID NO: 582665 - RNA, 14 nt, Escherichia coli CFT073
caggugcagcccau

SEQ ID NO: 582666 - RNA, 15 nt, Escherichia coli CFT073
caggggcagaaacaa

SEQ ID NO: 582667 - RNA, 18 nt, Escherichia coli CFT073
cagggcggacugauaacu

SEQ ID NO: 582668 - RNA, 23 nt, Escherichia coli CFT073
cagggccaaacagcagaucgaac

SEQ ID NO: 582669 - RNA, 14 nt, Escherichia coli CFT073
cagguagcagcagc

SEQ ID NO: 582670 - RNA, 19 nt, Escherichia coli CFT073
cagguaagcgaaggugccu

SEQ ID NO: 582671 - RNA, 19 nt, Escherichia coli CFT073
cagguaagcgauaaaaaua

SEQ ID NO: 582672 - RNA, 18 nt, Escherichia coli CFT073
cagcuuaaucaccagcgc

SEQ ID NO: 582673 - RNA, 18 nt, Escherichia coli CFT073
cagcuucacaaaggcuug

SEQ ID NO: 582674 - RNA, 14 nt, Escherichia coli CFT073
cagcuguugcgcca

SEQ ID NO: 582675 - RNA, 16 nt, Escherichia coli CFT073
cagcuuaaaaugcugg

SEQ ID NO: 582676 - RNA, 18 nt, Escherichia coli CFT073
cagcuugugaaucaucgc

SEQ ID NO: 582677 - RNA, 12 nt, Escherichia coli CFT073
cagcuuucgcuu

SEQ ID NO: 582678 - RNA, 19 nt, Escherichia coli CFT073
cagcuuuucgauaacccug

SEQ ID NO: 582679 - RNA, 23 nt, Escherichia coli CFT073
cagcuuuugcaaacaacgcuuca

SEQ ID NO: 582680 - RNA, 21 nt, Escherichia coli CFT073
caggaaccacaaccacuuugu

SEQ ID NO: 582681 - RNA, 13 nt, Escherichia coli CFT073
caggaaauaaaua

SEQ ID NO: 582682 - RNA, 15 nt, Escherichia coli CFT073
caggaaauauaacag

SEQ ID NO: 582683 - RNA, 23 nt, Escherichia coli CFT073
caggaaaucaaugccaccagaaa

SEQ ID NO: 582684 - RNA, 18 nt, Escherichia coli CFT073
cagcuguccauaccggac

SEQ ID NO: 582685 - RNA, 16 nt, Escherichia coli CFT073
cagcuguaccagcaac

SEQ ID NO: 582686 - RNA, 14 nt, Escherichia coli CFT073
cagcuggcugucga

SEQ ID NO: 582687 - RNA, 17 nt, Escherichia coli CFT073
cagcugcucccagcgca

SEQ ID NO: 582688 - RNA, 16 nt, Escherichia coli CFT073
cagcugccugcggcga

SEQ ID NO: 582689 - RNA, 20 nt, Escherichia coli CFT073
cagcuccguccagccaccgc

SEQ ID NO: 582690 - RNA, 13 nt, Escherichia coli CFT073
cagcuccggcagc

SEQ ID NO: 582691 - RNA, 13 nt, Escherichia coli CFT073
caggaagcccgcc

SEQ ID NO: 582692 - RNA, 20 nt, Escherichia coli CFT073
caggaagcccgcccagcuua

SEQ ID NO: 582693 - RNA, 23 nt, Escherichia coli CFT073
caggaucagaccgccaaucagca

SEQ ID NO: 582694 - RNA, 15 nt, Escherichia coli CFT073
caggagcgauuauga

SEQ ID NO: 582695 - RNA, 22 nt, Escherichia coli CFT073
caggagcgauuaugaaacaaga

SEQ ID NO: 582696 - RNA, 14 nt, Escherichia coli CFT073
caggagcgccgaau

SEQ ID NO: 582697 - RNA, 16 nt, Escherichia coli CFT073
caggagcaauuuucgg

SEQ ID NO: 582698 - RNA, 23 nt, Escherichia coli CFT073
caggauccgcucugcccugccau

SEQ ID NO: 582699 - RNA, 23 nt, Escherichia coli CFT073
caggaugcucgcgaaaagaaacu

SEQ ID NO: 582700 - RNA, 17 nt, Escherichia coli CFT073
caggcagacgaugaugc

SEQ ID NO: 582701 - RNA, 17 nt, Escherichia coli CFT073
caggcacuucuuccgcc

SEQ ID NO: 582702 - RNA, 22 nt, Escherichia coli CFT073
caggcacuucuuccgccagcau

SEQ ID NO: 582703 - RNA, 17 nt, Escherichia coli CFT073
caggaugggcugccagc

SEQ ID NO: 582704 - RNA, 11 nt, Escherichia coli CFT073
caggcagugaa

SEQ ID NO: 582705 - RNA, 15 nt, Escherichia coli CFT073
caggccaucagcagc

SEQ ID NO: 582706 - RNA, 20 nt, Escherichia coli CFT073
caggccauaugacaccaacg

SEQ ID NO: 582707 - RNA, 22 nt, Escherichia coli CFT073
caggccgcccaaaauaucacgc

SEQ ID NO: 582708 - RNA, 19 nt, Escherichia coli CFT073
caggccgccgucaucacgc

SEQ ID NO: 582709 - RNA, 22 nt, Escherichia coli CFT073
caggccugauuaagaucgugca

SEQ ID NO: 582710 - RNA, 14 nt, Escherichia coli CFT073
caggccuccgguga

SEQ ID NO: 582711 - RNA, 15 nt, Escherichia coli CFT073
caggccuaccagaga

SEQ ID NO: 582712 - RNA, 16 nt, Escherichia coli CFT073
caggccuacgccagac

SEQ ID NO: 582713 - RNA, 17 nt, Escherichia coli CFT073
caggcgaaaccagcagc

SEQ ID NO: 582714 - RNA, 12 nt, Escherichia coli CFT073
cagcggcggauu

SEQ ID NO: 582715 - RNA, 16 nt, Escherichia coli CFT073
cagcggcggcacagcg

SEQ ID NO: 582716 - RNA, 23 nt, Escherichia coli CFT073
cagcggcguguuauugccgagaa

SEQ ID NO: 582717 - RNA, 23 nt, Escherichia coli CFT073
cagcggcguuuuaucacgcaucu

SEQ ID NO: 582718 - RNA, 13 nt, Escherichia coli CFT073
cagcggcgcaacc

SEQ ID NO: 582719 - RNA, 19 nt, Escherichia coli CFT073
cagcggcgagcuuuucugg

SEQ ID NO: 582720 - RNA, 12 nt, Escherichia coli CFT073
cagcuaucagcg

SEQ ID NO: 582721 - RNA, 11 nt, Escherichia coli CFT073
cagcguuaauu

SEQ ID NO: 582722 - RNA, 19 nt, Escherichia coli CFT073
cagcguuauaaaacacauu

SEQ ID NO: 582723 - RNA, 16 nt, Escherichia coli CFT073
cagcguuauagcgcau

SEQ ID NO: 582724 - RNA, 17 nt, Escherichia coli CFT073
cagcucaaucgccucgc

SEQ ID NO: 582725 - RNA, 14 nt, Escherichia coli CFT073
cagcucauccagcg

SEQ ID NO: 582726 - RNA, 20 nt, Escherichia coli CFT073
cagcucacuucgauccagug

SEQ ID NO: 582727 - RNA, 19 nt, Escherichia coli CFT073
cagcucauaggccugcuga

SEQ ID NO: 582728 - RNA, 22 nt, Escherichia coli CFT073
cagcguguuaaugcccaucagu

SEQ ID NO: 582729 - RNA, 22 nt, Escherichia coli CFT073
cagcguguucgugacgauaucu

SEQ ID NO: 582730 - RNA, 17 nt, Escherichia coli CFT073
cagcguguugaggaagc

SEQ ID NO: 582731 - RNA, 22 nt, Escherichia coli CFT073
cagcguguugaggaagcgcaac

SEQ ID NO: 582732 - RNA, 22 nt, Escherichia coli CFT073
cagcgugcugguggucagcagc

SEQ ID NO: 582733 - RNA, 17 nt, Escherichia coli CFT073
cagcgucugacuguuga

SEQ ID NO: 582734 - RNA, 20 nt, Escherichia coli CFT073
cagcgucucacuaucgccga

SEQ ID NO: 582735 - RNA, 18 nt, Escherichia coli CFT073
cagcgucaucggccacgc

SEQ ID NO: 582736 - RNA, 19 nt, Escherichia coli CFT073
cagcgucaucaauccugca

SEQ ID NO: 582737 - RNA, 21 nt, Escherichia coli CFT073
cagcgucacuuccuucgccgc

SEQ ID NO: 582738 - RNA, 20 nt, Escherichia coli CFT073
cagcggguuaucuuccagcg

SEQ ID NO: 582739 - RNA, 22 nt, Escherichia coli CFT073
cagcggguuaucuuccagcggc

SEQ ID NO: 582740 - RNA, 17 nt, Escherichia coli CFT073
cagcggcagaguaauug

SEQ ID NO: 582741 - RNA, 15 nt, Escherichia coli CFT073
cagcggcacguucga

SEQ ID NO: 582742 - RNA, 14 nt, Escherichia coli CFT073
cagcggcaaaacgg

SEQ ID NO: 582743 - RNA, 17 nt, Escherichia coli CFT073
cagcggcaaccagcagc

SEQ ID NO: 582744 - RNA, 22 nt, Escherichia coli CFT073
cagcggcaccuaucgcgucgcc

SEQ ID NO: 582745 - RNA, 19 nt, Escherichia coli CFT073
cagcggagaucgccagccc

SEQ ID NO: 582746 - RNA, 15 nt, Escherichia coli CFT073
cagcggacggcugau

SEQ ID NO: 582747 - RNA, 23 nt, Escherichia coli CFT073
cagcggaauaaaaagcgauaucc

SEQ ID NO: 582748 - RNA, 22 nt, Escherichia coli CFT073
cagcggaauuacgcgaucgcga

SEQ ID NO: 582749 - RNA, 23 nt, Escherichia coli CFT073
cagcgcuuuaucaucggucagcg

SEQ ID NO: 582750 - RNA, 20 nt, Escherichia coli CFT073
cagcgcuaccagagccgcgc

SEQ ID NO: 582751 - RNA, 18 nt, Escherichia coli CFT073
cagcgcgugcgccaccgc

SEQ ID NO: 582752 - RNA, 15 nt, Escherichia coli CFT073
cagcgcggcggcaau

SEQ ID NO: 582753 - RNA, 14 nt, Escherichia coli CFT073
cagcgcgcgcagca

SEQ ID NO: 582754 - RNA, 13 nt, Escherichia coli CFT073
cagcgcggcagcg

SEQ ID NO: 582755 - RNA, 16 nt, Escherichia coli CFT073
cagcgcgcgcgggaau

SEQ ID NO: 582756 - RNA, 14 nt, Escherichia coli CFT073
cagcgcgcgaauau

SEQ ID NO: 582757 - RNA, 14 nt, Escherichia coli CFT073
cacggcaaacugcg

SEQ ID NO: 582758 - RNA, 15 nt, Escherichia coli CFT073
cacggcaaacugcgc

SEQ ID NO: 582759 - RNA, 13 nt, Escherichia coli CFT073
cacggcgcaugac

SEQ ID NO: 582760 - RNA, 21 nt, Escherichia coli CFT073
cacggcugcuaauauuuucgc

SEQ ID NO: 582761 - RNA, 16 nt, Escherichia coli CFT073
cacggcuccagcaaug

SEQ ID NO: 582762 - RNA, 16 nt, Escherichia coli CFT073
cacgguaucaagcccg

SEQ ID NO: 582763 - RNA, 15 nt, Escherichia coli CFT073
cacgguacucaucac

SEQ ID NO: 582764 - RNA, 15 nt, Escherichia coli CFT073
cacgguuacgcuacc

SEQ ID NO: 582765 - RNA, 19 nt, Escherichia coli CFT073
cacgguggcuggcgcggcg

SEQ ID NO: 582766 - RNA, 18 nt, Escherichia coli CFT073
cacuuucagaccgccgau

SEQ ID NO: 582767 - RNA, 16 nt, Escherichia coli CFT073
cacuuucuccggcagc

SEQ ID NO: 582768 - RNA, 22 nt, Escherichia coli CFT073
cacuuuggugaaugccugauca

SEQ ID NO: 582769 - RNA, 18 nt, Escherichia coli CFT073
cacuuuguaggccugaua

SEQ ID NO: 582770 - RNA, 17 nt, Escherichia coli CFT073
cacuuugucugcaaucu

SEQ ID NO: 582771 - RNA, 19 nt, Escherichia coli CFT073
cagaaaucucuuccagcga

SEQ ID NO: 582772 - RNA, 19 nt, Escherichia coli CFT073
cagaacacgccguggccga

SEQ ID NO: 582773 - RNA, 14 nt, Escherichia coli CFT073
cagaacacugcgcu

SEQ ID NO: 582774 - RNA, 14 nt, Escherichia coli CFT073
cagaaccagcaacc

SEQ ID NO: 582775 - RNA, 14 nt, Escherichia coli CFT073
cacuggccagcggc

SEQ ID NO: 582776 - RNA, 20 nt, Escherichia coli CFT073
cacuggcgacacgcaucacg

SEQ ID NO: 582777 - RNA, 18 nt, Escherichia coli CFT073
cacuggcacaagacugac

SEQ ID NO: 582778 - RNA, 19 nt, Escherichia coli CFT073
cacuggguucaucuuccag

SEQ ID NO: 582779 - RNA, 21 nt, Escherichia coli CFT073
cacuggcugggcgucaucccg

SEQ ID NO: 582780 - RNA, 14 nt, Escherichia coli CFT073
cacuggcggcagca

SEQ ID NO: 582781 - RNA, 15 nt, Escherichia coli CFT073
cacuguuaccgcugc

SEQ ID NO: 582782 - RNA, 15 nt, Escherichia coli CFT073
cacuguucauugaua

SEQ ID NO: 582783 - RNA, 23 nt, Escherichia coli CFT073
cacuggugugucuuuucaggccu

SEQ ID NO: 582784 - RNA, 15 nt, Escherichia coli CFT073
cacugguucccagag

SEQ ID NO: 582785 - RNA, 15 nt, Escherichia coli CFT073
cacuguccgccagac

SEQ ID NO: 582786 - RNA, 19 nt, Escherichia coli CFT073
cacuguuucgccagguuuu

SEQ ID NO: 582787 - RNA, 18 nt, Escherichia coli CFT073
cacuuaucucuuccgcau

SEQ ID NO: 582788 - RNA, 13 nt, Escherichia coli CFT073
cacuucaaccagc

SEQ ID NO: 582789 - RNA, 20 nt, Escherichia coli CFT073
cacuucacccaucgccagau

SEQ ID NO: 582790 - RNA, 18 nt, Escherichia coli CFT073
cacuucauacuccgucug

SEQ ID NO: 582791 - RNA, 18 nt, Escherichia coli CFT073
cacugauuuccccccggc

SEQ ID NO: 582792 - RNA, 23 nt, Escherichia coli CFT073
cacugauauggugguaacuaccg

SEQ ID NO: 582793 - RNA, 17 nt, Escherichia coli CFT073
cacugacacaggcagca

SEQ ID NO: 582794 - RNA, 20 nt, Escherichia coli CFT073
cacugacacaggcagcaauc

SEQ ID NO: 582795 - RNA, 14 nt, Escherichia coli CFT073
cacugacauccacg

SEQ ID NO: 582796 - RNA, 15 nt, Escherichia coli CFT073
cacugacugacagac

SEQ ID NO: 582797 - RNA, 21 nt, Escherichia coli CFT073
cacugccagaauagccgcagc

SEQ ID NO: 582798 - RNA, 22 nt, Escherichia coli CFT073
cacugccagaauagccgcagcu

SEQ ID NO: 582799 - RNA, 15 nt, Escherichia coli CFT073
cacugcaggcugaug

SEQ ID NO: 582800 - RNA, 17 nt, Escherichia coli CFT073
cacugcacaguguuugu

SEQ ID NO: 582801 - RNA, 22 nt, Escherichia coli CFT073
cacugcucgcagaaauaccccg

SEQ ID NO: 582802 - RNA, 18 nt, Escherichia coli CFT073
cacugcgcucuaaaauca

SEQ ID NO: 582803 - RNA, 24 nt, Escherichia coli CFT073
cacugcggaagcuaccgaccagac

SEQ ID NO: 582804 - RNA, 18 nt, Escherichia coli CFT073
cacugccagcccggcagc

SEQ ID NO: 582805 - RNA, 17 nt, Escherichia coli CFT073
cacugccguacaggcag

SEQ ID NO: 582806 - RNA, 12 nt, Escherichia coli CFT073
cacugcgagaaa

SEQ ID NO: 582807 - RNA, 23 nt, Escherichia coli CFT073
cacugcgaucgcccgcaaucagc

SEQ ID NO: 582808 - RNA, 20 nt, Escherichia coli CFT073
cacugaaacaugaacaucaa

SEQ ID NO: 582809 - RNA, 22 nt, Escherichia coli CFT073
cacugaaagagucgccagcugc

SEQ ID NO: 582810 - RNA, 14 nt, Escherichia coli CFT073
cacucgccgcugcg

SEQ ID NO: 582811 - RNA, 23 nt, Escherichia coli CFT073
cacuccgguaauaucgcgcagaa

SEQ ID NO: 582812 - RNA, 16 nt, Escherichia coli CFT073
cacuccuuauucagcg

SEQ ID NO: 582813 - RNA, 19 nt, Escherichia coli CFT073
caccugaguaccuugcuga

SEQ ID NO: 582814 - RNA, 24 nt, Escherichia coli CFT073
caccugauacgcgccaaucggcaa

SEQ ID NO: 582815 - RNA, 18 nt, Escherichia coli CFT073
caccugauagucacgcag

SEQ ID NO: 582816 - RNA, 20 nt, Escherichia coli CFT073
caccugauccagcucuuccu

SEQ ID NO: 582817 - RNA, 17 nt, Escherichia coli CFT073
caccucugucgaugcgc

SEQ ID NO: 582818 - RNA, 14 nt, Escherichia coli CFT073
caccucuuccagcg

SEQ ID NO: 582819 - RNA, 20 nt, Escherichia coli CFT073
caccugcacaggcauucaga

SEQ ID NO: 582820 - RNA, 16 nt, Escherichia coli CFT073
caccugcguugccgca

SEQ ID NO: 582821 - RNA, 14 nt, Escherichia coli CFT073
caccugcgcuggca

SEQ ID NO: 582822 - RNA, 20 nt, Escherichia coli CFT073
caccuucguccagcaucaua

SEQ ID NO: 582823 - RNA, 14 nt, Escherichia coli CFT073
caccuucagcgaag

SEQ ID NO: 582824 - RNA, 22 nt, Escherichia coli CFT073
caccuucaacuugcuguuucgc

SEQ ID NO: 582825 - RNA, 21 nt, Escherichia coli CFT073
caccuguccauauuucgucgc

SEQ ID NO: 582826 - RNA, 14 nt, Escherichia coli CFT073
caccugggcaaugg

SEQ ID NO: 582827 - RNA, 23 nt, Escherichia coli CFT073
cacgaaaugaauaaucugaaaac

SEQ ID NO: 582828 - RNA, 18 nt, Escherichia coli CFT073
cacgacacauaaauaaca

SEQ ID NO: 582829 - RNA, 18 nt, Escherichia coli CFT073
cacgacaaaugcgccgcc

SEQ ID NO: 582830 - RNA, 13 nt, Escherichia coli CFT073
cacgcaccauaau

SEQ ID NO: 582831 - RNA, 19 nt, Escherichia coli CFT073
cacgcacagcccgccgcca

SEQ ID NO: 582832 - RNA, 17 nt, Escherichia coli CFT073
cacgcaacaccagcagu

SEQ ID NO: 582833 - RNA, 18 nt, Escherichia coli CFT073
cacgacucaaaucacgca

SEQ ID NO: 582834 - RNA, 15 nt, Escherichia coli CFT073
cacgacgguucauug

SEQ ID NO: 582835 - RNA, 18 nt, Escherichia coli CFT073
cacgacgguuaaauugag

SEQ ID NO: 582836 - RNA, 23 nt, Escherichia coli CFT073
cacgagguugcagaucuuucugc

SEQ ID NO: 582837 - RNA, 13 nt, Escherichia coli CFT073
cacgagcgcgauu

SEQ ID NO: 582838 - RNA, 21 nt, Escherichia coli CFT073
cacgccuuccugauaacacag

SEQ ID NO: 582839 - RNA, 18 nt, Escherichia coli CFT073
cacgccugcuucuacgca

SEQ ID NO: 582840 - RNA, 12 nt, Escherichia coli CFT073
cacgccgcaucc

SEQ ID NO: 582841 - RNA, 19 nt, Escherichia coli CFT073
cacgccgcauccggcaagu

SEQ ID NO: 582842 - RNA, 14 nt, Escherichia coli CFT073
cacgcccgccagau

SEQ ID NO: 582843 - RNA, 18 nt, Escherichia coli CFT073
cacgccagugucgcauca

SEQ ID NO: 582844 - RNA, 19 nt, Escherichia coli CFT073
cacgccagugucgcaucag

SEQ ID NO: 582845 - RNA, 21 nt, Escherichia coli CFT073
cacgccagugucgcaucaggc

SEQ ID NO: 582846 - RNA, 18 nt, Escherichia coli CFT073
cacgccauacccgcacaa

SEQ ID NO: 582847 - RNA, 14 nt, Escherichia coli CFT073
cacgcauuucucgg

SEQ ID NO: 582848 - RNA, 13 nt, Escherichia coli CFT073
cacgccaaccacc

SEQ ID NO: 582849 - RNA, 16 nt, Escherichia coli CFT073
cacgcaucugcacaau

SEQ ID NO: 582850 - RNA, 18 nt, Escherichia coli CFT073
cacgccaccagcgucauc

SEQ ID NO: 582851 - RNA, 19 nt, Escherichia coli CFT073
cacgccaccagcgucauca

SEQ ID NO: 582852 - RNA, 15 nt, Escherichia coli CFT073
cacgcauccggcaau

SEQ ID NO: 582853 - RNA, 18 nt, Escherichia coli CFT073
cacgcaggccacgaauca

SEQ ID NO: 582854 - RNA, 16 nt, Escherichia coli CFT073
cacgcagggcauccag

SEQ ID NO: 582855 - RNA, 15 nt, Escherichia coli CFT073
cacgcagcaagccgu

SEQ ID NO: 582856 - RNA, 19 nt, Escherichia coli CFT073
cacgcagcagggcaauacg

SEQ ID NO: 582857 - RNA, 20 nt, Escherichia coli CFT073
cagcgaagcccacaccgccc

SEQ ID NO: 582858 - RNA, 21 nt, Escherichia coli CFT073
cagcgaagcccacaccgccca

SEQ ID NO: 582859 - RNA, 15 nt, Escherichia coli CFT073
cagcgaagcgcauca

SEQ ID NO: 582860 - RNA, 17 nt, Escherichia coli CFT073
cagcgaaguacgcggca

SEQ ID NO: 582861 - RNA, 20 nt, Escherichia coli CFT073
cagcgaagucacaaaauucg

SEQ ID NO: 582862 - RNA, 23 nt, Escherichia coli CFT073
cagcgaaccgccaaucgccacgc

SEQ ID NO: 582863 - RNA, 19 nt, Escherichia coli CFT073
cagcgacgacuggcgcggc

SEQ ID NO: 582864 - RNA, 17 nt, Escherichia coli CFT073
cagccugcaaacgcuuu

SEQ ID NO: 582865 - RNA, 19 nt, Escherichia coli CFT073
cagccugaaugccgcgccc

SEQ ID NO: 582866 - RNA, 16 nt, Escherichia coli CFT073
cagccucauccaugcg

SEQ ID NO: 582867 - RNA, 20 nt, Escherichia coli CFT073
cagccgccucgccucacgaa

SEQ ID NO: 582868 - RNA, 22 nt, Escherichia coli CFT073
cagccgcccagcgaaccgccaa

SEQ ID NO: 582869 - RNA, 17 nt, Escherichia coli CFT073
cagccgccaacuccacc

SEQ ID NO: 582870 - RNA, 19 nt, Escherichia coli CFT073
cagccgcgucugaauauca

SEQ ID NO: 582871 - RNA, 23 nt, Escherichia coli CFT073
cagccgcuaacuuccugcuggcu

SEQ ID NO: 582872 - RNA, 18 nt, Escherichia coli CFT073
cagcauucaucacaaaau

SEQ ID NO: 582873 - RNA, 16 nt, Escherichia coli CFT073
cagcauucccgccacc

SEQ ID NO: 582874 - RNA, 15 nt, Escherichia coli CFT073
cagcauugcgccagc

SEQ ID NO: 582875 - RNA, 22 nt, Escherichia coli CFT073
cagccaaauaaaaucccgguga

SEQ ID NO: 582876 - RNA, 14 nt, Escherichia coli CFT073
cagccacuguuuca

SEQ ID NO: 582877 - RNA, 23 nt, Escherichia coli CFT073
cagccacuucaaccagcggcgca

SEQ ID NO: 582878 - RNA, 17 nt, Escherichia coli CFT073
cagccaaaucgccccgc

SEQ ID NO: 582879 - RNA, 15 nt, Escherichia coli CFT073
cagccaaauccagcg

SEQ ID NO: 582880 - RNA, 20 nt, Escherichia coli CFT073
cagccagauggggugaccgu

SEQ ID NO: 582881 - RNA, 15 nt, Escherichia coli CFT073
cagccagccagcacc

SEQ ID NO: 582882 - RNA, 17 nt, Escherichia coli CFT073
cagccagaacagcggag

SEQ ID NO: 582883 - RNA, 20 nt, Escherichia coli CFT073
cagcaucacgcccgcuuuuu

SEQ ID NO: 582884 - RNA, 21 nt, Escherichia coli CFT073
cagcaucaugucgcccacgcc

SEQ ID NO: 582885 - RNA, 22 nt, Escherichia coli CFT073
cagcauauguuuacgcuggcgg

SEQ ID NO: 582886 - RNA, 13 nt, Escherichia coli CFT073
cagcaucaacaac

SEQ ID NO: 582887 - RNA, 10 nt, Escherichia coli CFT073
cagcaucaau

SEQ ID NO: 582888 - RNA, 18 nt, Escherichia coli CFT073
cagcauaccuuccagcgc

SEQ ID NO: 582889 - RNA, 17 nt, Escherichia coli CFT073
cagcauacgccacaucc

SEQ ID NO: 582890 - RNA, 16 nt, Escherichia coli CFT073
cagcaggaucagaccg

SEQ ID NO: 582891 - RNA, 12 nt, Escherichia coli CFT073
cagcaggcagau

SEQ ID NO: 582892 - RNA, 19 nt, Escherichia coli CFT073
cagcaggaaucccaucaga

SEQ ID NO: 582893 - RNA, 17 nt, Escherichia coli CFT073
cagcaggacguuggcga

SEQ ID NO: 582894 - RNA, 14 nt, Escherichia coli CFT073
cagccagccgaaca

SEQ ID NO: 582895 - RNA, 13 nt, Escherichia coli CFT073
cagccagcggcga

SEQ ID NO: 582896 - RNA, 14 nt, Escherichia coli CFT073
cagccagcgccgcg

SEQ ID NO: 582897 - RNA, 15 nt, Escherichia coli CFT073
cagccagcgccgcgc

SEQ ID NO: 582898 - RNA, 16 nt, Escherichia coli CFT073
cagccagcgcuuugau

SEQ ID NO: 582899 - RNA, 16 nt, Escherichia coli CFT073
cagccaugucgccacc

SEQ ID NO: 582900 - RNA, 21 nt, Escherichia coli CFT073
cagccaugguuuaaucgccgu

SEQ ID NO: 582901 - RNA, 20 nt, Escherichia coli CFT073
cagccauuuugcacauucca

SEQ ID NO: 582902 - RNA, 18 nt, Escherichia coli CFT073
cagcccacaugccugcau

SEQ ID NO: 582903 - RNA, 18 nt, Escherichia coli CFT073
cagcccaaagagcaagaa

SEQ ID NO: 582904 - RNA, 12 nt, Escherichia coli CFT073
cagcccaggaag

SEQ ID NO: 582905 - RNA, 22 nt, Escherichia coli CFT073
cagcccggguuugccgcuggca

SEQ ID NO: 582906 - RNA, 19 nt, Escherichia coli CFT073
cagcccgccaaugccgcgc

SEQ ID NO: 582907 - RNA, 15 nt, Escherichia coli CFT073
cagccccagaacuca

SEQ ID NO: 582908 - RNA, 22 nt, Escherichia coli CFT073
cagccccagcacuucgcuggug

SEQ ID NO: 582909 - RNA, 19 nt, Escherichia coli CFT073
cagaaguaguugcugucga

SEQ ID NO: 582910 - RNA, 17 nt, Escherichia coli CFT073
cagaauaacgcggcagg

SEQ ID NO: 582911 - RNA, 17 nt, Escherichia coli CFT073
cagaauacccgaagcgc

SEQ ID NO: 582912 - RNA, 23 nt, Escherichia coli CFT073
cagaagugaagcauggcgcggaa

SEQ ID NO: 582913 - RNA, 16 nt, Escherichia coli CFT073
cagaauauccggcacg

SEQ ID NO: 582914 - RNA, 23 nt, Escherichia coli CFT073
cagaauaucgccaaggauaucgu

SEQ ID NO: 582915 - RNA, 19 nt, Escherichia coli CFT073
cagaaucagauugaugcga

SEQ ID NO: 582916 - RNA, 14 nt, Escherichia coli CFT073
cagaaucagcagcg

SEQ ID NO: 582917 - RNA, 22 nt, Escherichia coli CFT073
cagaauccccacaaaccaccga

SEQ ID NO: 582918 - RNA, 16 nt, Escherichia coli CFT073
cagaauccccggcagg

SEQ ID NO: 582919 - RNA, 17 nt, Escherichia coli CFT073
cagaaugacaucaucgc

SEQ ID NO: 582920 - RNA, 20 nt, Escherichia coli CFT073
cagaaugacaucaucgcccc

SEQ ID NO: 582921 - RNA, 13 nt, Escherichia coli CFT073
cagaaugcgcgcg

SEQ ID NO: 582922 - RNA, 18 nt, Escherichia coli CFT073
cagaaugguuucauucca

SEQ ID NO: 582923 - RNA, 22 nt, Escherichia coli CFT073
cagaaugguuucauuccaguaa

SEQ ID NO: 582924 - RNA, 14 nt, Escherichia coli CFT073
cagaauccggcgcu

SEQ ID NO: 582925 - RNA, 22 nt, Escherichia coli CFT073
cagaauccggcgcucaucaggc

SEQ ID NO: 582926 - RNA, 13 nt, Escherichia coli CFT073
cagaaucgccagc

SEQ ID NO: 582927 - RNA, 14 nt, Escherichia coli CFT073
cagaaucgccagca

SEQ ID NO: 582928 - RNA, 17 nt, Escherichia coli CFT073
cagaaucgccagcaucg

SEQ ID NO: 582929 - RNA, 21 nt, Escherichia coli CFT073
cagaaucgccagcaucggcaa

SEQ ID NO: 582930 - RNA, 22 nt, Escherichia coli CFT073
cagauagccagguuuaccagca

SEQ ID NO: 582931 - RNA, 13 nt, Escherichia coli CFT073
cagauagccgcca

SEQ ID NO: 582932 - RNA, 16 nt, Escherichia coli CFT073
cagauaccaccagcgc

SEQ ID NO: 582933 - RNA, 18 nt, Escherichia coli CFT073
cagauaccaccagcgcca

SEQ ID NO: 582934 - RNA, 14 nt, Escherichia coli CFT073
cagauacuggaaaa

SEQ ID NO: 582935 - RNA, 20 nt, Escherichia coli CFT073
cagaauuccgugccagcacc

SEQ ID NO: 582936 - RNA, 19 nt, Escherichia coli CFT073
cagaauuugagcuugcugc

SEQ ID NO: 582937 - RNA, 17 nt, Escherichia coli CFT073
cagauaaggcguucacg

SEQ ID NO: 582938 - RNA, 23 nt, Escherichia coli CFT073
cagauaaggcguucacgccgcau

SEQ ID NO: 582939 - RNA, 17 nt, Escherichia coli CFT073
cagauaauaaaaaagaa

SEQ ID NO: 582940 - RNA, 16 nt, Escherichia coli CFT073
cagauacaaccaaucg

SEQ ID NO: 582941 - RNA, 14 nt, Escherichia coli CFT073
cagauacauugcca

SEQ ID NO: 582942 - RNA, 17 nt, Escherichia coli CFT073
cagauaccacaucaacc

SEQ ID NO: 582943 - RNA, 18 nt, Escherichia coli CFT073
cagauuagcuggccugcu

SEQ ID NO: 582944 - RNA, 19 nt, Escherichia coli CFT073
cagauuauucaaaaacaga

SEQ ID NO: 582945 - RNA, 13 nt, Escherichia coli CFT073
cagauggacaaaa

SEQ ID NO: 582946 - RNA, 14 nt, Escherichia coli CFT073
cagauggaucagcg

SEQ ID NO: 582947 - RNA, 19 nt, Escherichia coli CFT073
cagaugcucuucaaaacga

SEQ ID NO: 582948 - RNA, 17 nt, Escherichia coli CFT073
cagauaucccgccagca

SEQ ID NO: 582949 - RNA, 22 nt, Escherichia coli CFT073
cagauauuaagcggcaccaucc

SEQ ID NO: 582950 - RNA, 23 nt, Escherichia coli CFT073
cagauauuuaaguugaucgccca

SEQ ID NO: 582951 - RNA, 15 nt, Escherichia coli CFT073
cagaugcggcgugaa

SEQ ID NO: 582952 - RNA, 16 nt, Escherichia coli CFT073
cagaugcggugcgcca

SEQ ID NO: 582953 - RNA, 19 nt, Escherichia coli CFT073
cagaugcggugcgccacac

SEQ ID NO: 582954 - RNA, 19 nt, Escherichia coli CFT073
cagaucagccacuuccugc

SEQ ID NO: 582955 - RNA, 16 nt, Escherichia coli CFT073
cagaucauccggcacg

SEQ ID NO: 582956 - RNA, 17 nt, Escherichia coli CFT073
cagaucauccggcacgc

SEQ ID NO: 582957 - RNA, 14 nt, Escherichia coli CFT073
cagcaccaucgcgc

SEQ ID NO: 582958 - RNA, 17 nt, Escherichia coli CFT073
cagcaccaucgcgcuaa

SEQ ID NO: 582959 - RNA, 18 nt, Escherichia coli CFT073
cagcaccacgcagaaaaa

SEQ ID NO: 582960 - RNA, 16 nt, Escherichia coli CFT073
cagcaccacuggcgau

SEQ ID NO: 582961 - RNA, 13 nt, Escherichia coli CFT073
cagcacaggcggg

SEQ ID NO: 582962 - RNA, 21 nt, Escherichia coli CFT073
cagcacacccagcgaaccguu

SEQ ID NO: 582963 - RNA, 22 nt, Escherichia coli CFT073
cagcacaauaaucagcccaacc

SEQ ID NO: 582964 - RNA, 18 nt, Escherichia coli CFT073
cagcaauuucuccgccgg

SEQ ID NO: 582965 - RNA, 15 nt, Escherichia coli CFT073
cagcaauuuuacccg

SEQ ID NO: 582966 - RNA, 23 nt, Escherichia coli CFT073
cagcaacggccaaauauccgcgc

SEQ ID NO: 582967 - RNA, 18 nt, Escherichia coli CFT073
cagcaacgugcuucgcgc

SEQ ID NO: 582968 - RNA, 18 nt, Escherichia coli CFT073
cagcaauagcaaagccuu

SEQ ID NO: 582969 - RNA, 22 nt, Escherichia coli CFT073
cagcagaaugacaucaucgccc

SEQ ID NO: 582970 - RNA, 14 nt, Escherichia coli CFT073
cagcacuuuucgca

SEQ ID NO: 582971 - RNA, 19 nt, Escherichia coli CFT073
cagcagagauacaggccac

SEQ ID NO: 582972 - RNA, 15 nt, Escherichia coli CFT073
cagcagagcaaaaau

SEQ ID NO: 582973 - RNA, 18 nt, Escherichia coli CFT073
cagcagauaccaacccug

SEQ ID NO: 582974 - RNA, 15 nt, Escherichia coli CFT073
cagcagcagcgcaau

SEQ ID NO: 582975 - RNA, 13 nt, Escherichia coli CFT073
cagcagauuaacc

SEQ ID NO: 582976 - RNA, 14 nt, Escherichia coli CFT073
cagcagauccaucg

SEQ ID NO: 582977 - RNA, 19 nt, Escherichia coli CFT073
cagcagauccgguucgcca

SEQ ID NO: 582978 - RNA, 19 nt, Escherichia coli CFT073
cagcacggauaccgcacgc

SEQ ID NO: 582979 - RNA, 22 nt, Escherichia coli CFT073
cagcacgaucccuucgauaucc

SEQ ID NO: 582980 - RNA, 19 nt, Escherichia coli CFT073
cagcagcuucacgccgcgc

SEQ ID NO: 582981 - RNA, 20 nt, Escherichia coli CFT073
cagcagcugcucccagcgca

SEQ ID NO: 582982 - RNA, 14 nt, Escherichia coli CFT073
cagcagcgccgcgc

SEQ ID NO: 582983 - RNA, 23 nt, Escherichia coli CFT073
cagcagcguucccagccaguccg

SEQ ID NO: 582984 - RNA, 18 nt, Escherichia coli CFT073
cagcagcucaaucgccuc

SEQ ID NO: 582985 - RNA, 21 nt, Escherichia coli CFT073
cagcagcagcgguugagagaa

SEQ ID NO: 582986 - RNA, 17 nt, Escherichia coli CFT073
cagcaccggcaaauugg

SEQ ID NO: 582987 - RNA, 22 nt, Escherichia coli CFT073
cagcaccgccagcagcagcgaa

SEQ ID NO: 582988 - RNA, 21 nt, Escherichia coli CFT073
cagcaccgcagagaucgcccc

SEQ ID NO: 582989 - RNA, 24 nt, Escherichia coli CFT073
cagcacccugaguuuucaguaccg

SEQ ID NO: 582990 - RNA, 18 nt, Escherichia coli CFT073
cgccgggcuugccaggua

SEQ ID NO: 582991 - RNA, 18 nt, Escherichia coli CFT073
cgccggcuucaucuuuau

SEQ ID NO: 582992 - RNA, 13 nt, Escherichia coli CFT073
cgccggagagaaa

SEQ ID NO: 582993 - RNA, 20 nt, Escherichia coli CFT073
cgccggagagaaaaaucucc

SEQ ID NO: 582994 - RNA, 16 nt, Escherichia coli CFT073
cgccgcuuuaaucacc

SEQ ID NO: 582995 - RNA, 17 nt, Escherichia coli CFT073
cgccgcgugccaccauu

SEQ ID NO: 582996 - RNA, 21 nt, Escherichia coli CFT073
cgccggauggguaaucgucag

SEQ ID NO: 582997 - RNA, 17 nt, Escherichia coli CFT073
cgccggaugaaaaguca

SEQ ID NO: 582998 - RNA, 22 nt, Escherichia coli CFT073
cgccggaucgaccgguucgccu

SEQ ID NO: 582999 - RNA, 15 nt, Escherichia coli CFT073
cgccugcgcgauacu

SEQ ID NO: 583000 - RNA, 19 nt, Escherichia coli CFT073
cgccugcgccagugccgga

SEQ ID NO: 583001 - RNA, 21 nt, Escherichia coli CFT073
cgccugcagucagccagcgca

SEQ ID NO: 583002 - RNA, 16 nt, Escherichia coli CFT073
cgccugcagcugcaga

SEQ ID NO: 583003 - RNA, 18 nt, Escherichia coli CFT073
cgccugcacaaagcgcca

SEQ ID NO: 583004 - RNA, 13 nt, Escherichia coli CFT073
cgccugaucgcgc

SEQ ID NO: 583005 - RNA, 20 nt, Escherichia coli CFT073
cgccugcaagcgucgcgcca

SEQ ID NO: 583006 - RNA, 20 nt, Escherichia coli CFT073
cgccucgcuuuuaugccugg

SEQ ID NO: 583007 - RNA, 15 nt, Escherichia coli CFT073
cgccguggccgagau

SEQ ID NO: 583008 - RNA, 17 nt, Escherichia coli CFT073
cgccuuccgucagcaaa

SEQ ID NO: 583009 - RNA, 23 nt, Escherichia coli CFT073
cgccuucagguuuuucagcugcc

SEQ ID NO: 583010 - RNA, 19 nt, Escherichia coli CFT073
cgccuucccuuucagcaaa

SEQ ID NO: 583011 - RNA, 19 nt, Escherichia coli CFT073
cgccuuauccggccuacgg

SEQ ID NO: 583012 - RNA, 20 nt, Escherichia coli CFT073
cgccuuauccggccuacugg

SEQ ID NO: 583013 - RNA, 20 nt, Escherichia coli CFT073
cgccuuauccggccugcaaa

SEQ ID NO: 583014 - RNA, 19 nt, Escherichia coli CFT073
cgccuuauccgaccuacaa

SEQ ID NO: 583015 - RNA, 19 nt, Escherichia coli CFT073
cgccuuauccggccuacaa

SEQ ID NO: 583016 - RNA, 12 nt, Escherichia coli CFT073
cgccugucugca

SEQ ID NO: 583017 - RNA, 16 nt, Escherichia coli CFT073
cgccuggugcaggcgu

SEQ ID NO: 583018 - RNA, 15 nt, Escherichia coli CFT073
cgccugggugcgauu

SEQ ID NO: 583019 - RNA, 21 nt, Escherichia coli CFT073
cgccugcggcugauaaucuuc

SEQ ID NO: 583020 - RNA, 15 nt, Escherichia coli CFT073
cgcgacaauaccggu

SEQ ID NO: 583021 - RNA, 20 nt, Escherichia coli CFT073
cgcgaauucauguucgguaa

SEQ ID NO: 583022 - RNA, 22 nt, Escherichia coli CFT073
cgcgaagcugguguaacugcgc

SEQ ID NO: 583023 - RNA, 13 nt, Escherichia coli CFT073
cgcgaagcacaca

SEQ ID NO: 583024 - RNA, 23 nt, Escherichia coli CFT073
cgcgaagagccucgucggcgguu

SEQ ID NO: 583025 - RNA, 14 nt, Escherichia coli CFT073
cgcgaaccaucacc

SEQ ID NO: 583026 - RNA, 21 nt, Escherichia coli CFT073
cgcgaaaugucaaacaguuca

SEQ ID NO: 583027 - RNA, 21 nt, Escherichia coli CFT073
cgcgaaauuauccauauucag

SEQ ID NO: 583028 - RNA, 19 nt, Escherichia coli CFT073
cgccuugaguaccgagaaa

SEQ ID NO: 583029 - RNA, 21 nt, Escherichia coli CFT073
cgccuucuuccagcgcaagga

SEQ ID NO: 583030 - RNA, 15 nt, Escherichia coli CFT073
cgccgcaacaauaac

SEQ ID NO: 583031 - RNA, 17 nt, Escherichia coli CFT073
cgccgauuggcaccgac

SEQ ID NO: 583032 - RNA, 13 nt, Escherichia coli CFT073
cgccgccagcggg

SEQ ID NO: 583033 - RNA, 11 nt, Escherichia coli CFT073
cgccgccaggg

SEQ ID NO: 583034 - RNA, 15 nt, Escherichia coli CFT073
cgccgcagccagaua

SEQ ID NO: 583035 - RNA, 23 nt, Escherichia coli CFT073
cgccgccgagauuugccagauua

SEQ ID NO: 583036 - RNA, 13 nt, Escherichia coli CFT073
cgccgagcgccag

SEQ ID NO: 583037 - RNA, 13 nt, Escherichia coli CFT073
cgccgacgcccug

SEQ ID NO: 583038 - RNA, 17 nt, Escherichia coli CFT073
cgccgaagcagcugcug

SEQ ID NO: 583039 - RNA, 18 nt, Escherichia coli CFT073
cgccgaagcagcugcugg

SEQ ID NO: 583040 - RNA, 18 nt, Escherichia coli CFT073
cgccgaaauuucgccgcg

SEQ ID NO: 583041 - RNA, 21 nt, Escherichia coli CFT073
cgccgaaaucgcauugcgcca

SEQ ID NO: 583042 - RNA, 14 nt, Escherichia coli CFT073
cgcccugccgaucu

SEQ ID NO: 583043 - RNA, 21 nt, Escherichia coli CFT073
cgcccuggcccauugccagcg

SEQ ID NO: 583044 - RNA, 22 nt, Escherichia coli CFT073
cgcccggcguggugcagccgcc

SEQ ID NO: 583045 - RNA, 13 nt, Escherichia coli CFT073
cgcccccagacug

SEQ ID NO: 583046 - RNA, 20 nt, Escherichia coli CFT073
cgccccaguaaauggugaua

SEQ ID NO: 583047 - RNA, 13 nt, Escherichia coli CFT073
cgccccaauccac

SEQ ID NO: 583048 - RNA, 23 nt, Escherichia coli CFT073
cgccccacaagcccgccagacca

SEQ ID NO: 583049 - RNA, 17 nt, Escherichia coli CFT073
cgcccaucuucguacca

SEQ ID NO: 583050 - RNA, 13 nt, Escherichia coli CFT073
cgcccgccugcgu

SEQ ID NO: 583051 - RNA, 17 nt, Escherichia coli CFT073
cgcccgcacugucgcca

SEQ ID NO: 583052 - RNA, 22 nt, Escherichia coli CFT073
cgcccgacaauaugcagcaguc

SEQ ID NO: 583053 - RNA, 23 nt, Escherichia coli CFT073
cgccccuggcgaugcccccagga

SEQ ID NO: 583054 - RNA, 14 nt, Escherichia coli CFT073
cgccauugacagaa

SEQ ID NO: 583055 - RNA, 15 nt, Escherichia coli CFT073
cgccauugaugagaa

SEQ ID NO: 583056 - RNA, 16 nt, Escherichia coli CFT073
cgccauucagauugau

SEQ ID NO: 583057 - RNA, 23 nt, Escherichia coli CFT073
cgccauggcauuaaauucagcaa

SEQ ID NO: 583058 - RNA, 14 nt, Escherichia coli CFT073
cgccauuaacaacg

SEQ ID NO: 583059 - RNA, 17 nt, Escherichia coli CFT073
cgccauuaacaacgucg

SEQ ID NO: 583060 - RNA, 15 nt, Escherichia coli CFT073
cgccauuaucgauaa

SEQ ID NO: 583061 - RNA, 16 nt, Escherichia coli CFT073
cgccauuuccagcguc

SEQ ID NO: 583062 - RNA, 19 nt, Escherichia coli CFT073
cgccauuuugcaacgcuuu

SEQ ID NO: 583063 - RNA, 17 nt, Escherichia coli CFT073
cgccaggcacaccagca

SEQ ID NO: 583064 - RNA, 22 nt, Escherichia coli CFT073
cgccaggcauggcuugcgccau

SEQ ID NO: 583065 - RNA, 18 nt, Escherichia coli CFT073
cgccaggacaucagcgca

SEQ ID NO: 583066 - RNA, 15 nt, Escherichia coli CFT073
cgcccagcucuuuac

SEQ ID NO: 583067 - RNA, 20 nt, Escherichia coli CFT073
cgcccaggcaaguagcgcca

SEQ ID NO: 583068 - RNA, 14 nt, Escherichia coli CFT073
cgcccacuucuuuc

SEQ ID NO: 583069 - RNA, 22 nt, Escherichia coli CFT073
cgcccaccucuucuuuaaaacg

SEQ ID NO: 583070 - RNA, 15 nt, Escherichia coli CFT073
cgcccaccgccaggc

SEQ ID NO: 583071 - RNA, 20 nt, Escherichia coli CFT073
cgcccacauaaccaaucauc

SEQ ID NO: 583072 - RNA, 17 nt, Escherichia coli CFT073
cgcgcuuaucgccagcg

SEQ ID NO: 583073 - RNA, 18 nt, Escherichia coli CFT073
cgcgcuuaucgccagcgc

SEQ ID NO: 583074 - RNA, 18 nt, Escherichia coli CFT073
cgcgcuuucuggcgcaga

SEQ ID NO: 583075 - RNA, 22 nt, Escherichia coli CFT073
cgcgcuuuuacugcgucaucgg

SEQ ID NO: 583076 - RNA, 22 nt, Escherichia coli CFT073
cgcggaaauucacuuccgucau

SEQ ID NO: 583077 - RNA, 19 nt, Escherichia coli CFT073
cgcgcggugguacggcauu

SEQ ID NO: 583078 - RNA, 19 nt, Escherichia coli CFT073
cgcgcgguguaccgcaucg

SEQ ID NO: 583079 - RNA, 22 nt, Escherichia coli CFT073
cgcgcgcuaacggagaauccag

SEQ ID NO: 583080 - RNA, 14 nt, Escherichia coli CFT073
cgcgcggaacauga

SEQ ID NO: 583081 - RNA, 22 nt, Escherichia coli CFT073
cgcggcaaucuuuaccggucag

SEQ ID NO: 583082 - RNA, 17 nt, Escherichia coli CFT073
cgcggcaauccccgcca

SEQ ID NO: 583083 - RNA, 15 nt, Escherichia coli CFT073
cgcggcacaccagcc

SEQ ID NO: 583084 - RNA, 16 nt, Escherichia coli CFT073
cgcggcauaacagaau

SEQ ID NO: 583085 - RNA, 22 nt, Escherichia coli CFT073
cgcgcaccgcgugaugcggcau

SEQ ID NO: 583086 - RNA, 16 nt, Escherichia coli CFT073
cgcgcagaucauccgg

SEQ ID NO: 583087 - RNA, 19 nt, Escherichia coli CFT073
cgcgcaaucagcaccgcgc

SEQ ID NO: 583088 - RNA, 14 nt, Escherichia coli CFT073
cgcgaccgccauga

SEQ ID NO: 583089 - RNA, 14 nt, Escherichia coli CFT073
cgcgcaggagcggc

SEQ ID NO: 583090 - RNA, 18 nt, Escherichia coli CFT073
cgcgcaucauuaccggca

SEQ ID NO: 583091 - RNA, 19 nt, Escherichia coli CFT073
cgcgcaguaaauccgccac

SEQ ID NO: 583092 - RNA, 22 nt, Escherichia coli CFT073
cgcgcaguaccacuucauccgg

SEQ ID NO: 583093 - RNA, 17 nt, Escherichia coli CFT073
cgcgcauaguuuuuugg

SEQ ID NO: 583094 - RNA, 14 nt, Escherichia coli CFT073
cgcgccaaucagcg

SEQ ID NO: 583095 - RNA, 21 nt, Escherichia coli CFT073
cgcgccaauccagaacaccau

SEQ ID NO: 583096 - RNA, 22 nt, Escherichia coli CFT073
cgcgccauccauaaucacgcug

SEQ ID NO: 583097 - RNA, 15 nt, Escherichia coli CFT073
cgcgccagcgucgca

SEQ ID NO: 583098 - RNA, 12 nt, Escherichia coli CFT073
cgcgccagcgug

SEQ ID NO: 583099 - RNA, 13 nt, Escherichia coli CFT073
cgcgccagcagcg

SEQ ID NO: 583100 - RNA, 17 nt, Escherichia coli CFT073
cgcgcccaacaguagac

SEQ ID NO: 583101 - RNA, 14 nt, Escherichia coli CFT073
cgcgcccaaccagc

SEQ ID NO: 583102 - RNA, 14 nt, Escherichia coli CFT073
cgcgccgcugagaa

SEQ ID NO: 583103 - RNA, 23 nt, Escherichia coli CFT073
cgcgccggacgauuuauuuuucu

SEQ ID NO: 583104 - RNA, 13 nt, Escherichia coli CFT073
cgcgccgcauccg

SEQ ID NO: 583105 - RNA, 16 nt, Escherichia coli CFT073
cgcuccggcagcagca

SEQ ID NO: 583106 - RNA, 12 nt, Escherichia coli CFT073
cgcuccggcacu

SEQ ID NO: 583107 - RNA, 19 nt, Escherichia coli CFT073
cgcucgaaguuuuccucag

SEQ ID NO: 583108 - RNA, 21 nt, Escherichia coli CFT073
cgcuccaucagauucagcagc

SEQ ID NO: 583109 - RNA, 13 nt, Escherichia coli CFT073
cgcuccauugccc

SEQ ID NO: 583110 - RNA, 22 nt, Escherichia coli CFT073
cgcucccaaaccgcccagcagc

SEQ ID NO: 583111 - RNA, 23 nt, Escherichia coli CFT073
cgcucccaaaccgcccagcagcg

SEQ ID NO: 583112 - RNA, 13 nt, Escherichia coli CFT073
cgcuccaguaccu

SEQ ID NO: 583113 - RNA, 21 nt, Escherichia coli CFT073
cgcucauaaauugcagcgauu

SEQ ID NO: 583114 - RNA, 20 nt, Escherichia coli CFT073
cgcucaucacgcaguuguuu

SEQ ID NO: 583115 - RNA, 21 nt, Escherichia coli CFT073
cgcucuggauaaucacaaugg

SEQ ID NO: 583116 - RNA, 13 nt, Escherichia coli CFT073
cgcucuggcaggc

SEQ ID NO: 583117 - RNA, 13 nt, Escherichia coli CFT073
cgcucuucaaacu

SEQ ID NO: 583118 - RNA, 14 nt, Escherichia coli CFT073
cgcucugacgacau

SEQ ID NO: 583119 - RNA, 18 nt, Escherichia coli CFT073
cgcucugcaucccggcag

SEQ ID NO: 583120 - RNA, 21 nt, Escherichia coli CFT073
cgcugaccuucuucagcaaua

SEQ ID NO: 583121 - RNA, 19 nt, Escherichia coli CFT073
cgcugaccuucuucagcaa

SEQ ID NO: 583122 - RNA, 22 nt, Escherichia coli CFT073
cgcugauacccggcacacaaau

SEQ ID NO: 583123 - RNA, 14 nt, Escherichia coli CFT073
cgcucgcauccugc

SEQ ID NO: 583124 - RNA, 20 nt, Escherichia coli CFT073
cgcugcgucuuccacuucau

SEQ ID NO: 583125 - RNA, 14 nt, Escherichia coli CFT073
cgcugcugcacaua

SEQ ID NO: 583126 - RNA, 14 nt, Escherichia coli CFT073
cgcugcgcuucuca

SEQ ID NO: 583127 - RNA, 17 nt, Escherichia coli CFT073
cgcugcgcuugcugcca

SEQ ID NO: 583128 - RNA, 22 nt, Escherichia coli CFT073
cgcugauauugcuccagacguu

SEQ ID NO: 583129 - RNA, 12 nt, Escherichia coli CFT073
cgcugccccugg

SEQ ID NO: 583130 - RNA, 12 nt, Escherichia coli CFT073
cgcugcccgccg

SEQ ID NO: 583131 - RNA, 18 nt, Escherichia coli CFT073
cgcugcgaaguuuuuccg

SEQ ID NO: 583132 - RNA, 15 nt, Escherichia coli CFT073
cgcugggccaucagg

SEQ ID NO: 583133 - RNA, 23 nt, Escherichia coli CFT073
cgcuggccaugauuaccagcauc

SEQ ID NO: 583134 - RNA, 14 nt, Escherichia coli CFT073
cgcuggcagccaua

SEQ ID NO: 583135 - RNA, 20 nt, Escherichia coli CFT073
cgcuggaugcgaccagcguc

SEQ ID NO: 583136 - RNA, 16 nt, Escherichia coli CFT073
cgcuggaugcgaugcu

SEQ ID NO: 583137 - RNA, 21 nt, Escherichia coli CFT073
cgcuggaugcgaugcuggcgc

SEQ ID NO: 583138 - RNA, 12 nt, Escherichia coli CFT073
cgcguaacgcca

SEQ ID NO: 583139 - RNA, 15 nt, Escherichia coli CFT073
cgcguaacgccagaa

SEQ ID NO: 583140 - RNA, 21 nt, Escherichia coli CFT073
cgcguaaaauauugcugcuaa

SEQ ID NO: 583141 - RNA, 19 nt, Escherichia coli CFT073
cgcguaaacgugcggcugu

SEQ ID NO: 583142 - RNA, 20 nt, Escherichia coli CFT073
cgcguaauguuuccagcauc

SEQ ID NO: 583143 - RNA, 17 nt, Escherichia coli CFT073
cgcguagccaggcggca

SEQ ID NO: 583144 - RNA, 14 nt, Escherichia coli CFT073
cgcgguauccggcu

SEQ ID NO: 583145 - RNA, 21 nt, Escherichia coli CFT073
cgcgguaucgccgucaccacc

SEQ ID NO: 583146 - RNA, 14 nt, Escherichia coli CFT073
cgcguugcggguac

SEQ ID NO: 583147 - RNA, 22 nt, Escherichia coli CFT073
cgcguuuaaccaccuccacgcc

SEQ ID NO: 583148 - RNA, 15 nt, Escherichia coli CFT073
cgcguuggcaagaua

SEQ ID NO: 583149 - RNA, 13 nt, Escherichia coli CFT073
cgcguuacgccau

SEQ ID NO: 583150 - RNA, 20 nt, Escherichia coli CFT073
cgcguuaaauccugccaacg

SEQ ID NO: 583151 - RNA, 21 nt, Escherichia coli CFT073
cgcguuaaauccugccaacgc

SEQ ID NO: 583152 - RNA, 16 nt, Escherichia coli CFT073
cgcguggucagcacaa

SEQ ID NO: 583153 - RNA, 23 nt, Escherichia coli CFT073
cgcgugaaaugccaaauauuucu

SEQ ID NO: 583154 - RNA, 22 nt, Escherichia coli CFT073
cgcgucuuaucuggccuacagg

SEQ ID NO: 583155 - RNA, 21 nt, Escherichia coli CFT073
cgcgucuucaucguccagcgu

SEQ ID NO: 583156 - RNA, 14 nt, Escherichia coli CFT073
cggucacggcugua

SEQ ID NO: 583157 - RNA, 16 nt, Escherichia coli CFT073
cgguauuaacucggaa

SEQ ID NO: 583158 - RNA, 20 nt, Escherichia coli CFT073
cgguaugacgaggaacauuc

SEQ ID NO: 583159 - RNA, 16 nt, Escherichia coli CFT073
cgguauugagcuucuc

SEQ ID NO: 583160 - RNA, 17 nt, Escherichia coli CFT073
cggucaacccaaccugc

SEQ ID NO: 583161 - RNA, 18 nt, Escherichia coli CFT073
cgguauggccuuucuggc

SEQ ID NO: 583162 - RNA, 15 nt, Escherichia coli CFT073
cgguaucucgcgcca

SEQ ID NO: 583163 - RNA, 14 nt, Escherichia coli CFT073
cgguauaacccagu

SEQ ID NO: 583164 - RNA, 16 nt, Escherichia coli CFT073
cgguaucaaagcgcca

SEQ ID NO: 583165 - RNA, 14 nt, Escherichia coli CFT073
cgguaguuccacca

SEQ ID NO: 583166 - RNA, 15 nt, Escherichia coli CFT073
cgguagcccagccga

SEQ ID NO: 583167 - RNA, 13 nt, Escherichia coli CFT073
cggguucggauaa

SEQ ID NO: 583168 - RNA, 19 nt, Escherichia coli CFT073
cgggugucccguaacggaa

SEQ ID NO: 583169 - RNA, 16 nt, Escherichia coli CFT073
cggguucuggcgcagc

SEQ ID NO: 583170 - RNA, 16 nt, Escherichia coli CFT073
cggguugcucucgcca

SEQ ID NO: 583171 - RNA, 15 nt, Escherichia coli CFT073
cgguagagaaaacca

SEQ ID NO: 583172 - RNA, 20 nt, Escherichia coli CFT073
cgguaccuuugaacugcuga

SEQ ID NO: 583173 - RNA, 23 nt, Escherichia coli CFT073
cgguacggauagccgccccagac

SEQ ID NO: 583174 - RNA, 13 nt, Escherichia coli CFT073
cgggucgcuucgu

SEQ ID NO: 583175 - RNA, 22 nt, Escherichia coli CFT073
cgggucauaaucagacugugau

SEQ ID NO: 583176 - RNA, 23 nt, Escherichia coli CFT073
cgggucaucaaaaucaucauugc

SEQ ID NO: 583177 - RNA, 22 nt, Escherichia coli CFT073
cggguauuuaaacuucacgcuc

SEQ ID NO: 583178 - RNA, 15 nt, Escherichia coli CFT073
cggguaagcgccaca

SEQ ID NO: 583179 - RNA, 23 nt, Escherichia coli CFT073
cggguaaguacgccaucgcgcau

SEQ ID NO: 583180 - RNA, 14 nt, Escherichia coli CFT073
cggguaauaaacca

SEQ ID NO: 583181 - RNA, 16 nt, Escherichia coli CFT073
cggggcgaucgcgcca

SEQ ID NO: 583182 - RNA, 15 nt, Escherichia coli CFT073
cgggcugcccggaua

SEQ ID NO: 583183 - RNA, 22 nt, Escherichia coli CFT073
cgggaacagccacaguuugcug

SEQ ID NO: 583184 - RNA, 16 nt, Escherichia coli CFT073
cgggaagucacugcgc

SEQ ID NO: 583185 - RNA, 18 nt, Escherichia coli CFT073
cgggaauaaaagccagga

SEQ ID NO: 583186 - RNA, 21 nt, Escherichia coli CFT073
cgggcaaucuccugcgcacgu

SEQ ID NO: 583187 - RNA, 22 nt, Escherichia coli CFT073
cgggcaugaacaaaucgcacgu

SEQ ID NO: 583188 - RNA, 17 nt, Escherichia coli CFT073
cgggcauuuccauuuuu

SEQ ID NO: 583189 - RNA, 20 nt, Escherichia coli CFT073
cgggccaaaaaccggcacgc

SEQ ID NO: 583190 - RNA, 18 nt, Escherichia coli CFT073
cgggcggaaaacuuucuu

SEQ ID NO: 583191 - RNA, 14 nt, Escherichia coli CFT073
cgggcgcaaaaaca

SEQ ID NO: 583192 - RNA, 13 nt, Escherichia coli CFT073
cggcgcauugccu

SEQ ID NO: 583193 - RNA, 17 nt, Escherichia coli CFT073
cggcgcucaucaggcca

SEQ ID NO: 583194 - RNA, 15 nt, Escherichia coli CFT073
cggcgcguaucgcga

SEQ ID NO: 583195 - RNA, 16 nt, Escherichia coli CFT073
cggcggcacucgcuga

SEQ ID NO: 583196 - RNA, 15 nt, Escherichia coli CFT073
cggcguccccacagu

SEQ ID NO: 583197 - RNA, 16 nt, Escherichia coli CFT073
cggcgugacgccagaa

SEQ ID NO: 583198 - RNA, 15 nt, Escherichia coli CFT073
cggcguguagcccau

SEQ ID NO: 583199 - RNA, 16 nt, Escherichia coli CFT073
cggcgugguuccggcu

SEQ ID NO: 583200 - RNA, 18 nt, Escherichia coli CFT073
cggcgugauauccauaaa

SEQ ID NO: 583201 - RNA, 13 nt, Escherichia coli CFT073
cggcguugcugcc

SEQ ID NO: 583202 - RNA, 17 nt, Escherichia coli CFT073
cggcguucuuuacacag

SEQ ID NO: 583203 - RNA, 14 nt, Escherichia coli CFT073
cggcuccagcaaug

SEQ ID NO: 583204 - RNA, 15 nt, Escherichia coli CFT073
cggcuccagcaaugu

SEQ ID NO: 583205 - RNA, 11 nt, Escherichia coli CFT073
cggcuccagca

SEQ ID NO: 583206 - RNA, 20 nt, Escherichia coli CFT073
cggcuauucuggccgcuuca

SEQ ID NO: 583207 - RNA, 15 nt, Escherichia coli CFT073
cggcuauaccgccga

SEQ ID NO: 583208 - RNA, 23 nt, Escherichia coli CFT073
cggcuauauugcaggagcgauua

SEQ ID NO: 583209 - RNA, 18 nt, Escherichia coli CFT073
cggcguuuugcuuuuuau

SEQ ID NO: 583210 - RNA, 16 nt, Escherichia coli CFT073
cggcuaagcaauuaca

SEQ ID NO: 583211 - RNA, 15 nt, Escherichia coli CFT073
cggcguuucacauuc

SEQ ID NO: 583212 - RNA, 16 nt, Escherichia coli CFT073
cggcguuugcuccugc

SEQ ID NO: 583213 - RNA, 20 nt, Escherichia coli CFT073
cggcugcgcuucuuccagca

SEQ ID NO: 583214 - RNA, 22 nt, Escherichia coli CFT073
cggcugcguaauucgccaccgg

SEQ ID NO: 583215 - RNA, 13 nt, Escherichia coli CFT073
cggcugcguaccu

SEQ ID NO: 583216 - RNA, 15 nt, Escherichia coli CFT073
cggcugaauacgcag

SEQ ID NO: 583217 - RNA, 15 nt, Escherichia coli CFT073
cggcuccccgcccug

SEQ ID NO: 583218 - RNA, 20 nt, Escherichia coli CFT073
cggcuucaaaacagaaaccc

SEQ ID NO: 583219 - RNA, 22 nt, Escherichia coli CFT073
cggcuucaaggugauauccacc

SEQ ID NO: 583220 - RNA, 20 nt, Escherichia coli CFT073
cggcuguuacgcacuucuuc

SEQ ID NO: 583221 - RNA, 19 nt, Escherichia coli CFT073
cggcuguugaccccacagc

SEQ ID NO: 583222 - RNA, 19 nt, Escherichia coli CFT073
cggcuggguagcuuccugc

SEQ ID NO: 583223 - RNA, 22 nt, Escherichia coli CFT073
cggcugggaaaucaccaccagc

SEQ ID NO: 583224 - RNA, 14 nt, Escherichia coli CFT073
cggcuggcggcguu

SEQ ID NO: 583225 - RNA, 15 nt, Escherichia coli CFT073
cggcuucaucuuuau

SEQ ID NO: 583226 - RNA, 18 nt, Escherichia coli CFT073
cgggaaacgagccauaaa

SEQ ID NO: 583227 - RNA, 22 nt, Escherichia coli CFT073
cggcuuuuugagauuuaccgga

SEQ ID NO: 583228 - RNA, 16 nt, Escherichia coli CFT073
cggcuuugaucagcgu

SEQ ID NO: 583229 - RNA, 17 nt, Escherichia coli CFT073
cggcuuugcagguucug

SEQ ID NO: 583230 - RNA, 20 nt, Escherichia coli CFT073
cggcuuucugcaaccagaaa

SEQ ID NO: 583231 - RNA, 13 nt, Escherichia coli CFT073
cggagaauagcgc

SEQ ID NO: 583232 - RNA, 15 nt, Escherichia coli CFT073
cggagaauagcgcca

SEQ ID NO: 583233 - RNA, 16 nt, Escherichia coli CFT073
cggagaauagcgccau

SEQ ID NO: 583234 - RNA, 17 nt, Escherichia coli CFT073
cggagaaggcguucacg

SEQ ID NO: 583235 - RNA, 23 nt, Escherichia coli CFT073
cggacuucaguuucuucaacagg

SEQ ID NO: 583236 - RNA, 20 nt, Escherichia coli CFT073
cggacuucuuugucguacca

SEQ ID NO: 583237 - RNA, 17 nt, Escherichia coli CFT073
cggauaaggcuuccuac

SEQ ID NO: 583238 - RNA, 14 nt, Escherichia coli CFT073
cggauaaggcguuu

SEQ ID NO: 583239 - RNA, 16 nt, Escherichia coli CFT073
cggauaaggcguuuac

SEQ ID NO: 583240 - RNA, 14 nt, Escherichia coli CFT073
cggauaaggcguuc

SEQ ID NO: 583241 - RNA, 23 nt, Escherichia coli CFT073
cggauaaggcguuuacgccgcau

SEQ ID NO: 583242 - RNA, 18 nt, Escherichia coli CFT073
cggauaaaugacucacgu

SEQ ID NO: 583243 - RNA, 20 nt, Escherichia coli CFT073
cggauaaaugacucacguua

SEQ ID NO: 583244 - RNA, 16 nt, Escherichia coli CFT073
cggauaagacgcgcca

SEQ ID NO: 583245 - RNA, 16 nt, Escherichia coli CFT073
cggauaagaugcgcca

SEQ ID NO: 583246 - RNA, 15 nt, Escherichia coli CFT073
cggaucgccgccgga

SEQ ID NO: 583247 - RNA, 23 nt, Escherichia coli CFT073
cggaucuuucaggaacagcgaca

SEQ ID NO: 583248 - RNA, 19 nt, Escherichia coli CFT073
cggaugaaaagucauccgg

SEQ ID NO: 583249 - RNA, 14 nt, Escherichia coli CFT073
cggaucuuccagcg

SEQ ID NO: 583250 - RNA, 16 nt, Escherichia coli CFT073
cggaucuuccagcgca

SEQ ID NO: 583251 - RNA, 11 nt, Escherichia coli CFT073
cggaucuccgg

SEQ ID NO: 583252 - RNA, 13 nt, Escherichia coli CFT073
cggaucguucacg

SEQ ID NO: 583253 - RNA, 19 nt, Escherichia coli CFT073
cgcuguacucaccaacgca

SEQ ID NO: 583254 - RNA, 19 nt, Escherichia coli CFT073
cgcuguagccgccaucguu

SEQ ID NO: 583255 - RNA, 20 nt, Escherichia coli CFT073
cgcuguaagccaagcgccgc

SEQ ID NO: 583256 - RNA, 24 nt, Escherichia coli CFT073
cgcuguaagccaagcgccgccuca

SEQ ID NO: 583257 - RNA, 18 nt, Escherichia coli CFT073
cgcuguaagccgccgcca

SEQ ID NO: 583258 - RNA, 21 nt, Escherichia coli CFT073
cgcuguaauucuucaagugug

SEQ ID NO: 583259 - RNA, 18 nt, Escherichia coli CFT073
cgcugguucuccguucag

SEQ ID NO: 583260 - RNA, 21 nt, Escherichia coli CFT073
cgcuggugauucagggcagca

SEQ ID NO: 583261 - RNA, 15 nt, Escherichia coli CFT073
cggaccaacaaaaau

SEQ ID NO: 583262 - RNA, 13 nt, Escherichia coli CFT073
cggacauguugcu

SEQ ID NO: 583263 - RNA, 17 nt, Escherichia coli CFT073
cggacagucacguagcg

SEQ ID NO: 583264 - RNA, 21 nt, Escherichia coli CFT073
cggacaugaaccgugucgcca

SEQ ID NO: 583265 - RNA, 15 nt, Escherichia coli CFT073
cggacacucggcgcg

SEQ ID NO: 583266 - RNA, 15 nt, Escherichia coli CFT073
cggacacuuuccugc

SEQ ID NO: 583267 - RNA, 16 nt, Escherichia coli CFT073
cggacggcucacuuug

SEQ ID NO: 583268 - RNA, 22 nt, Escherichia coli CFT073
cggcauacuuugauuaaccguu

SEQ ID NO: 583269 - RNA, 23 nt, Escherichia coli CFT073
cggcauaagccgucccuacuggu

SEQ ID NO: 583270 - RNA, 15 nt, Escherichia coli CFT073
cggcaucaaccgccg

SEQ ID NO: 583271 - RNA, 16 nt, Escherichia coli CFT073
cggcauauaccgucag

SEQ ID NO: 583272 - RNA, 17 nt, Escherichia coli CFT073
cggcagucgcgcuucgu

SEQ ID NO: 583273 - RNA, 17 nt, Escherichia coli CFT073
cggcagguugaugauga

SEQ ID NO: 583274 - RNA, 21 nt, Escherichia coli CFT073
cggcagguuuaaccaucaggc

SEQ ID NO: 583275 - RNA, 17 nt, Escherichia coli CFT073
cggcaguauagcggcau

SEQ ID NO: 583276 - RNA, 17 nt, Escherichia coli CFT073
cggcagcggcuucaugc

SEQ ID NO: 583277 - RNA, 22 nt, Escherichia coli CFT073
cggcagcgggauuuccggcauc

SEQ ID NO: 583278 - RNA, 14 nt, Escherichia coli CFT073
cggcagcucuuucu

SEQ ID NO: 583279 - RNA, 22 nt, Escherichia coli CFT073
cggcagcgucgcauccaacaau

SEQ ID NO: 583280 - RNA, 21 nt, Escherichia coli CFT073
cggcagcgugccaggcgcgcu

SEQ ID NO: 583281 - RNA, 19 nt, Escherichia coli CFT073
cggcaggugauggcggcuu

SEQ ID NO: 583282 - RNA, 15 nt, Escherichia coli CFT073
cggcaggucaucgug

SEQ ID NO: 583283 - RNA, 19 nt, Escherichia coli CFT073
cggcaggguguuaucaaua

SEQ ID NO: 583284 - RNA, 21 nt, Escherichia coli CFT073
cggcaggguacgacuuccugg

SEQ ID NO: 583285 - RNA, 14 nt, Escherichia coli CFT073
cggcaggaacagau

SEQ ID NO: 583286 - RNA, 15 nt, Escherichia coli CFT073
cggcauuuugcugau

SEQ ID NO: 583287 - RNA, 14 nt, Escherichia coli CFT073
cggcauuuccgcca

SEQ ID NO: 583288 - RNA, 16 nt, Escherichia coli CFT073
cggcauggaucgccgc

SEQ ID NO: 583289 - RNA, 17 nt, Escherichia coli CFT073
cggcauggaucgccgcg

SEQ ID NO: 583290 - RNA, 20 nt, Escherichia coli CFT073
cggcauccagaccgcuguaa

SEQ ID NO: 583291 - RNA, 14 nt, Escherichia coli CFT073
cggcaagagaauug

SEQ ID NO: 583292 - RNA, 19 nt, Escherichia coli CFT073
cggcaagaaauaccgaaga

SEQ ID NO: 583293 - RNA, 19 nt, Escherichia coli CFT073
cggaugcguuguaccagcu

SEQ ID NO: 583294 - RNA, 20 nt, Escherichia coli CFT073
cggaugcggggcgagcgcca

SEQ ID NO: 583295 - RNA, 14 nt, Escherichia coli CFT073
cggaugcggcgauu

SEQ ID NO: 583296 - RNA, 16 nt, Escherichia coli CFT073
cggaugcggcgcgagc

SEQ ID NO: 583297 - RNA, 14 nt, Escherichia coli CFT073
cggaugcgaaguaa

SEQ ID NO: 583298 - RNA, 19 nt, Escherichia coli CFT073
cggaugcgacgcaaacgcc

SEQ ID NO: 583299 - RNA, 16 nt, Escherichia coli CFT073
cggaugcgacgcuggc

SEQ ID NO: 583300 - RNA, 16 nt, Escherichia coli CFT073
cggaugcgaugcuggc

SEQ ID NO: 583301 - RNA, 17 nt, Escherichia coli CFT073
cggaugcgaugcuggcg

SEQ ID NO: 583302 - RNA, 20 nt, Escherichia coli CFT073
cggcaaucgcaaucauuuuu

SEQ ID NO: 583303 - RNA, 15 nt, Escherichia coli CFT073
cggcaauccgugcaa

SEQ ID NO: 583304 - RNA, 17 nt, Escherichia coli CFT073
cggcaaucgcgccagaa

SEQ ID NO: 583305 - RNA, 17 nt, Escherichia coli CFT073
cggcaauccccgccagc

SEQ ID NO: 583306 - RNA, 20 nt, Escherichia coli CFT073
cggcaaucaccgccagcggc

SEQ ID NO: 583307 - RNA, 15 nt, Escherichia coli CFT073
cggcaaucacgcccg

SEQ ID NO: 583308 - RNA, 13 nt, Escherichia coli CFT073
cggcaaugagcgc

SEQ ID NO: 583309 - RNA, 20 nt, Escherichia coli CFT073
cggcaaugcguuccagcaga

SEQ ID NO: 583310 - RNA, 18 nt, Escherichia coli CFT073
cggcaaugaaagcgagcg

SEQ ID NO: 583311 - RNA, 14 nt, Escherichia coli CFT073
cggcaccgccgcca

SEQ ID NO: 583312 - RNA, 18 nt, Escherichia coli CFT073
cggcacugaccaccacca

SEQ ID NO: 583313 - RNA, 19 nt, Escherichia coli CFT073
cggcagccugcgucgccau

SEQ ID NO: 583314 - RNA, 21 nt, Escherichia coli CFT073
cggccauauccagccaacgcc

SEQ ID NO: 583315 - RNA, 20 nt, Escherichia coli CFT073
cggccaguagcuugaaauca

SEQ ID NO: 583316 - RNA, 19 nt, Escherichia coli CFT073
cggccaguauuugucugcc

SEQ ID NO: 583317 - RNA, 22 nt, Escherichia coli CFT073
cggcccaugacaaacucaccug

SEQ ID NO: 583318 - RNA, 21 nt, Escherichia coli CFT073
cggcgaaaauuacuuuccgcc

SEQ ID NO: 583319 - RNA, 17 nt, Escherichia coli CFT073
cggcgaagagagcgcca

SEQ ID NO: 583320 - RNA, 20 nt, Escherichia coli CFT073
cggccuaccguuccgacacc

SEQ ID NO: 583321 - RNA, 14 nt, Escherichia coli CFT073
cggcgcagcaauua

SEQ ID NO: 583322 - RNA, 17 nt, Escherichia coli CFT073
cggcgauguagcgcugu

SEQ ID NO: 583323 - RNA, 15 nt, Escherichia coli CFT073
cggcgauaccaguaa

SEQ ID NO: 583324 - RNA, 19 nt, Escherichia coli CFT073
cggcgagagccuucggcaa

SEQ ID NO: 583325 - RNA, 17 nt, Escherichia coli CFT073
cggcgagaucuucgcca

SEQ ID NO: 583326 - RNA, 20 nt, Escherichia coli CFT073
cgacguugcguugccgccaa

SEQ ID NO: 583327 - RNA, 21 nt, Escherichia coli CFT073
cgacguuuuccaucgaccagc

SEQ ID NO: 583328 - RNA, 19 nt, Escherichia coli CFT073
cgacuuaaaaggaaaauca

SEQ ID NO: 583329 - RNA, 14 nt, Escherichia coli CFT073
cgacuggauaauga

SEQ ID NO: 583330 - RNA, 17 nt, Escherichia coli CFT073
cgacuccagcgcuucgc

SEQ ID NO: 583331 - RNA, 21 nt, Escherichia coli CFT073
cgagaaaaagccuaagaaguc

SEQ ID NO: 583332 - RNA, 17 nt, Escherichia coli CFT073
cgagaaaagccaaccug

SEQ ID NO: 583333 - RNA, 16 nt, Escherichia coli CFT073
cgagaacgucgcaggg

SEQ ID NO: 583334 - RNA, 22 nt, Escherichia coli CFT073
cgagaacucggaagcagcguaa

SEQ ID NO: 583335 - RNA, 23 nt, Escherichia coli CFT073
cgagaagccgaccagcaccgcca

SEQ ID NO: 583336 - RNA, 13 nt, Escherichia coli CFT073
cgacuucucgcaa

SEQ ID NO: 583337 - RNA, 15 nt, Escherichia coli CFT073
cgacuuccaccagcg

SEQ ID NO: 583338 - RNA, 16 nt, Escherichia coli CFT073
cgacgugcccuuucag

SEQ ID NO: 583339 - RNA, 15 nt, Escherichia coli CFT073
cgacgcugauagcgu

SEQ ID NO: 583340 - RNA, 20 nt, Escherichia coli CFT073
cgagaauaucuucgaccguc

SEQ ID NO: 583341 - RNA, 19 nt, Escherichia coli CFT073
cgagaaucugccgcaguac

SEQ ID NO: 583342 - RNA, 22 nt, Escherichia coli CFT073
cgagcacaaagccgugccagau

SEQ ID NO: 583343 - RNA, 18 nt, Escherichia coli CFT073
cgagauacagguugccga

SEQ ID NO: 583344 - RNA, 16 nt, Escherichia coli CFT073
cgagcagcauaauugc

SEQ ID NO: 583345 - RNA, 19 nt, Escherichia coli CFT073
cgagcagccacugcggcau

SEQ ID NO: 583346 - RNA, 16 nt, Escherichia coli CFT073
cgagccagcgcauccu

SEQ ID NO: 583347 - RNA, 19 nt, Escherichia coli CFT073
cgagcaguuguuccaguug

SEQ ID NO: 583348 - RNA, 21 nt, Escherichia coli CFT073
cgagcaguuguuccaguugau

SEQ ID NO: 583349 - RNA, 20 nt, Escherichia coli CFT073
cgagccaccaauacuugcga

SEQ ID NO: 583350 - RNA, 23 nt, Escherichia coli CFT073
cgacgcuccugaucaagcuggcg

SEQ ID NO: 583351 - RNA, 23 nt, Escherichia coli CFT073
cgacgcgggccgcgucuuaucag

SEQ ID NO: 583352 - RNA, 15 nt, Escherichia coli CFT073
cgacccuucaucggu

SEQ ID NO: 583353 - RNA, 18 nt, Escherichia coli CFT073
cgaccgaucaccacaaua

SEQ ID NO: 583354 - RNA, 13 nt, Escherichia coli CFT073
cgacccugaugaa

SEQ ID NO: 583355 - RNA, 18 nt, Escherichia coli CFT073
cgacccgauucggucaug

SEQ ID NO: 583356 - RNA, 14 nt, Escherichia coli CFT073
cgacaucgccacgg

SEQ ID NO: 583357 - RNA, 21 nt, Escherichia coli CFT073
cgaccgcgggacaaauaauga

SEQ ID NO: 583358 - RNA, 14 nt, Escherichia coli CFT073
cgaccgccuucagu

SEQ ID NO: 583359 - RNA, 11 nt, Escherichia coli CFT073
cgaccgccgcu

SEQ ID NO: 583360 - RNA, 16 nt, Escherichia coli CFT073
cgaccgccauuaaacg

SEQ ID NO: 583361 - RNA, 17 nt, Escherichia coli CFT073
cgaagcgcaugccuucg

SEQ ID NO: 583362 - RNA, 15 nt, Escherichia coli CFT073
cgaaggacugccgca

SEQ ID NO: 583363 - RNA, 15 nt, Escherichia coli CFT073
cgaacucuucgccca

SEQ ID NO: 583364 - RNA, 20 nt, Escherichia coli CFT073
cgaagccugcgacgucugau

SEQ ID NO: 583365 - RNA, 22 nt, Escherichia coli CFT073
cgaagccugcggauaaucgcgg

SEQ ID NO: 583366 - RNA, 19 nt, Escherichia coli CFT073
cgaaaugucaaacaguuca

SEQ ID NO: 583367 - RNA, 18 nt, Escherichia coli CFT073
cgaaaucuuccaguggca

SEQ ID NO: 583368 - RNA, 16 nt, Escherichia coli CFT073
cgaaaucggcaccgcc

SEQ ID NO: 583369 - RNA, 22 nt, Escherichia coli CFT073
cgaaaucggcaccgccgccaaa

SEQ ID NO: 583370 - RNA, 21 nt, Escherichia coli CFT073
cgaacaacucgguuaacggca

SEQ ID NO: 583371 - RNA, 18 nt, Escherichia coli CFT073
cgaacgcugacaaacugc

SEQ ID NO: 583372 - RNA, 20 nt, Escherichia coli CFT073
cgaacgcugacaaacugcgu

SEQ ID NO: 583373 - RNA, 21 nt, Escherichia coli CFT073
cgaaccuuccaucgcaucuuc

SEQ ID NO: 583374 - RNA, 21 nt, Escherichia coli CFT073
cgaacguacaucccgcgcacg

SEQ ID NO: 583375 - RNA, 17 nt, Escherichia coli CFT073
cgaacuccgccccggca

SEQ ID NO: 583376 - RNA, 16 nt, Escherichia coli CFT073
cgaacgugaucgcccc

SEQ ID NO: 583377 - RNA, 22 nt, Escherichia coli CFT073
cgaacucauugcgggccaggaa

SEQ ID NO: 583378 - RNA, 16 nt, Escherichia coli CFT073
cgacaauaaucaacgc

SEQ ID NO: 583379 - RNA, 15 nt, Escherichia coli CFT073
cgacaaucccugcau

SEQ ID NO: 583380 - RNA, 21 nt, Escherichia coli CFT073
cgacaagcucauuucccaaca

SEQ ID NO: 583381 - RNA, 18 nt, Escherichia coli CFT073
cgacaagcauaacaaaau

SEQ ID NO: 583382 - RNA, 18 nt, Escherichia coli CFT073
cgacacacugcgccgcca

SEQ ID NO: 583383 - RNA, 13 nt, Escherichia coli CFT073
cgacacaacgcuu

SEQ ID NO: 583384 - RNA, 15 nt, Escherichia coli CFT073
cgacacaaugccaua

SEQ ID NO: 583385 - RNA, 12 nt, Escherichia coli CFT073
cgacauccgcca

SEQ ID NO: 583386 - RNA, 21 nt, Escherichia coli CFT073
cgacauaucauuuugcugcca

SEQ ID NO: 583387 - RNA, 17 nt, Escherichia coli CFT073
cgacaucaagaaaugca

SEQ ID NO: 583388 - RNA, 16 nt, Escherichia coli CFT073
cgacauaucgccagua

SEQ ID NO: 583389 - RNA, 23 nt, Escherichia coli CFT073
cgacaggcuuacguuacccagca

SEQ ID NO: 583390 - RNA, 14 nt, Escherichia coli CFT073
cgaauccaauaaaa

SEQ ID NO: 583391 - RNA, 14 nt, Escherichia coli CFT073
cgaaucccuaagcg

SEQ ID NO: 583392 - RNA, 18 nt, Escherichia coli CFT073
cgaauguacgucaggcca

SEQ ID NO: 583393 - RNA, 21 nt, Escherichia coli CFT073
cgaauuaagaauuucucaguu

SEQ ID NO: 583394 - RNA, 16 nt, Escherichia coli CFT073
cgacaaaaucccggcg

SEQ ID NO: 583395 - RNA, 16 nt, Escherichia coli CFT073
cgacaaaaaagcguuc

SEQ ID NO: 583396 - RNA, 14 nt, Escherichia coli CFT073
cgacaacaccgaua

SEQ ID NO: 583397 - RNA, 17 nt, Escherichia coli CFT073
cgacaaaugcgccgcca

SEQ ID NO: 583398 - RNA, 18 nt, Escherichia coli CFT073
cgacaaaugcgccgccaa

SEQ ID NO: 583399 - RNA, 21 nt, Escherichia coli CFT073
cgacaacgccuuguucgcccu

SEQ ID NO: 583400 - RNA, 16 nt, Escherichia coli CFT073
cgaauaacgcgcagcg

SEQ ID NO: 583401 - RNA, 15 nt, Escherichia coli CFT073
cgaauaccguaacga

SEQ ID NO: 583402 - RNA, 14 nt, Escherichia coli CFT073
cgaauacggcggau

SEQ ID NO: 583403 - RNA, 11 nt, Escherichia coli CFT073
cgaauccagca

SEQ ID NO: 583404 - RNA, 13 nt, Escherichia coli CFT073
cgaauauaacuaa

SEQ ID NO: 583405 - RNA, 13 nt, Escherichia coli CFT073
cgaauaucaacaa

SEQ ID NO: 583406 - RNA, 20 nt, Escherichia coli CFT073
cgaauauuggagagcgauaa

SEQ ID NO: 583407 - RNA, 23 nt, Escherichia coli CFT073
cgaaaucacgcacucgacgcagc

SEQ ID NO: 583408 - RNA, 15 nt, Escherichia coli CFT073
cgaaaucacuggcgu

SEQ ID NO: 583409 - RNA, 20 nt, Escherichia coli CFT073
cgaaaguucaaccucaagca

SEQ ID NO: 583410 - RNA, 12 nt, Escherichia coli CFT073
cgaaauaacuga

SEQ ID NO: 583411 - RNA, 17 nt, Escherichia coli CFT073
cgaaaaucccggcaaca

SEQ ID NO: 583412 - RNA, 16 nt, Escherichia coli CFT073
cgaaaaggauaaauaa

SEQ ID NO: 583413 - RNA, 22 nt, Escherichia coli CFT073
cgaaaauuacgccggaaaguua

SEQ ID NO: 583414 - RNA, 21 nt, Escherichia coli CFT073
cgaaaauuacuuuccgccauu

SEQ ID NO: 583415 - RNA, 22 nt, Escherichia coli CFT073
cgaaacaccggugaccaucagc

SEQ ID NO: 583416 - RNA, 18 nt, Escherichia coli CFT073
cgaaaccaagaccaaucc

SEQ ID NO: 583417 - RNA, 22 nt, Escherichia coli CFT073
cgaaaccacaguucaaugcgcc

SEQ ID NO: 583418 - RNA, 21 nt, Escherichia coli CFT073
cgaaaccacucccgcgcuucg

SEQ ID NO: 583419 - RNA, 20 nt, Escherichia coli CFT073
cgaaacgaaagucccgauaa

SEQ ID NO: 583420 - RNA, 14 nt, Escherichia coli CFT073
cgaaaccgcucuca

SEQ ID NO: 583421 - RNA, 17 nt, Escherichia coli CFT073
cgaaacccgaaccacgc

SEQ ID NO: 583422 - RNA, 16 nt, Escherichia coli CFT073
cgaaaacugacgguuu

SEQ ID NO: 583423 - RNA, 13 nt, Escherichia coli CFT073
cgaaaacaucaug

SEQ ID NO: 583424 - RNA, 12 nt, Escherichia coli CFT073
cgaaaacccuca

SEQ ID NO: 583425 - RNA, 19 nt, Escherichia coli CFT073
ccuuucugcagcgcggcga

SEQ ID NO: 583426 - RNA, 20 nt, Escherichia coli CFT073
cgaaaaagaaucgauuaucu

SEQ ID NO: 583427 - RNA, 15 nt, Escherichia coli CFT073
ccuuucggugaauac

SEQ ID NO: 583428 - RNA, 20 nt, Escherichia coli CFT073
ccuuuccagcaaucgucgau

SEQ ID NO: 583429 - RNA, 17 nt, Escherichia coli CFT073
ccuuucaaucacccgau

SEQ ID NO: 583430 - RNA, 21 nt, Escherichia coli CFT073
ccuuuauucagaaaacguugg

SEQ ID NO: 583431 - RNA, 20 nt, Escherichia coli CFT073
ccuuuaaacaggccgacaaa

SEQ ID NO: 583432 - RNA, 15 nt, Escherichia coli CFT073
ccuuuacaugaaaaa

SEQ ID NO: 583433 - RNA, 13 nt, Escherichia coli CFT073
ccuuuacgcaaag

SEQ ID NO: 583434 - RNA, 14 nt, Escherichia coli CFT073
ccuuuagcgagcga

SEQ ID NO: 583435 - RNA, 13 nt, Escherichia coli CFT073
ccuugcuggcgau

SEQ ID NO: 583436 - RNA, 20 nt, Escherichia coli CFT073
ccuuguuuaaggaaaaacga

SEQ ID NO: 583437 - RNA, 14 nt, Escherichia coli CFT073
ccuugcugauuuua

SEQ ID NO: 583438 - RNA, 16 nt, Escherichia coli CFT073
ccugucaccgggcaaa

SEQ ID NO: 583439 - RNA, 15 nt, Escherichia coli CFT073
ccuucacccucacgc

SEQ ID NO: 583440 - RNA, 19 nt, Escherichia coli CFT073
ccuucaucuucauccggcu

SEQ ID NO: 583441 - RNA, 22 nt, Escherichia coli CFT073
ccuucgccagugcguugugcgc

SEQ ID NO: 583442 - RNA, 13 nt, Escherichia coli CFT073
ccuucagcaucga

SEQ ID NO: 583443 - RNA, 14 nt, Escherichia coli CFT073
ccuggcgagcagca

SEQ ID NO: 583444 - RNA, 18 nt, Escherichia coli CFT073
ccuggcgcgacaauauuc

SEQ ID NO: 583445 - RNA, 20 nt, Escherichia coli CFT073
ccuggcggcagauagcgaua

SEQ ID NO: 583446 - RNA, 22 nt, Escherichia coli CFT073
ccugccgggcugauaccgcguu

SEQ ID NO: 583447 - RNA, 20 nt, Escherichia coli CFT073
ccugccggaacgugcauauu

SEQ ID NO: 583448 - RNA, 12 nt, Escherichia coli CFT073
ccugccgccauc

SEQ ID NO: 583449 - RNA, 13 nt, Escherichia coli CFT073
ccugcccgcugcc

SEQ ID NO: 583450 - RNA, 13 nt, Escherichia coli CFT073
ccugcccuccggu

SEQ ID NO: 583451 - RNA, 20 nt, Escherichia coli CFT073
ccuguaauggcuggaucaga

SEQ ID NO: 583452 - RNA, 12 nt, Escherichia coli CFT073
ccuggucgcugg

SEQ ID NO: 583453 - RNA, 17 nt, Escherichia coli CFT073
ccugggucagcgccgua

SEQ ID NO: 583454 - RNA, 19 nt, Escherichia coli CFT073
ccugggcguuugcgcgacg

SEQ ID NO: 583455 - RNA, 17 nt, Escherichia coli CFT073
ccuggggauucaucacc

SEQ ID NO: 583456 - RNA, 15 nt, Escherichia coli CFT073
cgcaggucgcgcauu

SEQ ID NO: 583457 - RNA, 19 nt, Escherichia coli CFT073
cgcaggucgcgcauuaccu

SEQ ID NO: 583458 - RNA, 20 nt, Escherichia coli CFT073
cgcaggucggauaagacgcg

SEQ ID NO: 583459 - RNA, 13 nt, Escherichia coli CFT073
cgcaggugauccu

SEQ ID NO: 583460 - RNA, 14 nt, Escherichia coli CFT073
cgcaggcuuccugg

SEQ ID NO: 583461 - RNA, 15 nt, Escherichia coli CFT073
cgcaggaugagcgcg

SEQ ID NO: 583462 - RNA, 12 nt, Escherichia coli CFT073
cgcagcgcagcg

SEQ ID NO: 583463 - RNA, 12 nt, Escherichia coli CFT073
cgcaggcaguaa

SEQ ID NO: 583464 - RNA, 15 nt, Escherichia coli CFT073
cgcagcgcagcgcca

SEQ ID NO: 583465 - RNA, 16 nt, Escherichia coli CFT073
cgcagcgcagcgccaa

SEQ ID NO: 583466 - RNA, 22 nt, Escherichia coli CFT073
cgcagcgcaucaggcaacccag

SEQ ID NO: 583467 - RNA, 18 nt, Escherichia coli CFT073
cgcagaaauaccccgcca

SEQ ID NO: 583468 - RNA, 20 nt, Escherichia coli CFT073
cgcagaaauaccccgccagc

SEQ ID NO: 583469 - RNA, 19 nt, Escherichia coli CFT073
cgcacuuucuccggcagcu

SEQ ID NO: 583470 - RNA, 21 nt, Escherichia coli CFT073
cgcagccagcacugccgcauc

SEQ ID NO: 583471 - RNA, 13 nt, Escherichia coli CFT073
cgcagccaguuaa

SEQ ID NO: 583472 - RNA, 13 nt, Escherichia coli CFT073
cgcagccagcgca

SEQ ID NO: 583473 - RNA, 23 nt, Escherichia coli CFT073
cgcacguuuuuccagugauuguc

SEQ ID NO: 583474 - RNA, 13 nt, Escherichia coli CFT073
cgcacugucgcca

SEQ ID NO: 583475 - RNA, 18 nt, Escherichia coli CFT073
cgcacuuaaaaugcgcuc

SEQ ID NO: 583476 - RNA, 13 nt, Escherichia coli CFT073
cgcacugccgcca

SEQ ID NO: 583477 - RNA, 15 nt, Escherichia coli CFT073
cgcacuggcgcgccu

SEQ ID NO: 583478 - RNA, 20 nt, Escherichia coli CFT073
cgcacguaacgaguuaccgu

SEQ ID NO: 583479 - RNA, 21 nt, Escherichia coli CFT073
cgcacggcacacuuucaucaa

SEQ ID NO: 583480 - RNA, 18 nt, Escherichia coli CFT073
cgcacgcugucgccagug

SEQ ID NO: 583481 - RNA, 23 nt, Escherichia coli CFT073
cgcaagccacgggccgaaugcga

SEQ ID NO: 583482 - RNA, 16 nt, Escherichia coli CFT073
cgcaaggaucggugcu

SEQ ID NO: 583483 - RNA, 16 nt, Escherichia coli CFT073
cgcaccgcgugaugcg

SEQ ID NO: 583484 - RNA, 18 nt, Escherichia coli CFT073
cgcaccgcgugaugcggc

SEQ ID NO: 583485 - RNA, 22 nt, Escherichia coli CFT073
cgcaccuugccaaauuuacugu

SEQ ID NO: 583486 - RNA, 13 nt, Escherichia coli CFT073
cgcaccugccagu

SEQ ID NO: 583487 - RNA, 16 nt, Escherichia coli CFT073
cgcaccgguuccgggc

SEQ ID NO: 583488 - RNA, 18 nt, Escherichia coli CFT073
cgcauccggcaauucuca

SEQ ID NO: 583489 - RNA, 17 nt, Escherichia coli CFT073
cgcauccggcaucaacc

SEQ ID NO: 583490 - RNA, 21 nt, Escherichia coli CFT073
cgcauccggcaugaacaaagc

SEQ ID NO: 583491 - RNA, 17 nt, Escherichia coli CFT073
cgcauccggccaucagu

SEQ ID NO: 583492 - RNA, 21 nt, Escherichia coli CFT073
cgcauccggcguaaacaacga

SEQ ID NO: 583493 - RNA, 17 nt, Escherichia coli CFT073
cgcaguaaacgccaggg

SEQ ID NO: 583494 - RNA, 16 nt, Escherichia coli CFT073
cgcaguaaauccgcca

SEQ ID NO: 583495 - RNA, 15 nt, Escherichia coli CFT073
cgcaugacgcaacaa

SEQ ID NO: 583496 - RNA, 22 nt, Escherichia coli CFT073
cgcaucuuaaucucucaacacc

SEQ ID NO: 583497 - RNA, 17 nt, Escherichia coli CFT073
cgcaucuucgcccacgg

SEQ ID NO: 583498 - RNA, 15 nt, Escherichia coli CFT073
cgcaucugaccagau

SEQ ID NO: 583499 - RNA, 22 nt, Escherichia coli CFT073
cgcaucuggcaucggcgcacaa

SEQ ID NO: 583500 - RNA, 19 nt, Escherichia coli CFT073
cgcauggaaccaguucacu

SEQ ID NO: 583501 - RNA, 17 nt, Escherichia coli CFT073
cgcauggaagcgcaggu

SEQ ID NO: 583502 - RNA, 16 nt, Escherichia coli CFT073
cgcauucugugccgga

SEQ ID NO: 583503 - RNA, 23 nt, Escherichia coli CFT073
cgccaacuucaugaccuuccagc

SEQ ID NO: 583504 - RNA, 19 nt, Escherichia coli CFT073
cgccaagauagaaccacgc

SEQ ID NO: 583505 - RNA, 14 nt, Escherichia coli CFT073
cgcauuucccagca

SEQ ID NO: 583506 - RNA, 17 nt, Escherichia coli CFT073
cgccaaugaucccgcca

SEQ ID NO: 583507 - RNA, 15 nt, Escherichia coli CFT073
cgccaaugcgcaaua

SEQ ID NO: 583508 - RNA, 18 nt, Escherichia coli CFT073
cgccaauggcugccgcca

SEQ ID NO: 583509 - RNA, 21 nt, Escherichia coli CFT073
cgccaauggcugccgccaggu

SEQ ID NO: 583510 - RNA, 18 nt, Escherichia coli CFT073
cgccaauuacgccugccc

SEQ ID NO: 583511 - RNA, 17 nt, Escherichia coli CFT073
cgccacaacuucaacgu

SEQ ID NO: 583512 - RNA, 22 nt, Escherichia coli CFT073
cgccacaaucagcgcggcgaua

SEQ ID NO: 583513 - RNA, 13 nt, Escherichia coli CFT073
cgccaccccacac

SEQ ID NO: 583514 - RNA, 13 nt, Escherichia coli CFT073
cgccaccagcgcc

SEQ ID NO: 583515 - RNA, 18 nt, Escherichia coli CFT073
cgccaccagcgccaccac

SEQ ID NO: 583516 - RNA, 14 nt, Escherichia coli CFT073
cgccaccgcuucgc

SEQ ID NO: 583517 - RNA, 12 nt, Escherichia coli CFT073
cgccacccgaua

SEQ ID NO: 583518 - RNA, 13 nt, Escherichia coli CFT073
cgccacgaucggu

SEQ ID NO: 583519 - RNA, 16 nt, Escherichia coli CFT073
cgccacgccaaccacc

SEQ ID NO: 583520 - RNA, 14 nt, Escherichia coli CFT073
cgccacgccaagaa

SEQ ID NO: 583521 - RNA, 17 nt, Escherichia coli CFT073
cgccacuugagccgcca

SEQ ID NO: 583522 - RNA, 21 nt, Escherichia coli CFT073
cgccagauagccgccagagaa

SEQ ID NO: 583523 - RNA, 17 nt, Escherichia coli CFT073
cgccagauaguucgcaa

SEQ ID NO: 583524 - RNA, 21 nt, Escherichia coli CFT073
cgccagcuucgcuucccaacg

SEQ ID NO: 583525 - RNA, 16 nt, Escherichia coli CFT073
cgccagcugcauuuca

SEQ ID NO: 583526 - RNA, 17 nt, Escherichia coli CFT073
cgccagcucugcgcccu

SEQ ID NO: 583527 - RNA, 20 nt, Escherichia coli CFT073
cgccagcucugcgcccugca

SEQ ID NO: 583528 - RNA, 22 nt, Escherichia coli CFT073
cgccagcgucgcaucaggcauc

SEQ ID NO: 583529 - RNA, 23 nt, Escherichia coli CFT073
cgccagcggucauaacgcugaua

SEQ ID NO: 583530 - RNA, 23 nt, Escherichia coli CFT073
cgccagcgccaguuuuugcuucu

SEQ ID NO: 583531 - RNA, 14 nt, Escherichia coli CFT073
cgccagcgcaucau

SEQ ID NO: 583532 - RNA, 18 nt, Escherichia coli CFT073
cgccagcgccaaagccag

SEQ ID NO: 583533 - RNA, 20 nt, Escherichia coli CFT073
cgccagccgccagcaucuca

SEQ ID NO: 583534 - RNA, 22 nt, Escherichia coli CFT073
cgccagcgagaaauacgcccug

SEQ ID NO: 583535 - RNA, 16 nt, Escherichia coli CFT073
cgccagccaguauugc

SEQ ID NO: 583536 - RNA, 18 nt, Escherichia coli CFT073
cgccagcaggaacgagaa

SEQ ID NO: 583537 - RNA, 15 nt, Escherichia coli CFT073
cgccagaugcggcgu

SEQ ID NO: 583538 - RNA, 19 nt, Escherichia coli CFT073
cgccagauccgcuucgcca

SEQ ID NO: 583539 - RNA, 15 nt, Escherichia coli CFT073
cgaucaccgcaauga

SEQ ID NO: 583540 - RNA, 18 nt, Escherichia coli CFT073
cgaucagaaugaugcggu

SEQ ID NO: 583541 - RNA, 13 nt, Escherichia coli CFT073
cgauccggcacca

SEQ ID NO: 583542 - RNA, 16 nt, Escherichia coli CFT073
cgauccggcaccaaug

SEQ ID NO: 583543 - RNA, 22 nt, Escherichia coli CFT073
cgaucccggagaagagauaaac

SEQ ID NO: 583544 - RNA, 15 nt, Escherichia coli CFT073
cgaucauuaacacca

SEQ ID NO: 583545 - RNA, 13 nt, Escherichia coli CFT073
cgaucaucuggcg

SEQ ID NO: 583546 - RNA, 14 nt, Escherichia coli CFT073
cgaucaugauaaau

SEQ ID NO: 583547 - RNA, 15 nt, Escherichia coli CFT073
cgaucaugauaaaua

SEQ ID NO: 583548 - RNA, 16 nt, Escherichia coli CFT073
cgauaucuuucacaaa

SEQ ID NO: 583549 - RNA, 15 nt, Escherichia coli CFT073
cgauaugccccagcc

SEQ ID NO: 583550 - RNA, 19 nt, Escherichia coli CFT073
cgauauuacgggucacaaa

SEQ ID NO: 583551 - RNA, 21 nt, Escherichia coli CFT073
cgauauuaguggcaaccgcaa

SEQ ID NO: 583552 - RNA, 19 nt, Escherichia coli CFT073
cgauauucauuuugcugga

SEQ ID NO: 583553 - RNA, 17 nt, Escherichia coli CFT073
cgauacugccgcccauc

SEQ ID NO: 583554 - RNA, 21 nt, Escherichia coli CFT073
cgauacugccgcccaucgcga

SEQ ID NO: 583555 - RNA, 22 nt, Escherichia coli CFT073
cgauaugggcagcucuaucugc

SEQ ID NO: 583556 - RNA, 16 nt, Escherichia coli CFT073
cgauauuuaugccggu

SEQ ID NO: 583557 - RNA, 23 nt, Escherichia coli CFT073
cgaguugcgguuucaacugcggu

SEQ ID NO: 583558 - RNA, 20 nt, Escherichia coli CFT073
cgaguuguugugcggcaacg

SEQ ID NO: 583559 - RNA, 20 nt, Escherichia coli CFT073
cgaguuucguuaaacgccaa

SEQ ID NO: 583560 - RNA, 13 nt, Escherichia coli CFT073
cgauaccgccgca

SEQ ID NO: 583561 - RNA, 17 nt, Escherichia coli CFT073
cgauaccuaacgccagc

SEQ ID NO: 583562 - RNA, 15 nt, Escherichia coli CFT073
cgauacaccugaugu

SEQ ID NO: 583563 - RNA, 19 nt, Escherichia coli CFT073
cgauacagaccccggcauu

SEQ ID NO: 583564 - RNA, 14 nt, Escherichia coli CFT073
cgaguaucuuugcc

SEQ ID NO: 583565 - RNA, 23 nt, Escherichia coli CFT073
cgaguagcucaccagcaggcacu

SEQ ID NO: 583566 - RNA, 15 nt, Escherichia coli CFT073
cgagguuauaaaccc

SEQ ID NO: 583567 - RNA, 12 nt, Escherichia coli CFT073
cgagguuaucgu

SEQ ID NO: 583568 - RNA, 13 nt, Escherichia coli CFT073
cgaguggcgcagu

SEQ ID NO: 583569 - RNA, 18 nt, Escherichia coli CFT073
cgagucgccuaccaucaa

SEQ ID NO: 583570 - RNA, 21 nt, Escherichia coli CFT073
cgagucgccuguacuuccugu

SEQ ID NO: 583571 - RNA, 11 nt, Escherichia coli CFT073
cgaguccgcuu

SEQ ID NO: 583572 - RNA, 18 nt, Escherichia coli CFT073
cgaggcuuauccggcauu

SEQ ID NO: 583573 - RNA, 18 nt, Escherichia coli CFT073
cgcaaagucggcaccagu

SEQ ID NO: 583574 - RNA, 13 nt, Escherichia coli CFT073
cgcaaaucagcgg

SEQ ID NO: 583575 - RNA, 14 nt, Escherichia coli CFT073
cgcaaauccacguu

SEQ ID NO: 583576 - RNA, 21 nt, Escherichia coli CFT073
cgauuuuguccucggcacgcg

SEQ ID NO: 583577 - RNA, 23 nt, Escherichia coli CFT073
cgcaaagauaaugacuuccgcca

SEQ ID NO: 583578 - RNA, 18 nt, Escherichia coli CFT073
cgauuuucguccaccagg

SEQ ID NO: 583579 - RNA, 20 nt, Escherichia coli CFT073
cgauuuugccagccgcagcu

SEQ ID NO: 583580 - RNA, 14 nt, Escherichia coli CFT073
cgauuuugccaguu

SEQ ID NO: 583581 - RNA, 13 nt, Escherichia coli CFT073
cgcaacaccguaa

SEQ ID NO: 583582 - RNA, 14 nt, Escherichia coli CFT073
cgcaacagaaacgc

SEQ ID NO: 583583 - RNA, 19 nt, Escherichia coli CFT073
cgcaacagagccaaagaau

SEQ ID NO: 583584 - RNA, 19 nt, Escherichia coli CFT073
cgcaacgccgccaacguga

SEQ ID NO: 583585 - RNA, 17 nt, Escherichia coli CFT073
cgauucuggugagagca

SEQ ID NO: 583586 - RNA, 17 nt, Escherichia coli CFT073
cgauucucccacagcac

SEQ ID NO: 583587 - RNA, 15 nt, Escherichia coli CFT073
cgauuucaucgccca

SEQ ID NO: 583588 - RNA, 18 nt, Escherichia coli CFT073
cgauugcacaaagguuuc

SEQ ID NO: 583589 - RNA, 16 nt, Escherichia coli CFT073
cgauuaucaacacauu

SEQ ID NO: 583590 - RNA, 16 nt, Escherichia coli CFT073
cgauuaucccauauac

SEQ ID NO: 583591 - RNA, 21 nt, Escherichia coli CFT073
cgauucagaugccauuuugca

SEQ ID NO: 583592 - RNA, 17 nt, Escherichia coli CFT073
cgauuacaggaacugca

SEQ ID NO: 583593 - RNA, 16 nt, Escherichia coli CFT073
cgauuaccauuucacu

SEQ ID NO: 583594 - RNA, 15 nt, Escherichia coli CFT073
cgauuaccgccagca

SEQ ID NO: 583595 - RNA, 13 nt, Escherichia coli CFT073
cgauuacucagca

SEQ ID NO: 583596 - RNA, 13 nt, Escherichia coli CFT073
cgauguuugcugc

SEQ ID NO: 583597 - RNA, 17 nt, Escherichia coli CFT073
cgaugcuuuccagcugu

SEQ ID NO: 583598 - RNA, 17 nt, Escherichia coli CFT073
cgauggaaaacaacacc

SEQ ID NO: 583599 - RNA, 16 nt, Escherichia coli CFT073
cgauggcgauucagca

SEQ ID NO: 583600 - RNA, 22 nt, Escherichia coli CFT073
cgaucgucgcucacuucacgcu

SEQ ID NO: 583601 - RNA, 17 nt, Escherichia coli CFT073
cgaucgauauucaccgu

SEQ ID NO: 583602 - RNA, 18 nt, Escherichia coli CFT073
cgaucuuccgaccgcccu

SEQ ID NO: 583603 - RNA, 19 nt, Escherichia coli CFT073
cgaucuucggcgucagaaa

SEQ ID NO: 583604 - RNA, 14 nt, Escherichia coli CFT073
cgaucucgccagag

SEQ ID NO: 583605 - RNA, 16 nt, Escherichia coli CFT073
cgaucugacauuugca

SEQ ID NO: 583606 - RNA, 23 nt, Escherichia coli CFT073
cgaugccugaugcgacgcuggcg

SEQ ID NO: 583607 - RNA, 21 nt, Escherichia coli CFT073
cgaugcgauaaccaggcaguu

SEQ ID NO: 583608 - RNA, 21 nt, Escherichia coli CFT073
cgaugccgccuggugcaggcg

SEQ ID NO: 583609 - RNA, 17 nt, Escherichia coli CFT073
cgaugcgcuggcgcaac

SEQ ID NO: 583610 - RNA, 17 nt, Escherichia coli CFT073
cgaugcgcuauugccgu

SEQ ID NO: 583611 - RNA, 14 nt, Escherichia coli CFT073
cgaugccagcgcug

SEQ ID NO: 583612 - RNA, 17 nt, Escherichia coli CFT073
cgaugccagcgcuguua

SEQ ID NO: 583613 - RNA, 12 nt, Escherichia coli CFT073
cgaugccagucg

SEQ ID NO: 583614 - RNA, 16 nt, Escherichia coli CFT073
cgaugcauccggcacg

SEQ ID NO: 583615 - RNA, 15 nt, Escherichia coli CFT073
cgaucuucaaacugg

SEQ ID NO: 583616 - RNA, 18 nt, Escherichia coli CFT073
ccgauauagaccaucggc

SEQ ID NO: 583617 - RNA, 16 nt, Escherichia coli CFT073
ccgauacgcauaaaca

SEQ ID NO: 583618 - RNA, 16 nt, Escherichia coli CFT073
ccgauauuugccgcga

SEQ ID NO: 583619 - RNA, 13 nt, Escherichia coli CFT073
ccgaucaccacaa

SEQ ID NO: 583620 - RNA, 20 nt, Escherichia coli CFT073
ccgauaucuuuccggcagaa

SEQ ID NO: 583621 - RNA, 14 nt, Escherichia coli CFT073
ccgaucagauugag

SEQ ID NO: 583622 - RNA, 15 nt, Escherichia coli CFT073
ccgaucaucaaaaaa

SEQ ID NO: 583623 - RNA, 20 nt, Escherichia coli CFT073
ccgaucaucaaaaaacacga

SEQ ID NO: 583624 - RNA, 13 nt, Escherichia coli CFT073
ccgauccagcggu

SEQ ID NO: 583625 - RNA, 18 nt, Escherichia coli CFT073
ccgauccuggacgcagaa

SEQ ID NO: 583626 - RNA, 12 nt, Escherichia coli CFT073
ccgaugucugca

SEQ ID NO: 583627 - RNA, 16 nt, Escherichia coli CFT073
ccgaugcaaaaaauga

SEQ ID NO: 583628 - RNA, 18 nt, Escherichia coli CFT073
ccgaugacagaaucagca

SEQ ID NO: 583629 - RNA, 21 nt, Escherichia coli CFT073
ccgcacauuucccggccacgc

SEQ ID NO: 583630 - RNA, 15 nt, Escherichia coli CFT073
ccgcaccaacgcaaa

SEQ ID NO: 583631 - RNA, 14 nt, Escherichia coli CFT073
ccgcaccaccagca

SEQ ID NO: 583632 - RNA, 16 nt, Escherichia coli CFT073
ccgcaccaccagcagc

SEQ ID NO: 583633 - RNA, 18 nt, Escherichia coli CFT073
ccgcaauuccgcccguca

SEQ ID NO: 583634 - RNA, 14 nt, Escherichia coli CFT073
ccgcaauugcugua

SEQ ID NO: 583635 - RNA, 24 nt, Escherichia coli CFT073
ccgcacaaagcacguugucuggcg

SEQ ID NO: 583636 - RNA, 23 nt, Escherichia coli CFT073
ccgcaaucagcguuucgccauaa

SEQ ID NO: 583637 - RNA, 14 nt, Escherichia coli CFT073
ccgcaacgccgcca

SEQ ID NO: 583638 - RNA, 20 nt, Escherichia coli CFT073
ccgcaacgccgccaacguga

SEQ ID NO: 583639 - RNA, 14 nt, Escherichia coli CFT073
ccgcaacgacagaa

SEQ ID NO: 583640 - RNA, 20 nt, Escherichia coli CFT073
ccgcaaccgccaacagcagc

SEQ ID NO: 583641 - RNA, 17 nt, Escherichia coli CFT073
ccgcaggaugagcgcga

SEQ ID NO: 583642 - RNA, 13 nt, Escherichia coli CFT073
ccgcaggcggcaa

SEQ ID NO: 583643 - RNA, 16 nt, Escherichia coli CFT073
ccgcaggagcgccgaa

SEQ ID NO: 583644 - RNA, 15 nt, Escherichia coli CFT073
ccgcauagacgguuu

SEQ ID NO: 583645 - RNA, 14 nt, Escherichia coli CFT073
ccgcaucaauuacc

SEQ ID NO: 583646 - RNA, 17 nt, Escherichia coli CFT073
ccgcaucacgacagcac

SEQ ID NO: 583647 - RNA, 15 nt, Escherichia coli CFT073
ccgcauccgacaaaa

SEQ ID NO: 583648 - RNA, 15 nt, Escherichia coli CFT073
ccgcauccgacauca

SEQ ID NO: 583649 - RNA, 11 nt, Escherichia coli CFT073
ccgcauccggc

SEQ ID NO: 583650 - RNA, 17 nt, Escherichia coli CFT073
ccgcauccggcaucagu

SEQ ID NO: 583651 - RNA, 23 nt, Escherichia coli CFT073
ccgcauccggcgauuuucaucgc

SEQ ID NO: 583652 - RNA, 19 nt, Escherichia coli CFT073
ccgcauccggcgcaaaaaa

SEQ ID NO: 583653 - RNA, 20 nt, Escherichia coli CFT073
ccgcauuuuuucuucaguuc

SEQ ID NO: 583654 - RNA, 18 nt, Escherichia coli CFT073
ccgccaaaacaucuucgg

SEQ ID NO: 583655 - RNA, 22 nt, Escherichia coli CFT073
ccgccaaaacaucuucggcguu

SEQ ID NO: 583656 - RNA, 19 nt, Escherichia coli CFT073
ccgcauugguaaaaccggu

SEQ ID NO: 583657 - RNA, 15 nt, Escherichia coli CFT073
ccgccaaacgccgca

SEQ ID NO: 583658 - RNA, 18 nt, Escherichia coli CFT073
ccgcauucuucugaauau

SEQ ID NO: 583659 - RNA, 17 nt, Escherichia coli CFT073
ccgccagauagccgcca

SEQ ID NO: 583660 - RNA, 15 nt, Escherichia coli CFT073
ccgccagaugcggcg

SEQ ID NO: 583661 - RNA, 15 nt, Escherichia coli CFT073
ccgccagaccagcua

SEQ ID NO: 583662 - RNA, 22 nt, Escherichia coli CFT073
ccgccagaaauuugcagugcug

SEQ ID NO: 583663 - RNA, 16 nt, Escherichia coli CFT073
ccgccagaagaaccgc

SEQ ID NO: 583664 - RNA, 14 nt, Escherichia coli CFT073
ccgccagaagggaa

SEQ ID NO: 583665 - RNA, 12 nt, Escherichia coli CFT073
ccgccaucaucg

SEQ ID NO: 583666 - RNA, 12 nt, Escherichia coli CFT073
ccgccaggcaaa

SEQ ID NO: 583667 - RNA, 14 nt, Escherichia coli CFT073
ccgccagcgcggag

SEQ ID NO: 583668 - RNA, 14 nt, Escherichia coli CFT073
ccgccagcgccaaa

SEQ ID NO: 583669 - RNA, 9 nt, Escherichia coli CFT073
ccgaagcgc

SEQ ID NO: 583670 - RNA, 22 nt, Escherichia coli CFT073
ccgaauuaaacaacgccagucc

SEQ ID NO: 583671 - RNA, 15 nt, Escherichia coli CFT073
ccgacaaccggugcu

SEQ ID NO: 583672 - RNA, 17 nt, Escherichia coli CFT073
ccgacaaccggugcugc

SEQ ID NO: 583673 - RNA, 13 nt, Escherichia coli CFT073
ccgacaauggcgc

SEQ ID NO: 583674 - RNA, 14 nt, Escherichia coli CFT073
ccgacugcgccaau

SEQ ID NO: 583675 - RNA, 21 nt, Escherichia coli CFT073
ccgacguugcguugccgccaa

SEQ ID NO: 583676 - RNA, 22 nt, Escherichia coli CFT073
ccgacguugcguugccgccaau

SEQ ID NO: 583677 - RNA, 16 nt, Escherichia coli CFT073
ccgagccaaacgccca

SEQ ID NO: 583678 - RNA, 16 nt, Escherichia coli CFT073
ccgagcgcaagccacg

SEQ ID NO: 583679 - RNA, 14 nt, Escherichia coli CFT073
ccgagcgcccgcca

SEQ ID NO: 583680 - RNA, 16 nt, Escherichia coli CFT073
ccgauaaccacgcuca

SEQ ID NO: 583681 - RNA, 21 nt, Escherichia coli CFT073
ccgauaaucaacgcgccgcca

SEQ ID NO: 583682 - RNA, 17 nt, Escherichia coli CFT073
ccgagguuaauauuuuc

SEQ ID NO: 583683 - RNA, 16 nt, Escherichia coli CFT073
ccgaguagccagcugc

SEQ ID NO: 583684 - RNA, 18 nt, Escherichia coli CFT073
ccgcgcauagcaccaccg

SEQ ID NO: 583685 - RNA, 15 nt, Escherichia coli CFT073
ccgcgauuuuguccu

SEQ ID NO: 583686 - RNA, 12 nt, Escherichia coli CFT073
ccgcgcaaaucc

SEQ ID NO: 583687 - RNA, 14 nt, Escherichia coli CFT073
ccgcgacaauauca

SEQ ID NO: 583688 - RNA, 17 nt, Escherichia coli CFT073
ccgcgauaccacccgca

SEQ ID NO: 583689 - RNA, 18 nt, Escherichia coli CFT073
ccgcgauaaaaauccugu

SEQ ID NO: 583690 - RNA, 16 nt, Escherichia coli CFT073
ccgccuaccgccagua

SEQ ID NO: 583691 - RNA, 21 nt, Escherichia coli CFT073
ccgccugacggaaaucaucca

SEQ ID NO: 583692 - RNA, 22 nt, Escherichia coli CFT073
ccgccuuuugccuuacgcaccg

SEQ ID NO: 583693 - RNA, 14 nt, Escherichia coli CFT073
ccgccggugcagua

SEQ ID NO: 583694 - RNA, 16 nt, Escherichia coli CFT073
ccgccggggcuggugg

SEQ ID NO: 583695 - RNA, 19 nt, Escherichia coli CFT073
ccgccgcucucuucguggc

SEQ ID NO: 583696 - RNA, 13 nt, Escherichia coli CFT073
ccgccgcaaccgu

SEQ ID NO: 583697 - RNA, 20 nt, Escherichia coli CFT073
ccgccgcacaauacauagaa

SEQ ID NO: 583698 - RNA, 23 nt, Escherichia coli CFT073
ccgccgagaaauaucagcagcac

SEQ ID NO: 583699 - RNA, 13 nt, Escherichia coli CFT073
ccgccaucgccca

SEQ ID NO: 583700 - RNA, 22 nt, Escherichia coli CFT073
ccgcucugggaucgccggggcg

SEQ ID NO: 583701 - RNA, 18 nt, Escherichia coli CFT073
ccgcucuuucaccgccga

SEQ ID NO: 583702 - RNA, 22 nt, Escherichia coli CFT073
ccgcuaaugcgacccacgcccc

SEQ ID NO: 583703 - RNA, 18 nt, Escherichia coli CFT073
ccgcuccucaucaauauu

SEQ ID NO: 583704 - RNA, 13 nt, Escherichia coli CFT073
ccgcuaacagcag

SEQ ID NO: 583705 - RNA, 20 nt, Escherichia coli CFT073
ccgcuaacugauacccggcu

SEQ ID NO: 583706 - RNA, 19 nt, Escherichia coli CFT073
ccgcuaagcccgaugauga

SEQ ID NO: 583707 - RNA, 16 nt, Escherichia coli CFT073
ccgcgucuuauccggc

SEQ ID NO: 583708 - RNA, 15 nt, Escherichia coli CFT073
ccgcgucgggcgacg

SEQ ID NO: 583709 - RNA, 16 nt, Escherichia coli CFT073
ccgcgugaugcggcau

SEQ ID NO: 583710 - RNA, 15 nt, Escherichia coli CFT073
ccgcggaugauuccg

SEQ ID NO: 583711 - RNA, 16 nt, Escherichia coli CFT073
ccguucagaucggcaa

SEQ ID NO: 583712 - RNA, 20 nt, Escherichia coli CFT073
ccguuacggaccacgcacag

SEQ ID NO: 583713 - RNA, 21 nt, Escherichia coli CFT073
ccgugugugagauauaucgcg

SEQ ID NO: 583714 - RNA, 23 nt, Escherichia coli CFT073
ccguguuguagauauccacaaca

SEQ ID NO: 583715 - RNA, 21 nt, Escherichia coli CFT073
ccguuaacacggugccaguac

SEQ ID NO: 583716 - RNA, 21 nt, Escherichia coli CFT073
ccgugugacuguacaauaucg

SEQ ID NO: 583717 - RNA, 18 nt, Escherichia coli CFT073
ccgugaaucggacgugau

SEQ ID NO: 583718 - RNA, 20 nt, Escherichia coli CFT073
ccgugccagcaccaaacugg

SEQ ID NO: 583719 - RNA, 19 nt, Escherichia coli CFT073
ccgucuuuggcccauugca

SEQ ID NO: 583720 - RNA, 17 nt, Escherichia coli CFT073
ccgucugggcaaaauca

SEQ ID NO: 583721 - RNA, 24 nt, Escherichia coli CFT073
ccgucugggcaaaaucaucacucc

SEQ ID NO: 583722 - RNA, 15 nt, Escherichia coli CFT073
ccgucugcugcugcg

SEQ ID NO: 583723 - RNA, 12 nt, Escherichia coli CFT073
ccgucugaaaac

SEQ ID NO: 583724 - RNA, 21 nt, Escherichia coli CFT073
ccguaacgcucaagaacggca

SEQ ID NO: 583725 - RNA, 22 nt, Escherichia coli CFT073
ccguaacgcucaagaacggcaa

SEQ ID NO: 583726 - RNA, 16 nt, Escherichia coli CFT073
ccguaaccaccagcac

SEQ ID NO: 583727 - RNA, 17 nt, Escherichia coli CFT073
ccguaaccaccagcacu

SEQ ID NO: 583728 - RNA, 13 nt, Escherichia coli CFT073
ccguaaccagcgc

SEQ ID NO: 583729 - RNA, 20 nt, Escherichia coli CFT073
ccguaaacccuaacaucauc

SEQ ID NO: 583730 - RNA, 19 nt, Escherichia coli CFT073
ccguaaaacucacaaccag

SEQ ID NO: 583731 - RNA, 23 nt, Escherichia coli CFT073
ccgguugggcgauaaaucguuuc

SEQ ID NO: 583732 - RNA, 23 nt, Escherichia coli CFT073
ccgguuguucaaccaccggcacc

SEQ ID NO: 583733 - RNA, 16 nt, Escherichia coli CFT073
ccgguuucccggcaau

SEQ ID NO: 583734 - RNA, 15 nt, Escherichia coli CFT073
ccgguuuggcauaac

SEQ ID NO: 583735 - RNA, 15 nt, Escherichia coli CFT073
ccguaugcgguacug

SEQ ID NO: 583736 - RNA, 12 nt, Escherichia coli CFT073
ccguauugucag

SEQ ID NO: 583737 - RNA, 12 nt, Escherichia coli CFT073
ccgucaccagca

SEQ ID NO: 583738 - RNA, 13 nt, Escherichia coli CFT073
ccgucaccagcau

SEQ ID NO: 583739 - RNA, 15 nt, Escherichia coli CFT073
ccgucaauaggcaua

SEQ ID NO: 583740 - RNA, 21 nt, Escherichia coli CFT073
ccgucaauccagccgcccagc

SEQ ID NO: 583741 - RNA, 15 nt, Escherichia coli CFT073
ccgucagccgcccgc

SEQ ID NO: 583742 - RNA, 16 nt, Escherichia coli CFT073
ccgucaacaauccauu

SEQ ID NO: 583743 - RNA, 21 nt, Escherichia coli CFT073
ccgucauguagcaaauuucgu

SEQ ID NO: 583744 - RNA, 22 nt, Escherichia coli CFT073
ccgucaguucauccauuaacag

SEQ ID NO: 583745 - RNA, 20 nt, Escherichia coli CFT073
ccgucaguuuuucacccgca

SEQ ID NO: 583746 - RNA, 15 nt, Escherichia coli CFT073
ccgguugagauaacg

SEQ ID NO: 583747 - RNA, 14 nt, Escherichia coli CFT073
ccgguguaggcaua

SEQ ID NO: 583748 - RNA, 19 nt, Escherichia coli CFT073
ccggugauuucgccaucaa

SEQ ID NO: 583749 - RNA, 22 nt, Escherichia coli CFT073
ccucuuuauuuccugcgcaaua

SEQ ID NO: 583750 - RNA, 15 nt, Escherichia coli CFT073
ccucuuccagcgaua

SEQ ID NO: 583751 - RNA, 22 nt, Escherichia coli CFT073
ccugaagaaccaagccugcugg

SEQ ID NO: 583752 - RNA, 15 nt, Escherichia coli CFT073
ccucuccccagcgga

SEQ ID NO: 583753 - RNA, 16 nt, Escherichia coli CFT073
ccucucaacgugcggg

SEQ ID NO: 583754 - RNA, 23 nt, Escherichia coli CFT073
ccucucacgacgcugguuacauc

SEQ ID NO: 583755 - RNA, 18 nt, Escherichia coli CFT073
ccucugauuccugacguu

SEQ ID NO: 583756 - RNA, 23 nt, Escherichia coli CFT073
ccugaucaagcuggcgcuggcga

SEQ ID NO: 583757 - RNA, 18 nt, Escherichia coli CFT073
ccugaucaauaaucucuu

SEQ ID NO: 583758 - RNA, 16 nt, Escherichia coli CFT073
ccugaugugaugcccg

SEQ ID NO: 583759 - RNA, 14 nt, Escherichia coli CFT073
ccugaugugcagau

SEQ ID NO: 583760 - RNA, 20 nt, Escherichia coli CFT073
ccugauguuucugcgcgaaa

SEQ ID NO: 583761 - RNA, 16 nt, Escherichia coli CFT073
ccugaugcgcuucgcu

SEQ ID NO: 583762 - RNA, 16 nt, Escherichia coli CFT073
ccugaugcgaugcugg

SEQ ID NO: 583763 - RNA, 18 nt, Escherichia coli CFT073
ccugaugcgaugcuggcg

SEQ ID NO: 583764 - RNA, 19 nt, Escherichia coli CFT073
ccugaugcgacgcuugacg

SEQ ID NO: 583765 - RNA, 20 nt, Escherichia coli CFT073
ccugaccaaauacacgcacg

SEQ ID NO: 583766 - RNA, 14 nt, Escherichia coli CFT073
ccugaccacccgcu

SEQ ID NO: 583767 - RNA, 16 nt, Escherichia coli CFT073
ccugacccagcaccag

SEQ ID NO: 583768 - RNA, 14 nt, Escherichia coli CFT073
ccugacaggcggga

SEQ ID NO: 583769 - RNA, 17 nt, Escherichia coli CFT073
ccugauaagacgcgaac

SEQ ID NO: 583770 - RNA, 23 nt, Escherichia coli CFT073
ccugauaagcguagcgcaucagg

SEQ ID NO: 583771 - RNA, 13 nt, Escherichia coli CFT073
ccugaaucgccga

SEQ ID NO: 583772 - RNA, 20 nt, Escherichia coli CFT073
ccugaauaaucguaaucagc

SEQ ID NO: 583773 - RNA, 22 nt, Escherichia coli CFT073
ccugaauaaucguaaucagcau

SEQ ID NO: 583774 - RNA, 17 nt, Escherichia coli CFT073
ccugaauacacugcuga

SEQ ID NO: 583775 - RNA, 23 nt, Escherichia coli CFT073
ccugaacaccagaaccagcaacc

SEQ ID NO: 583776 - RNA, 16 nt, Escherichia coli CFT073
ccugaaucagccagua

SEQ ID NO: 583777 - RNA, 23 nt, Escherichia coli CFT073
ccugaaucagccaguaaaccaau

SEQ ID NO: 583778 - RNA, 16 nt, Escherichia coli CFT073
ccugccccgucuuccg

SEQ ID NO: 583779 - RNA, 14 nt, Escherichia coli CFT073
ccugcccaauauac

SEQ ID NO: 583780 - RNA, 19 nt, Escherichia coli CFT073
ccugccaaccaacgcgccg

SEQ ID NO: 583781 - RNA, 20 nt, Escherichia coli CFT073
ccugccaugccaaacagaau

SEQ ID NO: 583782 - RNA, 15 nt, Escherichia coli CFT073
ccugccaguuuuucc

SEQ ID NO: 583783 - RNA, 15 nt, Escherichia coli CFT073
ccugauuuacguaaa

SEQ ID NO: 583784 - RNA, 20 nt, Escherichia coli CFT073
ccugauuaccuaccaacgca

SEQ ID NO: 583785 - RNA, 21 nt, Escherichia coli CFT073
ccuacuaccaguagugaaaaa

SEQ ID NO: 583786 - RNA, 20 nt, Escherichia coli CFT073
ccuacauagccccugcaaua

SEQ ID NO: 583787 - RNA, 18 nt, Escherichia coli CFT073
ccuaccagagauagcgaa

SEQ ID NO: 583788 - RNA, 13 nt, Escherichia coli CFT073
ccuaccaacgcac

SEQ ID NO: 583789 - RNA, 14 nt, Escherichia coli CFT073
ccguuccagcguuc

SEQ ID NO: 583790 - RNA, 13 nt, Escherichia coli CFT073
ccguuccggcaac

SEQ ID NO: 583791 - RNA, 23 nt, Escherichia coli CFT073
ccucaucuccaguuucgagaaau

SEQ ID NO: 583792 - RNA, 14 nt, Escherichia coli CFT073
ccucaucauccucu

SEQ ID NO: 583793 - RNA, 15 nt, Escherichia coli CFT073
ccucaucgcgcaacg

SEQ ID NO: 583794 - RNA, 23 nt, Escherichia coli CFT073
ccucagguugauagaaauaucgc

SEQ ID NO: 583795 - RNA, 14 nt, Escherichia coli CFT073
ccucagcaguuucg

SEQ ID NO: 583796 - RNA, 15 nt, Escherichia coli CFT073
ccucgccccuccggg

SEQ ID NO: 583797 - RNA, 23 nt, Escherichia coli CFT073
ccggaagcaaaauaaccggcaag

SEQ ID NO: 583798 - RNA, 20 nt, Escherichia coli CFT073
ccggaagcuacgguugucuu

SEQ ID NO: 583799 - RNA, 14 nt, Escherichia coli CFT073
ccggaauaaucaga

SEQ ID NO: 583800 - RNA, 14 nt, Escherichia coli CFT073
ccggaaucagaauc

SEQ ID NO: 583801 - RNA, 16 nt, Escherichia coli CFT073
ccggcaucaaccagca

SEQ ID NO: 583802 - RNA, 20 nt, Escherichia coli CFT073
ccggcauuaucacaucagcg

SEQ ID NO: 583803 - RNA, 12 nt, Escherichia coli CFT073
ccggccaucagu

SEQ ID NO: 583804 - RNA, 18 nt, Escherichia coli CFT073
ccggcauuugagcaggau

SEQ ID NO: 583805 - RNA, 15 nt, Escherichia coli CFT073
ccggccuugauuauu

SEQ ID NO: 583806 - RNA, 21 nt, Escherichia coli CFT073
ccggccuaucaacgucgucgu

SEQ ID NO: 583807 - RNA, 15 nt, Escherichia coli CFT073
ccggcgcacuggcgc

SEQ ID NO: 583808 - RNA, 16 nt, Escherichia coli CFT073
ccggcgcagcgcgcga

SEQ ID NO: 583809 - RNA, 18 nt, Escherichia coli CFT073
ccggcguggcguugcggc

SEQ ID NO: 583810 - RNA, 21 nt, Escherichia coli CFT073
ccggcgugcguugacucggua

SEQ ID NO: 583811 - RNA, 19 nt, Escherichia coli CFT073
ccggcgugauauccauaaa

SEQ ID NO: 583812 - RNA, 22 nt, Escherichia coli CFT073
ccggcugcugcaaugccauuca

SEQ ID NO: 583813 - RNA, 13 nt, Escherichia coli CFT073
ccgggaaaacauc

SEQ ID NO: 583814 - RNA, 20 nt, Escherichia coli CFT073
ccggcuucuucugccgcuuc

SEQ ID NO: 583815 - RNA, 18 nt, Escherichia coli CFT073
ccggcuucgucgccagcu

SEQ ID NO: 583816 - RNA, 19 nt, Escherichia coli CFT073
ccggcuucaaggugauauc

SEQ ID NO: 583817 - RNA, 16 nt, Escherichia coli CFT073
ccggggucaaaccugg

SEQ ID NO: 583818 - RNA, 15 nt, Escherichia coli CFT073
ccggguaaacaccac

SEQ ID NO: 583819 - RNA, 22 nt, Escherichia coli CFT073
ccgggcuguuuuccagcaccac

SEQ ID NO: 583820 - RNA, 20 nt, Escherichia coli CFT073
ccgggcuuccggcaauggcu

SEQ ID NO: 583821 - RNA, 17 nt, Escherichia coli CFT073
ccgggcugguuuucagc

SEQ ID NO: 583822 - RNA, 16 nt, Escherichia coli CFT073
ccgggauuucaaugcg

SEQ ID NO: 583823 - RNA, 12 nt, Escherichia coli CFT073
ccgggagcggcg

SEQ ID NO: 583824 - RNA, 23 nt, Escherichia coli CFT073
ccgggagcggcgucagccagucu

SEQ ID NO: 583825 - RNA, 23 nt, Escherichia coli CFT073
gccgccuggcuaagcaucgcaau

SEQ ID NO: 583826 - RNA, 13 nt, Escherichia coli CFT073
gccgccugcgcca

SEQ ID NO: 583827 - RNA, 15 nt, Escherichia coli CFT073
gccgccugcgccagu

SEQ ID NO: 583828 - RNA, 16 nt, Escherichia coli CFT073
gccgcgaaacugcgug

SEQ ID NO: 583829 - RNA, 22 nt, Escherichia coli CFT073
gccgcgaaccagaccagcaaua

SEQ ID NO: 583830 - RNA, 14 nt, Escherichia coli CFT073
gccgcgccgacugc

SEQ ID NO: 583831 - RNA, 13 nt, Escherichia coli CFT073
gccgcgcccgcua

SEQ ID NO: 583832 - RNA, 17 nt, Escherichia coli CFT073
gccgcgcauagcuggcg

SEQ ID NO: 583833 - RNA, 14 nt, Escherichia coli CFT073
gccgcgcaguuucu

SEQ ID NO: 583834 - RNA, 13 nt, Escherichia coli CFT073
gccgccauccuga

SEQ ID NO: 583835 - RNA, 13 nt, Escherichia coli CFT073
gccgcccagcgaa

SEQ ID NO: 583836 - RNA, 21 nt, Escherichia coli CFT073
gccgcccagcgaaccgccaau

SEQ ID NO: 583837 - RNA, 13 nt, Escherichia coli CFT073
gccgcccagcagc

SEQ ID NO: 583838 - RNA, 17 nt, Escherichia coli CFT073
gccgcucagucggcgcu

SEQ ID NO: 583839 - RNA, 16 nt, Escherichia coli CFT073
gccgcguucgccagcg

SEQ ID NO: 583840 - RNA, 20 nt, Escherichia coli CFT073
gccgcuaguucucgggcggc

SEQ ID NO: 583841 - RNA, 16 nt, Escherichia coli CFT073
gccgcuaucgcugaua

SEQ ID NO: 583842 - RNA, 18 nt, Escherichia coli CFT073
gccgcgugcgcuggacgc

SEQ ID NO: 583843 - RNA, 13 nt, Escherichia coli CFT073
gccgcgugcaaua

SEQ ID NO: 583844 - RNA, 14 nt, Escherichia coli CFT073
gccgcgucuuaucc

SEQ ID NO: 583845 - RNA, 17 nt, Escherichia coli CFT073
gccgcgucgggcaucag

SEQ ID NO: 583846 - RNA, 14 nt, Escherichia coli CFT073
gccggaggcgcugg

SEQ ID NO: 583847 - RNA, 19 nt, Escherichia coli CFT073
gccggacgucaggccgcca

SEQ ID NO: 583848 - RNA, 18 nt, Escherichia coli CFT073
gccggaugcggcgugaua

SEQ ID NO: 583849 - RNA, 14 nt, Escherichia coli CFT073
gccggaugcggcgu

SEQ ID NO: 583850 - RNA, 18 nt, Escherichia coli CFT073
gccggaucgguagaccgg

SEQ ID NO: 583851 - RNA, 15 nt, Escherichia coli CFT073
gccggaugaucaucc

SEQ ID NO: 583852 - RNA, 21 nt, Escherichia coli CFT073
gccggaugaugugaaucaucc

SEQ ID NO: 583853 - RNA, 15 nt, Escherichia coli CFT073
gccggaugcaucaca

SEQ ID NO: 583854 - RNA, 16 nt, Escherichia coli CFT073
gccggaucgaccgguu

SEQ ID NO: 583855 - RNA, 16 nt, Escherichia coli CFT073
gccggauaagauacgc

SEQ ID NO: 583856 - RNA, 13 nt, Escherichia coli CFT073
gccggauaagcaa

SEQ ID NO: 583857 - RNA, 17 nt, Escherichia coli CFT073
gcccgguuuguuaucaa

SEQ ID NO: 583858 - RNA, 23 nt, Escherichia coli CFT073
gcccguuuuuuuaucccuucucc

SEQ ID NO: 583859 - RNA, 15 nt, Escherichia coli CFT073
gcccguuaagcguuc

SEQ ID NO: 583860 - RNA, 14 nt, Escherichia coli CFT073
gcccgugaugcaac

SEQ ID NO: 583861 - RNA, 21 nt, Escherichia coli CFT073
gcccugaaccaucgacgucca

SEQ ID NO: 583862 - RNA, 19 nt, Escherichia coli CFT073
gcccugcuccagcagcuca

SEQ ID NO: 583863 - RNA, 12 nt, Escherichia coli CFT073
gcccugcgucgc

SEQ ID NO: 583864 - RNA, 14 nt, Escherichia coli CFT073
gcccugcgucgcac

SEQ ID NO: 583865 - RNA, 16 nt, Escherichia coli CFT073
gcccugcaucaugcgc

SEQ ID NO: 583866 - RNA, 20 nt, Escherichia coli CFT073
gcccugaugcgugcgccaga

SEQ ID NO: 583867 - RNA, 19 nt, Escherichia coli CFT073
gcccugucaccgggcaaac

SEQ ID NO: 583868 - RNA, 20 nt, Escherichia coli CFT073
gccgaaacuugguuacgcac

SEQ ID NO: 583869 - RNA, 13 nt, Escherichia coli CFT073
gccgaacagucgc

SEQ ID NO: 583870 - RNA, 22 nt, Escherichia coli CFT073
gccgaagugguuccacgcccgc

SEQ ID NO: 583871 - RNA, 13 nt, Escherichia coli CFT073
gccgaauaacgcg

SEQ ID NO: 583872 - RNA, 17 nt, Escherichia coli CFT073
gccgaauaacgcgcagc

SEQ ID NO: 583873 - RNA, 19 nt, Escherichia coli CFT073
gccgaauaacgcgcagcgu

SEQ ID NO: 583874 - RNA, 19 nt, Escherichia coli CFT073
gccgacauuaucaccgaca

SEQ ID NO: 583875 - RNA, 20 nt, Escherichia coli CFT073
gccgacauuaucaccgacaa

SEQ ID NO: 583876 - RNA, 20 nt, Escherichia coli CFT073
gccgacaauaaacgcgcagg

SEQ ID NO: 583877 - RNA, 13 nt, Escherichia coli CFT073
gccgaccagagcc

SEQ ID NO: 583878 - RNA, 17 nt, Escherichia coli CFT073
gccgacgccagcguuca

SEQ ID NO: 583879 - RNA, 16 nt, Escherichia coli CFT073
gccgauggcccgcgua

SEQ ID NO: 583880 - RNA, 22 nt, Escherichia coli CFT073
gccgauagacacugccgccguc

SEQ ID NO: 583881 - RNA, 18 nt, Escherichia coli CFT073
gccgauauaaauuccacg

SEQ ID NO: 583882 - RNA, 20 nt, Escherichia coli CFT073
gccgauaucgauaaacagcg

SEQ ID NO: 583883 - RNA, 18 nt, Escherichia coli CFT073
gccgaguagccagcugcc

SEQ ID NO: 583884 - RNA, 23 nt, Escherichia coli CFT073
gccgagcuaauaaucaucgcaau

SEQ ID NO: 583885 - RNA, 23 nt, Escherichia coli CFT073
gccacauugcugcacauccggua

SEQ ID NO: 583886 - RNA, 17 nt, Escherichia coli CFT073
gccaccacaccagacca

SEQ ID NO: 583887 - RNA, 20 nt, Escherichia coli CFT073
gccaccacaccagaccagac

SEQ ID NO: 583888 - RNA, 14 nt, Escherichia coli CFT073
gccaccacaaaagc

SEQ ID NO: 583889 - RNA, 23 nt, Escherichia coli CFT073
gccaccacaacauucccaucagu

SEQ ID NO: 583890 - RNA, 15 nt, Escherichia coli CFT073
gccacauggcgugca

SEQ ID NO: 583891 - RNA, 19 nt, Escherichia coli CFT073
gccacaguuuuacugcagc

SEQ ID NO: 583892 - RNA, 14 nt, Escherichia coli CFT073
gccacauccagcgg

SEQ ID NO: 583893 - RNA, 18 nt, Escherichia coli CFT073
gccacagccgagcgcuac

SEQ ID NO: 583894 - RNA, 18 nt, Escherichia coli CFT073
gccaaucgucgccgucau

SEQ ID NO: 583895 - RNA, 23 nt, Escherichia coli CFT073
gccaaucuucacaucaucaucgc

SEQ ID NO: 583896 - RNA, 19 nt, Escherichia coli CFT073
gccaaugaucccgccaucg

SEQ ID NO: 583897 - RNA, 17 nt, Escherichia coli CFT073
gccaauggugucgucga

SEQ ID NO: 583898 - RNA, 16 nt, Escherichia coli CFT073
gccaaucggcccgccc

SEQ ID NO: 583899 - RNA, 14 nt, Escherichia coli CFT073
gccaaugccugauu

SEQ ID NO: 583900 - RNA, 18 nt, Escherichia coli CFT073
gccacacgacgccagcca

SEQ ID NO: 583901 - RNA, 20 nt, Escherichia coli CFT073
gccacaauacugaucaucau

SEQ ID NO: 583902 - RNA, 21 nt, Escherichia coli CFT073
gccacaauacugaucaucauu

SEQ ID NO: 583903 - RNA, 14 nt, Escherichia coli CFT073
gccacaaucagcgc

SEQ ID NO: 583904 - RNA, 19 nt, Escherichia coli CFT073
gccacaaucgcuucaucgc

SEQ ID NO: 583905 - RNA, 23 nt, Escherichia coli CFT073
gccacaccacgguguugguaaac

SEQ ID NO: 583906 - RNA, 19 nt, Escherichia coli CFT073
gccaagauagaaccacgca

SEQ ID NO: 583907 - RNA, 22 nt, Escherichia coli CFT073
gccaagaagaacgccgguugcg

SEQ ID NO: 583908 - RNA, 14 nt, Escherichia coli CFT073
gcauccggccauca

SEQ ID NO: 583909 - RNA, 15 nt, Escherichia coli CFT073
gcauccggccaucag

SEQ ID NO: 583910 - RNA, 16 nt, Escherichia coli CFT073
gcauccauaucgccau

SEQ ID NO: 583911 - RNA, 18 nt, Escherichia coli CFT073
gcauccaguugcgccgca

SEQ ID NO: 583912 - RNA, 20 nt, Escherichia coli CFT073
gcauccaguugcgccgcauu

SEQ ID NO: 583913 - RNA, 21 nt, Escherichia coli CFT073
gcauccaggccaaaagcuaac

SEQ ID NO: 583914 - RNA, 15 nt, Escherichia coli CFT073
gccaagcgccgccuc

SEQ ID NO: 583915 - RNA, 18 nt, Escherichia coli CFT073
gccaagcauuacgaaauc

SEQ ID NO: 583916 - RNA, 14 nt, Escherichia coli CFT073
gccaagccagagca

SEQ ID NO: 583917 - RNA, 18 nt, Escherichia coli CFT073
gccaauaccgaucaguac

SEQ ID NO: 583918 - RNA, 16 nt, Escherichia coli CFT073
gccaaucgccacgcca

SEQ ID NO: 583919 - RNA, 12 nt, Escherichia coli CFT073
gccaaucgccag

SEQ ID NO: 583920 - RNA, 20 nt, Escherichia coli CFT073
gccaaucccgucuucgucug

SEQ ID NO: 583921 - RNA, 15 nt, Escherichia coli CFT073
gccaaucagcgcagc

SEQ ID NO: 583922 - RNA, 19 nt, Escherichia coli CFT073
gccaccagcacaccgucag

SEQ ID NO: 583923 - RNA, 20 nt, Escherichia coli CFT073
gccaccagcacaccgucagc

SEQ ID NO: 583924 - RNA, 19 nt, Escherichia coli CFT073
gccaccaggaacgcgccaa

SEQ ID NO: 583925 - RNA, 15 nt, Escherichia coli CFT073
gccaccagcgucaga

SEQ ID NO: 583926 - RNA, 20 nt, Escherichia coli CFT073
gccaccagcgucagaaacag

SEQ ID NO: 583927 - RNA, 12 nt, Escherichia coli CFT073
gccaccagcgcc

SEQ ID NO: 583928 - RNA, 18 nt, Escherichia coli CFT073
gccaccccagucguccag

SEQ ID NO: 583929 - RNA, 10 nt, Escherichia coli CFT073
gccaccaggu

SEQ ID NO: 583930 - RNA, 23 nt, Escherichia coli CFT073
gccaccgcaucgcucacggcggc

SEQ ID NO: 583931 - RNA, 16 nt, Escherichia coli CFT073
gccaccguguucauga

SEQ ID NO: 583932 - RNA, 23 nt, Escherichia coli CFT073
gccaccguguucaugaccgugau

SEQ ID NO: 583933 - RNA, 22 nt, Escherichia coli CFT073
gccaccgguacaaacaucaucc

SEQ ID NO: 583934 - RNA, 16 nt, Escherichia coli CFT073
gccacuggcggaugcg

SEQ ID NO: 583935 - RNA, 18 nt, Escherichia coli CFT073
gccacuggcuuuccugau

SEQ ID NO: 583936 - RNA, 19 nt, Escherichia coli CFT073
gccacuucaaccagcggcg

SEQ ID NO: 583937 - RNA, 20 nt, Escherichia coli CFT073
gccacucugcgcauguaaug

SEQ ID NO: 583938 - RNA, 16 nt, Escherichia coli CFT073
gccacugcaaaucacc

SEQ ID NO: 583939 - RNA, 21 nt, Escherichia coli CFT073
gccacgguaucaagcccgccg

SEQ ID NO: 583940 - RNA, 22 nt, Escherichia coli CFT073
gccacggcagaaugguuucgcu

SEQ ID NO: 583941 - RNA, 12 nt, Escherichia coli CFT073
gccagagcugcg

SEQ ID NO: 583942 - RNA, 14 nt, Escherichia coli CFT073
gccagagucagcac

SEQ ID NO: 583943 - RNA, 16 nt, Escherichia coli CFT073
gccagagaucgcacau

SEQ ID NO: 583944 - RNA, 16 nt, Escherichia coli CFT073
gccagagcagcaacaa

SEQ ID NO: 583945 - RNA, 19 nt, Escherichia coli CFT073
gccacuugagccgccacca

SEQ ID NO: 583946 - RNA, 23 nt, Escherichia coli CFT073
gccagauagccgaccgcaaggaa

SEQ ID NO: 583947 - RNA, 18 nt, Escherichia coli CFT073
gccagauguuccgccauu

SEQ ID NO: 583948 - RNA, 17 nt, Escherichia coli CFT073
gccagauugaagcagau

SEQ ID NO: 583949 - RNA, 20 nt, Escherichia coli CFT073
gccagauuuucuucagcuua

SEQ ID NO: 583950 - RNA, 19 nt, Escherichia coli CFT073
gccagcaaaaucaccauca

SEQ ID NO: 583951 - RNA, 14 nt, Escherichia coli CFT073
gccagaggcgacaa

SEQ ID NO: 583952 - RNA, 18 nt, Escherichia coli CFT073
gccagauaagacgcguca

SEQ ID NO: 583953 - RNA, 20 nt, Escherichia coli CFT073
gccagauaagacgcgucagu

SEQ ID NO: 583954 - RNA, 14 nt, Escherichia coli CFT073
gccagauaauggcu

SEQ ID NO: 583955 - RNA, 20 nt, Escherichia coli CFT073
gccagcaacagcgcgucagc

SEQ ID NO: 583956 - RNA, 24 nt, Escherichia coli CFT073
gccagcaaccaacgcuagcagcag

SEQ ID NO: 583957 - RNA, 17 nt, Escherichia coli CFT073
gccagcaacugauacac

SEQ ID NO: 583958 - RNA, 14 nt, Escherichia coli CFT073
gccagcaacuggcg

SEQ ID NO: 583959 - RNA, 22 nt, Escherichia coli CFT073
gccagcagaaugacaucaucgc

SEQ ID NO: 583960 - RNA, 13 nt, Escherichia coli CFT073
gccagcaccaggc

SEQ ID NO: 583961 - RNA, 16 nt, Escherichia coli CFT073
gccagcaccaucgcgc

SEQ ID NO: 583962 - RNA, 22 nt, Escherichia coli CFT073
gccagcccgaucggcuggcauu

SEQ ID NO: 583963 - RNA, 19 nt, Escherichia coli CFT073
gccagcagcgaaucagccc

SEQ ID NO: 583964 - RNA, 18 nt, Escherichia coli CFT073
gccagccgauaucuuucc

SEQ ID NO: 583965 - RNA, 15 nt, Escherichia coli CFT073
gccagccgauccgga

SEQ ID NO: 583966 - RNA, 15 nt, Escherichia coli CFT073
gccagccggguaauc

SEQ ID NO: 583967 - RNA, 12 nt, Escherichia coli CFT073
gccagccgucgu

SEQ ID NO: 583968 - RNA, 15 nt, Escherichia coli CFT073
gccagccucauccau

SEQ ID NO: 583969 - RNA, 18 nt, Escherichia coli CFT073
gccagcgauuugucggca

SEQ ID NO: 583970 - RNA, 18 nt, Escherichia coli CFT073
gccagcgauuuugccagc

SEQ ID NO: 583971 - RNA, 13 nt, Escherichia coli CFT073
gccagcgccaucg

SEQ ID NO: 583972 - RNA, 19 nt, Escherichia coli CFT073
gccagcgccaaagccaguu

SEQ ID NO: 583973 - RNA, 15 nt, Escherichia coli CFT073
gccagcgccaccacc

SEQ ID NO: 583974 - RNA, 15 nt, Escherichia coli CFT073
gccagcuugcuuucc

SEQ ID NO: 583975 - RNA, 19 nt, Escherichia coli CFT073
gccagcuugcagccgucgc

SEQ ID NO: 583976 - RNA, 14 nt, Escherichia coli CFT073
gccagcuucacgcg

SEQ ID NO: 583977 - RNA, 22 nt, Escherichia coli CFT073
gccagcuucgcuucccaacgca

SEQ ID NO: 583978 - RNA, 21 nt, Escherichia coli CFT073
gccagcucaucguuacgccca

SEQ ID NO: 583979 - RNA, 19 nt, Escherichia coli CFT073
gccagcucccacaguuuca

SEQ ID NO: 583980 - RNA, 13 nt, Escherichia coli CFT073
gccagcuccagcg

SEQ ID NO: 583981 - RNA, 22 nt, Escherichia coli CFT073
gccagcggcuuuuuacgcgaca

SEQ ID NO: 583982 - RNA, 16 nt, Escherichia coli CFT073
gccagcgcgcggcugg

SEQ ID NO: 583983 - RNA, 18 nt, Escherichia coli CFT073
gccagcgcgcggcuggca

SEQ ID NO: 583984 - RNA, 15 nt, Escherichia coli CFT073
gccauccggcugauu

SEQ ID NO: 583985 - RNA, 19 nt, Escherichia coli CFT073
gccauaccuggugcagcgg

SEQ ID NO: 583986 - RNA, 13 nt, Escherichia coli CFT073
gccauccgcguga

SEQ ID NO: 583987 - RNA, 18 nt, Escherichia coli CFT073
gccauccgcgugacgcug

SEQ ID NO: 583988 - RNA, 20 nt, Escherichia coli CFT073
gccauccgcgugacgcuggc

SEQ ID NO: 583989 - RNA, 14 nt, Escherichia coli CFT073
gccauaaaaacgau

SEQ ID NO: 583990 - RNA, 20 nt, Escherichia coli CFT073
gccaguuuuugcuucugaau

SEQ ID NO: 583991 - RNA, 20 nt, Escherichia coli CFT073
gccaguuuuuuagcguguuc

SEQ ID NO: 583992 - RNA, 16 nt, Escherichia coli CFT073
gccauaaacgguuuca

SEQ ID NO: 583993 - RNA, 19 nt, Escherichia coli CFT073
gccauaaacuucauucagc

SEQ ID NO: 583994 - RNA, 23 nt, Escherichia coli CFT073
gccauaaccaugcagcgccgcgu

SEQ ID NO: 583995 - RNA, 15 nt, Escherichia coli CFT073
gccauaaccgccagc

SEQ ID NO: 583996 - RNA, 18 nt, Escherichia coli CFT073
gccauaaccgccagcaca

SEQ ID NO: 583997 - RNA, 13 nt, Escherichia coli CFT073
gccauaaucagcg

SEQ ID NO: 583998 - RNA, 15 nt, Escherichia coli CFT073
gccauaaucagcgca

SEQ ID NO: 583999 - RNA, 23 nt, Escherichia coli CFT073
gccaugccgccaccaccagcgca

SEQ ID NO: 584000 - RNA, 20 nt, Escherichia coli CFT073
gccaugccgaugccgacgau

SEQ ID NO: 584001 - RNA, 21 nt, Escherichia coli CFT073
gccaugcacgcaaaaacgcau

SEQ ID NO: 584002 - RNA, 22 nt, Escherichia coli CFT073
gccaucugaugauauuuuuccc

SEQ ID NO: 584003 - RNA, 21 nt, Escherichia coli CFT073
gccaucugccagcaagcgcac

SEQ ID NO: 584004 - RNA, 19 nt, Escherichia coli CFT073
gccagugcacuaccguaaa

SEQ ID NO: 584005 - RNA, 14 nt, Escherichia coli CFT073
gccagugcaucagc

SEQ ID NO: 584006 - RNA, 19 nt, Escherichia coli CFT073
gccagugccugacgaaugg

SEQ ID NO: 584007 - RNA, 23 nt, Escherichia coli CFT073
gccagucuuccggcuguagcccu

SEQ ID NO: 584008 - RNA, 17 nt, Escherichia coli CFT073
gccaguguagcgauuuc

SEQ ID NO: 584009 - RNA, 20 nt, Escherichia coli CFT073
gccagugguaaaaaagugau

SEQ ID NO: 584010 - RNA, 18 nt, Escherichia coli CFT073
gccaguguuggcgucaga

SEQ ID NO: 584011 - RNA, 16 nt, Escherichia coli CFT073
gccaguuaucgcaggu

SEQ ID NO: 584012 - RNA, 18 nt, Escherichia coli CFT073
gccaguucauccagacgg

SEQ ID NO: 584013 - RNA, 21 nt, Escherichia coli CFT073
gccaguucaugacgcaggcgu

SEQ ID NO: 584014 - RNA, 14 nt, Escherichia coli CFT073
gccaguuccaggca

SEQ ID NO: 584015 - RNA, 16 nt, Escherichia coli CFT073
gccaguugcgcaacgu

SEQ ID NO: 584016 - RNA, 23 nt, Escherichia coli CFT073
gccaguuuuuccgcuuacugguu

SEQ ID NO: 584017 - RNA, 19 nt, Escherichia coli CFT073
gccaguucuuccgcagagu

SEQ ID NO: 584018 - RNA, 21 nt, Escherichia coli CFT073
gccaguucggcagccugcguc

SEQ ID NO: 584019 - RNA, 14 nt, Escherichia coli CFT073
gccaguucaguaaa

SEQ ID NO: 584020 - RNA, 17 nt, Escherichia coli CFT073
gccagucgcgaugcagc

SEQ ID NO: 584021 - RNA, 20 nt, Escherichia coli CFT073
gccaguacagcccgccggaa

SEQ ID NO: 584022 - RNA, 14 nt, Escherichia coli CFT073
gccaguaccgccgc

SEQ ID NO: 584023 - RNA, 13 nt, Escherichia coli CFT073
gccaguacugcag

SEQ ID NO: 584024 - RNA, 15 nt, Escherichia coli CFT073
gccaguaaagcagcg

SEQ ID NO: 584025 - RNA, 18 nt, Escherichia coli CFT073
gccaguaagcaguccagc

SEQ ID NO: 584026 - RNA, 21 nt, Escherichia coli CFT073
gccaguaagcaguccagcgcc

SEQ ID NO: 584027 - RNA, 15 nt, Escherichia coli CFT073
gccaguacacgcuga

SEQ ID NO: 584028 - RNA, 22 nt, Escherichia coli CFT073
gccaguacacguucuaccguau

SEQ ID NO: 584029 - RNA, 14 nt, Escherichia coli CFT073
gccaggaccgcuga

SEQ ID NO: 584030 - RNA, 22 nt, Escherichia coli CFT073
gccaggaaccugugacagcagc

SEQ ID NO: 584031 - RNA, 21 nt, Escherichia coli CFT073
gccaggaacgggauugccagc

SEQ ID NO: 584032 - RNA, 16 nt, Escherichia coli CFT073
gccaggacaucagcgc

SEQ ID NO: 584033 - RNA, 14 nt, Escherichia coli CFT073
gccaggaccauuca

SEQ ID NO: 584034 - RNA, 21 nt, Escherichia coli CFT073
gccauggcauccaagcuggug

SEQ ID NO: 584035 - RNA, 16 nt, Escherichia coli CFT073
gccaugcgguaacaga

SEQ ID NO: 584036 - RNA, 22 nt, Escherichia coli CFT073
gccaugcgguaaguuuucgccg

SEQ ID NO: 584037 - RNA, 23 nt, Escherichia coli CFT073
gcccacgcaccaccagcgccugg

SEQ ID NO: 584038 - RNA, 14 nt, Escherichia coli CFT073
gcccacuaccagcu

SEQ ID NO: 584039 - RNA, 15 nt, Escherichia coli CFT073
gcccacuacgcccgc

SEQ ID NO: 584040 - RNA, 15 nt, Escherichia coli CFT073
gcccagaaaccaguu

SEQ ID NO: 584041 - RNA, 14 nt, Escherichia coli CFT073
gcccacuuucugcg

SEQ ID NO: 584042 - RNA, 12 nt, Escherichia coli CFT073
gcccagccugaa

SEQ ID NO: 584043 - RNA, 15 nt, Escherichia coli CFT073
gcccagccgugaaug

SEQ ID NO: 584044 - RNA, 12 nt, Escherichia coli CFT073
gcccaguaccgc

SEQ ID NO: 584045 - RNA, 17 nt, Escherichia coli CFT073
gcccaucaucuggcugu

SEQ ID NO: 584046 - RNA, 15 nt, Escherichia coli CFT073
gcccaucaucaucgg

SEQ ID NO: 584047 - RNA, 17 nt, Escherichia coli CFT073
gcccaucaucaucggca

SEQ ID NO: 584048 - RNA, 22 nt, Escherichia coli CFT073
gcccauacuuaaugccaguuca

SEQ ID NO: 584049 - RNA, 19 nt, Escherichia coli CFT073
gcccaugcgggcaacuuuc

SEQ ID NO: 584050 - RNA, 17 nt, Escherichia coli CFT073
gccccagaacucacgca

SEQ ID NO: 584051 - RNA, 17 nt, Escherichia coli CFT073
gcccaugccaauuaaau

SEQ ID NO: 584052 - RNA, 12 nt, Escherichia coli CFT073
gcccaugccagu

SEQ ID NO: 584053 - RNA, 15 nt, Escherichia coli CFT073
gcccccgccagcgcc

SEQ ID NO: 584054 - RNA, 22 nt, Escherichia coli CFT073
gccccaguuccuuaacuucauc

SEQ ID NO: 584055 - RNA, 16 nt, Escherichia coli CFT073
gcccgauagacaccau

SEQ ID NO: 584056 - RNA, 17 nt, Escherichia coli CFT073
gcccgacgaggcgcugg

SEQ ID NO: 584057 - RNA, 19 nt, Escherichia coli CFT073
gcccgcauagcccagcgcc

SEQ ID NO: 584058 - RNA, 13 nt, Escherichia coli CFT073
gcccgccagugca

SEQ ID NO: 584059 - RNA, 13 nt, Escherichia coli CFT073
gcccgcagcggcg

SEQ ID NO: 584060 - RNA, 20 nt, Escherichia coli CFT073
gcccgauggugaugccaucg

SEQ ID NO: 584061 - RNA, 12 nt, Escherichia coli CFT073
gcaggagcggcg

SEQ ID NO: 584062 - RNA, 13 nt, Escherichia coli CFT073
gcaggagaccaaa

SEQ ID NO: 584063 - RNA, 13 nt, Escherichia coli CFT073
gcaggagagaucg

SEQ ID NO: 584064 - RNA, 14 nt, Escherichia coli CFT073
gcaggaugagcgcg

SEQ ID NO: 584065 - RNA, 15 nt, Escherichia coli CFT073
gcaggaugagcgcga

SEQ ID NO: 584066 - RNA, 21 nt, Escherichia coli CFT073
gcaggaugacauaaccuugca

SEQ ID NO: 584067 - RNA, 20 nt, Escherichia coli CFT073
gcaggagcgguguaggccug

SEQ ID NO: 584068 - RNA, 23 nt, Escherichia coli CFT073
gcaggaacgagaacucggaagca

SEQ ID NO: 584069 - RNA, 22 nt, Escherichia coli CFT073
gcaggaacaaugccucgcuaau

SEQ ID NO: 584070 - RNA, 23 nt, Escherichia coli CFT073
gcagcuuuaauauuacgugccgc

SEQ ID NO: 584071 - RNA, 16 nt, Escherichia coli CFT073
gcaggaaaucaaugcc

SEQ ID NO: 584072 - RNA, 23 nt, Escherichia coli CFT073
gcaggaaaucaaugccaccagaa

SEQ ID NO: 584073 - RNA, 18 nt, Escherichia coli CFT073
gcagcuuugugcuucagu

SEQ ID NO: 584074 - RNA, 20 nt, Escherichia coli CFT073
gcagcuucuucuccagcugc

SEQ ID NO: 584075 - RNA, 21 nt, Escherichia coli CFT073
gcagcuucuucuccagcugcg

SEQ ID NO: 584076 - RNA, 15 nt, Escherichia coli CFT073
gcagcuguugcgcca

SEQ ID NO: 584077 - RNA, 17 nt, Escherichia coli CFT073
gcagcuguuucaucuca

SEQ ID NO: 584078 - RNA, 16 nt, Escherichia coli CFT073
gcagcuguuuggccug

SEQ ID NO: 584079 - RNA, 16 nt, Escherichia coli CFT073
gcagggcaaacagcac

SEQ ID NO: 584080 - RNA, 13 nt, Escherichia coli CFT073
gcagggaagcgag

SEQ ID NO: 584081 - RNA, 21 nt, Escherichia coli CFT073
gcaggcuguuaccccugcggc

SEQ ID NO: 584082 - RNA, 23 nt, Escherichia coli CFT073
gcaggcuguuaccccugcggccg

SEQ ID NO: 584083 - RNA, 19 nt, Escherichia coli CFT073
gcaggcgcuuaucguccca

SEQ ID NO: 584084 - RNA, 14 nt, Escherichia coli CFT073
gcaggccugauaag

SEQ ID NO: 584085 - RNA, 17 nt, Escherichia coli CFT073
gcaggcaaaguaggccg

SEQ ID NO: 584086 - RNA, 23 nt, Escherichia coli CFT073
gcaggcaauagucguauuaucgc

SEQ ID NO: 584087 - RNA, 18 nt, Escherichia coli CFT073
gcaucaggcaugauacgc

SEQ ID NO: 584088 - RNA, 20 nt, Escherichia coli CFT073
gcaucaggcauuuaucgccu

SEQ ID NO: 584089 - RNA, 17 nt, Escherichia coli CFT073
gcaucaggccaaacaga

SEQ ID NO: 584090 - RNA, 14 nt, Escherichia coli CFT073
gcaucagucacgac

SEQ ID NO: 584091 - RNA, 12 nt, Escherichia coli CFT073
gcaucagcgauu

SEQ ID NO: 584092 - RNA, 18 nt, Escherichia coli CFT073
gcaucagcgccuuaccaa

SEQ ID NO: 584093 - RNA, 18 nt, Escherichia coli CFT073
gcaucagcaguuuuuccc

SEQ ID NO: 584094 - RNA, 11 nt, Escherichia coli CFT073
gcaucagcaau

SEQ ID NO: 584095 - RNA, 12 nt, Escherichia coli CFT073
gcaucagauggg

SEQ ID NO: 584096 - RNA, 20 nt, Escherichia coli CFT073
gcauccacaguaagccggua

SEQ ID NO: 584097 - RNA, 13 nt, Escherichia coli CFT073
gcauccagauucu

SEQ ID NO: 584098 - RNA, 13 nt, Escherichia coli CFT073
gcauccagcagcc

SEQ ID NO: 584099 - RNA, 22 nt, Escherichia coli CFT073
gcaucaggcuagaugugccaau

SEQ ID NO: 584100 - RNA, 20 nt, Escherichia coli CFT073
gcaucauaaauagagacgac

SEQ ID NO: 584101 - RNA, 15 nt, Escherichia coli CFT073
gcaucauaugcgcca

SEQ ID NO: 584102 - RNA, 16 nt, Escherichia coli CFT073
gcaucauaugcgccag

SEQ ID NO: 584103 - RNA, 17 nt, Escherichia coli CFT073
gcaucaucgagaucgac

SEQ ID NO: 584104 - RNA, 22 nt, Escherichia coli CFT073
gcaucaucucacgcaguuuauc

SEQ ID NO: 584105 - RNA, 21 nt, Escherichia coli CFT073
gcauauaugaauauugcugaa

SEQ ID NO: 584106 - RNA, 17 nt, Escherichia coli CFT073
gcauaccuuccagcgcg

SEQ ID NO: 584107 - RNA, 15 nt, Escherichia coli CFT073
gcauacuaauaucau

SEQ ID NO: 584108 - RNA, 16 nt, Escherichia coli CFT073
gcauacugauuaccca

SEQ ID NO: 584109 - RNA, 17 nt, Escherichia coli CFT073
gcaucaacccgcucaua

SEQ ID NO: 584110 - RNA, 17 nt, Escherichia coli CFT073
gcauauuuaaaaacgag

SEQ ID NO: 584111 - RNA, 19 nt, Escherichia coli CFT073
gcaucaaagaacucacgcg

SEQ ID NO: 584112 - RNA, 16 nt, Escherichia coli CFT073
gcauaugaaugccagc

SEQ ID NO: 584113 - RNA, 22 nt, Escherichia coli CFT073
gcauaugcugcuuuuacgcugg

SEQ ID NO: 584114 - RNA, 22 nt, Escherichia coli CFT073
gcauauguuuacgcuggcggaa

SEQ ID NO: 584115 - RNA, 22 nt, Escherichia coli CFT073
gcauauuauucauaaugcccag

SEQ ID NO: 584116 - RNA, 19 nt, Escherichia coli CFT073
gcauaccauccggcauaaa

SEQ ID NO: 584117 - RNA, 22 nt, Escherichia coli CFT073
gcauaccauccggcauaaacgc

SEQ ID NO: 584118 - RNA, 17 nt, Escherichia coli CFT073
gcauacaguaucgccug

SEQ ID NO: 584119 - RNA, 19 nt, Escherichia coli CFT073
gcauacaucaacgcgcaac

SEQ ID NO: 584120 - RNA, 13 nt, Escherichia coli CFT073
gcaguaauccagc

SEQ ID NO: 584121 - RNA, 22 nt, Escherichia coli CFT073
gcaguaaugguuuuauugcccu

SEQ ID NO: 584122 - RNA, 18 nt, Escherichia coli CFT073
gcaguaaaccacaucagc

SEQ ID NO: 584123 - RNA, 13 nt, Escherichia coli CFT073
gcaguaaacgcca

SEQ ID NO: 584124 - RNA, 15 nt, Escherichia coli CFT073
gcaguaaacgccagg

SEQ ID NO: 584125 - RNA, 23 nt, Escherichia coli CFT073
gcaguaacguuaguucgcguagc

SEQ ID NO: 584126 - RNA, 18 nt, Escherichia coli CFT073
gcaguaccgcagccggaa

SEQ ID NO: 584127 - RNA, 16 nt, Escherichia coli CFT073
gcaguacggcagguca

SEQ ID NO: 584128 - RNA, 21 nt, Escherichia coli CFT073
gcaggguacgacuuccuggcu

SEQ ID NO: 584129 - RNA, 22 nt, Escherichia coli CFT073
gcagucggaaccgguuuagaaa

SEQ ID NO: 584130 - RNA, 21 nt, Escherichia coli CFT073
gcaguccgcuaaaaauaguuc

SEQ ID NO: 584131 - RNA, 19 nt, Escherichia coli CFT073
gcagugaaguaauaaucaa

SEQ ID NO: 584132 - RNA, 18 nt, Escherichia coli CFT073
gcagugacauucaccuca

SEQ ID NO: 584133 - RNA, 19 nt, Escherichia coli CFT073
gcagugauagcacgguucg

SEQ ID NO: 584134 - RNA, 16 nt, Escherichia coli CFT073
gcagugauugccgcga

SEQ ID NO: 584135 - RNA, 12 nt, Escherichia coli CFT073
gcagccagcgca

SEQ ID NO: 584136 - RNA, 18 nt, Escherichia coli CFT073
gcagccaguuaaccugcg

SEQ ID NO: 584137 - RNA, 18 nt, Escherichia coli CFT073
gcagcgguugagagaaga

SEQ ID NO: 584138 - RNA, 14 nt, Escherichia coli CFT073
gcagcguccagcgc

SEQ ID NO: 584139 - RNA, 14 nt, Escherichia coli CFT073
gcagcguucccagc

SEQ ID NO: 584140 - RNA, 19 nt, Escherichia coli CFT073
gcagcguggugcugauacg

SEQ ID NO: 584141 - RNA, 22 nt, Escherichia coli CFT073
gcagcguggugcugauacgcgc

SEQ ID NO: 584142 - RNA, 12 nt, Escherichia coli CFT073
gcagcgucgcau

SEQ ID NO: 584143 - RNA, 15 nt, Escherichia coli CFT073
gcagcgucgcaucag

SEQ ID NO: 584144 - RNA, 15 nt, Escherichia coli CFT073
gcagcggccaguagc

SEQ ID NO: 584145 - RNA, 23 nt, Escherichia coli CFT073
gcagcggcagcuuaacgguuuua

SEQ ID NO: 584146 - RNA, 15 nt, Escherichia coli CFT073
gcagcggcaagcugg

SEQ ID NO: 584147 - RNA, 15 nt, Escherichia coli CFT073
gcagcggaccgcuuu

SEQ ID NO: 584148 - RNA, 23 nt, Escherichia coli CFT073
gcagcggagaaauguugguuucg

SEQ ID NO: 584149 - RNA, 18 nt, Escherichia coli CFT073
gcagcggagaucgccagc

SEQ ID NO: 584150 - RNA, 18 nt, Escherichia coli CFT073
gcagcucuuuauccagca

SEQ ID NO: 584151 - RNA, 21 nt, Escherichia coli CFT073
gcagcuccccacaccaccaug

SEQ ID NO: 584152 - RNA, 12 nt, Escherichia coli CFT073
gcagcuccagcc

SEQ ID NO: 584153 - RNA, 22 nt, Escherichia coli CFT073
gcagagccugaauaaacgccau

SEQ ID NO: 584154 - RNA, 13 nt, Escherichia coli CFT073
gcacucgccagga

SEQ ID NO: 584155 - RNA, 16 nt, Escherichia coli CFT073
gcagauaacuuaguua

SEQ ID NO: 584156 - RNA, 16 nt, Escherichia coli CFT073
gcagagucuccgguuu

SEQ ID NO: 584157 - RNA, 23 nt, Escherichia coli CFT073
gcagagucuccgguuucccggca

SEQ ID NO: 584158 - RNA, 15 nt, Escherichia coli CFT073
gcagaguaucgccau

SEQ ID NO: 584159 - RNA, 14 nt, Escherichia coli CFT073
gcagauacaaccaa

SEQ ID NO: 584160 - RNA, 21 nt, Escherichia coli CFT073
gcagauacaaccaaucgcggc

SEQ ID NO: 584161 - RNA, 21 nt, Escherichia coli CFT073
gcagauaccacaucaacccgc

SEQ ID NO: 584162 - RNA, 20 nt, Escherichia coli CFT073
gcagauaagaccaauccagc

SEQ ID NO: 584163 - RNA, 21 nt, Escherichia coli CFT073
gcagauaccaccagcgccauu

SEQ ID NO: 584164 - RNA, 23 nt, Escherichia coli CFT073
gcagauacugaugaacgcgcaga

SEQ ID NO: 584165 - RNA, 19 nt, Escherichia coli CFT073
gcagauaaacaaccccauc

SEQ ID NO: 584166 - RNA, 18 nt, Escherichia coli CFT073
gcagcaauagcaaagccu

SEQ ID NO: 584167 - RNA, 13 nt, Escherichia coli CFT073
gcagcacaaugcc

SEQ ID NO: 584168 - RNA, 22 nt, Escherichia coli CFT073
gcagcaagugcggcgcaccagc

SEQ ID NO: 584169 - RNA, 22 nt, Escherichia coli CFT073
gcagaugacucgccgcaaaacc

SEQ ID NO: 584170 - RNA, 15 nt, Escherichia coli CFT073
gcagaucugcgccau

SEQ ID NO: 584171 - RNA, 12 nt, Escherichia coli CFT073
gcagaucgccag

SEQ ID NO: 584172 - RNA, 15 nt, Escherichia coli CFT073
gcagcaucgcucacc

SEQ ID NO: 584173 - RNA, 13 nt, Escherichia coli CFT073
gcagcaucagcaa

SEQ ID NO: 584174 - RNA, 12 nt, Escherichia coli CFT073
gcagcaucacgc

SEQ ID NO: 584175 - RNA, 16 nt, Escherichia coli CFT073
gcagcauggguaaagc

SEQ ID NO: 584176 - RNA, 15 nt, Escherichia coli CFT073
gcagcauggucgcag

SEQ ID NO: 584177 - RNA, 15 nt, Escherichia coli CFT073
gcagccacggcagca

SEQ ID NO: 584178 - RNA, 14 nt, Escherichia coli CFT073
gcagccacugcggc

SEQ ID NO: 584179 - RNA, 13 nt, Escherichia coli CFT073
gcagcauuuccuc

SEQ ID NO: 584180 - RNA, 22 nt, Escherichia coli CFT073
gcagcagauuaaccgcuucgcu

SEQ ID NO: 584181 - RNA, 14 nt, Escherichia coli CFT073
gcagcacugauaau

SEQ ID NO: 584182 - RNA, 16 nt, Escherichia coli CFT073
gcacagccagccucca

SEQ ID NO: 584183 - RNA, 14 nt, Escherichia coli CFT073
gcacagccagcgca

SEQ ID NO: 584184 - RNA, 19 nt, Escherichia coli CFT073
gcacagccagcgcaggcag

SEQ ID NO: 584185 - RNA, 22 nt, Escherichia coli CFT073
gcacagccagugauuccggugc

SEQ ID NO: 584186 - RNA, 15 nt, Escherichia coli CFT073
gcacagcauccgaac

SEQ ID NO: 584187 - RNA, 13 nt, Escherichia coli CFT073
gcacacugccagu

SEQ ID NO: 584188 - RNA, 19 nt, Escherichia coli CFT073
gcacacugccagugucgga

SEQ ID NO: 584189 - RNA, 17 nt, Escherichia coli CFT073
gcacacuaccaaaacgg

SEQ ID NO: 584190 - RNA, 17 nt, Escherichia coli CFT073
gcacaaccggaaccagc

SEQ ID NO: 584191 - RNA, 19 nt, Escherichia coli CFT073
gcacaaccggaaccagcgc

SEQ ID NO: 584192 - RNA, 20 nt, Escherichia coli CFT073
gcacaaccggaaccagcgcc

SEQ ID NO: 584193 - RNA, 14 nt, Escherichia coli CFT073
gcacaaccgccaga

SEQ ID NO: 584194 - RNA, 15 nt, Escherichia coli CFT073
gcacaaccgccagau

SEQ ID NO: 584195 - RNA, 18 nt, Escherichia coli CFT073
gcacaaccgccagaugcg

SEQ ID NO: 584196 - RNA, 20 nt, Escherichia coli CFT073
gcacauaauugagcagcaaa

SEQ ID NO: 584197 - RNA, 16 nt, Escherichia coli CFT073
gcacauauucacgggc

SEQ ID NO: 584198 - RNA, 17 nt, Escherichia coli CFT073
gcacaguguuuguugaa

SEQ ID NO: 584199 - RNA, 18 nt, Escherichia coli CFT073
gcacagucgcgacgcuga

SEQ ID NO: 584200 - RNA, 19 nt, Escherichia coli CFT073
gcacagggggauucaccau

SEQ ID NO: 584201 - RNA, 20 nt, Escherichia coli CFT073
gcacagggggauucaccaug

SEQ ID NO: 584202 - RNA, 15 nt, Escherichia coli CFT073
gcacagguggcaaac

SEQ ID NO: 584203 - RNA, 15 nt, Escherichia coli CFT073
gcacaggcgggugau

SEQ ID NO: 584204 - RNA, 22 nt, Escherichia coli CFT073
gcacaggcaauccagcucggcg

SEQ ID NO: 584205 - RNA, 19 nt, Escherichia coli CFT073
gcacagcccgccgccaucc

SEQ ID NO: 584206 - RNA, 13 nt, Escherichia coli CFT073
gcacagccgcauu

SEQ ID NO: 584207 - RNA, 20 nt, Escherichia coli CFT073
gcaaucgaccaggccaucag

SEQ ID NO: 584208 - RNA, 22 nt, Escherichia coli CFT073
gcaaucgaccaggccaucagca

SEQ ID NO: 584209 - RNA, 14 nt, Escherichia coli CFT073
gcaaucgauuugaa

SEQ ID NO: 584210 - RNA, 21 nt, Escherichia coli CFT073
gcaaucgcauauuucaacgac

SEQ ID NO: 584211 - RNA, 18 nt, Escherichia coli CFT073
gcaaucgccagcggcagc

SEQ ID NO: 584212 - RNA, 22 nt, Escherichia coli CFT073
gcacaaagcgccagaaugcgga

SEQ ID NO: 584213 - RNA, 18 nt, Escherichia coli CFT073
gcacaaauagccagcaga

SEQ ID NO: 584214 - RNA, 18 nt, Escherichia coli CFT073
gcaauggucccuugcugg

SEQ ID NO: 584215 - RNA, 21 nt, Escherichia coli CFT073
gcaaugguucccggaccggcg

SEQ ID NO: 584216 - RNA, 17 nt, Escherichia coli CFT073
gcaaugugaaaucagcg

SEQ ID NO: 584217 - RNA, 23 nt, Escherichia coli CFT073
gcaaugcguuuggagccgcuggc

SEQ ID NO: 584218 - RNA, 14 nt, Escherichia coli CFT073
gcaauggacaccag

SEQ ID NO: 584219 - RNA, 17 nt, Escherichia coli CFT073
gcaauggacaccaggca

SEQ ID NO: 584220 - RNA, 16 nt, Escherichia coli CFT073
gcaauggaccagaacg

SEQ ID NO: 584221 - RNA, 13 nt, Escherichia coli CFT073
gcaauaucaacaa

SEQ ID NO: 584222 - RNA, 15 nt, Escherichia coli CFT073
gcaauauucuuuugc

SEQ ID NO: 584223 - RNA, 17 nt, Escherichia coli CFT073
gcaaucaacgccugaug

SEQ ID NO: 584224 - RNA, 15 nt, Escherichia coli CFT073
gcaaucaccgccagc

SEQ ID NO: 584225 - RNA, 20 nt, Escherichia coli CFT073
gcaaucacgcccgccagaua

SEQ ID NO: 584226 - RNA, 20 nt, Escherichia coli CFT073
gcaauagugauguucuggcg

SEQ ID NO: 584227 - RNA, 13 nt, Escherichia coli CFT073
gcaauagccgcca

SEQ ID NO: 584228 - RNA, 16 nt, Escherichia coli CFT073
gcaauaccugacgcaa

SEQ ID NO: 584229 - RNA, 19 nt, Escherichia coli CFT073
gcaauaauaucccaacgca

SEQ ID NO: 584230 - RNA, 15 nt, Escherichia coli CFT073
gcaauacagccagcc

SEQ ID NO: 584231 - RNA, 17 nt, Escherichia coli CFT073
gcaaacggucaaucgca

SEQ ID NO: 584232 - RNA, 18 nt, Escherichia coli CFT073
gcaaacguaaaugccagc

SEQ ID NO: 584233 - RNA, 17 nt, Escherichia coli CFT073
gcaaacgucgcgcaugc

SEQ ID NO: 584234 - RNA, 19 nt, Escherichia coli CFT073
gcaauaaucagauggcggc

SEQ ID NO: 584235 - RNA, 19 nt, Escherichia coli CFT073
gcaauaaucucaauauccg

SEQ ID NO: 584236 - RNA, 14 nt, Escherichia coli CFT073
gcaauaaugccagu

SEQ ID NO: 584237 - RNA, 15 nt, Escherichia coli CFT073
gcaaaccggacgauc

SEQ ID NO: 584238 - RNA, 14 nt, Escherichia coli CFT073
gcaaaccuuucgcc

SEQ ID NO: 584239 - RNA, 14 nt, Escherichia coli CFT073
gcaaacgauaaaag

SEQ ID NO: 584240 - RNA, 14 nt, Escherichia coli CFT073
gcacauuagcgacc

SEQ ID NO: 584241 - RNA, 21 nt, Escherichia coli CFT073
gcacauuccagaugcgccagu

SEQ ID NO: 584242 - RNA, 19 nt, Escherichia coli CFT073
gcacaugcuuuugcgccau

SEQ ID NO: 584243 - RNA, 12 nt, Escherichia coli CFT073
gcaccaaacggg

SEQ ID NO: 584244 - RNA, 14 nt, Escherichia coli CFT073
gcaccaaagcguuu

SEQ ID NO: 584245 - RNA, 19 nt, Escherichia coli CFT073
gcacaugacuuccaacgaa

SEQ ID NO: 584246 - RNA, 20 nt, Escherichia coli CFT073
gcacaucucaaaucuucuca

SEQ ID NO: 584247 - RNA, 14 nt, Escherichia coli CFT073
gcaccaaguucuuc

SEQ ID NO: 584248 - RNA, 12 nt, Escherichia coli CFT073
gcaccaacgcaa

SEQ ID NO: 584249 - RNA, 17 nt, Escherichia coli CFT073
gcaccaacggucagcgc

SEQ ID NO: 584250 - RNA, 15 nt, Escherichia coli CFT073
gcaccacuacagcgg

SEQ ID NO: 584251 - RNA, 17 nt, Escherichia coli CFT073
gcaccaggcgaaaacgc

SEQ ID NO: 584252 - RNA, 16 nt, Escherichia coli CFT073
gcaccaggccgcgcag

SEQ ID NO: 584253 - RNA, 16 nt, Escherichia coli CFT073
gcaccagcccgacgau

SEQ ID NO: 584254 - RNA, 16 nt, Escherichia coli CFT073
gcacggaaagcagcau

SEQ ID NO: 584255 - RNA, 16 nt, Escherichia coli CFT073
gcacgcucaaagacgc

SEQ ID NO: 584256 - RNA, 21 nt, Escherichia coli CFT073
gcacgcguaauauccagcgua

SEQ ID NO: 584257 - RNA, 17 nt, Escherichia coli CFT073
gcacgguuuugucggca

SEQ ID NO: 584258 - RNA, 15 nt, Escherichia coli CFT073
gcacgguggcuggcg

SEQ ID NO: 584259 - RNA, 17 nt, Escherichia coli CFT073
gcaccuucaacuugcug

SEQ ID NO: 584260 - RNA, 19 nt, Escherichia coli CFT073
gcacgacguuucuuucgau

SEQ ID NO: 584261 - RNA, 17 nt, Escherichia coli CFT073
gcacgccaauuacgccu

SEQ ID NO: 584262 - RNA, 17 nt, Escherichia coli CFT073
gcaccgaggccaaaacc

SEQ ID NO: 584263 - RNA, 16 nt, Escherichia coli CFT073
gcaccgaccaucggca

SEQ ID NO: 584264 - RNA, 18 nt, Escherichia coli CFT073
gcacccaguacgggcagc

SEQ ID NO: 584265 - RNA, 19 nt, Escherichia coli CFT073
gcaccucuccacgcaucug

SEQ ID NO: 584266 - RNA, 15 nt, Escherichia coli CFT073
gcaccgguuccgggc

SEQ ID NO: 584267 - RNA, 19 nt, Escherichia coli CFT073
gcaccgggggguugccgcc

SEQ ID NO: 584268 - RNA, 20 nt, Escherichia coli CFT073
gcaccggcguaacgccgcga

SEQ ID NO: 584269 - RNA, 14 nt, Escherichia coli CFT073
gcaccgccgccagg

SEQ ID NO: 584270 - RNA, 18 nt, Escherichia coli CFT073
gcaccgcccugcaucaug

SEQ ID NO: 584271 - RNA, 19 nt, Escherichia coli CFT073
gcaccgccauauugaccgu

SEQ ID NO: 584272 - RNA, 20 nt, Escherichia coli CFT073
gauugauagcgacgcgcugg

SEQ ID NO: 584273 - RNA, 11 nt, Escherichia coli CFT073
gauugaugcga

SEQ ID NO: 584274 - RNA, 21 nt, Escherichia coli CFT073
gauugcggucagcgcagcaag

SEQ ID NO: 584275 - RNA, 15 nt, Escherichia coli CFT073
gauugccugaugcgc

SEQ ID NO: 584276 - RNA, 13 nt, Escherichia coli CFT073
gauucaccaccgu

SEQ ID NO: 584277 - RNA, 17 nt, Escherichia coli CFT073
gauucacgccaaccagc

SEQ ID NO: 584278 - RNA, 14 nt, Escherichia coli CFT073
gauucacuuucuga

SEQ ID NO: 584279 - RNA, 17 nt, Escherichia coli CFT073
gauucagaugccauuuu

SEQ ID NO: 584280 - RNA, 12 nt, Escherichia coli CFT073
gauuacagccag

SEQ ID NO: 584281 - RNA, 19 nt, Escherichia coli CFT073
gauuaccauuucacuguca

SEQ ID NO: 584282 - RNA, 18 nt, Escherichia coli CFT073
gauuccaacgaaaaugau

SEQ ID NO: 584283 - RNA, 21 nt, Escherichia coli CFT073
gauugaccauauuaacgcagc

SEQ ID NO: 584284 - RNA, 14 nt, Escherichia coli CFT073
gauugaccgccagc

SEQ ID NO: 584285 - RNA, 21 nt, Escherichia coli CFT073
gauugaccgccagcgccaucu

SEQ ID NO: 584286 - RNA, 14 nt, Escherichia coli CFT073
gauucccugccuga

SEQ ID NO: 584287 - RNA, 20 nt, Escherichia coli CFT073
gcaaaacgcaggauccacgc

SEQ ID NO: 584288 - RNA, 15 nt, Escherichia coli CFT073
gcaaaauauaaaccg

SEQ ID NO: 584289 - RNA, 14 nt, Escherichia coli CFT073
gcaaaaucaaacag

SEQ ID NO: 584290 - RNA, 21 nt, Escherichia coli CFT073
gcaaaauccagaaaaaaagca

SEQ ID NO: 584291 - RNA, 22 nt, Escherichia coli CFT073
gcaaaaaugauagccaggcgga

SEQ ID NO: 584292 - RNA, 20 nt, Escherichia coli CFT073
gcaaaaauuauucagcguuu

SEQ ID NO: 584293 - RNA, 17 nt, Escherichia coli CFT073
gcaaaacccugcgccag

SEQ ID NO: 584294 - RNA, 18 nt, Escherichia coli CFT073
gcaaaacccugcgccagc

SEQ ID NO: 584295 - RNA, 11 nt, Escherichia coli CFT073
gcaaaaaaaga

SEQ ID NO: 584296 - RNA, 13 nt, Escherichia coli CFT073
gcaaaaaaagcua

SEQ ID NO: 584297 - RNA, 19 nt, Escherichia coli CFT073
gauuuuuagcaugugcaau

SEQ ID NO: 584298 - RNA, 14 nt, Escherichia coli CFT073
gauuggcaccgaca

SEQ ID NO: 584299 - RNA, 21 nt, Escherichia coli CFT073
gauuuucauaaggcggauagc

SEQ ID NO: 584300 - RNA, 15 nt, Escherichia coli CFT073
gauuuucuuccagua

SEQ ID NO: 584301 - RNA, 16 nt, Escherichia coli CFT073
gauuuugccuucauac

SEQ ID NO: 584302 - RNA, 20 nt, Escherichia coli CFT073
gauuaaacgccauccggcag

SEQ ID NO: 584303 - RNA, 16 nt, Escherichia coli CFT073
gauuaaacuggcacgc

SEQ ID NO: 584304 - RNA, 14 nt, Escherichia coli CFT073
gauuaacgccagau

SEQ ID NO: 584305 - RNA, 22 nt, Escherichia coli CFT073
gauuaagaucgugcagcaccgc

SEQ ID NO: 584306 - RNA, 17 nt, Escherichia coli CFT073
gauguuugcugcggcgc

SEQ ID NO: 584307 - RNA, 20 nt, Escherichia coli CFT073
gauguuggcagcggcaagcu

SEQ ID NO: 584308 - RNA, 12 nt, Escherichia coli CFT073
gaugugaugcau

SEQ ID NO: 584309 - RNA, 19 nt, Escherichia coli CFT073
gaugucgauaucaggcaaa

SEQ ID NO: 584310 - RNA, 16 nt, Escherichia coli CFT073
gauguacccgcugcaa

SEQ ID NO: 584311 - RNA, 16 nt, Escherichia coli CFT073
gauguaauuaucgcag

SEQ ID NO: 584312 - RNA, 19 nt, Escherichia coli CFT073
gaugccagucaaugaaauu

SEQ ID NO: 584313 - RNA, 13 nt, Escherichia coli CFT073
gaugccauucagu

SEQ ID NO: 584314 - RNA, 23 nt, Escherichia coli CFT073
gaugccagcacagaucgcacuua

SEQ ID NO: 584315 - RNA, 18 nt, Escherichia coli CFT073
gaugccggguuugccaug

SEQ ID NO: 584316 - RNA, 18 nt, Escherichia coli CFT073
gauggcguaaccaaugcc

SEQ ID NO: 584317 - RNA, 21 nt, Escherichia coli CFT073
gauggcguaaccaaugccacc

SEQ ID NO: 584318 - RNA, 23 nt, Escherichia coli CFT073
gauggcggcuuaguugaucgaca

SEQ ID NO: 584319 - RNA, 19 nt, Escherichia coli CFT073
gauggcggcaguauagcgg

SEQ ID NO: 584320 - RNA, 17 nt, Escherichia coli CFT073
gaugcuucagauaccaa

SEQ ID NO: 584321 - RNA, 18 nt, Escherichia coli CFT073
gaugcugggcgaucggca

SEQ ID NO: 584322 - RNA, 20 nt, Escherichia coli CFT073
gaugcguccgcuaguggcaa

SEQ ID NO: 584323 - RNA, 22 nt, Escherichia coli CFT073
gaugcgguuaacaauacgccca

SEQ ID NO: 584324 - RNA, 11 nt, Escherichia coli CFT073
gaugcggcagu

SEQ ID NO: 584325 - RNA, 17 nt, Escherichia coli CFT073
gaugcggcagucgcgcu

SEQ ID NO: 584326 - RNA, 19 nt, Escherichia coli CFT073
gaugcgggugaacgcguua

SEQ ID NO: 584327 - RNA, 15 nt, Escherichia coli CFT073
gaugcagcaucaugu

SEQ ID NO: 584328 - RNA, 16 nt, Escherichia coli CFT073
gaugcagcgcaugacc

SEQ ID NO: 584329 - RNA, 14 nt, Escherichia coli CFT073
gaugcacaccaucg

SEQ ID NO: 584330 - RNA, 19 nt, Escherichia coli CFT073
gaugauugccacaagggca

SEQ ID NO: 584331 - RNA, 15 nt, Escherichia coli CFT073
gaugauuuccgccag

SEQ ID NO: 584332 - RNA, 16 nt, Escherichia coli CFT073
gaugaucuccauugcc

SEQ ID NO: 584333 - RNA, 21 nt, Escherichia coli CFT073
gaugaucggcguacccagcgu

SEQ ID NO: 584334 - RNA, 22 nt, Escherichia coli CFT073
gaugaugccaaaaugcaccgga

SEQ ID NO: 584335 - RNA, 17 nt, Escherichia coli CFT073
gaugaucaucaucgcga

SEQ ID NO: 584336 - RNA, 18 nt, Escherichia coli CFT073
gaugaucaucaucgcgau

SEQ ID NO: 584337 - RNA, 18 nt, Escherichia coli CFT073
gaugaucccuucgcuggc

SEQ ID NO: 584338 - RNA, 18 nt, Escherichia coli CFT073
gaugagaucccgauacca

SEQ ID NO: 584339 - RNA, 21 nt, Escherichia coli CFT073
gaugagaaaagagaugaauga

SEQ ID NO: 584340 - RNA, 19 nt, Escherichia coli CFT073
gaugauauuuuucccugaa

SEQ ID NO: 584341 - RNA, 13 nt, Escherichia coli CFT073
gaugaccgguucu

SEQ ID NO: 584342 - RNA, 14 nt, Escherichia coli CFT073
gaugacgcgcucac

SEQ ID NO: 584343 - RNA, 16 nt, Escherichia coli CFT073
gaucuaucuggcgcgc

SEQ ID NO: 584344 - RNA, 17 nt, Escherichia coli CFT073
gaucuccacccgcaaau

SEQ ID NO: 584345 - RNA, 19 nt, Escherichia coli CFT073
gaucucgccagagagcgga

SEQ ID NO: 584346 - RNA, 19 nt, Escherichia coli CFT073
gaucgucuucaaccgcagu

SEQ ID NO: 584347 - RNA, 18 nt, Escherichia coli CFT073
gaucuggcgucagcggcu

SEQ ID NO: 584348 - RNA, 20 nt, Escherichia coli CFT073
gaucugcuuguacggaaccg

SEQ ID NO: 584349 - RNA, 12 nt, Escherichia coli CFT073
gaucgaccgguu

SEQ ID NO: 584350 - RNA, 13 nt, Escherichia coli CFT073
gaucacgccccuc

SEQ ID NO: 584351 - RNA, 16 nt, Escherichia coli CFT073
gaucccagaaccaguu

SEQ ID NO: 584352 - RNA, 20 nt, Escherichia coli CFT073
gaucgcgaccgccuucaguc

SEQ ID NO: 584353 - RNA, 22 nt, Escherichia coli CFT073
gaucgacgugggcgugggaaua

SEQ ID NO: 584354 - RNA, 20 nt, Escherichia coli CFT073
gaucgagaauauucacgaca

SEQ ID NO: 584355 - RNA, 17 nt, Escherichia coli CFT073
gaucggagccaaaauca

SEQ ID NO: 584356 - RNA, 19 nt, Escherichia coli CFT073
gaucgcguucccgaccaau

SEQ ID NO: 584357 - RNA, 13 nt, Escherichia coli CFT073
gaucgcuggcagc

SEQ ID NO: 584358 - RNA, 22 nt, Escherichia coli CFT073
gaucgcgcaguaaauccgccac

SEQ ID NO: 584359 - RNA, 22 nt, Escherichia coli CFT073
gaucgcgccaaucagcgcagca

SEQ ID NO: 584360 - RNA, 12 nt, Escherichia coli CFT073
gagccuggcugc

SEQ ID NO: 584361 - RNA, 16 nt, Escherichia coli CFT073
gagcgcaaauugcugg

SEQ ID NO: 584362 - RNA, 13 nt, Escherichia coli CFT073
gagcgccauaucg

SEQ ID NO: 584363 - RNA, 13 nt, Escherichia coli CFT073
gagcgccagcgaa

SEQ ID NO: 584364 - RNA, 17 nt, Escherichia coli CFT073
gagcgccccagaccuga

SEQ ID NO: 584365 - RNA, 19 nt, Escherichia coli CFT073
gagcgccugucugcaaaaa

SEQ ID NO: 584366 - RNA, 22 nt, Escherichia coli CFT073
gagcgccgauuucucaucaauu

SEQ ID NO: 584367 - RNA, 23 nt, Escherichia coli CFT073
gagcggcguuuuguagagcagca

SEQ ID NO: 584368 - RNA, 15 nt, Escherichia coli CFT073
gagcugaagcauggu

SEQ ID NO: 584369 - RNA, 20 nt, Escherichia coli CFT073
gagcguauagagcagcggcg

SEQ ID NO: 584370 - RNA, 15 nt, Escherichia coli CFT073
gagcgugagugcgaa

SEQ ID NO: 584371 - RNA, 20 nt, Escherichia coli CFT073
gagcguggcgauaaucagcg

SEQ ID NO: 584372 - RNA, 15 nt, Escherichia coli CFT073
gagcguucaaaacgg

SEQ ID NO: 584373 - RNA, 22 nt, Escherichia coli CFT073
gagccgguuuugguuuucuguc

SEQ ID NO: 584374 - RNA, 17 nt, Escherichia coli CFT073
gagccgucgcuaucgau

SEQ ID NO: 584375 - RNA, 17 nt, Escherichia coli CFT073
gagcagcuguuucaucu

SEQ ID NO: 584376 - RNA, 19 nt, Escherichia coli CFT073
gacgucgguuuccagcauc

SEQ ID NO: 584377 - RNA, 18 nt, Escherichia coli CFT073
gagcaugguaacgcccca

SEQ ID NO: 584378 - RNA, 22 nt, Escherichia coli CFT073
gagcaucgugccggaaggaaga

SEQ ID NO: 584379 - RNA, 15 nt, Escherichia coli CFT073
gauaucuuucacaaa

SEQ ID NO: 584380 - RNA, 22 nt, Escherichia coli CFT073
gauauuucaccagcgcacguaa

SEQ ID NO: 584381 - RNA, 15 nt, Escherichia coli CFT073
gaucaacagaaugau

SEQ ID NO: 584382 - RNA, 20 nt, Escherichia coli CFT073
gauauuggucaccacggcca

SEQ ID NO: 584383 - RNA, 20 nt, Escherichia coli CFT073
gauauccugaaacgcggcgu

SEQ ID NO: 584384 - RNA, 18 nt, Escherichia coli CFT073
gaucacaauguaaaucau

SEQ ID NO: 584385 - RNA, 16 nt, Escherichia coli CFT073
gaucaacuucgcugcg

SEQ ID NO: 584386 - RNA, 12 nt, Escherichia coli CFT073
gaucaccaccga

SEQ ID NO: 584387 - RNA, 16 nt, Escherichia coli CFT073
gaucacacggccauca

SEQ ID NO: 584388 - RNA, 15 nt, Escherichia coli CFT073
gauacucgccgaacc

SEQ ID NO: 584389 - RNA, 23 nt, Escherichia coli CFT073
gauacggcgaucguucgccaucc

SEQ ID NO: 584390 - RNA, 20 nt, Escherichia coli CFT073
gauacggcgcaaacggcgga

SEQ ID NO: 584391 - RNA, 15 nt, Escherichia coli CFT073
gauacgcgcaccgga

SEQ ID NO: 584392 - RNA, 15 nt, Escherichia coli CFT073
gauaggcaucagcaa

SEQ ID NO: 584393 - RNA, 13 nt, Escherichia coli CFT073
gauagguuucacg

SEQ ID NO: 584394 - RNA, 15 nt, Escherichia coli CFT073
gauagucgaaucagu

SEQ ID NO: 584395 - RNA, 21 nt, Escherichia coli CFT073
gauaauccagcagaugcugug

SEQ ID NO: 584396 - RNA, 18 nt, Escherichia coli CFT073
gauaaugaaccaaucagc

SEQ ID NO: 584397 - RNA, 13 nt, Escherichia coli CFT073
gauaaugacuucc

SEQ ID NO: 584398 - RNA, 16 nt, Escherichia coli CFT073
gauaauggcuuccagu

SEQ ID NO: 584399 - RNA, 17 nt, Escherichia coli CFT073
gauaaugggaauuggcg

SEQ ID NO: 584400 - RNA, 20 nt, Escherichia coli CFT073
gauaaugguuuccagcaucg

SEQ ID NO: 584401 - RNA, 16 nt, Escherichia coli CFT073
gauaauguuaaccugc

SEQ ID NO: 584402 - RNA, 16 nt, Escherichia coli CFT073
gauaaggucacgcccc

SEQ ID NO: 584403 - RNA, 14 nt, Escherichia coli CFT073
gauaaggugucaau

SEQ ID NO: 584404 - RNA, 19 nt, Escherichia coli CFT073
gauaauagguaaacauccg

SEQ ID NO: 584405 - RNA, 14 nt, Escherichia coli CFT073
gauaauaacgucgc

SEQ ID NO: 584406 - RNA, 12 nt, Escherichia coli CFT073
gauaaucaacaa

SEQ ID NO: 584407 - RNA, 16 nt, Escherichia coli CFT073
gauaaucaacgcgccg

SEQ ID NO: 584408 - RNA, 14 nt, Escherichia coli CFT073
gauaagacacgcca

SEQ ID NO: 584409 - RNA, 14 nt, Escherichia coli CFT073
gauaagacgcggca

SEQ ID NO: 584410 - RNA, 22 nt, Escherichia coli CFT073
gauaagacgcgucagcgccgca

SEQ ID NO: 584411 - RNA, 20 nt, Escherichia coli CFT073
gauaaggcguuaacgccgca

SEQ ID NO: 584412 - RNA, 19 nt, Escherichia coli CFT073
gaguucgcgcgcugccaga

SEQ ID NO: 584413 - RNA, 13 nt, Escherichia coli CFT073
gaguugcaccagc

SEQ ID NO: 584414 - RNA, 17 nt, Escherichia coli CFT073
gauaaccacuaccguag

SEQ ID NO: 584415 - RNA, 17 nt, Escherichia coli CFT073
gauaaccccagauggau

SEQ ID NO: 584416 - RNA, 20 nt, Escherichia coli CFT073
gauaaccgccgccaaacugu

SEQ ID NO: 584417 - RNA, 14 nt, Escherichia coli CFT073
gauaaccucauuaa

SEQ ID NO: 584418 - RNA, 16 nt, Escherichia coli CFT073
gauaacgaaucgggca

SEQ ID NO: 584419 - RNA, 12 nt, Escherichia coli CFT073
gauaacgcuggc

SEQ ID NO: 584420 - RNA, 17 nt, Escherichia coli CFT073
gauaacuggcaaaaaca

SEQ ID NO: 584421 - RNA, 14 nt, Escherichia coli CFT073
gaggagaguaugcg

SEQ ID NO: 584422 - RNA, 17 nt, Escherichia coli CFT073
gaggaugaucugcgccc

SEQ ID NO: 584423 - RNA, 16 nt, Escherichia coli CFT073
gaggaggcuauagcag

SEQ ID NO: 584424 - RNA, 19 nt, Escherichia coli CFT073
gagcuucuucaaaaaaguc

SEQ ID NO: 584425 - RNA, 21 nt, Escherichia coli CFT073
gagcuucaauaucaucauccg

SEQ ID NO: 584426 - RNA, 14 nt, Escherichia coli CFT073
gagcuucagcuaaa

SEQ ID NO: 584427 - RNA, 15 nt, Escherichia coli CFT073
gagcuuucuuccagg

SEQ ID NO: 584428 - RNA, 19 nt, Escherichia coli CFT073
gagcuuucuuccagguuaa

SEQ ID NO: 584429 - RNA, 19 nt, Escherichia coli CFT073
gaggaacaauccucccuua

SEQ ID NO: 584430 - RNA, 18 nt, Escherichia coli CFT073
gagcuuuauccugcccgc

SEQ ID NO: 584431 - RNA, 22 nt, Escherichia coli CFT073
gagcuuuugccaucucacuuug

SEQ ID NO: 584432 - RNA, 15 nt, Escherichia coli CFT073
gagcugccaguugcg

SEQ ID NO: 584433 - RNA, 19 nt, Escherichia coli CFT073
gagcugcccggcucauuuu

SEQ ID NO: 584434 - RNA, 20 nt, Escherichia coli CFT073
gagcugggaauuucugacga

SEQ ID NO: 584435 - RNA, 17 nt, Escherichia coli CFT073
gagguaauccagcgucg

SEQ ID NO: 584436 - RNA, 17 nt, Escherichia coli CFT073
gaguaauuuuucuuucg

SEQ ID NO: 584437 - RNA, 16 nt, Escherichia coli CFT073
gaguauuuccagcuca

SEQ ID NO: 584438 - RNA, 15 nt, Escherichia coli CFT073
gaguauauucuguaa

SEQ ID NO: 584439 - RNA, 14 nt, Escherichia coli CFT073
gaggcucaaccgcc

SEQ ID NO: 584440 - RNA, 20 nt, Escherichia coli CFT073
gaggcuccgccugauuuacu

SEQ ID NO: 584441 - RNA, 15 nt, Escherichia coli CFT073
gaggcaaaaucauca

SEQ ID NO: 584442 - RNA, 20 nt, Escherichia coli CFT073
gaggcgaaaaagucagcgua

SEQ ID NO: 584443 - RNA, 23 nt, Escherichia coli CFT073
gaccgcuuuccucaucagaaaga

SEQ ID NO: 584444 - RNA, 16 nt, Escherichia coli CFT073
gaccuccaucgcacca

SEQ ID NO: 584445 - RNA, 17 nt, Escherichia coli CFT073
gaccugcgucugaugaa

SEQ ID NO: 584446 - RNA, 17 nt, Escherichia coli CFT073
gacgacgacaggcaagc

SEQ ID NO: 584447 - RNA, 16 nt, Escherichia coli CFT073
gacgacgaccagcggc

SEQ ID NO: 584448 - RNA, 23 nt, Escherichia coli CFT073
gacgagaaaugucggcccgcauu

SEQ ID NO: 584449 - RNA, 14 nt, Escherichia coli CFT073
gaccuuccagcgcu

SEQ ID NO: 584450 - RNA, 20 nt, Escherichia coli CFT073
gacgacaugguagauaaccu

SEQ ID NO: 584451 - RNA, 14 nt, Escherichia coli CFT073
gacgaccagcggca

SEQ ID NO: 584452 - RNA, 13 nt, Escherichia coli CFT073
gacgacaggcaag

SEQ ID NO: 584453 - RNA, 23 nt, Escherichia coli CFT073
gaccgccuucguacugugcgccc

SEQ ID NO: 584454 - RNA, 22 nt, Escherichia coli CFT073
gaccgccauuaaacgcaguaaa

SEQ ID NO: 584455 - RNA, 13 nt, Escherichia coli CFT073
gaccgccagcgcc

SEQ ID NO: 584456 - RNA, 14 nt, Escherichia coli CFT073
gaccgccagcgcca

SEQ ID NO: 584457 - RNA, 13 nt, Escherichia coli CFT073
gaccgaacagcau

SEQ ID NO: 584458 - RNA, 12 nt, Escherichia coli CFT073
gaccgaacaggu

SEQ ID NO: 584459 - RNA, 20 nt, Escherichia coli CFT073
gacccguuuuucuuugcgua

SEQ ID NO: 584460 - RNA, 16 nt, Escherichia coli CFT073
gaccauuggugcuguu

SEQ ID NO: 584461 - RNA, 14 nt, Escherichia coli CFT073
gaccaccgcagcaa

SEQ ID NO: 584462 - RNA, 22 nt, Escherichia coli CFT073
gaccaaucccgccauaacggcu

SEQ ID NO: 584463 - RNA, 13 nt, Escherichia coli CFT073
gaccaauggcuuu

SEQ ID NO: 584464 - RNA, 16 nt, Escherichia coli CFT073
gaccaaucccgccaua

SEQ ID NO: 584465 - RNA, 15 nt, Escherichia coli CFT073
gacguccaaucagca

SEQ ID NO: 584466 - RNA, 15 nt, Escherichia coli CFT073
gacguccggcgcugc

SEQ ID NO: 584467 - RNA, 23 nt, Escherichia coli CFT073
gacgucgggcggaaaacuuucuu

SEQ ID NO: 584468 - RNA, 16 nt, Escherichia coli CFT073
gacgggcgucagcgca

SEQ ID NO: 584469 - RNA, 16 nt, Escherichia coli CFT073
gacgggccaagcaggc

SEQ ID NO: 584470 - RNA, 16 nt, Escherichia coli CFT073
gacggugccagguaau

SEQ ID NO: 584471 - RNA, 19 nt, Escherichia coli CFT073
gacggugauaaucauccca

SEQ ID NO: 584472 - RNA, 17 nt, Escherichia coli CFT073
gacggcgcacaggcaau

SEQ ID NO: 584473 - RNA, 15 nt, Escherichia coli CFT073
gacggcuggcaaaaa

SEQ ID NO: 584474 - RNA, 19 nt, Escherichia coli CFT073
gacggcugucauccagcag

SEQ ID NO: 584475 - RNA, 22 nt, Escherichia coli CFT073
gacggccaguuugacaucguca

SEQ ID NO: 584476 - RNA, 17 nt, Escherichia coli CFT073
gacgcguggcgucgcau

SEQ ID NO: 584477 - RNA, 13 nt, Escherichia coli CFT073
gacgcguuaagcg

SEQ ID NO: 584478 - RNA, 14 nt, Escherichia coli CFT073
gacgauacaacgcu

SEQ ID NO: 584479 - RNA, 15 nt, Escherichia coli CFT073
gacgagggauaaaga

SEQ ID NO: 584480 - RNA, 16 nt, Escherichia coli CFT073
gacgauguuaccguuu

SEQ ID NO: 584481 - RNA, 15 nt, Escherichia coli CFT073
gacgauuauuuuccg

SEQ ID NO: 584482 - RNA, 18 nt, Escherichia coli CFT073
gacgcaacagaaacgcca

SEQ ID NO: 584483 - RNA, 19 nt, Escherichia coli CFT073
gacgcggcagcgucgcauc

SEQ ID NO: 584484 - RNA, 19 nt, Escherichia coli CFT073
gacgcggcaggcgucgcau

SEQ ID NO: 584485 - RNA, 20 nt, Escherichia coli CFT073
gacgcgccgccaccgccaga

SEQ ID NO: 584486 - RNA, 22 nt, Escherichia coli CFT073
gacgcgcguccccugcccgcga

SEQ ID NO: 584487 - RNA, 15 nt, Escherichia coli CFT073
gacgcgccagcgucg

SEQ ID NO: 584488 - RNA, 19 nt, Escherichia coli CFT073
gacgccgcuggugucgcac

SEQ ID NO: 584489 - RNA, 19 nt, Escherichia coli CFT073
gacgccacuaucugauaau

SEQ ID NO: 584490 - RNA, 23 nt, Escherichia coli CFT073
gacgccagaaaaccuggcgcagu

SEQ ID NO: 584491 - RNA, 15 nt, Escherichia coli CFT073
gaauuccugacuuac

SEQ ID NO: 584492 - RNA, 17 nt, Escherichia coli CFT073
gaauugaagcuguauca

SEQ ID NO: 584493 - RNA, 21 nt, Escherichia coli CFT073
gaauugacuagcuuuucgccc

SEQ ID NO: 584494 - RNA, 22 nt, Escherichia coli CFT073
gaauugcaucuacgcucucuuc

SEQ ID NO: 584495 - RNA, 16 nt, Escherichia coli CFT073
gaauuccgaauuucau

SEQ ID NO: 584496 - RNA, 17 nt, Escherichia coli CFT073
gaauuaaacaacgccag

SEQ ID NO: 584497 - RNA, 17 nt, Escherichia coli CFT073
gaaugccucaaucagcg

SEQ ID NO: 584498 - RNA, 14 nt, Escherichia coli CFT073
gaaugccugccagc

SEQ ID NO: 584499 - RNA, 13 nt, Escherichia coli CFT073
gaaugcagcagca

SEQ ID NO: 584500 - RNA, 17 nt, Escherichia coli CFT073
gaaugccaaauccggca

SEQ ID NO: 584501 - RNA, 21 nt, Escherichia coli CFT073
gaaugccccauugcaacgugg

SEQ ID NO: 584502 - RNA, 14 nt, Escherichia coli CFT073
gaauagcucaguug

SEQ ID NO: 584503 - RNA, 18 nt, Escherichia coli CFT073
gaauaucaucacccugcg

SEQ ID NO: 584504 - RNA, 19 nt, Escherichia coli CFT073
gaauaucgaucgccgcacc

SEQ ID NO: 584505 - RNA, 15 nt, Escherichia coli CFT073
gaauaucguauccgg

SEQ ID NO: 584506 - RNA, 20 nt, Escherichia coli CFT073
gaauauguucacgaagauau

SEQ ID NO: 584507 - RNA, 19 nt, Escherichia coli CFT073
gaaguuuugucgcugauuc

SEQ ID NO: 584508 - RNA, 15 nt, Escherichia coli CFT073
gaauaaaaagcgaua

SEQ ID NO: 584509 - RNA, 19 nt, Escherichia coli CFT073
gaauaaaagaaauagcgga

SEQ ID NO: 584510 - RNA, 13 nt, Escherichia coli CFT073
gaauaaacgccau

SEQ ID NO: 584511 - RNA, 16 nt, Escherichia coli CFT073
gaaucaaccaugguuu

SEQ ID NO: 584512 - RNA, 18 nt, Escherichia coli CFT073
gaaucgccagcaucggca

SEQ ID NO: 584513 - RNA, 19 nt, Escherichia coli CFT073
gaaucgucggaauggcauc

SEQ ID NO: 584514 - RNA, 15 nt, Escherichia coli CFT073
gaaugagcgauggcg

SEQ ID NO: 584515 - RNA, 15 nt, Escherichia coli CFT073
gaaugauaugcccag

SEQ ID NO: 584516 - RNA, 15 nt, Escherichia coli CFT073
gaaucguaggccgga

SEQ ID NO: 584517 - RNA, 15 nt, Escherichia coli CFT073
gaaucgguccgccac

SEQ ID NO: 584518 - RNA, 12 nt, Escherichia coli CFT073
gaaucgccugua

SEQ ID NO: 584519 - RNA, 21 nt, Escherichia coli CFT073
gaaucgcgcguguugcgccaa

SEQ ID NO: 584520 - RNA, 13 nt, Escherichia coli CFT073
gaaggugccugcc

SEQ ID NO: 584521 - RNA, 21 nt, Escherichia coli CFT073
gaaguauggaaaucacccagc

SEQ ID NO: 584522 - RNA, 23 nt, Escherichia coli CFT073
gaagugguugagugugcacagca

SEQ ID NO: 584523 - RNA, 16 nt, Escherichia coli CFT073
gaaguuagagccgaua

SEQ ID NO: 584524 - RNA, 22 nt, Escherichia coli CFT073
gaaguuagagccgauauccgga

SEQ ID NO: 584525 - RNA, 16 nt, Escherichia coli CFT073
gaaguucgguaggccg

SEQ ID NO: 584526 - RNA, 20 nt, Escherichia coli CFT073
gaagugagggccagcguuuu

SEQ ID NO: 584527 - RNA, 22 nt, Escherichia coli CFT073
gaagguaaaaguagggcgcugc

SEQ ID NO: 584528 - RNA, 20 nt, Escherichia coli CFT073
gaagguaagcaacagaugga

SEQ ID NO: 584529 - RNA, 19 nt, Escherichia coli CFT073
gaagguauacugcaaauau

SEQ ID NO: 584530 - RNA, 23 nt, Escherichia coli CFT073
gaaggguaaacacccaggccauc

SEQ ID NO: 584531 - RNA, 21 nt, Escherichia coli CFT073
gaagggaucuuccaguucuuc

SEQ ID NO: 584532 - RNA, 21 nt, Escherichia coli CFT073
gaaguaaccgcauccggcgca

SEQ ID NO: 584533 - RNA, 20 nt, Escherichia coli CFT073
gaagguuuuuucuguauuca

SEQ ID NO: 584534 - RNA, 14 nt, Escherichia coli CFT073
gaagguucgaaucc

SEQ ID NO: 584535 - RNA, 21 nt, Escherichia coli CFT073
gaaggugaacgccaccaacgc

SEQ ID NO: 584536 - RNA, 17 nt, Escherichia coli CFT073
gaaggugauucccagca

SEQ ID NO: 584537 - RNA, 17 nt, Escherichia coli CFT073
gacaaacugccgacaau

SEQ ID NO: 584538 - RNA, 13 nt, Escherichia coli CFT073
gacaaacugcgug

SEQ ID NO: 584539 - RNA, 23 nt, Escherichia coli CFT073
gacaaacgcaaaauugccugaug

SEQ ID NO: 584540 - RNA, 13 nt, Escherichia coli CFT073
gacaaaugucaga

SEQ ID NO: 584541 - RNA, 21 nt, Escherichia coli CFT073
gaauugucccauuugccagcg

SEQ ID NO: 584542 - RNA, 17 nt, Escherichia coli CFT073
gacaaacuaaccagacg

SEQ ID NO: 584543 - RNA, 20 nt, Escherichia coli CFT073
gacaacagucaaccgccuga

SEQ ID NO: 584544 - RNA, 20 nt, Escherichia coli CFT073
gacaacaaacgcaaacacca

SEQ ID NO: 584545 - RNA, 14 nt, Escherichia coli CFT073
gacacgcaacggcu

SEQ ID NO: 584546 - RNA, 15 nt, Escherichia coli CFT073
gacagccauccccac

SEQ ID NO: 584547 - RNA, 18 nt, Escherichia coli CFT073
gacagaguguucgccauu

SEQ ID NO: 584548 - RNA, 21 nt, Escherichia coli CFT073
gacagaaaaccaaaaccggcu

SEQ ID NO: 584549 - RNA, 13 nt, Escherichia coli CFT073
gacagaaucagca

SEQ ID NO: 584550 - RNA, 23 nt, Escherichia coli CFT073
gacagacagccucaagcacccgc

SEQ ID NO: 584551 - RNA, 15 nt, Escherichia coli CFT073
gacagacgccagcgc

SEQ ID NO: 584552 - RNA, 17 nt, Escherichia coli CFT073
gacagacgccagcgcuu

SEQ ID NO: 584553 - RNA, 15 nt, Escherichia coli CFT073
gacacuuucagcgca

SEQ ID NO: 584554 - RNA, 15 nt, Escherichia coli CFT073
gacacugucaccuuu

SEQ ID NO: 584555 - RNA, 13 nt, Escherichia coli CFT073
gacacugccgccg

SEQ ID NO: 584556 - RNA, 21 nt, Escherichia coli CFT073
gacacugcgaucgcccgcaau

SEQ ID NO: 584557 - RNA, 18 nt, Escherichia coli CFT073
gacacuauucgccagcac

SEQ ID NO: 584558 - RNA, 14 nt, Escherichia coli CFT073
gacacgccgccaga

SEQ ID NO: 584559 - RNA, 15 nt, Escherichia coli CFT073
gacauuucugcugcc

SEQ ID NO: 584560 - RNA, 23 nt, Escherichia coli CFT073
gaccaaaacucgcuggcggcugg

SEQ ID NO: 584561 - RNA, 16 nt, Escherichia coli CFT073
gacauugaccagugca

SEQ ID NO: 584562 - RNA, 15 nt, Escherichia coli CFT073
gaccaaacugaacgu

SEQ ID NO: 584563 - RNA, 15 nt, Escherichia coli CFT073
gaccaauaaacgcca

SEQ ID NO: 584564 - RNA, 15 nt, Escherichia coli CFT073
gaccaauaacccguu

SEQ ID NO: 584565 - RNA, 21 nt, Escherichia coli CFT073
gaccaauacgugaacgggugg

SEQ ID NO: 584566 - RNA, 13 nt, Escherichia coli CFT073
gaccaauagaaag

SEQ ID NO: 584567 - RNA, 20 nt, Escherichia coli CFT073
gacaucuucucuacccgcuc

SEQ ID NO: 584568 - RNA, 18 nt, Escherichia coli CFT073
gacaugcaguugauuaca

SEQ ID NO: 584569 - RNA, 14 nt, Escherichia coli CFT073
gacauuaaagcuuu

SEQ ID NO: 584570 - RNA, 18 nt, Escherichia coli CFT073
gacauuaucaccgacaaa

SEQ ID NO: 584571 - RNA, 17 nt, Escherichia coli CFT073
gacaucaacgccugaug

SEQ ID NO: 584572 - RNA, 21 nt, Escherichia coli CFT073
gacaucaagaaaugcauguuc

SEQ ID NO: 584573 - RNA, 17 nt, Escherichia coli CFT073
gacaucaccaguaccgc

SEQ ID NO: 584574 - RNA, 20 nt, Escherichia coli CFT073
gacagugcauaaauaccggc

SEQ ID NO: 584575 - RNA, 14 nt, Escherichia coli CFT073
gacagugucuggcg

SEQ ID NO: 584576 - RNA, 16 nt, Escherichia coli CFT073
gacauaaacaccagca

SEQ ID NO: 584577 - RNA, 19 nt, Escherichia coli CFT073
gacauaaaucauuccguag

SEQ ID NO: 584578 - RNA, 15 nt, Escherichia coli CFT073
gacauacagcguuuu

SEQ ID NO: 584579 - RNA, 15 nt, Escherichia coli CFT073
gacagcucacgcgcc

SEQ ID NO: 584580 - RNA, 17 nt, Escherichia coli CFT073
gacagcggugauuuccg

SEQ ID NO: 584581 - RNA, 18 nt, Escherichia coli CFT073
gacagccccaccagcaaa

SEQ ID NO: 584582 - RNA, 19 nt, Escherichia coli CFT073
gaaaccgucuucccgcagc

SEQ ID NO: 584583 - RNA, 20 nt, Escherichia coli CFT073
gaaaccgucuucccgcagcc

SEQ ID NO: 584584 - RNA, 16 nt, Escherichia coli CFT073
gaaaccuuuaugcagc

SEQ ID NO: 584585 - RNA, 21 nt, Escherichia coli CFT073
gaaacgagccauaaaaucaca

SEQ ID NO: 584586 - RNA, 17 nt, Escherichia coli CFT073
gaaacgcuuaaagcguu

SEQ ID NO: 584587 - RNA, 20 nt, Escherichia coli CFT073
gaaacgcgucugaccgucuu

SEQ ID NO: 584588 - RNA, 12 nt, Escherichia coli CFT073
gaaacgccaucu

SEQ ID NO: 584589 - RNA, 21 nt, Escherichia coli CFT073
gaaacgccaucugaauaaacg

SEQ ID NO: 584590 - RNA, 21 nt, Escherichia coli CFT073
gaaacgccccuaaauaaacac

SEQ ID NO: 584591 - RNA, 20 nt, Escherichia coli CFT073
gaaacgguuaaucuguugaa

SEQ ID NO: 584592 - RNA, 16 nt, Escherichia coli CFT073
gaacgcaccgaccauc

SEQ ID NO: 584593 - RNA, 15 nt, Escherichia coli CFT073
gaacgguaggccgga

SEQ ID NO: 584594 - RNA, 16 nt, Escherichia coli CFT073
gaacgggauugccagc

SEQ ID NO: 584595 - RNA, 23 nt, Escherichia coli CFT073
gaagacaauccccgccagcguug

SEQ ID NO: 584596 - RNA, 17 nt, Escherichia coli CFT073
gaagaauacgccccaga

SEQ ID NO: 584597 - RNA, 15 nt, Escherichia coli CFT073
gaagacguagcaagc

SEQ ID NO: 584598 - RNA, 23 nt, Escherichia coli CFT073
gaagacgaagauuuuaccgucac

SEQ ID NO: 584599 - RNA, 17 nt, Escherichia coli CFT073
gaagaucuucagucuug

SEQ ID NO: 584600 - RNA, 22 nt, Escherichia coli CFT073
gaagaucaccacauucagcagc

SEQ ID NO: 584601 - RNA, 23 nt, Escherichia coli CFT073
gaagaaaaugguuugccagcaga

SEQ ID NO: 584602 - RNA, 19 nt, Escherichia coli CFT073
gaagaaacgagcguacuga

SEQ ID NO: 584603 - RNA, 18 nt, Escherichia coli CFT073
gaacuuaagcgccugaua

SEQ ID NO: 584604 - RNA, 19 nt, Escherichia coli CFT073
gaacuuaguaggccugaua

SEQ ID NO: 584605 - RNA, 22 nt, Escherichia coli CFT073
gaacuuaucgauuaccgccagc

SEQ ID NO: 584606 - RNA, 12 nt, Escherichia coli CFT073
gaagaaaaaaug

SEQ ID NO: 584607 - RNA, 23 nt, Escherichia coli CFT073
gaagcgcgaucaguugcucggca

SEQ ID NO: 584608 - RNA, 13 nt, Escherichia coli CFT073
gaagcugaacagu

SEQ ID NO: 584609 - RNA, 19 nt, Escherichia coli CFT073
gaagcuuuucgggaacacg

SEQ ID NO: 584610 - RNA, 16 nt, Escherichia coli CFT073
gaaggaagacguagca

SEQ ID NO: 584611 - RNA, 20 nt, Escherichia coli CFT073
gaagcgaguuaccacgccuu

SEQ ID NO: 584612 - RNA, 18 nt, Escherichia coli CFT073
gaagauuuuuugccagca

SEQ ID NO: 584613 - RNA, 18 nt, Escherichia coli CFT073
gaagcaaaccaggccggu

SEQ ID NO: 584614 - RNA, 13 nt, Escherichia coli CFT073
gaagcaaccggug

SEQ ID NO: 584615 - RNA, 20 nt, Escherichia coli CFT073
gaagcaauccauaccagcac

SEQ ID NO: 584616 - RNA, 22 nt, Escherichia coli CFT073
gaagcagaaugaaugauacaga

SEQ ID NO: 584617 - RNA, 20 nt, Escherichia coli CFT073
gaagcauaaccgagcagaua

SEQ ID NO: 584618 - RNA, 23 nt, Escherichia coli CFT073
gaagcagcaucagcaaauagaua

SEQ ID NO: 584619 - RNA, 22 nt, Escherichia coli CFT073
gaagccaaccgggccgcagaga

SEQ ID NO: 584620 - RNA, 23 nt, Escherichia coli CFT073
gaagcccacaccgcccagcgagc

SEQ ID NO: 584621 - RNA, 20 nt, Escherichia coli CFT073
gaagccgaacagucgcugau

SEQ ID NO: 584622 - RNA, 18 nt, Escherichia coli CFT073
gaagcccaguaccgccag

SEQ ID NO: 584623 - RNA, 14 nt, Escherichia coli CFT073
gaagcccgcccagc

SEQ ID NO: 584624 - RNA, 12 nt, Escherichia coli CFT073
gaagccccagcu

SEQ ID NO: 584625 - RNA, 14 nt, Escherichia coli CFT073
gaaaaacggaauga

SEQ ID NO: 584626 - RNA, 12 nt, Escherichia coli CFT073
gaaaaccauaau

SEQ ID NO: 584627 - RNA, 16 nt, Escherichia coli CFT073
gaaaacaucaugguuu

SEQ ID NO: 584628 - RNA, 20 nt, Escherichia coli CFT073
gaaaaaugguuugcccugcc

SEQ ID NO: 584629 - RNA, 22 nt, Escherichia coli CFT073
gaaaaauucaggggaagccaga

SEQ ID NO: 584630 - RNA, 22 nt, Escherichia coli CFT073
gaaaaagauauguugcgggagg

SEQ ID NO: 584631 - RNA, 13 nt, Escherichia coli CFT073
cuuuguaagcagg

SEQ ID NO: 584632 - RNA, 16 nt, Escherichia coli CFT073
cuuuguaggccagaua

SEQ ID NO: 584633 - RNA, 16 nt, Escherichia coli CFT073
cuuuguaggccggaua

SEQ ID NO: 584634 - RNA, 16 nt, Escherichia coli CFT073
cuuuguaggccugaua

SEQ ID NO: 584635 - RNA, 15 nt, Escherichia coli CFT073
cuuuuaaauccugca

SEQ ID NO: 584636 - RNA, 15 nt, Escherichia coli CFT073
cuuuuuuucauugga

SEQ ID NO: 584637 - RNA, 22 nt, Escherichia coli CFT073
gaaaaaccguauucaucgccau

SEQ ID NO: 584638 - RNA, 15 nt, Escherichia coli CFT073
gaaaaaccuaauacu

SEQ ID NO: 584639 - RNA, 20 nt, Escherichia coli CFT073
gaaaaaccugacgcugcuca

SEQ ID NO: 584640 - RNA, 14 nt, Escherichia coli CFT073
gaaaccauugcagc

SEQ ID NO: 584641 - RNA, 14 nt, Escherichia coli CFT073
gaaacccaacgcaa

SEQ ID NO: 584642 - RNA, 14 nt, Escherichia coli CFT073
gaaacccacgacca

SEQ ID NO: 584643 - RNA, 22 nt, Escherichia coli CFT073
gaaaccaagaccaauccgccag

SEQ ID NO: 584644 - RNA, 16 nt, Escherichia coli CFT073
gaaacauccggcaacc

SEQ ID NO: 584645 - RNA, 16 nt, Escherichia coli CFT073
gaaaccaaacuuaugc

SEQ ID NO: 584646 - RNA, 20 nt, Escherichia coli CFT073
gaaaccgguuuguaggccgg

SEQ ID NO: 584647 - RNA, 23 nt, Escherichia coli CFT073
gaaaccgguuuguaggccggaua

SEQ ID NO: 584648 - RNA, 22 nt, Escherichia coli CFT073
gaaaauccaucccaaugcggcg

SEQ ID NO: 584649 - RNA, 20 nt, Escherichia coli CFT073
gaaaaucgccggaugcggca

SEQ ID NO: 584650 - RNA, 23 nt, Escherichia coli CFT073
gaaaaucgccggaugcggcaggc

SEQ ID NO: 584651 - RNA, 17 nt, Escherichia coli CFT073
gaaaaucucacgcagga

SEQ ID NO: 584652 - RNA, 15 nt, Escherichia coli CFT073
gaaaaugagcguaua

SEQ ID NO: 584653 - RNA, 18 nt, Escherichia coli CFT073
gaaaauaauccgcuguaa

SEQ ID NO: 584654 - RNA, 16 nt, Escherichia coli CFT073
gaaaauacacgcugca

SEQ ID NO: 584655 - RNA, 21 nt, Escherichia coli CFT073
gaaaagguuaaaccgccaguc

SEQ ID NO: 584656 - RNA, 22 nt, Escherichia coli CFT073
gaaaagguuaaaccgccaguca

SEQ ID NO: 584657 - RNA, 17 nt, Escherichia coli CFT073
cuuuccguuuucacccu

SEQ ID NO: 584658 - RNA, 20 nt, Escherichia coli CFT073
cuuucgacagcgauuccagu

SEQ ID NO: 584659 - RNA, 23 nt, Escherichia coli CFT073
cuuucgauugcacaaagguuucg

SEQ ID NO: 584660 - RNA, 16 nt, Escherichia coli CFT073
cuuucgcaauaaucau

SEQ ID NO: 584661 - RNA, 23 nt, Escherichia coli CFT073
cuuucgcuuucucuucggcuucu

SEQ ID NO: 584662 - RNA, 20 nt, Escherichia coli CFT073
cuuucggguggccagcaaca

SEQ ID NO: 584663 - RNA, 15 nt, Escherichia coli CFT073
cuuucggugacuuca

SEQ ID NO: 584664 - RNA, 17 nt, Escherichia coli CFT073
cuuucguaggccugaua

SEQ ID NO: 584665 - RNA, 15 nt, Escherichia coli CFT073
cuuucuccggcagcu

SEQ ID NO: 584666 - RNA, 17 nt, Escherichia coli CFT073
cuuucucuggcuguuuc

SEQ ID NO: 584667 - RNA, 14 nt, Escherichia coli CFT073
cuuucucuucuagu

SEQ ID NO: 584668 - RNA, 16 nt, Escherichia coli CFT073
cuuucugauaaccgua

SEQ ID NO: 584669 - RNA, 21 nt, Escherichia coli CFT073
cuuugcccggcaacggauuua

SEQ ID NO: 584670 - RNA, 23 nt, Escherichia coli CFT073
cuuugccaggucgcuugccgcca

SEQ ID NO: 584671 - RNA, 21 nt, Escherichia coli CFT073
cuuuggcggccuucuuccagu

SEQ ID NO: 584672 - RNA, 21 nt, Escherichia coli CFT073
cuuugcgcccccgauccagcg

SEQ ID NO: 584673 - RNA, 13 nt, Escherichia coli CFT073
cuuugaucgccgc

SEQ ID NO: 584674 - RNA, 13 nt, Escherichia coli CFT073
cuuugauauucau

SEQ ID NO: 584675 - RNA, 15 nt, Escherichia coli CFT073
cuuuccauucuuucc

SEQ ID NO: 584676 - RNA, 23 nt, Escherichia coli CFT073
cuuuccagacccuuauuuaacau

SEQ ID NO: 584677 - RNA, 21 nt, Escherichia coli CFT073
cuuuccagagagacauuggca

SEQ ID NO: 584678 - RNA, 20 nt, Escherichia coli CFT073
cuuucagggcgucaauuugc

SEQ ID NO: 584679 - RNA, 21 nt, Escherichia coli CFT073
cuuucauacugccgaccaucu

SEQ ID NO: 584680 - RNA, 19 nt, Escherichia coli CFT073
cuuucauauaagcguccca

SEQ ID NO: 584681 - RNA, 16 nt, Escherichia coli CFT073
cuuucaguucaacggu

SEQ ID NO: 584682 - RNA, 23 nt, Escherichia coli CFT073
cuuucagcaccagcccgacgaua

SEQ ID NO: 584683 - RNA, 17 nt, Escherichia coli CFT073
cuuucagccacuucauu

SEQ ID NO: 584684 - RNA, 17 nt, Escherichia coli CFT073
cuuucagcguuaauuca

SEQ ID NO: 584685 - RNA, 23 nt, Escherichia coli CFT073
cuuucaccagaauagcggcuuca

SEQ ID NO: 584686 - RNA, 18 nt, Escherichia coli CFT073
cuuucacuacaaucaggc

SEQ ID NO: 584687 - RNA, 13 nt, Escherichia coli CFT073
cuuucacuuccgu

SEQ ID NO: 584688 - RNA, 14 nt, Escherichia coli CFT073
cuugcggcguauau

SEQ ID NO: 584689 - RNA, 22 nt, Escherichia coli CFT073
cuugcggucaggugcccgcguu

SEQ ID NO: 584690 - RNA, 13 nt, Escherichia coli CFT073
cuugccaggccga

SEQ ID NO: 584691 - RNA, 22 nt, Escherichia coli CFT073
cuuggcaaagcugucaccaauc

SEQ ID NO: 584692 - RNA, 21 nt, Escherichia coli CFT073
cuugagacagaaacaaaugaa

SEQ ID NO: 584693 - RNA, 19 nt, Escherichia coli CFT073
cuugaguaccgagaaaauc

SEQ ID NO: 584694 - RNA, 20 nt, Escherichia coli CFT073
cuugaggccauccgcaucac

SEQ ID NO: 584695 - RNA, 17 nt, Escherichia coli CFT073
cuugauuauccucugua

SEQ ID NO: 584696 - RNA, 22 nt, Escherichia coli CFT073
cuugauccugcagugcguaagc

SEQ ID NO: 584697 - RNA, 14 nt, Escherichia coli CFT073
cuugcaaaggcugu

SEQ ID NO: 584698 - RNA, 22 nt, Escherichia coli CFT073
cuugcaggaucagcuccggcag

SEQ ID NO: 584699 - RNA, 19 nt, Escherichia coli CFT073
cuugccagguagcguuuca

SEQ ID NO: 584700 - RNA, 13 nt, Escherichia coli CFT073
cuucacacugacg

SEQ ID NO: 584701 - RNA, 19 nt, Escherichia coli CFT073
cuucacacugaugacaggc

SEQ ID NO: 584702 - RNA, 12 nt, Escherichia coli CFT073
cuucacagacau

SEQ ID NO: 584703 - RNA, 17 nt, Escherichia coli CFT073
cuucacagacauccuga

SEQ ID NO: 584704 - RNA, 13 nt, Escherichia coli CFT073
cuucauucauccg

SEQ ID NO: 584705 - RNA, 16 nt, Escherichia coli CFT073
cuucauuugcggguuc

SEQ ID NO: 584706 - RNA, 18 nt, Escherichia coli CFT073
cuucaccauaaaacgcgc

SEQ ID NO: 584707 - RNA, 17 nt, Escherichia coli CFT073
cuucacccgcagcacgg

SEQ ID NO: 584708 - RNA, 18 nt, Escherichia coli CFT073
cuucauguugcagaugcu

SEQ ID NO: 584709 - RNA, 17 nt, Escherichia coli CFT073
cuucccgauaagggagc

SEQ ID NO: 584710 - RNA, 23 nt, Escherichia coli CFT073
cuuccacggcguggucguuggug

SEQ ID NO: 584711 - RNA, 18 nt, Escherichia coli CFT073
cuuccagccaugccacgc

SEQ ID NO: 584712 - RNA, 20 nt, Escherichia coli CFT073
cuucgccaaugaucccgcca

SEQ ID NO: 584713 - RNA, 15 nt, Escherichia coli CFT073
cuucgccacagcggc

SEQ ID NO: 584714 - RNA, 17 nt, Escherichia coli CFT073
cuucgccacagcggcau

SEQ ID NO: 584715 - RNA, 14 nt, Escherichia coli CFT073
cuucgccagacguu

SEQ ID NO: 584716 - RNA, 17 nt, Escherichia coli CFT073
cuucgcaucccgguauc

SEQ ID NO: 584717 - RNA, 22 nt, Escherichia coli CFT073
cuucgacuuucaguggcuuauc

SEQ ID NO: 584718 - RNA, 19 nt, Escherichia coli CFT073
cuucgagaauaucuucgac

SEQ ID NO: 584719 - RNA, 17 nt, Escherichia coli CFT073
cuuccggaaccaccaga

SEQ ID NO: 584720 - RNA, 14 nt, Escherichia coli CFT073
cuucuguuaaauca

SEQ ID NO: 584721 - RNA, 16 nt, Escherichia coli CFT073
cuucuguuaaaucauc

SEQ ID NO: 584722 - RNA, 15 nt, Escherichia coli CFT073
cuucuggcaccagua

SEQ ID NO: 584723 - RNA, 16 nt, Escherichia coli CFT073
cuucugaccgggauuu

SEQ ID NO: 584724 - RNA, 23 nt, Escherichia coli CFT073
cuucugaccgggauuuucaacau

SEQ ID NO: 584725 - RNA, 23 nt, Escherichia coli CFT073
cuucugauaaccggauggcgcga

SEQ ID NO: 584726 - RNA, 16 nt, Escherichia coli CFT073
cuucugaagcaaacuu

SEQ ID NO: 584727 - RNA, 17 nt, Escherichia coli CFT073
cuucugccaauuuuucg

SEQ ID NO: 584728 - RNA, 20 nt, Escherichia coli CFT073
cuucugccacgguaugaccc

SEQ ID NO: 584729 - RNA, 16 nt, Escherichia coli CFT073
cuucuugcgcaaaccu

SEQ ID NO: 584730 - RNA, 16 nt, Escherichia coli CFT073
cuucuucggucgcuuc

SEQ ID NO: 584731 - RNA, 14 nt, Escherichia coli CFT073
cuucuucuuccagg

SEQ ID NO: 584732 - RNA, 12 nt, Escherichia coli CFT073
cuucuuccgcgc

SEQ ID NO: 584733 - RNA, 12 nt, Escherichia coli CFT073
cuucuucaguuu

SEQ ID NO: 584734 - RNA, 12 nt, Escherichia coli CFT073
cuucuuccagca

SEQ ID NO: 584735 - RNA, 16 nt, Escherichia coli CFT073
cuucuuccagcggcag

SEQ ID NO: 584736 - RNA, 23 nt, Escherichia coli CFT073
cuucucaagauuggagcgugaua

SEQ ID NO: 584737 - RNA, 15 nt, Escherichia coli CFT073
cuucucacggaucca

SEQ ID NO: 584738 - RNA, 17 nt, Escherichia coli CFT073
cuucucaucuuucagaa

SEQ ID NO: 584739 - RNA, 17 nt, Escherichia coli CFT073
cuucuaccuuauccagc

SEQ ID NO: 584740 - RNA, 18 nt, Escherichia coli CFT073
cuucgggcgcuuccagcc

SEQ ID NO: 584741 - RNA, 11 nt, Escherichia coli CFT073
cuucgguaaau

SEQ ID NO: 584742 - RNA, 20 nt, Escherichia coli CFT073
cuucgcccugcgucgcacuc

SEQ ID NO: 584743 - RNA, 11 nt, Escherichia coli CFT073
cuucgccaggu

SEQ ID NO: 584744 - RNA, 17 nt, Escherichia coli CFT073
cuguauuuggcugccga

SEQ ID NO: 584745 - RNA, 13 nt, Escherichia coli CFT073
cugucaacaccag

SEQ ID NO: 584746 - RNA, 13 nt, Escherichia coli CFT073
cuguccugcggcg

SEQ ID NO: 584747 - RNA, 12 nt, Escherichia coli CFT073
cugugauugcgc

SEQ ID NO: 584748 - RNA, 19 nt, Escherichia coli CFT073
cugugcaaccuuuuccauu

SEQ ID NO: 584749 - RNA, 22 nt, Escherichia coli CFT073
cugugcguuacccacaguuuca

SEQ ID NO: 584750 - RNA, 21 nt, Escherichia coli CFT073
cugugcuuguaaaacagccaa

SEQ ID NO: 584751 - RNA, 14 nt, Escherichia coli CFT073
cugugaauuacugc

SEQ ID NO: 584752 - RNA, 21 nt, Escherichia coli CFT073
cugugaauuacugcugcggaa

SEQ ID NO: 584753 - RNA, 16 nt, Escherichia coli CFT073
cuguguaggccggaua

SEQ ID NO: 584754 - RNA, 21 nt, Escherichia coli CFT073
cugugucgccgagccuuccau

SEQ ID NO: 584755 - RNA, 19 nt, Escherichia coli CFT073
cugugucucuucuuugcug

SEQ ID NO: 584756 - RNA, 17 nt, Escherichia coli CFT073
cuguguuuaugccggau

SEQ ID NO: 584757 - RNA, 16 nt, Escherichia coli CFT073
cugugguacugccgac

SEQ ID NO: 584758 - RNA, 14 nt, Escherichia coli CFT073
cuucaauaccaccc

SEQ ID NO: 584759 - RNA, 19 nt, Escherichia coli CFT073
cuucaaguguggccgccag

SEQ ID NO: 584760 - RNA, 14 nt, Escherichia coli CFT073
cuucaaauaaacgu

SEQ ID NO: 584761 - RNA, 13 nt, Escherichia coli CFT073
cuucaaauauuga

SEQ ID NO: 584762 - RNA, 13 nt, Escherichia coli CFT073
cuucaacagcggc

SEQ ID NO: 584763 - RNA, 16 nt, Escherichia coli CFT073
cuucaacauuaaagca

SEQ ID NO: 584764 - RNA, 20 nt, Escherichia coli CFT073
cuucaaccaccucaguaccc

SEQ ID NO: 584765 - RNA, 20 nt, Escherichia coli CFT073
cuucaaccagcggcgcaucc

SEQ ID NO: 584766 - RNA, 15 nt, Escherichia coli CFT073
cuuacguccgccguu

SEQ ID NO: 584767 - RNA, 16 nt, Escherichia coli CFT073
cuuacguuacccagca

SEQ ID NO: 584768 - RNA, 16 nt, Escherichia coli CFT073
cuuauccggccuacaa

SEQ ID NO: 584769 - RNA, 16 nt, Escherichia coli CFT073
cuuaucuggccuacaa

SEQ ID NO: 584770 - RNA, 13 nt, Escherichia coli CFT073
cuuaucuuccugu

SEQ ID NO: 584771 - RNA, 17 nt, Escherichia coli CFT073
cuuauggcguacugaag

SEQ ID NO: 584772 - RNA, 14 nt, Escherichia coli CFT073
cuuauugccggaug

SEQ ID NO: 584773 - RNA, 18 nt, Escherichia coli CFT073
cuuauugccggaugcggc

SEQ ID NO: 584774 - RNA, 17 nt, Escherichia coli CFT073
cuuauugcuucaagaug

SEQ ID NO: 584775 - RNA, 19 nt, Escherichia coli CFT073
cuuaauugcaccucagcau

SEQ ID NO: 584776 - RNA, 13 nt, Escherichia coli CFT073
cuuaacuacugcu

SEQ ID NO: 584777 - RNA, 14 nt, Escherichia coli CFT073
cuuaccaaccgcaa

SEQ ID NO: 584778 - RNA, 17 nt, Escherichia coli CFT073
cuuaccuaccugcucaa

SEQ ID NO: 584779 - RNA, 14 nt, Escherichia coli CFT073
cuuaccuucacgaa

SEQ ID NO: 584780 - RNA, 17 nt, Escherichia coli CFT073
cuuacgaaguuccugca

SEQ ID NO: 584781 - RNA, 20 nt, Escherichia coli CFT073
cuguuguuccagcuuccagg

SEQ ID NO: 584782 - RNA, 23 nt, Escherichia coli CFT073
cuguuacucauaaguuucccagc

SEQ ID NO: 584783 - RNA, 15 nt, Escherichia coli CFT073
cuguugugaugcaac

SEQ ID NO: 584784 - RNA, 15 nt, Escherichia coli CFT073
cuguuuaccggugcc

SEQ ID NO: 584785 - RNA, 13 nt, Escherichia coli CFT073
cuguuuagccgcu

SEQ ID NO: 584786 - RNA, 17 nt, Escherichia coli CFT073
cuguuguggguaacguu

SEQ ID NO: 584787 - RNA, 19 nt, Escherichia coli CFT073
cuguuucgcggcaaacugc

SEQ ID NO: 584788 - RNA, 15 nt, Escherichia coli CFT073
cuguuucgcuucuuc

SEQ ID NO: 584789 - RNA, 22 nt, Escherichia coli CFT073
cuguuucgcuucuucagccugc

SEQ ID NO: 584790 - RNA, 21 nt, Escherichia coli CFT073
cuuaacgcaccaugcacggac

SEQ ID NO: 584791 - RNA, 16 nt, Escherichia coli CFT073
cuggauuucaauaucg

SEQ ID NO: 584792 - RNA, 22 nt, Escherichia coli CFT073
cuggcaaaaacaaggaucgcga

SEQ ID NO: 584793 - RNA, 18 nt, Escherichia coli CFT073
cuggcaaucgccagcggc

SEQ ID NO: 584794 - RNA, 21 nt, Escherichia coli CFT073
cuggcaccgcagauaagacca

SEQ ID NO: 584795 - RNA, 17 nt, Escherichia coli CFT073
cuggcaccgcaucaaag

SEQ ID NO: 584796 - RNA, 23 nt, Escherichia coli CFT073
cuggcaauuaacgcacaaccagc

SEQ ID NO: 584797 - RNA, 23 nt, Escherichia coli CFT073
cuggcaaaucaaaucacgauggc

SEQ ID NO: 584798 - RNA, 15 nt, Escherichia coli CFT073
cuggcaagaaacgcu

SEQ ID NO: 584799 - RNA, 16 nt, Escherichia coli CFT073
cuggccaauuggcugg

SEQ ID NO: 584800 - RNA, 18 nt, Escherichia coli CFT073
cuggcauuuuugucgcgc

SEQ ID NO: 584801 - RNA, 20 nt, Escherichia coli CFT073
cuggcauuuuugucgcgcug

SEQ ID NO: 584802 - RNA, 19 nt, Escherichia coli CFT073
cuggccaguucggauguga

SEQ ID NO: 584803 - RNA, 17 nt, Escherichia coli CFT073
cuggcaugaauggucau

SEQ ID NO: 584804 - RNA, 23 nt, Escherichia coli CFT073
cuggcaguucccuacucucgcau

SEQ ID NO: 584805 - RNA, 18 nt, Escherichia coli CFT073
cuggaagugaucuuucag

SEQ ID NO: 584806 - RNA, 18 nt, Escherichia coli CFT073
cuggacaucgucugcggu

SEQ ID NO: 584807 - RNA, 16 nt, Escherichia coli CFT073
cuggaacgggaagaaa

SEQ ID NO: 584808 - RNA, 15 nt, Escherichia coli CFT073
cuggaaccacagcgc

SEQ ID NO: 584809 - RNA, 18 nt, Escherichia coli CFT073
cuggaaccacagcgccgu

SEQ ID NO: 584810 - RNA, 15 nt, Escherichia coli CFT073
cugcuucauguugca

SEQ ID NO: 584811 - RNA, 18 nt, Escherichia coli CFT073
cugcuuacauaguucuuc

SEQ ID NO: 584812 - RNA, 14 nt, Escherichia coli CFT073
cugcugugugaucc

SEQ ID NO: 584813 - RNA, 21 nt, Escherichia coli CFT073
cugcuggguauagcgcaucac

SEQ ID NO: 584814 - RNA, 23 nt, Escherichia coli CFT073
cugcugcgucgcggccuguucca

SEQ ID NO: 584815 - RNA, 18 nt, Escherichia coli CFT073
cuggcuccuguuugcauu

SEQ ID NO: 584816 - RNA, 20 nt, Escherichia coli CFT073
cuggcugacauaaacaccag

SEQ ID NO: 584817 - RNA, 22 nt, Escherichia coli CFT073
cuggcugacauaaacaccagca

SEQ ID NO: 584818 - RNA, 22 nt, Escherichia coli CFT073
cuggcguuacccuuguggauaa

SEQ ID NO: 584819 - RNA, 17 nt, Escherichia coli CFT073
cuggcguaucuccagua

SEQ ID NO: 584820 - RNA, 22 nt, Escherichia coli CFT073
cuggcggaucugaucagcacga

SEQ ID NO: 584821 - RNA, 22 nt, Escherichia coli CFT073
cuggcggcaaaccuuucgccac

SEQ ID NO: 584822 - RNA, 14 nt, Escherichia coli CFT073
cuggcgcugcucag

SEQ ID NO: 584823 - RNA, 13 nt, Escherichia coli CFT073
cuggcgcggcgca

SEQ ID NO: 584824 - RNA, 15 nt, Escherichia coli CFT073
cuggcuggcaaccca

SEQ ID NO: 584825 - RNA, 16 nt, Escherichia coli CFT073
cuggcuggcaacccag

SEQ ID NO: 584826 - RNA, 14 nt, Escherichia coli CFT073
cuggcugcuccaga

SEQ ID NO: 584827 - RNA, 16 nt, Escherichia coli CFT073
cuggcugaugcuggca

SEQ ID NO: 584828 - RNA, 22 nt, Escherichia coli CFT073
cuggcugauuaacguuuccauu

SEQ ID NO: 584829 - RNA, 21 nt, Escherichia coli CFT073
cuggguagaguuugaacucac

SEQ ID NO: 584830 - RNA, 20 nt, Escherichia coli CFT073
cugguaguuguacaacugcu

SEQ ID NO: 584831 - RNA, 15 nt, Escherichia coli CFT073
cugguaggccugaua

SEQ ID NO: 584832 - RNA, 15 nt, Escherichia coli CFT073
cuggucacugacgac

SEQ ID NO: 584833 - RNA, 19 nt, Escherichia coli CFT073
cuggucagcaucgucaacg

SEQ ID NO: 584834 - RNA, 21 nt, Escherichia coli CFT073
cugguauucgcuaaucgguac

SEQ ID NO: 584835 - RNA, 16 nt, Escherichia coli CFT073
cuggucaaagacaaua

SEQ ID NO: 584836 - RNA, 14 nt, Escherichia coli CFT073
cugcugaauuuccu

SEQ ID NO: 584837 - RNA, 15 nt, Escherichia coli CFT073
cugcucuuucagcac

SEQ ID NO: 584838 - RNA, 12 nt, Escherichia coli CFT073
cugcucuucggg

SEQ ID NO: 584839 - RNA, 18 nt, Escherichia coli CFT073
cugcugaauauugccaau

SEQ ID NO: 584840 - RNA, 15 nt, Escherichia coli CFT073
cugcucuauugccgu

SEQ ID NO: 584841 - RNA, 20 nt, Escherichia coli CFT073
cugcucuggcagcaccacgc

SEQ ID NO: 584842 - RNA, 15 nt, Escherichia coli CFT073
cugcugcauuucugg

SEQ ID NO: 584843 - RNA, 22 nt, Escherichia coli CFT073
cugcugagaacauaaacaccca

SEQ ID NO: 584844 - RNA, 19 nt, Escherichia coli CFT073
cugcugacggugauaauca

SEQ ID NO: 584845 - RNA, 17 nt, Escherichia coli CFT073
cugcuccaucauccgcg

SEQ ID NO: 584846 - RNA, 15 nt, Escherichia coli CFT073
cugcucgcagaaaua

SEQ ID NO: 584847 - RNA, 19 nt, Escherichia coli CFT073
cugcucgcagaaauacccc

SEQ ID NO: 584848 - RNA, 20 nt, Escherichia coli CFT073
cugcuaacaguuugccaaac

SEQ ID NO: 584849 - RNA, 21 nt, Escherichia coli CFT073
cugcuaacaguuugccaaacc

SEQ ID NO: 584850 - RNA, 15 nt, Escherichia coli CFT073
cugcuagauaagcaa

SEQ ID NO: 584851 - RNA, 22 nt, Escherichia coli CFT073
cugcgugucguaagccaccgcc

SEQ ID NO: 584852 - RNA, 19 nt, Escherichia coli CFT073
cugcguuagaaaacgccug

SEQ ID NO: 584853 - RNA, 16 nt, Escherichia coli CFT073
cugcgucaucggcguu

SEQ ID NO: 584854 - RNA, 14 nt, Escherichia coli CFT073
cugcgggaacauau

SEQ ID NO: 584855 - RNA, 23 nt, Escherichia coli CFT073
cugcggcugguuacucaccagcc

SEQ ID NO: 584856 - RNA, 21 nt, Escherichia coli CFT073
cugcggcuguccggcaccauu

SEQ ID NO: 584857 - RNA, 17 nt, Escherichia coli CFT073
cugcggacgucuguuua

SEQ ID NO: 584858 - RNA, 16 nt, Escherichia coli CFT073
cugcggaagcuaccga

SEQ ID NO: 584859 - RNA, 12 nt, Escherichia coli CFT073
cugcggaaucac

SEQ ID NO: 584860 - RNA, 15 nt, Escherichia coli CFT073
cugcgcuucuuccag

SEQ ID NO: 584861 - RNA, 13 nt, Escherichia coli CFT073
cugcgcuuucugc

SEQ ID NO: 584862 - RNA, 22 nt, Escherichia coli CFT073
cugcgcuuucugcuucgccauc

SEQ ID NO: 584863 - RNA, 23 nt, Escherichia coli CFT073
cugcgcuggcaagaagaucagca

SEQ ID NO: 584864 - RNA, 15 nt, Escherichia coli CFT073
cugcgcugcaccagu

SEQ ID NO: 584865 - RNA, 20 nt, Escherichia coli CFT073
cugcggcgacaaauguugca

SEQ ID NO: 584866 - RNA, 11 nt, Escherichia coli CFT073
cugcggcagcu

SEQ ID NO: 584867 - RNA, 14 nt, Escherichia coli CFT073
cugcgccuuccagc

SEQ ID NO: 584868 - RNA, 19 nt, Escherichia coli CFT073
cugcgccuuuuuucgccgc

SEQ ID NO: 584869 - RNA, 14 nt, Escherichia coli CFT073
cugcgcuauccagc

SEQ ID NO: 584870 - RNA, 17 nt, Escherichia coli CFT073
cugcgcggaccccgcgc

SEQ ID NO: 584871 - RNA, 12 nt, Escherichia coli CFT073
cugcacgaugcc

SEQ ID NO: 584872 - RNA, 15 nt, Escherichia coli CFT073
cugcgauaacggucg

SEQ ID NO: 584873 - RNA, 17 nt, Escherichia coli CFT073
cugcgcaucggucgcgu

SEQ ID NO: 584874 - RNA, 15 nt, Escherichia coli CFT073
cugcgcauuucgcuc

SEQ ID NO: 584875 - RNA, 16 nt, Escherichia coli CFT073
cugcgcacgaguuucu

SEQ ID NO: 584876 - RNA, 17 nt, Escherichia coli CFT073
cugcgccauauaccgcg

SEQ ID NO: 584877 - RNA, 17 nt, Escherichia coli CFT073
cugcgccagcgaaccac

SEQ ID NO: 584878 - RNA, 11 nt, Escherichia coli CFT073
cugcgccagac

SEQ ID NO: 584879 - RNA, 15 nt, Escherichia coli CFT073
cugcgccacgaaaac

SEQ ID NO: 584880 - RNA, 23 nt, Escherichia coli CFT073
cugcgccuaacaacugcuggacg

SEQ ID NO: 584881 - RNA, 24 nt, Escherichia coli CFT073
cugcgccuaacaacugcuggacga

SEQ ID NO: 584882 - RNA, 13 nt, Escherichia coli CFT073
cguacaaccgcga

SEQ ID NO: 584883 - RNA, 13 nt, Escherichia coli CFT073
cguaauuuuucgg

SEQ ID NO: 584884 - RNA, 17 nt, Escherichia coli CFT073
cguaaaaaucggcaaca

SEQ ID NO: 584885 - RNA, 18 nt, Escherichia coli CFT073
cguaaaaacccgcuucgg

SEQ ID NO: 584886 - RNA, 22 nt, Escherichia coli CFT073
cgguuuuucugucaguuggcug

SEQ ID NO: 584887 - RNA, 19 nt, Escherichia coli CFT073
cgguuuugucggcaugaua

SEQ ID NO: 584888 - RNA, 14 nt, Escherichia coli CFT073
cgguuuuucagcuu

SEQ ID NO: 584889 - RNA, 14 nt, Escherichia coli CFT073
cgguuuuuccagcu

SEQ ID NO: 584890 - RNA, 17 nt, Escherichia coli CFT073
cgguuuucaccuccggc

SEQ ID NO: 584891 - RNA, 15 nt, Escherichia coli CFT073
cguaaucauaaaaca

SEQ ID NO: 584892 - RNA, 23 nt, Escherichia coli CFT073
cguaaaccacugacacaggcagc

SEQ ID NO: 584893 - RNA, 21 nt, Escherichia coli CFT073
cguaauccugaaagcguguca

SEQ ID NO: 584894 - RNA, 20 nt, Escherichia coli CFT073
cguaauccugcgguacgcga

SEQ ID NO: 584895 - RNA, 16 nt, Escherichia coli CFT073
cguaaucucuuuccau

SEQ ID NO: 584896 - RNA, 17 nt, Escherichia coli CFT073
cguaaucucuuuccauu

SEQ ID NO: 584897 - RNA, 15 nt, Escherichia coli CFT073
cguaaucuuuucaua

SEQ ID NO: 584898 - RNA, 22 nt, Escherichia coli CFT073
cgguugaacgccaaauucuuua

SEQ ID NO: 584899 - RNA, 15 nt, Escherichia coli CFT073
cgguucggacauguu

SEQ ID NO: 584900 - RNA, 19 nt, Escherichia coli CFT073
cgguuucuccccuucagca

SEQ ID NO: 584901 - RNA, 19 nt, Escherichia coli CFT073
cgguuugccauaaccugcc

SEQ ID NO: 584902 - RNA, 21 nt, Escherichia coli CFT073
cgguuuccaggcagccauaac

SEQ ID NO: 584903 - RNA, 22 nt, Escherichia coli CFT073
cgguuucccggcaaucgccaga

SEQ ID NO: 584904 - RNA, 16 nt, Escherichia coli CFT073
cgguugagagcaaaca

SEQ ID NO: 584905 - RNA, 12 nt, Escherichia coli CFT073
cgguuucaacca

SEQ ID NO: 584906 - RNA, 16 nt, Escherichia coli CFT073
cgguuucagcucacgg

SEQ ID NO: 584907 - RNA, 14 nt, Escherichia coli CFT073
cgguuccagcuuca

SEQ ID NO: 584908 - RNA, 15 nt, Escherichia coli CFT073
cgguuaaucagauaa

SEQ ID NO: 584909 - RNA, 13 nt, Escherichia coli CFT073
cgguguuuccauc

SEQ ID NO: 584910 - RNA, 15 nt, Escherichia coli CFT073
cgguguaaccgcaac

SEQ ID NO: 584911 - RNA, 21 nt, Escherichia coli CFT073
cgguguaaccgcaacggcgac

SEQ ID NO: 584912 - RNA, 20 nt, Escherichia coli CFT073
cggugucaucgacaucaacg

SEQ ID NO: 584913 - RNA, 14 nt, Escherichia coli CFT073
cguaugaccaccug

SEQ ID NO: 584914 - RNA, 17 nt, Escherichia coli CFT073
cgucaacuguacgccga

SEQ ID NO: 584915 - RNA, 20 nt, Escherichia coli CFT073
cguaucguucgccagcucca

SEQ ID NO: 584916 - RNA, 19 nt, Escherichia coli CFT073
cgucaagcgucgcauccgg

SEQ ID NO: 584917 - RNA, 13 nt, Escherichia coli CFT073
cgucaauaaaaac

SEQ ID NO: 584918 - RNA, 18 nt, Escherichia coli CFT073
cguaucccagugcagcau

SEQ ID NO: 584919 - RNA, 18 nt, Escherichia coli CFT073
cguaguuuuugcccauca

SEQ ID NO: 584920 - RNA, 12 nt, Escherichia coli CFT073
cguaguugcugc

SEQ ID NO: 584921 - RNA, 21 nt, Escherichia coli CFT073
cguauaccgucaggauaaacu

SEQ ID NO: 584922 - RNA, 16 nt, Escherichia coli CFT073
cgucaccgguucggac

SEQ ID NO: 584923 - RNA, 19 nt, Escherichia coli CFT073
cgucacgguuucaaagaaa

SEQ ID NO: 584924 - RNA, 21 nt, Escherichia coli CFT073
cgucacguaggcuucauuacg

SEQ ID NO: 584925 - RNA, 20 nt, Escherichia coli CFT073
cgucagcgucgcaucuggca

SEQ ID NO: 584926 - RNA, 23 nt, Escherichia coli CFT073
cgucagacagcgcaauagccuga

SEQ ID NO: 584927 - RNA, 16 nt, Escherichia coli CFT073
cgucacuuugcugucg

SEQ ID NO: 584928 - RNA, 11 nt, Escherichia coli CFT073
cgucacuuuuc

SEQ ID NO: 584929 - RNA, 19 nt, Escherichia coli CFT073
cgucacuuuucuuaauugc

SEQ ID NO: 584930 - RNA, 14 nt, Escherichia coli CFT073
cgucacucacgcug

SEQ ID NO: 584931 - RNA, 20 nt, Escherichia coli CFT073
cgucacucacgcugcguaca

SEQ ID NO: 584932 - RNA, 14 nt, Escherichia coli CFT073
cguaguaguucauc

SEQ ID NO: 584933 - RNA, 19 nt, Escherichia coli CFT073
cguagcccaucagcuggca

SEQ ID NO: 584934 - RNA, 15 nt, Escherichia coli CFT073
cguagccccagucuu

SEQ ID NO: 584935 - RNA, 20 nt, Escherichia coli CFT073
cguagccccagucuuccugc

SEQ ID NO: 584936 - RNA, 20 nt, Escherichia coli CFT073
cguaggccagauaaggcguu

SEQ ID NO: 584937 - RNA, 18 nt, Escherichia coli CFT073
cguagaauaaaagcauua

SEQ ID NO: 584938 - RNA, 13 nt, Escherichia coli CFT073
cguacccagcgug

SEQ ID NO: 584939 - RNA, 13 nt, Escherichia coli CFT073
cguacccuccggg

SEQ ID NO: 584940 - RNA, 15 nt, Escherichia coli CFT073
cguaccaucgccagc

SEQ ID NO: 584941 - RNA, 17 nt, Escherichia coli CFT073
cguaccaugauccugca

SEQ ID NO: 584942 - RNA, 18 nt, Escherichia coli CFT073
cguaccaugauccugcaa

SEQ ID NO: 584943 - RNA, 16 nt, Escherichia coli CFT073
cguacccaucaacaac

SEQ ID NO: 584944 - RNA, 18 nt, Escherichia coli CFT073
cguacccaucaacaacug

SEQ ID NO: 584945 - RNA, 16 nt, Escherichia coli CFT073
cguacaugcagggcaa

SEQ ID NO: 584946 - RNA, 18 nt, Escherichia coli CFT073
cggugauggccgcgccga

SEQ ID NO: 584947 - RNA, 23 nt, Escherichia coli CFT073
cggugauauacgccacuucaucg

SEQ ID NO: 584948 - RNA, 16 nt, Escherichia coli CFT073
cggugauauccagguu

SEQ ID NO: 584949 - RNA, 13 nt, Escherichia coli CFT073
cggugagacgcca

SEQ ID NO: 584950 - RNA, 18 nt, Escherichia coli CFT073
cggugagacgccagaacc

SEQ ID NO: 584951 - RNA, 20 nt, Escherichia coli CFT073
cggugagcacaucagcgccc

SEQ ID NO: 584952 - RNA, 14 nt, Escherichia coli CFT073
cggugacuagcagc

SEQ ID NO: 584953 - RNA, 11 nt, Escherichia coli CFT073
cggugacuuca

SEQ ID NO: 584954 - RNA, 22 nt, Escherichia coli CFT073
cggugccgccgucagacgcgcg

SEQ ID NO: 584955 - RNA, 22 nt, Escherichia coli CFT073
cggugccauuaaaccaacaaaa

SEQ ID NO: 584956 - RNA, 13 nt, Escherichia coli CFT073
cggugccagcaac

SEQ ID NO: 584957 - RNA, 20 nt, Escherichia coli CFT073
cggugcaucuucacacugau

SEQ ID NO: 584958 - RNA, 23 nt, Escherichia coli CFT073
cggugcauccacuuugguuacac

SEQ ID NO: 584959 - RNA, 22 nt, Escherichia coli CFT073
cggugcauuuucuaugcugcca

SEQ ID NO: 584960 - RNA, 18 nt, Escherichia coli CFT073
cggugauuuuacccggug

SEQ ID NO: 584961 - RNA, 22 nt, Escherichia coli CFT073
cggugauucagcguaacgccca

SEQ ID NO: 584962 - RNA, 13 nt, Escherichia coli CFT073
cggugccggagcg

SEQ ID NO: 584963 - RNA, 14 nt, Escherichia coli CFT073
cggugcgcccgcca

SEQ ID NO: 584964 - RNA, 21 nt, Escherichia coli CFT073
cggugcgggaguugaucgcca

SEQ ID NO: 584965 - RNA, 13 nt, Escherichia coli CFT073
cggugcuccagug

SEQ ID NO: 584966 - RNA, 17 nt, Escherichia coli CFT073
cgguggcaguagcgccu

SEQ ID NO: 584967 - RNA, 14 nt, Escherichia coli CFT073
cgguggccacagca

SEQ ID NO: 584968 - RNA, 18 nt, Escherichia coli CFT073
cgguggauuuuucgcgac

SEQ ID NO: 584969 - RNA, 23 nt, Escherichia coli CFT073
cgguggcacauaauugagcagca

SEQ ID NO: 584970 - RNA, 13 nt, Escherichia coli CFT073
cgugaaauccccu

SEQ ID NO: 584971 - RNA, 19 nt, Escherichia coli CFT073
cgucuuuaggaacgcgcug

SEQ ID NO: 584972 - RNA, 20 nt, Escherichia coli CFT073
cgucuuuaggaacgcgcugc

SEQ ID NO: 584973 - RNA, 18 nt, Escherichia coli CFT073
cgugaacgccuuauccga

SEQ ID NO: 584974 - RNA, 18 nt, Escherichia coli CFT073
cgugaacgccuuauccgg

SEQ ID NO: 584975 - RNA, 20 nt, Escherichia coli CFT073
cgugaacaauuucagcaaua

SEQ ID NO: 584976 - RNA, 18 nt, Escherichia coli CFT073
cgugagguuaucgcccug

SEQ ID NO: 584977 - RNA, 18 nt, Escherichia coli CFT073
cgugacgggugacgccaa

SEQ ID NO: 584978 - RNA, 18 nt, Escherichia coli CFT073
cgugcagcaccgccgcca

SEQ ID NO: 584979 - RNA, 18 nt, Escherichia coli CFT073
cgugaucgucuucaaccg

SEQ ID NO: 584980 - RNA, 20 nt, Escherichia coli CFT073
cgugauauuacauaccagca

SEQ ID NO: 584981 - RNA, 18 nt, Escherichia coli CFT073
cgugaucccuaacuggcg

SEQ ID NO: 584982 - RNA, 17 nt, Escherichia coli CFT073
cgugauacaacugccgc

SEQ ID NO: 584983 - RNA, 21 nt, Escherichia coli CFT073
cgugccgguaaugcugaaauu

SEQ ID NO: 584984 - RNA, 20 nt, Escherichia coli CFT073
cgugccgcuacugcuugcca

SEQ ID NO: 584985 - RNA, 18 nt, Escherichia coli CFT073
cgugccggaacgccgcug

SEQ ID NO: 584986 - RNA, 22 nt, Escherichia coli CFT073
cgugcagguucuuuuaaaccuu

SEQ ID NO: 584987 - RNA, 21 nt, Escherichia coli CFT073
cgugaugauaagugagcgauu

SEQ ID NO: 584988 - RNA, 22 nt, Escherichia coli CFT073
cgugcgggugguaaacacaacg

SEQ ID NO: 584989 - RNA, 12 nt, Escherichia coli CFT073
cgugcgggcaaa

SEQ ID NO: 584990 - RNA, 21 nt, Escherichia coli CFT073
cgugcgauuuguucaugcccg

SEQ ID NO: 584991 - RNA, 20 nt, Escherichia coli CFT073
cgucucaacaaacgauuuau

SEQ ID NO: 584992 - RNA, 17 nt, Escherichia coli CFT073
cgucucacuaucgccga

SEQ ID NO: 584993 - RNA, 15 nt, Escherichia coli CFT073
cgucuaucagcuucu

SEQ ID NO: 584994 - RNA, 17 nt, Escherichia coli CFT073
cgucuaucagcuucugc

SEQ ID NO: 584995 - RNA, 15 nt, Escherichia coli CFT073
cgucuaucagugcaa

SEQ ID NO: 584996 - RNA, 13 nt, Escherichia coli CFT073
cgucuaugccggu

SEQ ID NO: 584997 - RNA, 15 nt, Escherichia coli CFT073
cgucgucccuuccgc

SEQ ID NO: 584998 - RNA, 13 nt, Escherichia coli CFT073
cgucugaucggca

SEQ ID NO: 584999 - RNA, 23 nt, Escherichia coli CFT073
cgucugccucccauucaucgcca

SEQ ID NO: 585000 - RNA, 16 nt, Escherichia coli CFT073
cgucugccccgccgcc

SEQ ID NO: 585001 - RNA, 22 nt, Escherichia coli CFT073
cgucugcggugcgccaaacugc

SEQ ID NO: 585002 - RNA, 19 nt, Escherichia coli CFT073
cgucgguuauacacgcccg

SEQ ID NO: 585003 - RNA, 21 nt, Escherichia coli CFT073
cgucgguucguaggccagaua

SEQ ID NO: 585004 - RNA, 13 nt, Escherichia coli CFT073
cgucgggcgacgu

SEQ ID NO: 585005 - RNA, 20 nt, Escherichia coli CFT073
cgucgggauugcauccugcg

SEQ ID NO: 585006 - RNA, 18 nt, Escherichia coli CFT073
cgucgggaagccggucau

SEQ ID NO: 585007 - RNA, 19 nt, Escherichia coli CFT073
cgucaucaccuugcucgau

SEQ ID NO: 585008 - RNA, 19 nt, Escherichia coli CFT073
cgucauauucgccaucagc

SEQ ID NO: 585009 - RNA, 23 nt, Escherichia coli CFT073
cgucaggauuaaacuggcacgcu

SEQ ID NO: 585010 - RNA, 15 nt, Escherichia coli CFT073
cgucaguacaaacau

SEQ ID NO: 585011 - RNA, 16 nt, Escherichia coli CFT073
cguccauguuggagau

SEQ ID NO: 585012 - RNA, 19 nt, Escherichia coli CFT073
cgucccugguacagcagac

SEQ ID NO: 585013 - RNA, 22 nt, Escherichia coli CFT073
cguccugcgguugaaacacagc

SEQ ID NO: 585014 - RNA, 19 nt, Escherichia coli CFT073
cgucgccgguuugcaguau

SEQ ID NO: 585015 - RNA, 22 nt, Escherichia coli CFT073
cgucgccaauggaauagcgaag

SEQ ID NO: 585016 - RNA, 14 nt, Escherichia coli CFT073
cgucgcagccagcg

SEQ ID NO: 585017 - RNA, 20 nt, Escherichia coli CFT073
cgucgcaccgguaucugcca

SEQ ID NO: 585018 - RNA, 23 nt, Escherichia coli CFT073
cgucgcagcuauccugccgguga

SEQ ID NO: 585019 - RNA, 12 nt, Escherichia coli CFT073
cgucgcaucagg

SEQ ID NO: 585020 - RNA, 14 nt, Escherichia coli CFT073
cgucgcuuuccagu

SEQ ID NO: 585021 - RNA, 23 nt, Escherichia coli CFT073
cgucgcugauauugcuccagacg

SEQ ID NO: 585022 - RNA, 19 nt, Escherichia coli CFT073
cgucgcguuuuucucuuuu

SEQ ID NO: 585023 - RNA, 20 nt, Escherichia coli CFT073
cucggucacugacaccagca

SEQ ID NO: 585024 - RNA, 21 nt, Escherichia coli CFT073
cucggucaccaugaacaccaa

SEQ ID NO: 585025 - RNA, 22 nt, Escherichia coli CFT073
cucggggcuuuucucuaucugc

SEQ ID NO: 585026 - RNA, 14 nt, Escherichia coli CFT073
cucuccuguuuaau

SEQ ID NO: 585027 - RNA, 14 nt, Escherichia coli CFT073
cucuggcugcuuca

SEQ ID NO: 585028 - RNA, 20 nt, Escherichia coli CFT073
cucgugguugaugccggaug

SEQ ID NO: 585029 - RNA, 22 nt, Escherichia coli CFT073
cucucacgguuaauggccggaa

SEQ ID NO: 585030 - RNA, 18 nt, Escherichia coli CFT073
cucgugcagaacauccag

SEQ ID NO: 585031 - RNA, 16 nt, Escherichia coli CFT073
cucuucaagcugcuga

SEQ ID NO: 585032 - RNA, 17 nt, Escherichia coli CFT073
cucuguguaggccggau

SEQ ID NO: 585033 - RNA, 17 nt, Escherichia coli CFT073
cucuguuggcgacguuu

SEQ ID NO: 585034 - RNA, 20 nt, Escherichia coli CFT073
cucuuaagguucacuuaauc

SEQ ID NO: 585035 - RNA, 17 nt, Escherichia coli CFT073
cucuucgcgaucaaacg

SEQ ID NO: 585036 - RNA, 20 nt, Escherichia coli CFT073
cugaaaaugaaauaaaacaa

SEQ ID NO: 585037 - RNA, 13 nt, Escherichia coli CFT073
cugaaaauugucu

SEQ ID NO: 585038 - RNA, 19 nt, Escherichia coli CFT073
cucuucguuaauuucugcu

SEQ ID NO: 585039 - RNA, 17 nt, Escherichia coli CFT073
cucuucguuuucaacgu

SEQ ID NO: 585040 - RNA, 14 nt, Escherichia coli CFT073
cucuucuucgcuca

SEQ ID NO: 585041 - RNA, 18 nt, Escherichia coli CFT073
cugaaagcgaaccauagu

SEQ ID NO: 585042 - RNA, 23 nt, Escherichia coli CFT073
cugaaagggaagggagcgccguc

SEQ ID NO: 585043 - RNA, 17 nt, Escherichia coli CFT073
cugaaaggucaucauca

SEQ ID NO: 585044 - RNA, 20 nt, Escherichia coli CFT073
cugaggggcaaaaucggcgu

SEQ ID NO: 585045 - RNA, 17 nt, Escherichia coli CFT073
cugaggccuacguucga

SEQ ID NO: 585046 - RNA, 15 nt, Escherichia coli CFT073
cugagcucaugccgu

SEQ ID NO: 585047 - RNA, 14 nt, Escherichia coli CFT073
cugauaaaucccgc

SEQ ID NO: 585048 - RNA, 17 nt, Escherichia coli CFT073
cugauaaccuuccagcu

SEQ ID NO: 585049 - RNA, 16 nt, Escherichia coli CFT073
cugaguuauuucauua

SEQ ID NO: 585050 - RNA, 16 nt, Escherichia coli CFT073
cugaugcgacgcaggu

SEQ ID NO: 585051 - RNA, 15 nt, Escherichia coli CFT073
cugaugcgacgccga

SEQ ID NO: 585052 - RNA, 18 nt, Escherichia coli CFT073
cugaugcgacgcuggcgc

SEQ ID NO: 585053 - RNA, 17 nt, Escherichia coli CFT073
cugaugcgaugcuggcg

SEQ ID NO: 585054 - RNA, 18 nt, Escherichia coli CFT073
cugaugcgaugcuggcgc

SEQ ID NO: 585055 - RNA, 14 nt, Escherichia coli CFT073
cugauggccggaug

SEQ ID NO: 585056 - RNA, 14 nt, Escherichia coli CFT073
cugauggcgcgcca

SEQ ID NO: 585057 - RNA, 20 nt, Escherichia coli CFT073
cugauggacauucuccggca

SEQ ID NO: 585058 - RNA, 17 nt, Escherichia coli CFT073
cugaugcugugaauauu

SEQ ID NO: 585059 - RNA, 12 nt, Escherichia coli CFT073
cugaugcuucag

SEQ ID NO: 585060 - RNA, 13 nt, Escherichia coli CFT073
cugaugcuggcac

SEQ ID NO: 585061 - RNA, 19 nt, Escherichia coli CFT073
cugauagaacugcggcagg

SEQ ID NO: 585062 - RNA, 19 nt, Escherichia coli CFT073
cugauaccgcguuggcgca

SEQ ID NO: 585063 - RNA, 16 nt, Escherichia coli CFT073
cugauacuuaucauca

SEQ ID NO: 585064 - RNA, 20 nt, Escherichia coli CFT073
cugauaagcguagcgcauca

SEQ ID NO: 585065 - RNA, 22 nt, Escherichia coli CFT073
cugauaaggcggcucuggcggc

SEQ ID NO: 585066 - RNA, 16 nt, Escherichia coli CFT073
cugauaaucggggauc

SEQ ID NO: 585067 - RNA, 12 nt, Escherichia coli CFT073
cugauugcuggc

SEQ ID NO: 585068 - RNA, 17 nt, Escherichia coli CFT073
cugauuuuauuucacau

SEQ ID NO: 585069 - RNA, 22 nt, Escherichia coli CFT073
cugauuuucaucuucuucuggc

SEQ ID NO: 585070 - RNA, 19 nt, Escherichia coli CFT073
cugcaacuucacggcugua

SEQ ID NO: 585071 - RNA, 23 nt, Escherichia coli CFT073
cugauggcuguuuucagcaccag

SEQ ID NO: 585072 - RNA, 19 nt, Escherichia coli CFT073
cugauguagcgugauuuug

SEQ ID NO: 585073 - RNA, 16 nt, Escherichia coli CFT073
cugauguauccggcau

SEQ ID NO: 585074 - RNA, 21 nt, Escherichia coli CFT073
cugaugugucccuuuacuggc

SEQ ID NO: 585075 - RNA, 16 nt, Escherichia coli CFT073
cugauguucgccagau

SEQ ID NO: 585076 - RNA, 20 nt, Escherichia coli CFT073
cugauuaagaucgugcagca

SEQ ID NO: 585077 - RNA, 19 nt, Escherichia coli CFT073
cugauuaauuuucgcccgu

SEQ ID NO: 585078 - RNA, 19 nt, Escherichia coli CFT073
cugauuaccuaccaacgca

SEQ ID NO: 585079 - RNA, 20 nt, Escherichia coli CFT073
cugcaauaacaucggcuguu

SEQ ID NO: 585080 - RNA, 14 nt, Escherichia coli CFT073
cugcaaucaacacu

SEQ ID NO: 585081 - RNA, 23 nt, Escherichia coli CFT073
cugcaaggcaacgcagccccagc

SEQ ID NO: 585082 - RNA, 22 nt, Escherichia coli CFT073
cugcacagcauucagcuuccag

SEQ ID NO: 585083 - RNA, 15 nt, Escherichia coli CFT073
cugcacaccaaccgc

SEQ ID NO: 585084 - RNA, 14 nt, Escherichia coli CFT073
cugcacacggauaa

SEQ ID NO: 585085 - RNA, 17 nt, Escherichia coli CFT073
cugacguucagccgcuu

SEQ ID NO: 585086 - RNA, 13 nt, Escherichia coli CFT073
cugacguugggua

SEQ ID NO: 585087 - RNA, 21 nt, Escherichia coli CFT073
cugacguuggguaaauugcga

SEQ ID NO: 585088 - RNA, 23 nt, Escherichia coli CFT073
cugacgugcacaaacuucuucag

SEQ ID NO: 585089 - RNA, 19 nt, Escherichia coli CFT073
cugacuccgauauuugccg

SEQ ID NO: 585090 - RNA, 13 nt, Escherichia coli CFT073
cugacugacuuca

SEQ ID NO: 585091 - RNA, 12 nt, Escherichia coli CFT073
cugacuggcgag

SEQ ID NO: 585092 - RNA, 17 nt, Escherichia coli CFT073
cugacuguuuagcgacg

SEQ ID NO: 585093 - RNA, 13 nt, Escherichia coli CFT073
cugacuugccgga

SEQ ID NO: 585094 - RNA, 19 nt, Escherichia coli CFT073
cugacuuuguaccagcggg

SEQ ID NO: 585095 - RNA, 20 nt, Escherichia coli CFT073
cugagaacuucggcagagaa

SEQ ID NO: 585096 - RNA, 20 nt, Escherichia coli CFT073
cugagcaccacacgacgcgc

SEQ ID NO: 585097 - RNA, 15 nt, Escherichia coli CFT073
cugaacagaaaucug

SEQ ID NO: 585098 - RNA, 15 nt, Escherichia coli CFT073
cugaagaaguaaaac

SEQ ID NO: 585099 - RNA, 20 nt, Escherichia coli CFT073
cugaacacauuugucggaug

SEQ ID NO: 585100 - RNA, 21 nt, Escherichia coli CFT073
cugaccguaagcgucguucgc

SEQ ID NO: 585101 - RNA, 13 nt, Escherichia coli CFT073
cugaagcgcgccu

SEQ ID NO: 585102 - RNA, 19 nt, Escherichia coli CFT073
cugaaggauuagacgaaua

SEQ ID NO: 585103 - RNA, 20 nt, Escherichia coli CFT073
cugacgccauucucaccuac

SEQ ID NO: 585104 - RNA, 22 nt, Escherichia coli CFT073
cugacgcccaguuucgacauca

SEQ ID NO: 585105 - RNA, 16 nt, Escherichia coli CFT073
cugacgcaaaacgcgc

SEQ ID NO: 585106 - RNA, 12 nt, Escherichia coli CFT073
cugacgcaucuu

SEQ ID NO: 585107 - RNA, 12 nt, Escherichia coli CFT073
cugacgccacca

SEQ ID NO: 585108 - RNA, 14 nt, Escherichia coli CFT073
cugaccuucuucag

SEQ ID NO: 585109 - RNA, 16 nt, Escherichia coli CFT073
cugaccuauuucauuc

SEQ ID NO: 585110 - RNA, 22 nt, Escherichia coli CFT073
cugaccuggaaguguccaguug

SEQ ID NO: 585111 - RNA, 19 nt, Escherichia coli CFT073
cuccugcggcgacaaaugu

SEQ ID NO: 585112 - RNA, 15 nt, Escherichia coli CFT073
cuccugccaguuaua

SEQ ID NO: 585113 - RNA, 17 nt, Escherichia coli CFT073
cuccgguugguuaucuc

SEQ ID NO: 585114 - RNA, 16 nt, Escherichia coli CFT073
cucccgcgccgcagcc

SEQ ID NO: 585115 - RNA, 16 nt, Escherichia coli CFT073
cuccccugcgagccgc

SEQ ID NO: 585116 - RNA, 13 nt, Escherichia coli CFT073
cucgacuuucgca

SEQ ID NO: 585117 - RNA, 17 nt, Escherichia coli CFT073
cucggcugcugccagca

SEQ ID NO: 585118 - RNA, 12 nt, Escherichia coli CFT073
cucggccaccgu

SEQ ID NO: 585119 - RNA, 17 nt, Escherichia coli CFT073
cucgcguucuguugccg

SEQ ID NO: 585120 - RNA, 20 nt, Escherichia coli CFT073
cucgcguucuguugccgcua

SEQ ID NO: 585121 - RNA, 14 nt, Escherichia coli CFT073
cucgcgccgcaucc

SEQ ID NO: 585122 - RNA, 13 nt, Escherichia coli CFT073
cucgcgcaccuac

SEQ ID NO: 585123 - RNA, 11 nt, Escherichia coli CFT073
cuccacgccca

SEQ ID NO: 585124 - RNA, 14 nt, Escherichia coli CFT073
cuccacgcucagac

SEQ ID NO: 585125 - RNA, 12 nt, Escherichia coli CFT073
cuccagaauacc

SEQ ID NO: 585126 - RNA, 16 nt, Escherichia coli CFT073
cuccaguuaacgccgc

SEQ ID NO: 585127 - RNA, 15 nt, Escherichia coli CFT073
cucaucagcuuacgg

SEQ ID NO: 585128 - RNA, 18 nt, Escherichia coli CFT073
cucauaaguuucccagcu

SEQ ID NO: 585129 - RNA, 22 nt, Escherichia coli CFT073
cucagccaaauccagcgcaaag

SEQ ID NO: 585130 - RNA, 19 nt, Escherichia coli CFT073
cucaccuuucgguucauaa

SEQ ID NO: 585131 - RNA, 22 nt, Escherichia coli CFT073
cucacuucgcugacgccugcca

SEQ ID NO: 585132 - RNA, 19 nt, Escherichia coli CFT073
cucacuuuguaggccugau

SEQ ID NO: 585133 - RNA, 17 nt, Escherichia coli CFT073
cucaggcgaucagugau

SEQ ID NO: 585134 - RNA, 18 nt, Escherichia coli CFT073
cucauaaaccagcggcac

SEQ ID NO: 585135 - RNA, 17 nt, Escherichia coli CFT073
cucaggaaauugcacca

SEQ ID NO: 585136 - RNA, 16 nt, Escherichia coli CFT073
cuauucauuguaaaua

SEQ ID NO: 585137 - RNA, 21 nt, Escherichia coli CFT073
cuauucgccagcacggcgcag

SEQ ID NO: 585138 - RNA, 20 nt, Escherichia coli CFT073
cuauugccauacgccggaug

SEQ ID NO: 585139 - RNA, 17 nt, Escherichia coli CFT073
cuauugccguaaucgcc

SEQ ID NO: 585140 - RNA, 15 nt, Escherichia coli CFT073
cuauuuuuugcaggc

SEQ ID NO: 585141 - RNA, 21 nt, Escherichia coli CFT073
cucaaaagcguaccgccaauu

SEQ ID NO: 585142 - RNA, 23 nt, Escherichia coli CFT073
cucaccaucaaacagccccugac

SEQ ID NO: 585143 - RNA, 16 nt, Escherichia coli CFT073
cucacccagggaaagg

SEQ ID NO: 585144 - RNA, 16 nt, Escherichia coli CFT073
cucacccccaucagca

SEQ ID NO: 585145 - RNA, 22 nt, Escherichia coli CFT073
cucaccgaugaucgccaucagc

SEQ ID NO: 585146 - RNA, 15 nt, Escherichia coli CFT073
cucaccgcuggcgua

SEQ ID NO: 585147 - RNA, 22 nt, Escherichia coli CFT073
cucaccggcauuuuuuagcgcc

SEQ ID NO: 585148 - RNA, 14 nt, Escherichia coli CFT073
cucaccgguaaagu

SEQ ID NO: 585149 - RNA, 22 nt, Escherichia coli CFT073
cuaauguagcgaccauaacagc

SEQ ID NO: 585150 - RNA, 21 nt, Escherichia coli CFT073
cuaaugucgugguacugccgg

SEQ ID NO: 585151 - RNA, 21 nt, Escherichia coli CFT073
cuaauuuuuccagcauuucuu

SEQ ID NO: 585152 - RNA, 20 nt, Escherichia coli CFT073
cuacaaaaaaagccacggaa

SEQ ID NO: 585153 - RNA, 13 nt, Escherichia coli CFT073
cuacaccccagcg

SEQ ID NO: 585154 - RNA, 15 nt, Escherichia coli CFT073
cuaccacgccgauaa

SEQ ID NO: 585155 - RNA, 15 nt, Escherichia coli CFT073
cuaccagaccgcaca

SEQ ID NO: 585156 - RNA, 15 nt, Escherichia coli CFT073
cuaccagcaccugcu

SEQ ID NO: 585157 - RNA, 18 nt, Escherichia coli CFT073
cuaccagcgccaccgguu

SEQ ID NO: 585158 - RNA, 15 nt, Escherichia coli CFT073
cuaccguguucagcg

SEQ ID NO: 585159 - RNA, 22 nt, Escherichia coli CFT073
cuaccguugaggcgaucgucgc

SEQ ID NO: 585160 - RNA, 21 nt, Escherichia coli CFT073
cuaaucgcuuuauagcauagc

SEQ ID NO: 585161 - RNA, 21 nt, Escherichia coli CFT073
cuaaucaucaucagcgcuuua

SEQ ID NO: 585162 - RNA, 18 nt, Escherichia coli CFT073
cuaaucaucuguugugcc

SEQ ID NO: 585163 - RNA, 17 nt, Escherichia coli CFT073
cuaauaauguaauaugc

SEQ ID NO: 585164 - RNA, 15 nt, Escherichia coli CFT073
cuaauaaaaccggug

SEQ ID NO: 585165 - RNA, 16 nt, Escherichia coli CFT073
cuaagauaccccagcg

SEQ ID NO: 585166 - RNA, 23 nt, Escherichia coli CFT073
cuaagcggcuccgguccaagaug

SEQ ID NO: 585167 - RNA, 15 nt, Escherichia coli CFT073
cuaacuccugauucc

SEQ ID NO: 585168 - RNA, 15 nt, Escherichia coli CFT073
cuaacucuuccugcg

SEQ ID NO: 585169 - RNA, 22 nt, Escherichia coli CFT073
cuaucgcgaaaacacucugcgc

SEQ ID NO: 585170 - RNA, 20 nt, Escherichia coli CFT073
cuaucggcauaaccaauugc

SEQ ID NO: 585171 - RNA, 16 nt, Escherichia coli CFT073
cuaugguguaacgauu

SEQ ID NO: 585172 - RNA, 21 nt, Escherichia coli CFT073
cuauucaccacuuuaucggca

SEQ ID NO: 585173 - RNA, 22 nt, Escherichia coli CFT073
cuauguuugaaccagauaucgc

SEQ ID NO: 585174 - RNA, 12 nt, Escherichia coli CFT073
cuauuaauccau

SEQ ID NO: 585175 - RNA, 15 nt, Escherichia coli CFT073
cuagcuuuucgccca

SEQ ID NO: 585176 - RNA, 16 nt, Escherichia coli CFT073
cuacggcgacagcaaa

SEQ ID NO: 585177 - RNA, 15 nt, Escherichia coli CFT073
cuacgcgccgccagc

SEQ ID NO: 585178 - RNA, 14 nt, Escherichia coli CFT073
cuacguaggccgga

SEQ ID NO: 585179 - RNA, 17 nt, Escherichia coli CFT073
cuacgcuuaucaggccu

SEQ ID NO: 585180 - RNA, 16 nt, Escherichia coli CFT073
cuaccugcucgucauc

SEQ ID NO: 585181 - RNA, 19 nt, Escherichia coli CFT073
cuaccuggcuuuacuuaac

SEQ ID NO: 585182 - RNA, 19 nt, Escherichia coli CFT073
cuaccuggucaccgacaac

SEQ ID NO: 585183 - RNA, 13 nt, Escherichia coli CFT073
cuacgacuuucuc

SEQ ID NO: 585184 - RNA, 16 nt, Escherichia coli CFT073
cuacgcagguuaacgc

SEQ ID NO: 585185 - RNA, 14 nt, Escherichia coli CFT073
cuacgcaucaugcc

SEQ ID NO: 585186 - RNA, 15 nt, Escherichia coli CFT073
cuacgccagacagcg

SEQ ID NO: 585187 - RNA, 15 nt, Escherichia coli CFT073
cguugcaaucagcgg

SEQ ID NO: 585188 - RNA, 23 nt, Escherichia coli CFT073
cguugcagagagucacgcagcau

SEQ ID NO: 585189 - RNA, 16 nt, Escherichia coli CFT073
cguugauugccggaug

SEQ ID NO: 585190 - RNA, 20 nt, Escherichia coli CFT073
cguugauugccggaugcggc

SEQ ID NO: 585191 - RNA, 13 nt, Escherichia coli CFT073
cguugauccagcg

SEQ ID NO: 585192 - RNA, 16 nt, Escherichia coli CFT073
cguugauccagcgcga

SEQ ID NO: 585193 - RNA, 20 nt, Escherichia coli CFT073
cguugacgcuuuacuuaaua

SEQ ID NO: 585194 - RNA, 23 nt, Escherichia coli CFT073
cguugaagucaggggcuuccagc

SEQ ID NO: 585195 - RNA, 20 nt, Escherichia coli CFT073
cguucuccucaacgaugcga

SEQ ID NO: 585196 - RNA, 15 nt, Escherichia coli CFT073
cguugacgaccaguc

SEQ ID NO: 585197 - RNA, 17 nt, Escherichia coli CFT073
cguuccggcaacgacgu

SEQ ID NO: 585198 - RNA, 22 nt, Escherichia coli CFT073
cguucccuuguugugccagacc

SEQ ID NO: 585199 - RNA, 14 nt, Escherichia coli CFT073
cgugcuguacagca

SEQ ID NO: 585200 - RNA, 14 nt, Escherichia coli CFT073
cgugcuucgcgcug

SEQ ID NO: 585201 - RNA, 14 nt, Escherichia coli CFT073
cguugccagcaacu

SEQ ID NO: 585202 - RNA, 21 nt, Escherichia coli CFT073
cguugccaguuuuuuagcgug

SEQ ID NO: 585203 - RNA, 18 nt, Escherichia coli CFT073
cguugccgcaucagugau

SEQ ID NO: 585204 - RNA, 20 nt, Escherichia coli CFT073
cguugcccgcagauccagug

SEQ ID NO: 585205 - RNA, 17 nt, Escherichia coli CFT073
cguugccgcucuuuuau

SEQ ID NO: 585206 - RNA, 16 nt, Escherichia coli CFT073
cguugcucaugcaaca

SEQ ID NO: 585207 - RNA, 18 nt, Escherichia coli CFT073
cguugcucaugcaacaca

SEQ ID NO: 585208 - RNA, 13 nt, Escherichia coli CFT073
cguugcgcgguga

SEQ ID NO: 585209 - RNA, 16 nt, Escherichia coli CFT073
cguuggcaaauugcgg

SEQ ID NO: 585210 - RNA, 15 nt, Escherichia coli CFT073
cguugcugucgcgca

SEQ ID NO: 585211 - RNA, 13 nt, Escherichia coli CFT073
cguugcugcggcg

SEQ ID NO: 585212 - RNA, 14 nt, Escherichia coli CFT073
cguuggcauuucga

SEQ ID NO: 585213 - RNA, 23 nt, Escherichia coli CFT073
cguuugcauccaguucgugucgg

SEQ ID NO: 585214 - RNA, 16 nt, Escherichia coli CFT073
cguuugcauccggcac

SEQ ID NO: 585215 - RNA, 21 nt, Escherichia coli CFT073
cguuucuucacccuuuucgau

SEQ ID NO: 585216 - RNA, 18 nt, Escherichia coli CFT073
cguuucuuucgauugcac

SEQ ID NO: 585217 - RNA, 12 nt, Escherichia coli CFT073
cguuucugccgu

SEQ ID NO: 585218 - RNA, 13 nt, Escherichia coli CFT073
cguuugaacugaa

SEQ ID NO: 585219 - RNA, 23 nt, Escherichia coli CFT073
cguuucuggcaauucgugaugcc

SEQ ID NO: 585220 - RNA, 16 nt, Escherichia coli CFT073
cguuugcguuccggcg

SEQ ID NO: 585221 - RNA, 19 nt, Escherichia coli CFT073
cguuugcugcuuaucgcga

SEQ ID NO: 585222 - RNA, 18 nt, Escherichia coli CFT073
cguuuuuaucgcccacgc

SEQ ID NO: 585223 - RNA, 18 nt, Escherichia coli CFT073
cguuuuguagcgugcggc

SEQ ID NO: 585224 - RNA, 11 nt, Escherichia coli CFT073
cguuuuuacag

SEQ ID NO: 585225 - RNA, 19 nt, Escherichia coli CFT073
cguuuugccgccaucaucg

SEQ ID NO: 585226 - RNA, 23 nt, Escherichia coli CFT073
cguuuugcucucacgagguugca

SEQ ID NO: 585227 - RNA, 12 nt, Escherichia coli CFT073
cguuuugcuggu

SEQ ID NO: 585228 - RNA, 18 nt, Escherichia coli CFT073
cguuuugcuggugcaggc

SEQ ID NO: 585229 - RNA, 14 nt, Escherichia coli CFT073
cguuuucacaguaa

SEQ ID NO: 585230 - RNA, 13 nt, Escherichia coli CFT073
cguuugucagcaa

SEQ ID NO: 585231 - RNA, 15 nt, Escherichia coli CFT073
cguuuggcaucaguc

SEQ ID NO: 585232 - RNA, 15 nt, Escherichia coli CFT073
cguuuuacagcaacg

SEQ ID NO: 585233 - RNA, 17 nt, Escherichia coli CFT073
cguuuuaucaaacaggu

SEQ ID NO: 585234 - RNA, 18 nt, Escherichia coli CFT073
cguuuucaaccguuugau

SEQ ID NO: 585235 - RNA, 20 nt, Escherichia coli CFT073
cuaaaacugauaaugcagau

SEQ ID NO: 585236 - RNA, 23 nt, Escherichia coli CFT073
cuaaaccaucagcaguacguuuu

SEQ ID NO: 585237 - RNA, 17 nt, Escherichia coli CFT073
cuaaacccgaccacuuc

SEQ ID NO: 585238 - RNA, 19 nt, Escherichia coli CFT073
cuaaaccgcugccugcgcc

SEQ ID NO: 585239 - RNA, 19 nt, Escherichia coli CFT073
cuaaagaaaacgaauugca

SEQ ID NO: 585240 - RNA, 14 nt, Escherichia coli CFT073
cuaaauaccagcgu

SEQ ID NO: 585241 - RNA, 20 nt, Escherichia coli CFT073
cuaacacagcaauaauaaua

SEQ ID NO: 585242 - RNA, 20 nt, Escherichia coli CFT073
cguuucaugccauccgcauc

SEQ ID NO: 585243 - RNA, 23 nt, Escherichia coli CFT073
cguuucacuucugaguucggcau

SEQ ID NO: 585244 - RNA, 17 nt, Escherichia coli CFT073
cguuucaaacaggcugc

SEQ ID NO: 585245 - RNA, 19 nt, Escherichia coli CFT073
cguuucacauucuccgccg

SEQ ID NO: 585246 - RNA, 20 nt, Escherichia coli CFT073
cguuuaugucgcauccugca

SEQ ID NO: 585247 - RNA, 16 nt, Escherichia coli CFT073
cguuguuuacgccgga

SEQ ID NO: 585248 - RNA, 18 nt, Escherichia coli CFT073
cguuguuuacgccggaug

SEQ ID NO: 585249 - RNA, 19 nt, Escherichia coli CFT073
cguuuaaucgccuuccggc

SEQ ID NO: 585250 - RNA, 22 nt, Escherichia coli CFT073
cguuuacaauaaccauuccacg

SEQ ID NO: 585251 - RNA, 18 nt, Escherichia coli CFT073
cguuuaggcgcaggauaa

SEQ ID NO: 585252 - RNA, 19 nt, Escherichia coli CFT073
cguugugguaaagcggcga

SEQ ID NO: 585253 - RNA, 16 nt, Escherichia coli CFT073
cguugucuggcuggug

SEQ ID NO: 585254 - RNA, 14 nt, Escherichia coli CFT073
cguugugcgaucca

SEQ ID NO: 585255 - RNA, 21 nt, Escherichia coli CFT073
cguugguuugauagcaaugcc

SEQ ID NO: 585256 - RNA, 23 nt, Escherichia coli CFT073
cguuguaacuucuuuacuggcuu

SEQ ID NO: 585257 - RNA, 14 nt, Escherichia coli CFT073
cguugucagcaauc

SEQ ID NO: 585258 - RNA, 15 nt, Escherichia coli CFT073
cguuggcggcgugac

SEQ ID NO: 585259 - RNA, 16 nt, Escherichia coli CFT073
cgucagaguggcguau

SEQ ID NO: 585260 - RNA, 14 nt, Escherichia coli CFT073
cgucagauccgcca

SEQ ID NO: 585261 - RNA, 20 nt, Escherichia coli CFT073
cgucagauuauucaaaaaca

SEQ ID NO: 585262 - RNA, 17 nt, Escherichia coli CFT073
cgucagcacuucauagu

SEQ ID NO: 585263 - RNA, 15 nt, Escherichia coli CFT073
cgucacuguugcugu

SEQ ID NO: 585264 - RNA, 23 nt, Escherichia coli CFT073
cgucacaaauaccccugccgccg

SEQ ID NO: 585265 - RNA, 17 nt, Escherichia coli CFT073
cgucaaucacuuucugc

SEQ ID NO: 585266 - RNA, 16 nt, Escherichia coli CFT073
cgucaaugccgcuucg

SEQ ID NO: 585267 - RNA, 20 nt, Escherichia coli CFT073
cgucaaugccgucaccagca

SEQ ID NO: 585268 - RNA, 15 nt, Escherichia coli CFT073
cgucaauaaucaugc

SEQ ID NO: 585269 - RNA, 18 nt, Escherichia coli CFT073
cgucacaucaccaacacc

SEQ ID NO: 585270 - RNA, 17 nt, Escherichia coli CFT073
cgucagggccugcgugu

SEQ ID NO: 585271 - RNA, 21 nt, Escherichia coli CFT073
cgucagggccugcguguggcg

SEQ ID NO: 585272 - RNA, 14 nt, Escherichia coli CFT073
cgucaggccgccac

SEQ ID NO: 585273 - RNA, 20 nt, Escherichia coli CFT073
cgucaggaagaagcccauca

SEQ ID NO: 585274 - RNA, 18 nt, Escherichia coli CFT073
cgucaggugagcgucauu

SEQ ID NO: 585275 - RNA, 23 nt, Escherichia coli CFT073
cgucagcugccaguugucgguaa

SEQ ID NO: 585276 - RNA, 14 nt, Escherichia coli CFT073
cgucagcuccggac

SEQ ID NO: 585277 - RNA, 13 nt, Escherichia coli CFT073
cgucagcuuucag

SEQ ID NO: 585278 - RNA, 14 nt, Escherichia coli CFT073
cgucagcggcagcu

SEQ ID NO: 585279 - RNA, 21 nt, Escherichia coli CFT073
cgucagcgccaccgcgauccc

SEQ ID NO: 585280 - RNA, 16 nt, Escherichia coli CFT073
cgucagccacaacaaa

SEQ ID NO: 585281 - RNA, 19 nt, Escherichia coli CFT073
cguaguugcgcugguggca

SEQ ID NO: 585282 - RNA, 13 nt, Escherichia coli CFT073
cguauacgcuucg

SEQ ID NO: 585283 - RNA, 13 nt, Escherichia coli CFT073
cguauacugcagc

SEQ ID NO: 585284 - RNA, 22 nt, Escherichia coli CFT073
cguauuggugcauaacacaaua

SEQ ID NO: 585285 - RNA, 22 nt, Escherichia coli CFT073
cgucaaacucauaaaccagcgg

SEQ ID NO: 585286 - RNA, 23 nt, Escherichia coli CFT073
cgucaacggugcuuuaauuucau

SEQ ID NO: 585287 - RNA, 14 nt, Escherichia coli CFT073
cgucaacguaauga

SEQ ID NO: 585288 - RNA, 14 nt, Escherichia coli CFT073
cgucaagcgucgca

SEQ ID NO: 585289 - RNA, 22 nt, Escherichia coli CFT073
cgucaacaacacucucugcagu

SEQ ID NO: 585290 - RNA, 12 nt, Escherichia coli CFT073
cgucaaccugac

SEQ ID NO: 585291 - RNA, 16 nt, Escherichia coli CFT073
cguaaucauaaaacac

SEQ ID NO: 585292 - RNA, 18 nt, Escherichia coli CFT073
cguaauccugaaagcgug

SEQ ID NO: 585293 - RNA, 15 nt, Escherichia coli CFT073
cguaauggucugcga

SEQ ID NO: 585294 - RNA, 19 nt, Escherichia coli CFT073
cguaauguuuccagcaucg

SEQ ID NO: 585295 - RNA, 18 nt, Escherichia coli CFT073
cguaauucaccguucaau

SEQ ID NO: 585296 - RNA, 15 nt, Escherichia coli CFT073
cguaauagcucugcu

SEQ ID NO: 585297 - RNA, 17 nt, Escherichia coli CFT073
cguaaguggaacuaaca

SEQ ID NO: 585298 - RNA, 14 nt, Escherichia coli CFT073
cguaaauguggcgg

SEQ ID NO: 585299 - RNA, 16 nt, Escherichia coli CFT073
cguagugaugcaucau

SEQ ID NO: 585300 - RNA, 16 nt, Escherichia coli CFT073
cguccccugcaaacgg

SEQ ID NO: 585301 - RNA, 16 nt, Escherichia coli CFT073
cguccaucccacacug

SEQ ID NO: 585302 - RNA, 19 nt, Escherichia coli CFT073
cguccaaucagcacacaua

SEQ ID NO: 585303 - RNA, 19 nt, Escherichia coli CFT073
cgucauauagccgcgcagu

SEQ ID NO: 585304 - RNA, 22 nt, Escherichia coli CFT073
cgucauauagccgcgcaguuuc

SEQ ID NO: 585305 - RNA, 22 nt, Escherichia coli CFT073
cgucaguuuuucacccgcaauc

SEQ ID NO: 585306 - RNA, 17 nt, Escherichia coli CFT073
cgucaguuuuuccagau

SEQ ID NO: 585307 - RNA, 18 nt, Escherichia coli CFT073
cgucaguuuuuccagauc

SEQ ID NO: 585308 - RNA, 17 nt, Escherichia coli CFT073
cgucauaauccggcaac

SEQ ID NO: 585309 - RNA, 18 nt, Escherichia coli CFT073
cguccgacggcauuaacg

SEQ ID NO: 585310 - RNA, 18 nt, Escherichia coli CFT073
cgucccugguacagcaga

SEQ ID NO: 585311 - RNA, 12 nt, Escherichia coli CFT073
cguccgguuucc

SEQ ID NO: 585312 - RNA, 14 nt, Escherichia coli CFT073
cguccgguuuccgu

SEQ ID NO: 585313 - RNA, 16 nt, Escherichia coli CFT073
cgucgaaaauaucgag

SEQ ID NO: 585314 - RNA, 14 nt, Escherichia coli CFT073
cguccugcucgcca

SEQ ID NO: 585315 - RNA, 12 nt, Escherichia coli CFT073
cgucgaccagca

SEQ ID NO: 585316 - RNA, 22 nt, Escherichia coli CFT073
cgucgaaagcccaucauccgcg

SEQ ID NO: 585317 - RNA, 21 nt, Escherichia coli CFT073
cgucuaucagcuucugcacga

SEQ ID NO: 585318 - RNA, 16 nt, Escherichia coli CFT073
cgucuaaaucguacca

SEQ ID NO: 585319 - RNA, 19 nt, Escherichia coli CFT073
cgucgucuucaacguuccu

SEQ ID NO: 585320 - RNA, 16 nt, Escherichia coli CFT073
cgucgucuuuauccug

SEQ ID NO: 585321 - RNA, 17 nt, Escherichia coli CFT073
cgucguaaucauaaaac

SEQ ID NO: 585322 - RNA, 14 nt, Escherichia coli CFT073
cgucggugcagcau

SEQ ID NO: 585323 - RNA, 17 nt, Escherichia coli CFT073
cgucgggauugcauccu

SEQ ID NO: 585324 - RNA, 17 nt, Escherichia coli CFT073
cgucgauaucaaccagu

SEQ ID NO: 585325 - RNA, 20 nt, Escherichia coli CFT073
cgucgaguuuauagccuguc

SEQ ID NO: 585326 - RNA, 22 nt, Escherichia coli CFT073
cgucgauaaacaucgccauaaa

SEQ ID NO: 585327 - RNA, 22 nt, Escherichia coli CFT073
cgucgcaucaggcaaugggcaa

SEQ ID NO: 585328 - RNA, 20 nt, Escherichia coli CFT073
cgucgcauccggcaauuacg

SEQ ID NO: 585329 - RNA, 15 nt, Escherichia coli CFT073
cgucgccaaugcgca

SEQ ID NO: 585330 - RNA, 22 nt, Escherichia coli CFT073
cgucgcguuucuccacuggcac

SEQ ID NO: 585331 - RNA, 15 nt, Escherichia coli CFT073
cgucgccuucaacgu

SEQ ID NO: 585332 - RNA, 15 nt, Escherichia coli CFT073
cgucgccgccgccag

SEQ ID NO: 585333 - RNA, 17 nt, Escherichia coli CFT073
cgucgccgguuugcagu

SEQ ID NO: 585334 - RNA, 13 nt, Escherichia coli CFT073
cgguuuuuuucga

SEQ ID NO: 585335 - RNA, 16 nt, Escherichia coli CFT073
cguaaaacucacaacc

SEQ ID NO: 585336 - RNA, 17 nt, Escherichia coli CFT073
cgguuuaaucgauuuag

SEQ ID NO: 585337 - RNA, 17 nt, Escherichia coli CFT073
cgguuucaaaacuggug

SEQ ID NO: 585338 - RNA, 20 nt, Escherichia coli CFT073
cgguuucaacauuuccagcg

SEQ ID NO: 585339 - RNA, 17 nt, Escherichia coli CFT073
cgguuucaaccagcagg

SEQ ID NO: 585340 - RNA, 19 nt, Escherichia coli CFT073
cguaaagccugcuggcagc

SEQ ID NO: 585341 - RNA, 19 nt, Escherichia coli CFT073
cguaaaaaucggcaacauc

SEQ ID NO: 585342 - RNA, 15 nt, Escherichia coli CFT073
cguaaacgaucaucg

SEQ ID NO: 585343 - RNA, 16 nt, Escherichia coli CFT073
cguaaacgccuuaucc

SEQ ID NO: 585344 - RNA, 16 nt, Escherichia coli CFT073
cgguugugugcuggcc

SEQ ID NO: 585345 - RNA, 13 nt, Escherichia coli CFT073
cgguuguuuuaau

SEQ ID NO: 585346 - RNA, 12 nt, Escherichia coli CFT073
cgguugcuuuuc

SEQ ID NO: 585347 - RNA, 14 nt, Escherichia coli CFT073
cgguuggccugaua

SEQ ID NO: 585348 - RNA, 16 nt, Escherichia coli CFT073
cgguuggccugauaag

SEQ ID NO: 585349 - RNA, 22 nt, Escherichia coli CFT073
cgguucuucaucuucaucaucu

SEQ ID NO: 585350 - RNA, 19 nt, Escherichia coli CFT073
cgguugagagaagaaacga

SEQ ID NO: 585351 - RNA, 16 nt, Escherichia coli CFT073
cgguugaacgccaaau

SEQ ID NO: 585352 - RNA, 20 nt, Escherichia coli CFT073
cgguugacgccccuggcgau

SEQ ID NO: 585353 - RNA, 11 nt, Escherichia coli CFT073
cgguucccaga

SEQ ID NO: 585354 - RNA, 14 nt, Escherichia coli CFT073
cgguuaauaagaga

SEQ ID NO: 585355 - RNA, 21 nt, Escherichia coli CFT073
cgguguuguugaguccgguag

SEQ ID NO: 585356 - RNA, 16 nt, Escherichia coli CFT073
cgguguuucgggcagc

SEQ ID NO: 585357 - RNA, 21 nt, Escherichia coli CFT073
cgguuaaaaacagccagcagc

SEQ ID NO: 585358 - RNA, 15 nt, Escherichia coli CFT073
cgguuaacagcgcac

SEQ ID NO: 585359 - RNA, 17 nt, Escherichia coli CFT073
cgguuaacgccagccac

SEQ ID NO: 585360 - RNA, 23 nt, Escherichia coli CFT073
cgguuaacgccagccacaaacca

SEQ ID NO: 585361 - RNA, 16 nt, Escherichia coli CFT073
cggugguuucucccca

SEQ ID NO: 585362 - RNA, 21 nt, Escherichia coli CFT073
cgguguucccgcgccagcgug

SEQ ID NO: 585363 - RNA, 20 nt, Escherichia coli CFT073
cggugucuuuuugcuccgaa

SEQ ID NO: 585364 - RNA, 16 nt, Escherichia coli CFT073
cgguguccacuuccgc

SEQ ID NO: 585365 - RNA, 13 nt, Escherichia coli CFT073
cgguggccacagc

SEQ ID NO: 585366 - RNA, 22 nt, Escherichia coli CFT073
cgguggcggcgucagcggcugu

SEQ ID NO: 585367 - RNA, 15 nt, Escherichia coli CFT073
cgguggauuuuucgc

SEQ ID NO: 585368 - RNA, 13 nt, Escherichia coli CFT073
cgguggaccacgg

SEQ ID NO: 585369 - RNA, 20 nt, Escherichia coli CFT073
cggugcuggcggccugaugc

SEQ ID NO: 585370 - RNA, 17 nt, Escherichia coli CFT073
cggugcgguaaucgccc

SEQ ID NO: 585371 - RNA, 16 nt, Escherichia coli CFT073
cggugcgccaaacugc

SEQ ID NO: 585372 - RNA, 19 nt, Escherichia coli CFT073
cggugcgccaaacugccgu

SEQ ID NO: 585373 - RNA, 18 nt, Escherichia coli CFT073
cggucugauacaugcugu

SEQ ID NO: 585374 - RNA, 17 nt, Escherichia coli CFT073
cggucuguauuuggcug

SEQ ID NO: 585375 - RNA, 22 nt, Escherichia coli CFT073
cggucguugucuggcuggugga

SEQ ID NO: 585376 - RNA, 21 nt, Escherichia coli CFT073
cggucuaccgauccggcacca

SEQ ID NO: 585377 - RNA, 21 nt, Escherichia coli CFT073
cggugacaucaauacgguuga

SEQ ID NO: 585378 - RNA, 18 nt, Escherichia coli CFT073
cggucgugacugccgcca

SEQ ID NO: 585379 - RNA, 20 nt, Escherichia coli CFT073
cggucgccgcgcaaauccac

SEQ ID NO: 585380 - RNA, 14 nt, Escherichia coli CFT073
cggugccgguuuca

SEQ ID NO: 585381 - RNA, 21 nt, Escherichia coli CFT073
cggugccgcgauaccacccgc

SEQ ID NO: 585382 - RNA, 17 nt, Escherichia coli CFT073
cggugccauuucgcugg

SEQ ID NO: 585383 - RNA, 17 nt, Escherichia coli CFT073
cggugcaccugccagca

SEQ ID NO: 585384 - RNA, 16 nt, Escherichia coli CFT073
cggugcagcagcuucg

SEQ ID NO: 585385 - RNA, 20 nt, Escherichia coli CFT073
cggugaugguuggcccgaua

SEQ ID NO: 585386 - RNA, 23 nt, Escherichia coli CFT073
cggugauuuccgccgccagcaga

SEQ ID NO: 585387 - RNA, 16 nt, Escherichia coli CFT073
cggugaucagcgucag

SEQ ID NO: 585388 - RNA, 14 nt, Escherichia coli CFT073
cggugauacagcaa

SEQ ID NO: 585389 - RNA, 14 nt, Escherichia coli CFT073
cggugaccaucagc

SEQ ID NO: 585390 - RNA, 17 nt, Escherichia coli CFT073
cguugcuuauugccgga

SEQ ID NO: 585391 - RNA, 21 nt, Escherichia coli CFT073
cguugcuuauugccggaugcg

SEQ ID NO: 585392 - RNA, 16 nt, Escherichia coli CFT073
cguugcuucacgcggg

SEQ ID NO: 585393 - RNA, 16 nt, Escherichia coli CFT073
cguugcguugccgcca

SEQ ID NO: 585394 - RNA, 23 nt, Escherichia coli CFT073
cguugcucaaggguuucgcgguu

SEQ ID NO: 585395 - RNA, 20 nt, Escherichia coli CFT073
cguugcucagaaucacgcca

SEQ ID NO: 585396 - RNA, 15 nt, Escherichia coli CFT073
cguugcggucugcca

SEQ ID NO: 585397 - RNA, 13 nt, Escherichia coli CFT073
cguugcaucaccc

SEQ ID NO: 585398 - RNA, 14 nt, Escherichia coli CFT073
cguugcauuccaga

SEQ ID NO: 585399 - RNA, 17 nt, Escherichia coli CFT073
cguugcagguuaggcug

SEQ ID NO: 585400 - RNA, 17 nt, Escherichia coli CFT073
cguugaguuuacgcagc

SEQ ID NO: 585401 - RNA, 13 nt, Escherichia coli CFT073
cguucucgcgaua

SEQ ID NO: 585402 - RNA, 20 nt, Escherichia coli CFT073
cguucucaccaacuggcgca

SEQ ID NO: 585403 - RNA, 19 nt, Escherichia coli CFT073
cguuauacaucgcuuucca

SEQ ID NO: 585404 - RNA, 17 nt, Escherichia coli CFT073
cguuauacaucgucgca

SEQ ID NO: 585405 - RNA, 16 nt, Escherichia coli CFT073
cguuauacauugagca

SEQ ID NO: 585406 - RNA, 21 nt, Escherichia coli CFT073
cguuagaacccaacagaugag

SEQ ID NO: 585407 - RNA, 13 nt, Escherichia coli CFT073
cguuaccggcaau

SEQ ID NO: 585408 - RNA, 15 nt, Escherichia coli CFT073
cguuacccagcacgg

SEQ ID NO: 585409 - RNA, 15 nt, Escherichia coli CFT073
cguuacccagcgcca

SEQ ID NO: 585410 - RNA, 16 nt, Escherichia coli CFT073
cgugugguaaaaccuu

SEQ ID NO: 585411 - RNA, 14 nt, Escherichia coli CFT073
cgugugugagauau

SEQ ID NO: 585412 - RNA, 22 nt, Escherichia coli CFT073
cgugugugagauauaucgcgua

SEQ ID NO: 585413 - RNA, 15 nt, Escherichia coli CFT073
cguguggcgguagcg

SEQ ID NO: 585414 - RNA, 22 nt, Escherichia coli CFT073
cgugugcggcgaugaugacgcg

SEQ ID NO: 585415 - RNA, 13 nt, Escherichia coli CFT073
cgugugauaaugu

SEQ ID NO: 585416 - RNA, 18 nt, Escherichia coli CFT073
cguucgccagcuccagcg

SEQ ID NO: 585417 - RNA, 19 nt, Escherichia coli CFT073
cguucgccagcuccagcgc

SEQ ID NO: 585418 - RNA, 18 nt, Escherichia coli CFT073
cguucgccccauacagcg

SEQ ID NO: 585419 - RNA, 15 nt, Escherichia coli CFT073
cgugcuucacuucag

SEQ ID NO: 585420 - RNA, 13 nt, Escherichia coli CFT073
cguggcagcagga

SEQ ID NO: 585421 - RNA, 20 nt, Escherichia coli CFT073
cguggguucaucgagcagca

SEQ ID NO: 585422 - RNA, 16 nt, Escherichia coli CFT073
cgugguaagaagagcg

SEQ ID NO: 585423 - RNA, 16 nt, Escherichia coli CFT073
cgugguuugcggcauu

SEQ ID NO: 585424 - RNA, 17 nt, Escherichia coli CFT073
cguguauuuugcaucga

SEQ ID NO: 585425 - RNA, 22 nt, Escherichia coli CFT073
cgugucgagcauugccagcauu

SEQ ID NO: 585426 - RNA, 13 nt, Escherichia coli CFT073
cguuucgcuggau

SEQ ID NO: 585427 - RNA, 22 nt, Escherichia coli CFT073
cguuucguggaaaacaccgaua

SEQ ID NO: 585428 - RNA, 24 nt, Escherichia coli CFT073
cguuugcccuaaagcgcgaucgcu

SEQ ID NO: 585429 - RNA, 20 nt, Escherichia coli CFT073
cguuugcagcuuacgcgcca

SEQ ID NO: 585430 - RNA, 23 nt, Escherichia coli CFT073
cguuugaccgacaccggcagaga

SEQ ID NO: 585431 - RNA, 15 nt, Escherichia coli CFT073
cguuugaugcgcgag

SEQ ID NO: 585432 - RNA, 19 nt, Escherichia coli CFT073
cguuuuaaugauuuccagg

SEQ ID NO: 585433 - RNA, 17 nt, Escherichia coli CFT073
cguuuuaaugcgauccu

SEQ ID NO: 585434 - RNA, 14 nt, Escherichia coli CFT073
cguuuggcaucagc

SEQ ID NO: 585435 - RNA, 13 nt, Escherichia coli CFT073
cguuuguagcaga

SEQ ID NO: 585436 - RNA, 13 nt, Escherichia coli CFT073
cguuugcggcugu

SEQ ID NO: 585437 - RNA, 23 nt, Escherichia coli CFT073
cguuugccagaacugcugcgcca

SEQ ID NO: 585438 - RNA, 12 nt, Escherichia coli CFT073
cguuuucaacac

SEQ ID NO: 585439 - RNA, 12 nt, Escherichia coli CFT073
cguuuucaaccg

SEQ ID NO: 585440 - RNA, 17 nt, Escherichia coli CFT073
cguuuucuccagcgccg

SEQ ID NO: 585441 - RNA, 21 nt, Escherichia coli CFT073
cguuuucuucucuacgcaaag

SEQ ID NO: 585442 - RNA, 19 nt, Escherichia coli CFT073
cguuuugacagguugccgg

SEQ ID NO: 585443 - RNA, 20 nt, Escherichia coli CFT073
cguuuugaucuuacguuuaa

SEQ ID NO: 585444 - RNA, 18 nt, Escherichia coli CFT073
cguuuugcuguuccagca

SEQ ID NO: 585445 - RNA, 18 nt, Escherichia coli CFT073
cguuuuucaucuuccgga

SEQ ID NO: 585446 - RNA, 11 nt, Escherichia coli CFT073
cguuuuuucgc

SEQ ID NO: 585447 - RNA, 17 nt, Escherichia coli CFT073
cguuuuuugaucaguaa

SEQ ID NO: 585448 - RNA, 15 nt, Escherichia coli CFT073
cuaaaccaucagcag

SEQ ID NO: 585449 - RNA, 14 nt, Escherichia coli CFT073
cuaaaccccaacca

SEQ ID NO: 585450 - RNA, 15 nt, Escherichia coli CFT073
cuaaaaucaucacgc

SEQ ID NO: 585451 - RNA, 13 nt, Escherichia coli CFT073
cuaaaagcacgcc

SEQ ID NO: 585452 - RNA, 23 nt, Escherichia coli CFT073
cuaaaauuggggucaucgcccug

SEQ ID NO: 585453 - RNA, 13 nt, Escherichia coli CFT073
cuaaaauuucuuu

SEQ ID NO: 585454 - RNA, 14 nt, Escherichia coli CFT073
cuaaaucggggauc

SEQ ID NO: 585455 - RNA, 22 nt, Escherichia coli CFT073
cuaacaauggagcacauugccu

SEQ ID NO: 585456 - RNA, 14 nt, Escherichia coli CFT073
cuaacacuuucgcc

SEQ ID NO: 585457 - RNA, 19 nt, Escherichia coli CFT073
cuaacaugcccauucccca

SEQ ID NO: 585458 - RNA, 11 nt, Escherichia coli CFT073
cuaaccaaacu

SEQ ID NO: 585459 - RNA, 13 nt, Escherichia coli CFT073
cuaacccuuccag

SEQ ID NO: 585460 - RNA, 12 nt, Escherichia coli CFT073
cuaaccgcgcau

SEQ ID NO: 585461 - RNA, 22 nt, Escherichia coli CFT073
cuaacgacaaaucauacaggcg

SEQ ID NO: 585462 - RNA, 17 nt, Escherichia coli CFT073
cuaacgcuucuggcgua

SEQ ID NO: 585463 - RNA, 17 nt, Escherichia coli CFT073
cuaacgguucggcaauc

SEQ ID NO: 585464 - RNA, 22 nt, Escherichia coli CFT073
cguuuaugucgcauccugcacu

SEQ ID NO: 585465 - RNA, 22 nt, Escherichia coli CFT073
cguuuacgccgcauccggcaac

SEQ ID NO: 585466 - RNA, 22 nt, Escherichia coli CFT073
cguuuacgccgcauccggcaau

SEQ ID NO: 585467 - RNA, 15 nt, Escherichia coli CFT073
cguuuagacgcugcg

SEQ ID NO: 585468 - RNA, 12 nt, Escherichia coli CFT073
cguuuaaucgcc

SEQ ID NO: 585469 - RNA, 13 nt, Escherichia coli CFT073
cguuuaccuaucu

SEQ ID NO: 585470 - RNA, 19 nt, Escherichia coli CFT073
cguuucauguaacgcugca

SEQ ID NO: 585471 - RNA, 16 nt, Escherichia coli CFT073
cguuuccauaaccgcu

SEQ ID NO: 585472 - RNA, 18 nt, Escherichia coli CFT073
cguuuccauaucgcuggc

SEQ ID NO: 585473 - RNA, 13 nt, Escherichia coli CFT073
cguugugcgaucc

SEQ ID NO: 585474 - RNA, 21 nt, Escherichia coli CFT073
cguugugcuuugugaccacgg

SEQ ID NO: 585475 - RNA, 18 nt, Escherichia coli CFT073
cguuguuaaauccagauc

SEQ ID NO: 585476 - RNA, 14 nt, Escherichia coli CFT073
cguuguuuacagca

SEQ ID NO: 585477 - RNA, 19 nt, Escherichia coli CFT073
cguuggcgcguguuccaga

SEQ ID NO: 585478 - RNA, 20 nt, Escherichia coli CFT073
cguugguuugauagcaaugc

SEQ ID NO: 585479 - RNA, 19 nt, Escherichia coli CFT073
cuacugauguucgccagau

SEQ ID NO: 585480 - RNA, 11 nt, Escherichia coli CFT073
cuagcgucgca

SEQ ID NO: 585481 - RNA, 15 nt, Escherichia coli CFT073
cuacgccuaccacca

SEQ ID NO: 585482 - RNA, 21 nt, Escherichia coli CFT073
cuacgccuuccgucagcaaag

SEQ ID NO: 585483 - RNA, 19 nt, Escherichia coli CFT073
cuaccugcucgucauccgc

SEQ ID NO: 585484 - RNA, 19 nt, Escherichia coli CFT073
cuaccugacugaauacgau

SEQ ID NO: 585485 - RNA, 17 nt, Escherichia coli CFT073
cuaccugauucgcacca

SEQ ID NO: 585486 - RNA, 20 nt, Escherichia coli CFT073
cuacgcuaacuucgccauca

SEQ ID NO: 585487 - RNA, 13 nt, Escherichia coli CFT073
cuacgcuuaucag

SEQ ID NO: 585488 - RNA, 14 nt, Escherichia coli CFT073
cuacgcuugcugcg

SEQ ID NO: 585489 - RNA, 12 nt, Escherichia coli CFT073
cuaccgccagac

SEQ ID NO: 585490 - RNA, 12 nt, Escherichia coli CFT073
cuaccggaacca

SEQ ID NO: 585491 - RNA, 16 nt, Escherichia coli CFT073
cuaccggaaucgcgcg

SEQ ID NO: 585492 - RNA, 15 nt, Escherichia coli CFT073
cuaagcaauuacagg

SEQ ID NO: 585493 - RNA, 15 nt, Escherichia coli CFT073
cuaagcacgauauca

SEQ ID NO: 585494 - RNA, 17 nt, Escherichia coli CFT073
cuaagcaggcuggcgac

SEQ ID NO: 585495 - RNA, 18 nt, Escherichia coli CFT073
cuaagcaggcuggcgacg

SEQ ID NO: 585496 - RNA, 14 nt, Escherichia coli CFT073
cuaacucacgcaga

SEQ ID NO: 585497 - RNA, 14 nt, Escherichia coli CFT073
cuaacucuuccugc

SEQ ID NO: 585498 - RNA, 16 nt, Escherichia coli CFT073
cuaacugacuuucuuu

SEQ ID NO: 585499 - RNA, 23 nt, Escherichia coli CFT073
cuaacuguuucgcggcaaacugc

SEQ ID NO: 585500 - RNA, 15 nt, Escherichia coli CFT073
cuaauguagcgacca

SEQ ID NO: 585501 - RNA, 14 nt, Escherichia coli CFT073
cuaaugauucauaa

SEQ ID NO: 585502 - RNA, 13 nt, Escherichia coli CFT073
cuaauaucaacgc

SEQ ID NO: 585503 - RNA, 21 nt, Escherichia coli CFT073
cuaauagcaaaauauaaaccg

SEQ ID NO: 585504 - RNA, 14 nt, Escherichia coli CFT073
cuaauagcgcagcg

SEQ ID NO: 585505 - RNA, 17 nt, Escherichia coli CFT073
cuaauacucuggcuggu

SEQ ID NO: 585506 - RNA, 19 nt, Escherichia coli CFT073
cuaaucgagccgauuaaaa

SEQ ID NO: 585507 - RNA, 11 nt, Escherichia coli CFT073
cuaauuucacg

SEQ ID NO: 585508 - RNA, 20 nt, Escherichia coli CFT073
cuaauuuccuggacuucuuu

SEQ ID NO: 585509 - RNA, 15 nt, Escherichia coli CFT073
cuaauuuaucggcgu

SEQ ID NO: 585510 - RNA, 14 nt, Escherichia coli CFT073
cuaccaacgcaccc

SEQ ID NO: 585511 - RNA, 18 nt, Escherichia coli CFT073
cuacaggcggugucggaa

SEQ ID NO: 585512 - RNA, 16 nt, Escherichia coli CFT073
cuacagguaagguaau

SEQ ID NO: 585513 - RNA, 23 nt, Escherichia coli CFT073
cuacagugccccaaaugucggau

SEQ ID NO: 585514 - RNA, 21 nt, Escherichia coli CFT073
cuacccaaccgauaaccacgc

SEQ ID NO: 585515 - RNA, 16 nt, Escherichia coli CFT073
cuaccagcgccaccgg

SEQ ID NO: 585516 - RNA, 17 nt, Escherichia coli CFT073
cuaccagcgccaccggu

SEQ ID NO: 585517 - RNA, 15 nt, Escherichia coli CFT073
cuaccaguuccagcg

SEQ ID NO: 585518 - RNA, 22 nt, Escherichia coli CFT073
cuaccaguuuggugacgccaca

SEQ ID NO: 585519 - RNA, 15 nt, Escherichia coli CFT073
cuaccaucgacacca

SEQ ID NO: 585520 - RNA, 21 nt, Escherichia coli CFT073
cuccagccugcgucagcuauu

SEQ ID NO: 585521 - RNA, 19 nt, Escherichia coli CFT073
cuccagcgacacaaugggc

SEQ ID NO: 585522 - RNA, 21 nt, Escherichia coli CFT073
cuccgagagauccugagaaau

SEQ ID NO: 585523 - RNA, 14 nt, Escherichia coli CFT073
cucccuugccugca

SEQ ID NO: 585524 - RNA, 19 nt, Escherichia coli CFT073
cuccgauauuugccgcgac

SEQ ID NO: 585525 - RNA, 12 nt, Escherichia coli CFT073
cucccgcuggcg

SEQ ID NO: 585526 - RNA, 16 nt, Escherichia coli CFT073
cucccgcuuuggcauc

SEQ ID NO: 585527 - RNA, 20 nt, Escherichia coli CFT073
cucccgcgccgcagccggaa

SEQ ID NO: 585528 - RNA, 14 nt, Escherichia coli CFT073
cucaucaauacccg

SEQ ID NO: 585529 - RNA, 23 nt, Escherichia coli CFT073
cucaguugccauauccaccggaa

SEQ ID NO: 585530 - RNA, 17 nt, Escherichia coli CFT073
  misc_feature (5)..(5): n is a, c, g or u
cucangagugaacacgu

SEQ ID NO: 585531 - RNA, 19 nt, Escherichia coli CFT073
cucagguugauagaaauau

SEQ ID NO: 585532 - RNA, 19 nt, Escherichia coli CFT073
cucauggaaucuuuaauga

SEQ ID NO: 585533 - RNA, 21 nt, Escherichia coli CFT073
cuccacccgcaaauaauugcc

SEQ ID NO: 585534 - RNA, 16 nt, Escherichia coli CFT073
cuccaccagcaccagc

SEQ ID NO: 585535 - RNA, 22 nt, Escherichia coli CFT073
cuccaccagcaccagcaacaac

SEQ ID NO: 585536 - RNA, 18 nt, Escherichia coli CFT073
cuccagacgcccgcgccc

SEQ ID NO: 585537 - RNA, 20 nt, Escherichia coli CFT073
cucaucuuuaucggugagac

SEQ ID NO: 585538 - RNA, 16 nt, Escherichia coli CFT073
cucauccgccaaaaca

SEQ ID NO: 585539 - RNA, 17 nt, Escherichia coli CFT073
cuccugaacuuucucuc

SEQ ID NO: 585540 - RNA, 22 nt, Escherichia coli CFT073
cuccgucgggcuuaacguccgg

SEQ ID NO: 585541 - RNA, 14 nt, Escherichia coli CFT073
cuccugaucaagcu

SEQ ID NO: 585542 - RNA, 19 nt, Escherichia coli CFT073
cuccugcaacagguuacgc

SEQ ID NO: 585543 - RNA, 20 nt, Escherichia coli CFT073
cucgacacccagcuucauca

SEQ ID NO: 585544 - RNA, 20 nt, Escherichia coli CFT073
cuccggcguuuuggcuguga

SEQ ID NO: 585545 - RNA, 18 nt, Escherichia coli CFT073
cuccggugguuaacgcug

SEQ ID NO: 585546 - RNA, 18 nt, Escherichia coli CFT073
cuccggccuacaaaacau

SEQ ID NO: 585547 - RNA, 15 nt, Escherichia coli CFT073
cuccgccaucuucuu

SEQ ID NO: 585548 - RNA, 13 nt, Escherichia coli CFT073
cucgaucaguuca

SEQ ID NO: 585549 - RNA, 19 nt, Escherichia coli CFT073
cucgacuagauacugacga

SEQ ID NO: 585550 - RNA, 15 nt, Escherichia coli CFT073
cucuucguggcccgc

SEQ ID NO: 585551 - RNA, 21 nt, Escherichia coli CFT073
cucuucuaaaucguaccagcg

SEQ ID NO: 585552 - RNA, 17 nt, Escherichia coli CFT073
cucuucggcuucuaccu

SEQ ID NO: 585553 - RNA, 22 nt, Escherichia coli CFT073
cucuucgcgaaugguaaucagc

SEQ ID NO: 585554 - RNA, 12 nt, Escherichia coli CFT073
cucuuccggcgu

SEQ ID NO: 585555 - RNA, 17 nt, Escherichia coli CFT073
cucuuccagguaagcaa

SEQ ID NO: 585556 - RNA, 19 nt, Escherichia coli CFT073
cucuuccgguguaucaggg

SEQ ID NO: 585557 - RNA, 13 nt, Escherichia coli CFT073
cucugaaugccag

SEQ ID NO: 585558 - RNA, 15 nt, Escherichia coli CFT073
cucuccgggcggcgu

SEQ ID NO: 585559 - RNA, 15 nt, Escherichia coli CFT073
cucguugcgccggga

SEQ ID NO: 585560 - RNA, 15 nt, Escherichia coli CFT073
cucguuggguugcca

SEQ ID NO: 585561 - RNA, 22 nt, Escherichia coli CFT073
cucguucugaauacccgccaga

SEQ ID NO: 585562 - RNA, 15 nt, Escherichia coli CFT073
cucgugcgcgggaug

SEQ ID NO: 585563 - RNA, 13 nt, Escherichia coli CFT073
cucgugcgucgca

SEQ ID NO: 585564 - RNA, 13 nt, Escherichia coli CFT073
cucgugccagagc

SEQ ID NO: 585565 - RNA, 20 nt, Escherichia coli CFT073
cucgucaaucugcuccauua

SEQ ID NO: 585566 - RNA, 23 nt, Escherichia coli CFT073
cucgucccaaaagcucggucauu

SEQ ID NO: 585567 - RNA, 13 nt, Escherichia coli CFT073
cucggucacugac

SEQ ID NO: 585568 - RNA, 20 nt, Escherichia coli CFT073
cucgguaaaacuaacgccag

SEQ ID NO: 585569 - RNA, 18 nt, Escherichia coli CFT073
cucgcgucgugguaucgc

SEQ ID NO: 585570 - RNA, 18 nt, Escherichia coli CFT073
cucgcucaguuucgcgua

SEQ ID NO: 585571 - RNA, 22 nt, Escherichia coli CFT073
cucgcugacaucaacaauucgu

SEQ ID NO: 585572 - RNA, 19 nt, Escherichia coli CFT073
cucgcgguuggcaaucagu

SEQ ID NO: 585573 - RNA, 23 nt, Escherichia coli CFT073
cucgcaauuauaauacgcuugau

SEQ ID NO: 585574 - RNA, 20 nt, Escherichia coli CFT073
cucgcuggcguuguccgcca

SEQ ID NO: 585575 - RNA, 13 nt, Escherichia coli CFT073
cucgcuggcaggc

SEQ ID NO: 585576 - RNA, 22 nt, Escherichia coli CFT073
cucggcgggcaacguuccagca

SEQ ID NO: 585577 - RNA, 14 nt, Escherichia coli CFT073
aacgcuucugucgc

SEQ ID NO: 585578 - RNA, 19 nt, Escherichia coli CFT073
aacgcugugcguaaucgcc

SEQ ID NO: 585579 - RNA, 20 nt, Escherichia coli CFT073
aacgcugcgugcgugcgggu

SEQ ID NO: 585580 - RNA, 16 nt, Escherichia coli CFT073
aacgcugcccgccgcg

SEQ ID NO: 585581 - RNA, 20 nt, Escherichia coli CFT073
aacgcuggggccaucgccgc

SEQ ID NO: 585582 - RNA, 23 nt, Escherichia coli CFT073
gaccgauuaauuccccugccaga

SEQ ID NO: 585583 - RNA, 15 nt, Escherichia coli CFT073
gaccgccaaucagca

SEQ ID NO: 585584 - RNA, 15 nt, Escherichia coli CFT073
gaccgcuccgccauc

SEQ ID NO: 585585 - RNA, 16 nt, Escherichia coli CFT073
gaccggaauuuacccg

SEQ ID NO: 585586 - RNA, 21 nt, Escherichia coli CFT073
gaccgguccacuuccugcgcc

SEQ ID NO: 585587 - RNA, 18 nt, Escherichia coli CFT073
gacgaaagcgcaguaagc

SEQ ID NO: 585588 - RNA, 16 nt, Escherichia coli CFT073
aacgggucgagaacga

SEQ ID NO: 585589 - RNA, 23 nt, Escherichia coli CFT073
aacgguaaagcccucaccgaagc

SEQ ID NO: 585590 - RNA, 13 nt, Escherichia coli CFT073
aacggucgauucg

SEQ ID NO: 585591 - RNA, 17 nt, Escherichia coli CFT073
aacggucuacauugcuc

SEQ ID NO: 585592 - RNA, 17 nt, Escherichia coli CFT073
aacgggggaauaacccg

SEQ ID NO: 585593 - RNA, 15 nt, Escherichia coli CFT073
aacggggcugccagc

SEQ ID NO: 585594 - RNA, 13 nt, Escherichia coli CFT073
aacgggucaucaa

SEQ ID NO: 585595 - RNA, 16 nt, Escherichia coli CFT073
aacgggauugccagca

SEQ ID NO: 585596 - RNA, 19 nt, Escherichia coli CFT073
aacgggcaccgccgccacu

SEQ ID NO: 585597 - RNA, 13 nt, Escherichia coli CFT073
aacggugccagcc

SEQ ID NO: 585598 - RNA, 14 nt, Escherichia coli CFT073
aacggugcugcaca

SEQ ID NO: 585599 - RNA, 15 nt, Escherichia coli CFT073
aacggugucgauacc

SEQ ID NO: 585600 - RNA, 20 nt, Escherichia coli CFT073
aacggcugauaacaauauca

SEQ ID NO: 585601 - RNA, 18 nt, Escherichia coli CFT073
aacggcugggaaaucacc

SEQ ID NO: 585602 - RNA, 18 nt, Escherichia coli CFT073
aacggcucaaacugcucc

SEQ ID NO: 585603 - RNA, 16 nt, Escherichia coli CFT073
aacggcucacccccau

SEQ ID NO: 585604 - RNA, 19 nt, Escherichia coli CFT073
gaccgugaagguaccgcaa

SEQ ID NO: 585605 - RNA, 16 nt, Escherichia coli CFT073
gaauuaaaaacgauau

SEQ ID NO: 585606 - RNA, 14 nt, Escherichia coli CFT073
gaauuauccccgau

SEQ ID NO: 585607 - RNA, 23 nt, Escherichia coli CFT073
gaauuaucggcgucgcaucaggu

SEQ ID NO: 585608 - RNA, 16 nt, Escherichia coli CFT073
gaauucaacuaacuga

SEQ ID NO: 585609 - RNA, 18 nt, Escherichia coli CFT073
gaauuaugcccaaugagc

SEQ ID NO: 585610 - RNA, 15 nt, Escherichia coli CFT073
gaauggucaguuucg

SEQ ID NO: 585611 - RNA, 15 nt, Escherichia coli CFT073
gaauggugaccugca

SEQ ID NO: 585612 - RNA, 12 nt, Escherichia coli CFT073
gaaugguuaacg

SEQ ID NO: 585613 - RNA, 22 nt, Escherichia coli CFT073
gaauuccggcuucuucugccgc

SEQ ID NO: 585614 - RNA, 22 nt, Escherichia coli CFT073
aacgaaucuuuaaccaggcaag

SEQ ID NO: 585615 - RNA, 12 nt, Escherichia coli CFT073
aacgacaccacg

SEQ ID NO: 585616 - RNA, 16 nt, Escherichia coli CFT073
aacgacacugcucgca

SEQ ID NO: 585617 - RNA, 20 nt, Escherichia coli CFT073
aacgacacugcucgcagaaa

SEQ ID NO: 585618 - RNA, 16 nt, Escherichia coli CFT073
gacagcgcccgacaag

SEQ ID NO: 585619 - RNA, 14 nt, Escherichia coli CFT073
gacauaaacaccag

SEQ ID NO: 585620 - RNA, 19 nt, Escherichia coli CFT073
gacauaaacaccagcaaua

SEQ ID NO: 585621 - RNA, 18 nt, Escherichia coli CFT073
gacagugaugacgccagc

SEQ ID NO: 585622 - RNA, 15 nt, Escherichia coli CFT073
gacaguaccagcagu

SEQ ID NO: 585623 - RNA, 17 nt, Escherichia coli CFT073
gacagucacguagcggc

SEQ ID NO: 585624 - RNA, 18 nt, Escherichia coli CFT073
gacaggucaucgcaucgu

SEQ ID NO: 585625 - RNA, 23 nt, Escherichia coli CFT073
gacauuaucaccgacaaacagcg

SEQ ID NO: 585626 - RNA, 15 nt, Escherichia coli CFT073
gacauugccaguuuu

SEQ ID NO: 585627 - RNA, 22 nt, Escherichia coli CFT073
gacaugcgguucacgcgccaga

SEQ ID NO: 585628 - RNA, 17 nt, Escherichia coli CFT073
gacauggcuaugcguug

SEQ ID NO: 585629 - RNA, 18 nt, Escherichia coli CFT073
gacauguuuuccagcaca

SEQ ID NO: 585630 - RNA, 20 nt, Escherichia coli CFT073
gacaugcgguucacgcgcca

SEQ ID NO: 585631 - RNA, 12 nt, Escherichia coli CFT073
aacgagaacguc

SEQ ID NO: 585632 - RNA, 19 nt, Escherichia coli CFT073
gaccaacacccacagccau

SEQ ID NO: 585633 - RNA, 14 nt, Escherichia coli CFT073
gaccaacaguugcc

SEQ ID NO: 585634 - RNA, 20 nt, Escherichia coli CFT073
aacgaguugcgguuucaacu

SEQ ID NO: 585635 - RNA, 15 nt, Escherichia coli CFT073
aacgauaaauaacgu

SEQ ID NO: 585636 - RNA, 18 nt, Escherichia coli CFT073
aacgauaacaaucaccaa

SEQ ID NO: 585637 - RNA, 21 nt, Escherichia coli CFT073
aacgauaacaaucaccaaacc

SEQ ID NO: 585638 - RNA, 22 nt, Escherichia coli CFT073
aacgauaacaaucaccaaacca

SEQ ID NO: 585639 - RNA, 18 nt, Escherichia coli CFT073
gaccaaucacacaaccau

SEQ ID NO: 585640 - RNA, 14 nt, Escherichia coli CFT073
gaccaauccgccag

SEQ ID NO: 585641 - RNA, 15 nt, Escherichia coli CFT073
gaccaauccgccagc

SEQ ID NO: 585642 - RNA, 19 nt, Escherichia coli CFT073
gaccaauucaaugccccac

SEQ ID NO: 585643 - RNA, 23 nt, Escherichia coli CFT073
gaccaauugccgcaccaaccauc

SEQ ID NO: 585644 - RNA, 13 nt, Escherichia coli CFT073
gaccacaaucaac

SEQ ID NO: 585645 - RNA, 24 nt, Escherichia coli CFT073
gaccacgcacagcccgccgccauc

SEQ ID NO: 585646 - RNA, 16 nt, Escherichia coli CFT073
aacgcagcaucgccau

SEQ ID NO: 585647 - RNA, 20 nt, Escherichia coli CFT073
aacgcagcauuuccucaaca

SEQ ID NO: 585648 - RNA, 13 nt, Escherichia coli CFT073
aacgcacuggcgc

SEQ ID NO: 585649 - RNA, 15 nt, Escherichia coli CFT073
aacgcacuggcgcgc

SEQ ID NO: 585650 - RNA, 23 nt, Escherichia coli CFT073
aacgcagacgcauacugauuacc

SEQ ID NO: 585651 - RNA, 21 nt, Escherichia coli CFT073
aacgcaguuugcgaguggcgc

SEQ ID NO: 585652 - RNA, 14 nt, Escherichia coli CFT073
aacgcaucccgguu

SEQ ID NO: 585653 - RNA, 18 nt, Escherichia coli CFT073
gaccaccagcacgcugaa

SEQ ID NO: 585654 - RNA, 23 nt, Escherichia coli CFT073
gaccaccaaauaaaaaaacgcca

SEQ ID NO: 585655 - RNA, 19 nt, Escherichia coli CFT073
aacgccgaauaacgcgcag

SEQ ID NO: 585656 - RNA, 13 nt, Escherichia coli CFT073
aacgcccgcaacu

SEQ ID NO: 585657 - RNA, 22 nt, Escherichia coli CFT073
aacgccggaaaaacguuucaaa

SEQ ID NO: 585658 - RNA, 18 nt, Escherichia coli CFT073
aacgccugaugcgacgcu

SEQ ID NO: 585659 - RNA, 20 nt, Escherichia coli CFT073
aacgccucguuugcggcaau

SEQ ID NO: 585660 - RNA, 15 nt, Escherichia coli CFT073
aacgccuuauccgac

SEQ ID NO: 585661 - RNA, 20 nt, Escherichia coli CFT073
aacgccuuauccgaccuaca

SEQ ID NO: 585662 - RNA, 18 nt, Escherichia coli CFT073
aacgccuuauccggccua

SEQ ID NO: 585663 - RNA, 20 nt, Escherichia coli CFT073
aacgccuuauccggccuaca

SEQ ID NO: 585664 - RNA, 20 nt, Escherichia coli CFT073
aacgccuuauccggccuacc

SEQ ID NO: 585665 - RNA, 20 nt, Escherichia coli CFT073
aacgccuuauccggccuacu

SEQ ID NO: 585666 - RNA, 20 nt, Escherichia coli CFT073
aacgccuuauccggccugca

SEQ ID NO: 585667 - RNA, 13 nt, Escherichia coli CFT073
aacgccgggaaau

SEQ ID NO: 585668 - RNA, 20 nt, Escherichia coli CFT073
aacgccgguuccugcaucgc

SEQ ID NO: 585669 - RNA, 21 nt, Escherichia coli CFT073
gaccagugcagacucaccuga

SEQ ID NO: 585670 - RNA, 18 nt, Escherichia coli CFT073
gaccagugcagauaccac

SEQ ID NO: 585671 - RNA, 23 nt, Escherichia coli CFT073
gaccaguucacaccgaccaccgc

SEQ ID NO: 585672 - RNA, 15 nt, Escherichia coli CFT073
aacgcgauucccagu

SEQ ID NO: 585673 - RNA, 18 nt, Escherichia coli CFT073
aacgcgauucccagucgc

SEQ ID NO: 585674 - RNA, 23 nt, Escherichia coli CFT073
aacgcgauucccagucgcgcaau

SEQ ID NO: 585675 - RNA, 19 nt, Escherichia coli CFT073
aacgcgacauaucgccagu

SEQ ID NO: 585676 - RNA, 18 nt, Escherichia coli CFT073
aacgccuuauucggccua

SEQ ID NO: 585677 - RNA, 20 nt, Escherichia coli CFT073
aacgccuuauucggccuacc

SEQ ID NO: 585678 - RNA, 20 nt, Escherichia coli CFT073
aacgccuucuccggccuacc

SEQ ID NO: 585679 - RNA, 20 nt, Escherichia coli CFT073
aacgccuuuaccaccagugg

SEQ ID NO: 585680 - RNA, 12 nt, Escherichia coli CFT073
aacgcgccgcaa

SEQ ID NO: 585681 - RNA, 19 nt, Escherichia coli CFT073
aacgcgccaauagccgcac

SEQ ID NO: 585682 - RNA, 23 nt, Escherichia coli CFT073
aacgcgcccaguggaugcgccau

SEQ ID NO: 585683 - RNA, 15 nt, Escherichia coli CFT073
aacgcgccgacgaau

SEQ ID NO: 585684 - RNA, 19 nt, Escherichia coli CFT073
aacgcgccuuaaaaaccag

SEQ ID NO: 585685 - RNA, 23 nt, Escherichia coli CFT073
gaagcauucagacacgccgccag

SEQ ID NO: 585686 - RNA, 14 nt, Escherichia coli CFT073
gaagcagcgcugga

SEQ ID NO: 585687 - RNA, 22 nt, Escherichia coli CFT073
gaagcaauguauuuguccacgc

SEQ ID NO: 585688 - RNA, 17 nt, Escherichia coli CFT073
gaagauuuuuugccagc

SEQ ID NO: 585689 - RNA, 19 nt, Escherichia coli CFT073
gaagcaacaguaauaaugc

SEQ ID NO: 585690 - RNA, 15 nt, Escherichia coli CFT073
gaagaugcguucacc

SEQ ID NO: 585691 - RNA, 14 nt, Escherichia coli CFT073
gaagaguuccagcg

SEQ ID NO: 585692 - RNA, 19 nt, Escherichia coli CFT073
gaagaguuccagcgccgcg

SEQ ID NO: 585693 - RNA, 17 nt, Escherichia coli CFT073
gaagauccaugaagcaa

SEQ ID NO: 585694 - RNA, 23 nt, Escherichia coli CFT073
gaagaucaugaugaugccaaaau

SEQ ID NO: 585695 - RNA, 13 nt, Escherichia coli CFT073
gaagauccagauu

SEQ ID NO: 585696 - RNA, 18 nt, Escherichia coli CFT073
gaagccaguacacgcuga

SEQ ID NO: 585697 - RNA, 22 nt, Escherichia coli CFT073
gaagccauuaccgauaucaaua

SEQ ID NO: 585698 - RNA, 15 nt, Escherichia coli CFT073
gaagcccacaccgcc

SEQ ID NO: 585699 - RNA, 19 nt, Escherichia coli CFT073
gaagccgcuccggcagcag

SEQ ID NO: 585700 - RNA, 19 nt, Escherichia coli CFT073
gaagcgcaacagcgcgccc

SEQ ID NO: 585701 - RNA, 16 nt, Escherichia coli CFT073
gaagccgggcagguga

SEQ ID NO: 585702 - RNA, 14 nt, Escherichia coli CFT073
gaagccggucauau

SEQ ID NO: 585703 - RNA, 20 nt, Escherichia coli CFT073
gaagccguuggucaucauca

SEQ ID NO: 585704 - RNA, 23 nt, Escherichia coli CFT073
gaagcggcggucuucucaccgcc

SEQ ID NO: 585705 - RNA, 17 nt, Escherichia coli CFT073
gaagcgccaccagcgcc

SEQ ID NO: 585706 - RNA, 17 nt, Escherichia coli CFT073
gaagcgacugacgucac

SEQ ID NO: 585707 - RNA, 17 nt, Escherichia coli CFT073
gaaggaaaauacagcaa

SEQ ID NO: 585708 - RNA, 14 nt, Escherichia coli CFT073
gaaggacugccgca

SEQ ID NO: 585709 - RNA, 21 nt, Escherichia coli CFT073
gaagcucguuguuuacgccgg

SEQ ID NO: 585710 - RNA, 22 nt, Escherichia coli CFT073
gaagcucguuguuuacgccgga

SEQ ID NO: 585711 - RNA, 20 nt, Escherichia coli CFT073
gaagcugaacagucgcugau

SEQ ID NO: 585712 - RNA, 22 nt, Escherichia coli CFT073
gaagcugguguaacugcgccag

SEQ ID NO: 585713 - RNA, 22 nt, Escherichia coli CFT073
gaaucuggcuucaucugcgcga

SEQ ID NO: 585714 - RNA, 17 nt, Escherichia coli CFT073
gaaugacacuuucagcg

SEQ ID NO: 585715 - RNA, 20 nt, Escherichia coli CFT073
gaaucucuucuucgcucaug

SEQ ID NO: 585716 - RNA, 13 nt, Escherichia coli CFT073
gaaucucaauucc

SEQ ID NO: 585717 - RNA, 20 nt, Escherichia coli CFT073
gaaugaucacuuguucagcg

SEQ ID NO: 585718 - RNA, 14 nt, Escherichia coli CFT073
gaaucggcgcagca

SEQ ID NO: 585719 - RNA, 13 nt, Escherichia coli CFT073
gaaucccaucaga

SEQ ID NO: 585720 - RNA, 20 nt, Escherichia coli CFT073
gaauccccacaaaccaccga

SEQ ID NO: 585721 - RNA, 13 nt, Escherichia coli CFT073
gaauccagcaagc

SEQ ID NO: 585722 - RNA, 14 nt, Escherichia coli CFT073
gaauccgcaccaac

SEQ ID NO: 585723 - RNA, 16 nt, Escherichia coli CFT073
gaauacacugcugaua

SEQ ID NO: 585724 - RNA, 14 nt, Escherichia coli CFT073
gaauagccgcagcu

SEQ ID NO: 585725 - RNA, 16 nt, Escherichia coli CFT073
gaauagcucaguuggu

SEQ ID NO: 585726 - RNA, 14 nt, Escherichia coli CFT073
gaauacccagcaau

SEQ ID NO: 585727 - RNA, 21 nt, Escherichia coli CFT073
gaagugaucuuucagcguuuu

SEQ ID NO: 585728 - RNA, 13 nt, Escherichia coli CFT073
gaauacgccgaua

SEQ ID NO: 585729 - RNA, 16 nt, Escherichia coli CFT073
gaauaccuucuuccug

SEQ ID NO: 585730 - RNA, 21 nt, Escherichia coli CFT073
gaauaccuuucuccgcgaccu

SEQ ID NO: 585731 - RNA, 19 nt, Escherichia coli CFT073
gaaucaucgcuguggcagu

SEQ ID NO: 585732 - RNA, 13 nt, Escherichia coli CFT073
gaaucagcccagc

SEQ ID NO: 585733 - RNA, 12 nt, Escherichia coli CFT073
gaaucagcagcg

SEQ ID NO: 585734 - RNA, 20 nt, Escherichia coli CFT073
gaaucaccuguucacgacca

SEQ ID NO: 585735 - RNA, 18 nt, Escherichia coli CFT073
gaaucacgaauuccgccu

SEQ ID NO: 585736 - RNA, 14 nt, Escherichia coli CFT073
gaaucacucaucau

SEQ ID NO: 585737 - RNA, 22 nt, Escherichia coli CFT073
gaagguugccauaucuucccgg

SEQ ID NO: 585738 - RNA, 17 nt, Escherichia coli CFT073
gaaggugguuaccgcca

SEQ ID NO: 585739 - RNA, 23 nt, Escherichia coli CFT073
gaaguaauaaucaacgcgccgac

SEQ ID NO: 585740 - RNA, 13 nt, Escherichia coli CFT073
gaaggugccguuc

SEQ ID NO: 585741 - RNA, 16 nt, Escherichia coli CFT073
gaaggugccugcccag

SEQ ID NO: 585742 - RNA, 20 nt, Escherichia coli CFT073
gaagucaacgcucaggccga

SEQ ID NO: 585743 - RNA, 14 nt, Escherichia coli CFT073
gaagguaccgcaau

SEQ ID NO: 585744 - RNA, 13 nt, Escherichia coli CFT073
gaagggcuggcca

SEQ ID NO: 585745 - RNA, 15 nt, Escherichia coli CFT073
gaagggaauauacca

SEQ ID NO: 585746 - RNA, 17 nt, Escherichia coli CFT073
gaacauuaagaggcauu

SEQ ID NO: 585747 - RNA, 19 nt, Escherichia coli CFT073
gaacaugcgggucuuacug

SEQ ID NO: 585748 - RNA, 15 nt, Escherichia coli CFT073
gaacauugcugcuga

SEQ ID NO: 585749 - RNA, 21 nt, Escherichia coli CFT073
gaacauuucccgcauaaagag

SEQ ID NO: 585750 - RNA, 16 nt, Escherichia coli CFT073
gaaccgugucgccauc

SEQ ID NO: 585751 - RNA, 21 nt, Escherichia coli CFT073
gaaccguucauuucacgcagc

SEQ ID NO: 585752 - RNA, 19 nt, Escherichia coli CFT073
gaaccugaggcaauaaaua

SEQ ID NO: 585753 - RNA, 19 nt, Escherichia coli CFT073
gaacgccuaacucuugcca

SEQ ID NO: 585754 - RNA, 21 nt, Escherichia coli CFT073
gaacgccgaauaacgcgcagc

SEQ ID NO: 585755 - RNA, 13 nt, Escherichia coli CFT073
gaacgccgccagu

SEQ ID NO: 585756 - RNA, 18 nt, Escherichia coli CFT073
gaacgcagugauaacuca

SEQ ID NO: 585757 - RNA, 12 nt, Escherichia coli CFT073
gaagaauaaauu

SEQ ID NO: 585758 - RNA, 20 nt, Escherichia coli CFT073
gaagaagcuugcuucuuugc

SEQ ID NO: 585759 - RNA, 17 nt, Escherichia coli CFT073
gaagaauuuucgcugga

SEQ ID NO: 585760 - RNA, 12 nt, Escherichia coli CFT073
gaagacaaaacc

SEQ ID NO: 585761 - RNA, 14 nt, Escherichia coli CFT073
gaagacaauccccg

SEQ ID NO: 585762 - RNA, 20 nt, Escherichia coli CFT073
gaagaccagauuaaucagca

SEQ ID NO: 585763 - RNA, 21 nt, Escherichia coli CFT073
gaagaccagcgaaaccugaau

SEQ ID NO: 585764 - RNA, 12 nt, Escherichia coli CFT073
gaagacgccucg

SEQ ID NO: 585765 - RNA, 16 nt, Escherichia coli CFT073
gaagaccucacgguuu

SEQ ID NO: 585766 - RNA, 12 nt, Escherichia coli CFT073
gaagaaccgcac

SEQ ID NO: 585767 - RNA, 15 nt, Escherichia coli CFT073
gaagaaaucgacauu

SEQ ID NO: 585768 - RNA, 16 nt, Escherichia coli CFT073
gaacuucgccagcgug

SEQ ID NO: 585769 - RNA, 14 nt, Escherichia coli CFT073
gaacucuuccggca

SEQ ID NO: 585770 - RNA, 19 nt, Escherichia coli CFT073
gaacucuuccggcagggug

SEQ ID NO: 585771 - RNA, 23 nt, Escherichia coli CFT073
gaacggcgaugcuuugaccuccc

SEQ ID NO: 585772 - RNA, 21 nt, Escherichia coli CFT073
gaaaucggggucaucuuuaac

SEQ ID NO: 585773 - RNA, 17 nt, Escherichia coli CFT073
gaacacauuugucggau

SEQ ID NO: 585774 - RNA, 23 nt, Escherichia coli CFT073
gaacacauuugucggaugcggcg

SEQ ID NO: 585775 - RNA, 18 nt, Escherichia coli CFT073
gaaaucccccagcaucac

SEQ ID NO: 585776 - RNA, 19 nt, Escherichia coli CFT073
gaaaucgacauugaugaaa

SEQ ID NO: 585777 - RNA, 21 nt, Escherichia coli CFT073
gaacagaccacauuccaggcc

SEQ ID NO: 585778 - RNA, 19 nt, Escherichia coli CFT073
gaacaccagaaccagcaac

SEQ ID NO: 585779 - RNA, 21 nt, Escherichia coli CFT073
gaacaggcaucacuuuaccgg

SEQ ID NO: 585780 - RNA, 13 nt, Escherichia coli CFT073
gaacagcccgcca

SEQ ID NO: 585781 - RNA, 14 nt, Escherichia coli CFT073
gaacagcccgccaa

SEQ ID NO: 585782 - RNA, 23 nt, Escherichia coli CFT073
gaacaucgaugccgccuggugca

SEQ ID NO: 585783 - RNA, 14 nt, Escherichia coli CFT073
gaacagugccagac

SEQ ID NO: 585784 - RNA, 18 nt, Escherichia coli CFT073
gaacagggguuauaucuu

SEQ ID NO: 585785 - RNA, 14 nt, Escherichia coli CFT073
gaaaguaaauuauu

SEQ ID NO: 585786 - RNA, 20 nt, Escherichia coli CFT073
gaaaguaacaauagcgaaca

SEQ ID NO: 585787 - RNA, 17 nt, Escherichia coli CFT073
gaaagucguaggccuga

SEQ ID NO: 585788 - RNA, 19 nt, Escherichia coli CFT073
gaaagucguaggccugaua

SEQ ID NO: 585789 - RNA, 21 nt, Escherichia coli CFT073
gaaagugccacgccccgcaua

SEQ ID NO: 585790 - RNA, 20 nt, Escherichia coli CFT073
gaaagcguacccgccugaua

SEQ ID NO: 585791 - RNA, 15 nt, Escherichia coli CFT073
gaaagcucuucaugc

SEQ ID NO: 585792 - RNA, 16 nt, Escherichia coli CFT073
gaaagaacaccagcac

SEQ ID NO: 585793 - RNA, 14 nt, Escherichia coli CFT073
gaaacuggauggcc

SEQ ID NO: 585794 - RNA, 14 nt, Escherichia coli CFT073
gaaacuguucgcug

SEQ ID NO: 585795 - RNA, 16 nt, Escherichia coli CFT073
gaaacuuccagcuuca

SEQ ID NO: 585796 - RNA, 21 nt, Escherichia coli CFT073
gaaagcacuguucgccgcagc

SEQ ID NO: 585797 - RNA, 18 nt, Escherichia coli CFT073
gaaagccgcuggcgcagc

SEQ ID NO: 585798 - RNA, 13 nt, Escherichia coli CFT073
gaaagcccaucau

SEQ ID NO: 585799 - RNA, 22 nt, Escherichia coli CFT073
cuuguggaaauuccagcggcag

SEQ ID NO: 585800 - RNA, 19 nt, Escherichia coli CFT073
gaaaccgguuuguaggccg

SEQ ID NO: 585801 - RNA, 21 nt, Escherichia coli CFT073
gaaaccgguuuguaggccgga

SEQ ID NO: 585802 - RNA, 16 nt, Escherichia coli CFT073
gaaacgcaaauacuga

SEQ ID NO: 585803 - RNA, 18 nt, Escherichia coli CFT073
gaaacucgcugacugaua

SEQ ID NO: 585804 - RNA, 16 nt, Escherichia coli CFT073
gaaacugacaggucau

SEQ ID NO: 585805 - RNA, 21 nt, Escherichia coli CFT073
gaaacugcuggcuuaaaaaac

SEQ ID NO: 585806 - RNA, 14 nt, Escherichia coli CFT073
cugcuuuuugcucu

SEQ ID NO: 585807 - RNA, 17 nt, Escherichia coli CFT073
cugcuuuuaaaugcccg

SEQ ID NO: 585808 - RNA, 18 nt, Escherichia coli CFT073
cugcuuuuaaaugcccga

SEQ ID NO: 585809 - RNA, 20 nt, Escherichia coli CFT073
cugcuuuacccacgcuuuuc

SEQ ID NO: 585810 - RNA, 15 nt, Escherichia coli CFT073
cuggaacaguugcag

SEQ ID NO: 585811 - RNA, 16 nt, Escherichia coli CFT073
cuggaaaggccgcgaa

SEQ ID NO: 585812 - RNA, 16 nt, Escherichia coli CFT073
cuggaaaaucuggcgc

SEQ ID NO: 585813 - RNA, 21 nt, Escherichia coli CFT073
cugcuucaguaauaccgaacg

SEQ ID NO: 585814 - RNA, 20 nt, Escherichia coli CFT073
cugcuuauuaaugcuuucag

SEQ ID NO: 585815 - RNA, 15 nt, Escherichia coli CFT073
cugcuucaaaguuuu

SEQ ID NO: 585816 - RNA, 19 nt, Escherichia coli CFT073
cugcugugugauccacugc

SEQ ID NO: 585817 - RNA, 15 nt, Escherichia coli CFT073
cugcuuauagcgcau

SEQ ID NO: 585818 - RNA, 22 nt, Escherichia coli CFT073
cugcuguagcaguuccagcauc

SEQ ID NO: 585819 - RNA, 17 nt, Escherichia coli CFT073
cugcugccguugccgcu

SEQ ID NO: 585820 - RNA, 12 nt, Escherichia coli CFT073
cuggcaggcgac

SEQ ID NO: 585821 - RNA, 22 nt, Escherichia coli CFT073
cuggcagggaaagaaacgccau

SEQ ID NO: 585822 - RNA, 17 nt, Escherichia coli CFT073
cuggcauacaucaacgc

SEQ ID NO: 585823 - RNA, 16 nt, Escherichia coli CFT073
cuggcauuguaggcca

SEQ ID NO: 585824 - RNA, 21 nt, Escherichia coli CFT073
cuggcauucagaacacaaaac

SEQ ID NO: 585825 - RNA, 15 nt, Escherichia coli CFT073
cuggccaguccaggu

SEQ ID NO: 585826 - RNA, 16 nt, Escherichia coli CFT073
cuggcagccacgacgc

SEQ ID NO: 585827 - RNA, 13 nt, Escherichia coli CFT073
cuggcacuguuca

SEQ ID NO: 585828 - RNA, 18 nt, Escherichia coli CFT073
cuggcagaaugaaguaaa

SEQ ID NO: 585829 - RNA, 20 nt, Escherichia coli CFT073
cuggaugaucccuucgcugg

SEQ ID NO: 585830 - RNA, 23 nt, Escherichia coli CFT073
cuggacgccaauaccgaucagua

SEQ ID NO: 585831 - RNA, 12 nt, Escherichia coli CFT073
cugcuacaccau

SEQ ID NO: 585832 - RNA, 22 nt, Escherichia coli CFT073
cugcguuucauguaacgcugca

SEQ ID NO: 585833 - RNA, 13 nt, Escherichia coli CFT073
cugcguucaguug

SEQ ID NO: 585834 - RNA, 16 nt, Escherichia coli CFT073
cugcgugaucgaaaau

SEQ ID NO: 585835 - RNA, 18 nt, Escherichia coli CFT073
cugcgugaucgaaaaucg

SEQ ID NO: 585836 - RNA, 17 nt, Escherichia coli CFT073
cugcgugaccgccagaa

SEQ ID NO: 585837 - RNA, 14 nt, Escherichia coli CFT073
cugcucaucagcgg

SEQ ID NO: 585838 - RNA, 18 nt, Escherichia coli CFT073
cugcucaggcgacgcgga

SEQ ID NO: 585839 - RNA, 19 nt, Escherichia coli CFT073
cugcucaggcgaggcagac

SEQ ID NO: 585840 - RNA, 14 nt, Escherichia coli CFT073
cugcucaagcguuu

SEQ ID NO: 585841 - RNA, 21 nt, Escherichia coli CFT073
cugcuauggcgcguccggcgu

SEQ ID NO: 585842 - RNA, 23 nt, Escherichia coli CFT073
cugcuccugcagaaaauccagcg

SEQ ID NO: 585843 - RNA, 18 nt, Escherichia coli CFT073
aaccgcguaacuuuugcc

SEQ ID NO: 585844 - RNA, 10 nt, Escherichia coli CFT073
cugcgucgca

SEQ ID NO: 585845 - RNA, 14 nt, Escherichia coli CFT073
cugcggucacgcug

SEQ ID NO: 585846 - RNA, 16 nt, Escherichia coli CFT073
cugcgguguaaaccag

SEQ ID NO: 585847 - RNA, 17 nt, Escherichia coli CFT073
cugcgguugaaacacag

SEQ ID NO: 585848 - RNA, 16 nt, Escherichia coli CFT073
cugcgguuucggcgua

SEQ ID NO: 585849 - RNA, 18 nt, Escherichia coli CFT073
cugcguagaguccagcgc

SEQ ID NO: 585850 - RNA, 16 nt, Escherichia coli CFT073
cugcguaucgcccugc

SEQ ID NO: 585851 - RNA, 18 nt, Escherichia coli CFT073
cugcggggagaaugccag

SEQ ID NO: 585852 - RNA, 20 nt, Escherichia coli CFT073
cugcggggaugaauauguag

SEQ ID NO: 585853 - RNA, 21 nt, Escherichia coli CFT073
cugcgggcgaucauauccagc

SEQ ID NO: 585854 - RNA, 18 nt, Escherichia coli CFT073
cugcucuuucgccggauu

SEQ ID NO: 585855 - RNA, 18 nt, Escherichia coli CFT073
cugcucguaaagcaucag

SEQ ID NO: 585856 - RNA, 23 nt, Escherichia coli CFT073
cugcugcacgcccugauaaauca

SEQ ID NO: 585857 - RNA, 18 nt, Escherichia coli CFT073
cugcugcaaugccauuca

SEQ ID NO: 585858 - RNA, 23 nt, Escherichia coli CFT073
cugcucgcgauggcgaucgugau

SEQ ID NO: 585859 - RNA, 16 nt, Escherichia coli CFT073
aaccggauuuucacca

SEQ ID NO: 585860 - RNA, 18 nt, Escherichia coli CFT073
cugcgauuucagcgccgc

SEQ ID NO: 585861 - RNA, 13 nt, Escherichia coli CFT073
cugccuucccuuc

SEQ ID NO: 585862 - RNA, 14 nt, Escherichia coli CFT073
cugccuugcucuuc

SEQ ID NO: 585863 - RNA, 22 nt, Escherichia coli CFT073
cugccuggauaaggccaccagc

SEQ ID NO: 585864 - RNA, 13 nt, Escherichia coli CFT073
cugccuucgcagu

SEQ ID NO: 585865 - RNA, 13 nt, Escherichia coli CFT073
cugcgacacugug

SEQ ID NO: 585866 - RNA, 23 nt, Escherichia coli CFT073
cugcgacaccagcauguuccauu

SEQ ID NO: 585867 - RNA, 17 nt, Escherichia coli CFT073
cugcgaaucgcuucauu

SEQ ID NO: 585868 - RNA, 23 nt, Escherichia coli CFT073
cugccugcggcgaucuucaaacu

SEQ ID NO: 585869 - RNA, 12 nt, Escherichia coli CFT073
cucuucuuuaau

SEQ ID NO: 585870 - RNA, 20 nt, Escherichia coli CFT073
cugaaacucgaccaguagcu

SEQ ID NO: 585871 - RNA, 15 nt, Escherichia coli CFT073
cugaaacucgaugac

SEQ ID NO: 585872 - RNA, 21 nt, Escherichia coli CFT073
cugaaagaacaccagcaccga

SEQ ID NO: 585873 - RNA, 17 nt, Escherichia coli CFT073
cugccgagauggugcca

SEQ ID NO: 585874 - RNA, 12 nt, Escherichia coli CFT073
cugaacaccaga

SEQ ID NO: 585875 - RNA, 17 nt, Escherichia coli CFT073
cugaaagcugagaaaau

SEQ ID NO: 585876 - RNA, 12 nt, Escherichia coli CFT073
cugaaagggaag

SEQ ID NO: 585877 - RNA, 16 nt, Escherichia coli CFT073
cugaaaggucaucauc

SEQ ID NO: 585878 - RNA, 22 nt, Escherichia coli CFT073
cugaaaucaccgccaccagcgu

SEQ ID NO: 585879 - RNA, 14 nt, Escherichia coli CFT073
cugccgcaauggcc

SEQ ID NO: 585880 - RNA, 17 nt, Escherichia coli CFT073
cugccgagcgcaagcca

SEQ ID NO: 585881 - RNA, 23 nt, Escherichia coli CFT073
cugccgccagcauugucaggauc

SEQ ID NO: 585882 - RNA, 15 nt, Escherichia coli CFT073
cugccgccagguuau

SEQ ID NO: 585883 - RNA, 19 nt, Escherichia coli CFT073
cugccgccaauuugucgcc

SEQ ID NO: 585884 - RNA, 15 nt, Escherichia coli CFT073
cugccgcauccggcg

SEQ ID NO: 585885 - RNA, 21 nt, Escherichia coli CFT073
cugccgccgcaaucagcguuu

SEQ ID NO: 585886 - RNA, 14 nt, Escherichia coli CFT073
cugccggaauaauc

SEQ ID NO: 585887 - RNA, 15 nt, Escherichia coli CFT073
cugccggaauaauca

SEQ ID NO: 585888 - RNA, 23 nt, Escherichia coli CFT073
cugcgcggaccccgcgcucgcgc

SEQ ID NO: 585889 - RNA, 19 nt, Escherichia coli CFT073
cugcgcggcaaaggcuucg

SEQ ID NO: 585890 - RNA, 19 nt, Escherichia coli CFT073
cugcgcuugcgcggcagcu

SEQ ID NO: 585891 - RNA, 14 nt, Escherichia coli CFT073
cugcgcuugcugcc

SEQ ID NO: 585892 - RNA, 14 nt, Escherichia coli CFT073
cugcgcuuucugcu

SEQ ID NO: 585893 - RNA, 17 nt, Escherichia coli CFT073
cugcgcuuucugcuucg

SEQ ID NO: 585894 - RNA, 15 nt, Escherichia coli CFT073
cugcggacgucuguu

SEQ ID NO: 585895 - RNA, 19 nt, Escherichia coli CFT073
cugcgcuuacacacccggc

SEQ ID NO: 585896 - RNA, 12 nt, Escherichia coli CFT073
cugcgcuuccag

SEQ ID NO: 585897 - RNA, 15 nt, Escherichia coli CFT073
cugcggcuugucgua

SEQ ID NO: 585898 - RNA, 13 nt, Escherichia coli CFT073
cugcggcaaugcg

SEQ ID NO: 585899 - RNA, 20 nt, Escherichia coli CFT073
cugcggaugcgccauccagu

SEQ ID NO: 585900 - RNA, 16 nt, Escherichia coli CFT073
cugcgccgcucggugc

SEQ ID NO: 585901 - RNA, 17 nt, Escherichia coli CFT073
cugcgccgcgagcauuu

SEQ ID NO: 585902 - RNA, 16 nt, Escherichia coli CFT073
cugcgccgaucgucgc

SEQ ID NO: 585903 - RNA, 20 nt, Escherichia coli CFT073
cugcgccaucaguguuggcg

SEQ ID NO: 585904 - RNA, 14 nt, Escherichia coli CFT073
cugcgccaucccca

SEQ ID NO: 585905 - RNA, 14 nt, Escherichia coli CFT073
cugcgcccgcccgc

SEQ ID NO: 585906 - RNA, 21 nt, Escherichia coli CFT073
cugcgcauuucccagcaagaa

SEQ ID NO: 585907 - RNA, 22 nt, Escherichia coli CFT073
cugcgcauuaaauaccaagcca

SEQ ID NO: 585908 - RNA, 22 nt, Escherichia coli CFT073
cugcgcagguuuaccuguuucg

SEQ ID NO: 585909 - RNA, 12 nt, Escherichia coli CFT073
cugcgcaaugcg

SEQ ID NO: 585910 - RNA, 21 nt, Escherichia coli CFT073
cuuccauacgaauugccgcgc

SEQ ID NO: 585911 - RNA, 14 nt, Escherichia coli CFT073
cuucacuucagcga

SEQ ID NO: 585912 - RNA, 15 nt, Escherichia coli CFT073
cuucagaagaucgga

SEQ ID NO: 585913 - RNA, 20 nt, Escherichia coli CFT073
cuucagacaccguuuccaua

SEQ ID NO: 585914 - RNA, 14 nt, Escherichia coli CFT073
cuucagcaacgugc

SEQ ID NO: 585915 - RNA, 21 nt, Escherichia coli CFT073
cuucagcaaucucuucaagcu

SEQ ID NO: 585916 - RNA, 22 nt, Escherichia coli CFT073
cuucagcagcagccgcgcuuuc

SEQ ID NO: 585917 - RNA, 16 nt, Escherichia coli CFT073
cuuccugaaucgccga

SEQ ID NO: 585918 - RNA, 21 nt, Escherichia coli CFT073
cuuccugacucacacgcacga

SEQ ID NO: 585919 - RNA, 23 nt, Escherichia coli CFT073
cuucccgcugugguucauaugau

SEQ ID NO: 585920 - RNA, 18 nt, Escherichia coli CFT073
cuucccgagacaucccuu

SEQ ID NO: 585921 - RNA, 13 nt, Escherichia coli CFT073
cuuccgucagcaa

SEQ ID NO: 585922 - RNA, 20 nt, Escherichia coli CFT073
cuucccugcugaauccccuu

SEQ ID NO: 585923 - RNA, 15 nt, Escherichia coli CFT073
cuuccggugcgauca

SEQ ID NO: 585924 - RNA, 18 nt, Escherichia coli CFT073
cuucgcggaauuucagaa

SEQ ID NO: 585925 - RNA, 22 nt, Escherichia coli CFT073
cuucgcggcaaaacagccugcg

SEQ ID NO: 585926 - RNA, 14 nt, Escherichia coli CFT073
cuucggcaucuuuu

SEQ ID NO: 585927 - RNA, 15 nt, Escherichia coli CFT073
cuucgccgcaucguc

SEQ ID NO: 585928 - RNA, 13 nt, Escherichia coli CFT073
cuucgccgccgcu

SEQ ID NO: 585929 - RNA, 19 nt, Escherichia coli CFT073
cuucuagugccugcacaac

SEQ ID NO: 585930 - RNA, 18 nt, Escherichia coli CFT073
cuucuaaaucguaccagc

SEQ ID NO: 585931 - RNA, 22 nt, Escherichia coli CFT073
cuucugcacgguuuuuccagcu

SEQ ID NO: 585932 - RNA, 15 nt, Escherichia coli CFT073
cuucucuuucccgcg

SEQ ID NO: 585933 - RNA, 21 nt, Escherichia coli CFT073
cuucucuggcugcuucaguaa

SEQ ID NO: 585934 - RNA, 16 nt, Escherichia coli CFT073
cuucucuuauauuuca

SEQ ID NO: 585935 - RNA, 20 nt, Escherichia coli CFT073
cuucugccgcaauucgcccu

SEQ ID NO: 585936 - RNA, 16 nt, Escherichia coli CFT073
cuucuggccauugaau

SEQ ID NO: 585937 - RNA, 14 nt, Escherichia coli CFT073
cuucuggcuggcgc

SEQ ID NO: 585938 - RNA, 22 nt, Escherichia coli CFT073
cuucugcguucucuucacgcca

SEQ ID NO: 585939 - RNA, 15 nt, Escherichia coli CFT073
cuucuguuugcgcca

SEQ ID NO: 585940 - RNA, 12 nt, Escherichia coli CFT073
cuucuuccagcu

SEQ ID NO: 585941 - RNA, 23 nt, Escherichia coli CFT073
cuucuucagccaguuuuucagcg

SEQ ID NO: 585942 - RNA, 15 nt, Escherichia coli CFT073
cuucuucauccagcg

SEQ ID NO: 585943 - RNA, 14 nt, Escherichia coli CFT073
cuucuucaucgcgc

SEQ ID NO: 585944 - RNA, 15 nt, Escherichia coli CFT073
cuucuuucgcccagc

SEQ ID NO: 585945 - RNA, 23 nt, Escherichia coli CFT073
cuucuuuuuccgggccaaaaacc

SEQ ID NO: 585946 - RNA, 21 nt, Escherichia coli CFT073
cuucuuugcgccagcggguaa

SEQ ID NO: 585947 - RNA, 20 nt, Escherichia coli CFT073
cuugaacuuaucaucagucg

SEQ ID NO: 585948 - RNA, 20 nt, Escherichia coli CFT073
cuugaaggguuuaauaaucg

SEQ ID NO: 585949 - RNA, 13 nt, Escherichia coli CFT073
cuugaaucggcgu

SEQ ID NO: 585950 - RNA, 22 nt, Escherichia coli CFT073
cuugaauuuaucuucaccaaau

SEQ ID NO: 585951 - RNA, 19 nt, Escherichia coli CFT073
cuugacccguuuuaaaucg

SEQ ID NO: 585952 - RNA, 13 nt, Escherichia coli CFT073
cuugcggaucggc

SEQ ID NO: 585953 - RNA, 15 nt, Escherichia coli CFT073
cuuguaccuucagcg

SEQ ID NO: 585954 - RNA, 16 nt, Escherichia coli CFT073
cuugcaagaucgcgca

SEQ ID NO: 585955 - RNA, 22 nt, Escherichia coli CFT073
cuugcaaucucugacauaaaaa

SEQ ID NO: 585956 - RNA, 22 nt, Escherichia coli CFT073
cuugcagucggcuuucucauuu

SEQ ID NO: 585957 - RNA, 13 nt, Escherichia coli CFT073
cuugccaaauuua

SEQ ID NO: 585958 - RNA, 19 nt, Escherichia coli CFT073
cuugccauuccacaaaaac

SEQ ID NO: 585959 - RNA, 12 nt, Escherichia coli CFT073
cuugaucuuccu

SEQ ID NO: 585960 - RNA, 15 nt, Escherichia coli CFT073
cuugaucuuccugau

SEQ ID NO: 585961 - RNA, 23 nt, Escherichia coli CFT073
cuugaucaggaaaucgucgaggg

SEQ ID NO: 585962 - RNA, 14 nt, Escherichia coli CFT073
cuuacuucaacaca

SEQ ID NO: 585963 - RNA, 16 nt, Escherichia coli CFT073
cuuacuauauaaaccu

SEQ ID NO: 585964 - RNA, 16 nt, Escherichia coli CFT073
cuuaccaaauaaacga

SEQ ID NO: 585965 - RNA, 13 nt, Escherichia coli CFT073
cuguugugaugca

SEQ ID NO: 585966 - RNA, 17 nt, Escherichia coli CFT073
cuguugccagcaguuca

SEQ ID NO: 585967 - RNA, 21 nt, Escherichia coli CFT073
cuguugcccaugcuucugcac

SEQ ID NO: 585968 - RNA, 15 nt, Escherichia coli CFT073
cuguuggcaacgcaa

SEQ ID NO: 585969 - RNA, 23 nt, Escherichia coli CFT073
cuucacaggccgccaggcagagc

SEQ ID NO: 585970 - RNA, 14 nt, Escherichia coli CFT073
cuucaccaauguuc

SEQ ID NO: 585971 - RNA, 13 nt, Escherichia coli CFT073
cuucacccgcagc

SEQ ID NO: 585972 - RNA, 13 nt, Escherichia coli CFT073
cuucacggcuuug

SEQ ID NO: 585973 - RNA, 21 nt, Escherichia coli CFT073
cuucaccguggucuuuugccu

SEQ ID NO: 585974 - RNA, 22 nt, Escherichia coli CFT073
cuuauaaaggcgcuucggcgcc

SEQ ID NO: 585975 - RNA, 15 nt, Escherichia coli CFT073
cuuauaacugcccgc

SEQ ID NO: 585976 - RNA, 14 nt, Escherichia coli CFT073
aaccgguacgccgc

SEQ ID NO: 585977 - RNA, 14 nt, Escherichia coli CFT073
cuuaucaagaaagc

SEQ ID NO: 585978 - RNA, 16 nt, Escherichia coli CFT073
cuuaucaggccuacaa

SEQ ID NO: 585979 - RNA, 16 nt, Escherichia coli CFT073
cuuaucaggccuacga

SEQ ID NO: 585980 - RNA, 18 nt, Escherichia coli CFT073
cuuauccagcagaucgau

SEQ ID NO: 585981 - RNA, 17 nt, Escherichia coli CFT073
cuuauccgaccuacguu

SEQ ID NO: 585982 - RNA, 15 nt, Escherichia coli CFT073
cuuauccggccuaca

SEQ ID NO: 585983 - RNA, 20 nt, Escherichia coli CFT073
cuuauccggccuacguagau

SEQ ID NO: 585984 - RNA, 21 nt, Escherichia coli CFT073
cuuaucgcaggcuuccuggcu

SEQ ID NO: 585985 - RNA, 23 nt, Escherichia coli CFT073
cuguucagacauuaagcaucgca

SEQ ID NO: 585986 - RNA, 20 nt, Escherichia coli CFT073
cuguucauuuuguaggccug

SEQ ID NO: 585987 - RNA, 14 nt, Escherichia coli CFT073
cuguucgcgguuuu

SEQ ID NO: 585988 - RNA, 15 nt, Escherichia coli CFT073
cuguucggacggcga

SEQ ID NO: 585989 - RNA, 20 nt, Escherichia coli CFT073
cuguucgagguaauccagcg

SEQ ID NO: 585990 - RNA, 13 nt, Escherichia coli CFT073
cugucuuccugcg

SEQ ID NO: 585991 - RNA, 13 nt, Escherichia coli CFT073
cuguaagccaaac

SEQ ID NO: 585992 - RNA, 17 nt, Escherichia coli CFT073
cuguaauagacugcacu

SEQ ID NO: 585993 - RNA, 20 nt, Escherichia coli CFT073
cuguaccagcggcuuccagc

SEQ ID NO: 585994 - RNA, 18 nt, Escherichia coli CFT073
cugucaucgacaaaaacc

SEQ ID NO: 585995 - RNA, 16 nt, Escherichia coli CFT073
cugucauucauucaga

SEQ ID NO: 585996 - RNA, 14 nt, Escherichia coli CFT073
cugguuugccacgu

SEQ ID NO: 585997 - RNA, 16 nt, Escherichia coli CFT073
cugguuuugugcgcca

SEQ ID NO: 585998 - RNA, 19 nt, Escherichia coli CFT073
cuguaaaagccccuucgcg

SEQ ID NO: 585999 - RNA, 15 nt, Escherichia coli CFT073
cuguaaacuccuuuc

SEQ ID NO: 586000 - RNA, 15 nt, Escherichia coli CFT073
cuguaacgcaggaug

SEQ ID NO: 586001 - RNA, 12 nt, Escherichia coli CFT073
cuguccggcacc

SEQ ID NO: 586002 - RNA, 13 nt, Escherichia coli CFT073
cuguccugaaaau

SEQ ID NO: 586003 - RNA, 16 nt, Escherichia coli CFT073
cugguaccccauaacg

SEQ ID NO: 586004 - RNA, 13 nt, Escherichia coli CFT073
cugguaaucgcaa

SEQ ID NO: 586005 - RNA, 14 nt, Escherichia coli CFT073
cugguaacgaucgu

SEQ ID NO: 586006 - RNA, 15 nt, Escherichia coli CFT073
cuggggucaucagca

SEQ ID NO: 586007 - RNA, 19 nt, Escherichia coli CFT073
cuggguagcuuccugcugu

SEQ ID NO: 586008 - RNA, 22 nt, Escherichia coli CFT073
cuggguauaccggcguuucugg

SEQ ID NO: 586009 - RNA, 16 nt, Escherichia coli CFT073
cugggauucacguuga

SEQ ID NO: 586010 - RNA, 15 nt, Escherichia coli CFT073
cugggcaauggugaa

SEQ ID NO: 586011 - RNA, 13 nt, Escherichia coli CFT073
cugggccaucagg

SEQ ID NO: 586012 - RNA, 19 nt, Escherichia coli CFT073
cugguugauauuuuccugc

SEQ ID NO: 586013 - RNA, 14 nt, Escherichia coli CFT073
cugguucaggcguu

SEQ ID NO: 586014 - RNA, 14 nt, Escherichia coli CFT073
cugguucccaacaa

SEQ ID NO: 586015 - RNA, 19 nt, Escherichia coli CFT073
cugguuccccauucugcgc

SEQ ID NO: 586016 - RNA, 21 nt, Escherichia coli CFT073
cugguggccaucggcccguua

SEQ ID NO: 586017 - RNA, 17 nt, Escherichia coli CFT073
cuggugcguuuaccugc

SEQ ID NO: 586018 - RNA, 16 nt, Escherichia coli CFT073
cuggugccagcgccag

SEQ ID NO: 586019 - RNA, 16 nt, Escherichia coli CFT073
cuggucuggcccacga

SEQ ID NO: 586020 - RNA, 17 nt, Escherichia coli CFT073
cuggugaaaucagccgu

SEQ ID NO: 586021 - RNA, 14 nt, Escherichia coli CFT073
gauuccagcauaau

SEQ ID NO: 586022 - RNA, 22 nt, Escherichia coli CFT073
gauuccgccgauggugcagcag

SEQ ID NO: 586023 - RNA, 18 nt, Escherichia coli CFT073
gauuccugcgcuuccagu

SEQ ID NO: 586024 - RNA, 17 nt, Escherichia coli CFT073
gauuaucaugcccuuuu

SEQ ID NO: 586025 - RNA, 19 nt, Escherichia coli CFT073
gauuagacggcgcaacauc

SEQ ID NO: 586026 - RNA, 14 nt, Escherichia coli CFT073
gauuauuucgcugc

SEQ ID NO: 586027 - RNA, 15 nt, Escherichia coli CFT073
gauuacguacugcaa

SEQ ID NO: 586028 - RNA, 20 nt, Escherichia coli CFT073
gauugaagcagcgcuggaga

SEQ ID NO: 586029 - RNA, 13 nt, Escherichia coli CFT073
gauuggcaggugg

SEQ ID NO: 586030 - RNA, 20 nt, Escherichia coli CFT073
gauuucuacuuauucaccac

SEQ ID NO: 586031 - RNA, 19 nt, Escherichia coli CFT073
gcaacaaccaccacaccug

SEQ ID NO: 586032 - RNA, 15 nt, Escherichia coli CFT073
gcaacaacaacacgc

SEQ ID NO: 586033 - RNA, 12 nt, Escherichia coli CFT073
gcaacaacuuca

SEQ ID NO: 586034 - RNA, 21 nt, Escherichia coli CFT073
gcaacaaggcuacgccacagc

SEQ ID NO: 586035 - RNA, 14 nt, Escherichia coli CFT073
gcaacaauuugcgg

SEQ ID NO: 586036 - RNA, 15 nt, Escherichia coli CFT073
gcaacaauuugcggu

SEQ ID NO: 586037 - RNA, 13 nt, Escherichia coli CFT073
gcaacacaagcca

SEQ ID NO: 586038 - RNA, 16 nt, Escherichia coli CFT073
gcaaagcugucaccaa

SEQ ID NO: 586039 - RNA, 18 nt, Escherichia coli CFT073
gcaaagcguacaaccgcg

SEQ ID NO: 586040 - RNA, 22 nt, Escherichia coli CFT073
gcaaaggcguuaugcugcggca

SEQ ID NO: 586041 - RNA, 16 nt, Escherichia coli CFT073
gcaaaguagagcgaaa

SEQ ID NO: 586042 - RNA, 22 nt, Escherichia coli CFT073
gcaaaguaggccguacagccca

SEQ ID NO: 586043 - RNA, 21 nt, Escherichia coli CFT073
gcaaccagcgucgcaucaggc

SEQ ID NO: 586044 - RNA, 17 nt, Escherichia coli CFT073
gcaaccacuugcagcuc

SEQ ID NO: 586045 - RNA, 22 nt, Escherichia coli CFT073
gcaacaugcggugauuuugccu

SEQ ID NO: 586046 - RNA, 21 nt, Escherichia coli CFT073
gcaaccaacgcuagcagcagc

SEQ ID NO: 586047 - RNA, 13 nt, Escherichia coli CFT073
gcaaaauacguuu

SEQ ID NO: 586048 - RNA, 22 nt, Escherichia coli CFT073
gcaaaauacguuuucaccucug

SEQ ID NO: 586049 - RNA, 12 nt, Escherichia coli CFT073
gcaaaauccaga

SEQ ID NO: 586050 - RNA, 13 nt, Escherichia coli CFT073
gcaaaaugccagc

SEQ ID NO: 586051 - RNA, 13 nt, Escherichia coli CFT073
gcaaaacagguca

SEQ ID NO: 586052 - RNA, 16 nt, Escherichia coli CFT073
gcaaaacugccugaug

SEQ ID NO: 586053 - RNA, 18 nt, Escherichia coli CFT073
gcaaaacugccugaugcg

SEQ ID NO: 586054 - RNA, 12 nt, Escherichia coli CFT073
gcaaaaacgcau

SEQ ID NO: 586055 - RNA, 14 nt, Escherichia coli CFT073
gcaaaaauaaggcg

SEQ ID NO: 586056 - RNA, 20 nt, Escherichia coli CFT073
gauuugcguaaaaccugcca

SEQ ID NO: 586057 - RNA, 24 nt, Escherichia coli CFT073
gcaaaaaagaaggaaaauacagca

SEQ ID NO: 586058 - RNA, 15 nt, Escherichia coli CFT073
gcaaaaaaucaacag

SEQ ID NO: 586059 - RNA, 14 nt, Escherichia coli CFT073
gcaaagcgcaucag

SEQ ID NO: 586060 - RNA, 21 nt, Escherichia coli CFT073
gcaaagcccaucaccgccagg

SEQ ID NO: 586061 - RNA, 17 nt, Escherichia coli CFT073
gcaaagacgcguucauc

SEQ ID NO: 586062 - RNA, 12 nt, Escherichia coli CFT073
gcaaacaccgcu

SEQ ID NO: 586063 - RNA, 17 nt, Escherichia coli CFT073
gcaaaccacaggccgga

SEQ ID NO: 586064 - RNA, 15 nt, Escherichia coli CFT073
gcaaaccaggccggu

SEQ ID NO: 586065 - RNA, 22 nt, Escherichia coli CFT073
gcaaaccaggccgguaacgcuu

SEQ ID NO: 586066 - RNA, 15 nt, Escherichia coli CFT073
gcaaaccaugccgga

SEQ ID NO: 586067 - RNA, 17 nt, Escherichia coli CFT073
gcaaaauuucguuccca

SEQ ID NO: 586068 - RNA, 13 nt, Escherichia coli CFT073
gcaaacaacgcuu

SEQ ID NO: 586069 - RNA, 16 nt, Escherichia coli CFT073
gaugcuuuuuucugug

SEQ ID NO: 586070 - RNA, 23 nt, Escherichia coli CFT073
gaugcggugacagaggauauucu

SEQ ID NO: 586071 - RNA, 20 nt, Escherichia coli CFT073
gaugcggugcgagcgccuua

SEQ ID NO: 586072 - RNA, 17 nt, Escherichia coli CFT073
gaugcguggucaguugu

SEQ ID NO: 586073 - RNA, 16 nt, Escherichia coli CFT073
gaugcgucuucugcag

SEQ ID NO: 586074 - RNA, 20 nt, Escherichia coli CFT073
gaugcggcgaaaacgccuca

SEQ ID NO: 586075 - RNA, 19 nt, Escherichia coli CFT073
gaugcggcgagaacgccuu

SEQ ID NO: 586076 - RNA, 20 nt, Escherichia coli CFT073
gaugcggcgagaacgccuua

SEQ ID NO: 586077 - RNA, 20 nt, Escherichia coli CFT073
gaucuggaauggaaacagca

SEQ ID NO: 586078 - RNA, 11 nt, Escherichia coli CFT073
gaucugcugcc

SEQ ID NO: 586079 - RNA, 20 nt, Escherichia coli CFT073
gaugcggcguaaacgccuua

SEQ ID NO: 586080 - RNA, 20 nt, Escherichia coli CFT073
gaugcggcgcgagcgccuua

SEQ ID NO: 586081 - RNA, 13 nt, Escherichia coli CFT073
gaugcggcgugaa

SEQ ID NO: 586082 - RNA, 16 nt, Escherichia coli CFT073
gaugcggcgugaacgc

SEQ ID NO: 586083 - RNA, 19 nt, Escherichia coli CFT073
gaugcggcgugaacgccuu

SEQ ID NO: 586084 - RNA, 20 nt, Escherichia coli CFT073
gaugcggcgugaacgccuua

SEQ ID NO: 586085 - RNA, 20 nt, Escherichia coli CFT073
gaugcggcgugaacgccuuc

SEQ ID NO: 586086 - RNA, 20 nt, Escherichia coli CFT073
gaugcggcgugaccgccuua

SEQ ID NO: 586087 - RNA, 18 nt, Escherichia coli CFT073
gaugguaaaauaucacuc

SEQ ID NO: 586088 - RNA, 21 nt, Escherichia coli CFT073
gaugguugcugucaacugacu

SEQ ID NO: 586089 - RNA, 18 nt, Escherichia coli CFT073
gauggugcuaauugcacc

SEQ ID NO: 586090 - RNA, 15 nt, Escherichia coli CFT073
gaugguaugccaucc

SEQ ID NO: 586091 - RNA, 15 nt, Escherichia coli CFT073
gaugguggucgcauc

SEQ ID NO: 586092 - RNA, 17 nt, Escherichia coli CFT073
gcaauaaccaucagcuc

SEQ ID NO: 586093 - RNA, 15 nt, Escherichia coli CFT073
gcaauaaccguaacg

SEQ ID NO: 586094 - RNA, 19 nt, Escherichia coli CFT073
gcaauaaccguaacgcauu

SEQ ID NO: 586095 - RNA, 19 nt, Escherichia coli CFT073
gcaauaacucccaggcuac

SEQ ID NO: 586096 - RNA, 18 nt, Escherichia coli CFT073
gcaauaagcacucuggcg

SEQ ID NO: 586097 - RNA, 15 nt, Escherichia coli CFT073
gcaauaaaacagggc

SEQ ID NO: 586098 - RNA, 14 nt, Escherichia coli CFT073
gcaauaaacauccu

SEQ ID NO: 586099 - RNA, 16 nt, Escherichia coli CFT073
gcaaguucccggaaaa

SEQ ID NO: 586100 - RNA, 23 nt, Escherichia coli CFT073
gcaauaaucagugccgcgccgcg

SEQ ID NO: 586101 - RNA, 15 nt, Escherichia coli CFT073
gcaauaaugccaguc

SEQ ID NO: 586102 - RNA, 15 nt, Escherichia coli CFT073
gcaagucuugcugcg

SEQ ID NO: 586103 - RNA, 22 nt, Escherichia coli CFT073
gcaaguggaaauccccaucagg

SEQ ID NO: 586104 - RNA, 14 nt, Escherichia coli CFT073
gcaaggaugcguuu

SEQ ID NO: 586105 - RNA, 14 nt, Escherichia coli CFT073
gcaaucaucgcagc

SEQ ID NO: 586106 - RNA, 14 nt, Escherichia coli CFT073
gcaauccccgccag

SEQ ID NO: 586107 - RNA, 11 nt, Escherichia coli CFT073
gcaaucagcgg

SEQ ID NO: 586108 - RNA, 16 nt, Escherichia coli CFT073
gcaaucaguacguuau

SEQ ID NO: 586109 - RNA, 23 nt, Escherichia coli CFT073
gcaaucaguacguuaucaccgau

SEQ ID NO: 586110 - RNA, 11 nt, Escherichia coli CFT073
gcaaucgccag

SEQ ID NO: 586111 - RNA, 20 nt, Escherichia coli CFT073
gcaaucgccagacucaccag

SEQ ID NO: 586112 - RNA, 17 nt, Escherichia coli CFT073
gcaaucgauuugaaucg

SEQ ID NO: 586113 - RNA, 22 nt, Escherichia coli CFT073
gcaaucgacucugaaugccagu

SEQ ID NO: 586114 - RNA, 17 nt, Escherichia coli CFT073
gcaaucgcugcuaauuu

SEQ ID NO: 586115 - RNA, 22 nt, Escherichia coli CFT073
gcaaucgcugggcgauaaaauc

SEQ ID NO: 586116 - RNA, 21 nt, Escherichia coli CFT073
gcaaucgcgccagaacacgcu

SEQ ID NO: 586117 - RNA, 14 nt, Escherichia coli CFT073
gcaaucgcggcagc

SEQ ID NO: 586118 - RNA, 15 nt, Escherichia coli CFT073
gcaaucgcggcagcg

SEQ ID NO: 586119 - RNA, 23 nt, Escherichia coli CFT073
gcaauacccugacccagaccgau

SEQ ID NO: 586120 - RNA, 14 nt, Escherichia coli CFT073
gcaauagccugaug

SEQ ID NO: 586121 - RNA, 21 nt, Escherichia coli CFT073
gcaauauagcgcauggcagcc

SEQ ID NO: 586122 - RNA, 17 nt, Escherichia coli CFT073
gcaauauaggccgccga

SEQ ID NO: 586123 - RNA, 21 nt, Escherichia coli CFT073
gcaauauuacuucagacgguc

SEQ ID NO: 586124 - RNA, 13 nt, Escherichia coli CFT073
gcaaucaaaugac

SEQ ID NO: 586125 - RNA, 17 nt, Escherichia coli CFT073
gcaaucaaauggcuggc

SEQ ID NO: 586126 - RNA, 15 nt, Escherichia coli CFT073
gcaaucacaucacca

SEQ ID NO: 586127 - RNA, 21 nt, Escherichia coli CFT073
gcaaucacauccaccagcgcc

SEQ ID NO: 586128 - RNA, 20 nt, Escherichia coli CFT073
gcaaucacuuccucaagcgu

SEQ ID NO: 586129 - RNA, 22 nt, Escherichia coli CFT073
gcaaucacuuccucaagcguuu

SEQ ID NO: 586130 - RNA, 17 nt, Escherichia coli CFT073
gcaaucacgcccgccag

SEQ ID NO: 586131 - RNA, 15 nt, Escherichia coli CFT073
gcacaaagcgccaga

SEQ ID NO: 586132 - RNA, 22 nt, Escherichia coli CFT073
gcaauguuuuucucugccgccg

SEQ ID NO: 586133 - RNA, 14 nt, Escherichia coli CFT073
gcaauuauaauacg

SEQ ID NO: 586134 - RNA, 18 nt, Escherichia coli CFT073
gcacaaauuugccgucga

SEQ ID NO: 586135 - RNA, 16 nt, Escherichia coli CFT073
gcacaaccaccugaua

SEQ ID NO: 586136 - RNA, 14 nt, Escherichia coli CFT073
gcacaagcggcagu

SEQ ID NO: 586137 - RNA, 21 nt, Escherichia coli CFT073
gcacaaccgccagaugcggcg

SEQ ID NO: 586138 - RNA, 14 nt, Escherichia coli CFT073
gcacaaccgccgga

SEQ ID NO: 586139 - RNA, 18 nt, Escherichia coli CFT073
gcacaaccgccggaugcg

SEQ ID NO: 586140 - RNA, 21 nt, Escherichia coli CFT073
gcacaaccgccggaugcggcg

SEQ ID NO: 586141 - RNA, 23 nt, Escherichia coli CFT073
gcacacugccagugucggaugcg

SEQ ID NO: 586142 - RNA, 17 nt, Escherichia coli CFT073
gcacaccccgcgccgcu

SEQ ID NO: 586143 - RNA, 18 nt, Escherichia coli CFT073
gcacaccgaagacaucgc

SEQ ID NO: 586144 - RNA, 23 nt, Escherichia coli CFT073
gcaaugagacgguuaaaaacagc

SEQ ID NO: 586145 - RNA, 17 nt, Escherichia coli CFT073
gcaaugauuguaggccg

SEQ ID NO: 586146 - RNA, 21 nt, Escherichia coli CFT073
gcaaugauuguaggccggaua

SEQ ID NO: 586147 - RNA, 14 nt, Escherichia coli CFT073
gcaaugccagcgua

SEQ ID NO: 586148 - RNA, 17 nt, Escherichia coli CFT073
gcaaugccauucacaaa

SEQ ID NO: 586149 - RNA, 12 nt, Escherichia coli CFT073
gcaaugccagcg

SEQ ID NO: 586150 - RNA, 21 nt, Escherichia coli CFT073
gcaaucucguggucaauauca

SEQ ID NO: 586151 - RNA, 18 nt, Escherichia coli CFT073
gcaaucuuccucgccagc

SEQ ID NO: 586152 - RNA, 21 nt, Escherichia coli CFT073
gcaaugcgaucccgacaauca

SEQ ID NO: 586153 - RNA, 17 nt, Escherichia coli CFT073
gcaauggaccagaacgc

SEQ ID NO: 586154 - RNA, 19 nt, Escherichia coli CFT073
gcaaugcgcucgcauccug

SEQ ID NO: 586155 - RNA, 23 nt, Escherichia coli CFT073
gcaaugcgcucgcauccugccag

SEQ ID NO: 586156 - RNA, 17 nt, Escherichia coli CFT073
gcaauggaauucgcagc

SEQ ID NO: 586157 - RNA, 19 nt, Escherichia coli CFT073
gcaaugugcucuaacccuu

SEQ ID NO: 586158 - RNA, 15 nt, Escherichia coli CFT073
gcaauguuaccgauc

SEQ ID NO: 586159 - RNA, 21 nt, Escherichia coli CFT073
gcaaugguguccaaaugcagc

SEQ ID NO: 586160 - RNA, 22 nt, Escherichia coli CFT073
gcaaugguguccaaaugcagca

SEQ ID NO: 586161 - RNA, 14 nt, Escherichia coli CFT073
gcaagcugaacagg

SEQ ID NO: 586162 - RNA, 22 nt, Escherichia coli CFT073
gcaagcugugcgauagcaauga

SEQ ID NO: 586163 - RNA, 22 nt, Escherichia coli CFT073
gcaagcuuaucgggccuacaau

SEQ ID NO: 586164 - RNA, 19 nt, Escherichia coli CFT073
gcaaggaaaaacuacccgc

SEQ ID NO: 586165 - RNA, 21 nt, Escherichia coli CFT073
gcaagcgucgcgccauuggcc

SEQ ID NO: 586166 - RNA, 16 nt, Escherichia coli CFT073
gcaagcaaauacucgu

SEQ ID NO: 586167 - RNA, 12 nt, Escherichia coli CFT073
gcaagccaacga

SEQ ID NO: 586168 - RNA, 17 nt, Escherichia coli CFT073
gcaagaagaucagcaaa

SEQ ID NO: 586169 - RNA, 23 nt, Escherichia coli CFT073
gcaagcagccgauaauauucggc

SEQ ID NO: 586170 - RNA, 19 nt, Escherichia coli CFT073
gcaagccagguaaaucaga

SEQ ID NO: 586171 - RNA, 14 nt, Escherichia coli CFT073
gcaacguuccagca

SEQ ID NO: 586172 - RNA, 15 nt, Escherichia coli CFT073
gcaacuaccagcagu

SEQ ID NO: 586173 - RNA, 19 nt, Escherichia coli CFT073
gcaacucaccuuuaaacag

SEQ ID NO: 586174 - RNA, 17 nt, Escherichia coli CFT073
gcaacuccaccagcacc

SEQ ID NO: 586175 - RNA, 16 nt, Escherichia coli CFT073
gcaacugccaguaaag

SEQ ID NO: 586176 - RNA, 17 nt, Escherichia coli CFT073
gcaacugcgccgcgagc

SEQ ID NO: 586177 - RNA, 18 nt, Escherichia coli CFT073
gcaacugcgccgcgagca

SEQ ID NO: 586178 - RNA, 15 nt, Escherichia coli CFT073
gcaacugcccaggca

SEQ ID NO: 586179 - RNA, 14 nt, Escherichia coli CFT073
gcaagaguuuuaaa

SEQ ID NO: 586180 - RNA, 16 nt, Escherichia coli CFT073
gcaagauaaaucgcac

SEQ ID NO: 586181 - RNA, 17 nt, Escherichia coli CFT073
gcaagaucgcgcaucag

SEQ ID NO: 586182 - RNA, 19 nt, Escherichia coli CFT073
gcaagacuuuguaggccgg

SEQ ID NO: 586183 - RNA, 20 nt, Escherichia coli CFT073
gcaagacuuuguaggccgga

SEQ ID NO: 586184 - RNA, 22 nt, Escherichia coli CFT073
gcaacuuuguauucaguucauc

SEQ ID NO: 586185 - RNA, 20 nt, Escherichia coli CFT073
gcaacuugugcucgcguugc

SEQ ID NO: 586186 - RNA, 16 nt, Escherichia coli CFT073
gcaacuguuuuaccaa

SEQ ID NO: 586187 - RNA, 18 nt, Escherichia coli CFT073
gcaacuuaaucaucaaug

SEQ ID NO: 586188 - RNA, 17 nt, Escherichia coli CFT073
gcaacuucggccagcgu

SEQ ID NO: 586189 - RNA, 19 nt, Escherichia coli CFT073
gcaacgauaacaaucacca

SEQ ID NO: 586190 - RNA, 13 nt, Escherichia coli CFT073
gcaacgaccagaa

SEQ ID NO: 586191 - RNA, 15 nt, Escherichia coli CFT073
gcaacgaccgcgagc

SEQ ID NO: 586192 - RNA, 16 nt, Escherichia coli CFT073
gcaaccuguaggccga

SEQ ID NO: 586193 - RNA, 15 nt, Escherichia coli CFT073
gcaaccgggcuauuu

SEQ ID NO: 586194 - RNA, 21 nt, Escherichia coli CFT073
gcaaccgcgccaagccugaug

SEQ ID NO: 586195 - RNA, 22 nt, Escherichia coli CFT073
gcaaccgccgcugcuuucgccg

SEQ ID NO: 586196 - RNA, 23 nt, Escherichia coli CFT073
gcaaccgacgacgaccagcggca

SEQ ID NO: 586197 - RNA, 13 nt, Escherichia coli CFT073
gcaacgcaucaaa

SEQ ID NO: 586198 - RNA, 14 nt, Escherichia coli CFT073
gcagccgucgccag

SEQ ID NO: 586199 - RNA, 11 nt, Escherichia coli CFT073
gcagccaggau

SEQ ID NO: 586200 - RNA, 17 nt, Escherichia coli CFT073
gcagcccguggcgcgaa

SEQ ID NO: 586201 - RNA, 15 nt, Escherichia coli CFT073
gcagccacugcugcg

SEQ ID NO: 586202 - RNA, 15 nt, Escherichia coli CFT073
gcagccacgucaccu

SEQ ID NO: 586203 - RNA, 13 nt, Escherichia coli CFT073
gcagccacaccaa

SEQ ID NO: 586204 - RNA, 12 nt, Escherichia coli CFT073
gcagcauucauc

SEQ ID NO: 586205 - RNA, 19 nt, Escherichia coli CFT073
gcagcaugauacaaaacag

SEQ ID NO: 586206 - RNA, 17 nt, Escherichia coli CFT073
gcagcaggugcgccagc

SEQ ID NO: 586207 - RNA, 17 nt, Escherichia coli CFT073
gcagcagggcaauacgc

SEQ ID NO: 586208 - RNA, 12 nt, Escherichia coli CFT073
gcagcaucacca

SEQ ID NO: 586209 - RNA, 12 nt, Escherichia coli CFT073
gcagcaucacgg

SEQ ID NO: 586210 - RNA, 14 nt, Escherichia coli CFT073
gcagcaucaguagc

SEQ ID NO: 586211 - RNA, 19 nt, Escherichia coli CFT073
gcagcaggcaauuucgccu

SEQ ID NO: 586212 - RNA, 12 nt, Escherichia coli CFT073
gcagcagcuucg

SEQ ID NO: 586213 - RNA, 12 nt, Escherichia coli CFT073
gcagcagcgucc

SEQ ID NO: 586214 - RNA, 24 nt, Escherichia coli CFT073
gcagaucgccagagucagcacgag

SEQ ID NO: 586215 - RNA, 13 nt, Escherichia coli CFT073
gcagaucgaucuu

SEQ ID NO: 586216 - RNA, 21 nt, Escherichia coli CFT073
gcagaucccacucaucaagca

SEQ ID NO: 586217 - RNA, 14 nt, Escherichia coli CFT073
gcagaucugcgcca

SEQ ID NO: 586218 - RNA, 16 nt, Escherichia coli CFT073
gcagaauaacggcuga

SEQ ID NO: 586219 - RNA, 21 nt, Escherichia coli CFT073
gcacguuccguauaccgucag

SEQ ID NO: 586220 - RNA, 19 nt, Escherichia coli CFT073
gcacguucugucgcucugc

SEQ ID NO: 586221 - RNA, 14 nt, Escherichia coli CFT073
gcacguugccagca

SEQ ID NO: 586222 - RNA, 21 nt, Escherichia coli CFT073
gcacguugcuuauugccggau

SEQ ID NO: 586223 - RNA, 18 nt, Escherichia coli CFT073
gcagagcauccagcagcc

SEQ ID NO: 586224 - RNA, 13 nt, Escherichia coli CFT073
aagaaaccauugc

SEQ ID NO: 586225 - RNA, 21 nt, Escherichia coli CFT073
gcagacguuuuuucugcccca

SEQ ID NO: 586226 - RNA, 18 nt, Escherichia coli CFT073
gcagacucaccugauuac

SEQ ID NO: 586227 - RNA, 22 nt, Escherichia coli CFT073
gcagacuguaaaucugccguca

SEQ ID NO: 586228 - RNA, 17 nt, Escherichia coli CFT073
gcagacuuuuugcggca

SEQ ID NO: 586229 - RNA, 18 nt, Escherichia coli CFT073
gcagacgccguuccagau

SEQ ID NO: 586230 - RNA, 18 nt, Escherichia coli CFT073
gcagacgaugaugcagau

SEQ ID NO: 586231 - RNA, 17 nt, Escherichia coli CFT073
gcagaccuucugccaga

SEQ ID NO: 586232 - RNA, 12 nt, Escherichia coli CFT073
gcacccgccaga

SEQ ID NO: 586233 - RNA, 14 nt, Escherichia coli CFT073
gcacccgccgcuau

SEQ ID NO: 586234 - RNA, 13 nt, Escherichia coli CFT073
gcacccgcgccga

SEQ ID NO: 586235 - RNA, 19 nt, Escherichia coli CFT073
gcacccauuuauccagcgg

SEQ ID NO: 586236 - RNA, 19 nt, Escherichia coli CFT073
gcaccccauagccagcgac

SEQ ID NO: 586237 - RNA, 15 nt, Escherichia coli CFT073
gcaccaguucgccgu

SEQ ID NO: 586238 - RNA, 21 nt, Escherichia coli CFT073
gcaccaguaaaccaauuucug

SEQ ID NO: 586239 - RNA, 12 nt, Escherichia coli CFT073
gcacagcauccg

SEQ ID NO: 586240 - RNA, 17 nt, Escherichia coli CFT073
gcacagaaaagcagagu

SEQ ID NO: 586241 - RNA, 23 nt, Escherichia coli CFT073
gcacacucaagccguuaauucuu

SEQ ID NO: 586242 - RNA, 15 nt, Escherichia coli CFT073
gcacagagauaaaag

SEQ ID NO: 586243 - RNA, 23 nt, Escherichia coli CFT073
gcacagagauaaaaggcgucaug

SEQ ID NO: 586244 - RNA, 13 nt, Escherichia coli CFT073
gcaccgugaaaga

SEQ ID NO: 586245 - RNA, 19 nt, Escherichia coli CFT073
gcaccguguuccugaacgu

SEQ ID NO: 586246 - RNA, 18 nt, Escherichia coli CFT073
gcaccuaucgcgucgccg

SEQ ID NO: 586247 - RNA, 20 nt, Escherichia coli CFT073
gcaccgguacacaaccgccg

SEQ ID NO: 586248 - RNA, 15 nt, Escherichia coli CFT073
gcaccgccagcagca

SEQ ID NO: 586249 - RNA, 14 nt, Escherichia coli CFT073
gcaccgccagcagg

SEQ ID NO: 586250 - RNA, 15 nt, Escherichia coli CFT073
gcaccuuuaccgauu

SEQ ID NO: 586251 - RNA, 13 nt, Escherichia coli CFT073
gcaccugcacagg

SEQ ID NO: 586252 - RNA, 20 nt, Escherichia coli CFT073
gcaccuuguucaucggccuu

SEQ ID NO: 586253 - RNA, 15 nt, Escherichia coli CFT073
gcaccugccagcgcc

SEQ ID NO: 586254 - RNA, 12 nt, Escherichia coli CFT073
gcaccugaaucg

SEQ ID NO: 586255 - RNA, 13 nt, Escherichia coli CFT073
gcacgaccuugcc

SEQ ID NO: 586256 - RNA, 22 nt, Escherichia coli CFT073
gcacgacgaaucugauucgccu

SEQ ID NO: 586257 - RNA, 21 nt, Escherichia coli CFT073
gcacgacuuucucuucaucua

SEQ ID NO: 586258 - RNA, 23 nt, Escherichia coli CFT073
gcacgacggaauuucauaugcgc

SEQ ID NO: 586259 - RNA, 16 nt, Escherichia coli CFT073
gcacgaugcugcgcag

SEQ ID NO: 586260 - RNA, 19 nt, Escherichia coli CFT073
gcacgauuuuguaggccgg

SEQ ID NO: 586261 - RNA, 15 nt, Escherichia coli CFT073
gcacggaaagcagca

SEQ ID NO: 586262 - RNA, 14 nt, Escherichia coli CFT073
gcacgcugucgcca

SEQ ID NO: 586263 - RNA, 22 nt, Escherichia coli CFT073
gaucgccccggaagcaucaaac

SEQ ID NO: 586264 - RNA, 23 nt, Escherichia coli CFT073
gaucgccagcccuuucagcccac

SEQ ID NO: 586265 - RNA, 22 nt, Escherichia coli CFT073
gaucgccacuuucacgccgcca

SEQ ID NO: 586266 - RNA, 12 nt, Escherichia coli CFT073
gaucgcgaaacc

SEQ ID NO: 586267 - RNA, 17 nt, Escherichia coli CFT073
gauccgcuuuacgcagu

SEQ ID NO: 586268 - RNA, 17 nt, Escherichia coli CFT073
gaucaugguagcgugau

SEQ ID NO: 586269 - RNA, 16 nt, Escherichia coli CFT073
gaucaguaauucgcau

SEQ ID NO: 586270 - RNA, 14 nt, Escherichia coli CFT073
gaucaguaccagcc

SEQ ID NO: 586271 - RNA, 19 nt, Escherichia coli CFT073
gauccacgcucgcuggcgu

SEQ ID NO: 586272 - RNA, 16 nt, Escherichia coli CFT073
gauccacgccaucccc

SEQ ID NO: 586273 - RNA, 18 nt, Escherichia coli CFT073
gaucauuuucaugcuguu

SEQ ID NO: 586274 - RNA, 14 nt, Escherichia coli CFT073
gaucccgacgugau

SEQ ID NO: 586275 - RNA, 16 nt, Escherichia coli CFT073
gaucccgauaccagua

SEQ ID NO: 586276 - RNA, 16 nt, Escherichia coli CFT073
gaucccgccaucgcgg

SEQ ID NO: 586277 - RNA, 17 nt, Escherichia coli CFT073
gaucccagcgccugcag

SEQ ID NO: 586278 - RNA, 13 nt, Escherichia coli CFT073
gaucagaagaggu

SEQ ID NO: 586279 - RNA, 21 nt, Escherichia coli CFT073
gaucagaccgccaaucagcau

SEQ ID NO: 586280 - RNA, 22 nt, Escherichia coli CFT073
gaucagagaacggaucaggcag

SEQ ID NO: 586281 - RNA, 20 nt, Escherichia coli CFT073
gaucagaguacgcaguugcu

SEQ ID NO: 586282 - RNA, 17 nt, Escherichia coli CFT073
gaucaggugauggcagc

SEQ ID NO: 586283 - RNA, 16 nt, Escherichia coli CFT073
gaucagguauaccgaa

SEQ ID NO: 586284 - RNA, 23 nt, Escherichia coli CFT073
gaucacuucuguuugcgccacgc

SEQ ID NO: 586285 - RNA, 14 nt, Escherichia coli CFT073
gaucacgcagcaag

SEQ ID NO: 586286 - RNA, 21 nt, Escherichia coli CFT073
gaucacgacuuguaccuucag

SEQ ID NO: 586287 - RNA, 12 nt, Escherichia coli CFT073
gaucgugauagc

SEQ ID NO: 586288 - RNA, 22 nt, Escherichia coli CFT073
gaucggcguacuggcaaucgcc

SEQ ID NO: 586289 - RNA, 14 nt, Escherichia coli CFT073
gaucgggcagugcu

SEQ ID NO: 586290 - RNA, 15 nt, Escherichia coli CFT073
gaucgggaacagcca

SEQ ID NO: 586291 - RNA, 15 nt, Escherichia coli CFT073
gaucgguagaccgga

SEQ ID NO: 586292 - RNA, 14 nt, Escherichia coli CFT073
gaucguacucaauc

SEQ ID NO: 586293 - RNA, 21 nt, Escherichia coli CFT073
gaucgcuuucaacguagccug

SEQ ID NO: 586294 - RNA, 22 nt, Escherichia coli CFT073
gaucgcgcucaauguugcugcu

SEQ ID NO: 586295 - RNA, 13 nt, Escherichia coli CFT073
gaucgcuuucgcu

SEQ ID NO: 586296 - RNA, 17 nt, Escherichia coli CFT073
gauauccugaaacgcgg

SEQ ID NO: 586297 - RNA, 16 nt, Escherichia coli CFT073
gauaucgucgagagau

SEQ ID NO: 586298 - RNA, 13 nt, Escherichia coli CFT073
gauaugaccguuu

SEQ ID NO: 586299 - RNA, 21 nt, Escherichia coli CFT073
gauaugagacaccuguaaguu

SEQ ID NO: 586300 - RNA, 22 nt, Escherichia coli CFT073
gauaugauguaacaguugcagu

SEQ ID NO: 586301 - RNA, 21 nt, Escherichia coli CFT073
gauaugccccagcccgccaau

SEQ ID NO: 586302 - RNA, 16 nt, Escherichia coli CFT073
gaucaaagaccgguuu

SEQ ID NO: 586303 - RNA, 17 nt, Escherichia coli CFT073
gaucaaauaaccgguau

SEQ ID NO: 586304 - RNA, 12 nt, Escherichia coli CFT073
gaucaacacaug

SEQ ID NO: 586305 - RNA, 20 nt, Escherichia coli CFT073
gaucaaggcauauaccacac

SEQ ID NO: 586306 - RNA, 13 nt, Escherichia coli CFT073
gaucaagcaccgc

SEQ ID NO: 586307 - RNA, 11 nt, Escherichia coli CFT073
gauagcaaugc

SEQ ID NO: 586308 - RNA, 22 nt, Escherichia coli CFT073
gauagccagguuuaccagcagc

SEQ ID NO: 586309 - RNA, 15 nt, Escherichia coli CFT073
gauagccgaccgcaa

SEQ ID NO: 586310 - RNA, 18 nt, Escherichia coli CFT073
gauacgcgccaaucggca

SEQ ID NO: 586311 - RNA, 14 nt, Escherichia coli CFT073
gauaggucauauca

SEQ ID NO: 586312 - RNA, 19 nt, Escherichia coli CFT073
gauaucgcuggcagaaagc

SEQ ID NO: 586313 - RNA, 20 nt, Escherichia coli CFT073
gauaucccgccagcaccagc

SEQ ID NO: 586314 - RNA, 15 nt, Escherichia coli CFT073
gaguuuuaaacgcag

SEQ ID NO: 586315 - RNA, 17 nt, Escherichia coli CFT073
gauaaaauaaccgucuu

SEQ ID NO: 586316 - RNA, 19 nt, Escherichia coli CFT073
gauaaaccgaucgccguua

SEQ ID NO: 586317 - RNA, 15 nt, Escherichia coli CFT073
gauaaacgaccacuc

SEQ ID NO: 586318 - RNA, 13 nt, Escherichia coli CFT073
gauaaacggaaca

SEQ ID NO: 586319 - RNA, 15 nt, Escherichia coli CFT073
gauaaacagcgucga

SEQ ID NO: 586320 - RNA, 19 nt, Escherichia coli CFT073
gauaaagcccccacaacau

SEQ ID NO: 586321 - RNA, 23 nt, Escherichia coli CFT073
gauaaaucgcacguugccagcaa

SEQ ID NO: 586322 - RNA, 16 nt, Escherichia coli CFT073
gauaagaccaauccag

SEQ ID NO: 586323 - RNA, 21 nt, Escherichia coli CFT073
gauaagacgcgaacagcgucg

SEQ ID NO: 586324 - RNA, 13 nt, Escherichia coli CFT073
gaguuugaugacc

SEQ ID NO: 586325 - RNA, 15 nt, Escherichia coli CFT073
gaguuuacgcagcag

SEQ ID NO: 586326 - RNA, 15 nt, Escherichia coli CFT073
gaguugccauccggc

SEQ ID NO: 586327 - RNA, 18 nt, Escherichia coli CFT073
gaguugccauccggcuga

SEQ ID NO: 586328 - RNA, 16 nt, Escherichia coli CFT073
gauaccgugcagcacg

SEQ ID NO: 586329 - RNA, 15 nt, Escherichia coli CFT073
gauaauuuucagacc

SEQ ID NO: 586330 - RNA, 13 nt, Escherichia coli CFT073
gauaauuuugaaa

SEQ ID NO: 586331 - RNA, 18 nt, Escherichia coli CFT073
gauacacggugcuccagu

SEQ ID NO: 586332 - RNA, 14 nt, Escherichia coli CFT073
gauaagacgcgcca

SEQ ID NO: 586333 - RNA, 20 nt, Escherichia coli CFT073
gauaagacgcgccagcaucg

SEQ ID NO: 586334 - RNA, 14 nt, Escherichia coli CFT073
gauaagacgcguca

SEQ ID NO: 586335 - RNA, 19 nt, Escherichia coli CFT073
gauaagacgcgucaagcgu

SEQ ID NO: 586336 - RNA, 14 nt, Escherichia coli CFT073
gauaagaugcguua

SEQ ID NO: 586337 - RNA, 21 nt, Escherichia coli CFT073
gauaagcaggagugcgaauac

SEQ ID NO: 586338 - RNA, 18 nt, Escherichia coli CFT073
gauaauacgucggcauca

SEQ ID NO: 586339 - RNA, 19 nt, Escherichia coli CFT073
gauaaucacaauggucaac

SEQ ID NO: 586340 - RNA, 16 nt, Escherichia coli CFT073
gauaaucggugcggca

SEQ ID NO: 586341 - RNA, 19 nt, Escherichia coli CFT073
gauaaugaaugaugcggcg

SEQ ID NO: 586342 - RNA, 21 nt, Escherichia coli CFT073
gaguuaauuagcuuaucaauc

SEQ ID NO: 586343 - RNA, 14 nt, Escherichia coli CFT073
gaguucacugccgu

SEQ ID NO: 586344 - RNA, 16 nt, Escherichia coli CFT073
gaguucacugccguac

SEQ ID NO: 586345 - RNA, 21 nt, Escherichia coli CFT073
gaguucacugccguacaggca

SEQ ID NO: 586346 - RNA, 12 nt, Escherichia coli CFT073
gagucagcagcg

SEQ ID NO: 586347 - RNA, 22 nt, Escherichia coli CFT073
gagggagcagauacggcgcauc

SEQ ID NO: 586348 - RNA, 17 nt, Escherichia coli CFT073
gagggcauagcgcagcg

SEQ ID NO: 586349 - RNA, 20 nt, Escherichia coli CFT073
gagguuaucgcccugccagc

SEQ ID NO: 586350 - RNA, 21 nt, Escherichia coli CFT073
gaggcgacaaacacuugcggc

SEQ ID NO: 586351 - RNA, 18 nt, Escherichia coli CFT073
gaggccugauaaaacgcg

SEQ ID NO: 586352 - RNA, 18 nt, Escherichia coli CFT073
aacguuuccauucgcugc

SEQ ID NO: 586353 - RNA, 12 nt, Escherichia coli CFT073
aacuacccgguu

SEQ ID NO: 586354 - RNA, 17 nt, Escherichia coli CFT073
aacuacggcuuuuuuca

SEQ ID NO: 586355 - RNA, 20 nt, Escherichia coli CFT073
aacuacggcuuuuuucauuu

SEQ ID NO: 586356 - RNA, 17 nt, Escherichia coli CFT073
aacguuugauuaacgcc

SEQ ID NO: 586357 - RNA, 17 nt, Escherichia coli CFT073
aacguugaaccgcccca

SEQ ID NO: 586358 - RNA, 15 nt, Escherichia coli CFT073
aacgugguuugcggc

SEQ ID NO: 586359 - RNA, 22 nt, Escherichia coli CFT073
aacguguacccagcagcgccac

SEQ ID NO: 586360 - RNA, 22 nt, Escherichia coli CFT073
aacguguguuucgauauaacca

SEQ ID NO: 586361 - RNA, 20 nt, Escherichia coli CFT073
aacguguuuauauuugaaca

SEQ ID NO: 586362 - RNA, 14 nt, Escherichia coli CFT073
aacguuaacgcguc

SEQ ID NO: 586363 - RNA, 16 nt, Escherichia coli CFT073
aacguucgaucacccg

SEQ ID NO: 586364 - RNA, 16 nt, Escherichia coli CFT073
aacuauuguauaccaa

SEQ ID NO: 586365 - RNA, 22 nt, Escherichia coli CFT073
gacuucaaaaauaaguugccac

SEQ ID NO: 586366 - RNA, 22 nt, Escherichia coli CFT073
gagaaagccaauuugcgccgcc

SEQ ID NO: 586367 - RNA, 15 nt, Escherichia coli CFT073
gagaaauaucagcag

SEQ ID NO: 586368 - RNA, 16 nt, Escherichia coli CFT073
gagaaauaucagcagc

SEQ ID NO: 586369 - RNA, 17 nt, Escherichia coli CFT073
gagaaaucggggucauc

SEQ ID NO: 586370 - RNA, 20 nt, Escherichia coli CFT073
gacuuuagcgaaaucuuccg

SEQ ID NO: 586371 - RNA, 13 nt, Escherichia coli CFT073
gacuuugcgccau

SEQ ID NO: 586372 - RNA, 13 nt, Escherichia coli CFT073
gacugaaguucug

SEQ ID NO: 586373 - RNA, 14 nt, Escherichia coli CFT073
gacugaaccagcgc

SEQ ID NO: 586374 - RNA, 15 nt, Escherichia coli CFT073
gacugacagagaaca

SEQ ID NO: 586375 - RNA, 20 nt, Escherichia coli CFT073
gacucugaaugccaguuuau

SEQ ID NO: 586376 - RNA, 18 nt, Escherichia coli CFT073
gacugacgucacgcacca

SEQ ID NO: 586377 - RNA, 11 nt, Escherichia coli CFT073
gacugacuuca

SEQ ID NO: 586378 - RNA, 23 nt, Escherichia coli CFT073
gacugauauccagccaggucgug

SEQ ID NO: 586379 - RNA, 18 nt, Escherichia coli CFT073
gacugaugacaaacgcaa

SEQ ID NO: 586380 - RNA, 19 nt, Escherichia coli CFT073
aacgugcucugcgccgccu

SEQ ID NO: 586381 - RNA, 15 nt, Escherichia coli CFT073
gacuggcgcggcagg

SEQ ID NO: 586382 - RNA, 17 nt, Escherichia coli CFT073
gacuggccauggauuca

SEQ ID NO: 586383 - RNA, 19 nt, Escherichia coli CFT073
gacugcgccuuccagccag

SEQ ID NO: 586384 - RNA, 13 nt, Escherichia coli CFT073
gacuauuugacac

SEQ ID NO: 586385 - RNA, 19 nt, Escherichia coli CFT073
gacucaaacggucagucgc

SEQ ID NO: 586386 - RNA, 17 nt, Escherichia coli CFT073
gacguuuuccaucgacc

SEQ ID NO: 586387 - RNA, 12 nt, Escherichia coli CFT073
gacuaacauccg

SEQ ID NO: 586388 - RNA, 18 nt, Escherichia coli CFT073
gacuaagcgaucgcuaaa

SEQ ID NO: 586389 - RNA, 12 nt, Escherichia coli CFT073
gacuccagcgcu

SEQ ID NO: 586390 - RNA, 13 nt, Escherichia coli CFT073
gacguucaguuca

SEQ ID NO: 586391 - RNA, 19 nt, Escherichia coli CFT073
gacguguugucagcucauc

SEQ ID NO: 586392 - RNA, 14 nt, Escherichia coli CFT073
gacguuacgcgcca

SEQ ID NO: 586393 - RNA, 18 nt, Escherichia coli CFT073
gacgugcucgaacauccc

SEQ ID NO: 586394 - RNA, 18 nt, Escherichia coli CFT073
gacguacaucagcggcaa

SEQ ID NO: 586395 - RNA, 14 nt, Escherichia coli CFT073
gacguaccagcguc

SEQ ID NO: 586396 - RNA, 17 nt, Escherichia coli CFT073
gacgucaggccgccacu

SEQ ID NO: 586397 - RNA, 16 nt, Escherichia coli CFT073
gacguccaaucagcac

SEQ ID NO: 586398 - RNA, 23 nt, Escherichia coli CFT073
gacguccagcccuucucgcuccu

SEQ ID NO: 586399 - RNA, 13 nt, Escherichia coli CFT073
gacguccagaacc

SEQ ID NO: 586400 - RNA, 15 nt, Escherichia coli CFT073
gagcacaucagcgcc

SEQ ID NO: 586401 - RNA, 14 nt, Escherichia coli CFT073
gagauuaaacgcau

SEQ ID NO: 586402 - RNA, 17 nt, Escherichia coli CFT073
gagauuuuccggguucu

SEQ ID NO: 586403 - RNA, 17 nt, Escherichia coli CFT073
gagcaaaagccuuaucc

SEQ ID NO: 586404 - RNA, 20 nt, Escherichia coli CFT073
gagcaaaaucguaagcagga

SEQ ID NO: 586405 - RNA, 17 nt, Escherichia coli CFT073
gagcacugcgcccgcca

SEQ ID NO: 586406 - RNA, 22 nt, Escherichia coli CFT073
gagaauaaaacaagcagcugcc

SEQ ID NO: 586407 - RNA, 22 nt, Escherichia coli CFT073
gagaauaaagcuuuaauauccg

SEQ ID NO: 586408 - RNA, 17 nt, Escherichia coli CFT073
gagaauauguuuuuaaa

SEQ ID NO: 586409 - RNA, 17 nt, Escherichia coli CFT073
gagaauauugccgggaa

SEQ ID NO: 586410 - RNA, 21 nt, Escherichia coli CFT073
gagaauagcgccaucgcgacg

SEQ ID NO: 586411 - RNA, 13 nt, Escherichia coli CFT073
gagaagccaggua

SEQ ID NO: 586412 - RNA, 19 nt, Escherichia coli CFT073
gagaagucggcuuuuagcg

SEQ ID NO: 586413 - RNA, 18 nt, Escherichia coli CFT073
gagaaugccagcagcacc

SEQ ID NO: 586414 - RNA, 15 nt, Escherichia coli CFT073
gagaccaaaccauca

SEQ ID NO: 586415 - RNA, 14 nt, Escherichia coli CFT073
gagacgaucgccac

SEQ ID NO: 586416 - RNA, 12 nt, Escherichia coli CFT073
gagacgccagaa

SEQ ID NO: 586417 - RNA, 13 nt, Escherichia coli CFT073
gagagaacugcug

SEQ ID NO: 586418 - RNA, 15 nt, Escherichia coli CFT073
gagagccccagccgc

SEQ ID NO: 586419 - RNA, 16 nt, Escherichia coli CFT073
gagauaaaaucgagcg

SEQ ID NO: 586420 - RNA, 16 nt, Escherichia coli CFT073
gagaucccuuccggug

SEQ ID NO: 586421 - RNA, 15 nt, Escherichia coli CFT073
gagaucgagcgccgu

SEQ ID NO: 586422 - RNA, 15 nt, Escherichia coli CFT073
gagauaaugcgccag

SEQ ID NO: 586423 - RNA, 17 nt, Escherichia coli CFT073
gagauaauggcaauggu

SEQ ID NO: 586424 - RNA, 21 nt, Escherichia coli CFT073
gagauaaugguuuccagcauc

SEQ ID NO: 586425 - RNA, 18 nt, Escherichia coli CFT073
gagauaauucagcagagc

SEQ ID NO: 586426 - RNA, 24 nt, Escherichia coli CFT073
gagauauuucaccagcgcacguaa

SEQ ID NO: 586427 - RNA, 15 nt, Escherichia coli CFT073
gagaucaaugcgcca

SEQ ID NO: 586428 - RNA, 21 nt, Escherichia coli CFT073
gagccgccgcauuauggugaa

SEQ ID NO: 586429 - RNA, 19 nt, Escherichia coli CFT073
gagcgccuuauccggccua

SEQ ID NO: 586430 - RNA, 18 nt, Escherichia coli CFT073
gagcgauuuguaggccug

SEQ ID NO: 586431 - RNA, 19 nt, Escherichia coli CFT073
gagcgccguugcgcccauc

SEQ ID NO: 586432 - RNA, 21 nt, Escherichia coli CFT073
gagccaguucguugaucagca

SEQ ID NO: 586433 - RNA, 13 nt, Escherichia coli CFT073
gagcagcggcguu

SEQ ID NO: 586434 - RNA, 16 nt, Escherichia coli CFT073
aacucaucgccgccaa

SEQ ID NO: 586435 - RNA, 16 nt, Escherichia coli CFT073
aacucaggaacaucag

SEQ ID NO: 586436 - RNA, 15 nt, Escherichia coli CFT073
aacucaauucacgcc

SEQ ID NO: 586437 - RNA, 18 nt, Escherichia coli CFT073
aacuccaccaauaaugcc

SEQ ID NO: 586438 - RNA, 15 nt, Escherichia coli CFT073
aacucgaauuauuca

SEQ ID NO: 586439 - RNA, 23 nt, Escherichia coli CFT073
aacuccgaaauggucauuuuuca

SEQ ID NO: 586440 - RNA, 19 nt, Escherichia coli CFT073
aacuccgccgcuaaauacc

SEQ ID NO: 586441 - RNA, 20 nt, Escherichia coli CFT073
gagcaugguaacgccccaca

SEQ ID NO: 586442 - RNA, 19 nt, Escherichia coli CFT073
gagccaaacucauccacca

SEQ ID NO: 586443 - RNA, 12 nt, Escherichia coli CFT073
gcaucguggccu

SEQ ID NO: 586444 - RNA, 13 nt, Escherichia coli CFT073
gcaucguggccug

SEQ ID NO: 586445 - RNA, 17 nt, Escherichia coli CFT073
gcaucguagauuucauc

SEQ ID NO: 586446 - RNA, 19 nt, Escherichia coli CFT073
gcaucucuucaaauagcgg

SEQ ID NO: 586447 - RNA, 18 nt, Escherichia coli CFT073
gcaucgggaauggcauac

SEQ ID NO: 586448 - RNA, 16 nt, Escherichia coli CFT073
gcaucggagcaccggg

SEQ ID NO: 586449 - RNA, 14 nt, Escherichia coli CFT073
gcaucggcaucaaa

SEQ ID NO: 586450 - RNA, 15 nt, Escherichia coli CFT073
gcaucgcgcaccagc

SEQ ID NO: 586451 - RNA, 22 nt, Escherichia coli CFT073
gcaucgccgggaguuucagcgg

SEQ ID NO: 586452 - RNA, 24 nt, Escherichia coli CFT073
gcaucgccugcgcgauacuacguu

SEQ ID NO: 586453 - RNA, 23 nt, Escherichia coli CFT073
gcaucgcccagccaucgacacca

SEQ ID NO: 586454 - RNA, 18 nt, Escherichia coli CFT073
gcaucgccaaacaggcga

SEQ ID NO: 586455 - RNA, 15 nt, Escherichia coli CFT073
gcaucgccagacaau

SEQ ID NO: 586456 - RNA, 17 nt, Escherichia coli CFT073
gcaucgccaucaacaau

SEQ ID NO: 586457 - RNA, 17 nt, Escherichia coli CFT073
gcaucgccauccuuucc

SEQ ID NO: 586458 - RNA, 19 nt, Escherichia coli CFT073
gcaucgccauccuuucccu

SEQ ID NO: 586459 - RNA, 21 nt, Escherichia coli CFT073
gcaucgccauccuuucccugg

SEQ ID NO: 586460 - RNA, 20 nt, Escherichia coli CFT073
gcaucaguuucgaucagcaa

SEQ ID NO: 586461 - RNA, 21 nt, Escherichia coli CFT073
gcaucauccucuucaccggua

SEQ ID NO: 586462 - RNA, 12 nt, Escherichia coli CFT073
gcaucaucgaca

SEQ ID NO: 586463 - RNA, 22 nt, Escherichia coli CFT073
gcaucagcgccuuaccaauacc

SEQ ID NO: 586464 - RNA, 19 nt, Escherichia coli CFT073
gcaucaggcaacccagaag

SEQ ID NO: 586465 - RNA, 15 nt, Escherichia coli CFT073
gcaucaggcaugaua

SEQ ID NO: 586466 - RNA, 11 nt, Escherichia coli CFT073
gcaucaugcgg

SEQ ID NO: 586467 - RNA, 15 nt, Escherichia coli CFT073
gcauccacaacccgu

SEQ ID NO: 586468 - RNA, 19 nt, Escherichia coli CFT073
gcauccgcgcacaggcggc

SEQ ID NO: 586469 - RNA, 16 nt, Escherichia coli CFT073
gcauccgaaaaccgau

SEQ ID NO: 586470 - RNA, 17 nt, Escherichia coli CFT073
gcauccgccacuuuaug

SEQ ID NO: 586471 - RNA, 13 nt, Escherichia coli CFT073
gcauccagcguuc

SEQ ID NO: 586472 - RNA, 17 nt, Escherichia coli CFT073
gcauccaggccaaaagc

SEQ ID NO: 586473 - RNA, 19 nt, Escherichia coli CFT073
gcauccagccaacguuucu

SEQ ID NO: 586474 - RNA, 13 nt, Escherichia coli CFT073
gcauccaguuccu

SEQ ID NO: 586475 - RNA, 14 nt, Escherichia coli CFT073
gcauccccagcgca

SEQ ID NO: 586476 - RNA, 16 nt, Escherichia coli CFT073
gcauccggccaucagu

SEQ ID NO: 586477 - RNA, 22 nt, Escherichia coli CFT073
gcauccggcaagaaaaugagca

SEQ ID NO: 586478 - RNA, 20 nt, Escherichia coli CFT073
gcauccggcaaucaacgccu

SEQ ID NO: 586479 - RNA, 18 nt, Escherichia coli CFT073
gcauccggcaugaacaaa

SEQ ID NO: 586480 - RNA, 16 nt, Escherichia coli CFT073
gcauccggcgcaaaaa

SEQ ID NO: 586481 - RNA, 12 nt, Escherichia coli CFT073
gcaucgacgcca

SEQ ID NO: 586482 - RNA, 15 nt, Escherichia coli CFT073
gcauacucgcgucug

SEQ ID NO: 586483 - RNA, 13 nt, Escherichia coli CFT073
gcauacuccagcc

SEQ ID NO: 586484 - RNA, 18 nt, Escherichia coli CFT073
gcauacuccggcggcagc

SEQ ID NO: 586485 - RNA, 15 nt, Escherichia coli CFT073
gcauaccauccggca

SEQ ID NO: 586486 - RNA, 20 nt, Escherichia coli CFT073
gcauaccgaucgcgguaaca

SEQ ID NO: 586487 - RNA, 22 nt, Escherichia coli CFT073
gcauacauuuauuucaacgaca

SEQ ID NO: 586488 - RNA, 21 nt, Escherichia coli CFT073
gcauaaugguggaguggccca

SEQ ID NO: 586489 - RNA, 20 nt, Escherichia coli CFT073
gcauacagcuuuuacagcca

SEQ ID NO: 586490 - RNA, 21 nt, Escherichia coli CFT073
gcauacauaacagaauaucug

SEQ ID NO: 586491 - RNA, 22 nt, Escherichia coli CFT073
gcauaauugcgccagagcugcg

SEQ ID NO: 586492 - RNA, 20 nt, Escherichia coli CFT073
gcauaauuucuucguucgcc

SEQ ID NO: 586493 - RNA, 22 nt, Escherichia coli CFT073
gcauagccaccuggcugcguuu

SEQ ID NO: 586494 - RNA, 14 nt, Escherichia coli CFT073
gcauauacaaccaa

SEQ ID NO: 586495 - RNA, 15 nt, Escherichia coli CFT073
gcauauaccgucagc

SEQ ID NO: 586496 - RNA, 12 nt, Escherichia coli CFT073
gcauauccucau

SEQ ID NO: 586497 - RNA, 23 nt, Escherichia coli CFT073
gcauauccucauuucauuguccg

SEQ ID NO: 586498 - RNA, 19 nt, Escherichia coli CFT073
gcauaucgguaaaugcuuu

SEQ ID NO: 586499 - RNA, 21 nt, Escherichia coli CFT073
gcaucaacugcgcuauaucgc

SEQ ID NO: 586500 - RNA, 12 nt, Escherichia coli CFT073
gcaucaagaaac

SEQ ID NO: 586501 - RNA, 21 nt, Escherichia coli CFT073
gcaucacauaaucgaaaacau

SEQ ID NO: 586502 - RNA, 19 nt, Escherichia coli CFT073
gcaucaccacguuagcaaa

SEQ ID NO: 586503 - RNA, 23 nt, Escherichia coli CFT073
gcauauucccuagucgauacugc

SEQ ID NO: 586504 - RNA, 16 nt, Escherichia coli CFT073
gcauauggauaugauc

SEQ ID NO: 586505 - RNA, 16 nt, Escherichia coli CFT073
gcaucaaacuuuuaaa

SEQ ID NO: 586506 - RNA, 13 nt, Escherichia coli CFT073
gcaucaaccagca

SEQ ID NO: 586507 - RNA, 18 nt, Escherichia coli CFT073
gcaucacugacaucacgc

SEQ ID NO: 586508 - RNA, 20 nt, Escherichia coli CFT073
gcaucacugacaucacgcca

SEQ ID NO: 586509 - RNA, 17 nt, Escherichia coli CFT073
gcaucaccgaugcgguu

SEQ ID NO: 586510 - RNA, 23 nt, Escherichia coli CFT073
gcaucacgacaaaugcgccgcca

SEQ ID NO: 586511 - RNA, 18 nt, Escherichia coli CFT073
gcaucacgacagcaccac

SEQ ID NO: 586512 - RNA, 20 nt, Escherichia coli CFT073
gcaucacgaccgcuucagga

SEQ ID NO: 586513 - RNA, 17 nt, Escherichia coli CFT073
gcaucacgcaacauucc

SEQ ID NO: 586514 - RNA, 16 nt, Escherichia coli CFT073
gcaucagcuacaccga

SEQ ID NO: 586515 - RNA, 18 nt, Escherichia coli CFT073
gcaucagcuacaccgauc

SEQ ID NO: 586516 - RNA, 15 nt, Escherichia coli CFT073
gcaucagcuccggua

SEQ ID NO: 586517 - RNA, 15 nt, Escherichia coli CFT073
gcaucagccucgaua

SEQ ID NO: 586518 - RNA, 12 nt, Escherichia coli CFT073
gcaucagcaauu

SEQ ID NO: 586519 - RNA, 16 nt, Escherichia coli CFT073
gcaucagccaggguuc

SEQ ID NO: 586520 - RNA, 21 nt, Escherichia coli CFT073
gcaucagccaggguucccggc

SEQ ID NO: 586521 - RNA, 19 nt, Escherichia coli CFT073
gcauaaucaccaucagcag

SEQ ID NO: 586522 - RNA, 19 nt, Escherichia coli CFT073
gcauaaggugcgaccuaca

SEQ ID NO: 586523 - RNA, 19 nt, Escherichia coli CFT073
gcauaagucccgaccacac

SEQ ID NO: 586524 - RNA, 20 nt, Escherichia coli CFT073
gcauaagcgcguuucugcgc

SEQ ID NO: 586525 - RNA, 23 nt, Escherichia coli CFT073
gcauaaauuucucgccguucucc

SEQ ID NO: 586526 - RNA, 15 nt, Escherichia coli CFT073
gcauaaccgagcaga

SEQ ID NO: 586527 - RNA, 19 nt, Escherichia coli CFT073
gcauaaccgauaccgacga

SEQ ID NO: 586528 - RNA, 19 nt, Escherichia coli CFT073
gcauaacguugcagcguuu

SEQ ID NO: 586529 - RNA, 20 nt, Escherichia coli CFT073
gcaguuguaaucacgcucaa

SEQ ID NO: 586530 - RNA, 19 nt, Escherichia coli CFT073
gcauaaaaucuaaugcucc

SEQ ID NO: 586531 - RNA, 15 nt, Escherichia coli CFT073
gcauaaacaccugcg

SEQ ID NO: 586532 - RNA, 15 nt, Escherichia coli CFT073
gcauaaacaucuucc

SEQ ID NO: 586533 - RNA, 13 nt, Escherichia coli CFT073
gcauaaacgccuu

SEQ ID NO: 586534 - RNA, 19 nt, Escherichia coli CFT073
gcaguugccggaugcggca

SEQ ID NO: 586535 - RNA, 19 nt, Escherichia coli CFT073
gcaguugccggaugcggcg

SEQ ID NO: 586536 - RNA, 17 nt, Escherichia coli CFT073
gcaguugcccgguuucg

SEQ ID NO: 586537 - RNA, 14 nt, Escherichia coli CFT073
gcaguuagcuuuuc

SEQ ID NO: 586538 - RNA, 14 nt, Escherichia coli CFT073
gcaguggcuucggc

SEQ ID NO: 586539 - RNA, 16 nt, Escherichia coli CFT073
gcagugcugcauccug

SEQ ID NO: 586540 - RNA, 19 nt, Escherichia coli CFT073
gcaguggauagacgcaggu

SEQ ID NO: 586541 - RNA, 22 nt, Escherichia coli CFT073
gcagugauuuauuuuuacucuu

SEQ ID NO: 586542 - RNA, 22 nt, Escherichia coli CFT073
gcauuaacucacuggcgcgcgc

SEQ ID NO: 586543 - RNA, 20 nt, Escherichia coli CFT073
gcauuaaguguaaucagccc

SEQ ID NO: 586544 - RNA, 18 nt, Escherichia coli CFT073
gcauguucagucacuuca

SEQ ID NO: 586545 - RNA, 17 nt, Escherichia coli CFT073
gcauuaauaugcucaac

SEQ ID NO: 586546 - RNA, 18 nt, Escherichia coli CFT073
gcauuacgcucgcugcaa

SEQ ID NO: 586547 - RNA, 24 nt, Escherichia coli CFT073
gcauuacggaacugcuccagggca

SEQ ID NO: 586548 - RNA, 16 nt, Escherichia coli CFT073
gcauuccuuuacuuag

SEQ ID NO: 586549 - RNA, 21 nt, Escherichia coli CFT073
gcauucagacacgccgccaga

SEQ ID NO: 586550 - RNA, 18 nt, Escherichia coli CFT073
gcauuaucacaucagcgc

SEQ ID NO: 586551 - RNA, 14 nt, Escherichia coli CFT073
gcauuauccucaau

SEQ ID NO: 586552 - RNA, 15 nt, Escherichia coli CFT073
gcauuaucgagcugc

SEQ ID NO: 586553 - RNA, 16 nt, Escherichia coli CFT073
gcauggugucaccacc

SEQ ID NO: 586554 - RNA, 14 nt, Escherichia coli CFT073
gcauguaacccuuu

SEQ ID NO: 586555 - RNA, 20 nt, Escherichia coli CFT073
gcauguaacugccuuucccu

SEQ ID NO: 586556 - RNA, 18 nt, Escherichia coli CFT073
gcauguuaugaauaucau

SEQ ID NO: 586557 - RNA, 15 nt, Escherichia coli CFT073
gcauggugagcgcac

SEQ ID NO: 586558 - RNA, 13 nt, Escherichia coli CFT073
gcaugaacgccug

SEQ ID NO: 586559 - RNA, 22 nt, Escherichia coli CFT073
gcaugaaguaacagaagaucau

SEQ ID NO: 586560 - RNA, 15 nt, Escherichia coli CFT073
gcaucuuuuuuuacc

SEQ ID NO: 586561 - RNA, 18 nt, Escherichia coli CFT073
gcaucuucuucauucccg

SEQ ID NO: 586562 - RNA, 16 nt, Escherichia coli CFT073
gcaucuucuucuaugc

SEQ ID NO: 586563 - RNA, 20 nt, Escherichia coli CFT073
gcaucuucuucuaugccagc

SEQ ID NO: 586564 - RNA, 22 nt, Escherichia coli CFT073
gcaucuucuucuggcucauuag

SEQ ID NO: 586565 - RNA, 22 nt, Escherichia coli CFT073
gcaucuggcauucagaacacaa

SEQ ID NO: 586566 - RNA, 15 nt, Escherichia coli CFT073
gcaucuggcauuuug

SEQ ID NO: 586567 - RNA, 22 nt, Escherichia coli CFT073
gcaucugguaacccauccagca

SEQ ID NO: 586568 - RNA, 18 nt, Escherichia coli CFT073
gcaucuggugccagcgcc

SEQ ID NO: 586569 - RNA, 21 nt, Escherichia coli CFT073
gcaucuguugguaacuuacug

SEQ ID NO: 586570 - RNA, 13 nt, Escherichia coli CFT073
gcaugccagcgcc

SEQ ID NO: 586571 - RNA, 21 nt, Escherichia coli CFT073
gcaugcauuuucaauaacugg

SEQ ID NO: 586572 - RNA, 22 nt, Escherichia coli CFT073
gcaugaugacuugccuccagcg

SEQ ID NO: 586573 - RNA, 17 nt, Escherichia coli CFT073
gccacaaucucgcccgc

SEQ ID NO: 586574 - RNA, 13 nt, Escherichia coli CFT073
gccacaaucagcg

SEQ ID NO: 586575 - RNA, 19 nt, Escherichia coli CFT073
gccaaggaguuugaacaua

SEQ ID NO: 586576 - RNA, 22 nt, Escherichia coli CFT073
gccaauaccgaucaguaccagc

SEQ ID NO: 586577 - RNA, 19 nt, Escherichia coli CFT073
gccaauacgugaucgcaau

SEQ ID NO: 586578 - RNA, 20 nt, Escherichia coli CFT073
gccaaucagcgcagcaccca

SEQ ID NO: 586579 - RNA, 19 nt, Escherichia coli CFT073
gccaauagccgcaccgagc

SEQ ID NO: 586580 - RNA, 19 nt, Escherichia coli CFT073
gccaaucaucguaccgaua

SEQ ID NO: 586581 - RNA, 18 nt, Escherichia coli CFT073
gccaagcaugucauacau

SEQ ID NO: 586582 - RNA, 17 nt, Escherichia coli CFT073
gccaacgugacguuuca

SEQ ID NO: 586583 - RNA, 22 nt, Escherichia coli CFT073
gccaacgugguuuaccaccagc

SEQ ID NO: 586584 - RNA, 18 nt, Escherichia coli CFT073
gcauucggcgaccagcgc

SEQ ID NO: 586585 - RNA, 22 nt, Escherichia coli CFT073
gcauucggcgaccagcgcagcu

SEQ ID NO: 586586 - RNA, 11 nt, Escherichia coli CFT073
gcauugccgga

SEQ ID NO: 586587 - RNA, 15 nt, Escherichia coli CFT073
gcauugcgccagcga

SEQ ID NO: 586588 - RNA, 17 nt, Escherichia coli CFT073
gcauugauggaguaguu

SEQ ID NO: 586589 - RNA, 13 nt, Escherichia coli CFT073
gcauuggcaaauu

SEQ ID NO: 586590 - RNA, 20 nt, Escherichia coli CFT073
gcauuguuuuuaucccggca

SEQ ID NO: 586591 - RNA, 19 nt, Escherichia coli CFT073
gcauuguguagggcagcgu

SEQ ID NO: 586592 - RNA, 21 nt, Escherichia coli CFT073
gcauuuacgccgcauccggca

SEQ ID NO: 586593 - RNA, 13 nt, Escherichia coli CFT073
gcauuuccaccga

SEQ ID NO: 586594 - RNA, 18 nt, Escherichia coli CFT073
gcauuucggcccaugaca

SEQ ID NO: 586595 - RNA, 16 nt, Escherichia coli CFT073
gcauuugucuguuucu

SEQ ID NO: 586596 - RNA, 16 nt, Escherichia coli CFT073
gcauuuucugcccguu

SEQ ID NO: 586597 - RNA, 20 nt, Escherichia coli CFT073
gcauuucuggaaugcggaga

SEQ ID NO: 586598 - RNA, 21 nt, Escherichia coli CFT073
gcauuugccgcugggccauca

SEQ ID NO: 586599 - RNA, 15 nt, Escherichia coli CFT073
gcauuugcggcagag

SEQ ID NO: 586600 - RNA, 20 nt, Escherichia coli CFT073
gccaaaaaccggcacgccgu

SEQ ID NO: 586601 - RNA, 17 nt, Escherichia coli CFT073
gccaaacauuucacguu

SEQ ID NO: 586602 - RNA, 15 nt, Escherichia coli CFT073
gccaaagaccaggaa

SEQ ID NO: 586603 - RNA, 15 nt, Escherichia coli CFT073
gccaaacgcgguaag

SEQ ID NO: 586604 - RNA, 16 nt, Escherichia coli CFT073
gccaaacgcgguaaga

SEQ ID NO: 586605 - RNA, 15 nt, Escherichia coli CFT073
gccaaacugccguca

SEQ ID NO: 586606 - RNA, 21 nt, Escherichia coli CFT073
gccaacagcagccacaccaau

SEQ ID NO: 586607 - RNA, 16 nt, Escherichia coli CFT073
gccaacauccaucagc

SEQ ID NO: 586608 - RNA, 22 nt, Escherichia coli CFT073
gccaaaucaguugccgaauacc

SEQ ID NO: 586609 - RNA, 16 nt, Escherichia coli CFT073
gccaaauccagcacca

SEQ ID NO: 586610 - RNA, 13 nt, Escherichia coli CFT073
gccaaaucguugc

SEQ ID NO: 586611 - RNA, 18 nt, Escherichia coli CFT073
gccaaaucuaccgucaug

SEQ ID NO: 586612 - RNA, 16 nt, Escherichia coli CFT073
gccaaauuuaaacgau

SEQ ID NO: 586613 - RNA, 23 nt, Escherichia coli CFT073
gccaacaccacaaaucgggugaa

SEQ ID NO: 586614 - RNA, 23 nt, Escherichia coli CFT073
gccagaagcccggaucguucacg

SEQ ID NO: 586615 - RNA, 19 nt, Escherichia coli CFT073
gccagaauaagucucccgc

SEQ ID NO: 586616 - RNA, 21 nt, Escherichia coli CFT073
gccagaauaaucggcgucauu

SEQ ID NO: 586617 - RNA, 22 nt, Escherichia coli CFT073
gccagaauacccgaagcgccaa

SEQ ID NO: 586618 - RNA, 15 nt, Escherichia coli CFT073
gccagaauagccgca

SEQ ID NO: 586619 - RNA, 16 nt, Escherichia coli CFT073
gccagaauagcgccgc

SEQ ID NO: 586620 - RNA, 17 nt, Escherichia coli CFT073
gccagaaucaaacugcc

SEQ ID NO: 586621 - RNA, 13 nt, Escherichia coli CFT073
gccagaaccgagc

SEQ ID NO: 586622 - RNA, 23 nt, Escherichia coli CFT073
gccagaaccgcuucuucgacguu

SEQ ID NO: 586623 - RNA, 16 nt, Escherichia coli CFT073
gccagaaaucagcagc

SEQ ID NO: 586624 - RNA, 20 nt, Escherichia coli CFT073
gccagaacugcugcgccagc

SEQ ID NO: 586625 - RNA, 19 nt, Escherichia coli CFT073
gccagaaugaggcaucauu

SEQ ID NO: 586626 - RNA, 18 nt, Escherichia coli CFT073
gccagaccgaacagcaua

SEQ ID NO: 586627 - RNA, 17 nt, Escherichia coli CFT073
gccagaaugucuucgac

SEQ ID NO: 586628 - RNA, 17 nt, Escherichia coli CFT073
gccagacaauccagcga

SEQ ID NO: 586629 - RNA, 19 nt, Escherichia coli CFT073
gccagacaauggcccgccg

SEQ ID NO: 586630 - RNA, 14 nt, Escherichia coli CFT073
gccagagaucgcac

SEQ ID NO: 586631 - RNA, 17 nt, Escherichia coli CFT073
gccagacucucgccaga

SEQ ID NO: 586632 - RNA, 23 nt, Escherichia coli CFT073
gccagacugacaaucaucgccgu

SEQ ID NO: 586633 - RNA, 17 nt, Escherichia coli CFT073
gccagacugaucaucgc

SEQ ID NO: 586634 - RNA, 21 nt, Escherichia coli CFT073
gccagagucagcaaugccaga

SEQ ID NO: 586635 - RNA, 16 nt, Escherichia coli CFT073
gccagacgcgccgcca

SEQ ID NO: 586636 - RNA, 14 nt, Escherichia coli CFT073
gccagaccugcgca

SEQ ID NO: 586637 - RNA, 17 nt, Escherichia coli CFT073
gccagaccuuaucacaa

SEQ ID NO: 586638 - RNA, 21 nt, Escherichia coli CFT073
gccacgguaugacccagcgcg

SEQ ID NO: 586639 - RNA, 22 nt, Escherichia coli CFT073
gccacugcgccacgggcuaaac

SEQ ID NO: 586640 - RNA, 13 nt, Escherichia coli CFT073
gccacugcgccau

SEQ ID NO: 586641 - RNA, 22 nt, Escherichia coli CFT073
gccacucugacggcgcauccga

SEQ ID NO: 586642 - RNA, 16 nt, Escherichia coli CFT073
gccacauugcugcaca

SEQ ID NO: 586643 - RNA, 19 nt, Escherichia coli CFT073
gccaccguccagaucaucc

SEQ ID NO: 586644 - RNA, 23 nt, Escherichia coli CFT073
gccacauccggcauauuaaccau

SEQ ID NO: 586645 - RNA, 18 nt, Escherichia coli CFT073
gccacaguaaaaccggua

SEQ ID NO: 586646 - RNA, 21 nt, Escherichia coli CFT073
gccacaguuuuacugcagcca

SEQ ID NO: 586647 - RNA, 24 nt, Escherichia coli CFT073
gccacaguuuuucaccguugcuca

SEQ ID NO: 586648 - RNA, 18 nt, Escherichia coli CFT073
gccacgccaccagcguca

SEQ ID NO: 586649 - RNA, 19 nt, Escherichia coli CFT073
gccacgccaccagcgucau

SEQ ID NO: 586650 - RNA, 20 nt, Escherichia coli CFT073
gccacgacgucgggcggaaa

SEQ ID NO: 586651 - RNA, 14 nt, Escherichia coli CFT073
gccacgcauaacgc

SEQ ID NO: 586652 - RNA, 11 nt, Escherichia coli CFT073
gccagauagcc

SEQ ID NO: 586653 - RNA, 23 nt, Escherichia coli CFT073
gccagauaaggcguucacgccgc

SEQ ID NO: 586654 - RNA, 20 nt, Escherichia coli CFT073
gccagauaaccggcacugaa

SEQ ID NO: 586655 - RNA, 19 nt, Escherichia coli CFT073
gccagauaagacgcgucag

SEQ ID NO: 586656 - RNA, 20 nt, Escherichia coli CFT073
gccagauaagacgcgucagc

SEQ ID NO: 586657 - RNA, 14 nt, Escherichia coli CFT073
gccagauccgccau

SEQ ID NO: 586658 - RNA, 14 nt, Escherichia coli CFT073
gccagaugcggcgu

SEQ ID NO: 586659 - RNA, 13 nt, Escherichia coli CFT073
gccagcaccaaac

SEQ ID NO: 586660 - RNA, 18 nt, Escherichia coli CFT073
gccagcacacccagcgaa

SEQ ID NO: 586661 - RNA, 15 nt, Escherichia coli CFT073
gccagcacagccagc

SEQ ID NO: 586662 - RNA, 20 nt, Escherichia coli CFT073
gccagcaccacuuuacgggc

SEQ ID NO: 586663 - RNA, 12 nt, Escherichia coli CFT073
gccagcaccagc

SEQ ID NO: 586664 - RNA, 14 nt, Escherichia coli CFT073
gccagcaccagcaa

SEQ ID NO: 586665 - RNA, 22 nt, Escherichia coli CFT073
gccagcagccacgacguuuggu

SEQ ID NO: 586666 - RNA, 15 nt, Escherichia coli CFT073
gccagcacggcgcag

SEQ ID NO: 586667 - RNA, 21 nt, Escherichia coli CFT073
gccagcacggcgcagacgguc

SEQ ID NO: 586668 - RNA, 15 nt, Escherichia coli CFT073
gccagcaguucaauc

SEQ ID NO: 586669 - RNA, 16 nt, Escherichia coli CFT073
gccagcaguugcugac

SEQ ID NO: 586670 - RNA, 22 nt, Escherichia coli CFT073
gccagcauugucaggaucacca

SEQ ID NO: 586671 - RNA, 14 nt, Escherichia coli CFT073
gccagccaauugcc

SEQ ID NO: 586672 - RNA, 15 nt, Escherichia coli CFT073
gccagccacaggccg

SEQ ID NO: 586673 - RNA, 17 nt, Escherichia coli CFT073
gccagccacaggccggu

SEQ ID NO: 586674 - RNA, 14 nt, Escherichia coli CFT073
gccagccccacagc

SEQ ID NO: 586675 - RNA, 14 nt, Escherichia coli CFT073
gccagccaugcggc

SEQ ID NO: 586676 - RNA, 15 nt, Escherichia coli CFT073
gccagccaugcggca

SEQ ID NO: 586677 - RNA, 12 nt, Escherichia coli CFT073
gccagccgcuaa

SEQ ID NO: 586678 - RNA, 17 nt, Escherichia coli CFT073
gccagcggcagcucgcg

SEQ ID NO: 586679 - RNA, 14 nt, Escherichia coli CFT073
gccagcgccagcac

SEQ ID NO: 586680 - RNA, 18 nt, Escherichia coli CFT073
gccagcgcaccagcguca

SEQ ID NO: 586681 - RNA, 18 nt, Escherichia coli CFT073
gccagcgagaaauacgcc

SEQ ID NO: 586682 - RNA, 20 nt, Escherichia coli CFT073
gccagcgauccggguaauaa

SEQ ID NO: 586683 - RNA, 17 nt, Escherichia coli CFT073
gccagcgauaucgcgau

SEQ ID NO: 586684 - RNA, 17 nt, Escherichia coli CFT073
gccaggacaucagcgca

SEQ ID NO: 586685 - RNA, 19 nt, Escherichia coli CFT073
gccagcgucugagcaggcg

SEQ ID NO: 586686 - RNA, 18 nt, Escherichia coli CFT073
gccagcguaccuugcggc

SEQ ID NO: 586687 - RNA, 17 nt, Escherichia coli CFT073
gccagcgucgcauccga

SEQ ID NO: 586688 - RNA, 19 nt, Escherichia coli CFT073
gccagcgucgcauccgaca

SEQ ID NO: 586689 - RNA, 15 nt, Escherichia coli CFT073
gccaggcuccagaua

SEQ ID NO: 586690 - RNA, 23 nt, Escherichia coli CFT073
gccaguguagcgauuucacgcuc

SEQ ID NO: 586691 - RNA, 16 nt, Escherichia coli CFT073
gccagugcacuaccgu

SEQ ID NO: 586692 - RNA, 12 nt, Escherichia coli CFT073
gccagugccgga

SEQ ID NO: 586693 - RNA, 16 nt, Escherichia coli CFT073
gccagucacaaugggc

SEQ ID NO: 586694 - RNA, 16 nt, Escherichia coli CFT073
gccagucaguuaagca

SEQ ID NO: 586695 - RNA, 14 nt, Escherichia coli CFT073
gccaguucgauguu

SEQ ID NO: 586696 - RNA, 14 nt, Escherichia coli CFT073
gccaguuauagcgc

SEQ ID NO: 586697 - RNA, 13 nt, Escherichia coli CFT073
gccaguacgccca

SEQ ID NO: 586698 - RNA, 14 nt, Escherichia coli CFT073
gccaguaccagcag

SEQ ID NO: 586699 - RNA, 22 nt, Escherichia coli CFT073
gccaggugcuuuuguuauagca

SEQ ID NO: 586700 - RNA, 16 nt, Escherichia coli CFT073
gccagggucaguuuca

SEQ ID NO: 586701 - RNA, 14 nt, Escherichia coli CFT073
gccauauaccgcgg

SEQ ID NO: 586702 - RNA, 12 nt, Escherichia coli CFT073
gccauauccagc

SEQ ID NO: 586703 - RNA, 18 nt, Escherichia coli CFT073
gccauagaaaggaccaaa

SEQ ID NO: 586704 - RNA, 24 nt, Escherichia coli CFT073
gccauacccgcacaaauagccagc

SEQ ID NO: 586705 - RNA, 13 nt, Escherichia coli CFT073
gccauacgcccgc

SEQ ID NO: 586706 - RNA, 19 nt, Escherichia coli CFT073
gccauaaucagcgcaccgu

SEQ ID NO: 586707 - RNA, 19 nt, Escherichia coli CFT073
gccauaaacagcaggcaga

SEQ ID NO: 586708 - RNA, 16 nt, Escherichia coli CFT073
gccauaaccaugcagc

SEQ ID NO: 586709 - RNA, 23 nt, Escherichia coli CFT073
gccauaaccugccagcaguuuga

SEQ ID NO: 586710 - RNA, 20 nt, Escherichia coli CFT073
gccaguuugcaggccaaaca

SEQ ID NO: 586711 - RNA, 16 nt, Escherichia coli CFT073
gccaguuggcguacca

SEQ ID NO: 586712 - RNA, 14 nt, Escherichia coli CFT073
gccaguucuucggu

SEQ ID NO: 586713 - RNA, 15 nt, Escherichia coli CFT073
gccaguugcgcuuca

SEQ ID NO: 586714 - RNA, 18 nt, Escherichia coli CFT073
gccaguugcgcuucacga

SEQ ID NO: 586715 - RNA, 17 nt, Escherichia coli CFT073
gccaucaauaaccagcg

SEQ ID NO: 586716 - RNA, 16 nt, Escherichia coli CFT073
gccaucaagcgaaaau

SEQ ID NO: 586717 - RNA, 16 nt, Escherichia coli CFT073
gccaucaauuuccggc

SEQ ID NO: 586718 - RNA, 17 nt, Escherichia coli CFT073
gccaucacauccugaua

SEQ ID NO: 586719 - RNA, 15 nt, Escherichia coli CFT073
gccauccaucaacgc

SEQ ID NO: 586720 - RNA, 17 nt, Escherichia coli CFT073
gccaucauacagccagc

SEQ ID NO: 586721 - RNA, 23 nt, Escherichia coli CFT073
gccaucaguauuaucaaaucacc

SEQ ID NO: 586722 - RNA, 23 nt, Escherichia coli CFT073
gccaucagccacuucaaccagcg

SEQ ID NO: 586723 - RNA, 17 nt, Escherichia coli CFT073
gccaugagacaaaacga

SEQ ID NO: 586724 - RNA, 18 nt, Escherichia coli CFT073
aagaaucacuucaucgcc

SEQ ID NO: 586725 - RNA, 24 nt, Escherichia coli CFT073
aagaauaaaaaaugcgcggucaga

SEQ ID NO: 586726 - RNA, 13 nt, Escherichia coli CFT073
gccaucuggcugc

SEQ ID NO: 586727 - RNA, 17 nt, Escherichia coli CFT073
gccaucuguuccggcgu

SEQ ID NO: 586728 - RNA, 15 nt, Escherichia coli CFT073
gccaugaccaccgca

SEQ ID NO: 586729 - RNA, 16 nt, Escherichia coli CFT073
gccaucugccagcaag

SEQ ID NO: 586730 - RNA, 20 nt, Escherichia coli CFT073
gccaucugccagcaagcgca

SEQ ID NO: 586731 - RNA, 22 nt, Escherichia coli CFT073
gccaucguugagcaucugcaaa

SEQ ID NO: 586732 - RNA, 17 nt, Escherichia coli CFT073
gccaucgacaccagcca

SEQ ID NO: 586733 - RNA, 23 nt, Escherichia coli CFT073
gccauccguuucagcuuauucau

SEQ ID NO: 586734 - RNA, 23 nt, Escherichia coli CFT073
gccauccgcgugacgcuggcaga

SEQ ID NO: 586735 - RNA, 15 nt, Escherichia coli CFT073
gccaucgccagcagc

SEQ ID NO: 586736 - RNA, 14 nt, Escherichia coli CFT073
gccaucgccaggaa

SEQ ID NO: 586737 - RNA, 13 nt, Escherichia coli CFT073
gcccgucaguuca

SEQ ID NO: 586738 - RNA, 19 nt, Escherichia coli CFT073
gcccguuuucuccagcgcc

SEQ ID NO: 586739 - RNA, 12 nt, Escherichia coli CFT073
gcccucacccgu

SEQ ID NO: 586740 - RNA, 18 nt, Escherichia coli CFT073
gcccgguaaucgguuuua

SEQ ID NO: 586741 - RNA, 14 nt, Escherichia coli CFT073
gcccgguuucgccg

SEQ ID NO: 586742 - RNA, 11 nt, Escherichia coli CFT073
gcccgguuuuu

SEQ ID NO: 586743 - RNA, 15 nt, Escherichia coli CFT073
gcccgcuucaucgug

SEQ ID NO: 586744 - RNA, 14 nt, Escherichia coli CFT073
gcccggaacggugg

SEQ ID NO: 586745 - RNA, 17 nt, Escherichia coli CFT073
gcccggcauucaccucu

SEQ ID NO: 586746 - RNA, 22 nt, Escherichia coli CFT073
gcccggcauucaccucugcggc

SEQ ID NO: 586747 - RNA, 15 nt, Escherichia coli CFT073
gcccggcaacguugc

SEQ ID NO: 586748 - RNA, 18 nt, Escherichia coli CFT073
gcccggcaagugucgccu

SEQ ID NO: 586749 - RNA, 24 nt, Escherichia coli CFT073
gcccggaucucuccgggcaugaac

SEQ ID NO: 586750 - RNA, 13 nt, Escherichia coli CFT073
aagaggcgcgcgg

SEQ ID NO: 586751 - RNA, 14 nt, Escherichia coli CFT073
aagaggcgcugacg

SEQ ID NO: 586752 - RNA, 13 nt, Escherichia coli CFT073
aagagugcgccag

SEQ ID NO: 586753 - RNA, 21 nt, Escherichia coli CFT073
aagaguuuuaaaaccauuagu

SEQ ID NO: 586754 - RNA, 15 nt, Escherichia coli CFT073
aagauaacccugcau

SEQ ID NO: 586755 - RNA, 24 nt, Escherichia coli CFT073
gcccgacaaagcccgaugcgcgac

SEQ ID NO: 586756 - RNA, 14 nt, Escherichia coli CFT073
gcccgaccacuuca

SEQ ID NO: 586757 - RNA, 20 nt, Escherichia coli CFT073
gcccgaccaucgccagcuca

SEQ ID NO: 586758 - RNA, 19 nt, Escherichia coli CFT073
gcccgacgaggcgcuggcg

SEQ ID NO: 586759 - RNA, 15 nt, Escherichia coli CFT073
gcccgccagcaugcc

SEQ ID NO: 586760 - RNA, 13 nt, Escherichia coli CFT073
gcccgagccgguu

SEQ ID NO: 586761 - RNA, 17 nt, Escherichia coli CFT073
gccccgaugccaucaug

SEQ ID NO: 586762 - RNA, 21 nt, Escherichia coli CFT073
aagacgcggcccgcgucgcau

SEQ ID NO: 586763 - RNA, 21 nt, Escherichia coli CFT073
aagacgcggcuagcgucgcau

SEQ ID NO: 586764 - RNA, 19 nt, Escherichia coli CFT073
aagacgcguggcgucgcau

SEQ ID NO: 586765 - RNA, 16 nt, Escherichia coli CFT073
aagacgcguuaagcgu

SEQ ID NO: 586766 - RNA, 20 nt, Escherichia coli CFT073
aagacgcguuagcgucgcau

SEQ ID NO: 586767 - RNA, 12 nt, Escherichia coli CFT073
gccccaacguau

SEQ ID NO: 586768 - RNA, 17 nt, Escherichia coli CFT073
gcccaugccaguaauaa

SEQ ID NO: 586769 - RNA, 20 nt, Escherichia coli CFT073
gcccaugacaggcagacgau

SEQ ID NO: 586770 - RNA, 16 nt, Escherichia coli CFT073
gcccaguaccgccagu

SEQ ID NO: 586771 - RNA, 19 nt, Escherichia coli CFT073
gcccaguggaugcgccaua

SEQ ID NO: 586772 - RNA, 19 nt, Escherichia coli CFT073
gccaugcgauggcggcagc

SEQ ID NO: 586773 - RNA, 14 nt, Escherichia coli CFT073
aagaucggaagauc

SEQ ID NO: 586774 - RNA, 17 nt, Escherichia coli CFT073
aagaucggugccgccac

SEQ ID NO: 586775 - RNA, 18 nt, Escherichia coli CFT073
aagaugaaaacgccacca

SEQ ID NO: 586776 - RNA, 14 nt, Escherichia coli CFT073
aagaugcgccagca

SEQ ID NO: 586777 - RNA, 13 nt, Escherichia coli CFT073
gccgaccagcacc

SEQ ID NO: 586778 - RNA, 22 nt, Escherichia coli CFT073
gccgaccagcaccgccagcagc

SEQ ID NO: 586779 - RNA, 12 nt, Escherichia coli CFT073
gccgaacagguu

SEQ ID NO: 586780 - RNA, 19 nt, Escherichia coli CFT073
gccgaaccagugcuccacc

SEQ ID NO: 586781 - RNA, 23 nt, Escherichia coli CFT073
gccgacaaauaccaccgugccgc

SEQ ID NO: 586782 - RNA, 21 nt, Escherichia coli CFT073
gccgaagccguuggucaucau

SEQ ID NO: 586783 - RNA, 22 nt, Escherichia coli CFT073
gccgaagccguuggucaucauc

SEQ ID NO: 586784 - RNA, 22 nt, Escherichia coli CFT073
aagauuucugcgggggcggcaa

SEQ ID NO: 586785 - RNA, 21 nt, Escherichia coli CFT073
gccgacucacuugcagucggc

SEQ ID NO: 586786 - RNA, 16 nt, Escherichia coli CFT073
gccgauaaagcgacca

SEQ ID NO: 586787 - RNA, 22 nt, Escherichia coli CFT073
gccgagucgguuuuauugacau

SEQ ID NO: 586788 - RNA, 17 nt, Escherichia coli CFT073
gccgauagaagcgccau

SEQ ID NO: 586789 - RNA, 20 nt, Escherichia coli CFT073
gccgcauugcccaauacugc

SEQ ID NO: 586790 - RNA, 18 nt, Escherichia coli CFT073
gccgcauugcgcauucua

SEQ ID NO: 586791 - RNA, 20 nt, Escherichia coli CFT073
gccgcauggaaccaguucac

SEQ ID NO: 586792 - RNA, 19 nt, Escherichia coli CFT073
gccgccaacuccaccaaua

SEQ ID NO: 586793 - RNA, 14 nt, Escherichia coli CFT073
gccgccaauaauga

SEQ ID NO: 586794 - RNA, 17 nt, Escherichia coli CFT073
gccgccagcagacacau

SEQ ID NO: 586795 - RNA, 13 nt, Escherichia coli CFT073
gccgccagcuucg

SEQ ID NO: 586796 - RNA, 16 nt, Escherichia coli CFT073
gccgcaaaccagcgca

SEQ ID NO: 586797 - RNA, 20 nt, Escherichia coli CFT073
gccgcaaucagcguuucgcc

SEQ ID NO: 586798 - RNA, 18 nt, Escherichia coli CFT073
gccgcaauggccguuccg

SEQ ID NO: 586799 - RNA, 13 nt, Escherichia coli CFT073
gccgcaaucagcc

SEQ ID NO: 586800 - RNA, 15 nt, Escherichia coli CFT073
gccgaucgucgcuca

SEQ ID NO: 586801 - RNA, 20 nt, Escherichia coli CFT073
gccgaucgucgcucacuuca

SEQ ID NO: 586802 - RNA, 15 nt, Escherichia coli CFT073
gccgccgccagcgcc

SEQ ID NO: 586803 - RNA, 14 nt, Escherichia coli CFT073
gccgccgcauuaug

SEQ ID NO: 586804 - RNA, 21 nt, Escherichia coli CFT073
gccgccccagacuccagcagu

SEQ ID NO: 586805 - RNA, 21 nt, Escherichia coli CFT073
gccgcccaucgcgacggcaga

SEQ ID NO: 586806 - RNA, 16 nt, Escherichia coli CFT073
gccgcccagcagcaca

SEQ ID NO: 586807 - RNA, 17 nt, Escherichia coli CFT073
gccgcccacaacagcau

SEQ ID NO: 586808 - RNA, 21 nt, Escherichia coli CFT073
gcgccaguaaucagcgcggaa

SEQ ID NO: 586809 - RNA, 18 nt, Escherichia coli CFT073
gcgccgaagcugaccaga

SEQ ID NO: 586810 - RNA, 20 nt, Escherichia coli CFT073
gcgcccgcuuuucgccaguu

SEQ ID NO: 586811 - RNA, 17 nt, Escherichia coli CFT073
gcgcauauugccaucac

SEQ ID NO: 586812 - RNA, 22 nt, Escherichia coli CFT073
gcgcauagcaccaccgacgggc

SEQ ID NO: 586813 - RNA, 20 nt, Escherichia coli CFT073
gcgcagucaccagcaucagc

SEQ ID NO: 586814 - RNA, 23 nt, Escherichia coli CFT073
gcgcaguaccagcaacgcuucaa

SEQ ID NO: 586815 - RNA, 12 nt, Escherichia coli CFT073
gcgcaucgccag

SEQ ID NO: 586816 - RNA, 17 nt, Escherichia coli CFT073
gcgcaucgacgccauca

SEQ ID NO: 586817 - RNA, 21 nt, Escherichia coli CFT073
gcgccaagcccguguuucuga

SEQ ID NO: 586818 - RNA, 12 nt, Escherichia coli CFT073
gcgccagcgauu

SEQ ID NO: 586819 - RNA, 15 nt, Escherichia coli CFT073
gcgccagcgcaucau

SEQ ID NO: 586820 - RNA, 14 nt, Escherichia coli CFT073
gcgccagccagcca

SEQ ID NO: 586821 - RNA, 12 nt, Escherichia coli CFT073
gcgccagcagcg

SEQ ID NO: 586822 - RNA, 23 nt, Escherichia coli CFT073
gcgccaauacccguccacacggc

SEQ ID NO: 586823 - RNA, 13 nt, Escherichia coli CFT073
gcgccaaucggca

SEQ ID NO: 586824 - RNA, 12 nt, Escherichia coli CFT073
gcgccugccagg

SEQ ID NO: 586825 - RNA, 23 nt, Escherichia coli CFT073
gcgccugcacaaagcgccagaau

SEQ ID NO: 586826 - RNA, 20 nt, Escherichia coli CFT073
gcgccuuaucccaccugcgg

SEQ ID NO: 586827 - RNA, 22 nt, Escherichia coli CFT073
gcgccugguuuugccaugcaau

SEQ ID NO: 586828 - RNA, 19 nt, Escherichia coli CFT073
gcgccuuccccguuuugcc

SEQ ID NO: 586829 - RNA, 19 nt, Escherichia coli CFT073
gcgccuuuuucgcuuguua

SEQ ID NO: 586830 - RNA, 17 nt, Escherichia coli CFT073
gcgcgaaauuauccaua

SEQ ID NO: 586831 - RNA, 22 nt, Escherichia coli CFT073
gcgcgaaauuauccauauucag

SEQ ID NO: 586832 - RNA, 19 nt, Escherichia coli CFT073
gcgcgauuugcccaucagg

SEQ ID NO: 586833 - RNA, 16 nt, Escherichia coli CFT073
gcgcgaucuuccucua

SEQ ID NO: 586834 - RNA, 19 nt, Escherichia coli CFT073
gcgcgauauccaguucaug

SEQ ID NO: 586835 - RNA, 13 nt, Escherichia coli CFT073
gcgcgauauuccg

SEQ ID NO: 586836 - RNA, 22 nt, Escherichia coli CFT073
gcgauaaugaaccaaucagccg

SEQ ID NO: 586837 - RNA, 23 nt, Escherichia coli CFT073
gcgauaauauugaugcacaccau

SEQ ID NO: 586838 - RNA, 12 nt, Escherichia coli CFT073
gcgauaaccagg

SEQ ID NO: 586839 - RNA, 22 nt, Escherichia coli CFT073
gcgauaacggaucggaacgcga

SEQ ID NO: 586840 - RNA, 23 nt, Escherichia coli CFT073
gcgauacggugcacaaugccuga

SEQ ID NO: 586841 - RNA, 21 nt, Escherichia coli CFT073
gcgauauuccgcaacgccgcc

SEQ ID NO: 586842 - RNA, 22 nt, Escherichia coli CFT073
gcgauauccgugcauuccagca

SEQ ID NO: 586843 - RNA, 22 nt, Escherichia coli CFT073
gcgauaugccggcaucaaacgg

SEQ ID NO: 586844 - RNA, 15 nt, Escherichia coli CFT073
gcgauauugccgcga

SEQ ID NO: 586845 - RNA, 14 nt, Escherichia coli CFT073
gcgauauugcugca

SEQ ID NO: 586846 - RNA, 15 nt, Escherichia coli CFT073
gcgaggaaugacgga

SEQ ID NO: 586847 - RNA, 22 nt, Escherichia coli CFT073
gcgaggaauucagcguggcgaa

SEQ ID NO: 586848 - RNA, 14 nt, Escherichia coli CFT073
gcgaggaucaucgg

SEQ ID NO: 586849 - RNA, 13 nt, Escherichia coli CFT073
gcgaggaucacgc

SEQ ID NO: 586850 - RNA, 12 nt, Escherichia coli CFT073
gcgagccgucgc

SEQ ID NO: 586851 - RNA, 14 nt, Escherichia coli CFT073
gcgacugccagcca

SEQ ID NO: 586852 - RNA, 16 nt, Escherichia coli CFT073
gcgacugccagccaca

SEQ ID NO: 586853 - RNA, 20 nt, Escherichia coli CFT073
gcgacucacgaaucgccuca

SEQ ID NO: 586854 - RNA, 15 nt, Escherichia coli CFT073
gcgacguuuaccgca

SEQ ID NO: 586855 - RNA, 13 nt, Escherichia coli CFT073
aagcccugcucgc

SEQ ID NO: 586856 - RNA, 15 nt, Escherichia coli CFT073
aagccgaacagucgc

SEQ ID NO: 586857 - RNA, 21 nt, Escherichia coli CFT073
gcgacaguuuugccaauagcg

SEQ ID NO: 586858 - RNA, 16 nt, Escherichia coli CFT073
gccuuccgcugacagc

SEQ ID NO: 586859 - RNA, 17 nt, Escherichia coli CFT073
gccuuauccggccuaca

SEQ ID NO: 586860 - RNA, 20 nt, Escherichia coli CFT073
gccuucggacguuugccaug

SEQ ID NO: 586861 - RNA, 15 nt, Escherichia coli CFT073
gcgacagcugcgacc

SEQ ID NO: 586862 - RNA, 21 nt, Escherichia coli CFT073
gcgacgcuguucgcgucuuau

SEQ ID NO: 586863 - RNA, 21 nt, Escherichia coli CFT073
gcgacgcuugacgcgucuuau

SEQ ID NO: 586864 - RNA, 21 nt, Escherichia coli CFT073
gcgacgcuugaugcgucuuau

SEQ ID NO: 586865 - RNA, 21 nt, Escherichia coli CFT073
gcgacgcuuuacgcgucuuau

SEQ ID NO: 586866 - RNA, 22 nt, Escherichia coli CFT073
gcgacgaccacccaccgcagcc

SEQ ID NO: 586867 - RNA, 21 nt, Escherichia coli CFT073
gcgacgaugagcgauaaacaa

SEQ ID NO: 586868 - RNA, 16 nt, Escherichia coli CFT073
gcgaccguuugccaga

SEQ ID NO: 586869 - RNA, 15 nt, Escherichia coli CFT073
gcgaccguuuucacc

SEQ ID NO: 586870 - RNA, 12 nt, Escherichia coli CFT073
gcgaccgccaug

SEQ ID NO: 586871 - RNA, 21 nt, Escherichia coli CFT073
gcgauugaguauuaaauguca

SEQ ID NO: 586872 - RNA, 14 nt, Escherichia coli CFT073
gcgauuucgcggau

SEQ ID NO: 586873 - RNA, 17 nt, Escherichia coli CFT073
gcgauuuauguaccguc

SEQ ID NO: 586874 - RNA, 14 nt, Escherichia coli CFT073
gcgauuuucgucca

SEQ ID NO: 586875 - RNA, 17 nt, Escherichia coli CFT073
gcgcaaaggccagcaau

SEQ ID NO: 586876 - RNA, 19 nt, Escherichia coli CFT073
gcgcaaaguaaagcgcguc

SEQ ID NO: 586877 - RNA, 21 nt, Escherichia coli CFT073
gcgcaaauccacguuccagau

SEQ ID NO: 586878 - RNA, 18 nt, Escherichia coli CFT073
gcgcaaauccacguucca

SEQ ID NO: 586879 - RNA, 20 nt, Escherichia coli CFT073
gcgcaaaaacauugccggaa

SEQ ID NO: 586880 - RNA, 14 nt, Escherichia coli CFT073
gcgcaaccaucagu

SEQ ID NO: 586881 - RNA, 14 nt, Escherichia coli CFT073
gcgcaacccccaca

SEQ ID NO: 586882 - RNA, 16 nt, Escherichia coli CFT073
gcgcaacccccacacu

SEQ ID NO: 586883 - RNA, 22 nt, Escherichia coli CFT073
gcgauuauuuauucccgccaga

SEQ ID NO: 586884 - RNA, 20 nt, Escherichia coli CFT073
gcgauuaaacgccauccggc

SEQ ID NO: 586885 - RNA, 22 nt, Escherichia coli CFT073
gcgauggucaguuuaaacagaa

SEQ ID NO: 586886 - RNA, 24 nt, Escherichia coli CFT073
gcgauggcuggaaucaucaagcac

SEQ ID NO: 586887 - RNA, 17 nt, Escherichia coli CFT073
gcgauggcuuuccaccu

SEQ ID NO: 586888 - RNA, 22 nt, Escherichia coli CFT073
gcgauggcaggccccgucagca

SEQ ID NO: 586889 - RNA, 16 nt, Escherichia coli CFT073
gcgcaauauguuuccg

SEQ ID NO: 586890 - RNA, 17 nt, Escherichia coli CFT073
gcgcaaugccauccagc

SEQ ID NO: 586891 - RNA, 15 nt, Escherichia coli CFT073
gcgcaaugcccgcag

SEQ ID NO: 586892 - RNA, 23 nt, Escherichia coli CFT073
gcgcaccaaccacugcucugacc

SEQ ID NO: 586893 - RNA, 12 nt, Escherichia coli CFT073
gcgcaccaacgg

SEQ ID NO: 586894 - RNA, 16 nt, Escherichia coli CFT073
gcgcaaucagcaccgc

SEQ ID NO: 586895 - RNA, 18 nt, Escherichia coli CFT073
gcgcaaugacgucuucca

SEQ ID NO: 586896 - RNA, 19 nt, Escherichia coli CFT073
gcgcaaugauaucgcuggc

SEQ ID NO: 586897 - RNA, 23 nt, Escherichia coli CFT073
gcgcaccgcauguugcucuguuu

SEQ ID NO: 586898 - RNA, 19 nt, Escherichia coli CFT073
gcgaucaucaguacgccuu

SEQ ID NO: 586899 - RNA, 22 nt, Escherichia coli CFT073
gcgauccagcgcaauaccgaua

SEQ ID NO: 586900 - RNA, 18 nt, Escherichia coli CFT073
gcgauccacgcucgcugg

SEQ ID NO: 586901 - RNA, 16 nt, Escherichia coli CFT073
gcgaucgcuaaagcau

SEQ ID NO: 586902 - RNA, 13 nt, Escherichia coli CFT073
gcgaugaccgcca

SEQ ID NO: 586903 - RNA, 22 nt, Escherichia coli CFT073
gcgaucucggucaccaggaagc

SEQ ID NO: 586904 - RNA, 20 nt, Escherichia coli CFT073
gcgaucgucaaaacgcgcgc

SEQ ID NO: 586905 - RNA, 15 nt, Escherichia coli CFT073
gcgaucgcuuucgcu

SEQ ID NO: 586906 - RNA, 20 nt, Escherichia coli CFT073
gcgaugcacaugcuucagca

SEQ ID NO: 586907 - RNA, 15 nt, Escherichia coli CFT073
gcgaugcaaaaucag

SEQ ID NO: 586908 - RNA, 15 nt, Escherichia coli CFT073
gcgaugcgucgcugg

SEQ ID NO: 586909 - RNA, 14 nt, Escherichia coli CFT073
gccuuaacgcaaaa

SEQ ID NO: 586910 - RNA, 14 nt, Escherichia coli CFT073
gccuuauccgaccu

SEQ ID NO: 586911 - RNA, 17 nt, Escherichia coli CFT073
gccuuauccgaccuaca

SEQ ID NO: 586912 - RNA, 17 nt, Escherichia coli CFT073
gccuuauccgaccuacg

SEQ ID NO: 586913 - RNA, 17 nt, Escherichia coli CFT073
gccuuauccgccugaca

SEQ ID NO: 586914 - RNA, 14 nt, Escherichia coli CFT073
gccuuauccggccu

SEQ ID NO: 586915 - RNA, 14 nt, Escherichia coli CFT073
gccuggugaccgcc

SEQ ID NO: 586916 - RNA, 19 nt, Escherichia coli CFT073
gccuggcuaagcaucgcaa

SEQ ID NO: 586917 - RNA, 13 nt, Escherichia coli CFT073
gccuggcggcaga

SEQ ID NO: 586918 - RNA, 11 nt, Escherichia coli CFT073
gccugcuggca

SEQ ID NO: 586919 - RNA, 18 nt, Escherichia coli CFT073
gccugcuucuacgcaggu

SEQ ID NO: 586920 - RNA, 19 nt, Escherichia coli CFT073
gccugcugcacaccauacu

SEQ ID NO: 586921 - RNA, 21 nt, Escherichia coli CFT073
gccugcuuuuaccaucgcgau

SEQ ID NO: 586922 - RNA, 17 nt, Escherichia coli CFT073
gccugcgugcauaucgc

SEQ ID NO: 586923 - RNA, 16 nt, Escherichia coli CFT073
gccugcggccagcagc

SEQ ID NO: 586924 - RNA, 15 nt, Escherichia coli CFT073
aagccauucuggcgc

SEQ ID NO: 586925 - RNA, 20 nt, Escherichia coli CFT073
aagcccaccacaaaccagcc

SEQ ID NO: 586926 - RNA, 17 nt, Escherichia coli CFT073
aagccauuuaacucacc

SEQ ID NO: 586927 - RNA, 20 nt, Escherichia coli CFT073
aagcccaggccaucgccacc

SEQ ID NO: 586928 - RNA, 13 nt, Escherichia coli CFT073
gccuaccguuccg

SEQ ID NO: 586929 - RNA, 12 nt, Escherichia coli CFT073
gccuacaguuca

SEQ ID NO: 586930 - RNA, 13 nt, Escherichia coli CFT073
gccuacaucgaca

SEQ ID NO: 586931 - RNA, 18 nt, Escherichia coli CFT073
gccuacauuggugccgga

SEQ ID NO: 586932 - RNA, 20 nt, Escherichia coli CFT073
gccuaccgaacuucgccagc

SEQ ID NO: 586933 - RNA, 13 nt, Escherichia coli CFT073
gccuaccgccagu

SEQ ID NO: 586934 - RNA, 18 nt, Escherichia coli CFT073
gccuacagaacgcugcaa

SEQ ID NO: 586935 - RNA, 16 nt, Escherichia coli CFT073
gccuaccgccugcaua

SEQ ID NO: 586936 - RNA, 19 nt, Escherichia coli CFT073
gccuacacguugaaacuua

SEQ ID NO: 586937 - RNA, 22 nt, Escherichia coli CFT073
gccucgauauuuaugccgguga

SEQ ID NO: 586938 - RNA, 17 nt, Escherichia coli CFT073
gccugaaugccgcgccc

SEQ ID NO: 586939 - RNA, 15 nt, Escherichia coli CFT073
gccugaauacacauc

SEQ ID NO: 586940 - RNA, 22 nt, Escherichia coli CFT073
gccugaaugcuuucauauucca

SEQ ID NO: 586941 - RNA, 17 nt, Escherichia coli CFT073
gccugacauuuccguaa

SEQ ID NO: 586942 - RNA, 18 nt, Escherichia coli CFT073
gccugacggaaaucaucc

SEQ ID NO: 586943 - RNA, 14 nt, Escherichia coli CFT073
gccugauucagcaa

SEQ ID NO: 586944 - RNA, 21 nt, Escherichia coli CFT073
gccugcaagcgucgcgccauu

SEQ ID NO: 586945 - RNA, 20 nt, Escherichia coli CFT073
gccugcaaaaccaauuaaau

SEQ ID NO: 586946 - RNA, 16 nt, Escherichia coli CFT073
gccugaugugacgcug

SEQ ID NO: 586947 - RNA, 14 nt, Escherichia coli CFT073
gccgggaucauaac

SEQ ID NO: 586948 - RNA, 22 nt, Escherichia coli CFT073
gccggugagcacaucagcgccc

SEQ ID NO: 586949 - RNA, 22 nt, Escherichia coli CFT073
gccgucaguugugccaguuuca

SEQ ID NO: 586950 - RNA, 20 nt, Escherichia coli CFT073
gccgucaccagcaucaacaa

SEQ ID NO: 586951 - RNA, 21 nt, Escherichia coli CFT073
gccguaugcgaagcuuugcac

SEQ ID NO: 586952 - RNA, 17 nt, Escherichia coli CFT073
gccgucaacaauccauu

SEQ ID NO: 586953 - RNA, 19 nt, Escherichia coli CFT073
gccgucaacaauccauuca

SEQ ID NO: 586954 - RNA, 18 nt, Escherichia coli CFT073
gccgucgccacaaucagc

SEQ ID NO: 586955 - RNA, 23 nt, Escherichia coli CFT073
gccgucgaccagcacguuaauca

SEQ ID NO: 586956 - RNA, 16 nt, Escherichia coli CFT073
gccgugccggaaaugg

SEQ ID NO: 586957 - RNA, 14 nt, Escherichia coli CFT073
gccguugccuuuac

SEQ ID NO: 586958 - RNA, 19 nt, Escherichia coli CFT073
gccgcuuaauaagaagaaa

SEQ ID NO: 586959 - RNA, 17 nt, Escherichia coli CFT073
gccgcuguaauaccagc

SEQ ID NO: 586960 - RNA, 11 nt, Escherichia coli CFT073
gccgcugguga

SEQ ID NO: 586961 - RNA, 17 nt, Escherichia coli CFT073
gccgcugggccaucagg

SEQ ID NO: 586962 - RNA, 15 nt, Escherichia coli CFT073
gccgcugcgauuuca

SEQ ID NO: 586963 - RNA, 14 nt, Escherichia coli CFT073
gccgccgcggacaa

SEQ ID NO: 586964 - RNA, 22 nt, Escherichia coli CFT073
gccgcuuuuuccaggcuggcag

SEQ ID NO: 586965 - RNA, 19 nt, Escherichia coli CFT073
gccgcuuuuggcucaucaa

SEQ ID NO: 586966 - RNA, 15 nt, Escherichia coli CFT073
gccggaacauccacu

SEQ ID NO: 586967 - RNA, 17 nt, Escherichia coli CFT073
gccggaacauccacuaa

SEQ ID NO: 586968 - RNA, 15 nt, Escherichia coli CFT073
gccggaaagcagcau

SEQ ID NO: 586969 - RNA, 17 nt, Escherichia coli CFT073
gccgcuuuaaucaccau

SEQ ID NO: 586970 - RNA, 15 nt, Escherichia coli CFT073
gccggaagcuacggu

SEQ ID NO: 586971 - RNA, 20 nt, Escherichia coli CFT073
gccggaccaucuuccagcug

SEQ ID NO: 586972 - RNA, 18 nt, Escherichia coli CFT073
gccggaggcaaguuuccu

SEQ ID NO: 586973 - RNA, 23 nt, Escherichia coli CFT073
gccggagcgcgcgucaucggcgc

SEQ ID NO: 586974 - RNA, 15 nt, Escherichia coli CFT073
gccggagagcaauuu

SEQ ID NO: 586975 - RNA, 18 nt, Escherichia coli CFT073
gccggagagcaauuuccg

SEQ ID NO: 586976 - RNA, 16 nt, Escherichia coli CFT073
gccggagacgacgccc

SEQ ID NO: 586977 - RNA, 14 nt, Escherichia coli CFT073
gccggacuccagca

SEQ ID NO: 586978 - RNA, 23 nt, Escherichia coli CFT073
gccggaucagguguuacgccgca

SEQ ID NO: 586979 - RNA, 18 nt, Escherichia coli CFT073
gccggaguacgccauuuc

SEQ ID NO: 586980 - RNA, 18 nt, Escherichia coli CFT073
gccggauaagacgcguca

SEQ ID NO: 586981 - RNA, 18 nt, Escherichia coli CFT073
gccggauaagaugcgcca

SEQ ID NO: 586982 - RNA, 19 nt, Escherichia coli CFT073
gccggauaagaugcgccag

SEQ ID NO: 586983 - RNA, 15 nt, Escherichia coli CFT073
gccggaugcggcagg

SEQ ID NO: 586984 - RNA, 19 nt, Escherichia coli CFT073
gccggaugcggcaggcgua

SEQ ID NO: 586985 - RNA, 10 nt, Escherichia coli CFT073
gccggaugcg

SEQ ID NO: 586986 - RNA, 22 nt, Escherichia coli CFT073
gccggaugcgaaguaaccgcau

SEQ ID NO: 586987 - RNA, 13 nt, Escherichia coli CFT073
gccggaugcgacg

SEQ ID NO: 586988 - RNA, 23 nt, Escherichia coli CFT073
gccggaugaggcguuuucgccgc

SEQ ID NO: 586989 - RNA, 16 nt, Escherichia coli CFT073
gccggaugguaugcca

SEQ ID NO: 586990 - RNA, 15 nt, Escherichia coli CFT073
gccggaugcggcgua

SEQ ID NO: 586991 - RNA, 16 nt, Escherichia coli CFT073
gccggaugcggcguaa

SEQ ID NO: 586992 - RNA, 22 nt, Escherichia coli CFT073
gccggaugcggcguaaacgccu

SEQ ID NO: 586993 - RNA, 15 nt, Escherichia coli CFT073
gccggauggcugaua

SEQ ID NO: 586994 - RNA, 15 nt, Escherichia coli CFT073
aagcauucucccgcc

SEQ ID NO: 586995 - RNA, 20 nt, Escherichia coli CFT073
aagccaaauccagcaccaca

SEQ ID NO: 586996 - RNA, 18 nt, Escherichia coli CFT073
aagcaguuucaccagcag

SEQ ID NO: 586997 - RNA, 15 nt, Escherichia coli CFT073
aagcagggccaaaca

SEQ ID NO: 586998 - RNA, 15 nt, Escherichia coli CFT073
aagcaggucaccaga

SEQ ID NO: 586999 - RNA, 14 nt, Escherichia coli CFT073
aagcagauaaccca

SEQ ID NO: 587000 - RNA, 15 nt, Escherichia coli CFT073
aagcagauaacccag

SEQ ID NO: 587001 - RNA, 17 nt, Escherichia coli CFT073
gcggcaggguuugcgcc

SEQ ID NO: 587002 - RNA, 15 nt, Escherichia coli CFT073
gcggcagcuccagca

SEQ ID NO: 587003 - RNA, 16 nt, Escherichia coli CFT073
gcggcaccacgagcgg

SEQ ID NO: 587004 - RNA, 19 nt, Escherichia coli CFT073
aagccugcggauaaucgcg

SEQ ID NO: 587005 - RNA, 20 nt, Escherichia coli CFT073
aagccuuacuucacaucauc

SEQ ID NO: 587006 - RNA, 18 nt, Escherichia coli CFT073
gcggcagauugagcguca

SEQ ID NO: 587007 - RNA, 19 nt, Escherichia coli CFT073
gcggcagcaaccgcuuccg

SEQ ID NO: 587008 - RNA, 21 nt, Escherichia coli CFT073
gcggcagcaaccgcuuccggu

SEQ ID NO: 587009 - RNA, 13 nt, Escherichia coli CFT073
gcggcaaucauca

SEQ ID NO: 587010 - RNA, 12 nt, Escherichia coli CFT073
aagccgcuugcg

SEQ ID NO: 587011 - RNA, 17 nt, Escherichia coli CFT073
aagccgcucugcuucgc

SEQ ID NO: 587012 - RNA, 23 nt, Escherichia coli CFT073
aagccgcuaacagcagcagcgca

SEQ ID NO: 587013 - RNA, 18 nt, Escherichia coli CFT073
aagccgcuccggcagcag

SEQ ID NO: 587014 - RNA, 19 nt, Escherichia coli CFT073
aagccgcuccggcagcagc

SEQ ID NO: 587015 - RNA, 15 nt, Escherichia coli CFT073
aagccgccgccaucu

SEQ ID NO: 587016 - RNA, 14 nt, Escherichia coli CFT073
aagccgaugucugc

SEQ ID NO: 587017 - RNA, 11 nt, Escherichia coli CFT073
aagccgcaacc

SEQ ID NO: 587018 - RNA, 17 nt, Escherichia coli CFT073
gcggcaaaccuuucgcc

SEQ ID NO: 587019 - RNA, 18 nt, Escherichia coli CFT073
gcggauuuuauucagcag

SEQ ID NO: 587020 - RNA, 19 nt, Escherichia coli CFT073
gcggauucgaugcccagcu

SEQ ID NO: 587021 - RNA, 19 nt, Escherichia coli CFT073
gcggauuauuggcgucagu

SEQ ID NO: 587022 - RNA, 14 nt, Escherichia coli CFT073
gcggcaacguugcg

SEQ ID NO: 587023 - RNA, 12 nt, Escherichia coli CFT073
gcggcaacgaau

SEQ ID NO: 587024 - RNA, 13 nt, Escherichia coli CFT073
gcggcaacaucau

SEQ ID NO: 587025 - RNA, 14 nt, Escherichia coli CFT073
gcggagaucaccac

SEQ ID NO: 587026 - RNA, 21 nt, Escherichia coli CFT073
gcggagaaagucguaggccug

SEQ ID NO: 587027 - RNA, 14 nt, Escherichia coli CFT073
gcggaguaagaaua

SEQ ID NO: 587028 - RNA, 18 nt, Escherichia coli CFT073
gcggaccccgcgcucgcg

SEQ ID NO: 587029 - RNA, 14 nt, Escherichia coli CFT073
gcggaucggcuggc

SEQ ID NO: 587030 - RNA, 21 nt, Escherichia coli CFT073
gcggauguugcugcaccaggc

SEQ ID NO: 587031 - RNA, 22 nt, Escherichia coli CFT073
gcggauccguugaucgcucaua

SEQ ID NO: 587032 - RNA, 18 nt, Escherichia coli CFT073
gcggaucauaugcacaau

SEQ ID NO: 587033 - RNA, 17 nt, Escherichia coli CFT073
gcggauaugcagcagcc

SEQ ID NO: 587034 - RNA, 21 nt, Escherichia coli CFT073
gcggauaaaacugccagaagc

SEQ ID NO: 587035 - RNA, 19 nt, Escherichia coli CFT073
gcgcuggcgcaacugcgcc

SEQ ID NO: 587036 - RNA, 16 nt, Escherichia coli CFT073
gcgcuguaagccacga

SEQ ID NO: 587037 - RNA, 22 nt, Escherichia coli CFT073
gcgcuguaauuucacaccauca

SEQ ID NO: 587038 - RNA, 20 nt, Escherichia coli CFT073
gcgcugguaaucaccaccca

SEQ ID NO: 587039 - RNA, 23 nt, Escherichia coli CFT073
gcgcuucgcuuaccaugccaacg

SEQ ID NO: 587040 - RNA, 18 nt, Escherichia coli CFT073
gcgcuuccggcagcuuca

SEQ ID NO: 587041 - RNA, 18 nt, Escherichia coli CFT073
gcgcuuaucgccagcgcg

SEQ ID NO: 587042 - RNA, 14 nt, Escherichia coli CFT073
gcgcuucagcgauc

SEQ ID NO: 587043 - RNA, 18 nt, Escherichia coli CFT073
gcgcuucguugaucagcg

SEQ ID NO: 587044 - RNA, 19 nt, Escherichia coli CFT073
gcgcuuaucagaccuacgg

SEQ ID NO: 587045 - RNA, 18 nt, Escherichia coli CFT073
gcgcuucuucuaucguuu

SEQ ID NO: 587046 - RNA, 12 nt, Escherichia coli CFT073
gcgcuugcugcc

SEQ ID NO: 587047 - RNA, 15 nt, Escherichia coli CFT073
gcgcuuuaucaucgg

SEQ ID NO: 587048 - RNA, 14 nt, Escherichia coli CFT073
gcgcuuugaugcgu

SEQ ID NO: 587049 - RNA, 15 nt, Escherichia coli CFT073
gcggaaugcagucac

SEQ ID NO: 587050 - RNA, 23 nt, Escherichia coli CFT073
gcggaaugcagucacgccaguaa

SEQ ID NO: 587051 - RNA, 23 nt, Escherichia coli CFT073
gcgcugaugugauaaugccggau

SEQ ID NO: 587052 - RNA, 18 nt, Escherichia coli CFT073
gcgcugccagaaccgcuu

SEQ ID NO: 587053 - RNA, 17 nt, Escherichia coli CFT073
gcgcuggcaaaucaaau

SEQ ID NO: 587054 - RNA, 15 nt, Escherichia coli CFT073
gcgcugcuggagcag

SEQ ID NO: 587055 - RNA, 22 nt, Escherichia coli CFT073
gcgcugaauaauggugaauuug

SEQ ID NO: 587056 - RNA, 17 nt, Escherichia coli CFT073
gcgcugagguuaugcaa

SEQ ID NO: 587057 - RNA, 21 nt, Escherichia coli CFT073
gcgcucuucaacuucagcagc

SEQ ID NO: 587058 - RNA, 19 nt, Escherichia coli CFT073
gcgcucguagguuucugcc

SEQ ID NO: 587059 - RNA, 14 nt, Escherichia coli CFT073
gcgcucgcgccgca

SEQ ID NO: 587060 - RNA, 13 nt, Escherichia coli CFT073
gcgcgcaggcaac

SEQ ID NO: 587061 - RNA, 20 nt, Escherichia coli CFT073
aagcuggguuaauaccgagc

SEQ ID NO: 587062 - RNA, 16 nt, Escherichia coli CFT073
aagcugucaccaauca

SEQ ID NO: 587063 - RNA, 23 nt, Escherichia coli CFT073
aagcugucaccucugcaacgucu

SEQ ID NO: 587064 - RNA, 18 nt, Escherichia coli CFT073
gcggcguuuugcuuuuua

SEQ ID NO: 587065 - RNA, 23 nt, Escherichia coli CFT073
gcggcuauucuugaauuguugau

SEQ ID NO: 587066 - RNA, 19 nt, Escherichia coli CFT073
gcggcucaggcgcacgcca

SEQ ID NO: 587067 - RNA, 18 nt, Escherichia coli CFT073
gcggcuugcaccagcagc

SEQ ID NO: 587068 - RNA, 22 nt, Escherichia coli CFT073
gcggcuuugucauaaccaaugu

SEQ ID NO: 587069 - RNA, 18 nt, Escherichia coli CFT073
gcgggaauagcucaguug

SEQ ID NO: 587070 - RNA, 21 nt, Escherichia coli CFT073
gcggcuugucguauuucagcc

SEQ ID NO: 587071 - RNA, 20 nt, Escherichia coli CFT073
gcgggacaacaaacgcaaac

SEQ ID NO: 587072 - RNA, 14 nt, Escherichia coli CFT073
gcgggacauauuga

SEQ ID NO: 587073 - RNA, 17 nt, Escherichia coli CFT073
gcgggguaaucgccagc

SEQ ID NO: 587074 - RNA, 23 nt, Escherichia coli CFT073
gcggguaaaaccauuuugcuggc

SEQ ID NO: 587075 - RNA, 22 nt, Escherichia coli CFT073
gcggggaugaauauguaggccg

SEQ ID NO: 587076 - RNA, 16 nt, Escherichia coli CFT073
gcgggugaacgcguua

SEQ ID NO: 587077 - RNA, 16 nt, Escherichia coli CFT073
gcggucauguaccguu

SEQ ID NO: 587078 - RNA, 22 nt, Escherichia coli CFT073
gcggucauguaccguugcugcc

SEQ ID NO: 587079 - RNA, 20 nt, Escherichia coli CFT073
gcggucaaguaaucaaucac

SEQ ID NO: 587080 - RNA, 15 nt, Escherichia coli CFT073
gcggucaaccaucgc

SEQ ID NO: 587081 - RNA, 15 nt, Escherichia coli CFT073
gcgguauuugauacc

SEQ ID NO: 587082 - RNA, 23 nt, Escherichia coli CFT073
gcgguacuucucaccgguaaagu

SEQ ID NO: 587083 - RNA, 23 nt, Escherichia coli CFT073
gcgguacgguaauaaaugccgga

SEQ ID NO: 587084 - RNA, 15 nt, Escherichia coli CFT073
gcgguagauggcgga

SEQ ID NO: 587085 - RNA, 21 nt, Escherichia coli CFT073
gcgguaaaauggucagccagc

SEQ ID NO: 587086 - RNA, 22 nt, Escherichia coli CFT073
gcgguaaaauggucagccagcg

SEQ ID NO: 587087 - RNA, 20 nt, Escherichia coli CFT073
gcggguugcucucgccagca

SEQ ID NO: 587088 - RNA, 13 nt, Escherichia coli CFT073
gcggguucaguga

SEQ ID NO: 587089 - RNA, 23 nt, Escherichia coli CFT073
aagcgcggauuuuauucagcaga

SEQ ID NO: 587090 - RNA, 17 nt, Escherichia coli CFT073
gcggcaugaacgccuga

SEQ ID NO: 587091 - RNA, 13 nt, Escherichia coli CFT073
gcggccaaaaagg

SEQ ID NO: 587092 - RNA, 17 nt, Escherichia coli CFT073
gcggccugaugcggcgu

SEQ ID NO: 587093 - RNA, 20 nt, Escherichia coli CFT073
gcggcgagaacgccuuaucc

SEQ ID NO: 587094 - RNA, 23 nt, Escherichia coli CFT073
gcggcgauaauauugaugcacac

SEQ ID NO: 587095 - RNA, 15 nt, Escherichia coli CFT073
gcggcgaugaccgcc

SEQ ID NO: 587096 - RNA, 23 nt, Escherichia coli CFT073
aagcucacuuugucugcaaucug

SEQ ID NO: 587097 - RNA, 17 nt, Escherichia coli CFT073
gcggcguaaacgccuua

SEQ ID NO: 587098 - RNA, 19 nt, Escherichia coli CFT073
aagcuccgguacucaucag

SEQ ID NO: 587099 - RNA, 23 nt, Escherichia coli CFT073
aagcugagaaaauguauuucauc

SEQ ID NO: 587100 - RNA, 15 nt, Escherichia coli CFT073
gcggcgcaugcaggc

SEQ ID NO: 587101 - RNA, 20 nt, Escherichia coli CFT073
gcggcgcgagcgccuuaucc

SEQ ID NO: 587102 - RNA, 17 nt, Escherichia coli CFT073
gcggcgcaaccaucagu

SEQ ID NO: 587103 - RNA, 18 nt, Escherichia coli CFT073
gcugcuuuuucguuacac

SEQ ID NO: 587104 - RNA, 22 nt, Escherichia coli CFT073
gcugcuguggcgucucgacaaa

SEQ ID NO: 587105 - RNA, 13 nt, Escherichia coli CFT073
gcugcugaagcaa

SEQ ID NO: 587106 - RNA, 20 nt, Escherichia coli CFT073
gcugcggcuguccggcacca

SEQ ID NO: 587107 - RNA, 18 nt, Escherichia coli CFT073
gcugcugcguuccggcau

SEQ ID NO: 587108 - RNA, 13 nt, Escherichia coli CFT073
gcugcugcggcga

SEQ ID NO: 587109 - RNA, 16 nt, Escherichia coli CFT073
gcuggaucccagaaga

SEQ ID NO: 587110 - RNA, 12 nt, Escherichia coli CFT073
gcuggauggcgc

SEQ ID NO: 587111 - RNA, 14 nt, Escherichia coli CFT073
gcuggaaggcgcgu

SEQ ID NO: 587112 - RNA, 14 nt, Escherichia coli CFT073
gcuggcaucaccaa

SEQ ID NO: 587113 - RNA, 17 nt, Escherichia coli CFT073
gcuggcaucggcaaaau

SEQ ID NO: 587114 - RNA, 22 nt, Escherichia coli CFT073
gcuggcaggccgcguguuuccg

SEQ ID NO: 587115 - RNA, 13 nt, Escherichia coli CFT073
gcuggcagcugcu

SEQ ID NO: 587116 - RNA, 12 nt, Escherichia coli CFT073
gcuggcagcaga

SEQ ID NO: 587117 - RNA, 23 nt, Escherichia coli CFT073
gcuggcaccgugaaagagaucaa

SEQ ID NO: 587118 - RNA, 19 nt, Escherichia coli CFT073
gcuggcaaaguagagcgaa

SEQ ID NO: 587119 - RNA, 20 nt, Escherichia coli CFT073
gcuggcaagaagaucagcaa

SEQ ID NO: 587120 - RNA, 14 nt, Escherichia coli CFT073
gcuggcaaguucgu

SEQ ID NO: 587121 - RNA, 21 nt, Escherichia coli CFT073
gcuggccaugauuaccagcau

SEQ ID NO: 587122 - RNA, 16 nt, Escherichia coli CFT073
gcuggcauugccagaa

SEQ ID NO: 587123 - RNA, 22 nt, Escherichia coli CFT073
gcuggcauuacaagaaucaugc

SEQ ID NO: 587124 - RNA, 16 nt, Escherichia coli CFT073
gcuggccuccagcacu

SEQ ID NO: 587125 - RNA, 13 nt, Escherichia coli CFT073
gcuggccgguuug

SEQ ID NO: 587126 - RNA, 18 nt, Escherichia coli CFT073
gcuggccgguuugccaua

SEQ ID NO: 587127 - RNA, 16 nt, Escherichia coli CFT073
gcugcaacagcgcggu

SEQ ID NO: 587128 - RNA, 21 nt, Escherichia coli CFT073
gcugcaacagcgcgguauucg

SEQ ID NO: 587129 - RNA, 20 nt, Escherichia coli CFT073
gcugcaaauauugccccagc

SEQ ID NO: 587130 - RNA, 21 nt, Escherichia coli CFT073
gcugauggaagugacaccggu

SEQ ID NO: 587131 - RNA, 21 nt, Escherichia coli CFT073
gcugauggagauuuuccgggu

SEQ ID NO: 587132 - RNA, 14 nt, Escherichia coli CFT073
gcugaugcgccgcu

SEQ ID NO: 587133 - RNA, 18 nt, Escherichia coli CFT073
gcugacugcgcucugacu

SEQ ID NO: 587134 - RNA, 18 nt, Escherichia coli CFT073
gcugacugacuucaacag

SEQ ID NO: 587135 - RNA, 18 nt, Escherichia coli CFT073
gcugccaucaauuuccgg

SEQ ID NO: 587136 - RNA, 14 nt, Escherichia coli CFT073
gcugccaucgacuu

SEQ ID NO: 587137 - RNA, 17 nt, Escherichia coli CFT073
gcugccaguugucggua

SEQ ID NO: 587138 - RNA, 13 nt, Escherichia coli CFT073
gcugccaguuucg

SEQ ID NO: 587139 - RNA, 22 nt, Escherichia coli CFT073
gcugccaguaauuccacaccaa

SEQ ID NO: 587140 - RNA, 15 nt, Escherichia coli CFT073
gcugccagccaggau

SEQ ID NO: 587141 - RNA, 20 nt, Escherichia coli CFT073
gcugccagccaggauaugcg

SEQ ID NO: 587142 - RNA, 12 nt, Escherichia coli CFT073
gcugcaguuuac

SEQ ID NO: 587143 - RNA, 15 nt, Escherichia coli CFT073
gcugcgcuugcugcc

SEQ ID NO: 587144 - RNA, 18 nt, Escherichia coli CFT073
gcugcgcuucuuccagca

SEQ ID NO: 587145 - RNA, 21 nt, Escherichia coli CFT073
gcugcgcauguuuagucgcca

SEQ ID NO: 587146 - RNA, 13 nt, Escherichia coli CFT073
gcugcgcagcggu

SEQ ID NO: 587147 - RNA, 14 nt, Escherichia coli CFT073
gcugcgauucaggg

SEQ ID NO: 587148 - RNA, 20 nt, Escherichia coli CFT073
gcugccuacacaaugccuga

SEQ ID NO: 587149 - RNA, 16 nt, Escherichia coli CFT073
gcugcccgccgcgagc

SEQ ID NO: 587150 - RNA, 23 nt, Escherichia coli CFT073
gcugccaucuuuuggcugauaau

SEQ ID NO: 587151 - RNA, 19 nt, Escherichia coli CFT073
gcucuucauacguggcaga

SEQ ID NO: 587152 - RNA, 14 nt, Escherichia coli CFT073
gcucuucaacuuca

SEQ ID NO: 587153 - RNA, 20 nt, Escherichia coli CFT073
gcucuuaauacgaguuucgc

SEQ ID NO: 587154 - RNA, 15 nt, Escherichia coli CFT073
gcucuguguaggccg

SEQ ID NO: 587155 - RNA, 18 nt, Escherichia coli CFT073
gcucugcuagauaagcaa

SEQ ID NO: 587156 - RNA, 15 nt, Escherichia coli CFT073
gcucuggcggcgcga

SEQ ID NO: 587157 - RNA, 23 nt, Escherichia coli CFT073
gcucugguguggagugcagcacu

SEQ ID NO: 587158 - RNA, 22 nt, Escherichia coli CFT073
gcugaagaaguaaaacagucgc

SEQ ID NO: 587159 - RNA, 18 nt, Escherichia coli CFT073
gcugaagcaacaguaaua

SEQ ID NO: 587160 - RNA, 17 nt, Escherichia coli CFT073
gcugaacgucgcguaau

SEQ ID NO: 587161 - RNA, 12 nt, Escherichia coli CFT073
gcucgucauccg

SEQ ID NO: 587162 - RNA, 22 nt, Escherichia coli CFT073
gcucggucacugacaccagcau

SEQ ID NO: 587163 - RNA, 14 nt, Escherichia coli CFT073
gcucacgaugccgc

SEQ ID NO: 587164 - RNA, 13 nt, Escherichia coli CFT073
gcucacgcaucaa

SEQ ID NO: 587165 - RNA, 14 nt, Escherichia coli CFT073
gcuccgccacuuug

SEQ ID NO: 587166 - RNA, 20 nt, Escherichia coli CFT073
gcuccgggugugacaacaac

SEQ ID NO: 587167 - RNA, 12 nt, Escherichia coli CFT073
gcuccucaucaa

SEQ ID NO: 587168 - RNA, 19 nt, Escherichia coli CFT073
gcucgaucagacgaucgcg

SEQ ID NO: 587169 - RNA, 20 nt, Escherichia coli CFT073
gcucgaucagacgaucgcgc

SEQ ID NO: 587170 - RNA, 23 nt, Escherichia coli CFT073
gcucgccgcagagaucagauaau

SEQ ID NO: 587171 - RNA, 18 nt, Escherichia coli CFT073
aaggaaauguuccggguu

SEQ ID NO: 587172 - RNA, 13 nt, Escherichia coli CFT073
aaggacaaaccgg

SEQ ID NO: 587173 - RNA, 12 nt, Escherichia coli CFT073
gcgugccaucaa

SEQ ID NO: 587174 - RNA, 21 nt, Escherichia coli CFT073
gcgugcccacguucaugccga

SEQ ID NO: 587175 - RNA, 23 nt, Escherichia coli CFT073
gcgugcccccguaccgguugucg

SEQ ID NO: 587176 - RNA, 18 nt, Escherichia coli CFT073
gcgugcgcccaucauugc

SEQ ID NO: 587177 - RNA, 22 nt, Escherichia coli CFT073
gcguggucguuggugaaguggu

SEQ ID NO: 587178 - RNA, 19 nt, Escherichia coli CFT073
gcgugguuugcucaucaug

SEQ ID NO: 587179 - RNA, 22 nt, Escherichia coli CFT073
gcguggcgauaaucagcgccag

SEQ ID NO: 587180 - RNA, 16 nt, Escherichia coli CFT073
gcgugcggcauccggu

SEQ ID NO: 587181 - RNA, 14 nt, Escherichia coli CFT073
gcgugacacuaaca

SEQ ID NO: 587182 - RNA, 14 nt, Escherichia coli CFT073
gcgugacaccagca

SEQ ID NO: 587183 - RNA, 23 nt, Escherichia coli CFT073
gcgugacaccagcacaucaucaa

SEQ ID NO: 587184 - RNA, 13 nt, Escherichia coli CFT073
gcgugaacgccuu

SEQ ID NO: 587185 - RNA, 15 nt, Escherichia coli CFT073
gcgucugaauaucau

SEQ ID NO: 587186 - RNA, 20 nt, Escherichia coli CFT073
gcgucucauaacggauugca

SEQ ID NO: 587187 - RNA, 17 nt, Escherichia coli CFT073
gcgucguuaaucgccug

SEQ ID NO: 587188 - RNA, 17 nt, Escherichia coli CFT073
gcgucguucaucgcaaa

SEQ ID NO: 587189 - RNA, 20 nt, Escherichia coli CFT073
gcgucguucgcgccaacagc

SEQ ID NO: 587190 - RNA, 22 nt, Escherichia coli CFT073
gcguaucgcccugccaaaucag

SEQ ID NO: 587191 - RNA, 17 nt, Escherichia coli CFT073
gcguaugcaucgguggc

SEQ ID NO: 587192 - RNA, 21 nt, Escherichia coli CFT073
gcgucagauucggauccagca

SEQ ID NO: 587193 - RNA, 23 nt, Escherichia coli CFT073
gcgucagacggccccgcgccagc

SEQ ID NO: 587194 - RNA, 12 nt, Escherichia coli CFT073
gcgucagcagca

SEQ ID NO: 587195 - RNA, 22 nt, Escherichia coli CFT073
gcgucaucuuacugcaacugug

SEQ ID NO: 587196 - RNA, 21 nt, Escherichia coli CFT073
gcgucaguaaaugcuggcgca

SEQ ID NO: 587197 - RNA, 19 nt, Escherichia coli CFT073
gcgucgaaaauaucgagca

SEQ ID NO: 587198 - RNA, 23 nt, Escherichia coli CFT073
gcguccaccugcgucgcgccgua

SEQ ID NO: 587199 - RNA, 20 nt, Escherichia coli CFT073
gcgucggaaucccuuccgcu

SEQ ID NO: 587200 - RNA, 20 nt, Escherichia coli CFT073
gcuaauuugaaaugacgcuu

SEQ ID NO: 587201 - RNA, 17 nt, Escherichia coli CFT073
gcuaaugcagguacgca

SEQ ID NO: 587202 - RNA, 21 nt, Escherichia coli CFT073
gcuacaucauuuuuuaauuca

SEQ ID NO: 587203 - RNA, 14 nt, Escherichia coli CFT073
gcuacaccgaucac

SEQ ID NO: 587204 - RNA, 16 nt, Escherichia coli CFT073
gcuaccauccgcgcgc

SEQ ID NO: 587205 - RNA, 14 nt, Escherichia coli CFT073
gcuaccgaccagac

SEQ ID NO: 587206 - RNA, 15 nt, Escherichia coli CFT073
gcuaccggcaaacuu

SEQ ID NO: 587207 - RNA, 22 nt, Escherichia coli CFT073
gcuaccggcaggaaauuaagau

SEQ ID NO: 587208 - RNA, 13 nt, Escherichia coli CFT073
gcuacccuggcga

SEQ ID NO: 587209 - RNA, 18 nt, Escherichia coli CFT073
gcuacccuggcgagcagc

SEQ ID NO: 587210 - RNA, 14 nt, Escherichia coli CFT073
gcuauacagcagcc

SEQ ID NO: 587211 - RNA, 13 nt, Escherichia coli CFT073
gcuagcagcagcg

SEQ ID NO: 587212 - RNA, 21 nt, Escherichia coli CFT073
gcuagccgcgucuuauccggc

SEQ ID NO: 587213 - RNA, 19 nt, Escherichia coli CFT073
gcuacguagcucaucuuca

SEQ ID NO: 587214 - RNA, 14 nt, Escherichia coli CFT073
gcuacgugccgggc

SEQ ID NO: 587215 - RNA, 19 nt, Escherichia coli CFT073
gcuaucggcaaaaauaauc

SEQ ID NO: 587216 - RNA, 18 nt, Escherichia coli CFT073
gcuaucgaugccgcuuau

SEQ ID NO: 587217 - RNA, 21 nt, Escherichia coli CFT073
gcuaucuauugcugaauggau

SEQ ID NO: 587218 - RNA, 20 nt, Escherichia coli CFT073
gcuaucucugguaggccuga

SEQ ID NO: 587219 - RNA, 15 nt, Escherichia coli CFT073
gcuauaccgccaggc

SEQ ID NO: 587220 - RNA, 13 nt, Escherichia coli CFT073
gcuauuuaccagc

SEQ ID NO: 587221 - RNA, 18 nt, Escherichia coli CFT073
gcucaaagacgcgguaaa

SEQ ID NO: 587222 - RNA, 22 nt, Escherichia coli CFT073
gcuauugcuuuagacagcuucg

SEQ ID NO: 587223 - RNA, 15 nt, Escherichia coli CFT073
gcuaugcgcaucaag

SEQ ID NO: 587224 - RNA, 18 nt, Escherichia coli CFT073
gcuaugcaacaacuggcg

SEQ ID NO: 587225 - RNA, 19 nt, Escherichia coli CFT073
gcuaugcaacaacuggcgg

SEQ ID NO: 587226 - RNA, 16 nt, Escherichia coli CFT073
gcuaugugccauugca

SEQ ID NO: 587227 - RNA, 18 nt, Escherichia coli CFT073
gcuauuacuuuaagccuu

SEQ ID NO: 587228 - RNA, 18 nt, Escherichia coli CFT073
gcguugagaaacgccgga

SEQ ID NO: 587229 - RNA, 23 nt, Escherichia coli CFT073
gcguucgguauuaauuugccagc

SEQ ID NO: 587230 - RNA, 15 nt, Escherichia coli CFT073
gcguucuuccaucac

SEQ ID NO: 587231 - RNA, 22 nt, Escherichia coli CFT073
gcguucgcgccgcauccggcau

SEQ ID NO: 587232 - RNA, 15 nt, Escherichia coli CFT073
gcguuccugccgcga

SEQ ID NO: 587233 - RNA, 20 nt, Escherichia coli CFT073
gcguguuaaugcccaucagu

SEQ ID NO: 587234 - RNA, 19 nt, Escherichia coli CFT073
gcgugugacaaaagugaau

SEQ ID NO: 587235 - RNA, 20 nt, Escherichia coli CFT073
gcguuuuuggcaucggcaaa

SEQ ID NO: 587236 - RNA, 15 nt, Escherichia coli CFT073
gcguuuucagaucca

SEQ ID NO: 587237 - RNA, 12 nt, Escherichia coli CFT073
gcguuuucugcc

SEQ ID NO: 587238 - RNA, 13 nt, Escherichia coli CFT073
gcguuugcagcuu

SEQ ID NO: 587239 - RNA, 15 nt, Escherichia coli CFT073
gcguuuggcaucagc

SEQ ID NO: 587240 - RNA, 13 nt, Escherichia coli CFT073
gcguuuggugcga

SEQ ID NO: 587241 - RNA, 18 nt, Escherichia coli CFT073
gcguuuguccgccagaaa

SEQ ID NO: 587242 - RNA, 21 nt, Escherichia coli CFT073
gcguuuuacaauauccagcgc

SEQ ID NO: 587243 - RNA, 22 nt, Escherichia coli CFT073
gcuaaaaaucccgccaucggcg

SEQ ID NO: 587244 - RNA, 20 nt, Escherichia coli CFT073
gcuaaaagcauagccccagc

SEQ ID NO: 587245 - RNA, 15 nt, Escherichia coli CFT073
gcuaaauccgccgcc

SEQ ID NO: 587246 - RNA, 17 nt, Escherichia coli CFT073
gcuaacacugccagccc

SEQ ID NO: 587247 - RNA, 16 nt, Escherichia coli CFT073
gcuaauaccggaugcc

SEQ ID NO: 587248 - RNA, 19 nt, Escherichia coli CFT073
gcuaauaccggaugccaga

SEQ ID NO: 587249 - RNA, 22 nt, Escherichia coli CFT073
gcuaauacgaugcaaccgagcg

SEQ ID NO: 587250 - RNA, 21 nt, Escherichia coli CFT073
gcuaaucaaaucaacacguuc

SEQ ID NO: 587251 - RNA, 23 nt, Escherichia coli CFT073
gcuaagccccugagcgaauaccc

SEQ ID NO: 587252 - RNA, 16 nt, Escherichia coli CFT073
gcuaacuucgccauca

SEQ ID NO: 587253 - RNA, 19 nt, Escherichia coli CFT073
gcuaagauaccccagcgca

SEQ ID NO: 587254 - RNA, 22 nt, Escherichia coli CFT073
gcuaacaguuugccaaaccagc

SEQ ID NO: 587255 - RNA, 12 nt, Escherichia coli CFT073
gcuaaccgucug

SEQ ID NO: 587256 - RNA, 21 nt, Escherichia coli CFT073
gcguugucauacgagucgccu

SEQ ID NO: 587257 - RNA, 16 nt, Escherichia coli CFT073
gcguuucuuccagcca

SEQ ID NO: 587258 - RNA, 18 nt, Escherichia coli CFT073
gcguuuaucgacagacgc

SEQ ID NO: 587259 - RNA, 13 nt, Escherichia coli CFT073
gcguugucaucgg

SEQ ID NO: 587260 - RNA, 15 nt, Escherichia coli CFT073
gcguuguccgccaga

SEQ ID NO: 587261 - RNA, 18 nt, Escherichia coli CFT073
gucgcguagccaggcggc

SEQ ID NO: 587262 - RNA, 20 nt, Escherichia coli CFT073
gucgcggcaaauuacuggcg

SEQ ID NO: 587263 - RNA, 22 nt, Escherichia coli CFT073
gucgcgaauucauguucgguaa

SEQ ID NO: 587264 - RNA, 18 nt, Escherichia coli CFT073
gucgauaaacaucgccau

SEQ ID NO: 587265 - RNA, 19 nt, Escherichia coli CFT073
gucgauaaacaucgccaua

SEQ ID NO: 587266 - RNA, 23 nt, Escherichia coli CFT073
gucgauaucaggcaaacagaauu

SEQ ID NO: 587267 - RNA, 15 nt, Escherichia coli CFT073
gucgcauccggcaau

SEQ ID NO: 587268 - RNA, 22 nt, Escherichia coli CFT073
gucgcauggggaucgugauaau

SEQ ID NO: 587269 - RNA, 16 nt, Escherichia coli CFT073
gucgccaacuucauga

SEQ ID NO: 587270 - RNA, 14 nt, Escherichia coli CFT073
gucgccagcaauac

SEQ ID NO: 587271 - RNA, 12 nt, Escherichia coli CFT073
gucgccaucguc

SEQ ID NO: 587272 - RNA, 13 nt, Escherichia coli CFT073
gucgccaucguca

SEQ ID NO: 587273 - RNA, 15 nt, Escherichia coli CFT073
gucggauaagacgcg

SEQ ID NO: 587274 - RNA, 18 nt, Escherichia coli CFT073
gucggauaagacgcguca

SEQ ID NO: 587275 - RNA, 19 nt, Escherichia coli CFT073
gucggcaagauacugcaua

SEQ ID NO: 587276 - RNA, 14 nt, Escherichia coli CFT073
gucggcaaucgcaa

SEQ ID NO: 587277 - RNA, 13 nt, Escherichia coli CFT073
gucggcaguucgu

SEQ ID NO: 587278 - RNA, 16 nt, Escherichia coli CFT073
gucgcuuuaacgcccu

SEQ ID NO: 587279 - RNA, 22 nt, Escherichia coli CFT073
gucgcuggaugcgaugcuggcg

SEQ ID NO: 587280 - RNA, 18 nt, Escherichia coli CFT073
gucgcugauauugcucca

SEQ ID NO: 587281 - RNA, 18 nt, Escherichia coli CFT073
gucgcugauucgcuucaa

SEQ ID NO: 587282 - RNA, 22 nt, Escherichia coli CFT073
gucgcuaagcacgauaucaaua

SEQ ID NO: 587283 - RNA, 19 nt, Escherichia coli CFT073
gucggcaugauaagacgcg

SEQ ID NO: 587284 - RNA, 15 nt, Escherichia coli CFT073
gucggcaucaggcaa

SEQ ID NO: 587285 - RNA, 20 nt, Escherichia coli CFT073
gucccgauaaccgcaaaacc

SEQ ID NO: 587286 - RNA, 16 nt, Escherichia coli CFT073
gucaucaaguuacgau

SEQ ID NO: 587287 - RNA, 17 nt, Escherichia coli CFT073
gucaucaucggcugcgc

SEQ ID NO: 587288 - RNA, 22 nt, Escherichia coli CFT073
gucaucauugguuaacuccagc

SEQ ID NO: 587289 - RNA, 22 nt, Escherichia coli CFT073
gucaucgcaucguacaucacga

SEQ ID NO: 587290 - RNA, 13 nt, Escherichia coli CFT073
gucaucgcguuaa

SEQ ID NO: 587291 - RNA, 18 nt, Escherichia coli CFT073
guccauauuucgucgcau

SEQ ID NO: 587292 - RNA, 17 nt, Escherichia coli CFT073
guccaucacaaucagcu

SEQ ID NO: 587293 - RNA, 17 nt, Escherichia coli CFT073
gucaucgcccuguuccu

SEQ ID NO: 587294 - RNA, 14 nt, Escherichia coli CFT073
guccaucacuugcu

SEQ ID NO: 587295 - RNA, 13 nt, Escherichia coli CFT073
guccggucgggaa

SEQ ID NO: 587296 - RNA, 15 nt, Escherichia coli CFT073
guccguaacgcucaa

SEQ ID NO: 587297 - RNA, 17 nt, Escherichia coli CFT073
guccggcaucgcaaacc

SEQ ID NO: 587298 - RNA, 16 nt, Escherichia coli CFT073
guccggcaccagcgcu

SEQ ID NO: 587299 - RNA, 15 nt, Escherichia coli CFT073
gucccuugcugguca

SEQ ID NO: 587300 - RNA, 23 nt, Escherichia coli CFT073
gucccuuccgcaauacagccagc

SEQ ID NO: 587301 - RNA, 22 nt, Escherichia coli CFT073
guccugcccgacgacgucgcug

SEQ ID NO: 587302 - RNA, 18 nt, Escherichia coli CFT073
guccugagugggcgucag

SEQ ID NO: 587303 - RNA, 13 nt, Escherichia coli CFT073
guccuggcgcugu

SEQ ID NO: 587304 - RNA, 22 nt, Escherichia coli CFT073
guccuggguauaaaacucaccg

SEQ ID NO: 587305 - RNA, 18 nt, Escherichia coli CFT073
gucgacaauccagucagc

SEQ ID NO: 587306 - RNA, 15 nt, Escherichia coli CFT073
gucgacaaccagcau

SEQ ID NO: 587307 - RNA, 20 nt, Escherichia coli CFT073
gucgaaugcgcaaccguaaa

SEQ ID NO: 587308 - RNA, 20 nt, Escherichia coli CFT073
gucgacaucaagaaaugcau

SEQ ID NO: 587309 - RNA, 18 nt, Escherichia coli CFT073
guauugcccugaucgcgc

SEQ ID NO: 587310 - RNA, 22 nt, Escherichia coli CFT073
guauucuuugaucgccgccagc

SEQ ID NO: 587311 - RNA, 12 nt, Escherichia coli CFT073
guauugaaucgg

SEQ ID NO: 587312 - RNA, 13 nt, Escherichia coli CFT073
guauuauucaggu

SEQ ID NO: 587313 - RNA, 23 nt, Escherichia coli CFT073
guauucacuuucaaauccagcca

SEQ ID NO: 587314 - RNA, 16 nt, Escherichia coli CFT073
guauucagaucagcgg

SEQ ID NO: 587315 - RNA, 22 nt, Escherichia coli CFT073
guauucaugcccugcccgcugc

SEQ ID NO: 587316 - RNA, 14 nt, Escherichia coli CFT073
guauuuauggauga

SEQ ID NO: 587317 - RNA, 16 nt, Escherichia coli CFT073
gucaaaacuuuucacc

SEQ ID NO: 587318 - RNA, 20 nt, Escherichia coli CFT073
gucaaaacuuuucaccagcg

SEQ ID NO: 587319 - RNA, 12 nt, Escherichia coli CFT073
gucaaaagcggu

SEQ ID NO: 587320 - RNA, 18 nt, Escherichia coli CFT073
gucaaacguaccgccaga

SEQ ID NO: 587321 - RNA, 14 nt, Escherichia coli CFT073
gucaaagcgccagc

SEQ ID NO: 587322 - RNA, 16 nt, Escherichia coli CFT073
gucaaagcgccagcgc

SEQ ID NO: 587323 - RNA, 22 nt, Escherichia coli CFT073
gucaacaaacguucauacgcaa

SEQ ID NO: 587324 - RNA, 12 nt, Escherichia coli CFT073
gucaacaaccag

SEQ ID NO: 587325 - RNA, 21 nt, Escherichia coli CFT073
guaugcacacggaucugauga

SEQ ID NO: 587326 - RNA, 14 nt, Escherichia coli CFT073
guaugccauccggc

SEQ ID NO: 587327 - RNA, 16 nt, Escherichia coli CFT073
guaugacgaggaacau

SEQ ID NO: 587328 - RNA, 20 nt, Escherichia coli CFT073
guaugacgaguauauucugu

SEQ ID NO: 587329 - RNA, 14 nt, Escherichia coli CFT073
guaucuuucaucau

SEQ ID NO: 587330 - RNA, 20 nt, Escherichia coli CFT073
guaugguuuuguaggccgga

SEQ ID NO: 587331 - RNA, 14 nt, Escherichia coli CFT073
guaugggaucccgu

SEQ ID NO: 587332 - RNA, 19 nt, Escherichia coli CFT073
guauguucagaaagcgcca

SEQ ID NO: 587333 - RNA, 22 nt, Escherichia coli CFT073
guauggcccagccuuuccagca

SEQ ID NO: 587334 - RNA, 14 nt, Escherichia coli CFT073
guauggccugguga

SEQ ID NO: 587335 - RNA, 14 nt, Escherichia coli CFT073
guaugcgcgucaga

SEQ ID NO: 587336 - RNA, 16 nt, Escherichia coli CFT073
guaucguaaucagcac

SEQ ID NO: 587337 - RNA, 19 nt, Escherichia coli CFT073
guaucuggcguuaaaacca

SEQ ID NO: 587338 - RNA, 15 nt, Escherichia coli CFT073
guaucacguagccac

SEQ ID NO: 587339 - RNA, 19 nt, Escherichia coli CFT073
gucaauuuuaagcagaucg

SEQ ID NO: 587340 - RNA, 15 nt, Escherichia coli CFT073
gucaauuucaauagc

SEQ ID NO: 587341 - RNA, 19 nt, Escherichia coli CFT073
gucacaaaucucccuugcg

SEQ ID NO: 587342 - RNA, 19 nt, Escherichia coli CFT073
gucacaacauugcgggcga

SEQ ID NO: 587343 - RNA, 16 nt, Escherichia coli CFT073
gucaaucgcacgauag

SEQ ID NO: 587344 - RNA, 14 nt, Escherichia coli CFT073
gucaaucacuuucu

SEQ ID NO: 587345 - RNA, 21 nt, Escherichia coli CFT073
gucaaucagggcgaugcggga

SEQ ID NO: 587346 - RNA, 21 nt, Escherichia coli CFT073
gucaaguuaagcauuggcaug

SEQ ID NO: 587347 - RNA, 14 nt, Escherichia coli CFT073
gucaauaaaaagcg

SEQ ID NO: 587348 - RNA, 18 nt, Escherichia coli CFT073
gucaauaguuacgaaaag

SEQ ID NO: 587349 - RNA, 16 nt, Escherichia coli CFT073
gucaauauccagcagg

SEQ ID NO: 587350 - RNA, 19 nt, Escherichia coli CFT073
gucaagcgucgcauccggc

SEQ ID NO: 587351 - RNA, 19 nt, Escherichia coli CFT073
gucaagccaccgccgcuac

SEQ ID NO: 587352 - RNA, 13 nt, Escherichia coli CFT073
gucaacgcugcca

SEQ ID NO: 587353 - RNA, 19 nt, Escherichia coli CFT073
gucaacccaaccugccaga

SEQ ID NO: 587354 - RNA, 22 nt, Escherichia coli CFT073
gucacagucugcuccaucgcau

SEQ ID NO: 587355 - RNA, 19 nt, Escherichia coli CFT073
gucacaguuaaccaguuuu

SEQ ID NO: 587356 - RNA, 16 nt, Escherichia coli CFT073
gucacaggccaucaca

SEQ ID NO: 587357 - RNA, 17 nt, Escherichia coli CFT073
gucaccagcaucaacaa

SEQ ID NO: 587358 - RNA, 18 nt, Escherichia coli CFT073
gucacccgugcagguucu

SEQ ID NO: 587359 - RNA, 18 nt, Escherichia coli CFT073
gucaccggaaccgucgcg

SEQ ID NO: 587360 - RNA, 17 nt, Escherichia coli CFT073
gucacgauggaaccgua

SEQ ID NO: 587361 - RNA, 16 nt, Escherichia coli CFT073
gucacgccgaccagac

SEQ ID NO: 587362 - RNA, 14 nt, Escherichia coli CFT073
gucacgcaucacga

SEQ ID NO: 587363 - RNA, 19 nt, Escherichia coli CFT073
gucacgcaucacgacaacc

SEQ ID NO: 587364 - RNA, 12 nt, Escherichia coli CFT073
gucaccgguucg

SEQ ID NO: 587365 - RNA, 18 nt, Escherichia coli CFT073
gucaccgucacaucaauu

SEQ ID NO: 587366 - RNA, 16 nt, Escherichia coli CFT073
gucacguagcggcggc

SEQ ID NO: 587367 - RNA, 19 nt, Escherichia coli CFT073
gucacuaccuguuuaaccu

SEQ ID NO: 587368 - RNA, 20 nt, Escherichia coli CFT073
gucagaccaaaacgcgccag

SEQ ID NO: 587369 - RNA, 17 nt, Escherichia coli CFT073
gucagcaauuuuacccg

SEQ ID NO: 587370 - RNA, 12 nt, Escherichia coli CFT073
gucagacgcgcg

SEQ ID NO: 587371 - RNA, 18 nt, Escherichia coli CFT073
gucagaccggcaaccagc

SEQ ID NO: 587372 - RNA, 20 nt, Escherichia coli CFT073
gucagaccggcaaccagcac

SEQ ID NO: 587373 - RNA, 14 nt, Escherichia coli CFT073
gucagccacaacaa

SEQ ID NO: 587374 - RNA, 14 nt, Escherichia coli CFT073
gucagcaucucugc

SEQ ID NO: 587375 - RNA, 19 nt, Escherichia coli CFT073
gucagcaguguccaguaau

SEQ ID NO: 587376 - RNA, 16 nt, Escherichia coli CFT073
gucagcacucacgcca

SEQ ID NO: 587377 - RNA, 15 nt, Escherichia coli CFT073
gucagcaccagacgc

SEQ ID NO: 587378 - RNA, 19 nt, Escherichia coli CFT073
gucagcgaacaccagcagu

SEQ ID NO: 587379 - RNA, 19 nt, Escherichia coli CFT073
gucagcccuuauucacgcc

SEQ ID NO: 587380 - RNA, 12 nt, Escherichia coli CFT073
gucagccagcgc

SEQ ID NO: 587381 - RNA, 13 nt, Escherichia coli CFT073
gucagccagcgca

SEQ ID NO: 587382 - RNA, 13 nt, Escherichia coli CFT073
gucagccagcggc

SEQ ID NO: 587383 - RNA, 22 nt, Escherichia coli CFT073
gucauacuuauugaaagcaaaa

SEQ ID NO: 587384 - RNA, 21 nt, Escherichia coli CFT073
gucauagcaauaaaugccugg

SEQ ID NO: 587385 - RNA, 20 nt, Escherichia coli CFT073
gucauaggcugccgacgcca

SEQ ID NO: 587386 - RNA, 15 nt, Escherichia coli CFT073
gucauagcgacuacc

SEQ ID NO: 587387 - RNA, 22 nt, Escherichia coli CFT073
gucauauagccgcgcaguuucu

SEQ ID NO: 587388 - RNA, 16 nt, Escherichia coli CFT073
gucauaucaucaucgg

SEQ ID NO: 587389 - RNA, 20 nt, Escherichia coli CFT073
gucaggcaugaucagcgucc

SEQ ID NO: 587390 - RNA, 23 nt, Escherichia coli CFT073
gucaggccaacauccaucagcgu

SEQ ID NO: 587391 - RNA, 14 nt, Escherichia coli CFT073
gucaggccgccacu

SEQ ID NO: 587392 - RNA, 19 nt, Escherichia coli CFT073
gucagcucauccagcgucu

SEQ ID NO: 587393 - RNA, 21 nt, Escherichia coli CFT073
gucagcgucucaacaaacgau

SEQ ID NO: 587394 - RNA, 23 nt, Escherichia coli CFT073
guaguagccgucuuucaguucgc

SEQ ID NO: 587395 - RNA, 22 nt, Escherichia coli CFT073
guauaguccgccagaauacccg

SEQ ID NO: 587396 - RNA, 20 nt, Escherichia coli CFT073
guaucaaacagaaaaacgaa

SEQ ID NO: 587397 - RNA, 22 nt, Escherichia coli CFT073
guagugauccugcauacugaca

SEQ ID NO: 587398 - RNA, 18 nt, Escherichia coli CFT073
aaguauuaaugucaggua

SEQ ID NO: 587399 - RNA, 20 nt, Escherichia coli CFT073
  misc_feature (7)..(7): n is a, c, g or u
guagcungcaggauaaacgc

SEQ ID NO: 587400 - RNA, 14 nt, Escherichia coli CFT073
aagucagcgcgaaa

SEQ ID NO: 587401 - RNA, 18 nt, Escherichia coli CFT073
aagucaccgcuuuuuuca

SEQ ID NO: 587402 - RNA, 18 nt, Escherichia coli CFT073
guacgguacugaaaccug

SEQ ID NO: 587403 - RNA, 21 nt, Escherichia coli CFT073
guacuuccuguugaugccagu

SEQ ID NO: 587404 - RNA, 13 nt, Escherichia coli CFT073
guacuuaacugcc

SEQ ID NO: 587405 - RNA, 22 nt, Escherichia coli CFT073
guagcaaauuucgucguaauca

SEQ ID NO: 587406 - RNA, 16 nt, Escherichia coli CFT073
guagcucaaacuggcu

SEQ ID NO: 587407 - RNA, 21 nt, Escherichia coli CFT073
guagcgcauuucauggcggaa

SEQ ID NO: 587408 - RNA, 18 nt, Escherichia coli CFT073
guagcagguaaucugcca

SEQ ID NO: 587409 - RNA, 17 nt, Escherichia coli CFT073
guagcaguuccagcauc

SEQ ID NO: 587410 - RNA, 15 nt, Escherichia coli CFT073
guagcagcagcgcca

SEQ ID NO: 587411 - RNA, 20 nt, Escherichia coli CFT073
guagccuuuuucagccgcaa

SEQ ID NO: 587412 - RNA, 18 nt, Escherichia coli CFT073
gguuuucugucuuaacgc

SEQ ID NO: 587413 - RNA, 15 nt, Escherichia coli CFT073
guaaaauaucacucg

SEQ ID NO: 587414 - RNA, 18 nt, Escherichia coli CFT073
guaaaaugcggaaaaggu

SEQ ID NO: 587415 - RNA, 20 nt, Escherichia coli CFT073
guaaaaaagcgucgccguca

SEQ ID NO: 587416 - RNA, 21 nt, Escherichia coli CFT073
guaaaacuaacgccaggaacc

SEQ ID NO: 587417 - RNA, 23 nt, Escherichia coli CFT073
guaaauaugccccacagacccag

SEQ ID NO: 587418 - RNA, 17 nt, Escherichia coli CFT073
guaaagcgcggcaguga

SEQ ID NO: 587419 - RNA, 14 nt, Escherichia coli CFT073
guaaagugcgaguc

SEQ ID NO: 587420 - RNA, 22 nt, Escherichia coli CFT073
guaaaguggcggggaucacucc

SEQ ID NO: 587421 - RNA, 15 nt, Escherichia coli CFT073
gguuuguaggccgga

SEQ ID NO: 587422 - RNA, 23 nt, Escherichia coli CFT073
guaaauugugucgacauagccau

SEQ ID NO: 587423 - RNA, 16 nt, Escherichia coli CFT073
guaacugacaguagcc

SEQ ID NO: 587424 - RNA, 20 nt, Escherichia coli CFT073
guaaaugcgggcuuggcugg

SEQ ID NO: 587425 - RNA, 14 nt, Escherichia coli CFT073
guaaaugcuuuaua

SEQ ID NO: 587426 - RNA, 20 nt, Escherichia coli CFT073
guaacugccuuucccuuucu

SEQ ID NO: 587427 - RNA, 22 nt, Escherichia coli CFT073
guaacugcuguaguccaggccu

SEQ ID NO: 587428 - RNA, 11 nt, Escherichia coli CFT073
guaacugucgg

SEQ ID NO: 587429 - RNA, 19 nt, Escherichia coli CFT073
guaacuuucuccgguuggu

SEQ ID NO: 587430 - RNA, 14 nt, Escherichia coli CFT073
guaagaaccacagc

SEQ ID NO: 587431 - RNA, 20 nt, Escherichia coli CFT073
guaauaagguucauugaacg

SEQ ID NO: 587432 - RNA, 22 nt, Escherichia coli CFT073
guaauacaaacucacugccagc

SEQ ID NO: 587433 - RNA, 23 nt, Escherichia coli CFT073
guaauacaaacucacugccagca

SEQ ID NO: 587434 - RNA, 18 nt, Escherichia coli CFT073
guaagguggguugcugau

SEQ ID NO: 587435 - RNA, 18 nt, Escherichia coli CFT073
guaaggcaucuucuucau

SEQ ID NO: 587436 - RNA, 22 nt, Escherichia coli CFT073
guaaggaacggggguuuuacuu

SEQ ID NO: 587437 - RNA, 12 nt, Escherichia coli CFT073
guaaggaauaag

SEQ ID NO: 587438 - RNA, 23 nt, Escherichia coli CFT073
guaaggauauucauuaauaacca

SEQ ID NO: 587439 - RNA, 23 nt, Escherichia coli CFT073
guaagcauuaaguguaaucagcc

SEQ ID NO: 587440 - RNA, 16 nt, Escherichia coli CFT073
guaagccgccgccauc

SEQ ID NO: 587441 - RNA, 18 nt, Escherichia coli CFT073
guaagccgguaaucacca

SEQ ID NO: 587442 - RNA, 18 nt, Escherichia coli CFT073
guaaucuauauuucugcg

SEQ ID NO: 587443 - RNA, 18 nt, Escherichia coli CFT073
guaaucgggcaacugcug

SEQ ID NO: 587444 - RNA, 14 nt, Escherichia coli CFT073
guaauagccugaug

SEQ ID NO: 587445 - RNA, 21 nt, Escherichia coli CFT073
guaaucaacuccgccagcaac

SEQ ID NO: 587446 - RNA, 21 nt, Escherichia coli CFT073
guaaucaguucguugaucaac

SEQ ID NO: 587447 - RNA, 12 nt, Escherichia coli CFT073
guaaucaugaac

SEQ ID NO: 587448 - RNA, 21 nt, Escherichia coli CFT073
guaauccaccguuggcagaua

SEQ ID NO: 587449 - RNA, 15 nt, Escherichia coli CFT073
guaaucugcaccagg

SEQ ID NO: 587450 - RNA, 23 nt, Escherichia coli CFT073
guaauuuaacaacucaccaacgu

SEQ ID NO: 587451 - RNA, 16 nt, Escherichia coli CFT073
guacacaaccgccgga

SEQ ID NO: 587452 - RNA, 23 nt, Escherichia coli CFT073
guacacaaccgccggaugcggcg

SEQ ID NO: 587453 - RNA, 17 nt, Escherichia coli CFT073
guacaccaacaucacgu

SEQ ID NO: 587454 - RNA, 20 nt, Escherichia coli CFT073
guacauugccgggcgcauca

SEQ ID NO: 587455 - RNA, 14 nt, Escherichia coli CFT073
guacaucucuccgu

SEQ ID NO: 587456 - RNA, 22 nt, Escherichia coli CFT073
guacagguaagcacacaucaca

SEQ ID NO: 587457 - RNA, 21 nt, Escherichia coli CFT073
guacaggauauauuucaucaa

SEQ ID NO: 587458 - RNA, 16 nt, Escherichia coli CFT073
guaccgagauaacguu

SEQ ID NO: 587459 - RNA, 23 nt, Escherichia coli CFT073
guaccgugcagcgcaaucgccuc

SEQ ID NO: 587460 - RNA, 14 nt, Escherichia coli CFT073
guacccaaucagcg

SEQ ID NO: 587461 - RNA, 16 nt, Escherichia coli CFT073
guaccagugcagaugc

SEQ ID NO: 587462 - RNA, 18 nt, Escherichia coli CFT073
guaccaucguccagcagc

SEQ ID NO: 587463 - RNA, 17 nt, Escherichia coli CFT073
guaccuuugaacugcug

SEQ ID NO: 587464 - RNA, 16 nt, Escherichia coli CFT073
guacgggacagcaggu

SEQ ID NO: 587465 - RNA, 21 nt, Escherichia coli CFT073
ggcguaugccggauggcugau

SEQ ID NO: 587466 - RNA, 15 nt, Escherichia coli CFT073
ggcgucagcgcaaau

SEQ ID NO: 587467 - RNA, 18 nt, Escherichia coli CFT073
ggcgucagcgccaucccc

SEQ ID NO: 587468 - RNA, 23 nt, Escherichia coli CFT073
gggagcgaaaaagcguucaucug

SEQ ID NO: 587469 - RNA, 21 nt, Escherichia coli CFT073
gggauacaagccacaucgcca

SEQ ID NO: 587470 - RNA, 19 nt, Escherichia coli CFT073
gggauaaagacuuuaucgu

SEQ ID NO: 587471 - RNA, 18 nt, Escherichia coli CFT073
gggauuucaaugcgcaag

SEQ ID NO: 587472 - RNA, 22 nt, Escherichia coli CFT073
gggaugcucuuuacgcacguaa

SEQ ID NO: 587473 - RNA, 22 nt, Escherichia coli CFT073
gggcauggugucaccacccugc

SEQ ID NO: 587474 - RNA, 16 nt, Escherichia coli CFT073
gggcauugaaaauuac

SEQ ID NO: 587475 - RNA, 18 nt, Escherichia coli CFT073
gggccagcgcauccauua

SEQ ID NO: 587476 - RNA, 16 nt, Escherichia coli CFT073
gggcuugccagguagc

SEQ ID NO: 587477 - RNA, 18 nt, Escherichia coli CFT073
gggcuuccggcaauggcu

SEQ ID NO: 587478 - RNA, 11 nt, Escherichia coli CFT073
gggcugguugg

SEQ ID NO: 587479 - RNA, 15 nt, Escherichia coli CFT073
aagguuuuaaucgcu

SEQ ID NO: 587480 - RNA, 20 nt, Escherichia coli CFT073
ggggcuuuucucugucugcc

SEQ ID NO: 587481 - RNA, 23 nt, Escherichia coli CFT073
gggcgaaaccauauuaaauggcc

SEQ ID NO: 587482 - RNA, 12 nt, Escherichia coli CFT073
gggccugauaag

SEQ ID NO: 587483 - RNA, 14 nt, Escherichia coli CFT073
gggcgaauuccuga

SEQ ID NO: 587484 - RNA, 16 nt, Escherichia coli CFT073
gguaaugauuaacagc

SEQ ID NO: 587485 - RNA, 18 nt, Escherichia coli CFT073
gguaaugcacuccgccgc

SEQ ID NO: 587486 - RNA, 15 nt, Escherichia coli CFT073
gguaaucaccaccca

SEQ ID NO: 587487 - RNA, 22 nt, Escherichia coli CFT073
gguaaucaccagcaacacgagg

SEQ ID NO: 587488 - RNA, 16 nt, Escherichia coli CFT073
gguaagcgugauaaca

SEQ ID NO: 587489 - RNA, 18 nt, Escherichia coli CFT073
gguaccgacugacgcucu

SEQ ID NO: 587490 - RNA, 14 nt, Escherichia coli CFT073
gguaaaucauuguu

SEQ ID NO: 587491 - RNA, 17 nt, Escherichia coli CFT073
gguaaagcaccugauua

SEQ ID NO: 587492 - RNA, 23 nt, Escherichia coli CFT073
gguaaagcaccugauuaguggca

SEQ ID NO: 587493 - RNA, 17 nt, Escherichia coli CFT073
gguaagcgauaaaaaua

SEQ ID NO: 587494 - RNA, 17 nt, Escherichia coli CFT073
gguaagcaugaauauca

SEQ ID NO: 587495 - RNA, 17 nt, Escherichia coli CFT073
gguaacuuaucuguaau

SEQ ID NO: 587496 - RNA, 17 nt, Escherichia coli CFT073
aaguacgcuucacgcac

SEQ ID NO: 587497 - RNA, 23 nt, Escherichia coli CFT073
aaguacgccgccgccaaucgccc

SEQ ID NO: 587498 - RNA, 14 nt, Escherichia coli CFT073
aaguaaucaaugcg

SEQ ID NO: 587499 - RNA, 14 nt, Escherichia coli CFT073
ggguugccagcgac

SEQ ID NO: 587500 - RNA, 12 nt, Escherichia coli CFT073
gguauuugauau

SEQ ID NO: 587501 - RNA, 14 nt, Escherichia coli CFT073
ggucaauaaggaca

SEQ ID NO: 587502 - RNA, 14 nt, Escherichia coli CFT073
gguauugcagcucu

SEQ ID NO: 587503 - RNA, 21 nt, Escherichia coli CFT073
gguauuacccucaaacgccag

SEQ ID NO: 587504 - RNA, 14 nt, Escherichia coli CFT073
gguaugcuccggca

SEQ ID NO: 587505 - RNA, 19 nt, Escherichia coli CFT073
gguaugaauuuucgacagc

SEQ ID NO: 587506 - RNA, 20 nt, Escherichia coli CFT073
gguaugacccagcgcgguaa

SEQ ID NO: 587507 - RNA, 15 nt, Escherichia coli CFT073
gguauagcgcaucac

SEQ ID NO: 587508 - RNA, 22 nt, Escherichia coli CFT073
ggucagcaucgucaacgccgcg

SEQ ID NO: 587509 - RNA, 20 nt, Escherichia coli CFT073
ggucgaugauuuccgccagc

SEQ ID NO: 587510 - RNA, 21 nt, Escherichia coli CFT073
gguccuaacaaccauccccaa

SEQ ID NO: 587511 - RNA, 17 nt, Escherichia coli CFT073
gguccgggcaucaacag

SEQ ID NO: 587512 - RNA, 15 nt, Escherichia coli CFT073
ggugcagccgccauc

SEQ ID NO: 587513 - RNA, 13 nt, Escherichia coli CFT073
ggugccagcgcca

SEQ ID NO: 587514 - RNA, 18 nt, Escherichia coli CFT073
ggugccgggaauauuuac

SEQ ID NO: 587515 - RNA, 17 nt, Escherichia coli CFT073
ggugcgcaccaggcgug

SEQ ID NO: 587516 - RNA, 17 nt, Escherichia coli CFT073
ggugcgaccaaacugcu

SEQ ID NO: 587517 - RNA, 21 nt, Escherichia coli CFT073
ggugcgggaguugaucgccag

SEQ ID NO: 587518 - RNA, 21 nt, Escherichia coli CFT073
ggucuugagcggaaacagcgg

SEQ ID NO: 587519 - RNA, 13 nt, Escherichia coli CFT073
ggucugauauuca

SEQ ID NO: 587520 - RNA, 22 nt, Escherichia coli CFT073
ggucggguuaagcccaaggcua

SEQ ID NO: 587521 - RNA, 24 nt, Escherichia coli CFT073
ggugauuauugucgugccgcuacu

SEQ ID NO: 587522 - RNA, 18 nt, Escherichia coli CFT073
ggugauuucaaaauuaaa

SEQ ID NO: 587523 - RNA, 20 nt, Escherichia coli CFT073
ggugcaagccgcggaauugg

SEQ ID NO: 587524 - RNA, 17 nt, Escherichia coli CFT073
ggugcaccgcauccggc

SEQ ID NO: 587525 - RNA, 22 nt, Escherichia coli CFT073
ggugagcacaucagcgcccucu

SEQ ID NO: 587526 - RNA, 16 nt, Escherichia coli CFT073
ggugaaguggcugacc

SEQ ID NO: 587527 - RNA, 17 nt, Escherichia coli CFT073
ggugaaucaagcgccga

SEQ ID NO: 587528 - RNA, 20 nt, Escherichia coli CFT073
aaggugacuggcagaaugaa

SEQ ID NO: 587529 - RNA, 17 nt, Escherichia coli CFT073
aaggugcaucggggaau

SEQ ID NO: 587530 - RNA, 17 nt, Escherichia coli CFT073
aagguuagaaacgcccc

SEQ ID NO: 587531 - RNA, 21 nt, Escherichia coli CFT073
aagguucuuuagcaguucuua

SEQ ID NO: 587532 - RNA, 11 nt, Escherichia coli CFT073
ggcgcgccgau

SEQ ID NO: 587533 - RNA, 19 nt, Escherichia coli CFT073
ggcgcaacauauuccgcac

SEQ ID NO: 587534 - RNA, 12 nt, Escherichia coli CFT073
aaggguaaaaag

SEQ ID NO: 587535 - RNA, 20 nt, Escherichia coli CFT073
aaggguaauauauaacagaa

SEQ ID NO: 587536 - RNA, 19 nt, Escherichia coli CFT073
aagggcuaacgugcagguu

SEQ ID NO: 587537 - RNA, 13 nt, Escherichia coli CFT073
aagggcaucagcc

SEQ ID NO: 587538 - RNA, 19 nt, Escherichia coli CFT073
ggcgcaguugccggaugcg

SEQ ID NO: 587539 - RNA, 13 nt, Escherichia coli CFT073
ggcgcaggcgcuu

SEQ ID NO: 587540 - RNA, 13 nt, Escherichia coli CFT073
ggcggaaacgcug

SEQ ID NO: 587541 - RNA, 14 nt, Escherichia coli CFT073
ggcggaaacgcugg

SEQ ID NO: 587542 - RNA, 14 nt, Escherichia coli CFT073
ggcggaaauaacgc

SEQ ID NO: 587543 - RNA, 22 nt, Escherichia coli CFT073
ggcggaacggcguugcugccag

SEQ ID NO: 587544 - RNA, 17 nt, Escherichia coli CFT073
ggcggauagcgauacag

SEQ ID NO: 587545 - RNA, 15 nt, Escherichia coli CFT073
ggcgguaaaaucauc

SEQ ID NO: 587546 - RNA, 15 nt, Escherichia coli CFT073
ggcggguuaaccagc

SEQ ID NO: 587547 - RNA, 18 nt, Escherichia coli CFT073
ggcgguuuggccagucgc

SEQ ID NO: 587548 - RNA, 20 nt, Escherichia coli CFT073
ggcguaauauaaaauauugc

SEQ ID NO: 587549 - RNA, 23 nt, Escherichia coli CFT073
ggcguaaacgccuuauccgacuu

SEQ ID NO: 587550 - RNA, 15 nt, Escherichia coli CFT073
ggcgguuuuucagcu

SEQ ID NO: 587551 - RNA, 22 nt, Escherichia coli CFT073
ggccgcaugugcccccugcaau

SEQ ID NO: 587552 - RNA, 15 nt, Escherichia coli CFT073
ggccgcgcagguggu

SEQ ID NO: 587553 - RNA, 13 nt, Escherichia coli CFT073
ggccuccugcagc

SEQ ID NO: 587554 - RNA, 21 nt, Escherichia coli CFT073
ggccuacgaucuucuugcaau

SEQ ID NO: 587555 - RNA, 13 nt, Escherichia coli CFT073
aaggcuucgcucu

SEQ ID NO: 587556 - RNA, 16 nt, Escherichia coli CFT073
ggcgacguaccagcgu

SEQ ID NO: 587557 - RNA, 16 nt, Escherichia coli CFT073
aagggagcagacugua

SEQ ID NO: 587558 - RNA, 18 nt, Escherichia coli CFT073
aaggcguucacgccgcau

SEQ ID NO: 587559 - RNA, 20 nt, Escherichia coli CFT073
aaggcguuuacgccgcaucc

SEQ ID NO: 587560 - RNA, 17 nt, Escherichia coli CFT073
aaggcguuugcgucgca

SEQ ID NO: 587561 - RNA, 18 nt, Escherichia coli CFT073
aaggcguuugcgucgcau

SEQ ID NO: 587562 - RNA, 17 nt, Escherichia coli CFT073
aaggcguuugaacugaa

SEQ ID NO: 587563 - RNA, 20 nt, Escherichia coli CFT073
ggcgaaucguauuaucgaca

SEQ ID NO: 587564 - RNA, 20 nt, Escherichia coli CFT073
ggcgacaaaguugaagccga

SEQ ID NO: 587565 - RNA, 22 nt, Escherichia coli CFT073
ggcgacaagcauaacaaaaugc

SEQ ID NO: 587566 - RNA, 13 nt, Escherichia coli CFT073
ggcgacacgcauc

SEQ ID NO: 587567 - RNA, 21 nt, Escherichia coli CFT073
ggcgacgaacaacucgguuaa

SEQ ID NO: 587568 - RNA, 22 nt, Escherichia coli CFT073
ggcgaaaccagcagccaucgca

SEQ ID NO: 587569 - RNA, 19 nt, Escherichia coli CFT073
ggcgaaguucgguaggccg

SEQ ID NO: 587570 - RNA, 21 nt, Escherichia coli CFT073
ggcgaagacaaaaccaacgca

SEQ ID NO: 587571 - RNA, 24 nt, Escherichia coli CFT073
ggcgaacucugacgauucucccac

SEQ ID NO: 587572 - RNA, 18 nt, Escherichia coli CFT073
aaggcguuaugcugcggc

SEQ ID NO: 587573 - RNA, 20 nt, Escherichia coli CFT073
aaggcguucaagccgcaucc

SEQ ID NO: 587574 - RNA, 15 nt, Escherichia coli CFT073
aaggcgucauguaau

SEQ ID NO: 587575 - RNA, 22 nt, Escherichia coli CFT073
aaggcggcucuggcggcgcgau

SEQ ID NO: 587576 - RNA, 18 nt, Escherichia coli CFT073
aaggcgcucgcgccgcau

SEQ ID NO: 587577 - RNA, 16 nt, Escherichia coli CFT073
ggccugaauaacggcg

SEQ ID NO: 587578 - RNA, 21 nt, Escherichia coli CFT073
ggccuuccggguuuucuccaa

SEQ ID NO: 587579 - RNA, 21 nt, Escherichia coli CFT073
ggccuugaacucugaaucgcu

SEQ ID NO: 587580 - RNA, 19 nt, Escherichia coli CFT073
ggccuuccggcacaucgcc

SEQ ID NO: 587581 - RNA, 20 nt, Escherichia coli CFT073
ggacaaucacauccggaucg

SEQ ID NO: 587582 - RNA, 17 nt, Escherichia coli CFT073
ggaauuugcuccgccac

SEQ ID NO: 587583 - RNA, 17 nt, Escherichia coli CFT073
ggaauuuucaccacauu

SEQ ID NO: 587584 - RNA, 23 nt, Escherichia coli CFT073
ggacaaauaaugacucaaacggu

SEQ ID NO: 587585 - RNA, 16 nt, Escherichia coli CFT073
ggacauucuccggcag

SEQ ID NO: 587586 - RNA, 14 nt, Escherichia coli CFT073
ggaccacgcacagc

SEQ ID NO: 587587 - RNA, 16 nt, Escherichia coli CFT073
ggaccacgcacagccc

SEQ ID NO: 587588 - RNA, 20 nt, Escherichia coli CFT073
ggacgauuucacccagcguu

SEQ ID NO: 587589 - RNA, 23 nt, Escherichia coli CFT073
ggaacacggacaauacacgcgug

SEQ ID NO: 587590 - RNA, 13 nt, Escherichia coli CFT073
gcuggcgcauacc

SEQ ID NO: 587591 - RNA, 12 nt, Escherichia coli CFT073
gcuggcgcagcg

SEQ ID NO: 587592 - RNA, 17 nt, Escherichia coli CFT073
gcuggcggaaacggguu

SEQ ID NO: 587593 - RNA, 16 nt, Escherichia coli CFT073
ggaacgggagaaaccc

SEQ ID NO: 587594 - RNA, 23 nt, Escherichia coli CFT073
ggaacgccuaacucuugccagau

SEQ ID NO: 587595 - RNA, 13 nt, Escherichia coli CFT073
ggaacgcgcugca

SEQ ID NO: 587596 - RNA, 14 nt, Escherichia coli CFT073
ggaacgcgcugcac

SEQ ID NO: 587597 - RNA, 20 nt, Escherichia coli CFT073
ggaacgcugacugaaucagg

SEQ ID NO: 587598 - RNA, 23 nt, Escherichia coli CFT073
ggaaccgucguacagucacccgc

SEQ ID NO: 587599 - RNA, 15 nt, Escherichia coli CFT073
ggaaccugacggcgc

SEQ ID NO: 587600 - RNA, 21 nt, Escherichia coli CFT073
ggaacgcacuauacaaccaga

SEQ ID NO: 587601 - RNA, 16 nt, Escherichia coli CFT073
ggaaccacaaccacuu

SEQ ID NO: 587602 - RNA, 17 nt, Escherichia coli CFT073
ggaaccggauuuucacc

SEQ ID NO: 587603 - RNA, 18 nt, Escherichia coli CFT073
ggaaccgcaggcugauaa

SEQ ID NO: 587604 - RNA, 20 nt, Escherichia coli CFT073
ggaauaccacuuucagcaag

SEQ ID NO: 587605 - RNA, 17 nt, Escherichia coli CFT073
ggaaucagaauccggug

SEQ ID NO: 587606 - RNA, 14 nt, Escherichia coli CFT073
ggaaucccaucgca

SEQ ID NO: 587607 - RNA, 18 nt, Escherichia coli CFT073
ggaauaauuucccgccga

SEQ ID NO: 587608 - RNA, 14 nt, Escherichia coli CFT073
ggaauaaaaagcga

SEQ ID NO: 587609 - RNA, 11 nt, Escherichia coli CFT073
ggaauaaacgc

SEQ ID NO: 587610 - RNA, 20 nt, Escherichia coli CFT073
ggaagguuuuaaucgcuauc

SEQ ID NO: 587611 - RNA, 19 nt, Escherichia coli CFT073
ggaagcuuauuuauacggc

SEQ ID NO: 587612 - RNA, 14 nt, Escherichia coli CFT073
ggaacuuccagccu

SEQ ID NO: 587613 - RNA, 23 nt, Escherichia coli CFT073
ggaacuuuuuucauccagcugcc

SEQ ID NO: 587614 - RNA, 18 nt, Escherichia coli CFT073
ggaagaaaacauuuuaaa

SEQ ID NO: 587615 - RNA, 13 nt, Escherichia coli CFT073
ggacuucaugcgc

SEQ ID NO: 587616 - RNA, 14 nt, Escherichia coli CFT073
ggacuuccccugcc

SEQ ID NO: 587617 - RNA, 13 nt, Escherichia coli CFT073
ggagaaacgacgc

SEQ ID NO: 587618 - RNA, 16 nt, Escherichia coli CFT073
ggagaaaauccgccaa

SEQ ID NO: 587619 - RNA, 22 nt, Escherichia coli CFT073
ggagaaaauccgccaaccgcug

SEQ ID NO: 587620 - RNA, 14 nt, Escherichia coli CFT073
ggacuguucauuuu

SEQ ID NO: 587621 - RNA, 19 nt, Escherichia coli CFT073
ggacguugaguuuacgcag

SEQ ID NO: 587622 - RNA, 14 nt, Escherichia coli CFT073
ggacggcucacuuu

SEQ ID NO: 587623 - RNA, 12 nt, Escherichia coli CFT073
ggacgcgucaga

SEQ ID NO: 587624 - RNA, 17 nt, Escherichia coli CFT073
ggagaguugcaccagca

SEQ ID NO: 587625 - RNA, 18 nt, Escherichia coli CFT073
ggagaguuuucaugaaua

SEQ ID NO: 587626 - RNA, 15 nt, Escherichia coli CFT073
ggagauauuccccag

SEQ ID NO: 587627 - RNA, 23 nt, Escherichia coli CFT073
ggagauauugcugcgugucggac

SEQ ID NO: 587628 - RNA, 18 nt, Escherichia coli CFT073
ggagaugggugugcugac

SEQ ID NO: 587629 - RNA, 22 nt, Escherichia coli CFT073
ggagcacggaggcuccgccuga

SEQ ID NO: 587630 - RNA, 14 nt, Escherichia coli CFT073
aaggccaagagcaa

SEQ ID NO: 587631 - RNA, 15 nt, Escherichia coli CFT073
aaggccagguuuucu

SEQ ID NO: 587632 - RNA, 20 nt, Escherichia coli CFT073
ggagggguuagucgaacaga

SEQ ID NO: 587633 - RNA, 15 nt, Escherichia coli CFT073
ggaggcgcugguaau

SEQ ID NO: 587634 - RNA, 12 nt, Escherichia coli CFT073
ggagugcagcac

SEQ ID NO: 587635 - RNA, 15 nt, Escherichia coli CFT073
ggaguugaucgccag

SEQ ID NO: 587636 - RNA, 19 nt, Escherichia coli CFT073
ggagcguccugcucgccac

SEQ ID NO: 587637 - RNA, 15 nt, Escherichia coli CFT073
ggagcguugcgccaa

SEQ ID NO: 587638 - RNA, 21 nt, Escherichia coli CFT073
ggaucgaagacaucaucguga

SEQ ID NO: 587639 - RNA, 23 nt, Escherichia coli CFT073
ggaucccuuuguaagcagggcca

SEQ ID NO: 587640 - RNA, 15 nt, Escherichia coli CFT073
ggaucauuaaccagu

SEQ ID NO: 587641 - RNA, 16 nt, Escherichia coli CFT073
ggaucagcuccggcag

SEQ ID NO: 587642 - RNA, 19 nt, Escherichia coli CFT073
ggaucagaaugcgcucuuc

SEQ ID NO: 587643 - RNA, 15 nt, Escherichia coli CFT073
ggauaaugcgccaga

SEQ ID NO: 587644 - RNA, 18 nt, Escherichia coli CFT073
ggauaaggcguuugaacu

SEQ ID NO: 587645 - RNA, 14 nt, Escherichia coli CFT073
ggauacaacucgcu

SEQ ID NO: 587646 - RNA, 17 nt, Escherichia coli CFT073
ggauauaugucaccagc

SEQ ID NO: 587647 - RNA, 20 nt, Escherichia coli CFT073
ggauauuacugacgccgaca

SEQ ID NO: 587648 - RNA, 17 nt, Escherichia coli CFT073
ggcaaaugcaacauuau

SEQ ID NO: 587649 - RNA, 19 nt, Escherichia coli CFT073
ggcaaauuggcguggcgga

SEQ ID NO: 587650 - RNA, 22 nt, Escherichia coli CFT073
ggcaacaaucgcucacaacaau

SEQ ID NO: 587651 - RNA, 12 nt, Escherichia coli CFT073
ggcaacagcagc

SEQ ID NO: 587652 - RNA, 20 nt, Escherichia coli CFT073
ggcaacguugaccagucaga

SEQ ID NO: 587653 - RNA, 21 nt, Escherichia coli CFT073
ggcaaguaauuguuucaucgu

SEQ ID NO: 587654 - RNA, 22 nt, Escherichia coli CFT073
ggcaaucagcacuacugccaga

SEQ ID NO: 587655 - RNA, 19 nt, Escherichia coli CFT073
ggcaaucacgcccgccaga

SEQ ID NO: 587656 - RNA, 18 nt, Escherichia coli CFT073
ggcaaucauucccagacc

SEQ ID NO: 587657 - RNA, 22 nt, Escherichia coli CFT073
ggcaauacgauccugagcagca

SEQ ID NO: 587658 - RNA, 15 nt, Escherichia coli CFT073
ggcaauacuuugcag

SEQ ID NO: 587659 - RNA, 14 nt, Escherichia coli CFT073
ggcaauaucgcggc

SEQ ID NO: 587660 - RNA, 20 nt, Escherichia coli CFT073
ggcaauccccgccagcacga

SEQ ID NO: 587661 - RNA, 12 nt, Escherichia coli CFT073
ggcaaucgccag

SEQ ID NO: 587662 - RNA, 21 nt, Escherichia coli CFT073
ggcaauucaauuaauucuccg

SEQ ID NO: 587663 - RNA, 22 nt, Escherichia coli CFT073
ggcaauucuuuccguuuucacc

SEQ ID NO: 587664 - RNA, 18 nt, Escherichia coli CFT073
ggcaauugccauaaaaac

SEQ ID NO: 587665 - RNA, 21 nt, Escherichia coli CFT073
ggcacacaaauaauucagccc

SEQ ID NO: 587666 - RNA, 20 nt, Escherichia coli CFT073
ggcacacugccagugucgga

SEQ ID NO: 587667 - RNA, 19 nt, Escherichia coli CFT073
ggcagaaaucaacggcguc

SEQ ID NO: 587668 - RNA, 17 nt, Escherichia coli CFT073
ggcagccagguggcaga

SEQ ID NO: 587669 - RNA, 14 nt, Escherichia coli CFT073
ggcagaacggugcg

SEQ ID NO: 587670 - RNA, 22 nt, Escherichia coli CFT073
ggcagugcuuucauuucagcgu

SEQ ID NO: 587671 - RNA, 15 nt, Escherichia coli CFT073
ggcagugauuuuccc

SEQ ID NO: 587672 - RNA, 21 nt, Escherichia coli CFT073
ggcaguaucggagauaaccac

SEQ ID NO: 587673 - RNA, 17 nt, Escherichia coli CFT073
ggcagcuaaugccaacg

SEQ ID NO: 587674 - RNA, 20 nt, Escherichia coli CFT073
ggcauccagagaucgcguag

SEQ ID NO: 587675 - RNA, 13 nt, Escherichia coli CFT073
ggcaucgcgacag

SEQ ID NO: 587676 - RNA, 13 nt, Escherichia coli CFT073
ggcaucaggcugg

SEQ ID NO: 587677 - RNA, 12 nt, Escherichia coli CFT073
ggcauauagccg

SEQ ID NO: 587678 - RNA, 14 nt, Escherichia coli CFT073
ggcauauuccgcca

SEQ ID NO: 587679 - RNA, 15 nt, Escherichia coli CFT073
ggcauauuccgccac

SEQ ID NO: 587680 - RNA, 20 nt, Escherichia coli CFT073
ggcaucaagaaaacugguua

SEQ ID NO: 587681 - RNA, 17 nt, Escherichia coli CFT073
ggccaccgcccaccaua

SEQ ID NO: 587682 - RNA, 13 nt, Escherichia coli CFT073
ggccagcauugcg

SEQ ID NO: 587683 - RNA, 19 nt, Escherichia coli CFT073
ggccaguuucggacgcggc

SEQ ID NO: 587684 - RNA, 16 nt, Escherichia coli CFT073
ggccaugauuaccagc

SEQ ID NO: 587685 - RNA, 19 nt, Escherichia coli CFT073
cgcgcucaccgcucuucau

SEQ ID NO: 587686 - RNA, 21 nt, Escherichia coli CFT073
cgcgcucauacgaucgcgaau

SEQ ID NO: 587687 - RNA, 16 nt, Escherichia coli CFT073
cgcgcguguugcgcca

SEQ ID NO: 587688 - RNA, 15 nt, Escherichia coli CFT073
cgcgcguuaauuucu

SEQ ID NO: 587689 - RNA, 20 nt, Escherichia coli CFT073
cgcgcguuaauuucuuuuca

SEQ ID NO: 587690 - RNA, 18 nt, Escherichia coli CFT073
cgcgcuccggcacuuaau

SEQ ID NO: 587691 - RNA, 18 nt, Escherichia coli CFT073
cgcgcgcaccguccagcg

SEQ ID NO: 587692 - RNA, 21 nt, Escherichia coli CFT073
cgcgccuucgugcggcugcau

SEQ ID NO: 587693 - RNA, 14 nt, Escherichia coli CFT073
cgcgccugcggcca

SEQ ID NO: 587694 - RNA, 17 nt, Escherichia coli CFT073
cgcgccuuacgggcgua

SEQ ID NO: 587695 - RNA, 21 nt, Escherichia coli CFT073
cgcgcggagcgccugucugca

SEQ ID NO: 587696 - RNA, 21 nt, Escherichia coli CFT073
cgcgcgcugccagaaccgcuu

SEQ ID NO: 587697 - RNA, 20 nt, Escherichia coli CFT073
cgccugcugauaagacgcau

SEQ ID NO: 587698 - RNA, 14 nt, Escherichia coli CFT073
cgcgauacgcagua

SEQ ID NO: 587699 - RNA, 19 nt, Escherichia coli CFT073
cgcgauacgcaguacggca

SEQ ID NO: 587700 - RNA, 20 nt, Escherichia coli CFT073
cgcgauaccacccgcaguga

SEQ ID NO: 587701 - RNA, 22 nt, Escherichia coli CFT073
cgcgauaggccuuaaccgccgc

SEQ ID NO: 587702 - RNA, 19 nt, Escherichia coli CFT073
cgcgauauuccgcaacgcc

SEQ ID NO: 587703 - RNA, 15 nt, Escherichia coli CFT073
cgcgauauucucgcc

SEQ ID NO: 587704 - RNA, 14 nt, Escherichia coli CFT073
cgcgaucccccaga

SEQ ID NO: 587705 - RNA, 21 nt, Escherichia coli CFT073
cgcgcacaugcuggauggcgu

SEQ ID NO: 587706 - RNA, 17 nt, Escherichia coli CFT073
cgcgcaauugccagaca

SEQ ID NO: 587707 - RNA, 15 nt, Escherichia coli CFT073
cgcgcaaucagcacc

SEQ ID NO: 587708 - RNA, 17 nt, Escherichia coli CFT073
cgcgauggaaaacaaca

SEQ ID NO: 587709 - RNA, 21 nt, Escherichia coli CFT073
cgcgauggcuuuccaccugca

SEQ ID NO: 587710 - RNA, 19 nt, Escherichia coli CFT073
cgcgaugaugcgacgcgau

SEQ ID NO: 587711 - RNA, 18 nt, Escherichia coli CFT073
cgcgaucgcgccaccguu

SEQ ID NO: 587712 - RNA, 22 nt, Escherichia coli CFT073
cgcgccggacgcaccuugccaa

SEQ ID NO: 587713 - RNA, 14 nt, Escherichia coli CFT073
cgcgccgccagcca

SEQ ID NO: 587714 - RNA, 23 nt, Escherichia coli CFT073
cgcgccagguggcaaaucgacgc

SEQ ID NO: 587715 - RNA, 17 nt, Escherichia coli CFT073
cgcgccaguaaucagcg

SEQ ID NO: 587716 - RNA, 22 nt, Escherichia coli CFT073
cgcgccaguucaaucauuugca

SEQ ID NO: 587717 - RNA, 19 nt, Escherichia coli CFT073
cgcgccagguauuugcgua

SEQ ID NO: 587718 - RNA, 18 nt, Escherichia coli CFT073
cgcgccagcuucacgcgc

SEQ ID NO: 587719 - RNA, 21 nt, Escherichia coli CFT073
cgcgccaaacucggucacgcg

SEQ ID NO: 587720 - RNA, 13 nt, Escherichia coli CFT073
cgcgcaugcgccu

SEQ ID NO: 587721 - RNA, 14 nt, Escherichia coli CFT073
cgcguaacgccaga

SEQ ID NO: 587722 - RNA, 22 nt, Escherichia coli CFT073
cgcguaaacgugcggcugugcg

SEQ ID NO: 587723 - RNA, 13 nt, Escherichia coli CFT073
cgcgguucgggaa

SEQ ID NO: 587724 - RNA, 19 nt, Escherichia coli CFT073
cgcgguuaugccgccgaca

SEQ ID NO: 587725 - RNA, 15 nt, Escherichia coli CFT073
cgcgguuacgcaccg

SEQ ID NO: 587726 - RNA, 14 nt, Escherichia coli CFT073
cgcggugcgccgua

SEQ ID NO: 587727 - RNA, 23 nt, Escherichia coli CFT073
cgcgguauuacccucaaacgcca

SEQ ID NO: 587728 - RNA, 15 nt, Escherichia coli CFT073
aacagccuuguauua

SEQ ID NO: 587729 - RNA, 18 nt, Escherichia coli CFT073
aacagcgacaccagccau

SEQ ID NO: 587730 - RNA, 16 nt, Escherichia coli CFT073
aacagcgacagauuca

SEQ ID NO: 587731 - RNA, 14 nt, Escherichia coli CFT073
aacagcgaccgcag

SEQ ID NO: 587732 - RNA, 12 nt, Escherichia coli CFT073
aacaggagcacg

SEQ ID NO: 587733 - RNA, 16 nt, Escherichia coli CFT073
aacagcgucgagccau

SEQ ID NO: 587734 - RNA, 16 nt, Escherichia coli CFT073
aacagcgggacaacaa

SEQ ID NO: 587735 - RNA, 14 nt, Escherichia coli CFT073
aacagcucaacgcc

SEQ ID NO: 587736 - RNA, 21 nt, Escherichia coli CFT073
aacagauugcguaacgugaca

SEQ ID NO: 587737 - RNA, 22 nt, Escherichia coli CFT073
aacagauuuugcaggccugaua

SEQ ID NO: 587738 - RNA, 22 nt, Escherichia coli CFT073
cgcggcgauaauacccagcaac

SEQ ID NO: 587739 - RNA, 18 nt, Escherichia coli CFT073
cgcggcgauauccagcgc

SEQ ID NO: 587740 - RNA, 20 nt, Escherichia coli CFT073
cgcggcuaacacuuucgccu

SEQ ID NO: 587741 - RNA, 17 nt, Escherichia coli CFT073
cgcggcuaacuccugau

SEQ ID NO: 587742 - RNA, 21 nt, Escherichia coli CFT073
cgcgggagaucccuaauucuu

SEQ ID NO: 587743 - RNA, 20 nt, Escherichia coli CFT073
aacagcagauccgguucgcc

SEQ ID NO: 587744 - RNA, 17 nt, Escherichia coli CFT073
aacagcagccacggcag

SEQ ID NO: 587745 - RNA, 22 nt, Escherichia coli CFT073
cgcucaguagauccuugcggau

SEQ ID NO: 587746 - RNA, 23 nt, Escherichia coli CFT073
cgcucauauuuaagccugcauca

SEQ ID NO: 587747 - RNA, 12 nt, Escherichia coli CFT073
cgcucaucagcg

SEQ ID NO: 587748 - RNA, 13 nt, Escherichia coli CFT073
cgcucauuuucuu

SEQ ID NO: 587749 - RNA, 22 nt, Escherichia coli CFT073
cgcucaucggcauacagcgaca

SEQ ID NO: 587750 - RNA, 17 nt, Escherichia coli CFT073
cgcuaucguguugcugu

SEQ ID NO: 587751 - RNA, 19 nt, Escherichia coli CFT073
cgcuaugcaacaacuggcg

SEQ ID NO: 587752 - RNA, 16 nt, Escherichia coli CFT073
cgcucaagaacggcaa

SEQ ID NO: 587753 - RNA, 18 nt, Escherichia coli CFT073
cgcucaagaacggcaaua

SEQ ID NO: 587754 - RNA, 20 nt, Escherichia coli CFT073
cgcucaauauaacgaucggc

SEQ ID NO: 587755 - RNA, 16 nt, Escherichia coli CFT073
cgcucaauauauucuu

SEQ ID NO: 587756 - RNA, 14 nt, Escherichia coli CFT073
cgcuauuugcugaa

SEQ ID NO: 587757 - RNA, 16 nt, Escherichia coli CFT073
cgcuacgcuuaucagg

SEQ ID NO: 587758 - RNA, 12 nt, Escherichia coli CFT073
cgcuaucagcgc

SEQ ID NO: 587759 - RNA, 15 nt, Escherichia coli CFT073
cgcuaucagcgccac

SEQ ID NO: 587760 - RNA, 14 nt, Escherichia coli CFT073
cgcuaguacgccaa

SEQ ID NO: 587761 - RNA, 15 nt, Escherichia coli CFT073
cgcuauacagcagcc

SEQ ID NO: 587762 - RNA, 16 nt, Escherichia coli CFT073
cgcguaugcccagcgc

SEQ ID NO: 587763 - RNA, 21 nt, Escherichia coli CFT073
cgcgucaaucacuuucugcgc

SEQ ID NO: 587764 - RNA, 20 nt, Escherichia coli CFT073
cgcguguugcgccaaucgcc

SEQ ID NO: 587765 - RNA, 19 nt, Escherichia coli CFT073
cgcguuaaauccugccaac

SEQ ID NO: 587766 - RNA, 11 nt, Escherichia coli CFT073
cgcguuaagcc

SEQ ID NO: 587767 - RNA, 14 nt, Escherichia coli CFT073
cgcguuacgcccaa

SEQ ID NO: 587768 - RNA, 15 nt, Escherichia coli CFT073
cgcguuacggaucag

SEQ ID NO: 587769 - RNA, 19 nt, Escherichia coli CFT073
cgcguuauuuguugccgga

SEQ ID NO: 587770 - RNA, 22 nt, Escherichia coli CFT073
cgcgucuuaucaggccuacaua

SEQ ID NO: 587771 - RNA, 22 nt, Escherichia coli CFT073
cgcgucuuaucaggccuacgcc

SEQ ID NO: 587772 - RNA, 19 nt, Escherichia coli CFT073
cgcucgccaaagcagugaa

SEQ ID NO: 587773 - RNA, 17 nt, Escherichia coli CFT073
cgcucgagccgcauccg

SEQ ID NO: 587774 - RNA, 18 nt, Escherichia coli CFT073
cgcucgagccgcauccga

SEQ ID NO: 587775 - RNA, 14 nt, Escherichia coli CFT073
cgcucggcaacacc

SEQ ID NO: 587776 - RNA, 20 nt, Escherichia coli CFT073
cgcucgcgguuggcaaucag

SEQ ID NO: 587777 - RNA, 21 nt, Escherichia coli CFT073
cgcucugcuagauaagcaagg

SEQ ID NO: 587778 - RNA, 15 nt, Escherichia coli CFT073
cgcucuggauaauca

SEQ ID NO: 587779 - RNA, 18 nt, Escherichia coli CFT073
cgcugaaacuucaccaac

SEQ ID NO: 587780 - RNA, 21 nt, Escherichia coli CFT073
cgcucugguuuguaggucagg

SEQ ID NO: 587781 - RNA, 15 nt, Escherichia coli CFT073
cgcugacaaacugcg

SEQ ID NO: 587782 - RNA, 17 nt, Escherichia coli CFT073
cgcugacaaacugcgug

SEQ ID NO: 587783 - RNA, 15 nt, Escherichia coli CFT073
cgcucucagcuggcg

SEQ ID NO: 587784 - RNA, 21 nt, Escherichia coli CFT073
cgcucuaaaaucaucacgcgg

SEQ ID NO: 587785 - RNA, 14 nt, Escherichia coli CFT073
cgcucguccgcgag

SEQ ID NO: 587786 - RNA, 22 nt, Escherichia coli CFT073
cgcucggucacugacaccagca

SEQ ID NO: 587787 - RNA, 21 nt, Escherichia coli CFT073
cgccgaccguagcguaaauca

SEQ ID NO: 587788 - RNA, 20 nt, Escherichia coli CFT073
cgccgaccauauagcgcaca

SEQ ID NO: 587789 - RNA, 18 nt, Escherichia coli CFT073
cgcccgucaguucaucca

SEQ ID NO: 587790 - RNA, 20 nt, Escherichia coli CFT073
cgcccguucauccgcuucag

SEQ ID NO: 587791 - RNA, 18 nt, Escherichia coli CFT073
cgcccguuuucuccagcg

SEQ ID NO: 587792 - RNA, 20 nt, Escherichia coli CFT073
cgcccguuuucuccagcgcc

SEQ ID NO: 587793 - RNA, 13 nt, Escherichia coli CFT073
cgcccgugcaucu

SEQ ID NO: 587794 - RNA, 17 nt, Escherichia coli CFT073
cgcccucuaaaauaacg

SEQ ID NO: 587795 - RNA, 15 nt, Escherichia coli CFT073
cgcccugcuccagca

SEQ ID NO: 587796 - RNA, 17 nt, Escherichia coli CFT073
cgcccugcccggagcca

SEQ ID NO: 587797 - RNA, 19 nt, Escherichia coli CFT073
cgcccugcaacaucaccgg

SEQ ID NO: 587798 - RNA, 14 nt, Escherichia coli CFT073
cgcccuuaaucaac

SEQ ID NO: 587799 - RNA, 18 nt, Escherichia coli CFT073
cgcccugggcuucaucca

SEQ ID NO: 587800 - RNA, 23 nt, Escherichia coli CFT073
cgcccugggcuucauccagcagc

SEQ ID NO: 587801 - RNA, 17 nt, Escherichia coli CFT073
cgccgaacgccacgacg

SEQ ID NO: 587802 - RNA, 19 nt, Escherichia coli CFT073
cgccgaaauuucgccgcgc

SEQ ID NO: 587803 - RNA, 21 nt, Escherichia coli CFT073
cgcccgaugcauaauccgccg

SEQ ID NO: 587804 - RNA, 16 nt, Escherichia coli CFT073
cgcccgcuucaucgug

SEQ ID NO: 587805 - RNA, 20 nt, Escherichia coli CFT073
cgccccugcccuuucaacca

SEQ ID NO: 587806 - RNA, 14 nt, Escherichia coli CFT073
cgcccccaucaccg

SEQ ID NO: 587807 - RNA, 11 nt, Escherichia coli CFT073
cgccccagauu

SEQ ID NO: 587808 - RNA, 16 nt, Escherichia coli CFT073
cgcccaugcgauuacg

SEQ ID NO: 587809 - RNA, 18 nt, Escherichia coli CFT073
cgcccaguggaugcgcca

SEQ ID NO: 587810 - RNA, 20 nt, Escherichia coli CFT073
cgcccaucauugcgccgaac

SEQ ID NO: 587811 - RNA, 16 nt, Escherichia coli CFT073
cgcccaucgcgcccgc

SEQ ID NO: 587812 - RNA, 21 nt, Escherichia coli CFT073
cgcccagucccguacccagca

SEQ ID NO: 587813 - RNA, 23 nt, Escherichia coli CFT073
cgcccaggcaaguagcgccagac

SEQ ID NO: 587814 - RNA, 20 nt, Escherichia coli CFT073
cgcccagcguacguaacuuc

SEQ ID NO: 587815 - RNA, 22 nt, Escherichia coli CFT073
cgccaccgcgggcaaucgccag

SEQ ID NO: 587816 - RNA, 14 nt, Escherichia coli CFT073
aacagaucauccau

SEQ ID NO: 587817 - RNA, 23 nt, Escherichia coli CFT073
cgccucaguuucgacaccuucag

SEQ ID NO: 587818 - RNA, 14 nt, Escherichia coli CFT073
cgccucaucaucgc

SEQ ID NO: 587819 - RNA, 18 nt, Escherichia coli CFT073
cgccuauacgcacgcggg

SEQ ID NO: 587820 - RNA, 21 nt, Escherichia coli CFT073
cgccucuucauacaucugcaa

SEQ ID NO: 587821 - RNA, 13 nt, Escherichia coli CFT073
cgccugcccaaua

SEQ ID NO: 587822 - RNA, 19 nt, Escherichia coli CFT073
cgccugccagaugcagcgg

SEQ ID NO: 587823 - RNA, 13 nt, Escherichia coli CFT073
cgccugacgcaau

SEQ ID NO: 587824 - RNA, 14 nt, Escherichia coli CFT073
cgccugacgcaaua

SEQ ID NO: 587825 - RNA, 18 nt, Escherichia coli CFT073
aacacgcugcucauccag

SEQ ID NO: 587826 - RNA, 12 nt, Escherichia coli CFT073
aacacuugcggc

SEQ ID NO: 587827 - RNA, 21 nt, Escherichia coli CFT073
aacacuuucgccugcggcgca

SEQ ID NO: 587828 - RNA, 14 nt, Escherichia coli CFT073
aacagaaacgccau

SEQ ID NO: 587829 - RNA, 18 nt, Escherichia coli CFT073
aacagaagaucaugccga

SEQ ID NO: 587830 - RNA, 16 nt, Escherichia coli CFT073
aacagaccagaaacgc

SEQ ID NO: 587831 - RNA, 15 nt, Escherichia coli CFT073
aacacucacauccag

SEQ ID NO: 587832 - RNA, 17 nt, Escherichia coli CFT073
cgccguuucagccagag

SEQ ID NO: 587833 - RNA, 21 nt, Escherichia coli CFT073
cgccguuuuuacccagcagca

SEQ ID NO: 587834 - RNA, 23 nt, Escherichia coli CFT073
cgccguuuuuuuauagcuuauuc

SEQ ID NO: 587835 - RNA, 16 nt, Escherichia coli CFT073
cgccgggagaucgcgu

SEQ ID NO: 587836 - RNA, 22 nt, Escherichia coli CFT073
cgccggugagcacaucagcgcc

SEQ ID NO: 587837 - RNA, 23 nt, Escherichia coli CFT073
cgccgguggcguuuccagcaguu

SEQ ID NO: 587838 - RNA, 19 nt, Escherichia coli CFT073
cgccgccucagccagaaua

SEQ ID NO: 587839 - RNA, 17 nt, Escherichia coli CFT073
cgccgcgauuaaccguu

SEQ ID NO: 587840 - RNA, 17 nt, Escherichia coli CFT073
cgccgcgcaaauccacg

SEQ ID NO: 587841 - RNA, 19 nt, Escherichia coli CFT073
cgccgauggugcagcagac

SEQ ID NO: 587842 - RNA, 20 nt, Escherichia coli CFT073
cgccgcuuuaaucaccaucg

SEQ ID NO: 587843 - RNA, 14 nt, Escherichia coli CFT073
cgccgcugguggcg

SEQ ID NO: 587844 - RNA, 15 nt, Escherichia coli CFT073
cgccgcugguggcga

SEQ ID NO: 587845 - RNA, 12 nt, Escherichia coli CFT073
cgccgcugguga

SEQ ID NO: 587846 - RNA, 18 nt, Escherichia coli CFT073
cgccgcuaaauaccagcg

SEQ ID NO: 587847 - RNA, 20 nt, Escherichia coli CFT073
cgccgcuaaauaccagcgua

SEQ ID NO: 587848 - RNA, 19 nt, Escherichia coli CFT073
cggcaacaaggcuacgcca

SEQ ID NO: 587849 - RNA, 14 nt, Escherichia coli CFT073
cggcaaccagcacc

SEQ ID NO: 587850 - RNA, 16 nt, Escherichia coli CFT073
cggcaaccagcagcau

SEQ ID NO: 587851 - RNA, 23 nt, Escherichia coli CFT073
cggcaaccgcaacgacuacgcca

SEQ ID NO: 587852 - RNA, 19 nt, Escherichia coli CFT073
cggcaaccacacccacauc

SEQ ID NO: 587853 - RNA, 15 nt, Escherichia coli CFT073
cggcaagaucagcau

SEQ ID NO: 587854 - RNA, 20 nt, Escherichia coli CFT073
cggcaacguugccaguacca

SEQ ID NO: 587855 - RNA, 19 nt, Escherichia coli CFT073
cggcaagcgucgcaucagg

SEQ ID NO: 587856 - RNA, 20 nt, Escherichia coli CFT073
cggcaagcgucgcaucaggc

SEQ ID NO: 587857 - RNA, 22 nt, Escherichia coli CFT073
cggcaaugcgcacggaguaaca

SEQ ID NO: 587858 - RNA, 14 nt, Escherichia coli CFT073
cggcaaucgcgcca

SEQ ID NO: 587859 - RNA, 23 nt, Escherichia coli CFT073
cggcaaucaccgccagcggcguu

SEQ ID NO: 587860 - RNA, 12 nt, Escherichia coli CFT073
cggcaaucacgc

SEQ ID NO: 587861 - RNA, 18 nt, Escherichia coli CFT073
cggcaauacuuugcagau

SEQ ID NO: 587862 - RNA, 15 nt, Escherichia coli CFT073
cggcaccauccgucg

SEQ ID NO: 587863 - RNA, 14 nt, Escherichia coli CFT073
aacagguaucauua

SEQ ID NO: 587864 - RNA, 18 nt, Escherichia coli CFT073
aacagguaucauuaaggc

SEQ ID NO: 587865 - RNA, 19 nt, Escherichia coli CFT073
aacaggugauaauccagau

SEQ ID NO: 587866 - RNA, 19 nt, Escherichia coli CFT073
cggcaccagcaccguguuu

SEQ ID NO: 587867 - RNA, 15 nt, Escherichia coli CFT073
cggcaccacauucug

SEQ ID NO: 587868 - RNA, 21 nt, Escherichia coli CFT073
cggcaccaauguaggccugau

SEQ ID NO: 587869 - RNA, 16 nt, Escherichia coli CFT073
cggcaauuugcgucaa

SEQ ID NO: 587870 - RNA, 21 nt, Escherichia coli CFT073
cggcaauggucccuugcuggu

SEQ ID NO: 587871 - RNA, 15 nt, Escherichia coli CFT073
cggcacagucgcgac

SEQ ID NO: 587872 - RNA, 15 nt, Escherichia coli CFT073
cggaucgacagcaac

SEQ ID NO: 587873 - RNA, 19 nt, Escherichia coli CFT073
cggaucgaccgguucgccu

SEQ ID NO: 587874 - RNA, 13 nt, Escherichia coli CFT073
cggauccagcggu

SEQ ID NO: 587875 - RNA, 13 nt, Escherichia coli CFT073
cggauccacaccu

SEQ ID NO: 587876 - RNA, 13 nt, Escherichia coli CFT073
cggauccagaacu

SEQ ID NO: 587877 - RNA, 15 nt, Escherichia coli CFT073
cggaugcgaugcugg

SEQ ID NO: 587878 - RNA, 17 nt, Escherichia coli CFT073
cggaugaguacagcgca

SEQ ID NO: 587879 - RNA, 15 nt, Escherichia coli CFT073
cggaugauuaccgga

SEQ ID NO: 587880 - RNA, 16 nt, Escherichia coli CFT073
cggaugauuaccggag

SEQ ID NO: 587881 - RNA, 14 nt, Escherichia coli CFT073
cggaugauuccgca

SEQ ID NO: 587882 - RNA, 19 nt, Escherichia coli CFT073
cggaugacguuucgcgcca

SEQ ID NO: 587883 - RNA, 22 nt, Escherichia coli CFT073
cggaugaggcguuaacagcgca

SEQ ID NO: 587884 - RNA, 16 nt, Escherichia coli CFT073
cggaugacccagcgcc

SEQ ID NO: 587885 - RNA, 17 nt, Escherichia coli CFT073
cggaugacccagcgcca

SEQ ID NO: 587886 - RNA, 17 nt, Escherichia coli CFT073
cggaugacccagcgcga

SEQ ID NO: 587887 - RNA, 22 nt, Escherichia coli CFT073
cggaucggcucaacaucgcgcu

SEQ ID NO: 587888 - RNA, 17 nt, Escherichia coli CFT073
cggauuuuucagcgcca

SEQ ID NO: 587889 - RNA, 13 nt, Escherichia coli CFT073
cggauuucggcgg

SEQ ID NO: 587890 - RNA, 15 nt, Escherichia coli CFT073
cggcaaaaccaucaa

SEQ ID NO: 587891 - RNA, 21 nt, Escherichia coli CFT073
cggcaaaaccaucaauccacu

SEQ ID NO: 587892 - RNA, 18 nt, Escherichia coli CFT073
cggcaaaacccugcgcca

SEQ ID NO: 587893 - RNA, 23 nt, Escherichia coli CFT073
cggcaaaacguuauuuugcuaau

SEQ ID NO: 587894 - RNA, 16 nt, Escherichia coli CFT073
cggcaaagcgcaucag

SEQ ID NO: 587895 - RNA, 18 nt, Escherichia coli CFT073
cggcaaagcgcugaauau

SEQ ID NO: 587896 - RNA, 19 nt, Escherichia coli CFT073
cggcaaaggcuucguucau

SEQ ID NO: 587897 - RNA, 16 nt, Escherichia coli CFT073
cggcaaacuucgucaa

SEQ ID NO: 587898 - RNA, 14 nt, Escherichia coli CFT073
cggcaaacugcuga

SEQ ID NO: 587899 - RNA, 19 nt, Escherichia coli CFT073
cggauugaccaacaguugc

SEQ ID NO: 587900 - RNA, 22 nt, Escherichia coli CFT073
cggauugaccaacaguugccca

SEQ ID NO: 587901 - RNA, 19 nt, Escherichia coli CFT073
cggauucacgccaaccagc

SEQ ID NO: 587902 - RNA, 14 nt, Escherichia coli CFT073
cggaugggcugaug

SEQ ID NO: 587903 - RNA, 21 nt, Escherichia coli CFT073
cggauggguaauaccauccgg

SEQ ID NO: 587904 - RNA, 19 nt, Escherichia coli CFT073
cggauggcaacagcagcca

SEQ ID NO: 587905 - RNA, 16 nt, Escherichia coli CFT073
cggaugcggggcgagc

SEQ ID NO: 587906 - RNA, 21 nt, Escherichia coli CFT073
cggaugcggagaaagucguag

SEQ ID NO: 587907 - RNA, 17 nt, Escherichia coli CFT073
cggaugcggcauaaacg

SEQ ID NO: 587908 - RNA, 13 nt, Escherichia coli CFT073
cggaugcggcgcg

SEQ ID NO: 587909 - RNA, 18 nt, Escherichia coli CFT073
cggacuucuuugucguac

SEQ ID NO: 587910 - RNA, 16 nt, Escherichia coli CFT073
cggagaaaauccgcca

SEQ ID NO: 587911 - RNA, 19 nt, Escherichia coli CFT073
cggagaacuuaaucaucgc

SEQ ID NO: 587912 - RNA, 22 nt, Escherichia coli CFT073
cggagaaggcguucacgccgca

SEQ ID NO: 587913 - RNA, 20 nt, Escherichia coli CFT073
cggagcugcagccaguugcu

SEQ ID NO: 587914 - RNA, 22 nt, Escherichia coli CFT073
cggagcuucacccgcagcacgg

SEQ ID NO: 587915 - RNA, 21 nt, Escherichia coli CFT073
cggagcucccccucuuccgga

SEQ ID NO: 587916 - RNA, 18 nt, Escherichia coli CFT073
cggaggccugauaaaacg

SEQ ID NO: 587917 - RNA, 20 nt, Escherichia coli CFT073
cggaggccugauaaaacgcg

SEQ ID NO: 587918 - RNA, 22 nt, Escherichia coli CFT073
cggaggaaacuugccuccggca

SEQ ID NO: 587919 - RNA, 15 nt, Escherichia coli CFT073
cggaggagugcgcca

SEQ ID NO: 587920 - RNA, 21 nt, Escherichia coli CFT073
cggagcccuacaaaccaucug

SEQ ID NO: 587921 - RNA, 13 nt, Escherichia coli CFT073
cggauaaggcguu

SEQ ID NO: 587922 - RNA, 17 nt, Escherichia coli CFT073
cggauaaggcguucacg

SEQ ID NO: 587923 - RNA, 23 nt, Escherichia coli CFT073
cggauaaggcguucacgccgcau

SEQ ID NO: 587924 - RNA, 23 nt, Escherichia coli CFT073
cggauacggucaguuuucgcccc

SEQ ID NO: 587925 - RNA, 15 nt, Escherichia coli CFT073
cggauaucggcagcg

SEQ ID NO: 587926 - RNA, 14 nt, Escherichia coli CFT073
cggauaugcagcag

SEQ ID NO: 587927 - RNA, 14 nt, Escherichia coli CFT073
cggauaucgaggau

SEQ ID NO: 587928 - RNA, 22 nt, Escherichia coli CFT073
cggauaaaugacucacguuacu

SEQ ID NO: 587929 - RNA, 21 nt, Escherichia coli CFT073
cggauaagacgcgccagcgcc

SEQ ID NO: 587930 - RNA, 21 nt, Escherichia coli CFT073
cggauaagacgcgccagcguc

SEQ ID NO: 587931 - RNA, 20 nt, Escherichia coli CFT073
cggauaagacgcgucagcgc

SEQ ID NO: 587932 - RNA, 22 nt, Escherichia coli CFT073
cggauaagacgcgucagcgccg

SEQ ID NO: 587933 - RNA, 19 nt, Escherichia coli CFT073
cggauaaacgucuucgcca

SEQ ID NO: 587934 - RNA, 16 nt, Escherichia coli CFT073
cggacgcgcaggagcg

SEQ ID NO: 587935 - RNA, 15 nt, Escherichia coli CFT073
cggacggcguccugc

SEQ ID NO: 587936 - RNA, 15 nt, Escherichia coli CFT073
cggacgucuguuuau

SEQ ID NO: 587937 - RNA, 14 nt, Escherichia coli CFT073
cggacguucgccca

SEQ ID NO: 587938 - RNA, 23 nt, Escherichia coli CFT073
cggacguuugccaugcauaucca

SEQ ID NO: 587939 - RNA, 22 nt, Escherichia coli CFT073
cggaccaucuuccagcugcacg

SEQ ID NO: 587940 - RNA, 16 nt, Escherichia coli CFT073
cggaccagcgggcgcu

SEQ ID NO: 587941 - RNA, 14 nt, Escherichia coli CFT073
cggaccgcauucac

SEQ ID NO: 587942 - RNA, 16 nt, Escherichia coli CFT073
cggacaguacugccgg

SEQ ID NO: 587943 - RNA, 21 nt, Escherichia coli CFT073
cgcugagccgacgccagcguu

SEQ ID NO: 587944 - RNA, 21 nt, Escherichia coli CFT073
cgcugagcacgcuuagcuuug

SEQ ID NO: 587945 - RNA, 20 nt, Escherichia coli CFT073
cggaccaauaaacgccaggu

SEQ ID NO: 587946 - RNA, 16 nt, Escherichia coli CFT073
cgcugagauccgucag

SEQ ID NO: 587947 - RNA, 21 nt, Escherichia coli CFT073
cgcugaccgcuuuguccgucg

SEQ ID NO: 587948 - RNA, 24 nt, Escherichia coli CFT073
aacagucgcccgaccaucgccagc

SEQ ID NO: 587949 - RNA, 18 nt, Escherichia coli CFT073
aacagucgcucggcgaca

SEQ ID NO: 587950 - RNA, 19 nt, Escherichia coli CFT073
cggcacgaccaggaacgcc

SEQ ID NO: 587951 - RNA, 20 nt, Escherichia coli CFT073
cggcagcuuuaccggcuucg

SEQ ID NO: 587952 - RNA, 15 nt, Escherichia coli CFT073
cggcaggcacaaaac

SEQ ID NO: 587953 - RNA, 21 nt, Escherichia coli CFT073
cggcaucauacacgccgccua

SEQ ID NO: 587954 - RNA, 21 nt, Escherichia coli CFT073
cggcaucaggcaacaucgcca

SEQ ID NO: 587955 - RNA, 22 nt, Escherichia coli CFT073
cggcaucaaaccauucccggcu

SEQ ID NO: 587956 - RNA, 15 nt, Escherichia coli CFT073
cggcaucgccaacca

SEQ ID NO: 587957 - RNA, 14 nt, Escherichia coli CFT073
cggcauuaacgaaa

SEQ ID NO: 587958 - RNA, 16 nt, Escherichia coli CFT073
cggcauuguucugcaa

SEQ ID NO: 587959 - RNA, 22 nt, Escherichia coli CFT073
cggcauuguuuuuaucccggca

SEQ ID NO: 587960 - RNA, 17 nt, Escherichia coli CFT073
cggcauuuauuccgcac

SEQ ID NO: 587961 - RNA, 19 nt, Escherichia coli CFT073
cggcauuuccagaccuaaa

SEQ ID NO: 587962 - RNA, 13 nt, Escherichia coli CFT073
cggccacagcgcc

SEQ ID NO: 587963 - RNA, 15 nt, Escherichia coli CFT073
cggccacgaucccgg

SEQ ID NO: 587964 - RNA, 20 nt, Escherichia coli CFT073
cggccaugaccgcuccgcca

SEQ ID NO: 587965 - RNA, 15 nt, Escherichia coli CFT073
cggccaucacggauc

SEQ ID NO: 587966 - RNA, 15 nt, Escherichia coli CFT073
cggccauauccagcc

SEQ ID NO: 587967 - RNA, 18 nt, Escherichia coli CFT073
cggccaguugcgcaacgu

SEQ ID NO: 587968 - RNA, 15 nt, Escherichia coli CFT073
cggccaguuucggac

SEQ ID NO: 587969 - RNA, 20 nt, Escherichia coli CFT073
cggccaguguuuaucaucuc

SEQ ID NO: 587970 - RNA, 16 nt, Escherichia coli CFT073
cggccuggcucguuau

SEQ ID NO: 587971 - RNA, 20 nt, Escherichia coli CFT073
cggccugauauaucaccuuc

SEQ ID NO: 587972 - RNA, 20 nt, Escherichia coli CFT073
cggccuaccaugaucugcaa

SEQ ID NO: 587973 - RNA, 16 nt, Escherichia coli CFT073
cgggaaacuuccagcu

SEQ ID NO: 587974 - RNA, 14 nt, Escherichia coli CFT073
cgggaaauagcuua

SEQ ID NO: 587975 - RNA, 21 nt, Escherichia coli CFT073
cggcuuuugguccgcaauaca

SEQ ID NO: 587976 - RNA, 17 nt, Escherichia coli CFT073
cggcuuuuuuacgccug

SEQ ID NO: 587977 - RNA, 20 nt, Escherichia coli CFT073
cgggaaaacauacacauuuu

SEQ ID NO: 587978 - RNA, 15 nt, Escherichia coli CFT073
cgggaaaccaacucc

SEQ ID NO: 587979 - RNA, 22 nt, Escherichia coli CFT073
cggcuucaaucaacauauuucu

SEQ ID NO: 587980 - RNA, 22 nt, Escherichia coli CFT073
cggcuucagacaccguuuccau

SEQ ID NO: 587981 - RNA, 22 nt, Escherichia coli CFT073
cggcuuauucauaucaaacgcc

SEQ ID NO: 587982 - RNA, 14 nt, Escherichia coli CFT073
cggcuguugccgua

SEQ ID NO: 587983 - RNA, 19 nt, Escherichia coli CFT073
cggcuguuccggcacaccu

SEQ ID NO: 587984 - RNA, 16 nt, Escherichia coli CFT073
cggcugcuaauauuuu

SEQ ID NO: 587985 - RNA, 14 nt, Escherichia coli CFT073
cggcugggaaauca

SEQ ID NO: 587986 - RNA, 14 nt, Escherichia coli CFT073
cggcuggcgcaaua

SEQ ID NO: 587987 - RNA, 18 nt, Escherichia coli CFT073
cggcugaauacgcagcgu

SEQ ID NO: 587988 - RNA, 20 nt, Escherichia coli CFT073
cggcugaauacgcagcguca

SEQ ID NO: 587989 - RNA, 21 nt, Escherichia coli CFT073
cggcugaauacgcagcgucau

SEQ ID NO: 587990 - RNA, 17 nt, Escherichia coli CFT073
cggcugaauauccugac

SEQ ID NO: 587991 - RNA, 19 nt, Escherichia coli CFT073
cggcgugccaaauauucag

SEQ ID NO: 587992 - RNA, 17 nt, Escherichia coli CFT073
cgggaauauuuaccgga

SEQ ID NO: 587993 - RNA, 18 nt, Escherichia coli CFT073
cgggaguugaucgccaga

SEQ ID NO: 587994 - RNA, 19 nt, Escherichia coli CFT073
cgggaguugaucgccagag

SEQ ID NO: 587995 - RNA, 21 nt, Escherichia coli CFT073
cgggaguuucagcggcguguu

SEQ ID NO: 587996 - RNA, 14 nt, Escherichia coli CFT073
cgggauaaacgaaa

SEQ ID NO: 587997 - RNA, 13 nt, Escherichia coli CFT073
aacauucgagaau

SEQ ID NO: 587998 - RNA, 21 nt, Escherichia coli CFT073
aacauuacuaauuaauaauau

SEQ ID NO: 587999 - RNA, 13 nt, Escherichia coli CFT073
aacauuagcgcau

SEQ ID NO: 588000 - RNA, 22 nt, Escherichia coli CFT073
cgggauugagauuucaccaauu

SEQ ID NO: 588001 - RNA, 16 nt, Escherichia coli CFT073
cgggaugguguucacu

SEQ ID NO: 588002 - RNA, 20 nt, Escherichia coli CFT073
aacaugacaccaagcaccau

SEQ ID NO: 588003 - RNA, 15 nt, Escherichia coli CFT073
aacaugcuauuacgc

SEQ ID NO: 588004 - RNA, 15 nt, Escherichia coli CFT073
cgggaucacaucaua

SEQ ID NO: 588005 - RNA, 22 nt, Escherichia coli CFT073
cgggauauaugucaccagcauu

SEQ ID NO: 588006 - RNA, 14 nt, Escherichia coli CFT073
cgggcaaucagcgu

SEQ ID NO: 588007 - RNA, 17 nt, Escherichia coli CFT073
cgggcaaucaucaccgg

SEQ ID NO: 588008 - RNA, 17 nt, Escherichia coli CFT073
cgggcaacguuccagca

SEQ ID NO: 588009 - RNA, 13 nt, Escherichia coli CFT073
cgggcauauuucc

SEQ ID NO: 588010 - RNA, 15 nt, Escherichia coli CFT073
cgggcauauuuccga

SEQ ID NO: 588011 - RNA, 19 nt, Escherichia coli CFT073
cgggcuccauggaaucacc

SEQ ID NO: 588012 - RNA, 23 nt, Escherichia coli CFT073
cgggcuaaucgucaucagcgcca

SEQ ID NO: 588013 - RNA, 23 nt, Escherichia coli CFT073
cgggcuuuuuugaucaaaauucc

SEQ ID NO: 588014 - RNA, 20 nt, Escherichia coli CFT073
cgggcugguuuucagcgaaa

SEQ ID NO: 588015 - RNA, 21 nt, Escherichia coli CFT073
cgggcugggaucugauuuucu

SEQ ID NO: 588016 - RNA, 16 nt, Escherichia coli CFT073
cgggcugcuguaccca

SEQ ID NO: 588017 - RNA, 15 nt, Escherichia coli CFT073
cgggcgcuauccugg

SEQ ID NO: 588018 - RNA, 15 nt, Escherichia coli CFT073
cggguaagggacgga

SEQ ID NO: 588019 - RNA, 21 nt, Escherichia coli CFT073
cggguaaaaccauuuugcugg

SEQ ID NO: 588020 - RNA, 19 nt, Escherichia coli CFT073
aaccaccgaagaucaccac

SEQ ID NO: 588021 - RNA, 14 nt, Escherichia coli CFT073
cgggggguugccgc

SEQ ID NO: 588022 - RNA, 13 nt, Escherichia coli CFT073
cggggccagcgca

SEQ ID NO: 588023 - RNA, 14 nt, Escherichia coli CFT073
cggggccagcgcau

SEQ ID NO: 588024 - RNA, 15 nt, Escherichia coli CFT073
cgggcuuuaaucacc

SEQ ID NO: 588025 - RNA, 18 nt, Escherichia coli CFT073
cggccuuuaacgccacga

SEQ ID NO: 588026 - RNA, 17 nt, Escherichia coli CFT073
cggcgaucgccugcugg

SEQ ID NO: 588027 - RNA, 22 nt, Escherichia coli CFT073
cggcgcaccaaagcguuuugcc

SEQ ID NO: 588028 - RNA, 20 nt, Escherichia coli CFT073
cggcgaugguuuucaucccg

SEQ ID NO: 588029 - RNA, 17 nt, Escherichia coli CFT073
cggcggcacagccagcg

SEQ ID NO: 588030 - RNA, 19 nt, Escherichia coli CFT073
cggcggaauuaaccgccca

SEQ ID NO: 588031 - RNA, 18 nt, Escherichia coli CFT073
cggcggcacagccagcgc

SEQ ID NO: 588032 - RNA, 23 nt, Escherichia coli CFT073
cggcgcuuuugcaucguucgcgu

SEQ ID NO: 588033 - RNA, 19 nt, Escherichia coli CFT073
cggcgcuuuuuagcgccgu

SEQ ID NO: 588034 - RNA, 20 nt, Escherichia coli CFT073
cggcgcuuucagcacgacau

SEQ ID NO: 588035 - RNA, 23 nt, Escherichia coli CFT073
cggcgcugcaauugaucgcgcaa

SEQ ID NO: 588036 - RNA, 16 nt, Escherichia coli CFT073
cggcgcgagcgccuua

SEQ ID NO: 588037 - RNA, 20 nt, Escherichia coli CFT073
cggcggcuuauucccuucuu

SEQ ID NO: 588038 - RNA, 20 nt, Escherichia coli CFT073
cggcggcgaccuuccaucuu

SEQ ID NO: 588039 - RNA, 19 nt, Escherichia coli CFT073
cggcggugagaagaccgcc

SEQ ID NO: 588040 - RNA, 18 nt, Escherichia coli CFT073
cggcggguuaaccagcac

SEQ ID NO: 588041 - RNA, 23 nt, Escherichia coli CFT073
cggcggguuaaccagcaccagcu

SEQ ID NO: 588042 - RNA, 14 nt, Escherichia coli CFT073
cggcggugucgcca

SEQ ID NO: 588043 - RNA, 17 nt, Escherichia coli CFT073
cggcgucgauugcucaa

SEQ ID NO: 588044 - RNA, 13 nt, Escherichia coli CFT073
cgcauccggcaau

SEQ ID NO: 588045 - RNA, 21 nt, Escherichia coli CFT073
cgcauccgacaaaaugauguc

SEQ ID NO: 588046 - RNA, 16 nt, Escherichia coli CFT073
cgcauccgacaucaac

SEQ ID NO: 588047 - RNA, 19 nt, Escherichia coli CFT073
cgcauccgacaucaacgcc

SEQ ID NO: 588048 - RNA, 18 nt, Escherichia coli CFT073
cgcauccgguauuaguua

SEQ ID NO: 588049 - RNA, 14 nt, Escherichia coli CFT073
cgcauccucauaac

SEQ ID NO: 588050 - RNA, 23 nt, Escherichia coli CFT073
cgcauccggcaaugauauuuauu

SEQ ID NO: 588051 - RNA, 22 nt, Escherichia coli CFT073
cgcauccggcacgucgcguuaa

SEQ ID NO: 588052 - RNA, 16 nt, Escherichia coli CFT073
cgcauccggcauaaua

SEQ ID NO: 588053 - RNA, 14 nt, Escherichia coli CFT073
cgcauccggcauga

SEQ ID NO: 588054 - RNA, 18 nt, Escherichia coli CFT073
cgcauccggcauuaucac

SEQ ID NO: 588055 - RNA, 18 nt, Escherichia coli CFT073
cgcauccggcauuguuca

SEQ ID NO: 588056 - RNA, 12 nt, Escherichia coli CFT073
cgcauccggcga

SEQ ID NO: 588057 - RNA, 19 nt, Escherichia coli CFT073
cgcauccggcguaaacaac

SEQ ID NO: 588058 - RNA, 14 nt, Escherichia coli CFT073
cgcauccgccagca

SEQ ID NO: 588059 - RNA, 16 nt, Escherichia coli CFT073
cgcaucgcuuuugcgg

SEQ ID NO: 588060 - RNA, 21 nt, Escherichia coli CFT073
cgcaucgcgguuaugccgccg

SEQ ID NO: 588061 - RNA, 14 nt, Escherichia coli CFT073
cgcaucgcccagcc

SEQ ID NO: 588062 - RNA, 18 nt, Escherichia coli CFT073
cgcaucgcgcaccagcgg

SEQ ID NO: 588063 - RNA, 15 nt, Escherichia coli CFT073
cgcaugaugucugca

SEQ ID NO: 588064 - RNA, 21 nt, Escherichia coli CFT073
cgcaugacaauccuucccugc

SEQ ID NO: 588065 - RNA, 15 nt, Escherichia coli CFT073
cgcaugccagcgccc

SEQ ID NO: 588066 - RNA, 16 nt, Escherichia coli CFT073
cgcaugguagaaaucu

SEQ ID NO: 588067 - RNA, 22 nt, Escherichia coli CFT073
cgcauuauggugaagaagccac

SEQ ID NO: 588068 - RNA, 19 nt, Escherichia coli CFT073
cgcauuaucaaggcaguug

SEQ ID NO: 588069 - RNA, 18 nt, Escherichia coli CFT073
cgcauuaaauaccaagcc

SEQ ID NO: 588070 - RNA, 18 nt, Escherichia coli CFT073
cgcauuaacucacuggcg

SEQ ID NO: 588071 - RNA, 24 nt, Escherichia coli CFT073
cgcaugugcccccugcaauaaaca

SEQ ID NO: 588072 - RNA, 23 nt, Escherichia coli CFT073
cgccaauuucaucgcugaauuuc

SEQ ID NO: 588073 - RNA, 21 nt, Escherichia coli CFT073
cgccaauuugucgccaucguu

SEQ ID NO: 588074 - RNA, 21 nt, Escherichia coli CFT073
cgccaacgccugcggcugaua

SEQ ID NO: 588075 - RNA, 20 nt, Escherichia coli CFT073
cgccaaccaggaugauauuc

SEQ ID NO: 588076 - RNA, 13 nt, Escherichia coli CFT073
cgccaaccagcug

SEQ ID NO: 588077 - RNA, 15 nt, Escherichia coli CFT073
cgccacauugcugca

SEQ ID NO: 588078 - RNA, 24 nt, Escherichia coli CFT073
cgccacauugugggauuccagcgc

SEQ ID NO: 588079 - RNA, 13 nt, Escherichia coli CFT073
cgccacagcagcc

SEQ ID NO: 588080 - RNA, 22 nt, Escherichia coli CFT073
cgccacacucucgcgcagcggu

SEQ ID NO: 588081 - RNA, 17 nt, Escherichia coli CFT073
cgcauacauaacagaau

SEQ ID NO: 588082 - RNA, 18 nt, Escherichia coli CFT073
cgcauacauaacagaaua

SEQ ID NO: 588083 - RNA, 22 nt, Escherichia coli CFT073
cgcauaaggugcgaccuacaca

SEQ ID NO: 588084 - RNA, 23 nt, Escherichia coli CFT073
cgcauaaaagauaaacggcagga

SEQ ID NO: 588085 - RNA, 15 nt, Escherichia coli CFT073
cgcauaccuaccugc

SEQ ID NO: 588086 - RNA, 15 nt, Escherichia coli CFT073
cgcauagacagccac

SEQ ID NO: 588087 - RNA, 14 nt, Escherichia coli CFT073
cgcauagccuccgg

SEQ ID NO: 588088 - RNA, 21 nt, Escherichia coli CFT073
cgcaucaggcaaugggcaaac

SEQ ID NO: 588089 - RNA, 11 nt, Escherichia coli CFT073
cgcaucauccg

SEQ ID NO: 588090 - RNA, 23 nt, Escherichia coli CFT073
cgcaucaguuucauuucgcgaaa

SEQ ID NO: 588091 - RNA, 20 nt, Escherichia coli CFT073
cgcaucaauugcguucuguc

SEQ ID NO: 588092 - RNA, 15 nt, Escherichia coli CFT073
cgcaucacgacagca

SEQ ID NO: 588093 - RNA, 14 nt, Escherichia coli CFT073
cgcaucagcagaua

SEQ ID NO: 588094 - RNA, 13 nt, Escherichia coli CFT073
cgcaucagcaucg

SEQ ID NO: 588095 - RNA, 19 nt, Escherichia coli CFT073
cgcauauugccaucacggc

SEQ ID NO: 588096 - RNA, 22 nt, Escherichia coli CFT073
cgcaucaaucuuuuucaugcua

SEQ ID NO: 588097 - RNA, 12 nt, Escherichia coli CFT073
cgcaucaccccu

SEQ ID NO: 588098 - RNA, 13 nt, Escherichia coli CFT073
cgcaguugcugac

SEQ ID NO: 588099 - RNA, 17 nt, Escherichia coli CFT073
cgcaguggauagacgca

SEQ ID NO: 588100 - RNA, 20 nt, Escherichia coli CFT073
cgcaguuguucggcgcugaa

SEQ ID NO: 588101 - RNA, 21 nt, Escherichia coli CFT073
cgcagugcugcaccaacauca

SEQ ID NO: 588102 - RNA, 21 nt, Escherichia coli CFT073
cgcagugccugccaugccaaa

SEQ ID NO: 588103 - RNA, 20 nt, Escherichia coli CFT073
cgcagugaaauuucugccuc

SEQ ID NO: 588104 - RNA, 17 nt, Escherichia coli CFT073
cgcagugauugccgcga

SEQ ID NO: 588105 - RNA, 16 nt, Escherichia coli CFT073
cgcagucgggugcugc

SEQ ID NO: 588106 - RNA, 14 nt, Escherichia coli CFT073
cgcaguaaacgcca

SEQ ID NO: 588107 - RNA, 22 nt, Escherichia coli CFT073
cgcaggauaaccuuccaccguu

SEQ ID NO: 588108 - RNA, 21 nt, Escherichia coli CFT073
cgcaggcaagccuugcagcca

SEQ ID NO: 588109 - RNA, 19 nt, Escherichia coli CFT073
cgcaggucguuauucgcca

SEQ ID NO: 588110 - RNA, 14 nt, Escherichia coli CFT073
cgcaggucggauaa

SEQ ID NO: 588111 - RNA, 20 nt, Escherichia coli CFT073
cgcaggugacgcuggcagca

SEQ ID NO: 588112 - RNA, 21 nt, Escherichia coli CFT073
cgcaggugcgugcgcccauca

SEQ ID NO: 588113 - RNA, 15 nt, Escherichia coli CFT073
cgcagggauauuuca

SEQ ID NO: 588114 - RNA, 21 nt, Escherichia coli CFT073
cgcaggcuguuaccccugcgg

SEQ ID NO: 588115 - RNA, 13 nt, Escherichia coli CFT073
cgcaggccgccca

SEQ ID NO: 588116 - RNA, 22 nt, Escherichia coli CFT073
cgcaggcaucuuuuucaaugca

SEQ ID NO: 588117 - RNA, 18 nt, Escherichia coli CFT073
cgcaaauacugacuggcg

SEQ ID NO: 588118 - RNA, 23 nt, Escherichia coli CFT073
cgcaagcccccaguaaucgggca

SEQ ID NO: 588119 - RNA, 22 nt, Escherichia coli CFT073
cgcaacgguucugcugccgcua

SEQ ID NO: 588120 - RNA, 16 nt, Escherichia coli CFT073
cgcaacguaucaucgc

SEQ ID NO: 588121 - RNA, 22 nt, Escherichia coli CFT073
cgcaacuuauuggcaaucgcgg

SEQ ID NO: 588122 - RNA, 23 nt, Escherichia coli CFT073
cgauuuauuuuucuggcgcggcg

SEQ ID NO: 588123 - RNA, 21 nt, Escherichia coli CFT073
cgauuucaaccacucacgaua

SEQ ID NO: 588124 - RNA, 17 nt, Escherichia coli CFT073
cgauuucacccagcguu

SEQ ID NO: 588125 - RNA, 19 nt, Escherichia coli CFT073
cgauggcccgcuugccaga

SEQ ID NO: 588126 - RNA, 14 nt, Escherichia coli CFT073
cgauuuucaaaaua

SEQ ID NO: 588127 - RNA, 17 nt, Escherichia coli CFT073
cgauuuugcaauaaugg

SEQ ID NO: 588128 - RNA, 12 nt, Escherichia coli CFT073
cgauuugccgga

SEQ ID NO: 588129 - RNA, 23 nt, Escherichia coli CFT073
cgaugcucuguguaggccggaua

SEQ ID NO: 588130 - RNA, 16 nt, Escherichia coli CFT073
cgcaauaaccaucagc

SEQ ID NO: 588131 - RNA, 19 nt, Escherichia coli CFT073
cgcaaugccgcauacauaa

SEQ ID NO: 588132 - RNA, 20 nt, Escherichia coli CFT073
cgcaauaucauucgguugcc

SEQ ID NO: 588133 - RNA, 21 nt, Escherichia coli CFT073
cgcaauagugauguucuggcg

SEQ ID NO: 588134 - RNA, 19 nt, Escherichia coli CFT073
cgcaauauguuuccgcgaa

SEQ ID NO: 588135 - RNA, 15 nt, Escherichia coli CFT073
cgcaaucgcgccgga

SEQ ID NO: 588136 - RNA, 15 nt, Escherichia coli CFT073
cgcaaucgacaaugu

SEQ ID NO: 588137 - RNA, 13 nt, Escherichia coli CFT073
cgcacaaccgccg

SEQ ID NO: 588138 - RNA, 21 nt, Escherichia coli CFT073
cgcaauuuauugaauuugcag

SEQ ID NO: 588139 - RNA, 16 nt, Escherichia coli CFT073
cgcaaugguguacuca

SEQ ID NO: 588140 - RNA, 18 nt, Escherichia coli CFT073
cgcaauucgcgucggcgu

SEQ ID NO: 588141 - RNA, 16 nt, Escherichia coli CFT073
cgcacaaacgccaccu

SEQ ID NO: 588142 - RNA, 13 nt, Escherichia coli CFT073
cgcacaagcguca

SEQ ID NO: 588143 - RNA, 16 nt, Escherichia coli CFT073
cgcacagcaguugcag

SEQ ID NO: 588144 - RNA, 15 nt, Escherichia coli CFT073
cgcacacgcgcugag

SEQ ID NO: 588145 - RNA, 17 nt, Escherichia coli CFT073
cgcacagguugcacgga

SEQ ID NO: 588146 - RNA, 15 nt, Escherichia coli CFT073
cgcacgggcaguuaa

SEQ ID NO: 588147 - RNA, 15 nt, Escherichia coli CFT073
cgcacuauuuaccgc

SEQ ID NO: 588148 - RNA, 18 nt, Escherichia coli CFT073
cgcacucuacucccugcu

SEQ ID NO: 588149 - RNA, 21 nt, Escherichia coli CFT073
cgcacucuacucccugcugau

SEQ ID NO: 588150 - RNA, 18 nt, Escherichia coli CFT073
cgcagcaacaucacgcug

SEQ ID NO: 588151 - RNA, 15 nt, Escherichia coli CFT073
cgcagaguuuccagg

SEQ ID NO: 588152 - RNA, 15 nt, Escherichia coli CFT073
cgcagaucauccggc

SEQ ID NO: 588153 - RNA, 16 nt, Escherichia coli CFT073
cgcacugcaggcugau

SEQ ID NO: 588154 - RNA, 15 nt, Escherichia coli CFT073
cgcagccagcgcacc

SEQ ID NO: 588155 - RNA, 20 nt, Escherichia coli CFT073
cgcagcacgacucuccccug

SEQ ID NO: 588156 - RNA, 19 nt, Escherichia coli CFT073
cgcagcaaguucagcguca

SEQ ID NO: 588157 - RNA, 20 nt, Escherichia coli CFT073
cgauccugauacagaccgcg

SEQ ID NO: 588158 - RNA, 22 nt, Escherichia coli CFT073
cgauccuggacgcagaauggcg

SEQ ID NO: 588159 - RNA, 21 nt, Escherichia coli CFT073
cgauccgcgucauugacgcug

SEQ ID NO: 588160 - RNA, 21 nt, Escherichia coli CFT073
cgaucccgguuaacugcaugu

SEQ ID NO: 588161 - RNA, 13 nt, Escherichia coli CFT073
cgaucauuaacac

SEQ ID NO: 588162 - RNA, 20 nt, Escherichia coli CFT073
cgaucauuaacaccacgcca

SEQ ID NO: 588163 - RNA, 22 nt, Escherichia coli CFT073
cgaucauggucugcgccgcauu

SEQ ID NO: 588164 - RNA, 19 nt, Escherichia coli CFT073
cgaucaucgacaguaccag

SEQ ID NO: 588165 - RNA, 15 nt, Escherichia coli CFT073
cgaucauauccagca

SEQ ID NO: 588166 - RNA, 18 nt, Escherichia coli CFT073
cgaucauauccagcaucg

SEQ ID NO: 588167 - RNA, 15 nt, Escherichia coli CFT073
cgauccagugauucc

SEQ ID NO: 588168 - RNA, 17 nt, Escherichia coli CFT073
cgauccaccaccgcaaa

SEQ ID NO: 588169 - RNA, 15 nt, Escherichia coli CFT073
cgaucgccugcugga

SEQ ID NO: 588170 - RNA, 17 nt, Escherichia coli CFT073
cgaucggcaucgggcca

SEQ ID NO: 588171 - RNA, 14 nt, Escherichia coli CFT073
cgaucgcugaugaa

SEQ ID NO: 588172 - RNA, 17 nt, Escherichia coli CFT073
cgaucgcgguaacagau

SEQ ID NO: 588173 - RNA, 18 nt, Escherichia coli CFT073
cgaucgcgccaaucagcg

SEQ ID NO: 588174 - RNA, 22 nt, Escherichia coli CFT073
cgaucgcgccaaucagcgcagc

SEQ ID NO: 588175 - RNA, 14 nt, Escherichia coli CFT073
cgaugcgcaacgca

SEQ ID NO: 588176 - RNA, 17 nt, Escherichia coli CFT073
cgaugccucaucacaaa

SEQ ID NO: 588177 - RNA, 16 nt, Escherichia coli CFT073
cgaucgugauagcgca

SEQ ID NO: 588178 - RNA, 23 nt, Escherichia coli CFT073
cgaucggugaugccaaucggcgg

SEQ ID NO: 588179 - RNA, 16 nt, Escherichia coli CFT073
cgaucucgccagagag

SEQ ID NO: 588180 - RNA, 15 nt, Escherichia coli CFT073
cgaugaccgccacgg

SEQ ID NO: 588181 - RNA, 20 nt, Escherichia coli CFT073
cgaugacagaaucagcagcg

SEQ ID NO: 588182 - RNA, 18 nt, Escherichia coli CFT073
cgaugaagucgaucagac

SEQ ID NO: 588183 - RNA, 16 nt, Escherichia coli CFT073
cgaucucggucaccag

SEQ ID NO: 588184 - RNA, 20 nt, Escherichia coli CFT073
cgaucucuuuauuugauucg

SEQ ID NO: 588185 - RNA, 14 nt, Escherichia coli CFT073
cgaguaucguuggc

SEQ ID NO: 588186 - RNA, 16 nt, Escherichia coli CFT073
cgaguagcaaccggau

SEQ ID NO: 588187 - RNA, 23 nt, Escherichia coli CFT073
cgaguagcguucuguuucuggca

SEQ ID NO: 588188 - RNA, 18 nt, Escherichia coli CFT073
cgaggggaccgaucgcgc

SEQ ID NO: 588189 - RNA, 17 nt, Escherichia coli CFT073
cgagggcgauauccuga

SEQ ID NO: 588190 - RNA, 23 nt, Escherichia coli CFT073
cgagcuucaauaucaucauccgc

SEQ ID NO: 588191 - RNA, 14 nt, Escherichia coli CFT073
cgauacugccgccc

SEQ ID NO: 588192 - RNA, 14 nt, Escherichia coli CFT073
cgauacggugcaca

SEQ ID NO: 588193 - RNA, 18 nt, Escherichia coli CFT073
cgauaauacccagcaacg

SEQ ID NO: 588194 - RNA, 21 nt, Escherichia coli CFT073
cgauaaccugccgcgccugcg

SEQ ID NO: 588195 - RNA, 19 nt, Escherichia coli CFT073
cgauaauauucggcguaau

SEQ ID NO: 588196 - RNA, 23 nt, Escherichia coli CFT073
cgauaaucaacgcgccgccaacc

SEQ ID NO: 588197 - RNA, 12 nt, Escherichia coli CFT073
cgauaaugaugu

SEQ ID NO: 588198 - RNA, 17 nt, Escherichia coli CFT073
cgauaauguuaaccugc

SEQ ID NO: 588199 - RNA, 14 nt, Escherichia coli CFT073
cgauacaccagaug

SEQ ID NO: 588200 - RNA, 19 nt, Escherichia coli CFT073
cgauaaccaucccuucacc

SEQ ID NO: 588201 - RNA, 22 nt, Escherichia coli CFT073
cgauagcgcaccaaccacugcu

SEQ ID NO: 588202 - RNA, 13 nt, Escherichia coli CFT073
cgauagcccagac

SEQ ID NO: 588203 - RNA, 20 nt, Escherichia coli CFT073
cgauaguagagauccuggcg

SEQ ID NO: 588204 - RNA, 18 nt, Escherichia coli CFT073
cgauaguggucgauguac

SEQ ID NO: 588205 - RNA, 19 nt, Escherichia coli CFT073
cgauaguggaacaaagaaa

SEQ ID NO: 588206 - RNA, 15 nt, Escherichia coli CFT073
cgauaggccuuaacc

SEQ ID NO: 588207 - RNA, 18 nt, Escherichia coli CFT073
cgauaggcuuccgccauc

SEQ ID NO: 588208 - RNA, 18 nt, Escherichia coli CFT073
cgauauagaccaucggcg

SEQ ID NO: 588209 - RNA, 23 nt, Escherichia coli CFT073
cgauaggggggauugccgcgaga

SEQ ID NO: 588210 - RNA, 19 nt, Escherichia coli CFT073
cgauauaaggguugcugac

SEQ ID NO: 588211 - RNA, 19 nt, Escherichia coli CFT073
cgaucaagagauccgcacu

SEQ ID NO: 588212 - RNA, 14 nt, Escherichia coli CFT073
cgaucacguaauaa

SEQ ID NO: 588213 - RNA, 15 nt, Escherichia coli CFT073
cgaucagacgaucgc

SEQ ID NO: 588214 - RNA, 18 nt, Escherichia coli CFT073
cgaucagacgaucgcgca

SEQ ID NO: 588215 - RNA, 21 nt, Escherichia coli CFT073
cgaucaccgcacggcgaguau

SEQ ID NO: 588216 - RNA, 23 nt, Escherichia coli CFT073
cgaucaccgcagaaaguugcgga

SEQ ID NO: 588217 - RNA, 14 nt, Escherichia coli CFT073
cgaucagccauacc

SEQ ID NO: 588218 - RNA, 23 nt, Escherichia coli CFT073
ccuguuuucaccggcacgcguug

SEQ ID NO: 588219 - RNA, 20 nt, Escherichia coli CFT073
ccuuaccaccuuacuuacac

SEQ ID NO: 588220 - RNA, 17 nt, Escherichia coli CFT073
ccuuauccgaccuacac

SEQ ID NO: 588221 - RNA, 19 nt, Escherichia coli CFT073
ccuuauauaaaacacugag

SEQ ID NO: 588222 - RNA, 22 nt, Escherichia coli CFT073
ccuuauggugucuaugcauaga

SEQ ID NO: 588223 - RNA, 13 nt, Escherichia coli CFT073
ccuguuaauucuc

SEQ ID NO: 588224 - RNA, 14 nt, Escherichia coli CFT073
ccuguucgccgccg

SEQ ID NO: 588225 - RNA, 21 nt, Escherichia coli CFT073
ccuguugcacaauacgcccgg

SEQ ID NO: 588226 - RNA, 15 nt, Escherichia coli CFT073
ccuguugaugccagu

SEQ ID NO: 588227 - RNA, 15 nt, Escherichia coli CFT073
ccuguugcgcuacgu

SEQ ID NO: 588228 - RNA, 15 nt, Escherichia coli CFT073
ccugugacagcagcg

SEQ ID NO: 588229 - RNA, 22 nt, Escherichia coli CFT073
ccugucuggauuuacugcaugg

SEQ ID NO: 588230 - RNA, 15 nt, Escherichia coli CFT073
ccuucauauuccuga

SEQ ID NO: 588231 - RNA, 17 nt, Escherichia coli CFT073
ccuucauacgacgacgg

SEQ ID NO: 588232 - RNA, 13 nt, Escherichia coli CFT073
ccuuccagcuucg

SEQ ID NO: 588233 - RNA, 23 nt, Escherichia coli CFT073
ccuucagguuuuucagcugccca

SEQ ID NO: 588234 - RNA, 22 nt, Escherichia coli CFT073
ccuucgcggaauuucagaaaac

SEQ ID NO: 588235 - RNA, 18 nt, Escherichia coli CFT073
ccuucgcccugcgucgca

SEQ ID NO: 588236 - RNA, 21 nt, Escherichia coli CFT073
ccuuccgccagucguuucgcc

SEQ ID NO: 588237 - RNA, 16 nt, Escherichia coli CFT073
ccuuccgguuucaaau

SEQ ID NO: 588238 - RNA, 16 nt, Escherichia coli CFT073
ccuuccugaacggucg

SEQ ID NO: 588239 - RNA, 16 nt, Escherichia coli CFT073
ccuucguacugugcgc

SEQ ID NO: 588240 - RNA, 14 nt, Escherichia coli CFT073
ccuucuugucggua

SEQ ID NO: 588241 - RNA, 20 nt, Escherichia coli CFT073
ccuugaacucugaaucgcua

SEQ ID NO: 588242 - RNA, 13 nt, Escherichia coli CFT073
ccuugugcugcgc

SEQ ID NO: 588243 - RNA, 18 nt, Escherichia coli CFT073
ccuugcucuucgcguaau

SEQ ID NO: 588244 - RNA, 13 nt, Escherichia coli CFT073
ccuugcggcggug

SEQ ID NO: 588245 - RNA, 14 nt, Escherichia coli CFT073
ccuugcagacgauc

SEQ ID NO: 588246 - RNA, 19 nt, Escherichia coli CFT073
ccuugcggaucggcuggcg

SEQ ID NO: 588247 - RNA, 19 nt, Escherichia coli CFT073
cgaaagggcgucgauaucc

SEQ ID NO: 588248 - RNA, 16 nt, Escherichia coli CFT073
cgaaagcacuguucgc

SEQ ID NO: 588249 - RNA, 22 nt, Escherichia coli CFT073
cgaaagcacuguucgccgcagc

SEQ ID NO: 588250 - RNA, 15 nt, Escherichia coli CFT073
cgaaacuugcgugau

SEQ ID NO: 588251 - RNA, 17 nt, Escherichia coli CFT073
cgaaacugcguggcgaa

SEQ ID NO: 588252 - RNA, 12 nt, Escherichia coli CFT073
cgaaaccacagu

SEQ ID NO: 588253 - RNA, 17 nt, Escherichia coli CFT073
cgaaaccagcagccauc

SEQ ID NO: 588254 - RNA, 17 nt, Escherichia coli CFT073
cgaaaccuucagcaucg

SEQ ID NO: 588255 - RNA, 19 nt, Escherichia coli CFT073
cgaaacgaaagucccgaua

SEQ ID NO: 588256 - RNA, 22 nt, Escherichia coli CFT073
ccuuuaaucuuagacaucaaaa

SEQ ID NO: 588257 - RNA, 20 nt, Escherichia coli CFT073
ccuuuacuggccuggcgaua

SEQ ID NO: 588258 - RNA, 15 nt, Escherichia coli CFT073
ccuuuacuucaccau

SEQ ID NO: 588259 - RNA, 21 nt, Escherichia coli CFT073
ccuuuaccagacgggcauuuc

SEQ ID NO: 588260 - RNA, 15 nt, Escherichia coli CFT073
ccuuuacgaagaaau

SEQ ID NO: 588261 - RNA, 23 nt, Escherichia coli CFT073
ccuuucccuuacccucuccccag

SEQ ID NO: 588262 - RNA, 14 nt, Escherichia coli CFT073
ccuuuccagcaauc

SEQ ID NO: 588263 - RNA, 19 nt, Escherichia coli CFT073
ccuuuguaaccugcuggcg

SEQ ID NO: 588264 - RNA, 19 nt, Escherichia coli CFT073
ccuuuguaggccagauaag

SEQ ID NO: 588265 - RNA, 18 nt, Escherichia coli CFT073
ccuuugucgggcaggcuu

SEQ ID NO: 588266 - RNA, 12 nt, Escherichia coli CFT073
ccuuuuucacau

SEQ ID NO: 588267 - RNA, 13 nt, Escherichia coli CFT073
cgaaaaaugaaua

SEQ ID NO: 588268 - RNA, 16 nt, Escherichia coli CFT073
ccuuuuuucgccgcag

SEQ ID NO: 588269 - RNA, 20 nt, Escherichia coli CFT073
cgaaaaugccccagcguucg

SEQ ID NO: 588270 - RNA, 16 nt, Escherichia coli CFT073
cgaaaaucacgcugcc

SEQ ID NO: 588271 - RNA, 20 nt, Escherichia coli CFT073
cgaaaacgauguuugcugcg

SEQ ID NO: 588272 - RNA, 18 nt, Escherichia coli CFT073
cgaagaauacgccccaga

SEQ ID NO: 588273 - RNA, 16 nt, Escherichia coli CFT073
cgaacucugacgauuc

SEQ ID NO: 588274 - RNA, 14 nt, Escherichia coli CFT073
cgaacgcugacaaa

SEQ ID NO: 588275 - RNA, 12 nt, Escherichia coli CFT073
cgaacgggugau

SEQ ID NO: 588276 - RNA, 15 nt, Escherichia coli CFT073
cgaagcggucgagaa

SEQ ID NO: 588277 - RNA, 15 nt, Escherichia coli CFT073
cgaaguaaccgcauc

SEQ ID NO: 588278 - RNA, 23 nt, Escherichia coli CFT073
cgaaggugcauugaaggcaauug

SEQ ID NO: 588279 - RNA, 22 nt, Escherichia coli CFT073
cgaagcugguguaacugcgcca

SEQ ID NO: 588280 - RNA, 21 nt, Escherichia coli CFT073
cgaaucgcguugccaguuuuu

SEQ ID NO: 588281 - RNA, 13 nt, Escherichia coli CFT073
cgaaucggcgaac

SEQ ID NO: 588282 - RNA, 17 nt, Escherichia coli CFT073
cgaaugaagcagaagcc

SEQ ID NO: 588283 - RNA, 16 nt, Escherichia coli CFT073
cgaauagaacauaaug

SEQ ID NO: 588284 - RNA, 19 nt, Escherichia coli CFT073
cgaaguucuuccggcagcc

SEQ ID NO: 588285 - RNA, 19 nt, Escherichia coli CFT073
cgaauaagaauaugaacaa

SEQ ID NO: 588286 - RNA, 13 nt, Escherichia coli CFT073
cgaauaauccagc

SEQ ID NO: 588287 - RNA, 14 nt, Escherichia coli CFT073
cgaauaaucccggc

SEQ ID NO: 588288 - RNA, 22 nt, Escherichia coli CFT073
cgaaguucauccauaccacagg

SEQ ID NO: 588289 - RNA, 15 nt, Escherichia coli CFT073
cgaacgccgccagua

SEQ ID NO: 588290 - RNA, 16 nt, Escherichia coli CFT073
cgaaccaucggcuuug

SEQ ID NO: 588291 - RNA, 17 nt, Escherichia coli CFT073
cgaaccaaacagcgcca

SEQ ID NO: 588292 - RNA, 23 nt, Escherichia coli CFT073
cgaaccaaaguagauaaucgcuu

SEQ ID NO: 588293 - RNA, 21 nt, Escherichia coli CFT073
cgaaccagaccagcaauaaaa

SEQ ID NO: 588294 - RNA, 15 nt, Escherichia coli CFT073
cgaacauauucgaca

SEQ ID NO: 588295 - RNA, 19 nt, Escherichia coli CFT073
cgaacaaggcaauuaaaaa

SEQ ID NO: 588296 - RNA, 17 nt, Escherichia coli CFT073
cgaacaauaucgccagc

SEQ ID NO: 588297 - RNA, 20 nt, Escherichia coli CFT073
cgaacaauaucgccagcuug

SEQ ID NO: 588298 - RNA, 15 nt, Escherichia coli CFT073
cgaaaucgccauucc

SEQ ID NO: 588299 - RNA, 12 nt, Escherichia coli CFT073
cgaaaucgcccu

SEQ ID NO: 588300 - RNA, 15 nt, Escherichia coli CFT073
cgaaauccccccggu

SEQ ID NO: 588301 - RNA, 20 nt, Escherichia coli CFT073
cgaaaucuuuuuacugccgc

SEQ ID NO: 588302 - RNA, 18 nt, Escherichia coli CFT073
cgaaauaacugaauaaua

SEQ ID NO: 588303 - RNA, 22 nt, Escherichia coli CFT073
cgaaauacaaguccccgcuucg

SEQ ID NO: 588304 - RNA, 19 nt, Escherichia coli CFT073
cgaacagcgucgcaucagg

SEQ ID NO: 588305 - RNA, 19 nt, Escherichia coli CFT073
cgaacagauugaagauaga

SEQ ID NO: 588306 - RNA, 14 nt, Escherichia coli CFT073
cgacgcugucgcgu

SEQ ID NO: 588307 - RNA, 15 nt, Escherichia coli CFT073
cgacgcuugaugcgu

SEQ ID NO: 588308 - RNA, 23 nt, Escherichia coli CFT073
cgacgcuugccgcgucuuaucag

SEQ ID NO: 588309 - RNA, 14 nt, Escherichia coli CFT073
cgacgcuggcgcgu

SEQ ID NO: 588310 - RNA, 23 nt, Escherichia coli CFT073
cgacgcugguugcgucuuaucag

SEQ ID NO: 588311 - RNA, 18 nt, Escherichia coli CFT073
cgacgccagcguucaaac

SEQ ID NO: 588312 - RNA, 12 nt, Escherichia coli CFT073
cgacggcauaag

SEQ ID NO: 588313 - RNA, 20 nt, Escherichia coli CFT073
cgacggcauaagaaacacac

SEQ ID NO: 588314 - RNA, 12 nt, Escherichia coli CFT073
cgacgggcuaau

SEQ ID NO: 588315 - RNA, 17 nt, Escherichia coli CFT073
cgacgguaaaccacgcc

SEQ ID NO: 588316 - RNA, 18 nt, Escherichia coli CFT073
cgacgguaaaccacgcca

SEQ ID NO: 588317 - RNA, 18 nt, Escherichia coli CFT073
cgacgggccugcaggugu

SEQ ID NO: 588318 - RNA, 14 nt, Escherichia coli CFT073
cgagagaagcgcgu

SEQ ID NO: 588319 - RNA, 15 nt, Escherichia coli CFT073
cgagacuuauuaaag

SEQ ID NO: 588320 - RNA, 17 nt, Escherichia coli CFT073
cgagaauaaaacaagca

SEQ ID NO: 588321 - RNA, 18 nt, Escherichia coli CFT073
cgagaagccgaccagcac

SEQ ID NO: 588322 - RNA, 15 nt, Escherichia coli CFT073
cgacugucuuccugc

SEQ ID NO: 588323 - RNA, 21 nt, Escherichia coli CFT073
cgacuggcugaacaguuuacc

SEQ ID NO: 588324 - RNA, 23 nt, Escherichia coli CFT073
cgagcacaaagccgugccagaug

SEQ ID NO: 588325 - RNA, 16 nt, Escherichia coli CFT073
cgagagccuucggcaa

SEQ ID NO: 588326 - RNA, 20 nt, Escherichia coli CFT073
cgagauauccacauuaacga

SEQ ID NO: 588327 - RNA, 19 nt, Escherichia coli CFT073
cgagauauuucaccagcgc

SEQ ID NO: 588328 - RNA, 23 nt, Escherichia coli CFT073
aacacaauuuguggcccuugcgc

SEQ ID NO: 588329 - RNA, 20 nt, Escherichia coli CFT073
aacacaccguaauugccaga

SEQ ID NO: 588330 - RNA, 14 nt, Escherichia coli CFT073
cgacgucagcagau

SEQ ID NO: 588331 - RNA, 17 nt, Escherichia coli CFT073
cgacucggugcgcccgc

SEQ ID NO: 588332 - RNA, 19 nt, Escherichia coli CFT073
cgacucggugcgcccgcca

SEQ ID NO: 588333 - RNA, 16 nt, Escherichia coli CFT073
cgacugaaccagcgcc

SEQ ID NO: 588334 - RNA, 21 nt, Escherichia coli CFT073
cgacugaaaggucaucaucac

SEQ ID NO: 588335 - RNA, 12 nt, Escherichia coli CFT073
cgacugaugaag

SEQ ID NO: 588336 - RNA, 15 nt, Escherichia coli CFT073
cgacucaaaucacgc

SEQ ID NO: 588337 - RNA, 18 nt, Escherichia coli CFT073
cgacucaagcguugcgga

SEQ ID NO: 588338 - RNA, 16 nt, Escherichia coli CFT073
cgacguuuaccgcauc

SEQ ID NO: 588339 - RNA, 17 nt, Escherichia coli CFT073
cgacuaccacguaacga

SEQ ID NO: 588340 - RNA, 14 nt, Escherichia coli CFT073
cgacguugcuucuc

SEQ ID NO: 588341 - RNA, 17 nt, Escherichia coli CFT073
cgaauugcuuccaguaa

SEQ ID NO: 588342 - RNA, 15 nt, Escherichia coli CFT073
cgaaugcaggcgcgc

SEQ ID NO: 588343 - RNA, 22 nt, Escherichia coli CFT073
cgacaaagcccgaugcgcgacc

SEQ ID NO: 588344 - RNA, 19 nt, Escherichia coli CFT073
cgacaaaugcgccgccaaa

SEQ ID NO: 588345 - RNA, 16 nt, Escherichia coli CFT073
cgacaaaaacccugcc

SEQ ID NO: 588346 - RNA, 18 nt, Escherichia coli CFT073
cgacaaaaacccugccgu

SEQ ID NO: 588347 - RNA, 13 nt, Escherichia coli CFT073
cgaauuuccugcc

SEQ ID NO: 588348 - RNA, 19 nt, Escherichia coli CFT073
cgacaaacgccggauggca

SEQ ID NO: 588349 - RNA, 18 nt, Escherichia coli CFT073
cgacauccaugcacugca

SEQ ID NO: 588350 - RNA, 14 nt, Escherichia coli CFT073
cgacauccgccagc

SEQ ID NO: 588351 - RNA, 13 nt, Escherichia coli CFT073
cgacaucgcccgg

SEQ ID NO: 588352 - RNA, 18 nt, Escherichia coli CFT073
cgacauagccaucccuaa

SEQ ID NO: 588353 - RNA, 20 nt, Escherichia coli CFT073
cgaccaaucacacaaccaug

SEQ ID NO: 588354 - RNA, 22 nt, Escherichia coli CFT073
cgaccaaucacacaaccaugca

SEQ ID NO: 588355 - RNA, 23 nt, Escherichia coli CFT073
cgaccaauuacacacaacacauc

SEQ ID NO: 588356 - RNA, 12 nt, Escherichia coli CFT073
cgaccaaagaau

SEQ ID NO: 588357 - RNA, 24 nt, Escherichia coli CFT073
cgacauuuuuaugaugcacuucag

SEQ ID NO: 588358 - RNA, 14 nt, Escherichia coli CFT073
cgaccagcgccgca

SEQ ID NO: 588359 - RNA, 13 nt, Escherichia coli CFT073
cgacccacgcccc

SEQ ID NO: 588360 - RNA, 17 nt, Escherichia coli CFT073
cgaccagaaaugcagcu

SEQ ID NO: 588361 - RNA, 18 nt, Escherichia coli CFT073
cgaccacuucaugcccca

SEQ ID NO: 588362 - RNA, 23 nt, Escherichia coli CFT073
cgaccagaauaucguauccgguu

SEQ ID NO: 588363 - RNA, 14 nt, Escherichia coli CFT073
cgacgauaccgccg

SEQ ID NO: 588364 - RNA, 18 nt, Escherichia coli CFT073
cgacgauaccgccgcaca

SEQ ID NO: 588365 - RNA, 16 nt, Escherichia coli CFT073
cgacgauacgcccgga

SEQ ID NO: 588366 - RNA, 12 nt, Escherichia coli CFT073
cgacgaaguuga

SEQ ID NO: 588367 - RNA, 18 nt, Escherichia coli CFT073
cgaccuucugaauaauga

SEQ ID NO: 588368 - RNA, 22 nt, Escherichia coli CFT073
cgaccguagcguaaaucaucgg

SEQ ID NO: 588369 - RNA, 22 nt, Escherichia coli CFT073
cgaccgccuucguacugugcgc

SEQ ID NO: 588370 - RNA, 16 nt, Escherichia coli CFT073
ccgauaaaugccacca

SEQ ID NO: 588371 - RNA, 14 nt, Escherichia coli CFT073
ccgauaaccgcaaa

SEQ ID NO: 588372 - RNA, 22 nt, Escherichia coli CFT073
ccgauaaccgcaaaaccaacgc

SEQ ID NO: 588373 - RNA, 18 nt, Escherichia coli CFT073
ccgaguagcucaccagca

SEQ ID NO: 588374 - RNA, 17 nt, Escherichia coli CFT073
ccgagggaagcaauaag

SEQ ID NO: 588375 - RNA, 13 nt, Escherichia coli CFT073
ccgaggcaaugcc

SEQ ID NO: 588376 - RNA, 18 nt, Escherichia coli CFT073
ccgaggauacagccgaag

SEQ ID NO: 588377 - RNA, 12 nt, Escherichia coli CFT073
ccgaacaagaaa

SEQ ID NO: 588378 - RNA, 14 nt, Escherichia coli CFT073
ccgaugaucaaaaa

SEQ ID NO: 588379 - RNA, 12 nt, Escherichia coli CFT073
ccgaugccagca

SEQ ID NO: 588380 - RNA, 18 nt, Escherichia coli CFT073
ccgaugcccucaauaucu

SEQ ID NO: 588381 - RNA, 13 nt, Escherichia coli CFT073
ccgauggcgauuu

SEQ ID NO: 588382 - RNA, 20 nt, Escherichia coli CFT073
ccgauggcaaaagugauauu

SEQ ID NO: 588383 - RNA, 17 nt, Escherichia coli CFT073
ccgauuacucagcaacu

SEQ ID NO: 588384 - RNA, 13 nt, Escherichia coli CFT073
ccgauuaaucagu

SEQ ID NO: 588385 - RNA, 22 nt, Escherichia coli CFT073
ccgauuaauuccccugccagaa

SEQ ID NO: 588386 - RNA, 13 nt, Escherichia coli CFT073
ccgaucgccagca

SEQ ID NO: 588387 - RNA, 20 nt, Escherichia coli CFT073
ccgaucgccagcagggcaaa

SEQ ID NO: 588388 - RNA, 15 nt, Escherichia coli CFT073
ccgauccuggacgca

SEQ ID NO: 588389 - RNA, 13 nt, Escherichia coli CFT073
ccgauccggcacc

SEQ ID NO: 588390 - RNA, 17 nt, Escherichia coli CFT073
ccgauaucgcuggcaga

SEQ ID NO: 588391 - RNA, 14 nt, Escherichia coli CFT073
ccgauauaaaaaau

SEQ ID NO: 588392 - RNA, 13 nt, Escherichia coli CFT073
ccgaucaaggcau

SEQ ID NO: 588393 - RNA, 13 nt, Escherichia coli CFT073
ccgauacgcauaa

SEQ ID NO: 588394 - RNA, 22 nt, Escherichia coli CFT073
ccgauacgcauaaacaucuucc

SEQ ID NO: 588395 - RNA, 16 nt, Escherichia coli CFT073
ccgcaaaucgccgaga

SEQ ID NO: 588396 - RNA, 20 nt, Escherichia coli CFT073
ccgcaaacucaucgccgcca

SEQ ID NO: 588397 - RNA, 23 nt, Escherichia coli CFT073
ccgcaaaccagacaacagucaac

SEQ ID NO: 588398 - RNA, 20 nt, Escherichia coli CFT073
ccgauuuugccgguuugcgc

SEQ ID NO: 588399 - RNA, 19 nt, Escherichia coli CFT073
ccgauuguacuuuaaaaua

SEQ ID NO: 588400 - RNA, 15 nt, Escherichia coli CFT073
ccgcaacgucaguga

SEQ ID NO: 588401 - RNA, 13 nt, Escherichia coli CFT073
ccgcaaucgcggc

SEQ ID NO: 588402 - RNA, 18 nt, Escherichia coli CFT073
ccgcaccaacgcaaaaaa

SEQ ID NO: 588403 - RNA, 20 nt, Escherichia coli CFT073
ccgcacaaagcgguuuguga

SEQ ID NO: 588404 - RNA, 14 nt, Escherichia coli CFT073
ccgcacccgccaga

SEQ ID NO: 588405 - RNA, 17 nt, Escherichia coli CFT073
ccgcagccaucaccacg

SEQ ID NO: 588406 - RNA, 13 nt, Escherichia coli CFT073
ccgcagagaucgc

SEQ ID NO: 588407 - RNA, 22 nt, Escherichia coli CFT073
ccgcagacaccgugcacuucug

SEQ ID NO: 588408 - RNA, 16 nt, Escherichia coli CFT073
ccgcacuuacagcaac

SEQ ID NO: 588409 - RNA, 19 nt, Escherichia coli CFT073
ccgccaaccagcgcgccgu

SEQ ID NO: 588410 - RNA, 19 nt, Escherichia coli CFT073
ccgccaaccgcugauugcu

SEQ ID NO: 588411 - RNA, 18 nt, Escherichia coli CFT073
ccgcauggaaccaguuca

SEQ ID NO: 588412 - RNA, 20 nt, Escherichia coli CFT073
ccgcagcguccagcgccugg

SEQ ID NO: 588413 - RNA, 16 nt, Escherichia coli CFT073
ccgccaaucgccacgc

SEQ ID NO: 588414 - RNA, 18 nt, Escherichia coli CFT073
ccgccaaucgccacgcca

SEQ ID NO: 588415 - RNA, 14 nt, Escherichia coli CFT073
ccgccaaucgcccg

SEQ ID NO: 588416 - RNA, 20 nt, Escherichia coli CFT073
ccgccaccggcuuucgcuuc

SEQ ID NO: 588417 - RNA, 15 nt, Escherichia coli CFT073
ccgccacagcagccu

SEQ ID NO: 588418 - RNA, 16 nt, Escherichia coli CFT073
ccgccacacucucgcg

SEQ ID NO: 588419 - RNA, 18 nt, Escherichia coli CFT073
ccgccacuacggcgguga

SEQ ID NO: 588420 - RNA, 21 nt, Escherichia coli CFT073
ccgccaugccgacggguucuu

SEQ ID NO: 588421 - RNA, 20 nt, Escherichia coli CFT073
ccgccauuaaacgcaguaaa

SEQ ID NO: 588422 - RNA, 19 nt, Escherichia coli CFT073
ccgccaggcaaauucuguu

SEQ ID NO: 588423 - RNA, 13 nt, Escherichia coli CFT073
ccgccccggcaau

SEQ ID NO: 588424 - RNA, 15 nt, Escherichia coli CFT073
ccgcuauuauacugc

SEQ ID NO: 588425 - RNA, 22 nt, Escherichia coli CFT073
ccgcguuggcaaugucaaguga

SEQ ID NO: 588426 - RNA, 17 nt, Escherichia coli CFT073
ccgcguuuccacgcuga

SEQ ID NO: 588427 - RNA, 18 nt, Escherichia coli CFT073
ccgcucacgguuagcaua

SEQ ID NO: 588428 - RNA, 18 nt, Escherichia coli CFT073
ccgcguucgccagcguca

SEQ ID NO: 588429 - RNA, 13 nt, Escherichia coli CFT073
ccgcgugcugcga

SEQ ID NO: 588430 - RNA, 15 nt, Escherichia coli CFT073
ccgcgucgcccgugg

SEQ ID NO: 588431 - RNA, 15 nt, Escherichia coli CFT073
ccgcuucgcccgcca

SEQ ID NO: 588432 - RNA, 20 nt, Escherichia coli CFT073
ccgcuguuuguucaagcgca

SEQ ID NO: 588433 - RNA, 22 nt, Escherichia coli CFT073
ccgcuguuuguucaagcgcaau

SEQ ID NO: 588434 - RNA, 21 nt, Escherichia coli CFT073
ccgcuuaaauuuccaccgcua

SEQ ID NO: 588435 - RNA, 23 nt, Escherichia coli CFT073
ccgcuuaccauccacaccaaaau

SEQ ID NO: 588436 - RNA, 18 nt, Escherichia coli CFT073
ccgcuucaggaacugcau

SEQ ID NO: 588437 - RNA, 17 nt, Escherichia coli CFT073
ccgcugucugaaugaua

SEQ ID NO: 588438 - RNA, 16 nt, Escherichia coli CFT073
ccgcucugcuucgccu

SEQ ID NO: 588439 - RNA, 14 nt, Escherichia coli CFT073
ccgcucucuucgug

SEQ ID NO: 588440 - RNA, 18 nt, Escherichia coli CFT073
ccgcucugaaagcggccu

SEQ ID NO: 588441 - RNA, 20 nt, Escherichia coli CFT073
ccgcucugaaagcggccuua

SEQ ID NO: 588442 - RNA, 21 nt, Escherichia coli CFT073
ccgcggaacgcacuauacaac

SEQ ID NO: 588443 - RNA, 17 nt, Escherichia coli CFT073
aaauuaucccccagcac

SEQ ID NO: 588444 - RNA, 16 nt, Escherichia coli CFT073
aaauuacuggcggcga

SEQ ID NO: 588445 - RNA, 14 nt, Escherichia coli CFT073
aaauuaagcggcaa

SEQ ID NO: 588446 - RNA, 14 nt, Escherichia coli CFT073
aaauuaccaccagc

SEQ ID NO: 588447 - RNA, 19 nt, Escherichia coli CFT073
aaauuaccgcaccaccagc

SEQ ID NO: 588448 - RNA, 20 nt, Escherichia coli CFT073
ccgcgcuucgcggacuucug

SEQ ID NO: 588449 - RNA, 23 nt, Escherichia coli CFT073
aaauucaaugacaguaucaccaa

SEQ ID NO: 588450 - RNA, 20 nt, Escherichia coli CFT073
aaauucacgccuucuuccag

SEQ ID NO: 588451 - RNA, 13 nt, Escherichia coli CFT073
ccgcgggacaaau

SEQ ID NO: 588452 - RNA, 16 nt, Escherichia coli CFT073
aaaugucgauuaucga

SEQ ID NO: 588453 - RNA, 12 nt, Escherichia coli CFT073
aaauggccaucc

SEQ ID NO: 588454 - RNA, 17 nt, Escherichia coli CFT073
aaauggcugaccggaau

SEQ ID NO: 588455 - RNA, 13 nt, Escherichia coli CFT073
aaauggucagcca

SEQ ID NO: 588456 - RNA, 16 nt, Escherichia coli CFT073
aaauggucauuuuuca

SEQ ID NO: 588457 - RNA, 18 nt, Escherichia coli CFT073
aaauggagagaaccagcg

SEQ ID NO: 588458 - RNA, 20 nt, Escherichia coli CFT073
ccgccgugcggugggcuacg

SEQ ID NO: 588459 - RNA, 19 nt, Escherichia coli CFT073
ccgccggggucaaaccugg

SEQ ID NO: 588460 - RNA, 23 nt, Escherichia coli CFT073
ccgccggaugcggcgugaacgcc

SEQ ID NO: 588461 - RNA, 12 nt, Escherichia coli CFT073
ccgccugcgcca

SEQ ID NO: 588462 - RNA, 20 nt, Escherichia coli CFT073
ccgcgacaucgucuccagcg

SEQ ID NO: 588463 - RNA, 23 nt, Escherichia coli CFT073
ccgcgagaacugaaccaauauuc

SEQ ID NO: 588464 - RNA, 17 nt, Escherichia coli CFT073
ccgcgaugaccaaaaac

SEQ ID NO: 588465 - RNA, 13 nt, Escherichia coli CFT073
ccgcgcccgcuaa

SEQ ID NO: 588466 - RNA, 23 nt, Escherichia coli CFT073
ccgcuugccuagggcgcagcugu

SEQ ID NO: 588467 - RNA, 22 nt, Escherichia coli CFT073
ccgcuugcgauauggcugcgcu

SEQ ID NO: 588468 - RNA, 14 nt, Escherichia coli CFT073
ccgcuuuuacgcgg

SEQ ID NO: 588469 - RNA, 18 nt, Escherichia coli CFT073
ccgcuuguggaacgcuga

SEQ ID NO: 588470 - RNA, 23 nt, Escherichia coli CFT073
ccgcuuuaaaauuauccagcgcc

SEQ ID NO: 588471 - RNA, 15 nt, Escherichia coli CFT073
ccgcuuuuccggcau

SEQ ID NO: 588472 - RNA, 19 nt, Escherichia coli CFT073
ccgcuuuuuuacgccugca

SEQ ID NO: 588473 - RNA, 17 nt, Escherichia coli CFT073
ccggcaugacgccgggc

SEQ ID NO: 588474 - RNA, 12 nt, Escherichia coli CFT073
ccggaaagcgua

SEQ ID NO: 588475 - RNA, 22 nt, Escherichia coli CFT073
ccggcauguuuaauucugcggc

SEQ ID NO: 588476 - RNA, 19 nt, Escherichia coli CFT073
ccggcauggugagcgcaca

SEQ ID NO: 588477 - RNA, 23 nt, Escherichia coli CFT073
ccggcauuuuuuagcgccagcca

SEQ ID NO: 588478 - RNA, 21 nt, Escherichia coli CFT073
ccggcauuaucacaucagcgc

SEQ ID NO: 588479 - RNA, 20 nt, Escherichia coli CFT073
ccggccagcgccaccaccag

SEQ ID NO: 588480 - RNA, 15 nt, Escherichia coli CFT073
ccggccuaccggacg

SEQ ID NO: 588481 - RNA, 15 nt, Escherichia coli CFT073
ccggccccgucgccc

SEQ ID NO: 588482 - RNA, 18 nt, Escherichia coli CFT073
ccggccaguccccucgcc

SEQ ID NO: 588483 - RNA, 18 nt, Escherichia coli CFT073
ccgggcugagucccccaa

SEQ ID NO: 588484 - RNA, 17 nt, Escherichia coli CFT073
aaauugagcugcgcgac

SEQ ID NO: 588485 - RNA, 14 nt, Escherichia coli CFT073
aaauugccccagac

SEQ ID NO: 588486 - RNA, 14 nt, Escherichia coli CFT073
aaauugcccccagu

SEQ ID NO: 588487 - RNA, 13 nt, Escherichia coli CFT073
aaauugccugaug

SEQ ID NO: 588488 - RNA, 20 nt, Escherichia coli CFT073
aaauugcgacugaaccagcg

SEQ ID NO: 588489 - RNA, 22 nt, Escherichia coli CFT073
aaauugcugugauuaagcagcg

SEQ ID NO: 588490 - RNA, 23 nt, Escherichia coli CFT073
aaauucgagagaauuaaccagaa

SEQ ID NO: 588491 - RNA, 13 nt, Escherichia coli CFT073
aaauucgcgcaga

SEQ ID NO: 588492 - RNA, 22 nt, Escherichia coli CFT073
aaauucucccgcccccgccagc

SEQ ID NO: 588493 - RNA, 14 nt, Escherichia coli CFT073
ccgggcaugaacaa

SEQ ID NO: 588494 - RNA, 22 nt, Escherichia coli CFT073
ccgggauauaugucaccagcau

SEQ ID NO: 588495 - RNA, 16 nt, Escherichia coli CFT073
ccggcugugcgacuuc

SEQ ID NO: 588496 - RNA, 21 nt, Escherichia coli CFT073
ccggcgggguuuuuugucucu

SEQ ID NO: 588497 - RNA, 20 nt, Escherichia coli CFT073
ccggcugcaaacccugagcg

SEQ ID NO: 588498 - RNA, 17 nt, Escherichia coli CFT073
ccggcucccgcagccac

SEQ ID NO: 588499 - RNA, 22 nt, Escherichia coli CFT073
ccggcuaacagucuggcguuuu

SEQ ID NO: 588500 - RNA, 21 nt, Escherichia coli CFT073
ccggcguggugcagccgccau

SEQ ID NO: 588501 - RNA, 16 nt, Escherichia coli CFT073
ccggcguccaccugcg

SEQ ID NO: 588502 - RNA, 22 nt, Escherichia coli CFT073
ccguucggugguaucaaaauga

SEQ ID NO: 588503 - RNA, 15 nt, Escherichia coli CFT073
ccguucguccgagcg

SEQ ID NO: 588504 - RNA, 18 nt, Escherichia coli CFT073
ccguugaggcgaucgucg

SEQ ID NO: 588505 - RNA, 17 nt, Escherichia coli CFT073
ccguucauccgcuucag

SEQ ID NO: 588506 - RNA, 15 nt, Escherichia coli CFT073
ccguuccaacgccac

SEQ ID NO: 588507 - RNA, 20 nt, Escherichia coli CFT073
ccguguuuuugugccagagc

SEQ ID NO: 588508 - RNA, 14 nt, Escherichia coli CFT073
ccguuaaccaauau

SEQ ID NO: 588509 - RNA, 21 nt, Escherichia coli CFT073
ccguuacccgacgcgccaggu

SEQ ID NO: 588510 - RNA, 14 nt, Escherichia coli CFT073
ccguuaccggaaga

SEQ ID NO: 588511 - RNA, 13 nt, Escherichia coli CFT073
ccguuaccggacg

SEQ ID NO: 588512 - RNA, 17 nt, Escherichia coli CFT073
ccguuagcgaguugauc

SEQ ID NO: 588513 - RNA, 21 nt, Escherichia coli CFT073
ccguuaauucuuaacaccggc

SEQ ID NO: 588514 - RNA, 20 nt, Escherichia coli CFT073
ccguuaugaucagcaacgcc

SEQ ID NO: 588515 - RNA, 22 nt, Escherichia coli CFT073
ccguuggcggcgugacgccaga

SEQ ID NO: 588516 - RNA, 21 nt, Escherichia coli CFT073
ccguugcuucgccgcaucguc

SEQ ID NO: 588517 - RNA, 21 nt, Escherichia coli CFT073
ccguugcgcccaucaucaucg

SEQ ID NO: 588518 - RNA, 18 nt, Escherichia coli CFT073
ccguuuaaagcguucacu

SEQ ID NO: 588519 - RNA, 16 nt, Escherichia coli CFT073
ccguuuuaaaucgccg

SEQ ID NO: 588520 - RNA, 21 nt, Escherichia coli CFT073
ccguuugccagaacugcugcg

SEQ ID NO: 588521 - RNA, 22 nt, Escherichia coli CFT073
ccguuugccagaacugcugcgc

SEQ ID NO: 588522 - RNA, 18 nt, Escherichia coli CFT073
ccguuuuuacccagcagc

SEQ ID NO: 588523 - RNA, 19 nt, Escherichia coli CFT073
ccguuuuuuuaucccuucu

SEQ ID NO: 588524 - RNA, 17 nt, Escherichia coli CFT073
ccuacaaaggcacgcca

SEQ ID NO: 588525 - RNA, 20 nt, Escherichia coli CFT073
ccuacaaaggcacgccaauu

SEQ ID NO: 588526 - RNA, 13 nt, Escherichia coli CFT073
ccuacacacgcca

SEQ ID NO: 588527 - RNA, 23 nt, Escherichia coli CFT073
ccuacauccaguauauugcugau

SEQ ID NO: 588528 - RNA, 17 nt, Escherichia coli CFT073
ccuaaccggcgcggacg

SEQ ID NO: 588529 - RNA, 18 nt, Escherichia coli CFT073
ccuaaaagcacgccagac

SEQ ID NO: 588530 - RNA, 20 nt, Escherichia coli CFT073
ccuaaauaaacaccagcagu

SEQ ID NO: 588531 - RNA, 15 nt, Escherichia coli CFT073
ccuaaauuuuuccac

SEQ ID NO: 588532 - RNA, 19 nt, Escherichia coli CFT073
ccuaacacgaucagccaua

SEQ ID NO: 588533 - RNA, 13 nt, Escherichia coli CFT073
ccuacucucgcau

SEQ ID NO: 588534 - RNA, 15 nt, Escherichia coli CFT073
ccuacgcuugcugcg

SEQ ID NO: 588535 - RNA, 19 nt, Escherichia coli CFT073
ccuaugcagguuggcgacg

SEQ ID NO: 588536 - RNA, 23 nt, Escherichia coli CFT073
ccuauuauccggcaaccaccguu

SEQ ID NO: 588537 - RNA, 19 nt, Escherichia coli CFT073
ccucauaacguaaaccaau

SEQ ID NO: 588538 - RNA, 16 nt, Escherichia coli CFT073
ccucaacaaucgucag

SEQ ID NO: 588539 - RNA, 17 nt, Escherichia coli CFT073
ccucaacaaucgucagc

SEQ ID NO: 588540 - RNA, 13 nt, Escherichia coli CFT073
ccucaaucagcgg

SEQ ID NO: 588541 - RNA, 21 nt, Escherichia coli CFT073
ccucauuucauuguccgucug

SEQ ID NO: 588542 - RNA, 14 nt, Escherichia coli CFT073
ccucauuaagccac

SEQ ID NO: 588543 - RNA, 22 nt, Escherichia coli CFT073
ccuccgcuaaauccgccgccac

SEQ ID NO: 588544 - RNA, 10 nt, Escherichia coli CFT073
ccuccggcgu

SEQ ID NO: 588545 - RNA, 21 nt, Escherichia coli CFT073
ccuccggcgucagauucggau

SEQ ID NO: 588546 - RNA, 19 nt, Escherichia coli CFT073
ccuccguuuuucuguugau

SEQ ID NO: 588547 - RNA, 15 nt, Escherichia coli CFT073
ccucgcuuuuaugcc

SEQ ID NO: 588548 - RNA, 18 nt, Escherichia coli CFT073
ccucgcucucgccgcgcu

SEQ ID NO: 588549 - RNA, 22 nt, Escherichia coli CFT073
ccgguuucgccgcggcgcagcu

SEQ ID NO: 588550 - RNA, 13 nt, Escherichia coli CFT073
ccgguuugcgccg

SEQ ID NO: 588551 - RNA, 22 nt, Escherichia coli CFT073
ccgguuguucaaccaccggcac

SEQ ID NO: 588552 - RNA, 20 nt, Escherichia coli CFT073
ccgguuuacucaacaaccag

SEQ ID NO: 588553 - RNA, 15 nt, Escherichia coli CFT073
ccgguuucaauccag

SEQ ID NO: 588554 - RNA, 18 nt, Escherichia coli CFT073
ccgguuuuacuuugccuu

SEQ ID NO: 588555 - RNA, 13 nt, Escherichia coli CFT073
ccgguuuucugcc

SEQ ID NO: 588556 - RNA, 13 nt, Escherichia coli CFT073
ccgguuuuucugg

SEQ ID NO: 588557 - RNA, 18 nt, Escherichia coli CFT073
ccguaaaaaucggcaaca

SEQ ID NO: 588558 - RNA, 20 nt, Escherichia coli CFT073
ccguaaaacucacaaccagg

SEQ ID NO: 588559 - RNA, 15 nt, Escherichia coli CFT073
ccguaaacaucaucc

SEQ ID NO: 588560 - RNA, 22 nt, Escherichia coli CFT073
ccguaaaucgucaguagcgcaa

SEQ ID NO: 588561 - RNA, 18 nt, Escherichia coli CFT073
ccguaacauaacagccau

SEQ ID NO: 588562 - RNA, 19 nt, Escherichia coli CFT073
ccguaaccaccagcacuga

SEQ ID NO: 588563 - RNA, 17 nt, Escherichia coli CFT073
ccgguugugaagugcaa

SEQ ID NO: 588564 - RNA, 19 nt, Escherichia coli CFT073
ccgguuaaucuaaucugua

SEQ ID NO: 588565 - RNA, 17 nt, Escherichia coli CFT073
ccgguuagcucaacgca

SEQ ID NO: 588566 - RNA, 23 nt, Escherichia coli CFT073
ccgguuauuuuuauauagccagc

SEQ ID NO: 588567 - RNA, 15 nt, Escherichia coli CFT073
ccgguggagagcaua

SEQ ID NO: 588568 - RNA, 16 nt, Escherichia coli CFT073
ccgggguuucacccac

SEQ ID NO: 588569 - RNA, 12 nt, Escherichia coli CFT073
ccggucuuucuu

SEQ ID NO: 588570 - RNA, 17 nt, Escherichia coli CFT073
ccggucucagcccagau

SEQ ID NO: 588571 - RNA, 23 nt, Escherichia coli CFT073
ccggucgugacugccgccagcau

SEQ ID NO: 588572 - RNA, 20 nt, Escherichia coli CFT073
ccguacgcuaugcgccaguu

SEQ ID NO: 588573 - RNA, 22 nt, Escherichia coli CFT073
ccguacccagcggucaaacucg

SEQ ID NO: 588574 - RNA, 20 nt, Escherichia coli CFT073
ccguacagucgagcaccaga

SEQ ID NO: 588575 - RNA, 21 nt, Escherichia coli CFT073
ccgucaguuuuucacccgcaa

SEQ ID NO: 588576 - RNA, 16 nt, Escherichia coli CFT073
ccgucagggccugcgu

SEQ ID NO: 588577 - RNA, 23 nt, Escherichia coli CFT073
ccguccucacuuaaagcaacacc

SEQ ID NO: 588578 - RNA, 18 nt, Escherichia coli CFT073
ccgucggcuucacgccca

SEQ ID NO: 588579 - RNA, 19 nt, Escherichia coli CFT073
ccgucggcuucacgcccag

SEQ ID NO: 588580 - RNA, 22 nt, Escherichia coli CFT073
ccgucggcuucacgcccagcac

SEQ ID NO: 588581 - RNA, 15 nt, Escherichia coli CFT073
ccgugccaauguuga

SEQ ID NO: 588582 - RNA, 12 nt, Escherichia coli CFT073
ccgugccagcac

SEQ ID NO: 588583 - RNA, 13 nt, Escherichia coli CFT073
ccgugagcaaugc

SEQ ID NO: 588584 - RNA, 14 nt, Escherichia coli CFT073
ccgugagcaaugca

SEQ ID NO: 588585 - RNA, 11 nt, Escherichia coli CFT073
ccgugacuuca

SEQ ID NO: 588586 - RNA, 14 nt, Escherichia coli CFT073
ccgucgucccuucc

SEQ ID NO: 588587 - RNA, 13 nt, Escherichia coli CFT073
ccaugcaggcugg

SEQ ID NO: 588588 - RNA, 16 nt, Escherichia coli CFT073
ccaugauuaccagcau

SEQ ID NO: 588589 - RNA, 14 nt, Escherichia coli CFT073
ccaugauaaacggc

SEQ ID NO: 588590 - RNA, 20 nt, Escherichia coli CFT073
ccaugauaagagagcaacag

SEQ ID NO: 588591 - RNA, 19 nt, Escherichia coli CFT073
ccaugacgaugcagaaaua

SEQ ID NO: 588592 - RNA, 22 nt, Escherichia coli CFT073
ccaucucaaaacguccggcaau

SEQ ID NO: 588593 - RNA, 15 nt, Escherichia coli CFT073
ccaucuccuuacugc

SEQ ID NO: 588594 - RNA, 15 nt, Escherichia coli CFT073
ccaucuccaucaucu

SEQ ID NO: 588595 - RNA, 23 nt, Escherichia coli CFT073
ccaucuucguaccaaaugaaccg

SEQ ID NO: 588596 - RNA, 22 nt, Escherichia coli CFT073
ccaucuucacuguccgccagac

SEQ ID NO: 588597 - RNA, 24 nt, Escherichia coli CFT073
ccaugcaaucacugccaccaggaa

SEQ ID NO: 588598 - RNA, 14 nt, Escherichia coli CFT073
ccaucaugcgccag

SEQ ID NO: 588599 - RNA, 13 nt, Escherichia coli CFT073
ccaucaucaucgg

SEQ ID NO: 588600 - RNA, 15 nt, Escherichia coli CFT073
ccaucauacagccag

SEQ ID NO: 588601 - RNA, 20 nt, Escherichia coli CFT073
ccaucauacagccagcaaua

SEQ ID NO: 588602 - RNA, 13 nt, Escherichia coli CFT073
ccaucaggucauc

SEQ ID NO: 588603 - RNA, 20 nt, Escherichia coli CFT073
ccaucccuaauauaaacaac

SEQ ID NO: 588604 - RNA, 14 nt, Escherichia coli CFT073
ccauccaucaacgc

SEQ ID NO: 588605 - RNA, 23 nt, Escherichia coli CFT073
ccauccccacggcucgugcggua

SEQ ID NO: 588606 - RNA, 14 nt, Escherichia coli CFT073
ccauccagcagacg

SEQ ID NO: 588607 - RNA, 21 nt, Escherichia coli CFT073
ccaucgacguccaaucagcac

SEQ ID NO: 588608 - RNA, 20 nt, Escherichia coli CFT073
ccauccgcgugacgcuggca

SEQ ID NO: 588609 - RNA, 18 nt, Escherichia coli CFT073
ccaucgcagaaacgacac

SEQ ID NO: 588610 - RNA, 13 nt, Escherichia coli CFT073
ccaucgcaucguc

SEQ ID NO: 588611 - RNA, 13 nt, Escherichia coli CFT073
ccaucgcaugcca

SEQ ID NO: 588612 - RNA, 15 nt, Escherichia coli CFT073
ccaucgcaugccagc

SEQ ID NO: 588613 - RNA, 19 nt, Escherichia coli CFT073
ccaucgccacaccaguaaa

SEQ ID NO: 588614 - RNA, 16 nt, Escherichia coli CFT073
ccaucgccaccgcuuc

SEQ ID NO: 588615 - RNA, 16 nt, Escherichia coli CFT073
ccaucgccgccuggcu

SEQ ID NO: 588616 - RNA, 24 nt, Escherichia coli CFT073
ccaucggcauuaaucugcucggcg

SEQ ID NO: 588617 - RNA, 15 nt, Escherichia coli CFT073
ccaucggcgcuacgg

SEQ ID NO: 588618 - RNA, 14 nt, Escherichia coli CFT073
ccaucgcuucaugc

SEQ ID NO: 588619 - RNA, 18 nt, Escherichia coli CFT073
ccaucgucggguaguuaa

SEQ ID NO: 588620 - RNA, 17 nt, Escherichia coli CFT073
ccauguaccagacugac

SEQ ID NO: 588621 - RNA, 23 nt, Escherichia coli CFT073
aaaucgggugaaguuuugucgcu

SEQ ID NO: 588622 - RNA, 21 nt, Escherichia coli CFT073
ccaugugccgacaucgccacg

SEQ ID NO: 588623 - RNA, 14 nt, Escherichia coli CFT073
cccaagaucaauac

SEQ ID NO: 588624 - RNA, 14 nt, Escherichia coli CFT073
cccacaacauugcg

SEQ ID NO: 588625 - RNA, 15 nt, Escherichia coli CFT073
cccaaugacgucggu

SEQ ID NO: 588626 - RNA, 21 nt, Escherichia coli CFT073
cccaaucaaacuuccggcaag

SEQ ID NO: 588627 - RNA, 20 nt, Escherichia coli CFT073
cccacgccccuggugcuugc

SEQ ID NO: 588628 - RNA, 16 nt, Escherichia coli CFT073
cccacguuuaccgccc

SEQ ID NO: 588629 - RNA, 20 nt, Escherichia coli CFT073
cccagaaaauacucagcacc

SEQ ID NO: 588630 - RNA, 19 nt, Escherichia coli CFT073
cccagaaacaggcggcgcg

SEQ ID NO: 588631 - RNA, 16 nt, Escherichia coli CFT073
cccacucggcgaccag

SEQ ID NO: 588632 - RNA, 14 nt, Escherichia coli CFT073
cccaccucgugcac

SEQ ID NO: 588633 - RNA, 14 nt, Escherichia coli CFT073
cccacagaaacaau

SEQ ID NO: 588634 - RNA, 20 nt, Escherichia coli CFT073
cccagccaucgacaccagcc

SEQ ID NO: 588635 - RNA, 16 nt, Escherichia coli CFT073
cccaggaagcccgccc

SEQ ID NO: 588636 - RNA, 16 nt, Escherichia coli CFT073
cccagcgcgaucgcgc

SEQ ID NO: 588637 - RNA, 17 nt, Escherichia coli CFT073
cccagcgaggcaaucag

SEQ ID NO: 588638 - RNA, 14 nt, Escherichia coli CFT073
cccagcgaagcaaa

SEQ ID NO: 588639 - RNA, 16 nt, Escherichia coli CFT073
ccauaagugcgucauu

SEQ ID NO: 588640 - RNA, 17 nt, Escherichia coli CFT073
ccauaaucaaugccagg

SEQ ID NO: 588641 - RNA, 13 nt, Escherichia coli CFT073
ccauaaucagcgc

SEQ ID NO: 588642 - RNA, 17 nt, Escherichia coli CFT073
ccaguuuguagccgaua

SEQ ID NO: 588643 - RNA, 15 nt, Escherichia coli CFT073
ccauaaaaucacagg

SEQ ID NO: 588644 - RNA, 16 nt, Escherichia coli CFT073
ccauaaacaccagcag

SEQ ID NO: 588645 - RNA, 21 nt, Escherichia coli CFT073
ccaguuucuucaggccagccu

SEQ ID NO: 588646 - RNA, 14 nt, Escherichia coli CFT073
ccaguugugaugcc

SEQ ID NO: 588647 - RNA, 17 nt, Escherichia coli CFT073
ccaguugugcaccacca

SEQ ID NO: 588648 - RNA, 14 nt, Escherichia coli CFT073
ccaguugugcugcc

SEQ ID NO: 588649 - RNA, 14 nt, Escherichia coli CFT073
ccaguuuaccgaaa

SEQ ID NO: 588650 - RNA, 15 nt, Escherichia coli CFT073
ccauacagcgucggu

SEQ ID NO: 588651 - RNA, 16 nt, Escherichia coli CFT073
ccauacaguguccaac

SEQ ID NO: 588652 - RNA, 19 nt, Escherichia coli CFT073
ccauaccacagcaaaacgc

SEQ ID NO: 588653 - RNA, 18 nt, Escherichia coli CFT073
ccauaaugccccagcgca

SEQ ID NO: 588654 - RNA, 15 nt, Escherichia coli CFT073
ccauaauggacguuu

SEQ ID NO: 588655 - RNA, 15 nt, Escherichia coli CFT073
ccauacccaccaauu

SEQ ID NO: 588656 - RNA, 16 nt, Escherichia coli CFT073
ccauaccgucgccaga

SEQ ID NO: 588657 - RNA, 16 nt, Escherichia coli CFT073
ccauaccuggugcagc

SEQ ID NO: 588658 - RNA, 20 nt, Escherichia coli CFT073
ccauaguguguuccucugcu

SEQ ID NO: 588659 - RNA, 21 nt, Escherichia coli CFT073
ccauacucacaucaacaacga

SEQ ID NO: 588660 - RNA, 19 nt, Escherichia coli CFT073
ccauauuggcaacagccau

SEQ ID NO: 588661 - RNA, 21 nt, Escherichia coli CFT073
ccauauuuugaaucgguggcg

SEQ ID NO: 588662 - RNA, 20 nt, Escherichia coli CFT073
ccauaugcagcacuugcagc

SEQ ID NO: 588663 - RNA, 13 nt, Escherichia coli CFT073
ccauaugcagcca

SEQ ID NO: 588664 - RNA, 18 nt, Escherichia coli CFT073
ccauauggcccaucaucu

SEQ ID NO: 588665 - RNA, 11 nt, Escherichia coli CFT073
ccauauaccgc

SEQ ID NO: 588666 - RNA, 22 nt, Escherichia coli CFT073
ccaucacaaucagcuuaccgcc

SEQ ID NO: 588667 - RNA, 19 nt, Escherichia coli CFT073
ccaucacaauucaguacgc

SEQ ID NO: 588668 - RNA, 15 nt, Escherichia coli CFT073
ccaucagcagcaaca

SEQ ID NO: 588669 - RNA, 13 nt, Escherichia coli CFT073
ccaucaccggcac

SEQ ID NO: 588670 - RNA, 16 nt, Escherichia coli CFT073
ccaucacuaaggguaa

SEQ ID NO: 588671 - RNA, 20 nt, Escherichia coli CFT073
ccaucaccgccacuaucgcc

SEQ ID NO: 588672 - RNA, 15 nt, Escherichia coli CFT073
ccaucaccgccaggc

SEQ ID NO: 588673 - RNA, 21 nt, Escherichia coli CFT073
ccagugguuaccgaauccagc

SEQ ID NO: 588674 - RNA, 20 nt, Escherichia coli CFT073
ccaguggcauuuucugcccg

SEQ ID NO: 588675 - RNA, 20 nt, Escherichia coli CFT073
ccagugcguugugcgccagu

SEQ ID NO: 588676 - RNA, 19 nt, Escherichia coli CFT073
ccaguggagccaucaccau

SEQ ID NO: 588677 - RNA, 14 nt, Escherichia coli CFT073
ccaguggaugcgcc

SEQ ID NO: 588678 - RNA, 16 nt, Escherichia coli CFT073
ccagugucgcaucagg

SEQ ID NO: 588679 - RNA, 20 nt, Escherichia coli CFT073
ccagugugaugcguccgcua

SEQ ID NO: 588680 - RNA, 19 nt, Escherichia coli CFT073
ccaguuaccaccgccagau

SEQ ID NO: 588681 - RNA, 20 nt, Escherichia coli CFT073
ccaguuaccaccgccagauu

SEQ ID NO: 588682 - RNA, 21 nt, Escherichia coli CFT073
ccagucauaauucagaucgcu

SEQ ID NO: 588683 - RNA, 16 nt, Escherichia coli CFT073
ccagucacugccacca

SEQ ID NO: 588684 - RNA, 22 nt, Escherichia coli CFT073
ccagucacugugacgcggugcu

SEQ ID NO: 588685 - RNA, 16 nt, Escherichia coli CFT073
ccagucccaguucaug

SEQ ID NO: 588686 - RNA, 22 nt, Escherichia coli CFT073
ccagucgcgcaauugccagaca

SEQ ID NO: 588687 - RNA, 23 nt, Escherichia coli CFT073
ccagugcccgaccacuucaugcc

SEQ ID NO: 588688 - RNA, 17 nt, Escherichia coli CFT073
ccagucuuccgccggau

SEQ ID NO: 588689 - RNA, 15 nt, Escherichia coli CFT073
ccagugacgcagcga

SEQ ID NO: 588690 - RNA, 16 nt, Escherichia coli CFT073
ccagugauuccgggua

SEQ ID NO: 588691 - RNA, 21 nt, Escherichia coli CFT073
ccagugcaaaaaaucaacagc

SEQ ID NO: 588692 - RNA, 14 nt, Escherichia coli CFT073
ccagugaucuggcu

SEQ ID NO: 588693 - RNA, 23 nt, Escherichia coli CFT073
ccagugcagauaccaccagcgcc

SEQ ID NO: 588694 - RNA, 22 nt, Escherichia coli CFT073
ccagugcaugggcaaauuguuc

SEQ ID NO: 588695 - RNA, 16 nt, Escherichia coli CFT073
ccaguagugcgcagaa

SEQ ID NO: 588696 - RNA, 20 nt, Escherichia coli CFT073
ccaguauauugcugauuuuc

SEQ ID NO: 588697 - RNA, 17 nt, Escherichia coli CFT073
ccagguuucggaugggc

SEQ ID NO: 588698 - RNA, 22 nt, Escherichia coli CFT073
ccagguuuuaguuucgccguuu

SEQ ID NO: 588699 - RNA, 19 nt, Escherichia coli CFT073
ccaguaaucagcgcggaac

SEQ ID NO: 588700 - RNA, 16 nt, Escherichia coli CFT073
ccagguuuaccagcag

SEQ ID NO: 588701 - RNA, 16 nt, Escherichia coli CFT073
ccagguuuaucaugcu

SEQ ID NO: 588702 - RNA, 20 nt, Escherichia coli CFT073
ccaggugaaauccggcuucu

SEQ ID NO: 588703 - RNA, 12 nt, Escherichia coli CFT073
ccaggucgugau

SEQ ID NO: 588704 - RNA, 23 nt, Escherichia coli CFT073
ccaggcgucuggcccaugccagu

SEQ ID NO: 588705 - RNA, 17 nt, Escherichia coli CFT073
ccaggccaucagcagcg

SEQ ID NO: 588706 - RNA, 22 nt, Escherichia coli CFT073
ccagcgcuuuugcuacuuuuuu

SEQ ID NO: 588707 - RNA, 15 nt, Escherichia coli CFT073
ccagcgcugcggccu

SEQ ID NO: 588708 - RNA, 19 nt, Escherichia coli CFT073
cccuuaccauucccagacu

SEQ ID NO: 588709 - RNA, 13 nt, Escherichia coli CFT073
cccuguugcgcuc

SEQ ID NO: 588710 - RNA, 19 nt, Escherichia coli CFT073
cccugugcgcccuguucug

SEQ ID NO: 588711 - RNA, 16 nt, Escherichia coli CFT073
cccuggcuaucggcaa

SEQ ID NO: 588712 - RNA, 17 nt, Escherichia coli CFT073
cccugaguuuucaguac

SEQ ID NO: 588713 - RNA, 15 nt, Escherichia coli CFT073
cccugagcaucaaua

SEQ ID NO: 588714 - RNA, 15 nt, Escherichia coli CFT073
cccugaccuacggaa

SEQ ID NO: 588715 - RNA, 18 nt, Escherichia coli CFT073
cccugcgucgcacucuca

SEQ ID NO: 588716 - RNA, 13 nt, Escherichia coli CFT073
cccugcggcggag

SEQ ID NO: 588717 - RNA, 14 nt, Escherichia coli CFT073
cccugcggcggaga

SEQ ID NO: 588718 - RNA, 23 nt, Escherichia coli CFT073
cccugcagucaccugcccuccgg

SEQ ID NO: 588719 - RNA, 16 nt, Escherichia coli CFT073
cccugccaaccaacgc

SEQ ID NO: 588720 - RNA, 12 nt, Escherichia coli CFT073
cccucaacggaa

SEQ ID NO: 588721 - RNA, 21 nt, Escherichia coli CFT073
cccugaaagcgacagcgcacg

SEQ ID NO: 588722 - RNA, 16 nt, Escherichia coli CFT073
cccucuaaaauaacga

SEQ ID NO: 588723 - RNA, 20 nt, Escherichia coli CFT073
cccgugacgggugacgccaa

SEQ ID NO: 588724 - RNA, 15 nt, Escherichia coli CFT073
cccgucugcugcugc

SEQ ID NO: 588725 - RNA, 19 nt, Escherichia coli CFT073
cccgguucgagaaaaccga

SEQ ID NO: 588726 - RNA, 17 nt, Escherichia coli CFT073
cccggcaaucgccagau

SEQ ID NO: 588727 - RNA, 16 nt, Escherichia coli CFT073
cccggcaaugcgccga

SEQ ID NO: 588728 - RNA, 15 nt, Escherichia coli CFT073
cccggcaauggugug

SEQ ID NO: 588729 - RNA, 14 nt, Escherichia coli CFT073
cccggcaggaauau

SEQ ID NO: 588730 - RNA, 22 nt, Escherichia coli CFT073
cccggucguuuauuucgcgaau

SEQ ID NO: 588731 - RNA, 15 nt, Escherichia coli CFT073
cccggcuaacagucu

SEQ ID NO: 588732 - RNA, 14 nt, Escherichia coli CFT073
cccggcguuaucgg

SEQ ID NO: 588733 - RNA, 20 nt, Escherichia coli CFT073
cccgccgucuaugccggucu

SEQ ID NO: 588734 - RNA, 12 nt, Escherichia coli CFT073
cccgccagcgcg

SEQ ID NO: 588735 - RNA, 18 nt, Escherichia coli CFT073
cccgcgccucaacgccua

SEQ ID NO: 588736 - RNA, 13 nt, Escherichia coli CFT073
cccgcuucgccug

SEQ ID NO: 588737 - RNA, 16 nt, Escherichia coli CFT073
cccggagccauugccc

SEQ ID NO: 588738 - RNA, 16 nt, Escherichia coli CFT073
cccggagcccuacaaa

SEQ ID NO: 588739 - RNA, 13 nt, Escherichia coli CFT073
cccggagacgccg

SEQ ID NO: 588740 - RNA, 12 nt, Escherichia coli CFT073
cccggaggaugc

SEQ ID NO: 588741 - RNA, 13 nt, Escherichia coli CFT073
cccgcuggcgacg

SEQ ID NO: 588742 - RNA, 13 nt, Escherichia coli CFT073
cccgcuccagcua

SEQ ID NO: 588743 - RNA, 12 nt, Escherichia coli CFT073
ccccggcaggaa

SEQ ID NO: 588744 - RNA, 12 nt, Escherichia coli CFT073
ccccggccagua

SEQ ID NO: 588745 - RNA, 20 nt, Escherichia coli CFT073
ccccuaaauaaacaccagca

SEQ ID NO: 588746 - RNA, 21 nt, Escherichia coli CFT073
ccccucagggcggcuauccca

SEQ ID NO: 588747 - RNA, 14 nt, Escherichia coli CFT073
ccccgcgcggcgca

SEQ ID NO: 588748 - RNA, 13 nt, Escherichia coli CFT073
ccccgcgccagcg

SEQ ID NO: 588749 - RNA, 18 nt, Escherichia coli CFT073
ccccgagguguauuucac

SEQ ID NO: 588750 - RNA, 13 nt, Escherichia coli CFT073
cccccuuaccccg

SEQ ID NO: 588751 - RNA, 13 nt, Escherichia coli CFT073
ccccaccugcccg

SEQ ID NO: 588752 - RNA, 14 nt, Escherichia coli CFT073
ccccacugccgccu

SEQ ID NO: 588753 - RNA, 13 nt, Escherichia coli CFT073
aaauagaucgcca

SEQ ID NO: 588754 - RNA, 18 nt, Escherichia coli CFT073
aaauagccagcagagcaa

SEQ ID NO: 588755 - RNA, 14 nt, Escherichia coli CFT073
ccagcacugccgca

SEQ ID NO: 588756 - RNA, 18 nt, Escherichia coli CFT073
ccagcacuuuaaccugca

SEQ ID NO: 588757 - RNA, 22 nt, Escherichia coli CFT073
ccagcagaaugacaucaucgcc

SEQ ID NO: 588758 - RNA, 13 nt, Escherichia coli CFT073
ccagcagagcaaa

SEQ ID NO: 588759 - RNA, 12 nt, Escherichia coli CFT073
ccagcagcaacc

SEQ ID NO: 588760 - RNA, 12 nt, Escherichia coli CFT073
ccagcaccagca

SEQ ID NO: 588761 - RNA, 13 nt, Escherichia coli CFT073
ccagcaccagcaa

SEQ ID NO: 588762 - RNA, 15 nt, Escherichia coli CFT073
ccagcaccagcaaca

SEQ ID NO: 588763 - RNA, 23 nt, Escherichia coli CFT073
ccagcacauauucacgggcgcgg

SEQ ID NO: 588764 - RNA, 18 nt, Escherichia coli CFT073
ccagcacggauaccgcac

SEQ ID NO: 588765 - RNA, 15 nt, Escherichia coli CFT073
ccagcaccgcuggcu

SEQ ID NO: 588766 - RNA, 16 nt, Escherichia coli CFT073
ccagccagaagaaaac

SEQ ID NO: 588767 - RNA, 17 nt, Escherichia coli CFT073
ccagcauuacgcguccu

SEQ ID NO: 588768 - RNA, 21 nt, Escherichia coli CFT073
ccagcaggaagcggcucggcu

SEQ ID NO: 588769 - RNA, 14 nt, Escherichia coli CFT073
ccagcagcucccug

SEQ ID NO: 588770 - RNA, 15 nt, Escherichia coli CFT073
ccagcagcggcagau

SEQ ID NO: 588771 - RNA, 17 nt, Escherichia coli CFT073
ccagcagcagcgaauaa

SEQ ID NO: 588772 - RNA, 23 nt, Escherichia coli CFT073
aaauauguugcuuuaaaucgucg

SEQ ID NO: 588773 - RNA, 15 nt, Escherichia coli CFT073
aaauauuaucuaacc

SEQ ID NO: 588774 - RNA, 19 nt, Escherichia coli CFT073
aaauauuucuuuaucacca

SEQ ID NO: 588775 - RNA, 17 nt, Escherichia coli CFT073
ccagcgcauggcgguau

SEQ ID NO: 588776 - RNA, 16 nt, Escherichia coli CFT073
ccagcgagcuggcgcu

SEQ ID NO: 588777 - RNA, 19 nt, Escherichia coli CFT073
ccagcgccaccacgccgau

SEQ ID NO: 588778 - RNA, 17 nt, Escherichia coli CFT073
ccagcgccaccgguuua

SEQ ID NO: 588779 - RNA, 20 nt, Escherichia coli CFT073
ccagcgcggcagcggcuuca

SEQ ID NO: 588780 - RNA, 13 nt, Escherichia coli CFT073
ccagcgcgcggcu

SEQ ID NO: 588781 - RNA, 15 nt, Escherichia coli CFT073
ccagcgccugaauaa

SEQ ID NO: 588782 - RNA, 10 nt, Escherichia coli CFT073
aaaucaccac

SEQ ID NO: 588783 - RNA, 13 nt, Escherichia coli CFT073
aaaucaccaucgu

SEQ ID NO: 588784 - RNA, 14 nt, Escherichia coli CFT073
aaaucacgauggcg

SEQ ID NO: 588785 - RNA, 13 nt, Escherichia coli CFT073
aaaucaagcgccg

SEQ ID NO: 588786 - RNA, 18 nt, Escherichia coli CFT073
aaaucaauuaauccagac

SEQ ID NO: 588787 - RNA, 18 nt, Escherichia coli CFT073
aaaucaccgccaccagcg

SEQ ID NO: 588788 - RNA, 21 nt, Escherichia coli CFT073
ccagcgauacucucgcgucgu

SEQ ID NO: 588789 - RNA, 11 nt, Escherichia coli CFT073
ccagcgaugcu

SEQ ID NO: 588790 - RNA, 15 nt, Escherichia coli CFT073
ccagcgauccgggua

SEQ ID NO: 588791 - RNA, 19 nt, Escherichia coli CFT073
ccagccugcgcuaccagaa

SEQ ID NO: 588792 - RNA, 15 nt, Escherichia coli CFT073
ccagccuccaaccca

SEQ ID NO: 588793 - RNA, 20 nt, Escherichia coli CFT073
ccagccuacagaacgcugca

SEQ ID NO: 588794 - RNA, 12 nt, Escherichia coli CFT073
ccagccggcaaa

SEQ ID NO: 588795 - RNA, 17 nt, Escherichia coli CFT073
ccagccgaacagugcca

SEQ ID NO: 588796 - RNA, 16 nt, Escherichia coli CFT073
aaaguuuugugcuuug

SEQ ID NO: 588797 - RNA, 18 nt, Escherichia coli CFT073
aaauaacccgccaugccg

SEQ ID NO: 588798 - RNA, 19 nt, Escherichia coli CFT073
aaauaacagugauugcuuu

SEQ ID NO: 588799 - RNA, 18 nt, Escherichia coli CFT073
ccacgcucagcaaucgca

SEQ ID NO: 588800 - RNA, 19 nt, Escherichia coli CFT073
ccacggcuaccguugcggc

SEQ ID NO: 588801 - RNA, 20 nt, Escherichia coli CFT073
ccacggcggugucgccagaa

SEQ ID NO: 588802 - RNA, 13 nt, Escherichia coli CFT073
ccacgccuuuuuu

SEQ ID NO: 588803 - RNA, 21 nt, Escherichia coli CFT073
ccacgccgauaaucaacgcgc

SEQ ID NO: 588804 - RNA, 17 nt, Escherichia coli CFT073
aaagugugcaucgccgg

SEQ ID NO: 588805 - RNA, 14 nt, Escherichia coli CFT073
ccacgaccagcgca

SEQ ID NO: 588806 - RNA, 15 nt, Escherichia coli CFT073
ccaccguguauuucu

SEQ ID NO: 588807 - RNA, 15 nt, Escherichia coli CFT073
ccaccuccacgccca

SEQ ID NO: 588808 - RNA, 21 nt, Escherichia coli CFT073
ccaccuccgcuaaauccgccg

SEQ ID NO: 588809 - RNA, 19 nt, Escherichia coli CFT073
ccaccguacgccagcguca

SEQ ID NO: 588810 - RNA, 21 nt, Escherichia coli CFT073
ccaccguacgccagcgucacu

SEQ ID NO: 588811 - RNA, 23 nt, Escherichia coli CFT073
ccaccgaccaggcaaaccaguac

SEQ ID NO: 588812 - RNA, 20 nt, Escherichia coli CFT073
ccagagcagcaacaagccca

SEQ ID NO: 588813 - RNA, 19 nt, Escherichia coli CFT073
ccagagccgcgccgcuacu

SEQ ID NO: 588814 - RNA, 20 nt, Escherichia coli CFT073
ccagagcagcgguaagguga

SEQ ID NO: 588815 - RNA, 17 nt, Escherichia coli CFT073
ccagagagcggagcaau

SEQ ID NO: 588816 - RNA, 14 nt, Escherichia coli CFT073
ccagaccggcaauc

SEQ ID NO: 588817 - RNA, 23 nt, Escherichia coli CFT073
ccagaccggcaaucgcgccagaa

SEQ ID NO: 588818 - RNA, 15 nt, Escherichia coli CFT073
ccagacccggcaagc

SEQ ID NO: 588819 - RNA, 13 nt, Escherichia coli CFT073
ccagaccgccuuu

SEQ ID NO: 588820 - RNA, 16 nt, Escherichia coli CFT073
ccagaaucgccaacgc

SEQ ID NO: 588821 - RNA, 15 nt, Escherichia coli CFT073
ccagaaucgccagca

SEQ ID NO: 588822 - RNA, 17 nt, Escherichia coli CFT073
ccagaaucgccagcauc

SEQ ID NO: 588823 - RNA, 19 nt, Escherichia coli CFT073
ccagacaaaacugacgcca

SEQ ID NO: 588824 - RNA, 17 nt, Escherichia coli CFT073
ccagacaaucauuucca

SEQ ID NO: 588825 - RNA, 21 nt, Escherichia coli CFT073
ccagacaauggcccgccgcau

SEQ ID NO: 588826 - RNA, 15 nt, Escherichia coli CFT073
ccagacaauuaacac

SEQ ID NO: 588827 - RNA, 20 nt, Escherichia coli CFT073
ccagacaauugccgcuaguu

SEQ ID NO: 588828 - RNA, 17 nt, Escherichia coli CFT073
ccagaccaaacauacga

SEQ ID NO: 588829 - RNA, 17 nt, Escherichia coli CFT073
ccagacagucgccgcuu

SEQ ID NO: 588830 - RNA, 22 nt, Escherichia coli CFT073
ccagaccagcuaccacgccgau

SEQ ID NO: 588831 - RNA, 19 nt, Escherichia coli CFT073
ccagaccauauaucagcgc

SEQ ID NO: 588832 - RNA, 15 nt, Escherichia coli CFT073
ccagacccagcuuca

SEQ ID NO: 588833 - RNA, 21 nt, Escherichia coli CFT073
ccagcacagaucgcacuuaau

SEQ ID NO: 588834 - RNA, 15 nt, Escherichia coli CFT073
ccagcaccaacaaag

SEQ ID NO: 588835 - RNA, 14 nt, Escherichia coli CFT073
ccagcaagcgcacc

SEQ ID NO: 588836 - RNA, 17 nt, Escherichia coli CFT073
ccagauagccgccagag

SEQ ID NO: 588837 - RNA, 16 nt, Escherichia coli CFT073
ccagauaagacacuga

SEQ ID NO: 588838 - RNA, 15 nt, Escherichia coli CFT073
ccagauaaaacacau

SEQ ID NO: 588839 - RNA, 15 nt, Escherichia coli CFT073
ccagaucacgcagca

SEQ ID NO: 588840 - RNA, 14 nt, Escherichia coli CFT073
ccagaucagaacgc

SEQ ID NO: 588841 - RNA, 14 nt, Escherichia coli CFT073
ccacgggaaauagc

SEQ ID NO: 588842 - RNA, 20 nt, Escherichia coli CFT073
ccacuaacccuucgccagca

SEQ ID NO: 588843 - RNA, 23 nt, Escherichia coli CFT073
ccacuaacuguuucgcggcaaac

SEQ ID NO: 588844 - RNA, 14 nt, Escherichia coli CFT073
ccacguuagcaaau

SEQ ID NO: 588845 - RNA, 11 nt, Escherichia coli CFT073
ccacguucucu

SEQ ID NO: 588846 - RNA, 18 nt, Escherichia coli CFT073
ccacguacugaucuuuuu

SEQ ID NO: 588847 - RNA, 12 nt, Escherichia coli CFT073
ccagaauacccg

SEQ ID NO: 588848 - RNA, 18 nt, Escherichia coli CFT073
ccagaauacccgaagcgc

SEQ ID NO: 588849 - RNA, 17 nt, Escherichia coli CFT073
ccagaaaaagaaugcgc

SEQ ID NO: 588850 - RNA, 17 nt, Escherichia coli CFT073
ccacuuuauagcuuuuc

SEQ ID NO: 588851 - RNA, 19 nt, Escherichia coli CFT073
ccacuuucacgccgccaaa

SEQ ID NO: 588852 - RNA, 22 nt, Escherichia coli CFT073
ccacuuuggugaaugccugauc

SEQ ID NO: 588853 - RNA, 22 nt, Escherichia coli CFT073
ccacuuugucguaagcgccaaa

SEQ ID NO: 588854 - RNA, 12 nt, Escherichia coli CFT073
ccacuuuuaaau

SEQ ID NO: 588855 - RNA, 15 nt, Escherichia coli CFT073
ccacuucuggcggcg

SEQ ID NO: 588856 - RNA, 16 nt, Escherichia coli CFT073
ccacuuccugcgccag

SEQ ID NO: 588857 - RNA, 12 nt, Escherichia coli CFT073
ccacuuccgcgu

SEQ ID NO: 588858 - RNA, 14 nt, Escherichia coli CFT073
ccacuuccaccacu

SEQ ID NO: 588859 - RNA, 22 nt, Escherichia coli CFT073
ccacucacuaccagugccagaa

SEQ ID NO: 588860 - RNA, 15 nt, Escherichia coli CFT073
ccacugaccgcccgg

SEQ ID NO: 588861 - RNA, 14 nt, Escherichia coli CFT073
ccacugaauaaagu

SEQ ID NO: 588862 - RNA, 18 nt, Escherichia coli CFT073
ccacugacaaucgccagu

SEQ ID NO: 588863 - RNA, 17 nt, Escherichia coli CFT073
ccacucaccgccguuac

SEQ ID NO: 588864 - RNA, 16 nt, Escherichia coli CFT073
ccaauuugcgccgccg

SEQ ID NO: 588865 - RNA, 21 nt, Escherichia coli CFT073
ccacaauggcauauuccgcca

SEQ ID NO: 588866 - RNA, 21 nt, Escherichia coli CFT073
ccacaaucgcuucaucgccca

SEQ ID NO: 588867 - RNA, 22 nt, Escherichia coli CFT073
ccaauucuccgcgagcgauuuc

SEQ ID NO: 588868 - RNA, 23 nt, Escherichia coli CFT073
ccaauguggaaagccccagccca

SEQ ID NO: 588869 - RNA, 19 nt, Escherichia coli CFT073
ccaauucaaugccccacag

SEQ ID NO: 588870 - RNA, 21 nt, Escherichia coli CFT073
ccaauggaauagcgaagaaua

SEQ ID NO: 588871 - RNA, 19 nt, Escherichia coli CFT073
ccaauguacggaauaagua

SEQ ID NO: 588872 - RNA, 16 nt, Escherichia coli CFT073
ccaaguuucaauaucc

SEQ ID NO: 588873 - RNA, 21 nt, Escherichia coli CFT073
ccaauaaaacgcaccggcaag

SEQ ID NO: 588874 - RNA, 20 nt, Escherichia coli CFT073
ccaauaaagaacccggcaau

SEQ ID NO: 588875 - RNA, 21 nt, Escherichia coli CFT073
ccaauacgauuaacgccagac

SEQ ID NO: 588876 - RNA, 16 nt, Escherichia coli CFT073
ccaauacgauuaacgc

SEQ ID NO: 588877 - RNA, 19 nt, Escherichia coli CFT073
ccaauaaucugcccggcau

SEQ ID NO: 588878 - RNA, 12 nt, Escherichia coli CFT073
ccacaccaguga

SEQ ID NO: 588879 - RNA, 16 nt, Escherichia coli CFT073
ccacagcccgccacaa

SEQ ID NO: 588880 - RNA, 20 nt, Escherichia coli CFT073
ccacaccgccuaccgccagu

SEQ ID NO: 588881 - RNA, 20 nt, Escherichia coli CFT073
ccacaguuuuacugcagcca

SEQ ID NO: 588882 - RNA, 19 nt, Escherichia coli CFT073
ccacauaaccaaucaucga

SEQ ID NO: 588883 - RNA, 23 nt, Escherichia coli CFT073
ccacagugacccgcagccagcac

SEQ ID NO: 588884 - RNA, 18 nt, Escherichia coli CFT073
ccacauccgcgguaucgc

SEQ ID NO: 588885 - RNA, 20 nt, Escherichia coli CFT073
ccacaucucaauccgcuuac

SEQ ID NO: 588886 - RNA, 16 nt, Escherichia coli CFT073
ccacauggaaugguca

SEQ ID NO: 588887 - RNA, 12 nt, Escherichia coli CFT073
ccaccaccugca

SEQ ID NO: 588888 - RNA, 16 nt, Escherichia coli CFT073
ccaccagacgauggcu

SEQ ID NO: 588889 - RNA, 15 nt, Escherichia coli CFT073
ccacccaccagcgcc

SEQ ID NO: 588890 - RNA, 22 nt, Escherichia coli CFT073
ccaccaggaaaaagaucagcgg

SEQ ID NO: 588891 - RNA, 22 nt, Escherichia coli CFT073
ccaccaggaacucagcgugcca

SEQ ID NO: 588892 - RNA, 11 nt, Escherichia coli CFT073
ccaccagcgua

SEQ ID NO: 588893 - RNA, 20 nt, Escherichia coli CFT073
ccaccagcaccgcgacaauc

SEQ ID NO: 588894 - RNA, 17 nt, Escherichia coli CFT073
ccaccagcacugauuuu

SEQ ID NO: 588895 - RNA, 16 nt, Escherichia coli CFT073
cauugugggauuccag

SEQ ID NO: 588896 - RNA, 20 nt, Escherichia coli CFT073
cauugugggauuccagcgcc

SEQ ID NO: 588897 - RNA, 18 nt, Escherichia coli CFT073
cauuguguagggcagcgu

SEQ ID NO: 588898 - RNA, 21 nt, Escherichia coli CFT073
cauugugucugauugccggau

SEQ ID NO: 588899 - RNA, 19 nt, Escherichia coli CFT073
cauuguguuaucccgauga

SEQ ID NO: 588900 - RNA, 20 nt, Escherichia coli CFT073
cauuuacccgauccacugaa

SEQ ID NO: 588901 - RNA, 15 nt, Escherichia coli CFT073
cauugguaucggcgg

SEQ ID NO: 588902 - RNA, 18 nt, Escherichia coli CFT073
cauugguauuccaguuca

SEQ ID NO: 588903 - RNA, 20 nt, Escherichia coli CFT073
cauugguauuccaguucaga

SEQ ID NO: 588904 - RNA, 20 nt, Escherichia coli CFT073
cauuggguucaucugauagc

SEQ ID NO: 588905 - RNA, 20 nt, Escherichia coli CFT073
cauuguauauugcagcaacg

SEQ ID NO: 588906 - RNA, 13 nt, Escherichia coli CFT073
cauugccugaugu

SEQ ID NO: 588907 - RNA, 17 nt, Escherichia coli CFT073
cauugcucuuucacuuu

SEQ ID NO: 588908 - RNA, 18 nt, Escherichia coli CFT073
cauuggcggcagaugacu

SEQ ID NO: 588909 - RNA, 14 nt, Escherichia coli CFT073
cauuggcaaaacca

SEQ ID NO: 588910 - RNA, 21 nt, Escherichia coli CFT073
cauuuauuccgcaccaacgca

SEQ ID NO: 588911 - RNA, 22 nt, Escherichia coli CFT073
cauuugucuguuucuguugcca

SEQ ID NO: 588912 - RNA, 13 nt, Escherichia coli CFT073
cauuuucgcuggc

SEQ ID NO: 588913 - RNA, 13 nt, Escherichia coli CFT073
cauuuucauuuaa

SEQ ID NO: 588914 - RNA, 21 nt, Escherichia coli CFT073
cauuuuccagcucuucuacau

SEQ ID NO: 588915 - RNA, 16 nt, Escherichia coli CFT073
cauuuugcacauucca

SEQ ID NO: 588916 - RNA, 12 nt, Escherichia coli CFT073
cauuuugcuauu

SEQ ID NO: 588917 - RNA, 12 nt, Escherichia coli CFT073
cauuuugcuggc

SEQ ID NO: 588918 - RNA, 14 nt, Escherichia coli CFT073
cauuuuguaggccu

SEQ ID NO: 588919 - RNA, 17 nt, Escherichia coli CFT073
cauuugcggguucuggc

SEQ ID NO: 588920 - RNA, 19 nt, Escherichia coli CFT073
cauuucugcaaucgucugc

SEQ ID NO: 588921 - RNA, 18 nt, Escherichia coli CFT073
cauuucuggcggcgugau

SEQ ID NO: 588922 - RNA, 23 nt, Escherichia coli CFT073
cauuucuggcggcgugaugccga

SEQ ID NO: 588923 - RNA, 14 nt, Escherichia coli CFT073
cauuugaucgcugg

SEQ ID NO: 588924 - RNA, 12 nt, Escherichia coli CFT073
ccaaaaagcguc

SEQ ID NO: 588925 - RNA, 15 nt, Escherichia coli CFT073
ccaaaacagcgacac

SEQ ID NO: 588926 - RNA, 12 nt, Escherichia coli CFT073
ccaaaaccacag

SEQ ID NO: 588927 - RNA, 20 nt, Escherichia coli CFT073
ccaaaaccgaggagcaacaa

SEQ ID NO: 588928 - RNA, 12 nt, Escherichia coli CFT073
ccaaaaccgcuc

SEQ ID NO: 588929 - RNA, 15 nt, Escherichia coli CFT073
ccaaaaccggcucua

SEQ ID NO: 588930 - RNA, 16 nt, Escherichia coli CFT073
ccaaaacgcgccaggu

SEQ ID NO: 588931 - RNA, 16 nt, Escherichia coli CFT073
ccaaaacucgcuggcg

SEQ ID NO: 588932 - RNA, 14 nt, Escherichia coli CFT073
ccaaaagcuaacag

SEQ ID NO: 588933 - RNA, 17 nt, Escherichia coli CFT073
ccaaaagcucggucauu

SEQ ID NO: 588934 - RNA, 16 nt, Escherichia coli CFT073
ccaaacagcgccagau

SEQ ID NO: 588935 - RNA, 13 nt, Escherichia coli CFT073
ccaaaccagccgc

SEQ ID NO: 588936 - RNA, 16 nt, Escherichia coli CFT073
ccaaacgcccagcuaa

SEQ ID NO: 588937 - RNA, 23 nt, Escherichia coli CFT073
ccaaacugauuuagcaucagcgc

SEQ ID NO: 588938 - RNA, 15 nt, Escherichia coli CFT073
ccaaaugcagcaacc

SEQ ID NO: 588939 - RNA, 23 nt, Escherichia coli CFT073
ccaaaugucaccagccggucauu

SEQ ID NO: 588940 - RNA, 18 nt, Escherichia coli CFT073
ccaacaagcaccggcacc

SEQ ID NO: 588941 - RNA, 18 nt, Escherichia coli CFT073
ccaacacccacagccaug

SEQ ID NO: 588942 - RNA, 21 nt, Escherichia coli CFT073
ccaacuggcgcagcaguucgc

SEQ ID NO: 588943 - RNA, 12 nt, Escherichia coli CFT073
ccaacucuuuac

SEQ ID NO: 588944 - RNA, 22 nt, Escherichia coli CFT073
ccaacucuuuuaccaccgcaaa

SEQ ID NO: 588945 - RNA, 22 nt, Escherichia coli CFT073
ccaaccccaauguaaccacagg

SEQ ID NO: 588946 - RNA, 13 nt, Escherichia coli CFT073
ccaacguguugcu

SEQ ID NO: 588947 - RNA, 14 nt, Escherichia coli CFT073
ccaacuccaccaau

SEQ ID NO: 588948 - RNA, 14 nt, Escherichia coli CFT073
caugcucaccaauc

SEQ ID NO: 588949 - RNA, 16 nt, Escherichia coli CFT073
caugcuaaugguugca

SEQ ID NO: 588950 - RNA, 17 nt, Escherichia coli CFT073
caugcugacugcgcucu

SEQ ID NO: 588951 - RNA, 14 nt, Escherichia coli CFT073
caugcucugccagc

SEQ ID NO: 588952 - RNA, 20 nt, Escherichia coli CFT073
caugcgggucgagaaaaucg

SEQ ID NO: 588953 - RNA, 23 nt, Escherichia coli CFT073
caugcuuaccaaaaugcugcaau

SEQ ID NO: 588954 - RNA, 19 nt, Escherichia coli CFT073
cauggaauagaaucaccgc

SEQ ID NO: 588955 - RNA, 14 nt, Escherichia coli CFT073
caugcuuuugcgcc

SEQ ID NO: 588956 - RNA, 21 nt, Escherichia coli CFT073
cauggaaucuuuaaugacuga

SEQ ID NO: 588957 - RNA, 14 nt, Escherichia coli CFT073
caugcgcgccggac

SEQ ID NO: 588958 - RNA, 14 nt, Escherichia coli CFT073
caugcgcauaagac

SEQ ID NO: 588959 - RNA, 16 nt, Escherichia coli CFT073
caugcgcauaagaccg

SEQ ID NO: 588960 - RNA, 23 nt, Escherichia coli CFT073
caugcgcauaagaccgugagcaa

SEQ ID NO: 588961 - RNA, 14 nt, Escherichia coli CFT073
caugcgaaugccaa

SEQ ID NO: 588962 - RNA, 22 nt, Escherichia coli CFT073
caugccuuguuuaaucaucggg

SEQ ID NO: 588963 - RNA, 14 nt, Escherichia coli CFT073
caucgcccugaugg

SEQ ID NO: 588964 - RNA, 12 nt, Escherichia coli CFT073
cauggcgugaca

SEQ ID NO: 588965 - RNA, 15 nt, Escherichia coli CFT073
caugggugccggaua

SEQ ID NO: 588966 - RNA, 22 nt, Escherichia coli CFT073
caugguacuggcgacugccagc

SEQ ID NO: 588967 - RNA, 22 nt, Escherichia coli CFT073
cauguaacccuuugcggugcag

SEQ ID NO: 588968 - RNA, 22 nt, Escherichia coli CFT073
caugguuagccuguaaugucau

SEQ ID NO: 588969 - RNA, 15 nt, Escherichia coli CFT073
cauggugaugaucgc

SEQ ID NO: 588970 - RNA, 17 nt, Escherichia coli CFT073
cauuaacucacuggcgc

SEQ ID NO: 588971 - RNA, 18 nt, Escherichia coli CFT073
cauguugcgcuucaccag

SEQ ID NO: 588972 - RNA, 18 nt, Escherichia coli CFT073
cauuacaacgcaauaucc

SEQ ID NO: 588973 - RNA, 17 nt, Escherichia coli CFT073
cauuacacugaaaaaaa

SEQ ID NO: 588974 - RNA, 19 nt, Escherichia coli CFT073
cauuacacugaaaaaaagu

SEQ ID NO: 588975 - RNA, 19 nt, Escherichia coli CFT073
cauuaaugucggaugcggc

SEQ ID NO: 588976 - RNA, 18 nt, Escherichia coli CFT073
cauuacaggcaucuucca

SEQ ID NO: 588977 - RNA, 19 nt, Escherichia coli CFT073
cauuaccccguaauaacca

SEQ ID NO: 588978 - RNA, 17 nt, Escherichia coli CFT073
cauuaaggcauaagcgc

SEQ ID NO: 588979 - RNA, 18 nt, Escherichia coli CFT073
cauuaaguguaaucagcc

SEQ ID NO: 588980 - RNA, 11 nt, Escherichia coli CFT073
cauuaauaccg

SEQ ID NO: 588981 - RNA, 18 nt, Escherichia coli CFT073
cauuagugcgcaguugcc

SEQ ID NO: 588982 - RNA, 22 nt, Escherichia coli CFT073
cauuagugcgcaguugccggau

SEQ ID NO: 588983 - RNA, 16 nt, Escherichia coli CFT073
cauuagcauuaacagu

SEQ ID NO: 588984 - RNA, 21 nt, Escherichia coli CFT073
caugucagacaacaugccgaa

SEQ ID NO: 588985 - RNA, 15 nt, Escherichia coli CFT073
caugucaguugcaua

SEQ ID NO: 588986 - RNA, 17 nt, Escherichia coli CFT073
caugucaucaauugcgc

SEQ ID NO: 588987 - RNA, 16 nt, Escherichia coli CFT073
caugguuuacggcggu

SEQ ID NO: 588988 - RNA, 16 nt, Escherichia coli CFT073
cauguguucugcauau

SEQ ID NO: 588989 - RNA, 15 nt, Escherichia coli CFT073
cauguuaaccaacca

SEQ ID NO: 588990 - RNA, 15 nt, Escherichia coli CFT073
cauguuaugaauauc

SEQ ID NO: 588991 - RNA, 15 nt, Escherichia coli CFT073
caugugauuugaugu

SEQ ID NO: 588992 - RNA, 21 nt, Escherichia coli CFT073
cauucaggccaaagccgccga

SEQ ID NO: 588993 - RNA, 18 nt, Escherichia coli CFT073
cauucagacacgccgcca

SEQ ID NO: 588994 - RNA, 15 nt, Escherichia coli CFT073
cauucagacaggcga

SEQ ID NO: 588995 - RNA, 21 nt, Escherichia coli CFT073
cauuaucacccugaucaauaa

SEQ ID NO: 588996 - RNA, 15 nt, Escherichia coli CFT073
cauuaucucaacaca

SEQ ID NO: 588997 - RNA, 16 nt, Escherichia coli CFT073
cauuccagucugcuga

SEQ ID NO: 588998 - RNA, 16 nt, Escherichia coli CFT073
cauucccuacgcgaua

SEQ ID NO: 588999 - RNA, 15 nt, Escherichia coli CFT073
cauuccuugaaaucg

SEQ ID NO: 589000 - RNA, 14 nt, Escherichia coli CFT073
cauuccgccgccca

SEQ ID NO: 589001 - RNA, 21 nt, Escherichia coli CFT073
cauuccgcccagaccgugcgc

SEQ ID NO: 589002 - RNA, 23 nt, Escherichia coli CFT073
cauucgcgcacggugcaucuuca

SEQ ID NO: 589003 - RNA, 20 nt, Escherichia coli CFT073
cauucgcaauacauaagcac

SEQ ID NO: 589004 - RNA, 17 nt, Escherichia coli CFT073
cauucgccguuaccagc

SEQ ID NO: 589005 - RNA, 15 nt, Escherichia coli CFT073
cauugaguagccucu

SEQ ID NO: 589006 - RNA, 18 nt, Escherichia coli CFT073
cauugauuuucaaaucga

SEQ ID NO: 589007 - RNA, 22 nt, Escherichia coli CFT073
cauugauucgccgccgcauauc

SEQ ID NO: 589008 - RNA, 19 nt, Escherichia coli CFT073
cauucuugucagaugcggc

SEQ ID NO: 589009 - RNA, 15 nt, Escherichia coli CFT073
cauugaauuaaaaug

SEQ ID NO: 589010 - RNA, 21 nt, Escherichia coli CFT073
cauugaauuaaaauguguacu

SEQ ID NO: 589011 - RNA, 14 nt, Escherichia coli CFT073
caguucugcagcgu

SEQ ID NO: 589012 - RNA, 13 nt, Escherichia coli CFT073
caguugaccugcg

SEQ ID NO: 589013 - RNA, 16 nt, Escherichia coli CFT073
caguucuuucaggcgu

SEQ ID NO: 589014 - RNA, 15 nt, Escherichia coli CFT073
caguugacagccaca

SEQ ID NO: 589015 - RNA, 22 nt, Escherichia coli CFT073
caguugauuaugaucgccacgc

SEQ ID NO: 589016 - RNA, 13 nt, Escherichia coli CFT073
caguucagcugcc

SEQ ID NO: 589017 - RNA, 15 nt, Escherichia coli CFT073
caguucaucaacgcc

SEQ ID NO: 589018 - RNA, 20 nt, Escherichia coli CFT073
caguucacguccggcagcag

SEQ ID NO: 589019 - RNA, 17 nt, Escherichia coli CFT073
caguuauagcgcagacg

SEQ ID NO: 589020 - RNA, 19 nt, Escherichia coli CFT073
caguucaacggugucgaua

SEQ ID NO: 589021 - RNA, 15 nt, Escherichia coli CFT073
caguucaaugcgccg

SEQ ID NO: 589022 - RNA, 21 nt, Escherichia coli CFT073
caguucaccaccuggcggcgu

SEQ ID NO: 589023 - RNA, 23 nt, Escherichia coli CFT073
caguucaccaccuggcggcgugu

SEQ ID NO: 589024 - RNA, 14 nt, Escherichia coli CFT073
caguucacccgguc

SEQ ID NO: 589025 - RNA, 16 nt, Escherichia coli CFT073
caguucaugacgugac

SEQ ID NO: 589026 - RNA, 14 nt, Escherichia coli CFT073
caguuccugaucga

SEQ ID NO: 589027 - RNA, 17 nt, Escherichia coli CFT073
cagugguaaacaccacg

SEQ ID NO: 589028 - RNA, 15 nt, Escherichia coli CFT073
cagugguaucaauau

SEQ ID NO: 589029 - RNA, 18 nt, Escherichia coli CFT073
cagugguaucaauaucca

SEQ ID NO: 589030 - RNA, 13 nt, Escherichia coli CFT073
cagugaacugugg

SEQ ID NO: 589031 - RNA, 20 nt, Escherichia coli CFT073
cagucgcgcaauugccagac

SEQ ID NO: 589032 - RNA, 23 nt, Escherichia coli CFT073
cagucgcuuuaccgcugcgccau

SEQ ID NO: 589033 - RNA, 14 nt, Escherichia coli CFT073
cagugaggaugcga

SEQ ID NO: 589034 - RNA, 18 nt, Escherichia coli CFT073
cagugaaucucaggcaaa

SEQ ID NO: 589035 - RNA, 18 nt, Escherichia coli CFT073
cagugaccaucuuccagc

SEQ ID NO: 589036 - RNA, 14 nt, Escherichia coli CFT073
cagugacccgcagc

SEQ ID NO: 589037 - RNA, 17 nt, Escherichia coli CFT073
cagugacgccgccagau

SEQ ID NO: 589038 - RNA, 17 nt, Escherichia coli CFT073
cagugccgaugccgcua

SEQ ID NO: 589039 - RNA, 16 nt, Escherichia coli CFT073
cagugccgcgccgcgc

SEQ ID NO: 589040 - RNA, 15 nt, Escherichia coli CFT073
caguacagccgccag

SEQ ID NO: 589041 - RNA, 21 nt, Escherichia coli CFT073
caguaaaccaauuucugugca

SEQ ID NO: 589042 - RNA, 20 nt, Escherichia coli CFT073
caguaaacugacccgcucgu

SEQ ID NO: 589043 - RNA, 23 nt, Escherichia coli CFT073
caguaaacugacccgcucguuuu

SEQ ID NO: 589044 - RNA, 16 nt, Escherichia coli CFT073
caguaaacugucaaca

SEQ ID NO: 589045 - RNA, 22 nt, Escherichia coli CFT073
caguaaagauaaccucauuaau

SEQ ID NO: 589046 - RNA, 13 nt, Escherichia coli CFT073
caguaaccagccg

SEQ ID NO: 589047 - RNA, 19 nt, Escherichia coli CFT073
caguaagggaucacgcggu

SEQ ID NO: 589048 - RNA, 17 nt, Escherichia coli CFT073
caguccggcuuaucugc

SEQ ID NO: 589049 - RNA, 14 nt, Escherichia coli CFT073
caguaccagcaacg

SEQ ID NO: 589050 - RNA, 16 nt, Escherichia coli CFT073
caguaccagcaacgcu

SEQ ID NO: 589051 - RNA, 15 nt, Escherichia coli CFT073
caguaccagcagcgc

SEQ ID NO: 589052 - RNA, 16 nt, Escherichia coli CFT073
caguaccgcagccgga

SEQ ID NO: 589053 - RNA, 12 nt, Escherichia coli CFT073
caguaccgccag

SEQ ID NO: 589054 - RNA, 17 nt, Escherichia coli CFT073
cagucccguacccagca

SEQ ID NO: 589055 - RNA, 21 nt, Escherichia coli CFT073
caggguuucgacggcaccaaa

SEQ ID NO: 589056 - RNA, 18 nt, Escherichia coli CFT073
caggucacgggcggugcg

SEQ ID NO: 589057 - RNA, 22 nt, Escherichia coli CFT073
caggucauuauucauuuuucgc

SEQ ID NO: 589058 - RNA, 15 nt, Escherichia coli CFT073
cagguaguugccagc

SEQ ID NO: 589059 - RNA, 14 nt, Escherichia coli CFT073
cagguaaacaccuu

SEQ ID NO: 589060 - RNA, 20 nt, Escherichia coli CFT073
cagguaacugacuccgauau

SEQ ID NO: 589061 - RNA, 19 nt, Escherichia coli CFT073
cagguaaucaaugcgguaa

SEQ ID NO: 589062 - RNA, 18 nt, Escherichia coli CFT073
cagguaauuugaucaaau

SEQ ID NO: 589063 - RNA, 17 nt, Escherichia coli CFT073
cagguguuuaaccaaca

SEQ ID NO: 589064 - RNA, 24 nt, Escherichia coli CFT073
cagguuaacggaggagagugcaau

SEQ ID NO: 589065 - RNA, 22 nt, Escherichia coli CFT073
cagguuacgcauggucaguuga

SEQ ID NO: 589066 - RNA, 21 nt, Escherichia coli CFT073
caggugcccgcguuucgcugc

SEQ ID NO: 589067 - RNA, 14 nt, Escherichia coli CFT073
caggugauggcagc

SEQ ID NO: 589068 - RNA, 20 nt, Escherichia coli CFT073
caggugacaccaccgcccgg

SEQ ID NO: 589069 - RNA, 17 nt, Escherichia coli CFT073
caggucgcuugccgcca

SEQ ID NO: 589070 - RNA, 17 nt, Escherichia coli CFT073
caggucgccagaaacca

SEQ ID NO: 589071 - RNA, 22 nt, Escherichia coli CFT073
caucauccggcacuuuuucauc

SEQ ID NO: 589072 - RNA, 15 nt, Escherichia coli CFT073
caucaucgcagauuu

SEQ ID NO: 589073 - RNA, 12 nt, Escherichia coli CFT073
caucauccagca

SEQ ID NO: 589074 - RNA, 18 nt, Escherichia coli CFT073
caucauccccaucgccgc

SEQ ID NO: 589075 - RNA, 22 nt, Escherichia coli CFT073
caucauccccguaucuucaugc

SEQ ID NO: 589076 - RNA, 20 nt, Escherichia coli CFT073
caucaucaagguaauuguuc

SEQ ID NO: 589077 - RNA, 22 nt, Escherichia coli CFT073
caucaugggcaagguauugcac

SEQ ID NO: 589078 - RNA, 13 nt, Escherichia coli CFT073
caucauuaaaggc

SEQ ID NO: 589079 - RNA, 17 nt, Escherichia coli CFT073
caucaccaguaccgcca

SEQ ID NO: 589080 - RNA, 21 nt, Escherichia coli CFT073
caucaagcuaacgaacgcagu

SEQ ID NO: 589081 - RNA, 17 nt, Escherichia coli CFT073
caucaccgccaggccua

SEQ ID NO: 589082 - RNA, 20 nt, Escherichia coli CFT073
caucagucuuaagcggcuaa

SEQ ID NO: 589083 - RNA, 16 nt, Escherichia coli CFT073
caucaguugcaccuga

SEQ ID NO: 589084 - RNA, 22 nt, Escherichia coli CFT073
caucaguuucgaucagcaauuu

SEQ ID NO: 589085 - RNA, 20 nt, Escherichia coli CFT073
cauccacaccaaaauaacga

SEQ ID NO: 589086 - RNA, 14 nt, Escherichia coli CFT073
caucauugccgccu

SEQ ID NO: 589087 - RNA, 17 nt, Escherichia coli CFT073
cauccacugcauacuga

SEQ ID NO: 589088 - RNA, 13 nt, Escherichia coli CFT073
cauccccacagaa

SEQ ID NO: 589089 - RNA, 17 nt, Escherichia coli CFT073
cauccccaucaacgcag

SEQ ID NO: 589090 - RNA, 21 nt, Escherichia coli CFT073
caucgaauaaauugagcugcg

SEQ ID NO: 589091 - RNA, 18 nt, Escherichia coli CFT073
caucgacaguaccagcag

SEQ ID NO: 589092 - RNA, 21 nt, Escherichia coli CFT073
caucgacauaauugaccagau

SEQ ID NO: 589093 - RNA, 18 nt, Escherichia coli CFT073
caucgacagcaaauugcg

SEQ ID NO: 589094 - RNA, 19 nt, Escherichia coli CFT073
caucgacagcaaauugcgc

SEQ ID NO: 589095 - RNA, 15 nt, Escherichia coli CFT073
caucgaaccaucggc

SEQ ID NO: 589096 - RNA, 14 nt, Escherichia coli CFT073
cauccuucagugcc

SEQ ID NO: 589097 - RNA, 21 nt, Escherichia coli CFT073
cauccuguucauuuuuaggau

SEQ ID NO: 589098 - RNA, 18 nt, Escherichia coli CFT073
cauccgcgcacaggcggc

SEQ ID NO: 589099 - RNA, 18 nt, Escherichia coli CFT073
cauccgcgcuuucuggcg

SEQ ID NO: 589100 - RNA, 16 nt, Escherichia coli CFT073
cauccgcgugacgcug

SEQ ID NO: 589101 - RNA, 13 nt, Escherichia coli CFT073
cauccgcgcgcgu

SEQ ID NO: 589102 - RNA, 17 nt, Escherichia coli CFT073
cauccugaauauccugu

SEQ ID NO: 589103 - RNA, 21 nt, Escherichia coli CFT073
cauccgcuucaggaauaagac

SEQ ID NO: 589104 - RNA, 12 nt, Escherichia coli CFT073
cauccggcaaca

SEQ ID NO: 589105 - RNA, 13 nt, Escherichia coli CFT073
caucgauuuacug

SEQ ID NO: 589106 - RNA, 20 nt, Escherichia coli CFT073
caucgcauccggcaaugcgc

SEQ ID NO: 589107 - RNA, 15 nt, Escherichia coli CFT073
caucgcaugccagcg

SEQ ID NO: 589108 - RNA, 15 nt, Escherichia coli CFT073
caucgauuuucugcu

SEQ ID NO: 589109 - RNA, 23 nt, Escherichia coli CFT073
caucgcaaaauacaccguuagag

SEQ ID NO: 589110 - RNA, 22 nt, Escherichia coli CFT073
caucgcccagccaucgacacca

SEQ ID NO: 589111 - RNA, 13 nt, Escherichia coli CFT073
caucgcccgcagg

SEQ ID NO: 589112 - RNA, 16 nt, Escherichia coli CFT073
caucgcccggcguggu

SEQ ID NO: 589113 - RNA, 14 nt, Escherichia coli CFT073
cauauauaaaauca

SEQ ID NO: 589114 - RNA, 21 nt, Escherichia coli CFT073
cauauaccacacccgcaagac

SEQ ID NO: 589115 - RNA, 16 nt, Escherichia coli CFT073
cauauaccgcaucagc

SEQ ID NO: 589116 - RNA, 14 nt, Escherichia coli CFT073
cauaucgaccagcg

SEQ ID NO: 589117 - RNA, 11 nt, Escherichia coli CFT073
cauauccagcg

SEQ ID NO: 589118 - RNA, 14 nt, Escherichia coli CFT073
cauaucagcgcaaa

SEQ ID NO: 589119 - RNA, 23 nt, Escherichia coli CFT073
caucaaaucugccguaacugcgc

SEQ ID NO: 589120 - RNA, 18 nt, Escherichia coli CFT073
cauaugcgccgcgauuaa

SEQ ID NO: 589121 - RNA, 20 nt, Escherichia coli CFT073
cauaugauaggcuucaaccg

SEQ ID NO: 589122 - RNA, 17 nt, Escherichia coli CFT073
cauaugcaaaucacgca

SEQ ID NO: 589123 - RNA, 21 nt, Escherichia coli CFT073
cauaugcacaugaugauggcu

SEQ ID NO: 589124 - RNA, 14 nt, Escherichia coli CFT073
caucaacugcgcua

SEQ ID NO: 589125 - RNA, 20 nt, Escherichia coli CFT073
caucaacgccugaugcgacg

SEQ ID NO: 589126 - RNA, 21 nt, Escherichia coli CFT073
caucaacgcagacgccguucc

SEQ ID NO: 589127 - RNA, 14 nt, Escherichia coli CFT073
cauaggcugccgac

SEQ ID NO: 589128 - RNA, 15 nt, Escherichia coli CFT073
cauagugccugaugc

SEQ ID NO: 589129 - RNA, 23 nt, Escherichia coli CFT073
cauaguugcgacugauagcggcg

SEQ ID NO: 589130 - RNA, 18 nt, Escherichia coli CFT073
cauagcuuuggcggcauc

SEQ ID NO: 589131 - RNA, 19 nt, Escherichia coli CFT073
cauaggccagccgccgcuc

SEQ ID NO: 589132 - RNA, 18 nt, Escherichia coli CFT073
cauaggccaucggcagca

SEQ ID NO: 589133 - RNA, 18 nt, Escherichia coli CFT073
cauagcguucgucgauau

SEQ ID NO: 589134 - RNA, 14 nt, Escherichia coli CFT073
cauaccgaucgcgg

SEQ ID NO: 589135 - RNA, 22 nt, Escherichia coli CFT073
cauaauauugccgggaacaccg

SEQ ID NO: 589136 - RNA, 19 nt, Escherichia coli CFT073
cauaauauagcagcgccgg

SEQ ID NO: 589137 - RNA, 21 nt, Escherichia coli CFT073
cauaauaugaccugacauuaa

SEQ ID NO: 589138 - RNA, 18 nt, Escherichia coli CFT073
cauaaucaaugccaggac

SEQ ID NO: 589139 - RNA, 13 nt, Escherichia coli CFT073
cauaaucauuaac

SEQ ID NO: 589140 - RNA, 18 nt, Escherichia coli CFT073
cauaaucauuaacggcca

SEQ ID NO: 589141 - RNA, 13 nt, Escherichia coli CFT073
cauaauccgccgc

SEQ ID NO: 589142 - RNA, 20 nt, Escherichia coli CFT073
cauaaucgggaugcguaaca

SEQ ID NO: 589143 - RNA, 16 nt, Escherichia coli CFT073
cauacagcaccgcccg

SEQ ID NO: 589144 - RNA, 13 nt, Escherichia coli CFT073
cauaccagcagca

SEQ ID NO: 589145 - RNA, 18 nt, Escherichia coli CFT073
cauaccagcagcaucacg

SEQ ID NO: 589146 - RNA, 18 nt, Escherichia coli CFT073
cauaccacuuccagcaga

SEQ ID NO: 589147 - RNA, 13 nt, Escherichia coli CFT073
cauaccauugcgc

SEQ ID NO: 589148 - RNA, 18 nt, Escherichia coli CFT073
cauacaggggaucgacgc

SEQ ID NO: 589149 - RNA, 13 nt, Escherichia coli CFT073
cauacauaaaucg

SEQ ID NO: 589150 - RNA, 22 nt, Escherichia coli CFT073
cauacauaacagaauaucugcg

SEQ ID NO: 589151 - RNA, 13 nt, Escherichia coli CFT073
cauacaucaacgc

SEQ ID NO: 589152 - RNA, 14 nt, Escherichia coli CFT073
cauacaucaacgcg

SEQ ID NO: 589153 - RNA, 13 nt, Escherichia coli CFT073
cauaaaucagcgu

SEQ ID NO: 589154 - RNA, 18 nt, Escherichia coli CFT073
cauaaacgccuuauccgg

SEQ ID NO: 589155 - RNA, 16 nt, Escherichia coli CFT073
cauaaacuacgcucgc

SEQ ID NO: 589156 - RNA, 18 nt, Escherichia coli CFT073
cauaaaagggcagcagga

SEQ ID NO: 589157 - RNA, 14 nt, Escherichia coli CFT073
cauaaacaccagca

SEQ ID NO: 589158 - RNA, 15 nt, Escherichia coli CFT073
cauaaacaccagcaa

SEQ ID NO: 589159 - RNA, 16 nt, Escherichia coli CFT073
cauaaacaccagcagc

SEQ ID NO: 589160 - RNA, 20 nt, Escherichia coli CFT073
cauaaacacgguuuuucauu

SEQ ID NO: 589161 - RNA, 20 nt, Escherichia coli CFT073
cauaauacugacaaaaccga

SEQ ID NO: 589162 - RNA, 18 nt, Escherichia coli CFT073
cauaaauuaccaccagcg

SEQ ID NO: 589163 - RNA, 14 nt, Escherichia coli CFT073
cauaaauuugugcc

SEQ ID NO: 589164 - RNA, 14 nt, Escherichia coli CFT073
cauaagcaccgaac

SEQ ID NO: 589165 - RNA, 15 nt, Escherichia coli CFT073
cauaagcgccaggaa

SEQ ID NO: 589166 - RNA, 15 nt, Escherichia coli CFT073
caguuugcguucaau

SEQ ID NO: 589167 - RNA, 17 nt, Escherichia coli CFT073
caguuucgaucagcaau

SEQ ID NO: 589168 - RNA, 19 nt, Escherichia coli CFT073
cauaaaaauugcggccuau

SEQ ID NO: 589169 - RNA, 18 nt, Escherichia coli CFT073
caguuuaccgagcgccgg

SEQ ID NO: 589170 - RNA, 22 nt, Escherichia coli CFT073
caguuuauccaucucuugcggc

SEQ ID NO: 589171 - RNA, 16 nt, Escherichia coli CFT073
caguuuauccugacga

SEQ ID NO: 589172 - RNA, 19 nt, Escherichia coli CFT073
caguuucagagcgaauuaa

SEQ ID NO: 589173 - RNA, 15 nt, Escherichia coli CFT073
caguuuagcucagaa

SEQ ID NO: 589174 - RNA, 13 nt, Escherichia coli CFT073
caguuuaucaauc

SEQ ID NO: 589175 - RNA, 19 nt, Escherichia coli CFT073
caguuuaucaaucucagca

SEQ ID NO: 589176 - RNA, 20 nt, Escherichia coli CFT073
caguuguaugucauaaaaau

SEQ ID NO: 589177 - RNA, 16 nt, Escherichia coli CFT073
caguugguagagcacg

SEQ ID NO: 589178 - RNA, 17 nt, Escherichia coli CFT073
caguugccggaugcggc

SEQ ID NO: 589179 - RNA, 23 nt, Escherichia coli CFT073
caguugcauaauuucuucguucg

SEQ ID NO: 589180 - RNA, 15 nt, Escherichia coli CFT073
cagcuugaaggguuu

SEQ ID NO: 589181 - RNA, 19 nt, Escherichia coli CFT073
cagcuucucgugaaauuca

SEQ ID NO: 589182 - RNA, 14 nt, Escherichia coli CFT073
cagcuugcagccgu

SEQ ID NO: 589183 - RNA, 17 nt, Escherichia coli CFT073
cagcuugagaaaaucgu

SEQ ID NO: 589184 - RNA, 17 nt, Escherichia coli CFT073
cagcuuaaucaccagcg

SEQ ID NO: 589185 - RNA, 15 nt, Escherichia coli CFT073
cagcuuacgcgccag

SEQ ID NO: 589186 - RNA, 18 nt, Escherichia coli CFT073
cagcuuacgcgccagagc

SEQ ID NO: 589187 - RNA, 15 nt, Escherichia coli CFT073
cagcuuagacaacgc

SEQ ID NO: 589188 - RNA, 15 nt, Escherichia coli CFT073
cagcuuagcggcgcg

SEQ ID NO: 589189 - RNA, 18 nt, Escherichia coli CFT073
cagcuucggcgacuauuu

SEQ ID NO: 589190 - RNA, 16 nt, Escherichia coli CFT073
cagcuucagcgucuuc

SEQ ID NO: 589191 - RNA, 22 nt, Escherichia coli CFT073
cagcuucacaaaggcuugcugc

SEQ ID NO: 589192 - RNA, 14 nt, Escherichia coli CFT073
cagcuuauccagca

SEQ ID NO: 589193 - RNA, 19 nt, Escherichia coli CFT073
cagcugggcgauuuucuac

SEQ ID NO: 589194 - RNA, 17 nt, Escherichia coli CFT073
cagcuggcgccaggcuu

SEQ ID NO: 589195 - RNA, 14 nt, Escherichia coli CFT073
cagcuggaguagau

SEQ ID NO: 589196 - RNA, 18 nt, Escherichia coli CFT073
cagcugcucccagcgcau

SEQ ID NO: 589197 - RNA, 17 nt, Escherichia coli CFT073
cagcugcucgcgauggc

SEQ ID NO: 589198 - RNA, 17 nt, Escherichia coli CFT073
cagcucgcgccaggugu

SEQ ID NO: 589199 - RNA, 16 nt, Escherichia coli CFT073
cagcugacugacuuca

SEQ ID NO: 589200 - RNA, 21 nt, Escherichia coli CFT073
cagcugaaaucaccgccacca

SEQ ID NO: 589201 - RNA, 23 nt, Escherichia coli CFT073
cagcugaaaucaccgccaccagc

SEQ ID NO: 589202 - RNA, 23 nt, Escherichia coli CFT073
cagcucgugcagaacauccagcu

SEQ ID NO: 589203 - RNA, 13 nt, Escherichia coli CFT073
cagcgucagcagc

SEQ ID NO: 589204 - RNA, 14 nt, Escherichia coli CFT073
cagcgucagcagca

SEQ ID NO: 589205 - RNA, 21 nt, Escherichia coli CFT073
cagcgucaucaauccugcagc

SEQ ID NO: 589206 - RNA, 22 nt, Escherichia coli CFT073
cagcgucaucggaucauuaguc

SEQ ID NO: 589207 - RNA, 13 nt, Escherichia coli CFT073
cagcguccagcgc

SEQ ID NO: 589208 - RNA, 21 nt, Escherichia coli CFT073
cagcguagugauaccccgcau

SEQ ID NO: 589209 - RNA, 21 nt, Escherichia coli CFT073
cagcggguuaauuuccgcgaa

SEQ ID NO: 589210 - RNA, 21 nt, Escherichia coli CFT073
cagcguaccaugauccugcaa

SEQ ID NO: 589211 - RNA, 22 nt, Escherichia coli CFT073
cagcgccgggauguugcugcga

SEQ ID NO: 589212 - RNA, 12 nt, Escherichia coli CFT073
cagcgccggauu

SEQ ID NO: 589213 - RNA, 13 nt, Escherichia coli CFT073
cagcuaucagcga

SEQ ID NO: 589214 - RNA, 19 nt, Escherichia coli CFT073
cagcuaaucaucaucagcg

SEQ ID NO: 589215 - RNA, 15 nt, Escherichia coli CFT073
cagcguuuccagcac

SEQ ID NO: 589216 - RNA, 14 nt, Escherichia coli CFT073
cagcguuugcugaa

SEQ ID NO: 589217 - RNA, 14 nt, Escherichia coli CFT073
cagcuccggcucua

SEQ ID NO: 589218 - RNA, 13 nt, Escherichia coli CFT073
cagcuccagcagu

SEQ ID NO: 589219 - RNA, 18 nt, Escherichia coli CFT073
cagcuccccacaccacca

SEQ ID NO: 589220 - RNA, 15 nt, Escherichia coli CFT073
cagcucacgcgccag

SEQ ID NO: 589221 - RNA, 15 nt, Escherichia coli CFT073
cagcucauaggccug

SEQ ID NO: 589222 - RNA, 17 nt, Escherichia coli CFT073
cagcucauauuccugca

SEQ ID NO: 589223 - RNA, 17 nt, Escherichia coli CFT073
cagcucaucagcauuug

SEQ ID NO: 589224 - RNA, 12 nt, Escherichia coli CFT073
cagcucauccag

SEQ ID NO: 589225 - RNA, 18 nt, Escherichia coli CFT073
cagcuuuuccauaucaag

SEQ ID NO: 589226 - RNA, 22 nt, Escherichia coli CFT073
caggaacagauacuggaaguga

SEQ ID NO: 589227 - RNA, 15 nt, Escherichia coli CFT073
caggaaaucaaugcc

SEQ ID NO: 589228 - RNA, 18 nt, Escherichia coli CFT073
caggaaaaagaucagcgg

SEQ ID NO: 589229 - RNA, 20 nt, Escherichia coli CFT073
caggaaccaaaugccggaug

SEQ ID NO: 589230 - RNA, 17 nt, Escherichia coli CFT073
caggaacucagcgugcc

SEQ ID NO: 589231 - RNA, 19 nt, Escherichia coli CFT073
caggaacuuaguaggccug

SEQ ID NO: 589232 - RNA, 15 nt, Escherichia coli CFT073
caggagccaguuggc

SEQ ID NO: 589233 - RNA, 12 nt, Escherichia coli CFT073
caggagcgccga

SEQ ID NO: 589234 - RNA, 15 nt, Escherichia coli CFT073
caggacauaucaggc

SEQ ID NO: 589235 - RNA, 20 nt, Escherichia coli CFT073
caggaauaucgaucgccgca

SEQ ID NO: 589236 - RNA, 16 nt, Escherichia coli CFT073
caggaauggaaauaga

SEQ ID NO: 589237 - RNA, 21 nt, Escherichia coli CFT073
aaagcaagaccaacacccaca

SEQ ID NO: 589238 - RNA, 19 nt, Escherichia coli CFT073
aaagcacuguucgccgcag

SEQ ID NO: 589239 - RNA, 19 nt, Escherichia coli CFT073
aaagcagauaacccagcag

SEQ ID NO: 589240 - RNA, 22 nt, Escherichia coli CFT073
aaagcaucagacugcuuuuccc

SEQ ID NO: 589241 - RNA, 16 nt, Escherichia coli CFT073
aaagccagcggcaccg

SEQ ID NO: 589242 - RNA, 20 nt, Escherichia coli CFT073
aaagccacccacaccgcaga

SEQ ID NO: 589243 - RNA, 19 nt, Escherichia coli CFT073
aaagccauucuggcgcaac

SEQ ID NO: 589244 - RNA, 21 nt, Escherichia coli CFT073
caggccagauacugccgacca

SEQ ID NO: 589245 - RNA, 17 nt, Escherichia coli CFT073
aaagcccaucauccgcg

SEQ ID NO: 589246 - RNA, 14 nt, Escherichia coli CFT073
aaagcccgccgcca

SEQ ID NO: 589247 - RNA, 22 nt, Escherichia coli CFT073
aaagcccgccgccacaaucacc

SEQ ID NO: 589248 - RNA, 18 nt, Escherichia coli CFT073
caggccacgaaucagcac

SEQ ID NO: 589249 - RNA, 13 nt, Escherichia coli CFT073
caggccaacggcc

SEQ ID NO: 589250 - RNA, 21 nt, Escherichia coli CFT073
caggcauuguguagggcagcg

SEQ ID NO: 589251 - RNA, 19 nt, Escherichia coli CFT073
caggcauuuaucgccugau

SEQ ID NO: 589252 - RNA, 20 nt, Escherichia coli CFT073
caggccaacauccaucagcg

SEQ ID NO: 589253 - RNA, 13 nt, Escherichia coli CFT073
caggcaucgugca

SEQ ID NO: 589254 - RNA, 18 nt, Escherichia coli CFT073
caggcaauuucgccucgc

SEQ ID NO: 589255 - RNA, 19 nt, Escherichia coli CFT073
caggcaaguagcgccagac

SEQ ID NO: 589256 - RNA, 22 nt, Escherichia coli CFT073
caggcaaguagcgccagacuga

SEQ ID NO: 589257 - RNA, 14 nt, Escherichia coli CFT073
caggcaaucggcgc

SEQ ID NO: 589258 - RNA, 19 nt, Escherichia coli CFT073
caggcaaugacaucgcccu

SEQ ID NO: 589259 - RNA, 20 nt, Escherichia coli CFT073
caggcaagaauccgccccgc

SEQ ID NO: 589260 - RNA, 22 nt, Escherichia coli CFT073
caggcaagaauccgccccgcgu

SEQ ID NO: 589261 - RNA, 14 nt, Escherichia coli CFT073
caggaugagcgcga

SEQ ID NO: 589262 - RNA, 20 nt, Escherichia coli CFT073
caggcgaaaccagcagccau

SEQ ID NO: 589263 - RNA, 16 nt, Escherichia coli CFT073
caggcgaagacaaaac

SEQ ID NO: 589264 - RNA, 19 nt, Escherichia coli CFT073
cagggaaacagccacccau

SEQ ID NO: 589265 - RNA, 18 nt, Escherichia coli CFT073
cagggaaagaaacgccau

SEQ ID NO: 589266 - RNA, 20 nt, Escherichia coli CFT073
caggcuggagcguugcgcca

SEQ ID NO: 589267 - RNA, 12 nt, Escherichia coli CFT073
caggcugcguag

SEQ ID NO: 589268 - RNA, 23 nt, Escherichia coli CFT073
caggcugcguaguuuguccugca

SEQ ID NO: 589269 - RNA, 16 nt, Escherichia coli CFT073
caggcucuccgugggc

SEQ ID NO: 589270 - RNA, 16 nt, Escherichia coli CFT073
caggcuagccgccagc

SEQ ID NO: 589271 - RNA, 14 nt, Escherichia coli CFT073
caggcucauuaauu

SEQ ID NO: 589272 - RNA, 21 nt, Escherichia coli CFT073
caggcguuuuuggcaucggca

SEQ ID NO: 589273 - RNA, 18 nt, Escherichia coli CFT073
caggcuaaccaguaaaaa

SEQ ID NO: 589274 - RNA, 20 nt, Escherichia coli CFT073
cagccuucuugcuguccggu

SEQ ID NO: 589275 - RNA, 15 nt, Escherichia coli CFT073
cagcgaccacaaaua

SEQ ID NO: 589276 - RNA, 20 nt, Escherichia coli CFT073
cagcgacgacuggcgcggca

SEQ ID NO: 589277 - RNA, 22 nt, Escherichia coli CFT073
cagcgacgaugucgucgguauc

SEQ ID NO: 589278 - RNA, 17 nt, Escherichia coli CFT073
cagccugaaugccgcgc

SEQ ID NO: 589279 - RNA, 15 nt, Escherichia coli CFT073
cagccucuuccagag

SEQ ID NO: 589280 - RNA, 23 nt, Escherichia coli CFT073
cagccugauaacgaauugcugcg

SEQ ID NO: 589281 - RNA, 19 nt, Escherichia coli CFT073
cagccuucuucauccagcg

SEQ ID NO: 589282 - RNA, 21 nt, Escherichia coli CFT073
cagccuuaccggagaaaaaca

SEQ ID NO: 589283 - RNA, 21 nt, Escherichia coli CFT073
cagccguuuaauugccucuuc

SEQ ID NO: 589284 - RNA, 19 nt, Escherichia coli CFT073
cagcgcauaagccacaaua

SEQ ID NO: 589285 - RNA, 19 nt, Escherichia coli CFT073
cagcgcaaagcccgccgcc

SEQ ID NO: 589286 - RNA, 17 nt, Escherichia coli CFT073
cagcgagcuggcggcaa

SEQ ID NO: 589287 - RNA, 18 nt, Escherichia coli CFT073
cagcgauguuagcgucaa

SEQ ID NO: 589288 - RNA, 17 nt, Escherichia coli CFT073
cagcgauuaacugcgcg

SEQ ID NO: 589289 - RNA, 15 nt, Escherichia coli CFT073
cagcgccaccacaaa

SEQ ID NO: 589290 - RNA, 16 nt, Escherichia coli CFT073
cagcgccaccaccagu

SEQ ID NO: 589291 - RNA, 15 nt, Escherichia coli CFT073
cagcgccaacgguga

SEQ ID NO: 589292 - RNA, 18 nt, Escherichia coli CFT073
cagcgccaacggugaaaa

SEQ ID NO: 589293 - RNA, 19 nt, Escherichia coli CFT073
cagcgcauggcggcagcgu

SEQ ID NO: 589294 - RNA, 23 nt, Escherichia coli CFT073
cagcgcaugauuuucaucuuuug

SEQ ID NO: 589295 - RNA, 15 nt, Escherichia coli CFT073
cagcgcauccuggcu

SEQ ID NO: 589296 - RNA, 17 nt, Escherichia coli CFT073
cagcgccauaaucagcg

SEQ ID NO: 589297 - RNA, 18 nt, Escherichia coli CFT073
cagcgccauaaucagcgc

SEQ ID NO: 589298 - RNA, 19 nt, Escherichia coli CFT073
cagccgacaauaccacaaa

SEQ ID NO: 589299 - RNA, 21 nt, Escherichia coli CFT073
cagccgccugggcaagcaccu

SEQ ID NO: 589300 - RNA, 14 nt, Escherichia coli CFT073
cagcccgccgagaa

SEQ ID NO: 589301 - RNA, 12 nt, Escherichia coli CFT073
cagcccgccgcc

SEQ ID NO: 589302 - RNA, 15 nt, Escherichia coli CFT073
cagccccucagcggu

SEQ ID NO: 589303 - RNA, 14 nt, Escherichia coli CFT073
cagccccaucagcg

SEQ ID NO: 589304 - RNA, 17 nt, Escherichia coli CFT073
cagccccaucagcgcca

SEQ ID NO: 589305 - RNA, 21 nt, Escherichia coli CFT073
cagccccaucagcgccaucgc

SEQ ID NO: 589306 - RNA, 14 nt, Escherichia coli CFT073
cagcccagcgcuuc

SEQ ID NO: 589307 - RNA, 12 nt, Escherichia coli CFT073
cagcccagcgga

SEQ ID NO: 589308 - RNA, 16 nt, Escherichia coli CFT073
cagccauuccgggaaa

SEQ ID NO: 589309 - RNA, 18 nt, Escherichia coli CFT073
cagccaucauuuuuacag

SEQ ID NO: 589310 - RNA, 14 nt, Escherichia coli CFT073
cagccaugccacgc

SEQ ID NO: 589311 - RNA, 22 nt, Escherichia coli CFT073
cagccaugccgccaccaccagc

SEQ ID NO: 589312 - RNA, 22 nt, Escherichia coli CFT073
cagccaucaaucccaucuucga

SEQ ID NO: 589313 - RNA, 15 nt, Escherichia coli CFT073
cagccaguuguugau

SEQ ID NO: 589314 - RNA, 18 nt, Escherichia coli CFT073
cagccaguuuuucagcgc

SEQ ID NO: 589315 - RNA, 18 nt, Escherichia coli CFT073
cagccagggcaccaguaa

SEQ ID NO: 589316 - RNA, 15 nt, Escherichia coli CFT073
cagccaguucgagaa

SEQ ID NO: 589317 - RNA, 18 nt, Escherichia coli CFT073
cagcaaccaaugccgcca

SEQ ID NO: 589318 - RNA, 15 nt, Escherichia coli CFT073
cagauagccuauacc

SEQ ID NO: 589319 - RNA, 17 nt, Escherichia coli CFT073
cagauacauugccacca

SEQ ID NO: 589320 - RNA, 14 nt, Escherichia coli CFT073
cagauacggcgauc

SEQ ID NO: 589321 - RNA, 16 nt, Escherichia coli CFT073
cagauacugccgacca

SEQ ID NO: 589322 - RNA, 22 nt, Escherichia coli CFT073
cagauacugccgaccagagcca

SEQ ID NO: 589323 - RNA, 13 nt, Escherichia coli CFT073
cagauacuggaag

SEQ ID NO: 589324 - RNA, 20 nt, Escherichia coli CFT073
cagauagaggucauuaggcc

SEQ ID NO: 589325 - RNA, 15 nt, Escherichia coli CFT073
cagcaacgggcugaa

SEQ ID NO: 589326 - RNA, 19 nt, Escherichia coli CFT073
cagcacaccacaucgccga

SEQ ID NO: 589327 - RNA, 20 nt, Escherichia coli CFT073
cagcaacggaaaagcaacaa

SEQ ID NO: 589328 - RNA, 17 nt, Escherichia coli CFT073
cagcacaauaaucagcc

SEQ ID NO: 589329 - RNA, 14 nt, Escherichia coli CFT073
cagcaccaguacca

SEQ ID NO: 589330 - RNA, 21 nt, Escherichia coli CFT073
cagcaccaucgcgauccacgc

SEQ ID NO: 589331 - RNA, 16 nt, Escherichia coli CFT073
cagcaccacuuccggc

SEQ ID NO: 589332 - RNA, 20 nt, Escherichia coli CFT073
cagcaccacuuuacgggcaa

SEQ ID NO: 589333 - RNA, 11 nt, Escherichia coli CFT073
cagcaccagau

SEQ ID NO: 589334 - RNA, 15 nt, Escherichia coli CFT073
cagcaccagcaacaa

SEQ ID NO: 589335 - RNA, 22 nt, Escherichia coli CFT073
cagcaccaaacuggaauagcgc

SEQ ID NO: 589336 - RNA, 17 nt, Escherichia coli CFT073
cagcacuacugccagau

SEQ ID NO: 589337 - RNA, 16 nt, Escherichia coli CFT073
cagcagauaccaaccc

SEQ ID NO: 589338 - RNA, 12 nt, Escherichia coli CFT073
cagcagauccgg

SEQ ID NO: 589339 - RNA, 15 nt, Escherichia coli CFT073
cagcagaucgaucuu

SEQ ID NO: 589340 - RNA, 17 nt, Escherichia coli CFT073
cagcagcaauauguuga

SEQ ID NO: 589341 - RNA, 23 nt, Escherichia coli CFT073
cagcagcaauauguugauaauca

SEQ ID NO: 589342 - RNA, 16 nt, Escherichia coli CFT073
cagcagcaucaccacg

SEQ ID NO: 589343 - RNA, 18 nt, Escherichia coli CFT073
cagcagccacaccaauca

SEQ ID NO: 589344 - RNA, 23 nt, Escherichia coli CFT073
cagcacgguggcuggcgcggcgc

SEQ ID NO: 589345 - RNA, 14 nt, Escherichia coli CFT073
cagcacgcagugag

SEQ ID NO: 589346 - RNA, 20 nt, Escherichia coli CFT073
cagcaucacaucaaaucccc

SEQ ID NO: 589347 - RNA, 12 nt, Escherichia coli CFT073
cagcauacgcca

SEQ ID NO: 589348 - RNA, 19 nt, Escherichia coli CFT073
cagcauaaucaccaucagc

SEQ ID NO: 589349 - RNA, 16 nt, Escherichia coli CFT073
cagcauaccuuccagc

SEQ ID NO: 589350 - RNA, 16 nt, Escherichia coli CFT073
cagcaggugcgccagc

SEQ ID NO: 589351 - RNA, 13 nt, Escherichia coli CFT073
cagcagcgcaauu

SEQ ID NO: 589352 - RNA, 23 nt, Escherichia coli CFT073
cagcagcccuugcuucgccaguu

SEQ ID NO: 589353 - RNA, 15 nt, Escherichia coli CFT073
cagccaggaaagaac

SEQ ID NO: 589354 - RNA, 18 nt, Escherichia coli CFT073
cagccagaagcccggauc

SEQ ID NO: 589355 - RNA, 18 nt, Escherichia coli CFT073
cagccagacgcgucacgc

SEQ ID NO: 589356 - RNA, 17 nt, Escherichia coli CFT073
cagccagauaaaucgau

SEQ ID NO: 589357 - RNA, 17 nt, Escherichia coli CFT073
cagccacuucaaccagc

SEQ ID NO: 589358 - RNA, 18 nt, Escherichia coli CFT073
cagccacaacaaacgacc

SEQ ID NO: 589359 - RNA, 14 nt, Escherichia coli CFT073
cagccacaccaauc

SEQ ID NO: 589360 - RNA, 12 nt, Escherichia coli CFT073
cagccacaccac

SEQ ID NO: 589361 - RNA, 22 nt, Escherichia coli CFT073
cagcaugauuucaucaucaggc

SEQ ID NO: 589362 - RNA, 22 nt, Escherichia coli CFT073
cagccaaugcaggcaucgguga

SEQ ID NO: 589363 - RNA, 21 nt, Escherichia coli CFT073
cagcaugauacaaaacagaua

SEQ ID NO: 589364 - RNA, 17 nt, Escherichia coli CFT073
cagcaucuuaccgauga

SEQ ID NO: 589365 - RNA, 17 nt, Escherichia coli CFT073
cagcaucgggaugagca

SEQ ID NO: 589366 - RNA, 22 nt, Escherichia coli CFT073
cagcaucacgguaccuaccggu

SEQ ID NO: 589367 - RNA, 15 nt, Escherichia coli CFT073
aaacuuuucaccagc

SEQ ID NO: 589368 - RNA, 17 nt, Escherichia coli CFT073
aaacuugguuacgcacc

SEQ ID NO: 589369 - RNA, 13 nt, Escherichia coli CFT073
aaagaaaauaccg

SEQ ID NO: 589370 - RNA, 17 nt, Escherichia coli CFT073
cacggcuccagcaaugu

SEQ ID NO: 589371 - RNA, 18 nt, Escherichia coli CFT073
cacggcuccagcaauguc

SEQ ID NO: 589372 - RNA, 16 nt, Escherichia coli CFT073
aaacuguuuacgcagc

SEQ ID NO: 589373 - RNA, 17 nt, Escherichia coli CFT073
aaacuggaaaaccgcac

SEQ ID NO: 589374 - RNA, 22 nt, Escherichia coli CFT073
aaacuggcugaugcuggcaccg

SEQ ID NO: 589375 - RNA, 15 nt, Escherichia coli CFT073
aaacuggcugugcgu

SEQ ID NO: 589376 - RNA, 20 nt, Escherichia coli CFT073
aaacugauuuagcaucagcg

SEQ ID NO: 589377 - RNA, 22 nt, Escherichia coli CFT073
cacggugguuccacucugcccu

SEQ ID NO: 589378 - RNA, 23 nt, Escherichia coli CFT073
cacgggugagggcguagagagau

SEQ ID NO: 589379 - RNA, 14 nt, Escherichia coli CFT073
cacggguugcgccu

SEQ ID NO: 589380 - RNA, 23 nt, Escherichia coli CFT073
cacggucauaaucauuaacggcc

SEQ ID NO: 589381 - RNA, 14 nt, Escherichia coli CFT073
cacgggcgcggaaa

SEQ ID NO: 589382 - RNA, 20 nt, Escherichia coli CFT073
cacgggcgcggaaagcaccu

SEQ ID NO: 589383 - RNA, 17 nt, Escherichia coli CFT073
cacgcuuugauccgcca

SEQ ID NO: 589384 - RNA, 19 nt, Escherichia coli CFT073
cacgcuuacucuucguucu

SEQ ID NO: 589385 - RNA, 14 nt, Escherichia coli CFT073
cacgcuuaaucgaa

SEQ ID NO: 589386 - RNA, 13 nt, Escherichia coli CFT073
cacgcugucggca

SEQ ID NO: 589387 - RNA, 14 nt, Escherichia coli CFT073
cacggaauaaaccg

SEQ ID NO: 589388 - RNA, 23 nt, Escherichia coli CFT073
cacggaauaaucgggaacgcuuu

SEQ ID NO: 589389 - RNA, 18 nt, Escherichia coli CFT073
cacggaacaacggcaaac

SEQ ID NO: 589390 - RNA, 22 nt, Escherichia coli CFT073
cacggaucguuuugauauugcg

SEQ ID NO: 589391 - RNA, 22 nt, Escherichia coli CFT073
cacggaugaauuugugaacagc

SEQ ID NO: 589392 - RNA, 22 nt, Escherichia coli CFT073
cacggcaggaucugcgcggcaa

SEQ ID NO: 589393 - RNA, 15 nt, Escherichia coli CFT073
cacggccaucacgga

SEQ ID NO: 589394 - RNA, 16 nt, Escherichia coli CFT073
cacggcauuuccgcca

SEQ ID NO: 589395 - RNA, 14 nt, Escherichia coli CFT073
cacgcuacucgccu

SEQ ID NO: 589396 - RNA, 19 nt, Escherichia coli CFT073
cacgcuacucgccugccac

SEQ ID NO: 589397 - RNA, 14 nt, Escherichia coli CFT073
cacgcucaggcggu

SEQ ID NO: 589398 - RNA, 22 nt, Escherichia coli CFT073
cacgcucagcaaucgcauauuu

SEQ ID NO: 589399 - RNA, 16 nt, Escherichia coli CFT073
cacgcucgcaggcggc

SEQ ID NO: 589400 - RNA, 17 nt, Escherichia coli CFT073
cacgcgguuacgcaccg

SEQ ID NO: 589401 - RNA, 17 nt, Escherichia coli CFT073
cacgcguaauauccagc

SEQ ID NO: 589402 - RNA, 18 nt, Escherichia coli CFT073
cacgcguaauauccagcg

SEQ ID NO: 589403 - RNA, 14 nt, Escherichia coli CFT073
cacgcggcaacggc

SEQ ID NO: 589404 - RNA, 14 nt, Escherichia coli CFT073
caccuccacgccca

SEQ ID NO: 589405 - RNA, 14 nt, Escherichia coli CFT073
caccuacgcuggca

SEQ ID NO: 589406 - RNA, 18 nt, Escherichia coli CFT073
caccucaccuuucgguuc

SEQ ID NO: 589407 - RNA, 18 nt, Escherichia coli CFT073
caccguugaaaucgucgc

SEQ ID NO: 589408 - RNA, 17 nt, Escherichia coli CFT073
caccguuaccggacggc

SEQ ID NO: 589409 - RNA, 20 nt, Escherichia coli CFT073
cacguccaccaaugccaaug

SEQ ID NO: 589410 - RNA, 17 nt, Escherichia coli CFT073
cacgucaucagcaauuu

SEQ ID NO: 589411 - RNA, 21 nt, Escherichia coli CFT073
cacgucgaagacgaagauuuu

SEQ ID NO: 589412 - RNA, 14 nt, Escherichia coli CFT073
cacuacaaucaggc

SEQ ID NO: 589413 - RNA, 22 nt, Escherichia coli CFT073
cacuaccaucggcgcuacggcg

SEQ ID NO: 589414 - RNA, 19 nt, Escherichia coli CFT073
cacuacgcuguagccgcca

SEQ ID NO: 589415 - RNA, 23 nt, Escherichia coli CFT073
cacuacgguguaacccgccugac

SEQ ID NO: 589416 - RNA, 20 nt, Escherichia coli CFT073
cacguuuuucauccagcggc

SEQ ID NO: 589417 - RNA, 23 nt, Escherichia coli CFT073
cacguuuuucauccagcggcaac

SEQ ID NO: 589418 - RNA, 19 nt, Escherichia coli CFT073
cacuaacaugacaccaagc

SEQ ID NO: 589419 - RNA, 18 nt, Escherichia coli CFT073
cacuaaucgggccgacaa

SEQ ID NO: 589420 - RNA, 20 nt, Escherichia coli CFT073
cacuaaucgggccgacaaaa

SEQ ID NO: 589421 - RNA, 17 nt, Escherichia coli CFT073
cacuaauuaagacugau

SEQ ID NO: 589422 - RNA, 18 nt, Escherichia coli CFT073
cacugggguaaauccacg

SEQ ID NO: 589423 - RNA, 14 nt, Escherichia coli CFT073
cacugcccgcguaa

SEQ ID NO: 589424 - RNA, 16 nt, Escherichia coli CFT073
cacugaccgcccggcc

SEQ ID NO: 589425 - RNA, 14 nt, Escherichia coli CFT073
cacucuuccccgcu

SEQ ID NO: 589426 - RNA, 22 nt, Escherichia coli CFT073
cacugaaauuguaggccugaua

SEQ ID NO: 589427 - RNA, 22 nt, Escherichia coli CFT073
cacugaauaaacagcagauggc

SEQ ID NO: 589428 - RNA, 21 nt, Escherichia coli CFT073
cacugacaaucgccagugauu

SEQ ID NO: 589429 - RNA, 17 nt, Escherichia coli CFT073
cacucggggcuuuucuc

SEQ ID NO: 589430 - RNA, 13 nt, Escherichia coli CFT073
cacucugcgcaug

SEQ ID NO: 589431 - RNA, 13 nt, Escherichia coli CFT073
cacucugcgccuu

SEQ ID NO: 589432 - RNA, 15 nt, Escherichia coli CFT073
cacucugcugccaca

SEQ ID NO: 589433 - RNA, 14 nt, Escherichia coli CFT073
aaagaauccgcccu

SEQ ID NO: 589434 - RNA, 20 nt, Escherichia coli CFT073
cagagauacaggccaccgcc

SEQ ID NO: 589435 - RNA, 22 nt, Escherichia coli CFT073
cagagauacaggccaccgccca

SEQ ID NO: 589436 - RNA, 13 nt, Escherichia coli CFT073
cagagaucgcccc

SEQ ID NO: 589437 - RNA, 19 nt, Escherichia coli CFT073
cagagauguugaagaaguc

SEQ ID NO: 589438 - RNA, 12 nt, Escherichia coli CFT073
cagagcaauauc

SEQ ID NO: 589439 - RNA, 15 nt, Escherichia coli CFT073
cagagcagcaacaag

SEQ ID NO: 589440 - RNA, 21 nt, Escherichia coli CFT073
cagagccugaauaaacgccau

SEQ ID NO: 589441 - RNA, 16 nt, Escherichia coli CFT073
cagauaagaccaaucc

SEQ ID NO: 589442 - RNA, 23 nt, Escherichia coli CFT073
cagauaaggcguuuacgccgcau

SEQ ID NO: 589443 - RNA, 22 nt, Escherichia coli CFT073
cagauaauagcguuucagcggu

SEQ ID NO: 589444 - RNA, 14 nt, Escherichia coli CFT073
cagauaauagguaa

SEQ ID NO: 589445 - RNA, 17 nt, Escherichia coli CFT073
cagagaacacccagaau

SEQ ID NO: 589446 - RNA, 18 nt, Escherichia coli CFT073
cagagaaacgccagcagc

SEQ ID NO: 589447 - RNA, 21 nt, Escherichia coli CFT073
cagacugacaaucaucgccgu

SEQ ID NO: 589448 - RNA, 23 nt, Escherichia coli CFT073
cagacugugccguggcgcucgca

SEQ ID NO: 589449 - RNA, 19 nt, Escherichia coli CFT073
cagacuugugcgcuuguuc

SEQ ID NO: 589450 - RNA, 15 nt, Escherichia coli CFT073
cagacgguccgcgag

SEQ ID NO: 589451 - RNA, 22 nt, Escherichia coli CFT073
cagacgguccgcgagauaacgc

SEQ ID NO: 589452 - RNA, 14 nt, Escherichia coli CFT073
cagacgggcaccga

SEQ ID NO: 589453 - RNA, 16 nt, Escherichia coli CFT073
cagacggcccaacuga

SEQ ID NO: 589454 - RNA, 19 nt, Escherichia coli CFT073
cagacggccccgcgccagc

SEQ ID NO: 589455 - RNA, 20 nt, Escherichia coli CFT073
cagacggccccgcgccagcg

SEQ ID NO: 589456 - RNA, 15 nt, Escherichia coli CFT073
cagacggcgacgcgc

SEQ ID NO: 589457 - RNA, 15 nt, Escherichia coli CFT073
cagacugaucaucgc

SEQ ID NO: 589458 - RNA, 21 nt, Escherichia coli CFT073
cagacugcuuuucccuuucag

SEQ ID NO: 589459 - RNA, 22 nt, Escherichia coli CFT073
cagacugcuuuucccuuucaga

SEQ ID NO: 589460 - RNA, 22 nt, Escherichia coli CFT073
cagacuggagcacugcgcccgc

SEQ ID NO: 589461 - RNA, 16 nt, Escherichia coli CFT073
cagacgcccgcgccca

SEQ ID NO: 589462 - RNA, 21 nt, Escherichia coli CFT073
cagacgcccgcgcccaggcca

SEQ ID NO: 589463 - RNA, 18 nt, Escherichia coli CFT073
cagacgccguuccagauu

SEQ ID NO: 589464 - RNA, 13 nt, Escherichia coli CFT073
cagacgcgccgcc

SEQ ID NO: 589465 - RNA, 21 nt, Escherichia coli CFT073
cagacgcgccgccaccgccag

SEQ ID NO: 589466 - RNA, 17 nt, Escherichia coli CFT073
cagaccuuaucccgccg

SEQ ID NO: 589467 - RNA, 22 nt, Escherichia coli CFT073
cagaccuuuacggcuugcgcgc

SEQ ID NO: 589468 - RNA, 23 nt, Escherichia coli CFT073
cagaccgugcgcagcaucggcgc

SEQ ID NO: 589469 - RNA, 14 nt, Escherichia coli CFT073
cagaccuaaaaauu

SEQ ID NO: 589470 - RNA, 18 nt, Escherichia coli CFT073
cagaccggcaaucgcgcc

SEQ ID NO: 589471 - RNA, 18 nt, Escherichia coli CFT073
cagaccgccaaucagcau

SEQ ID NO: 589472 - RNA, 15 nt, Escherichia coli CFT073
cagaccgcgcaguac

SEQ ID NO: 589473 - RNA, 17 nt, Escherichia coli CFT073
cacuuaaagcaacacca

SEQ ID NO: 589474 - RNA, 14 nt, Escherichia coli CFT073
cacuuaauaccacu

SEQ ID NO: 589475 - RNA, 19 nt, Escherichia coli CFT073
cacuuacagcaacgccuaa

SEQ ID NO: 589476 - RNA, 16 nt, Escherichia coli CFT073
cacuuaccuucacgaa

SEQ ID NO: 589477 - RNA, 22 nt, Escherichia coli CFT073
cacuucaaauuucauaaucuga

SEQ ID NO: 589478 - RNA, 15 nt, Escherichia coli CFT073
cacuuuuauuucacc

SEQ ID NO: 589479 - RNA, 14 nt, Escherichia coli CFT073
cacuuuucggcaac

SEQ ID NO: 589480 - RNA, 17 nt, Escherichia coli CFT073
cacuuuucggcaaccgc

SEQ ID NO: 589481 - RNA, 17 nt, Escherichia coli CFT073
cagaaaaaacaaacggc

SEQ ID NO: 589482 - RNA, 21 nt, Escherichia coli CFT073
cagaaaaaacaaacggcacga

SEQ ID NO: 589483 - RNA, 15 nt, Escherichia coli CFT073
cagaaaaacgaagac

SEQ ID NO: 589484 - RNA, 17 nt, Escherichia coli CFT073
cagaaacaggcggcgcg

SEQ ID NO: 589485 - RNA, 13 nt, Escherichia coli CFT073
cagaaacaucauc

SEQ ID NO: 589486 - RNA, 17 nt, Escherichia coli CFT073
cagaaaauacucagcac

SEQ ID NO: 589487 - RNA, 14 nt, Escherichia coli CFT073
cagaaaaucacggc

SEQ ID NO: 589488 - RNA, 17 nt, Escherichia coli CFT073
cagaaacagaguauaaa

SEQ ID NO: 589489 - RNA, 20 nt, Escherichia coli CFT073
cagaaacagaguauaaaaaa

SEQ ID NO: 589490 - RNA, 14 nt, Escherichia coli CFT073
cacuguaguuaucc

SEQ ID NO: 589491 - RNA, 14 nt, Escherichia coli CFT073
cacugucaaucgca

SEQ ID NO: 589492 - RNA, 15 nt, Escherichia coli CFT073
cacugguucccaaca

SEQ ID NO: 589493 - RNA, 14 nt, Escherichia coli CFT073
cacugguucccaga

SEQ ID NO: 589494 - RNA, 13 nt, Escherichia coli CFT073
cacugugccggua

SEQ ID NO: 589495 - RNA, 12 nt, Escherichia coli CFT073
cacuguugcugu

SEQ ID NO: 589496 - RNA, 20 nt, Escherichia coli CFT073
cacuguuugaucugcugcca

SEQ ID NO: 589497 - RNA, 21 nt, Escherichia coli CFT073
cagaaggccagugguaaaaaa

SEQ ID NO: 589498 - RNA, 11 nt, Escherichia coli CFT073
cagaagguuua

SEQ ID NO: 589499 - RNA, 17 nt, Escherichia coli CFT073
cagaagguuucgccgcu

SEQ ID NO: 589500 - RNA, 20 nt, Escherichia coli CFT073
cagaauagaaaguugccaga

SEQ ID NO: 589501 - RNA, 22 nt, Escherichia coli CFT073
cagaccaauggcuuuugccgcc

SEQ ID NO: 589502 - RNA, 19 nt, Escherichia coli CFT073
cagaccaauguuacgaccu

SEQ ID NO: 589503 - RNA, 21 nt, Escherichia coli CFT073
cagaauaacggcugauaacaa

SEQ ID NO: 589504 - RNA, 23 nt, Escherichia coli CFT073
cagaauauugccgaagaccagau

SEQ ID NO: 589505 - RNA, 21 nt, Escherichia coli CFT073
cagaccaaaacucgcuggcgg

SEQ ID NO: 589506 - RNA, 21 nt, Escherichia coli CFT073
cagaccaaacucuucgacaau

SEQ ID NO: 589507 - RNA, 18 nt, Escherichia coli CFT073
cagaccacugcgccgcuc

SEQ ID NO: 589508 - RNA, 17 nt, Escherichia coli CFT073
cagaccagaaacgccac

SEQ ID NO: 589509 - RNA, 18 nt, Escherichia coli CFT073
cagaccagcaauaaaaaa

SEQ ID NO: 589510 - RNA, 18 nt, Escherichia coli CFT073
caagaguaaacaucuucu

SEQ ID NO: 589511 - RNA, 19 nt, Escherichia coli CFT073
caagauaacgccuggcagu

SEQ ID NO: 589512 - RNA, 18 nt, Escherichia coli CFT073
caagaccaauccgccagc

SEQ ID NO: 589513 - RNA, 22 nt, Escherichia coli CFT073
caagcgaacccgcaguccugca

SEQ ID NO: 589514 - RNA, 14 nt, Escherichia coli CFT073
caagccuaccggca

SEQ ID NO: 589515 - RNA, 15 nt, Escherichia coli CFT073
caagcgucgcgccau

SEQ ID NO: 589516 - RNA, 17 nt, Escherichia coli CFT073
caagcuggcgcuggcga

SEQ ID NO: 589517 - RNA, 18 nt, Escherichia coli CFT073
caagcuuacugagcagau

SEQ ID NO: 589518 - RNA, 20 nt, Escherichia coli CFT073
caaggaaaaacuacccgcca

SEQ ID NO: 589519 - RNA, 22 nt, Escherichia coli CFT073
caaggaaaaacuacccgccagu

SEQ ID NO: 589520 - RNA, 17 nt, Escherichia coli CFT073
caaggcuucuauggaag

SEQ ID NO: 589521 - RNA, 14 nt, Escherichia coli CFT073
caacucaacgccug

SEQ ID NO: 589522 - RNA, 16 nt, Escherichia coli CFT073
caacguuuuucgcugu

SEQ ID NO: 589523 - RNA, 18 nt, Escherichia coli CFT073
caacugacgaccaugcgc

SEQ ID NO: 589524 - RNA, 18 nt, Escherichia coli CFT073
caacugacugacgugaug

SEQ ID NO: 589525 - RNA, 19 nt, Escherichia coli CFT073
caacugauuuucaucuucu

SEQ ID NO: 589526 - RNA, 22 nt, Escherichia coli CFT073
caacugccaguaaagcagcgaa

SEQ ID NO: 589527 - RNA, 21 nt, Escherichia coli CFT073
caacggugcuuuaauuucaug

SEQ ID NO: 589528 - RNA, 20 nt, Escherichia coli CFT073
caacggugacuggcuuaaua

SEQ ID NO: 589529 - RNA, 16 nt, Escherichia coli CFT073
caacguacucugccac

SEQ ID NO: 589530 - RNA, 15 nt, Escherichia coli CFT073
caacguaucaucgcu

SEQ ID NO: 589531 - RNA, 22 nt, Escherichia coli CFT073
caacggugaaaaaccaaucucc

SEQ ID NO: 589532 - RNA, 15 nt, Escherichia coli CFT073
caacggggccagcac

SEQ ID NO: 589533 - RNA, 19 nt, Escherichia coli CFT073
caacgggcaccgccgccac

SEQ ID NO: 589534 - RNA, 15 nt, Escherichia coli CFT073
caacggcgucagcca

SEQ ID NO: 589535 - RNA, 22 nt, Escherichia coli CFT073
caacggcaggguacgacuuccu

SEQ ID NO: 589536 - RNA, 15 nt, Escherichia coli CFT073
caacggaauaaacgc

SEQ ID NO: 589537 - RNA, 13 nt, Escherichia coli CFT073
caacggcaacaau

SEQ ID NO: 589538 - RNA, 18 nt, Escherichia coli CFT073
caaucgaacgcagcaaca

SEQ ID NO: 589539 - RNA, 13 nt, Escherichia coli CFT073
caaucgauuugaa

SEQ ID NO: 589540 - RNA, 23 nt, Escherichia coli CFT073
caauccgccagccaauugccaua

SEQ ID NO: 589541 - RNA, 22 nt, Escherichia coli CFT073
caauccgcagcaaagcccgggc

SEQ ID NO: 589542 - RNA, 20 nt, Escherichia coli CFT073
caauccgcgagcgucuggcu

SEQ ID NO: 589543 - RNA, 21 nt, Escherichia coli CFT073
caauccgcgauaacgccccaa

SEQ ID NO: 589544 - RNA, 22 nt, Escherichia coli CFT073
caaucacuuuuuaccguaacag

SEQ ID NO: 589545 - RNA, 13 nt, Escherichia coli CFT073
caauaucgccagc

SEQ ID NO: 589546 - RNA, 21 nt, Escherichia coli CFT073
caauaucgccuuuugcccggc

SEQ ID NO: 589547 - RNA, 16 nt, Escherichia coli CFT073
caauaucuaaaauguc

SEQ ID NO: 589548 - RNA, 12 nt, Escherichia coli CFT073
caauaucuuccu

SEQ ID NO: 589549 - RNA, 17 nt, Escherichia coli CFT073
caauauguuuccgcgaa

SEQ ID NO: 589550 - RNA, 14 nt, Escherichia coli CFT073
caauauuaaauauc

SEQ ID NO: 589551 - RNA, 21 nt, Escherichia coli CFT073
caaucaacgccaccaucacua

SEQ ID NO: 589552 - RNA, 13 nt, Escherichia coli CFT073
caaucaauaacag

SEQ ID NO: 589553 - RNA, 13 nt, Escherichia coli CFT073
caaucacacugac

SEQ ID NO: 589554 - RNA, 14 nt, Escherichia coli CFT073
caaucacacugacu

SEQ ID NO: 589555 - RNA, 22 nt, Escherichia coli CFT073
caaucacccgauacuccacgcu

SEQ ID NO: 589556 - RNA, 14 nt, Escherichia coli CFT073
caaucaccgccaac

SEQ ID NO: 589557 - RNA, 13 nt, Escherichia coli CFT073
caaucacgcccgc

SEQ ID NO: 589558 - RNA, 14 nt, Escherichia coli CFT073
caaucacgcccgcc

SEQ ID NO: 589559 - RNA, 13 nt, Escherichia coli CFT073
caaucaccgcuuc

SEQ ID NO: 589560 - RNA, 20 nt, Escherichia coli CFT073
caaucaccucuuuaccgguc

SEQ ID NO: 589561 - RNA, 20 nt, Escherichia coli CFT073
caaucacuacuacaucugca

SEQ ID NO: 589562 - RNA, 15 nt, Escherichia coli CFT073
caaucacugccacca

SEQ ID NO: 589563 - RNA, 14 nt, Escherichia coli CFT073
caaucacugccaga

SEQ ID NO: 589564 - RNA, 18 nt, Escherichia coli CFT073
caauaguguugccgccac

SEQ ID NO: 589565 - RNA, 20 nt, Escherichia coli CFT073
caauauagcgcauggcagcc

SEQ ID NO: 589566 - RNA, 15 nt, Escherichia coli CFT073
caauaucaaagcguu

SEQ ID NO: 589567 - RNA, 16 nt, Escherichia coli CFT073
caauaucaaagcguuu

SEQ ID NO: 589568 - RNA, 16 nt, Escherichia coli CFT073
caauaucaaaugcguu

SEQ ID NO: 589569 - RNA, 15 nt, Escherichia coli CFT073
caauaucaaucuucu

SEQ ID NO: 589570 - RNA, 14 nt, Escherichia coli CFT073
caauauccagcgcg

SEQ ID NO: 589571 - RNA, 19 nt, Escherichia coli CFT073
caauauccauuaaaacuga

SEQ ID NO: 589572 - RNA, 13 nt, Escherichia coli CFT073
caauaucagcaau

SEQ ID NO: 589573 - RNA, 15 nt, Escherichia coli CFT073
caauacugaucauca

SEQ ID NO: 589574 - RNA, 18 nt, Escherichia coli CFT073
caauacuggcaaaaucaa

SEQ ID NO: 589575 - RNA, 14 nt, Escherichia coli CFT073
caauagauauucau

SEQ ID NO: 589576 - RNA, 14 nt, Escherichia coli CFT073
caauagccgccaua

SEQ ID NO: 589577 - RNA, 15 nt, Escherichia coli CFT073
caagggccgccgcuu

SEQ ID NO: 589578 - RNA, 16 nt, Escherichia coli CFT073
caaguccccacccggg

SEQ ID NO: 589579 - RNA, 21 nt, Escherichia coli CFT073
caagucagcgcgaaaucgccc

SEQ ID NO: 589580 - RNA, 22 nt, Escherichia coli CFT073
caagucagcgcgaaaucgcccu

SEQ ID NO: 589581 - RNA, 15 nt, Escherichia coli CFT073
caaguccagcaccgu

SEQ ID NO: 589582 - RNA, 18 nt, Escherichia coli CFT073
caauuaauucuccgcacu

SEQ ID NO: 589583 - RNA, 21 nt, Escherichia coli CFT073
caauuaagucaacaccaucuu

SEQ ID NO: 589584 - RNA, 20 nt, Escherichia coli CFT073
caauuacgccgagcgccagc

SEQ ID NO: 589585 - RNA, 17 nt, Escherichia coli CFT073
caauuacgccugcccaa

SEQ ID NO: 589586 - RNA, 15 nt, Escherichia coli CFT073
caauuacuucuggca

SEQ ID NO: 589587 - RNA, 20 nt, Escherichia coli CFT073
caauguuaccgaucgccagc

SEQ ID NO: 589588 - RNA, 21 nt, Escherichia coli CFT073
caaugggcuuaaugagauaau

SEQ ID NO: 589589 - RNA, 13 nt, Escherichia coli CFT073
caauucggcuuuu

SEQ ID NO: 589590 - RNA, 20 nt, Escherichia coli CFT073
caauuugcuuaagccgcucu

SEQ ID NO: 589591 - RNA, 15 nt, Escherichia coli CFT073
caauuugcuucuggc

SEQ ID NO: 589592 - RNA, 19 nt, Escherichia coli CFT073
caauuuuacccgugcaucc

SEQ ID NO: 589593 - RNA, 14 nt, Escherichia coli CFT073
caauuccgcagcgc

SEQ ID NO: 589594 - RNA, 17 nt, Escherichia coli CFT073
caauuccagcgccagua

SEQ ID NO: 589595 - RNA, 13 nt, Escherichia coli CFT073
caaugaugccgcc

SEQ ID NO: 589596 - RNA, 12 nt, Escherichia coli CFT073
caaugauaacgu

SEQ ID NO: 589597 - RNA, 19 nt, Escherichia coli CFT073
caaugauaucgcuggcagg

SEQ ID NO: 589598 - RNA, 12 nt, Escherichia coli CFT073
caaucucugcaa

SEQ ID NO: 589599 - RNA, 15 nt, Escherichia coli CFT073
caaucucuucaagcu

SEQ ID NO: 589600 - RNA, 21 nt, Escherichia coli CFT073
caaucugaugacugauaucca

SEQ ID NO: 589601 - RNA, 20 nt, Escherichia coli CFT073
caaucgcacgauagcuaacu

SEQ ID NO: 589602 - RNA, 18 nt, Escherichia coli CFT073
caaucgcagcgcaagcug

SEQ ID NO: 589603 - RNA, 21 nt, Escherichia coli CFT073
caaucguaugaucauccgccu

SEQ ID NO: 589604 - RNA, 22 nt, Escherichia coli CFT073
caaucgucagcucgcugccauc

SEQ ID NO: 589605 - RNA, 13 nt, Escherichia coli CFT073
caaucuccugcgc

SEQ ID NO: 589606 - RNA, 22 nt, Escherichia coli CFT073
caauggccagcacauuaaaaug

SEQ ID NO: 589607 - RNA, 18 nt, Escherichia coli CFT073
caaugcguuccagcagaa

SEQ ID NO: 589608 - RNA, 16 nt, Escherichia coli CFT073
caaugcguuguagcuu

SEQ ID NO: 589609 - RNA, 21 nt, Escherichia coli CFT073
caaugcccaaaauggcgugaa

SEQ ID NO: 589610 - RNA, 15 nt, Escherichia coli CFT073
caaugccaucaccaa

SEQ ID NO: 589611 - RNA, 15 nt, Escherichia coli CFT073
caaugccauccagcu

SEQ ID NO: 589612 - RNA, 16 nt, Escherichia coli CFT073
caaugccagcauaccg

SEQ ID NO: 589613 - RNA, 13 nt, Escherichia coli CFT073
caaugcauaucau

SEQ ID NO: 589614 - RNA, 19 nt, Escherichia coli CFT073
caaugcauuauugauaccc

SEQ ID NO: 589615 - RNA, 16 nt, Escherichia coli CFT073
caaugcaauauuuuga

SEQ ID NO: 589616 - RNA, 23 nt, Escherichia coli CFT073
caaugcaaucaaauggcuggcgu

SEQ ID NO: 589617 - RNA, 23 nt, Escherichia coli CFT073
caaugcacacaaaauugccgcua

SEQ ID NO: 589618 - RNA, 14 nt, Escherichia coli CFT073
caaauaauucccca

SEQ ID NO: 589619 - RNA, 13 nt, Escherichia coli CFT073
caaauaaauaauc

SEQ ID NO: 589620 - RNA, 17 nt, Escherichia coli CFT073
caaagugggcgacaaag

SEQ ID NO: 589621 - RNA, 16 nt, Escherichia coli CFT073
caaaguuaaucagcgc

SEQ ID NO: 589622 - RNA, 13 nt, Escherichia coli CFT073
caaagcgccagaa

SEQ ID NO: 589623 - RNA, 12 nt, Escherichia coli CFT073
caaagcgacaca

SEQ ID NO: 589624 - RNA, 12 nt, Escherichia coli CFT073
caaagcgcugaa

SEQ ID NO: 589625 - RNA, 23 nt, Escherichia coli CFT073
caaagcguucagugaucgccugc

SEQ ID NO: 589626 - RNA, 16 nt, Escherichia coli CFT073
caaagcugucaccaau

SEQ ID NO: 589627 - RNA, 18 nt, Escherichia coli CFT073
caaagcugucaccaauca

SEQ ID NO: 589628 - RNA, 14 nt, Escherichia coli CFT073
auuuacguuuuucu

SEQ ID NO: 589629 - RNA, 15 nt, Escherichia coli CFT073
auuuacgccgcaucc

SEQ ID NO: 589630 - RNA, 18 nt, Escherichia coli CFT073
auuuacgccgcauccggc

SEQ ID NO: 589631 - RNA, 17 nt, Escherichia coli CFT073
auuuagcgaucuguuca

SEQ ID NO: 589632 - RNA, 14 nt, Escherichia coli CFT073
caaagccaacagca

SEQ ID NO: 589633 - RNA, 21 nt, Escherichia coli CFT073
caaagcccaucaccgccaggc

SEQ ID NO: 589634 - RNA, 17 nt, Escherichia coli CFT073
caaagcccgccgccaca

SEQ ID NO: 589635 - RNA, 20 nt, Escherichia coli CFT073
caaagcccgggcacaucacc

SEQ ID NO: 589636 - RNA, 16 nt, Escherichia coli CFT073
caaaugaccgacguua

SEQ ID NO: 589637 - RNA, 17 nt, Escherichia coli CFT073
caaaucuucucacugcc

SEQ ID NO: 589638 - RNA, 16 nt, Escherichia coli CFT073
caaauagccugccagu

SEQ ID NO: 589639 - RNA, 20 nt, Escherichia coli CFT073
caaaucugccguaacugcgc

SEQ ID NO: 589640 - RNA, 20 nt, Escherichia coli CFT073
caaauagauaaaauauggcg

SEQ ID NO: 589641 - RNA, 17 nt, Escherichia coli CFT073
caaauagaucgccagaa

SEQ ID NO: 589642 - RNA, 16 nt, Escherichia coli CFT073
caaaugcagcaaccag

SEQ ID NO: 589643 - RNA, 23 nt, Escherichia coli CFT073
caaaugcugacgugugauaaugu

SEQ ID NO: 589644 - RNA, 15 nt, Escherichia coli CFT073
caaaugucggaugcg

SEQ ID NO: 589645 - RNA, 14 nt, Escherichia coli CFT073
caaauggaccaucu

SEQ ID NO: 589646 - RNA, 14 nt, Escherichia coli CFT073
caacaagcccacgg

SEQ ID NO: 589647 - RNA, 19 nt, Escherichia coli CFT073
caacaagccgcuugcgaua

SEQ ID NO: 589648 - RNA, 20 nt, Escherichia coli CFT073
caacaauaaaaagcggcagg

SEQ ID NO: 589649 - RNA, 16 nt, Escherichia coli CFT073
caacaccguguggcgu

SEQ ID NO: 589650 - RNA, 16 nt, Escherichia coli CFT073
caacaaccuugcguuu

SEQ ID NO: 589651 - RNA, 22 nt, Escherichia coli CFT073
caacaaccuugcguuuuucauc

SEQ ID NO: 589652 - RNA, 19 nt, Escherichia coli CFT073
caacaaccuuuguauuuuu

SEQ ID NO: 589653 - RNA, 19 nt, Escherichia coli CFT073
caacaaacgcaaacaccag

SEQ ID NO: 589654 - RNA, 14 nt, Escherichia coli CFT073
caacaacagcgcga

SEQ ID NO: 589655 - RNA, 13 nt, Escherichia coli CFT073
caacacgccagcg

SEQ ID NO: 589656 - RNA, 20 nt, Escherichia coli CFT073
caacagccagguuuugcucu

SEQ ID NO: 589657 - RNA, 16 nt, Escherichia coli CFT073
caacacgccugcaagc

SEQ ID NO: 589658 - RNA, 13 nt, Escherichia coli CFT073
caacagcgcgccc

SEQ ID NO: 589659 - RNA, 22 nt, Escherichia coli CFT073
caacagcgcgcuaucggcagag

SEQ ID NO: 589660 - RNA, 13 nt, Escherichia coli CFT073
caacagcggcauu

SEQ ID NO: 589661 - RNA, 15 nt, Escherichia coli CFT073
caacagguugcggac

SEQ ID NO: 589662 - RNA, 16 nt, Escherichia coli CFT073
caacagugccgaugcc

SEQ ID NO: 589663 - RNA, 22 nt, Escherichia coli CFT073
caacagugccgaugccgcuaca

SEQ ID NO: 589664 - RNA, 14 nt, Escherichia coli CFT073
caacauaacgcauc

SEQ ID NO: 589665 - RNA, 23 nt, Escherichia coli CFT073
caacauaaucaaccauuaaacgu

SEQ ID NO: 589666 - RNA, 22 nt, Escherichia coli CFT073
caacauaauccagccuucuaua

SEQ ID NO: 589667 - RNA, 18 nt, Escherichia coli CFT073
caacauaaugccgacauc

SEQ ID NO: 589668 - RNA, 12 nt, Escherichia coli CFT073
caacauauuucu

SEQ ID NO: 589669 - RNA, 15 nt, Escherichia coli CFT073
caacaucacaccaua

SEQ ID NO: 589670 - RNA, 17 nt, Escherichia coli CFT073
caacaucacgcugacgc

SEQ ID NO: 589671 - RNA, 22 nt, Escherichia coli CFT073
caacauugcgccucaccggaua

SEQ ID NO: 589672 - RNA, 12 nt, Escherichia coli CFT073
caaccaacgcgc

SEQ ID NO: 589673 - RNA, 13 nt, Escherichia coli CFT073
caaccaacgcgcc

SEQ ID NO: 589674 - RNA, 15 nt, Escherichia coli CFT073
caaccaacgcgccgc

SEQ ID NO: 589675 - RNA, 20 nt, Escherichia coli CFT073
caacaugcuauuacgccagc

SEQ ID NO: 589676 - RNA, 16 nt, Escherichia coli CFT073
caacaucguuagcggc

SEQ ID NO: 589677 - RNA, 11 nt, Escherichia coli CFT073
caacaucgaca

SEQ ID NO: 589678 - RNA, 23 nt, Escherichia coli CFT073
caaccagcggcgcauccgccagc

SEQ ID NO: 589679 - RNA, 21 nt, Escherichia coli CFT073
caaccagcgucgcaucaggcg

SEQ ID NO: 589680 - RNA, 14 nt, Escherichia coli CFT073
caaccagcaaugcc

SEQ ID NO: 589681 - RNA, 18 nt, Escherichia coli CFT073
caaccaguugagcggauu

SEQ ID NO: 589682 - RNA, 17 nt, Escherichia coli CFT073
caacccaaccugccaga

SEQ ID NO: 589683 - RNA, 21 nt, Escherichia coli CFT073
caaccaccugauacgagcaaa

SEQ ID NO: 589684 - RNA, 19 nt, Escherichia coli CFT073
caaccaccacaccugccac

SEQ ID NO: 589685 - RNA, 17 nt, Escherichia coli CFT073
caaccacacccacauca

SEQ ID NO: 589686 - RNA, 21 nt, Escherichia coli CFT073
caaccuuuguauuuuuccgca

SEQ ID NO: 589687 - RNA, 21 nt, Escherichia coli CFT073
caaccuuuuccauugccgcag

SEQ ID NO: 589688 - RNA, 13 nt, Escherichia coli CFT073
caacgaaugccgc

SEQ ID NO: 589689 - RNA, 21 nt, Escherichia coli CFT073
caacgaccgcgagcaaaaucg

SEQ ID NO: 589690 - RNA, 18 nt, Escherichia coli CFT073
caacgaugcgaccgccgc

SEQ ID NO: 589691 - RNA, 14 nt, Escherichia coli CFT073
caacgcacccgcgc

SEQ ID NO: 589692 - RNA, 22 nt, Escherichia coli CFT073
caacgcacuggcgagcgccagc

SEQ ID NO: 589693 - RNA, 16 nt, Escherichia coli CFT073
caacgcacuggcgcgc

SEQ ID NO: 589694 - RNA, 12 nt, Escherichia coli CFT073
caacgcagacgc

SEQ ID NO: 589695 - RNA, 14 nt, Escherichia coli CFT073
caacgcagcggcga

SEQ ID NO: 589696 - RNA, 14 nt, Escherichia coli CFT073
caacgcaucaaacc

SEQ ID NO: 589697 - RNA, 17 nt, Escherichia coli CFT073
caacgcaucccgguuua

SEQ ID NO: 589698 - RNA, 19 nt, Escherichia coli CFT073
caacgccaaauuuaaacga

SEQ ID NO: 589699 - RNA, 23 nt, Escherichia coli CFT073
caacgccaccacucaaaagcgua

SEQ ID NO: 589700 - RNA, 13 nt, Escherichia coli CFT073
caacgccaccauc

SEQ ID NO: 589701 - RNA, 16 nt, Escherichia coli CFT073
caacgccagcgaagcc

SEQ ID NO: 589702 - RNA, 16 nt, Escherichia coli CFT073
caacgcgguuucgccg

SEQ ID NO: 589703 - RNA, 17 nt, Escherichia coli CFT073
caacgcgguuucgccgc

SEQ ID NO: 589704 - RNA, 14 nt, Escherichia coli CFT073
caacgcgccaccga

SEQ ID NO: 589705 - RNA, 13 nt, Escherichia coli CFT073
caacgccugaugc

SEQ ID NO: 589706 - RNA, 17 nt, Escherichia coli CFT073
caacgccuuguucgccc

SEQ ID NO: 589707 - RNA, 18 nt, Escherichia coli CFT073
caacgccuuguucgcccu

SEQ ID NO: 589708 - RNA, 19 nt, Escherichia coli CFT073
caacgccuuuaccaccagu

SEQ ID NO: 589709 - RNA, 23 nt, Escherichia coli CFT073
caacgccuuucgcuguaaacggc

SEQ ID NO: 589710 - RNA, 23 nt, Escherichia coli CFT073
caacgccgauuaauauuaaacca

SEQ ID NO: 589711 - RNA, 12 nt, Escherichia coli CFT073
caacgccgcaca

SEQ ID NO: 589712 - RNA, 12 nt, Escherichia coli CFT073
caacgccgccaa

SEQ ID NO: 589713 - RNA, 16 nt, Escherichia coli CFT073
caacccgagcgccagc

SEQ ID NO: 589714 - RNA, 14 nt, Escherichia coli CFT073
caacccgccaucgc

SEQ ID NO: 589715 - RNA, 18 nt, Escherichia coli CFT073
caacccgcacggucacua

SEQ ID NO: 589716 - RNA, 13 nt, Escherichia coli CFT073
caaccaucgccgu

SEQ ID NO: 589717 - RNA, 22 nt, Escherichia coli CFT073
caaccgccggaugcggcgugaa

SEQ ID NO: 589718 - RNA, 22 nt, Escherichia coli CFT073
caaccgccagaugcggcgugaa

SEQ ID NO: 589719 - RNA, 13 nt, Escherichia coli CFT073
caaccgccaucca

SEQ ID NO: 589720 - RNA, 13 nt, Escherichia coli CFT073
caaccgacgacga

SEQ ID NO: 589721 - RNA, 19 nt, Escherichia coli CFT073
caaccgcaacgacuacgcc

SEQ ID NO: 589722 - RNA, 15 nt, Escherichia coli CFT073
caaccuucgccagaa

SEQ ID NO: 589723 - RNA, 15 nt, Escherichia coli CFT073
caaccugaucgugcc

SEQ ID NO: 589724 - RNA, 17 nt, Escherichia coli CFT073
caaccuccgucuggcca

SEQ ID NO: 589725 - RNA, 23 nt, Escherichia coli CFT073
caaccgucgccucgccgagcagc

SEQ ID NO: 589726 - RNA, 18 nt, Escherichia coli CFT073
caaccguucgggaaaaua

SEQ ID NO: 589727 - RNA, 17 nt, Escherichia coli CFT073
caaccgggccucgcagc

SEQ ID NO: 589728 - RNA, 16 nt, Escherichia coli CFT073
caaccggggcauucau

SEQ ID NO: 589729 - RNA, 19 nt, Escherichia coli CFT073
caaccggggcauucaugaa

SEQ ID NO: 589730 - RNA, 20 nt, Escherichia coli CFT073
caaccgcuuccggucugcga

SEQ ID NO: 589731 - RNA, 15 nt, Escherichia coli CFT073
cacaaaaacaguaag

SEQ ID NO: 589732 - RNA, 15 nt, Escherichia coli CFT073
cacaaagcgccagaa

SEQ ID NO: 589733 - RNA, 14 nt, Escherichia coli CFT073
cacaaaccaccgaa

SEQ ID NO: 589734 - RNA, 17 nt, Escherichia coli CFT073
cacaaacgccgugcaca

SEQ ID NO: 589735 - RNA, 18 nt, Escherichia coli CFT073
cacagcauccgaacgcug

SEQ ID NO: 589736 - RNA, 14 nt, Escherichia coli CFT073
cacaaaggcgcgaa

SEQ ID NO: 589737 - RNA, 15 nt, Escherichia coli CFT073
cacaaauccccaguu

SEQ ID NO: 589738 - RNA, 15 nt, Escherichia coli CFT073
cacaggcauucagau

SEQ ID NO: 589739 - RNA, 14 nt, Escherichia coli CFT073
cacagcccgccaca

SEQ ID NO: 589740 - RNA, 15 nt, Escherichia coli CFT073
cacagcccgccgcca

SEQ ID NO: 589741 - RNA, 15 nt, Escherichia coli CFT073
cacaguuuuccgcca

SEQ ID NO: 589742 - RNA, 18 nt, Escherichia coli CFT073
cacaguuucagccccauc

SEQ ID NO: 589743 - RNA, 11 nt, Escherichia coli CFT073
cacaggcgcga

SEQ ID NO: 589744 - RNA, 13 nt, Escherichia coli CFT073
cacagugucauug

SEQ ID NO: 589745 - RNA, 14 nt, Escherichia coli CFT073
cacaguuaaccagu

SEQ ID NO: 589746 - RNA, 16 nt, Escherichia coli CFT073
cacaugcugacuacuu

SEQ ID NO: 589747 - RNA, 20 nt, Escherichia coli CFT073
cacaugaucauucaccagcc

SEQ ID NO: 589748 - RNA, 16 nt, Escherichia coli CFT073
cacaucauuacaacgc

SEQ ID NO: 589749 - RNA, 16 nt, Escherichia coli CFT073
cacauauguuuaaccg

SEQ ID NO: 589750 - RNA, 15 nt, Escherichia coli CFT073
cacaucaacccagaa

SEQ ID NO: 589751 - RNA, 21 nt, Escherichia coli CFT073
cacaucacgccgcuggcauac

SEQ ID NO: 589752 - RNA, 19 nt, Escherichia coli CFT073
caccaaacuggaauagcgc

SEQ ID NO: 589753 - RNA, 18 nt, Escherichia coli CFT073
caccaaagaagcguugau

SEQ ID NO: 589754 - RNA, 16 nt, Escherichia coli CFT073
caccaaaaaucaccgc

SEQ ID NO: 589755 - RNA, 12 nt, Escherichia coli CFT073
caccaccacuga

SEQ ID NO: 589756 - RNA, 13 nt, Escherichia coli CFT073
caccaccagcagc

SEQ ID NO: 589757 - RNA, 13 nt, Escherichia coli CFT073
caccacgccaaga

SEQ ID NO: 589758 - RNA, 17 nt, Escherichia coli CFT073
caccauauucagcagca

SEQ ID NO: 589759 - RNA, 14 nt, Escherichia coli CFT073
caccauauccagcg

SEQ ID NO: 589760 - RNA, 18 nt, Escherichia coli CFT073
caccaugccgauggcaaa

SEQ ID NO: 589761 - RNA, 21 nt, Escherichia coli CFT073
cacccgagagaacugcugcau

SEQ ID NO: 589762 - RNA, 16 nt, Escherichia coli CFT073
cacccgagcuaacaau

SEQ ID NO: 589763 - RNA, 22 nt, Escherichia coli CFT073
cacccgacgugcagcaucgaug

SEQ ID NO: 589764 - RNA, 18 nt, Escherichia coli CFT073
caccaguuguugcgugaa

SEQ ID NO: 589765 - RNA, 17 nt, Escherichia coli CFT073
caccaggcuaaauugca

SEQ ID NO: 589766 - RNA, 14 nt, Escherichia coli CFT073
caccagcguaccga

SEQ ID NO: 589767 - RNA, 14 nt, Escherichia coli CFT073
caccagcgccacca

SEQ ID NO: 589768 - RNA, 13 nt, Escherichia coli CFT073
caccagcgcacug

SEQ ID NO: 589769 - RNA, 12 nt, Escherichia coli CFT073
cacccuguuugu

SEQ ID NO: 589770 - RNA, 16 nt, Escherichia coli CFT073
cacccugcacggguga

SEQ ID NO: 589771 - RNA, 21 nt, Escherichia coli CFT073
cacccuaacccucuccccaga

SEQ ID NO: 589772 - RNA, 17 nt, Escherichia coli CFT073
caccgaagcggccguca

SEQ ID NO: 589773 - RNA, 17 nt, Escherichia coli CFT073
caccgaaugcgccuacc

SEQ ID NO: 589774 - RNA, 14 nt, Escherichia coli CFT073
caccgacaauccag

SEQ ID NO: 589775 - RNA, 14 nt, Escherichia coli CFT073
cacccgcggcgauc

SEQ ID NO: 589776 - RNA, 15 nt, Escherichia coli CFT073
caccgcaucggcauc

SEQ ID NO: 589777 - RNA, 16 nt, Escherichia coli CFT073
caccgcaucggcauca

SEQ ID NO: 589778 - RNA, 15 nt, Escherichia coli CFT073
caccgccaaccagcg

SEQ ID NO: 589779 - RNA, 15 nt, Escherichia coli CFT073
caccgccgaggccga

SEQ ID NO: 589780 - RNA, 14 nt, Escherichia coli CFT073
caccgccuucguaa

SEQ ID NO: 589781 - RNA, 19 nt, Escherichia coli CFT073
caccggcaaucugcuggca

SEQ ID NO: 589782 - RNA, 22 nt, Escherichia coli CFT073
caccggcauuuuuuagcgccag

SEQ ID NO: 589783 - RNA, 17 nt, Escherichia coli CFT073
caccgcucugcaucccg

SEQ ID NO: 589784 - RNA, 18 nt, Escherichia coli CFT073
caccgcuacguucgcgag

SEQ ID NO: 589785 - RNA, 13 nt, Escherichia coli CFT073
caccgcgaaaaca

SEQ ID NO: 589786 - RNA, 15 nt, Escherichia coli CFT073
caccgcgaaaacaau

SEQ ID NO: 589787 - RNA, 14 nt, Escherichia coli CFT073
caccgcgacaauca

SEQ ID NO: 589788 - RNA, 16 nt, Escherichia coli CFT073
caccgugauccgccgc

SEQ ID NO: 589789 - RNA, 21 nt, Escherichia coli CFT073
caccgugcacuucugcgguga

SEQ ID NO: 589790 - RNA, 21 nt, Escherichia coli CFT073
caccguguucaugaccgugau

SEQ ID NO: 589791 - RNA, 18 nt, Escherichia coli CFT073
caccgucgcaccgguauc

SEQ ID NO: 589792 - RNA, 14 nt, Escherichia coli CFT073
caccgucacuucuu

SEQ ID NO: 589793 - RNA, 20 nt, Escherichia coli CFT073
caccgggggguugccgccac

SEQ ID NO: 589794 - RNA, 20 nt, Escherichia coli CFT073
auggcuguuaaacgccgguu

SEQ ID NO: 589795 - RNA, 21 nt, Escherichia coli CFT073
auggcuucuggcugcuccaga

SEQ ID NO: 589796 - RNA, 18 nt, Escherichia coli CFT073
auggcugaguuaccagcg

SEQ ID NO: 589797 - RNA, 20 nt, Escherichia coli CFT073
auggcuaucgaaaucaaagu

SEQ ID NO: 589798 - RNA, 17 nt, Escherichia coli CFT073
auggcucuucccuuuca

SEQ ID NO: 589799 - RNA, 16 nt, Escherichia coli CFT073
auggcguuaggcggaa

SEQ ID NO: 589800 - RNA, 14 nt, Escherichia coli CFT073
auggcguuaucacg

SEQ ID NO: 589801 - RNA, 16 nt, Escherichia coli CFT073
auggcguuaucacggu

SEQ ID NO: 589802 - RNA, 21 nt, Escherichia coli CFT073
auggcgucuucuucaaaacca

SEQ ID NO: 589803 - RNA, 19 nt, Escherichia coli CFT073
auggcguuuccuuccagaa

SEQ ID NO: 589804 - RNA, 15 nt, Escherichia coli CFT073
auggcucagauugaa

SEQ ID NO: 589805 - RNA, 17 nt, Escherichia coli CFT073
auggcgacguaccagcg

SEQ ID NO: 589806 - RNA, 15 nt, Escherichia coli CFT073
auggcgcugcugcac

SEQ ID NO: 589807 - RNA, 14 nt, Escherichia coli CFT073
auggacaaaagccc

SEQ ID NO: 589808 - RNA, 14 nt, Escherichia coli CFT073
auggaauaacgaua

SEQ ID NO: 589809 - RNA, 12 nt, Escherichia coli CFT073
auggaacaacac

SEQ ID NO: 589810 - RNA, 13 nt, Escherichia coli CFT073
auggaaaucaccc

SEQ ID NO: 589811 - RNA, 17 nt, Escherichia coli CFT073
auggcgaacauaaggau

SEQ ID NO: 589812 - RNA, 23 nt, Escherichia coli CFT073
auggcccaguguuuuaccggcaa

SEQ ID NO: 589813 - RNA, 17 nt, Escherichia coli CFT073
auggcccauucagcaug

SEQ ID NO: 589814 - RNA, 15 nt, Escherichia coli CFT073
auguccauuuccgga

SEQ ID NO: 589815 - RNA, 19 nt, Escherichia coli CFT073
auguagcggaucgccgccg

SEQ ID NO: 589816 - RNA, 13 nt, Escherichia coli CFT073
auguagcgugauu

SEQ ID NO: 589817 - RNA, 22 nt, Escherichia coli CFT073
augucugaugcgacgcggcagc

SEQ ID NO: 589818 - RNA, 23 nt, Escherichia coli CFT073
augucugcaagagggacuccgga

SEQ ID NO: 589819 - RNA, 20 nt, Escherichia coli CFT073
augguguugcaccaucaggc

SEQ ID NO: 589820 - RNA, 13 nt, Escherichia coli CFT073
auguaauaaaccu

SEQ ID NO: 589821 - RNA, 14 nt, Escherichia coli CFT073
augggcauccacag

SEQ ID NO: 589822 - RNA, 13 nt, Escherichia coli CFT073
auggugcagcaga

SEQ ID NO: 589823 - RNA, 14 nt, Escherichia coli CFT073
auggugcagcagac

SEQ ID NO: 589824 - RNA, 20 nt, Escherichia coli CFT073
auggugaaaaauaaugccac

SEQ ID NO: 589825 - RNA, 17 nt, Escherichia coli CFT073
auggugaaaccgcagca

SEQ ID NO: 589826 - RNA, 19 nt, Escherichia coli CFT073
augcuuugaccucccgcug

SEQ ID NO: 589827 - RNA, 19 nt, Escherichia coli CFT073
augcuuuacguauccguuc

SEQ ID NO: 589828 - RNA, 17 nt, Escherichia coli CFT073
augcuucuucugugaag

SEQ ID NO: 589829 - RNA, 18 nt, Escherichia coli CFT073
augcuucgcucucuuuca

SEQ ID NO: 589830 - RNA, 22 nt, Escherichia coli CFT073
augcuucagccagaggcggcaa

SEQ ID NO: 589831 - RNA, 15 nt, Escherichia coli CFT073
augcuuaacgccaga

SEQ ID NO: 589832 - RNA, 13 nt, Escherichia coli CFT073
augcguuaagcgu

SEQ ID NO: 589833 - RNA, 14 nt, Escherichia coli CFT073
augcguuaucgcca

SEQ ID NO: 589834 - RNA, 16 nt, Escherichia coli CFT073
augcguuaucgccauc

SEQ ID NO: 589835 - RNA, 21 nt, Escherichia coli CFT073
augcgucuuccgugccugacg

SEQ ID NO: 589836 - RNA, 20 nt, Escherichia coli CFT073
augcggugcgccacaccgca

SEQ ID NO: 589837 - RNA, 16 nt, Escherichia coli CFT073
augcggguaacgccca

SEQ ID NO: 589838 - RNA, 22 nt, Escherichia coli CFT073
augcgcaacaccguaagaaagg

SEQ ID NO: 589839 - RNA, 12 nt, Escherichia coli CFT073
augcgaugcuga

SEQ ID NO: 589840 - RNA, 22 nt, Escherichia coli CFT073
augcgcucgaucaguucagcag

SEQ ID NO: 589841 - RNA, 15 nt, Escherichia coli CFT073
augcgcuugcagacg

SEQ ID NO: 589842 - RNA, 15 nt, Escherichia coli CFT073
augcgcuuuaucguc

SEQ ID NO: 589843 - RNA, 16 nt, Escherichia coli CFT073
augcggucgcugccgc

SEQ ID NO: 589844 - RNA, 18 nt, Escherichia coli CFT073
augccggaauuaauaauc

SEQ ID NO: 589845 - RNA, 15 nt, Escherichia coli CFT073
augccggacuccagc

SEQ ID NO: 589846 - RNA, 22 nt, Escherichia coli CFT073
augccggaggagugcgccaguu

SEQ ID NO: 589847 - RNA, 14 nt, Escherichia coli CFT073
augccguacagcag

SEQ ID NO: 589848 - RNA, 16 nt, Escherichia coli CFT073
augccucuuucauccg

SEQ ID NO: 589849 - RNA, 20 nt, Escherichia coli CFT073
augccucgcuaaucucuuca

SEQ ID NO: 589850 - RNA, 20 nt, Escherichia coli CFT073
augccucuugucucguuuca

SEQ ID NO: 589851 - RNA, 22 nt, Escherichia coli CFT073
augccucuugucucguuucagu

SEQ ID NO: 589852 - RNA, 16 nt, Escherichia coli CFT073
augccguuaaggccaa

SEQ ID NO: 589853 - RNA, 21 nt, Escherichia coli CFT073
augccgucaauccagccgccc

SEQ ID NO: 589854 - RNA, 13 nt, Escherichia coli CFT073
augaucgcggcgu

SEQ ID NO: 589855 - RNA, 16 nt, Escherichia coli CFT073
augaucgccgccagug

SEQ ID NO: 589856 - RNA, 15 nt, Escherichia coli CFT073
augaugacgggcaag

SEQ ID NO: 589857 - RNA, 21 nt, Escherichia coli CFT073
augaugauugaccauauuaac

SEQ ID NO: 589858 - RNA, 19 nt, Escherichia coli CFT073
augaugccacaaacuggcu

SEQ ID NO: 589859 - RNA, 22 nt, Escherichia coli CFT073
augaugccgaagugaaucggau

SEQ ID NO: 589860 - RNA, 17 nt, Escherichia coli CFT073
augaugccgacggcgca

SEQ ID NO: 589861 - RNA, 18 nt, Escherichia coli CFT073
augaugccgacggcgcac

SEQ ID NO: 589862 - RNA, 10 nt, Escherichia coli CFT073
augccgccaa

SEQ ID NO: 589863 - RNA, 16 nt, Escherichia coli CFT073
augccgcacaucaccg

SEQ ID NO: 589864 - RNA, 17 nt, Escherichia coli CFT073
augccgcacaucaccgc

SEQ ID NO: 589865 - RNA, 14 nt, Escherichia coli CFT073
auugauucacaucc

SEQ ID NO: 589866 - RNA, 13 nt, Escherichia coli CFT073
auugauucgcuca

SEQ ID NO: 589867 - RNA, 18 nt, Escherichia coli CFT073
auugaugagaacaucauc

SEQ ID NO: 589868 - RNA, 13 nt, Escherichia coli CFT073
auugaucaucccg

SEQ ID NO: 589869 - RNA, 18 nt, Escherichia coli CFT073
auugcaaacagagcgggc

SEQ ID NO: 589870 - RNA, 19 nt, Escherichia coli CFT073
auugcaacuggcugccguu

SEQ ID NO: 589871 - RNA, 15 nt, Escherichia coli CFT073
auugcacauucccug

SEQ ID NO: 589872 - RNA, 16 nt, Escherichia coli CFT073
auugcaccacaucggu

SEQ ID NO: 589873 - RNA, 22 nt, Escherichia coli CFT073
auugcaccagaucuuccagcgg

SEQ ID NO: 589874 - RNA, 16 nt, Escherichia coli CFT073
auugccgcgauagcaa

SEQ ID NO: 589875 - RNA, 18 nt, Escherichia coli CFT073
auugccgcuaucaggcca

SEQ ID NO: 589876 - RNA, 17 nt, Escherichia coli CFT073
auugccggaagcgccac

SEQ ID NO: 589877 - RNA, 21 nt, Escherichia coli CFT073
auugcuccauaauugccagcu

SEQ ID NO: 589878 - RNA, 17 nt, Escherichia coli CFT073
auugccuguucgccgcc

SEQ ID NO: 589879 - RNA, 18 nt, Escherichia coli CFT073
auugccuguucgccgccg

SEQ ID NO: 589880 - RNA, 21 nt, Escherichia coli CFT073
auugcugugauuaagcagcgc

SEQ ID NO: 589881 - RNA, 19 nt, Escherichia coli CFT073
auugcuggccuagaugaau

SEQ ID NO: 589882 - RNA, 22 nt, Escherichia coli CFT073
auugcugaaaaggcuaaaauug

SEQ ID NO: 589883 - RNA, 18 nt, Escherichia coli CFT073
auugcugaaaauugucuu

SEQ ID NO: 589884 - RNA, 14 nt, Escherichia coli CFT073
auugcugcacaucc

SEQ ID NO: 589885 - RNA, 16 nt, Escherichia coli CFT073
auugccguaaucgccu

SEQ ID NO: 589886 - RNA, 15 nt, Escherichia coli CFT073
auugccugaaccggu

SEQ ID NO: 589887 - RNA, 12 nt, Escherichia coli CFT073
auugccugaugc

SEQ ID NO: 589888 - RNA, 15 nt, Escherichia coli CFT073
auugccggaugcggc

SEQ ID NO: 589889 - RNA, 17 nt, Escherichia coli CFT073
auuggggucaucgcccu

SEQ ID NO: 589890 - RNA, 16 nt, Escherichia coli CFT073
auugguaauacccaga

SEQ ID NO: 589891 - RNA, 19 nt, Escherichia coli CFT073
auugguacaacguccuuuc

SEQ ID NO: 589892 - RNA, 14 nt, Escherichia coli CFT073
auugguuucgucgu

SEQ ID NO: 589893 - RNA, 24 nt, Escherichia coli CFT073
auugguuuuugaauuugccgaaca

SEQ ID NO: 589894 - RNA, 14 nt, Escherichia coli CFT073
auuggagcgugaua

SEQ ID NO: 589895 - RNA, 14 nt, Escherichia coli CFT073
auuggcaacagcca

SEQ ID NO: 589896 - RNA, 10 nt, Escherichia coli CFT073
auuguuugac

SEQ ID NO: 589897 - RNA, 20 nt, Escherichia coli CFT073
auuguaggccagauaaaaca

SEQ ID NO: 589898 - RNA, 14 nt, Escherichia coli CFT073
auuguaggccggau

SEQ ID NO: 589899 - RNA, 21 nt, Escherichia coli CFT073
auuguaucuagggacauagua

SEQ ID NO: 589900 - RNA, 14 nt, Escherichia coli CFT073
auuguuaaucacau

SEQ ID NO: 589901 - RNA, 16 nt, Escherichia coli CFT073
auucauucaaauuaaa

SEQ ID NO: 589902 - RNA, 14 nt, Escherichia coli CFT073
auuccguucaguaa

SEQ ID NO: 589903 - RNA, 22 nt, Escherichia coli CFT073
auucaugcccugcccgcugcca

SEQ ID NO: 589904 - RNA, 19 nt, Escherichia coli CFT073
auuccugaauggugaccug

SEQ ID NO: 589905 - RNA, 23 nt, Escherichia coli CFT073
auuccugacccagcaccaguacc

SEQ ID NO: 589906 - RNA, 12 nt, Escherichia coli CFT073
auucgaaaucug

SEQ ID NO: 589907 - RNA, 15 nt, Escherichia coli CFT073
auucggcaaucacaa

SEQ ID NO: 589908 - RNA, 12 nt, Escherichia coli CFT073
auucggcaaugg

SEQ ID NO: 589909 - RNA, 11 nt, Escherichia coli CFT073
auucggcggca

SEQ ID NO: 589910 - RNA, 13 nt, Escherichia coli CFT073
auucugacgccac

SEQ ID NO: 589911 - RNA, 17 nt, Escherichia coli CFT073
auugacgccaucaacga

SEQ ID NO: 589912 - RNA, 19 nt, Escherichia coli CFT073
auugacgaauauagcgcca

SEQ ID NO: 589913 - RNA, 14 nt, Escherichia coli CFT073
auugacuaucugac

SEQ ID NO: 589914 - RNA, 18 nt, Escherichia coli CFT073
auugagauccauuaugau

SEQ ID NO: 589915 - RNA, 18 nt, Escherichia coli CFT073
auucugcgagcuuucgac

SEQ ID NO: 589916 - RNA, 21 nt, Escherichia coli CFT073
auucuguccuccaugaugacc

SEQ ID NO: 589917 - RNA, 17 nt, Escherichia coli CFT073
auucuggcgcaacaccc

SEQ ID NO: 589918 - RNA, 15 nt, Escherichia coli CFT073
auguuuuuuuuauca

SEQ ID NO: 589919 - RNA, 21 nt, Escherichia coli CFT073
auuaaaucugcuuuucauaca

SEQ ID NO: 589920 - RNA, 15 nt, Escherichia coli CFT073
auuaaaccaggaaca

SEQ ID NO: 589921 - RNA, 20 nt, Escherichia coli CFT073
auuaaacgccucugucagaa

SEQ ID NO: 589922 - RNA, 18 nt, Escherichia coli CFT073
auguuccgccauuucugg

SEQ ID NO: 589923 - RNA, 13 nt, Escherichia coli CFT073
auguugagcggca

SEQ ID NO: 589924 - RNA, 16 nt, Escherichia coli CFT073
auguugauaaucaccg

SEQ ID NO: 589925 - RNA, 16 nt, Escherichia coli CFT073
auguugcugcaccagg

SEQ ID NO: 589926 - RNA, 15 nt, Escherichia coli CFT073
auguugucgccagua

SEQ ID NO: 589927 - RNA, 17 nt, Escherichia coli CFT073
auguuguuucucuuucu

SEQ ID NO: 589928 - RNA, 23 nt, Escherichia coli CFT073
auguuucauccaggcacuggccu

SEQ ID NO: 589929 - RNA, 16 nt, Escherichia coli CFT073
auguguucagcgacag

SEQ ID NO: 589930 - RNA, 16 nt, Escherichia coli CFT073
auguguuggcaccauc

SEQ ID NO: 589931 - RNA, 17 nt, Escherichia coli CFT073
auguguuggcaccaucc

SEQ ID NO: 589932 - RNA, 15 nt, Escherichia coli CFT073
auguggugaaaugcc

SEQ ID NO: 589933 - RNA, 18 nt, Escherichia coli CFT073
auguggcucagccagacg

SEQ ID NO: 589934 - RNA, 20 nt, Escherichia coli CFT073
augugcguugucaucgcggc

SEQ ID NO: 589935 - RNA, 16 nt, Escherichia coli CFT073
augugcagcagugcca

SEQ ID NO: 589936 - RNA, 22 nt, Escherichia coli CFT073
augugaucgaauauaucagccu

SEQ ID NO: 589937 - RNA, 19 nt, Escherichia coli CFT073
augugaaggugauucccag

SEQ ID NO: 589938 - RNA, 22 nt, Escherichia coli CFT073
augugagucagaugcugugcaa

SEQ ID NO: 589939 - RNA, 12 nt, Escherichia coli CFT073
auuauuuauuca

SEQ ID NO: 589940 - RNA, 14 nt, Escherichia coli CFT073
auuauuuuaaauuu

SEQ ID NO: 589941 - RNA, 15 nt, Escherichia coli CFT073
auuaucacaucagcg

SEQ ID NO: 589942 - RNA, 20 nt, Escherichia coli CFT073
auuaucacccugaucaauaa

SEQ ID NO: 589943 - RNA, 14 nt, Escherichia coli CFT073
auucaucgccaccg

SEQ ID NO: 589944 - RNA, 20 nt, Escherichia coli CFT073
auucaucguaaucucuuucc

SEQ ID NO: 589945 - RNA, 16 nt, Escherichia coli CFT073
auucaguccacaucuc

SEQ ID NO: 589946 - RNA, 14 nt, Escherichia coli CFT073
auucaguuucuggc

SEQ ID NO: 589947 - RNA, 24 nt, Escherichia coli CFT073
auucacacagugaaucucuuauca

SEQ ID NO: 589948 - RNA, 16 nt, Escherichia coli CFT073
auucacacucugccag

SEQ ID NO: 589949 - RNA, 14 nt, Escherichia coli CFT073
auucaguaccagca

SEQ ID NO: 589950 - RNA, 15 nt, Escherichia coli CFT073
auucaguaccagcac

SEQ ID NO: 589951 - RNA, 13 nt, Escherichia coli CFT073
auuaagaagcggc

SEQ ID NO: 589952 - RNA, 15 nt, Escherichia coli CFT073
auuaagaagcggcua

SEQ ID NO: 589953 - RNA, 15 nt, Escherichia coli CFT073
auuaaggucauaucu

SEQ ID NO: 589954 - RNA, 16 nt, Escherichia coli CFT073
auuaaguguccgccaa

SEQ ID NO: 589955 - RNA, 19 nt, Escherichia coli CFT073
auuaaauuguucauauuaa

SEQ ID NO: 589956 - RNA, 18 nt, Escherichia coli CFT073
auuaaccgcccaccgcca

SEQ ID NO: 589957 - RNA, 22 nt, Escherichia coli CFT073
auuaacgaaacccgaaccacgc

SEQ ID NO: 589958 - RNA, 23 nt, Escherichia coli CFT073
auuaacgaaacccgaaccacgca

SEQ ID NO: 589959 - RNA, 22 nt, Escherichia coli CFT073
auuaacgcugaagccaugaccu

SEQ ID NO: 589960 - RNA, 18 nt, Escherichia coli CFT073
auuaacggccacgaugca

SEQ ID NO: 589961 - RNA, 22 nt, Escherichia coli CFT073
auuaacggccuuuugccagaua

SEQ ID NO: 589962 - RNA, 11 nt, Escherichia coli CFT073
auuaacgccag

SEQ ID NO: 589963 - RNA, 16 nt, Escherichia coli CFT073
auuagugcugcuggaa

SEQ ID NO: 589964 - RNA, 14 nt, Escherichia coli CFT073
auuaacugcuggaa

SEQ ID NO: 589965 - RNA, 20 nt, Escherichia coli CFT073
auuagccgguaaaucaccau

SEQ ID NO: 589966 - RNA, 22 nt, Escherichia coli CFT073
auuagccgguaaaucaccaucg

SEQ ID NO: 589967 - RNA, 17 nt, Escherichia coli CFT073
auuagcggccagcgggc

SEQ ID NO: 589968 - RNA, 16 nt, Escherichia coli CFT073
aucgcugaacgcaccu

SEQ ID NO: 589969 - RNA, 21 nt, Escherichia coli CFT073
aucgcugaacgcaccuuccag

SEQ ID NO: 589970 - RNA, 23 nt, Escherichia coli CFT073
aucgcugaacgggccauccauca

SEQ ID NO: 589971 - RNA, 13 nt, Escherichia coli CFT073
aucgcuaucaguc

SEQ ID NO: 589972 - RNA, 12 nt, Escherichia coli CFT073
aucgcuaccagu

SEQ ID NO: 589973 - RNA, 22 nt, Escherichia coli CFT073
aucgcuagauaggucaccagag

SEQ ID NO: 589974 - RNA, 20 nt, Escherichia coli CFT073
aucgcgugcacuacaacggc

SEQ ID NO: 589975 - RNA, 13 nt, Escherichia coli CFT073
aucggaccauugg

SEQ ID NO: 589976 - RNA, 16 nt, Escherichia coli CFT073
aucggaccauuggcau

SEQ ID NO: 589977 - RNA, 23 nt, Escherichia coli CFT073
aucgcuuuugcgguuuuucucac

SEQ ID NO: 589978 - RNA, 22 nt, Escherichia coli CFT073
aucgcuucaucgcccacaucau

SEQ ID NO: 589979 - RNA, 21 nt, Escherichia coli CFT073
aucgcuguguguaggcguuau

SEQ ID NO: 589980 - RNA, 16 nt, Escherichia coli CFT073
aucgcuucaaucagcg

SEQ ID NO: 589981 - RNA, 19 nt, Escherichia coli CFT073
aucgcuugcucgcgcaccu

SEQ ID NO: 589982 - RNA, 14 nt, Escherichia coli CFT073
aucgcuuucaacgu

SEQ ID NO: 589983 - RNA, 12 nt, Escherichia coli CFT073
aucgcgccgcga

SEQ ID NO: 589984 - RNA, 16 nt, Escherichia coli CFT073
aucgcgcccgccgcca

SEQ ID NO: 589985 - RNA, 21 nt, Escherichia coli CFT073
aucgcgcccgccgccauugaa

SEQ ID NO: 589986 - RNA, 17 nt, Escherichia coli CFT073
aucgcgcguguugcgcc

SEQ ID NO: 589987 - RNA, 20 nt, Escherichia coli CFT073
aucgcgcgggcauugaugaa

SEQ ID NO: 589988 - RNA, 14 nt, Escherichia coli CFT073
aucgcgcuuagcaa

SEQ ID NO: 589989 - RNA, 12 nt, Escherichia coli CFT073
aucgcggcagcg

SEQ ID NO: 589990 - RNA, 23 nt, Escherichia coli CFT073
aucgccguuuuuuucuucucgca

SEQ ID NO: 589991 - RNA, 21 nt, Escherichia coli CFT073
aucgccugcugaauauugcca

SEQ ID NO: 589992 - RNA, 21 nt, Escherichia coli CFT073
aucgccuucgcaaaaaaccau

SEQ ID NO: 589993 - RNA, 20 nt, Escherichia coli CFT073
aucgcgaucccccagaaaau

SEQ ID NO: 589994 - RNA, 17 nt, Escherichia coli CFT073
aucgcgccaucaaaucu

SEQ ID NO: 589995 - RNA, 19 nt, Escherichia coli CFT073
aucgcgccaucaaaucugc

SEQ ID NO: 589996 - RNA, 19 nt, Escherichia coli CFT073
aucgcgccaaucagcgcag

SEQ ID NO: 589997 - RNA, 16 nt, Escherichia coli CFT073
aucgccuuuuuucacc

SEQ ID NO: 589998 - RNA, 14 nt, Escherichia coli CFT073
aucgcgacggcaga

SEQ ID NO: 589999 - RNA, 15 nt, Escherichia coli CFT073
aucgcgaucaucagu

SEQ ID NO: 590000 - RNA, 20 nt, Escherichia coli CFT073
aucgccggaauaucaccacu

SEQ ID NO: 590001 - RNA, 13 nt, Escherichia coli CFT073
aucgccgcaucau

SEQ ID NO: 590002 - RNA, 17 nt, Escherichia coli CFT073
aucgccgcaucauccuc

SEQ ID NO: 590003 - RNA, 23 nt, Escherichia coli CFT073
aucgcccugaauuucaauaauuc

SEQ ID NO: 590004 - RNA, 18 nt, Escherichia coli CFT073
aucgcccugauggcgcgc

SEQ ID NO: 590005 - RNA, 14 nt, Escherichia coli CFT073
aucgcccugccagc

SEQ ID NO: 590006 - RNA, 13 nt, Escherichia coli CFT073
aucgcccucgccu

SEQ ID NO: 590007 - RNA, 16 nt, Escherichia coli CFT073
aucgcccggcguggug

SEQ ID NO: 590008 - RNA, 17 nt, Escherichia coli CFT073
aucgcccggcguggugc

SEQ ID NO: 590009 - RNA, 18 nt, Escherichia coli CFT073
aucgcccggcaccagcac

SEQ ID NO: 590010 - RNA, 18 nt, Escherichia coli CFT073
aucgcauucggcauugaa

SEQ ID NO: 590011 - RNA, 15 nt, Escherichia coli CFT073
aucgcaucuucgccc

SEQ ID NO: 590012 - RNA, 14 nt, Escherichia coli CFT073
aucgcaugccagcg

SEQ ID NO: 590013 - RNA, 18 nt, Escherichia coli CFT073
aucgcacuuaaucgcccu

SEQ ID NO: 590014 - RNA, 20 nt, Escherichia coli CFT073
aucgcaaaggacaucccggc

SEQ ID NO: 590015 - RNA, 23 nt, Escherichia coli CFT073
aucgcaacgcaucuuuuucaauc

SEQ ID NO: 590016 - RNA, 14 nt, Escherichia coli CFT073
aucgaugugauaaa

SEQ ID NO: 590017 - RNA, 21 nt, Escherichia coli CFT073
aucgauuaccgccagcaacaa

SEQ ID NO: 590018 - RNA, 23 nt, Escherichia coli CFT073
aucgcaaucauuuuuuccccuua

SEQ ID NO: 590019 - RNA, 12 nt, Escherichia coli CFT073
aucgaugcugcu

SEQ ID NO: 590020 - RNA, 14 nt, Escherichia coli CFT073
aucgccaacgccug

SEQ ID NO: 590021 - RNA, 22 nt, Escherichia coli CFT073
aucgccacgucguuccccauca

SEQ ID NO: 590022 - RNA, 17 nt, Escherichia coli CFT073
aucgccacuuucacgcc

SEQ ID NO: 590023 - RNA, 21 nt, Escherichia coli CFT073
aucgccacuuucacgccgcca

SEQ ID NO: 590024 - RNA, 18 nt, Escherichia coli CFT073
aucgccagacucaccagc

SEQ ID NO: 590025 - RNA, 16 nt, Escherichia coli CFT073
aucgccagcaaaauca

SEQ ID NO: 590026 - RNA, 20 nt, Escherichia coli CFT073
aucgccagcaaaaucaccau

SEQ ID NO: 590027 - RNA, 20 nt, Escherichia coli CFT073
aucgccaggaacaacgacag

SEQ ID NO: 590028 - RNA, 13 nt, Escherichia coli CFT073
aucgccaucagcg

SEQ ID NO: 590029 - RNA, 19 nt, Escherichia coli CFT073
aucgccauaaacaccagca

SEQ ID NO: 590030 - RNA, 20 nt, Escherichia coli CFT073
aucgccauaaacaccagcag

SEQ ID NO: 590031 - RNA, 13 nt, Escherichia coli CFT073
aucgccauauccg

SEQ ID NO: 590032 - RNA, 14 nt, Escherichia coli CFT073
aucgcccacaccac

SEQ ID NO: 590033 - RNA, 23 nt, Escherichia coli CFT073
aucgcccaguugaugaccagugc

SEQ ID NO: 590034 - RNA, 18 nt, Escherichia coli CFT073
aucgcccauggucgcgaa

SEQ ID NO: 590035 - RNA, 14 nt, Escherichia coli CFT073
aucgcccccaucac

SEQ ID NO: 590036 - RNA, 18 nt, Escherichia coli CFT073
aucgcccgcaaucagcgu

SEQ ID NO: 590037 - RNA, 20 nt, Escherichia coli CFT073
aucgagauucauccaguucc

SEQ ID NO: 590038 - RNA, 20 nt, Escherichia coli CFT073
aucgacuguuuauuguugau

SEQ ID NO: 590039 - RNA, 19 nt, Escherichia coli CFT073
aucgagcgcagcaacauca

SEQ ID NO: 590040 - RNA, 22 nt, Escherichia coli CFT073
aucgagcgcagcaacaucacgc

SEQ ID NO: 590041 - RNA, 15 nt, Escherichia coli CFT073
aucgauauacaaaca

SEQ ID NO: 590042 - RNA, 14 nt, Escherichia coli CFT073
aucgauaucaccaa

SEQ ID NO: 590043 - RNA, 12 nt, Escherichia coli CFT073
aucgauccccug

SEQ ID NO: 590044 - RNA, 24 nt, Escherichia coli CFT073
aucgauaaucuucaaauaaacguc

SEQ ID NO: 590045 - RNA, 24 nt, Escherichia coli CFT073
aucgagugcggcgagcaucgccca

SEQ ID NO: 590046 - RNA, 13 nt, Escherichia coli CFT073
aucaggcaacauc

SEQ ID NO: 590047 - RNA, 15 nt, Escherichia coli CFT073
aucaggcaacccgca

SEQ ID NO: 590048 - RNA, 16 nt, Escherichia coli CFT073
aucaggcaaucggcgc

SEQ ID NO: 590049 - RNA, 20 nt, Escherichia coli CFT073
aucaggcagugaauuucuac

SEQ ID NO: 590050 - RNA, 18 nt, Escherichia coli CFT073
aucaggccuacauuggug

SEQ ID NO: 590051 - RNA, 22 nt, Escherichia coli CFT073
aucaggcauuagugcgcaguug

SEQ ID NO: 590052 - RNA, 23 nt, Escherichia coli CFT073
aucgacguaguacccucugcacc

SEQ ID NO: 590053 - RNA, 19 nt, Escherichia coli CFT073
aucgaccaggccaucagca

SEQ ID NO: 590054 - RNA, 20 nt, Escherichia coli CFT073
aucgaccaggccaucagcag

SEQ ID NO: 590055 - RNA, 14 nt, Escherichia coli CFT073
aucgacauucaaca

SEQ ID NO: 590056 - RNA, 14 nt, Escherichia coli CFT073
aucgacauugacca

SEQ ID NO: 590057 - RNA, 15 nt, Escherichia coli CFT073
aucgacccugaugaa

SEQ ID NO: 590058 - RNA, 16 nt, Escherichia coli CFT073
aucuuuccggcagaag

SEQ ID NO: 590059 - RNA, 20 nt, Escherichia coli CFT073
aucuuucuugcgcccgguua

SEQ ID NO: 590060 - RNA, 16 nt, Escherichia coli CFT073
aucuuugagucaacau

SEQ ID NO: 590061 - RNA, 19 nt, Escherichia coli CFT073
augaaucgggucggcggca

SEQ ID NO: 590062 - RNA, 16 nt, Escherichia coli CFT073
augaaucgucggaaug

SEQ ID NO: 590063 - RNA, 20 nt, Escherichia coli CFT073
augaaucacgauacuggcgu

SEQ ID NO: 590064 - RNA, 22 nt, Escherichia coli CFT073
augaauagcggaaaucuccaga

SEQ ID NO: 590065 - RNA, 15 nt, Escherichia coli CFT073
augaauuaccccugg

SEQ ID NO: 590066 - RNA, 22 nt, Escherichia coli CFT073
augaccagugcagauaccacca

SEQ ID NO: 590067 - RNA, 23 nt, Escherichia coli CFT073
augaccagugcagauaccaccag

SEQ ID NO: 590068 - RNA, 22 nt, Escherichia coli CFT073
augauaucagccugcaaacgcu

SEQ ID NO: 590069 - RNA, 14 nt, Escherichia coli CFT073
augauaaccccgca

SEQ ID NO: 590070 - RNA, 20 nt, Escherichia coli CFT073
augaguuagcacaaccauca

SEQ ID NO: 590071 - RNA, 16 nt, Escherichia coli CFT073
augaguucgcggcgca

SEQ ID NO: 590072 - RNA, 20 nt, Escherichia coli CFT073
augaguugaaauugaugggu

SEQ ID NO: 590073 - RNA, 20 nt, Escherichia coli CFT073
augaucagcgguuuugccag

SEQ ID NO: 590074 - RNA, 13 nt, Escherichia coli CFT073
augaucauccgcc

SEQ ID NO: 590075 - RNA, 18 nt, Escherichia coli CFT073
augauauguuuauuagcc

SEQ ID NO: 590076 - RNA, 18 nt, Escherichia coli CFT073
augaguauuucauccggc

SEQ ID NO: 590077 - RNA, 19 nt, Escherichia coli CFT073
augacuguccacgacagaa

SEQ ID NO: 590078 - RNA, 19 nt, Escherichia coli CFT073
augacucgccgcaaaaccc

SEQ ID NO: 590079 - RNA, 23 nt, Escherichia coli CFT073
augacucguuauuguuugucgcc

SEQ ID NO: 590080 - RNA, 16 nt, Escherichia coli CFT073
augacuaaugccgcca

SEQ ID NO: 590081 - RNA, 13 nt, Escherichia coli CFT073
aucuuacguuuaa

SEQ ID NO: 590082 - RNA, 15 nt, Escherichia coli CFT073
aucuuacguuuaaua

SEQ ID NO: 590083 - RNA, 14 nt, Escherichia coli CFT073
aucuucacaucauc

SEQ ID NO: 590084 - RNA, 17 nt, Escherichia coli CFT073
aucuucagucaggcgau

SEQ ID NO: 590085 - RNA, 14 nt, Escherichia coli CFT073
aucugugaacucag

SEQ ID NO: 590086 - RNA, 21 nt, Escherichia coli CFT073
aucugugcuuguaaaacagcc

SEQ ID NO: 590087 - RNA, 22 nt, Escherichia coli CFT073
aucugugcuuguaaaacagcca

SEQ ID NO: 590088 - RNA, 20 nt, Escherichia coli CFT073
aucuguugauuuaacagcaa

SEQ ID NO: 590089 - RNA, 22 nt, Escherichia coli CFT073
aucuguuuaucgcgcaaccaca

SEQ ID NO: 590090 - RNA, 21 nt, Escherichia coli CFT073
aucuguuuuccgucugucaaa

SEQ ID NO: 590091 - RNA, 17 nt, Escherichia coli CFT073
aucuucuaggcuguguu

SEQ ID NO: 590092 - RNA, 12 nt, Escherichia coli CFT073
aucuucucucau

SEQ ID NO: 590093 - RNA, 17 nt, Escherichia coli CFT073
aucuucgcacuuaccuu

SEQ ID NO: 590094 - RNA, 17 nt, Escherichia coli CFT073
aucuuuaucaaucaccg

SEQ ID NO: 590095 - RNA, 17 nt, Escherichia coli CFT073
aucuucauugugcgguc

SEQ ID NO: 590096 - RNA, 14 nt, Escherichia coli CFT073
aucuuccaccacca

SEQ ID NO: 590097 - RNA, 17 nt, Escherichia coli CFT073
aucuuccagcauuucca

SEQ ID NO: 590098 - RNA, 15 nt, Escherichia coli CFT073
aucuuccagcgcauc

SEQ ID NO: 590099 - RNA, 21 nt, Escherichia coli CFT073
aucuuccagcugcacgccacg

SEQ ID NO: 590100 - RNA, 18 nt, Escherichia coli CFT073
aucuuccagggugacaaa

SEQ ID NO: 590101 - RNA, 24 nt, Escherichia coli CFT073
aucuguacaggacgcaauguccau

SEQ ID NO: 590102 - RNA, 21 nt, Escherichia coli CFT073
aucugguuuuugguuucacua

SEQ ID NO: 590103 - RNA, 20 nt, Escherichia coli CFT073
aucuggucuggugaaucccc

SEQ ID NO: 590104 - RNA, 15 nt, Escherichia coli CFT073
aucuggugccagcgc

SEQ ID NO: 590105 - RNA, 15 nt, Escherichia coli CFT073
aucuggucagaugcg

SEQ ID NO: 590106 - RNA, 12 nt, Escherichia coli CFT073
aucugcuggaaa

SEQ ID NO: 590107 - RNA, 19 nt, Escherichia coli CFT073
aucucgaauugucaccguc

SEQ ID NO: 590108 - RNA, 19 nt, Escherichia coli CFT073
aucucacccgguacaucaa

SEQ ID NO: 590109 - RNA, 21 nt, Escherichia coli CFT073
aucucgcccgcuucauagccg

SEQ ID NO: 590110 - RNA, 20 nt, Escherichia coli CFT073
aucucgccuuugagcaguuu

SEQ ID NO: 590111 - RNA, 21 nt, Escherichia coli CFT073
aucggcgaagagagcgccagu

SEQ ID NO: 590112 - RNA, 21 nt, Escherichia coli CFT073
aucggcgcacaaccgccggau

SEQ ID NO: 590113 - RNA, 19 nt, Escherichia coli CFT073
aucggcggcacucgcugac

SEQ ID NO: 590114 - RNA, 22 nt, Escherichia coli CFT073
aucggcuuauucauaucaaacg

SEQ ID NO: 590115 - RNA, 15 nt, Escherichia coli CFT073
aucggcugaacgugc

SEQ ID NO: 590116 - RNA, 14 nt, Escherichia coli CFT073
aucggcaaaacggu

SEQ ID NO: 590117 - RNA, 14 nt, Escherichia coli CFT073
aucggcaacgccag

SEQ ID NO: 590118 - RNA, 22 nt, Escherichia coli CFT073
aucggcaccgccagcaggaacg

SEQ ID NO: 590119 - RNA, 14 nt, Escherichia coli CFT073
aucggcaccgccgc

SEQ ID NO: 590120 - RNA, 16 nt, Escherichia coli CFT073
aucggcaccgccgcca

SEQ ID NO: 590121 - RNA, 14 nt, Escherichia coli CFT073
aucggcaaucgccu

SEQ ID NO: 590122 - RNA, 19 nt, Escherichia coli CFT073
aucggcacgaccaggaacg

SEQ ID NO: 590123 - RNA, 14 nt, Escherichia coli CFT073
aucggcauugcucc

SEQ ID NO: 590124 - RNA, 18 nt, Escherichia coli CFT073
aucggcaucaggccaaac

SEQ ID NO: 590125 - RNA, 23 nt, Escherichia coli CFT073
aucggcaucaggccaaacagacc

SEQ ID NO: 590126 - RNA, 15 nt, Escherichia coli CFT073
aucggccaugauaaa

SEQ ID NO: 590127 - RNA, 16 nt, Escherichia coli CFT073
aucgucaucagcgcca

SEQ ID NO: 590128 - RNA, 18 nt, Escherichia coli CFT073
aucgucagcacucacgcc

SEQ ID NO: 590129 - RNA, 22 nt, Escherichia coli CFT073
aucgucaggaagaagcccauca

SEQ ID NO: 590130 - RNA, 20 nt, Escherichia coli CFT073
aucguccuccgaauaaauuu

SEQ ID NO: 590131 - RNA, 14 nt, Escherichia coli CFT073
aucguccagcugcc

SEQ ID NO: 590132 - RNA, 12 nt, Escherichia coli CFT073
aucgucugcggu

SEQ ID NO: 590133 - RNA, 18 nt, Escherichia coli CFT073
aucgucugcggugcgcca

SEQ ID NO: 590134 - RNA, 18 nt, Escherichia coli CFT073
aucgucuucaaccgcagu

SEQ ID NO: 590135 - RNA, 16 nt, Escherichia coli CFT073
aucgguaucgaauaaa

SEQ ID NO: 590136 - RNA, 18 nt, Escherichia coli CFT073
aucgucacgauacgguua

SEQ ID NO: 590137 - RNA, 15 nt, Escherichia coli CFT073
aucgucacgcaucac

SEQ ID NO: 590138 - RNA, 17 nt, Escherichia coli CFT073
aucgucacgcaucacga

SEQ ID NO: 590139 - RNA, 22 nt, Escherichia coli CFT073
aucgugcagcaccgccgccagg

SEQ ID NO: 590140 - RNA, 19 nt, Escherichia coli CFT073
aucguugaacccggcauca

SEQ ID NO: 590141 - RNA, 12 nt, Escherichia coli CFT073
aucuaccagcgg

SEQ ID NO: 590142 - RNA, 13 nt, Escherichia coli CFT073
aucuaccagcgga

SEQ ID NO: 590143 - RNA, 15 nt, Escherichia coli CFT073
aucucaauauccgga

SEQ ID NO: 590144 - RNA, 15 nt, Escherichia coli CFT073
aucucaacacacgua

SEQ ID NO: 590145 - RNA, 23 nt, Escherichia coli CFT073
aucacccgagagaacugcugcau

SEQ ID NO: 590146 - RNA, 15 nt, Escherichia coli CFT073
aucaccgaucguuac

SEQ ID NO: 590147 - RNA, 22 nt, Escherichia coli CFT073
aucaccgccacuaucgccauca

SEQ ID NO: 590148 - RNA, 17 nt, Escherichia coli CFT073
aucaccgccagcggcgu

SEQ ID NO: 590149 - RNA, 21 nt, Escherichia coli CFT073
aucaccaguugugaugccacu

SEQ ID NO: 590150 - RNA, 22 nt, Escherichia coli CFT073
aucaccaccgcaucggcaucaa

SEQ ID NO: 590151 - RNA, 13 nt, Escherichia coli CFT073
aucaccaccguca

SEQ ID NO: 590152 - RNA, 15 nt, Escherichia coli CFT073
aucacgaauaaacga

SEQ ID NO: 590153 - RNA, 15 nt, Escherichia coli CFT073
aucacgaucagcgga

SEQ ID NO: 590154 - RNA, 21 nt, Escherichia coli CFT073
aucacgucauauucgccauca

SEQ ID NO: 590155 - RNA, 12 nt, Escherichia coli CFT073
aucaccucuuca

SEQ ID NO: 590156 - RNA, 19 nt, Escherichia coli CFT073
aucaccugauugaccgcca

SEQ ID NO: 590157 - RNA, 14 nt, Escherichia coli CFT073
aucaccugccggag

SEQ ID NO: 590158 - RNA, 15 nt, Escherichia coli CFT073
aucaccugcgauaaa

SEQ ID NO: 590159 - RNA, 22 nt, Escherichia coli CFT073
aucaccugcgcuggcaggccug

SEQ ID NO: 590160 - RNA, 22 nt, Escherichia coli CFT073
aucaccuguucacgaccaucaa

SEQ ID NO: 590161 - RNA, 14 nt, Escherichia coli CFT073
aucagaguuugcca

SEQ ID NO: 590162 - RNA, 17 nt, Escherichia coli CFT073
aucagaucacgcaucac

SEQ ID NO: 590163 - RNA, 23 nt, Escherichia coli CFT073
aucagaucgacgccgaugcccga

SEQ ID NO: 590164 - RNA, 18 nt, Escherichia coli CFT073
aucagauuguugaucgua

SEQ ID NO: 590165 - RNA, 19 nt, Escherichia coli CFT073
aucagcaauaaaaaaauga

SEQ ID NO: 590166 - RNA, 24 nt, Escherichia coli CFT073
aucacuaccugauucgcaccacgu

SEQ ID NO: 590167 - RNA, 18 nt, Escherichia coli CFT073
aucacuauuaaagaaagu

SEQ ID NO: 590168 - RNA, 20 nt, Escherichia coli CFT073
aucagacugugauugcgcag

SEQ ID NO: 590169 - RNA, 14 nt, Escherichia coli CFT073
aucagagaacgugg

SEQ ID NO: 590170 - RNA, 16 nt, Escherichia coli CFT073
aucagcgccuuaccaa

SEQ ID NO: 590171 - RNA, 22 nt, Escherichia coli CFT073
aucagcgccaucgccaggaaca

SEQ ID NO: 590172 - RNA, 14 nt, Escherichia coli CFT073
aucagcgcaccaua

SEQ ID NO: 590173 - RNA, 20 nt, Escherichia coli CFT073
aucaaagcguuaaaagcggu

SEQ ID NO: 590174 - RNA, 15 nt, Escherichia coli CFT073
aucaaaucauccugc

SEQ ID NO: 590175 - RNA, 14 nt, Escherichia coli CFT073
aucaaaugcgccug

SEQ ID NO: 590176 - RNA, 15 nt, Escherichia coli CFT073
aucaacaaccugcau

SEQ ID NO: 590177 - RNA, 17 nt, Escherichia coli CFT073
aucaacggugccaucac

SEQ ID NO: 590178 - RNA, 23 nt, Escherichia coli CFT073
aucaacguaguaucguaaucagc

SEQ ID NO: 590179 - RNA, 14 nt, Escherichia coli CFT073
aucaacgucugcgc

SEQ ID NO: 590180 - RNA, 14 nt, Escherichia coli CFT073
auauggcggcggcu

SEQ ID NO: 590181 - RNA, 19 nt, Escherichia coli CFT073
auauggcugcauccagaaa

SEQ ID NO: 590182 - RNA, 13 nt, Escherichia coli CFT073
auaugucgcgcca

SEQ ID NO: 590183 - RNA, 15 nt, Escherichia coli CFT073
auaugucgcgccagg

SEQ ID NO: 590184 - RNA, 19 nt, Escherichia coli CFT073
auaugugaucgaauauauc

SEQ ID NO: 590185 - RNA, 18 nt, Escherichia coli CFT073
auauguuuaaccggcagc

SEQ ID NO: 590186 - RNA, 15 nt, Escherichia coli CFT073
auauguuuuaaagcg

SEQ ID NO: 590187 - RNA, 21 nt, Escherichia coli CFT073
auaugcuucuuccugccagca

SEQ ID NO: 590188 - RNA, 16 nt, Escherichia coli CFT073
auauuaucccccgaua

SEQ ID NO: 590189 - RNA, 19 nt, Escherichia coli CFT073
aucaagcauuuucucacug

SEQ ID NO: 590190 - RNA, 23 nt, Escherichia coli CFT073
aucaagcauuuucucacuggcgu

SEQ ID NO: 590191 - RNA, 16 nt, Escherichia coli CFT073
aucaagacccggcgca

SEQ ID NO: 590192 - RNA, 22 nt, Escherichia coli CFT073
aucaagaaacucugcggcauca

SEQ ID NO: 590193 - RNA, 20 nt, Escherichia coli CFT073
aucaagcccugguaacugcc

SEQ ID NO: 590194 - RNA, 13 nt, Escherichia coli CFT073
aucaaugccagca

SEQ ID NO: 590195 - RNA, 22 nt, Escherichia coli CFT073
aucaauucagaaauaaucaccu

SEQ ID NO: 590196 - RNA, 18 nt, Escherichia coli CFT073
aucaauuugccaucccca

SEQ ID NO: 590197 - RNA, 20 nt, Escherichia coli CFT073
aucaauugcgucggugagcu

SEQ ID NO: 590198 - RNA, 23 nt, Escherichia coli CFT073
aucaauuuccggcuuaccaaaua

SEQ ID NO: 590199 - RNA, 14 nt, Escherichia coli CFT073
aucacauuaaauuu

SEQ ID NO: 590200 - RNA, 13 nt, Escherichia coli CFT073
aucaccaccagca

SEQ ID NO: 590201 - RNA, 14 nt, Escherichia coli CFT073
aucaccaccagcac

SEQ ID NO: 590202 - RNA, 19 nt, Escherichia coli CFT073
aucaccaccagcaccgcga

SEQ ID NO: 590203 - RNA, 21 nt, Escherichia coli CFT073
aucaccaauauaaacauuacu

SEQ ID NO: 590204 - RNA, 13 nt, Escherichia coli CFT073
aucacaggcgcga

SEQ ID NO: 590205 - RNA, 15 nt, Escherichia coli CFT073
aucacaucagcgcau

SEQ ID NO: 590206 - RNA, 20 nt, Escherichia coli CFT073
auauacaaauagaucgccag

SEQ ID NO: 590207 - RNA, 23 nt, Escherichia coli CFT073
auauaccgcaucagcaucgguga

SEQ ID NO: 590208 - RNA, 12 nt, Escherichia coli CFT073
auauacgccacu

SEQ ID NO: 590209 - RNA, 14 nt, Escherichia coli CFT073
auauaaacauauca

SEQ ID NO: 590210 - RNA, 17 nt, Escherichia coli CFT073
auauaaaccguccccaa

SEQ ID NO: 590211 - RNA, 19 nt, Escherichia coli CFT073
auaucgcgauggaaaacaa

SEQ ID NO: 590212 - RNA, 20 nt, Escherichia coli CFT073
auaucgugcgggaccagcac

SEQ ID NO: 590213 - RNA, 16 nt, Escherichia coli CFT073
auaucguucucgacac

SEQ ID NO: 590214 - RNA, 16 nt, Escherichia coli CFT073
auaucgaucgccgcac

SEQ ID NO: 590215 - RNA, 17 nt, Escherichia coli CFT073
auaucgagaaucugccg

SEQ ID NO: 590216 - RNA, 16 nt, Escherichia coli CFT073
auagugguaccaggau

SEQ ID NO: 590217 - RNA, 16 nt, Escherichia coli CFT073
auaguuacgaaaagga

SEQ ID NO: 590218 - RNA, 16 nt, Escherichia coli CFT073
auaguugcauuccagu

SEQ ID NO: 590219 - RNA, 21 nt, Escherichia coli CFT073
auaguuugggcguuacagcug

SEQ ID NO: 590220 - RNA, 20 nt, Escherichia coli CFT073
auaggccuuaaccgccgcca

SEQ ID NO: 590221 - RNA, 14 nt, Escherichia coli CFT073
auagguaaacaucc

SEQ ID NO: 590222 - RNA, 16 nt, Escherichia coli CFT073
auagcgccugcugcug

SEQ ID NO: 590223 - RNA, 15 nt, Escherichia coli CFT073
auagcgcaugacaug

SEQ ID NO: 590224 - RNA, 17 nt, Escherichia coli CFT073
auagcgcaugacaugcg

SEQ ID NO: 590225 - RNA, 15 nt, Escherichia coli CFT073
auagcgccacgccaa

SEQ ID NO: 590226 - RNA, 12 nt, Escherichia coli CFT073
auagcgcagcga

SEQ ID NO: 590227 - RNA, 14 nt, Escherichia coli CFT073
auagcgcaucacuu

SEQ ID NO: 590228 - RNA, 14 nt, Escherichia coli CFT073
auagcgccaucgcg

SEQ ID NO: 590229 - RNA, 14 nt, Escherichia coli CFT073
auagcgaaccgcag

SEQ ID NO: 590230 - RNA, 17 nt, Escherichia coli CFT073
auagcgaagaauacgcc

SEQ ID NO: 590231 - RNA, 18 nt, Escherichia coli CFT073
auagcgaauaaucccggc

SEQ ID NO: 590232 - RNA, 20 nt, Escherichia coli CFT073
auagcgauuuuucaucacug

SEQ ID NO: 590233 - RNA, 20 nt, Escherichia coli CFT073
auagcgcacaauaauguggu

SEQ ID NO: 590234 - RNA, 12 nt, Escherichia coli CFT073
auagccguuggg

SEQ ID NO: 590235 - RNA, 17 nt, Escherichia coli CFT073
auagccuuucucgcggu

SEQ ID NO: 590236 - RNA, 18 nt, Escherichia coli CFT073
auacguuuaugucgcauc

SEQ ID NO: 590237 - RNA, 14 nt, Escherichia coli CFT073
auacguccgguuuc

SEQ ID NO: 590238 - RNA, 19 nt, Escherichia coli CFT073
auacgucggcaucaggcaa

SEQ ID NO: 590239 - RNA, 23 nt, Escherichia coli CFT073
auacguucgcccauccgcucguc

SEQ ID NO: 590240 - RNA, 17 nt, Escherichia coli CFT073
auacgcggaucuccggc

SEQ ID NO: 590241 - RNA, 18 nt, Escherichia coli CFT073
auacgcuaaauaaacaau

SEQ ID NO: 590242 - RNA, 21 nt, Escherichia coli CFT073
auacucuuucccggcaaucac

SEQ ID NO: 590243 - RNA, 20 nt, Escherichia coli CFT073
auacuccagccgacgaccgg

SEQ ID NO: 590244 - RNA, 16 nt, Escherichia coli CFT073
auacuccggcggcagc

SEQ ID NO: 590245 - RNA, 15 nt, Escherichia coli CFT073
auacucgccgaacca

SEQ ID NO: 590246 - RNA, 15 nt, Escherichia coli CFT073
auacuuauaagcuca

SEQ ID NO: 590247 - RNA, 14 nt, Escherichia coli CFT073
auacugcaucagcg

SEQ ID NO: 590248 - RNA, 14 nt, Escherichia coli CFT073
auacugccgcccau

SEQ ID NO: 590249 - RNA, 15 nt, Escherichia coli CFT073
auacuuuccagcaua

SEQ ID NO: 590250 - RNA, 22 nt, Escherichia coli CFT073
auacuucuggguuccuuccagu

SEQ ID NO: 590251 - RNA, 12 nt, Escherichia coli CFT073
auacuugcgaau

SEQ ID NO: 590252 - RNA, 12 nt, Escherichia coli CFT073
auagaacauguc

SEQ ID NO: 590253 - RNA, 13 nt, Escherichia coli CFT073
auagaaccacgca

SEQ ID NO: 590254 - RNA, 14 nt, Escherichia coli CFT073
auagaauacgccac

SEQ ID NO: 590255 - RNA, 20 nt, Escherichia coli CFT073
auagauauucaucaaaauga

SEQ ID NO: 590256 - RNA, 12 nt, Escherichia coli CFT073
auagaucagcgg

SEQ ID NO: 590257 - RNA, 16 nt, Escherichia coli CFT073
auagacaccaugucca

SEQ ID NO: 590258 - RNA, 20 nt, Escherichia coli CFT073
auagacacugccgccgucau

SEQ ID NO: 590259 - RNA, 21 nt, Escherichia coli CFT073
auagccaccuggcugcguuuu

SEQ ID NO: 590260 - RNA, 16 nt, Escherichia coli CFT073
auagccgcuuucuaac

SEQ ID NO: 590261 - RNA, 16 nt, Escherichia coli CFT073
auagcagcacaccaca

SEQ ID NO: 590262 - RNA, 17 nt, Escherichia coli CFT073
auagaucuaaaugccac

SEQ ID NO: 590263 - RNA, 13 nt, Escherichia coli CFT073
auaaaaaaacgcc

SEQ ID NO: 590264 - RNA, 13 nt, Escherichia coli CFT073
aguuuuuccgccg

SEQ ID NO: 590265 - RNA, 21 nt, Escherichia coli CFT073
aguuuuugcagauggaugagc

SEQ ID NO: 590266 - RNA, 17 nt, Escherichia coli CFT073
aguuuuugcccaucaug

SEQ ID NO: 590267 - RNA, 21 nt, Escherichia coli CFT073
aguuuugucuucggccauuga

SEQ ID NO: 590268 - RNA, 13 nt, Escherichia coli CFT073
auaaaaacgauaa

SEQ ID NO: 590269 - RNA, 14 nt, Escherichia coli CFT073
auaacacugagcgu

SEQ ID NO: 590270 - RNA, 21 nt, Escherichia coli CFT073
auaacacuuggcgucaaacga

SEQ ID NO: 590271 - RNA, 18 nt, Escherichia coli CFT073
auaacagaaugcgcgcga

SEQ ID NO: 590272 - RNA, 19 nt, Escherichia coli CFT073
auaacagacuuuguaagaa

SEQ ID NO: 590273 - RNA, 20 nt, Escherichia coli CFT073
aguuuucauauaccgcauca

SEQ ID NO: 590274 - RNA, 21 nt, Escherichia coli CFT073
aguuuucauauaccgcaucag

SEQ ID NO: 590275 - RNA, 17 nt, Escherichia coli CFT073
aguuuuaucuccauccg

SEQ ID NO: 590276 - RNA, 18 nt, Escherichia coli CFT073
aguuugcgaguggcgcgc

SEQ ID NO: 590277 - RNA, 15 nt, Escherichia coli CFT073
aguuugcucaaaucc

SEQ ID NO: 590278 - RNA, 20 nt, Escherichia coli CFT073
aguuugcucaaauccaucag

SEQ ID NO: 590279 - RNA, 17 nt, Escherichia coli CFT073
aguuugcaggccaaaca

SEQ ID NO: 590280 - RNA, 17 nt, Escherichia coli CFT073
aguuuggugacgccaca

SEQ ID NO: 590281 - RNA, 19 nt, Escherichia coli CFT073
aguuugaacauaucagcgc

SEQ ID NO: 590282 - RNA, 13 nt, Escherichia coli CFT073
aguuucgccaguu

SEQ ID NO: 590283 - RNA, 15 nt, Escherichia coli CFT073
aguuucguuaaacgc

SEQ ID NO: 590284 - RNA, 23 nt, Escherichia coli CFT073
aguuucagaccaauaauccccaa

SEQ ID NO: 590285 - RNA, 17 nt, Escherichia coli CFT073
aguuucagccccaucag

SEQ ID NO: 590286 - RNA, 13 nt, Escherichia coli CFT073
aguuucagcggcg

SEQ ID NO: 590287 - RNA, 14 nt, Escherichia coli CFT073
aguuuccaguugaa

SEQ ID NO: 590288 - RNA, 23 nt, Escherichia coli CFT073
auaagaugcguuaagcgucgcau

SEQ ID NO: 590289 - RNA, 17 nt, Escherichia coli CFT073
auaagauacgccagcau

SEQ ID NO: 590290 - RNA, 13 nt, Escherichia coli CFT073
auaagacgcaacc

SEQ ID NO: 590291 - RNA, 22 nt, Escherichia coli CFT073
auaagacgcgccagcgucgcau

SEQ ID NO: 590292 - RNA, 23 nt, Escherichia coli CFT073
auaagacgcggcaagcgucgcau

SEQ ID NO: 590293 - RNA, 22 nt, Escherichia coli CFT073
auaagacgcggcagcgucgcau

SEQ ID NO: 590294 - RNA, 23 nt, Escherichia coli CFT073
auaagacgcggcaggcgucgcau

SEQ ID NO: 590295 - RNA, 21 nt, Escherichia coli CFT073
auaagacgcgucagcgccgca

SEQ ID NO: 590296 - RNA, 22 nt, Escherichia coli CFT073
auaagacgcgucagcgccgcau

SEQ ID NO: 590297 - RNA, 22 nt, Escherichia coli CFT073
auaagacgcgucugcgucgcau

SEQ ID NO: 590298 - RNA, 21 nt, Escherichia coli CFT073
auaagacgcguggcgucgcau

SEQ ID NO: 590299 - RNA, 22 nt, Escherichia coli CFT073
auaagacgcguuagcgucgcau

SEQ ID NO: 590300 - RNA, 14 nt, Escherichia coli CFT073
auaacuccgccgcu

SEQ ID NO: 590301 - RNA, 15 nt, Escherichia coli CFT073
auaacuccgccgcua

SEQ ID NO: 590302 - RNA, 23 nt, Escherichia coli CFT073
auaacuauaugacucauaaaaau

SEQ ID NO: 590303 - RNA, 14 nt, Escherichia coli CFT073
auaacucaccauca

SEQ ID NO: 590304 - RNA, 16 nt, Escherichia coli CFT073
auaacuacccaaccga

SEQ ID NO: 590305 - RNA, 21 nt, Escherichia coli CFT073
auaacucuugaaucggcguag

SEQ ID NO: 590306 - RNA, 20 nt, Escherichia coli CFT073
auaacuucuauucaccagca

SEQ ID NO: 590307 - RNA, 15 nt, Escherichia coli CFT073
auaaccugccagcag

SEQ ID NO: 590308 - RNA, 21 nt, Escherichia coli CFT073
auaaccugccgcgccugcgcc

SEQ ID NO: 590309 - RNA, 14 nt, Escherichia coli CFT073
auaacgaucggcgu

SEQ ID NO: 590310 - RNA, 17 nt, Escherichia coli CFT073
auaacgaaaguaucuuc

SEQ ID NO: 590311 - RNA, 23 nt, Escherichia coli CFT073
auaacgcccucuaaaauaacgaa

SEQ ID NO: 590312 - RNA, 16 nt, Escherichia coli CFT073
auaacguaaaaacccg

SEQ ID NO: 590313 - RNA, 14 nt, Escherichia coli CFT073
auaacguaguguaa

SEQ ID NO: 590314 - RNA, 20 nt, Escherichia coli CFT073
auaacgucggcauauuuaaa

SEQ ID NO: 590315 - RNA, 16 nt, Escherichia coli CFT073
auaacggcuguccauu

SEQ ID NO: 590316 - RNA, 22 nt, Escherichia coli CFT073
auaacgggcuucccaacugaaa

SEQ ID NO: 590317 - RNA, 18 nt, Escherichia coli CFT073
auaacgcuggggccaucg

SEQ ID NO: 590318 - RNA, 13 nt, Escherichia coli CFT073
auaaccaucagcu

SEQ ID NO: 590319 - RNA, 13 nt, Escherichia coli CFT073
auaacccccugcc

SEQ ID NO: 590320 - RNA, 16 nt, Escherichia coli CFT073
auaacccugcggcgga

SEQ ID NO: 590321 - RNA, 22 nt, Escherichia coli CFT073
auaaccgccgccaaacugugca

SEQ ID NO: 590322 - RNA, 21 nt, Escherichia coli CFT073
auaaccgcgcgugccggaacg

SEQ ID NO: 590323 - RNA, 13 nt, Escherichia coli CFT073
auaaccgucagcg

SEQ ID NO: 590324 - RNA, 19 nt, Escherichia coli CFT073
auaaccgugcgcaucgcca

SEQ ID NO: 590325 - RNA, 14 nt, Escherichia coli CFT073
auaccacacccgca

SEQ ID NO: 590326 - RNA, 15 nt, Escherichia coli CFT073
auacccucaacggaa

SEQ ID NO: 590327 - RNA, 16 nt, Escherichia coli CFT073
auaccgaaaucgccau

SEQ ID NO: 590328 - RNA, 15 nt, Escherichia coli CFT073
auaccgccaacaugc

SEQ ID NO: 590329 - RNA, 16 nt, Escherichia coli CFT073
auaccguaaaacucac

SEQ ID NO: 590330 - RNA, 24 nt, Escherichia coli CFT073
auaccgucagcgucuguuuuauca

SEQ ID NO: 590331 - RNA, 13 nt, Escherichia coli CFT073
auaccugacgcaa

SEQ ID NO: 590332 - RNA, 22 nt, Escherichia coli CFT073
auaccuucacaaaaugccagca

SEQ ID NO: 590333 - RNA, 23 nt, Escherichia coli CFT073
auaccuucacaaaaugccagcaa

SEQ ID NO: 590334 - RNA, 21 nt, Escherichia coli CFT073
auaccguugaccauaucauca

SEQ ID NO: 590335 - RNA, 22 nt, Escherichia coli CFT073
auaccuaacacgaucagccaua

SEQ ID NO: 590336 - RNA, 15 nt, Escherichia coli CFT073
auacgaugccugcaa

SEQ ID NO: 590337 - RNA, 18 nt, Escherichia coli CFT073
auaccgucugcaccgaga

SEQ ID NO: 590338 - RNA, 15 nt, Escherichia coli CFT073
auacgaucaguuacu

SEQ ID NO: 590339 - RNA, 16 nt, Escherichia coli CFT073
auacgauccgacaucc

SEQ ID NO: 590340 - RNA, 21 nt, Escherichia coli CFT073
auacgauccugagcagcaacc

SEQ ID NO: 590341 - RNA, 17 nt, Escherichia coli CFT073
auacgcaccacaccguc

SEQ ID NO: 590342 - RNA, 17 nt, Escherichia coli CFT073
auacgcauaaugcgccc

SEQ ID NO: 590343 - RNA, 20 nt, Escherichia coli CFT073
auacgcaucgcgcaccagcg

SEQ ID NO: 590344 - RNA, 19 nt, Escherichia coli CFT073
auaauacgucggcaucagg

SEQ ID NO: 590345 - RNA, 15 nt, Escherichia coli CFT073
auaaguuagacggaa

SEQ ID NO: 590346 - RNA, 14 nt, Escherichia coli CFT073
auaauaaagcuaca

SEQ ID NO: 590347 - RNA, 23 nt, Escherichia coli CFT073
auaauugcggcggcgcaaagcga

SEQ ID NO: 590348 - RNA, 14 nt, Escherichia coli CFT073
auaauugugcaauu

SEQ ID NO: 590349 - RNA, 24 nt, Escherichia coli CFT073
auaauuucggcagcgcgcucgcca

SEQ ID NO: 590350 - RNA, 22 nt, Escherichia coli CFT073
auaauuucuucguucgccgcau

SEQ ID NO: 590351 - RNA, 22 nt, Escherichia coli CFT073
auaccaaccauguagacauagg

SEQ ID NO: 590352 - RNA, 18 nt, Escherichia coli CFT073
auacauugcggaccagcg

SEQ ID NO: 590353 - RNA, 19 nt, Escherichia coli CFT073
auacaaccaaucgcggcga

SEQ ID NO: 590354 - RNA, 14 nt, Escherichia coli CFT073
auacauaccagcag

SEQ ID NO: 590355 - RNA, 20 nt, Escherichia coli CFT073
auacaucgcgcuuaucgcca

SEQ ID NO: 590356 - RNA, 13 nt, Escherichia coli CFT073
auacaucgcuuuc

SEQ ID NO: 590357 - RNA, 14 nt, Escherichia coli CFT073
auacaucgcuuucc

SEQ ID NO: 590358 - RNA, 24 nt, Escherichia coli CFT073
auaauuugugauuugucauaugca

SEQ ID NO: 590359 - RNA, 16 nt, Escherichia coli CFT073
agugacgcagcgauac

SEQ ID NO: 590360 - RNA, 18 nt, Escherichia coli CFT073
agugagacucaccaaucg

SEQ ID NO: 590361 - RNA, 15 nt, Escherichia coli CFT073
agugagggccagcgu

SEQ ID NO: 590362 - RNA, 15 nt, Escherichia coli CFT073
agugccuggcauaac

SEQ ID NO: 590363 - RNA, 22 nt, Escherichia coli CFT073
agugcgcgccaguaaucagcgc

SEQ ID NO: 590364 - RNA, 23 nt, Escherichia coli CFT073
agugcgcucuucaacuucagcag

SEQ ID NO: 590365 - RNA, 15 nt, Escherichia coli CFT073
agugcgcuuuauuca

SEQ ID NO: 590366 - RNA, 16 nt, Escherichia coli CFT073
agugcgcccaggaagg

SEQ ID NO: 590367 - RNA, 18 nt, Escherichia coli CFT073
agugcgauuaagauaacg

SEQ ID NO: 590368 - RNA, 22 nt, Escherichia coli CFT073
agugcgcagcaucggccugcaa

SEQ ID NO: 590369 - RNA, 16 nt, Escherichia coli CFT073
agugcgcaguugccgg

SEQ ID NO: 590370 - RNA, 15 nt, Escherichia coli CFT073
aguggaugcgccaua

SEQ ID NO: 590371 - RNA, 17 nt, Escherichia coli CFT073
aguggagccaucaccau

SEQ ID NO: 590372 - RNA, 23 nt, Escherichia coli CFT073
agugcugcuggaaaagguaagga

SEQ ID NO: 590373 - RNA, 15 nt, Escherichia coli CFT073
agugcuacccacuuc

SEQ ID NO: 590374 - RNA, 22 nt, Escherichia coli CFT073
agugcguaagcgcggauuuuau

SEQ ID NO: 590375 - RNA, 19 nt, Escherichia coli CFT073
agucagaugcugugcaauc

SEQ ID NO: 590376 - RNA, 18 nt, Escherichia coli CFT073
agucacugugacgcggug

SEQ ID NO: 590377 - RNA, 20 nt, Escherichia coli CFT073
agucacuuucgagcaauuuu

SEQ ID NO: 590378 - RNA, 23 nt, Escherichia coli CFT073
agucuccuuuauagugugcaauc

SEQ ID NO: 590379 - RNA, 18 nt, Escherichia coli CFT073
agucucauauauuuucgc

SEQ ID NO: 590380 - RNA, 20 nt, Escherichia coli CFT073
aguauuuccagcucaaccag

SEQ ID NO: 590381 - RNA, 17 nt, Escherichia coli CFT073
agucaaccgccugaauu

SEQ ID NO: 590382 - RNA, 13 nt, Escherichia coli CFT073
agucaauaaaaag

SEQ ID NO: 590383 - RNA, 20 nt, Escherichia coli CFT073
agugaaauuucugccucguc

SEQ ID NO: 590384 - RNA, 16 nt, Escherichia coli CFT073
agucuuucagacugag

SEQ ID NO: 590385 - RNA, 20 nt, Escherichia coli CFT073
agucuuucugugcaaucaca

SEQ ID NO: 590386 - RNA, 22 nt, Escherichia coli CFT073
agucuuuuuugguuauccagca

SEQ ID NO: 590387 - RNA, 20 nt, Escherichia coli CFT073
agucugauaguaguuugaug

SEQ ID NO: 590388 - RNA, 20 nt, Escherichia coli CFT073
agucugcgucaucggcagca

SEQ ID NO: 590389 - RNA, 17 nt, Escherichia coli CFT073
agucugcuccaucgcau

SEQ ID NO: 590390 - RNA, 15 nt, Escherichia coli CFT073
agucuggcaggaaau

SEQ ID NO: 590391 - RNA, 19 nt, Escherichia coli CFT073
agucuggccguuugcugcu

SEQ ID NO: 590392 - RNA, 17 nt, Escherichia coli CFT073
agugaauaacguagccc

SEQ ID NO: 590393 - RNA, 16 nt, Escherichia coli CFT073
agugaauucaucguaa

SEQ ID NO: 590394 - RNA, 21 nt, Escherichia coli CFT073
agugaccaccaauaaccggca

SEQ ID NO: 590395 - RNA, 14 nt, Escherichia coli CFT073
agugacgccgccag

SEQ ID NO: 590396 - RNA, 21 nt, Escherichia coli CFT073
aguugauuuuucguuuuaaug

SEQ ID NO: 590397 - RNA, 19 nt, Escherichia coli CFT073
aguucuuccggcagccagg

SEQ ID NO: 590398 - RNA, 19 nt, Escherichia coli CFT073
aguugauauacaccugaua

SEQ ID NO: 590399 - RNA, 13 nt, Escherichia coli CFT073
aguugaucgccag

SEQ ID NO: 590400 - RNA, 15 nt, Escherichia coli CFT073
aguugaucgccagag

SEQ ID NO: 590401 - RNA, 15 nt, Escherichia coli CFT073
aguucgucuuccggg

SEQ ID NO: 590402 - RNA, 17 nt, Escherichia coli CFT073
aguucguacacccgcca

SEQ ID NO: 590403 - RNA, 19 nt, Escherichia coli CFT073
aguucguacacccgccaga

SEQ ID NO: 590404 - RNA, 20 nt, Escherichia coli CFT073
aguucggcguucaccagcgc

SEQ ID NO: 590405 - RNA, 23 nt, Escherichia coli CFT073
aguucgcuuaacaguuccagcaa

SEQ ID NO: 590406 - RNA, 12 nt, Escherichia coli CFT073
aguuccaccagu

SEQ ID NO: 590407 - RNA, 20 nt, Escherichia coli CFT073
aguucccagggcuuucgcaa

SEQ ID NO: 590408 - RNA, 23 nt, Escherichia coli CFT073
aguuccgcaaagcccaucaccgc

SEQ ID NO: 590409 - RNA, 18 nt, Escherichia coli CFT073
aguuccgggaucaccaga

SEQ ID NO: 590410 - RNA, 21 nt, Escherichia coli CFT073
aguucgccuucauucaccagu

SEQ ID NO: 590411 - RNA, 17 nt, Escherichia coli CFT073
aguucgaacgccgccag

SEQ ID NO: 590412 - RNA, 14 nt, Escherichia coli CFT073
aguucgaugcucug

SEQ ID NO: 590413 - RNA, 23 nt, Escherichia coli CFT073
aguucauccauuaacagcggugc

SEQ ID NO: 590414 - RNA, 14 nt, Escherichia coli CFT073
aguucaucggauaa

SEQ ID NO: 590415 - RNA, 19 nt, Escherichia coli CFT073
agugugcaaacgauaaaag

SEQ ID NO: 590416 - RNA, 17 nt, Escherichia coli CFT073
agugugcaucgccgggc

SEQ ID NO: 590417 - RNA, 22 nt, Escherichia coli CFT073
agugugauuacagccaggcgcu

SEQ ID NO: 590418 - RNA, 18 nt, Escherichia coli CFT073
agugugaaacaguaaguu

SEQ ID NO: 590419 - RNA, 14 nt, Escherichia coli CFT073
agugucgccugcag

SEQ ID NO: 590420 - RNA, 15 nt, Escherichia coli CFT073
aguguaaaccaaagc

SEQ ID NO: 590421 - RNA, 12 nt, Escherichia coli CFT073
aguguaaucagc

SEQ ID NO: 590422 - RNA, 13 nt, Escherichia coli CFT073
aguggugauucag

SEQ ID NO: 590423 - RNA, 21 nt, Escherichia coli CFT073
aggcuccgccugauuuacuua

SEQ ID NO: 590424 - RNA, 21 nt, Escherichia coli CFT073
aggcugagaaccgcacagguu

SEQ ID NO: 590425 - RNA, 18 nt, Escherichia coli CFT073
aggcguuuaugccgcauc

SEQ ID NO: 590426 - RNA, 17 nt, Escherichia coli CFT073
aggcguuucacuuucag

SEQ ID NO: 590427 - RNA, 20 nt, Escherichia coli CFT073
aggcguuuacgccgcauccg

SEQ ID NO: 590428 - RNA, 15 nt, Escherichia coli CFT073
aggcggcuucgcauc

SEQ ID NO: 590429 - RNA, 14 nt, Escherichia coli CFT073
aggcggcucuggcg

SEQ ID NO: 590430 - RNA, 14 nt, Escherichia coli CFT073
aggggaaaaauuca

SEQ ID NO: 590431 - RNA, 14 nt, Escherichia coli CFT073
agggcgucaccggu

SEQ ID NO: 590432 - RNA, 16 nt, Escherichia coli CFT073
agggcgcacgcacggc

SEQ ID NO: 590433 - RNA, 20 nt, Escherichia coli CFT073
agggcgauuauccgccagcg

SEQ ID NO: 590434 - RNA, 12 nt, Escherichia coli CFT073
aggcuuauccgg

SEQ ID NO: 590435 - RNA, 23 nt, Escherichia coli CFT073
agguauugcuaagcucucagcau

SEQ ID NO: 590436 - RNA, 16 nt, Escherichia coli CFT073
agguauucagaaccgc

SEQ ID NO: 590437 - RNA, 13 nt, Escherichia coli CFT073
aggucaauaacga

SEQ ID NO: 590438 - RNA, 14 nt, Escherichia coli CFT073
aggucauaucauca

SEQ ID NO: 590439 - RNA, 14 nt, Escherichia coli CFT073
aggucaucgcaucg

SEQ ID NO: 590440 - RNA, 16 nt, Escherichia coli CFT073
agguccauaaaccgug

SEQ ID NO: 590441 - RNA, 18 nt, Escherichia coli CFT073
agguccaucacuugcugc

SEQ ID NO: 590442 - RNA, 21 nt, Escherichia coli CFT073
aggucgcaaaggccagccagg

SEQ ID NO: 590443 - RNA, 21 nt, Escherichia coli CFT073
aggucgaaccggaaauccagg

SEQ ID NO: 590444 - RNA, 12 nt, Escherichia coli CFT073
aggugaacgcca

SEQ ID NO: 590445 - RNA, 17 nt, Escherichia coli CFT073
aggugaaauccggcuuc

SEQ ID NO: 590446 - RNA, 19 nt, Escherichia coli CFT073
agguuuuucagcugcccac

SEQ ID NO: 590447 - RNA, 17 nt, Escherichia coli CFT073
aguaaaaagauuucugc

SEQ ID NO: 590448 - RNA, 19 nt, Escherichia coli CFT073
agguuuagccaaaaaucga

SEQ ID NO: 590449 - RNA, 20 nt, Escherichia coli CFT073
aguaaagcccgccaucgccc

SEQ ID NO: 590450 - RNA, 19 nt, Escherichia coli CFT073
aguaaacaauugcauauca

SEQ ID NO: 590451 - RNA, 17 nt, Escherichia coli CFT073
aguaaacacaccacagc

SEQ ID NO: 590452 - RNA, 16 nt, Escherichia coli CFT073
aguaaacccggcauca

SEQ ID NO: 590453 - RNA, 20 nt, Escherichia coli CFT073
aguaaaacgguggccacagc

SEQ ID NO: 590454 - RNA, 20 nt, Escherichia coli CFT073
aguaaaauauucgaaagcca

SEQ ID NO: 590455 - RNA, 19 nt, Escherichia coli CFT073
agguuguacccaacgcgau

SEQ ID NO: 590456 - RNA, 16 nt, Escherichia coli CFT073
aguauauauucgucca

SEQ ID NO: 590457 - RNA, 19 nt, Escherichia coli CFT073
aguauauuucgggaugacc

SEQ ID NO: 590458 - RNA, 18 nt, Escherichia coli CFT073
aguaucguaaucagcacc

SEQ ID NO: 590459 - RNA, 17 nt, Escherichia coli CFT073
aguagacaauuuuucau

SEQ ID NO: 590460 - RNA, 22 nt, Escherichia coli CFT073
aguagacaauuuuucauaauca

SEQ ID NO: 590461 - RNA, 16 nt, Escherichia coli CFT073
aguaguugcugucgac

SEQ ID NO: 590462 - RNA, 15 nt, Escherichia coli CFT073
aguaagccggauaau

SEQ ID NO: 590463 - RNA, 21 nt, Escherichia coli CFT073
aguaagccgguaaucaccagc

SEQ ID NO: 590464 - RNA, 15 nt, Escherichia coli CFT073
aguaaggcugcgagg

SEQ ID NO: 590465 - RNA, 16 nt, Escherichia coli CFT073
aguaagggaucacgcg

SEQ ID NO: 590466 - RNA, 19 nt, Escherichia coli CFT073
aguaacguugggugcaauc

SEQ ID NO: 590467 - RNA, 14 nt, Escherichia coli CFT073
aguaacaaaugugc

SEQ ID NO: 590468 - RNA, 23 nt, Escherichia coli CFT073
aguaacagaagaucaugccgaca

SEQ ID NO: 590469 - RNA, 16 nt, Escherichia coli CFT073
aguaaccuuuaucacg

SEQ ID NO: 590470 - RNA, 23 nt, Escherichia coli CFT073
aguacgccgccgccaaucgcccg

SEQ ID NO: 590471 - RNA, 20 nt, Escherichia coli CFT073
aguacggcuauauacagcgc

SEQ ID NO: 590472 - RNA, 23 nt, Escherichia coli CFT073
aguacgucgagcaguugcugaau

SEQ ID NO: 590473 - RNA, 23 nt, Escherichia coli CFT073
aggcgcaggguuugcaucgccau

SEQ ID NO: 590474 - RNA, 22 nt, Escherichia coli CFT073
aggcgcgaagcuggucagcauc

SEQ ID NO: 590475 - RNA, 21 nt, Escherichia coli CFT073
aggcgcuguaagccucuuuca

SEQ ID NO: 590476 - RNA, 17 nt, Escherichia coli CFT073
aggcgcugacgacaucg

SEQ ID NO: 590477 - RNA, 21 nt, Escherichia coli CFT073
aggcgcgucaagcgucgcauc

SEQ ID NO: 590478 - RNA, 15 nt, Escherichia coli CFT073
aggcgcaaccuucac

SEQ ID NO: 590479 - RNA, 16 nt, Escherichia coli CFT073
aggccuaccagagaua

SEQ ID NO: 590480 - RNA, 16 nt, Escherichia coli CFT073
aggccuaacaccauca

SEQ ID NO: 590481 - RNA, 22 nt, Escherichia coli CFT073
aggccgucgcguagcaccacgg

SEQ ID NO: 590482 - RNA, 15 nt, Escherichia coli CFT073
aggccgugcaguuug

SEQ ID NO: 590483 - RNA, 20 nt, Escherichia coli CFT073
aggcgaaaacgcugaccguc

SEQ ID NO: 590484 - RNA, 15 nt, Escherichia coli CFT073
aggccugaucagcga

SEQ ID NO: 590485 - RNA, 14 nt, Escherichia coli CFT073
aggccgaguagcca

SEQ ID NO: 590486 - RNA, 16 nt, Escherichia coli CFT073
aggccggagccagucg

SEQ ID NO: 590487 - RNA, 23 nt, Escherichia coli CFT073
aggccggauaagauacgccagca

SEQ ID NO: 590488 - RNA, 17 nt, Escherichia coli CFT073
aggccggauaaggcguu

SEQ ID NO: 590489 - RNA, 18 nt, Escherichia coli CFT073
aggccggugcugcuaccg

SEQ ID NO: 590490 - RNA, 14 nt, Escherichia coli CFT073
aggcagcaaucacu

SEQ ID NO: 590491 - RNA, 22 nt, Escherichia coli CFT073
aggcagcuuagaaaggaacaau

SEQ ID NO: 590492 - RNA, 16 nt, Escherichia coli CFT073
aggcagucgugcccaa

SEQ ID NO: 590493 - RNA, 21 nt, Escherichia coli CFT073
aggcaggcaucaucagauucu

SEQ ID NO: 590494 - RNA, 17 nt, Escherichia coli CFT073
agcuggcaccgcaucaa

SEQ ID NO: 590495 - RNA, 14 nt, Escherichia coli CFT073
agcuggaauaauaa

SEQ ID NO: 590496 - RNA, 16 nt, Escherichia coli CFT073
aggcacuuucgcgaau

SEQ ID NO: 590497 - RNA, 21 nt, Escherichia coli CFT073
aggcagaacaccggcagcggg

SEQ ID NO: 590498 - RNA, 14 nt, Escherichia coli CFT073
aggcagaacgccau

SEQ ID NO: 590499 - RNA, 21 nt, Escherichia coli CFT073
agcuggccugcuuuuucauca

SEQ ID NO: 590500 - RNA, 17 nt, Escherichia coli CFT073
aggcccagccgugaaug

SEQ ID NO: 590501 - RNA, 16 nt, Escherichia coli CFT073
aggccagcaaucccca

SEQ ID NO: 590502 - RNA, 14 nt, Escherichia coli CFT073
aggcaucagcaauu

SEQ ID NO: 590503 - RNA, 19 nt, Escherichia coli CFT073
aggcaucgcuaaucuggcg

SEQ ID NO: 590504 - RNA, 14 nt, Escherichia coli CFT073
aggcaucuuuuuca

SEQ ID NO: 590505 - RNA, 14 nt, Escherichia coli CFT073
aggccacgaaucag

SEQ ID NO: 590506 - RNA, 16 nt, Escherichia coli CFT073
agcgcgcgcagcacgg

SEQ ID NO: 590507 - RNA, 21 nt, Escherichia coli CFT073
agcgcggauuuuauucagcag

SEQ ID NO: 590508 - RNA, 22 nt, Escherichia coli CFT073
agcgcggauuuuauucagcaga

SEQ ID NO: 590509 - RNA, 11 nt, Escherichia coli CFT073
agcgcggcagc

SEQ ID NO: 590510 - RNA, 12 nt, Escherichia coli CFT073
agcgcggcagcg

SEQ ID NO: 590511 - RNA, 14 nt, Escherichia coli CFT073
agcgcgcggcuggc

SEQ ID NO: 590512 - RNA, 15 nt, Escherichia coli CFT073
agcgcgaaaucgccc

SEQ ID NO: 590513 - RNA, 16 nt, Escherichia coli CFT073
agcgcgaaaucgcccu

SEQ ID NO: 590514 - RNA, 20 nt, Escherichia coli CFT073
agcgcgaaaccuuacgccau

SEQ ID NO: 590515 - RNA, 20 nt, Escherichia coli CFT073
agcgccuuuacugacaugca

SEQ ID NO: 590516 - RNA, 23 nt, Escherichia coli CFT073
agcgccugcaggcggcucaucac

SEQ ID NO: 590517 - RNA, 18 nt, Escherichia coli CFT073
agcgccuuauccggccua

SEQ ID NO: 590518 - RNA, 13 nt, Escherichia coli CFT073
agcgccuguugau

SEQ ID NO: 590519 - RNA, 19 nt, Escherichia coli CFT073
agcgccuuaccaauaccgc

SEQ ID NO: 590520 - RNA, 22 nt, Escherichia coli CFT073
agcgccgaguaaaaaaacauca

SEQ ID NO: 590521 - RNA, 21 nt, Escherichia coli CFT073
agcgccaguuuuugcuucuga

SEQ ID NO: 590522 - RNA, 21 nt, Escherichia coli CFT073
agcgcaggggcaaucagcacu

SEQ ID NO: 590523 - RNA, 13 nt, Escherichia coli CFT073
agcgccgccucag

SEQ ID NO: 590524 - RNA, 17 nt, Escherichia coli CFT073
agcgccgcgauaaaauc

SEQ ID NO: 590525 - RNA, 18 nt, Escherichia coli CFT073
agcgccgcgauaaaaucc

SEQ ID NO: 590526 - RNA, 20 nt, Escherichia coli CFT073
agcgccgccagaaucaccuc

SEQ ID NO: 590527 - RNA, 15 nt, Escherichia coli CFT073
agcgccuggcagcau

SEQ ID NO: 590528 - RNA, 15 nt, Escherichia coli CFT073
agcgccugaauaauc

SEQ ID NO: 590529 - RNA, 14 nt, Escherichia coli CFT073
agcgcaaggcgcga

SEQ ID NO: 590530 - RNA, 13 nt, Escherichia coli CFT073
agcgcaagccacg

SEQ ID NO: 590531 - RNA, 16 nt, Escherichia coli CFT073
agcgcaccaaccacug

SEQ ID NO: 590532 - RNA, 15 nt, Escherichia coli CFT073
agcgcagcgcaucag

SEQ ID NO: 590533 - RNA, 13 nt, Escherichia coli CFT073
aaacgcgcggcaa

SEQ ID NO: 590534 - RNA, 20 nt, Escherichia coli CFT073
aaacgcgcagcgucgcauca

SEQ ID NO: 590535 - RNA, 16 nt, Escherichia coli CFT073
aaacgccuuauccggc

SEQ ID NO: 590536 - RNA, 16 nt, Escherichia coli CFT073
aaacgcucaaacagcg

SEQ ID NO: 590537 - RNA, 23 nt, Escherichia coli CFT073
aaacgcuccugcuacaccauugc

SEQ ID NO: 590538 - RNA, 15 nt, Escherichia coli CFT073
aaacgcucggcaaca

SEQ ID NO: 590539 - RNA, 19 nt, Escherichia coli CFT073
aaacgccaccuuuucggug

SEQ ID NO: 590540 - RNA, 15 nt, Escherichia coli CFT073
aaacgccucauccgg

SEQ ID NO: 590541 - RNA, 19 nt, Escherichia coli CFT073
aaacgccucauccggccua

SEQ ID NO: 590542 - RNA, 20 nt, Escherichia coli CFT073
aaacgccugaccguugauuu

SEQ ID NO: 590543 - RNA, 13 nt, Escherichia coli CFT073
agcgaccaaccau

SEQ ID NO: 590544 - RNA, 21 nt, Escherichia coli CFT073
agcgacgggcgacaaacgcug

SEQ ID NO: 590545 - RNA, 23 nt, Escherichia coli CFT073
agcgacgggcuaaucgucaucag

SEQ ID NO: 590546 - RNA, 21 nt, Escherichia coli CFT073
aaacgcugugcguaaucgccg

SEQ ID NO: 590547 - RNA, 18 nt, Escherichia coli CFT073
agccguucuggugggcga

SEQ ID NO: 590548 - RNA, 16 nt, Escherichia coli CFT073
agccguaggugaaacg

SEQ ID NO: 590549 - RNA, 19 nt, Escherichia coli CFT073
agccguaaacgugcgcgaa

SEQ ID NO: 590550 - RNA, 13 nt, Escherichia coli CFT073
agccgguaaauca

SEQ ID NO: 590551 - RNA, 17 nt, Escherichia coli CFT073
agccgguaaaucaccau

SEQ ID NO: 590552 - RNA, 21 nt, Escherichia coli CFT073
agccgcuaacuuccugcuggc

SEQ ID NO: 590553 - RNA, 12 nt, Escherichia coli CFT073
agcuaucagcga

SEQ ID NO: 590554 - RNA, 12 nt, Escherichia coli CFT073
agcuaucccuug

SEQ ID NO: 590555 - RNA, 13 nt, Escherichia coli CFT073
agcguugcgccaa

SEQ ID NO: 590556 - RNA, 21 nt, Escherichia coli CFT073
agcguugaggaacucaaacca

SEQ ID NO: 590557 - RNA, 18 nt, Escherichia coli CFT073
agcguucuuuaacugccg

SEQ ID NO: 590558 - RNA, 20 nt, Escherichia coli CFT073
agcguuccauaauggcgcga

SEQ ID NO: 590559 - RNA, 13 nt, Escherichia coli CFT073
agcguucccuucc

SEQ ID NO: 590560 - RNA, 22 nt, Escherichia coli CFT073
agcgugagugcgaaacagaaau

SEQ ID NO: 590561 - RNA, 16 nt, Escherichia coli CFT073
agcgugagguuaucgc

SEQ ID NO: 590562 - RNA, 20 nt, Escherichia coli CFT073
agcgugaaccgccucacgcg

SEQ ID NO: 590563 - RNA, 14 nt, Escherichia coli CFT073
agcgucuggcucga

SEQ ID NO: 590564 - RNA, 13 nt, Escherichia coli CFT073
agcgucgcaucag

SEQ ID NO: 590565 - RNA, 21 nt, Escherichia coli CFT073
agcgucgcauccgacuuugaa

SEQ ID NO: 590566 - RNA, 17 nt, Escherichia coli CFT073
agcguccggcugccagc

SEQ ID NO: 590567 - RNA, 15 nt, Escherichia coli CFT073
agcggugauaaaccc

SEQ ID NO: 590568 - RNA, 23 nt, Escherichia coli CFT073
agcggugauaaacccaacggcaa

SEQ ID NO: 590569 - RNA, 20 nt, Escherichia coli CFT073
agcggugauuuccgccgcca

SEQ ID NO: 590570 - RNA, 19 nt, Escherichia coli CFT073
agcggugcaccugccagca

SEQ ID NO: 590571 - RNA, 18 nt, Escherichia coli CFT073
agcggugaaaacggcaau

SEQ ID NO: 590572 - RNA, 19 nt, Escherichia coli CFT073
agcucaaagcaguauuucu

SEQ ID NO: 590573 - RNA, 13 nt, Escherichia coli CFT073
agcucaaucgccu

SEQ ID NO: 590574 - RNA, 15 nt, Escherichia coli CFT073
agcucaaugaaacgc

SEQ ID NO: 590575 - RNA, 22 nt, Escherichia coli CFT073
agcucaaugguguuuuccaccg

SEQ ID NO: 590576 - RNA, 19 nt, Escherichia coli CFT073
agcucaacaguaaggccug

SEQ ID NO: 590577 - RNA, 16 nt, Escherichia coli CFT073
agcucacuucgaucca

SEQ ID NO: 590578 - RNA, 19 nt, Escherichia coli CFT073
agcucgcgauacgcuucaa

SEQ ID NO: 590579 - RNA, 17 nt, Escherichia coli CFT073
agcuccgguacucauca

SEQ ID NO: 590580 - RNA, 16 nt, Escherichia coli CFT073
agcugaguauuaaccg

SEQ ID NO: 590581 - RNA, 18 nt, Escherichia coli CFT073
agcugcugaccaccagca

SEQ ID NO: 590582 - RNA, 23 nt, Escherichia coli CFT073
agcucuuuuaacuuacgcgucag

SEQ ID NO: 590583 - RNA, 19 nt, Escherichia coli CFT073
agcucuucuacauuucugu

SEQ ID NO: 590584 - RNA, 18 nt, Escherichia coli CFT073
agcugaccagacagucgc

SEQ ID NO: 590585 - RNA, 21 nt, Escherichia coli CFT073
agcucuaucugcacugcucau

SEQ ID NO: 590586 - RNA, 23 nt, Escherichia coli CFT073
agcucguugguuccacggcaucu

SEQ ID NO: 590587 - RNA, 14 nt, Escherichia coli CFT073
agcggagcaaugau

SEQ ID NO: 590588 - RNA, 13 nt, Escherichia coli CFT073
agcggagcaauuu

SEQ ID NO: 590589 - RNA, 20 nt, Escherichia coli CFT073
agcggaugacccagcgcgau

SEQ ID NO: 590590 - RNA, 22 nt, Escherichia coli CFT073
agcggcaccuucgcggcaaaac

SEQ ID NO: 590591 - RNA, 19 nt, Escherichia coli CFT073
agcggacucaccgagcagc

SEQ ID NO: 590592 - RNA, 12 nt, Escherichia coli CFT073
agcgcugugaaa

SEQ ID NO: 590593 - RNA, 13 nt, Escherichia coli CFT073
agcgcguugcgcc

SEQ ID NO: 590594 - RNA, 18 nt, Escherichia coli CFT073
agcgcguugcgccaaacg

SEQ ID NO: 590595 - RNA, 15 nt, Escherichia coli CFT073
agcgcguuucugcgc

SEQ ID NO: 590596 - RNA, 19 nt, Escherichia coli CFT073
agcgcgggagaucccuaau

SEQ ID NO: 590597 - RNA, 21 nt, Escherichia coli CFT073
agcgcgguauuccacuccagu

SEQ ID NO: 590598 - RNA, 16 nt, Escherichia coli CFT073
agcggcagcucuuucu

SEQ ID NO: 590599 - RNA, 23 nt, Escherichia coli CFT073
agcggcucuggcucaucgccuuc

SEQ ID NO: 590600 - RNA, 14 nt, Escherichia coli CFT073
agcggcugcgcagc

SEQ ID NO: 590601 - RNA, 15 nt, Escherichia coli CFT073
agcggcuuuuuacgc

SEQ ID NO: 590602 - RNA, 17 nt, Escherichia coli CFT073
agcggguuuuucccuuc

SEQ ID NO: 590603 - RNA, 23 nt, Escherichia coli CFT073
agcgguaaagaacugagcgccgu

SEQ ID NO: 590604 - RNA, 15 nt, Escherichia coli CFT073
agcgguaauuccggc

SEQ ID NO: 590605 - RNA, 16 nt, Escherichia coli CFT073
agccacaguuugcugc

SEQ ID NO: 590606 - RNA, 19 nt, Escherichia coli CFT073
agccaauuaacgaaaucuc

SEQ ID NO: 590607 - RNA, 15 nt, Escherichia coli CFT073
agccaauugccauau

SEQ ID NO: 590608 - RNA, 13 nt, Escherichia coli CFT073
agcauugccagca

SEQ ID NO: 590609 - RNA, 13 nt, Escherichia coli CFT073
agcauugcgccag

SEQ ID NO: 590610 - RNA, 18 nt, Escherichia coli CFT073
agcauugcgccagcgaga

SEQ ID NO: 590611 - RNA, 17 nt, Escherichia coli CFT073
agcauugucaggaucac

SEQ ID NO: 590612 - RNA, 20 nt, Escherichia coli CFT073
agcauugucaggaucaccaa

SEQ ID NO: 590613 - RNA, 15 nt, Escherichia coli CFT073
agccaggcacgccgc

SEQ ID NO: 590614 - RNA, 19 nt, Escherichia coli CFT073
agccagauaaaucgauaac

SEQ ID NO: 590615 - RNA, 15 nt, Escherichia coli CFT073
agccagauggcugcc

SEQ ID NO: 590616 - RNA, 20 nt, Escherichia coli CFT073
agccagauggggugaccguu

SEQ ID NO: 590617 - RNA, 14 nt, Escherichia coli CFT073
agccagaaaucacc

SEQ ID NO: 590618 - RNA, 22 nt, Escherichia coli CFT073
agccagacaaaugucagaaaga

SEQ ID NO: 590619 - RNA, 13 nt, Escherichia coli CFT073
agcaucaaugacc

SEQ ID NO: 590620 - RNA, 18 nt, Escherichia coli CFT073
agcaucaucuuccgguag

SEQ ID NO: 590621 - RNA, 13 nt, Escherichia coli CFT073
agcaucgcaucaa

SEQ ID NO: 590622 - RNA, 13 nt, Escherichia coli CFT073
agcauccgcgcac

SEQ ID NO: 590623 - RNA, 15 nt, Escherichia coli CFT073
agcaucggcaacgcc

SEQ ID NO: 590624 - RNA, 23 nt, Escherichia coli CFT073
agcaucggcaacgccagcgaagc

SEQ ID NO: 590625 - RNA, 15 nt, Escherichia coli CFT073
agcaucgaccaugcu

SEQ ID NO: 590626 - RNA, 18 nt, Escherichia coli CFT073
agcaucgguaucauccca

SEQ ID NO: 590627 - RNA, 21 nt, Escherichia coli CFT073
agcaucggugaggaucaccag

SEQ ID NO: 590628 - RNA, 14 nt, Escherichia coli CFT073
agcaucucauccau

SEQ ID NO: 590629 - RNA, 18 nt, Escherichia coli CFT073
agcauguuccauugagaa

SEQ ID NO: 590630 - RNA, 23 nt, Escherichia coli CFT073
agcauguuccauugagaaaaucc

SEQ ID NO: 590631 - RNA, 23 nt, Escherichia coli CFT073
agcauuacgcguccuuguaacgc

SEQ ID NO: 590632 - RNA, 18 nt, Escherichia coli CFT073
agcauucagacacgccgc

SEQ ID NO: 590633 - RNA, 16 nt, Escherichia coli CFT073
agcauuccuaaaccau

SEQ ID NO: 590634 - RNA, 19 nt, Escherichia coli CFT073
agcaggaucagaccgccaa

SEQ ID NO: 590635 - RNA, 20 nt, Escherichia coli CFT073
agcagguagcgccuuuacug

SEQ ID NO: 590636 - RNA, 16 nt, Escherichia coli CFT073
agcaguacagccgcca

SEQ ID NO: 590637 - RNA, 14 nt, Escherichia coli CFT073
agcaguaccgcagc

SEQ ID NO: 590638 - RNA, 23 nt, Escherichia coli CFT073
agcaguacgccgagaauaaaaca

SEQ ID NO: 590639 - RNA, 16 nt, Escherichia coli CFT073
agcaguccccacauca

SEQ ID NO: 590640 - RNA, 18 nt, Escherichia coli CFT073
agcagugggauuaaggcu

SEQ ID NO: 590641 - RNA, 14 nt, Escherichia coli CFT073
agcaguucagcacg

SEQ ID NO: 590642 - RNA, 14 nt, Escherichia coli CFT073
agcagcgcgugcgc

SEQ ID NO: 590643 - RNA, 13 nt, Escherichia coli CFT073
agcagcgaauaau

SEQ ID NO: 590644 - RNA, 22 nt, Escherichia coli CFT073
agcagcgaauaauucagcccaa

SEQ ID NO: 590645 - RNA, 23 nt, Escherichia coli CFT073
agcagcgacucacgaaucgccuc

SEQ ID NO: 590646 - RNA, 17 nt, Escherichia coli CFT073
agccaguacacgcugaa

SEQ ID NO: 590647 - RNA, 20 nt, Escherichia coli CFT073
agccaggcgaugaaauucac

SEQ ID NO: 590648 - RNA, 18 nt, Escherichia coli CFT073
agccaggucguggguuca

SEQ ID NO: 590649 - RNA, 19 nt, Escherichia coli CFT073
agcccagcgcuucagcgau

SEQ ID NO: 590650 - RNA, 12 nt, Escherichia coli CFT073
agcccaggccau

SEQ ID NO: 590651 - RNA, 15 nt, Escherichia coli CFT073
agcccaguucagcgg

SEQ ID NO: 590652 - RNA, 20 nt, Escherichia coli CFT073
agcccaucauccgcgcaaua

SEQ ID NO: 590653 - RNA, 17 nt, Escherichia coli CFT073
agcccaucguugaaaaa

SEQ ID NO: 590654 - RNA, 18 nt, Escherichia coli CFT073
agcccaucguugaaaaaa

SEQ ID NO: 590655 - RNA, 21 nt, Escherichia coli CFT073
agcccaugacaggcagacgau

SEQ ID NO: 590656 - RNA, 23 nt, Escherichia coli CFT073
agcccaugcguuaucgccaucca

SEQ ID NO: 590657 - RNA, 18 nt, Escherichia coli CFT073
agcccauaccacagcaaa

SEQ ID NO: 590658 - RNA, 12 nt, Escherichia coli CFT073
agcccgccgcca

SEQ ID NO: 590659 - RNA, 15 nt, Escherichia coli CFT073
agcccgccaucgccc

SEQ ID NO: 590660 - RNA, 15 nt, Escherichia coli CFT073
agcccgcccagcuua

SEQ ID NO: 590661 - RNA, 15 nt, Escherichia coli CFT073
agccccgcgcggcgc

SEQ ID NO: 590662 - RNA, 16 nt, Escherichia coli CFT073
agccgacaauaccaca

SEQ ID NO: 590663 - RNA, 14 nt, Escherichia coli CFT073
agccgaccagcacc

SEQ ID NO: 590664 - RNA, 21 nt, Escherichia coli CFT073
agccgcaaacuccgugaagcu

SEQ ID NO: 590665 - RNA, 19 nt, Escherichia coli CFT073
agccgcaaacuuugccaca

SEQ ID NO: 590666 - RNA, 22 nt, Escherichia coli CFT073
agccgagcgcuaccaucgacac

SEQ ID NO: 590667 - RNA, 18 nt, Escherichia coli CFT073
aaaccgucuucccgcagc

SEQ ID NO: 590668 - RNA, 19 nt, Escherichia coli CFT073
aaaccguuaauccgcccua

SEQ ID NO: 590669 - RNA, 16 nt, Escherichia coli CFT073
aaaccguuaucaccag

SEQ ID NO: 590670 - RNA, 22 nt, Escherichia coli CFT073
aaaccuucagcaucgacauuca

SEQ ID NO: 590671 - RNA, 15 nt, Escherichia coli CFT073
aaaccuuucgccacc

SEQ ID NO: 590672 - RNA, 15 nt, Escherichia coli CFT073
aaacgaaaguuaauc

SEQ ID NO: 590673 - RNA, 13 nt, Escherichia coli CFT073
aaacgaaucugca

SEQ ID NO: 590674 - RNA, 12 nt, Escherichia coli CFT073
aaacgauucggc

SEQ ID NO: 590675 - RNA, 15 nt, Escherichia coli CFT073
aaacgcaaaacugcc

SEQ ID NO: 590676 - RNA, 15 nt, Escherichia coli CFT073
agccgcgugcugcga

SEQ ID NO: 590677 - RNA, 14 nt, Escherichia coli CFT073
aaaccccgacaucg

SEQ ID NO: 590678 - RNA, 13 nt, Escherichia coli CFT073
aaacccagccgcg

SEQ ID NO: 590679 - RNA, 15 nt, Escherichia coli CFT073
aaacccagccgcguc

SEQ ID NO: 590680 - RNA, 14 nt, Escherichia coli CFT073
agcagacguuaaug

SEQ ID NO: 590681 - RNA, 18 nt, Escherichia coli CFT073
agcagagauacaggccac

SEQ ID NO: 590682 - RNA, 21 nt, Escherichia coli CFT073
agcagaaugacaucaucgccc

SEQ ID NO: 590683 - RNA, 21 nt, Escherichia coli CFT073
agcagacgcaucgcccagcca

SEQ ID NO: 590684 - RNA, 14 nt, Escherichia coli CFT073
agcagaucgaacuc

SEQ ID NO: 590685 - RNA, 22 nt, Escherichia coli CFT073
aaaccguaaagcacugguggaa

SEQ ID NO: 590686 - RNA, 23 nt, Escherichia coli CFT073
agcagauacugaugaacgcgcag

SEQ ID NO: 590687 - RNA, 17 nt, Escherichia coli CFT073
aaaccgcccagcagcgc

SEQ ID NO: 590688 - RNA, 22 nt, Escherichia coli CFT073
aaaccgccgacgcgaagcacac

SEQ ID NO: 590689 - RNA, 23 nt, Escherichia coli CFT073
aaaccccgguuguuacugauuaa

SEQ ID NO: 590690 - RNA, 14 nt, Escherichia coli CFT073
aaacccgcugauua

SEQ ID NO: 590691 - RNA, 19 nt, Escherichia coli CFT073
aaacccugcgccagcgcau

SEQ ID NO: 590692 - RNA, 18 nt, Escherichia coli CFT073
agcagcccugccggaacg

SEQ ID NO: 590693 - RNA, 14 nt, Escherichia coli CFT073
agcagcaucacggu

SEQ ID NO: 590694 - RNA, 13 nt, Escherichia coli CFT073
agcagcagcgcca

SEQ ID NO: 590695 - RNA, 17 nt, Escherichia coli CFT073
agcagcagaauuggcau

SEQ ID NO: 590696 - RNA, 21 nt, Escherichia coli CFT073
agcagcagaauuggcaucagg

SEQ ID NO: 590697 - RNA, 14 nt, Escherichia coli CFT073
agcagcaccaccgc

SEQ ID NO: 590698 - RNA, 14 nt, Escherichia coli CFT073
agcagcaaacgccg

SEQ ID NO: 590699 - RNA, 21 nt, Escherichia coli CFT073
agcagcacaccacaucgccga

SEQ ID NO: 590700 - RNA, 20 nt, Escherichia coli CFT073
agcagcacagccagaaucaa

SEQ ID NO: 590701 - RNA, 14 nt, Escherichia coli CFT073
agcacgaccgccau

SEQ ID NO: 590702 - RNA, 15 nt, Escherichia coli CFT073
agcacgaccgccauu

SEQ ID NO: 590703 - RNA, 15 nt, Escherichia coli CFT073
agcaccugcacaggc

SEQ ID NO: 590704 - RNA, 17 nt, Escherichia coli CFT073
agcaccugcaucacgcu

SEQ ID NO: 590705 - RNA, 22 nt, Escherichia coli CFT073
agcacggauaccgcacgcucaa

SEQ ID NO: 590706 - RNA, 22 nt, Escherichia coli CFT073
agcacuguucgccgcagccaga

SEQ ID NO: 590707 - RNA, 15 nt, Escherichia coli CFT073
agcacuucggcauca

SEQ ID NO: 590708 - RNA, 21 nt, Escherichia coli CFT073
agcacuacggagauuaaacgc

SEQ ID NO: 590709 - RNA, 15 nt, Escherichia coli CFT073
agcacucacgccagg

SEQ ID NO: 590710 - RNA, 20 nt, Escherichia coli CFT073
agcacguuacccaaucgccc

SEQ ID NO: 590711 - RNA, 20 nt, Escherichia coli CFT073
agauuuuuugccagcaccau

SEQ ID NO: 590712 - RNA, 18 nt, Escherichia coli CFT073
agcaaaagccuuauccgc

SEQ ID NO: 590713 - RNA, 15 nt, Escherichia coli CFT073
acuuucacgccgcca

SEQ ID NO: 590714 - RNA, 16 nt, Escherichia coli CFT073
acuuucacgccgccaa

SEQ ID NO: 590715 - RNA, 18 nt, Escherichia coli CFT073
acuuuccaugccaucugc

SEQ ID NO: 590716 - RNA, 19 nt, Escherichia coli CFT073
acuuuccgguguaaccgca

SEQ ID NO: 590717 - RNA, 16 nt, Escherichia coli CFT073
acuuucgccaguucuu

SEQ ID NO: 590718 - RNA, 15 nt, Escherichia coli CFT073
agcaaauaaaacugc

SEQ ID NO: 590719 - RNA, 17 nt, Escherichia coli CFT073
agcaaauuccucaaacg

SEQ ID NO: 590720 - RNA, 15 nt, Escherichia coli CFT073
agcaaagagagaucc

SEQ ID NO: 590721 - RNA, 18 nt, Escherichia coli CFT073
agcaaagagagauccagc

SEQ ID NO: 590722 - RNA, 20 nt, Escherichia coli CFT073
agcaaacuaucuguguaaug

SEQ ID NO: 590723 - RNA, 13 nt, Escherichia coli CFT073
agcaaaggcgaca

SEQ ID NO: 590724 - RNA, 14 nt, Escherichia coli CFT073
agcaacaaccacca

SEQ ID NO: 590725 - RNA, 15 nt, Escherichia coli CFT073
agcaacagcaguuug

SEQ ID NO: 590726 - RNA, 23 nt, Escherichia coli CFT073
agcaacgccuaaacugaucgaca

SEQ ID NO: 590727 - RNA, 15 nt, Escherichia coli CFT073
agcaaccggggcauu

SEQ ID NO: 590728 - RNA, 18 nt, Escherichia coli CFT073
agcaaugucauaaaccgc

SEQ ID NO: 590729 - RNA, 21 nt, Escherichia coli CFT073
agcaaugugaaaucagcgaga

SEQ ID NO: 590730 - RNA, 20 nt, Escherichia coli CFT073
agcaauuuugcccagccgaa

SEQ ID NO: 590731 - RNA, 18 nt, Escherichia coli CFT073
agcacaaucacgucauau

SEQ ID NO: 590732 - RNA, 13 nt, Escherichia coli CFT073
agcacaaucgcau

SEQ ID NO: 590733 - RNA, 19 nt, Escherichia coli CFT073
agcacaccacaucgccgac

SEQ ID NO: 590734 - RNA, 20 nt, Escherichia coli CFT073
agcaauccagcuaaccaucc

SEQ ID NO: 590735 - RNA, 21 nt, Escherichia coli CFT073
agcaauagcgcaaucgcugua

SEQ ID NO: 590736 - RNA, 23 nt, Escherichia coli CFT073
agcaauauagcgcauggcagcca

SEQ ID NO: 590737 - RNA, 20 nt, Escherichia coli CFT073
agcaaucgaccaggccauca

SEQ ID NO: 590738 - RNA, 23 nt, Escherichia coli CFT073
agcaaucgcauauuucaacgacg

SEQ ID NO: 590739 - RNA, 22 nt, Escherichia coli CFT073
agcaaucuggcguacagagggc

SEQ ID NO: 590740 - RNA, 16 nt, Escherichia coli CFT073
agcaaugaagaaccgc

SEQ ID NO: 590741 - RNA, 15 nt, Escherichia coli CFT073
agcaagaccgcgacc

SEQ ID NO: 590742 - RNA, 18 nt, Escherichia coli CFT073
agcaagguagugcuucua

SEQ ID NO: 590743 - RNA, 16 nt, Escherichia coli CFT073
agcaaggucaggcgaa

SEQ ID NO: 590744 - RNA, 11 nt, Escherichia coli CFT073
agcaacugguu

SEQ ID NO: 590745 - RNA, 17 nt, Escherichia coli CFT073
agcaacugguuaucacg

SEQ ID NO: 590746 - RNA, 14 nt, Escherichia coli CFT073
agcaagugcggcgc

SEQ ID NO: 590747 - RNA, 16 nt, Escherichia coli CFT073
agcaauaaaaaaccgc

SEQ ID NO: 590748 - RNA, 12 nt, Escherichia coli CFT073
agcaauaaacca

SEQ ID NO: 590749 - RNA, 17 nt, Escherichia coli CFT073
agcaauaagccagucca

SEQ ID NO: 590750 - RNA, 15 nt, Escherichia coli CFT073
agcaccgugcauuuu

SEQ ID NO: 590751 - RNA, 23 nt, Escherichia coli CFT073
agcaccguguuuucgucgccauc

SEQ ID NO: 590752 - RNA, 11 nt, Escherichia coli CFT073
agcaccggcac

SEQ ID NO: 590753 - RNA, 15 nt, Escherichia coli CFT073
agcaccgaacaagaa

SEQ ID NO: 590754 - RNA, 19 nt, Escherichia coli CFT073
agcacccagaacgccgaau

SEQ ID NO: 590755 - RNA, 23 nt, Escherichia coli CFT073
agcaccccgacagcaugcguuuc

SEQ ID NO: 590756 - RNA, 22 nt, Escherichia coli CFT073
agcaccagcccgacgauaccgc

SEQ ID NO: 590757 - RNA, 14 nt, Escherichia coli CFT073
agcaccacuggcga

SEQ ID NO: 590758 - RNA, 22 nt, Escherichia coli CFT073
agcaccaccgcccguuccaccg

SEQ ID NO: 590759 - RNA, 22 nt, Escherichia coli CFT073
agcaccaaacuggaauagcgcc

SEQ ID NO: 590760 - RNA, 19 nt, Escherichia coli CFT073
agcacacgauuccaacgaa

SEQ ID NO: 590761 - RNA, 14 nt, Escherichia coli CFT073
agcacagaucgcac

SEQ ID NO: 590762 - RNA, 14 nt, Escherichia coli CFT073
agcacagccagccu

SEQ ID NO: 590763 - RNA, 17 nt, Escherichia coli CFT073
acgcgagugugauuaca

SEQ ID NO: 590764 - RNA, 22 nt, Escherichia coli CFT073
acgccuguaccagcggcuucca

SEQ ID NO: 590765 - RNA, 18 nt, Escherichia coli CFT073
acgccuuccgucagcaaa

SEQ ID NO: 590766 - RNA, 17 nt, Escherichia coli CFT073
acgccuuccgucagcaa

SEQ ID NO: 590767 - RNA, 23 nt, Escherichia coli CFT073
acgcgcccaguggaugcgccaua

SEQ ID NO: 590768 - RNA, 20 nt, Escherichia coli CFT073
acgcgccagcaucgcaucag

SEQ ID NO: 590769 - RNA, 23 nt, Escherichia coli CFT073
acgcgauucccagucgcgcaauu

SEQ ID NO: 590770 - RNA, 13 nt, Escherichia coli CFT073
acgcgccagcguc

SEQ ID NO: 590771 - RNA, 20 nt, Escherichia coli CFT073
acgcgccagcgucgcaucag

SEQ ID NO: 590772 - RNA, 23 nt, Escherichia coli CFT073
acgcggcaaaacccugcgccagc

SEQ ID NO: 590773 - RNA, 13 nt, Escherichia coli CFT073
acgcggcaacggc

SEQ ID NO: 590774 - RNA, 21 nt, Escherichia coli CFT073
acgcggcaagcgucgcaucag

SEQ ID NO: 590775 - RNA, 23 nt, Escherichia coli CFT073
acgcgccgccaccgccagaagaa

SEQ ID NO: 590776 - RNA, 14 nt, Escherichia coli CFT073
acgcgccgacgaau

SEQ ID NO: 590777 - RNA, 11 nt, Escherichia coli CFT073
acgcgccgcca

SEQ ID NO: 590778 - RNA, 21 nt, Escherichia coli CFT073
acgcggcccgcgucgcaucag

SEQ ID NO: 590779 - RNA, 23 nt, Escherichia coli CFT073
acgcggcaauccccgccagcacg

SEQ ID NO: 590780 - RNA, 20 nt, Escherichia coli CFT073
acgcggcagcgucgcaucag

SEQ ID NO: 590781 - RNA, 21 nt, Escherichia coli CFT073
acgcggcaggcgucgcaucag

SEQ ID NO: 590782 - RNA, 23 nt, Escherichia coli CFT073
aaacaucggcuuauucauaucaa

SEQ ID NO: 590783 - RNA, 18 nt, Escherichia coli CFT073
aaacaucgggauaucgcc

SEQ ID NO: 590784 - RNA, 23 nt, Escherichia coli CFT073
aaacaucuucuuaggcauugccg

SEQ ID NO: 590785 - RNA, 19 nt, Escherichia coli CFT073
aaacauuuuaaacaucagg

SEQ ID NO: 590786 - RNA, 14 nt, Escherichia coli CFT073
aaacaucucuuccc

SEQ ID NO: 590787 - RNA, 19 nt, Escherichia coli CFT073
aaacauuauugagaaacag

SEQ ID NO: 590788 - RNA, 20 nt, Escherichia coli CFT073
aaaccaaaaccgcucgcgcu

SEQ ID NO: 590789 - RNA, 20 nt, Escherichia coli CFT073
acgcugaagucagcacaucc

SEQ ID NO: 590790 - RNA, 19 nt, Escherichia coli CFT073
acgcugaauacgcaccaca

SEQ ID NO: 590791 - RNA, 16 nt, Escherichia coli CFT073
acgcucucaacgcccu

SEQ ID NO: 590792 - RNA, 15 nt, Escherichia coli CFT073
acgcucuuucaccag

SEQ ID NO: 590793 - RNA, 17 nt, Escherichia coli CFT073
acgcuaccuaagcgcca

SEQ ID NO: 590794 - RNA, 18 nt, Escherichia coli CFT073
acgcuaccuaagcgccag

SEQ ID NO: 590795 - RNA, 19 nt, Escherichia coli CFT073
acgcuaugugcuucaucag

SEQ ID NO: 590796 - RNA, 21 nt, Escherichia coli CFT073
acgcgugguugguuucaaaga

SEQ ID NO: 590797 - RNA, 19 nt, Escherichia coli CFT073
acgcguuaaauccugccaa

SEQ ID NO: 590798 - RNA, 21 nt, Escherichia coli CFT073
acgcguuaaauccugccaacg

SEQ ID NO: 590799 - RNA, 16 nt, Escherichia coli CFT073
acgcgucuuaucaggc

SEQ ID NO: 590800 - RNA, 20 nt, Escherichia coli CFT073
acgcgucugaccgucuuuca

SEQ ID NO: 590801 - RNA, 20 nt, Escherichia coli CFT073
acgcgucagcgucgcaucug

SEQ ID NO: 590802 - RNA, 21 nt, Escherichia coli CFT073
acgcgucaagcgucgcauccg

SEQ ID NO: 590803 - RNA, 17 nt, Escherichia coli CFT073
acgcguagcgcaaauca

SEQ ID NO: 590804 - RNA, 16 nt, Escherichia coli CFT073
acgcgguuucgccgcc

SEQ ID NO: 590805 - RNA, 13 nt, Escherichia coli CFT073
acgccugcagcau

SEQ ID NO: 590806 - RNA, 13 nt, Escherichia coli CFT073
acgccugccgcau

SEQ ID NO: 590807 - RNA, 19 nt, Escherichia coli CFT073
acgccugcuccaucauccg

SEQ ID NO: 590808 - RNA, 20 nt, Escherichia coli CFT073
acgccucgggaaggucaggu

SEQ ID NO: 590809 - RNA, 13 nt, Escherichia coli CFT073
acgccgcuggugg

SEQ ID NO: 590810 - RNA, 22 nt, Escherichia coli CFT073
acgccggauuugagaucggaaa

SEQ ID NO: 590811 - RNA, 16 nt, Escherichia coli CFT073
acgccgguuccugcau

SEQ ID NO: 590812 - RNA, 15 nt, Escherichia coli CFT073
acgccgggcagccuu

SEQ ID NO: 590813 - RNA, 19 nt, Escherichia coli CFT073
acgccgauggcagaaauca

SEQ ID NO: 590814 - RNA, 18 nt, Escherichia coli CFT073
acgccgauaucgcuggca

SEQ ID NO: 590815 - RNA, 20 nt, Escherichia coli CFT073
acgcccuguaaaaaagaaau

SEQ ID NO: 590816 - RNA, 22 nt, Escherichia coli CFT073
acgccgcguuuaucgacagacg

SEQ ID NO: 590817 - RNA, 19 nt, Escherichia coli CFT073
acgccgccaguacgcgccc

SEQ ID NO: 590818 - RNA, 24 nt, Escherichia coli CFT073
acgccgcauccggcaugaacaaag

SEQ ID NO: 590819 - RNA, 20 nt, Escherichia coli CFT073
acgccgcauccggccaucag

SEQ ID NO: 590820 - RNA, 12 nt, Escherichia coli CFT073
acgccgcaucag

SEQ ID NO: 590821 - RNA, 19 nt, Escherichia coli CFT073
acgccgcauccgacaucaa

SEQ ID NO: 590822 - RNA, 14 nt, Escherichia coli CFT073
acgccaaaagcgau

SEQ ID NO: 590823 - RNA, 14 nt, Escherichia coli CFT073
acgccaaccagcug

SEQ ID NO: 590824 - RNA, 19 nt, Escherichia coli CFT073
acgccaagaaacaccagaa

SEQ ID NO: 590825 - RNA, 21 nt, Escherichia coli CFT073
acgccacaauacugaucauca

SEQ ID NO: 590826 - RNA, 19 nt, Escherichia coli CFT073
acgcauaccuaccugcagu

SEQ ID NO: 590827 - RNA, 16 nt, Escherichia coli CFT073
acgcauccccagcgca

SEQ ID NO: 590828 - RNA, 16 nt, Escherichia coli CFT073
acgcaucgcgcaccag

SEQ ID NO: 590829 - RNA, 22 nt, Escherichia coli CFT073
acgcauuauuuugcggauuauu

SEQ ID NO: 590830 - RNA, 14 nt, Escherichia coli CFT073
acgcauccaccaga

SEQ ID NO: 590831 - RNA, 13 nt, Escherichia coli CFT073
acgcauugccgcc

SEQ ID NO: 590832 - RNA, 22 nt, Escherichia coli CFT073
acgaugccgccgaggauacagc

SEQ ID NO: 590833 - RNA, 11 nt, Escherichia coli CFT073
acgcagcgaua

SEQ ID NO: 590834 - RNA, 16 nt, Escherichia coli CFT073
acgcagccccagcgca

SEQ ID NO: 590835 - RNA, 18 nt, Escherichia coli CFT073
acgcaguaaauaaaaaau

SEQ ID NO: 590836 - RNA, 22 nt, Escherichia coli CFT073
acgcagugugcuacggucugcc

SEQ ID NO: 590837 - RNA, 19 nt, Escherichia coli CFT073
acgcaguuuaaucguugau

SEQ ID NO: 590838 - RNA, 19 nt, Escherichia coli CFT073
acgcagcgugaagcuaccg

SEQ ID NO: 590839 - RNA, 13 nt, Escherichia coli CFT073
acgcagcucacgc

SEQ ID NO: 590840 - RNA, 23 nt, Escherichia coli CFT073
acgcaggcaucuuuuucaaugca

SEQ ID NO: 590841 - RNA, 15 nt, Escherichia coli CFT073
acgccauccagccgg

SEQ ID NO: 590842 - RNA, 18 nt, Escherichia coli CFT073
acgccagugucgcaucag

SEQ ID NO: 590843 - RNA, 18 nt, Escherichia coli CFT073
acgccauccggcagcaaa

SEQ ID NO: 590844 - RNA, 15 nt, Escherichia coli CFT073
acgccagcgaagcca

SEQ ID NO: 590845 - RNA, 14 nt, Escherichia coli CFT073
acgccagccgccag

SEQ ID NO: 590846 - RNA, 11 nt, Escherichia coli CFT073
acgccagcgcg

SEQ ID NO: 590847 - RNA, 20 nt, Escherichia coli CFT073
acgccagcggucauaacgcu

SEQ ID NO: 590848 - RNA, 19 nt, Escherichia coli CFT073
acgccagaaaaccuggcgc

SEQ ID NO: 590849 - RNA, 16 nt, Escherichia coli CFT073
acgccagaaacgggug

SEQ ID NO: 590850 - RNA, 16 nt, Escherichia coli CFT073
acgcccugaccgucaa

SEQ ID NO: 590851 - RNA, 12 nt, Escherichia coli CFT073
acgcccugcaac

SEQ ID NO: 590852 - RNA, 18 nt, Escherichia coli CFT073
acgcccugcaacugcugc

SEQ ID NO: 590853 - RNA, 14 nt, Escherichia coli CFT073
acgcccgguaaucg

SEQ ID NO: 590854 - RNA, 22 nt, Escherichia coli CFT073
acgcccgcacugucgccauacg

SEQ ID NO: 590855 - RNA, 15 nt, Escherichia coli CFT073
acgcccgauagcgaa

SEQ ID NO: 590856 - RNA, 21 nt, Escherichia coli CFT073
acgcccgcaacuuuaccgcaa

SEQ ID NO: 590857 - RNA, 16 nt, Escherichia coli CFT073
acgcccgacgaggcgc

SEQ ID NO: 590858 - RNA, 21 nt, Escherichia coli CFT073
acgcccaguccgcucgccgca

SEQ ID NO: 590859 - RNA, 13 nt, Escherichia coli CFT073
acgcccaucagcg

SEQ ID NO: 590860 - RNA, 14 nt, Escherichia coli CFT073
acgcccaucgcgcc

SEQ ID NO: 590861 - RNA, 22 nt, Escherichia coli CFT073
acgaucaagaauaguuuccagu

SEQ ID NO: 590862 - RNA, 20 nt, Escherichia coli CFT073
acgaugcaauuaucauugcu

SEQ ID NO: 590863 - RNA, 21 nt, Escherichia coli CFT073
acgaucagggcgacaaucauc

SEQ ID NO: 590864 - RNA, 17 nt, Escherichia coli CFT073
accuguugugcgcggcu

SEQ ID NO: 590865 - RNA, 19 nt, Escherichia coli CFT073
accuuaccgccacguaccg

SEQ ID NO: 590866 - RNA, 22 nt, Escherichia coli CFT073
accuucaaaauuuaacauuacu

SEQ ID NO: 590867 - RNA, 17 nt, Escherichia coli CFT073
accugugacagcagcgg

SEQ ID NO: 590868 - RNA, 22 nt, Escherichia coli CFT073
accuguucacgaccaucaaccu

SEQ ID NO: 590869 - RNA, 22 nt, Escherichia coli CFT073
accugucgcuuuugcaucuuca

SEQ ID NO: 590870 - RNA, 16 nt, Escherichia coli CFT073
accuucguccauccca

SEQ ID NO: 590871 - RNA, 19 nt, Escherichia coli CFT073
accuucgcuaucaaacuga

SEQ ID NO: 590872 - RNA, 22 nt, Escherichia coli CFT073
accuggcgcuucacuggcgaca

SEQ ID NO: 590873 - RNA, 20 nt, Escherichia coli CFT073
accuggcggcguguuauccg

SEQ ID NO: 590874 - RNA, 20 nt, Escherichia coli CFT073
accuguaaaaaaggcagcca

SEQ ID NO: 590875 - RNA, 23 nt, Escherichia coli CFT073
accuguaaaaaaggcagccaucu

SEQ ID NO: 590876 - RNA, 15 nt, Escherichia coli CFT073
accuguaggccgaau

SEQ ID NO: 590877 - RNA, 15 nt, Escherichia coli CFT073
accugcccggcagcu

SEQ ID NO: 590878 - RNA, 19 nt, Escherichia coli CFT073
accugcgaaaaucagccau

SEQ ID NO: 590879 - RNA, 22 nt, Escherichia coli CFT073
accugcguugccgcaucaguga

SEQ ID NO: 590880 - RNA, 23 nt, Escherichia coli CFT073
accugcucgaacgugaucgcccc

SEQ ID NO: 590881 - RNA, 13 nt, Escherichia coli CFT073
accugcggaauca

SEQ ID NO: 590882 - RNA, 20 nt, Escherichia coli CFT073
accugcggaaucaccggcaa

SEQ ID NO: 590883 - RNA, 21 nt, Escherichia coli CFT073
acguaucuuacagagcgauua

SEQ ID NO: 590884 - RNA, 20 nt, Escherichia coli CFT073
acguauggcgauagcccaga

SEQ ID NO: 590885 - RNA, 13 nt, Escherichia coli CFT073
acguagccacggc

SEQ ID NO: 590886 - RNA, 15 nt, Escherichia coli CFT073
acguaccggcgcgua

SEQ ID NO: 590887 - RNA, 18 nt, Escherichia coli CFT073
acgucagacagcgcaaua

SEQ ID NO: 590888 - RNA, 12 nt, Escherichia coli CFT073
acguccaccaga

SEQ ID NO: 590889 - RNA, 16 nt, Escherichia coli CFT073
acguccaaucagcaca

SEQ ID NO: 590890 - RNA, 22 nt, Escherichia coli CFT073
acgucaguacaaacauccaucu

SEQ ID NO: 590891 - RNA, 17 nt, Escherichia coli CFT073
acgguuuuuugaacaga

SEQ ID NO: 590892 - RNA, 21 nt, Escherichia coli CFT073
acguaaauuuauuccgagcag

SEQ ID NO: 590893 - RNA, 18 nt, Escherichia coli CFT073
acguaaaugccagcccau

SEQ ID NO: 590894 - RNA, 16 nt, Escherichia coli CFT073
acggugcgaccaaacu

SEQ ID NO: 590895 - RNA, 16 nt, Escherichia coli CFT073
acggugagacgccaga

SEQ ID NO: 590896 - RNA, 16 nt, Escherichia coli CFT073
acggugauacagcaaa

SEQ ID NO: 590897 - RNA, 16 nt, Escherichia coli CFT073
acggugauucagcgua

SEQ ID NO: 590898 - RNA, 19 nt, Escherichia coli CFT073
acgugaaaugucauuacga

SEQ ID NO: 590899 - RNA, 20 nt, Escherichia coli CFT073
acgugguuuaccaccagcgg

SEQ ID NO: 590900 - RNA, 16 nt, Escherichia coli CFT073
acguguacccagcagc

SEQ ID NO: 590901 - RNA, 17 nt, Escherichia coli CFT073
acguguaugcauaacca

SEQ ID NO: 590902 - RNA, 20 nt, Escherichia coli CFT073
acgucugaucggcaaucacg

SEQ ID NO: 590903 - RNA, 12 nt, Escherichia coli CFT073
acgucugcgccu

SEQ ID NO: 590904 - RNA, 21 nt, Escherichia coli CFT073
acgucgcaagacgaaaaauga

SEQ ID NO: 590905 - RNA, 21 nt, Escherichia coli CFT073
acgucgccagaaaucagcagc

SEQ ID NO: 590906 - RNA, 15 nt, Escherichia coli CFT073
acguccugcccgacg

SEQ ID NO: 590907 - RNA, 14 nt, Escherichia coli CFT073
acggcuuugucauu

SEQ ID NO: 590908 - RNA, 22 nt, Escherichia coli CFT073
acgggaaaccaacuccaguggc

SEQ ID NO: 590909 - RNA, 14 nt, Escherichia coli CFT073
acggcuugcgcgca

SEQ ID NO: 590910 - RNA, 19 nt, Escherichia coli CFT073
acggcuugcgcgcaaucag

SEQ ID NO: 590911 - RNA, 16 nt, Escherichia coli CFT073
acggcugggaaaucac

SEQ ID NO: 590912 - RNA, 20 nt, Escherichia coli CFT073
acggcuguugauguccaguu

SEQ ID NO: 590913 - RNA, 17 nt, Escherichia coli CFT073
acggcucacccccauca

SEQ ID NO: 590914 - RNA, 19 nt, Escherichia coli CFT073
acggcgugccaaauauuca

SEQ ID NO: 590915 - RNA, 18 nt, Escherichia coli CFT073
acggcguucuuuacacag

SEQ ID NO: 590916 - RNA, 22 nt, Escherichia coli CFT073
acggcguucuuuacacagcgua

SEQ ID NO: 590917 - RNA, 20 nt, Escherichia coli CFT073
acggcguuuuuucaucacug

SEQ ID NO: 590918 - RNA, 15 nt, Escherichia coli CFT073
acggcgcguuucauu

SEQ ID NO: 590919 - RNA, 14 nt, Escherichia coli CFT073
aaaccaucagcagu

SEQ ID NO: 590920 - RNA, 21 nt, Escherichia coli CFT073
aaaccauacucacaucaacaa

SEQ ID NO: 590921 - RNA, 22 nt, Escherichia coli CFT073
aaaccacacuucuucagccagu

SEQ ID NO: 590922 - RNA, 16 nt, Escherichia coli CFT073
aaaccacccaccagcg

SEQ ID NO: 590923 - RNA, 22 nt, Escherichia coli CFT073
acgcuggguuucgccugccaga

SEQ ID NO: 590924 - RNA, 14 nt, Escherichia coli CFT073
acggcgagccagcg

SEQ ID NO: 590925 - RNA, 16 nt, Escherichia coli CFT073
acggcgacgcgcgcgg

SEQ ID NO: 590926 - RNA, 22 nt, Escherichia coli CFT073
acggcgaucguucgccauccgu

SEQ ID NO: 590927 - RNA, 14 nt, Escherichia coli CFT073
acggcgcaccagaa

SEQ ID NO: 590928 - RNA, 22 nt, Escherichia coli CFT073
acggcgcgacuuuaaucaccug

SEQ ID NO: 590929 - RNA, 20 nt, Escherichia coli CFT073
acucgcugcggacaaaucgu

SEQ ID NO: 590930 - RNA, 16 nt, Escherichia coli CFT073
acucgccgcaaaaccc

SEQ ID NO: 590931 - RNA, 23 nt, Escherichia coli CFT073
acucgccuuucacacgcucaaua

SEQ ID NO: 590932 - RNA, 15 nt, Escherichia coli CFT073
acucgcgaaucgccg

SEQ ID NO: 590933 - RNA, 16 nt, Escherichia coli CFT073
acucgcgaaucgccgu

SEQ ID NO: 590934 - RNA, 18 nt, Escherichia coli CFT073
acucguaagaggcgugug

SEQ ID NO: 590935 - RNA, 22 nt, Escherichia coli CFT073
acucguccauaguaacgcggca

SEQ ID NO: 590936 - RNA, 21 nt, Escherichia coli CFT073
acuccgccagcaacugauaca

SEQ ID NO: 590937 - RNA, 20 nt, Escherichia coli CFT073
acucgccaggaugggcugcc

SEQ ID NO: 590938 - RNA, 18 nt, Escherichia coli CFT073
acucgaugacaacaccau

SEQ ID NO: 590939 - RNA, 14 nt, Escherichia coli CFT073
acucgaccugcaac

SEQ ID NO: 590940 - RNA, 15 nt, Escherichia coli CFT073
acucgaccugcaacu

SEQ ID NO: 590941 - RNA, 17 nt, Escherichia coli CFT073
acucaaaaauaaucauc

SEQ ID NO: 590942 - RNA, 20 nt, Escherichia coli CFT073
acguugcgacaaaccaggua

SEQ ID NO: 590943 - RNA, 16 nt, Escherichia coli CFT073
acguugccaguaccau

SEQ ID NO: 590944 - RNA, 17 nt, Escherichia coli CFT073
acguugauaaccacggc

SEQ ID NO: 590945 - RNA, 14 nt, Escherichia coli CFT073
acucacuggcgcgc

SEQ ID NO: 590946 - RNA, 22 nt, Escherichia coli CFT073
acucagccaaaucccgugaugc

SEQ ID NO: 590947 - RNA, 16 nt, Escherichia coli CFT073
acucagcgccugcugc

SEQ ID NO: 590948 - RNA, 16 nt, Escherichia coli CFT073
acucaccugauuaccu

SEQ ID NO: 590949 - RNA, 21 nt, Escherichia coli CFT073
acucacgaaucgccucacgac

SEQ ID NO: 590950 - RNA, 14 nt, Escherichia coli CFT073
acucacccgccagc

SEQ ID NO: 590951 - RNA, 19 nt, Escherichia coli CFT073
acucaacuuauugaucauc

SEQ ID NO: 590952 - RNA, 19 nt, Escherichia coli CFT073
acucaagagucggaagauu

SEQ ID NO: 590953 - RNA, 16 nt, Escherichia coli CFT073
acucaagccguuaauu

SEQ ID NO: 590954 - RNA, 15 nt, Escherichia coli CFT073
acucauuuuuucggu

SEQ ID NO: 590955 - RNA, 21 nt, Escherichia coli CFT073
acuccaacucuuuuaccaccg

SEQ ID NO: 590956 - RNA, 14 nt, Escherichia coli CFT073
acucaguccgguau

SEQ ID NO: 590957 - RNA, 19 nt, Escherichia coli CFT073
acucaucagagaaacaucc

SEQ ID NO: 590958 - RNA, 14 nt, Escherichia coli CFT073
acucaucgccgcca

SEQ ID NO: 590959 - RNA, 16 nt, Escherichia coli CFT073
acucaucucggggcaa

SEQ ID NO: 590960 - RNA, 16 nt, Escherichia coli CFT073
acucauuaaaacggau

SEQ ID NO: 590961 - RNA, 13 nt, Escherichia coli CFT073
acucauuaaacca

SEQ ID NO: 590962 - RNA, 21 nt, Escherichia coli CFT073
acucccuauaaugcgccacca

SEQ ID NO: 590963 - RNA, 20 nt, Escherichia coli CFT073
acucccuguuccuguauuug

SEQ ID NO: 590964 - RNA, 22 nt, Escherichia coli CFT073
acucccuuucugccacgccacg

SEQ ID NO: 590965 - RNA, 14 nt, Escherichia coli CFT073
acuccgauuaccgg

SEQ ID NO: 590966 - RNA, 13 nt, Escherichia coli CFT073
acuccccuucugg

SEQ ID NO: 590967 - RNA, 18 nt, Escherichia coli CFT073
acuccaguggcgcaucag

SEQ ID NO: 590968 - RNA, 21 nt, Escherichia coli CFT073
acuccagcccuuucgacgcgu

SEQ ID NO: 590969 - RNA, 21 nt, Escherichia coli CFT073
acuccagcgcuucgcucccca

SEQ ID NO: 590970 - RNA, 11 nt, Escherichia coli CFT073
acuucaugacc

SEQ ID NO: 590971 - RNA, 17 nt, Escherichia coli CFT073
acuucauucagaaaaac

SEQ ID NO: 590972 - RNA, 14 nt, Escherichia coli CFT073
acuuccaccagcgg

SEQ ID NO: 590973 - RNA, 14 nt, Escherichia coli CFT073
acuucgccagcgug

SEQ ID NO: 590974 - RNA, 22 nt, Escherichia coli CFT073
acuucgccaucagcgccugaug

SEQ ID NO: 590975 - RNA, 14 nt, Escherichia coli CFT073
acuucgcuaccggc

SEQ ID NO: 590976 - RNA, 22 nt, Escherichia coli CFT073
acuucgcugguguacugcaacu

SEQ ID NO: 590977 - RNA, 22 nt, Escherichia coli CFT073
acuucaguaaauacugcgcaug

SEQ ID NO: 590978 - RNA, 15 nt, Escherichia coli CFT073
acuucgguuaccaca

SEQ ID NO: 590979 - RNA, 20 nt, Escherichia coli CFT073
acuucggcaucaauaaagcc

SEQ ID NO: 590980 - RNA, 14 nt, Escherichia coli CFT073
acuguaacgcagaa

SEQ ID NO: 590981 - RNA, 16 nt, Escherichia coli CFT073
acuguaagccaucacc

SEQ ID NO: 590982 - RNA, 14 nt, Escherichia coli CFT073
acuguaucccagcc

SEQ ID NO: 590983 - RNA, 13 nt, Escherichia coli CFT073
acugucaauaaac

SEQ ID NO: 590984 - RNA, 17 nt, Escherichia coli CFT073
acugucaauaaacgccu

SEQ ID NO: 590985 - RNA, 19 nt, Escherichia coli CFT073
acugucagugaccagcggc

SEQ ID NO: 590986 - RNA, 23 nt, Escherichia coli CFT073
acuguccacgacagaacccggcu

SEQ ID NO: 590987 - RNA, 20 nt, Escherichia coli CFT073
acuuauggcguacugaagcc

SEQ ID NO: 590988 - RNA, 20 nt, Escherichia coli CFT073
acuguccugcggcguaccaa

SEQ ID NO: 590989 - RNA, 24 nt, Escherichia coli CFT073
acuguccugcggcguaccaauacg

SEQ ID NO: 590990 - RNA, 23 nt, Escherichia coli CFT073
acuucaaaaauaaguugccacgc

SEQ ID NO: 590991 - RNA, 13 nt, Escherichia coli CFT073
acuucaaccagcg

SEQ ID NO: 590992 - RNA, 14 nt, Escherichia coli CFT073
acuucaaccagcgg

SEQ ID NO: 590993 - RNA, 18 nt, Escherichia coli CFT073
acuucaaccagcggcgca

SEQ ID NO: 590994 - RNA, 13 nt, Escherichia coli CFT073
acuucaaucgcca

SEQ ID NO: 590995 - RNA, 22 nt, Escherichia coli CFT073
acuucugcugugacuucagcga

SEQ ID NO: 590996 - RNA, 17 nt, Escherichia coli CFT073
acuucuguuugcgccac

SEQ ID NO: 590997 - RNA, 15 nt, Escherichia coli CFT073
acuucuucauucauc

SEQ ID NO: 590998 - RNA, 18 nt, Escherichia coli CFT073
acuucuuccagcggcagg

SEQ ID NO: 590999 - RNA, 15 nt, Escherichia coli CFT073
acuucuucacaucaa

SEQ ID NO: 591000 - RNA, 16 nt, Escherichia coli CFT073
acuugacuaagcguuu

SEQ ID NO: 591001 - RNA, 21 nt, Escherichia coli CFT073
acuugcaagaucgcgcaucag

SEQ ID NO: 591002 - RNA, 18 nt, Escherichia coli CFT073
acuuguaccuucagcggc

SEQ ID NO: 591003 - RNA, 18 nt, Escherichia coli CFT073
acuugugcgcuuguucau

SEQ ID NO: 591004 - RNA, 13 nt, Escherichia coli CFT073
acuuuaaucaccu

SEQ ID NO: 591005 - RNA, 13 nt, Escherichia coli CFT073
acuuuacgggcaa

SEQ ID NO: 591006 - RNA, 20 nt, Escherichia coli CFT073
acuuuacuaaaaagugauaa

SEQ ID NO: 591007 - RNA, 16 nt, Escherichia coli CFT073
acuuuacucauccccu

SEQ ID NO: 591008 - RNA, 23 nt, Escherichia coli CFT073
acuugcucaaucuggcugaugaa

SEQ ID NO: 591009 - RNA, 22 nt, Escherichia coli CFT073
acuugcggucaggugcccgcgu

SEQ ID NO: 591010 - RNA, 19 nt, Escherichia coli CFT073
acucuaccguuaaaauacg

SEQ ID NO: 591011 - RNA, 13 nt, Escherichia coli CFT073
acucuaccugguc

SEQ ID NO: 591012 - RNA, 16 nt, Escherichia coli CFT073
acucucccaugcgcug

SEQ ID NO: 591013 - RNA, 23 nt, Escherichia coli CFT073
acucuccccguuuuccgggcaag

SEQ ID NO: 591014 - RNA, 22 nt, Escherichia coli CFT073
acucugaccugucgcagauauu

SEQ ID NO: 591015 - RNA, 17 nt, Escherichia coli CFT073
acucuucaauggcauca

SEQ ID NO: 591016 - RNA, 21 nt, Escherichia coli CFT073
acucugcaagucuugcugcgc

SEQ ID NO: 591017 - RNA, 12 nt, Escherichia coli CFT073
acucugcccuuc

SEQ ID NO: 591018 - RNA, 20 nt, Escherichia coli CFT073
acucugccguaccaucgcca

SEQ ID NO: 591019 - RNA, 21 nt, Escherichia coli CFT073
acucugcgcauguaauggggc

SEQ ID NO: 591020 - RNA, 18 nt, Escherichia coli CFT073
acucuuccagaccaaaca

SEQ ID NO: 591021 - RNA, 18 nt, Escherichia coli CFT073
acugccuuaaacuccaua

SEQ ID NO: 591022 - RNA, 14 nt, Escherichia coli CFT073
acugcgaccguaca

SEQ ID NO: 591023 - RNA, 21 nt, Escherichia coli CFT073
acugcgaucgcccgcaaucag

SEQ ID NO: 591024 - RNA, 19 nt, Escherichia coli CFT073
acugcuguugcugccgugc

SEQ ID NO: 591025 - RNA, 15 nt, Escherichia coli CFT073
acugcuggaauacug

SEQ ID NO: 591026 - RNA, 16 nt, Escherichia coli CFT073
acugcuuuuaaaugcc

SEQ ID NO: 591027 - RNA, 20 nt, Escherichia coli CFT073
acuggcaccccugcauaauu

SEQ ID NO: 591028 - RNA, 19 nt, Escherichia coli CFT073
acuggcaaucgccagcggc

SEQ ID NO: 591029 - RNA, 23 nt, Escherichia coli CFT073
acuggcaaucgccagcggcagcu

SEQ ID NO: 591030 - RNA, 15 nt, Escherichia coli CFT073
acuggcaaucgccag

SEQ ID NO: 591031 - RNA, 17 nt, Escherichia coli CFT073
acuggcacaagacugac

SEQ ID NO: 591032 - RNA, 23 nt, Escherichia coli CFT073
acuggcacaagacugacaaucaa

SEQ ID NO: 591033 - RNA, 16 nt, Escherichia coli CFT073
acuggaacaguugcag

SEQ ID NO: 591034 - RNA, 16 nt, Escherichia coli CFT073
acuggcaaaaucaaaa

SEQ ID NO: 591035 - RNA, 17 nt, Escherichia coli CFT073
acugggcuauggcaaca

SEQ ID NO: 591036 - RNA, 13 nt, Escherichia coli CFT073
acugggcgcggcc

SEQ ID NO: 591037 - RNA, 15 nt, Escherichia coli CFT073
acugguuaucacgaa

SEQ ID NO: 591038 - RNA, 16 nt, Escherichia coli CFT073
acuggcuuaauaauuc

SEQ ID NO: 591039 - RNA, 22 nt, Escherichia coli CFT073
acuggcucugaauaaagcguuu

SEQ ID NO: 591040 - RNA, 19 nt, Escherichia coli CFT073
acuggcucgccgcagccaa

SEQ ID NO: 591041 - RNA, 19 nt, Escherichia coli CFT073
acuggaaaaccgcacucac

SEQ ID NO: 591042 - RNA, 17 nt, Escherichia coli CFT073
accgcuuuccucaucag

SEQ ID NO: 591043 - RNA, 15 nt, Escherichia coli CFT073
accggaagcgccacc

SEQ ID NO: 591044 - RNA, 21 nt, Escherichia coli CFT073
accggaaggugagggggcgau

SEQ ID NO: 591045 - RNA, 13 nt, Escherichia coli CFT073
accggaaucgcgc

SEQ ID NO: 591046 - RNA, 22 nt, Escherichia coli CFT073
accggacgaaauccccccggug

SEQ ID NO: 591047 - RNA, 16 nt, Escherichia coli CFT073
accggcccaccaaaga

SEQ ID NO: 591048 - RNA, 15 nt, Escherichia coli CFT073
accggcgaaaacggu

SEQ ID NO: 591049 - RNA, 19 nt, Escherichia coli CFT073
accggcguuucacauucuc

SEQ ID NO: 591050 - RNA, 14 nt, Escherichia coli CFT073
accggcguuucugg

SEQ ID NO: 591051 - RNA, 12 nt, Escherichia coli CFT073
accggcuggcgc

SEQ ID NO: 591052 - RNA, 19 nt, Escherichia coli CFT073
accggcuggcgcauaccaa

SEQ ID NO: 591053 - RNA, 20 nt, Escherichia coli CFT073
accggcuuucgcuucaacca

SEQ ID NO: 591054 - RNA, 23 nt, Escherichia coli CFT073
accggcggcgacuggcugaacag

SEQ ID NO: 591055 - RNA, 16 nt, Escherichia coli CFT073
accggcguaacgccgc

SEQ ID NO: 591056 - RNA, 20 nt, Escherichia coli CFT073
accggcguaacggccacggc

SEQ ID NO: 591057 - RNA, 17 nt, Escherichia coli CFT073
accggcgacuuccugag

SEQ ID NO: 591058 - RNA, 23 nt, Escherichia coli CFT073
accggcgauaucccaggcaaaau

SEQ ID NO: 591059 - RNA, 10 nt, Escherichia coli CFT073
accgcuacgu

SEQ ID NO: 591060 - RNA, 16 nt, Escherichia coli CFT073
accgcucgucacauca

SEQ ID NO: 591061 - RNA, 14 nt, Escherichia coli CFT073
accgcuaacugcug

SEQ ID NO: 591062 - RNA, 15 nt, Escherichia coli CFT073
accgcuaacugcugc

SEQ ID NO: 591063 - RNA, 19 nt, Escherichia coli CFT073
accgcuaauagcgcagcgg

SEQ ID NO: 591064 - RNA, 22 nt, Escherichia coli CFT073
accgcguaugcccagcgcagaa

SEQ ID NO: 591065 - RNA, 16 nt, Escherichia coli CFT073
accgccuuaccaaacu

SEQ ID NO: 591066 - RNA, 17 nt, Escherichia coli CFT073
accgccgccgccacugc

SEQ ID NO: 591067 - RNA, 10 nt, Escherichia coli CFT073
accgccgccg

SEQ ID NO: 591068 - RNA, 14 nt, Escherichia coli CFT073
accgccgcacaaua

SEQ ID NO: 591069 - RNA, 20 nt, Escherichia coli CFT073
accgccgagucgguuuuauu

SEQ ID NO: 591070 - RNA, 16 nt, Escherichia coli CFT073
accgccgccaaacugu

SEQ ID NO: 591071 - RNA, 15 nt, Escherichia coli CFT073
accgccauuugcauc

SEQ ID NO: 591072 - RNA, 19 nt, Escherichia coli CFT073
accgccaccuccgcuaaau

SEQ ID NO: 591073 - RNA, 12 nt, Escherichia coli CFT073
accgcauuggac

SEQ ID NO: 591074 - RNA, 18 nt, Escherichia coli CFT073
accgccaauuaccacuga

SEQ ID NO: 591075 - RNA, 12 nt, Escherichia coli CFT073
accgagcagcca

SEQ ID NO: 591076 - RNA, 22 nt, Escherichia coli CFT073
accgaaaaucacgcugccaaua

SEQ ID NO: 591077 - RNA, 14 nt, Escherichia coli CFT073
acccugcgccagcg

SEQ ID NO: 591078 - RNA, 16 nt, Escherichia coli CFT073
acccugcgccagcgca

SEQ ID NO: 591079 - RNA, 18 nt, Escherichia coli CFT073
accgagaagccgaccagc

SEQ ID NO: 591080 - RNA, 14 nt, Escherichia coli CFT073
accgacuucagcca

SEQ ID NO: 591081 - RNA, 14 nt, Escherichia coli CFT073
accgaaaucgccau

SEQ ID NO: 591082 - RNA, 23 nt, Escherichia coli CFT073
accgaacaagaaacagauaacca

SEQ ID NO: 591083 - RNA, 18 nt, Escherichia coli CFT073
acccucaauaaucauucg

SEQ ID NO: 591084 - RNA, 16 nt, Escherichia coli CFT073
acccucaaacgccagc

SEQ ID NO: 591085 - RNA, 14 nt, Escherichia coli CFT073
acccgugcauccca

SEQ ID NO: 591086 - RNA, 15 nt, Escherichia coli CFT073
acccgugcaucccag

SEQ ID NO: 591087 - RNA, 19 nt, Escherichia coli CFT073
acccguguuuugcaucaac

SEQ ID NO: 591088 - RNA, 14 nt, Escherichia coli CFT073
acccggcguuuuca

SEQ ID NO: 591089 - RNA, 19 nt, Escherichia coli CFT073
acccacgguacucaucacg

SEQ ID NO: 591090 - RNA, 16 nt, Escherichia coli CFT073
acccagaacacgccgu

SEQ ID NO: 591091 - RNA, 13 nt, Escherichia coli CFT073
acccagucgcgcg

SEQ ID NO: 591092 - RNA, 12 nt, Escherichia coli CFT073
acccacagccau

SEQ ID NO: 591093 - RNA, 14 nt, Escherichia coli CFT073
accaggcaauaaac

SEQ ID NO: 591094 - RNA, 21 nt, Escherichia coli CFT073
accaggcaguuuauccagcca

SEQ ID NO: 591095 - RNA, 12 nt, Escherichia coli CFT073
accaggaucagc

SEQ ID NO: 591096 - RNA, 18 nt, Escherichia coli CFT073
accccgguaguacgugaa

SEQ ID NO: 591097 - RNA, 16 nt, Escherichia coli CFT073
accccauagccagcga

SEQ ID NO: 591098 - RNA, 21 nt, Escherichia coli CFT073
accccgccagcagaaugacau

SEQ ID NO: 591099 - RNA, 14 nt, Escherichia coli CFT073
acccgaagcgccaa

SEQ ID NO: 591100 - RNA, 17 nt, Escherichia coli CFT073
acccgcagccagcacug

SEQ ID NO: 591101 - RNA, 16 nt, Escherichia coli CFT073
acccgagcgccagcga

SEQ ID NO: 591102 - RNA, 22 nt, Escherichia coli CFT073
acccgagagaacugcugcaucc

SEQ ID NO: 591103 - RNA, 12 nt, Escherichia coli CFT073
acagcucugaau

SEQ ID NO: 591104 - RNA, 17 nt, Escherichia coli CFT073
acaggcacaccgccgcc

SEQ ID NO: 591105 - RNA, 18 nt, Escherichia coli CFT073
acaggcacaccgccgccg

SEQ ID NO: 591106 - RNA, 22 nt, Escherichia coli CFT073
acaguacaauauuaauuacuuc

SEQ ID NO: 591107 - RNA, 16 nt, Escherichia coli CFT073
acaguagagccgccag

SEQ ID NO: 591108 - RNA, 20 nt, Escherichia coli CFT073
acaguccauugcgcaaccgc

SEQ ID NO: 591109 - RNA, 19 nt, Escherichia coli CFT073
acagggugagcagggcgcu

SEQ ID NO: 591110 - RNA, 18 nt, Escherichia coli CFT073
acagggcgucaccgguca

SEQ ID NO: 591111 - RNA, 13 nt, Escherichia coli CFT073
acaggguaaaaag

SEQ ID NO: 591112 - RNA, 23 nt, Escherichia coli CFT073
acagguaaauuccuguagcggaa

SEQ ID NO: 591113 - RNA, 15 nt, Escherichia coli CFT073
acaggggaucgacgc

SEQ ID NO: 591114 - RNA, 17 nt, Escherichia coli CFT073
acauaucccaccagcgc

SEQ ID NO: 591115 - RNA, 16 nt, Escherichia coli CFT073
acauaugcacaugaug

SEQ ID NO: 591116 - RNA, 14 nt, Escherichia coli CFT073
acaucaaacuguuc

SEQ ID NO: 591117 - RNA, 16 nt, Escherichia coli CFT073
acaucaaagaaaagca

SEQ ID NO: 591118 - RNA, 22 nt, Escherichia coli CFT073
acaucaacgccugaugcgacgc

SEQ ID NO: 591119 - RNA, 23 nt, Escherichia coli CFT073
acaucaauucagaaauaaucacc

SEQ ID NO: 591120 - RNA, 18 nt, Escherichia coli CFT073
acaucaaauacagcuuaa

SEQ ID NO: 591121 - RNA, 13 nt, Escherichia coli CFT073
acaucacgccacu

SEQ ID NO: 591122 - RNA, 14 nt, Escherichia coli CFT073
acaucagugauaca

SEQ ID NO: 591123 - RNA, 14 nt, Escherichia coli CFT073
acaucaucaucgcg

SEQ ID NO: 591124 - RNA, 13 nt, Escherichia coli CFT073
acaucaucagaaa

SEQ ID NO: 591125 - RNA, 19 nt, Escherichia coli CFT073
acaucauccccaucgccgc

SEQ ID NO: 591126 - RNA, 23 nt, Escherichia coli CFT073
acaucaggcagaacgccaugcca

SEQ ID NO: 591127 - RNA, 21 nt, Escherichia coli CFT073
acaucacguaaauguggcgga

SEQ ID NO: 591128 - RNA, 17 nt, Escherichia coli CFT073
acaucacugcaaauacc

SEQ ID NO: 591129 - RNA, 14 nt, Escherichia coli CFT073
acauaggcgcucac

SEQ ID NO: 591130 - RNA, 20 nt, Escherichia coli CFT073
acauacucaucuuccgggca

SEQ ID NO: 591131 - RNA, 18 nt, Escherichia coli CFT073
acauaccagcagcaucac

SEQ ID NO: 591132 - RNA, 15 nt, Escherichia coli CFT073
acauagacgccaccc

SEQ ID NO: 591133 - RNA, 18 nt, Escherichia coli CFT073
acauagacgccacccgau

SEQ ID NO: 591134 - RNA, 14 nt, Escherichia coli CFT073
acauagccaucccu

SEQ ID NO: 591135 - RNA, 21 nt, Escherichia coli CFT073
acagugacccgcagccagcac

SEQ ID NO: 591136 - RNA, 22 nt, Escherichia coli CFT073
acagugccgcgcauagcaccac

SEQ ID NO: 591137 - RNA, 21 nt, Escherichia coli CFT073
acauaauuuuucuuuaacauc

SEQ ID NO: 591138 - RNA, 13 nt, Escherichia coli CFT073
acaaaccaccgaa

SEQ ID NO: 591139 - RNA, 12 nt, Escherichia coli CFT073
acaaacaucauc

SEQ ID NO: 591140 - RNA, 18 nt, Escherichia coli CFT073
acaaacgcaaaacugccu

SEQ ID NO: 591141 - RNA, 18 nt, Escherichia coli CFT073
acaaacgcaaacaccagc

SEQ ID NO: 591142 - RNA, 19 nt, Escherichia coli CFT073
acaaacgcaaacaccagcu

SEQ ID NO: 591143 - RNA, 14 nt, Escherichia coli CFT073
acaaaaucccggcg

SEQ ID NO: 591144 - RNA, 17 nt, Escherichia coli CFT073
acaaaaugccagcaacu

SEQ ID NO: 591145 - RNA, 15 nt, Escherichia coli CFT073
acaaaauugccgcua

SEQ ID NO: 591146 - RNA, 15 nt, Escherichia coli CFT073
aauuugucgccaacu

SEQ ID NO: 591147 - RNA, 15 nt, Escherichia coli CFT073
acagccaaaucauca

SEQ ID NO: 591148 - RNA, 19 nt, Escherichia coli CFT073
acagccaaucauaaacgcc

SEQ ID NO: 591149 - RNA, 12 nt, Escherichia coli CFT073
acaaacgccacc

SEQ ID NO: 591150 - RNA, 17 nt, Escherichia coli CFT073
acaaacgccggauggca

SEQ ID NO: 591151 - RNA, 20 nt, Escherichia coli CFT073
acagcccgccaaugccgcgc

SEQ ID NO: 591152 - RNA, 15 nt, Escherichia coli CFT073
acagcccgccgccau

SEQ ID NO: 591153 - RNA, 17 nt, Escherichia coli CFT073
acagccccaguuccuua

SEQ ID NO: 591154 - RNA, 22 nt, Escherichia coli CFT073
acagccaugccgccaccaccag

SEQ ID NO: 591155 - RNA, 23 nt, Escherichia coli CFT073
acagccaugccgccaccaccagc

SEQ ID NO: 591156 - RNA, 23 nt, Escherichia coli CFT073
acagccagcagcgaaucagccca

SEQ ID NO: 591157 - RNA, 17 nt, Escherichia coli CFT073
acagcguuucauuacua

SEQ ID NO: 591158 - RNA, 17 nt, Escherichia coli CFT073
acagcuauaccgccagg

SEQ ID NO: 591159 - RNA, 17 nt, Escherichia coli CFT073
acagcgucgcaucaggc

SEQ ID NO: 591160 - RNA, 21 nt, Escherichia coli CFT073
acagccgggagugaauucauc

SEQ ID NO: 591161 - RNA, 15 nt, Escherichia coli CFT073
acagccccaccagca

SEQ ID NO: 591162 - RNA, 23 nt, Escherichia coli CFT073
acauugccggaagcgccaccagc

SEQ ID NO: 591163 - RNA, 20 nt, Escherichia coli CFT073
acauugaugaaaagauuaac

SEQ ID NO: 591164 - RNA, 20 nt, Escherichia coli CFT073
acauugccaccaccagcgua

SEQ ID NO: 591165 - RNA, 14 nt, Escherichia coli CFT073
acauucuccgccga

SEQ ID NO: 591166 - RNA, 16 nt, Escherichia coli CFT073
acauuacguccaucac

SEQ ID NO: 591167 - RNA, 11 nt, Escherichia coli CFT073
acauucguugc

SEQ ID NO: 591168 - RNA, 21 nt, Escherichia coli CFT073
acaugucaguugcauaccauu

SEQ ID NO: 591169 - RNA, 21 nt, Escherichia coli CFT073
accaaagcgguaguuaagauu

SEQ ID NO: 591170 - RNA, 20 nt, Escherichia coli CFT073
accaaacguggucgccagca

SEQ ID NO: 591171 - RNA, 12 nt, Escherichia coli CFT073
accaaacugcuc

SEQ ID NO: 591172 - RNA, 15 nt, Escherichia coli CFT073
acauuuuccaucacg

SEQ ID NO: 591173 - RNA, 20 nt, Escherichia coli CFT073
acauuuuaaccguggugcgu

SEQ ID NO: 591174 - RNA, 19 nt, Escherichia coli CFT073
acauuuauuucaacgacau

SEQ ID NO: 591175 - RNA, 18 nt, Escherichia coli CFT073
acauuuccguaauaucuu

SEQ ID NO: 591176 - RNA, 20 nt, Escherichia coli CFT073
acauugcgccucaccggaua

SEQ ID NO: 591177 - RNA, 16 nt, Escherichia coli CFT073
accaauccgccagcca

SEQ ID NO: 591178 - RNA, 16 nt, Escherichia coli CFT073
accaaucgcgggcaac

SEQ ID NO: 591179 - RNA, 14 nt, Escherichia coli CFT073
accaagccaagcca

SEQ ID NO: 591180 - RNA, 15 nt, Escherichia coli CFT073
accaagccugcuggc

SEQ ID NO: 591181 - RNA, 18 nt, Escherichia coli CFT073
accaaggaagcuuucgca

SEQ ID NO: 591182 - RNA, 23 nt, Escherichia coli CFT073
accaacuccaguggcgcaucagc

SEQ ID NO: 591183 - RNA, 21 nt, Escherichia coli CFT073
accaacugugccgcgaccacc

SEQ ID NO: 591184 - RNA, 12 nt, Escherichia coli CFT073
accaagaaagau

SEQ ID NO: 591185 - RNA, 12 nt, Escherichia coli CFT073
accaacgcgccg

SEQ ID NO: 591186 - RNA, 12 nt, Escherichia coli CFT073
accaacgcaccc

SEQ ID NO: 591187 - RNA, 13 nt, Escherichia coli CFT073
accaacgcacccg

SEQ ID NO: 591188 - RNA, 18 nt, Escherichia coli CFT073
accaacgccccguaaauc

SEQ ID NO: 591189 - RNA, 17 nt, Escherichia coli CFT073
accaaaguagauaaucg

SEQ ID NO: 591190 - RNA, 19 nt, Escherichia coli CFT073
accaaaguuaaucagcgcc

SEQ ID NO: 591191 - RNA, 17 nt, Escherichia coli CFT073
accaaaucgaaaugaug

SEQ ID NO: 591192 - RNA, 15 nt, Escherichia coli CFT073
accaaaugcagcaac

SEQ ID NO: 591193 - RNA, 18 nt, Escherichia coli CFT073
accaacaccuaccggcug

SEQ ID NO: 591194 - RNA, 19 nt, Escherichia coli CFT073
accaacaccuaccggcugg

SEQ ID NO: 591195 - RNA, 13 nt, Escherichia coli CFT073
accaaccaccgcc

SEQ ID NO: 591196 - RNA, 15 nt, Escherichia coli CFT073
accaaccaucauccc

SEQ ID NO: 591197 - RNA, 16 nt, Escherichia coli CFT073
accaaccgcaauaacc

SEQ ID NO: 591198 - RNA, 19 nt, Escherichia coli CFT073
acaucugccccauugcuga

SEQ ID NO: 591199 - RNA, 23 nt, Escherichia coli CFT073
acaucugguaauugacgccauca

SEQ ID NO: 591200 - RNA, 17 nt, Escherichia coli CFT073
acaucuuaauagcugcc

SEQ ID NO: 591201 - RNA, 15 nt, Escherichia coli CFT073
acaugacaccaagca

SEQ ID NO: 591202 - RNA, 21 nt, Escherichia coli CFT073
acaugauacgccugcuggcua

SEQ ID NO: 591203 - RNA, 18 nt, Escherichia coli CFT073
acaugaucauucaccagc

SEQ ID NO: 591204 - RNA, 16 nt, Escherichia coli CFT073
acaugacgcgcaucac

SEQ ID NO: 591205 - RNA, 16 nt, Escherichia coli CFT073
acaugagauccagcga

SEQ ID NO: 591206 - RNA, 20 nt, Escherichia coli CFT073
acauggucaucaucauuaac

SEQ ID NO: 591207 - RNA, 21 nt, Escherichia coli CFT073
acaugcuuuugcgccaucgac

SEQ ID NO: 591208 - RNA, 21 nt, Escherichia coli CFT073
acauggcccaguguuuuaccg

SEQ ID NO: 591209 - RNA, 16 nt, Escherichia coli CFT073
acaugcccuucacgua

SEQ ID NO: 591210 - RNA, 22 nt, Escherichia coli CFT073
acaugcacgcccgcagcggaau

SEQ ID NO: 591211 - RNA, 14 nt, Escherichia coli CFT073
acaugcauaaagcg

SEQ ID NO: 591212 - RNA, 23 nt, Escherichia coli CFT073
acauccggcaaaccaugccggau

SEQ ID NO: 591213 - RNA, 14 nt, Escherichia coli CFT073
acauccaucugcuu

SEQ ID NO: 591214 - RNA, 22 nt, Escherichia coli CFT073
acaucccagcagagaucuuuca

SEQ ID NO: 591215 - RNA, 12 nt, Escherichia coli CFT073
acauccccagcg

SEQ ID NO: 591216 - RNA, 14 nt, Escherichia coli CFT073
acaucauugccgcc

SEQ ID NO: 591217 - RNA, 23 nt, Escherichia coli CFT073
acauccaccagcgccucuuccag

SEQ ID NO: 591218 - RNA, 12 nt, Escherichia coli CFT073
acauccagcggc

SEQ ID NO: 591219 - RNA, 14 nt, Escherichia coli CFT073
acaucgucugcggu

SEQ ID NO: 591220 - RNA, 18 nt, Escherichia coli CFT073
acaucgcgcuggcgcagc

SEQ ID NO: 591221 - RNA, 16 nt, Escherichia coli CFT073
acaucgcugugcugcu

SEQ ID NO: 591222 - RNA, 20 nt, Escherichia coli CFT073
acaucgcccugauggcgcgc

SEQ ID NO: 591223 - RNA, 23 nt, Escherichia coli CFT073
acaucgccauauuggggaugacg

SEQ ID NO: 591224 - RNA, 18 nt, Escherichia coli CFT073
accacuuguagaccagga

SEQ ID NO: 591225 - RNA, 17 nt, Escherichia coli CFT073
accacuuuacgcaaaau

SEQ ID NO: 591226 - RNA, 21 nt, Escherichia coli CFT073
accacuuuacgggcaaucucc

SEQ ID NO: 591227 - RNA, 16 nt, Escherichia coli CFT073
accagaaacgccacca

SEQ ID NO: 591228 - RNA, 16 nt, Escherichia coli CFT073
accagaaccagcaacc

SEQ ID NO: 591229 - RNA, 19 nt, Escherichia coli CFT073
accagaaucgccagcaucg

SEQ ID NO: 591230 - RNA, 12 nt, Escherichia coli CFT073
accagaucgccu

SEQ ID NO: 591231 - RNA, 13 nt, Escherichia coli CFT073
accagacgcgcgu

SEQ ID NO: 591232 - RNA, 14 nt, Escherichia coli CFT073
accagauaaacauc

SEQ ID NO: 591233 - RNA, 19 nt, Escherichia coli CFT073
accagacaucaaguaaccu

SEQ ID NO: 591234 - RNA, 18 nt, Escherichia coli CFT073
accacuaucaaccacggc

SEQ ID NO: 591235 - RNA, 21 nt, Escherichia coli CFT073
accacuaucaaccacggcaac

SEQ ID NO: 591236 - RNA, 13 nt, Escherichia coli CFT073
accacuggcgacg

SEQ ID NO: 591237 - RNA, 21 nt, Escherichia coli CFT073
accacuucauacuccgucugc

SEQ ID NO: 591238 - RNA, 21 nt, Escherichia coli CFT073
accacuucauccggauacagc

SEQ ID NO: 591239 - RNA, 23 nt, Escherichia coli CFT073
accacuccgguaauaucgcgcag

SEQ ID NO: 591240 - RNA, 19 nt, Escherichia coli CFT073
accacugauggaauuucau

SEQ ID NO: 591241 - RNA, 14 nt, Escherichia coli CFT073
accacugcgccgcu

SEQ ID NO: 591242 - RNA, 16 nt, Escherichia coli CFT073
accagcaaugccagcg

SEQ ID NO: 591243 - RNA, 23 nt, Escherichia coli CFT073
accagcaacgcuucaaccagugc

SEQ ID NO: 591244 - RNA, 16 nt, Escherichia coli CFT073
accagcaccgccagca

SEQ ID NO: 591245 - RNA, 18 nt, Escherichia coli CFT073
accagcaccgccagcagc

SEQ ID NO: 591246 - RNA, 21 nt, Escherichia coli CFT073
accagcaccuuuuccaguggc

SEQ ID NO: 591247 - RNA, 15 nt, Escherichia coli CFT073
accagcagcaucacg

SEQ ID NO: 591248 - RNA, 17 nt, Escherichia coli CFT073
accagcauuagcauuaa

SEQ ID NO: 591249 - RNA, 14 nt, Escherichia coli CFT073
accagcaucgccgg

SEQ ID NO: 591250 - RNA, 16 nt, Escherichia coli CFT073
accagcaguaaaccgc

SEQ ID NO: 591251 - RNA, 18 nt, Escherichia coli CFT073
accagcaguaaaccgcuc

SEQ ID NO: 591252 - RNA, 19 nt, Escherichia coli CFT073
accagcaggaaucccauca

SEQ ID NO: 591253 - RNA, 23 nt, Escherichia coli CFT073
accagcaggaaucccaucagacg

SEQ ID NO: 591254 - RNA, 16 nt, Escherichia coli CFT073
accagcagcgccggau

SEQ ID NO: 591255 - RNA, 13 nt, Escherichia coli CFT073
accagcuaccacg

SEQ ID NO: 591256 - RNA, 23 nt, Escherichia coli CFT073
accagcgucauaaaaauccgguu

SEQ ID NO: 591257 - RNA, 14 nt, Escherichia coli CFT073
accagcgcugcggc

SEQ ID NO: 591258 - RNA, 14 nt, Escherichia coli CFT073
accagcggcaacau

SEQ ID NO: 591259 - RNA, 16 nt, Escherichia coli CFT073
accagcggcaacauca

SEQ ID NO: 591260 - RNA, 21 nt, Escherichia coli CFT073
accagcggcaacaucaucacg

SEQ ID NO: 591261 - RNA, 22 nt, Escherichia coli CFT073
accagcggcaacaucaucacgc

SEQ ID NO: 591262 - RNA, 18 nt, Escherichia coli CFT073
accagcggccagacgcgc

SEQ ID NO: 591263 - RNA, 23 nt, Escherichia coli CFT073
accagcggccagacgcgccgcca

SEQ ID NO: 591264 - RNA, 14 nt, Escherichia coli CFT073
accagccuugugcc

SEQ ID NO: 591265 - RNA, 15 nt, Escherichia coli CFT073
accagcgaaacgcaa

SEQ ID NO: 591266 - RNA, 18 nt, Escherichia coli CFT073
accagcgcacugccgcca

SEQ ID NO: 591267 - RNA, 19 nt, Escherichia coli CFT073
accagcgcacugccgccau

SEQ ID NO: 591268 - RNA, 16 nt, Escherichia coli CFT073
accagcgcagacacca

SEQ ID NO: 591269 - RNA, 19 nt, Escherichia coli CFT073
accagccauuaaccagcca

SEQ ID NO: 591270 - RNA, 23 nt, Escherichia coli CFT073
accagccauuaaccagccacugc

SEQ ID NO: 591271 - RNA, 14 nt, Escherichia coli CFT073
accagccacggcgc

SEQ ID NO: 591272 - RNA, 18 nt, Escherichia coli CFT073
accagccaaauaaaaucc

SEQ ID NO: 591273 - RNA, 12 nt, Escherichia coli CFT073
accagccaacaa

SEQ ID NO: 591274 - RNA, 18 nt, Escherichia coli CFT073
accacauacugcuugcca

SEQ ID NO: 591275 - RNA, 16 nt, Escherichia coli CFT073
accacagugacccgca

SEQ ID NO: 591276 - RNA, 16 nt, Escherichia coli CFT073
accacaccugccacca

SEQ ID NO: 591277 - RNA, 19 nt, Escherichia coli CFT073
accacacgacgcgccagca

SEQ ID NO: 591278 - RNA, 20 nt, Escherichia coli CFT073
accacaccgccuaccgccag

SEQ ID NO: 591279 - RNA, 19 nt, Escherichia coli CFT073
accaaugccgccagggaua

SEQ ID NO: 591280 - RNA, 12 nt, Escherichia coli CFT073
accaaugaauuu

SEQ ID NO: 591281 - RNA, 14 nt, Escherichia coli CFT073
accaaugccaccca

SEQ ID NO: 591282 - RNA, 15 nt, Escherichia coli CFT073
accaauggccaaugc

SEQ ID NO: 591283 - RNA, 18 nt, Escherichia coli CFT073
accaauugccgcaccaac

SEQ ID NO: 591284 - RNA, 14 nt, Escherichia coli CFT073
accacaaaagcggu

SEQ ID NO: 591285 - RNA, 13 nt, Escherichia coli CFT073
accacaaacgccg

SEQ ID NO: 591286 - RNA, 22 nt, Escherichia coli CFT073
accacaaauaccccaccgccga

SEQ ID NO: 591287 - RNA, 20 nt, Escherichia coli CFT073
accaccagcgccaccacgcc

SEQ ID NO: 591288 - RNA, 14 nt, Escherichia coli CFT073
accaccagcgccau

SEQ ID NO: 591289 - RNA, 12 nt, Escherichia coli CFT073
accaccagcgga

SEQ ID NO: 591290 - RNA, 16 nt, Escherichia coli CFT073
accaccacgaccacga

SEQ ID NO: 591291 - RNA, 18 nt, Escherichia coli CFT073
accacauucugcauugcg

SEQ ID NO: 591292 - RNA, 23 nt, Escherichia coli CFT073
accaccaaauaaaaaaacgccag

SEQ ID NO: 591293 - RNA, 20 nt, Escherichia coli CFT073
accaccgcaaucgcggcagc

SEQ ID NO: 591294 - RNA, 17 nt, Escherichia coli CFT073
accaccgcagcaaccgu

SEQ ID NO: 591295 - RNA, 18 nt, Escherichia coli CFT073
accaccgauaaaauaauc

SEQ ID NO: 591296 - RNA, 21 nt, Escherichia coli CFT073
accaccgauaaaauaaucacc

SEQ ID NO: 591297 - RNA, 20 nt, Escherichia coli CFT073
accaccgcuaacugcugcgg

SEQ ID NO: 591298 - RNA, 16 nt, Escherichia coli CFT073
accaccgacgggccug

SEQ ID NO: 591299 - RNA, 17 nt, Escherichia coli CFT073
accacccagcgguaaaa

SEQ ID NO: 591300 - RNA, 18 nt, Escherichia coli CFT073
accacccagaacacgccg

SEQ ID NO: 591301 - RNA, 20 nt, Escherichia coli CFT073
accaccuuacuuacacauca

SEQ ID NO: 591302 - RNA, 14 nt, Escherichia coli CFT073
accacgauauccgc

SEQ ID NO: 591303 - RNA, 15 nt, Escherichia coli CFT073
accacgccaaccauc

SEQ ID NO: 591304 - RNA, 13 nt, Escherichia coli CFT073
accacgccagccg

SEQ ID NO: 591305 - RNA, 12 nt, Escherichia coli CFT073
accacgccagug

SEQ ID NO: 591306 - RNA, 20 nt, Escherichia coli CFT073
accacgguuuuuugcagcaa

SEQ ID NO: 591307 - RNA, 17 nt, Escherichia coli CFT073
accacggccuuccucgg

SEQ ID NO: 591308 - RNA, 22 nt, Escherichia coli CFT073
accacgcugcgcugcaccagua

SEQ ID NO: 591309 - RNA, 15 nt, Escherichia coli CFT073
accacggcaacgccg

SEQ ID NO: 591310 - RNA, 16 nt, Escherichia coli CFT073
accacgcgcauuaccu

SEQ ID NO: 591311 - RNA, 18 nt, Escherichia coli CFT073
aaucaucacgaucacggu

SEQ ID NO: 591312 - RNA, 11 nt, Escherichia coli CFT073
aaucaugacgc

SEQ ID NO: 591313 - RNA, 16 nt, Escherichia coli CFT073
aaucaucauaucguca

SEQ ID NO: 591314 - RNA, 12 nt, Escherichia coli CFT073
aaucaucaugcu

SEQ ID NO: 591315 - RNA, 21 nt, Escherichia coli CFT073
aauccaauaaaaaucagauau

SEQ ID NO: 591316 - RNA, 17 nt, Escherichia coli CFT073
aaucauucgcagcugca

SEQ ID NO: 591317 - RNA, 17 nt, Escherichia coli CFT073
aaucaugcuccgcacgc

SEQ ID NO: 591318 - RNA, 18 nt, Escherichia coli CFT073
aaucauugauaauaacgu

SEQ ID NO: 591319 - RNA, 17 nt, Escherichia coli CFT073
aaucauuguuuucauua

SEQ ID NO: 591320 - RNA, 23 nt, Escherichia coli CFT073
aauccacguuccuggaaccagug

SEQ ID NO: 591321 - RNA, 15 nt, Escherichia coli CFT073
aauccagacugcgca

SEQ ID NO: 591322 - RNA, 20 nt, Escherichia coli CFT073
aauccagacugcgcauuaaa

SEQ ID NO: 591323 - RNA, 14 nt, Escherichia coli CFT073
aauccagucuuucg

SEQ ID NO: 591324 - RNA, 13 nt, Escherichia coli CFT073
aauccccacugca

SEQ ID NO: 591325 - RNA, 15 nt, Escherichia coli CFT073
aaucccgccaucggc

SEQ ID NO: 591326 - RNA, 15 nt, Escherichia coli CFT073
aaucccggcgcagcg

SEQ ID NO: 591327 - RNA, 19 nt, Escherichia coli CFT073
aaucccguaggauuucuuc

SEQ ID NO: 591328 - RNA, 18 nt, Escherichia coli CFT073
aaucccuuuacaggcgug

SEQ ID NO: 591329 - RNA, 17 nt, Escherichia coli CFT073
aauccgcaccaacucca

SEQ ID NO: 591330 - RNA, 12 nt, Escherichia coli CFT073
aauccgccaccg

SEQ ID NO: 591331 - RNA, 12 nt, Escherichia coli CFT073
aauccgccgcca

SEQ ID NO: 591332 - RNA, 13 nt, Escherichia coli CFT073
aauccgccgccac

SEQ ID NO: 591333 - RNA, 14 nt, Escherichia coli CFT073
aauagcugccagcc

SEQ ID NO: 591334 - RNA, 19 nt, Escherichia coli CFT073
aauagcgucuacuaacgcu

SEQ ID NO: 591335 - RNA, 14 nt, Escherichia coli CFT073
aauagcuuuaccca

SEQ ID NO: 591336 - RNA, 19 nt, Escherichia coli CFT073
aauaggcauauagccgcca

SEQ ID NO: 591337 - RNA, 23 nt, Escherichia coli CFT073
aauagguguuaauggaauaacga

SEQ ID NO: 591338 - RNA, 14 nt, Escherichia coli CFT073
aauagucaucacuu

SEQ ID NO: 591339 - RNA, 13 nt, Escherichia coli CFT073
aauagucgccagc

SEQ ID NO: 591340 - RNA, 20 nt, Escherichia coli CFT073
aauagucgccagcucugcgc

SEQ ID NO: 591341 - RNA, 16 nt, Escherichia coli CFT073
aauagcgaacagacaa

SEQ ID NO: 591342 - RNA, 18 nt, Escherichia coli CFT073
aauagcggaaaucuccag

SEQ ID NO: 591343 - RNA, 16 nt, Escherichia coli CFT073
aauagcaaaauauaaa

SEQ ID NO: 591344 - RNA, 12 nt, Escherichia coli CFT073
aauagccagcgc

SEQ ID NO: 591345 - RNA, 21 nt, Escherichia coli CFT073
aaucacuuucugcgccagcga

SEQ ID NO: 591346 - RNA, 14 nt, Escherichia coli CFT073
aaucagaaucgcgc

SEQ ID NO: 591347 - RNA, 18 nt, Escherichia coli CFT073
aaucagauggcggcuggc

SEQ ID NO: 591348 - RNA, 23 nt, Escherichia coli CFT073
aaucagcacuacugccagauucu

SEQ ID NO: 591349 - RNA, 16 nt, Escherichia coli CFT073
aaucagcaucaacccg

SEQ ID NO: 591350 - RNA, 22 nt, Escherichia coli CFT073
aaucagcgagauaaugcgccag

SEQ ID NO: 591351 - RNA, 14 nt, Escherichia coli CFT073
aaucagcgcggaac

SEQ ID NO: 591352 - RNA, 16 nt, Escherichia coli CFT073
aaucagcguuucgcca

SEQ ID NO: 591353 - RNA, 23 nt, Escherichia coli CFT073
aaucaggcaaacgcccuuaccuu

SEQ ID NO: 591354 - RNA, 20 nt, Escherichia coli CFT073
aaucagguaagcgaaggugc

SEQ ID NO: 591355 - RNA, 21 nt, Escherichia coli CFT073
aaucaggcgauuagcgauaaa

SEQ ID NO: 591356 - RNA, 21 nt, Escherichia coli CFT073
aaucagugccgcgccgcgcgg

SEQ ID NO: 591357 - RNA, 20 nt, Escherichia coli CFT073
aaucguuugcauccggcacg

SEQ ID NO: 591358 - RNA, 12 nt, Escherichia coli CFT073
aaucucaccagg

SEQ ID NO: 591359 - RNA, 13 nt, Escherichia coli CFT073
aaucgucgcagac

SEQ ID NO: 591360 - RNA, 16 nt, Escherichia coli CFT073
aaucguugcccgcaga

SEQ ID NO: 591361 - RNA, 15 nt, Escherichia coli CFT073
aaucguaugaucauc

SEQ ID NO: 591362 - RNA, 21 nt, Escherichia coli CFT073
aaucgguuuguaagcgggcaa

SEQ ID NO: 591363 - RNA, 19 nt, Escherichia coli CFT073
aaucgucaggaucagccau

SEQ ID NO: 591364 - RNA, 14 nt, Escherichia coli CFT073
aaucggugauaaau

SEQ ID NO: 591365 - RNA, 16 nt, Escherichia coli CFT073
aaucggugcuggcggc

SEQ ID NO: 591366 - RNA, 15 nt, Escherichia coli CFT073
aaucguaaucagcau

SEQ ID NO: 591367 - RNA, 15 nt, Escherichia coli CFT073
aaucggccuuccaua

SEQ ID NO: 591368 - RNA, 13 nt, Escherichia coli CFT073
aaucggcgcggcg

SEQ ID NO: 591369 - RNA, 15 nt, Escherichia coli CFT073
aaucggcaacaucaa

SEQ ID NO: 591370 - RNA, 16 nt, Escherichia coli CFT073
aaucggcaccgccgcc

SEQ ID NO: 591371 - RNA, 17 nt, Escherichia coli CFT073
aaucggcaccgccgcca

SEQ ID NO: 591372 - RNA, 13 nt, Escherichia coli CFT073
aaucgcgccccac

SEQ ID NO: 591373 - RNA, 12 nt, Escherichia coli CFT073
aaucgcggcagc

SEQ ID NO: 591374 - RNA, 18 nt, Escherichia coli CFT073
aaucgcgggcaacgucgc

SEQ ID NO: 591375 - RNA, 14 nt, Escherichia coli CFT073
aaucgcguuuuaca

SEQ ID NO: 591376 - RNA, 16 nt, Escherichia coli CFT073
aaucgcuauuaacccg

SEQ ID NO: 591377 - RNA, 17 nt, Escherichia coli CFT073
aaucggaugacccagcg

SEQ ID NO: 591378 - RNA, 13 nt, Escherichia coli CFT073
aaucgauaacccc

SEQ ID NO: 591379 - RNA, 21 nt, Escherichia coli CFT073
aaucgauuuucucaccauugg

SEQ ID NO: 591380 - RNA, 13 nt, Escherichia coli CFT073
aaucgcaaauaug

SEQ ID NO: 591381 - RNA, 14 nt, Escherichia coli CFT073
aaucgcaaccagcc

SEQ ID NO: 591382 - RNA, 14 nt, Escherichia coli CFT073
aaucgccuccagcg

SEQ ID NO: 591383 - RNA, 18 nt, Escherichia coli CFT073
aaucgcccccaucaccgg

SEQ ID NO: 591384 - RNA, 17 nt, Escherichia coli CFT073
aaucgccgaaauuucgc

SEQ ID NO: 591385 - RNA, 15 nt, Escherichia coli CFT073
aaucgccgaaccagu

SEQ ID NO: 591386 - RNA, 20 nt, Escherichia coli CFT073
aaucgcaacgguucugcugc

SEQ ID NO: 591387 - RNA, 19 nt, Escherichia coli CFT073
aaucgcagccacguuaaua

SEQ ID NO: 591388 - RNA, 20 nt, Escherichia coli CFT073
aaucgccacaacuucaacgu

SEQ ID NO: 591389 - RNA, 21 nt, Escherichia coli CFT073
aaucgccacgccaaaaagcgu

SEQ ID NO: 591390 - RNA, 14 nt, Escherichia coli CFT073
aaucgccagauccg

SEQ ID NO: 591391 - RNA, 21 nt, Escherichia coli CFT073
aaucgccagcaaaaucaccau

SEQ ID NO: 591392 - RNA, 16 nt, Escherichia coli CFT073
aaucgccagcggcagc

SEQ ID NO: 591393 - RNA, 19 nt, Escherichia coli CFT073
aauccuggcagcaucagac

SEQ ID NO: 591394 - RNA, 20 nt, Escherichia coli CFT073
aaucgacaaugugaaaaccc

SEQ ID NO: 591395 - RNA, 14 nt, Escherichia coli CFT073
aauccgcgauaacg

SEQ ID NO: 591396 - RNA, 16 nt, Escherichia coli CFT073
aauccucaacgccgca

SEQ ID NO: 591397 - RNA, 14 nt, Escherichia coli CFT073
aauccguaaucgcu

SEQ ID NO: 591398 - RNA, 17 nt, Escherichia coli CFT073
aauccgucgcgccaggc

SEQ ID NO: 591399 - RNA, 23 nt, Escherichia coli CFT073
aauccguuauguuucauccaggc

SEQ ID NO: 591400 - RNA, 21 nt, Escherichia coli CFT073
aauggcacguugcugcggcgu

SEQ ID NO: 591401 - RNA, 18 nt, Escherichia coli CFT073
aauggcauauuccgccac

SEQ ID NO: 591402 - RNA, 15 nt, Escherichia coli CFT073
aauggcauccgccac

SEQ ID NO: 591403 - RNA, 22 nt, Escherichia coli CFT073
aaugccggaugcgacgcuagcc

SEQ ID NO: 591404 - RNA, 23 nt, Escherichia coli CFT073
aaugccggguaaagauuguucuu

SEQ ID NO: 591405 - RNA, 17 nt, Escherichia coli CFT073
aaugccguaaccagcgc

SEQ ID NO: 591406 - RNA, 18 nt, Escherichia coli CFT073
aaugccuucaaaucgccc

SEQ ID NO: 591407 - RNA, 16 nt, Escherichia coli CFT073
aaugccuuuuccagcg

SEQ ID NO: 591408 - RNA, 14 nt, Escherichia coli CFT073
aauggccaaugcgg

SEQ ID NO: 591409 - RNA, 14 nt, Escherichia coli CFT073
aauggcccgcgcag

SEQ ID NO: 591410 - RNA, 20 nt, Escherichia coli CFT073
aauggucuugacauccagcg

SEQ ID NO: 591411 - RNA, 13 nt, Escherichia coli CFT073
aauggugaccugc

SEQ ID NO: 591412 - RNA, 22 nt, Escherichia coli CFT073
aaugguguccaaaugcagcacg

SEQ ID NO: 591413 - RNA, 21 nt, Escherichia coli CFT073
aaugguuuccagcaucgacca

SEQ ID NO: 591414 - RNA, 14 nt, Escherichia coli CFT073
aauguaaccacagg

SEQ ID NO: 591415 - RNA, 19 nt, Escherichia coli CFT073
aaugaugcaccaccugauu

SEQ ID NO: 591416 - RNA, 14 nt, Escherichia coli CFT073
aaugaucacuggaa

SEQ ID NO: 591417 - RNA, 22 nt, Escherichia coli CFT073
aaugagcgauuuguaggccuga

SEQ ID NO: 591418 - RNA, 23 nt, Escherichia coli CFT073
aaugaggcacgacacaaugccau

SEQ ID NO: 591419 - RNA, 18 nt, Escherichia coli CFT073
aaugauaaguccgaugcc

SEQ ID NO: 591420 - RNA, 13 nt, Escherichia coli CFT073
aaugauaugugca

SEQ ID NO: 591421 - RNA, 14 nt, Escherichia coli CFT073
aaugccgcgcccca

SEQ ID NO: 591422 - RNA, 12 nt, Escherichia coli CFT073
aaugccgcaacu

SEQ ID NO: 591423 - RNA, 15 nt, Escherichia coli CFT073
aaucugaaaccagcg

SEQ ID NO: 591424 - RNA, 13 nt, Escherichia coli CFT073
aaucugcaaaaua

SEQ ID NO: 591425 - RNA, 14 nt, Escherichia coli CFT073
aaucucuucaccau

SEQ ID NO: 591426 - RNA, 19 nt, Escherichia coli CFT073
aaucugcucuggcagcacc

SEQ ID NO: 591427 - RNA, 22 nt, Escherichia coli CFT073
aaucugcuugcgauguucuuca

SEQ ID NO: 591428 - RNA, 17 nt, Escherichia coli CFT073
aaucuucacaucaucau

SEQ ID NO: 591429 - RNA, 14 nt, Escherichia coli CFT073
aaucuuccucgcca

SEQ ID NO: 591430 - RNA, 12 nt, Escherichia coli CFT073
aaucuggcgcgc

SEQ ID NO: 591431 - RNA, 12 nt, Escherichia coli CFT073
aauuugccagcg

SEQ ID NO: 591432 - RNA, 22 nt, Escherichia coli CFT073
aauuugccaggcuugauccagc

SEQ ID NO: 591433 - RNA, 21 nt, Escherichia coli CFT073
aauuugccaucucugcaacgu

SEQ ID NO: 591434 - RNA, 14 nt, Escherichia coli CFT073
aauuugcuccgcca

SEQ ID NO: 591435 - RNA, 13 nt, Escherichia coli CFT073
aauuucagcaaua

SEQ ID NO: 591436 - RNA, 13 nt, Escherichia coli CFT073
aauuuacccgcca

SEQ ID NO: 591437 - RNA, 23 nt, Escherichia coli CFT073
aauugaaguucguccccaccagu

SEQ ID NO: 591438 - RNA, 19 nt, Escherichia coli CFT073
aauucucccgcccccgcca

SEQ ID NO: 591439 - RNA, 13 nt, Escherichia coli CFT073
aauucguuuucgc

SEQ ID NO: 591440 - RNA, 12 nt, Escherichia coli CFT073
aauucagccauu

SEQ ID NO: 591441 - RNA, 22 nt, Escherichia coli CFT073
aauguuaccgaucgccagcagg

SEQ ID NO: 591442 - RNA, 14 nt, Escherichia coli CFT073
aauuacaccaucac

SEQ ID NO: 591443 - RNA, 20 nt, Escherichia coli CFT073
aaugucgcgaucauggucug

SEQ ID NO: 591444 - RNA, 20 nt, Escherichia coli CFT073
aaugucggaugcggcgugaa

SEQ ID NO: 591445 - RNA, 12 nt, Escherichia coli CFT073
aauguggaaagc

SEQ ID NO: 591446 - RNA, 17 nt, Escherichia coli CFT073
aauguggaaagccccag

SEQ ID NO: 591447 - RNA, 18 nt, Escherichia coli CFT073
aauuacgccgagcgccag

SEQ ID NO: 591448 - RNA, 21 nt, Escherichia coli CFT073
aauuacgccgagcgccagcca

SEQ ID NO: 591449 - RNA, 21 nt, Escherichia coli CFT073
aauuacgccggaaaguuaauu

SEQ ID NO: 591450 - RNA, 14 nt, Escherichia coli CFT073
aauuaccgcaccac

SEQ ID NO: 591451 - RNA, 15 nt, Escherichia coli CFT073
aauuacuguugucga

SEQ ID NO: 591452 - RNA, 15 nt, Escherichia coli CFT073
aauuagcggccagcg

SEQ ID NO: 591453 - RNA, 16 nt, Escherichia coli CFT073
aauuagcuuacgcccg

SEQ ID NO: 591454 - RNA, 16 nt, Escherichia coli CFT073
aauuaguggcuaaccg

SEQ ID NO: 591455 - RNA, 20 nt, Escherichia coli CFT073
aauuaucggcgucgcaucag

SEQ ID NO: 591456 - RNA, 14 nt, Escherichia coli CFT073
aauuauuaccaucg

SEQ ID NO: 591457 - RNA, 21 nt, Escherichia coli CFT073
aauucaacagauuucgaaucu

SEQ ID NO: 591458 - RNA, 17 nt, Escherichia coli CFT073
aauucaacuaacugacu

SEQ ID NO: 591459 - RNA, 19 nt, Escherichia coli CFT073
aauacaggcuacucccagu

SEQ ID NO: 591460 - RNA, 16 nt, Escherichia coli CFT073
aauacagcccgaacug

SEQ ID NO: 591461 - RNA, 21 nt, Escherichia coli CFT073
aauacagcuuaaucaccagcg

SEQ ID NO: 591462 - RNA, 12 nt, Escherichia coli CFT073
aauaauuucuca

SEQ ID NO: 591463 - RNA, 16 nt, Escherichia coli CFT073
aauaccacaaacgccg

SEQ ID NO: 591464 - RNA, 21 nt, Escherichia coli CFT073
aauacaaacucacugccagca

SEQ ID NO: 591465 - RNA, 22 nt, Escherichia coli CFT073
aauaagcacucuggcgaaucgu

SEQ ID NO: 591466 - RNA, 14 nt, Escherichia coli CFT073
aauaccccgccagc

SEQ ID NO: 591467 - RNA, 14 nt, Escherichia coli CFT073
aauacccgccagaa

SEQ ID NO: 591468 - RNA, 14 nt, Escherichia coli CFT073
aauacccgguccuu

SEQ ID NO: 591469 - RNA, 19 nt, Escherichia coli CFT073
aauaccgaagaguaaccaa

SEQ ID NO: 591470 - RNA, 15 nt, Escherichia coli CFT073
aauaccgacaucacg

SEQ ID NO: 591471 - RNA, 23 nt, Escherichia coli CFT073
aauaccggcauguuuaauucugc

SEQ ID NO: 591472 - RNA, 22 nt, Escherichia coli CFT073
aauaccguuccaacgccaccac

SEQ ID NO: 591473 - RNA, 15 nt, Escherichia coli CFT073
aauacgauccugagc

SEQ ID NO: 591474 - RNA, 14 nt, Escherichia coli CFT073
aauaaacaccagca

SEQ ID NO: 591475 - RNA, 19 nt, Escherichia coli CFT073
aauaaacauugguccgauu

SEQ ID NO: 591476 - RNA, 12 nt, Escherichia coli CFT073
aauaaaccacac

SEQ ID NO: 591477 - RNA, 22 nt, Escherichia coli CFT073
aauaaggcguacauccggcaau

SEQ ID NO: 591478 - RNA, 14 nt, Escherichia coli CFT073
aauaagaaaagcga

SEQ ID NO: 591479 - RNA, 20 nt, Escherichia coli CFT073
aauaacucccuauaaugcgc

SEQ ID NO: 591480 - RNA, 11 nt, Escherichia coli CFT073
aauaacgcuua

SEQ ID NO: 591481 - RNA, 15 nt, Escherichia coli CFT073
aagucacuaauugca

SEQ ID NO: 591482 - RNA, 19 nt, Escherichia coli CFT073
aagucagauuagaacugau

SEQ ID NO: 591483 - RNA, 12 nt, Escherichia coli CFT073
aagucaggcaau

SEQ ID NO: 591484 - RNA, 15 nt, Escherichia coli CFT073
aagucaucaauugca

SEQ ID NO: 591485 - RNA, 21 nt, Escherichia coli CFT073
aaguccccgcuucgcccgcca

SEQ ID NO: 591486 - RNA, 21 nt, Escherichia coli CFT073
aaguuugaucggagaacagga

SEQ ID NO: 591487 - RNA, 20 nt, Escherichia coli CFT073
aaguuugcccgucugcugcu

SEQ ID NO: 591488 - RNA, 14 nt, Escherichia coli CFT073
aauaaaaaaugcgc

SEQ ID NO: 591489 - RNA, 21 nt, Escherichia coli CFT073
aaggacagaguguucgccauu

SEQ ID NO: 591490 - RNA, 20 nt, Escherichia coli CFT073
aagcugcugaccaccagcac

SEQ ID NO: 591491 - RNA, 22 nt, Escherichia coli CFT073
aaggcguuaaacuggaaaaccg

SEQ ID NO: 591492 - RNA, 17 nt, Escherichia coli CFT073
aaggcguucaagccgca

SEQ ID NO: 591493 - RNA, 17 nt, Escherichia coli CFT073
aaggcguucacgccgca

SEQ ID NO: 591494 - RNA, 22 nt, Escherichia coli CFT073
aaggcguucacgccgcauccgg

SEQ ID NO: 591495 - RNA, 18 nt, Escherichia coli CFT073
aaggcgcuuggcuuccau

SEQ ID NO: 591496 - RNA, 13 nt, Escherichia coli CFT073
aaguauucgucgc

SEQ ID NO: 591497 - RNA, 18 nt, Escherichia coli CFT073
aaguauggaaaucaccca

SEQ ID NO: 591498 - RNA, 13 nt, Escherichia coli CFT073
aagucaaacugau

SEQ ID NO: 591499 - RNA, 21 nt, Escherichia coli CFT073
aaguaucaaacagaaaaacga

SEQ ID NO: 591500 - RNA, 17 nt, Escherichia coli CFT073
aaguaauuguuucaucg

SEQ ID NO: 591501 - RNA, 12 nt, Escherichia coli CFT073
aaguacauuaaa

SEQ ID NO: 591502 - RNA, 23 nt, Escherichia coli CFT073
aaguaccauugaucgauaagcca

SEQ ID NO: 591503 - RNA, 15 nt, Escherichia coli CFT073
aaguagauaaucgcu

SEQ ID NO: 591504 - RNA, 22 nt, Escherichia coli CFT073
aaguacugauugacgcguucgc

SEQ ID NO: 591505 - RNA, 14 nt, Escherichia coli CFT073
aagguuaaaccgcc

SEQ ID NO: 591506 - RNA, 14 nt, Escherichia coli CFT073
aagguuccaauauu

SEQ ID NO: 591507 - RNA, 20 nt, Escherichia coli CFT073
aagguuucaguaacaucaca

SEQ ID NO: 591508 - RNA, 19 nt, Escherichia coli CFT073
aagguuuuuucuguauuca

SEQ ID NO: 591509 - RNA, 22 nt, Escherichia coli CFT073
aagguuuuuucuguauucaucg

SEQ ID NO: 591510 - RNA, 14 nt, Escherichia coli CFT073
aagcgaacccgcag

SEQ ID NO: 591511 - RNA, 17 nt, Escherichia coli CFT073
aagcgaguuauugauag

SEQ ID NO: 591512 - RNA, 22 nt, Escherichia coli CFT073
aagcgauacgccagacucucgc

SEQ ID NO: 591513 - RNA, 18 nt, Escherichia coli CFT073
aagcgauauccgggcaaa

SEQ ID NO: 591514 - RNA, 13 nt, Escherichia coli CFT073
aagcgacgggcga

SEQ ID NO: 591515 - RNA, 22 nt, Escherichia coli CFT073
aagcgacgugcaguagcagcag

SEQ ID NO: 591516 - RNA, 17 nt, Escherichia coli CFT073
aagccugaugcgacgcu

SEQ ID NO: 591517 - RNA, 23 nt, Escherichia coli CFT073
aagcccgcuucaaacgcugacgg

SEQ ID NO: 591518 - RNA, 13 nt, Escherichia coli CFT073
aagcccgccgcca

SEQ ID NO: 591519 - RNA, 13 nt, Escherichia coli CFT073
aagccccagccca

SEQ ID NO: 591520 - RNA, 14 nt, Escherichia coli CFT073
aagcccccacaaca

SEQ ID NO: 591521 - RNA, 22 nt, Escherichia coli CFT073
aagcccaccccaauguuuuucu

SEQ ID NO: 591522 - RNA, 23 nt, Escherichia coli CFT073
aagcccacgguuucuacaagcag

SEQ ID NO: 591523 - RNA, 12 nt, Escherichia coli CFT073
aagcccagggaa

SEQ ID NO: 591524 - RNA, 15 nt, Escherichia coli CFT073
aagcauaugacgaaa

SEQ ID NO: 591525 - RNA, 17 nt, Escherichia coli CFT073
aagcauaacaaaaugcc

SEQ ID NO: 591526 - RNA, 16 nt, Escherichia coli CFT073
aagcauaaccgagcag

SEQ ID NO: 591527 - RNA, 17 nt, Escherichia coli CFT073
aagcauaaccgagcaga

SEQ ID NO: 591528 - RNA, 15 nt, Escherichia coli CFT073
aagcauuauuuuugc

SEQ ID NO: 591529 - RNA, 22 nt, Escherichia coli CFT073
aagcaucgcuagauauauauua

SEQ ID NO: 591530 - RNA, 16 nt, Escherichia coli CFT073
aagcucucuuccaguu

SEQ ID NO: 591531 - RNA, 18 nt, Escherichia coli CFT073
aagcucucuuccaguucg

SEQ ID NO: 591532 - RNA, 15 nt, Escherichia coli CFT073
aagcugcaucuggcg

SEQ ID NO: 591533 - RNA, 16 nt, Escherichia coli CFT073
aagcugccugcuaaca

SEQ ID NO: 591534 - RNA, 14 nt, Escherichia coli CFT073
aagcgucgcaucag

SEQ ID NO: 591535 - RNA, 21 nt, Escherichia coli CFT073
aagcgucgcauccggcaucaa

SEQ ID NO: 591536 - RNA, 21 nt, Escherichia coli CFT073
aagcgucgccgccgccagcgc

SEQ ID NO: 591537 - RNA, 16 nt, Escherichia coli CFT073
aagcgcucccgcagga

SEQ ID NO: 591538 - RNA, 22 nt, Escherichia coli CFT073
aagcgcgccguaugcgaagcuu

SEQ ID NO: 591539 - RNA, 13 nt, Escherichia coli CFT073
aagcgccgggaau

SEQ ID NO: 591540 - RNA, 22 nt, Escherichia coli CFT073
aagauaaugacuuccgccacca

SEQ ID NO: 591541 - RNA, 16 nt, Escherichia coli CFT073
aagagcggcucuggcg

SEQ ID NO: 591542 - RNA, 17 nt, Escherichia coli CFT073
aagagcgcaccgcgcgg

SEQ ID NO: 591543 - RNA, 18 nt, Escherichia coli CFT073
aacgugccauagcgggca

SEQ ID NO: 591544 - RNA, 20 nt, Escherichia coli CFT073
aacgugccauagcgggcaau

SEQ ID NO: 591545 - RNA, 18 nt, Escherichia coli CFT073
aacgugcggcugugcggu

SEQ ID NO: 591546 - RNA, 15 nt, Escherichia coli CFT073
aacguggucgaaucc

SEQ ID NO: 591547 - RNA, 16 nt, Escherichia coli CFT073
aacguguauaucacca

SEQ ID NO: 591548 - RNA, 16 nt, Escherichia coli CFT073
aacgugucaacgcuuc

SEQ ID NO: 591549 - RNA, 13 nt, Escherichia coli CFT073
aacgugucguuga

SEQ ID NO: 591550 - RNA, 19 nt, Escherichia coli CFT073
aacuacggcuuuuuucauu

SEQ ID NO: 591551 - RNA, 13 nt, Escherichia coli CFT073
aacguugccggau

SEQ ID NO: 591552 - RNA, 21 nt, Escherichia coli CFT073
aacguugcucaaggguuucgc

SEQ ID NO: 591553 - RNA, 21 nt, Escherichia coli CFT073
aacguuugauuaacgccagau

SEQ ID NO: 591554 - RNA, 21 nt, Escherichia coli CFT073
aagaucgcccugagggacguu

SEQ ID NO: 591555 - RNA, 20 nt, Escherichia coli CFT073
aagauauucaucagcaucac

SEQ ID NO: 591556 - RNA, 14 nt, Escherichia coli CFT073
aagaugggccagca

SEQ ID NO: 591557 - RNA, 19 nt, Escherichia coli CFT073
aagauguuggcagcggcaa

SEQ ID NO: 591558 - RNA, 15 nt, Escherichia coli CFT073
aagcacaaaaacccg

SEQ ID NO: 591559 - RNA, 15 nt, Escherichia coli CFT073
aagcaauuacaggug

SEQ ID NO: 591560 - RNA, 20 nt, Escherichia coli CFT073
aagcaauaagcacucuggcg

SEQ ID NO: 591561 - RNA, 15 nt, Escherichia coli CFT073
aagauuuuuugccag

SEQ ID NO: 591562 - RNA, 17 nt, Escherichia coli CFT073
aagauuuuuugccagca

SEQ ID NO: 591563 - RNA, 19 nt, Escherichia coli CFT073
aagcaaagcaaaggcgaca

SEQ ID NO: 591564 - RNA, 20 nt, Escherichia coli CFT073
aagcacggcgcgacucagcg

SEQ ID NO: 591565 - RNA, 13 nt, Escherichia coli CFT073
aagcacaauccgc

SEQ ID NO: 591566 - RNA, 18 nt, Escherichia coli CFT073
aagcagauaacccagcag

SEQ ID NO: 591567 - RNA, 13 nt, Escherichia coli CFT073
aacgcaaaaccaa

SEQ ID NO: 591568 - RNA, 14 nt, Escherichia coli CFT073
aacgcaaacaccag

SEQ ID NO: 591569 - RNA, 18 nt, Escherichia coli CFT073
aacgcaaacaccagcuga

SEQ ID NO: 591570 - RNA, 19 nt, Escherichia coli CFT073
aacgauucggcaaucacaa

SEQ ID NO: 591571 - RNA, 13 nt, Escherichia coli CFT073
aacgcacuggcga

SEQ ID NO: 591572 - RNA, 19 nt, Escherichia coli CFT073
aacgcacuuuuaacgccuc

SEQ ID NO: 591573 - RNA, 21 nt, Escherichia coli CFT073
aacgcagaaucucugcgcuau

SEQ ID NO: 591574 - RNA, 13 nt, Escherichia coli CFT073
aacgcauaaaccg

SEQ ID NO: 591575 - RNA, 13 nt, Escherichia coli CFT073
aacgcaucgccaa

SEQ ID NO: 591576 - RNA, 15 nt, Escherichia coli CFT073
aacgcaucuuuuuca

SEQ ID NO: 591577 - RNA, 18 nt, Escherichia coli CFT073
aacgccgcuggugauuca

SEQ ID NO: 591578 - RNA, 21 nt, Escherichia coli CFT073
aacgccaaacucuucgcgaua

SEQ ID NO: 591579 - RNA, 23 nt, Escherichia coli CFT073
aacgccgauaagguaucgcgaaa

SEQ ID NO: 591580 - RNA, 18 nt, Escherichia coli CFT073
aacgccgcauggucgaac

SEQ ID NO: 591581 - RNA, 23 nt, Escherichia coli CFT073
aacgaauugucccauuugccagc

SEQ ID NO: 591582 - RNA, 15 nt, Escherichia coli CFT073
aacgaaucgggcaac

SEQ ID NO: 591583 - RNA, 14 nt, Escherichia coli CFT073
aacgacaccacgcg

SEQ ID NO: 591584 - RNA, 15 nt, Escherichia coli CFT073
aacgacacugcucgc

SEQ ID NO: 591585 - RNA, 16 nt, Escherichia coli CFT073
aacgaacucuucgccc

SEQ ID NO: 591586 - RNA, 13 nt, Escherichia coli CFT073
aacgaaccgcuau

SEQ ID NO: 591587 - RNA, 13 nt, Escherichia coli CFT073
aacgaauaaucca

SEQ ID NO: 591588 - RNA, 16 nt, Escherichia coli CFT073
aacgacauccgccagc

SEQ ID NO: 591589 - RNA, 16 nt, Escherichia coli CFT073
aacgauaaauaacgua

SEQ ID NO: 591590 - RNA, 12 nt, Escherichia coli CFT073
aacgaucgccga

SEQ ID NO: 591591 - RNA, 18 nt, Escherichia coli CFT073
aacgauccuggucaggaa

SEQ ID NO: 591592 - RNA, 17 nt, Escherichia coli CFT073
aacgaucgcuuucaacg

SEQ ID NO: 591593 - RNA, 20 nt, Escherichia coli CFT073
aaccuucacggguugcgccu

SEQ ID NO: 591594 - RNA, 15 nt, Escherichia coli CFT073
aaccuuucgccacca

SEQ ID NO: 591595 - RNA, 12 nt, Escherichia coli CFT073
aaccgcuauccu

SEQ ID NO: 591596 - RNA, 10 nt, Escherichia coli CFT073
aaccgccgcu

SEQ ID NO: 591597 - RNA, 18 nt, Escherichia coli CFT073
aaccgccgacgcgaagca

SEQ ID NO: 591598 - RNA, 17 nt, Escherichia coli CFT073
aaccgccgauggcccgc

SEQ ID NO: 591599 - RNA, 20 nt, Escherichia coli CFT073
aaccgccggauagcuaauca

SEQ ID NO: 591600 - RNA, 20 nt, Escherichia coli CFT073
aacgcuuguacggcuccgcc

SEQ ID NO: 591601 - RNA, 23 nt, Escherichia coli CFT073
aacgcuuguacggcuccgcccca

SEQ ID NO: 591602 - RNA, 12 nt, Escherichia coli CFT073
aacgcgccaccg

SEQ ID NO: 591603 - RNA, 19 nt, Escherichia coli CFT073
aacgcgccagcgucgcauc

SEQ ID NO: 591604 - RNA, 21 nt, Escherichia coli CFT073
aacgcuuuuaacggugccagc

SEQ ID NO: 591605 - RNA, 22 nt, Escherichia coli CFT073
aacgcgccgcaacaauaacccc

SEQ ID NO: 591606 - RNA, 18 nt, Escherichia coli CFT073
aacgcgcagcgucgcauc

SEQ ID NO: 591607 - RNA, 14 nt, Escherichia coli CFT073
aacgcgaucgccaa

SEQ ID NO: 591608 - RNA, 14 nt, Escherichia coli CFT073
aacggcggucaggu

SEQ ID NO: 591609 - RNA, 14 nt, Escherichia coli CFT073
aacggcgucagcca

SEQ ID NO: 591610 - RNA, 20 nt, Escherichia coli CFT073
aacggcuggugauuucgucc

SEQ ID NO: 591611 - RNA, 20 nt, Escherichia coli CFT073
aacggauuaucccccgguuu

SEQ ID NO: 591612 - RNA, 19 nt, Escherichia coli CFT073
aacguacagacaccaauca

SEQ ID NO: 591613 - RNA, 14 nt, Escherichia coli CFT073
aacgguugcggcuu

SEQ ID NO: 591614 - RNA, 17 nt, Escherichia coli CFT073
aacgguuucaaccagca

SEQ ID NO: 591615 - RNA, 21 nt, Escherichia coli CFT073
aacgucauauacccugccaga

SEQ ID NO: 591616 - RNA, 13 nt, Escherichia coli CFT073
aacguccggcaau

SEQ ID NO: 591617 - RNA, 14 nt, Escherichia coli CFT073
aacgugacauucug

SEQ ID NO: 591618 - RNA, 17 nt, Escherichia coli CFT073
aacgugaccaugagcca

SEQ ID NO: 591619 - RNA, 24 nt, Escherichia coli CFT073
aacggugacuggcuuaauaauucc

SEQ ID NO: 591620 - RNA, 20 nt, Escherichia coli CFT073
aacgguuaugaauaacuccg

SEQ ID NO: 591621 - RNA, 12 nt, Escherichia coli CFT073
aacgguaucuuu

SEQ ID NO: 591622 - RNA, 20 nt, Escherichia coli CFT073
aacgggggcgauuuuccucc

SEQ ID NO: 591623 - RNA, 14 nt, Escherichia coli CFT073
aacgggauaaacga

SEQ ID NO: 591624 - RNA, 18 nt, Escherichia coli CFT073
aacgggcaaucucauacc

SEQ ID NO: 591625 - RNA, 20 nt, Escherichia coli CFT073
aaccaauuucugugcagcca

SEQ ID NO: 591626 - RNA, 18 nt, Escherichia coli CFT073
aaccaaaccagccgccaa

SEQ ID NO: 591627 - RNA, 18 nt, Escherichia coli CFT073
aaccaagacuauuaauau

SEQ ID NO: 591628 - RNA, 20 nt, Escherichia coli CFT073
aaccaaaguuugcaaaccca

SEQ ID NO: 591629 - RNA, 15 nt, Escherichia coli CFT073
aaccaaccagcgugu

SEQ ID NO: 591630 - RNA, 14 nt, Escherichia coli CFT073
aaccaaccgcaaua

SEQ ID NO: 591631 - RNA, 19 nt, Escherichia coli CFT073
aacauucaucauuucauuu

SEQ ID NO: 591632 - RNA, 21 nt, Escherichia coli CFT073
aacauuuuaguuuacauuaau

SEQ ID NO: 591633 - RNA, 20 nt, Escherichia coli CFT073
aacauggagaguuuucauga

SEQ ID NO: 591634 - RNA, 14 nt, Escherichia coli CFT073
aaccacaggcuggc

SEQ ID NO: 591635 - RNA, 21 nt, Escherichia coli CFT073
aaccacagugaggguuucuuc

SEQ ID NO: 591636 - RNA, 17 nt, Escherichia coli CFT073
aaccacacccacaucaa

SEQ ID NO: 591637 - RNA, 20 nt, Escherichia coli CFT073
aaccaccgaccacggccagu

SEQ ID NO: 591638 - RNA, 14 nt, Escherichia coli CFT073
aaccaccggcacca

SEQ ID NO: 591639 - RNA, 15 nt, Escherichia coli CFT073
aaccaccuccacgcc

SEQ ID NO: 591640 - RNA, 17 nt, Escherichia coli CFT073
aaccagccacgggaaau

SEQ ID NO: 591641 - RNA, 18 nt, Escherichia coli CFT073
aaccagccacugcgccau

SEQ ID NO: 591642 - RNA, 13 nt, Escherichia coli CFT073
aaccagccgccaa

SEQ ID NO: 591643 - RNA, 13 nt, Escherichia coli CFT073
aaccagcgagaag

SEQ ID NO: 591644 - RNA, 18 nt, Escherichia coli CFT073
aaccacucaccgcuggcg

SEQ ID NO: 591645 - RNA, 21 nt, Escherichia coli CFT073
aaccacugacacaggcagcaa

SEQ ID NO: 591646 - RNA, 23 nt, Escherichia coli CFT073
aaccacugacacaggcagcaauc

SEQ ID NO: 591647 - RNA, 22 nt, Escherichia coli CFT073
aaccacugauggaauuucauca

SEQ ID NO: 591648 - RNA, 23 nt, Escherichia coli CFT073
aaccacuuuacgcaaaauaucga

SEQ ID NO: 591649 - RNA, 13 nt, Escherichia coli CFT073
aacauccggcaac

SEQ ID NO: 591650 - RNA, 19 nt, Escherichia coli CFT073
aacauccuuuccuuaagcc

SEQ ID NO: 591651 - RNA, 20 nt, Escherichia coli CFT073
aacaucaucacgcagagcau

SEQ ID NO: 591652 - RNA, 14 nt, Escherichia coli CFT073
aacauccagcucgc

SEQ ID NO: 591653 - RNA, 11 nt, Escherichia coli CFT073
aacauccccac

SEQ ID NO: 591654 - RNA, 11 nt, Escherichia coli CFT073
aacaucgccau

SEQ ID NO: 591655 - RNA, 17 nt, Escherichia coli CFT073
aacaucgggauaucgcc

SEQ ID NO: 591656 - RNA, 17 nt, Escherichia coli CFT073
aacaugcgcagaagcau

SEQ ID NO: 591657 - RNA, 23 nt, Escherichia coli CFT073
aacaugcgggucuuacuggggaa

SEQ ID NO: 591658 - RNA, 21 nt, Escherichia coli CFT073
aacaugcuauuacgccagccu

SEQ ID NO: 591659 - RNA, 15 nt, Escherichia coli CFT073
aacaugagaacaguu

SEQ ID NO: 591660 - RNA, 15 nt, Escherichia coli CFT073
aacaguucagcaaca

SEQ ID NO: 591661 - RNA, 21 nt, Escherichia coli CFT073
aacagugccagacaaaccacg

SEQ ID NO: 591662 - RNA, 19 nt, Escherichia coli CFT073
aacaguuuucgcaccgcgu

SEQ ID NO: 591663 - RNA, 13 nt, Escherichia coli CFT073
aacauaaugccga

SEQ ID NO: 591664 - RNA, 15 nt, Escherichia coli CFT073
aacauaccuaaaagc

SEQ ID NO: 591665 - RNA, 16 nt, Escherichia coli CFT073
aacauacggcauaaua

SEQ ID NO: 591666 - RNA, 14 nt, Escherichia coli CFT073
aacaucacgcugac

SEQ ID NO: 591667 - RNA, 13 nt, Escherichia coli CFT073
aacaucacugcaa

SEQ ID NO: 591668 - RNA, 22 nt, Escherichia coli CFT073
aacaucaccaaugacagcccca

SEQ ID NO: 591669 - RNA, 13 nt, Escherichia coli CFT073
aacaucaauaaca

SEQ ID NO: 591670 - RNA, 16 nt, Escherichia coli CFT073
aacauagcccgguaua

SEQ ID NO: 591671 - RNA, 22 nt, Escherichia coli CFT073
aacauagcuuggcagagcgaca

SEQ ID NO: 591672 - RNA, 10 nt, Escherichia coli CFT073
aacauauaag

SEQ ID NO: 591673 - RNA, 17 nt, Escherichia coli CFT073
aacauauccccagggaa

SEQ ID NO: 591674 - RNA, 16 nt, Escherichia coli CFT073
aacccacgaccagugc

SEQ ID NO: 591675 - RNA, 21 nt, Escherichia coli CFT073
aacccagcagcccgagcaaca

SEQ ID NO: 591676 - RNA, 13 nt, Escherichia coli CFT073
aaccccguaucca

SEQ ID NO: 591677 - RNA, 14 nt, Escherichia coli CFT073
aaccaguucacuug

SEQ ID NO: 591678 - RNA, 17 nt, Escherichia coli CFT073
aaccaguuuaugccugu

SEQ ID NO: 591679 - RNA, 12 nt, Escherichia coli CFT073
aaccagcgccgg

SEQ ID NO: 591680 - RNA, 15 nt, Escherichia coli CFT073
aacccaagcgcgcug

SEQ ID NO: 591681 - RNA, 21 nt, Escherichia coli CFT073
aacccucuauacugcgcgccg

SEQ ID NO: 591682 - RNA, 12 nt, Escherichia coli CFT073
aacccugcgcau

SEQ ID NO: 591683 - RNA, 13 nt, Escherichia coli CFT073
aacccugcgccag

SEQ ID NO: 591684 - RNA, 19 nt, Escherichia coli CFT073
aacccgcgcgcuaacggag

SEQ ID NO: 591685 - RNA, 22 nt, Escherichia coli CFT073
aaccgacaauauugaugcucgc

SEQ ID NO: 591686 - RNA, 19 nt, Escherichia coli CFT073
aaccgaccaaucacaucgc

SEQ ID NO: 591687 - RNA, 20 nt, Escherichia coli CFT073
aaccgaccgguccacuuccu

SEQ ID NO: 591688 - RNA, 15 nt, Escherichia coli CFT073
aaccgcaaaaccaac

SEQ ID NO: 591689 - RNA, 13 nt, Escherichia coli CFT073
aaccgcaucaugu

SEQ ID NO: 591690 - RNA, 16 nt, Escherichia coli CFT073
aaccgccaaucgccac

SEQ ID NO: 591691 - RNA, 11 nt, Escherichia coli CFT073
aaccgccaccu

SEQ ID NO: 591692 - RNA, 13 nt, Escherichia coli CFT073
aaccgccagcaca

SEQ ID NO: 591693 - RNA, 21 nt, Escherichia coli CFT073
aaccgccaguucccccugcca

SEQ ID NO: 591694 - RNA, 15 nt, Escherichia coli CFT073
aaauugcugaugacg

SEQ ID NO: 591695 - RNA, 14 nt, Escherichia coli CFT073
aaauuauagaugca

SEQ ID NO: 591696 - RNA, 20 nt, Escherichia coli CFT073
aaauucaggggaagccagac

SEQ ID NO: 591697 - RNA, 15 nt, Escherichia coli CFT073
aaauuccccacccca

SEQ ID NO: 591698 - RNA, 16 nt, Escherichia coli CFT073
aaauucgagagaauua

SEQ ID NO: 591699 - RNA, 13 nt, Escherichia coli CFT073
aaaucaccaucac

SEQ ID NO: 591700 - RNA, 17 nt, Escherichia coli CFT073
aaaucaccgccaccagc

SEQ ID NO: 591701 - RNA, 21 nt, Escherichia coli CFT073
aaaucaaucugaugacugaua

SEQ ID NO: 591702 - RNA, 18 nt, Escherichia coli CFT073
aaaucaccaccagcaccg

SEQ ID NO: 591703 - RNA, 19 nt, Escherichia coli CFT073
aaaucaaaaucaccgauga

SEQ ID NO: 591704 - RNA, 11 nt, Escherichia coli CFT073
aaaucaaauca

SEQ ID NO: 591705 - RNA, 22 nt, Escherichia coli CFT073
aaaucaacauguuccugccagu

SEQ ID NO: 591706 - RNA, 12 nt, Escherichia coli CFT073
aaaucaaccagg

SEQ ID NO: 591707 - RNA, 23 nt, Escherichia coli CFT073
aaaucagauaugcgcugucauuc

SEQ ID NO: 591708 - RNA, 22 nt, Escherichia coli CFT073
aaaucacgcugccaauaaugcc

SEQ ID NO: 591709 - RNA, 12 nt, Escherichia coli CFT073
aaaucacggcaa

SEQ ID NO: 591710 - RNA, 19 nt, Escherichia coli CFT073
aaaucagcaucaacccgcu

SEQ ID NO: 591711 - RNA, 15 nt, Escherichia coli CFT073
aaaucguuaaaacgu

SEQ ID NO: 591712 - RNA, 17 nt, Escherichia coli CFT073
aaaucguuugcauccag

SEQ ID NO: 591713 - RNA, 22 nt, Escherichia coli CFT073
aaaugcugcgggucaaucggcg

SEQ ID NO: 591714 - RNA, 19 nt, Escherichia coli CFT073
aaaugggggagagccagca

SEQ ID NO: 591715 - RNA, 13 nt, Escherichia coli CFT073
aaaucucuuccag

SEQ ID NO: 591716 - RNA, 13 nt, Escherichia coli CFT073
aaaucugccguca

SEQ ID NO: 591717 - RNA, 21 nt, Escherichia coli CFT073
aaaucuucacugaauaccgua

SEQ ID NO: 591718 - RNA, 17 nt, Escherichia coli CFT073
aaaucuuccagaaugcc

SEQ ID NO: 591719 - RNA, 15 nt, Escherichia coli CFT073
aaaucucccgcuggc

SEQ ID NO: 591720 - RNA, 22 nt, Escherichia coli CFT073
aaaagcuguacaucgcgccaac

SEQ ID NO: 591721 - RNA, 15 nt, Escherichia coli CFT073
aaaagcgaagcggca

SEQ ID NO: 591722 - RNA, 13 nt, Escherichia coli CFT073
aacaagaucgccc

SEQ ID NO: 591723 - RNA, 19 nt, Escherichia coli CFT073
aacaauaaaaagcggcagg

SEQ ID NO: 591724 - RNA, 13 nt, Escherichia coli CFT073
aacaauaaaguuu

SEQ ID NO: 591725 - RNA, 22 nt, Escherichia coli CFT073
aacaagucagcgcgaaaucgcc

SEQ ID NO: 591726 - RNA, 15 nt, Escherichia coli CFT073
aacaaucaccaaacc

SEQ ID NO: 591727 - RNA, 16 nt, Escherichia coli CFT073
aacagauaaaaguuac

SEQ ID NO: 591728 - RNA, 23 nt, Escherichia coli CFT073
aacagauaauaaaaaagaaaaga

SEQ ID NO: 591729 - RNA, 23 nt, Escherichia coli CFT073
aacagcaaaucuccccggcgcag

SEQ ID NO: 591730 - RNA, 18 nt, Escherichia coli CFT073
aacagaagguauacugca

SEQ ID NO: 591731 - RNA, 22 nt, Escherichia coli CFT073
aacagaauggugccgacaggug

SEQ ID NO: 591732 - RNA, 22 nt, Escherichia coli CFT073
aacagaccagcaaagugcgcuu

SEQ ID NO: 591733 - RNA, 19 nt, Escherichia coli CFT073
aacaaugccucgcuaaucu

SEQ ID NO: 591734 - RNA, 14 nt, Escherichia coli CFT073
aacacucugcgccu

SEQ ID NO: 591735 - RNA, 14 nt, Escherichia coli CFT073
aacagccagcagcg

SEQ ID NO: 591736 - RNA, 22 nt, Escherichia coli CFT073
aacagccaaucauaaacgccug

SEQ ID NO: 591737 - RNA, 19 nt, Escherichia coli CFT073
aacagccacucuuaacgcc

SEQ ID NO: 591738 - RNA, 18 nt, Escherichia coli CFT073
aacagccuuguauuaaua

SEQ ID NO: 591739 - RNA, 19 nt, Escherichia coli CFT073
aacagcggugcaccugcca

SEQ ID NO: 591740 - RNA, 20 nt, Escherichia coli CFT073
aacagcguccacagccaaca

SEQ ID NO: 591741 - RNA, 15 nt, Escherichia coli CFT073
aacagcgucgagcca

SEQ ID NO: 591742 - RNA, 11 nt, Escherichia coli CFT073
aacagcgcauu

SEQ ID NO: 591743 - RNA, 20 nt, Escherichia coli CFT073
aacaggaauguuguccaggg

SEQ ID NO: 591744 - RNA, 18 nt, Escherichia coli CFT073
aacaggaauucggcaucg

SEQ ID NO: 591745 - RNA, 19 nt, Escherichia coli CFT073
aacaggcggcuaugcugga

SEQ ID NO: 591746 - RNA, 15 nt, Escherichia coli CFT073
aacaggcugcugccg

SEQ ID NO: 591747 - RNA, 11 nt, Escherichia coli CFT073
aacagguugcg

SEQ ID NO: 591748 - RNA, 20 nt, Escherichia coli CFT073
aacaguaacccagcaccaac

SEQ ID NO: 591749 - RNA, 16 nt, Escherichia coli CFT073
aacaguaugcaacaac

SEQ ID NO: 591750 - RNA, 19 nt, Escherichia coli CFT073
aacagucaguuaucgcauu

SEQ ID NO: 591751 - RNA, 15 nt, Escherichia coli CFT073
aacaguaauaaugcc

SEQ ID NO: 591752 - RNA, 22 nt, Escherichia coli CFT073
aacagggauccccagccgccuc

SEQ ID NO: 591753 - RNA, 18 nt, Escherichia coli CFT073
aacaggucaauuucaaua

SEQ ID NO: 591754 - RNA, 17 nt, Escherichia coli CFT073
aacaggucacgggcaau

SEQ ID NO: 591755 - RNA, 18 nt, Escherichia coli CFT073
aaaaauaaaagcgugaaa

SEQ ID NO: 591756 - RNA, 17 nt, Escherichia coli CFT073
aaagcaauagccgccau

SEQ ID NO: 591757 - RNA, 24 nt, Escherichia coli CFT073
aaaaagcuugucauuaccacaaca

SEQ ID NO: 591758 - RNA, 16 nt, Escherichia coli CFT073
aaagcaacaaccacca

SEQ ID NO: 591759 - RNA, 21 nt, Escherichia coli CFT073
aaagauuguucuuuauccggc

SEQ ID NO: 591760 - RNA, 20 nt, Escherichia coli CFT073
aaacuugaacuuaucaucag

SEQ ID NO: 591761 - RNA, 21 nt, Escherichia coli CFT073
aaagauaagcgaacauccggc

SEQ ID NO: 591762 - RNA, 14 nt, Escherichia coli CFT073
aaacucgcugcgga

SEQ ID NO: 591763 - RNA, 19 nt, Escherichia coli CFT073
aaacucgcuggcggcuggc

SEQ ID NO: 591764 - RNA, 16 nt, Escherichia coli CFT073
aaacucugcggcauca

SEQ ID NO: 591765 - RNA, 14 nt, Escherichia coli CFT073
aaacugaagcgcgc

SEQ ID NO: 591766 - RNA, 14 nt, Escherichia coli CFT073
aaacugccccgcca

SEQ ID NO: 591767 - RNA, 13 nt, Escherichia coli CFT073
aaacuaaccagac

SEQ ID NO: 591768 - RNA, 18 nt, Escherichia coli CFT073
aaacguggccuccaaaaa

SEQ ID NO: 591769 - RNA, 17 nt, Escherichia coli CFT073
aaacguuauccguuaac

SEQ ID NO: 591770 - RNA, 23 nt, Escherichia coli CFT073
aaacguucaucgggcaucgcaac

SEQ ID NO: 591771 - RNA, 17 nt, Escherichia coli CFT073
aaacuaucccaucagcg

SEQ ID NO: 591772 - RNA, 15 nt, Escherichia coli CFT073
aaacucaauucacgc

SEQ ID NO: 591773 - RNA, 13 nt, Escherichia coli CFT073
aaacucaccgcgc

SEQ ID NO: 591774 - RNA, 16 nt, Escherichia coli CFT073
aaacguuaacgcccca

SEQ ID NO: 591775 - RNA, 17 nt, Escherichia coli CFT073
aaacguaaaugccagcc

SEQ ID NO: 591776 - RNA, 23 nt, Escherichia coli CFT073
aaacgucgcaacuccaccagcac

SEQ ID NO: 591777 - RNA, 21 nt, Escherichia coli CFT073
aaacgccagaaucaaacugcc

SEQ ID NO: 591778 - RNA, 19 nt, Escherichia coli CFT073
aaacgccauaaacuucauu

SEQ ID NO: 591779 - RNA, 13 nt, Escherichia coli CFT073
aaacgguugauag

SEQ ID NO: 591780 - RNA, 20 nt, Escherichia coli CFT073
aaacgcauaaaacggcgcau

SEQ ID NO: 591781 - RNA, 16 nt, Escherichia coli CFT073
aaacgcauaucgcccu

SEQ ID NO: 591782 - RNA, 15 nt, Escherichia coli CFT073
aaacgcaaaauugcc

SEQ ID NO: 591783 - RNA, 22 nt, Escherichia coli CFT073
aaacgauaauacgucggcauca

SEQ ID NO: 591784 - RNA, 19 nt, Escherichia coli CFT073
aaacgauucggcaaucaca

SEQ ID NO: 591785 - RNA, 23 nt, Escherichia coli CFT073
aaacgaaucugcaaaucugcgcc

SEQ ID NO: 591786 - RNA, 16 nt, Escherichia coli CFT073
aaacgaccaaucgcgg

SEQ ID NO: 591787 - RNA, 15 nt, Escherichia coli CFT073
aaacgaagcggcugc

SEQ ID NO: 591788 - RNA, 19 nt, Escherichia coli CFT073
aaaaacaccucaucgcgca

SEQ ID NO: 591789 - RNA, 13 nt, Escherichia coli CFT073
aaaaaacgccaga

SEQ ID NO: 591790 - RNA, 12 nt, Escherichia coli CFT073
aaagcugcggau

SEQ ID NO: 591791 - RNA, 15 nt, Escherichia coli CFT073
aaagcugucaccaau

SEQ ID NO: 591792 - RNA, 21 nt, Escherichia coli CFT073
aaagcugucaccucugcaacg

SEQ ID NO: 591793 - RNA, 20 nt, Escherichia coli CFT073
aaagcuuuaauauccggugc

SEQ ID NO: 591794 - RNA, 18 nt, Escherichia coli CFT073
aaaggcaaaaugccagcc

SEQ ID NO: 591795 - RNA, 12 nt, Escherichia coli CFT073
aaaggccauccc

SEQ ID NO: 591796 - RNA, 22 nt, Escherichia coli CFT073
aaaggccggauggguaauacca

SEQ ID NO: 591797 - RNA, 19 nt, Escherichia coli CFT073
aaagucgcggaauauccag

SEQ ID NO: 591798 - RNA, 21 nt, Escherichia coli CFT073
aaaggcguuguccuugccgca

SEQ ID NO: 591799 - RNA, 11 nt, Escherichia coli CFT073
aaagucaugcg

SEQ ID NO: 591800 - RNA, 21 nt, Escherichia coli CFT073
aaaaauuacucucgugccaga

SEQ ID NO: 591801 - RNA, 14 nt, Escherichia coli CFT073
aaagcacccagcaa

SEQ ID NO: 591802 - RNA, 23 nt, Escherichia coli CFT073
aaaaauugcgcaacuuuuucuug

SEQ ID NO: 591803 - RNA, 20 nt, Escherichia coli CFT073
aaagcuaacagcgccgcgau

SEQ ID NO: 591804 - RNA, 21 nt, Escherichia coli CFT073
aaagcucacuuugucugcaau

SEQ ID NO: 591805 - RNA, 17 nt, Escherichia coli CFT073
aaaaaguaguuccagca

SEQ ID NO: 591806 - RNA, 22 nt, Escherichia coli CFT073
aaauaccgaagaguaaccaaac

SEQ ID NO: 591807 - RNA, 22 nt, Escherichia coli CFT073
aaauacauauaagcguuaaugg

SEQ ID NO: 591808 - RNA, 13 nt, Escherichia coli CFT073
aaauacugcugca

SEQ ID NO: 591809 - RNA, 21 nt, Escherichia coli CFT073
aaauagcccgguuuaccauca

SEQ ID NO: 591810 - RNA, 15 nt, Escherichia coli CFT073
aaaguuggcgcugaa

SEQ ID NO: 591811 - RNA, 20 nt, Escherichia coli CFT073
aaaguguucgaccaccgguu

SEQ ID NO: 591812 - RNA, 14 nt, Escherichia coli CFT073
aaauagcuuaacgg

SEQ ID NO: 591813 - RNA, 19 nt, Escherichia coli CFT073
aaauaguaagaaccacagc

SEQ ID NO: 591814 - RNA, 20 nt, Escherichia coli CFT073
aaauaguuuuuuacgaugca

SEQ ID NO: 591815 - RNA, 15 nt, Escherichia coli CFT073
aaauauacacgaaau

SEQ ID NO: 591816 - RNA, 17 nt, Escherichia coli CFT073
aaauaugcuuuuauuca

SEQ ID NO: 591817 - RNA, 12 nt, Escherichia coli CFT073
aaauaucaaaaa

SEQ ID NO: 591818 - RNA, 16 nt, Escherichia coli CFT073
aaauaugaaaaugccg

SEQ ID NO: 591819 - RNA, 23 nt, Escherichia coli CFT073
uuuuuccagcauuucuuccagcg

SEQ ID NO: 591820 - RNA, 24 nt, Escherichia coli CFT073
uuuuuccaucgucagacgcucugg

SEQ ID NO: 591821 - RNA, 13 nt, Escherichia coli CFT073
uuuuguaggccug

SEQ ID NO: 591822 - RNA, 14 nt, Escherichia coli CFT073
uuuugucgacauca

SEQ ID NO: 591823 - RNA, 12 nt, Escherichia coli CFT073
uuuugucucugc

SEQ ID NO: 591824 - RNA, 18 nt, Escherichia coli CFT073
uuuuuacagccagccgcu

SEQ ID NO: 591825 - RNA, 23 nt, Escherichia coli CFT073
uuuuaagauccaguugaccugcg

SEQ ID NO: 591826 - RNA, 18 nt, Escherichia coli CFT073
uuuuaacgcagagugcgc

SEQ ID NO: 591827 - RNA, 13 nt, Escherichia coli CFT073
uuuuaacgccucg

SEQ ID NO: 591828 - RNA, 14 nt, Escherichia coli CFT073
uuuuaacggugcca

SEQ ID NO: 591829 - RNA, 11 nt, Escherichia coli CFT073
uuuucagcgaa

SEQ ID NO: 591830 - RNA, 20 nt, Escherichia coli CFT073
uuuucagaaggauaauuaau

SEQ ID NO: 591831 - RNA, 22 nt, Escherichia coli CFT073
uuuggcgaaauagccgaaaacg

SEQ ID NO: 591832 - RNA, 16 nt, Escherichia coli CFT073
uuuucgccaucucaaa

SEQ ID NO: 591833 - RNA, 14 nt, Escherichia coli CFT073
uuuucuacuuugua

SEQ ID NO: 591834 - RNA, 15 nt, Escherichia coli CFT073
uuuuccccaucggau

SEQ ID NO: 591835 - RNA, 23 nt, Escherichia coli CFT073
uuuucgaugcguaccauuucuuc

SEQ ID NO: 591836 - RNA, 22 nt, Escherichia coli CFT073
uuuucccuuucagauaucccau

SEQ ID NO: 591837 - RNA, 13 nt, Escherichia coli CFT073
uuuucccuuuuag

SEQ ID NO: 591838 - RNA, 14 nt, Escherichia coli CFT073
uuugaucgccgcca

SEQ ID NO: 591839 - RNA, 20 nt, Escherichia coli CFT073
uuugcgcggcauuacgcccg

SEQ ID NO: 591840 - RNA, 21 nt, Escherichia coli CFT073
uuugcuaaggucaccaguuca

SEQ ID NO: 591841 - RNA, 15 nt, Escherichia coli CFT073
uuugcgucgcauccg

SEQ ID NO: 591842 - RNA, 20 nt, Escherichia coli CFT073
uuugcucggcaaucucuucc

SEQ ID NO: 591843 - RNA, 19 nt, Escherichia coli CFT073
uuugcucguaucagguggu

SEQ ID NO: 591844 - RNA, 18 nt, Escherichia coli CFT073
uuugcuguaaacauugau

SEQ ID NO: 591845 - RNA, 13 nt, Escherichia coli CFT073
uuugcugcuggca

SEQ ID NO: 591846 - RNA, 16 nt, Escherichia coli CFT073
uuugaagcccaguacc

SEQ ID NO: 591847 - RNA, 22 nt, Escherichia coli CFT073
uuugaaggaaaaaucgcacugg

SEQ ID NO: 591848 - RNA, 21 nt, Escherichia coli CFT073
uuugacacaauauugcggaua

SEQ ID NO: 591849 - RNA, 11 nt, Escherichia coli CFT073
uuuccagaaag

SEQ ID NO: 591850 - RNA, 12 nt, Escherichia coli CFT073
uuuccagcacca

SEQ ID NO: 591851 - RNA, 14 nt, Escherichia coli CFT073
uuucagcucacggc

SEQ ID NO: 591852 - RNA, 21 nt, Escherichia coli CFT073
uuucccaacgugaccaguacc

SEQ ID NO: 591853 - RNA, 13 nt, Escherichia coli CFT073
uuuccccaucgga

SEQ ID NO: 591854 - RNA, 19 nt, Escherichia coli CFT073
uuuccccggugcgcgguga

SEQ ID NO: 591855 - RNA, 20 nt, Escherichia coli CFT073
uuuccgcacguuuuuccagu

SEQ ID NO: 591856 - RNA, 20 nt, Escherichia coli CFT073
uuucccuucgauuugccgga

SEQ ID NO: 591857 - RNA, 21 nt, Escherichia coli CFT073
uuucguuagcaaacgacacau

SEQ ID NO: 591858 - RNA, 17 nt, Escherichia coli CFT073
uuucugcuucgccaucu

SEQ ID NO: 591859 - RNA, 17 nt, Escherichia coli CFT073
uuucugcaaucgucugc

SEQ ID NO: 591860 - RNA, 16 nt, Escherichia coli CFT073
uuucucgugccgccag

SEQ ID NO: 591861 - RNA, 21 nt, Escherichia coli CFT073
uuucucguuggguugccagcg

SEQ ID NO: 591862 - RNA, 18 nt, Escherichia coli CFT073
uugucggcgugaacgcgc

SEQ ID NO: 591863 - RNA, 15 nt, Escherichia coli CFT073
uuguccgccagaaag

SEQ ID NO: 591864 - RNA, 20 nt, Escherichia coli CFT073
uuguaggccggauaaggcau

SEQ ID NO: 591865 - RNA, 20 nt, Escherichia coli CFT073
uuguaggcuggauaaggcgu

SEQ ID NO: 591866 - RNA, 20 nt, Escherichia coli CFT073
uuguaggccagauaaaacac

SEQ ID NO: 591867 - RNA, 20 nt, Escherichia coli CFT073
uuguaggccggauaaggcgu

SEQ ID NO: 591868 - RNA, 13 nt, Escherichia coli CFT073
uuguacugcucgc

SEQ ID NO: 591869 - RNA, 15 nt, Escherichia coli CFT073
uuggcuuugauauuc

SEQ ID NO: 591870 - RNA, 21 nt, Escherichia coli CFT073
uugggaauuugcuccgccacu

SEQ ID NO: 591871 - RNA, 22 nt, Escherichia coli CFT073
uuggcuucacugauuaacguca

SEQ ID NO: 591872 - RNA, 14 nt, Escherichia coli CFT073
uugaaauaaaauca

SEQ ID NO: 591873 - RNA, 15 nt, Escherichia coli CFT073
uugaaaugcggcgac

SEQ ID NO: 591874 - RNA, 18 nt, Escherichia coli CFT073
uugaaaagaguucaucgg

SEQ ID NO: 591875 - RNA, 12 nt, Escherichia coli CFT073
uucuugcguuuu

SEQ ID NO: 591876 - RNA, 20 nt, Escherichia coli CFT073
uuggcguucacugccguaca

SEQ ID NO: 591877 - RNA, 21 nt, Escherichia coli CFT073
uuggcggcagaugaugaacgg

SEQ ID NO: 591878 - RNA, 19 nt, Escherichia coli CFT073
uuuacaauauccagcgcgc

SEQ ID NO: 591879 - RNA, 19 nt, Escherichia coli CFT073
uuuacgauggcagggcagc

SEQ ID NO: 591880 - RNA, 15 nt, Escherichia coli CFT073
uuuacgccgcaucag

SEQ ID NO: 591881 - RNA, 15 nt, Escherichia coli CFT073
uuuacgccgcauccg

SEQ ID NO: 591882 - RNA, 13 nt, Escherichia coli CFT073
uuuacgcgacaca

SEQ ID NO: 591883 - RNA, 12 nt, Escherichia coli CFT073
uuuaccgcaucc

SEQ ID NO: 591884 - RNA, 17 nt, Escherichia coli CFT073
uuuaccggucaugucgg

SEQ ID NO: 591885 - RNA, 20 nt, Escherichia coli CFT073
uuuaccggucaugucggcau

SEQ ID NO: 591886 - RNA, 17 nt, Escherichia coli CFT073
uuguuacccccauccac

SEQ ID NO: 591887 - RNA, 15 nt, Escherichia coli CFT073
uuguuauccaucagc

SEQ ID NO: 591888 - RNA, 13 nt, Escherichia coli CFT073
uuuaucugccgga

SEQ ID NO: 591889 - RNA, 13 nt, Escherichia coli CFT073
uuucaauuccugg

SEQ ID NO: 591890 - RNA, 18 nt, Escherichia coli CFT073
uuucacaccaucaacaaa

SEQ ID NO: 591891 - RNA, 15 nt, Escherichia coli CFT073
uuucacgcccagucc

SEQ ID NO: 591892 - RNA, 18 nt, Escherichia coli CFT073
uuucacgauguaauccug

SEQ ID NO: 591893 - RNA, 18 nt, Escherichia coli CFT073
uuucacuucgucagaaau

SEQ ID NO: 591894 - RNA, 10 nt, Escherichia coli CFT073
uuucagccgg

SEQ ID NO: 591895 - RNA, 13 nt, Escherichia coli CFT073
uuuacuugccugu

SEQ ID NO: 591896 - RNA, 20 nt, Escherichia coli CFT073
uuuacuguggucgacaacca

SEQ ID NO: 591897 - RNA, 21 nt, Escherichia coli CFT073
uuuauccuaauccuggccaua

SEQ ID NO: 591898 - RNA, 22 nt, Escherichia coli CFT073
uuuauccgaacacucguccagu

SEQ ID NO: 591899 - RNA, 14 nt, Escherichia coli CFT073
uucugucacgcugg

SEQ ID NO: 591900 - RNA, 19 nt, Escherichia coli CFT073
uucuggcagauugucgguu

SEQ ID NO: 591901 - RNA, 14 nt, Escherichia coli CFT073
uucuggcggcggca

SEQ ID NO: 591902 - RNA, 20 nt, Escherichia coli CFT073
uucugcgcuacgaccgauca

SEQ ID NO: 591903 - RNA, 22 nt, Escherichia coli CFT073
uucugcguuagaaaacgccugc

SEQ ID NO: 591904 - RNA, 11 nt, Escherichia coli CFT073
uucugcugcuu

SEQ ID NO: 591905 - RNA, 22 nt, Escherichia coli CFT073
uucugcuucgccaucuccauca

SEQ ID NO: 591906 - RNA, 22 nt, Escherichia coli CFT073
uucuucaggccagccugaucca

SEQ ID NO: 591907 - RNA, 21 nt, Escherichia coli CFT073
uucuucaauuuccgucgcaug

SEQ ID NO: 591908 - RNA, 17 nt, Escherichia coli CFT073
uucuucuuguucaucau

SEQ ID NO: 591909 - RNA, 15 nt, Escherichia coli CFT073
uucuuccggcagcca

SEQ ID NO: 591910 - RNA, 19 nt, Escherichia coli CFT073
uucuaucaaccugaggccu

SEQ ID NO: 591911 - RNA, 23 nt, Escherichia coli CFT073
uucucagucauaacguucagcac

SEQ ID NO: 591912 - RNA, 19 nt, Escherichia coli CFT073
uucuaucuucaucuccugg

SEQ ID NO: 591913 - RNA, 19 nt, Escherichia coli CFT073
uucucaccaugaccgauca

SEQ ID NO: 591914 - RNA, 15 nt, Escherichia coli CFT073
uucucagcacauuga

SEQ ID NO: 591915 - RNA, 14 nt, Escherichia coli CFT073
uucuccucaacgau

SEQ ID NO: 591916 - RNA, 23 nt, Escherichia coli CFT073
uucucgaaacgcuuuuaacggug

SEQ ID NO: 591917 - RNA, 21 nt, Escherichia coli CFT073
uucucuuuguuaaacagugcc

SEQ ID NO: 591918 - RNA, 23 nt, Escherichia coli CFT073
uucucgugcuucgaaacagaaau

SEQ ID NO: 591919 - RNA, 16 nt, Escherichia coli CFT073
uucugaggugagcaua

SEQ ID NO: 591920 - RNA, 18 nt, Escherichia coli CFT073
uucugcaaucgucugcug

SEQ ID NO: 591921 - RNA, 13 nt, Escherichia coli CFT073
uucggugacuuca

SEQ ID NO: 591922 - RNA, 17 nt, Escherichia coli CFT073
uucggugaugaauccgg

SEQ ID NO: 591923 - RNA, 15 nt, Escherichia coli CFT073
uucgguaaacggcac

SEQ ID NO: 591924 - RNA, 20 nt, Escherichia coli CFT073
uucggccccgguucgcuuuu

SEQ ID NO: 591925 - RNA, 21 nt, Escherichia coli CFT073
uucuaaagcaacuccaucaag

SEQ ID NO: 591926 - RNA, 16 nt, Escherichia coli CFT073
uucuaccguaucuacc

SEQ ID NO: 591927 - RNA, 20 nt, Escherichia coli CFT073
uucgguguauuucgaaugcu

SEQ ID NO: 591928 - RNA, 20 nt, Escherichia coli CFT073
uucgguuuugcgccaucaac

SEQ ID NO: 591929 - RNA, 22 nt, Escherichia coli CFT073
uucgucaccugguagcggguga

SEQ ID NO: 591930 - RNA, 13 nt, Escherichia coli CFT073
uucguccaccagg

SEQ ID NO: 591931 - RNA, 14 nt, Escherichia coli CFT073
uucgucgucuucgu

SEQ ID NO: 591932 - RNA, 17 nt, Escherichia coli CFT073
uucccccacugugcacc

SEQ ID NO: 591933 - RNA, 18 nt, Escherichia coli CFT073
uucccuuccgccaucaau

SEQ ID NO: 591934 - RNA, 12 nt, Escherichia coli CFT073
uuccgccagcgg

SEQ ID NO: 591935 - RNA, 16 nt, Escherichia coli CFT073
uuccgccauuucuggc

SEQ ID NO: 591936 - RNA, 16 nt, Escherichia coli CFT073
uuccugaaucgccgaa

SEQ ID NO: 591937 - RNA, 14 nt, Escherichia coli CFT073
uuccugaaugguga

SEQ ID NO: 591938 - RNA, 15 nt, Escherichia coli CFT073
uuccucguuucgccc

SEQ ID NO: 591939 - RNA, 20 nt, Escherichia coli CFT073
uuccugaugaaaaaucucca

SEQ ID NO: 591940 - RNA, 22 nt, Escherichia coli CFT073
uuccugcaaacaguaacccagc

SEQ ID NO: 591941 - RNA, 23 nt, Escherichia coli CFT073
uuccugcaaacaguaacccagca

SEQ ID NO: 591942 - RNA, 17 nt, Escherichia coli CFT073
uuccugcacaaugccuu

SEQ ID NO: 591943 - RNA, 16 nt, Escherichia coli CFT073
uuccugcgcuuccagu

SEQ ID NO: 591944 - RNA, 21 nt, Escherichia coli CFT073
uuccuggaaccagugaauacu

SEQ ID NO: 591945 - RNA, 13 nt, Escherichia coli CFT073
uuccuggaacugg

SEQ ID NO: 591946 - RNA, 14 nt, Escherichia coli CFT073
uuccugcucaucag

SEQ ID NO: 591947 - RNA, 19 nt, Escherichia coli CFT073
uucgaagaaaaacuggaug

SEQ ID NO: 591948 - RNA, 12 nt, Escherichia coli CFT073
uucgacaacuuu

SEQ ID NO: 591949 - RNA, 21 nt, Escherichia coli CFT073
uucgaccauugcguguuacgu

SEQ ID NO: 591950 - RNA, 14 nt, Escherichia coli CFT073
uucgacuuccacca

SEQ ID NO: 591951 - RNA, 20 nt, Escherichia coli CFT073
uucgauggucauauccagca

SEQ ID NO: 591952 - RNA, 21 nt, Escherichia coli CFT073
uucgcauccgguuaucgccug

SEQ ID NO: 591953 - RNA, 14 nt, Escherichia coli CFT073
uucgccacaaagcu

SEQ ID NO: 591954 - RNA, 9 nt, Escherichia coli CFT073
uucgccagc

SEQ ID NO: 591955 - RNA, 16 nt, Escherichia coli CFT073
uucgccagcacggcgc

SEQ ID NO: 591956 - RNA, 13 nt, Escherichia coli CFT073
uucgccaucccug

SEQ ID NO: 591957 - RNA, 16 nt, Escherichia coli CFT073
uucgcccgccgcuaac

SEQ ID NO: 591958 - RNA, 21 nt, Escherichia coli CFT073
uucgccguguaauucgccguc

SEQ ID NO: 591959 - RNA, 16 nt, Escherichia coli CFT073
uucgccguuaccagca

SEQ ID NO: 591960 - RNA, 23 nt, Escherichia coli CFT073
uucgccgcgcccgcguuccugac

SEQ ID NO: 591961 - RNA, 17 nt, Escherichia coli CFT073
uucgccgcagcaucguc

SEQ ID NO: 591962 - RNA, 14 nt, Escherichia coli CFT073
uucgccgcaucguc

SEQ ID NO: 591963 - RNA, 21 nt, Escherichia coli CFT073
uucgccgcccagucccguacc

SEQ ID NO: 591964 - RNA, 15 nt, Escherichia coli CFT073
uucgcguuguauaac

SEQ ID NO: 591965 - RNA, 20 nt, Escherichia coli CFT073
uucgcuaaaaguauggacgu

SEQ ID NO: 591966 - RNA, 12 nt, Escherichia coli CFT073
uucgcguaggug

SEQ ID NO: 591967 - RNA, 18 nt, Escherichia coli CFT073
uucgcgcuuaacgcgggc

SEQ ID NO: 591968 - RNA, 12 nt, Escherichia coli CFT073
uucgcgccaaca

SEQ ID NO: 591969 - RNA, 22 nt, Escherichia coli CFT073
uucgcuuuacccugguuagcaa

SEQ ID NO: 591970 - RNA, 23 nt, Escherichia coli CFT073
uucgcuuaacaguuccagcaaau

SEQ ID NO: 591971 - RNA, 23 nt, Escherichia coli CFT073
uucgcuuaccaugccaacgcgga

SEQ ID NO: 591972 - RNA, 18 nt, Escherichia coli CFT073
uucgcuggauguuggcgg

SEQ ID NO: 591973 - RNA, 20 nt, Escherichia coli CFT073
uucgcuggcaaagccgucca

SEQ ID NO: 591974 - RNA, 13 nt, Escherichia coli CFT073
uucggauccagca

SEQ ID NO: 591975 - RNA, 19 nt, Escherichia coli CFT073
uucggcaaccgcauccaga

SEQ ID NO: 591976 - RNA, 16 nt, Escherichia coli CFT073
uucggcauggggucag

SEQ ID NO: 591977 - RNA, 22 nt, Escherichia coli CFT073
uucggcauuaauuaguaggccg

SEQ ID NO: 591978 - RNA, 15 nt, Escherichia coli CFT073
uuaguuagaguuaau

SEQ ID NO: 591979 - RNA, 22 nt, Escherichia coli CFT073
uuauaaaucccugccgccauca

SEQ ID NO: 591980 - RNA, 19 nt, Escherichia coli CFT073
uuauacucacgaaucauag

SEQ ID NO: 591981 - RNA, 12 nt, Escherichia coli CFT073
uuauccaucaaa

SEQ ID NO: 591982 - RNA, 22 nt, Escherichia coli CFT073
uuagcgucaaggggucaaugcc

SEQ ID NO: 591983 - RNA, 16 nt, Escherichia coli CFT073
uuagccggauaagcaa

SEQ ID NO: 591984 - RNA, 22 nt, Escherichia coli CFT073
uuagcgauaaaacgccgcuggu

SEQ ID NO: 591985 - RNA, 16 nt, Escherichia coli CFT073
uuagcgaucuguucau

SEQ ID NO: 591986 - RNA, 14 nt, Escherichia coli CFT073
uuagcaaacgacac

SEQ ID NO: 591987 - RNA, 13 nt, Escherichia coli CFT073
uuacugacaugca

SEQ ID NO: 591988 - RNA, 22 nt, Escherichia coli CFT073
uuacugaugcgcacacgcgcug

SEQ ID NO: 591989 - RNA, 24 nt, Escherichia coli CFT073
uuacugauuaacuugcgacagcca

SEQ ID NO: 591990 - RNA, 16 nt, Escherichia coli CFT073
uuacugcagccagcgu

SEQ ID NO: 591991 - RNA, 16 nt, Escherichia coli CFT073
uuacucacaucugaca

SEQ ID NO: 591992 - RNA, 19 nt, Escherichia coli CFT073
uuacggccauggaacaucc

SEQ ID NO: 591993 - RNA, 18 nt, Escherichia coli CFT073
uuacggcggucuggcgau

SEQ ID NO: 591994 - RNA, 22 nt, Escherichia coli CFT073
uuacgguaagccgcaaccaccu

SEQ ID NO: 591995 - RNA, 13 nt, Escherichia coli CFT073
uuacgcggcuuca

SEQ ID NO: 591996 - RNA, 18 nt, Escherichia coli CFT073
uuacgcugauuggcccca

SEQ ID NO: 591997 - RNA, 17 nt, Escherichia coli CFT073
uuacgccggugauuaaa

SEQ ID NO: 591998 - RNA, 12 nt, Escherichia coli CFT073
uuacgccucagc

SEQ ID NO: 591999 - RNA, 20 nt, Escherichia coli CFT073
uuacgaucgagauugauccc

SEQ ID NO: 592000 - RNA, 18 nt, Escherichia coli CFT073
uuacgaaaucggcaccgc

SEQ ID NO: 592001 - RNA, 16 nt, Escherichia coli CFT073
uuacgcaaaauaucga

SEQ ID NO: 592002 - RNA, 21 nt, Escherichia coli CFT073
uuacgcaguuguucggcgcug

SEQ ID NO: 592003 - RNA, 21 nt, Escherichia coli CFT073
uuaauguccuuuuccggcguc

SEQ ID NO: 592004 - RNA, 15 nt, Escherichia coli CFT073
uuaaugucggaugcg

SEQ ID NO: 592005 - RNA, 19 nt, Escherichia coli CFT073
uuaauucuguccuccauga

SEQ ID NO: 592006 - RNA, 19 nt, Escherichia coli CFT073
uuaccggagcugcagccag

SEQ ID NO: 592007 - RNA, 21 nt, Escherichia coli CFT073
uuaccgggcuacaacgcacca

SEQ ID NO: 592008 - RNA, 22 nt, Escherichia coli CFT073
uuacgaaaaggauaaauaaaau

SEQ ID NO: 592009 - RNA, 18 nt, Escherichia coli CFT073
uguuuagcguuauauuau

SEQ ID NO: 592010 - RNA, 16 nt, Escherichia coli CFT073
uguuguaaaacgcgcc

SEQ ID NO: 592011 - RNA, 17 nt, Escherichia coli CFT073
uguuuacagcagccagc

SEQ ID NO: 592012 - RNA, 12 nt, Escherichia coli CFT073
uguuggugccag

SEQ ID NO: 592013 - RNA, 22 nt, Escherichia coli CFT073
ugugcucuaacccuuccagauu

SEQ ID NO: 592014 - RNA, 20 nt, Escherichia coli CFT073
ugugcuuguaaaacagccaa

SEQ ID NO: 592015 - RNA, 18 nt, Escherichia coli CFT073
uuaaaccaacaaaacuca

SEQ ID NO: 592016 - RNA, 13 nt, Escherichia coli CFT073
uuaaaccaucagc

SEQ ID NO: 592017 - RNA, 14 nt, Escherichia coli CFT073
uuaaagagaucaaa

SEQ ID NO: 592018 - RNA, 16 nt, Escherichia coli CFT073
uuaauaccagaauaag

SEQ ID NO: 592019 - RNA, 14 nt, Escherichia coli CFT073
uuaauaccaucggc

SEQ ID NO: 592020 - RNA, 14 nt, Escherichia coli CFT073
uuaauaccggcauc

SEQ ID NO: 592021 - RNA, 14 nt, Escherichia coli CFT073
uuaauaccugcacc

SEQ ID NO: 592022 - RNA, 14 nt, Escherichia coli CFT073
uuaagucaacacca

SEQ ID NO: 592023 - RNA, 21 nt, Escherichia coli CFT073
uuaauaaggcguacauccggc

SEQ ID NO: 592024 - RNA, 23 nt, Escherichia coli CFT073
uuaagugaaccuuaagaguucaa

SEQ ID NO: 592025 - RNA, 14 nt, Escherichia coli CFT073
uucaaaucaccaaa

SEQ ID NO: 592026 - RNA, 19 nt, Escherichia coli CFT073
uucaacuucugcugugacu

SEQ ID NO: 592027 - RNA, 21 nt, Escherichia coli CFT073
uucaauaaugucuuagcgugc

SEQ ID NO: 592028 - RNA, 14 nt, Escherichia coli CFT073
uucaauacgcauca

SEQ ID NO: 592029 - RNA, 21 nt, Escherichia coli CFT073
uucaaugaucgucauaucauc

SEQ ID NO: 592030 - RNA, 16 nt, Escherichia coli CFT073
uucaauggcgucaaca

SEQ ID NO: 592031 - RNA, 21 nt, Escherichia coli CFT073
uucagcacuggcggcagcagg

SEQ ID NO: 592032 - RNA, 18 nt, Escherichia coli CFT073
uucagcacuucggcauca

SEQ ID NO: 592033 - RNA, 18 nt, Escherichia coli CFT073
uucagccagaggcggcaa

SEQ ID NO: 592034 - RNA, 22 nt, Escherichia coli CFT073
uucagcaacgugcuucgcgcug

SEQ ID NO: 592035 - RNA, 14 nt, Escherichia coli CFT073
uucagcaccagaua

SEQ ID NO: 592036 - RNA, 23 nt, Escherichia coli CFT073
uucagcacgguguuaccguacca

SEQ ID NO: 592037 - RNA, 14 nt, Escherichia coli CFT073
uucacgccgccaaa

SEQ ID NO: 592038 - RNA, 13 nt, Escherichia coli CFT073
uucagaugaccaa

SEQ ID NO: 592039 - RNA, 22 nt, Escherichia coli CFT073
uucaccucagugaccgucaugc

SEQ ID NO: 592040 - RNA, 16 nt, Escherichia coli CFT073
uucaccucuucauuaa

SEQ ID NO: 592041 - RNA, 18 nt, Escherichia coli CFT073
uucaccugccugcagcug

SEQ ID NO: 592042 - RNA, 22 nt, Escherichia coli CFT073
uucacgaagauauucaucagca

SEQ ID NO: 592043 - RNA, 17 nt, Escherichia coli CFT073
uucacgccgcaucaggc

SEQ ID NO: 592044 - RNA, 18 nt, Escherichia coli CFT073
uucacgccgcauccggca

SEQ ID NO: 592045 - RNA, 16 nt, Escherichia coli CFT073
uucaaacuucgccaca

SEQ ID NO: 592046 - RNA, 16 nt, Escherichia coli CFT073
uucaaaccuucaucca

SEQ ID NO: 592047 - RNA, 19 nt, Escherichia coli CFT073
uucaaaacggucacggcug

SEQ ID NO: 592048 - RNA, 23 nt, Escherichia coli CFT073
uuauuuuaccauauaaacauauc

SEQ ID NO: 592049 - RNA, 12 nt, Escherichia coli CFT073
uuauucauaucu

SEQ ID NO: 592050 - RNA, 18 nt, Escherichia coli CFT073
uuauccggcauauaagug

SEQ ID NO: 592051 - RNA, 19 nt, Escherichia coli CFT073
uuauccggccuacggguga

SEQ ID NO: 592052 - RNA, 16 nt, Escherichia coli CFT073
uuauccucuguaaacu

SEQ ID NO: 592053 - RNA, 18 nt, Escherichia coli CFT073
uuaucgauuuucaaaaua

SEQ ID NO: 592054 - RNA, 22 nt, Escherichia coli CFT073
uucauuuaagccacuuccagca

SEQ ID NO: 592055 - RNA, 14 nt, Escherichia coli CFT073
uucauucauccgcc

SEQ ID NO: 592056 - RNA, 17 nt, Escherichia coli CFT073
uucauucacgauuugcg

SEQ ID NO: 592057 - RNA, 14 nt, Escherichia coli CFT073
uuccaacgccacca

SEQ ID NO: 592058 - RNA, 16 nt, Escherichia coli CFT073
uuccaguaaugcgccc

SEQ ID NO: 592059 - RNA, 17 nt, Escherichia coli CFT073
uuccaguaaugcgccca

SEQ ID NO: 592060 - RNA, 18 nt, Escherichia coli CFT073
uuccaguuccauccacca

SEQ ID NO: 592061 - RNA, 17 nt, Escherichia coli CFT073
uuccaucgcaucuucgc

SEQ ID NO: 592062 - RNA, 17 nt, Escherichia coli CFT073
uuccauaucgcuggcug

SEQ ID NO: 592063 - RNA, 21 nt, Escherichia coli CFT073
uuccaguucuuccgccagaca

SEQ ID NO: 592064 - RNA, 19 nt, Escherichia coli CFT073
uuccauucuuucccagcag

SEQ ID NO: 592065 - RNA, 15 nt, Escherichia coli CFT073
uuccauugcgcccau

SEQ ID NO: 592066 - RNA, 14 nt, Escherichia coli CFT073
uuccauuucaucgc

SEQ ID NO: 592067 - RNA, 16 nt, Escherichia coli CFT073
uucccauucucggcgg

SEQ ID NO: 592068 - RNA, 20 nt, Escherichia coli CFT073
uucccacugacgcucggcgc

SEQ ID NO: 592069 - RNA, 16 nt, Escherichia coli CFT073
uucccagcaccgcaga

SEQ ID NO: 592070 - RNA, 21 nt, Escherichia coli CFT073
uucaggccaaagccgccgagc

SEQ ID NO: 592071 - RNA, 12 nt, Escherichia coli CFT073
uucaggaacugc

SEQ ID NO: 592072 - RNA, 16 nt, Escherichia coli CFT073
uucagcguauccagca

SEQ ID NO: 592073 - RNA, 18 nt, Escherichia coli CFT073
uucagcgcccugccgauc

SEQ ID NO: 592074 - RNA, 23 nt, Escherichia coli CFT073
uucagcgagggcuaugcgcauca

SEQ ID NO: 592075 - RNA, 14 nt, Escherichia coli CFT073
uucagccccaucag

SEQ ID NO: 592076 - RNA, 16 nt, Escherichia coli CFT073
uucagcgccagcuucg

SEQ ID NO: 592077 - RNA, 22 nt, Escherichia coli CFT073
uucaucgcggucagcugcuguu

SEQ ID NO: 592078 - RNA, 19 nt, Escherichia coli CFT073
uucaucggauaggcaccgc

SEQ ID NO: 592079 - RNA, 21 nt, Escherichia coli CFT073
uucaucggcaguuugagauug

SEQ ID NO: 592080 - RNA, 20 nt, Escherichia coli CFT073
uucauccggcuguuccagca

SEQ ID NO: 592081 - RNA, 15 nt, Escherichia coli CFT073
uucaugcccgccgac

SEQ ID NO: 592082 - RNA, 22 nt, Escherichia coli CFT073
uucaugcacucguaacauggcg

SEQ ID NO: 592083 - RNA, 22 nt, Escherichia coli CFT073
uucaugcucaccaauccaggca

SEQ ID NO: 592084 - RNA, 14 nt, Escherichia coli CFT073
uucaugcuccagca

SEQ ID NO: 592085 - RNA, 17 nt, Escherichia coli CFT073
uucaucuucaacggcca

SEQ ID NO: 592086 - RNA, 13 nt, Escherichia coli CFT073
uucaucuuccagc

SEQ ID NO: 592087 - RNA, 16 nt, Escherichia coli CFT073
uggcuggcgcggcgca

SEQ ID NO: 592088 - RNA, 22 nt, Escherichia coli CFT073
uggcuguuucgcuucuucagcc

SEQ ID NO: 592089 - RNA, 15 nt, Escherichia coli CFT073
uggcuucaucccggu

SEQ ID NO: 592090 - RNA, 17 nt, Escherichia coli CFT073
uggcuaucggcaaaaau

SEQ ID NO: 592091 - RNA, 16 nt, Escherichia coli CFT073
uggcguuuaaucgccu

SEQ ID NO: 592092 - RNA, 15 nt, Escherichia coli CFT073
uggcguuugccaccu

SEQ ID NO: 592093 - RNA, 16 nt, Escherichia coli CFT073
uggcguuguccgccag

SEQ ID NO: 592094 - RNA, 20 nt, Escherichia coli CFT073
uggcgguauuugauaccagu

SEQ ID NO: 592095 - RNA, 16 nt, Escherichia coli CFT073
uggcggggaucacucc

SEQ ID NO: 592096 - RNA, 14 nt, Escherichia coli CFT073
uggcgggcuggugu

SEQ ID NO: 592097 - RNA, 21 nt, Escherichia coli CFT073
uggcgggauuuuuagcaugug

SEQ ID NO: 592098 - RNA, 17 nt, Escherichia coli CFT073
uggcggcuuggacgcac

SEQ ID NO: 592099 - RNA, 19 nt, Escherichia coli CFT073
ugggcuaccgcgagcguag

SEQ ID NO: 592100 - RNA, 18 nt, Escherichia coli CFT073
ugggcuucaccaccagaa

SEQ ID NO: 592101 - RNA, 21 nt, Escherichia coli CFT073
ugggcuucgauacugccuuuc

SEQ ID NO: 592102 - RNA, 13 nt, Escherichia coli CFT073
uggggcaagguag

SEQ ID NO: 592103 - RNA, 17 nt, Escherichia coli CFT073
uggggaucgugauaaua

SEQ ID NO: 592104 - RNA, 21 nt, Escherichia coli CFT073
uggguagaguuugaacucaca

SEQ ID NO: 592105 - RNA, 13 nt, Escherichia coli CFT073
ugguacuggcgac

SEQ ID NO: 592106 - RNA, 19 nt, Escherichia coli CFT073
ugguacgggacagcagguu

SEQ ID NO: 592107 - RNA, 19 nt, Escherichia coli CFT073
uggccgcgcaauugcugaa

SEQ ID NO: 592108 - RNA, 20 nt, Escherichia coli CFT073
uggccgcgcaauugcugaaa

SEQ ID NO: 592109 - RNA, 22 nt, Escherichia coli CFT073
uggccgcuccaaggucuccgcc

SEQ ID NO: 592110 - RNA, 17 nt, Escherichia coli CFT073
uggcgacugccagccac

SEQ ID NO: 592111 - RNA, 19 nt, Escherichia coli CFT073
uggcgauauugccgcgaua

SEQ ID NO: 592112 - RNA, 22 nt, Escherichia coli CFT073
uggcgauaaucgaaccaaacag

SEQ ID NO: 592113 - RNA, 20 nt, Escherichia coli CFT073
uggcgauaaugaaccaauca

SEQ ID NO: 592114 - RNA, 14 nt, Escherichia coli CFT073
uggcgauaccccaa

SEQ ID NO: 592115 - RNA, 22 nt, Escherichia coli CFT073
uggcgauuauccaugccacagu

SEQ ID NO: 592116 - RNA, 23 nt, Escherichia coli CFT073
uggcgauugcuguuggcguugca

SEQ ID NO: 592117 - RNA, 23 nt, Escherichia coli CFT073
uggcgauguaauucagccauucg

SEQ ID NO: 592118 - RNA, 19 nt, Escherichia coli CFT073
uggcggccugaugcggcgu

SEQ ID NO: 592119 - RNA, 13 nt, Escherichia coli CFT073
uggcggcgcgaua

SEQ ID NO: 592120 - RNA, 22 nt, Escherichia coli CFT073
uggcgcguccggcgucgcuucu

SEQ ID NO: 592121 - RNA, 16 nt, Escherichia coli CFT073
uggucaccacaccgac

SEQ ID NO: 592122 - RNA, 13 nt, Escherichia coli CFT073
ugguaucaaacag

SEQ ID NO: 592123 - RNA, 21 nt, Escherichia coli CFT073
ugguauggcugucgcacggcg

SEQ ID NO: 592124 - RNA, 16 nt, Escherichia coli CFT073
ugguccacacgcgccc

SEQ ID NO: 592125 - RNA, 17 nt, Escherichia coli CFT073
uggucaguuuaaacaga

SEQ ID NO: 592126 - RNA, 14 nt, Escherichia coli CFT073
uggucauucgucca

SEQ ID NO: 592127 - RNA, 23 nt, Escherichia coli CFT073
uggucggcgagauauucccccac

SEQ ID NO: 592128 - RNA, 22 nt, Escherichia coli CFT073
uggucgcggaccaacaaaaauc

SEQ ID NO: 592129 - RNA, 23 nt, Escherichia coli CFT073
ugguccuugguggccauguuguu

SEQ ID NO: 592130 - RNA, 16 nt, Escherichia coli CFT073
ugguuaaguugaaaac

SEQ ID NO: 592131 - RNA, 23 nt, Escherichia coli CFT073
ugguuaacguucgaucacccggc

SEQ ID NO: 592132 - RNA, 21 nt, Escherichia coli CFT073
ugguuagccgcguacauugcu

SEQ ID NO: 592133 - RNA, 19 nt, Escherichia coli CFT073
ugguuagccucuacaguau

SEQ ID NO: 592134 - RNA, 19 nt, Escherichia coli CFT073
ugguuauccagcaaccagg

SEQ ID NO: 592135 - RNA, 19 nt, Escherichia coli CFT073
ugguuauuaccaaaaacgg

SEQ ID NO: 592136 - RNA, 22 nt, Escherichia coli CFT073
uggugcccaggguaagaugaau

SEQ ID NO: 592137 - RNA, 14 nt, Escherichia coli CFT073
uggugcgcaccagg

SEQ ID NO: 592138 - RNA, 17 nt, Escherichia coli CFT073
uggucgguaaacaucag

SEQ ID NO: 592139 - RNA, 17 nt, Escherichia coli CFT073
uggucgguuaacuccac

SEQ ID NO: 592140 - RNA, 13 nt, Escherichia coli CFT073
uggugagcgcaca

SEQ ID NO: 592141 - RNA, 20 nt, Escherichia coli CFT073
ugucgccaucguuaaaaaac

SEQ ID NO: 592142 - RNA, 17 nt, Escherichia coli CFT073
ugucgguaauugcgccg

SEQ ID NO: 592143 - RNA, 21 nt, Escherichia coli CFT073
ugucgucgauaauaucggccu

SEQ ID NO: 592144 - RNA, 14 nt, Escherichia coli CFT073
ugucguccgguacg

SEQ ID NO: 592145 - RNA, 20 nt, Escherichia coli CFT073
ugucuucaucgaugcugcuc

SEQ ID NO: 592146 - RNA, 15 nt, Escherichia coli CFT073
ugugcgcgguaaagc

SEQ ID NO: 592147 - RNA, 19 nt, Escherichia coli CFT073
ugucugagauuacauuggg

SEQ ID NO: 592148 - RNA, 12 nt, Escherichia coli CFT073
ugucugccauau

SEQ ID NO: 592149 - RNA, 21 nt, Escherichia coli CFT073
ugucuggaaauuaagcggcaa

SEQ ID NO: 592150 - RNA, 13 nt, Escherichia coli CFT073
ugucaacagcguu

SEQ ID NO: 592151 - RNA, 13 nt, Escherichia coli CFT073
ugucaauaaacgc

SEQ ID NO: 592152 - RNA, 15 nt, Escherichia coli CFT073
ugucaauaaacgccu

SEQ ID NO: 592153 - RNA, 15 nt, Escherichia coli CFT073
ugucaaucagggcga

SEQ ID NO: 592154 - RNA, 20 nt, Escherichia coli CFT073
uguaggccugauaagacgcg

SEQ ID NO: 592155 - RNA, 16 nt, Escherichia coli CFT073
uguaaauaucaggauc

SEQ ID NO: 592156 - RNA, 20 nt, Escherichia coli CFT073
uguaggccugauaagcggag

SEQ ID NO: 592157 - RNA, 20 nt, Escherichia coli CFT073
uguaggccugauaagcguag

SEQ ID NO: 592158 - RNA, 20 nt, Escherichia coli CFT073
uguaggccugauaaggcauu

SEQ ID NO: 592159 - RNA, 18 nt, Escherichia coli CFT073
uguaggucggauaagacg

SEQ ID NO: 592160 - RNA, 20 nt, Escherichia coli CFT073
uguaggucggauaaggcguu

SEQ ID NO: 592161 - RNA, 12 nt, Escherichia coli CFT073
uguaguuaaaaa

SEQ ID NO: 592162 - RNA, 22 nt, Escherichia coli CFT073
uguaguuaaaaaaugcagcaaa

SEQ ID NO: 592163 - RNA, 21 nt, Escherichia coli CFT073
uguccaucgcuacaggcuauc

SEQ ID NO: 592164 - RNA, 14 nt, Escherichia coli CFT073
uguccguaucccac

SEQ ID NO: 592165 - RNA, 17 nt, Escherichia coli CFT073
ugucgauuaucgacucg

SEQ ID NO: 592166 - RNA, 18 nt, Escherichia coli CFT073
ugucgauuaucgacucgc

SEQ ID NO: 592167 - RNA, 19 nt, Escherichia coli CFT073
ugucgcacggcgcaccgca

SEQ ID NO: 592168 - RNA, 14 nt, Escherichia coli CFT073
ugcugccuuucgcu

SEQ ID NO: 592169 - RNA, 20 nt, Escherichia coli CFT073
ugcugcgccaguugcuuauc

SEQ ID NO: 592170 - RNA, 15 nt, Escherichia coli CFT073
ugcugccggaacagg

SEQ ID NO: 592171 - RNA, 19 nt, Escherichia coli CFT073
ugcugccuucacggcuuug

SEQ ID NO: 592172 - RNA, 11 nt, Escherichia coli CFT073
ugcugcuggca

SEQ ID NO: 592173 - RNA, 22 nt, Escherichia coli CFT073
ugcugcucugguggggcaaaaa

SEQ ID NO: 592174 - RNA, 15 nt, Escherichia coli CFT073
ugcugcucuucacgc

SEQ ID NO: 592175 - RNA, 21 nt, Escherichia coli CFT073
ugcugcgcggugacaucaaua

SEQ ID NO: 592176 - RNA, 20 nt, Escherichia coli CFT073
ugcugcacauacugcaucag

SEQ ID NO: 592177 - RNA, 19 nt, Escherichia coli CFT073
ugcugcaaggugauuugcg

SEQ ID NO: 592178 - RNA, 15 nt, Escherichia coli CFT073
ugcugacuugcggcc

SEQ ID NO: 592179 - RNA, 23 nt, Escherichia coli CFT073
ugcugauugcggucagcgcagca

SEQ ID NO: 592180 - RNA, 22 nt, Escherichia coli CFT073
ugcugcaguuuacgagugcgcu

SEQ ID NO: 592181 - RNA, 15 nt, Escherichia coli CFT073
ugcucguagaagcca

SEQ ID NO: 592182 - RNA, 16 nt, Escherichia coli CFT073
ugcucguagaagccag

SEQ ID NO: 592183 - RNA, 15 nt, Escherichia coli CFT073
ugcucuggcagcacc

SEQ ID NO: 592184 - RNA, 18 nt, Escherichia coli CFT073
ugcucuucuuucaucaug

SEQ ID NO: 592185 - RNA, 12 nt, Escherichia coli CFT073
ugcucugccagc

SEQ ID NO: 592186 - RNA, 20 nt, Escherichia coli CFT073
ugcugacguagcagcuccgc

SEQ ID NO: 592187 - RNA, 17 nt, Escherichia coli CFT073
ugcugauaagacgcauc

SEQ ID NO: 592188 - RNA, 15 nt, Escherichia coli CFT073
ugcugauagagcuca

SEQ ID NO: 592189 - RNA, 15 nt, Escherichia coli CFT073
ugcuguuuccaguaa

SEQ ID NO: 592190 - RNA, 19 nt, Escherichia coli CFT073
ugcuucaacgaaagcgccu

SEQ ID NO: 592191 - RNA, 19 nt, Escherichia coli CFT073
ugcuucaauaauccacggc

SEQ ID NO: 592192 - RNA, 16 nt, Escherichia coli CFT073
ugcuucuaacaucaug

SEQ ID NO: 592193 - RNA, 12 nt, Escherichia coli CFT073
ugcuguacagua

SEQ ID NO: 592194 - RNA, 19 nt, Escherichia coli CFT073
ugcuguacccaaauaaacu

SEQ ID NO: 592195 - RNA, 18 nt, Escherichia coli CFT073
ugcuggcugaacgccugc

SEQ ID NO: 592196 - RNA, 23 nt, Escherichia coli CFT073
ugcuggcaaugaguaguuugguu

SEQ ID NO: 592197 - RNA, 15 nt, Escherichia coli CFT073
ugcuggaucccagaa

SEQ ID NO: 592198 - RNA, 18 nt, Escherichia coli CFT073
ugcuggaugcaugccaac

SEQ ID NO: 592199 - RNA, 16 nt, Escherichia coli CFT073
ugcucauuacaguagc

SEQ ID NO: 592200 - RNA, 20 nt, Escherichia coli CFT073
ugcucauuuucuugccggau

SEQ ID NO: 592201 - RNA, 23 nt, Escherichia coli CFT073
ugcuccagcagcucaaucgccuc

SEQ ID NO: 592202 - RNA, 18 nt, Escherichia coli CFT073
ugcucauagaccauugca

SEQ ID NO: 592203 - RNA, 17 nt, Escherichia coli CFT073
ugcuauuuaacaauucu

SEQ ID NO: 592204 - RNA, 19 nt, Escherichia coli CFT073
ugcucaaggguuucgcggu

SEQ ID NO: 592205 - RNA, 18 nt, Escherichia coli CFT073
ugcuaaacguaacacaua

SEQ ID NO: 592206 - RNA, 17 nt, Escherichia coli CFT073
ugcuaauugcaccaucc

SEQ ID NO: 592207 - RNA, 20 nt, Escherichia coli CFT073
ugcuacuaugauuuuccuga

SEQ ID NO: 592208 - RNA, 13 nt, Escherichia coli CFT073
ugcuagauaagca

SEQ ID NO: 592209 - RNA, 16 nt, Escherichia coli CFT073
ugcucgcgaaaagaaa

SEQ ID NO: 592210 - RNA, 11 nt, Escherichia coli CFT073
ugcuccgccag

SEQ ID NO: 592211 - RNA, 22 nt, Escherichia coli CFT073
ugcucccgaacucgaccugcaa

SEQ ID NO: 592212 - RNA, 19 nt, Escherichia coli CFT073
ugcuccaucaggucaucaa

SEQ ID NO: 592213 - RNA, 17 nt, Escherichia coli CFT073
ugcguugagaaacgccg

SEQ ID NO: 592214 - RNA, 14 nt, Escherichia coli CFT073
ugcguugccgccaa

SEQ ID NO: 592215 - RNA, 15 nt, Escherichia coli CFT073
ugcguuauagcgauu

SEQ ID NO: 592216 - RNA, 15 nt, Escherichia coli CFT073
ugcguaacgugacau

SEQ ID NO: 592217 - RNA, 16 nt, Escherichia coli CFT073
ugcgguuuugucggca

SEQ ID NO: 592218 - RNA, 16 nt, Escherichia coli CFT073
ugcgguugugcaaaaa

SEQ ID NO: 592219 - RNA, 21 nt, Escherichia coli CFT073
ugcgguggauuuaaugccaau

SEQ ID NO: 592220 - RNA, 20 nt, Escherichia coli CFT073
ugcggugcgagcgccuuauc

SEQ ID NO: 592221 - RNA, 19 nt, Escherichia coli CFT073
ugcggugcgccaaacugcc

SEQ ID NO: 592222 - RNA, 15 nt, Escherichia coli CFT073
ugcggugaagccacc

SEQ ID NO: 592223 - RNA, 16 nt, Escherichia coli CFT073
ugcgcgccgugaacgu

SEQ ID NO: 592224 - RNA, 11 nt, Escherichia coli CFT073
ugcgcuggcaa

SEQ ID NO: 592225 - RNA, 17 nt, Escherichia coli CFT073
ugcgcucuuccgguuug

SEQ ID NO: 592226 - RNA, 13 nt, Escherichia coli CFT073
ugcgcccgccagc

SEQ ID NO: 592227 - RNA, 11 nt, Escherichia coli CFT073
ugcgcccgccc

SEQ ID NO: 592228 - RNA, 19 nt, Escherichia coli CFT073
ugcgcgagguaacaauaaa

SEQ ID NO: 592229 - RNA, 23 nt, Escherichia coli CFT073
ugcggaaaguuuacgucgccagu

SEQ ID NO: 592230 - RNA, 17 nt, Escherichia coli CFT073
ugcgcuugcugccaguu

SEQ ID NO: 592231 - RNA, 14 nt, Escherichia coli CFT073
ugcgcuucugccac

SEQ ID NO: 592232 - RNA, 22 nt, Escherichia coli CFT073
ugcgcuucuuccagcaucgccc

SEQ ID NO: 592233 - RNA, 21 nt, Escherichia coli CFT073
ugcggaaucaccggcaaaacc

SEQ ID NO: 592234 - RNA, 20 nt, Escherichia coli CFT073
ugcggcgaaaacgccucauc

SEQ ID NO: 592235 - RNA, 20 nt, Escherichia coli CFT073
ugcggcgagaacgccuuauc

SEQ ID NO: 592236 - RNA, 18 nt, Escherichia coli CFT073
ugcggcgaugaccgccac

SEQ ID NO: 592237 - RNA, 18 nt, Escherichia coli CFT073
ugcggcgaugaugacgcg

SEQ ID NO: 592238 - RNA, 17 nt, Escherichia coli CFT073
ugcggcugcccaucauc

SEQ ID NO: 592239 - RNA, 17 nt, Escherichia coli CFT073
ugcgggccgacgagaaa

SEQ ID NO: 592240 - RNA, 18 nt, Escherichia coli CFT073
ugcgggaguugaucgcca

SEQ ID NO: 592241 - RNA, 19 nt, Escherichia coli CFT073
ugcgggcacaggcgaugcc

SEQ ID NO: 592242 - RNA, 15 nt, Escherichia coli CFT073
ugcgguaaauuuuuu

SEQ ID NO: 592243 - RNA, 18 nt, Escherichia coli CFT073
ugcgguaacaggauggca

SEQ ID NO: 592244 - RNA, 20 nt, Escherichia coli CFT073
ugcggguugcucucgccagc

SEQ ID NO: 592245 - RNA, 17 nt, Escherichia coli CFT073
ugcgaagcuuugcacuc

SEQ ID NO: 592246 - RNA, 20 nt, Escherichia coli CFT073
ugcgaauagcgucuacuaac

SEQ ID NO: 592247 - RNA, 22 nt, Escherichia coli CFT073
ugcgcacgcguaauauccagcg

SEQ ID NO: 592248 - RNA, 19 nt, Escherichia coli CFT073
ugcgccaacgucugccugg

SEQ ID NO: 592249 - RNA, 20 nt, Escherichia coli CFT073
ugcgccaccguuucugccgu

SEQ ID NO: 592250 - RNA, 11 nt, Escherichia coli CFT073
ugcgcccaguu

SEQ ID NO: 592251 - RNA, 15 nt, Escherichia coli CFT073
ugcgcccaucaucau

SEQ ID NO: 592252 - RNA, 19 nt, Escherichia coli CFT073
ugcgccauaaccgccagca

SEQ ID NO: 592253 - RNA, 20 nt, Escherichia coli CFT073
ugcgccauaaccgccagcac

SEQ ID NO: 592254 - RNA, 20 nt, Escherichia coli CFT073
ugcgccacucgauaccagau

SEQ ID NO: 592255 - RNA, 12 nt, Escherichia coli CFT073
ugccuugccagg

SEQ ID NO: 592256 - RNA, 11 nt, Escherichia coli CFT073
ugcgaaacgga

SEQ ID NO: 592257 - RNA, 13 nt, Escherichia coli CFT073
ugccguuuuaccu

SEQ ID NO: 592258 - RNA, 24 nt, Escherichia coli CFT073
ugccuaaagugcugggcuggguga

SEQ ID NO: 592259 - RNA, 14 nt, Escherichia coli CFT073
ugccuguucgccgc

SEQ ID NO: 592260 - RNA, 15 nt, Escherichia coli CFT073
ugccuucaaaucgcc

SEQ ID NO: 592261 - RNA, 22 nt, Escherichia coli CFT073
ugccguuggcggcgugacgcca

SEQ ID NO: 592262 - RNA, 18 nt, Escherichia coli CFT073
ugccguaggcccagccgu

SEQ ID NO: 592263 - RNA, 14 nt, Escherichia coli CFT073
ugccguauaacgcg

SEQ ID NO: 592264 - RNA, 14 nt, Escherichia coli CFT073
ugccguagcggcga

SEQ ID NO: 592265 - RNA, 14 nt, Escherichia coli CFT073
ugcagccgucgccc

SEQ ID NO: 592266 - RNA, 16 nt, Escherichia coli CFT073
ugcagccgucgcccac

SEQ ID NO: 592267 - RNA, 12 nt, Escherichia coli CFT073
ugcagccgccau

SEQ ID NO: 592268 - RNA, 14 nt, Escherichia coli CFT073
ugcagccgccaucg

SEQ ID NO: 592269 - RNA, 23 nt, Escherichia coli CFT073
ugcagcauggguaaagcccaucg

SEQ ID NO: 592270 - RNA, 12 nt, Escherichia coli CFT073
ugcagcauucau

SEQ ID NO: 592271 - RNA, 17 nt, Escherichia coli CFT073
ugcagcauauucgccgu

SEQ ID NO: 592272 - RNA, 14 nt, Escherichia coli CFT073
ugcagaucgccaga

SEQ ID NO: 592273 - RNA, 12 nt, Escherichia coli CFT073
ugcagcaaagac

SEQ ID NO: 592274 - RNA, 21 nt, Escherichia coli CFT073
ugcagcaggcgagcugccagu

SEQ ID NO: 592275 - RNA, 17 nt, Escherichia coli CFT073
ugcagcagcaaacgccg

SEQ ID NO: 592276 - RNA, 13 nt, Escherichia coli CFT073
ugcagcagcuucg

SEQ ID NO: 592277 - RNA, 18 nt, Escherichia coli CFT073
ugcagcaccgccgccagg

SEQ ID NO: 592278 - RNA, 21 nt, Escherichia coli CFT073
ugcagcacgcuggacguggug

SEQ ID NO: 592279 - RNA, 13 nt, Escherichia coli CFT073
ugcagcugcagau

SEQ ID NO: 592280 - RNA, 23 nt, Escherichia coli CFT073
ugcagcuucgccauuucgucguc

SEQ ID NO: 592281 - RNA, 23 nt, Escherichia coli CFT073
ugcaggaaaucaaugccaccaga

SEQ ID NO: 592282 - RNA, 12 nt, Escherichia coli CFT073
ugcaggaacaau

SEQ ID NO: 592283 - RNA, 21 nt, Escherichia coli CFT073
ugcaggaagguuuuaaucgcu

SEQ ID NO: 592284 - RNA, 15 nt, Escherichia coli CFT073
ugcagcgugccuggg

SEQ ID NO: 592285 - RNA, 16 nt, Escherichia coli CFT073
ugcaggcaucggugau

SEQ ID NO: 592286 - RNA, 20 nt, Escherichia coli CFT073
ugcaggccggauaaggcguu

SEQ ID NO: 592287 - RNA, 20 nt, Escherichia coli CFT073
ugcaggccugauaagcguag

SEQ ID NO: 592288 - RNA, 13 nt, Escherichia coli CFT073
ugcaggcuggccc

SEQ ID NO: 592289 - RNA, 15 nt, Escherichia coli CFT073
ugccaacuuugccgu

SEQ ID NO: 592290 - RNA, 14 nt, Escherichia coli CFT073
ugccaacaccacaa

SEQ ID NO: 592291 - RNA, 18 nt, Escherichia coli CFT073
ugcauuuucuaugcugcc

SEQ ID NO: 592292 - RNA, 22 nt, Escherichia coli CFT073
ugccaauaaaacgcaccggcaa

SEQ ID NO: 592293 - RNA, 18 nt, Escherichia coli CFT073
ugccaauaaugcccgcac

SEQ ID NO: 592294 - RNA, 13 nt, Escherichia coli CFT073
ugccaaggucggg

SEQ ID NO: 592295 - RNA, 18 nt, Escherichia coli CFT073
ugccaaguccugccagaa

SEQ ID NO: 592296 - RNA, 22 nt, Escherichia coli CFT073
ugccaaucggcggcacucgcug

SEQ ID NO: 592297 - RNA, 13 nt, Escherichia coli CFT073
ugcauuauugaua

SEQ ID NO: 592298 - RNA, 18 nt, Escherichia coli CFT073
ugccagucuuccgccgga

SEQ ID NO: 592299 - RNA, 16 nt, Escherichia coli CFT073
ugccaguugcgcuuca

SEQ ID NO: 592300 - RNA, 14 nt, Escherichia coli CFT073
ugccaguaauucca

SEQ ID NO: 592301 - RNA, 14 nt, Escherichia coli CFT073
ugccaguaccauca

SEQ ID NO: 592302 - RNA, 17 nt, Escherichia coli CFT073
ugccagucacugugacg

SEQ ID NO: 592303 - RNA, 17 nt, Escherichia coli CFT073
ugccaggugcagcccau

SEQ ID NO: 592304 - RNA, 16 nt, Escherichia coli CFT073
ugccaguaauaaagac

SEQ ID NO: 592305 - RNA, 15 nt, Escherichia coli CFT073
ugccaggcuccagau

SEQ ID NO: 592306 - RNA, 19 nt, Escherichia coli CFT073
ugccaggcuugauccagcg

SEQ ID NO: 592307 - RNA, 16 nt, Escherichia coli CFT073
ugccagguagcguuuc

SEQ ID NO: 592308 - RNA, 19 nt, Escherichia coli CFT073
ugccagguagcguuucacc

SEQ ID NO: 592309 - RNA, 18 nt, Escherichia coli CFT073
ugccaggucgcuugccgc

SEQ ID NO: 592310 - RNA, 19 nt, Escherichia coli CFT073
ugccaggaccgcugaaaua

SEQ ID NO: 592311 - RNA, 19 nt, Escherichia coli CFT073
ugccaggcagcgauuaacu

SEQ ID NO: 592312 - RNA, 18 nt, Escherichia coli CFT073
ugccagaaaccagccacg

SEQ ID NO: 592313 - RNA, 21 nt, Escherichia coli CFT073
ugccagacaaaacugacgcca

SEQ ID NO: 592314 - RNA, 21 nt, Escherichia coli CFT073
ugccaucauggcgaugagaau

SEQ ID NO: 592315 - RNA, 18 nt, Escherichia coli CFT073
ugccaucacuauucagau

SEQ ID NO: 592316 - RNA, 16 nt, Escherichia coli CFT073
ugccauauaacgggcu

SEQ ID NO: 592317 - RNA, 23 nt, Escherichia coli CFT073
ugccauauaacguccaguugaag

SEQ ID NO: 592318 - RNA, 14 nt, Escherichia coli CFT073
ugccauauccagcc

SEQ ID NO: 592319 - RNA, 23 nt, Escherichia coli CFT073
ugccauuaaaccaacaaaacuca

SEQ ID NO: 592320 - RNA, 15 nt, Escherichia coli CFT073
ugccauuaaugucgg

SEQ ID NO: 592321 - RNA, 21 nt, Escherichia coli CFT073
ugccaucgacuucucgcaagc

SEQ ID NO: 592322 - RNA, 21 nt, Escherichia coli CFT073
ugccaucucggauaaggcuuc

SEQ ID NO: 592323 - RNA, 16 nt, Escherichia coli CFT073
ugccauuccacaaaaa

SEQ ID NO: 592324 - RNA, 21 nt, Escherichia coli CFT073
ugccauuccacaaaaaccacu

SEQ ID NO: 592325 - RNA, 15 nt, Escherichia coli CFT073
ugcccguuucucuua

SEQ ID NO: 592326 - RNA, 16 nt, Escherichia coli CFT073
ugccgacaucaaacag

SEQ ID NO: 592327 - RNA, 14 nt, Escherichia coli CFT073
ugccgaauccaaua

SEQ ID NO: 592328 - RNA, 13 nt, Escherichia coli CFT073
ugccgacaaacag

SEQ ID NO: 592329 - RNA, 16 nt, Escherichia coli CFT073
ugccgccagcauuguc

SEQ ID NO: 592330 - RNA, 14 nt, Escherichia coli CFT073
ugccgcgcagcgaa

SEQ ID NO: 592331 - RNA, 22 nt, Escherichia coli CFT073
ugccgcgcauagcaccaccgac

SEQ ID NO: 592332 - RNA, 15 nt, Escherichia coli CFT073
ugccgccaguucgau

SEQ ID NO: 592333 - RNA, 23 nt, Escherichia coli CFT073
ugaugaauuuuaauauguugacu

SEQ ID NO: 592334 - RNA, 15 nt, Escherichia coli CFT073
ugaucagcgguuuug

SEQ ID NO: 592335 - RNA, 13 nt, Escherichia coli CFT073
ugaucaagcguag

SEQ ID NO: 592336 - RNA, 16 nt, Escherichia coli CFT073
ugaucaagcguagugg

SEQ ID NO: 592337 - RNA, 22 nt, Escherichia coli CFT073
ugaugauuaaaucgaagcguac

SEQ ID NO: 592338 - RNA, 17 nt, Escherichia coli CFT073
ugaugauaaguucaagu

SEQ ID NO: 592339 - RNA, 21 nt, Escherichia coli CFT073
ugaugaugggcgagguugucu

SEQ ID NO: 592340 - RNA, 19 nt, Escherichia coli CFT073
ugaugcaggcaguaaacug

SEQ ID NO: 592341 - RNA, 14 nt, Escherichia coli CFT073
ugaugcaucaacau

SEQ ID NO: 592342 - RNA, 22 nt, Escherichia coli CFT073
ugaugagcggagcacaucaggc

SEQ ID NO: 592343 - RNA, 19 nt, Escherichia coli CFT073
ugaugacugauauccagcc

SEQ ID NO: 592344 - RNA, 21 nt, Escherichia coli CFT073
ugaugacuugccuccagcgac

SEQ ID NO: 592345 - RNA, 11 nt, Escherichia coli CFT073
ugauggcgcgc

SEQ ID NO: 592346 - RNA, 15 nt, Escherichia coli CFT073
ugaugggauaaagau

SEQ ID NO: 592347 - RNA, 15 nt, Escherichia coli CFT073
ugaugguaacgcgcc

SEQ ID NO: 592348 - RNA, 17 nt, Escherichia coli CFT073
ugauggcaaaauccaga

SEQ ID NO: 592349 - RNA, 22 nt, Escherichia coli CFT073
ugauggcaaaugcaacauuauc

SEQ ID NO: 592350 - RNA, 18 nt, Escherichia coli CFT073
ugaugcgacgcggcagcg

SEQ ID NO: 592351 - RNA, 18 nt, Escherichia coli CFT073
ugaugccgcauccggcuu

SEQ ID NO: 592352 - RNA, 12 nt, Escherichia coli CFT073
ugaugccggaug

SEQ ID NO: 592353 - RNA, 14 nt, Escherichia coli CFT073
ugaugccggguuug

SEQ ID NO: 592354 - RNA, 23 nt, Escherichia coli CFT073
ugauguuugcgacaaacuuccag

SEQ ID NO: 592355 - RNA, 16 nt, Escherichia coli CFT073
ugauugaagaaaucag

SEQ ID NO: 592356 - RNA, 15 nt, Escherichia coli CFT073
ugauugaccgccagc

SEQ ID NO: 592357 - RNA, 13 nt, Escherichia coli CFT073
ugauguguuguca

SEQ ID NO: 592358 - RNA, 17 nt, Escherichia coli CFT073
ugauguucaacuuucuc

SEQ ID NO: 592359 - RNA, 15 nt, Escherichia coli CFT073
ugauguucuggcgaa

SEQ ID NO: 592360 - RNA, 21 nt, Escherichia coli CFT073
ugauguacuaaccaugcgccc

SEQ ID NO: 592361 - RNA, 21 nt, Escherichia coli CFT073
ugcacauacugcaucagcgcc

SEQ ID NO: 592362 - RNA, 15 nt, Escherichia coli CFT073
ugcaacucuuucacu

SEQ ID NO: 592363 - RNA, 21 nt, Escherichia coli CFT073
ugcacagguggcaaacgccac

SEQ ID NO: 592364 - RNA, 22 nt, Escherichia coli CFT073
ugcacauucccugcagucaccu

SEQ ID NO: 592365 - RNA, 23 nt, Escherichia coli CFT073
ugcaccagcuggcugucgaucuc

SEQ ID NO: 592366 - RNA, 11 nt, Escherichia coli CFT073
ugcaccagcag

SEQ ID NO: 592367 - RNA, 19 nt, Escherichia coli CFT073
ugcaccagcagcgucagca

SEQ ID NO: 592368 - RNA, 23 nt, Escherichia coli CFT073
ugcaccacaacaccuuucacgcc

SEQ ID NO: 592369 - RNA, 19 nt, Escherichia coli CFT073
ugauuuccguuaccggaag

SEQ ID NO: 592370 - RNA, 15 nt, Escherichia coli CFT073
ugauuuauuuuuacu

SEQ ID NO: 592371 - RNA, 14 nt, Escherichia coli CFT073
ugauuggccccauu

SEQ ID NO: 592372 - RNA, 20 nt, Escherichia coli CFT073
ugcaacaaggguaugcugua

SEQ ID NO: 592373 - RNA, 23 nt, Escherichia coli CFT073
ugcaacauuaucugaugcgcuuc

SEQ ID NO: 592374 - RNA, 21 nt, Escherichia coli CFT073
ugcaaccagaaagucuucacc

SEQ ID NO: 592375 - RNA, 13 nt, Escherichia coli CFT073
ugcagaucaccaa

SEQ ID NO: 592376 - RNA, 14 nt, Escherichia coli CFT073
ugcagagucaucag

SEQ ID NO: 592377 - RNA, 15 nt, Escherichia coli CFT073
ugcagagucaucagu

SEQ ID NO: 592378 - RNA, 21 nt, Escherichia coli CFT073
ugcagaccgguggucggcucg

SEQ ID NO: 592379 - RNA, 19 nt, Escherichia coli CFT073
ugcagacgaucuucggcgu

SEQ ID NO: 592380 - RNA, 21 nt, Escherichia coli CFT073
ugcagaacggugagcgugcgg

SEQ ID NO: 592381 - RNA, 14 nt, Escherichia coli CFT073
ugcagacccgccac

SEQ ID NO: 592382 - RNA, 15 nt, Escherichia coli CFT073
ugcagaaucaaucuc

SEQ ID NO: 592383 - RNA, 22 nt, Escherichia coli CFT073
ugcagaaucaaucucagcgaua

SEQ ID NO: 592384 - RNA, 18 nt, Escherichia coli CFT073
ugcacugcucauuaauau

SEQ ID NO: 592385 - RNA, 21 nt, Escherichia coli CFT073
ugcacugucccaaaaugucgg

SEQ ID NO: 592386 - RNA, 22 nt, Escherichia coli CFT073
ugcacguugcuuauugccggau

SEQ ID NO: 592387 - RNA, 24 nt, Escherichia coli CFT073
ugcacguuuugcuggugcaggcga

SEQ ID NO: 592388 - RNA, 13 nt, Escherichia coli CFT073
ugcacucauagcc

SEQ ID NO: 592389 - RNA, 15 nt, Escherichia coli CFT073
ugcacugcaacgccu

SEQ ID NO: 592390 - RNA, 13 nt, Escherichia coli CFT073
ugcacgcucuuca

SEQ ID NO: 592391 - RNA, 15 nt, Escherichia coli CFT073
ugcacgcugccuggu

SEQ ID NO: 592392 - RNA, 15 nt, Escherichia coli CFT073
ugaacggucgaggca

SEQ ID NO: 592393 - RNA, 18 nt, Escherichia coli CFT073
ugaacucaggcugccaga

SEQ ID NO: 592394 - RNA, 21 nt, Escherichia coli CFT073
ugaagccaaccgggccgcaga

SEQ ID NO: 592395 - RNA, 15 nt, Escherichia coli CFT073
ugaagccaccagcgc

SEQ ID NO: 592396 - RNA, 13 nt, Escherichia coli CFT073
ugaagaucaugau

SEQ ID NO: 592397 - RNA, 13 nt, Escherichia coli CFT073
ugaagcagcgcug

SEQ ID NO: 592398 - RNA, 15 nt, Escherichia coli CFT073
ugaagcccaguaccg

SEQ ID NO: 592399 - RNA, 20 nt, Escherichia coli CFT073
ugaagcccaguaccgccagu

SEQ ID NO: 592400 - RNA, 17 nt, Escherichia coli CFT073
ugaagcgcgccuggcgu

SEQ ID NO: 592401 - RNA, 12 nt, Escherichia coli CFT073
ugaagcggcaga

SEQ ID NO: 592402 - RNA, 19 nt, Escherichia coli CFT073
ugaagccuucgccuuucag

SEQ ID NO: 592403 - RNA, 17 nt, Escherichia coli CFT073
ugacguuaagaaaacgg

SEQ ID NO: 592404 - RNA, 20 nt, Escherichia coli CFT073
ugacuaagcguuuucugcca

SEQ ID NO: 592405 - RNA, 16 nt, Escherichia coli CFT073
ugacuacaaaaaaagc

SEQ ID NO: 592406 - RNA, 12 nt, Escherichia coli CFT073
ugagauccagcg

SEQ ID NO: 592407 - RNA, 14 nt, Escherichia coli CFT073
ugagauccagcgag

SEQ ID NO: 592408 - RNA, 15 nt, Escherichia coli CFT073
ugagauccgucaggc

SEQ ID NO: 592409 - RNA, 13 nt, Escherichia coli CFT073
ugagauccugcca

SEQ ID NO: 592410 - RNA, 12 nt, Escherichia coli CFT073
ugagagcaacca

SEQ ID NO: 592411 - RNA, 21 nt, Escherichia coli CFT073
ugagaauuccggcagagaaag

SEQ ID NO: 592412 - RNA, 21 nt, Escherichia coli CFT073
ugagaacuucggcagagaaag

SEQ ID NO: 592413 - RNA, 20 nt, Escherichia coli CFT073
ugacuuuguaccuggccguu

SEQ ID NO: 592414 - RNA, 16 nt, Escherichia coli CFT073
ugagaagcgcagcgca

SEQ ID NO: 592415 - RNA, 12 nt, Escherichia coli CFT073
ugagaaacgccg

SEQ ID NO: 592416 - RNA, 20 nt, Escherichia coli CFT073
ugagaacaagauugccugau

SEQ ID NO: 592417 - RNA, 22 nt, Escherichia coli CFT073
ugagaucggggucaacuucgcu

SEQ ID NO: 592418 - RNA, 15 nt, Escherichia coli CFT073
ugagaugguuuugcu

SEQ ID NO: 592419 - RNA, 20 nt, Escherichia coli CFT073
ugaggccggaugccgcugcu

SEQ ID NO: 592420 - RNA, 23 nt, Escherichia coli CFT073
ugaggcacgacacaaugccauau

SEQ ID NO: 592421 - RNA, 22 nt, Escherichia coli CFT073
ugaggaucaccaguccaucggc

SEQ ID NO: 592422 - RNA, 17 nt, Escherichia coli CFT073
ugauaaauugccugcgu

SEQ ID NO: 592423 - RNA, 13 nt, Escherichia coli CFT073
ugauaaccacgcg

SEQ ID NO: 592424 - RNA, 22 nt, Escherichia coli CFT073
ugagugaugugcucuaaccaac

SEQ ID NO: 592425 - RNA, 21 nt, Escherichia coli CFT073
ugaguaucgaaaacaucaaaa

SEQ ID NO: 592426 - RNA, 15 nt, Escherichia coli CFT073
ugaguauuaaauguc

SEQ ID NO: 592427 - RNA, 22 nt, Escherichia coli CFT073
ugauagauuucucuaaaaacuc

SEQ ID NO: 592428 - RNA, 21 nt, Escherichia coli CFT073
ugauacucgucgcgcacgccc

SEQ ID NO: 592429 - RNA, 17 nt, Escherichia coli CFT073
ugauagaacugcggcag

SEQ ID NO: 592430 - RNA, 22 nt, Escherichia coli CFT073
ugauacagcucgugcgcuuuca

SEQ ID NO: 592431 - RNA, 14 nt, Escherichia coli CFT073
ugauacaggcgcug

SEQ ID NO: 592432 - RNA, 19 nt, Escherichia coli CFT073
ugauacaucaagucagaug

SEQ ID NO: 592433 - RNA, 13 nt, Escherichia coli CFT073
ugauacaugcugu

SEQ ID NO: 592434 - RNA, 19 nt, Escherichia coli CFT073
ugauacgggaggucaucag

SEQ ID NO: 592435 - RNA, 14 nt, Escherichia coli CFT073
ugauacacaccgag

SEQ ID NO: 592436 - RNA, 12 nt, Escherichia coli CFT073
ugauaaucaaca

SEQ ID NO: 592437 - RNA, 20 nt, Escherichia coli CFT073
ugauaacgaauugcugcgcc

SEQ ID NO: 592438 - RNA, 15 nt, Escherichia coli CFT073
ugauaacucaaaaau

SEQ ID NO: 592439 - RNA, 15 nt, Escherichia coli CFT073
ugauaagacgcggca

SEQ ID NO: 592440 - RNA, 14 nt, Escherichia coli CFT073
ugauaagcguagcg

SEQ ID NO: 592441 - RNA, 22 nt, Escherichia coli CFT073
ugauauacgccacuucaucguc

SEQ ID NO: 592442 - RNA, 18 nt, Escherichia coli CFT073
ugauagcuuacggcgcug

SEQ ID NO: 592443 - RNA, 17 nt, Escherichia coli CFT073
ugauagugcugccaucu

SEQ ID NO: 592444 - RNA, 18 nt, Escherichia coli CFT073
ugauaucagccugcaaac

SEQ ID NO: 592445 - RNA, 14 nt, Escherichia coli CFT073
ugaucaaaaaaauc

SEQ ID NO: 592446 - RNA, 20 nt, Escherichia coli CFT073
ugaaaaccguccggcuguuu

SEQ ID NO: 592447 - RNA, 16 nt, Escherichia coli CFT073
ugaaaagucauccggc

SEQ ID NO: 592448 - RNA, 21 nt, Escherichia coli CFT073
ugaaaagaguucaucggauaa

SEQ ID NO: 592449 - RNA, 13 nt, Escherichia coli CFT073
ugaaaauuaacgg

SEQ ID NO: 592450 - RNA, 21 nt, Escherichia coli CFT073
ugaacacauuugucggaugcg

SEQ ID NO: 592451 - RNA, 22 nt, Escherichia coli CFT073
ugaacaccagaaccagcaacca

SEQ ID NO: 592452 - RNA, 22 nt, Escherichia coli CFT073
ugaaaccgguuuguaggccgga

SEQ ID NO: 592453 - RNA, 20 nt, Escherichia coli CFT073
ugaacagccagaagcccgga

SEQ ID NO: 592454 - RNA, 15 nt, Escherichia coli CFT073
ugaacagaacuggcg

SEQ ID NO: 592455 - RNA, 16 nt, Escherichia coli CFT073
ugaacagaacuggcgc

SEQ ID NO: 592456 - RNA, 16 nt, Escherichia coli CFT073
ugaacaccuuauccgg

SEQ ID NO: 592457 - RNA, 19 nt, Escherichia coli CFT073
ugaacgcguuauccggcca

SEQ ID NO: 592458 - RNA, 20 nt, Escherichia coli CFT073
ugaacgccugauucggccua

SEQ ID NO: 592459 - RNA, 16 nt, Escherichia coli CFT073
ugaacgcaggccgccc

SEQ ID NO: 592460 - RNA, 18 nt, Escherichia coli CFT073
ugaacgcaggccgcccaa

SEQ ID NO: 592461 - RNA, 13 nt, Escherichia coli CFT073
ugaacaucgccau

SEQ ID NO: 592462 - RNA, 16 nt, Escherichia coli CFT073
ucuuuaauagauaauu

SEQ ID NO: 592463 - RNA, 14 nt, Escherichia coli CFT073
ucuucuuucucggc

SEQ ID NO: 592464 - RNA, 15 nt, Escherichia coli CFT073
ucuucucacugcccu

SEQ ID NO: 592465 - RNA, 16 nt, Escherichia coli CFT073
ucuucguggcccgcca

SEQ ID NO: 592466 - RNA, 19 nt, Escherichia coli CFT073
ucuucgucaaagauauuau

SEQ ID NO: 592467 - RNA, 22 nt, Escherichia coli CFT073
ucuucucgaaacgcuuuuaacg

SEQ ID NO: 592468 - RNA, 17 nt, Escherichia coli CFT073
ucuucuuaggcauugcc

SEQ ID NO: 592469 - RNA, 18 nt, Escherichia coli CFT073
ucuucuucguaacggcau

SEQ ID NO: 592470 - RNA, 19 nt, Escherichia coli CFT073
ucuucuucguugagcggau

SEQ ID NO: 592471 - RNA, 21 nt, Escherichia coli CFT073
ucuucgauuuaaccgcuuuca

SEQ ID NO: 592472 - RNA, 22 nt, Escherichia coli CFT073
ucuucgccgucaguugugccag

SEQ ID NO: 592473 - RNA, 14 nt, Escherichia coli CFT073
ucuucgagugucac

SEQ ID NO: 592474 - RNA, 19 nt, Escherichia coli CFT073
ucuuccuuaagcacaaucc

SEQ ID NO: 592475 - RNA, 13 nt, Escherichia coli CFT073
ucuuccucgccag

SEQ ID NO: 592476 - RNA, 14 nt, Escherichia coli CFT073
ucuuccgccagaca

SEQ ID NO: 592477 - RNA, 14 nt, Escherichia coli CFT073
ucuuccgccagcau

SEQ ID NO: 592478 - RNA, 23 nt, Escherichia coli CFT073
ucuuccggguagcgcggcagcgg

SEQ ID NO: 592479 - RNA, 20 nt, Escherichia coli CFT073
ucuuccauuucaucgccagc

SEQ ID NO: 592480 - RNA, 24 nt, Escherichia coli CFT073
ucuuccauuucaucgccagcgaau

SEQ ID NO: 592481 - RNA, 14 nt, Escherichia coli CFT073
ucuuccagcggcau

SEQ ID NO: 592482 - RNA, 22 nt, Escherichia coli CFT073
ucuucauucccggaaauugcca

SEQ ID NO: 592483 - RNA, 18 nt, Escherichia coli CFT073
ucuucauuaaaccagugc

SEQ ID NO: 592484 - RNA, 13 nt, Escherichia coli CFT073
ucuucauuaccuu

SEQ ID NO: 592485 - RNA, 14 nt, Escherichia coli CFT073
ucuuccagcgcauc

SEQ ID NO: 592486 - RNA, 16 nt, Escherichia coli CFT073
ucuuaugcaguuuugg

SEQ ID NO: 592487 - RNA, 15 nt, Escherichia coli CFT073
ucuuaucagcauacg

SEQ ID NO: 592488 - RNA, 23 nt, Escherichia coli CFT073
ucuucaaaccacugcgccaacgu

SEQ ID NO: 592489 - RNA, 15 nt, Escherichia coli CFT073
ucuucaccugccugc

SEQ ID NO: 592490 - RNA, 13 nt, Escherichia coli CFT073
ucuucagcuuuca

SEQ ID NO: 592491 - RNA, 19 nt, Escherichia coli CFT073
ucucuuccaguucguagcc

SEQ ID NO: 592492 - RNA, 13 nt, Escherichia coli CFT073
ucugaauaaacgg

SEQ ID NO: 592493 - RNA, 23 nt, Escherichia coli CFT073
ucugaccacggccauauccagcc

SEQ ID NO: 592494 - RNA, 19 nt, Escherichia coli CFT073
ucugacccagaagacgagc

SEQ ID NO: 592495 - RNA, 16 nt, Escherichia coli CFT073
ucugauuuacaaggaa

SEQ ID NO: 592496 - RNA, 13 nt, Escherichia coli CFT073
ucugcaauuugcg

SEQ ID NO: 592497 - RNA, 23 nt, Escherichia coli CFT073
ucugagcaggcggcuucgcaucc

SEQ ID NO: 592498 - RNA, 17 nt, Escherichia coli CFT073
ucugccggauuuuacga

SEQ ID NO: 592499 - RNA, 14 nt, Escherichia coli CFT073
ucugccgcaauggc

SEQ ID NO: 592500 - RNA, 14 nt, Escherichia coli CFT073
ucugcaucaaccag

SEQ ID NO: 592501 - RNA, 16 nt, Escherichia coli CFT073
ucugcagggcaauagc

SEQ ID NO: 592502 - RNA, 14 nt, Escherichia coli CFT073
ucugccagacgugu

SEQ ID NO: 592503 - RNA, 17 nt, Escherichia coli CFT073
ucugcaaggcgagcaau

SEQ ID NO: 592504 - RNA, 15 nt, Escherichia coli CFT073
ucugcccaaucaaac

SEQ ID NO: 592505 - RNA, 14 nt, Escherichia coli CFT073
ucugcgucgcaucu

SEQ ID NO: 592506 - RNA, 13 nt, Escherichia coli CFT073
ucugcggcaaugc

SEQ ID NO: 592507 - RNA, 16 nt, Escherichia coli CFT073
ucugcgcgacggcggu

SEQ ID NO: 592508 - RNA, 12 nt, Escherichia coli CFT073
ucugcgcaaugc

SEQ ID NO: 592509 - RNA, 20 nt, Escherichia coli CFT073
ucugcgcauuucccagcaag

SEQ ID NO: 592510 - RNA, 22 nt, Escherichia coli CFT073
ucugcgaauugagaugacgcca

SEQ ID NO: 592511 - RNA, 16 nt, Escherichia coli CFT073
ucugcgacgguuucug

SEQ ID NO: 592512 - RNA, 15 nt, Escherichia coli CFT073
ucugcgagacuccgc

SEQ ID NO: 592513 - RNA, 21 nt, Escherichia coli CFT073
ucugcgaucgucgugcgguga

SEQ ID NO: 592514 - RNA, 17 nt, Escherichia coli CFT073
ucuuaauagcugccagc

SEQ ID NO: 592515 - RNA, 18 nt, Escherichia coli CFT073
ucuuagugggaagagggc

SEQ ID NO: 592516 - RNA, 15 nt, Escherichia coli CFT073
ucugugcuuguaaaa

SEQ ID NO: 592517 - RNA, 18 nt, Escherichia coli CFT073
ucuguuccauaaucgccu

SEQ ID NO: 592518 - RNA, 21 nt, Escherichia coli CFT073
ucugucuuccgggaacggcau

SEQ ID NO: 592519 - RNA, 22 nt, Escherichia coli CFT073
ucugucuuccgggaacggcauc

SEQ ID NO: 592520 - RNA, 14 nt, Escherichia coli CFT073
ucugugaacuucag

SEQ ID NO: 592521 - RNA, 22 nt, Escherichia coli CFT073
ucuguccaaauccuucagcaau

SEQ ID NO: 592522 - RNA, 14 nt, Escherichia coli CFT073
ucugucaaaagcgg

SEQ ID NO: 592523 - RNA, 21 nt, Escherichia coli CFT073
ucuggugugcguugcagcaaa

SEQ ID NO: 592524 - RNA, 15 nt, Escherichia coli CFT073
ucugguguuaucgga

SEQ ID NO: 592525 - RNA, 16 nt, Escherichia coli CFT073
ucugguguucuuuuac

SEQ ID NO: 592526 - RNA, 21 nt, Escherichia coli CFT073
ucuggcugccagcccgcuggu

SEQ ID NO: 592527 - RNA, 14 nt, Escherichia coli CFT073
ucugcuuuacggaa

SEQ ID NO: 592528 - RNA, 20 nt, Escherichia coli CFT073
ucuggaaauagauuuucaga

SEQ ID NO: 592529 - RNA, 16 nt, Escherichia coli CFT073
ucuggaacggcagauc

SEQ ID NO: 592530 - RNA, 16 nt, Escherichia coli CFT073
ucugcuagauaagcaa

SEQ ID NO: 592531 - RNA, 21 nt, Escherichia coli CFT073
ucugcguucucuucacgccaa

SEQ ID NO: 592532 - RNA, 17 nt, Escherichia coli CFT073
ucugcucccggcaaugc

SEQ ID NO: 592533 - RNA, 20 nt, Escherichia coli CFT073
ucugcugacgaaauugcuga

SEQ ID NO: 592534 - RNA, 17 nt, Escherichia coli CFT073
ucugcuggcaaacguca

SEQ ID NO: 592535 - RNA, 23 nt, Escherichia coli CFT073
ucuggccucgcuuugccaguaau

SEQ ID NO: 592536 - RNA, 16 nt, Escherichia coli CFT073
ucuggcaucggcgcac

SEQ ID NO: 592537 - RNA, 22 nt, Escherichia coli CFT073
ucuggcaucggcgcacaaccgc

SEQ ID NO: 592538 - RNA, 20 nt, Escherichia coli CFT073
ucucguuggguugccagcga

SEQ ID NO: 592539 - RNA, 19 nt, Escherichia coli CFT073
ucucguccaacaguuccag

SEQ ID NO: 592540 - RNA, 22 nt, Escherichia coli CFT073
ucucugcgcuauccagcgcaua

SEQ ID NO: 592541 - RNA, 18 nt, Escherichia coli CFT073
ucucgcguuacuaccggc

SEQ ID NO: 592542 - RNA, 20 nt, Escherichia coli CFT073
ucucgcgcccaaccagcagg

SEQ ID NO: 592543 - RNA, 13 nt, Escherichia coli CFT073
ucucaaaacugaa

SEQ ID NO: 592544 - RNA, 18 nt, Escherichia coli CFT073
ucucaccgcaggcggcaa

SEQ ID NO: 592545 - RNA, 16 nt, Escherichia coli CFT073
ucuccgcccagcguac

SEQ ID NO: 592546 - RNA, 15 nt, Escherichia coli CFT073
ucuccggcguuuugg

SEQ ID NO: 592547 - RNA, 15 nt, Escherichia coli CFT073
ucuccucaacgaugc

SEQ ID NO: 592548 - RNA, 12 nt, Escherichia coli CFT073
ucuccggcagcu

SEQ ID NO: 592549 - RNA, 15 nt, Escherichia coli CFT073
ucuccggccuacaaa

SEQ ID NO: 592550 - RNA, 12 nt, Escherichia coli CFT073
ucguucgcacca

SEQ ID NO: 592551 - RNA, 13 nt, Escherichia coli CFT073
ucguucgccgcau

SEQ ID NO: 592552 - RNA, 23 nt, Escherichia coli CFT073
ucguucucgcgauaaaacuucug

SEQ ID NO: 592553 - RNA, 13 nt, Escherichia coli CFT073
ucguuaaucgccu

SEQ ID NO: 592554 - RNA, 12 nt, Escherichia coli CFT073
ucguuaccgugu

SEQ ID NO: 592555 - RNA, 15 nt, Escherichia coli CFT073
ucguguccggcaaua

SEQ ID NO: 592556 - RNA, 23 nt, Escherichia coli CFT073
ucguggugagggcaaacagacgc

SEQ ID NO: 592557 - RNA, 17 nt, Escherichia coli CFT073
ucguugaauacauucau

SEQ ID NO: 592558 - RNA, 14 nt, Escherichia coli CFT073
ucguugagcggauc

SEQ ID NO: 592559 - RNA, 19 nt, Escherichia coli CFT073
ucguugaccuguacaagca

SEQ ID NO: 592560 - RNA, 17 nt, Escherichia coli CFT073
ucguugacgaccagucc

SEQ ID NO: 592561 - RNA, 11 nt, Escherichia coli CFT073
ucuauccagcc

SEQ ID NO: 592562 - RNA, 15 nt, Escherichia coli CFT073
ucuaucgaaucuguu

SEQ ID NO: 592563 - RNA, 16 nt, Escherichia coli CFT073
ucuacgaacugagacu

SEQ ID NO: 592564 - RNA, 22 nt, Escherichia coli CFT073
ucuacgaacugagacugucugu

SEQ ID NO: 592565 - RNA, 17 nt, Escherichia coli CFT073
ucuacauguguucugca

SEQ ID NO: 592566 - RNA, 19 nt, Escherichia coli CFT073
ucuacauuucuguaguccc

SEQ ID NO: 592567 - RNA, 15 nt, Escherichia coli CFT073
ucuaccaccaucguc

SEQ ID NO: 592568 - RNA, 16 nt, Escherichia coli CFT073
ucuacccgcucgaagu

SEQ ID NO: 592569 - RNA, 18 nt, Escherichia coli CFT073
ucuaccgauccggcacca

SEQ ID NO: 592570 - RNA, 18 nt, Escherichia coli CFT073
ucuaccgggcugaguccc

SEQ ID NO: 592571 - RNA, 16 nt, Escherichia coli CFT073
ucgguguccacuuccg

SEQ ID NO: 592572 - RNA, 12 nt, Escherichia coli CFT073
ucguaauacccu

SEQ ID NO: 592573 - RNA, 12 nt, Escherichia coli CFT073
ucguaccagugc

SEQ ID NO: 592574 - RNA, 16 nt, Escherichia coli CFT073
ucguacacccgccaga

SEQ ID NO: 592575 - RNA, 23 nt, Escherichia coli CFT073
ucguacacccgccagaaucaccg

SEQ ID NO: 592576 - RNA, 23 nt, Escherichia coli CFT073
ucguagaagccauuaaacaccag

SEQ ID NO: 592577 - RNA, 18 nt, Escherichia coli CFT073
ucggggugguugucggca

SEQ ID NO: 592578 - RNA, 17 nt, Escherichia coli CFT073
ucggcgucgcaucaggu

SEQ ID NO: 592579 - RNA, 12 nt, Escherichia coli CFT073
ucggugauaaau

SEQ ID NO: 592580 - RNA, 23 nt, Escherichia coli CFT073
ucggugcauuuucuaugcugcca

SEQ ID NO: 592581 - RNA, 16 nt, Escherichia coli CFT073
ucgcguagcugcugcu

SEQ ID NO: 592582 - RNA, 22 nt, Escherichia coli CFT073
ucgcguaaugcuucuaccgucu

SEQ ID NO: 592583 - RNA, 19 nt, Escherichia coli CFT073
ucgcuaagcacgauaucaa

SEQ ID NO: 592584 - RNA, 14 nt, Escherichia coli CFT073
ucgcuaaggaaauc

SEQ ID NO: 592585 - RNA, 19 nt, Escherichia coli CFT073
ucgcguucgauagcgcgcc

SEQ ID NO: 592586 - RNA, 21 nt, Escherichia coli CFT073
ucgcuggcguuguccgccaga

SEQ ID NO: 592587 - RNA, 22 nt, Escherichia coli CFT073
ucgcugaacgggccauccauca

SEQ ID NO: 592588 - RNA, 18 nt, Escherichia coli CFT073
ucgcugguguacugcaac

SEQ ID NO: 592589 - RNA, 19 nt, Escherichia coli CFT073
ucggaaaacaaccgccaug

SEQ ID NO: 592590 - RNA, 20 nt, Escherichia coli CFT073
ucggaacaucgaugccgccu

SEQ ID NO: 592591 - RNA, 23 nt, Escherichia coli CFT073
ucgcuuaauagguuaaugacgaa

SEQ ID NO: 592592 - RNA, 15 nt, Escherichia coli CFT073
ucgcuuccauugccu

SEQ ID NO: 592593 - RNA, 22 nt, Escherichia coli CFT073
ucgcuucgcgaaucgccacaac

SEQ ID NO: 592594 - RNA, 16 nt, Escherichia coli CFT073
ucggcaaacaguugcu

SEQ ID NO: 592595 - RNA, 17 nt, Escherichia coli CFT073
ucggauuacccggcauc

SEQ ID NO: 592596 - RNA, 17 nt, Escherichia coli CFT073
ucggaugcggcgcgagc

SEQ ID NO: 592597 - RNA, 21 nt, Escherichia coli CFT073
ucggaugcggcgugaacgccu

SEQ ID NO: 592598 - RNA, 15 nt, Escherichia coli CFT073
ucggauaaggcguuu

SEQ ID NO: 592599 - RNA, 19 nt, Escherichia coli CFT073
ucggauaggcaccgccaaa

SEQ ID NO: 592600 - RNA, 19 nt, Escherichia coli CFT073
ucggauauuuuccagcaac

SEQ ID NO: 592601 - RNA, 17 nt, Escherichia coli CFT073
ucggaucaauccccaga

SEQ ID NO: 592602 - RNA, 18 nt, Escherichia coli CFT073
ucggcaaucacaucguag

SEQ ID NO: 592603 - RNA, 19 nt, Escherichia coli CFT073
ucggcaaggccaauacccg

SEQ ID NO: 592604 - RNA, 23 nt, Escherichia coli CFT073
ucggcacccaucgccagcacuuc

SEQ ID NO: 592605 - RNA, 20 nt, Escherichia coli CFT073
ucggcaggguauugcgcgcc

SEQ ID NO: 592606 - RNA, 22 nt, Escherichia coli CFT073
ucggcaggaacagauacuggaa

SEQ ID NO: 592607 - RNA, 20 nt, Escherichia coli CFT073
ucggcggcgaucgccugcug

SEQ ID NO: 592608 - RNA, 19 nt, Escherichia coli CFT073
ucgccauuuuucagacguu

SEQ ID NO: 592609 - RNA, 19 nt, Escherichia coli CFT073
ucgccauuaccaccaccuu

SEQ ID NO: 592610 - RNA, 17 nt, Escherichia coli CFT073
ucgccauuaucgauaau

SEQ ID NO: 592611 - RNA, 22 nt, Escherichia coli CFT073
ucgccauuccuggggucaucag

SEQ ID NO: 592612 - RNA, 17 nt, Escherichia coli CFT073
ucgcccacaccacgcca

SEQ ID NO: 592613 - RNA, 16 nt, Escherichia coli CFT073
ucgcccacaccagaug

SEQ ID NO: 592614 - RNA, 12 nt, Escherichia coli CFT073
ucgccaucaggc

SEQ ID NO: 592615 - RNA, 14 nt, Escherichia coli CFT073
ucgacgccaguuug

SEQ ID NO: 592616 - RNA, 13 nt, Escherichia coli CFT073
ucgacgcagcaga

SEQ ID NO: 592617 - RNA, 17 nt, Escherichia coli CFT073
ucgcccugccagcgaua

SEQ ID NO: 592618 - RNA, 17 nt, Escherichia coli CFT073
ucgcggcaaacugcaug

SEQ ID NO: 592619 - RNA, 17 nt, Escherichia coli CFT073
ucgcgcgccuuacgggc

SEQ ID NO: 592620 - RNA, 19 nt, Escherichia coli CFT073
ucgcggcacagaaacgcca

SEQ ID NO: 592621 - RNA, 21 nt, Escherichia coli CFT073
ucgcgaaucgccacaacuuca

SEQ ID NO: 592622 - RNA, 18 nt, Escherichia coli CFT073
ucgccgucaguugugcca

SEQ ID NO: 592623 - RNA, 17 nt, Escherichia coli CFT073
ucgcgagaacggcgcac

SEQ ID NO: 592624 - RNA, 16 nt, Escherichia coli CFT073
ucgcgcccaaccagca

SEQ ID NO: 592625 - RNA, 21 nt, Escherichia coli CFT073
uccuuugcugcucuauugccg

SEQ ID NO: 592626 - RNA, 16 nt, Escherichia coli CFT073
uccuuguaacgcgcua

SEQ ID NO: 592627 - RNA, 22 nt, Escherichia coli CFT073
uccuugcguacaccaacaucac

SEQ ID NO: 592628 - RNA, 21 nt, Escherichia coli CFT073
uccuugcugauuuuauuucac

SEQ ID NO: 592629 - RNA, 20 nt, Escherichia coli CFT073
ucgaaccaaacagcgccaga

SEQ ID NO: 592630 - RNA, 17 nt, Escherichia coli CFT073
uccuuaugcagcggaau

SEQ ID NO: 592631 - RNA, 21 nt, Escherichia coli CFT073
uccuuaugcugcuuacauagu

SEQ ID NO: 592632 - RNA, 22 nt, Escherichia coli CFT073
uccuguaugacaaaagaauggc

SEQ ID NO: 592633 - RNA, 22 nt, Escherichia coli CFT073
uccuguugauguguugucagcg

SEQ ID NO: 592634 - RNA, 20 nt, Escherichia coli CFT073
uccuguggacgcagcucaua

SEQ ID NO: 592635 - RNA, 16 nt, Escherichia coli CFT073
uccuucuccguguacg

SEQ ID NO: 592636 - RNA, 18 nt, Escherichia coli CFT073
uccuggguauaaaacuca

SEQ ID NO: 592637 - RNA, 21 nt, Escherichia coli CFT073
uccugcuucaggugcgcaaua

SEQ ID NO: 592638 - RNA, 22 nt, Escherichia coli CFT073
uccugcugcacgcccugauaaa

SEQ ID NO: 592639 - RNA, 20 nt, Escherichia coli CFT073
uccugcgguuugucaucauu

SEQ ID NO: 592640 - RNA, 23 nt, Escherichia coli CFT073
uccugcgccucuccacacggaga

SEQ ID NO: 592641 - RNA, 21 nt, Escherichia coli CFT073
uccugcccgacgacgucgcug

SEQ ID NO: 592642 - RNA, 12 nt, Escherichia coli CFT073
uccugcauugcu

SEQ ID NO: 592643 - RNA, 11 nt, Escherichia coli CFT073
uccugccagaa

SEQ ID NO: 592644 - RNA, 23 nt, Escherichia coli CFT073
uccugacggugauacagcaaaau

SEQ ID NO: 592645 - RNA, 15 nt, Escherichia coli CFT073
uccugagaggaugau

SEQ ID NO: 592646 - RNA, 16 nt, Escherichia coli CFT073
uccugagcucgugcau

SEQ ID NO: 592647 - RNA, 12 nt, Escherichia coli CFT073
uccugauuccag

SEQ ID NO: 592648 - RNA, 17 nt, Escherichia coli CFT073
uccugcaauaccgccgu

SEQ ID NO: 592649 - RNA, 20 nt, Escherichia coli CFT073
uccugcagaaaauccagcgu

SEQ ID NO: 592650 - RNA, 22 nt, Escherichia coli CFT073
uccugcagaaaauccagcgucg

SEQ ID NO: 592651 - RNA, 15 nt, Escherichia coli CFT073
uccugaacuuucucu

SEQ ID NO: 592652 - RNA, 14 nt, Escherichia coli CFT073
uccugaaacgcggc

SEQ ID NO: 592653 - RNA, 18 nt, Escherichia coli CFT073
uccugaaucacaauccgc

SEQ ID NO: 592654 - RNA, 16 nt, Escherichia coli CFT073
uccugaaucaccugau

SEQ ID NO: 592655 - RNA, 12 nt, Escherichia coli CFT073
ucgaacggguga

SEQ ID NO: 592656 - RNA, 16 nt, Escherichia coli CFT073
ucgaacgcugcgcgac

SEQ ID NO: 592657 - RNA, 14 nt, Escherichia coli CFT073
ucgaacgccgccag

SEQ ID NO: 592658 - RNA, 22 nt, Escherichia coli CFT073
ucgaacgccgccaguacgcgcc

SEQ ID NO: 592659 - RNA, 17 nt, Escherichia coli CFT073
ucgaaccucggaaugcc

SEQ ID NO: 592660 - RNA, 11 nt, Escherichia coli CFT073
ucgaaucacca

SEQ ID NO: 592661 - RNA, 21 nt, Escherichia coli CFT073
ucgacaaaaacccugccgucu

SEQ ID NO: 592662 - RNA, 15 nt, Escherichia coli CFT073
ucgacaccagccaga

SEQ ID NO: 592663 - RNA, 16 nt, Escherichia coli CFT073
ucgacaaugugaaaac

SEQ ID NO: 592664 - RNA, 12 nt, Escherichia coli CFT073
ucgacaauaacg

SEQ ID NO: 592665 - RNA, 22 nt, Escherichia coli CFT073
ucgacaauccagucagcgguuu

SEQ ID NO: 592666 - RNA, 20 nt, Escherichia coli CFT073
ucgacagcgauuccaguuca

SEQ ID NO: 592667 - RNA, 12 nt, Escherichia coli CFT073
ucgaccugcaac

SEQ ID NO: 592668 - RNA, 13 nt, Escherichia coli CFT073
ucgaccgucacca

SEQ ID NO: 592669 - RNA, 14 nt, Escherichia coli CFT073
ucgaccaggccauc

SEQ ID NO: 592670 - RNA, 20 nt, Escherichia coli CFT073
ucgaccagcgcacugccgcc

SEQ ID NO: 592671 - RNA, 21 nt, Escherichia coli CFT073
ucgaccaccgguuuuaauagu

SEQ ID NO: 592672 - RNA, 14 nt, Escherichia coli CFT073
ucgacauucaacau

SEQ ID NO: 592673 - RNA, 19 nt, Escherichia coli CFT073
uccgcagccaugaguaauu

SEQ ID NO: 592674 - RNA, 21 nt, Escherichia coli CFT073
uccgacuuauucuucaacaau

SEQ ID NO: 592675 - RNA, 17 nt, Escherichia coli CFT073
uccgacggcgagcguuc

SEQ ID NO: 592676 - RNA, 17 nt, Escherichia coli CFT073
uccgaaguucauccaua

SEQ ID NO: 592677 - RNA, 21 nt, Escherichia coli CFT073
uccgaacgcugacaaacugcg

SEQ ID NO: 592678 - RNA, 20 nt, Escherichia coli CFT073
uccgaaauuacuggauaacc

SEQ ID NO: 592679 - RNA, 14 nt, Escherichia coli CFT073
uccgagcggcacca

SEQ ID NO: 592680 - RNA, 15 nt, Escherichia coli CFT073
ucccugaucggccau

SEQ ID NO: 592681 - RNA, 16 nt, Escherichia coli CFT073
ucccugcaacacccgg

SEQ ID NO: 592682 - RNA, 17 nt, Escherichia coli CFT073
ucccuccaaccagauau

SEQ ID NO: 592683 - RNA, 20 nt, Escherichia coli CFT073
ucccuugccugcaggaaauc

SEQ ID NO: 592684 - RNA, 14 nt, Escherichia coli CFT073
ucccuuucgauaag

SEQ ID NO: 592685 - RNA, 12 nt, Escherichia coli CFT073
ucccuuccgcca

SEQ ID NO: 592686 - RNA, 12 nt, Escherichia coli CFT073
ucccuucgccgc

SEQ ID NO: 592687 - RNA, 20 nt, Escherichia coli CFT073
uccauucgcugcugcggcga

SEQ ID NO: 592688 - RNA, 15 nt, Escherichia coli CFT073
uccauuacaucacga

SEQ ID NO: 592689 - RNA, 18 nt, Escherichia coli CFT073
uccauucaaggacaaacc

SEQ ID NO: 592690 - RNA, 15 nt, Escherichia coli CFT073
uccauucuccgcucu

SEQ ID NO: 592691 - RNA, 19 nt, Escherichia coli CFT073
uccauugucuccagggcgg

SEQ ID NO: 592692 - RNA, 14 nt, Escherichia coli CFT073
uccauuguuagcaa

SEQ ID NO: 592693 - RNA, 17 nt, Escherichia coli CFT073
uccauuaaaacugauag

SEQ ID NO: 592694 - RNA, 23 nt, Escherichia coli CFT073
uccauguagcucaucugacguuc

SEQ ID NO: 592695 - RNA, 21 nt, Escherichia coli CFT073
uccaugcgcauaagaccguga

SEQ ID NO: 592696 - RNA, 17 nt, Escherichia coli CFT073
ucccgccaucguugaug

SEQ ID NO: 592697 - RNA, 14 nt, Escherichia coli CFT073
ucccgccagaugau

SEQ ID NO: 592698 - RNA, 18 nt, Escherichia coli CFT073
ucccgccgcuucgccaau

SEQ ID NO: 592699 - RNA, 19 nt, Escherichia coli CFT073
ucccgccugcugcgucgcg

SEQ ID NO: 592700 - RNA, 19 nt, Escherichia coli CFT073
ucccguccuucaucuucau

SEQ ID NO: 592701 - RNA, 13 nt, Escherichia coli CFT073
ucccgucgcccac

SEQ ID NO: 592702 - RNA, 14 nt, Escherichia coli CFT073
ucccgugccugcuu

SEQ ID NO: 592703 - RNA, 16 nt, Escherichia coli CFT073
ucccgcgcccgugcau

SEQ ID NO: 592704 - RNA, 19 nt, Escherichia coli CFT073
ucccgcgccucaggcacuu

SEQ ID NO: 592705 - RNA, 23 nt, Escherichia coli CFT073
ucccggcagagaaaaugccgcac

SEQ ID NO: 592706 - RNA, 17 nt, Escherichia coli CFT073
ucccggccaaagcgcga

SEQ ID NO: 592707 - RNA, 17 nt, Escherichia coli CFT073
uccucaaaucagccaua

SEQ ID NO: 592708 - RNA, 22 nt, Escherichia coli CFT073
uccucaacuuuguugcgaacuu

SEQ ID NO: 592709 - RNA, 23 nt, Escherichia coli CFT073
uccucaccguuuaauaacagcug

SEQ ID NO: 592710 - RNA, 14 nt, Escherichia coli CFT073
uccguucucaccaa

SEQ ID NO: 592711 - RNA, 23 nt, Escherichia coli CFT073
uccguuaaccgagggaagcaaua

SEQ ID NO: 592712 - RNA, 19 nt, Escherichia coli CFT073
uccuccggcaucuuuaacg

SEQ ID NO: 592713 - RNA, 21 nt, Escherichia coli CFT073
uccuccggcaucuuuaacgug

SEQ ID NO: 592714 - RNA, 22 nt, Escherichia coli CFT073
uccuccggcuuuaucaugucac

SEQ ID NO: 592715 - RNA, 16 nt, Escherichia coli CFT073
uccguauagaucagcg

SEQ ID NO: 592716 - RNA, 16 nt, Escherichia coli CFT073
uccguccagccaccgc

SEQ ID NO: 592717 - RNA, 12 nt, Escherichia coli CFT073
uccgucagcaaa

SEQ ID NO: 592718 - RNA, 20 nt, Escherichia coli CFT073
uccguacgcuuuuccacuca

SEQ ID NO: 592719 - RNA, 18 nt, Escherichia coli CFT073
uccguacucaaugccagc

SEQ ID NO: 592720 - RNA, 16 nt, Escherichia coli CFT073
uccgugccagcaccaa

SEQ ID NO: 592721 - RNA, 16 nt, Escherichia coli CFT073
uccgucguucaacaag

SEQ ID NO: 592722 - RNA, 14 nt, Escherichia coli CFT073
uccgucagcggcag

SEQ ID NO: 592723 - RNA, 13 nt, Escherichia coli CFT073
uccgucgccguaa

SEQ ID NO: 592724 - RNA, 13 nt, Escherichia coli CFT073
uccggugccggag

SEQ ID NO: 592725 - RNA, 17 nt, Escherichia coli CFT073
uccgcgauuaucccaua

SEQ ID NO: 592726 - RNA, 11 nt, Escherichia coli CFT073
uccgcuggugc

SEQ ID NO: 592727 - RNA, 13 nt, Escherichia coli CFT073
uccggccaucagu

SEQ ID NO: 592728 - RNA, 13 nt, Escherichia coli CFT073
uccggcaucuugu

SEQ ID NO: 592729 - RNA, 17 nt, Escherichia coli CFT073
uccggcauuugagcaua

SEQ ID NO: 592730 - RNA, 12 nt, Escherichia coli CFT073
uccggcaccauu

SEQ ID NO: 592731 - RNA, 19 nt, Escherichia coli CFT073
uccggcacucaaucgccaa

SEQ ID NO: 592732 - RNA, 16 nt, Escherichia coli CFT073
uccgggaucacaucau

SEQ ID NO: 592733 - RNA, 22 nt, Escherichia coli CFT073
uccggcuuugguuaauguacca

SEQ ID NO: 592734 - RNA, 14 nt, Escherichia coli CFT073
ucagcaauaaucag

SEQ ID NO: 592735 - RNA, 18 nt, Escherichia coli CFT073
ucagcaaaauacugaaca

SEQ ID NO: 592736 - RNA, 17 nt, Escherichia coli CFT073
ucagcaaauagauaaac

SEQ ID NO: 592737 - RNA, 16 nt, Escherichia coli CFT073
ucagacccagaaccau

SEQ ID NO: 592738 - RNA, 19 nt, Escherichia coli CFT073
ucagaccggcaaccagcac

SEQ ID NO: 592739 - RNA, 16 nt, Escherichia coli CFT073
ucagaccuguugccca

SEQ ID NO: 592740 - RNA, 18 nt, Escherichia coli CFT073
ucagacgcaggcgcgcug

SEQ ID NO: 592741 - RNA, 16 nt, Escherichia coli CFT073
ucagacgguccgcgag

SEQ ID NO: 592742 - RNA, 14 nt, Escherichia coli CFT073
ucagacggcuguua

SEQ ID NO: 592743 - RNA, 12 nt, Escherichia coli CFT073
ucacuuuaccuu

SEQ ID NO: 592744 - RNA, 19 nt, Escherichia coli CFT073
ucacuuucagaugcaccug

SEQ ID NO: 592745 - RNA, 23 nt, Escherichia coli CFT073
ucacuucaucccugaaaugugcg

SEQ ID NO: 592746 - RNA, 14 nt, Escherichia coli CFT073
ucacuuccagcagu

SEQ ID NO: 592747 - RNA, 16 nt, Escherichia coli CFT073
ucacuguucgccgcag

SEQ ID NO: 592748 - RNA, 18 nt, Escherichia coli CFT073
ucacuucaaccacauuca

SEQ ID NO: 592749 - RNA, 14 nt, Escherichia coli CFT073
ucagacauuaagca

SEQ ID NO: 592750 - RNA, 16 nt, Escherichia coli CFT073
ucagacaccggcgcac

SEQ ID NO: 592751 - RNA, 21 nt, Escherichia coli CFT073
ucagacaccggcgcacaaccg

SEQ ID NO: 592752 - RNA, 17 nt, Escherichia coli CFT073
ucagacacgccgccaga

SEQ ID NO: 592753 - RNA, 18 nt, Escherichia coli CFT073
ucacugaaacagauaaaa

SEQ ID NO: 592754 - RNA, 15 nt, Escherichia coli CFT073
ucacugccaccaucc

SEQ ID NO: 592755 - RNA, 22 nt, Escherichia coli CFT073
ucacuggccagcggcgaaaaau

SEQ ID NO: 592756 - RNA, 20 nt, Escherichia coli CFT073
ucacuggcgucauggcgcuc

SEQ ID NO: 592757 - RNA, 15 nt, Escherichia coli CFT073
ucacuguccgccaga

SEQ ID NO: 592758 - RNA, 15 nt, Escherichia coli CFT073
ucacgcugucggcac

SEQ ID NO: 592759 - RNA, 17 nt, Escherichia coli CFT073
ucacggcagccugacgc

SEQ ID NO: 592760 - RNA, 21 nt, Escherichia coli CFT073
ucacgucagggucgugcggca

SEQ ID NO: 592761 - RNA, 21 nt, Escherichia coli CFT073
ucacgucauauucgccaucag

SEQ ID NO: 592762 - RNA, 20 nt, Escherichia coli CFT073
ucacguccggcagcagaaag

SEQ ID NO: 592763 - RNA, 13 nt, Escherichia coli CFT073
ucacgucgcccac

SEQ ID NO: 592764 - RNA, 14 nt, Escherichia coli CFT073
ucacgccgaccaga

SEQ ID NO: 592765 - RNA, 19 nt, Escherichia coli CFT073
ucacgccccaaugcgcgcc

SEQ ID NO: 592766 - RNA, 17 nt, Escherichia coli CFT073
ucacgcagcggcggcac

SEQ ID NO: 592767 - RNA, 15 nt, Escherichia coli CFT073
ucacgcagugcugca

SEQ ID NO: 592768 - RNA, 16 nt, Escherichia coli CFT073
ucacgcaguuucgcgu

SEQ ID NO: 592769 - RNA, 22 nt, Escherichia coli CFT073
ucacgcauuuacacucgccccu

SEQ ID NO: 592770 - RNA, 15 nt, Escherichia coli CFT073
ucacgccaauaaucg

SEQ ID NO: 592771 - RNA, 17 nt, Escherichia coli CFT073
ucacgccaauaaucgau

SEQ ID NO: 592772 - RNA, 12 nt, Escherichia coli CFT073
ucacgccagcgu

SEQ ID NO: 592773 - RNA, 21 nt, Escherichia coli CFT073
ucacgcaaggcacaaagucgc

SEQ ID NO: 592774 - RNA, 13 nt, Escherichia coli CFT073
ucacgcacuuccg

SEQ ID NO: 592775 - RNA, 15 nt, Escherichia coli CFT073
ucaccuuucgguuca

SEQ ID NO: 592776 - RNA, 20 nt, Escherichia coli CFT073
ucaccuuguuucagcgcauc

SEQ ID NO: 592777 - RNA, 16 nt, Escherichia coli CFT073
ucacgaaucgccucac

SEQ ID NO: 592778 - RNA, 15 nt, Escherichia coli CFT073
ucacgaauuccgccu

SEQ ID NO: 592779 - RNA, 22 nt, Escherichia coli CFT073
ucacgacaaagacgucaaaccc

SEQ ID NO: 592780 - RNA, 19 nt, Escherichia coli CFT073
ucacgacaaaugcgccgcc

SEQ ID NO: 592781 - RNA, 20 nt, Escherichia coli CFT073
ucacgacaaaugcgccgcca

SEQ ID NO: 592782 - RNA, 20 nt, Escherichia coli CFT073
ucacgagagcgggaaaacau

SEQ ID NO: 592783 - RNA, 15 nt, Escherichia coli CFT073
ucaccggagcugcca

SEQ ID NO: 592784 - RNA, 15 nt, Escherichia coli CFT073
uauuugacauuuuuu

SEQ ID NO: 592785 - RNA, 12 nt, Escherichia coli CFT073
uauuugauggga

SEQ ID NO: 592786 - RNA, 17 nt, Escherichia coli CFT073
uauuugcaccuaaagcg

SEQ ID NO: 592787 - RNA, 15 nt, Escherichia coli CFT073
uauuuguuauaaacg

SEQ ID NO: 592788 - RNA, 23 nt, Escherichia coli CFT073
uauuuguuuuucaggaaauaaau

SEQ ID NO: 592789 - RNA, 24 nt, Escherichia coli CFT073
uauuuguacugucuaaugauucau

SEQ ID NO: 592790 - RNA, 15 nt, Escherichia coli CFT073
uauuguugaauuccg

SEQ ID NO: 592791 - RNA, 15 nt, Escherichia coli CFT073
uauuuaaacucgcug

SEQ ID NO: 592792 - RNA, 15 nt, Escherichia coli CFT073
uauuuucaaccgggc

SEQ ID NO: 592793 - RNA, 12 nt, Escherichia coli CFT073
ucaccgaugaca

SEQ ID NO: 592794 - RNA, 18 nt, Escherichia coli CFT073
ucaccgcaaagucggcac

SEQ ID NO: 592795 - RNA, 16 nt, Escherichia coli CFT073
ucaccgcacgacgaau

SEQ ID NO: 592796 - RNA, 18 nt, Escherichia coli CFT073
ucaggaaaaacggaauga

SEQ ID NO: 592797 - RNA, 13 nt, Escherichia coli CFT073
ucaggaucaccaa

SEQ ID NO: 592798 - RNA, 18 nt, Escherichia coli CFT073
ucaggauuuccagcucaa

SEQ ID NO: 592799 - RNA, 20 nt, Escherichia coli CFT073
ucaggcaaacagaauuauca

SEQ ID NO: 592800 - RNA, 12 nt, Escherichia coli CFT073
ucaggcaauggg

SEQ ID NO: 592801 - RNA, 20 nt, Escherichia coli CFT073
ucaggcagaacgccaugcca

SEQ ID NO: 592802 - RNA, 18 nt, Escherichia coli CFT073
ucaggccaaucaaaccca

SEQ ID NO: 592803 - RNA, 19 nt, Escherichia coli CFT073
ucagcguuuucuucaauga

SEQ ID NO: 592804 - RNA, 15 nt, Escherichia coli CFT073
ucagcuccacaagaa

SEQ ID NO: 592805 - RNA, 15 nt, Escherichia coli CFT073
ucagcgucgggaagc

SEQ ID NO: 592806 - RNA, 16 nt, Escherichia coli CFT073
ucagcggugucugcca

SEQ ID NO: 592807 - RNA, 12 nt, Escherichia coli CFT073
ucagcgguuuug

SEQ ID NO: 592808 - RNA, 14 nt, Escherichia coli CFT073
ucagcguaacgaug

SEQ ID NO: 592809 - RNA, 16 nt, Escherichia coli CFT073
ucagcguaugcagcca

SEQ ID NO: 592810 - RNA, 23 nt, Escherichia coli CFT073
ucagcguaugcagccaggccauu

SEQ ID NO: 592811 - RNA, 16 nt, Escherichia coli CFT073
ucagcggccaguuucg

SEQ ID NO: 592812 - RNA, 22 nt, Escherichia coli CFT073
ucagcggcacuguuucgccagg

SEQ ID NO: 592813 - RNA, 16 nt, Escherichia coli CFT073
ucagcgcuaccagagc

SEQ ID NO: 592814 - RNA, 22 nt, Escherichia coli CFT073
ucagcgccugcugcacaccaua

SEQ ID NO: 592815 - RNA, 23 nt, Escherichia coli CFT073
ucagcgccagcuucgaggccgga

SEQ ID NO: 592816 - RNA, 16 nt, Escherichia coli CFT073
ucagcgccauccccac

SEQ ID NO: 592817 - RNA, 14 nt, Escherichia coli CFT073
ucagcgccacggaa

SEQ ID NO: 592818 - RNA, 13 nt, Escherichia coli CFT073
ucagcgccagcgc

SEQ ID NO: 592819 - RNA, 16 nt, Escherichia coli CFT073
ucagcgaucagcauuu

SEQ ID NO: 592820 - RNA, 14 nt, Escherichia coli CFT073
ucagcgcaaagaua

SEQ ID NO: 592821 - RNA, 23 nt, Escherichia coli CFT073
ucagcgcaaagauaaugacuucc

SEQ ID NO: 592822 - RNA, 21 nt, Escherichia coli CFT073
ucagccacuucaaccagcggc

SEQ ID NO: 592823 - RNA, 19 nt, Escherichia coli CFT073
ucagccagagaagcgacuu

SEQ ID NO: 592824 - RNA, 19 nt, Escherichia coli CFT073
ucagccacacuuaauaacg

SEQ ID NO: 592825 - RNA, 17 nt, Escherichia coli CFT073
ucagccaaauccagcgc

SEQ ID NO: 592826 - RNA, 16 nt, Escherichia coli CFT073
ucagcacagagauaaa

SEQ ID NO: 592827 - RNA, 20 nt, Escherichia coli CFT073
ucagcacagagauaaaaggc

SEQ ID NO: 592828 - RNA, 21 nt, Escherichia coli CFT073
ucagcacacauaacagcggga

SEQ ID NO: 592829 - RNA, 14 nt, Escherichia coli CFT073
uccaggcuggucgc

SEQ ID NO: 592830 - RNA, 18 nt, Escherichia coli CFT073
uccaucaucucuggcggc

SEQ ID NO: 592831 - RNA, 20 nt, Escherichia coli CFT073
uccaucgcaucuucgcccac

SEQ ID NO: 592832 - RNA, 19 nt, Escherichia coli CFT073
uccaggugaaaaauaaaag

SEQ ID NO: 592833 - RNA, 21 nt, Escherichia coli CFT073
uccaucucgccauccuuaugc

SEQ ID NO: 592834 - RNA, 18 nt, Escherichia coli CFT073
uccagcgguuguagccac

SEQ ID NO: 592835 - RNA, 23 nt, Escherichia coli CFT073
uccagcuccguccagccaccgcg

SEQ ID NO: 592836 - RNA, 19 nt, Escherichia coli CFT073
uccagcucaaccagauucg

SEQ ID NO: 592837 - RNA, 18 nt, Escherichia coli CFT073
uccagccccaccagcaaa

SEQ ID NO: 592838 - RNA, 22 nt, Escherichia coli CFT073
uccagccacggcuccagcaaug

SEQ ID NO: 592839 - RNA, 20 nt, Escherichia coli CFT073
uccagcauaccuuccagcgc

SEQ ID NO: 592840 - RNA, 22 nt, Escherichia coli CFT073
uccagaucacgcagcaagccgu

SEQ ID NO: 592841 - RNA, 14 nt, Escherichia coli CFT073
uccacuuccugcca

SEQ ID NO: 592842 - RNA, 22 nt, Escherichia coli CFT073
uccacucuuucagcaccagccc

SEQ ID NO: 592843 - RNA, 22 nt, Escherichia coli CFT073
uccacugaaacaugaacaucaa

SEQ ID NO: 592844 - RNA, 21 nt, Escherichia coli CFT073
uccacugauggcgaaaucgcu

SEQ ID NO: 592845 - RNA, 13 nt, Escherichia coli CFT073
uccacugcgcaua

SEQ ID NO: 592846 - RNA, 18 nt, Escherichia coli CFT073
uccagaugucuuuacccg

SEQ ID NO: 592847 - RNA, 19 nt, Escherichia coli CFT073
uccagaucggcuucaaucu

SEQ ID NO: 592848 - RNA, 20 nt, Escherichia coli CFT073
uccagaugcuguaccaggug

SEQ ID NO: 592849 - RNA, 12 nt, Escherichia coli CFT073
uccagcaacgcu

SEQ ID NO: 592850 - RNA, 20 nt, Escherichia coli CFT073
uccagauucuccaccugcgg

SEQ ID NO: 592851 - RNA, 22 nt, Escherichia coli CFT073
uccagcacacuguaagccaccg

SEQ ID NO: 592852 - RNA, 14 nt, Escherichia coli CFT073
uccagcaccacuac

SEQ ID NO: 592853 - RNA, 20 nt, Escherichia coli CFT073
uccacgcuuugauccgccag

SEQ ID NO: 592854 - RNA, 21 nt, Escherichia coli CFT073
uccacgcuuugauccgccaga

SEQ ID NO: 592855 - RNA, 19 nt, Escherichia coli CFT073
uccacuaacccuucgccag

SEQ ID NO: 592856 - RNA, 19 nt, Escherichia coli CFT073
uccacaucggcaucaggcc

SEQ ID NO: 592857 - RNA, 21 nt, Escherichia coli CFT073
uccaacucuuuuaccaccgca

SEQ ID NO: 592858 - RNA, 21 nt, Escherichia coli CFT073
uccaacuaaacguagcggaaa

SEQ ID NO: 592859 - RNA, 17 nt, Escherichia coli CFT073
uccacaccaaaauaacg

SEQ ID NO: 592860 - RNA, 23 nt, Escherichia coli CFT073
ucauuaucaauugcuucaauaau

SEQ ID NO: 592861 - RNA, 13 nt, Escherichia coli CFT073
ucauuauuaauuu

SEQ ID NO: 592862 - RNA, 13 nt, Escherichia coli CFT073
ucaugucucucag

SEQ ID NO: 592863 - RNA, 22 nt, Escherichia coli CFT073
ucaugucgguuacuauccugaa

SEQ ID NO: 592864 - RNA, 15 nt, Escherichia coli CFT073
ucaugucagagcugu

SEQ ID NO: 592865 - RNA, 19 nt, Escherichia coli CFT073
ucauguauauuauccauca

SEQ ID NO: 592866 - RNA, 16 nt, Escherichia coli CFT073
ucaugguguaccgggu

SEQ ID NO: 592867 - RNA, 17 nt, Escherichia coli CFT073
ucauugauaauauccgu

SEQ ID NO: 592868 - RNA, 22 nt, Escherichia coli CFT073
ucauugaagcgccguccaguaa

SEQ ID NO: 592869 - RNA, 19 nt, Escherichia coli CFT073
ucauugacaaucgccgcca

SEQ ID NO: 592870 - RNA, 14 nt, Escherichia coli CFT073
ucauugacgccaag

SEQ ID NO: 592871 - RNA, 22 nt, Escherichia coli CFT073
ucauucaggccaaagccgccga

SEQ ID NO: 592872 - RNA, 15 nt, Escherichia coli CFT073
ucauucgcagcugca

SEQ ID NO: 592873 - RNA, 23 nt, Escherichia coli CFT073
ucaucggcggugacuagcagcau

SEQ ID NO: 592874 - RNA, 17 nt, Escherichia coli CFT073
ucaucggcgucgguuuc

SEQ ID NO: 592875 - RNA, 22 nt, Escherichia coli CFT073
ucaucgcugaauuucgccgcac

SEQ ID NO: 592876 - RNA, 23 nt, Escherichia coli CFT073
ucauccaggcacuggccuuuuca

SEQ ID NO: 592877 - RNA, 22 nt, Escherichia coli CFT073
ucaucggauaagguauagucac

SEQ ID NO: 592878 - RNA, 16 nt, Escherichia coli CFT073
ucaucggaucauuagu

SEQ ID NO: 592879 - RNA, 13 nt, Escherichia coli CFT073
ucaucggcaaagg

SEQ ID NO: 592880 - RNA, 15 nt, Escherichia coli CFT073
ucaucggcagcaucg

SEQ ID NO: 592881 - RNA, 20 nt, Escherichia coli CFT073
ucaucggcagcaucgcucac

SEQ ID NO: 592882 - RNA, 12 nt, Escherichia coli CFT073
ucauccagcagc

SEQ ID NO: 592883 - RNA, 23 nt, Escherichia coli CFT073
ucaucaucggcaccgccagcagg

SEQ ID NO: 592884 - RNA, 19 nt, Escherichia coli CFT073
ucaucaugcacuccgcugu

SEQ ID NO: 592885 - RNA, 16 nt, Escherichia coli CFT073
ucaugaugcuccgcca

SEQ ID NO: 592886 - RNA, 19 nt, Escherichia coli CFT073
ucaugauacuccacaucau

SEQ ID NO: 592887 - RNA, 16 nt, Escherichia coli CFT073
ucaugcaucgguuuug

SEQ ID NO: 592888 - RNA, 12 nt, Escherichia coli CFT073
ucaugccauccg

SEQ ID NO: 592889 - RNA, 21 nt, Escherichia coli CFT073
ucaucgugaccaaagcagacg

SEQ ID NO: 592890 - RNA, 19 nt, Escherichia coli CFT073
ucaucgucauaaugggcgc

SEQ ID NO: 592891 - RNA, 15 nt, Escherichia coli CFT073
ucaucguaccgauac

SEQ ID NO: 592892 - RNA, 13 nt, Escherichia coli CFT073
ucaucgucaaaau

SEQ ID NO: 592893 - RNA, 22 nt, Escherichia coli CFT073
ucaucguaaccgacgaugguuu

SEQ ID NO: 592894 - RNA, 14 nt, Escherichia coli CFT073
ucaucaacccgcgc

SEQ ID NO: 592895 - RNA, 13 nt, Escherichia coli CFT073
ucauaauaugacc

SEQ ID NO: 592896 - RNA, 21 nt, Escherichia coli CFT073
ucauaaucauuaacggccacg

SEQ ID NO: 592897 - RNA, 14 nt, Escherichia coli CFT073
ucauaauccggcaa

SEQ ID NO: 592898 - RNA, 20 nt, Escherichia coli CFT073
ucauaaauuaccaccagcga

SEQ ID NO: 592899 - RNA, 12 nt, Escherichia coli CFT073
ucaguucaacgg

SEQ ID NO: 592900 - RNA, 17 nt, Escherichia coli CFT073
ucaguucacacaaggua

SEQ ID NO: 592901 - RNA, 17 nt, Escherichia coli CFT073
ucaguugccgaauaccg

SEQ ID NO: 592902 - RNA, 13 nt, Escherichia coli CFT073
ucaguuugcccca

SEQ ID NO: 592903 - RNA, 17 nt, Escherichia coli CFT073
ucaucaguacgccuuua

SEQ ID NO: 592904 - RNA, 12 nt, Escherichia coli CFT073
ucaucaucacga

SEQ ID NO: 592905 - RNA, 15 nt, Escherichia coli CFT073
ucaucaucauuaacu

SEQ ID NO: 592906 - RNA, 17 nt, Escherichia coli CFT073
ucaucaucgcagauuuc

SEQ ID NO: 592907 - RNA, 18 nt, Escherichia coli CFT073
ucaucagcauaaucacca

SEQ ID NO: 592908 - RNA, 13 nt, Escherichia coli CFT073
ucaucagcaucac

SEQ ID NO: 592909 - RNA, 20 nt, Escherichia coli CFT073
ucaucaccuugcucgaucag

SEQ ID NO: 592910 - RNA, 22 nt, Escherichia coli CFT073
ucaucaacguuaauacuacgca

SEQ ID NO: 592911 - RNA, 14 nt, Escherichia coli CFT073
ucaucaagcaaggc

SEQ ID NO: 592912 - RNA, 20 nt, Escherichia coli CFT073
ucagucgguucaaccaucag

SEQ ID NO: 592913 - RNA, 18 nt, Escherichia coli CFT073
ucaggcgagugguaugac

SEQ ID NO: 592914 - RNA, 23 nt, Escherichia coli CFT073
ucaggcgagugguaugacuuaaa

SEQ ID NO: 592915 - RNA, 19 nt, Escherichia coli CFT073
ucaggucacccaugcgcgc

SEQ ID NO: 592916 - RNA, 22 nt, Escherichia coli CFT073
ucaggccugugaaggggcgcaa

SEQ ID NO: 592917 - RNA, 18 nt, Escherichia coli CFT073
ucaggccuacgccagaca

SEQ ID NO: 592918 - RNA, 18 nt, Escherichia coli CFT073
ucaggccuacgucagaca

SEQ ID NO: 592919 - RNA, 18 nt, Escherichia coli CFT073
uaguuuuugcccaucaug

SEQ ID NO: 592920 - RNA, 18 nt, Escherichia coli CFT073
uauaaacccccugaccgg

SEQ ID NO: 592921 - RNA, 19 nt, Escherichia coli CFT073
uauagcgcauggcagccag

SEQ ID NO: 592922 - RNA, 18 nt, Escherichia coli CFT073
uauagcacccgccagcgc

SEQ ID NO: 592923 - RNA, 15 nt, Escherichia coli CFT073
uauagcgaagguguu

SEQ ID NO: 592924 - RNA, 16 nt, Escherichia coli CFT073
uauagaaugcagcagc

SEQ ID NO: 592925 - RNA, 19 nt, Escherichia coli CFT073
uauacggcguuuccagcuc

SEQ ID NO: 592926 - RNA, 14 nt, Escherichia coli CFT073
uauacgucggguua

SEQ ID NO: 592927 - RNA, 20 nt, Escherichia coli CFT073
uauacgugaaauccccuggc

SEQ ID NO: 592928 - RNA, 21 nt, Escherichia coli CFT073
uauaucccucacgcuucugaa

SEQ ID NO: 592929 - RNA, 20 nt, Escherichia coli CFT073
uagggcgagaaauugagaua

SEQ ID NO: 592930 - RNA, 19 nt, Escherichia coli CFT073
uagguacaaagccaacagc

SEQ ID NO: 592931 - RNA, 16 nt, Escherichia coli CFT073
uaggucauaucaucaa

SEQ ID NO: 592932 - RNA, 19 nt, Escherichia coli CFT073
uaggucggauaagacgcac

SEQ ID NO: 592933 - RNA, 16 nt, Escherichia coli CFT073
uagguguaaauaucag

SEQ ID NO: 592934 - RNA, 20 nt, Escherichia coli CFT073
uagguuccggcaaucaacag

SEQ ID NO: 592935 - RNA, 17 nt, Escherichia coli CFT073
uagguugaaauaaaccg

SEQ ID NO: 592936 - RNA, 20 nt, Escherichia coli CFT073
uagguugaaauaaaccgugc

SEQ ID NO: 592937 - RNA, 11 nt, Escherichia coli CFT073
uagucaggugg

SEQ ID NO: 592938 - RNA, 13 nt, Escherichia coli CFT073
uaguaacgcggca

SEQ ID NO: 592939 - RNA, 18 nt, Escherichia coli CFT073
uaguccggauaaggcguu

SEQ ID NO: 592940 - RNA, 20 nt, Escherichia coli CFT073
uaguccggauaaggcguuca

SEQ ID NO: 592941 - RNA, 17 nt, Escherichia coli CFT073
uaguuaaaccagcuguc

SEQ ID NO: 592942 - RNA, 22 nt, Escherichia coli CFT073
uagugaugcaucauaugcgcca

SEQ ID NO: 592943 - RNA, 20 nt, Escherichia coli CFT073
uaguggcaaccgcaaccgcc

SEQ ID NO: 592944 - RNA, 13 nt, Escherichia coli CFT073
uagugucgcauca

SEQ ID NO: 592945 - RNA, 23 nt, Escherichia coli CFT073
uauucacguuuuucauccagcgg

SEQ ID NO: 592946 - RNA, 20 nt, Escherichia coli CFT073
uauucagaguauauauucgu

SEQ ID NO: 592947 - RNA, 20 nt, Escherichia coli CFT073
uauucaggcacuuucgcgaa

SEQ ID NO: 592948 - RNA, 23 nt, Escherichia coli CFT073
uauucaugcccugcccgcugcca

SEQ ID NO: 592949 - RNA, 13 nt, Escherichia coli CFT073
uauucauguugau

SEQ ID NO: 592950 - RNA, 19 nt, Escherichia coli CFT073
uauuccgcaacgccgccaa

SEQ ID NO: 592951 - RNA, 21 nt, Escherichia coli CFT073
uauuccugaaucagccaguaa

SEQ ID NO: 592952 - RNA, 17 nt, Escherichia coli CFT073
uauuccgcaccugccag

SEQ ID NO: 592953 - RNA, 18 nt, Escherichia coli CFT073
uauuccgcaccugccagc

SEQ ID NO: 592954 - RNA, 22 nt, Escherichia coli CFT073
uauucguuaucguaccaggcga

SEQ ID NO: 592955 - RNA, 13 nt, Escherichia coli CFT073
uauuggcacugcg

SEQ ID NO: 592956 - RNA, 17 nt, Escherichia coli CFT073
uauugcuugaucaggaa

SEQ ID NO: 592957 - RNA, 17 nt, Escherichia coli CFT073
uauggcugcauccagaa

SEQ ID NO: 592958 - RNA, 24 nt, Escherichia coli CFT073
uaugguuucccugauaauguccgg

SEQ ID NO: 592959 - RNA, 21 nt, Escherichia coli CFT073
uauggcccagccuuuccagca

SEQ ID NO: 592960 - RNA, 19 nt, Escherichia coli CFT073
uaugacucauaaaaauaua

SEQ ID NO: 592961 - RNA, 13 nt, Escherichia coli CFT073
uaugacccagcgc

SEQ ID NO: 592962 - RNA, 18 nt, Escherichia coli CFT073
uauguuuuugaauuaacu

SEQ ID NO: 592963 - RNA, 17 nt, Escherichia coli CFT073
uauguucagaaagcgcc

SEQ ID NO: 592964 - RNA, 12 nt, Escherichia coli CFT073
uauguucccuua

SEQ ID NO: 592965 - RNA, 18 nt, Escherichia coli CFT073
uaugucauccgguuugua

SEQ ID NO: 592966 - RNA, 17 nt, Escherichia coli CFT073
uauuaaauggcccgcgc

SEQ ID NO: 592967 - RNA, 19 nt, Escherichia coli CFT073
uauuaaagaaaguaaucua

SEQ ID NO: 592968 - RNA, 12 nt, Escherichia coli CFT073
uauuaaaccacc

SEQ ID NO: 592969 - RNA, 15 nt, Escherichia coli CFT073
uauccgguuucugau

SEQ ID NO: 592970 - RNA, 20 nt, Escherichia coli CFT073
uauccggccaacaaaaaauu

SEQ ID NO: 592971 - RNA, 15 nt, Escherichia coli CFT073
uauccggccuacaua

SEQ ID NO: 592972 - RNA, 15 nt, Escherichia coli CFT073
uauccggccuacgaa

SEQ ID NO: 592973 - RNA, 15 nt, Escherichia coli CFT073
uauccggccugcaaa

SEQ ID NO: 592974 - RNA, 12 nt, Escherichia coli CFT073
uauccgggcaaa

SEQ ID NO: 592975 - RNA, 21 nt, Escherichia coli CFT073
uaucccaccagcgccgcccac

SEQ ID NO: 592976 - RNA, 12 nt, Escherichia coli CFT073
uaucguuaucgc

SEQ ID NO: 592977 - RNA, 14 nt, Escherichia coli CFT073
uaucgguugcugga

SEQ ID NO: 592978 - RNA, 21 nt, Escherichia coli CFT073
uaucguaaucagcaccgaagu

SEQ ID NO: 592979 - RNA, 17 nt, Escherichia coli CFT073
uaucguaauuuuucggu

SEQ ID NO: 592980 - RNA, 14 nt, Escherichia coli CFT073
uaucuuuuucggua

SEQ ID NO: 592981 - RNA, 20 nt, Escherichia coli CFT073
uaucuauauuuauucaucag

SEQ ID NO: 592982 - RNA, 20 nt, Escherichia coli CFT073
uaucaccguggucgguaaac

SEQ ID NO: 592983 - RNA, 21 nt, Escherichia coli CFT073
uaucacgguaaugauuaacag

SEQ ID NO: 592984 - RNA, 19 nt, Escherichia coli CFT073
uaucaccgaucguuaccgu

SEQ ID NO: 592985 - RNA, 22 nt, Escherichia coli CFT073
uaucaauuaacugugccagcgu

SEQ ID NO: 592986 - RNA, 14 nt, Escherichia coli CFT073
uaucaaccacggca

SEQ ID NO: 592987 - RNA, 20 nt, Escherichia coli CFT073
uaucaacccgagcgccagcg

SEQ ID NO: 592988 - RNA, 14 nt, Escherichia coli CFT073
uaucaagcccgccg

SEQ ID NO: 592989 - RNA, 19 nt, Escherichia coli CFT073
uaucaucauccgcaauaac

SEQ ID NO: 592990 - RNA, 16 nt, Escherichia coli CFT073
uaucagcgagacgugc

SEQ ID NO: 592991 - RNA, 15 nt, Escherichia coli CFT073
uaucaggccuacaau

SEQ ID NO: 592992 - RNA, 16 nt, Escherichia coli CFT073
uaucaggccuacgcca

SEQ ID NO: 592993 - RNA, 19 nt, Escherichia coli CFT073
uauccaccgacacuacaaa

SEQ ID NO: 592994 - RNA, 14 nt, Escherichia coli CFT073
uauccagcagaucg

SEQ ID NO: 592995 - RNA, 16 nt, Escherichia coli CFT073
uauccagcagaucgau

SEQ ID NO: 592996 - RNA, 21 nt, Escherichia coli CFT073
uauccagucggcguaauccug

SEQ ID NO: 592997 - RNA, 22 nt, Escherichia coli CFT073
uauccagguguauuguucuggu

SEQ ID NO: 592998 - RNA, 19 nt, Escherichia coli CFT073
uagcggaaaucuccagaua

SEQ ID NO: 592999 - RNA, 15 nt, Escherichia coli CFT073
uagcguaaaucaucg

SEQ ID NO: 593000 - RNA, 16 nt, Escherichia coli CFT073
uagcgacgcgcuggca

SEQ ID NO: 593001 - RNA, 21 nt, Escherichia coli CFT073
uagaucguacucaaucccucg

SEQ ID NO: 593002 - RNA, 15 nt, Escherichia coli CFT073
uagauauauccugaa

SEQ ID NO: 593003 - RNA, 22 nt, Escherichia coli CFT073
uagaagacgcagggcgaauucc

SEQ ID NO: 593004 - RNA, 14 nt, Escherichia coli CFT073
uagaagccaguaca

SEQ ID NO: 593005 - RNA, 21 nt, Escherichia coli CFT073
uagcucaguugguagagcacg

SEQ ID NO: 593006 - RNA, 12 nt, Escherichia coli CFT073
uagcugauauca

SEQ ID NO: 593007 - RNA, 17 nt, Escherichia coli CFT073
uagcuguuggcaacgca

SEQ ID NO: 593008 - RNA, 19 nt, Escherichia coli CFT073
uagcuguuggcaacgcaaa

SEQ ID NO: 593009 - RNA, 21 nt, Escherichia coli CFT073
uagcuuaauaagaaaaaaggu

SEQ ID NO: 593010 - RNA, 20 nt, Escherichia coli CFT073
uaggccagauaagacgcguc

SEQ ID NO: 593011 - RNA, 20 nt, Escherichia coli CFT073
uaggccagauaaggcguuua

SEQ ID NO: 593012 - RNA, 19 nt, Escherichia coli CFT073
uaggccaucgcuuuucguc

SEQ ID NO: 593013 - RNA, 17 nt, Escherichia coli CFT073
uaggccaucggcagcau

SEQ ID NO: 593014 - RNA, 19 nt, Escherichia coli CFT073
uagggaaucgauaacugcu

SEQ ID NO: 593015 - RNA, 15 nt, Escherichia coli CFT073
uaggcugagaaccgc

SEQ ID NO: 593016 - RNA, 15 nt, Escherichia coli CFT073
uaggccugauaagcg

SEQ ID NO: 593017 - RNA, 20 nt, Escherichia coli CFT073
uaggccggauaagguguuca

SEQ ID NO: 593018 - RNA, 20 nt, Escherichia coli CFT073
uaggccggagaaggcguuca

SEQ ID NO: 593019 - RNA, 18 nt, Escherichia coli CFT073
uaggccggauaagacgcg

SEQ ID NO: 593020 - RNA, 20 nt, Escherichia coli CFT073
uaggccggauaaggcguuca

SEQ ID NO: 593021 - RNA, 18 nt, Escherichia coli CFT073
uacguucgacugcgccuu

SEQ ID NO: 593022 - RNA, 20 nt, Escherichia coli CFT073
uacgucgagcaguugcugaa

SEQ ID NO: 593023 - RNA, 17 nt, Escherichia coli CFT073
uacguccaucacaauca

SEQ ID NO: 593024 - RNA, 16 nt, Escherichia coli CFT073
uacucaucgcccgcaa

SEQ ID NO: 593025 - RNA, 17 nt, Escherichia coli CFT073
uacucaucuuccauucu

SEQ ID NO: 593026 - RNA, 14 nt, Escherichia coli CFT073
uacucccugcugau

SEQ ID NO: 593027 - RNA, 17 nt, Escherichia coli CFT073
uacggcguuaacuuguu

SEQ ID NO: 593028 - RNA, 20 nt, Escherichia coli CFT073
uacggcuaaaaaaagccacc

SEQ ID NO: 593029 - RNA, 17 nt, Escherichia coli CFT073
uacgguuuuuugaacag

SEQ ID NO: 593030 - RNA, 20 nt, Escherichia coli CFT073
uacguacugcaacguuaucc

SEQ ID NO: 593031 - RNA, 13 nt, Escherichia coli CFT073
uacguagcucauc

SEQ ID NO: 593032 - RNA, 21 nt, Escherichia coli CFT073
uacuccgcaccgcgguacagc

SEQ ID NO: 593033 - RNA, 14 nt, Escherichia coli CFT073
uacucgucgcgcac

SEQ ID NO: 593034 - RNA, 16 nt, Escherichia coli CFT073
uacucuccugcggcga

SEQ ID NO: 593035 - RNA, 18 nt, Escherichia coli CFT073
uacucuugugccaguucc

SEQ ID NO: 593036 - RNA, 23 nt, Escherichia coli CFT073
uacuguuuaccggugccagcaac

SEQ ID NO: 593037 - RNA, 13 nt, Escherichia coli CFT073
uacugaacuuauc

SEQ ID NO: 593038 - RNA, 14 nt, Escherichia coli CFT073
uacugguugcggua

SEQ ID NO: 593039 - RNA, 16 nt, Escherichia coli CFT073
uacugagcagaugcgc

SEQ ID NO: 593040 - RNA, 13 nt, Escherichia coli CFT073
uacuucacaucau

SEQ ID NO: 593041 - RNA, 21 nt, Escherichia coli CFT073
uagaaccacgcaaaggcguua

SEQ ID NO: 593042 - RNA, 15 nt, Escherichia coli CFT073
uacgaaacagacggc

SEQ ID NO: 593043 - RNA, 13 nt, Escherichia coli CFT073
uaccugauuacca

SEQ ID NO: 593044 - RNA, 16 nt, Escherichia coli CFT073
uaccugcuuaaucaua

SEQ ID NO: 593045 - RNA, 15 nt, Escherichia coli CFT073
uaccuggagcaguau

SEQ ID NO: 593046 - RNA, 14 nt, Escherichia coli CFT073
uacaugauccggca

SEQ ID NO: 593047 - RNA, 13 nt, Escherichia coli CFT073
uacauuaaccgcc

SEQ ID NO: 593048 - RNA, 17 nt, Escherichia coli CFT073
uaccaaaaacggucaua

SEQ ID NO: 593049 - RNA, 22 nt, Escherichia coli CFT073
uaccaaaacggguacgaugcgc

SEQ ID NO: 593050 - RNA, 18 nt, Escherichia coli CFT073
uaccguucauuaacgccc

SEQ ID NO: 593051 - RNA, 18 nt, Escherichia coli CFT073
uaccguugccgguuaucc

SEQ ID NO: 593052 - RNA, 16 nt, Escherichia coli CFT073
uacggauagccgcccc

SEQ ID NO: 593053 - RNA, 15 nt, Escherichia coli CFT073
uacggauucaaugca

SEQ ID NO: 593054 - RNA, 16 nt, Escherichia coli CFT073
uacgcuuuacuguaca

SEQ ID NO: 593055 - RNA, 20 nt, Escherichia coli CFT073
uacgcugucuuuugaucaaa

SEQ ID NO: 593056 - RNA, 17 nt, Escherichia coli CFT073
uacgcuuaucaggccua

SEQ ID NO: 593057 - RNA, 19 nt, Escherichia coli CFT073
uacgcugcggcgaaagcgg

SEQ ID NO: 593058 - RNA, 21 nt, Escherichia coli CFT073
uacgcguaaaauauugcugcu

SEQ ID NO: 593059 - RNA, 13 nt, Escherichia coli CFT073
uacgcgccagagc

SEQ ID NO: 593060 - RNA, 17 nt, Escherichia coli CFT073
uacgcgccgccagccac

SEQ ID NO: 593061 - RNA, 18 nt, Escherichia coli CFT073
uacgccuuccgucagcaa

SEQ ID NO: 593062 - RNA, 12 nt, Escherichia coli CFT073
uaaaacgccuga

SEQ ID NO: 593063 - RNA, 13 nt, Escherichia coli CFT073
uaaaacgcgccca

SEQ ID NO: 593064 - RNA, 23 nt, Escherichia coli CFT073
uaaaacgauaguggcucaggcuc

SEQ ID NO: 593065 - RNA, 20 nt, Escherichia coli CFT073
uaaaacccagaccggcgcac

SEQ ID NO: 593066 - RNA, 20 nt, Escherichia coli CFT073
uaaaacggcgcauugccuga

SEQ ID NO: 593067 - RNA, 18 nt, Escherichia coli CFT073
uaaaacgggauuccugcg

SEQ ID NO: 593068 - RNA, 23 nt, Escherichia coli CFT073
uaaaacugcgcguuauguagacu

SEQ ID NO: 593069 - RNA, 20 nt, Escherichia coli CFT073
uaaaaaagcgucgccgucaa

SEQ ID NO: 593070 - RNA, 18 nt, Escherichia coli CFT073
uaaaacagccuuguauua

SEQ ID NO: 593071 - RNA, 13 nt, Escherichia coli CFT073
guuuuuucaucga

SEQ ID NO: 593072 - RNA, 17 nt, Escherichia coli CFT073
guuuuuuuauaucucag

SEQ ID NO: 593073 - RNA, 15 nt, Escherichia coli CFT073
guuuuguagaccuga

SEQ ID NO: 593074 - RNA, 18 nt, Escherichia coli CFT073
guuuuucacccgcaauca

SEQ ID NO: 593075 - RNA, 19 nt, Escherichia coli CFT073
uaaaggauauucgucgcag

SEQ ID NO: 593076 - RNA, 14 nt, Escherichia coli CFT073
uaaaggccaucccu

SEQ ID NO: 593077 - RNA, 15 nt, Escherichia coli CFT073
uaaagccgcgaaacu

SEQ ID NO: 593078 - RNA, 21 nt, Escherichia coli CFT073
uaaagcgcguaguuugucuuc

SEQ ID NO: 593079 - RNA, 22 nt, Escherichia coli CFT073
uaaagcgguguuucgggcagcc

SEQ ID NO: 593080 - RNA, 17 nt, Escherichia coli CFT073
uaaagcguuccagcagc

SEQ ID NO: 593081 - RNA, 17 nt, Escherichia coli CFT073
uaaagcaacuccaucaa

SEQ ID NO: 593082 - RNA, 14 nt, Escherichia coli CFT073
uaaacggugauacu

SEQ ID NO: 593083 - RNA, 17 nt, Escherichia coli CFT073
uaaagcccgcagcgucc

SEQ ID NO: 593084 - RNA, 12 nt, Escherichia coli CFT073
uaaagcccgcca

SEQ ID NO: 593085 - RNA, 17 nt, Escherichia coli CFT073
uaaagcccgccaucgcc

SEQ ID NO: 593086 - RNA, 12 nt, Escherichia coli CFT073
uaaagccagcgg

SEQ ID NO: 593087 - RNA, 20 nt, Escherichia coli CFT073
uaaagcccugcucgcgcaga

SEQ ID NO: 593088 - RNA, 15 nt, Escherichia coli CFT073
uaaagccugauaccc

SEQ ID NO: 593089 - RNA, 14 nt, Escherichia coli CFT073
uaaagccugcuggc

SEQ ID NO: 593090 - RNA, 20 nt, Escherichia coli CFT073
uaaagcgaaacagcgcccca

SEQ ID NO: 593091 - RNA, 17 nt, Escherichia coli CFT073
uaaagcgauccaguucc

SEQ ID NO: 593092 - RNA, 23 nt, Escherichia coli CFT073
uaaacgaaaugcgcuuaaucaau

SEQ ID NO: 593093 - RNA, 19 nt, Escherichia coli CFT073
uaaacaauggcauaaccga

SEQ ID NO: 593094 - RNA, 15 nt, Escherichia coli CFT073
uaaaauuauccagcg

SEQ ID NO: 593095 - RNA, 15 nt, Escherichia coli CFT073
uaaacaacgccgcca

SEQ ID NO: 593096 - RNA, 20 nt, Escherichia coli CFT073
uaaacgccuuauccgaccua

SEQ ID NO: 593097 - RNA, 22 nt, Escherichia coli CFT073
uaaaucccgccgcuucgccaau

SEQ ID NO: 593098 - RNA, 12 nt, Escherichia coli CFT073
uaaaugucaucc

SEQ ID NO: 593099 - RNA, 15 nt, Escherichia coli CFT073
uaaaugucaugacau

SEQ ID NO: 593100 - RNA, 12 nt, Escherichia coli CFT073
uaaauauuauau

SEQ ID NO: 593101 - RNA, 14 nt, Escherichia coli CFT073
uaacaccggcgcac

SEQ ID NO: 593102 - RNA, 15 nt, Escherichia coli CFT073
uaaauuuccaccgcu

SEQ ID NO: 593103 - RNA, 20 nt, Escherichia coli CFT073
uaaauuguucauauuaaccu

SEQ ID NO: 593104 - RNA, 20 nt, Escherichia coli CFT073
uaacaguguuucuccgccaa

SEQ ID NO: 593105 - RNA, 18 nt, Escherichia coli CFT073
uaacacuuucgccugcgg

SEQ ID NO: 593106 - RNA, 21 nt, Escherichia coli CFT073
uaacagaagguuuauauagua

SEQ ID NO: 593107 - RNA, 17 nt, Escherichia coli CFT073
uaacagaaugcgcgcga

SEQ ID NO: 593108 - RNA, 12 nt, Escherichia coli CFT073
uaacagcgcauu

SEQ ID NO: 593109 - RNA, 21 nt, Escherichia coli CFT073
uaacagcgccgcgauaaaauc

SEQ ID NO: 593110 - RNA, 16 nt, Escherichia coli CFT073
uaacagcggugcaccu

SEQ ID NO: 593111 - RNA, 17 nt, Escherichia coli CFT073
uaacaucugacacagcg

SEQ ID NO: 593112 - RNA, 21 nt, Escherichia coli CFT073
uaacaucuuaauagcugccag

SEQ ID NO: 593113 - RNA, 16 nt, Escherichia coli CFT073
uaacauuaugucuguu

SEQ ID NO: 593114 - RNA, 17 nt, Escherichia coli CFT073
uaacccggcauaaugau

SEQ ID NO: 593115 - RNA, 20 nt, Escherichia coli CFT073
uaacccugcauauaaucgau

SEQ ID NO: 593116 - RNA, 14 nt, Escherichia coli CFT073
uaaccgccgccaga

SEQ ID NO: 593117 - RNA, 18 nt, Escherichia coli CFT073
uaaccggauaucuaaugc

SEQ ID NO: 593118 - RNA, 22 nt, Escherichia coli CFT073
uaaccgucagcgcaugauuccc

SEQ ID NO: 593119 - RNA, 20 nt, Escherichia coli CFT073
uaaccgucuuugcugauacu

SEQ ID NO: 593120 - RNA, 20 nt, Escherichia coli CFT073
uaacgguuucaaccagcagg

SEQ ID NO: 593121 - RNA, 22 nt, Escherichia coli CFT073
uaacgucgccagaaaucagcag

SEQ ID NO: 593122 - RNA, 15 nt, Escherichia coli CFT073
uaacguugaaccgcc

SEQ ID NO: 593123 - RNA, 21 nt, Escherichia coli CFT073
uaacgcugauacccggcacac

SEQ ID NO: 593124 - RNA, 19 nt, Escherichia coli CFT073
uaacgcuggggccaucgcc

SEQ ID NO: 593125 - RNA, 15 nt, Escherichia coli CFT073
uaacggcccggcgac

SEQ ID NO: 593126 - RNA, 12 nt, Escherichia coli CFT073
uaauuuccugcc

SEQ ID NO: 593127 - RNA, 17 nt, Escherichia coli CFT073
uaauuuccugccagcgu

SEQ ID NO: 593128 - RNA, 24 nt, Escherichia coli CFT073
uaauuucggcagcgcgcucgccaa

SEQ ID NO: 593129 - RNA, 12 nt, Escherichia coli CFT073
uacaaauuuagc

SEQ ID NO: 593130 - RNA, 22 nt, Escherichia coli CFT073
uacaaccaaaucugauuaauau

SEQ ID NO: 593131 - RNA, 13 nt, Escherichia coli CFT073
uaauggcaauggu

SEQ ID NO: 593132 - RNA, 19 nt, Escherichia coli CFT073
uaauggacuguaagccauc

SEQ ID NO: 593133 - RNA, 21 nt, Escherichia coli CFT073
uaauugccagccaucgccugc

SEQ ID NO: 593134 - RNA, 21 nt, Escherichia coli CFT073
uaaucugcucggcgagcaacg

SEQ ID NO: 593135 - RNA, 12 nt, Escherichia coli CFT073
uaaugccggacu

SEQ ID NO: 593136 - RNA, 22 nt, Escherichia coli CFT073
uaaugccggauaagccucgcuu

SEQ ID NO: 593137 - RNA, 16 nt, Escherichia coli CFT073
uaaugcgacccacgcc

SEQ ID NO: 593138 - RNA, 18 nt, Escherichia coli CFT073
uacagcuuaaucaccagc

SEQ ID NO: 593139 - RNA, 20 nt, Escherichia coli CFT073
uacagcuuaaucaccagcgc

SEQ ID NO: 593140 - RNA, 11 nt, Escherichia coli CFT073
uacagcggaac

SEQ ID NO: 593141 - RNA, 22 nt, Escherichia coli CFT073
uacagaccgaauucugcggcca

SEQ ID NO: 593142 - RNA, 15 nt, Escherichia coli CFT073
uacagacucaaacca

SEQ ID NO: 593143 - RNA, 21 nt, Escherichia coli CFT073
uacaucgacaacguuuucaac

SEQ ID NO: 593144 - RNA, 23 nt, Escherichia coli CFT073
uacaucgauuucgcuaaaaguau

SEQ ID NO: 593145 - RNA, 15 nt, Escherichia coli CFT073
uacaucgcgccaaca

SEQ ID NO: 593146 - RNA, 22 nt, Escherichia coli CFT073
uacaggcggugucggaacggua

SEQ ID NO: 593147 - RNA, 23 nt, Escherichia coli CFT073
uacaagcauauaaaccugauaau

SEQ ID NO: 593148 - RNA, 23 nt, Escherichia coli CFT073
uacaaccguuucaugccauccgc

SEQ ID NO: 593149 - RNA, 20 nt, Escherichia coli CFT073
uacaacgcaauauccgccac

SEQ ID NO: 593150 - RNA, 18 nt, Escherichia coli CFT073
uacaagaaucaugccaaa

SEQ ID NO: 593151 - RNA, 18 nt, Escherichia coli CFT073
uacaccguccggcacuca

SEQ ID NO: 593152 - RNA, 20 nt, Escherichia coli CFT073
uacacgcgauuuugccaguu

SEQ ID NO: 593153 - RNA, 18 nt, Escherichia coli CFT073
uacaccugcuccgccaga

SEQ ID NO: 593154 - RNA, 17 nt, Escherichia coli CFT073
uacacgugagccacggg

SEQ ID NO: 593155 - RNA, 17 nt, Escherichia coli CFT073
uacacguugaaacuuau

SEQ ID NO: 593156 - RNA, 22 nt, Escherichia coli CFT073
uaaucucaccagguucgccaac

SEQ ID NO: 593157 - RNA, 13 nt, Escherichia coli CFT073
uaaucucaucggc

SEQ ID NO: 593158 - RNA, 19 nt, Escherichia coli CFT073
uaaucucuuuacccagcgg

SEQ ID NO: 593159 - RNA, 18 nt, Escherichia coli CFT073
uaaucaacgcgccgccaa

SEQ ID NO: 593160 - RNA, 12 nt, Escherichia coli CFT073
uaaucaccagua

SEQ ID NO: 593161 - RNA, 16 nt, Escherichia coli CFT073
uaaucaccugccaggg

SEQ ID NO: 593162 - RNA, 19 nt, Escherichia coli CFT073
uaaucagaacaauuccugu

SEQ ID NO: 593163 - RNA, 20 nt, Escherichia coli CFT073
uaaucgucaucagcgccaac

SEQ ID NO: 593164 - RNA, 18 nt, Escherichia coli CFT073
uaauacaccguccagcgg

SEQ ID NO: 593165 - RNA, 19 nt, Escherichia coli CFT073
uaauaauugcggcggcgca

SEQ ID NO: 593166 - RNA, 19 nt, Escherichia coli CFT073
uaauaaauuuugccaccgg

SEQ ID NO: 593167 - RNA, 19 nt, Escherichia coli CFT073
uaagacuccagcgccagcg

SEQ ID NO: 593168 - RNA, 17 nt, Escherichia coli CFT073
uaagacuucguuguaac

SEQ ID NO: 593169 - RNA, 22 nt, Escherichia coli CFT073
uaagaaccagaauuuccagaaa

SEQ ID NO: 593170 - RNA, 21 nt, Escherichia coli CFT073
uaagacagcgucacaucaggc

SEQ ID NO: 593171 - RNA, 16 nt, Escherichia coli CFT073
uaagaccaauccagcc

SEQ ID NO: 593172 - RNA, 21 nt, Escherichia coli CFT073
uaagacgcguagugucgcauc

SEQ ID NO: 593173 - RNA, 22 nt, Escherichia coli CFT073
uaagacgcgucugcgucgcauc

SEQ ID NO: 593174 - RNA, 21 nt, Escherichia coli CFT073
uaagcauuauauauaauagug

SEQ ID NO: 593175 - RNA, 20 nt, Escherichia coli CFT073
uaagcugauaacgccacgcc

SEQ ID NO: 593176 - RNA, 22 nt, Escherichia coli CFT073
uaagcagccaucugaugauauu

SEQ ID NO: 593177 - RNA, 18 nt, Escherichia coli CFT073
uaagcaggguugcagcgg

SEQ ID NO: 593178 - RNA, 16 nt, Escherichia coli CFT073
uaagcaucgcaacgca

SEQ ID NO: 593179 - RNA, 19 nt, Escherichia coli CFT073
uaagcguuuucugccagac

SEQ ID NO: 593180 - RNA, 16 nt, Escherichia coli CFT073
uaagcuauaaaaaaac

SEQ ID NO: 593181 - RNA, 15 nt, Escherichia coli CFT073
uaagguacggcccgu

SEQ ID NO: 593182 - RNA, 18 nt, Escherichia coli CFT073
uaaggagcaauaaucagu

SEQ ID NO: 593183 - RNA, 14 nt, Escherichia coli CFT073
guugaagaugcggu

SEQ ID NO: 593184 - RNA, 19 nt, Escherichia coli CFT073
guucugccaaacgcuccca

SEQ ID NO: 593185 - RNA, 18 nt, Escherichia coli CFT073
guugaaaaccauaaugau

SEQ ID NO: 593186 - RNA, 22 nt, Escherichia coli CFT073
guugaaauaauacguagcacca

SEQ ID NO: 593187 - RNA, 16 nt, Escherichia coli CFT073
guugagcagcagauga

SEQ ID NO: 593188 - RNA, 21 nt, Escherichia coli CFT073
guugagcaaucgacgccguuu

SEQ ID NO: 593189 - RNA, 14 nt, Escherichia coli CFT073
guucguugaucaac

SEQ ID NO: 593190 - RNA, 23 nt, Escherichia coli CFT073
guucgugaauaugucgcgccagg

SEQ ID NO: 593191 - RNA, 22 nt, Escherichia coli CFT073
guucucgcaaaacgucgccagc

SEQ ID NO: 593192 - RNA, 22 nt, Escherichia coli CFT073
guucucuucauuaccuucaaua

SEQ ID NO: 593193 - RNA, 16 nt, Escherichia coli CFT073
guucugcaaggcgagc

SEQ ID NO: 593194 - RNA, 18 nt, Escherichia coli CFT073
guugcacccaguacgggc

SEQ ID NO: 593195 - RNA, 19 nt, Escherichia coli CFT073
guugaguucgucgaguuua

SEQ ID NO: 593196 - RNA, 19 nt, Escherichia coli CFT073
guugauuucaccaucuuca

SEQ ID NO: 593197 - RNA, 14 nt, Escherichia coli CFT073
guugccaccgguac

SEQ ID NO: 593198 - RNA, 23 nt, Escherichia coli CFT073
guugccagcaacuguaacgcaga

SEQ ID NO: 593199 - RNA, 20 nt, Escherichia coli CFT073
guugccagcgacagaaauca

SEQ ID NO: 593200 - RNA, 19 nt, Escherichia coli CFT073
guugccugaugcgcugcgc

SEQ ID NO: 593201 - RNA, 20 nt, Escherichia coli CFT073
guugcggaaagagcauccga

SEQ ID NO: 593202 - RNA, 15 nt, Escherichia coli CFT073
guugcgcuccgcgac

SEQ ID NO: 593203 - RNA, 20 nt, Escherichia coli CFT073
guugcgcugaaacuucacca

SEQ ID NO: 593204 - RNA, 13 nt, Escherichia coli CFT073
guugccggaugcg

SEQ ID NO: 593205 - RNA, 22 nt, Escherichia coli CFT073
guugccggauguguugcauccg

SEQ ID NO: 593206 - RNA, 17 nt, Escherichia coli CFT073
guugccguacucuucaa

SEQ ID NO: 593207 - RNA, 18 nt, Escherichia coli CFT073
guugccguucuucccgcc

SEQ ID NO: 593208 - RNA, 18 nt, Escherichia coli CFT073
guugcuuaaauacgccuc

SEQ ID NO: 593209 - RNA, 13 nt, Escherichia coli CFT073
guugcuucacgcg

SEQ ID NO: 593210 - RNA, 23 nt, Escherichia coli CFT073
guugcuucacggaucgcuuuuac

SEQ ID NO: 593211 - RNA, 14 nt, Escherichia coli CFT073
guuggagaucccgu

SEQ ID NO: 593212 - RNA, 13 nt, Escherichia coli CFT073
guuggcaacgcaa

SEQ ID NO: 593213 - RNA, 11 nt, Escherichia coli CFT073
guuuucauccc

SEQ ID NO: 593214 - RNA, 21 nt, Escherichia coli CFT073
guuuuacgcugacgcggguau

SEQ ID NO: 593215 - RNA, 15 nt, Escherichia coli CFT073
guuuguaaucgaugg

SEQ ID NO: 593216 - RNA, 20 nt, Escherichia coli CFT073
guuuguaggccggauaaggc

SEQ ID NO: 593217 - RNA, 22 nt, Escherichia coli CFT073
guuuguugaaacuuuccaugcc

SEQ ID NO: 593218 - RNA, 17 nt, Escherichia coli CFT073
guuuuccagccuuuuuc

SEQ ID NO: 593219 - RNA, 18 nt, Escherichia coli CFT073
guuuucgcaccugccagu

SEQ ID NO: 593220 - RNA, 21 nt, Escherichia coli CFT073
guuuugacagcucacgcgcca

SEQ ID NO: 593221 - RNA, 20 nt, Escherichia coli CFT073
guuuugagccucgcugcuca

SEQ ID NO: 593222 - RNA, 19 nt, Escherichia coli CFT073
guuugcagcuuacgcgcca

SEQ ID NO: 593223 - RNA, 13 nt, Escherichia coli CFT073
guuugcaucgcca

SEQ ID NO: 593224 - RNA, 20 nt, Escherichia coli CFT073
guuugaguucaccgccauua

SEQ ID NO: 593225 - RNA, 19 nt, Escherichia coli CFT073
guuugccaaaccagcuaau

SEQ ID NO: 593226 - RNA, 20 nt, Escherichia coli CFT073
guuugaugguggucgcauca

SEQ ID NO: 593227 - RNA, 20 nt, Escherichia coli CFT073
guuuggauucauccggcaac

SEQ ID NO: 593228 - RNA, 17 nt, Escherichia coli CFT073
guuucuucgauggcugg

SEQ ID NO: 593229 - RNA, 14 nt, Escherichia coli CFT073
guuucggugaugaa

SEQ ID NO: 593230 - RNA, 18 nt, Escherichia coli CFT073
guuucggguucgccaucc

SEQ ID NO: 593231 - RNA, 23 nt, Escherichia coli CFT073
guuucgguagaaaaauucaaccu

SEQ ID NO: 593232 - RNA, 20 nt, Escherichia coli CFT073
guuucuacaagcagagagac

SEQ ID NO: 593233 - RNA, 13 nt, Escherichia coli CFT073
guuucuaucccuu

SEQ ID NO: 593234 - RNA, 12 nt, Escherichia coli CFT073
guuucugauaca

SEQ ID NO: 593235 - RNA, 18 nt, Escherichia coli CFT073
guuguagacaugguaaaa

SEQ ID NO: 593236 - RNA, 20 nt, Escherichia coli CFT073
guugucagcccuuauucacg

SEQ ID NO: 593237 - RNA, 15 nt, Escherichia coli CFT073
guugucgccaguaau

SEQ ID NO: 593238 - RNA, 14 nt, Escherichia coli CFT073
guuggcauuucgac

SEQ ID NO: 593239 - RNA, 18 nt, Escherichia coli CFT073
guuggcagugccaucaau

SEQ ID NO: 593240 - RNA, 21 nt, Escherichia coli CFT073
guuggcaagauacgcaucgcg

SEQ ID NO: 593241 - RNA, 18 nt, Escherichia coli CFT073
guuggcagagauucuuca

SEQ ID NO: 593242 - RNA, 17 nt, Escherichia coli CFT073
guuucggccccgguucg

SEQ ID NO: 593243 - RNA, 14 nt, Escherichia coli CFT073
guuucgcgccaucc

SEQ ID NO: 593244 - RNA, 15 nt, Escherichia coli CFT073
guuucgccugccaga

SEQ ID NO: 593245 - RNA, 20 nt, Escherichia coli CFT073
guuucgccuugcguaccggc

SEQ ID NO: 593246 - RNA, 12 nt, Escherichia coli CFT073
guuucgccaucg

SEQ ID NO: 593247 - RNA, 14 nt, Escherichia coli CFT073
guuuccaggcuggu

SEQ ID NO: 593248 - RNA, 20 nt, Escherichia coli CFT073
guuucccugcauaaucagga

SEQ ID NO: 593249 - RNA, 17 nt, Escherichia coli CFT073
guuucccagcuuuugac

SEQ ID NO: 593250 - RNA, 20 nt, Escherichia coli CFT073
guuuaccggugauuucgcca

SEQ ID NO: 593251 - RNA, 19 nt, Escherichia coli CFT073
guuuaccggugccagcaac

SEQ ID NO: 593252 - RNA, 13 nt, Escherichia coli CFT073
guuuacgcccgga

SEQ ID NO: 593253 - RNA, 15 nt, Escherichia coli CFT073
guuuacgccgcauca

SEQ ID NO: 593254 - RNA, 16 nt, Escherichia coli CFT073
guuuacgccggaugcg

SEQ ID NO: 593255 - RNA, 18 nt, Escherichia coli CFT073
guuuacgccggaugcgga

SEQ ID NO: 593256 - RNA, 15 nt, Escherichia coli CFT073
guuuagccaaaaauc

SEQ ID NO: 593257 - RNA, 20 nt, Escherichia coli CFT073
guuuacuuccccggcagugc

SEQ ID NO: 593258 - RNA, 15 nt, Escherichia coli CFT073
guuuccagcaccagu

SEQ ID NO: 593259 - RNA, 17 nt, Escherichia coli CFT073
guuucauccugccaugc

SEQ ID NO: 593260 - RNA, 15 nt, Escherichia coli CFT073
guuucaucuucaguc

SEQ ID NO: 593261 - RNA, 18 nt, Escherichia coli CFT073
guuucaucuucagucagg

SEQ ID NO: 593262 - RNA, 16 nt, Escherichia coli CFT073
guuucauguaacgcug

SEQ ID NO: 593263 - RNA, 17 nt, Escherichia coli CFT073
guuucauaucugccaga

SEQ ID NO: 593264 - RNA, 16 nt, Escherichia coli CFT073
gggcuaugcgcaucaa

SEQ ID NO: 593265 - RNA, 14 nt, Escherichia coli CFT073
gggcguuacagcug

SEQ ID NO: 593266 - RNA, 20 nt, Escherichia coli CFT073
gggcuucaaaguuugcccgu

SEQ ID NO: 593267 - RNA, 19 nt, Escherichia coli CFT073
gggcuuaaugagauaauca

SEQ ID NO: 593268 - RNA, 13 nt, Escherichia coli CFT073
gggcuggaaacgc

SEQ ID NO: 593269 - RNA, 22 nt, Escherichia coli CFT073
gggcuggcauuuuuuauggcug

SEQ ID NO: 593270 - RNA, 17 nt, Escherichia coli CFT073
gggcuuucgcaauaauc

SEQ ID NO: 593271 - RNA, 14 nt, Escherichia coli CFT073
ggggccagcgcauc

SEQ ID NO: 593272 - RNA, 22 nt, Escherichia coli CFT073
ggguaaccagccaaauaaaauc

SEQ ID NO: 593273 - RNA, 23 nt, Escherichia coli CFT073
ggguagcaggccggagacgacgc

SEQ ID NO: 593274 - RNA, 15 nt, Escherichia coli CFT073
gggguuaaauugauc

SEQ ID NO: 593275 - RNA, 15 nt, Escherichia coli CFT073
gggguaaauccacgu

SEQ ID NO: 593276 - RNA, 21 nt, Escherichia coli CFT073
ggggcuggcggcaaucgccag

SEQ ID NO: 593277 - RNA, 15 nt, Escherichia coli CFT073
gggucaucgcccugu

SEQ ID NO: 593278 - RNA, 13 nt, Escherichia coli CFT073
gggucaucagcau

SEQ ID NO: 593279 - RNA, 18 nt, Escherichia coli CFT073
ggguauuuugucuuucag

SEQ ID NO: 593280 - RNA, 19 nt, Escherichia coli CFT073
gggauagcguagugauggu

SEQ ID NO: 593281 - RNA, 13 nt, Escherichia coli CFT073
gggaugaccgaca

SEQ ID NO: 593282 - RNA, 19 nt, Escherichia coli CFT073
gggaugaagcaacugguua

SEQ ID NO: 593283 - RNA, 15 nt, Escherichia coli CFT073
gggaguggugauggu

SEQ ID NO: 593284 - RNA, 23 nt, Escherichia coli CFT073
gggaacccgaugguucccuuuuu

SEQ ID NO: 593285 - RNA, 19 nt, Escherichia coli CFT073
gggaaauagcuuaacggca

SEQ ID NO: 593286 - RNA, 16 nt, Escherichia coli CFT073
gggaaaggauggcgau

SEQ ID NO: 593287 - RNA, 16 nt, Escherichia coli CFT073
gggagaaacccggcca

SEQ ID NO: 593288 - RNA, 15 nt, Escherichia coli CFT073
gggagaaugccagca

SEQ ID NO: 593289 - RNA, 18 nt, Escherichia coli CFT073
gggacaugauacgccugc

SEQ ID NO: 593290 - RNA, 17 nt, Escherichia coli CFT073
gggaagaaaccauugca

SEQ ID NO: 593291 - RNA, 15 nt, Escherichia coli CFT073
ggcuuaucuuccugu

SEQ ID NO: 593292 - RNA, 18 nt, Escherichia coli CFT073
ggcuguuuucagcaccag

SEQ ID NO: 593293 - RNA, 17 nt, Escherichia coli CFT073
ggcuuacacuuccuuua

SEQ ID NO: 593294 - RNA, 22 nt, Escherichia coli CFT073
ggcuguugccguauaacgcgau

SEQ ID NO: 593295 - RNA, 20 nt, Escherichia coli CFT073
ggcuucagcgacaucgucac

SEQ ID NO: 593296 - RNA, 15 nt, Escherichia coli CFT073
ggcuucaaucaacau

SEQ ID NO: 593297 - RNA, 13 nt, Escherichia coli CFT073
ggcuuccugcagc

SEQ ID NO: 593298 - RNA, 22 nt, Escherichia coli CFT073
gggcgauuuucuacuucuuuca

SEQ ID NO: 593299 - RNA, 22 nt, Escherichia coli CFT073
gggcgcaaaaacauugccggaa

SEQ ID NO: 593300 - RNA, 16 nt, Escherichia coli CFT073
gggcgcaaugcccgca

SEQ ID NO: 593301 - RNA, 20 nt, Escherichia coli CFT073
gggcgauuaauaaaauuauc

SEQ ID NO: 593302 - RNA, 20 nt, Escherichia coli CFT073
gggcgaaucaacuccagaau

SEQ ID NO: 593303 - RNA, 15 nt, Escherichia coli CFT073
gggcaauuucacgcu

SEQ ID NO: 593304 - RNA, 16 nt, Escherichia coli CFT073
ggcguugcaaggaacg

SEQ ID NO: 593305 - RNA, 17 nt, Escherichia coli CFT073
ggcguucacgccgcauc

SEQ ID NO: 593306 - RNA, 15 nt, Escherichia coli CFT073
ggcguucaccagcgc

SEQ ID NO: 593307 - RNA, 14 nt, Escherichia coli CFT073
ggcguuacagcugg

SEQ ID NO: 593308 - RNA, 18 nt, Escherichia coli CFT073
ggcguuaacaauaagauu

SEQ ID NO: 593309 - RNA, 17 nt, Escherichia coli CFT073
ggcgugcaucucuucaa

SEQ ID NO: 593310 - RNA, 20 nt, Escherichia coli CFT073
ggcuccagacgcccgcgccc

SEQ ID NO: 593311 - RNA, 14 nt, Escherichia coli CFT073
ggcuccagcaaugu

SEQ ID NO: 593312 - RNA, 15 nt, Escherichia coli CFT073
ggcucagccagacgc

SEQ ID NO: 593313 - RNA, 22 nt, Escherichia coli CFT073
ggcgucagcgcaaauggugguu

SEQ ID NO: 593314 - RNA, 21 nt, Escherichia coli CFT073
ggcgucaauuugcuccgccag

SEQ ID NO: 593315 - RNA, 16 nt, Escherichia coli CFT073
ggcguauuuaaugaca

SEQ ID NO: 593316 - RNA, 13 nt, Escherichia coli CFT073
ggcguacagcugg

SEQ ID NO: 593317 - RNA, 14 nt, Escherichia coli CFT073
ggcgguuuggccag

SEQ ID NO: 593318 - RNA, 15 nt, Escherichia coli CFT073
ggcguaaccaaugcc

SEQ ID NO: 593319 - RNA, 19 nt, Escherichia coli CFT073
ggcgguuucgcaaaccaaa

SEQ ID NO: 593320 - RNA, 14 nt, Escherichia coli CFT073
ggcggugguggcuu

SEQ ID NO: 593321 - RNA, 15 nt, Escherichia coli CFT073
ggcggugcuugcuca

SEQ ID NO: 593322 - RNA, 22 nt, Escherichia coli CFT073
ggcgggcaaacggaucgcguaa

SEQ ID NO: 593323 - RNA, 17 nt, Escherichia coli CFT073
ggcgcaccagaauaccu

SEQ ID NO: 593324 - RNA, 17 nt, Escherichia coli CFT073
ggcgcucgcgccgcauc

SEQ ID NO: 593325 - RNA, 20 nt, Escherichia coli CFT073
ggcgcugcaaagcugauaau

SEQ ID NO: 593326 - RNA, 21 nt, Escherichia coli CFT073
ggcggaaacaccguaccauca

SEQ ID NO: 593327 - RNA, 16 nt, Escherichia coli CFT073
ggcggcaaucgcugcu

SEQ ID NO: 593328 - RNA, 15 nt, Escherichia coli CFT073
ggcggcacucgcuga

SEQ ID NO: 593329 - RNA, 20 nt, Escherichia coli CFT073
ggcggcagcgugccaggcgc

SEQ ID NO: 593330 - RNA, 15 nt, Escherichia coli CFT073
ggcggcaggccuaac

SEQ ID NO: 593331 - RNA, 16 nt, Escherichia coli CFT073
ggcggcggcggucauc

SEQ ID NO: 593332 - RNA, 20 nt, Escherichia coli CFT073
ggcggcuuucagggcgucaa

SEQ ID NO: 593333 - RNA, 18 nt, Escherichia coli CFT073
ggcauucugcacauuauc

SEQ ID NO: 593334 - RNA, 19 nt, Escherichia coli CFT073
ggcauacaucaacgcgcaa

SEQ ID NO: 593335 - RNA, 15 nt, Escherichia coli CFT073
ggcauauaccgucag

SEQ ID NO: 593336 - RNA, 17 nt, Escherichia coli CFT073
ggcauauucaccgucag

SEQ ID NO: 593337 - RNA, 15 nt, Escherichia coli CFT073
ggcauauuuaaaaac

SEQ ID NO: 593338 - RNA, 19 nt, Escherichia coli CFT073
ggcaucaaucgcucccagc

SEQ ID NO: 593339 - RNA, 19 nt, Escherichia coli CFT073
ggccacgcauaacgcguaa

SEQ ID NO: 593340 - RNA, 16 nt, Escherichia coli CFT073
ggccacgaaucagcac

SEQ ID NO: 593341 - RNA, 18 nt, Escherichia coli CFT073
ggccagauaaaacacauc

SEQ ID NO: 593342 - RNA, 15 nt, Escherichia coli CFT073
ggcagagaaagcaaa

SEQ ID NO: 593343 - RNA, 19 nt, Escherichia coli CFT073
ggcagcaaucacugccaga

SEQ ID NO: 593344 - RNA, 17 nt, Escherichia coli CFT073
ggcagcaauggcacugu

SEQ ID NO: 593345 - RNA, 16 nt, Escherichia coli CFT073
ggcagauugagcguca

SEQ ID NO: 593346 - RNA, 15 nt, Escherichia coli CFT073
ggcagauccaccaga

SEQ ID NO: 593347 - RNA, 17 nt, Escherichia coli CFT073
ggcagauccaccagacc

SEQ ID NO: 593348 - RNA, 18 nt, Escherichia coli CFT073
ggcagcaucacgcaacau

SEQ ID NO: 593349 - RNA, 12 nt, Escherichia coli CFT073
ggcagcagaaag

SEQ ID NO: 593350 - RNA, 22 nt, Escherichia coli CFT073
ggcagccuuucacaucagaaca

SEQ ID NO: 593351 - RNA, 20 nt, Escherichia coli CFT073
ggcaggagcugagugcgaaa

SEQ ID NO: 593352 - RNA, 18 nt, Escherichia coli CFT073
ggcaguuuuaccgccgga

SEQ ID NO: 593353 - RNA, 20 nt, Escherichia coli CFT073
ggcaguggcuaagcaggcug

SEQ ID NO: 593354 - RNA, 21 nt, Escherichia coli CFT073
ggcaguaaaucaauauccacu

SEQ ID NO: 593355 - RNA, 19 nt, Escherichia coli CFT073
ggccaguguuuaucaucuc

SEQ ID NO: 593356 - RNA, 22 nt, Escherichia coli CFT073
ggccauaaucaaauaaauaauc

SEQ ID NO: 593357 - RNA, 17 nt, Escherichia coli CFT073
ggccaugauuaccagca

SEQ ID NO: 593358 - RNA, 17 nt, Escherichia coli CFT073
ggccauccaucaacgcc

SEQ ID NO: 593359 - RNA, 19 nt, Escherichia coli CFT073
ggccauuugcucuaccagc

SEQ ID NO: 593360 - RNA, 17 nt, Escherichia coli CFT073
ggccauuuuuuuaccca

SEQ ID NO: 593361 - RNA, 19 nt, Escherichia coli CFT073
ggccauuuuuuuacccagc

SEQ ID NO: 593362 - RNA, 14 nt, Escherichia coli CFT073
ggccgagauauuga

SEQ ID NO: 593363 - RNA, 23 nt, Escherichia coli CFT073
ggccccgucgcccgaugccagca

SEQ ID NO: 593364 - RNA, 11 nt, Escherichia coli CFT073
ggcgacauuua

SEQ ID NO: 593365 - RNA, 21 nt, Escherichia coli CFT073
ggcgagaacaccgagucgccu

SEQ ID NO: 593366 - RNA, 21 nt, Escherichia coli CFT073
ggcgagaacgccuuauccggc

SEQ ID NO: 593367 - RNA, 17 nt, Escherichia coli CFT073
ggcgaggggacgguccg

SEQ ID NO: 593368 - RNA, 19 nt, Escherichia coli CFT073
ggcgaggggagacuucacu

SEQ ID NO: 593369 - RNA, 15 nt, Escherichia coli CFT073
ggcgaguugccgaga

SEQ ID NO: 593370 - RNA, 18 nt, Escherichia coli CFT073
ggcgauaaucagcgccag

SEQ ID NO: 593371 - RNA, 14 nt, Escherichia coli CFT073
ggcgauagcaucca

SEQ ID NO: 593372 - RNA, 13 nt, Escherichia coli CFT073
ggcgauaaugacg

SEQ ID NO: 593373 - RNA, 21 nt, Escherichia coli CFT073
ggcgaugaaguaguaacugug

SEQ ID NO: 593374 - RNA, 16 nt, Escherichia coli CFT073
ggcgaucuguuccggc

SEQ ID NO: 593375 - RNA, 20 nt, Escherichia coli CFT073
ggcgaucuuccgaccgcccu

SEQ ID NO: 593376 - RNA, 17 nt, Escherichia coli CFT073
ggcgaucccuaccacga

SEQ ID NO: 593377 - RNA, 19 nt, Escherichia coli CFT073
ggcgaucccuaccacgauc

SEQ ID NO: 593378 - RNA, 20 nt, Escherichia coli CFT073
ggccuacgugauuccugcaa

SEQ ID NO: 593379 - RNA, 22 nt, Escherichia coli CFT073
ggccuacguguuuuuuugcaau

SEQ ID NO: 593380 - RNA, 23 nt, Escherichia coli CFT073
ggccuaccguuccgacaccgccu

SEQ ID NO: 593381 - RNA, 13 nt, Escherichia coli CFT073
ggccuaacacaug

SEQ ID NO: 593382 - RNA, 20 nt, Escherichia coli CFT073
ggccuacaaucccguugaaa

SEQ ID NO: 593383 - RNA, 20 nt, Escherichia coli CFT073
ggccuacauagccccugcaa

SEQ ID NO: 593384 - RNA, 21 nt, Escherichia coli CFT073
ggccuacauagccccugcaau

SEQ ID NO: 593385 - RNA, 21 nt, Escherichia coli CFT073
ggccuaccaugaucugcaaau

SEQ ID NO: 593386 - RNA, 14 nt, Escherichia coli CFT073
ggccgguaacgcuu

SEQ ID NO: 593387 - RNA, 17 nt, Escherichia coli CFT073
ggccugaacaagcaaga

SEQ ID NO: 593388 - RNA, 19 nt, Escherichia coli CFT073
ggccugauaaaacgcgcag

SEQ ID NO: 593389 - RNA, 12 nt, Escherichia coli CFT073
ggccugauaaga

SEQ ID NO: 593390 - RNA, 18 nt, Escherichia coli CFT073
ggccugauaagacgcggc

SEQ ID NO: 593391 - RNA, 19 nt, Escherichia coli CFT073
ggccugauaagacgcguua

SEQ ID NO: 593392 - RNA, 13 nt, Escherichia coli CFT073
ggccucugccagc

SEQ ID NO: 593393 - RNA, 19 nt, Escherichia coli CFT073
ggccuccugcagcguugcc

SEQ ID NO: 593394 - RNA, 20 nt, Escherichia coli CFT073
ggccugcuuuugccagcgug

SEQ ID NO: 593395 - RNA, 18 nt, Escherichia coli CFT073
ggccugcucacgcaucaa

SEQ ID NO: 593396 - RNA, 14 nt, Escherichia coli CFT073
ggccuggcgcgaca

SEQ ID NO: 593397 - RNA, 22 nt, Escherichia coli CFT073
ggccgcuccaaggucuccgccc

SEQ ID NO: 593398 - RNA, 19 nt, Escherichia coli CFT073
ggccggauaagacgcguca

SEQ ID NO: 593399 - RNA, 19 nt, Escherichia coli CFT073
ggccggauaaggcgcguca

SEQ ID NO: 593400 - RNA, 20 nt, Escherichia coli CFT073
ggccggauaaggcgcgucaa

SEQ ID NO: 593401 - RNA, 19 nt, Escherichia coli CFT073
ggugaugaaccuguguuga

SEQ ID NO: 593402 - RNA, 16 nt, Escherichia coli CFT073
ggugaucgugcgcgcc

SEQ ID NO: 593403 - RNA, 22 nt, Escherichia coli CFT073
ggucuuucuuuuuuucacuuuc

SEQ ID NO: 593404 - RNA, 13 nt, Escherichia coli CFT073
ggugacaucgccc

SEQ ID NO: 593405 - RNA, 22 nt, Escherichia coli CFT073
ggugagcacgguuuugucggca

SEQ ID NO: 593406 - RNA, 16 nt, Escherichia coli CFT073
ggucugaauacgcccu

SEQ ID NO: 593407 - RNA, 15 nt, Escherichia coli CFT073
ggucuccugaccguu

SEQ ID NO: 593408 - RNA, 11 nt, Escherichia coli CFT073
ggucgcccugu

SEQ ID NO: 593409 - RNA, 14 nt, Escherichia coli CFT073
ggucgaugcacucg

SEQ ID NO: 593410 - RNA, 21 nt, Escherichia coli CFT073
gguccaguuuuuaucauaaua

SEQ ID NO: 593411 - RNA, 20 nt, Escherichia coli CFT073
ggucaugaugcuccgccagc

SEQ ID NO: 593412 - RNA, 14 nt, Escherichia coli CFT073
ggugguaucgauca

SEQ ID NO: 593413 - RNA, 17 nt, Escherichia coli CFT073
ggugguaucgaucacuu

SEQ ID NO: 593414 - RNA, 13 nt, Escherichia coli CFT073
ggugguacggcau

SEQ ID NO: 593415 - RNA, 24 nt, Escherichia coli CFT073
ggugggugauuaaauucaggccgu

SEQ ID NO: 593416 - RNA, 18 nt, Escherichia coli CFT073
gguggccagcaacagcgc

SEQ ID NO: 593417 - RNA, 20 nt, Escherichia coli CFT073
ggugcgggaguugaucgcca

SEQ ID NO: 593418 - RNA, 16 nt, Escherichia coli CFT073
ggugcgccaaacugcc

SEQ ID NO: 593419 - RNA, 16 nt, Escherichia coli CFT073
ggugcgcaggcgcuga

SEQ ID NO: 593420 - RNA, 15 nt, Escherichia coli CFT073
ggugccugucagccc

SEQ ID NO: 593421 - RNA, 13 nt, Escherichia coli CFT073
ggugccuuaccgc

SEQ ID NO: 593422 - RNA, 19 nt, Escherichia coli CFT073
ggugccgccgucagacgcg

SEQ ID NO: 593423 - RNA, 20 nt, Escherichia coli CFT073
ggugccgccacgaaacugcu

SEQ ID NO: 593424 - RNA, 21 nt, Escherichia coli CFT073
ggugcccugacaccaucaccc

SEQ ID NO: 593425 - RNA, 17 nt, Escherichia coli CFT073
gguugaugccggaugcg

SEQ ID NO: 593426 - RNA, 23 nt, Escherichia coli CFT073
gguugauucauggcauuuucucg

SEQ ID NO: 593427 - RNA, 22 nt, Escherichia coli CFT073
gguugauuuuuuugauaaaccu

SEQ ID NO: 593428 - RNA, 18 nt, Escherichia coli CFT073
gguugaucaauucgagca

SEQ ID NO: 593429 - RNA, 16 nt, Escherichia coli CFT073
gguugagagcaaacac

SEQ ID NO: 593430 - RNA, 19 nt, Escherichia coli CFT073
gguugaggaacuuccagcc

SEQ ID NO: 593431 - RNA, 15 nt, Escherichia coli CFT073
gguugaagaucauga

SEQ ID NO: 593432 - RNA, 13 nt, Escherichia coli CFT073
gguugacgcguaa

SEQ ID NO: 593433 - RNA, 21 nt, Escherichia coli CFT073
gguugacgcguaaauccagca

SEQ ID NO: 593434 - RNA, 14 nt, Escherichia coli CFT073
gguuaucgcccugc

SEQ ID NO: 593435 - RNA, 23 nt, Escherichia coli CFT073
gguuauuucacuucaaccacauu

SEQ ID NO: 593436 - RNA, 15 nt, Escherichia coli CFT073
ggugguugugcugag

SEQ ID NO: 593437 - RNA, 22 nt, Escherichia coli CFT073
gguguaaaauucacaucguuga

SEQ ID NO: 593438 - RNA, 21 nt, Escherichia coli CFT073
gguguaacgagacaaugcaaa

SEQ ID NO: 593439 - RNA, 14 nt, Escherichia coli CFT073
gguguaaucggcuc

SEQ ID NO: 593440 - RNA, 19 nt, Escherichia coli CFT073
gguuugacgccugcagcau

SEQ ID NO: 593441 - RNA, 19 nt, Escherichia coli CFT073
guaaaacgguggccacagc

SEQ ID NO: 593442 - RNA, 19 nt, Escherichia coli CFT073
guaaaaccccgcguacuga

SEQ ID NO: 593443 - RNA, 21 nt, Escherichia coli CFT073
guaaaacgcccaaugcccaga

SEQ ID NO: 593444 - RNA, 23 nt, Escherichia coli CFT073
gguuucgaacugaugugcggaag

SEQ ID NO: 593445 - RNA, 18 nt, Escherichia coli CFT073
gguuucggaugggcugau

SEQ ID NO: 593446 - RNA, 14 nt, Escherichia coli CFT073
gguuucaaagauuu

SEQ ID NO: 593447 - RNA, 19 nt, Escherichia coli CFT073
gguuucacguaccagaugc

SEQ ID NO: 593448 - RNA, 16 nt, Escherichia coli CFT073
gguuucauuccaguaa

SEQ ID NO: 593449 - RNA, 12 nt, Escherichia coli CFT073
gguuuaccacca

SEQ ID NO: 593450 - RNA, 17 nt, Escherichia coli CFT073
gguugcaguaacugcug

SEQ ID NO: 593451 - RNA, 19 nt, Escherichia coli CFT073
guaaaccacaucagcgaac

SEQ ID NO: 593452 - RNA, 13 nt, Escherichia coli CFT073
guaaacaccuucg

SEQ ID NO: 593453 - RNA, 22 nt, Escherichia coli CFT073
guaaacaccuucguccagcauc

SEQ ID NO: 593454 - RNA, 23 nt, Escherichia coli CFT073
guaaacgacccugccacaguuuu

SEQ ID NO: 593455 - RNA, 16 nt, Escherichia coli CFT073
guaaacuucaacgcug

SEQ ID NO: 593456 - RNA, 17 nt, Escherichia coli CFT073
guaaagaccauaaugau

SEQ ID NO: 593457 - RNA, 22 nt, Escherichia coli CFT073
guaaccaaacguggucgccagc

SEQ ID NO: 593458 - RNA, 17 nt, Escherichia coli CFT073
guaacaccagagugacc

SEQ ID NO: 593459 - RNA, 20 nt, Escherichia coli CFT073
guaaauuuuuugaucaaucu

SEQ ID NO: 593460 - RNA, 17 nt, Escherichia coli CFT073
guaaagcacugguggaa

SEQ ID NO: 593461 - RNA, 21 nt, Escherichia coli CFT073
guaaagccggugcccgccagu

SEQ ID NO: 593462 - RNA, 13 nt, Escherichia coli CFT073
guaaccacccagu

SEQ ID NO: 593463 - RNA, 17 nt, Escherichia coli CFT073
guaacccuuugcggugc

SEQ ID NO: 593464 - RNA, 23 nt, Escherichia coli CFT073
guaacccuuugcggugcagcagc

SEQ ID NO: 593465 - RNA, 15 nt, Escherichia coli CFT073
guaaccgcaacggcg

SEQ ID NO: 593466 - RNA, 16 nt, Escherichia coli CFT073
guaaccugagaucuga

SEQ ID NO: 593467 - RNA, 17 nt, Escherichia coli CFT073
gucauuccuuaugcugc

SEQ ID NO: 593468 - RNA, 16 nt, Escherichia coli CFT073
gucauuaccacaacaa

SEQ ID NO: 593469 - RNA, 16 nt, Escherichia coli CFT073
gucauucggcgcaggu

SEQ ID NO: 593470 - RNA, 20 nt, Escherichia coli CFT073
gucauugaauguugacgcua

SEQ ID NO: 593471 - RNA, 13 nt, Escherichia coli CFT073
gucauugacgcug

SEQ ID NO: 593472 - RNA, 13 nt, Escherichia coli CFT073
gucauugccugau

SEQ ID NO: 593473 - RNA, 19 nt, Escherichia coli CFT073
gucauugccuguucgccgc

SEQ ID NO: 593474 - RNA, 20 nt, Escherichia coli CFT073
gucauggugaugaucgccgu

SEQ ID NO: 593475 - RNA, 16 nt, Escherichia coli CFT073
gucauggcugaccguc

SEQ ID NO: 593476 - RNA, 12 nt, Escherichia coli CFT073
gucaugucggca

SEQ ID NO: 593477 - RNA, 23 nt, Escherichia coli CFT073
gucaguucaggcugaggcguuuc

SEQ ID NO: 593478 - RNA, 16 nt, Escherichia coli CFT073
gucaguucucuggcau

SEQ ID NO: 593479 - RNA, 12 nt, Escherichia coli CFT073
gucauauagccg

SEQ ID NO: 593480 - RNA, 16 nt, Escherichia coli CFT073
gucauagcgacuacca

SEQ ID NO: 593481 - RNA, 16 nt, Escherichia coli CFT073
gucauaucgaccagcg

SEQ ID NO: 593482 - RNA, 18 nt, Escherichia coli CFT073
gucauaucgaccagcgca

SEQ ID NO: 593483 - RNA, 16 nt, Escherichia coli CFT073
gucauauucgccauca

SEQ ID NO: 593484 - RNA, 13 nt, Escherichia coli CFT073
gucaucagucaga

SEQ ID NO: 593485 - RNA, 17 nt, Escherichia coli CFT073
gucaucaauccugcagc

SEQ ID NO: 593486 - RNA, 16 nt, Escherichia coli CFT073
gucaucacaucccagc

SEQ ID NO: 593487 - RNA, 19 nt, Escherichia coli CFT073
gucaucacaucccagcaga

SEQ ID NO: 593488 - RNA, 17 nt, Escherichia coli CFT073
gucaucgacgucagcag

SEQ ID NO: 593489 - RNA, 23 nt, Escherichia coli CFT073
gucaucaucacuuuuuccggugc

SEQ ID NO: 593490 - RNA, 13 nt, Escherichia coli CFT073
gucagcgucgcau

SEQ ID NO: 593491 - RNA, 23 nt, Escherichia coli CFT073
gucagcgucuguuuuaucacauc

SEQ ID NO: 593492 - RNA, 17 nt, Escherichia coli CFT073
gucagcgccgcauccga

SEQ ID NO: 593493 - RNA, 16 nt, Escherichia coli CFT073
gucaggaagaagccca

SEQ ID NO: 593494 - RNA, 15 nt, Escherichia coli CFT073
gucagggccugcgug

SEQ ID NO: 593495 - RNA, 21 nt, Escherichia coli CFT073
gucaggcuaaagaaaacgaau

SEQ ID NO: 593496 - RNA, 21 nt, Escherichia coli CFT073
gucaggccaacauccaucagc

SEQ ID NO: 593497 - RNA, 16 nt, Escherichia coli CFT073
gucaggcggauaaggc

SEQ ID NO: 593498 - RNA, 16 nt, Escherichia coli CFT073
gucaguaucgcgggga

SEQ ID NO: 593499 - RNA, 22 nt, Escherichia coli CFT073
gucccacaguuguccauuaaua

SEQ ID NO: 593500 - RNA, 18 nt, Escherichia coli CFT073
guccgagcggcaccacga

SEQ ID NO: 593501 - RNA, 17 nt, Escherichia coli CFT073
gucccguacccagcaag

SEQ ID NO: 593502 - RNA, 14 nt, Escherichia coli CFT073
gucccaguucaugu

SEQ ID NO: 593503 - RNA, 14 nt, Escherichia coli CFT073
gucccaugaugcgc

SEQ ID NO: 593504 - RNA, 14 nt, Escherichia coli CFT073
gucccaugcaggcu

SEQ ID NO: 593505 - RNA, 13 nt, Escherichia coli CFT073
guccaaucagcac

SEQ ID NO: 593506 - RNA, 19 nt, Escherichia coli CFT073
guccacuggucugacgcug

SEQ ID NO: 593507 - RNA, 17 nt, Escherichia coli CFT073
guacuggcaaucgccag

SEQ ID NO: 593508 - RNA, 21 nt, Escherichia coli CFT073
guacuggcaaucgccagcggc

SEQ ID NO: 593509 - RNA, 22 nt, Escherichia coli CFT073
guacuggcaaucgccagcggca

SEQ ID NO: 593510 - RNA, 15 nt, Escherichia coli CFT073
guacugaccaucagc

SEQ ID NO: 593511 - RNA, 22 nt, Escherichia coli CFT073
guacugaccaucagcagcggca

SEQ ID NO: 593512 - RNA, 20 nt, Escherichia coli CFT073
guacugaccgucgccuucaa

SEQ ID NO: 593513 - RNA, 19 nt, Escherichia coli CFT073
guacugacuauccacugga

SEQ ID NO: 593514 - RNA, 22 nt, Escherichia coli CFT073
guacucugccacuacccgcauu

SEQ ID NO: 593515 - RNA, 22 nt, Escherichia coli CFT073
guacucuucaauggcaucacgc

SEQ ID NO: 593516 - RNA, 15 nt, Escherichia coli CFT073
guacucuuccggugu

SEQ ID NO: 593517 - RNA, 14 nt, Escherichia coli CFT073
guagagaucgagcg

SEQ ID NO: 593518 - RNA, 18 nt, Escherichia coli CFT073
guaauccgccuguugccc

SEQ ID NO: 593519 - RNA, 13 nt, Escherichia coli CFT073
guaauccagcguc

SEQ ID NO: 593520 - RNA, 14 nt, Escherichia coli CFT073
guaauccagcgucg

SEQ ID NO: 593521 - RNA, 15 nt, Escherichia coli CFT073
guaaugaaucagcag

SEQ ID NO: 593522 - RNA, 22 nt, Escherichia coli CFT073
guaaucgccagcaaaaucacca

SEQ ID NO: 593523 - RNA, 23 nt, Escherichia coli CFT073
guacgcuaucguguugcugugca

SEQ ID NO: 593524 - RNA, 18 nt, Escherichia coli CFT073
guaaucgccuuuuuucac

SEQ ID NO: 593525 - RNA, 17 nt, Escherichia coli CFT073
guacggcuucgaucagg

SEQ ID NO: 593526 - RNA, 18 nt, Escherichia coli CFT073
guacgcuuuguccagugc

SEQ ID NO: 593527 - RNA, 18 nt, Escherichia coli CFT073
guaagcagauucuucgau

SEQ ID NO: 593528 - RNA, 21 nt, Escherichia coli CFT073
guaagccacgauucagcgucg

SEQ ID NO: 593529 - RNA, 23 nt, Escherichia coli CFT073
guaagccgguaaucaccagcaac

SEQ ID NO: 593530 - RNA, 15 nt, Escherichia coli CFT073
guaaguacgccaucg

SEQ ID NO: 593531 - RNA, 22 nt, Escherichia coli CFT073
guaagcgggcaauaucgcggca

SEQ ID NO: 593532 - RNA, 20 nt, Escherichia coli CFT073
guaagguaacgcugcccgcc

SEQ ID NO: 593533 - RNA, 13 nt, Escherichia coli CFT073
guaaguacgccau

SEQ ID NO: 593534 - RNA, 19 nt, Escherichia coli CFT073
guaauauauaacagaaggu

SEQ ID NO: 593535 - RNA, 13 nt, Escherichia coli CFT073
guaauaucgcgca

SEQ ID NO: 593536 - RNA, 16 nt, Escherichia coli CFT073
guaaucaaugcgauag

SEQ ID NO: 593537 - RNA, 16 nt, Escherichia coli CFT073
guagcucaccagcagg

SEQ ID NO: 593538 - RNA, 18 nt, Escherichia coli CFT073
guagcucaccagcaggca

SEQ ID NO: 593539 - RNA, 14 nt, Escherichia coli CFT073
guagcucaucuuca

SEQ ID NO: 593540 - RNA, 11 nt, Escherichia coli CFT073
guagcgugcgg

SEQ ID NO: 593541 - RNA, 23 nt, Escherichia coli CFT073
guaggcguuauacaucgucgcaa

SEQ ID NO: 593542 - RNA, 19 nt, Escherichia coli CFT073
guaggccggauaagguguu

SEQ ID NO: 593543 - RNA, 22 nt, Escherichia coli CFT073
guaggccggauaaggcgcguca

SEQ ID NO: 593544 - RNA, 18 nt, Escherichia coli CFT073
guaggccggauaaggcgu

SEQ ID NO: 593545 - RNA, 19 nt, Escherichia coli CFT073
guaggccagauaagacgcg

SEQ ID NO: 593546 - RNA, 19 nt, Escherichia coli CFT073
guaggccggagaaggcguu

SEQ ID NO: 593547 - RNA, 19 nt, Escherichia coli CFT073
guaggccggauaagacgcg

SEQ ID NO: 593548 - RNA, 14 nt, Escherichia coli CFT073
guaggccugauaag

SEQ ID NO: 593549 - RNA, 19 nt, Escherichia coli CFT073
guaggccugauaagcggag

SEQ ID NO: 593550 - RNA, 17 nt, Escherichia coli CFT073
guaggcgaucccagcgc

SEQ ID NO: 593551 - RNA, 16 nt, Escherichia coli CFT073
guaggucggauaaggc

SEQ ID NO: 593552 - RNA, 19 nt, Escherichia coli CFT073
guaggucggauaagacgcg

SEQ ID NO: 593553 - RNA, 18 nt, Escherichia coli CFT073
guauuaaaugucaugaca

SEQ ID NO: 593554 - RNA, 16 nt, Escherichia coli CFT073
guauuaagccaguucu

SEQ ID NO: 593555 - RNA, 13 nt, Escherichia coli CFT073
guauucaaccguu

SEQ ID NO: 593556 - RNA, 20 nt, Escherichia coli CFT073
guauucacauagcccgguuu

SEQ ID NO: 593557 - RNA, 19 nt, Escherichia coli CFT073
guauucaugcccugcccgc

SEQ ID NO: 593558 - RNA, 17 nt, Escherichia coli CFT073
guauuaguuaaaugauu

SEQ ID NO: 593559 - RNA, 23 nt, Escherichia coli CFT073
guauuaucggcgcagagcccggg

SEQ ID NO: 593560 - RNA, 12 nt, Escherichia coli CFT073
guaucggcaucg

SEQ ID NO: 593561 - RNA, 19 nt, Escherichia coli CFT073
guauuuguuuucggucagc

SEQ ID NO: 593562 - RNA, 16 nt, Escherichia coli CFT073
guauuuggcugccgag

SEQ ID NO: 593563 - RNA, 21 nt, Escherichia coli CFT073
guauugcccugaucgcgcagu

SEQ ID NO: 593564 - RNA, 14 nt, Escherichia coli CFT073
guauugcggaacgg

SEQ ID NO: 593565 - RNA, 22 nt, Escherichia coli CFT073
guauuuccggauuauccagcca

SEQ ID NO: 593566 - RNA, 17 nt, Escherichia coli CFT073
guauuccugaaucagcc

SEQ ID NO: 593567 - RNA, 16 nt, Escherichia coli CFT073
guauucgcuaaucggu

SEQ ID NO: 593568 - RNA, 19 nt, Escherichia coli CFT073
gucaaggugauuuuacccc

SEQ ID NO: 593569 - RNA, 15 nt, Escherichia coli CFT073
gucaacuccgucgcg

SEQ ID NO: 593570 - RNA, 20 nt, Escherichia coli CFT073
gucaagaaggauauaaaaau

SEQ ID NO: 593571 - RNA, 18 nt, Escherichia coli CFT073
gucagcccccacgccaua

SEQ ID NO: 593572 - RNA, 19 nt, Escherichia coli CFT073
gucagaccaaaacgcgcca

SEQ ID NO: 593573 - RNA, 23 nt, Escherichia coli CFT073
gucagaaaugguuggcgugcggg

SEQ ID NO: 593574 - RNA, 16 nt, Escherichia coli CFT073
gucacuggccagcggc

SEQ ID NO: 593575 - RNA, 16 nt, Escherichia coli CFT073
gucacugccaccaucc

SEQ ID NO: 593576 - RNA, 21 nt, Escherichia coli CFT073
gucacugagcccgcuucgccu

SEQ ID NO: 593577 - RNA, 16 nt, Escherichia coli CFT073
gucacgauaucgauau

SEQ ID NO: 593578 - RNA, 14 nt, Escherichia coli CFT073
gucaauaaacgccu

SEQ ID NO: 593579 - RNA, 20 nt, Escherichia coli CFT073
gucaaucauugauaauaacg

SEQ ID NO: 593580 - RNA, 17 nt, Escherichia coli CFT073
gucaagcgguaaccauc

SEQ ID NO: 593581 - RNA, 19 nt, Escherichia coli CFT073
gucaauuugcuccgccagu

SEQ ID NO: 593582 - RNA, 16 nt, Escherichia coli CFT073
gucucauauauuuucg

SEQ ID NO: 593583 - RNA, 17 nt, Escherichia coli CFT073
gucguuguacaaaccau

SEQ ID NO: 593584 - RNA, 16 nt, Escherichia coli CFT073
gucuaccaguuuggug

SEQ ID NO: 593585 - RNA, 20 nt, Escherichia coli CFT073
gucguugccacacgacgcca

SEQ ID NO: 593586 - RNA, 20 nt, Escherichia coli CFT073
gucguugcugucgcgcagca

SEQ ID NO: 593587 - RNA, 19 nt, Escherichia coli CFT073
gucgucgcgcgaaucuuca

SEQ ID NO: 593588 - RNA, 14 nt, Escherichia coli CFT073
gucguccggacugg

SEQ ID NO: 593589 - RNA, 20 nt, Escherichia coli CFT073
gucugaugcgacgcggcagc

SEQ ID NO: 593590 - RNA, 18 nt, Escherichia coli CFT073
gucugccacggcagaaug

SEQ ID NO: 593591 - RNA, 20 nt, Escherichia coli CFT073
gucugccuuucggugaauac

SEQ ID NO: 593592 - RNA, 23 nt, Escherichia coli CFT073
gucugccucccauucaucgccac

SEQ ID NO: 593593 - RNA, 20 nt, Escherichia coli CFT073
gucugccaucauggcauccu

SEQ ID NO: 593594 - RNA, 20 nt, Escherichia coli CFT073
gucuccucccgagcgugcgg

SEQ ID NO: 593595 - RNA, 17 nt, Escherichia coli CFT073
gucuccgguuucccggc

SEQ ID NO: 593596 - RNA, 19 nt, Escherichia coli CFT073
gucugaaucagucccugaa

SEQ ID NO: 593597 - RNA, 11 nt, Escherichia coli CFT073
gucugaaugau

SEQ ID NO: 593598 - RNA, 17 nt, Escherichia coli CFT073
gucuuauccgaccuaca

SEQ ID NO: 593599 - RNA, 14 nt, Escherichia coli CFT073
gucugcgccgaucg

SEQ ID NO: 593600 - RNA, 19 nt, Escherichia coli CFT073
gucugcgccgcauucaggg

SEQ ID NO: 593601 - RNA, 22 nt, Escherichia coli CFT073
gucuuucaguucgccuuccagc

SEQ ID NO: 593602 - RNA, 14 nt, Escherichia coli CFT073
gucuuuaccgcugu

SEQ ID NO: 593603 - RNA, 19 nt, Escherichia coli CFT073
gucuuugcguuuggcauca

SEQ ID NO: 593604 - RNA, 15 nt, Escherichia coli CFT073
gucuuguugaacaga

SEQ ID NO: 593605 - RNA, 17 nt, Escherichia coli CFT073
gugaaagaaaaugagcg

SEQ ID NO: 593606 - RNA, 18 nt, Escherichia coli CFT073
gugaaagauaaaacgaca

SEQ ID NO: 593607 - RNA, 16 nt, Escherichia coli CFT073
gugaaagcauggcacg

SEQ ID NO: 593608 - RNA, 17 nt, Escherichia coli CFT073
gugaaauaaaaucagca

SEQ ID NO: 593609 - RNA, 17 nt, Escherichia coli CFT073
gucggcgagauauuccc

SEQ ID NO: 593610 - RNA, 22 nt, Escherichia coli CFT073
gucggucgauugucgcggcuaa

SEQ ID NO: 593611 - RNA, 20 nt, Escherichia coli CFT073
gucgggccacgcugcgcuug

SEQ ID NO: 593612 - RNA, 13 nt, Escherichia coli CFT073
gucgggccgauaa

SEQ ID NO: 593613 - RNA, 18 nt, Escherichia coli CFT073
gucgggauauucagcuca

SEQ ID NO: 593614 - RNA, 14 nt, Escherichia coli CFT073
gucggcgugaacgc

SEQ ID NO: 593615 - RNA, 15 nt, Escherichia coli CFT073
guccgaugccguuaa

SEQ ID NO: 593616 - RNA, 21 nt, Escherichia coli CFT073
guccgauuuguucucuucugc

SEQ ID NO: 593617 - RNA, 18 nt, Escherichia coli CFT073
guccgcaguggcuucggc

SEQ ID NO: 593618 - RNA, 17 nt, Escherichia coli CFT073
gucgaugcgcaacgcaa

SEQ ID NO: 593619 - RNA, 13 nt, Escherichia coli CFT073
gucgccaugcggu

SEQ ID NO: 593620 - RNA, 14 nt, Escherichia coli CFT073
gucgccaucaaagg

SEQ ID NO: 593621 - RNA, 18 nt, Escherichia coli CFT073
gucgccaguaccagcagc

SEQ ID NO: 593622 - RNA, 18 nt, Escherichia coli CFT073
gucgccaguccuucaaua

SEQ ID NO: 593623 - RNA, 18 nt, Escherichia coli CFT073
gucgccucgccgagcagc

SEQ ID NO: 593624 - RNA, 13 nt, Escherichia coli CFT073
gucgcccgaccau

SEQ ID NO: 593625 - RNA, 23 nt, Escherichia coli CFT073
gucgcugauauugcuccagacgu

SEQ ID NO: 593626 - RNA, 15 nt, Escherichia coli CFT073
gucgcugagcgugcc

SEQ ID NO: 593627 - RNA, 13 nt, Escherichia coli CFT073
gucgcuucacgca

SEQ ID NO: 593628 - RNA, 17 nt, Escherichia coli CFT073
gucggaaucccaucgca

SEQ ID NO: 593629 - RNA, 13 nt, Escherichia coli CFT073
gucggaugcggcu

SEQ ID NO: 593630 - RNA, 18 nt, Escherichia coli CFT073
gucgcuugcgggcuggcg

SEQ ID NO: 593631 - RNA, 14 nt, Escherichia coli CFT073
guggcaggcaaaaa

SEQ ID NO: 593632 - RNA, 17 nt, Escherichia coli CFT073
guggccaaauucagugu

SEQ ID NO: 593633 - RNA, 15 nt, Escherichia coli CFT073
guggcauuuuuauua

SEQ ID NO: 593634 - RNA, 22 nt, Escherichia coli CFT073
guggcaucuggugccagcgcca

SEQ ID NO: 593635 - RNA, 21 nt, Escherichia coli CFT073
guggcagucacuuccugaucc

SEQ ID NO: 593636 - RNA, 16 nt, Escherichia coli CFT073
guggcccgccagcaug

SEQ ID NO: 593637 - RNA, 18 nt, Escherichia coli CFT073
guggccaucggcccguua

SEQ ID NO: 593638 - RNA, 13 nt, Escherichia coli CFT073
guggccacagcaa

SEQ ID NO: 593639 - RNA, 14 nt, Escherichia coli CFT073
guggccugcuuuug

SEQ ID NO: 593640 - RNA, 14 nt, Escherichia coli CFT073
guggccuccaaaaa

SEQ ID NO: 593641 - RNA, 13 nt, Escherichia coli CFT073
guggaugcgccau

SEQ ID NO: 593642 - RNA, 11 nt, Escherichia coli CFT073
guggcaaccgc

SEQ ID NO: 593643 - RNA, 20 nt, Escherichia coli CFT073
guggauauggaacggaugca

SEQ ID NO: 593644 - RNA, 18 nt, Escherichia coli CFT073
guggaucgaacuccgccc

SEQ ID NO: 593645 - RNA, 21 nt, Escherichia coli CFT073
gugcuuucagugccuguggau

SEQ ID NO: 593646 - RNA, 16 nt, Escherichia coli CFT073
gugcuuuuguuauagc

SEQ ID NO: 593647 - RNA, 22 nt, Escherichia coli CFT073
gugcuuauaacugcccgcauca

SEQ ID NO: 593648 - RNA, 23 nt, Escherichia coli CFT073
gugcuuauaacugcccgcaucaa

SEQ ID NO: 593649 - RNA, 14 nt, Escherichia coli CFT073
gugcuguacagcag

SEQ ID NO: 593650 - RNA, 12 nt, Escherichia coli CFT073
gugcugcgguca

SEQ ID NO: 593651 - RNA, 21 nt, Escherichia coli CFT073
gugggauuaaggcuuccagcg

SEQ ID NO: 593652 - RNA, 21 nt, Escherichia coli CFT073
gugguauagaaugcagcagca

SEQ ID NO: 593653 - RNA, 13 nt, Escherichia coli CFT073
gugguaucgccac

SEQ ID NO: 593654 - RNA, 15 nt, Escherichia coli CFT073
gugguacugccgacg

SEQ ID NO: 593655 - RNA, 12 nt, Escherichia coli CFT073
gugguagcggcu

SEQ ID NO: 593656 - RNA, 17 nt, Escherichia coli CFT073
guggguuucgcggccaa

SEQ ID NO: 593657 - RNA, 23 nt, Escherichia coli CFT073
gugguaacgcucacaucugcaau

SEQ ID NO: 593658 - RNA, 16 nt, Escherichia coli CFT073
gugguaaacacaacga

SEQ ID NO: 593659 - RNA, 22 nt, Escherichia coli CFT073
gugguaccaggaucagcaaaau

SEQ ID NO: 593660 - RNA, 21 nt, Escherichia coli CFT073
gugggguucccgagcggccaa

SEQ ID NO: 593661 - RNA, 21 nt, Escherichia coli CFT073
gugggugauuaaauucaggcc

SEQ ID NO: 593662 - RNA, 20 nt, Escherichia coli CFT073
guggcguguuguaaaacgcg

SEQ ID NO: 593663 - RNA, 12 nt, Escherichia coli CFT073
guggcgguuuug

SEQ ID NO: 593664 - RNA, 23 nt, Escherichia coli CFT073
guggcgguuuugucguccggacu

SEQ ID NO: 593665 - RNA, 19 nt, Escherichia coli CFT073
guggcgauaaucagcgcca

SEQ ID NO: 593666 - RNA, 13 nt, Escherichia coli CFT073
guggcgauugucg

SEQ ID NO: 593667 - RNA, 21 nt, Escherichia coli CFT073
gugcacagcauccgaacgcug

SEQ ID NO: 593668 - RNA, 13 nt, Escherichia coli CFT073
gugaugcguccgc

SEQ ID NO: 593669 - RNA, 17 nt, Escherichia coli CFT073
gugaugcccugaugcgu

SEQ ID NO: 593670 - RNA, 20 nt, Escherichia coli CFT073
gugaucccgcuaccugccgc

SEQ ID NO: 593671 - RNA, 18 nt, Escherichia coli CFT073
gugauccacccuugauua

SEQ ID NO: 593672 - RNA, 15 nt, Escherichia coli CFT073
gugaucagcgucagu

SEQ ID NO: 593673 - RNA, 21 nt, Escherichia coli CFT073
gugauauucacguuuuucauc

SEQ ID NO: 593674 - RNA, 14 nt, Escherichia coli CFT073
gugauauuuucacu

SEQ ID NO: 593675 - RNA, 12 nt, Escherichia coli CFT073
gugaucaacaca

SEQ ID NO: 593676 - RNA, 22 nt, Escherichia coli CFT073
gugaucacaucaucuaccagca

SEQ ID NO: 593677 - RNA, 13 nt, Escherichia coli CFT073
gugaacgccacca

SEQ ID NO: 593678 - RNA, 17 nt, Escherichia coli CFT073
gugaacgccaccaacgc

SEQ ID NO: 593679 - RNA, 14 nt, Escherichia coli CFT073
gugaacaccuuauc

SEQ ID NO: 593680 - RNA, 14 nt, Escherichia coli CFT073
gugaacaucgccau

SEQ ID NO: 593681 - RNA, 20 nt, Escherichia coli CFT073
gugaacgccuuauccgaccu

SEQ ID NO: 593682 - RNA, 20 nt, Escherichia coli CFT073
gugaacgccuuauccggccu

SEQ ID NO: 593683 - RNA, 20 nt, Escherichia coli CFT073
gugaacgccuucuccggccu

SEQ ID NO: 593684 - RNA, 18 nt, Escherichia coli CFT073
gugaacugggccugcaua

SEQ ID NO: 593685 - RNA, 18 nt, Escherichia coli CFT073
gugagcgauugcuggccu

SEQ ID NO: 593686 - RNA, 15 nt, Escherichia coli CFT073
gugauaccccgcauc

SEQ ID NO: 593687 - RNA, 22 nt, Escherichia coli CFT073
gugauauacgccacuucaucgu

SEQ ID NO: 593688 - RNA, 20 nt, Escherichia coli CFT073
gugcagcgguuccuggcggu

SEQ ID NO: 593689 - RNA, 20 nt, Escherichia coli CFT073
gugcaccacuguuuuucagc

SEQ ID NO: 593690 - RNA, 18 nt, Escherichia coli CFT073
gugccaaagucaucaauu

SEQ ID NO: 593691 - RNA, 20 nt, Escherichia coli CFT073
gugcaugguguucagaugac

SEQ ID NO: 593692 - RNA, 15 nt, Escherichia coli CFT073
gugccagcggcagua

SEQ ID NO: 593693 - RNA, 13 nt, Escherichia coli CFT073
gugccagugcacu

SEQ ID NO: 593694 - RNA, 23 nt, Escherichia coli CFT073
gugccaguuccgguggcaaugcc

SEQ ID NO: 593695 - RNA, 12 nt, Escherichia coli CFT073
gugccaucacgc

SEQ ID NO: 593696 - RNA, 18 nt, Escherichia coli CFT073
gugcccccauaagccgcg

SEQ ID NO: 593697 - RNA, 21 nt, Escherichia coli CFT073
gugccccaaaugucggaugcg

SEQ ID NO: 593698 - RNA, 18 nt, Escherichia coli CFT073
gugccugacggacgcgcg

SEQ ID NO: 593699 - RNA, 22 nt, Escherichia coli CFT073
gugccggauguucgcauccggc

SEQ ID NO: 593700 - RNA, 14 nt, Escherichia coli CFT073
gugccgcucguuug

SEQ ID NO: 593701 - RNA, 13 nt, Escherichia coli CFT073
gugcgaaacggaa

SEQ ID NO: 593702 - RNA, 22 nt, Escherichia coli CFT073
gugcgaauaaugguaucgacac

SEQ ID NO: 593703 - RNA, 18 nt, Escherichia coli CFT073
gugcgccacauccggcau

SEQ ID NO: 593704 - RNA, 13 nt, Escherichia coli CFT073
gugcgcaguugcc

SEQ ID NO: 593705 - RNA, 21 nt, Escherichia coli CFT073
gugcgguaagcugcgguuccg

SEQ ID NO: 593706 - RNA, 18 nt, Escherichia coli CFT073
gugcgguaucaccaccca

SEQ ID NO: 593707 - RNA, 23 nt, Escherichia coli CFT073
gugcggcuguagagcuaccggca

SEQ ID NO: 593708 - RNA, 15 nt, Escherichia coli CFT073
gugcgcccggcguca

SEQ ID NO: 593709 - RNA, 21 nt, Escherichia coli CFT073
gugcugcauuuggacaccauu

SEQ ID NO: 593710 - RNA, 12 nt, Escherichia coli CFT073
gugcugauacgc

SEQ ID NO: 593711 - RNA, 20 nt, Escherichia coli CFT073
gugcugauacgcgcaccgga

SEQ ID NO: 593712 - RNA, 14 nt, Escherichia coli CFT073
gugcuccuucagcc

SEQ ID NO: 593713 - RNA, 22 nt, Escherichia coli CFT073
gugcuccaucaggucaucaauc

SEQ ID NO: 593714 - RNA, 21 nt, Escherichia coli CFT073
gcgcgagguggaacaucagga

SEQ ID NO: 593715 - RNA, 19 nt, Escherichia coli CFT073
gcgccugcacaaagcgcca

SEQ ID NO: 593716 - RNA, 23 nt, Escherichia coli CFT073
gcgccgugaacgugaccaugagc

SEQ ID NO: 593717 - RNA, 19 nt, Escherichia coli CFT073
gcgccugcagcggccagua

SEQ ID NO: 593718 - RNA, 20 nt, Escherichia coli CFT073
gcgccugcggccagcagcug

SEQ ID NO: 593719 - RNA, 16 nt, Escherichia coli CFT073
gcgccugaauaaucag

SEQ ID NO: 593720 - RNA, 16 nt, Escherichia coli CFT073
gcgcgaaccagagaca

SEQ ID NO: 593721 - RNA, 17 nt, Escherichia coli CFT073
gcgcgaaccaucaccuc

SEQ ID NO: 593722 - RNA, 22 nt, Escherichia coli CFT073
gcgcgaaaacccucgaccaucu

SEQ ID NO: 593723 - RNA, 18 nt, Escherichia coli CFT073
gcgccuggcgaaucgccu

SEQ ID NO: 593724 - RNA, 20 nt, Escherichia coli CFT073
gcgccguagccauuaccagg

SEQ ID NO: 593725 - RNA, 17 nt, Escherichia coli CFT073
gcgcccuugcagacgau

SEQ ID NO: 593726 - RNA, 22 nt, Escherichia coli CFT073
gcgcccugggcuucauccagca

SEQ ID NO: 593727 - RNA, 13 nt, Escherichia coli CFT073
gcgccgccagcca

SEQ ID NO: 593728 - RNA, 12 nt, Escherichia coli CFT073
gcgcccgccagc

SEQ ID NO: 593729 - RNA, 16 nt, Escherichia coli CFT073
gcgccccuggcgcagc

SEQ ID NO: 593730 - RNA, 13 nt, Escherichia coli CFT073
gcgcccgccaguu

SEQ ID NO: 593731 - RNA, 22 nt, Escherichia coli CFT073
gcgcaugguagaaaucuaucgc

SEQ ID NO: 593732 - RNA, 17 nt, Escherichia coli CFT073
gcgcauucgaucaccgc

SEQ ID NO: 593733 - RNA, 14 nt, Escherichia coli CFT073
gcgcaccagcaggc

SEQ ID NO: 593734 - RNA, 15 nt, Escherichia coli CFT073
gcgcaccagcaggcc

SEQ ID NO: 593735 - RNA, 17 nt, Escherichia coli CFT073
gcgccaaucagcgcagc

SEQ ID NO: 593736 - RNA, 13 nt, Escherichia coli CFT073
gcgccaaucgaca

SEQ ID NO: 593737 - RNA, 21 nt, Escherichia coli CFT073
gcgccacaaucgcuucaucgc

SEQ ID NO: 593738 - RNA, 15 nt, Escherichia coli CFT073
gcgccaccaccagua

SEQ ID NO: 593739 - RNA, 16 nt, Escherichia coli CFT073
gcgccacauccggcau

SEQ ID NO: 593740 - RNA, 21 nt, Escherichia coli CFT073
gcgccaaccaugccgcccagc

SEQ ID NO: 593741 - RNA, 18 nt, Escherichia coli CFT073
gcgcauuuccaagauuaa

SEQ ID NO: 593742 - RNA, 14 nt, Escherichia coli CFT073
gcgcauugcuggcu

SEQ ID NO: 593743 - RNA, 20 nt, Escherichia coli CFT073
gcgccagcggccagcgcacc

SEQ ID NO: 593744 - RNA, 15 nt, Escherichia coli CFT073
gcgccaucaaaucug

SEQ ID NO: 593745 - RNA, 14 nt, Escherichia coli CFT073
gcgccauaucggca

SEQ ID NO: 593746 - RNA, 12 nt, Escherichia coli CFT073
gcgccauccaua

SEQ ID NO: 593747 - RNA, 20 nt, Escherichia coli CFT073
gcgccaggcuuuccgucagc

SEQ ID NO: 593748 - RNA, 22 nt, Escherichia coli CFT073
gcgccaggcgcgagaagaucca

SEQ ID NO: 593749 - RNA, 15 nt, Escherichia coli CFT073
gcgccaggcgcugaa

SEQ ID NO: 593750 - RNA, 17 nt, Escherichia coli CFT073
gcgccagcuaccagaau

SEQ ID NO: 593751 - RNA, 15 nt, Escherichia coli CFT073
gcgcggcggguuaac

SEQ ID NO: 593752 - RNA, 20 nt, Escherichia coli CFT073
gcgcgguaucucgcgccagu

SEQ ID NO: 593753 - RNA, 19 nt, Escherichia coli CFT073
gcgcucgcgccgcauccga

SEQ ID NO: 593754 - RNA, 16 nt, Escherichia coli CFT073
gcgcuggcgcagcauc

SEQ ID NO: 593755 - RNA, 14 nt, Escherichia coli CFT073
gcgcuaucgccugc

SEQ ID NO: 593756 - RNA, 17 nt, Escherichia coli CFT073
gcgcuauaucgcugaua

SEQ ID NO: 593757 - RNA, 12 nt, Escherichia coli CFT073
gcgcuaucaaua

SEQ ID NO: 593758 - RNA, 22 nt, Escherichia coli CFT073
gcgcuaccaucgacaccaucgc

SEQ ID NO: 593759 - RNA, 21 nt, Escherichia coli CFT073
gcgcguuauuuguugccggau

SEQ ID NO: 593760 - RNA, 17 nt, Escherichia coli CFT073
gcggaagcgaguucgcg

SEQ ID NO: 593761 - RNA, 16 nt, Escherichia coli CFT073
gcggaauaccgacauc

SEQ ID NO: 593762 - RNA, 12 nt, Escherichia coli CFT073
gcggaauaucag

SEQ ID NO: 593763 - RNA, 22 nt, Escherichia coli CFT073
gcggaccccgcgcucgcgcagc

SEQ ID NO: 593764 - RNA, 17 nt, Escherichia coli CFT073
gcggauaucuuucgcca

SEQ ID NO: 593765 - RNA, 23 nt, Escherichia coli CFT073
gcggauaaccgggguuucaccca

SEQ ID NO: 593766 - RNA, 20 nt, Escherichia coli CFT073
gcggauaaacgucuucgcca

SEQ ID NO: 593767 - RNA, 15 nt, Escherichia coli CFT073
gcggauauguucgcg

SEQ ID NO: 593768 - RNA, 16 nt, Escherichia coli CFT073
gcggacgaucgcugau

SEQ ID NO: 593769 - RNA, 15 nt, Escherichia coli CFT073
gcggacgucuguuua

SEQ ID NO: 593770 - RNA, 15 nt, Escherichia coli CFT073
gcggacgucgacacu

SEQ ID NO: 593771 - RNA, 15 nt, Escherichia coli CFT073
gcggcaaagcgcauc

SEQ ID NO: 593772 - RNA, 18 nt, Escherichia coli CFT073
gcggcaaagcgcaucagc

SEQ ID NO: 593773 - RNA, 13 nt, Escherichia coli CFT073
gcggcaaaccuuu

SEQ ID NO: 593774 - RNA, 15 nt, Escherichia coli CFT073
gcggcaaacugcaug

SEQ ID NO: 593775 - RNA, 16 nt, Escherichia coli CFT073
gcggcaacaucaucac

SEQ ID NO: 593776 - RNA, 18 nt, Escherichia coli CFT073
gcggcaaccagcagcauc

SEQ ID NO: 593777 - RNA, 20 nt, Escherichia coli CFT073
gcggcacaccagccaguagc

SEQ ID NO: 593778 - RNA, 19 nt, Escherichia coli CFT073
gcggcaaucacauccacca

SEQ ID NO: 593779 - RNA, 17 nt, Escherichia coli CFT073
gcggcaaucaucaucgg

SEQ ID NO: 593780 - RNA, 14 nt, Escherichia coli CFT073
gcggcaacuuuauu

SEQ ID NO: 593781 - RNA, 17 nt, Escherichia coli CFT073
gcggcagacgcucgcca

SEQ ID NO: 593782 - RNA, 17 nt, Escherichia coli CFT073
gcgaaugccaacgggaa

SEQ ID NO: 593783 - RNA, 23 nt, Escherichia coli CFT073
gcgaauuaagaauuucucaguug

SEQ ID NO: 593784 - RNA, 14 nt, Escherichia coli CFT073
gcgacaaacauugc

SEQ ID NO: 593785 - RNA, 22 nt, Escherichia coli CFT073
gcgacaaacauugcugccagaa

SEQ ID NO: 593786 - RNA, 22 nt, Escherichia coli CFT073
gcgacaaagccucuauggaagu

SEQ ID NO: 593787 - RNA, 12 nt, Escherichia coli CFT073
gcgaaucgccgu

SEQ ID NO: 593788 - RNA, 15 nt, Escherichia coli CFT073
gcgaaucuaaaucag

SEQ ID NO: 593789 - RNA, 12 nt, Escherichia coli CFT073
gcgaaucaggua

SEQ ID NO: 593790 - RNA, 14 nt, Escherichia coli CFT073
gcgaauagcgucua

SEQ ID NO: 593791 - RNA, 13 nt, Escherichia coli CFT073
gcgaaucaaccgc

SEQ ID NO: 593792 - RNA, 13 nt, Escherichia coli CFT073
gcgaauaauggua

SEQ ID NO: 593793 - RNA, 19 nt, Escherichia coli CFT073
gccuuguucggucagcgca

SEQ ID NO: 593794 - RNA, 20 nt, Escherichia coli CFT073
gcgaccagaacugauccaua

SEQ ID NO: 593795 - RNA, 13 nt, Escherichia coli CFT073
gcgaccagcaaua

SEQ ID NO: 593796 - RNA, 20 nt, Escherichia coli CFT073
gcgacauaucauuuugcugc

SEQ ID NO: 593797 - RNA, 15 nt, Escherichia coli CFT073
gcgacauaucgccag

SEQ ID NO: 593798 - RNA, 15 nt, Escherichia coli CFT073
gcgacagacggcgac

SEQ ID NO: 593799 - RNA, 18 nt, Escherichia coli CFT073
gcgacacgcaucacgcgc

SEQ ID NO: 593800 - RNA, 14 nt, Escherichia coli CFT073
gcgacaaauguugc

SEQ ID NO: 593801 - RNA, 21 nt, Escherichia coli CFT073
gcgaggggacgguccgugcgc

SEQ ID NO: 593802 - RNA, 15 nt, Escherichia coli CFT073
gcgagaugaccgaca

SEQ ID NO: 593803 - RNA, 19 nt, Escherichia coli CFT073
gcgagacuccgccgccauu

SEQ ID NO: 593804 - RNA, 19 nt, Escherichia coli CFT073
gcgacucacgaaucgccuc

SEQ ID NO: 593805 - RNA, 21 nt, Escherichia coli CFT073
gcgacguuugaugcgucuuau

SEQ ID NO: 593806 - RNA, 12 nt, Escherichia coli CFT073
gcgacguucucg

SEQ ID NO: 593807 - RNA, 22 nt, Escherichia coli CFT073
gcgacguugcuucucuugcugg

SEQ ID NO: 593808 - RNA, 18 nt, Escherichia coli CFT073
gcgacgggcgacaaacgc

SEQ ID NO: 593809 - RNA, 16 nt, Escherichia coli CFT073
gcgacggcaccacauu

SEQ ID NO: 593810 - RNA, 21 nt, Escherichia coli CFT073
gcgacgcuugccgcgucuuau

SEQ ID NO: 593811 - RNA, 22 nt, Escherichia coli CFT073
gcgaccgucuuuauccagcacc

SEQ ID NO: 593812 - RNA, 20 nt, Escherichia coli CFT073
gcgaccuacacaccuucucc

SEQ ID NO: 593813 - RNA, 17 nt, Escherichia coli CFT073
gcgcaacguaucaucgc

SEQ ID NO: 593814 - RNA, 22 nt, Escherichia coli CFT073
gcgcaagcugcugacauacggc

SEQ ID NO: 593815 - RNA, 16 nt, Escherichia coli CFT073
gcgcaaccaucaguac

SEQ ID NO: 593816 - RNA, 17 nt, Escherichia coli CFT073
gcgcaauagugacagau

SEQ ID NO: 593817 - RNA, 13 nt, Escherichia coli CFT073
gcgcaaugcguuu

SEQ ID NO: 593818 - RNA, 22 nt, Escherichia coli CFT073
gcgcaaucguaugaucauccgc

SEQ ID NO: 593819 - RNA, 14 nt, Escherichia coli CFT073
gcgcaaugcccgca

SEQ ID NO: 593820 - RNA, 20 nt, Escherichia coli CFT073
gcgcaauauucaagauaacg

SEQ ID NO: 593821 - RNA, 13 nt, Escherichia coli CFT073
gcgcacaugcagc

SEQ ID NO: 593822 - RNA, 20 nt, Escherichia coli CFT073
gcgcacaaccgccggaugcg

SEQ ID NO: 593823 - RNA, 15 nt, Escherichia coli CFT073
gcgauggcggcagcc

SEQ ID NO: 593824 - RNA, 20 nt, Escherichia coli CFT073
gcgauggcccgcuugccaga

SEQ ID NO: 593825 - RNA, 20 nt, Escherichia coli CFT073
gcgaugcuggcgcgucuuau

SEQ ID NO: 593826 - RNA, 18 nt, Escherichia coli CFT073
gcgaugcuuuccagcugu

SEQ ID NO: 593827 - RNA, 16 nt, Escherichia coli CFT073
gcgauggguuguugag

SEQ ID NO: 593828 - RNA, 22 nt, Escherichia coli CFT073
gcgaugguacuucaaucgccac

SEQ ID NO: 593829 - RNA, 17 nt, Escherichia coli CFT073
gcgauugaucucguuga

SEQ ID NO: 593830 - RNA, 19 nt, Escherichia coli CFT073
gcgauuguaauuucacgcu

SEQ ID NO: 593831 - RNA, 17 nt, Escherichia coli CFT073
gcgauuucagcgccgcg

SEQ ID NO: 593832 - RNA, 23 nt, Escherichia coli CFT073
gcgcaaaaaacuaucccaucagc

SEQ ID NO: 593833 - RNA, 21 nt, Escherichia coli CFT073
gcgauuccaguucaaucucuu

SEQ ID NO: 593834 - RNA, 17 nt, Escherichia coli CFT073
gcgauguuagcgucaac

SEQ ID NO: 593835 - RNA, 21 nt, Escherichia coli CFT073
gcgauuaaacgccauccggca

SEQ ID NO: 593836 - RNA, 13 nt, Escherichia coli CFT073
gcgauuaaccguu

SEQ ID NO: 593837 - RNA, 13 nt, Escherichia coli CFT073
gcgauuaaucuca

SEQ ID NO: 593838 - RNA, 19 nt, Escherichia coli CFT073
gcgauuacguucgacugcg

SEQ ID NO: 593839 - RNA, 18 nt, Escherichia coli CFT073
gcgauuacguucggcaaa

SEQ ID NO: 593840 - RNA, 18 nt, Escherichia coli CFT073
gcgauuauccaugccaca

SEQ ID NO: 593841 - RNA, 14 nt, Escherichia coli CFT073
gcgauuaucccaua

SEQ ID NO: 593842 - RNA, 12 nt, Escherichia coli CFT073
gcgauucagcaa

SEQ ID NO: 593843 - RNA, 15 nt, Escherichia coli CFT073
gcgauucauaugcgc

SEQ ID NO: 593844 - RNA, 19 nt, Escherichia coli CFT073
gcgaugcacaugcuucagc

SEQ ID NO: 593845 - RNA, 15 nt, Escherichia coli CFT073
gcgaugauagggcug

SEQ ID NO: 593846 - RNA, 15 nt, Escherichia coli CFT073
gcgaugaugcgacgc

SEQ ID NO: 593847 - RNA, 18 nt, Escherichia coli CFT073
gcgaugcgucgcuggcgg

SEQ ID NO: 593848 - RNA, 19 nt, Escherichia coli CFT073
gcgaucugcaccuggcgca

SEQ ID NO: 593849 - RNA, 22 nt, Escherichia coli CFT073
gcgaugaaaaucgccggaugcg

SEQ ID NO: 593850 - RNA, 19 nt, Escherichia coli CFT073
gcgauccacgcucgcuggc

SEQ ID NO: 593851 - RNA, 18 nt, Escherichia coli CFT073
gcgaucaucaguacgccu

SEQ ID NO: 593852 - RNA, 18 nt, Escherichia coli CFT073
gcgaucgccugcuggaca

SEQ ID NO: 593853 - RNA, 19 nt, Escherichia coli CFT073
gcgaucgcgccaaucagcg

SEQ ID NO: 593854 - RNA, 19 nt, Escherichia coli CFT073
gcgaucgcccgcaaucagc

SEQ ID NO: 593855 - RNA, 17 nt, Escherichia coli CFT073
gccuuacgcaccggaaa

SEQ ID NO: 593856 - RNA, 18 nt, Escherichia coli CFT073
gccuuauccggccuacga

SEQ ID NO: 593857 - RNA, 22 nt, Escherichia coli CFT073
gccuuccgcaaacaggcgcaga

SEQ ID NO: 593858 - RNA, 18 nt, Escherichia coli CFT073
gccuucccuuucagcaaa

SEQ ID NO: 593859 - RNA, 21 nt, Escherichia coli CFT073
gccuuccugauaacacagcgg

SEQ ID NO: 593860 - RNA, 15 nt, Escherichia coli CFT073
gccuuccgucagcaa

SEQ ID NO: 593861 - RNA, 16 nt, Escherichia coli CFT073
gccuuccgucagcaaa

SEQ ID NO: 593862 - RNA, 13 nt, Escherichia coli CFT073
gccuuaaacucca

SEQ ID NO: 593863 - RNA, 19 nt, Escherichia coli CFT073
gccuuaacaagauauuccg

SEQ ID NO: 593864 - RNA, 16 nt, Escherichia coli CFT073
gccuuaaaaaccagag

SEQ ID NO: 593865 - RNA, 21 nt, Escherichia coli CFT073
gccuguuuaccggucaccgga

SEQ ID NO: 593866 - RNA, 18 nt, Escherichia coli CFT073
gccuugcgugacgccugc

SEQ ID NO: 593867 - RNA, 18 nt, Escherichia coli CFT073
gccuucgcaguggugaua

SEQ ID NO: 593868 - RNA, 13 nt, Escherichia coli CFT073
gccuucgccuuuc

SEQ ID NO: 593869 - RNA, 14 nt, Escherichia coli CFT073
gccugcggcugaua

SEQ ID NO: 593870 - RNA, 21 nt, Escherichia coli CFT073
gccugcuucuacgcagguuaa

SEQ ID NO: 593871 - RNA, 19 nt, Escherichia coli CFT073
gccuggcagcaugcugcca

SEQ ID NO: 593872 - RNA, 19 nt, Escherichia coli CFT073
gccuggagguggcaguuac

SEQ ID NO: 593873 - RNA, 21 nt, Escherichia coli CFT073
gccuggagguuuagccaaaaa

SEQ ID NO: 593874 - RNA, 17 nt, Escherichia coli CFT073
gccuggaauuucuucgg

SEQ ID NO: 593875 - RNA, 17 nt, Escherichia coli CFT073
gccugcuuuugccagcg

SEQ ID NO: 593876 - RNA, 11 nt, Escherichia coli CFT073
gccugaaaaau

SEQ ID NO: 593877 - RNA, 21 nt, Escherichia coli CFT073
gccugcacaaagcgccagaau

SEQ ID NO: 593878 - RNA, 15 nt, Escherichia coli CFT073
gccugcacaaccgga

SEQ ID NO: 593879 - RNA, 13 nt, Escherichia coli CFT073
gccugcacgaccg

SEQ ID NO: 593880 - RNA, 18 nt, Escherichia coli CFT073
gccugaauacacugcuga

SEQ ID NO: 593881 - RNA, 14 nt, Escherichia coli CFT073
gccugaaugccaca

SEQ ID NO: 593882 - RNA, 23 nt, Escherichia coli CFT073
gccugaaauugcaaacgcguuaa

SEQ ID NO: 593883 - RNA, 17 nt, Escherichia coli CFT073
gccugaacaccagaacc

SEQ ID NO: 593884 - RNA, 20 nt, Escherichia coli CFT073
gccugagacagacagccuca

SEQ ID NO: 593885 - RNA, 19 nt, Escherichia coli CFT073
gccugauaaaacgcgcagc

SEQ ID NO: 593886 - RNA, 14 nt, Escherichia coli CFT073
gccugaggcgucag

SEQ ID NO: 593887 - RNA, 15 nt, Escherichia coli CFT073
gccugaggcgucagc

SEQ ID NO: 593888 - RNA, 19 nt, Escherichia coli CFT073
gccugaugcgcuaugcuua

SEQ ID NO: 593889 - RNA, 18 nt, Escherichia coli CFT073
gccugaugcgcugcgcuu

SEQ ID NO: 593890 - RNA, 20 nt, Escherichia coli CFT073
gccugaucagcgaagcgcau

SEQ ID NO: 593891 - RNA, 13 nt, Escherichia coli CFT073
gccugaugcgacg

SEQ ID NO: 593892 - RNA, 15 nt, Escherichia coli CFT073
gccugagcuaaugga

SEQ ID NO: 593893 - RNA, 20 nt, Escherichia coli CFT073
gccugauaagacgcguuagc

SEQ ID NO: 593894 - RNA, 16 nt, Escherichia coli CFT073
gccugauaagcguagc

SEQ ID NO: 593895 - RNA, 13 nt, Escherichia coli CFT073
gccugauaaggca

SEQ ID NO: 593896 - RNA, 21 nt, Escherichia coli CFT073
gccugauaccccauauuggca

SEQ ID NO: 593897 - RNA, 14 nt, Escherichia coli CFT073
gccgguuggcgacu

SEQ ID NO: 593898 - RNA, 14 nt, Escherichia coli CFT073
gccgguuaucccgc

SEQ ID NO: 593899 - RNA, 16 nt, Escherichia coli CFT073
gccgguuccagcuuca

SEQ ID NO: 593900 - RNA, 17 nt, Escherichia coli CFT073
gccgggaguuucagcgg

SEQ ID NO: 593901 - RNA, 23 nt, Escherichia coli CFT073
gccgggauauaugucaccagcau

SEQ ID NO: 593902 - RNA, 13 nt, Escherichia coli CFT073
gccguacgucagc

SEQ ID NO: 593903 - RNA, 16 nt, Escherichia coli CFT073
gccguacgucagcgcc

SEQ ID NO: 593904 - RNA, 20 nt, Escherichia coli CFT073
gccguaccugacgguaaaua

SEQ ID NO: 593905 - RNA, 16 nt, Escherichia coli CFT073
gccguaccaucgccag

SEQ ID NO: 593906 - RNA, 17 nt, Escherichia coli CFT073
gccguaccaucgccagc

SEQ ID NO: 593907 - RNA, 21 nt, Escherichia coli CFT073
gccguaauguugcgccaguuc

SEQ ID NO: 593908 - RNA, 14 nt, Escherichia coli CFT073
gccguaauuaacac

SEQ ID NO: 593909 - RNA, 19 nt, Escherichia coli CFT073
gccguaagcaacgccaaau

SEQ ID NO: 593910 - RNA, 18 nt, Escherichia coli CFT073
gccgucaucaucggcugc

SEQ ID NO: 593911 - RNA, 21 nt, Escherichia coli CFT073
gccguuaaagauaaugccagc

SEQ ID NO: 593912 - RNA, 21 nt, Escherichia coli CFT073
gccguuaacuucaccgguuca

SEQ ID NO: 593913 - RNA, 14 nt, Escherichia coli CFT073
gccguuaccuuacc

SEQ ID NO: 593914 - RNA, 14 nt, Escherichia coli CFT073
gccguuaccuucgg

SEQ ID NO: 593915 - RNA, 17 nt, Escherichia coli CFT073
gccguuaggaccgguuu

SEQ ID NO: 593916 - RNA, 15 nt, Escherichia coli CFT073
gccguggcaggcaaa

SEQ ID NO: 593917 - RNA, 18 nt, Escherichia coli CFT073
gccucaggcacuucuucc

SEQ ID NO: 593918 - RNA, 12 nt, Escherichia coli CFT073
gccucaucacaa

SEQ ID NO: 593919 - RNA, 13 nt, Escherichia coli CFT073
gccucaugugaug

SEQ ID NO: 593920 - RNA, 13 nt, Escherichia coli CFT073
gccuaccgccugc

SEQ ID NO: 593921 - RNA, 18 nt, Escherichia coli CFT073
gccuacacaacauaucgc

SEQ ID NO: 593922 - RNA, 20 nt, Escherichia coli CFT073
gccuacaggugcaccgcauc

SEQ ID NO: 593923 - RNA, 20 nt, Escherichia coli CFT073
gccuacauuaguccgguugu

SEQ ID NO: 593924 - RNA, 16 nt, Escherichia coli CFT073
gccuacauauccgcgc

SEQ ID NO: 593925 - RNA, 18 nt, Escherichia coli CFT073
gccuacaaaggcacgcca

SEQ ID NO: 593926 - RNA, 20 nt, Escherichia coli CFT073
gccguuuuuacccagcagca

SEQ ID NO: 593927 - RNA, 13 nt, Escherichia coli CFT073
gccuaaauggaaa

SEQ ID NO: 593928 - RNA, 15 nt, Escherichia coli CFT073
gccuaacaccaucag

SEQ ID NO: 593929 - RNA, 20 nt, Escherichia coli CFT073
gcggcgaguguguggaaaac

SEQ ID NO: 593930 - RNA, 22 nt, Escherichia coli CFT073
gcggcgagaucuuuaucaauca

SEQ ID NO: 593931 - RNA, 16 nt, Escherichia coli CFT073
gcggcagcuccagcag

SEQ ID NO: 593932 - RNA, 20 nt, Escherichia coli CFT073
gcggcgcugacgcgucuuau

SEQ ID NO: 593933 - RNA, 17 nt, Escherichia coli CFT073
gcggcgcaggcgcuuau

SEQ ID NO: 593934 - RNA, 18 nt, Escherichia coli CFT073
gcggcgcaggcgcuuauc

SEQ ID NO: 593935 - RNA, 19 nt, Escherichia coli CFT073
gcggcgaucuucaaacugg

SEQ ID NO: 593936 - RNA, 21 nt, Escherichia coli CFT073
gcggcgaucuucaaacuggcg

SEQ ID NO: 593937 - RNA, 19 nt, Escherichia coli CFT073
gcggcgugaacaccuuauc

SEQ ID NO: 593938 - RNA, 18 nt, Escherichia coli CFT073
gcggcgugaacgccuuau

SEQ ID NO: 593939 - RNA, 19 nt, Escherichia coli CFT073
gcggcguaaacgccuuauc

SEQ ID NO: 593940 - RNA, 18 nt, Escherichia coli CFT073
gcggcguaaacgccuuau

SEQ ID NO: 593941 - RNA, 18 nt, Escherichia coli CFT073
gcggcggugagaagaccg

SEQ ID NO: 593942 - RNA, 13 nt, Escherichia coli CFT073
gcggcugcguaau

SEQ ID NO: 593943 - RNA, 17 nt, Escherichia coli CFT073
gcggcuuaguugaucga

SEQ ID NO: 593944 - RNA, 19 nt, Escherichia coli CFT073
gcggcugguaacaguccgu

SEQ ID NO: 593945 - RNA, 13 nt, Escherichia coli CFT073
gcggcuuuuacga

SEQ ID NO: 593946 - RNA, 20 nt, Escherichia coli CFT073
gcgggaaaaauugccugaug

SEQ ID NO: 593947 - RNA, 18 nt, Escherichia coli CFT073
gcgggaaaacauacacau

SEQ ID NO: 593948 - RNA, 18 nt, Escherichia coli CFT073
gcgggauaauccggaaaa

SEQ ID NO: 593949 - RNA, 15 nt, Escherichia coli CFT073
gcgggcagacaaaac

SEQ ID NO: 593950 - RNA, 17 nt, Escherichia coli CFT073
gcggggagaaugccagc

SEQ ID NO: 593951 - RNA, 18 nt, Escherichia coli CFT073
gcggggagaaugccagca

SEQ ID NO: 593952 - RNA, 16 nt, Escherichia coli CFT073
gcggguacguuucgcc

SEQ ID NO: 593953 - RNA, 14 nt, Escherichia coli CFT073
gcggguaagugcgg

SEQ ID NO: 593954 - RNA, 16 nt, Escherichia coli CFT073
gcggguaaaaccauuu

SEQ ID NO: 593955 - RNA, 13 nt, Escherichia coli CFT073
gcggggcuaccgc

SEQ ID NO: 593956 - RNA, 22 nt, Escherichia coli CFT073
gcgguaagaguaaagcccgcca

SEQ ID NO: 593957 - RNA, 17 nt, Escherichia coli CFT073
gcgguaaaccguuauca

SEQ ID NO: 593958 - RNA, 23 nt, Escherichia coli CFT073
gcgguaaagaacugagcgccguc

SEQ ID NO: 593959 - RNA, 15 nt, Escherichia coli CFT073
gcggguuuaccacgg

SEQ ID NO: 593960 - RNA, 13 nt, Escherichia coli CFT073
gcggguuuugaau

SEQ ID NO: 593961 - RNA, 16 nt, Escherichia coli CFT073
gcggguuuuucccuuc

SEQ ID NO: 593962 - RNA, 15 nt, Escherichia coli CFT073
gcgguaugguaaagc

SEQ ID NO: 593963 - RNA, 18 nt, Escherichia coli CFT073
gcgguaugugaaacgccg

SEQ ID NO: 593964 - RNA, 18 nt, Escherichia coli CFT073
gcgguacugaccaucagc

SEQ ID NO: 593965 - RNA, 16 nt, Escherichia coli CFT073
gcgguacucgcgcagu

SEQ ID NO: 593966 - RNA, 23 nt, Escherichia coli CFT073
gcgguacucgcgcaguucgcaca

SEQ ID NO: 593967 - RNA, 21 nt, Escherichia coli CFT073
gcggugucuaacgaugccagc

SEQ ID NO: 593968 - RNA, 13 nt, Escherichia coli CFT073
gcgguuagcggcu

SEQ ID NO: 593969 - RNA, 20 nt, Escherichia coli CFT073
gcgguuagucgcugugacau

SEQ ID NO: 593970 - RNA, 16 nt, Escherichia coli CFT073
gcgguucagcuuuuua

SEQ ID NO: 593971 - RNA, 23 nt, Escherichia coli CFT073
gcggugaagccaccagcgccagc

SEQ ID NO: 593972 - RNA, 12 nt, Escherichia coli CFT073
gcggucuggcag

SEQ ID NO: 593973 - RNA, 23 nt, Escherichia coli CFT073
gcguuaacuuguugcgccguuuc

SEQ ID NO: 593974 - RNA, 21 nt, Escherichia coli CFT073
gcguuaauauugugugccggg

SEQ ID NO: 593975 - RNA, 19 nt, Escherichia coli CFT073
gcguuaaugauaucccugc

SEQ ID NO: 593976 - RNA, 12 nt, Escherichia coli CFT073
gcguuaacgcug

SEQ ID NO: 593977 - RNA, 21 nt, Escherichia coli CFT073
gcguucgcgccgcauccggca

SEQ ID NO: 593978 - RNA, 15 nt, Escherichia coli CFT073
gcguuccccagaagc

SEQ ID NO: 593979 - RNA, 21 nt, Escherichia coli CFT073
gcguuccagcagcuuaagcga

SEQ ID NO: 593980 - RNA, 22 nt, Escherichia coli CFT073
gcguucauaaauacagagcacg

SEQ ID NO: 593981 - RNA, 21 nt, Escherichia coli CFT073
gcgugguaucacguagccacg

SEQ ID NO: 593982 - RNA, 21 nt, Escherichia coli CFT073
gcguggcguugcggcugccca

SEQ ID NO: 593983 - RNA, 18 nt, Escherichia coli CFT073
gcgugcaggaacaggcga

SEQ ID NO: 593984 - RNA, 14 nt, Escherichia coli CFT073
gcgugcaauaucaa

SEQ ID NO: 593985 - RNA, 16 nt, Escherichia coli CFT073
gcgucgcaucaggcaa

SEQ ID NO: 593986 - RNA, 13 nt, Escherichia coli CFT073
gcgucgcauccga

SEQ ID NO: 593987 - RNA, 16 nt, Escherichia coli CFT073
gcgucgcauccggcau

SEQ ID NO: 593988 - RNA, 15 nt, Escherichia coli CFT073
gcgucggcgguuucc

SEQ ID NO: 593989 - RNA, 18 nt, Escherichia coli CFT073
gcguccgggaaauccuca

SEQ ID NO: 593990 - RNA, 22 nt, Escherichia coli CFT073
gcguaaacgccuuaucaggcca

SEQ ID NO: 593991 - RNA, 15 nt, Escherichia coli CFT073
gcguaaauccagcac

SEQ ID NO: 593992 - RNA, 22 nt, Escherichia coli CFT073
gcguaaccaaugccacccagcg

SEQ ID NO: 593993 - RNA, 15 nt, Escherichia coli CFT073
gcguaacgcaccagg

SEQ ID NO: 593994 - RNA, 20 nt, Escherichia coli CFT073
gcguaacgcaccaggcgaaa

SEQ ID NO: 593995 - RNA, 16 nt, Escherichia coli CFT073
gcgguuucuuuauccg

SEQ ID NO: 593996 - RNA, 13 nt, Escherichia coli CFT073
gcucaacaucgcg

SEQ ID NO: 593997 - RNA, 13 nt, Escherichia coli CFT073
gcuauuaacccgc

SEQ ID NO: 593998 - RNA, 19 nt, Escherichia coli CFT073
gcuauuacgccagccuuuc

SEQ ID NO: 593999 - RNA, 15 nt, Escherichia coli CFT073
gcuauucccgcaaaa

SEQ ID NO: 594000 - RNA, 16 nt, Escherichia coli CFT073
gcuauugaccagcgcc

SEQ ID NO: 594001 - RNA, 18 nt, Escherichia coli CFT073
gcuauuuaccgcuacugc

SEQ ID NO: 594002 - RNA, 21 nt, Escherichia coli CFT073
gcuauuuaccgcuacugcguc

SEQ ID NO: 594003 - RNA, 23 nt, Escherichia coli CFT073
gcuauuucccccucccccuuuac

SEQ ID NO: 594004 - RNA, 15 nt, Escherichia coli CFT073
gcucacacaaacggc

SEQ ID NO: 594005 - RNA, 16 nt, Escherichia coli CFT073
gcucaaugaaacgcaa

SEQ ID NO: 594006 - RNA, 17 nt, Escherichia coli CFT073
gcucaagcugaccgaua

SEQ ID NO: 594007 - RNA, 16 nt, Escherichia coli CFT073
gcucacccccaucagc

SEQ ID NO: 594008 - RNA, 18 nt, Escherichia coli CFT073
gcuauaccagauaaacau

SEQ ID NO: 594009 - RNA, 16 nt, Escherichia coli CFT073
gcuauaccgccaggca

SEQ ID NO: 594010 - RNA, 18 nt, Escherichia coli CFT073
gcuauacgccucacagag

SEQ ID NO: 594011 - RNA, 22 nt, Escherichia coli CFT073
gcuaguacaggcggcaauggcg

SEQ ID NO: 594012 - RNA, 17 nt, Escherichia coli CFT073
gcuauaaaaaaacggcg

SEQ ID NO: 594013 - RNA, 16 nt, Escherichia coli CFT073
gcuagcgucgcauccg

SEQ ID NO: 594014 - RNA, 14 nt, Escherichia coli CFT073
gcuaucgaaaucaa

SEQ ID NO: 594015 - RNA, 22 nt, Escherichia coli CFT073
gcuaucgaaaucaaaguaccgg

SEQ ID NO: 594016 - RNA, 20 nt, Escherichia coli CFT073
gcuauaucgcugauaucaaa

SEQ ID NO: 594017 - RNA, 17 nt, Escherichia coli CFT073
gcuacgguugucuuggc

SEQ ID NO: 594018 - RNA, 13 nt, Escherichia coli CFT073
gcuacgugccggg

SEQ ID NO: 594019 - RNA, 17 nt, Escherichia coli CFT073
gcuacgugccgggcaaa

SEQ ID NO: 594020 - RNA, 17 nt, Escherichia coli CFT073
gcuaccggucucagccc

SEQ ID NO: 594021 - RNA, 18 nt, Escherichia coli CFT073
gcuaccguuucaacuucu

SEQ ID NO: 594022 - RNA, 18 nt, Escherichia coli CFT073
gcguugauuggcgcaggu

SEQ ID NO: 594023 - RNA, 20 nt, Escherichia coli CFT073
gcuaccaugcuaauaaucag

SEQ ID NO: 594024 - RNA, 15 nt, Escherichia coli CFT073
gcuacccuggcgagc

SEQ ID NO: 594025 - RNA, 21 nt, Escherichia coli CFT073
gcuacccuggcgagcagcaau

SEQ ID NO: 594026 - RNA, 21 nt, Escherichia coli CFT073
gcuaccgcccugagcaucaau

SEQ ID NO: 594027 - RNA, 22 nt, Escherichia coli CFT073
gcguugauuagcagagcguuua

SEQ ID NO: 594028 - RNA, 15 nt, Escherichia coli CFT073
gcguugauugccgga

SEQ ID NO: 594029 - RNA, 16 nt, Escherichia coli CFT073
gcguugauugccggau

SEQ ID NO: 594030 - RNA, 15 nt, Escherichia coli CFT073
gcguugauuggcgca

SEQ ID NO: 594031 - RNA, 17 nt, Escherichia coli CFT073
gcguugcacgugcuuau

SEQ ID NO: 594032 - RNA, 13 nt, Escherichia coli CFT073
gcguugcagagag

SEQ ID NO: 594033 - RNA, 13 nt, Escherichia coli CFT073
gcucacugauaau

SEQ ID NO: 594034 - RNA, 18 nt, Escherichia coli CFT073
gcucacuuuguaggccug

SEQ ID NO: 594035 - RNA, 21 nt, Escherichia coli CFT073
gcucacuuuguaggccugaua

SEQ ID NO: 594036 - RNA, 15 nt, Escherichia coli CFT073
gcucagcaaucgcau

SEQ ID NO: 594037 - RNA, 15 nt, Escherichia coli CFT073
gcucacgcagcuucu

SEQ ID NO: 594038 - RNA, 14 nt, Escherichia coli CFT073
gcucacgcaucaac

SEQ ID NO: 594039 - RNA, 17 nt, Escherichia coli CFT073
gcucacgcagcggcggc

SEQ ID NO: 594040 - RNA, 15 nt, Escherichia coli CFT073
gcucaccugauacgc

SEQ ID NO: 594041 - RNA, 11 nt, Escherichia coli CFT073
gcucaggcggu

SEQ ID NO: 594042 - RNA, 22 nt, Escherichia coli CFT073
gcuccagauagagccgguuuug

SEQ ID NO: 594043 - RNA, 17 nt, Escherichia coli CFT073
gcuccagaauuccgugc

SEQ ID NO: 594044 - RNA, 12 nt, Escherichia coli CFT073
gcuccagcagcu

SEQ ID NO: 594045 - RNA, 17 nt, Escherichia coli CFT073
gcucaucugcugcguuu

SEQ ID NO: 594046 - RNA, 23 nt, Escherichia coli CFT073
gcucaucggcauacagcgacaga

SEQ ID NO: 594047 - RNA, 20 nt, Escherichia coli CFT073
gcucaucaccgcaaagucgg

SEQ ID NO: 594048 - RNA, 13 nt, Escherichia coli CFT073
gcucauaggccug

SEQ ID NO: 594049 - RNA, 21 nt, Escherichia coli CFT073
gcucaguugguagagcacgac

SEQ ID NO: 594050 - RNA, 22 nt, Escherichia coli CFT073
gcucaguugguagagcacgacc

SEQ ID NO: 594051 - RNA, 14 nt, Escherichia coli CFT073
gcucaguuucgcgu

SEQ ID NO: 594052 - RNA, 20 nt, Escherichia coli CFT073
gcucauaaaaucacgcgccu

SEQ ID NO: 594053 - RNA, 18 nt, Escherichia coli CFT073
gcucaguuuauagaacgg

SEQ ID NO: 594054 - RNA, 15 nt, Escherichia coli CFT073
gcucauaaccgucca

SEQ ID NO: 594055 - RNA, 20 nt, Escherichia coli CFT073
ggauacgcugacgugcugca

SEQ ID NO: 594056 - RNA, 16 nt, Escherichia coli CFT073
ggauaagacgcgccag

SEQ ID NO: 594057 - RNA, 16 nt, Escherichia coli CFT073
ggauaagacgcgucag

SEQ ID NO: 594058 - RNA, 20 nt, Escherichia coli CFT073
ggaguggggcggugaugcgg

SEQ ID NO: 594059 - RNA, 14 nt, Escherichia coli CFT073
ggaguaaacggcag

SEQ ID NO: 594060 - RNA, 20 nt, Escherichia coli CFT073
ggaguagauaauaaaacgcg

SEQ ID NO: 594061 - RNA, 15 nt, Escherichia coli CFT073
ggaggagugcgccag

SEQ ID NO: 594062 - RNA, 19 nt, Escherichia coli CFT073
ggagcugccaggccgcauc

SEQ ID NO: 594063 - RNA, 13 nt, Escherichia coli CFT073
ggacgcccgccga

SEQ ID NO: 594064 - RNA, 18 nt, Escherichia coli CFT073
ggacgacggcaucgccau

SEQ ID NO: 594065 - RNA, 21 nt, Escherichia coli CFT073
ggagcggaauugcgcaacaga

SEQ ID NO: 594066 - RNA, 20 nt, Escherichia coli CFT073
ggagccugauccauacucuu

SEQ ID NO: 594067 - RNA, 15 nt, Escherichia coli CFT073
ggagcgauuaugaaa

SEQ ID NO: 594068 - RNA, 15 nt, Escherichia coli CFT073
ggagccaaaaucaaa

SEQ ID NO: 594069 - RNA, 23 nt, Escherichia coli CFT073
ggagccauugcccgaugcgcaag

SEQ ID NO: 594070 - RNA, 22 nt, Escherichia coli CFT073
ggagcagagcauucccgccauc

SEQ ID NO: 594071 - RNA, 19 nt, Escherichia coli CFT073
ggaucagguguuacgccgc

SEQ ID NO: 594072 - RNA, 12 nt, Escherichia coli CFT073
ggauccacgcca

SEQ ID NO: 594073 - RNA, 21 nt, Escherichia coli CFT073
ggauccacaccugacgaugcg

SEQ ID NO: 594074 - RNA, 15 nt, Escherichia coli CFT073
ggaucagaccgccaa

SEQ ID NO: 594075 - RNA, 21 nt, Escherichia coli CFT073
ggaucagaccgccaaucagca

SEQ ID NO: 594076 - RNA, 18 nt, Escherichia coli CFT073
ggauauuuauauuuugcg

SEQ ID NO: 594077 - RNA, 17 nt, Escherichia coli CFT073
ggauaucuaaugccauu

SEQ ID NO: 594078 - RNA, 17 nt, Escherichia coli CFT073
ggauagagcgcugcgca

SEQ ID NO: 594079 - RNA, 14 nt, Escherichia coli CFT073
ggauaucaccguaa

SEQ ID NO: 594080 - RNA, 20 nt, Escherichia coli CFT073
ggaucaccaguccaucggca

SEQ ID NO: 594081 - RNA, 15 nt, Escherichia coli CFT073
ggaucgaccgguucg

SEQ ID NO: 594082 - RNA, 22 nt, Escherichia coli CFT073
ggaucuccacaagcauauggau

SEQ ID NO: 594083 - RNA, 16 nt, Escherichia coli CFT073
ggaucggucagcgagc

SEQ ID NO: 594084 - RNA, 15 nt, Escherichia coli CFT073
ggaugaucauccggc

SEQ ID NO: 594085 - RNA, 15 nt, Escherichia coli CFT073
ggaugauuccgcaga

SEQ ID NO: 594086 - RNA, 15 nt, Escherichia coli CFT073
ggaugacguuucgcg

SEQ ID NO: 594087 - RNA, 16 nt, Escherichia coli CFT073
ggaucuuucaggaaca

SEQ ID NO: 594088 - RNA, 23 nt, Escherichia coli CFT073
ggaucuuccaguucuuccgccag

SEQ ID NO: 594089 - RNA, 20 nt, Escherichia coli CFT073
ggaugggcugccagcucauc

SEQ ID NO: 594090 - RNA, 17 nt, Escherichia coli CFT073
ggauggaugcccccaga

SEQ ID NO: 594091 - RNA, 19 nt, Escherichia coli CFT073
ggaugcguuuuucggucag

SEQ ID NO: 594092 - RNA, 14 nt, Escherichia coli CFT073
ggaugcgccgucag

SEQ ID NO: 594093 - RNA, 23 nt, Escherichia coli CFT073
ggaugcggcgaaaacgccucauc

SEQ ID NO: 594094 - RNA, 14 nt, Escherichia coli CFT073
ggaugcggcgcuga

SEQ ID NO: 594095 - RNA, 12 nt, Escherichia coli CFT073
ggaugcggcgug

SEQ ID NO: 594096 - RNA, 19 nt, Escherichia coli CFT073
ggaugcgauguucccccag

SEQ ID NO: 594097 - RNA, 22 nt, Escherichia coli CFT073
ggaugccguuaauaauaaacug

SEQ ID NO: 594098 - RNA, 15 nt, Escherichia coli CFT073
ggaugccugaugcga

SEQ ID NO: 594099 - RNA, 16 nt, Escherichia coli CFT073
ggaugcccccagacgc

SEQ ID NO: 594100 - RNA, 12 nt, Escherichia coli CFT073
gcuuggcagagc

SEQ ID NO: 594101 - RNA, 16 nt, Escherichia coli CFT073
gcuuguaaaacagcca

SEQ ID NO: 594102 - RNA, 21 nt, Escherichia coli CFT073
gcuugucauuaccacaacaaa

SEQ ID NO: 594103 - RNA, 16 nt, Escherichia coli CFT073
gcuuucaaugccugau

SEQ ID NO: 594104 - RNA, 17 nt, Escherichia coli CFT073
gcuuucaccgccugauc

SEQ ID NO: 594105 - RNA, 20 nt, Escherichia coli CFT073
gcuuuuacggcuuuggcggu

SEQ ID NO: 594106 - RNA, 23 nt, Escherichia coli CFT073
gcuuucagcacuuaucucuuccg

SEQ ID NO: 594107 - RNA, 22 nt, Escherichia coli CFT073
gcuuuuucugcacacacacgcc

SEQ ID NO: 594108 - RNA, 20 nt, Escherichia coli CFT073
gcuuuuucugcaucaaccag

SEQ ID NO: 594109 - RNA, 19 nt, Escherichia coli CFT073
gcuuuuuuaauguggcugg

SEQ ID NO: 594110 - RNA, 18 nt, Escherichia coli CFT073
gcuuuuuuacgccugcaa

SEQ ID NO: 594111 - RNA, 13 nt, Escherichia coli CFT073
gcuuuuggcgcgu

SEQ ID NO: 594112 - RNA, 22 nt, Escherichia coli CFT073
gcuuuugcaaacaacgcuucaa

SEQ ID NO: 594113 - RNA, 17 nt, Escherichia coli CFT073
gcuuuugcggucgccuu

SEQ ID NO: 594114 - RNA, 14 nt, Escherichia coli CFT073
gcuuuuagcgacaa

SEQ ID NO: 594115 - RNA, 19 nt, Escherichia coli CFT073
gcuguuuguucaagcgcaa

SEQ ID NO: 594116 - RNA, 21 nt, Escherichia coli CFT073
gcuguugccgccgcgugcaau

SEQ ID NO: 594117 - RNA, 22 nt, Escherichia coli CFT073
gcuugcaggaucagcuccggca

SEQ ID NO: 594118 - RNA, 22 nt, Escherichia coli CFT073
gcuugcgcaucgggcgauucga

SEQ ID NO: 594119 - RNA, 14 nt, Escherichia coli CFT073
gcuugcgcggcagc

SEQ ID NO: 594120 - RNA, 18 nt, Escherichia coli CFT073
ggaaccugugacagcagc

SEQ ID NO: 594121 - RNA, 16 nt, Escherichia coli CFT073
ggaaccuguucaacaa

SEQ ID NO: 594122 - RNA, 19 nt, Escherichia coli CFT073
gcuuuuugugggccugaua

SEQ ID NO: 594123 - RNA, 22 nt, Escherichia coli CFT073
gcuuuuuuauugcugcaccagc

SEQ ID NO: 594124 - RNA, 11 nt, Escherichia coli CFT073
ggaaaaaagcc

SEQ ID NO: 594125 - RNA, 16 nt, Escherichia coli CFT073
ggaaaacaaccgccau

SEQ ID NO: 594126 - RNA, 19 nt, Escherichia coli CFT073
ggaaugaccgcuaauagcg

SEQ ID NO: 594127 - RNA, 16 nt, Escherichia coli CFT073
ggaaucuuuaaugacu

SEQ ID NO: 594128 - RNA, 19 nt, Escherichia coli CFT073
ggaaucccaucgcagaaac

SEQ ID NO: 594129 - RNA, 16 nt, Escherichia coli CFT073
ggaccaaagaaugaca

SEQ ID NO: 594130 - RNA, 15 nt, Escherichia coli CFT073
gcugauugcggucag

SEQ ID NO: 594131 - RNA, 23 nt, Escherichia coli CFT073
gcugauuacccacgccaacaaua

SEQ ID NO: 594132 - RNA, 21 nt, Escherichia coli CFT073
gcugacggugccagguaaaca

SEQ ID NO: 594133 - RNA, 21 nt, Escherichia coli CFT073
gcugacggugauaaucauccc

SEQ ID NO: 594134 - RNA, 19 nt, Escherichia coli CFT073
gcugacgccugccagcucu

SEQ ID NO: 594135 - RNA, 23 nt, Escherichia coli CFT073
gcugaauaauggugaauuugucg

SEQ ID NO: 594136 - RNA, 21 nt, Escherichia coli CFT073
gcugaauaucuuucucgcggc

SEQ ID NO: 594137 - RNA, 13 nt, Escherichia coli CFT073
gcugaaauaucau

SEQ ID NO: 594138 - RNA, 19 nt, Escherichia coli CFT073
gcucuuucucgcucaguuu

SEQ ID NO: 594139 - RNA, 22 nt, Escherichia coli CFT073
gcugcaucucuuugcuguugau

SEQ ID NO: 594140 - RNA, 15 nt, Escherichia coli CFT073
gcugcacuuucagua

SEQ ID NO: 594141 - RNA, 14 nt, Escherichia coli CFT073
gcugccagaaaucg

SEQ ID NO: 594142 - RNA, 16 nt, Escherichia coli CFT073
gcucugggaucgccgg

SEQ ID NO: 594143 - RNA, 14 nt, Escherichia coli CFT073
gcucuggcagcacc

SEQ ID NO: 594144 - RNA, 12 nt, Escherichia coli CFT073
gcucuggcaggc

SEQ ID NO: 594145 - RNA, 17 nt, Escherichia coli CFT073
gcucuucaugcagcaua

SEQ ID NO: 594146 - RNA, 14 nt, Escherichia coli CFT073
gcucucuucaucgu

SEQ ID NO: 594147 - RNA, 19 nt, Escherichia coli CFT073
gcucucuuucaccagcgcg

SEQ ID NO: 594148 - RNA, 14 nt, Escherichia coli CFT073
gcucugcgguaucg

SEQ ID NO: 594149 - RNA, 15 nt, Escherichia coli CFT073
gcucgucgcgacgac

SEQ ID NO: 594150 - RNA, 15 nt, Escherichia coli CFT073
gcucgucauccgcua

SEQ ID NO: 594151 - RNA, 19 nt, Escherichia coli CFT073
gcucgucacaucaccaaca

SEQ ID NO: 594152 - RNA, 21 nt, Escherichia coli CFT073
gcucguagaagccagagaaca

SEQ ID NO: 594153 - RNA, 15 nt, Escherichia coli CFT073
gcucggucacugaca

SEQ ID NO: 594154 - RNA, 16 nt, Escherichia coli CFT073
gcucggucacugacac

SEQ ID NO: 594155 - RNA, 22 nt, Escherichia coli CFT073
gcuccaguaccugcaaaccgua

SEQ ID NO: 594156 - RNA, 15 nt, Escherichia coli CFT073
gcucggcaaacugcu

SEQ ID NO: 594157 - RNA, 14 nt, Escherichia coli CFT073
gcugucaauugaga

SEQ ID NO: 594158 - RNA, 20 nt, Escherichia coli CFT073
gcugucaccaaucagguaag

SEQ ID NO: 594159 - RNA, 18 nt, Escherichia coli CFT073
gcugucggaauaagggau

SEQ ID NO: 594160 - RNA, 20 nt, Escherichia coli CFT073
gcugucggcaagauacugca

SEQ ID NO: 594161 - RNA, 15 nt, Escherichia coli CFT073
gcugucauucauuca

SEQ ID NO: 594162 - RNA, 16 nt, Escherichia coli CFT073
gcugucgcgcagcacu

SEQ ID NO: 594163 - RNA, 15 nt, Escherichia coli CFT073
gcugugcgauagcaa

SEQ ID NO: 594164 - RNA, 14 nt, Escherichia coli CFT073
gcugugccuccugc

SEQ ID NO: 594165 - RNA, 17 nt, Escherichia coli CFT073
gcugugccagcuccaca

SEQ ID NO: 594166 - RNA, 18 nt, Escherichia coli CFT073
gcugguggaacagcugca

SEQ ID NO: 594167 - RNA, 17 nt, Escherichia coli CFT073
gcuggggccaucgccgc

SEQ ID NO: 594168 - RNA, 15 nt, Escherichia coli CFT073
gcuggcgagugcauc

SEQ ID NO: 594169 - RNA, 14 nt, Escherichia coli CFT073
gcuggccuccagca

SEQ ID NO: 594170 - RNA, 19 nt, Escherichia coli CFT073
gcugggcuucaccaccaga

SEQ ID NO: 594171 - RNA, 15 nt, Escherichia coli CFT073
gcugggcgcguucgg

SEQ ID NO: 594172 - RNA, 14 nt, Escherichia coli CFT073
gcugggcgauuucg

SEQ ID NO: 594173 - RNA, 18 nt, Escherichia coli CFT073
gcugggccaucaggcgac

SEQ ID NO: 594174 - RNA, 13 nt, Escherichia coli CFT073
gcuggcguagcca

SEQ ID NO: 594175 - RNA, 16 nt, Escherichia coli CFT073
gcuggcguagagaucc

SEQ ID NO: 594176 - RNA, 12 nt, Escherichia coli CFT073
gcugcuuucgcc

SEQ ID NO: 594177 - RNA, 18 nt, Escherichia coli CFT073
gcugcuucggucagcacg

SEQ ID NO: 594178 - RNA, 17 nt, Escherichia coli CFT073
gcugcuggagcagguga

SEQ ID NO: 594179 - RNA, 20 nt, Escherichia coli CFT073
gcuggaaaggccgcgaacca

SEQ ID NO: 594180 - RNA, 22 nt, Escherichia coli CFT073
gcugcuccugcgacugcauuug

SEQ ID NO: 594181 - RNA, 12 nt, Escherichia coli CFT073
gcugcuccagcg

SEQ ID NO: 594182 - RNA, 20 nt, Escherichia coli CFT073
gcuggcaaguucgucuuccg

SEQ ID NO: 594183 - RNA, 20 nt, Escherichia coli CFT073
gcuggcagaugcgucuucug

SEQ ID NO: 594184 - RNA, 19 nt, Escherichia coli CFT073
gcuggcagccccguucgcg

SEQ ID NO: 594185 - RNA, 17 nt, Escherichia coli CFT073
gcuggcaacccagcguu

SEQ ID NO: 594186 - RNA, 19 nt, Escherichia coli CFT073
gcuggacugagcaaucugg

SEQ ID NO: 594187 - RNA, 21 nt, Escherichia coli CFT073
gcuggcauuuuuuauggcuga

SEQ ID NO: 594188 - RNA, 19 nt, Escherichia coli CFT073
ucgccaugaugagcgccau

SEQ ID NO: 594189 - RNA, 21 nt, Escherichia coli CFT073
ucgccagugcguugugcgcca

SEQ ID NO: 594190 - RNA, 14 nt, Escherichia coli CFT073
ucgccaguccuuca

SEQ ID NO: 594191 - RNA, 18 nt, Escherichia coli CFT073
ucgccauccugauagcuu

SEQ ID NO: 594192 - RNA, 20 nt, Escherichia coli CFT073
ucgcccagccaucgacacca

SEQ ID NO: 594193 - RNA, 16 nt, Escherichia coli CFT073
ucgccaguaccagcag

SEQ ID NO: 594194 - RNA, 21 nt, Escherichia coli CFT073
ucgcacgccacgccgaaccau

SEQ ID NO: 594195 - RNA, 19 nt, Escherichia coli CFT073
ucgcacuuuucccacuaac

SEQ ID NO: 594196 - RNA, 18 nt, Escherichia coli CFT073
ucgccgaaauuucgccgc

SEQ ID NO: 594197 - RNA, 16 nt, Escherichia coli CFT073
ucgcccggcguggugc

SEQ ID NO: 594198 - RNA, 22 nt, Escherichia coli CFT073
ucgcccgcuggcgacggcuacg

SEQ ID NO: 594199 - RNA, 14 nt, Escherichia coli CFT073
ucgcccgccgcuaa

SEQ ID NO: 594200 - RNA, 13 nt, Escherichia coli CFT073
ucgccgccagcgg

SEQ ID NO: 594201 - RNA, 19 nt, Escherichia coli CFT073
ucgccgcagguagcagcag

SEQ ID NO: 594202 - RNA, 15 nt, Escherichia coli CFT073
ucgccgcaucgucac

SEQ ID NO: 594203 - RNA, 14 nt, Escherichia coli CFT073
ucgccgcagccaga

SEQ ID NO: 594204 - RNA, 17 nt, Escherichia coli CFT073
ucgccgcacccgccaga

SEQ ID NO: 594205 - RNA, 17 nt, Escherichia coli CFT073
ucgccggcgugauaucc

SEQ ID NO: 594206 - RNA, 21 nt, Escherichia coli CFT073
ucgccgggauauaugucacca

SEQ ID NO: 594207 - RNA, 15 nt, Escherichia coli CFT073
ucgcgcucaucaggu

SEQ ID NO: 594208 - RNA, 14 nt, Escherichia coli CFT073
ucgcgcuccggcac

SEQ ID NO: 594209 - RNA, 17 nt, Escherichia coli CFT073
ucgcggaauauccagua

SEQ ID NO: 594210 - RNA, 21 nt, Escherichia coli CFT073
ucgcggcugacguaaucauga

SEQ ID NO: 594211 - RNA, 18 nt, Escherichia coli CFT073
ucgccgucaaaaggcgug

SEQ ID NO: 594212 - RNA, 15 nt, Escherichia coli CFT073
ucggauaaccaauca

SEQ ID NO: 594213 - RNA, 18 nt, Escherichia coli CFT073
ucggauaaccaaucacgu

SEQ ID NO: 594214 - RNA, 14 nt, Escherichia coli CFT073
ucggauaaggcuuc

SEQ ID NO: 594215 - RNA, 15 nt, Escherichia coli CFT073
ucgcuguguucuggg

SEQ ID NO: 594216 - RNA, 16 nt, Escherichia coli CFT073
ucgcugugacauccag

SEQ ID NO: 594217 - RNA, 21 nt, Escherichia coli CFT073
ucgcuggauguuggcggcaac

SEQ ID NO: 594218 - RNA, 17 nt, Escherichia coli CFT073
ucgcgggaaaaaguacu

SEQ ID NO: 594219 - RNA, 20 nt, Escherichia coli CFT073
ucgcugacgaucauuccgcc

SEQ ID NO: 594220 - RNA, 23 nt, Escherichia coli CFT073
ucggcaaaaauaaucucaccauu

SEQ ID NO: 594221 - RNA, 17 nt, Escherichia coli CFT073
ucggcagcgccaaucgc

SEQ ID NO: 594222 - RNA, 19 nt, Escherichia coli CFT073
ucggcagccugcgucgcca

SEQ ID NO: 594223 - RNA, 19 nt, Escherichia coli CFT073
ucggcaggguauugcgcgc

SEQ ID NO: 594224 - RNA, 11 nt, Escherichia coli CFT073
ucggcaguuuu

SEQ ID NO: 594225 - RNA, 16 nt, Escherichia coli CFT073
ucggcauauaccguca

SEQ ID NO: 594226 - RNA, 21 nt, Escherichia coli CFT073
ucggcauauaccgucagcguc

SEQ ID NO: 594227 - RNA, 22 nt, Escherichia coli CFT073
ucggcauauaccgucagcgucu

SEQ ID NO: 594228 - RNA, 14 nt, Escherichia coli CFT073
ucggcaucaauaaa

SEQ ID NO: 594229 - RNA, 21 nt, Escherichia coli CFT073
ucggcaucaauaaagccggua

SEQ ID NO: 594230 - RNA, 15 nt, Escherichia coli CFT073
ucggcccguguccca

SEQ ID NO: 594231 - RNA, 12 nt, Escherichia coli CFT073
ucggcgcuucaa

SEQ ID NO: 594232 - RNA, 19 nt, Escherichia coli CFT073
ucggcuacgaaccgagcgg

SEQ ID NO: 594233 - RNA, 11 nt, Escherichia coli CFT073
ucggcgucgcc

SEQ ID NO: 594234 - RNA, 15 nt, Escherichia coli CFT073
ucggcgucgguuucg

SEQ ID NO: 594235 - RNA, 18 nt, Escherichia coli CFT073
ucggcgucauuuugucga

SEQ ID NO: 594236 - RNA, 18 nt, Escherichia coli CFT073
ucggcggugacuagcagc

SEQ ID NO: 594237 - RNA, 19 nt, Escherichia coli CFT073
uccguguuguacggcaaua

SEQ ID NO: 594238 - RNA, 18 nt, Escherichia coli CFT073
uccgugcuggcugcgcuu

SEQ ID NO: 594239 - RNA, 16 nt, Escherichia coli CFT073
uccgugcauuccagca

SEQ ID NO: 594240 - RNA, 20 nt, Escherichia coli CFT073
uccgugaagcucacuucgcu

SEQ ID NO: 594241 - RNA, 22 nt, Escherichia coli CFT073
uccgggauugagauuucaccaa

SEQ ID NO: 594242 - RNA, 14 nt, Escherichia coli CFT073
uccgggaucaccag

SEQ ID NO: 594243 - RNA, 16 nt, Escherichia coli CFT073
uccucaaucggaaaac

SEQ ID NO: 594244 - RNA, 20 nt, Escherichia coli CFT073
uccucaaacgugcggcaggc

SEQ ID NO: 594245 - RNA, 17 nt, Escherichia coli CFT073
uccucauuucauugucc

SEQ ID NO: 594246 - RNA, 22 nt, Escherichia coli CFT073
uccggcauaaacacaggcacuu

SEQ ID NO: 594247 - RNA, 16 nt, Escherichia coli CFT073
uccggcauacauuuau

SEQ ID NO: 594248 - RNA, 21 nt, Escherichia coli CFT073
uccggcaugauucauccguca

SEQ ID NO: 594249 - RNA, 19 nt, Escherichia coli CFT073
uccggcauuaaguggcgau

SEQ ID NO: 594250 - RNA, 17 nt, Escherichia coli CFT073
uccggcuuucacuugac

SEQ ID NO: 594251 - RNA, 14 nt, Escherichia coli CFT073
uccggcucauaucu

SEQ ID NO: 594252 - RNA, 12 nt, Escherichia coli CFT073
uccggcgcacug

SEQ ID NO: 594253 - RNA, 14 nt, Escherichia coli CFT073
uccgcuuucaacgc

SEQ ID NO: 594254 - RNA, 20 nt, Escherichia coli CFT073
uccggaagaugaaaaacgca

SEQ ID NO: 594255 - RNA, 20 nt, Escherichia coli CFT073
uccggacguucagccauacg

SEQ ID NO: 594256 - RNA, 14 nt, Escherichia coli CFT073
uccggacuggcauu

SEQ ID NO: 594257 - RNA, 20 nt, Escherichia coli CFT073
uccggaguaaugaaaccgaa

SEQ ID NO: 594258 - RNA, 21 nt, Escherichia coli CFT073
uccggagucaacaucucaaua

SEQ ID NO: 594259 - RNA, 13 nt, Escherichia coli CFT073
uccgcuuccgcug

SEQ ID NO: 594260 - RNA, 14 nt, Escherichia coli CFT073
uccgcuuccgcuga

SEQ ID NO: 594261 - RNA, 16 nt, Escherichia coli CFT073
uccgcgcacaggcggc

SEQ ID NO: 594262 - RNA, 17 nt, Escherichia coli CFT073
ucccaccaucagaccag

SEQ ID NO: 594263 - RNA, 18 nt, Escherichia coli CFT073
ucccacggauuaccguga

SEQ ID NO: 594264 - RNA, 17 nt, Escherichia coli CFT073
uccccuuucacauugau

SEQ ID NO: 594265 - RNA, 14 nt, Escherichia coli CFT073
ucccgagcggccaa

SEQ ID NO: 594266 - RNA, 16 nt, Escherichia coli CFT073
ucccgauaaccgcaaa

SEQ ID NO: 594267 - RNA, 16 nt, Escherichia coli CFT073
ucccgcccccgccagc

SEQ ID NO: 594268 - RNA, 22 nt, Escherichia coli CFT073
ucccgcccccgccagcgccauc

SEQ ID NO: 594269 - RNA, 18 nt, Escherichia coli CFT073
ucccgcauuccauugucc

SEQ ID NO: 594270 - RNA, 11 nt, Escherichia coli CFT073
ucccgccaacc

SEQ ID NO: 594271 - RNA, 15 nt, Escherichia coli CFT073
uccgacguuacgcgc

SEQ ID NO: 594272 - RNA, 21 nt, Escherichia coli CFT073
uccgaccuacacucggcaccc

SEQ ID NO: 594273 - RNA, 19 nt, Escherichia coli CFT073
ucccgguauaacuugccag

SEQ ID NO: 594274 - RNA, 22 nt, Escherichia coli CFT073
uccgagaaucgacaccaguuca

SEQ ID NO: 594275 - RNA, 19 nt, Escherichia coli CFT073
uccgaguagcucaccagca

SEQ ID NO: 594276 - RNA, 15 nt, Escherichia coli CFT073
uccgcacaaacgcca

SEQ ID NO: 594277 - RNA, 17 nt, Escherichia coli CFT073
uccgauuuguucucuuc

SEQ ID NO: 594278 - RNA, 18 nt, Escherichia coli CFT073
uccgcaugaguacgcggu

SEQ ID NO: 594279 - RNA, 19 nt, Escherichia coli CFT073
uccgccaaaacaucuucgg

SEQ ID NO: 594280 - RNA, 20 nt, Escherichia coli CFT073
uccgccaaauggauaagaaa

SEQ ID NO: 594281 - RNA, 18 nt, Escherichia coli CFT073
uccgccacgucaucagca

SEQ ID NO: 594282 - RNA, 12 nt, Escherichia coli CFT073
uccgccagaaua

SEQ ID NO: 594283 - RNA, 18 nt, Escherichia coli CFT073
uccgccauucagauugau

SEQ ID NO: 594284 - RNA, 14 nt, Escherichia coli CFT073
uccgcccacaccag

SEQ ID NO: 594285 - RNA, 22 nt, Escherichia coli CFT073
uccgccaugcugguuacuggaa

SEQ ID NO: 594286 - RNA, 17 nt, Escherichia coli CFT073
ucgaagauuacgccgau

SEQ ID NO: 594287 - RNA, 18 nt, Escherichia coli CFT073
ucgaaucuguucuggaaa

SEQ ID NO: 594288 - RNA, 13 nt, Escherichia coli CFT073
ucgaaguuuuccu

SEQ ID NO: 594289 - RNA, 17 nt, Escherichia coli CFT073
ucgaauaacuccgcgcc

SEQ ID NO: 594290 - RNA, 15 nt, Escherichia coli CFT073
ucgaacgccgccagu

SEQ ID NO: 594291 - RNA, 17 nt, Escherichia coli CFT073
uccuucacauccaucgc

SEQ ID NO: 594292 - RNA, 16 nt, Escherichia coli CFT073
uccuuccagcuccagc

SEQ ID NO: 594293 - RNA, 22 nt, Escherichia coli CFT073
ucgaaaccacaguucaaugcgc

SEQ ID NO: 594294 - RNA, 16 nt, Escherichia coli CFT073
uccuguuucacgccca

SEQ ID NO: 594295 - RNA, 17 nt, Escherichia coli CFT073
ucgacaaacuccgcgac

SEQ ID NO: 594296 - RNA, 21 nt, Escherichia coli CFT073
ucgacaauccagucagcgguu

SEQ ID NO: 594297 - RNA, 16 nt, Escherichia coli CFT073
ucgacaccaucgcuuc

SEQ ID NO: 594298 - RNA, 14 nt, Escherichia coli CFT073
ucgaccgacuuuag

SEQ ID NO: 594299 - RNA, 16 nt, Escherichia coli CFT073
ucgacauaauugacca

SEQ ID NO: 594300 - RNA, 22 nt, Escherichia coli CFT073
ucgacgcccagcgcggcagcgg

SEQ ID NO: 594301 - RNA, 13 nt, Escherichia coli CFT073
ucgauauuaucgu

SEQ ID NO: 594302 - RNA, 16 nt, Escherichia coli CFT073
ucgauauugacgaucu

SEQ ID NO: 594303 - RNA, 17 nt, Escherichia coli CFT073
ucgauagagaacgcgug

SEQ ID NO: 594304 - RNA, 15 nt, Escherichia coli CFT073
ucgauauacaccggc

SEQ ID NO: 594305 - RNA, 22 nt, Escherichia coli CFT073
ucgauaucaggcaaacagaauu

SEQ ID NO: 594306 - RNA, 22 nt, Escherichia coli CFT073
ucgauaagacauaacccagcga

SEQ ID NO: 594307 - RNA, 14 nt, Escherichia coli CFT073
ucgauaagccagca

SEQ ID NO: 594308 - RNA, 21 nt, Escherichia coli CFT073
ucgauaaucuucaaauaaacg

SEQ ID NO: 594309 - RNA, 18 nt, Escherichia coli CFT073
ucgauaccguccaccaga

SEQ ID NO: 594310 - RNA, 18 nt, Escherichia coli CFT073
ucgagcaguaauccagca

SEQ ID NO: 594311 - RNA, 19 nt, Escherichia coli CFT073
ucgauugcucaacaccguu

SEQ ID NO: 594312 - RNA, 13 nt, Escherichia coli CFT073
ucgauuaccgcca

SEQ ID NO: 594313 - RNA, 15 nt, Escherichia coli CFT073
ucgauuaccgccagc

SEQ ID NO: 594314 - RNA, 19 nt, Escherichia coli CFT073
ucgcaaacacccgacgugc

SEQ ID NO: 594315 - RNA, 17 nt, Escherichia coli CFT073
ucgcaaaccaaaccaaa

SEQ ID NO: 594316 - RNA, 21 nt, Escherichia coli CFT073
ucgauuuuauaaagggaugcc

SEQ ID NO: 594317 - RNA, 17 nt, Escherichia coli CFT073
ucgcaagccgaauaacg

SEQ ID NO: 594318 - RNA, 20 nt, Escherichia coli CFT073
ucgaugcggauacggcgcaa

SEQ ID NO: 594319 - RNA, 18 nt, Escherichia coli CFT073
ucgaugauuuccgccagc

SEQ ID NO: 594320 - RNA, 18 nt, Escherichia coli CFT073
ucgaugauaugcagacga

SEQ ID NO: 594321 - RNA, 19 nt, Escherichia coli CFT073
ucgaucaguuggcagagau

SEQ ID NO: 594322 - RNA, 17 nt, Escherichia coli CFT073
ugcaugauuagcacuuu

SEQ ID NO: 594323 - RNA, 16 nt, Escherichia coli CFT073
ugcauggcaacuuuaa

SEQ ID NO: 594324 - RNA, 21 nt, Escherichia coli CFT073
ugcauuaauauaaucgugguu

SEQ ID NO: 594325 - RNA, 16 nt, Escherichia coli CFT073
ugcaucgccugcgcga

SEQ ID NO: 594326 - RNA, 21 nt, Escherichia coli CFT073
ugcaucgguggcgauacuggc

SEQ ID NO: 594327 - RNA, 23 nt, Escherichia coli CFT073
ugcaucgguggcgauacuggcgu

SEQ ID NO: 594328 - RNA, 12 nt, Escherichia coli CFT073
ugcaucuccuga

SEQ ID NO: 594329 - RNA, 19 nt, Escherichia coli CFT073
ugcaucggcaaagcgcuga

SEQ ID NO: 594330 - RNA, 20 nt, Escherichia coli CFT073
ugcauugcgcugaacaucgu

SEQ ID NO: 594331 - RNA, 18 nt, Escherichia coli CFT073
ugcauuuuucgcuuuuca

SEQ ID NO: 594332 - RNA, 17 nt, Escherichia coli CFT073
ugccaaguccugccaga

SEQ ID NO: 594333 - RNA, 20 nt, Escherichia coli CFT073
ugccaaccaacgcgccgcaa

SEQ ID NO: 594334 - RNA, 21 nt, Escherichia coli CFT073
ugcagugaucgugugccacca

SEQ ID NO: 594335 - RNA, 22 nt, Escherichia coli CFT073
ugcaucacugacaucacgccac

SEQ ID NO: 594336 - RNA, 22 nt, Escherichia coli CFT073
ugcaucccggcaggaauaucga

SEQ ID NO: 594337 - RNA, 20 nt, Escherichia coli CFT073
ugcauccgauuguuccugcu

SEQ ID NO: 594338 - RNA, 14 nt, Escherichia coli CFT073
ugcaguaacugcug

SEQ ID NO: 594339 - RNA, 13 nt, Escherichia coli CFT073
ugcaguacgucga

SEQ ID NO: 594340 - RNA, 23 nt, Escherichia coli CFT073
ugcaggucguccugcaaagcuga

SEQ ID NO: 594341 - RNA, 20 nt, Escherichia coli CFT073
ugcaccugauccagcucuuc

SEQ ID NO: 594342 - RNA, 18 nt, Escherichia coli CFT073
ugcaccugcguugccgca

SEQ ID NO: 594343 - RNA, 13 nt, Escherichia coli CFT073
ugcaggcuggugg

SEQ ID NO: 594344 - RNA, 15 nt, Escherichia coli CFT073
ugcaggcuaaaaacg

SEQ ID NO: 594345 - RNA, 17 nt, Escherichia coli CFT073
ugcccaaucgagccacg

SEQ ID NO: 594346 - RNA, 22 nt, Escherichia coli CFT073
ugcccaaugcugguaauggcuu

SEQ ID NO: 594347 - RNA, 12 nt, Escherichia coli CFT073
ugccauugcucu

SEQ ID NO: 594348 - RNA, 20 nt, Escherichia coli CFT073
ugccaucaauaaucaccgaa

SEQ ID NO: 594349 - RNA, 21 nt, Escherichia coli CFT073
ugccaucaaucacuuugcgcu

SEQ ID NO: 594350 - RNA, 23 nt, Escherichia coli CFT073
ugccaucacggcagccugacgcc

SEQ ID NO: 594351 - RNA, 17 nt, Escherichia coli CFT073
ugccauauaugccaucg

SEQ ID NO: 594352 - RNA, 13 nt, Escherichia coli CFT073
ugcccauucccca

SEQ ID NO: 594353 - RNA, 16 nt, Escherichia coli CFT073
ugccccagacacaguu

SEQ ID NO: 594354 - RNA, 18 nt, Escherichia coli CFT073
ugccagucgcacgccugg

SEQ ID NO: 594355 - RNA, 14 nt, Escherichia coli CFT073
ugccaguaauaaag

SEQ ID NO: 594356 - RNA, 16 nt, Escherichia coli CFT073
ugccaggucgcuugcc

SEQ ID NO: 594357 - RNA, 22 nt, Escherichia coli CFT073
ugccaggucgcuugccgccagu

SEQ ID NO: 594358 - RNA, 20 nt, Escherichia coli CFT073
ugccaggucgugccagaaaa

SEQ ID NO: 594359 - RNA, 19 nt, Escherichia coli CFT073
ugccaggugaucccccugg

SEQ ID NO: 594360 - RNA, 14 nt, Escherichia coli CFT073
ugccaggccgauag

SEQ ID NO: 594361 - RNA, 13 nt, Escherichia coli CFT073
ugccaggaccacu

SEQ ID NO: 594362 - RNA, 15 nt, Escherichia coli CFT073
ugccaggaccauuca

SEQ ID NO: 594363 - RNA, 21 nt, Escherichia coli CFT073
ugccaccgguacaaacaucau

SEQ ID NO: 594364 - RNA, 13 nt, Escherichia coli CFT073
ugccaccagugcc

SEQ ID NO: 594365 - RNA, 17 nt, Escherichia coli CFT073
ugccaccagugccggaa

SEQ ID NO: 594366 - RNA, 15 nt, Escherichia coli CFT073
ugccaccauccccac

SEQ ID NO: 594367 - RNA, 17 nt, Escherichia coli CFT073
ugccaccaccagcguac

SEQ ID NO: 594368 - RNA, 12 nt, Escherichia coli CFT073
ugccaccagcac

SEQ ID NO: 594369 - RNA, 14 nt, Escherichia coli CFT073
ugccacccagcgag

SEQ ID NO: 594370 - RNA, 21 nt, Escherichia coli CFT073
ugccaaucuucacaucaucau

SEQ ID NO: 594371 - RNA, 22 nt, Escherichia coli CFT073
ugccaauugccuggugcccauc

SEQ ID NO: 594372 - RNA, 15 nt, Escherichia coli CFT073
ugccacaaacuggcu

SEQ ID NO: 594373 - RNA, 18 nt, Escherichia coli CFT073
ugccacauccagcggcag

SEQ ID NO: 594374 - RNA, 19 nt, Escherichia coli CFT073
ugccgauuucaaccacuca

SEQ ID NO: 594375 - RNA, 22 nt, Escherichia coli CFT073
ugccgcccguuuucuccagcgc

SEQ ID NO: 594376 - RNA, 14 nt, Escherichia coli CFT073
ugccgccaccacca

SEQ ID NO: 594377 - RNA, 15 nt, Escherichia coli CFT073
ugccgcaucagugau

SEQ ID NO: 594378 - RNA, 22 nt, Escherichia coli CFT073
ugccgcacuuacagcaacgccu

SEQ ID NO: 594379 - RNA, 22 nt, Escherichia coli CFT073
ugccgcacuuaaaaugcgcuca

SEQ ID NO: 594380 - RNA, 22 nt, Escherichia coli CFT073
ugccgcgcagcgaaacucgcug

SEQ ID NO: 594381 - RNA, 19 nt, Escherichia coli CFT073
ugcaauauuaugcguagcc

SEQ ID NO: 594382 - RNA, 15 nt, Escherichia coli CFT073
ugcaauggaauucgc

SEQ ID NO: 594383 - RNA, 18 nt, Escherichia coli CFT073
ugcaaucuuucgaguaaa

SEQ ID NO: 594384 - RNA, 18 nt, Escherichia coli CFT073
ugcaaugaaaaaccgugu

SEQ ID NO: 594385 - RNA, 21 nt, Escherichia coli CFT073
ugcaauuuccgcuuucaacgc

SEQ ID NO: 594386 - RNA, 22 nt, Escherichia coli CFT073
ugcaauguuaacuguuuaucgu

SEQ ID NO: 594387 - RNA, 21 nt, Escherichia coli CFT073
ugcaauuccugcgcgaaauag

SEQ ID NO: 594388 - RNA, 17 nt, Escherichia coli CFT073
ugcacagguaaacgcau

SEQ ID NO: 594389 - RNA, 22 nt, Escherichia coli CFT073
ugcacacggauaaacguggugc

SEQ ID NO: 594390 - RNA, 22 nt, Escherichia coli CFT073
ugcaccgacaauccaguugguu

SEQ ID NO: 594391 - RNA, 16 nt, Escherichia coli CFT073
ugcaacugugcggcaa

SEQ ID NO: 594392 - RNA, 15 nt, Escherichia coli CFT073
ugcaaccagaaaguc

SEQ ID NO: 594393 - RNA, 16 nt, Escherichia coli CFT073
ugcaaccuguaggccg

SEQ ID NO: 594394 - RNA, 18 nt, Escherichia coli CFT073
ugcaacguuuuaagcaaa

SEQ ID NO: 594395 - RNA, 14 nt, Escherichia coli CFT073
ugcaaaccguacaa

SEQ ID NO: 594396 - RNA, 13 nt, Escherichia coli CFT073
ugcaaagacaucg

SEQ ID NO: 594397 - RNA, 20 nt, Escherichia coli CFT073
ugcaaaagcaggagcaauuu

SEQ ID NO: 594398 - RNA, 13 nt, Escherichia coli CFT073
ugauuucaggaua

SEQ ID NO: 594399 - RNA, 12 nt, Escherichia coli CFT073
ugauuuccgccg

SEQ ID NO: 594400 - RNA, 12 nt, Escherichia coli CFT073
ugauuucgaacu

SEQ ID NO: 594401 - RNA, 17 nt, Escherichia coli CFT073
ugauuugcugccggaug

SEQ ID NO: 594402 - RNA, 12 nt, Escherichia coli CFT073
ugauuugcugga

SEQ ID NO: 594403 - RNA, 13 nt, Escherichia coli CFT073
ugauuugucugcc

SEQ ID NO: 594404 - RNA, 14 nt, Escherichia coli CFT073
ugaucauccggcuu

SEQ ID NO: 594405 - RNA, 22 nt, Escherichia coli CFT073
ugauccagcucuuccucgcucu

SEQ ID NO: 594406 - RNA, 19 nt, Escherichia coli CFT073
ugaucccccugggccaccu

SEQ ID NO: 594407 - RNA, 18 nt, Escherichia coli CFT073
ugaucccggcuuccugca

SEQ ID NO: 594408 - RNA, 18 nt, Escherichia coli CFT073
ugaucccuucgcuggcaa

SEQ ID NO: 594409 - RNA, 21 nt, Escherichia coli CFT073
ugauccucuauaaaagaggcg

SEQ ID NO: 594410 - RNA, 14 nt, Escherichia coli CFT073
ugaugcauccggca

SEQ ID NO: 594411 - RNA, 18 nt, Escherichia coli CFT073
ugaugccaaacgcaaaau

SEQ ID NO: 594412 - RNA, 16 nt, Escherichia coli CFT073
ugaugcaacuguuuua

SEQ ID NO: 594413 - RNA, 22 nt, Escherichia coli CFT073
ugaugcccggucgcuccggcua

SEQ ID NO: 594414 - RNA, 15 nt, Escherichia coli CFT073
ugauugccggaugcg

SEQ ID NO: 594415 - RNA, 16 nt, Escherichia coli CFT073
ugauuguuuguagccg

SEQ ID NO: 594416 - RNA, 12 nt, Escherichia coli CFT073
ugauuggcgcga

SEQ ID NO: 594417 - RNA, 23 nt, Escherichia coli CFT073
ugauuuacuuucuugccacuggc

SEQ ID NO: 594418 - RNA, 14 nt, Escherichia coli CFT073
ugauuccgcagaua

SEQ ID NO: 594419 - RNA, 21 nt, Escherichia coli CFT073
ugauugaaaaacaccucaucg

SEQ ID NO: 594420 - RNA, 17 nt, Escherichia coli CFT073
ugauugaccgccagcgc

SEQ ID NO: 594421 - RNA, 17 nt, Escherichia coli CFT073
ugauugacgcguucgcu

SEQ ID NO: 594422 - RNA, 16 nt, Escherichia coli CFT073
ugauuaucaugcccuu

SEQ ID NO: 594423 - RNA, 19 nt, Escherichia coli CFT073
ugauuauuuaggugccaac

SEQ ID NO: 594424 - RNA, 19 nt, Escherichia coli CFT073
ugauuauuucccucguuuu

SEQ ID NO: 594425 - RNA, 15 nt, Escherichia coli CFT073
ugauuacucauuaau

SEQ ID NO: 594426 - RNA, 18 nt, Escherichia coli CFT073
ugauuagucuuuaucugc

SEQ ID NO: 594427 - RNA, 21 nt, Escherichia coli CFT073
ugauuaaaucgaagcguacug

SEQ ID NO: 594428 - RNA, 17 nt, Escherichia coli CFT073
ugauuacccacgccaac

SEQ ID NO: 594429 - RNA, 18 nt, Escherichia coli CFT073
ugauuaccgcaaacucau

SEQ ID NO: 594430 - RNA, 16 nt, Escherichia coli CFT073
ugauuacgcaucaccc

SEQ ID NO: 594431 - RNA, 17 nt, Escherichia coli CFT073
ugaguaccgagaaaauc

SEQ ID NO: 594432 - RNA, 19 nt, Escherichia coli CFT073
ugagucgccgcaaucagcc

SEQ ID NO: 594433 - RNA, 18 nt, Escherichia coli CFT073
ugagugaggcguggcgcc

SEQ ID NO: 594434 - RNA, 16 nt, Escherichia coli CFT073
ugauaucgcuggcagg

SEQ ID NO: 594435 - RNA, 15 nt, Escherichia coli CFT073
ugauauccagccagg

SEQ ID NO: 594436 - RNA, 21 nt, Escherichia coli CFT073
ugauauccagguuacgcaugg

SEQ ID NO: 594437 - RNA, 20 nt, Escherichia coli CFT073
ugaucagcgaagcgcaucag

SEQ ID NO: 594438 - RNA, 22 nt, Escherichia coli CFT073
ugauaggucaugccaaccgcga

SEQ ID NO: 594439 - RNA, 12 nt, Escherichia coli CFT073
ugaguggcgcga

SEQ ID NO: 594440 - RNA, 15 nt, Escherichia coli CFT073
ugaguggcgcgcgcc

SEQ ID NO: 594441 - RNA, 14 nt, Escherichia coli CFT073
ugaguggucgacaa

SEQ ID NO: 594442 - RNA, 14 nt, Escherichia coli CFT073
ugaguguggccagu

SEQ ID NO: 594443 - RNA, 19 nt, Escherichia coli CFT073
ugagccgcuugugccacca

SEQ ID NO: 594444 - RNA, 23 nt, Escherichia coli CFT073
ugagccguaauccguaugacaaa

SEQ ID NO: 594445 - RNA, 20 nt, Escherichia coli CFT073
ugagcaugguaacgccccac

SEQ ID NO: 594446 - RNA, 16 nt, Escherichia coli CFT073
ugagccgccaccagaa

SEQ ID NO: 594447 - RNA, 19 nt, Escherichia coli CFT073
ugagggagcguccugcucg

SEQ ID NO: 594448 - RNA, 22 nt, Escherichia coli CFT073
ugagcuauguuugaaccagaua

SEQ ID NO: 594449 - RNA, 12 nt, Escherichia coli CFT073
ugagcuccagug

SEQ ID NO: 594450 - RNA, 18 nt, Escherichia coli CFT073
ugagcucgugcaucugaa

SEQ ID NO: 594451 - RNA, 16 nt, Escherichia coli CFT073
ugagaauugccggaug

SEQ ID NO: 594452 - RNA, 16 nt, Escherichia coli CFT073
ugagaucaaugcgcca

SEQ ID NO: 594453 - RNA, 20 nt, Escherichia coli CFT073
ugagacgcggcacuccgcca

SEQ ID NO: 594454 - RNA, 21 nt, Escherichia coli CFT073
ugagaacacgaccugccagag

SEQ ID NO: 594455 - RNA, 21 nt, Escherichia coli CFT073
ugagaaaauguauuucaucau

SEQ ID NO: 594456 - RNA, 13 nt, Escherichia coli CFT073
ugacuugccagcc

SEQ ID NO: 594457 - RNA, 22 nt, Escherichia coli CFT073
ugacuucagcgacgacuggcgc

SEQ ID NO: 594458 - RNA, 18 nt, Escherichia coli CFT073
ugagauuguuggucacaa

SEQ ID NO: 594459 - RNA, 23 nt, Escherichia coli CFT073
ugagcaacguugaacgcggaucg

SEQ ID NO: 594460 - RNA, 17 nt, Escherichia coli CFT073
ugagcaagagcaccgcu

SEQ ID NO: 594461 - RNA, 12 nt, Escherichia coli CFT073
ugagcacaucag

SEQ ID NO: 594462 - RNA, 23 nt, Escherichia coli CFT073
ugagcagcgauaucugccgagau

SEQ ID NO: 594463 - RNA, 14 nt, Escherichia coli CFT073
ugagcacgguuuug

SEQ ID NO: 594464 - RNA, 17 nt, Escherichia coli CFT073
ugacugaaccuucacgc

SEQ ID NO: 594465 - RNA, 20 nt, Escherichia coli CFT073
ugacugacuucaacaggaaa

SEQ ID NO: 594466 - RNA, 18 nt, Escherichia coli CFT073
ugacugauugccgauacc

SEQ ID NO: 594467 - RNA, 16 nt, Escherichia coli CFT073
ugacguacaccauuua

SEQ ID NO: 594468 - RNA, 18 nt, Escherichia coli CFT073
ugacgguuucucccgccu

SEQ ID NO: 594469 - RNA, 15 nt, Escherichia coli CFT073
ugacccagcgcgauc

SEQ ID NO: 594470 - RNA, 16 nt, Escherichia coli CFT073
ugaccccguaauuacg

SEQ ID NO: 594471 - RNA, 23 nt, Escherichia coli CFT073
ugaccaguaauauccccagccua

SEQ ID NO: 594472 - RNA, 17 nt, Escherichia coli CFT073
ugaccaguaccaccgcg

SEQ ID NO: 594473 - RNA, 14 nt, Escherichia coli CFT073
ugaccagugcagau

SEQ ID NO: 594474 - RNA, 21 nt, Escherichia coli CFT073
ugacauuaaguguccgccaau

SEQ ID NO: 594475 - RNA, 20 nt, Escherichia coli CFT073
ugacauuaaguguccgccaa

SEQ ID NO: 594476 - RNA, 13 nt, Escherichia coli CFT073
ugacaucaauacg

SEQ ID NO: 594477 - RNA, 16 nt, Escherichia coli CFT073
ugacauccauauccag

SEQ ID NO: 594478 - RNA, 13 nt, Escherichia coli CFT073
ugacauccccauc

SEQ ID NO: 594479 - RNA, 19 nt, Escherichia coli CFT073
ugacacuauucgccagcac

SEQ ID NO: 594480 - RNA, 15 nt, Escherichia coli CFT073
ugacagaccgccagu

SEQ ID NO: 594481 - RNA, 14 nt, Escherichia coli CFT073
ugacauaaacacca

SEQ ID NO: 594482 - RNA, 13 nt, Escherichia coli CFT073
ugaccaccgcagc

SEQ ID NO: 594483 - RNA, 22 nt, Escherichia coli CFT073
ugaccaauaacccguuguaaau

SEQ ID NO: 594484 - RNA, 11 nt, Escherichia coli CFT073
ugaaugccuga

SEQ ID NO: 594485 - RNA, 19 nt, Escherichia coli CFT073
ugaauuaacuuaucaagaa

SEQ ID NO: 594486 - RNA, 14 nt, Escherichia coli CFT073
ugaauugugauggu

SEQ ID NO: 594487 - RNA, 23 nt, Escherichia coli CFT073
ugaauuuaauugguuuugcaggc

SEQ ID NO: 594488 - RNA, 12 nt, Escherichia coli CFT073
ugaaugaggcuu

SEQ ID NO: 594489 - RNA, 20 nt, Escherichia coli CFT073
ugaauuuuaauauguugacu

SEQ ID NO: 594490 - RNA, 13 nt, Escherichia coli CFT073
ugaauuucgccgc

SEQ ID NO: 594491 - RNA, 23 nt, Escherichia coli CFT073
ugacaaacguauaauugccugau

SEQ ID NO: 594492 - RNA, 14 nt, Escherichia coli CFT073
ugacaaacucaccu

SEQ ID NO: 594493 - RNA, 14 nt, Escherichia coli CFT073
ugacaaucgccagu

SEQ ID NO: 594494 - RNA, 20 nt, Escherichia coli CFT073
ugacacggaacaacggcaaa

SEQ ID NO: 594495 - RNA, 21 nt, Escherichia coli CFT073
ugacacuaacagcaguacgcc

SEQ ID NO: 594496 - RNA, 21 nt, Escherichia coli CFT073
ugaagacagaccuggcgcuuc

SEQ ID NO: 594497 - RNA, 14 nt, Escherichia coli CFT073
ugaagacgccucgc

SEQ ID NO: 594498 - RNA, 15 nt, Escherichia coli CFT073
ugaagccauuaccga

SEQ ID NO: 594499 - RNA, 16 nt, Escherichia coli CFT073
ugaagccaccagcgcc

SEQ ID NO: 594500 - RNA, 15 nt, Escherichia coli CFT073
ugaagauuugcagau

SEQ ID NO: 594501 - RNA, 23 nt, Escherichia coli CFT073
ugaagauuugcagaucgcggccu

SEQ ID NO: 594502 - RNA, 22 nt, Escherichia coli CFT073
ugaagcaaugauaaguccgaug

SEQ ID NO: 594503 - RNA, 20 nt, Escherichia coli CFT073
ugaagcaguuucaccagcag

SEQ ID NO: 594504 - RNA, 20 nt, Escherichia coli CFT073
ugaacgccuuauccggccua

SEQ ID NO: 594505 - RNA, 20 nt, Escherichia coli CFT073
ugaacgccuucuccggccua

SEQ ID NO: 594506 - RNA, 20 nt, Escherichia coli CFT073
ugaacgccuuauccggucua

SEQ ID NO: 594507 - RNA, 21 nt, Escherichia coli CFT073
ugaacgcuggcggcaggccua

SEQ ID NO: 594508 - RNA, 16 nt, Escherichia coli CFT073
ugaacgugcaaaauca

SEQ ID NO: 594509 - RNA, 15 nt, Escherichia coli CFT073
ugaacuagaagagga

SEQ ID NO: 594510 - RNA, 16 nt, Escherichia coli CFT073
ugaacuguaggccgga

SEQ ID NO: 594511 - RNA, 13 nt, Escherichia coli CFT073
ugaaguggcugac

SEQ ID NO: 594512 - RNA, 22 nt, Escherichia coli CFT073
ugaaguggguaaugucacacca

SEQ ID NO: 594513 - RNA, 15 nt, Escherichia coli CFT073
ugaaguugaaaucac

SEQ ID NO: 594514 - RNA, 18 nt, Escherichia coli CFT073
ugaaguuuaaugucgcca

SEQ ID NO: 594515 - RNA, 22 nt, Escherichia coli CFT073
ugaauaaacgccauauucugau

SEQ ID NO: 594516 - RNA, 23 nt, Escherichia coli CFT073
ugaauaaucguucccgcggcgca

SEQ ID NO: 594517 - RNA, 14 nt, Escherichia coli CFT073
ugaauacacaucag

SEQ ID NO: 594518 - RNA, 18 nt, Escherichia coli CFT073
ugaaucaaaucaaccagg

SEQ ID NO: 594519 - RNA, 21 nt, Escherichia coli CFT073
ugaaucagcagauccaucgcc

SEQ ID NO: 594520 - RNA, 23 nt, Escherichia coli CFT073
ugaaucagucccugaaucgccac

SEQ ID NO: 594521 - RNA, 14 nt, Escherichia coli CFT073
ugaaucaucgcugu

SEQ ID NO: 594522 - RNA, 14 nt, Escherichia coli CFT073
ugaauacugcgcgu

SEQ ID NO: 594523 - RNA, 19 nt, Escherichia coli CFT073
ugaauaucuaauuauuacc

SEQ ID NO: 594524 - RNA, 18 nt, Escherichia coli CFT073
ugaagcugacaggcgcug

SEQ ID NO: 594525 - RNA, 15 nt, Escherichia coli CFT073
ugaaggaauuaaucc

SEQ ID NO: 594526 - RNA, 15 nt, Escherichia coli CFT073
ugaagggaugcugug

SEQ ID NO: 594527 - RNA, 15 nt, Escherichia coli CFT073
ugaaguauuaauguc

SEQ ID NO: 594528 - RNA, 14 nt, Escherichia coli CFT073
ugaagucauugaua

SEQ ID NO: 594529 - RNA, 15 nt, Escherichia coli CFT073
ucuucccgcgccagc

SEQ ID NO: 594530 - RNA, 19 nt, Escherichia coli CFT073
ucuucccguuuucaguccu

SEQ ID NO: 594531 - RNA, 19 nt, Escherichia coli CFT073
ucuguucagugauggcaca

SEQ ID NO: 594532 - RNA, 15 nt, Escherichia coli CFT073
ucuguuuuaucaauu

SEQ ID NO: 594533 - RNA, 16 nt, Escherichia coli CFT073
ucuucgacaaucgcaa

SEQ ID NO: 594534 - RNA, 19 nt, Escherichia coli CFT073
ucuucgaccgucaccaguc

SEQ ID NO: 594535 - RNA, 20 nt, Escherichia coli CFT073
ucuuccuggggaagugguga

SEQ ID NO: 594536 - RNA, 17 nt, Escherichia coli CFT073
ucuuccucgccagcgau

SEQ ID NO: 594537 - RNA, 13 nt, Escherichia coli CFT073
ucuuguacuuccg

SEQ ID NO: 594538 - RNA, 15 nt, Escherichia coli CFT073
ucuuguacuuccgga

SEQ ID NO: 594539 - RNA, 15 nt, Escherichia coli CFT073
ucuugucacuggcga

SEQ ID NO: 594540 - RNA, 20 nt, Escherichia coli CFT073
ucuugccacuggccucccag

SEQ ID NO: 594541 - RNA, 15 nt, Escherichia coli CFT073
ucuucugaauaucau

SEQ ID NO: 594542 - RNA, 12 nt, Escherichia coli CFT073
ucuucugccagg

SEQ ID NO: 594543 - RNA, 19 nt, Escherichia coli CFT073
ucuucuggcaccaguaaac

SEQ ID NO: 594544 - RNA, 16 nt, Escherichia coli CFT073
ucuugacauccagcgu

SEQ ID NO: 594545 - RNA, 19 nt, Escherichia coli CFT073
ucuugacggcuccccgccc

SEQ ID NO: 594546 - RNA, 12 nt, Escherichia coli CFT073
ugaaacaguaag

SEQ ID NO: 594547 - RNA, 13 nt, Escherichia coli CFT073
ugaaaaugcuggu

SEQ ID NO: 594548 - RNA, 17 nt, Escherichia coli CFT073
ugaaaauaacguagugu

SEQ ID NO: 594549 - RNA, 17 nt, Escherichia coli CFT073
ugaaaaaauuuuaucca

SEQ ID NO: 594550 - RNA, 17 nt, Escherichia coli CFT073
ucuuuaauacacggcag

SEQ ID NO: 594551 - RNA, 20 nt, Escherichia coli CFT073
ucuuuaccgcugucgaucag

SEQ ID NO: 594552 - RNA, 22 nt, Escherichia coli CFT073
ucuugugcaauguggugaaaug

SEQ ID NO: 594553 - RNA, 12 nt, Escherichia coli CFT073
ucuuuucacgca

SEQ ID NO: 594554 - RNA, 15 nt, Escherichia coli CFT073
aauagaacguuuauc

SEQ ID NO: 594555 - RNA, 20 nt, Escherichia coli CFT073
aauacguuuaugucgcaucc

SEQ ID NO: 594556 - RNA, 14 nt, Escherichia coli CFT073
aauacucauuaauu

SEQ ID NO: 594557 - RNA, 17 nt, Escherichia coli CFT073
aauacucugcacguuuu

SEQ ID NO: 594558 - RNA, 20 nt, Escherichia coli CFT073
aauacugccgagaaugacga

SEQ ID NO: 594559 - RNA, 17 nt, Escherichia coli CFT073
ucuggugaugcauaaaa

SEQ ID NO: 594560 - RNA, 22 nt, Escherichia coli CFT073
ucuccguuggcauuucgaccau

SEQ ID NO: 594561 - RNA, 14 nt, Escherichia coli CFT073
ucuccugcggcgac

SEQ ID NO: 594562 - RNA, 18 nt, Escherichia coli CFT073
ucucgaauuaauggugau

SEQ ID NO: 594563 - RNA, 17 nt, Escherichia coli CFT073
ucucgaauugucaccgu

SEQ ID NO: 594564 - RNA, 21 nt, Escherichia coli CFT073
ucuggcgucuccucccgagcg

SEQ ID NO: 594565 - RNA, 19 nt, Escherichia coli CFT073
ucuggcuaaaacugauaau

SEQ ID NO: 594566 - RNA, 14 nt, Escherichia coli CFT073
ucuggcggcggcaa

SEQ ID NO: 594567 - RNA, 15 nt, Escherichia coli CFT073
ucugcucccggcaau

SEQ ID NO: 594568 - RNA, 22 nt, Escherichia coli CFT073
ucgucacgauuggguaacgcac

SEQ ID NO: 594569 - RNA, 13 nt, Escherichia coli CFT073
ucguaccagcgaa

SEQ ID NO: 594570 - RNA, 15 nt, Escherichia coli CFT073
ucgguggugccgaca

SEQ ID NO: 594571 - RNA, 16 nt, Escherichia coli CFT073
ucggugauauacgcca

SEQ ID NO: 594572 - RNA, 16 nt, Escherichia coli CFT073
ucggugaucagcguca

SEQ ID NO: 594573 - RNA, 22 nt, Escherichia coli CFT073
ucgguagagaaaaccacccgca

SEQ ID NO: 594574 - RNA, 13 nt, Escherichia coli CFT073
ucggcugcaccuu

SEQ ID NO: 594575 - RNA, 21 nt, Escherichia coli CFT073
ucgguaaaaucaacgccgcau

SEQ ID NO: 594576 - RNA, 20 nt, Escherichia coli CFT073
ucgguaaagaaaauaccgaa

SEQ ID NO: 594577 - RNA, 13 nt, Escherichia coli CFT073
ucgguaacgcuug

SEQ ID NO: 594578 - RNA, 18 nt, Escherichia coli CFT073
ucuaugucgcauccggca

SEQ ID NO: 594579 - RNA, 22 nt, Escherichia coli CFT073
ucuccuccagcgcuuccagaau

SEQ ID NO: 594580 - RNA, 18 nt, Escherichia coli CFT073
ucuccauuuuuuugcauu

SEQ ID NO: 594581 - RNA, 23 nt, Escherichia coli CFT073
ucuccauacucguugacgaccag

SEQ ID NO: 594582 - RNA, 19 nt, Escherichia coli CFT073
ucguuuugccgccaucauc

SEQ ID NO: 594583 - RNA, 21 nt, Escherichia coli CFT073
ucuacaauugguaaauaagcg

SEQ ID NO: 594584 - RNA, 22 nt, Escherichia coli CFT073
ucuacacccagccccgguuuuu

SEQ ID NO: 594585 - RNA, 16 nt, Escherichia coli CFT073
ucuaccagcacgcagg

SEQ ID NO: 594586 - RNA, 16 nt, Escherichia coli CFT073
ucuaccuggucaccga

SEQ ID NO: 594587 - RNA, 15 nt, Escherichia coli CFT073
ucguuggcagacguu

SEQ ID NO: 594588 - RNA, 14 nt, Escherichia coli CFT073
ucguugugucgcca

SEQ ID NO: 594589 - RNA, 18 nt, Escherichia coli CFT073
ucguugugccuuccaucc

SEQ ID NO: 594590 - RNA, 17 nt, Escherichia coli CFT073
ucguucgcgccaacagc

SEQ ID NO: 594591 - RNA, 22 nt, Escherichia coli CFT073
ucguuaccuuugcagucaaauc

SEQ ID NO: 594592 - RNA, 22 nt, Escherichia coli CFT073
ucguuauaacaggcuaccgcag

SEQ ID NO: 594593 - RNA, 24 nt, Escherichia coli CFT073
ucguguuuugcaaucaucgcagca

SEQ ID NO: 594594 - RNA, 14 nt, Escherichia coli CFT073
ucguuaaugcgccc

SEQ ID NO: 594595 - RNA, 18 nt, Escherichia coli CFT073
ucguuaaugcgcccagua

SEQ ID NO: 594596 - RNA, 19 nt, Escherichia coli CFT073
ucgugcgguaacuucgcug

SEQ ID NO: 594597 - RNA, 19 nt, Escherichia coli CFT073
ucgugcgucgcauccggca

SEQ ID NO: 594598 - RNA, 18 nt, Escherichia coli CFT073
ucagcguuauagcgcaug

SEQ ID NO: 594599 - RNA, 17 nt, Escherichia coli CFT073
ucagcgucucaacaaac

SEQ ID NO: 594600 - RNA, 15 nt, Escherichia coli CFT073
ucagcucauccagcg

SEQ ID NO: 594601 - RNA, 17 nt, Escherichia coli CFT073
ucagcuaauggcugcgg

SEQ ID NO: 594602 - RNA, 13 nt, Escherichia coli CFT073
ucagcgugcccac

SEQ ID NO: 594603 - RNA, 14 nt, Escherichia coli CFT073
ucagcuccggcagc

SEQ ID NO: 594604 - RNA, 20 nt, Escherichia coli CFT073
ucagcgguuuugccagcgag

SEQ ID NO: 594605 - RNA, 20 nt, Escherichia coli CFT073
ucagcguaauggaaggcuug

SEQ ID NO: 594606 - RNA, 18 nt, Escherichia coli CFT073
ucagcggugucugccagu

SEQ ID NO: 594607 - RNA, 23 nt, Escherichia coli CFT073
ucagcguauccauuaccgccauc

SEQ ID NO: 594608 - RNA, 19 nt, Escherichia coli CFT073
ucagcgcggggaucacugg

SEQ ID NO: 594609 - RNA, 14 nt, Escherichia coli CFT073
ucaggaucaccaau

SEQ ID NO: 594610 - RNA, 22 nt, Escherichia coli CFT073
ucaggcagauacaaccaaucgc

SEQ ID NO: 594611 - RNA, 19 nt, Escherichia coli CFT073
ucaggcacuucuuccgcca

SEQ ID NO: 594612 - RNA, 22 nt, Escherichia coli CFT073
ucaggcacuucuuccgccagca

SEQ ID NO: 594613 - RNA, 18 nt, Escherichia coli CFT073
ucaggaugugagcuggcg

SEQ ID NO: 594614 - RNA, 20 nt, Escherichia coli CFT073
ucaggauuaaacuggcacgc

SEQ ID NO: 594615 - RNA, 22 nt, Escherichia coli CFT073
ucaggcaaagcuguuucagugu

SEQ ID NO: 594616 - RNA, 21 nt, Escherichia coli CFT073
ucaggaacauccccugcgcgc

SEQ ID NO: 594617 - RNA, 15 nt, Escherichia coli CFT073
ucagcugguaauggc

SEQ ID NO: 594618 - RNA, 15 nt, Escherichia coli CFT073
ucagcuuauccagca

SEQ ID NO: 594619 - RNA, 20 nt, Escherichia coli CFT073
ucagauuagaacugauaaac

SEQ ID NO: 594620 - RNA, 19 nt, Escherichia coli CFT073
ucagcauccauaucgccau

SEQ ID NO: 594621 - RNA, 21 nt, Escherichia coli CFT073
ucagauugcugacaacgugcg

SEQ ID NO: 594622 - RNA, 19 nt, Escherichia coli CFT073
ucagauggcggcuggcgca

SEQ ID NO: 594623 - RNA, 20 nt, Escherichia coli CFT073
aauaaugaacgccaccccac

SEQ ID NO: 594624 - RNA, 22 nt, Escherichia coli CFT073
aauaaugccguugaucagcgca

SEQ ID NO: 594625 - RNA, 23 nt, Escherichia coli CFT073
aauaauggccuuuucgccaccgg

SEQ ID NO: 594626 - RNA, 19 nt, Escherichia coli CFT073
aauaauuacuucgccggaa

SEQ ID NO: 594627 - RNA, 20 nt, Escherichia coli CFT073
ucagauaaaugcaaacgcau

SEQ ID NO: 594628 - RNA, 16 nt, Escherichia coli CFT073
aauaaugcaaaaaggc

SEQ ID NO: 594629 - RNA, 14 nt, Escherichia coli CFT073
ucagauauaaacgg

SEQ ID NO: 594630 - RNA, 14 nt, Escherichia coli CFT073
ucagccccaucagc

SEQ ID NO: 594631 - RNA, 15 nt, Escherichia coli CFT073
ucagccccaucagcg

SEQ ID NO: 594632 - RNA, 23 nt, Escherichia coli CFT073
ucagccagacgcgucacgcacug

SEQ ID NO: 594633 - RNA, 20 nt, Escherichia coli CFT073
ucagccacuucauuuaugga

SEQ ID NO: 594634 - RNA, 21 nt, Escherichia coli CFT073
ucagccaaagcgacacaauca

SEQ ID NO: 594635 - RNA, 17 nt, Escherichia coli CFT073
ucagcaucccaccugaa

SEQ ID NO: 594636 - RNA, 17 nt, Escherichia coli CFT073
ucagccccuucgccagu

SEQ ID NO: 594637 - RNA, 15 nt, Escherichia coli CFT073
ucagcgaaaaagucc

SEQ ID NO: 594638 - RNA, 22 nt, Escherichia coli CFT073
ucagcgaacaccagcaguaaac

SEQ ID NO: 594639 - RNA, 17 nt, Escherichia coli CFT073
aauaauugucaacggca

SEQ ID NO: 594640 - RNA, 20 nt, Escherichia coli CFT073
ucacuacaaucaggccaauc

SEQ ID NO: 594641 - RNA, 23 nt, Escherichia coli CFT073
ucacuaccagcgccaccgguuua

SEQ ID NO: 594642 - RNA, 22 nt, Escherichia coli CFT073
ucacuaucguuggcgaauaacc

SEQ ID NO: 594643 - RNA, 18 nt, Escherichia coli CFT073
ucacuacggcucagcaau

SEQ ID NO: 594644 - RNA, 22 nt, Escherichia coli CFT073
ucacuuccgugguuugcgcauu

SEQ ID NO: 594645 - RNA, 16 nt, Escherichia coli CFT073
ucacuuccuucgccgc

SEQ ID NO: 594646 - RNA, 15 nt, Escherichia coli CFT073
ucacuuuccaguuca

SEQ ID NO: 594647 - RNA, 17 nt, Escherichia coli CFT073
ucacuuucgccaguucu

SEQ ID NO: 594648 - RNA, 17 nt, Escherichia coli CFT073
ucacuugccugcuguga

SEQ ID NO: 594649 - RNA, 15 nt, Escherichia coli CFT073
ucacuuugcagaaaa

SEQ ID NO: 594650 - RNA, 14 nt, Escherichia coli CFT073
ucacuuuugccaga

SEQ ID NO: 594651 - RNA, 16 nt, Escherichia coli CFT073
aauaaucaacgcgaaa

SEQ ID NO: 594652 - RNA, 12 nt, Escherichia coli CFT073
aauaauccccac

SEQ ID NO: 594653 - RNA, 18 nt, Escherichia coli CFT073
aauaauccccacaucagg

SEQ ID NO: 594654 - RNA, 14 nt, Escherichia coli CFT073
aauaaucucaccau

SEQ ID NO: 594655 - RNA, 18 nt, Escherichia coli CFT073
aauaaguuuuuugcgaaa

SEQ ID NO: 594656 - RNA, 15 nt, Escherichia coli CFT073
aauaauaaccaaacc

SEQ ID NO: 594657 - RNA, 17 nt, Escherichia coli CFT073
aauaauaauccgcugca

SEQ ID NO: 594658 - RNA, 22 nt, Escherichia coli CFT073
aauaagcaggccauuugcucua

SEQ ID NO: 594659 - RNA, 17 nt, Escherichia coli CFT073
aauaaguaagcauuaua

SEQ ID NO: 594660 - RNA, 17 nt, Escherichia coli CFT073
aauaagugcuaaacgcu

SEQ ID NO: 594661 - RNA, 14 nt, Escherichia coli CFT073
ucagaaacgcucau

SEQ ID NO: 594662 - RNA, 16 nt, Escherichia coli CFT073
aauaagcacaaagcaa

SEQ ID NO: 594663 - RNA, 22 nt, Escherichia coli CFT073
aauaacgcccacuuuugccgca

SEQ ID NO: 594664 - RNA, 19 nt, Escherichia coli CFT073
aauaacggccuggcacgua

SEQ ID NO: 594665 - RNA, 20 nt, Escherichia coli CFT073
aauaacuucuauucaccagc

SEQ ID NO: 594666 - RNA, 12 nt, Escherichia coli CFT073
aauaagaaaagc

SEQ ID NO: 594667 - RNA, 20 nt, Escherichia coli CFT073
ucacggcuguagccagcucg

SEQ ID NO: 594668 - RNA, 16 nt, Escherichia coli CFT073
aauaacacccauaaaa

SEQ ID NO: 594669 - RNA, 20 nt, Escherichia coli CFT073
aauaaccaacggcgagccag

SEQ ID NO: 594670 - RNA, 19 nt, Escherichia coli CFT073
ucacggaucaguuuaucca

SEQ ID NO: 594671 - RNA, 18 nt, Escherichia coli CFT073
ucacaaaucuuauagcga

SEQ ID NO: 594672 - RNA, 17 nt, Escherichia coli CFT073
ucacaacuucgcaaaca

SEQ ID NO: 594673 - RNA, 17 nt, Escherichia coli CFT073
ucaccgaaccagggcga

SEQ ID NO: 594674 - RNA, 13 nt, Escherichia coli CFT073
ucacaauguaaau

SEQ ID NO: 594675 - RNA, 18 nt, Escherichia coli CFT073
ucaccgauuuugccuuca

SEQ ID NO: 594676 - RNA, 20 nt, Escherichia coli CFT073
ucaccgcaaagucggcacca

SEQ ID NO: 594677 - RNA, 23 nt, Escherichia coli CFT073
ucaccgcucuucauacguggcag

SEQ ID NO: 594678 - RNA, 17 nt, Escherichia coli CFT073
ucaccggagcugccagc

SEQ ID NO: 594679 - RNA, 20 nt, Escherichia coli CFT073
ucaccggaggccugauaaaa

SEQ ID NO: 594680 - RNA, 18 nt, Escherichia coli CFT073
ucacgcccauaacgcgcg

SEQ ID NO: 594681 - RNA, 21 nt, Escherichia coli CFT073
ucacgccacgcggcggcguag

SEQ ID NO: 594682 - RNA, 13 nt, Escherichia coli CFT073
ucacgaugccgcc

SEQ ID NO: 594683 - RNA, 17 nt, Escherichia coli CFT073
ucacgcacucgacgcag

SEQ ID NO: 594684 - RNA, 21 nt, Escherichia coli CFT073
ucacgauuugcguaaaaccug

SEQ ID NO: 594685 - RNA, 15 nt, Escherichia coli CFT073
ucaccggcaaaacca

SEQ ID NO: 594686 - RNA, 16 nt, Escherichia coli CFT073
ucaccugaccgagcca

SEQ ID NO: 594687 - RNA, 23 nt, Escherichia coli CFT073
ucaccugcccuccgguacgugcg

SEQ ID NO: 594688 - RNA, 13 nt, Escherichia coli CFT073
ucaccugccugca

SEQ ID NO: 594689 - RNA, 16 nt, Escherichia coli CFT073
ucaccugcgcuggcag

SEQ ID NO: 594690 - RNA, 18 nt, Escherichia coli CFT073
ucaccugguagcggguga

SEQ ID NO: 594691 - RNA, 16 nt, Escherichia coli CFT073
uccagcgaaauaaaag

SEQ ID NO: 594692 - RNA, 13 nt, Escherichia coli CFT073
uccagcagcaaug

SEQ ID NO: 594693 - RNA, 18 nt, Escherichia coli CFT073
uccagcagacgcuccauu

SEQ ID NO: 594694 - RNA, 13 nt, Escherichia coli CFT073
uccagcagccaga

SEQ ID NO: 594695 - RNA, 15 nt, Escherichia coli CFT073
uccagccaguuggug

SEQ ID NO: 594696 - RNA, 22 nt, Escherichia coli CFT073
uccagccccaccagcaaaaacg

SEQ ID NO: 594697 - RNA, 20 nt, Escherichia coli CFT073
uccagaccgcgcuugccgcc

SEQ ID NO: 594698 - RNA, 13 nt, Escherichia coli CFT073
uccagauauucau

SEQ ID NO: 594699 - RNA, 13 nt, Escherichia coli CFT073
uccagauauugcu

SEQ ID NO: 594700 - RNA, 17 nt, Escherichia coli CFT073
uccagcaaugucauaaa

SEQ ID NO: 594701 - RNA, 17 nt, Escherichia coli CFT073
uccagcaccaguucgcc

SEQ ID NO: 594702 - RNA, 22 nt, Escherichia coli CFT073
uccacaagaaugccugccagcu

SEQ ID NO: 594703 - RNA, 23 nt, Escherichia coli CFT073
uccacaauggcauauuccgccac

SEQ ID NO: 594704 - RNA, 21 nt, Escherichia coli CFT073
uccacaccuacgcccgccagu

SEQ ID NO: 594705 - RNA, 18 nt, Escherichia coli CFT073
uccacaccuuuacugacu

SEQ ID NO: 594706 - RNA, 18 nt, Escherichia coli CFT073
uccacacggcauaagccg

SEQ ID NO: 594707 - RNA, 13 nt, Escherichia coli CFT073
uccacacugagca

SEQ ID NO: 594708 - RNA, 20 nt, Escherichia coli CFT073
uccacaucaaccagaucgcu

SEQ ID NO: 594709 - RNA, 13 nt, Escherichia coli CFT073
uccacauccagau

SEQ ID NO: 594710 - RNA, 17 nt, Escherichia coli CFT073
uccagaauauguucgcu

SEQ ID NO: 594711 - RNA, 14 nt, Escherichia coli CFT073
uccacuuccugcgg

SEQ ID NO: 594712 - RNA, 18 nt, Escherichia coli CFT073
uccaguuguuuuugcaua

SEQ ID NO: 594713 - RNA, 14 nt, Escherichia coli CFT073
uccagugauuccag

SEQ ID NO: 594714 - RNA, 21 nt, Escherichia coli CFT073
uccaguuccuucaagccauca

SEQ ID NO: 594715 - RNA, 15 nt, Escherichia coli CFT073
uccaguagcgccaua

SEQ ID NO: 594716 - RNA, 20 nt, Escherichia coli CFT073
uccaguauauugcugauuuu

SEQ ID NO: 594717 - RNA, 20 nt, Escherichia coli CFT073
uccagcgguugggcauuggc

SEQ ID NO: 594718 - RNA, 19 nt, Escherichia coli CFT073
uccagcgacuccaguucgu

SEQ ID NO: 594719 - RNA, 20 nt, Escherichia coli CFT073
uccagcgcaaaguagcugaa

SEQ ID NO: 594720 - RNA, 16 nt, Escherichia coli CFT073
uccagcgagcuggcgc

SEQ ID NO: 594721 - RNA, 12 nt, Escherichia coli CFT073
uccaugauauug

SEQ ID NO: 594722 - RNA, 19 nt, Escherichia coli CFT073
uccaugcacugcaacgccu

SEQ ID NO: 594723 - RNA, 21 nt, Escherichia coli CFT073
uccauucuugcgcggauggcc

SEQ ID NO: 594724 - RNA, 22 nt, Escherichia coli CFT073
uccauugaaaucaaaaucaccg

SEQ ID NO: 594725 - RNA, 22 nt, Escherichia coli CFT073
uccauugcaacuggcugccguu

SEQ ID NO: 594726 - RNA, 14 nt, Escherichia coli CFT073
uccauugccugcaa

SEQ ID NO: 594727 - RNA, 18 nt, Escherichia coli CFT073
uccauaguaacgcggcaa

SEQ ID NO: 594728 - RNA, 24 nt, Escherichia coli CFT073
uccaucacuaaggguaaaacgacu

SEQ ID NO: 594729 - RNA, 13 nt, Escherichia coli CFT073
uccaucagacguu

SEQ ID NO: 594730 - RNA, 12 nt, Escherichia coli CFT073
uccaucagcguu

SEQ ID NO: 594731 - RNA, 19 nt, Escherichia coli CFT073
uccauccgggaucacauca

SEQ ID NO: 594732 - RNA, 17 nt, Escherichia coli CFT073
ucauuucgauauagccg

SEQ ID NO: 594733 - RNA, 20 nt, Escherichia coli CFT073
ucauuugcaccaggccgcgc

SEQ ID NO: 594734 - RNA, 11 nt, Escherichia coli CFT073
ucauuucgucg

SEQ ID NO: 594735 - RNA, 18 nt, Escherichia coli CFT073
ucauuucgucgaacucau

SEQ ID NO: 594736 - RNA, 22 nt, Escherichia coli CFT073
ucauugccacgucaucuguaag

SEQ ID NO: 594737 - RNA, 15 nt, Escherichia coli CFT073
ucauugccgguuggc

SEQ ID NO: 594738 - RNA, 17 nt, Escherichia coli CFT073
ucauugcucuuaaucgu

SEQ ID NO: 594739 - RNA, 21 nt, Escherichia coli CFT073
ucauuggccggaauaccacuu

SEQ ID NO: 594740 - RNA, 14 nt, Escherichia coli CFT073
ucauuuucaauucu

SEQ ID NO: 594741 - RNA, 21 nt, Escherichia coli CFT073
ucauuuuguaggccugauaag

SEQ ID NO: 594742 - RNA, 19 nt, Escherichia coli CFT073
ucauuuucucuuuuagcgu

SEQ ID NO: 594743 - RNA, 16 nt, Escherichia coli CFT073
uccaagcugguggcaa

SEQ ID NO: 594744 - RNA, 22 nt, Escherichia coli CFT073
uccaaucagcacacauaacagc

SEQ ID NO: 594745 - RNA, 17 nt, Escherichia coli CFT073
ucauguauucuggcuaa

SEQ ID NO: 594746 - RNA, 22 nt, Escherichia coli CFT073
ucauguagcaaauuucgucgua

SEQ ID NO: 594747 - RNA, 16 nt, Escherichia coli CFT073
ucaugguacuggcgac

SEQ ID NO: 594748 - RNA, 21 nt, Escherichia coli CFT073
ucaugguacuggcgacugcca

SEQ ID NO: 594749 - RNA, 19 nt, Escherichia coli CFT073
ucaugggcuaacgagcagu

SEQ ID NO: 594750 - RNA, 21 nt, Escherichia coli CFT073
ucaucuuacugcaacugugcg

SEQ ID NO: 594751 - RNA, 17 nt, Escherichia coli CFT073
ucaucuuccaguugccg

SEQ ID NO: 594752 - RNA, 19 nt, Escherichia coli CFT073
ucaucuuccgggcaacaau

SEQ ID NO: 594753 - RNA, 18 nt, Escherichia coli CFT073
ucauucagguauuguguu

SEQ ID NO: 594754 - RNA, 22 nt, Escherichia coli CFT073
ucauuaauaaccauuaaauagu

SEQ ID NO: 594755 - RNA, 16 nt, Escherichia coli CFT073
ucauuaaagccgccca

SEQ ID NO: 594756 - RNA, 15 nt, Escherichia coli CFT073
ucauguucgguaaac

SEQ ID NO: 594757 - RNA, 20 nt, Escherichia coli CFT073
ucauguugauuugcuggaag

SEQ ID NO: 594758 - RNA, 21 nt, Escherichia coli CFT073
ucaucaucggcaccgccagca

SEQ ID NO: 594759 - RNA, 15 nt, Escherichia coli CFT073
ucaucagcgccaacc

SEQ ID NO: 594760 - RNA, 16 nt, Escherichia coli CFT073
ucaucauuaacugcug

SEQ ID NO: 594761 - RNA, 20 nt, Escherichia coli CFT073
ucaucauugguuaacuccag

SEQ ID NO: 594762 - RNA, 14 nt, Escherichia coli CFT073
ucauccugaugcuu

SEQ ID NO: 594763 - RNA, 17 nt, Escherichia coli CFT073
ucaucgacaucaacgau

SEQ ID NO: 594764 - RNA, 22 nt, Escherichia coli CFT073
ucaucgacaucaacgaugccuu

SEQ ID NO: 594765 - RNA, 14 nt, Escherichia coli CFT073
ucaucgagcagcau

SEQ ID NO: 594766 - RNA, 18 nt, Escherichia coli CFT073
ucaucggucaguuugccc

SEQ ID NO: 594767 - RNA, 14 nt, Escherichia coli CFT073
ucaucgucguuucu

SEQ ID NO: 594768 - RNA, 22 nt, Escherichia coli CFT073
ucaucguucaucuguaacaggu

SEQ ID NO: 594769 - RNA, 22 nt, Escherichia coli CFT073
ucauaacucuccuguuuaauau

SEQ ID NO: 594770 - RNA, 13 nt, Escherichia coli CFT073
ucauaaugggcgc

SEQ ID NO: 594771 - RNA, 18 nt, Escherichia coli CFT073
ucauaaugggcgcgggca

SEQ ID NO: 594772 - RNA, 19 nt, Escherichia coli CFT073
ucauacuccagucgcugcu

SEQ ID NO: 594773 - RNA, 19 nt, Escherichia coli CFT073
ucauagcgacuaccacgua

SEQ ID NO: 594774 - RNA, 17 nt, Escherichia coli CFT073
ucauagguaaacaucac

SEQ ID NO: 594775 - RNA, 12 nt, Escherichia coli CFT073
ucauauccagca

SEQ ID NO: 594776 - RNA, 19 nt, Escherichia coli CFT073
ucauaaaccagcggcacgc

SEQ ID NO: 594777 - RNA, 16 nt, Escherichia coli CFT073
ucauaaauuaccacca

SEQ ID NO: 594778 - RNA, 21 nt, Escherichia coli CFT073
ucaguugguuagagcacauca

SEQ ID NO: 594779 - RNA, 15 nt, Escherichia coli CFT073
ucaguuugccgcuca

SEQ ID NO: 594780 - RNA, 14 nt, Escherichia coli CFT073
ucaguugauuauga

SEQ ID NO: 594781 - RNA, 22 nt, Escherichia coli CFT073
ucaggcauuauggcgcaguugc

SEQ ID NO: 594782 - RNA, 21 nt, Escherichia coli CFT073
ucaggcauuguguagggcagc

SEQ ID NO: 594783 - RNA, 21 nt, Escherichia coli CFT073
ucaggccaaagccgccgagca

SEQ ID NO: 594784 - RNA, 15 nt, Escherichia coli CFT073
ucaauauuaaugcug

SEQ ID NO: 594785 - RNA, 19 nt, Escherichia coli CFT073
ucaauagcccggcaauggu

SEQ ID NO: 594786 - RNA, 12 nt, Escherichia coli CFT073
ucaaugauaaag

SEQ ID NO: 594787 - RNA, 20 nt, Escherichia coli CFT073
ucaaugauaauucaacagau

SEQ ID NO: 594788 - RNA, 20 nt, Escherichia coli CFT073
ucaaugauaugugcagaagc

SEQ ID NO: 594789 - RNA, 15 nt, Escherichia coli CFT073
ucaaugaaacgcaaa

SEQ ID NO: 594790 - RNA, 23 nt, Escherichia coli CFT073
ucaaucaggcuaucgaacaugcg

SEQ ID NO: 594791 - RNA, 16 nt, Escherichia coli CFT073
ucaaucauugauaaua

SEQ ID NO: 594792 - RNA, 18 nt, Escherichia coli CFT073
ucaaucgaacgcagcaac

SEQ ID NO: 594793 - RNA, 22 nt, Escherichia coli CFT073
ucaaucgccucgccgaaacgcu

SEQ ID NO: 594794 - RNA, 15 nt, Escherichia coli CFT073
ucaaucucagcgaua

SEQ ID NO: 594795 - RNA, 15 nt, Escherichia coli CFT073
ucaaugccccacaga

SEQ ID NO: 594796 - RNA, 22 nt, Escherichia coli CFT073
ucaaugccggacuguaaacgau

SEQ ID NO: 594797 - RNA, 20 nt, Escherichia coli CFT073
ucaaucugagcgaagcgcau

SEQ ID NO: 594798 - RNA, 21 nt, Escherichia coli CFT073
ucaaugaugccgacggcgcac

SEQ ID NO: 594799 - RNA, 21 nt, Escherichia coli CFT073
ucaaugcaauuuaucgcaggu

SEQ ID NO: 594800 - RNA, 24 nt, Escherichia coli CFT073
ucaauggucuggcgacggcgaauc

SEQ ID NO: 594801 - RNA, 16 nt, Escherichia coli CFT073
ucaaugguggcaaucu

SEQ ID NO: 594802 - RNA, 16 nt, Escherichia coli CFT073
ucaauggcauccgcca

SEQ ID NO: 594803 - RNA, 11 nt, Escherichia coli CFT073
ucaauuaugcc

SEQ ID NO: 594804 - RNA, 12 nt, Escherichia coli CFT073
ucaauaauaacc

SEQ ID NO: 594805 - RNA, 11 nt, Escherichia coli CFT073
ucaauaaucau

SEQ ID NO: 594806 - RNA, 18 nt, Escherichia coli CFT073
ucaaguguggccgccagu

SEQ ID NO: 594807 - RNA, 18 nt, Escherichia coli CFT073
ucaaguacgccgccgcca

SEQ ID NO: 594808 - RNA, 20 nt, Escherichia coli CFT073
ucaaggugauauccaccgcg

SEQ ID NO: 594809 - RNA, 16 nt, Escherichia coli CFT073
ucaagaccucaucguu

SEQ ID NO: 594810 - RNA, 15 nt, Escherichia coli CFT073
ucaagcaccgccaua

SEQ ID NO: 594811 - RNA, 15 nt, Escherichia coli CFT073
ucaagcccugguaac

SEQ ID NO: 594812 - RNA, 19 nt, Escherichia coli CFT073
ucaagcugcaucuggcgau

SEQ ID NO: 594813 - RNA, 22 nt, Escherichia coli CFT073
ucaagcggacgaucgcugauga

SEQ ID NO: 594814 - RNA, 23 nt, Escherichia coli CFT073
ucaagcggacgaucgcugaugaa

SEQ ID NO: 594815 - RNA, 20 nt, Escherichia coli CFT073
ucaagaaucucuucuucgcu

SEQ ID NO: 594816 - RNA, 22 nt, Escherichia coli CFT073
ucaacuuuguugcgaacuucag

SEQ ID NO: 594817 - RNA, 15 nt, Escherichia coli CFT073
ucaacugacugacgu

SEQ ID NO: 594818 - RNA, 23 nt, Escherichia coli CFT073
ucaacguuuacccaaucccccac

SEQ ID NO: 594819 - RNA, 23 nt, Escherichia coli CFT073
ucaacuccagaauaccgccgaua

SEQ ID NO: 594820 - RNA, 14 nt, Escherichia coli CFT073
ucaacguguauauc

SEQ ID NO: 594821 - RNA, 18 nt, Escherichia coli CFT073
ucaacguuaggcggaaac

SEQ ID NO: 594822 - RNA, 14 nt, Escherichia coli CFT073
ucaacguuauucgc

SEQ ID NO: 594823 - RNA, 19 nt, Escherichia coli CFT073
ucaacccaaccugccagag

SEQ ID NO: 594824 - RNA, 13 nt, Escherichia coli CFT073
ucaaccaugguuu

SEQ ID NO: 594825 - RNA, 19 nt, Escherichia coli CFT073
ucaaccgguggcaguagcg

SEQ ID NO: 594826 - RNA, 20 nt, Escherichia coli CFT073
ucaaaucugccguaacugcg

SEQ ID NO: 594827 - RNA, 19 nt, Escherichia coli CFT073
ucaaaucaccaaacugcuc

SEQ ID NO: 594828 - RNA, 13 nt, Escherichia coli CFT073
uauugauggugug

SEQ ID NO: 594829 - RNA, 22 nt, Escherichia coli CFT073
uauugcaccagaucuuccagcg

SEQ ID NO: 594830 - RNA, 23 nt, Escherichia coli CFT073
uauugcaccagaucuuccagcgg

SEQ ID NO: 594831 - RNA, 19 nt, Escherichia coli CFT073
uauugcggcauuugucugu

SEQ ID NO: 594832 - RNA, 12 nt, Escherichia coli CFT073
uauugcucuacc

SEQ ID NO: 594833 - RNA, 13 nt, Escherichia coli CFT073
ucaaacggcguuu

SEQ ID NO: 594834 - RNA, 17 nt, Escherichia coli CFT073
ucaaaauuuaacauuac

SEQ ID NO: 594835 - RNA, 16 nt, Escherichia coli CFT073
ucaaacaggcggucug

SEQ ID NO: 594836 - RNA, 18 nt, Escherichia coli CFT073
ucaaacagguuauugacc

SEQ ID NO: 594837 - RNA, 20 nt, Escherichia coli CFT073
ucaaacgaaugcaggcgcgc

SEQ ID NO: 594838 - RNA, 19 nt, Escherichia coli CFT073
ucaaagaacagcccgccaa

SEQ ID NO: 594839 - RNA, 22 nt, Escherichia coli CFT073
ucaaagaccguuucggugauga

SEQ ID NO: 594840 - RNA, 12 nt, Escherichia coli CFT073
ucaaacugagcg

SEQ ID NO: 594841 - RNA, 15 nt, Escherichia coli CFT073
ucaaagugcaccggc

SEQ ID NO: 594842 - RNA, 19 nt, Escherichia coli CFT073
ucaaaguuaccggaagcgc

SEQ ID NO: 594843 - RNA, 14 nt, Escherichia coli CFT073
uauuaacgcagcaa

SEQ ID NO: 594844 - RNA, 13 nt, Escherichia coli CFT073
uauuaagcggcac

SEQ ID NO: 594845 - RNA, 19 nt, Escherichia coli CFT073
uaugauaggcuucaaccgu

SEQ ID NO: 594846 - RNA, 22 nt, Escherichia coli CFT073
uaugaugagaacuccuggcgaa

SEQ ID NO: 594847 - RNA, 13 nt, Escherichia coli CFT073
uaugcauaaaccg

SEQ ID NO: 594848 - RNA, 16 nt, Escherichia coli CFT073
uaugcauaaaccgggu

SEQ ID NO: 594849 - RNA, 21 nt, Escherichia coli CFT073
uaugcaccgacaauccaguug

SEQ ID NO: 594850 - RNA, 19 nt, Escherichia coli CFT073
uauguuucauccaggcacu

SEQ ID NO: 594851 - RNA, 17 nt, Escherichia coli CFT073
uaugccccagcccgcca

SEQ ID NO: 594852 - RNA, 17 nt, Escherichia coli CFT073
uaugaguucgcggcgca

SEQ ID NO: 594853 - RNA, 16 nt, Escherichia coli CFT073
uaucuucaaagccaca

SEQ ID NO: 594854 - RNA, 21 nt, Escherichia coli CFT073
uaugaaacaagaaguuauccu

SEQ ID NO: 594855 - RNA, 16 nt, Escherichia coli CFT073
uaugaaacuccaccgg

SEQ ID NO: 594856 - RNA, 19 nt, Escherichia coli CFT073
uaucgguagggaaugccgg

SEQ ID NO: 594857 - RNA, 15 nt, Escherichia coli CFT073
uaucgucuggcgcgu

SEQ ID NO: 594858 - RNA, 21 nt, Escherichia coli CFT073
uaucuccaguaaagcgauacg

SEQ ID NO: 594859 - RNA, 23 nt, Escherichia coli CFT073
uaucugcccuuuaguaugcugau

SEQ ID NO: 594860 - RNA, 15 nt, Escherichia coli CFT073
uaucuggccuacaaa

SEQ ID NO: 594861 - RNA, 15 nt, Escherichia coli CFT073
uauccgaccuacaaa

SEQ ID NO: 594862 - RNA, 18 nt, Escherichia coli CFT073
uaucaggucuuucugaaa

SEQ ID NO: 594863 - RNA, 15 nt, Escherichia coli CFT073
uaucaggccuucagg

SEQ ID NO: 594864 - RNA, 17 nt, Escherichia coli CFT073
uauccaguucaugacgu

SEQ ID NO: 594865 - RNA, 13 nt, Escherichia coli CFT073
uauccaguugguu

SEQ ID NO: 594866 - RNA, 16 nt, Escherichia coli CFT073
uaucggcguaaucacg

SEQ ID NO: 594867 - RNA, 15 nt, Escherichia coli CFT073
uauccggccaacaaa

SEQ ID NO: 594868 - RNA, 14 nt, Escherichia coli CFT073
uauccggccuacaa

SEQ ID NO: 594869 - RNA, 15 nt, Escherichia coli CFT073
uauccggccuacuaa

SEQ ID NO: 594870 - RNA, 15 nt, Escherichia coli CFT073
uauccggcugaccug

SEQ ID NO: 594871 - RNA, 19 nt, Escherichia coli CFT073
uauccggcugaccuggaag

SEQ ID NO: 594872 - RNA, 18 nt, Escherichia coli CFT073
uaucagccugcaaacgcu

SEQ ID NO: 594873 - RNA, 22 nt, Escherichia coli CFT073
uaucaggcauggugcuggcuua

SEQ ID NO: 594874 - RNA, 15 nt, Escherichia coli CFT073
uaucaggccuacaaa

SEQ ID NO: 594875 - RNA, 15 nt, Escherichia coli CFT073
uaucaggccuacaag

SEQ ID NO: 594876 - RNA, 20 nt, Escherichia coli CFT073
uauaugccggauaagacgcg

SEQ ID NO: 594877 - RNA, 16 nt, Escherichia coli CFT073
uaucacguagccacgg

SEQ ID NO: 594878 - RNA, 16 nt, Escherichia coli CFT073
uauaccaacaaaaaac

SEQ ID NO: 594879 - RNA, 18 nt, Escherichia coli CFT073
uauaugcuuguauuagcg

SEQ ID NO: 594880 - RNA, 21 nt, Escherichia coli CFT073
uauaugcuuguauuagcgcgc

SEQ ID NO: 594881 - RNA, 21 nt, Escherichia coli CFT073
uagggaaguagccuucaucag

SEQ ID NO: 594882 - RNA, 12 nt, Escherichia coli CFT073
uauacaaaaucu

SEQ ID NO: 594883 - RNA, 19 nt, Escherichia coli CFT073
uacgcggaucuccggcgac

SEQ ID NO: 594884 - RNA, 18 nt, Escherichia coli CFT073
uacgcaggcggcuggcau

SEQ ID NO: 594885 - RNA, 11 nt, Escherichia coli CFT073
uacgcaucacc

SEQ ID NO: 594886 - RNA, 18 nt, Escherichia coli CFT073
uacgcaucaugccgccca

SEQ ID NO: 594887 - RNA, 13 nt, Escherichia coli CFT073
uacgcauccccag

SEQ ID NO: 594888 - RNA, 21 nt, Escherichia coli CFT073
uacgcauccccagcgcaaggc

SEQ ID NO: 594889 - RNA, 20 nt, Escherichia coli CFT073
uacgcauucgaguagcguuc

SEQ ID NO: 594890 - RNA, 20 nt, Escherichia coli CFT073
uacgcaguaaauaaaaaauc

SEQ ID NO: 594891 - RNA, 23 nt, Escherichia coli CFT073
uacgccacuucaucgucauaaug

SEQ ID NO: 594892 - RNA, 14 nt, Escherichia coli CFT073
uacgggaggucauc

SEQ ID NO: 594893 - RNA, 16 nt, Escherichia coli CFT073
uacgggcgaugguguu

SEQ ID NO: 594894 - RNA, 13 nt, Escherichia coli CFT073
uacggucgccgua

SEQ ID NO: 594895 - RNA, 19 nt, Escherichia coli CFT073
uacggcgacagcaaaaucu

SEQ ID NO: 594896 - RNA, 16 nt, Escherichia coli CFT073
uacggcauucugcaca

SEQ ID NO: 594897 - RNA, 16 nt, Escherichia coli CFT073
uacggcauugucugaa

SEQ ID NO: 594898 - RNA, 15 nt, Escherichia coli CFT073
uacgcuccgcccauu

SEQ ID NO: 594899 - RNA, 18 nt, Escherichia coli CFT073
uacgaauugccgcgccgg

SEQ ID NO: 594900 - RNA, 24 nt, Escherichia coli CFT073
uacgacccgauucggucaugguga

SEQ ID NO: 594901 - RNA, 13 nt, Escherichia coli CFT073
uacgaagcagcau

SEQ ID NO: 594902 - RNA, 21 nt, Escherichia coli CFT073
uacgagcuucgacuuccugca

SEQ ID NO: 594903 - RNA, 14 nt, Escherichia coli CFT073
uacgacagucaaua

SEQ ID NO: 594904 - RNA, 16 nt, Escherichia coli CFT073
uacgcaaaauaucgau

SEQ ID NO: 594905 - RNA, 11 nt, Escherichia coli CFT073
uacgcaaagag

SEQ ID NO: 594906 - RNA, 23 nt, Escherichia coli CFT073
uacgcaccgguuccgggcuguuu

SEQ ID NO: 594907 - RNA, 17 nt, Escherichia coli CFT073
uaccagccccaucaggu

SEQ ID NO: 594908 - RNA, 20 nt, Escherichia coli CFT073
uaccagcuguuuugguaaac

SEQ ID NO: 594909 - RNA, 16 nt, Escherichia coli CFT073
uaccacuuccagcaga

SEQ ID NO: 594910 - RNA, 15 nt, Escherichia coli CFT073
uaccagacagaacga

SEQ ID NO: 594911 - RNA, 22 nt, Escherichia coli CFT073
uaccagcaacugauggcccauc

SEQ ID NO: 594912 - RNA, 20 nt, Escherichia coli CFT073
uacguuaucgcgccaucaaa

SEQ ID NO: 594913 - RNA, 22 nt, Escherichia coli CFT073
uacguuauuugcggauuaacga

SEQ ID NO: 594914 - RNA, 20 nt, Escherichia coli CFT073
uacguuuuaaugauuuccag

SEQ ID NO: 594915 - RNA, 13 nt, Escherichia coli CFT073
uacgugaaaucgg

SEQ ID NO: 594916 - RNA, 20 nt, Escherichia coli CFT073
uacgugaacgcgacauaucg

SEQ ID NO: 594917 - RNA, 22 nt, Escherichia coli CFT073
uacgugaucgucuucaaccgca

SEQ ID NO: 594918 - RNA, 14 nt, Escherichia coli CFT073
uacucuucguucuu

SEQ ID NO: 594919 - RNA, 19 nt, Escherichia coli CFT073
uacugacgaaggugccgga

SEQ ID NO: 594920 - RNA, 21 nt, Escherichia coli CFT073
uacucuggcuggucauugccg

SEQ ID NO: 594921 - RNA, 15 nt, Escherichia coli CFT073
uacugcgaauuuccu

SEQ ID NO: 594922 - RNA, 22 nt, Escherichia coli CFT073
uacuggaagccauuuugcauga

SEQ ID NO: 594923 - RNA, 19 nt, Escherichia coli CFT073
uagaaacgcugaaugcugc

SEQ ID NO: 594924 - RNA, 15 nt, Escherichia coli CFT073
uagaaaagaguauua

SEQ ID NO: 594925 - RNA, 12 nt, Escherichia coli CFT073
uacuuugccuuu

SEQ ID NO: 594926 - RNA, 23 nt, Escherichia coli CFT073
uagacaggguugcagacccgcca

SEQ ID NO: 594927 - RNA, 14 nt, Escherichia coli CFT073
uagaauuauuagca

SEQ ID NO: 594928 - RNA, 20 nt, Escherichia coli CFT073
uagauuucguugugucgcca

SEQ ID NO: 594929 - RNA, 16 nt, Escherichia coli CFT073
uagacgccauuuugca

SEQ ID NO: 594930 - RNA, 20 nt, Escherichia coli CFT073
uaggccagauaaggcguuca

SEQ ID NO: 594931 - RNA, 20 nt, Escherichia coli CFT073
uaggccugauaagacgcaac

SEQ ID NO: 594932 - RNA, 18 nt, Escherichia coli CFT073
uaggccugauaagacgcg

SEQ ID NO: 594933 - RNA, 18 nt, Escherichia coli CFT073
uaggccuuaaccgccgcc

SEQ ID NO: 594934 - RNA, 13 nt, Escherichia coli CFT073
aauaaaugcuuga

SEQ ID NO: 594935 - RNA, 16 nt, Escherichia coli CFT073
aaguuuucgccggauc

SEQ ID NO: 594936 - RNA, 14 nt, Escherichia coli CFT073
aauaaaacgccuga

SEQ ID NO: 594937 - RNA, 17 nt, Escherichia coli CFT073
aauaaaaaaacgccaga

SEQ ID NO: 594938 - RNA, 12 nt, Escherichia coli CFT073
aauaaaaagcgg

SEQ ID NO: 594939 - RNA, 13 nt, Escherichia coli CFT073
aauaaaaagcggc

SEQ ID NO: 594940 - RNA, 14 nt, Escherichia coli CFT073
aauaaaacaucacc

SEQ ID NO: 594941 - RNA, 19 nt, Escherichia coli CFT073
uaggaccgguuucaaaacu

SEQ ID NO: 594942 - RNA, 17 nt, Escherichia coli CFT073
uaggcaggcaucaucag

SEQ ID NO: 594943 - RNA, 15 nt, Escherichia coli CFT073
uaggcaucagcaauu

SEQ ID NO: 594944 - RNA, 18 nt, Escherichia coli CFT073
aaguuuccuccggcuuua

SEQ ID NO: 594945 - RNA, 18 nt, Escherichia coli CFT073
aaguugcgaaagcgagca

SEQ ID NO: 594946 - RNA, 22 nt, Escherichia coli CFT073
aaguuggcguucacugccguac

SEQ ID NO: 594947 - RNA, 16 nt, Escherichia coli CFT073
uagcucaaacuggcug

SEQ ID NO: 594948 - RNA, 20 nt, Escherichia coli CFT073
uagcugaaaaucagauccgc

SEQ ID NO: 594949 - RNA, 11 nt, Escherichia coli CFT073
uagcugaacgc

SEQ ID NO: 594950 - RNA, 21 nt, Escherichia coli CFT073
uagcggaaaaucgggcgacag

SEQ ID NO: 594951 - RNA, 14 nt, Escherichia coli CFT073
uagcgugcaggacg

SEQ ID NO: 594952 - RNA, 15 nt, Escherichia coli CFT073
uagcggcaacaaugc

SEQ ID NO: 594953 - RNA, 14 nt, Escherichia coli CFT073
uagccgaaaacgcu

SEQ ID NO: 594954 - RNA, 17 nt, Escherichia coli CFT073
uagcaagcgcugugaaa

SEQ ID NO: 594955 - RNA, 16 nt, Escherichia coli CFT073
uagcaaccggggcauu

SEQ ID NO: 594956 - RNA, 20 nt, Escherichia coli CFT073
uagccucccugccuccauga

SEQ ID NO: 594957 - RNA, 15 nt, Escherichia coli CFT073
uagcgaagaauacgc

SEQ ID NO: 594958 - RNA, 17 nt, Escherichia coli CFT073
uagccgcauccggcaua

SEQ ID NO: 594959 - RNA, 20 nt, Escherichia coli CFT073
uacaggauauauuucaucaa

SEQ ID NO: 594960 - RNA, 16 nt, Escherichia coli CFT073
uacaggcaucuuccag

SEQ ID NO: 594961 - RNA, 23 nt, Escherichia coli CFT073
uacaggccaccaggccacggcga

SEQ ID NO: 594962 - RNA, 21 nt, Escherichia coli CFT073
uacaguuuccuucugauauua

SEQ ID NO: 594963 - RNA, 14 nt, Escherichia coli CFT073
uacauaagcaccga

SEQ ID NO: 594964 - RNA, 13 nt, Escherichia coli CFT073
uacauaccagcag

SEQ ID NO: 594965 - RNA, 19 nt, Escherichia coli CFT073
uacagguuguugaagaugc

SEQ ID NO: 594966 - RNA, 12 nt, Escherichia coli CFT073
uacagccgccag

SEQ ID NO: 594967 - RNA, 17 nt, Escherichia coli CFT073
uacagcgcauaaaagcu

SEQ ID NO: 594968 - RNA, 20 nt, Escherichia coli CFT073
uacagcgcccagacaauuaa

SEQ ID NO: 594969 - RNA, 20 nt, Escherichia coli CFT073
uacagcgaauaguggaguau

SEQ ID NO: 594970 - RNA, 16 nt, Escherichia coli CFT073
uacagcaccgcccguu

SEQ ID NO: 594971 - RNA, 16 nt, Escherichia coli CFT073
uacauagccaucugcc

SEQ ID NO: 594972 - RNA, 22 nt, Escherichia coli CFT073
uacaucacgauuuuuccgcugg

SEQ ID NO: 594973 - RNA, 16 nt, Escherichia coli CFT073
uacaucaggcagaacg

SEQ ID NO: 594974 - RNA, 11 nt, Escherichia coli CFT073
uacaucaucag

SEQ ID NO: 594975 - RNA, 13 nt, Escherichia coli CFT073
uaccaaaaacggu

SEQ ID NO: 594976 - RNA, 20 nt, Escherichia coli CFT073
uaccaagaaagauaguaacc

SEQ ID NO: 594977 - RNA, 20 nt, Escherichia coli CFT073
uaccaauuuauuuuaucgcu

SEQ ID NO: 594978 - RNA, 20 nt, Escherichia coli CFT073
uaccacaucaacccgcccag

SEQ ID NO: 594979 - RNA, 22 nt, Escherichia coli CFT073
uacacagcccaguuuuucagga

SEQ ID NO: 594980 - RNA, 21 nt, Escherichia coli CFT073
uacacgccgggcagccuuuca

SEQ ID NO: 594981 - RNA, 17 nt, Escherichia coli CFT073
uacaccugcuccgccag

SEQ ID NO: 594982 - RNA, 18 nt, Escherichia coli CFT073
uacaccgcgaagcagcuc

SEQ ID NO: 594983 - RNA, 23 nt, Escherichia coli CFT073
uacaauauccagcgcgcgcagca

SEQ ID NO: 594984 - RNA, 14 nt, Escherichia coli CFT073
uaauugagcagcaa

SEQ ID NO: 594985 - RNA, 12 nt, Escherichia coli CFT073
uaauguuuugca

SEQ ID NO: 594986 - RNA, 23 nt, Escherichia coli CFT073
uaauuguccaucgcuacaggcua

SEQ ID NO: 594987 - RNA, 20 nt, Escherichia coli CFT073
uaauguucguugcauuccag

SEQ ID NO: 594988 - RNA, 22 nt, Escherichia coli CFT073
uaaucaauuacuuauuaacgaa

SEQ ID NO: 594989 - RNA, 14 nt, Escherichia coli CFT073
uaaucaccaucgcg

SEQ ID NO: 594990 - RNA, 12 nt, Escherichia coli CFT073
uaaucaccggau

SEQ ID NO: 594991 - RNA, 22 nt, Escherichia coli CFT073
uaaucagaucguugaccuggau

SEQ ID NO: 594992 - RNA, 22 nt, Escherichia coli CFT073
uaacucgaauuauucagaguau

SEQ ID NO: 594993 - RNA, 19 nt, Escherichia coli CFT073
uaacuagcaacaaaaaaac

SEQ ID NO: 594994 - RNA, 20 nt, Escherichia coli CFT073
uaacugguuagcuuuaaucc

SEQ ID NO: 594995 - RNA, 20 nt, Escherichia coli CFT073
uaacugaucacguuuuccuu

SEQ ID NO: 594996 - RNA, 13 nt, Escherichia coli CFT073
uaagcccggccug

SEQ ID NO: 594997 - RNA, 16 nt, Escherichia coli CFT073
uaagccgguaaucacc

SEQ ID NO: 594998 - RNA, 15 nt, Escherichia coli CFT073
uaaggccgccaggca

SEQ ID NO: 594999 - RNA, 19 nt, Escherichia coli CFT073
uaaggcguuugcgucgcau

SEQ ID NO: 595000 - RNA, 15 nt, Escherichia coli CFT073
uaagggacaucaggu

SEQ ID NO: 595001 - RNA, 15 nt, Escherichia coli CFT073
uaagccugcaucacg

SEQ ID NO: 595002 - RNA, 18 nt, Escherichia coli CFT073
uaagcgaacauccggcuc

SEQ ID NO: 595003 - RNA, 17 nt, Escherichia coli CFT073
uaagcgacgggcgacaa

SEQ ID NO: 595004 - RNA, 22 nt, Escherichia coli CFT073
uaagcgauaacgcuggcagcaa

SEQ ID NO: 595005 - RNA, 19 nt, Escherichia coli CFT073
uaagcgcaucgacgccauc

SEQ ID NO: 595006 - RNA, 15 nt, Escherichia coli CFT073
uaaucaacaaacgcu

SEQ ID NO: 595007 - RNA, 13 nt, Escherichia coli CFT073
uaaucaacgcgcc

SEQ ID NO: 595008 - RNA, 17 nt, Escherichia coli CFT073
uaauauaaauuaauaag

SEQ ID NO: 595009 - RNA, 17 nt, Escherichia coli CFT073
uaagguaaugcgcgagc

SEQ ID NO: 595010 - RNA, 16 nt, Escherichia coli CFT073
uaaggucaccaguuca

SEQ ID NO: 595011 - RNA, 14 nt, Escherichia coli CFT073
uaagucaacaccau

SEQ ID NO: 595012 - RNA, 22 nt, Escherichia coli CFT073
uaagucaacaccaucuucaacu

SEQ ID NO: 595013 - RNA, 18 nt, Escherichia coli CFT073
uaagucugcgucaucggc

SEQ ID NO: 595014 - RNA, 15 nt, Escherichia coli CFT073
uaacaguaguuacgc

SEQ ID NO: 595015 - RNA, 20 nt, Escherichia coli CFT073
uaacagugccgcgcauagca

SEQ ID NO: 595016 - RNA, 14 nt, Escherichia coli CFT073
uaacauaacagcca

SEQ ID NO: 595017 - RNA, 19 nt, Escherichia coli CFT073
uaacauuuuaguuuacauu

SEQ ID NO: 595018 - RNA, 20 nt, Escherichia coli CFT073
uaaccaucagcuccgggcua

SEQ ID NO: 595019 - RNA, 15 nt, Escherichia coli CFT073
uaaccaugcagcgcc

SEQ ID NO: 595020 - RNA, 17 nt, Escherichia coli CFT073
uaaacgauaauacgucg

SEQ ID NO: 595021 - RNA, 20 nt, Escherichia coli CFT073
uaaacgccuuauccggccua

SEQ ID NO: 595022 - RNA, 20 nt, Escherichia coli CFT073
uaaacgccuuauccguccua

SEQ ID NO: 595023 - RNA, 22 nt, Escherichia coli CFT073
uaaacggcauaaauuucaggca

SEQ ID NO: 595024 - RNA, 15 nt, Escherichia coli CFT073
uaaacgggcgaugga

SEQ ID NO: 595025 - RNA, 14 nt, Escherichia coli CFT073
uaacagcagcagcg

SEQ ID NO: 595026 - RNA, 18 nt, Escherichia coli CFT073
uaacagccaugccgccac

SEQ ID NO: 595027 - RNA, 23 nt, Escherichia coli CFT073
uaacagcccaauaccuucaucga

SEQ ID NO: 595028 - RNA, 12 nt, Escherichia coli CFT073
uaaaccgccagu

SEQ ID NO: 595029 - RNA, 13 nt, Escherichia coli CFT073
uaacguccaguug

SEQ ID NO: 595030 - RNA, 21 nt, Escherichia coli CFT073
uaacguccauucccuggcacu

SEQ ID NO: 595031 - RNA, 16 nt, Escherichia coli CFT073
uaacguuauaaccgcc

SEQ ID NO: 595032 - RNA, 22 nt, Escherichia coli CFT073
uaacguugcucaaggguuucgc

SEQ ID NO: 595033 - RNA, 22 nt, Escherichia coli CFT073
uaacguugggugcaaucaguac

SEQ ID NO: 595034 - RNA, 18 nt, Escherichia coli CFT073
uaacguuuaucccaguca

SEQ ID NO: 595035 - RNA, 18 nt, Escherichia coli CFT073
uaacguuucuuucaucag

SEQ ID NO: 595036 - RNA, 13 nt, Escherichia coli CFT073
uaacguuuuacgc

SEQ ID NO: 595037 - RNA, 18 nt, Escherichia coli CFT073
uaacggcagaagcagcag

SEQ ID NO: 595038 - RNA, 17 nt, Escherichia coli CFT073
uaacggcagaucgguaa

SEQ ID NO: 595039 - RNA, 21 nt, Escherichia coli CFT073
uaacggcgguaaacucgugau

SEQ ID NO: 595040 - RNA, 21 nt, Escherichia coli CFT073
uaacggcugauaacaauauca

SEQ ID NO: 595041 - RNA, 19 nt, Escherichia coli CFT073
uaacgcguccuguaacgca

SEQ ID NO: 595042 - RNA, 21 nt, Escherichia coli CFT073
uaacgcagcaaaagcaggcac

SEQ ID NO: 595043 - RNA, 20 nt, Escherichia coli CFT073
uaacgcccgagccgguugcc

SEQ ID NO: 595044 - RNA, 19 nt, Escherichia coli CFT073
uaacgccgcauccggcaua

SEQ ID NO: 595045 - RNA, 14 nt, Escherichia coli CFT073
uaacgccgcuauac

SEQ ID NO: 595046 - RNA, 22 nt, Escherichia coli CFT073
uaacgccuuauccggccugcaa

SEQ ID NO: 595047 - RNA, 20 nt, Escherichia coli CFT073
uaacgcgccaauagccgcac

SEQ ID NO: 595048 - RNA, 21 nt, Escherichia coli CFT073
uaacccaguacaacgccgauu

SEQ ID NO: 595049 - RNA, 18 nt, Escherichia coli CFT073
uaacccgcgacgacgaca

SEQ ID NO: 595050 - RNA, 19 nt, Escherichia coli CFT073
uaaccgccagcacagccag

SEQ ID NO: 595051 - RNA, 15 nt, Escherichia coli CFT073
uaaccgcccaccgcc

SEQ ID NO: 595052 - RNA, 23 nt, Escherichia coli CFT073
uaaccgcccagugccagcaccac

SEQ ID NO: 595053 - RNA, 17 nt, Escherichia coli CFT073
uaacgaucaucacgaca

SEQ ID NO: 595054 - RNA, 20 nt, Escherichia coli CFT073
uaacgauuacucguuaucag

SEQ ID NO: 595055 - RNA, 15 nt, Escherichia coli CFT073
guuucgggcgguuug

SEQ ID NO: 595056 - RNA, 23 nt, Escherichia coli CFT073
guuuccggugcuuuauacaaaug

SEQ ID NO: 595057 - RNA, 18 nt, Escherichia coli CFT073
guuucgcauccagagauu

SEQ ID NO: 595058 - RNA, 16 nt, Escherichia coli CFT073
guuucgccugccagau

SEQ ID NO: 595059 - RNA, 22 nt, Escherichia coli CFT073
guuucgaaauccgguucauggu

SEQ ID NO: 595060 - RNA, 18 nt, Escherichia coli CFT073
guuucgagaaauucucgu

SEQ ID NO: 595061 - RNA, 21 nt, Escherichia coli CFT073
guuguaaaaaaccccgcuccg

SEQ ID NO: 595062 - RNA, 16 nt, Escherichia coli CFT073
guuggugcgccgguaa

SEQ ID NO: 595063 - RNA, 15 nt, Escherichia coli CFT073
guuggguugccagcg

SEQ ID NO: 595064 - RNA, 18 nt, Escherichia coli CFT073
guugguaccguaaaaaua

SEQ ID NO: 595065 - RNA, 13 nt, Escherichia coli CFT073
guuuuaagguuuc

SEQ ID NO: 595066 - RNA, 20 nt, Escherichia coli CFT073
guuugucccuugucuggcau

SEQ ID NO: 595067 - RNA, 14 nt, Escherichia coli CFT073
guuugucuauuccg

SEQ ID NO: 595068 - RNA, 14 nt, Escherichia coli CFT073
guuuggucuccugc

SEQ ID NO: 595069 - RNA, 22 nt, Escherichia coli CFT073
guuugguuaagucacgggcggu

SEQ ID NO: 595070 - RNA, 12 nt, Escherichia coli CFT073
guuugcgcagcu

SEQ ID NO: 595071 - RNA, 19 nt, Escherichia coli CFT073
guuugccggauacguuuga

SEQ ID NO: 595072 - RNA, 16 nt, Escherichia coli CFT073
guuuggagccgcuggc

SEQ ID NO: 595073 - RNA, 17 nt, Escherichia coli CFT073
guuuggagccgcuggca

SEQ ID NO: 595074 - RNA, 14 nt, Escherichia coli CFT073
guuucuucgaagaa

SEQ ID NO: 595075 - RNA, 17 nt, Escherichia coli CFT073
guuucuucacccuuuuc

SEQ ID NO: 595076 - RNA, 19 nt, Escherichia coli CFT073
guuucugccagcguggcga

SEQ ID NO: 595077 - RNA, 15 nt, Escherichia coli CFT073
guuucuggcaccagg

SEQ ID NO: 595078 - RNA, 21 nt, Escherichia coli CFT073
guuucuccccaaggacgcguc

SEQ ID NO: 595079 - RNA, 15 nt, Escherichia coli CFT073
guuugaucgcuucca

SEQ ID NO: 595080 - RNA, 18 nt, Escherichia coli CFT073
guuugccauaaccugcca

SEQ ID NO: 595081 - RNA, 15 nt, Escherichia coli CFT073
guuugccgcugucca

SEQ ID NO: 595082 - RNA, 18 nt, Escherichia coli CFT073
guuugaaagaugcuggau

SEQ ID NO: 595083 - RNA, 17 nt, Escherichia coli CFT073
uaaaaagaagaucauca

SEQ ID NO: 595084 - RNA, 18 nt, Escherichia coli CFT073
uaaaaauccgguugcuac

SEQ ID NO: 595085 - RNA, 14 nt, Escherichia coli CFT073
guuuuuuuuaucac

SEQ ID NO: 595086 - RNA, 16 nt, Escherichia coli CFT073
uaaaaucaacgccgca

SEQ ID NO: 595087 - RNA, 22 nt, Escherichia coli CFT073
guuuucucguuggguugccagc

SEQ ID NO: 595088 - RNA, 13 nt, Escherichia coli CFT073
guuuucugccaga

SEQ ID NO: 595089 - RNA, 19 nt, Escherichia coli CFT073
guuuucucaaugaugccgc

SEQ ID NO: 595090 - RNA, 11 nt, Escherichia coli CFT073
guuuugccauc

SEQ ID NO: 595091 - RNA, 18 nt, Escherichia coli CFT073
guuuuguagugcgcgcca

SEQ ID NO: 595092 - RNA, 12 nt, Escherichia coli CFT073
guuuuucaacac

SEQ ID NO: 595093 - RNA, 15 nt, Escherichia coli CFT073
guuuuuccccugcca

SEQ ID NO: 595094 - RNA, 17 nt, Escherichia coli CFT073
guuuuuccccugccaga

SEQ ID NO: 595095 - RNA, 22 nt, Escherichia coli CFT073
guuuuuguccccgcaucaguga

SEQ ID NO: 595096 - RNA, 16 nt, Escherichia coli CFT073
guuuuuuaauucagga

SEQ ID NO: 595097 - RNA, 16 nt, Escherichia coli CFT073
guuuuuuacgaugcaa

SEQ ID NO: 595098 - RNA, 14 nt, Escherichia coli CFT073
guuuuugcccauca

SEQ ID NO: 595099 - RNA, 14 nt, Escherichia coli CFT073
guuuuuuauacuca

SEQ ID NO: 595100 - RNA, 21 nt, Escherichia coli CFT073
guuuucgucguacugaccgua

SEQ ID NO: 595101 - RNA, 18 nt, Escherichia coli CFT073
guuuucgccgcauccggc

SEQ ID NO: 595102 - RNA, 21 nt, Escherichia coli CFT073
guuuucccuuuuucauccccg

SEQ ID NO: 595103 - RNA, 18 nt, Escherichia coli CFT073
guuuucacccucgccaua

SEQ ID NO: 595104 - RNA, 14 nt, Escherichia coli CFT073
guuuuccaguuucu

SEQ ID NO: 595105 - RNA, 19 nt, Escherichia coli CFT073
guuuuccauccuccgcagc

SEQ ID NO: 595106 - RNA, 20 nt, Escherichia coli CFT073
guuuucaacgugucuuuuac

SEQ ID NO: 595107 - RNA, 19 nt, Escherichia coli CFT073
guuuuaaaucgccgcauca

SEQ ID NO: 595108 - RNA, 14 nt, Escherichia coli CFT073
guuuuaaacgcagu

SEQ ID NO: 595109 - RNA, 22 nt, Escherichia coli CFT073
guuuuaccugcuauagccuccu

SEQ ID NO: 595110 - RNA, 14 nt, Escherichia coli CFT073
guuuuacgcgucac

SEQ ID NO: 595111 - RNA, 14 nt, Escherichia coli CFT073
guugcgcuucacca

SEQ ID NO: 595112 - RNA, 21 nt, Escherichia coli CFT073
guugcggcugcccaucaucgu

SEQ ID NO: 595113 - RNA, 16 nt, Escherichia coli CFT073
guugcggacgcgcagg

SEQ ID NO: 595114 - RNA, 18 nt, Escherichia coli CFT073
guugccaguaccaucaau

SEQ ID NO: 595115 - RNA, 16 nt, Escherichia coli CFT073
guugcauuccagauga

SEQ ID NO: 595116 - RNA, 19 nt, Escherichia coli CFT073
guugcauaaaugccgcaau

SEQ ID NO: 595117 - RNA, 18 nt, Escherichia coli CFT073
guugcauaauuucuucgu

SEQ ID NO: 595118 - RNA, 13 nt, Escherichia coli CFT073
guugccagcgaca

SEQ ID NO: 595119 - RNA, 12 nt, Escherichia coli CFT073
guugccagcaac

SEQ ID NO: 595120 - RNA, 15 nt, Escherichia coli CFT073
guugcgucgaaacca

SEQ ID NO: 595121 - RNA, 22 nt, Escherichia coli CFT073
guugcucggcaaggccaauacc

SEQ ID NO: 595122 - RNA, 22 nt, Escherichia coli CFT073
guugcgugcuaaaugucauccc

SEQ ID NO: 595123 - RNA, 13 nt, Escherichia coli CFT073
guugaugaugacg

SEQ ID NO: 595124 - RNA, 13 nt, Escherichia coli CFT073
guugaguccggua

SEQ ID NO: 595125 - RNA, 19 nt, Escherichia coli CFT073
guugaguacgcauccccag

SEQ ID NO: 595126 - RNA, 11 nt, Escherichia coli CFT073
guugcaccagc

SEQ ID NO: 595127 - RNA, 14 nt, Escherichia coli CFT073
guugcaccagcaau

SEQ ID NO: 595128 - RNA, 22 nt, Escherichia coli CFT073
guugauuucaccaucuucacug

SEQ ID NO: 595129 - RNA, 20 nt, Escherichia coli CFT073
guugauuuuguucaauaaga

SEQ ID NO: 595130 - RNA, 16 nt, Escherichia coli CFT073
guugaugcucagccuc

SEQ ID NO: 595131 - RNA, 17 nt, Escherichia coli CFT073
guugcagauuugccagu

SEQ ID NO: 595132 - RNA, 22 nt, Escherichia coli CFT073
guucuuucaggcgugaagcccc

SEQ ID NO: 595133 - RNA, 14 nt, Escherichia coli CFT073
guucugucgcucug

SEQ ID NO: 595134 - RNA, 17 nt, Escherichia coli CFT073
guucuucacugacgccc

SEQ ID NO: 595135 - RNA, 22 nt, Escherichia coli CFT073
guucuucgccaauggcugccgc

SEQ ID NO: 595136 - RNA, 18 nt, Escherichia coli CFT073
guugaggcuaauaaacag

SEQ ID NO: 595137 - RNA, 12 nt, Escherichia coli CFT073
gugucggaugcg

SEQ ID NO: 595138 - RNA, 14 nt, Escherichia coli CFT073
gugucgccaucaaa

SEQ ID NO: 595139 - RNA, 16 nt, Escherichia coli CFT073
gugucugauugccgga

SEQ ID NO: 595140 - RNA, 15 nt, Escherichia coli CFT073
gugguuaccgccagc

SEQ ID NO: 595141 - RNA, 16 nt, Escherichia coli CFT073
gugguuaccgccagca

SEQ ID NO: 595142 - RNA, 23 nt, Escherichia coli CFT073
gugucagugcgcgauagauagcg

SEQ ID NO: 595143 - RNA, 19 nt, Escherichia coli CFT073
guggugaacgacacacagu

SEQ ID NO: 595144 - RNA, 12 nt, Escherichia coli CFT073
gugggccugaua

SEQ ID NO: 595145 - RNA, 14 nt, Escherichia coli CFT073
guggcauuacgcag

SEQ ID NO: 595146 - RNA, 19 nt, Escherichia coli CFT073
gugguaccaggaucagcaa

SEQ ID NO: 595147 - RNA, 20 nt, Escherichia coli CFT073
gugguaccaggaucagcaaa

SEQ ID NO: 595148 - RNA, 13 nt, Escherichia coli CFT073
guggguucaucga

SEQ ID NO: 595149 - RNA, 24 nt, Escherichia coli CFT073
gugggucugacugguaacguggca

SEQ ID NO: 595150 - RNA, 22 nt, Escherichia coli CFT073
guggucgaugauuuccgccagc

SEQ ID NO: 595151 - RNA, 20 nt, Escherichia coli CFT073
guggucaaauuucuucagcc

SEQ ID NO: 595152 - RNA, 20 nt, Escherichia coli CFT073
guggucgaauccccucaaua

SEQ ID NO: 595153 - RNA, 21 nt, Escherichia coli CFT073
guucauuuuguaggccugaua

SEQ ID NO: 595154 - RNA, 17 nt, Escherichia coli CFT073
guucaugacgcaggcgu

SEQ ID NO: 595155 - RNA, 17 nt, Escherichia coli CFT073
guuccacucuuucagca

SEQ ID NO: 595156 - RNA, 22 nt, Escherichia coli CFT073
guuccacucuuucagcaccagc

SEQ ID NO: 595157 - RNA, 18 nt, Escherichia coli CFT073
guucauaccacgccauca

SEQ ID NO: 595158 - RNA, 14 nt, Escherichia coli CFT073
guucagugauggca

SEQ ID NO: 595159 - RNA, 22 nt, Escherichia coli CFT073
guucaggcgauaguagagaucc

SEQ ID NO: 595160 - RNA, 11 nt, Escherichia coli CFT073
guucaucaucg

SEQ ID NO: 595161 - RNA, 16 nt, Escherichia coli CFT073
guucauccagacgggu

SEQ ID NO: 595162 - RNA, 20 nt, Escherichia coli CFT073
guuccugacuugccagccau

SEQ ID NO: 595163 - RNA, 14 nt, Escherichia coli CFT073
guuccugcaucgcc

SEQ ID NO: 595164 - RNA, 14 nt, Escherichia coli CFT073
guuccuguauuuga

SEQ ID NO: 595165 - RNA, 19 nt, Escherichia coli CFT073
guuccggauaucggcagcg

SEQ ID NO: 595166 - RNA, 21 nt, Escherichia coli CFT073
guuccggcaaucaacagauaa

SEQ ID NO: 595167 - RNA, 21 nt, Escherichia coli CFT073
guucccagccaguccggcaau

SEQ ID NO: 595168 - RNA, 12 nt, Escherichia coli CFT073
guuccgcaaucc

SEQ ID NO: 595169 - RNA, 19 nt, Escherichia coli CFT073
guuaaaaaaagaacaacca

SEQ ID NO: 595170 - RNA, 23 nt, Escherichia coli CFT073
guguuuuccaccgugauccgccg

SEQ ID NO: 595171 - RNA, 19 nt, Escherichia coli CFT073
guguuugaucacuuccagc

SEQ ID NO: 595172 - RNA, 22 nt, Escherichia coli CFT073
guuagaagcaucguggaugaaa

SEQ ID NO: 595173 - RNA, 18 nt, Escherichia coli CFT073
guuacuucuuaaugccca

SEQ ID NO: 595174 - RNA, 22 nt, Escherichia coli CFT073
guguguuugaucacuuccagca

SEQ ID NO: 595175 - RNA, 16 nt, Escherichia coli CFT073
guguuggcaaucagcg

SEQ ID NO: 595176 - RNA, 21 nt, Escherichia coli CFT073
guguuggcaaucagcggcagu

SEQ ID NO: 595177 - RNA, 16 nt, Escherichia coli CFT073
guuaggaccgguuuca

SEQ ID NO: 595178 - RNA, 17 nt, Escherichia coli CFT073
guuauccagcaaccagg

SEQ ID NO: 595179 - RNA, 22 nt, Escherichia coli CFT073
guuauccguuaacgccgcugcu

SEQ ID NO: 595180 - RNA, 15 nt, Escherichia coli CFT073
guuauccuucugcgu

SEQ ID NO: 595181 - RNA, 20 nt, Escherichia coli CFT073
guuauagcgauuuuucauca

SEQ ID NO: 595182 - RNA, 22 nt, Escherichia coli CFT073
guuauagcgcaugacaugcggu

SEQ ID NO: 595183 - RNA, 17 nt, Escherichia coli CFT073
guuauaggcauucucgc

SEQ ID NO: 595184 - RNA, 18 nt, Escherichia coli CFT073
guuauaguguuccugcgg

SEQ ID NO: 595185 - RNA, 17 nt, Escherichia coli CFT073
guuauaucuucuuuaua

SEQ ID NO: 595186 - RNA, 17 nt, Escherichia coli CFT073
guuaucgcccugccagc

SEQ ID NO: 595187 - RNA, 19 nt, Escherichia coli CFT073
guuaugcgaaauagcgcca

SEQ ID NO: 595188 - RNA, 21 nt, Escherichia coli CFT073
guucacgcgauuuuucaucga

SEQ ID NO: 595189 - RNA, 20 nt, Escherichia coli CFT073
guucacgccgcauccggcca

SEQ ID NO: 595190 - RNA, 13 nt, Escherichia coli CFT073
guucaccgccauu

SEQ ID NO: 595191 - RNA, 20 nt, Escherichia coli CFT073
guucagcgauguuagcguca

SEQ ID NO: 595192 - RNA, 23 nt, Escherichia coli CFT073
guucagcgguccguugaugcggu

SEQ ID NO: 595193 - RNA, 19 nt, Escherichia coli CFT073
guucagcggugucugccag

SEQ ID NO: 595194 - RNA, 17 nt, Escherichia coli CFT073
guucagccgcuuuaucu

SEQ ID NO: 595195 - RNA, 19 nt, Escherichia coli CFT073
guucagcaaccacaaccuc

SEQ ID NO: 595196 - RNA, 22 nt, Escherichia coli CFT073
guucacuuaaucucugacgcgc

SEQ ID NO: 595197 - RNA, 20 nt, Escherichia coli CFT073
guggagagcaacaucaacag

SEQ ID NO: 595198 - RNA, 23 nt, Escherichia coli CFT073
guggauuaucuucaccgguagua

SEQ ID NO: 595199 - RNA, 22 nt, Escherichia coli CFT073
guggauuuuucgcgaccgccuc

SEQ ID NO: 595200 - RNA, 15 nt, Escherichia coli CFT073
guggcaaacugcgua

SEQ ID NO: 595201 - RNA, 20 nt, Escherichia coli CFT073
guggcaaagaaaucaacaaa

SEQ ID NO: 595202 - RNA, 17 nt, Escherichia coli CFT073
guggcaaaucgacgcca

SEQ ID NO: 595203 - RNA, 15 nt, Escherichia coli CFT073
guggcaaauugccca

SEQ ID NO: 595204 - RNA, 22 nt, Escherichia coli CFT073
guggcaaccgcaaccgccguug

SEQ ID NO: 595205 - RNA, 14 nt, Escherichia coli CFT073
guggcaagcaguag

SEQ ID NO: 595206 - RNA, 14 nt, Escherichia coli CFT073
guggcaaucaucgu

SEQ ID NO: 595207 - RNA, 22 nt, Escherichia coli CFT073
gugcuccuucucugagcuggga

SEQ ID NO: 595208 - RNA, 20 nt, Escherichia coli CFT073
gugcucucaaauaucugccg

SEQ ID NO: 595209 - RNA, 15 nt, Escherichia coli CFT073
gugcuguucugccgg

SEQ ID NO: 595210 - RNA, 16 nt, Escherichia coli CFT073
gugcuuuaaucagcac

SEQ ID NO: 595211 - RNA, 14 nt, Escherichia coli CFT073
guggaaagccccag

SEQ ID NO: 595212 - RNA, 20 nt, Escherichia coli CFT073
guggaaaggccaacauccau

SEQ ID NO: 595213 - RNA, 13 nt, Escherichia coli CFT073
guggaaaucccca

SEQ ID NO: 595214 - RNA, 14 nt, Escherichia coli CFT073
guggaaauccccau

SEQ ID NO: 595215 - RNA, 23 nt, Escherichia coli CFT073
gugcgggaacauaucaaaaagcu

SEQ ID NO: 595216 - RNA, 14 nt, Escherichia coli CFT073
gugcgggaccagca

SEQ ID NO: 595217 - RNA, 21 nt, Escherichia coli CFT073
gugcggcaauuagcggccagc

SEQ ID NO: 595218 - RNA, 13 nt, Escherichia coli CFT073
gugcgauagcaau

SEQ ID NO: 595219 - RNA, 16 nt, Escherichia coli CFT073
gugcgacgccauugcu

SEQ ID NO: 595220 - RNA, 14 nt, Escherichia coli CFT073
gugcgacgggccaa

SEQ ID NO: 595221 - RNA, 23 nt, Escherichia coli CFT073
gugcgacaaacauugcugccaga

SEQ ID NO: 595222 - RNA, 21 nt, Escherichia coli CFT073
gugcauuuuucgcuuuucacc

SEQ ID NO: 595223 - RNA, 14 nt, Escherichia coli CFT073
gugcaucgcgacca

SEQ ID NO: 595224 - RNA, 23 nt, Escherichia coli CFT073
gugcaucgcgaccaaucacacaa

SEQ ID NO: 595225 - RNA, 11 nt, Escherichia coli CFT073
gugcagcgugc

SEQ ID NO: 595226 - RNA, 16 nt, Escherichia coli CFT073
gugccauugcucucgc

SEQ ID NO: 595227 - RNA, 19 nt, Escherichia coli CFT073
gugccauuuacgaacauua

SEQ ID NO: 595228 - RNA, 22 nt, Escherichia coli CFT073
gugccauagcgggcaaucagcg

SEQ ID NO: 595229 - RNA, 12 nt, Escherichia coli CFT073
gugccaugcuga

SEQ ID NO: 595230 - RNA, 22 nt, Escherichia coli CFT073
gugccaaugauuuugaucccgc

SEQ ID NO: 595231 - RNA, 17 nt, Escherichia coli CFT073
gugccagcgccagcacu

SEQ ID NO: 595232 - RNA, 22 nt, Escherichia coli CFT073
gugccaguacgcccacgccagc

SEQ ID NO: 595233 - RNA, 14 nt, Escherichia coli CFT073
gugcaccugccagc

SEQ ID NO: 595234 - RNA, 14 nt, Escherichia coli CFT073
gugcaccagcuggc

SEQ ID NO: 595235 - RNA, 18 nt, Escherichia coli CFT073
gugauaggguacgaccca

SEQ ID NO: 595236 - RNA, 22 nt, Escherichia coli CFT073
gugauaggguacgacccagguu

SEQ ID NO: 595237 - RNA, 13 nt, Escherichia coli CFT073
gugauaaaaaucg

SEQ ID NO: 595238 - RNA, 23 nt, Escherichia coli CFT073
gugauaaaagucaggcaauucuu

SEQ ID NO: 595239 - RNA, 14 nt, Escherichia coli CFT073
gugccgacgguuug

SEQ ID NO: 595240 - RNA, 14 nt, Escherichia coli CFT073
gugccgauaucgau

SEQ ID NO: 595241 - RNA, 13 nt, Escherichia coli CFT073
gugcccgccagug

SEQ ID NO: 595242 - RNA, 15 nt, Escherichia coli CFT073
gugccuuccaucccu

SEQ ID NO: 595243 - RNA, 23 nt, Escherichia coli CFT073
gugccuuauccgacauuucugcu

SEQ ID NO: 595244 - RNA, 16 nt, Escherichia coli CFT073
gugcgaaaaaaauuac

SEQ ID NO: 595245 - RNA, 17 nt, Escherichia coli CFT073
gugcgaaaaaaauuacu

SEQ ID NO: 595246 - RNA, 18 nt, Escherichia coli CFT073
gugccgguaaagcaauga

SEQ ID NO: 595247 - RNA, 21 nt, Escherichia coli CFT073
gugccggucugaauacgcccu

SEQ ID NO: 595248 - RNA, 15 nt, Escherichia coli CFT073
gugccgguuucacgu

SEQ ID NO: 595249 - RNA, 14 nt, Escherichia coli CFT073
gugccgcgccgcgc

SEQ ID NO: 595250 - RNA, 16 nt, Escherichia coli CFT073
ugcgcaugaccuuuca

SEQ ID NO: 595251 - RNA, 16 nt, Escherichia coli CFT073
ugcgccgcgagcauuu

SEQ ID NO: 595252 - RNA, 18 nt, Escherichia coli CFT073
ugcgcgaagaaacgaccu

SEQ ID NO: 595253 - RNA, 18 nt, Escherichia coli CFT073
ugcgccuuugaugccacc

SEQ ID NO: 595254 - RNA, 20 nt, Escherichia coli CFT073
ugcgccuuuuuucgccgcag

SEQ ID NO: 595255 - RNA, 16 nt, Escherichia coli CFT073
ugcgcgaaaacgcaua

SEQ ID NO: 595256 - RNA, 18 nt, Escherichia coli CFT073
ugcgcggccagugccagu

SEQ ID NO: 595257 - RNA, 13 nt, Escherichia coli CFT073
ugcgcugcgcuuc

SEQ ID NO: 595258 - RNA, 19 nt, Escherichia coli CFT073
ugcgcucuaaaaucaucac

SEQ ID NO: 595259 - RNA, 15 nt, Escherichia coli CFT073
ugcgcuacgcuuauc

SEQ ID NO: 595260 - RNA, 22 nt, Escherichia coli CFT073
ugcgcguuauuuguugccggau

SEQ ID NO: 595261 - RNA, 22 nt, Escherichia coli CFT073
ugcgcuauaucgcugauaucaa

SEQ ID NO: 595262 - RNA, 22 nt, Escherichia coli CFT073
ugcgcuccgcuuaucaggccua

SEQ ID NO: 595263 - RNA, 23 nt, Escherichia coli CFT073
ugcggagaaagucguaggccuga

SEQ ID NO: 595264 - RNA, 16 nt, Escherichia coli CFT073
ugcggaggcaaagccu

SEQ ID NO: 595265 - RNA, 18 nt, Escherichia coli CFT073
ugcggaggcauagcguuc

SEQ ID NO: 595266 - RNA, 22 nt, Escherichia coli CFT073
ugcggcaggucaucgugcguca

SEQ ID NO: 595267 - RNA, 16 nt, Escherichia coli CFT073
ugcggcauaaacgccu

SEQ ID NO: 595268 - RNA, 20 nt, Escherichia coli CFT073
ugcggcaucauacacgccgc

SEQ ID NO: 595269 - RNA, 16 nt, Escherichia coli CFT073
ugccugaaauuuaucu

SEQ ID NO: 595270 - RNA, 23 nt, Escherichia coli CFT073
ugccugauuguuuguagccgcca

SEQ ID NO: 595271 - RNA, 15 nt, Escherichia coli CFT073
ugccugcaaugccgu

SEQ ID NO: 595272 - RNA, 11 nt, Escherichia coli CFT073
ugccugaaaaa

SEQ ID NO: 595273 - RNA, 12 nt, Escherichia coli CFT073
ugccucgcccac

SEQ ID NO: 595274 - RNA, 13 nt, Escherichia coli CFT073
ugccucccauuca

SEQ ID NO: 595275 - RNA, 23 nt, Escherichia coli CFT073
ugccgucugggcaaaaucaucac

SEQ ID NO: 595276 - RNA, 19 nt, Escherichia coli CFT073
ugccguaggcccagccgug

SEQ ID NO: 595277 - RNA, 22 nt, Escherichia coli CFT073
ugccgucaaucggaucgauauc

SEQ ID NO: 595278 - RNA, 16 nt, Escherichia coli CFT073
ugccgcgcuguucguu

SEQ ID NO: 595279 - RNA, 23 nt, Escherichia coli CFT073
aauagugguaccaggaucagcaa

SEQ ID NO: 595280 - RNA, 23 nt, Escherichia coli CFT073
aauaguucuggucuggcccacga

SEQ ID NO: 595281 - RNA, 23 nt, Escherichia coli CFT073
aauagucaagccaccgccgcuac

SEQ ID NO: 595282 - RNA, 14 nt, Escherichia coli CFT073
aauagucgugcggu

SEQ ID NO: 595283 - RNA, 15 nt, Escherichia coli CFT073
aauagugauguucug

SEQ ID NO: 595284 - RNA, 18 nt, Escherichia coli CFT073
aauagugcuucaaauauu

SEQ ID NO: 595285 - RNA, 15 nt, Escherichia coli CFT073
ugcgauccugcagau

SEQ ID NO: 595286 - RNA, 12 nt, Escherichia coli CFT073
ugcgauccacgc

SEQ ID NO: 595287 - RNA, 12 nt, Escherichia coli CFT073
ugcgcaguacca

SEQ ID NO: 595288 - RNA, 15 nt, Escherichia coli CFT073
ugcgcaguugccgga

SEQ ID NO: 595289 - RNA, 20 nt, Escherichia coli CFT073
ugcgcaggcaagccuugcag

SEQ ID NO: 595290 - RNA, 15 nt, Escherichia coli CFT073
ugccugcuaccggga

SEQ ID NO: 595291 - RNA, 13 nt, Escherichia coli CFT073
ugccugcacucag

SEQ ID NO: 595292 - RNA, 18 nt, Escherichia coli CFT073
ugcgacauagcaaccgga

SEQ ID NO: 595293 - RNA, 18 nt, Escherichia coli CFT073
ugcgacaugcgaucccau

SEQ ID NO: 595294 - RNA, 13 nt, Escherichia coli CFT073
ugcgaaugccaau

SEQ ID NO: 595295 - RNA, 13 nt, Escherichia coli CFT073
ugcgacaccagca

SEQ ID NO: 595296 - RNA, 18 nt, Escherichia coli CFT073
ugcgaaucuaaaucaggu

SEQ ID NO: 595297 - RNA, 17 nt, Escherichia coli CFT073
ugcgagguuauccgcca

SEQ ID NO: 595298 - RNA, 15 nt, Escherichia coli CFT073
ugcgaguaaucaggc

SEQ ID NO: 595299 - RNA, 14 nt, Escherichia coli CFT073
ugcgagcuuucgac

SEQ ID NO: 595300 - RNA, 15 nt, Escherichia coli CFT073
ugcgaccaaacugcu

SEQ ID NO: 595301 - RNA, 15 nt, Escherichia coli CFT073
ugcucaacggugacc

SEQ ID NO: 595302 - RNA, 21 nt, Escherichia coli CFT073
ugcucaagcugaccgauaacc

SEQ ID NO: 595303 - RNA, 13 nt, Escherichia coli CFT073
ugcucaaucgcau

SEQ ID NO: 595304 - RNA, 23 nt, Escherichia coli CFT073
ugcucacagaguauuuccagcuc

SEQ ID NO: 595305 - RNA, 20 nt, Escherichia coli CFT073
ugcucuaccagccccaucag

SEQ ID NO: 595306 - RNA, 22 nt, Escherichia coli CFT073
ugcucuauugccguaaucgccu

SEQ ID NO: 595307 - RNA, 17 nt, Escherichia coli CFT073
ugcugaagcaacaguaa

SEQ ID NO: 595308 - RNA, 22 nt, Escherichia coli CFT073
ugcucuuugguuucgaugccuu

SEQ ID NO: 595309 - RNA, 19 nt, Escherichia coli CFT073
ugcugaacagcuuuuuccu

SEQ ID NO: 595310 - RNA, 16 nt, Escherichia coli CFT073
ugcucuggcagcacca

SEQ ID NO: 595311 - RNA, 18 nt, Escherichia coli CFT073
ugcucuguguaggccgga

SEQ ID NO: 595312 - RNA, 17 nt, Escherichia coli CFT073
ugcucucgccagcacua

SEQ ID NO: 595313 - RNA, 14 nt, Escherichia coli CFT073
ugcugcgccagcgg

SEQ ID NO: 595314 - RNA, 20 nt, Escherichia coli CFT073
ugcugccguuccuggcacca

SEQ ID NO: 595315 - RNA, 16 nt, Escherichia coli CFT073
ugcugccgcgccagau

SEQ ID NO: 595316 - RNA, 12 nt, Escherichia coli CFT073
ugcugccgcuau

SEQ ID NO: 595317 - RNA, 22 nt, Escherichia coli CFT073
ugcuggcgcacguucugucgcu

SEQ ID NO: 595318 - RNA, 18 nt, Escherichia coli CFT073
aauaucaucgauuuucug

SEQ ID NO: 595319 - RNA, 20 nt, Escherichia coli CFT073
aauaucauuaagccgaucgu

SEQ ID NO: 595320 - RNA, 20 nt, Escherichia coli CFT073
ugcguggcgcgcgucacgau

SEQ ID NO: 595321 - RNA, 20 nt, Escherichia coli CFT073
ugcguuggcuucaccuuuca

SEQ ID NO: 595322 - RNA, 13 nt, Escherichia coli CFT073
ugcguucgcacca

SEQ ID NO: 595323 - RNA, 15 nt, Escherichia coli CFT073
aauauccccagccua

SEQ ID NO: 595324 - RNA, 14 nt, Escherichia coli CFT073
aauauccgccguau

SEQ ID NO: 595325 - RNA, 17 nt, Escherichia coli CFT073
ugcguuuguccgccaga

SEQ ID NO: 595326 - RNA, 17 nt, Escherichia coli CFT073
ugcgucagggcgaacuu

SEQ ID NO: 595327 - RNA, 22 nt, Escherichia coli CFT073
ugcgucccuacugcacucauag

SEQ ID NO: 595328 - RNA, 17 nt, Escherichia coli CFT073
ugcgugcgcccaucauu

SEQ ID NO: 595329 - RNA, 19 nt, Escherichia coli CFT073
ugcgugaucgaaaaucgcu

SEQ ID NO: 595330 - RNA, 20 nt, Escherichia coli CFT073
ugcggcgcgagcgccuuauc

SEQ ID NO: 595331 - RNA, 19 nt, Escherichia coli CFT073
ugcguaaucgccgaaccag

SEQ ID NO: 595332 - RNA, 14 nt, Escherichia coli CFT073
ugcguaaucuuuuc

SEQ ID NO: 595333 - RNA, 13 nt, Escherichia coli CFT073
uggaugaucgcgg

SEQ ID NO: 595334 - RNA, 13 nt, Escherichia coli CFT073
uggaucuguugcu

SEQ ID NO: 595335 - RNA, 15 nt, Escherichia coli CFT073
uggaucuguugcugg

SEQ ID NO: 595336 - RNA, 12 nt, Escherichia coli CFT073
uggaucgaacuc

SEQ ID NO: 595337 - RNA, 18 nt, Escherichia coli CFT073
uggaucaaggauugcagc

SEQ ID NO: 595338 - RNA, 20 nt, Escherichia coli CFT073
uggaucacauacgcgguauu

SEQ ID NO: 595339 - RNA, 15 nt, Escherichia coli CFT073
uggaucaccaucgga

SEQ ID NO: 595340 - RNA, 21 nt, Escherichia coli CFT073
uggauauggaaaaacagcaaa

SEQ ID NO: 595341 - RNA, 21 nt, Escherichia coli CFT073
uggauauggaacggaugcagc

SEQ ID NO: 595342 - RNA, 20 nt, Escherichia coli CFT073
uggcaaagaaaucaacaaau

SEQ ID NO: 595343 - RNA, 13 nt, Escherichia coli CFT073
uggcaacaacgca

SEQ ID NO: 595344 - RNA, 18 nt, Escherichia coli CFT073
uggaugaaucucaauucc

SEQ ID NO: 595345 - RNA, 15 nt, Escherichia coli CFT073
uggcagaccuuuugg

SEQ ID NO: 595346 - RNA, 19 nt, Escherichia coli CFT073
uggcacguugcugcggcgu

SEQ ID NO: 595347 - RNA, 16 nt, Escherichia coli CFT073
uggcagcaagcgcauc

SEQ ID NO: 595348 - RNA, 17 nt, Escherichia coli CFT073
uggcagcaagcgcaucg

SEQ ID NO: 595349 - RNA, 20 nt, Escherichia coli CFT073
uggcagcaccacgcagaaaa

SEQ ID NO: 595350 - RNA, 21 nt, Escherichia coli CFT073
uggcaauaauaucccaacgca

SEQ ID NO: 595351 - RNA, 18 nt, Escherichia coli CFT073
uggcaaucaucguacugu

SEQ ID NO: 595352 - RNA, 20 nt, Escherichia coli CFT073
uggcaagccugaaaacgaaa

SEQ ID NO: 595353 - RNA, 14 nt, Escherichia coli CFT073
uggcaccaucagcu

SEQ ID NO: 595354 - RNA, 23 nt, Escherichia coli CFT073
uggcaaucgccagcggcagcucg

SEQ ID NO: 595355 - RNA, 18 nt, Escherichia coli CFT073
uggcacaagacugacaau

SEQ ID NO: 595356 - RNA, 19 nt, Escherichia coli CFT073
uggagcacugcgcccgcca

SEQ ID NO: 595357 - RNA, 16 nt, Escherichia coli CFT073
uggauaaggcaacgcc

SEQ ID NO: 595358 - RNA, 20 nt, Escherichia coli CFT073
uggacuguaagccaucaccg

SEQ ID NO: 595359 - RNA, 18 nt, Escherichia coli CFT073
uggagaucccgugacggu

SEQ ID NO: 595360 - RNA, 14 nt, Escherichia coli CFT073
uggacguggugcgc

SEQ ID NO: 595361 - RNA, 13 nt, Escherichia coli CFT073
uggacgucgauaa

SEQ ID NO: 595362 - RNA, 14 nt, Escherichia coli CFT073
uggacgucgauaaa

SEQ ID NO: 595363 - RNA, 19 nt, Escherichia coli CFT073
uggaaguuccggcaccguu

SEQ ID NO: 595364 - RNA, 19 nt, Escherichia coli CFT073
uggaaccucgcgaaugcuu

SEQ ID NO: 595365 - RNA, 21 nt, Escherichia coli CFT073
uggaacccgcagccgucgcca

SEQ ID NO: 595366 - RNA, 22 nt, Escherichia coli CFT073
ugcuguaguuguucaacaguaa

SEQ ID NO: 595367 - RNA, 19 nt, Escherichia coli CFT073
uggacgcaaaaacgcguug

SEQ ID NO: 595368 - RNA, 17 nt, Escherichia coli CFT073
uggaauacuggugcgau

SEQ ID NO: 595369 - RNA, 18 nt, Escherichia coli CFT073
uggaaucaccgccacgcc

SEQ ID NO: 595370 - RNA, 12 nt, Escherichia coli CFT073
uggaaucacuca

SEQ ID NO: 595371 - RNA, 22 nt, Escherichia coli CFT073
ugguuauuucacuucaaccaca

SEQ ID NO: 595372 - RNA, 17 nt, Escherichia coli CFT073
ugguucccgaugcuguu

SEQ ID NO: 595373 - RNA, 13 nt, Escherichia coli CFT073
ugguugaacacau

SEQ ID NO: 595374 - RNA, 22 nt, Escherichia coli CFT073
uguaaagagugugaauauucag

SEQ ID NO: 595375 - RNA, 18 nt, Escherichia coli CFT073
uguaaaaaagcgucgccg

SEQ ID NO: 595376 - RNA, 16 nt, Escherichia coli CFT073
uguaacgucgcaucug

SEQ ID NO: 595377 - RNA, 17 nt, Escherichia coli CFT073
uguaacguuuggcacgc

SEQ ID NO: 595378 - RNA, 14 nt, Escherichia coli CFT073
uguaacgauggcga

SEQ ID NO: 595379 - RNA, 19 nt, Escherichia coli CFT073
uguaacuuuguaaggaguu

SEQ ID NO: 595380 - RNA, 20 nt, Escherichia coli CFT073
uguaggccggauaagguguu

SEQ ID NO: 595381 - RNA, 20 nt, Escherichia coli CFT073
uguaggccugauaagacacg

SEQ ID NO: 595382 - RNA, 22 nt, Escherichia coli CFT073
aaucacaggcgcgaugcuacua

SEQ ID NO: 595383 - RNA, 17 nt, Escherichia coli CFT073
aaucacaucgcgcucgu

SEQ ID NO: 595384 - RNA, 12 nt, Escherichia coli CFT073
aaucaaugccac

SEQ ID NO: 595385 - RNA, 16 nt, Escherichia coli CFT073
uguauuguucgugcaa

SEQ ID NO: 595386 - RNA, 22 nt, Escherichia coli CFT073
ugucagggacguaccaaugacc

SEQ ID NO: 595387 - RNA, 11 nt, Escherichia coli CFT073
uguaucaccac

SEQ ID NO: 595388 - RNA, 15 nt, Escherichia coli CFT073
uguaucgaugcuguu

SEQ ID NO: 595389 - RNA, 20 nt, Escherichia coli CFT073
aaucaccauauucagcagca

SEQ ID NO: 595390 - RNA, 17 nt, Escherichia coli CFT073
aaucaccaucagcagca

SEQ ID NO: 595391 - RNA, 13 nt, Escherichia coli CFT073
ugucauagcaaua

SEQ ID NO: 595392 - RNA, 13 nt, Escherichia coli CFT073
ugucaguaauugc

SEQ ID NO: 595393 - RNA, 13 nt, Escherichia coli CFT073
ugucagugcgcga

SEQ ID NO: 595394 - RNA, 11 nt, Escherichia coli CFT073
ugucaucaauu

SEQ ID NO: 595395 - RNA, 12 nt, Escherichia coli CFT073
ugucauucgccu

SEQ ID NO: 595396 - RNA, 13 nt, Escherichia coli CFT073
uguccaaauccuu

SEQ ID NO: 595397 - RNA, 22 nt, Escherichia coli CFT073
uguccacgccgcugucuaccag

SEQ ID NO: 595398 - RNA, 15 nt, Escherichia coli CFT073
uguccagaugcugua

SEQ ID NO: 595399 - RNA, 21 nt, Escherichia coli CFT073
ugucccaaaaugucggaugcg

SEQ ID NO: 595400 - RNA, 14 nt, Escherichia coli CFT073
uguccauuaauacc

SEQ ID NO: 595401 - RNA, 22 nt, Escherichia coli CFT073
uguccuuccaguaaccagccgu

SEQ ID NO: 595402 - RNA, 23 nt, Escherichia coli CFT073
ugucgacaaagccgcaggcgugc

SEQ ID NO: 595403 - RNA, 14 nt, Escherichia coli CFT073
ugucgcgcaaagua

SEQ ID NO: 595404 - RNA, 23 nt, Escherichia coli CFT073
ugucgcgcacucuacucccugcu

SEQ ID NO: 595405 - RNA, 14 nt, Escherichia coli CFT073
ugucgcgcagcacu

SEQ ID NO: 595406 - RNA, 13 nt, Escherichia coli CFT073
ugucgcaucaggc

SEQ ID NO: 595407 - RNA, 16 nt, Escherichia coli CFT073
ugucgauuuguacucu

SEQ ID NO: 595408 - RNA, 18 nt, Escherichia coli CFT073
aaucaaauuugccagcga

SEQ ID NO: 595409 - RNA, 15 nt, Escherichia coli CFT073
aaucaacaaauucgc

SEQ ID NO: 595410 - RNA, 12 nt, Escherichia coli CFT073
aaucaacaggaa

SEQ ID NO: 595411 - RNA, 17 nt, Escherichia coli CFT073
aaucaacauaaugccga

SEQ ID NO: 595412 - RNA, 16 nt, Escherichia coli CFT073
aaucaacauauuucuc

SEQ ID NO: 595413 - RNA, 14 nt, Escherichia coli CFT073
aaucaaaucacgau

SEQ ID NO: 595414 - RNA, 21 nt, Escherichia coli CFT073
aaucaaccgcgccugaccauu

SEQ ID NO: 595415 - RNA, 21 nt, Escherichia coli CFT073
aaucaacgccaccaucacuau

SEQ ID NO: 595416 - RNA, 15 nt, Escherichia coli CFT073
aaucaacgcgaaaau

SEQ ID NO: 595417 - RNA, 22 nt, Escherichia coli CFT073
aaucaacggcaacaauuuccgc

SEQ ID NO: 595418 - RNA, 15 nt, Escherichia coli CFT073
aaucaagcgccgcca

SEQ ID NO: 595419 - RNA, 15 nt, Escherichia coli CFT073
aaucaauauccacug

SEQ ID NO: 595420 - RNA, 11 nt, Escherichia coli CFT073
aaucaaucacc

SEQ ID NO: 595421 - RNA, 15 nt, Escherichia coli CFT073
uggugaguggcgcga

SEQ ID NO: 595422 - RNA, 16 nt, Escherichia coli CFT073
ugguuaaauugaaauu

SEQ ID NO: 595423 - RNA, 13 nt, Escherichia coli CFT073
ugguuacaucaac

SEQ ID NO: 595424 - RNA, 14 nt, Escherichia coli CFT073
ugguuaccaucaac

SEQ ID NO: 595425 - RNA, 16 nt, Escherichia coli CFT073
uggugguucagauaaa

SEQ ID NO: 595426 - RNA, 15 nt, Escherichia coli CFT073
ugguguaaccuucac

SEQ ID NO: 595427 - RNA, 14 nt, Escherichia coli CFT073
ugguguaguuaaua

SEQ ID NO: 595428 - RNA, 15 nt, Escherichia coli CFT073
uggugcgaaucaggu

SEQ ID NO: 595429 - RNA, 16 nt, Escherichia coli CFT073
uggugcgauuaccaug

SEQ ID NO: 595430 - RNA, 13 nt, Escherichia coli CFT073
ugguggucgcauc

SEQ ID NO: 595431 - RNA, 17 nt, Escherichia coli CFT073
uggugagugcgguuuug

SEQ ID NO: 595432 - RNA, 16 nt, Escherichia coli CFT073
uggucggaucguucuc

SEQ ID NO: 595433 - RNA, 13 nt, Escherichia coli CFT073
uggucgcguagcc

SEQ ID NO: 595434 - RNA, 19 nt, Escherichia coli CFT073
uggucgcucgagccgcauc

SEQ ID NO: 595435 - RNA, 21 nt, Escherichia coli CFT073
ugggccugaaagcucauaacg

SEQ ID NO: 595436 - RNA, 16 nt, Escherichia coli CFT073
uggguauguuuugucu

SEQ ID NO: 595437 - RNA, 21 nt, Escherichia coli CFT073
uggguaaagacaucgcccgau

SEQ ID NO: 595438 - RNA, 18 nt, Escherichia coli CFT073
ugguaacaguccguggca

SEQ ID NO: 595439 - RNA, 16 nt, Escherichia coli CFT073
uggguuuuuuguugcc

SEQ ID NO: 595440 - RNA, 18 nt, Escherichia coli CFT073
ugguaacaucaauaacaa

SEQ ID NO: 595441 - RNA, 22 nt, Escherichia coli CFT073
ugguaacccauccagcagagau

SEQ ID NO: 595442 - RNA, 13 nt, Escherichia coli CFT073
ugguaacgcgcca

SEQ ID NO: 595443 - RNA, 13 nt, Escherichia coli CFT073
ugguaauucgcca

SEQ ID NO: 595444 - RNA, 21 nt, Escherichia coli CFT073
ugguacaauggagcuaaacag

SEQ ID NO: 595445 - RNA, 18 nt, Escherichia coli CFT073
ugguaccaugggaaaugg

SEQ ID NO: 595446 - RNA, 20 nt, Escherichia coli CFT073
ugguagagauuuuuccccac

SEQ ID NO: 595447 - RNA, 16 nt, Escherichia coli CFT073
uggucagaucagccac

SEQ ID NO: 595448 - RNA, 20 nt, Escherichia coli CFT073
uggucaguuaacaauaacaa

SEQ ID NO: 595449 - RNA, 13 nt, Escherichia coli CFT073
uggucaggaaugg

SEQ ID NO: 595450 - RNA, 14 nt, Escherichia coli CFT073
uggcgugcgggaga

SEQ ID NO: 595451 - RNA, 20 nt, Escherichia coli CFT073
uggcguggagcaacacgcca

SEQ ID NO: 595452 - RNA, 13 nt, Escherichia coli CFT073
uggcgugacacua

SEQ ID NO: 595453 - RNA, 13 nt, Escherichia coli CFT073
uggcguaacgaca

SEQ ID NO: 595454 - RNA, 17 nt, Escherichia coli CFT073
uggcugacacuauucgc

SEQ ID NO: 595455 - RNA, 14 nt, Escherichia coli CFT073
uggcguucacugcc

SEQ ID NO: 595456 - RNA, 20 nt, Escherichia coli CFT073
uggcguugcaccgaggccaa

SEQ ID NO: 595457 - RNA, 16 nt, Escherichia coli CFT073
aauaugcggugccauu

SEQ ID NO: 595458 - RNA, 20 nt, Escherichia coli CFT073
ugggcaccaggcaauuggca

SEQ ID NO: 595459 - RNA, 19 nt, Escherichia coli CFT073
ugggauauaaacucgccaa

SEQ ID NO: 595460 - RNA, 20 nt, Escherichia coli CFT073
ugggauauaaacucgccaaa

SEQ ID NO: 595461 - RNA, 20 nt, Escherichia coli CFT073
uggcuuuccaccaucacgcc

SEQ ID NO: 595462 - RNA, 17 nt, Escherichia coli CFT073
uggcuucccguagcagg

SEQ ID NO: 595463 - RNA, 19 nt, Escherichia coli CFT073
uggcuguuuucagcaccag

SEQ ID NO: 595464 - RNA, 17 nt, Escherichia coli CFT073
uggcugagugauacgua

SEQ ID NO: 595465 - RNA, 19 nt, Escherichia coli CFT073
uggcauaaaagggcagcag

SEQ ID NO: 595466 - RNA, 15 nt, Escherichia coli CFT073
uggcauccagcguuc

SEQ ID NO: 595467 - RNA, 22 nt, Escherichia coli CFT073
uggcauacacgucgucgccaau

SEQ ID NO: 595468 - RNA, 17 nt, Escherichia coli CFT073
uggcagggaaagaaacg

SEQ ID NO: 595469 - RNA, 17 nt, Escherichia coli CFT073
uggcauuaacgcgaaau

SEQ ID NO: 595470 - RNA, 16 nt, Escherichia coli CFT073
uggcaucggcgcacaa

SEQ ID NO: 595471 - RNA, 12 nt, Escherichia coli CFT073
uggcauccgcca

SEQ ID NO: 595472 - RNA, 12 nt, Escherichia coli CFT073
uggcauccgcua

SEQ ID NO: 595473 - RNA, 14 nt, Escherichia coli CFT073
uggccuuccggcac

SEQ ID NO: 595474 - RNA, 16 nt, Escherichia coli CFT073
uggccuuaauuggcca

SEQ ID NO: 595475 - RNA, 19 nt, Escherichia coli CFT073
uggccugcuuuugccagcg

SEQ ID NO: 595476 - RNA, 16 nt, Escherichia coli CFT073
uggccuuuucacaacg

SEQ ID NO: 595477 - RNA, 23 nt, Escherichia coli CFT073
uggccucguggaaaccgagauaa

SEQ ID NO: 595478 - RNA, 13 nt, Escherichia coli CFT073
uggcgacguacca

SEQ ID NO: 595479 - RNA, 18 nt, Escherichia coli CFT073
uggcgacguaccagcguc

SEQ ID NO: 595480 - RNA, 15 nt, Escherichia coli CFT073
uggcgagcagcaaua

SEQ ID NO: 595481 - RNA, 23 nt, Escherichia coli CFT073
uggcgcagcacgacucuccccug

SEQ ID NO: 595482 - RNA, 23 nt, Escherichia coli CFT073
uggcggcagccuccugcacgguc

SEQ ID NO: 595483 - RNA, 22 nt, Escherichia coli CFT073
uggcggcaguugcccgguuucg

SEQ ID NO: 595484 - RNA, 18 nt, Escherichia coli CFT073
uggcggcaucugccaccg

SEQ ID NO: 595485 - RNA, 17 nt, Escherichia coli CFT073
uggcgcgcgucacgaua

SEQ ID NO: 595486 - RNA, 23 nt, Escherichia coli CFT073
aauuuaucggcguuauuacuggu

SEQ ID NO: 595487 - RNA, 19 nt, Escherichia coli CFT073
aauuucacaccaucaacaa

SEQ ID NO: 595488 - RNA, 16 nt, Escherichia coli CFT073
aauuucacgcucaccc

SEQ ID NO: 595489 - RNA, 17 nt, Escherichia coli CFT073
aauuucauaugcgccag

SEQ ID NO: 595490 - RNA, 19 nt, Escherichia coli CFT073
aauuucaucgcuacaccaa

SEQ ID NO: 595491 - RNA, 17 nt, Escherichia coli CFT073
aauuucaugcucaccaa

SEQ ID NO: 595492 - RNA, 12 nt, Escherichia coli CFT073
aauuucgccgca

SEQ ID NO: 595493 - RNA, 13 nt, Escherichia coli CFT073
aauuucgccgcac

SEQ ID NO: 595494 - RNA, 20 nt, Escherichia coli CFT073
aauugucccauuugccagcg

SEQ ID NO: 595495 - RNA, 20 nt, Escherichia coli CFT073
aauugccuggugcccaucac

SEQ ID NO: 595496 - RNA, 19 nt, Escherichia coli CFT073
aauugcauuugaacuggaa

SEQ ID NO: 595497 - RNA, 18 nt, Escherichia coli CFT073
aauugccaaguccugcca

SEQ ID NO: 595498 - RNA, 20 nt, Escherichia coli CFT073
aauugcccccagucgccagu

SEQ ID NO: 595499 - RNA, 21 nt, Escherichia coli CFT073
aauugccgcaccaaccaucag

SEQ ID NO: 595500 - RNA, 12 nt, Escherichia coli CFT073
aauugccgccag

SEQ ID NO: 595501 - RNA, 21 nt, Escherichia coli CFT073
aauugccggaugcggcgugaa

SEQ ID NO: 595502 - RNA, 23 nt, Escherichia coli CFT073
aauucuucaaguguggccgccag

SEQ ID NO: 595503 - RNA, 12 nt, Escherichia coli CFT073
aauucggcaucg

SEQ ID NO: 595504 - RNA, 15 nt, Escherichia coli CFT073
aauucggucagcgua

SEQ ID NO: 595505 - RNA, 14 nt, Escherichia coli CFT073
aauuaauacgccag

SEQ ID NO: 595506 - RNA, 22 nt, Escherichia coli CFT073
aauuaccaccagcgacagccag

SEQ ID NO: 595507 - RNA, 18 nt, Escherichia coli CFT073
aauuaccgcaccaccagc

SEQ ID NO: 595508 - RNA, 15 nt, Escherichia coli CFT073
aauuaauaauauaaa

SEQ ID NO: 595509 - RNA, 16 nt, Escherichia coli CFT073
aauuaacaccaccagc

SEQ ID NO: 595510 - RNA, 19 nt, Escherichia coli CFT073
aauuagcggccagcgggcg

SEQ ID NO: 595511 - RNA, 17 nt, Escherichia coli CFT073
aauuacgacccgaccga

SEQ ID NO: 595512 - RNA, 16 nt, Escherichia coli CFT073
aauuacgauccaccac

SEQ ID NO: 595513 - RNA, 21 nt, Escherichia coli CFT073
aauuacgauguguggcaucgu

SEQ ID NO: 595514 - RNA, 19 nt, Escherichia coli CFT073
aauuacgcaaccaguucau

SEQ ID NO: 595515 - RNA, 16 nt, Escherichia coli CFT073
aauuacgcggugcgcc

SEQ ID NO: 595516 - RNA, 22 nt, Escherichia coli CFT073
aaugcugguuuugugcgccaca

SEQ ID NO: 595517 - RNA, 22 nt, Escherichia coli CFT073
aaugcuuuauacgaugccugca

SEQ ID NO: 595518 - RNA, 13 nt, Escherichia coli CFT073
aaugcuuucagua

SEQ ID NO: 595519 - RNA, 17 nt, Escherichia coli CFT073
aauggaaacagcaccau

SEQ ID NO: 595520 - RNA, 18 nt, Escherichia coli CFT073
aauggacgucgauaaaca

SEQ ID NO: 595521 - RNA, 12 nt, Escherichia coli CFT073
aauggagaaacg

SEQ ID NO: 595522 - RNA, 18 nt, Escherichia coli CFT073
aauggagagaaccagcgc

SEQ ID NO: 595523 - RNA, 19 nt, Escherichia coli CFT073
aauggagcuaaacagagcu

SEQ ID NO: 595524 - RNA, 22 nt, Escherichia coli CFT073
aauggagcuaaacagagcugca

SEQ ID NO: 595525 - RNA, 15 nt, Escherichia coli CFT073
aaugcguucgccagc

SEQ ID NO: 595526 - RNA, 18 nt, Escherichia coli CFT073
aaugcucaagcaucauuu

SEQ ID NO: 595527 - RNA, 17 nt, Escherichia coli CFT073
aaugcuccccuuucuua

SEQ ID NO: 595528 - RNA, 15 nt, Escherichia coli CFT073
aaugccgggccguuu

SEQ ID NO: 595529 - RNA, 17 nt, Escherichia coli CFT073
aaugccguaauccugca

SEQ ID NO: 595530 - RNA, 14 nt, Escherichia coli CFT073
aauuccaguugauu

SEQ ID NO: 595531 - RNA, 20 nt, Escherichia coli CFT073
aauucaggccgucguuaauc

SEQ ID NO: 595532 - RNA, 22 nt, Escherichia coli CFT073
aauucaguaccagcaccugaau

SEQ ID NO: 595533 - RNA, 18 nt, Escherichia coli CFT073
aauucaguacguucacgc

SEQ ID NO: 595534 - RNA, 24 nt, Escherichia coli CFT073
aauuccgcccucgauaugccagac

SEQ ID NO: 595535 - RNA, 12 nt, Escherichia coli CFT073
aauucgccaccg

SEQ ID NO: 595536 - RNA, 21 nt, Escherichia coli CFT073
aauucgccacugcgacaccag

SEQ ID NO: 595537 - RNA, 15 nt, Escherichia coli CFT073
aauucgcccuucggc

SEQ ID NO: 595538 - RNA, 18 nt, Escherichia coli CFT073
aauucacugucguucauu

SEQ ID NO: 595539 - RNA, 15 nt, Escherichia coli CFT073
aauucagcguggcga

SEQ ID NO: 595540 - RNA, 23 nt, Escherichia coli CFT073
aauuauugccuugaugaaaaaac

SEQ ID NO: 595541 - RNA, 11 nt, Escherichia coli CFT073
aaucucacgca

SEQ ID NO: 595542 - RNA, 13 nt, Escherichia coli CFT073
uuuuuuacgccug

SEQ ID NO: 595543 - RNA, 22 nt, Escherichia coli CFT073
aaucgccgcauaauaucuuucc

SEQ ID NO: 595544 - RNA, 14 nt, Escherichia coli CFT073
aaucgccgcaucau

SEQ ID NO: 595545 - RNA, 17 nt, Escherichia coli CFT073
aaucucaucggcgucgg

SEQ ID NO: 595546 - RNA, 21 nt, Escherichia coli CFT073
aaucucguggucaauaucauc

SEQ ID NO: 595547 - RNA, 17 nt, Escherichia coli CFT073
aaucucucguauuucgc

SEQ ID NO: 595548 - RNA, 18 nt, Escherichia coli CFT073
aaucucuuuacccagcgg

SEQ ID NO: 595549 - RNA, 16 nt, Escherichia coli CFT073
uuuugcuguuccagca

SEQ ID NO: 595550 - RNA, 17 nt, Escherichia coli CFT073
uuuugucgcugauucgc

SEQ ID NO: 595551 - RNA, 14 nt, Escherichia coli CFT073
uuuuucauccagcg

SEQ ID NO: 595552 - RNA, 17 nt, Escherichia coli CFT073
uuuuucaugcuauuccu

SEQ ID NO: 595553 - RNA, 13 nt, Escherichia coli CFT073
uuuuucgaaccga

SEQ ID NO: 595554 - RNA, 20 nt, Escherichia coli CFT073
aaucgccagcaucggcaacg

SEQ ID NO: 595555 - RNA, 15 nt, Escherichia coli CFT073
aaucgcccucgccuu

SEQ ID NO: 595556 - RNA, 18 nt, Escherichia coli CFT073
aaucuuuaccggucagga

SEQ ID NO: 595557 - RNA, 24 nt, Escherichia coli CFT073
aaucuggcguguucagaucaucaa

SEQ ID NO: 595558 - RNA, 16 nt, Escherichia coli CFT073
aaucuggucuggugaa

SEQ ID NO: 595559 - RNA, 15 nt, Escherichia coli CFT073
aaucuucacaucauc

SEQ ID NO: 595560 - RNA, 22 nt, Escherichia coli CFT073
aaucuucacugaauaccguaaa

SEQ ID NO: 595561 - RNA, 22 nt, Escherichia coli CFT073
aaugcacccgccagagagcgaa

SEQ ID NO: 595562 - RNA, 18 nt, Escherichia coli CFT073
aaugcacacaaaauugcc

SEQ ID NO: 595563 - RNA, 22 nt, Escherichia coli CFT073
aaugcaauaaaaaagccgccag

SEQ ID NO: 595564 - RNA, 17 nt, Escherichia coli CFT073
aaugcaauuuaucgcag

SEQ ID NO: 595565 - RNA, 19 nt, Escherichia coli CFT073
aaugccccacuuuacggcc

SEQ ID NO: 595566 - RNA, 22 nt, Escherichia coli CFT073
aaugcccaucgugauaaacgua

SEQ ID NO: 595567 - RNA, 15 nt, Escherichia coli CFT073
aaugcccaaaauggc

SEQ ID NO: 595568 - RNA, 12 nt, Escherichia coli CFT073
aaugcccgcagu

SEQ ID NO: 595569 - RNA, 19 nt, Escherichia coli CFT073
aaugccaaauauuucuuua

SEQ ID NO: 595570 - RNA, 22 nt, Escherichia coli CFT073
aaugccaaauguauccaucacc

SEQ ID NO: 595571 - RNA, 14 nt, Escherichia coli CFT073
aaugccacugcgcc

SEQ ID NO: 595572 - RNA, 17 nt, Escherichia coli CFT073
aaugccagaaacaucgg

SEQ ID NO: 595573 - RNA, 10 nt, Escherichia coli CFT073
aaugccagcg

SEQ ID NO: 595574 - RNA, 19 nt, Escherichia coli CFT073
aaugccagcgauaucgcga

SEQ ID NO: 595575 - RNA, 14 nt, Escherichia coli CFT073
aaugccaucaccaa

SEQ ID NO: 595576 - RNA, 20 nt, Escherichia coli CFT073
uuuuaacacacaauuaccuu

SEQ ID NO: 595577 - RNA, 23 nt, Escherichia coli CFT073
uuuuaacaucuuaauagcugcca

SEQ ID NO: 595578 - RNA, 13 nt, Escherichia coli CFT073
uuuguucuucugu

SEQ ID NO: 595579 - RNA, 16 nt, Escherichia coli CFT073
uuuguugagcuggaag

SEQ ID NO: 595580 - RNA, 15 nt, Escherichia coli CFT073
uuuguucagcgggca

SEQ ID NO: 595581 - RNA, 14 nt, Escherichia coli CFT073
uuuguugccggaug

SEQ ID NO: 595582 - RNA, 18 nt, Escherichia coli CFT073
uuuguugcgucgaaacca

SEQ ID NO: 595583 - RNA, 14 nt, Escherichia coli CFT073
uuucgucguggcaa

SEQ ID NO: 595584 - RNA, 15 nt, Escherichia coli CFT073
uuuucgcuggcagac

SEQ ID NO: 595585 - RNA, 10 nt, Escherichia coli CFT073
uuuucgucgc

SEQ ID NO: 595586 - RNA, 14 nt, Escherichia coli CFT073
uuuucacauaagcu

SEQ ID NO: 595587 - RNA, 13 nt, Escherichia coli CFT073
uuuucagcgugcc

SEQ ID NO: 595588 - RNA, 21 nt, Escherichia coli CFT073
uuuucaacgugucuuuuaccg

SEQ ID NO: 595589 - RNA, 20 nt, Escherichia coli CFT073
uuuucucgcgaaccgccugg

SEQ ID NO: 595590 - RNA, 17 nt, Escherichia coli CFT073
uuuugaaucgguggcgg

SEQ ID NO: 595591 - RNA, 17 nt, Escherichia coli CFT073
uuuugcagcuguugcgc

SEQ ID NO: 595592 - RNA, 19 nt, Escherichia coli CFT073
uuuugccuuacgcaccgga

SEQ ID NO: 595593 - RNA, 12 nt, Escherichia coli CFT073
uuuccuuuucgc

SEQ ID NO: 595594 - RNA, 22 nt, Escherichia coli CFT073
uuucgcauguaacugccuuucc

SEQ ID NO: 595595 - RNA, 20 nt, Escherichia coli CFT073
uuucgccaccggcaaucugc

SEQ ID NO: 595596 - RNA, 13 nt, Escherichia coli CFT073
uuucaucaucacg

SEQ ID NO: 595597 - RNA, 16 nt, Escherichia coli CFT073
uuucauccagcggcaa

SEQ ID NO: 595598 - RNA, 22 nt, Escherichia coli CFT073
uuucaucaacugacuauccugg

SEQ ID NO: 595599 - RNA, 17 nt, Escherichia coli CFT073
uuucauucagcguauca

SEQ ID NO: 595600 - RNA, 20 nt, Escherichia coli CFT073
uuuaucggcguuauuacugg

SEQ ID NO: 595601 - RNA, 16 nt, Escherichia coli CFT073
uuuaucgcgggaaaaa

SEQ ID NO: 595602 - RNA, 11 nt, Escherichia coli CFT073
uuuauccagca

SEQ ID NO: 595603 - RNA, 23 nt, Escherichia coli CFT073
uuuaucaauuaacugugccagcg

SEQ ID NO: 595604 - RNA, 18 nt, Escherichia coli CFT073
uuucaauuaucaccgcac

SEQ ID NO: 595605 - RNA, 14 nt, Escherichia coli CFT073
uuucaaccagcagg

SEQ ID NO: 595606 - RNA, 12 nt, Escherichia coli CFT073
uuucacauauuc

SEQ ID NO: 595607 - RNA, 15 nt, Escherichia coli CFT073
uuucacccacacuuc

SEQ ID NO: 595608 - RNA, 14 nt, Escherichia coli CFT073
uuucacgccgccaa

SEQ ID NO: 595609 - RNA, 20 nt, Escherichia coli CFT073
uuucacuucagcaacgugcu

SEQ ID NO: 595610 - RNA, 14 nt, Escherichia coli CFT073
uuucacuuuaccuu

SEQ ID NO: 595611 - RNA, 17 nt, Escherichia coli CFT073
aauccuggccauaccau

SEQ ID NO: 595612 - RNA, 20 nt, Escherichia coli CFT073
aauccuucccccaccaccau

SEQ ID NO: 595613 - RNA, 17 nt, Escherichia coli CFT073
aauccguuccucaccgu

SEQ ID NO: 595614 - RNA, 12 nt, Escherichia coli CFT073
aauccuguaucu

SEQ ID NO: 595615 - RNA, 14 nt, Escherichia coli CFT073
aauccuguaucuuc

SEQ ID NO: 595616 - RNA, 15 nt, Escherichia coli CFT073
aauccugcauaccau

SEQ ID NO: 595617 - RNA, 20 nt, Escherichia coli CFT073
aauccucccggaugcaccau

SEQ ID NO: 595618 - RNA, 20 nt, Escherichia coli CFT073
uuguaggccugauaagacac

SEQ ID NO: 595619 - RNA, 20 nt, Escherichia coli CFT073
uuguaggccugauaaggcau

SEQ ID NO: 595620 - RNA, 20 nt, Escherichia coli CFT073
uuguaggucggauaaggcgu

SEQ ID NO: 595621 - RNA, 15 nt, Escherichia coli CFT073
aaucgaaaucaacau

SEQ ID NO: 595622 - RNA, 18 nt, Escherichia coli CFT073
aaucgaaaucaacauguu

SEQ ID NO: 595623 - RNA, 13 nt, Escherichia coli CFT073
aaucgacaccagu

SEQ ID NO: 595624 - RNA, 20 nt, Escherichia coli CFT073
uuguaggcaggauaaggcgu

SEQ ID NO: 595625 - RNA, 14 nt, Escherichia coli CFT073
uuguaggccggaua

SEQ ID NO: 595626 - RNA, 11 nt, Escherichia coli CFT073
uuuaacgccac

SEQ ID NO: 595627 - RNA, 14 nt, Escherichia coli CFT073
uuguugaacagacg

SEQ ID NO: 595628 - RNA, 13 nt, Escherichia coli CFT073
uuguuauccagcu

SEQ ID NO: 595629 - RNA, 22 nt, Escherichia coli CFT073
uuguucaaaggcagaaacggcu

SEQ ID NO: 595630 - RNA, 17 nt, Escherichia coli CFT073
uuguucacaccaucauc

SEQ ID NO: 595631 - RNA, 14 nt, Escherichia coli CFT073
uuuacgccgcaucc

SEQ ID NO: 595632 - RNA, 21 nt, Escherichia coli CFT073
uuuacgccgcauccgacauca

SEQ ID NO: 595633 - RNA, 16 nt, Escherichia coli CFT073
uuuacugcacucgcca

SEQ ID NO: 595634 - RNA, 21 nt, Escherichia coli CFT073
uuuacgguauaacccaguaca

SEQ ID NO: 595635 - RNA, 16 nt, Escherichia coli CFT073
uuuagaaaagaguauu

SEQ ID NO: 595636 - RNA, 11 nt, Escherichia coli CFT073
uuuagaagcac

SEQ ID NO: 595637 - RNA, 16 nt, Escherichia coli CFT073
uuuagucguugccgga

SEQ ID NO: 595638 - RNA, 19 nt, Escherichia coli CFT073
uuggcuuuaucuguacuua

SEQ ID NO: 595639 - RNA, 16 nt, Escherichia coli CFT073
uuggcuuugauauuca

SEQ ID NO: 595640 - RNA, 19 nt, Escherichia coli CFT073
uuguagacaugguaaaacc

SEQ ID NO: 595641 - RNA, 22 nt, Escherichia coli CFT073
uuguagcuuuuuccucagcuua

SEQ ID NO: 595642 - RNA, 16 nt, Escherichia coli CFT073
aauccgggucuguaaa

SEQ ID NO: 595643 - RNA, 17 nt, Escherichia coli CFT073
aauccgguucauggucg

SEQ ID NO: 595644 - RNA, 18 nt, Escherichia coli CFT073
aauccguggcaaauugcc

SEQ ID NO: 595645 - RNA, 16 nt, Escherichia coli CFT073
uugggcgagaucuucu

SEQ ID NO: 595646 - RNA, 23 nt, Escherichia coli CFT073
uuguaccuggccguuacggacca

SEQ ID NO: 595647 - RNA, 13 nt, Escherichia coli CFT073
uugcuguuguucc

SEQ ID NO: 595648 - RNA, 13 nt, Escherichia coli CFT073
uugcuucgccagu

SEQ ID NO: 595649 - RNA, 20 nt, Escherichia coli CFT073
uugcgaguggcgcgccugua

SEQ ID NO: 595650 - RNA, 14 nt, Escherichia coli CFT073
uugccuggggagag

SEQ ID NO: 595651 - RNA, 23 nt, Escherichia coli CFT073
uugaucgcuggcagccauaauca

SEQ ID NO: 595652 - RNA, 19 nt, Escherichia coli CFT073
uugaucaggugauggcagc

SEQ ID NO: 595653 - RNA, 16 nt, Escherichia coli CFT073
uugaucacuuccagca

SEQ ID NO: 595654 - RNA, 19 nt, Escherichia coli CFT073
uugcguuuuuugaucagua

SEQ ID NO: 595655 - RNA, 19 nt, Escherichia coli CFT073
uugcuaagcucucagcaua

SEQ ID NO: 595656 - RNA, 22 nt, Escherichia coli CFT073
uugcuaaugcagguacgcaaua

SEQ ID NO: 595657 - RNA, 18 nt, Escherichia coli CFT073
uugcguacaccaacauca

SEQ ID NO: 595658 - RNA, 23 nt, Escherichia coli CFT073
uugcgugaaaguuugugccgccg

SEQ ID NO: 595659 - RNA, 13 nt, Escherichia coli CFT073
uugcguucaucag

SEQ ID NO: 595660 - RNA, 15 nt, Escherichia coli CFT073
uugcgugacgccugc

SEQ ID NO: 595661 - RNA, 21 nt, Escherichia coli CFT073
uugcucgacuagauacugacg

SEQ ID NO: 595662 - RNA, 15 nt, Escherichia coli CFT073
uugcugucgacaaag

SEQ ID NO: 595663 - RNA, 12 nt, Escherichia coli CFT073
uugcugucgcgc

SEQ ID NO: 595664 - RNA, 15 nt, Escherichia coli CFT073
uugcugaauuggguu

SEQ ID NO: 595665 - RNA, 15 nt, Escherichia coli CFT073
uugcugacgaucggc

SEQ ID NO: 595666 - RNA, 23 nt, Escherichia coli CFT073
uugcugcccccgccacuccguca

SEQ ID NO: 595667 - RNA, 13 nt, Escherichia coli CFT073
uugcugccuuucg

SEQ ID NO: 595668 - RNA, 21 nt, Escherichia coli CFT073
uugaagcaauccauaccagca

SEQ ID NO: 595669 - RNA, 21 nt, Escherichia coli CFT073
uugaagcccaguaccgccagu

SEQ ID NO: 595670 - RNA, 15 nt, Escherichia coli CFT073
uugacgccaucaacg

SEQ ID NO: 595671 - RNA, 16 nt, Escherichia coli CFT073
uugaauuaacuccagu

SEQ ID NO: 595672 - RNA, 20 nt, Escherichia coli CFT073
uugaccgacaccggcagaga

SEQ ID NO: 595673 - RNA, 15 nt, Escherichia coli CFT073
uugacagcucacgcg

SEQ ID NO: 595674 - RNA, 16 nt, Escherichia coli CFT073
uugagcuugcugcagu

SEQ ID NO: 595675 - RNA, 20 nt, Escherichia coli CFT073
uugagguuagugacauaggc

SEQ ID NO: 595676 - RNA, 12 nt, Escherichia coli CFT073
uugauauccgca

SEQ ID NO: 595677 - RNA, 21 nt, Escherichia coli CFT073
uugauagcccaacgaucccaa

SEQ ID NO: 595678 - RNA, 17 nt, Escherichia coli CFT073
uugaguucaccgccauu

SEQ ID NO: 595679 - RNA, 23 nt, Escherichia coli CFT073
uugauaaucguuugcauccggca

SEQ ID NO: 595680 - RNA, 17 nt, Escherichia coli CFT073
uugauaauuagugcugc

SEQ ID NO: 595681 - RNA, 18 nt, Escherichia coli CFT073
uugagauaagcaacaaac

SEQ ID NO: 595682 - RNA, 22 nt, Escherichia coli CFT073
uugagcaaagacgcguucaucu

SEQ ID NO: 595683 - RNA, 16 nt, Escherichia coli CFT073
uugagcgcaaauugcu

SEQ ID NO: 595684 - RNA, 12 nt, Escherichia coli CFT073
uugagcggaucg

SEQ ID NO: 595685 - RNA, 20 nt, Escherichia coli CFT073
uugacuuccagacggcgaua

SEQ ID NO: 595686 - RNA, 23 nt, Escherichia coli CFT073
uucucugacgcucucaacgcccu

SEQ ID NO: 595687 - RNA, 16 nt, Escherichia coli CFT073
uucucuuuccagcaac

SEQ ID NO: 595688 - RNA, 17 nt, Escherichia coli CFT073
uucucauugaccgaccc

SEQ ID NO: 595689 - RNA, 22 nt, Escherichia coli CFT073
uucucggcaaacaguugcugau

SEQ ID NO: 595690 - RNA, 22 nt, Escherichia coli CFT073
uucucaaaaaagagggcauagc

SEQ ID NO: 595691 - RNA, 12 nt, Escherichia coli CFT073
uucuauggaagu

SEQ ID NO: 595692 - RNA, 22 nt, Escherichia coli CFT073
uucuaucgcauuauccuuuauc

SEQ ID NO: 595693 - RNA, 20 nt, Escherichia coli CFT073
uucucaaugaugccgccaca

SEQ ID NO: 595694 - RNA, 16 nt, Escherichia coli CFT073
uucucaaugauggcgc

SEQ ID NO: 595695 - RNA, 17 nt, Escherichia coli CFT073
aaucagccuuaaucuuc

SEQ ID NO: 595696 - RNA, 22 nt, Escherichia coli CFT073
aaucagcgaauggguuguacuu

SEQ ID NO: 595697 - RNA, 19 nt, Escherichia coli CFT073
aaucagcgagauaaugcgc

SEQ ID NO: 595698 - RNA, 16 nt, Escherichia coli CFT073
aaucagcggcaguucg

SEQ ID NO: 595699 - RNA, 23 nt, Escherichia coli CFT073
aaucagcguaaaggccggaaccg

SEQ ID NO: 595700 - RNA, 12 nt, Escherichia coli CFT073
uucgguuuugcg

SEQ ID NO: 595701 - RNA, 19 nt, Escherichia coli CFT073
uucguaccaacgagagugc

SEQ ID NO: 595702 - RNA, 14 nt, Escherichia coli CFT073
uucuuuauccgcuu

SEQ ID NO: 595703 - RNA, 12 nt, Escherichia coli CFT073
uucuucuuucgc

SEQ ID NO: 595704 - RNA, 12 nt, Escherichia coli CFT073
uucugccagcgu

SEQ ID NO: 595705 - RNA, 16 nt, Escherichia coli CFT073
uucugcaaccagaaag

SEQ ID NO: 595706 - RNA, 19 nt, Escherichia coli CFT073
uucugagcccacuguuuga

SEQ ID NO: 595707 - RNA, 23 nt, Escherichia coli CFT073
uucuuugcgcccccgauccagcg

SEQ ID NO: 595708 - RNA, 21 nt, Escherichia coli CFT073
uugaaaccgguuuguaggccg

SEQ ID NO: 595709 - RNA, 17 nt, Escherichia coli CFT073
uugaaaugauuacuccc

SEQ ID NO: 595710 - RNA, 20 nt, Escherichia coli CFT073
uucgcuggcaaguucgucuu

SEQ ID NO: 595711 - RNA, 23 nt, Escherichia coli CFT073
uucgcugacgccugccagcucuu

SEQ ID NO: 595712 - RNA, 21 nt, Escherichia coli CFT073
uucgcugauuuaaucgcuuca

SEQ ID NO: 595713 - RNA, 20 nt, Escherichia coli CFT073
uucggcaucacgaauccgca

SEQ ID NO: 595714 - RNA, 22 nt, Escherichia coli CFT073
uucgcuggaauaaucguaccgu

SEQ ID NO: 595715 - RNA, 13 nt, Escherichia coli CFT073
uucggcccacaac

SEQ ID NO: 595716 - RNA, 16 nt, Escherichia coli CFT073
uucgcuaagauacccc

SEQ ID NO: 595717 - RNA, 17 nt, Escherichia coli CFT073
uucgcucuuucgcaucg

SEQ ID NO: 595718 - RNA, 18 nt, Escherichia coli CFT073
uucgcgacaucgcccggc

SEQ ID NO: 595719 - RNA, 16 nt, Escherichia coli CFT073
uucgcgaaucgccaca

SEQ ID NO: 595720 - RNA, 18 nt, Escherichia coli CFT073
uucgcgaaucgccacaac

SEQ ID NO: 595721 - RNA, 23 nt, Escherichia coli CFT073
uucgccaccguguucaugaccgu

SEQ ID NO: 595722 - RNA, 21 nt, Escherichia coli CFT073
uucgccgccgcauaucaucaa

SEQ ID NO: 595723 - RNA, 13 nt, Escherichia coli CFT073
uucgcaaaccaaa

SEQ ID NO: 595724 - RNA, 21 nt, Escherichia coli CFT073
uucgcaaucaccuuacaucaa

SEQ ID NO: 595725 - RNA, 19 nt, Escherichia coli CFT073
uucgcacgguucgccauca

SEQ ID NO: 595726 - RNA, 19 nt, Escherichia coli CFT073
uucgauggugaugagcuga

SEQ ID NO: 595727 - RNA, 15 nt, Escherichia coli CFT073
uucgaccgucaccag

SEQ ID NO: 595728 - RNA, 13 nt, Escherichia coli CFT073
uucgauauccaga

SEQ ID NO: 595729 - RNA, 21 nt, Escherichia coli CFT073
uucgagaaugaagucaccaaa

SEQ ID NO: 595730 - RNA, 14 nt, Escherichia coli CFT073
uuccccaacgaugg

SEQ ID NO: 595731 - RNA, 18 nt, Escherichia coli CFT073
uucccagcaggaucaaua

SEQ ID NO: 595732 - RNA, 14 nt, Escherichia coli CFT073
uuccccugguucaa

SEQ ID NO: 595733 - RNA, 16 nt, Escherichia coli CFT073
uucccgagcggccaaa

SEQ ID NO: 595734 - RNA, 18 nt, Escherichia coli CFT073
uuccggcagcuucacgga

SEQ ID NO: 595735 - RNA, 15 nt, Escherichia coli CFT073
uucccgcgccagcgc

SEQ ID NO: 595736 - RNA, 17 nt, Escherichia coli CFT073
uucauagauagccagca

SEQ ID NO: 595737 - RNA, 11 nt, Escherichia coli CFT073
uucccagcaac

SEQ ID NO: 595738 - RNA, 16 nt, Escherichia coli CFT073
uucauauaccgcauca

SEQ ID NO: 595739 - RNA, 13 nt, Escherichia coli CFT073
uucaguucaucua

SEQ ID NO: 595740 - RNA, 19 nt, Escherichia coli CFT073
uucaguucgccuuccagca

SEQ ID NO: 595741 - RNA, 17 nt, Escherichia coli CFT073
uucagcgucaucaagca

SEQ ID NO: 595742 - RNA, 14 nt, Escherichia coli CFT073
uuccgugguuugcg

SEQ ID NO: 595743 - RNA, 14 nt, Escherichia coli CFT073
uuccggcguggugc

SEQ ID NO: 595744 - RNA, 21 nt, Escherichia coli CFT073
uuccggcguuucgccaucguu

SEQ ID NO: 595745 - RNA, 15 nt, Escherichia coli CFT073
uuccgucagcaaagu

SEQ ID NO: 595746 - RNA, 14 nt, Escherichia coli CFT073
uuccugauccgcuu

SEQ ID NO: 595747 - RNA, 14 nt, Escherichia coli CFT073
uuccugaugcgguu

SEQ ID NO: 595748 - RNA, 15 nt, Escherichia coli CFT073
uuccugcacacggau

SEQ ID NO: 595749 - RNA, 21 nt, Escherichia coli CFT073
uuccugcaucgccugauucaa

SEQ ID NO: 595750 - RNA, 13 nt, Escherichia coli CFT073
uuccugccagcgu

SEQ ID NO: 595751 - RNA, 19 nt, Escherichia coli CFT073
uuccugacuugccagccau

SEQ ID NO: 595752 - RNA, 14 nt, Escherichia coli CFT073
uuccugacccagca

SEQ ID NO: 595753 - RNA, 23 nt, Escherichia coli CFT073
uuccucuacgacaaaauuuucgu

SEQ ID NO: 595754 - RNA, 20 nt, Escherichia coli CFT073
uuccugcgccagcguuugcg

SEQ ID NO: 595755 - RNA, 22 nt, Escherichia coli CFT073
uuccugcggcagacgcucgcca

SEQ ID NO: 595756 - RNA, 11 nt, Escherichia coli CFT073
uuccugcucgg

SEQ ID NO: 595757 - RNA, 21 nt, Escherichia coli CFT073
uucaaugcaauuuaucgcagg

SEQ ID NO: 595758 - RNA, 17 nt, Escherichia coli CFT073
uucacaagacuguaaau

SEQ ID NO: 595759 - RNA, 18 nt, Escherichia coli CFT073
uucaaguguggccgccag

SEQ ID NO: 595760 - RNA, 20 nt, Escherichia coli CFT073
uucaauccgucccaauucuu

SEQ ID NO: 595761 - RNA, 17 nt, Escherichia coli CFT073
uucacauauugcagcuu

SEQ ID NO: 595762 - RNA, 11 nt, Escherichia coli CFT073
uucacaucaga

SEQ ID NO: 595763 - RNA, 19 nt, Escherichia coli CFT073
uucaccacauuaccgauga

SEQ ID NO: 595764 - RNA, 16 nt, Escherichia coli CFT073
uucagcaguucugcca

SEQ ID NO: 595765 - RNA, 23 nt, Escherichia coli CFT073
uucagccagaggcggcaaaauca

SEQ ID NO: 595766 - RNA, 24 nt, Escherichia coli CFT073
uucaccccguugcuucgccgcauc

SEQ ID NO: 595767 - RNA, 19 nt, Escherichia coli CFT073
uucaccgacaucuuucugc

SEQ ID NO: 595768 - RNA, 15 nt, Escherichia coli CFT073
uucagcgacaucguc

SEQ ID NO: 595769 - RNA, 13 nt, Escherichia coli CFT073
uucagcgcaucgu

SEQ ID NO: 595770 - RNA, 21 nt, Escherichia coli CFT073
uucagccccagcacuucgcug

SEQ ID NO: 595771 - RNA, 19 nt, Escherichia coli CFT073
uucagcccggcaacguugc

SEQ ID NO: 595772 - RNA, 12 nt, Escherichia coli CFT073
uucaagcggacg

SEQ ID NO: 595773 - RNA, 12 nt, Escherichia coli CFT073
uucaaccgcagc

SEQ ID NO: 595774 - RNA, 12 nt, Escherichia coli CFT073
uucaaccgcagu

SEQ ID NO: 595775 - RNA, 23 nt, Escherichia coli CFT073
uucaaccgcagugauuucaaccg

SEQ ID NO: 595776 - RNA, 19 nt, Escherichia coli CFT073
uucaaaucaccaaacugcu

SEQ ID NO: 595777 - RNA, 19 nt, Escherichia coli CFT073
uucaacaucauuucccacg

SEQ ID NO: 595778 - RNA, 16 nt, Escherichia coli CFT073
uuauuggguugcagua

SEQ ID NO: 595779 - RNA, 14 nt, Escherichia coli CFT073
uucaaacgccaacu

SEQ ID NO: 595780 - RNA, 12 nt, Escherichia coli CFT073
uucaaacacgau

SEQ ID NO: 595781 - RNA, 12 nt, Escherichia coli CFT073
uuacgaaagcgc

SEQ ID NO: 595782 - RNA, 18 nt, Escherichia coli CFT073
uuacgaagcagcaucagc

SEQ ID NO: 595783 - RNA, 13 nt, Escherichia coli CFT073
uuacugaugcgca

SEQ ID NO: 595784 - RNA, 14 nt, Escherichia coli CFT073
uuacugacaucgcu

SEQ ID NO: 595785 - RNA, 15 nt, Escherichia coli CFT073
uuaccugucgcuuug

SEQ ID NO: 595786 - RNA, 17 nt, Escherichia coli CFT073
uuaccguaggccagcgg

SEQ ID NO: 595787 - RNA, 15 nt, Escherichia coli CFT073
uuaccgaucgccagc

SEQ ID NO: 595788 - RNA, 12 nt, Escherichia coli CFT073
uuaccgccaacg

SEQ ID NO: 595789 - RNA, 17 nt, Escherichia coli CFT073
uuaccgcaaucgaucug

SEQ ID NO: 595790 - RNA, 21 nt, Escherichia coli CFT073
uuaccgcgccauguugccugg

SEQ ID NO: 595791 - RNA, 20 nt, Escherichia coli CFT073
uuaccgcuuggcgauacccc

SEQ ID NO: 595792 - RNA, 22 nt, Escherichia coli CFT073
uuauacaucgucgcaaauauga

SEQ ID NO: 595793 - RNA, 20 nt, Escherichia coli CFT073
uuauaccacuuacauuccgg

SEQ ID NO: 595794 - RNA, 16 nt, Escherichia coli CFT073
uuacuggcuguauaua

SEQ ID NO: 595795 - RNA, 19 nt, Escherichia coli CFT073
uuauacgguuggauuucgc

SEQ ID NO: 595796 - RNA, 19 nt, Escherichia coli CFT073
uuauagcgauuuuucauca

SEQ ID NO: 595797 - RNA, 20 nt, Escherichia coli CFT073
uuauagaacagagucugacc

SEQ ID NO: 595798 - RNA, 13 nt, Escherichia coli CFT073
uuauaguucggcu

SEQ ID NO: 595799 - RNA, 12 nt, Escherichia coli CFT073
uuauauaaaaca

SEQ ID NO: 595800 - RNA, 15 nt, Escherichia coli CFT073
uuauuaccaucgguu

SEQ ID NO: 595801 - RNA, 20 nt, Escherichia coli CFT073
uuauuacuggcgauugucau

SEQ ID NO: 595802 - RNA, 12 nt, Escherichia coli CFT073
uuaugaucagca

SEQ ID NO: 595803 - RNA, 19 nt, Escherichia coli CFT073
uuaugaucagcaacgccgg

SEQ ID NO: 595804 - RNA, 13 nt, Escherichia coli CFT073
uuaugauccagcu

SEQ ID NO: 595805 - RNA, 19 nt, Escherichia coli CFT073
uuaugcagagcauccagca

SEQ ID NO: 595806 - RNA, 22 nt, Escherichia coli CFT073
uuaugccgaucaucauccagca

SEQ ID NO: 595807 - RNA, 14 nt, Escherichia coli CFT073
uuaugccuggcgaa

SEQ ID NO: 595808 - RNA, 18 nt, Escherichia coli CFT073
uuaugcguuuugaucuua

SEQ ID NO: 595809 - RNA, 23 nt, Escherichia coli CFT073
uuaugcucaacggugaccucagg

SEQ ID NO: 595810 - RNA, 23 nt, Escherichia coli CFT073
uuaucgauuuucaaaauaucgac

SEQ ID NO: 595811 - RNA, 22 nt, Escherichia coli CFT073
uuauccguacagucgagcacca

SEQ ID NO: 595812 - RNA, 19 nt, Escherichia coli CFT073
uuauccggccuacugguga

SEQ ID NO: 595813 - RNA, 16 nt, Escherichia coli CFT073
uuaucgcagccuuacc

SEQ ID NO: 595814 - RNA, 21 nt, Escherichia coli CFT073
uuaucgccaagcgcaauauca

SEQ ID NO: 595815 - RNA, 17 nt, Escherichia coli CFT073
uuaucguaaugcucgac

SEQ ID NO: 595816 - RNA, 21 nt, Escherichia coli CFT073
uuaucuggcuaaaacugauaa

SEQ ID NO: 595817 - RNA, 13 nt, Escherichia coli CFT073
uuaucuuauuccc

SEQ ID NO: 595818 - RNA, 21 nt, Escherichia coli CFT073
uuaucuuugauugaagaaauc

SEQ ID NO: 595819 - RNA, 13 nt, Escherichia coli CFT073
uguuccgauaagu

SEQ ID NO: 595820 - RNA, 18 nt, Escherichia coli CFT073
uguugccuguuucauagu

SEQ ID NO: 595821 - RNA, 16 nt, Escherichia coli CFT073
uguuggguuagccaac

SEQ ID NO: 595822 - RNA, 15 nt, Escherichia coli CFT073
uguugucgcagacga

SEQ ID NO: 595823 - RNA, 15 nt, Escherichia coli CFT073
uguugucgccaguaa

SEQ ID NO: 595824 - RNA, 23 nt, Escherichia coli CFT073
uguugugccacauccagcggcag

SEQ ID NO: 595825 - RNA, 13 nt, Escherichia coli CFT073
uguugugccagac

SEQ ID NO: 595826 - RNA, 16 nt, Escherichia coli CFT073
ugucgcuauucaacgu

SEQ ID NO: 595827 - RNA, 15 nt, Escherichia coli CFT073
ugucggaugcggcgu

SEQ ID NO: 595828 - RNA, 20 nt, Escherichia coli CFT073
ugucggcaugauaagacgcg

SEQ ID NO: 595829 - RNA, 15 nt, Escherichia coli CFT073
uguucacgccgcauc

SEQ ID NO: 595830 - RNA, 14 nt, Escherichia coli CFT073
ugugugggcacucg

SEQ ID NO: 595831 - RNA, 16 nt, Escherichia coli CFT073
ugugugggucuaaaaa

SEQ ID NO: 595832 - RNA, 15 nt, Escherichia coli CFT073
ugugucgacauagcc

SEQ ID NO: 595833 - RNA, 17 nt, Escherichia coli CFT073
ugugguuaccaucaacc

SEQ ID NO: 595834 - RNA, 14 nt, Escherichia coli CFT073
uguuugaagucaac

SEQ ID NO: 595835 - RNA, 17 nt, Escherichia coli CFT073
uguuucuuacgguuuuc

SEQ ID NO: 595836 - RNA, 19 nt, Escherichia coli CFT073
uguuucauccaggcacugg

SEQ ID NO: 595837 - RNA, 14 nt, Escherichia coli CFT073
uguuuucaguagca

SEQ ID NO: 595838 - RNA, 23 nt, Escherichia coli CFT073
uuaaccugcgccucaguuucgac

SEQ ID NO: 595839 - RNA, 22 nt, Escherichia coli CFT073
uuaacgaaggugaacgccacca

SEQ ID NO: 595840 - RNA, 19 nt, Escherichia coli CFT073
uuaacgagucauuguaaau

SEQ ID NO: 595841 - RNA, 17 nt, Escherichia coli CFT073
uuaacgcagcaaaagca

SEQ ID NO: 595842 - RNA, 13 nt, Escherichia coli CFT073
uuacaagaaucau

SEQ ID NO: 595843 - RNA, 12 nt, Escherichia coli CFT073
uuacccggcaca

SEQ ID NO: 595844 - RNA, 22 nt, Escherichia coli CFT073
uuacccguugguuugauagcaa

SEQ ID NO: 595845 - RNA, 23 nt, Escherichia coli CFT073
uuaagaaaacugcgcccgcuuuu

SEQ ID NO: 595846 - RNA, 15 nt, Escherichia coli CFT073
uuaagcgucgcauca

SEQ ID NO: 595847 - RNA, 18 nt, Escherichia coli CFT073
uuaagcgucgcaucaggc

SEQ ID NO: 595848 - RNA, 23 nt, Escherichia coli CFT073
acguacggcuucgacaauaacgc

SEQ ID NO: 595849 - RNA, 21 nt, Escherichia coli CFT073
acguaauuaucaaucuccgcc

SEQ ID NO: 595850 - RNA, 14 nt, Escherichia coli CFT073
acguaccagaugca

SEQ ID NO: 595851 - RNA, 18 nt, Escherichia coli CFT073
acgguuuucucgccaccg

SEQ ID NO: 595852 - RNA, 15 nt, Escherichia coli CFT073
acgguuuuuccagcu

SEQ ID NO: 595853 - RNA, 18 nt, Escherichia coli CFT073
acguaacagagcaucggu

SEQ ID NO: 595854 - RNA, 20 nt, Escherichia coli CFT073
acgguuucaaagaaacggaa

SEQ ID NO: 595855 - RNA, 16 nt, Escherichia coli CFT073
acgucagcugccaguu

SEQ ID NO: 595856 - RNA, 22 nt, Escherichia coli CFT073
acgucaggccaacauccaucag

SEQ ID NO: 595857 - RNA, 15 nt, Escherichia coli CFT073
acgucaggccgccac

SEQ ID NO: 595858 - RNA, 17 nt, Escherichia coli CFT073
acgucgcaucuggucag

SEQ ID NO: 595859 - RNA, 22 nt, Escherichia coli CFT073
acguccucgucgagcagaaucg

SEQ ID NO: 595860 - RNA, 17 nt, Escherichia coli CFT073
acgucucaaucaccacc

SEQ ID NO: 595861 - RNA, 23 nt, Escherichia coli CFT073
acgucugaaguaagucuuccggu

SEQ ID NO: 595862 - RNA, 23 nt, Escherichia coli CFT073
acgucuucccgagacaucccuuu

SEQ ID NO: 595863 - RNA, 21 nt, Escherichia coli CFT073
acgucuugcugugcagcaagc

SEQ ID NO: 595864 - RNA, 18 nt, Escherichia coli CFT073
acgugaacgcgacauauc

SEQ ID NO: 595865 - RNA, 20 nt, Escherichia coli CFT073
acgucuuugcgcuccaucag

SEQ ID NO: 595866 - RNA, 15 nt, Escherichia coli CFT073
acgugaauccagcgc

SEQ ID NO: 595867 - RNA, 12 nt, Escherichia coli CFT073
acgugaucgaac

SEQ ID NO: 595868 - RNA, 22 nt, Escherichia coli CFT073
acgugaucgcaauucuucauuc

SEQ ID NO: 595869 - RNA, 22 nt, Escherichia coli CFT073
acgugaucgucuucaaccgcag

SEQ ID NO: 595870 - RNA, 23 nt, Escherichia coli CFT073
acgugaucgucuucaaccgcagu

SEQ ID NO: 595871 - RNA, 18 nt, Escherichia coli CFT073
acuauuaaagaaaguaau

SEQ ID NO: 595872 - RNA, 11 nt, Escherichia coli CFT073
acuauuacuga

SEQ ID NO: 595873 - RNA, 14 nt, Escherichia coli CFT073
acuauccacuggaa

SEQ ID NO: 595874 - RNA, 17 nt, Escherichia coli CFT073
acuauccgccauaucac

SEQ ID NO: 595875 - RNA, 17 nt, Escherichia coli CFT073
acuacgccagaaacggg

SEQ ID NO: 595876 - RNA, 14 nt, Escherichia coli CFT073
acuacgcccgcaau

SEQ ID NO: 595877 - RNA, 19 nt, Escherichia coli CFT073
acuacgccgcaaaucgccg

SEQ ID NO: 595878 - RNA, 22 nt, Escherichia coli CFT073
acuacgcugcggcgaaagcggg

SEQ ID NO: 595879 - RNA, 17 nt, Escherichia coli CFT073
acuaauugagcgugaag

SEQ ID NO: 595880 - RNA, 14 nt, Escherichia coli CFT073
acguugcaacugcg

SEQ ID NO: 595881 - RNA, 21 nt, Escherichia coli CFT073
acgugguuuaccaccagcgga

SEQ ID NO: 595882 - RNA, 15 nt, Escherichia coli CFT073
acguguacccagcag

SEQ ID NO: 595883 - RNA, 17 nt, Escherichia coli CFT073
acgugucauaacugguc

SEQ ID NO: 595884 - RNA, 20 nt, Escherichia coli CFT073
acguggugaaaucgccgaca

SEQ ID NO: 595885 - RNA, 22 nt, Escherichia coli CFT073
acguuaacaauguugucgccag

SEQ ID NO: 595886 - RNA, 14 nt, Escherichia coli CFT073
acguuacccagcac

SEQ ID NO: 595887 - RNA, 16 nt, Escherichia coli CFT073
acguuaucugaccguu

SEQ ID NO: 595888 - RNA, 17 nt, Escherichia coli CFT073
acgugauuguucaacga

SEQ ID NO: 595889 - RNA, 15 nt, Escherichia coli CFT073
acgugcaaaaucaaa

SEQ ID NO: 595890 - RNA, 17 nt, Escherichia coli CFT073
acgugcaccgucacuuc

SEQ ID NO: 595891 - RNA, 21 nt, Escherichia coli CFT073
acggcaaacaucgggauaucg

SEQ ID NO: 595892 - RNA, 21 nt, Escherichia coli CFT073
acggcguuaacuuguugcgcc

SEQ ID NO: 595893 - RNA, 14 nt, Escherichia coli CFT073
acggcguugcugcc

SEQ ID NO: 595894 - RNA, 13 nt, Escherichia coli CFT073
acggcguuucacu

SEQ ID NO: 595895 - RNA, 21 nt, Escherichia coli CFT073
acggcuaccguugcggcguca

SEQ ID NO: 595896 - RNA, 19 nt, Escherichia coli CFT073
acggcgguuucgcaaacca

SEQ ID NO: 595897 - RNA, 12 nt, Escherichia coli CFT073
acgggagaucgc

SEQ ID NO: 595898 - RNA, 16 nt, Escherichia coli CFT073
acggcuauaccccacc

SEQ ID NO: 595899 - RNA, 17 nt, Escherichia coli CFT073
acggucaguuuucgccc

SEQ ID NO: 595900 - RNA, 20 nt, Escherichia coli CFT073
acggucauucgacgcgcgca

SEQ ID NO: 595901 - RNA, 14 nt, Escherichia coli CFT073
acggucacggcugu

SEQ ID NO: 595902 - RNA, 14 nt, Escherichia coli CFT073
acggguaaugacgg

SEQ ID NO: 595903 - RNA, 15 nt, Escherichia coli CFT073
acggguaaggcgcga

SEQ ID NO: 595904 - RNA, 22 nt, Escherichia coli CFT073
acgguugacgucccacaguugu

SEQ ID NO: 595905 - RNA, 17 nt, Escherichia coli CFT073
acgguugagagcaaaca

SEQ ID NO: 595906 - RNA, 17 nt, Escherichia coli CFT073
acgguugcggcuuacca

SEQ ID NO: 595907 - RNA, 16 nt, Escherichia coli CFT073
acgguuauccugcaaa

SEQ ID NO: 595908 - RNA, 17 nt, Escherichia coli CFT073
acgguuaacgccagcca

SEQ ID NO: 595909 - RNA, 18 nt, Escherichia coli CFT073
acgguguuauucaucgca

SEQ ID NO: 595910 - RNA, 20 nt, Escherichia coli CFT073
acgguggcuggcgcggcgca

SEQ ID NO: 595911 - RNA, 12 nt, Escherichia coli CFT073
acggugcgggcu

SEQ ID NO: 595912 - RNA, 14 nt, Escherichia coli CFT073
acucggugcgcccg

SEQ ID NO: 595913 - RNA, 20 nt, Escherichia coli CFT073
acucaucaaaaaaacucauu

SEQ ID NO: 595914 - RNA, 17 nt, Escherichia coli CFT073
acucggcgaccaguucg

SEQ ID NO: 595915 - RNA, 11 nt, Escherichia coli CFT073
acucggcgcgg

SEQ ID NO: 595916 - RNA, 14 nt, Escherichia coli CFT073
acucggcgcggaug

SEQ ID NO: 595917 - RNA, 18 nt, Escherichia coli CFT073
acuauuguauaccaaucg

SEQ ID NO: 595918 - RNA, 15 nt, Escherichia coli CFT073
acucaacgguccaau

SEQ ID NO: 595919 - RNA, 22 nt, Escherichia coli CFT073
acucaacuuauugaucaucccg

SEQ ID NO: 595920 - RNA, 22 nt, Escherichia coli CFT073
acucaccgaugaucgccaucag

SEQ ID NO: 595921 - RNA, 15 nt, Escherichia coli CFT073
acucaccugauuacc

SEQ ID NO: 595922 - RNA, 16 nt, Escherichia coli CFT073
acucaccuggcugaug

SEQ ID NO: 595923 - RNA, 17 nt, Escherichia coli CFT073
acucacgaaucgccuca

SEQ ID NO: 595924 - RNA, 18 nt, Escherichia coli CFT073
acucacgaaucgccucac

SEQ ID NO: 595925 - RNA, 13 nt, Escherichia coli CFT073
acucaccgcucac

SEQ ID NO: 595926 - RNA, 15 nt, Escherichia coli CFT073
acucacugaugccgu

SEQ ID NO: 595927 - RNA, 16 nt, Escherichia coli CFT073
acucacuguaucaggu

SEQ ID NO: 595928 - RNA, 18 nt, Escherichia coli CFT073
acucaguccgguauucua

SEQ ID NO: 595929 - RNA, 16 nt, Escherichia coli CFT073
acucauaaaccagcgg

SEQ ID NO: 595930 - RNA, 18 nt, Escherichia coli CFT073
acucauacaucgcgcuua

SEQ ID NO: 595931 - RNA, 18 nt, Escherichia coli CFT073
acucuuaagguucacuua

SEQ ID NO: 595932 - RNA, 11 nt, Escherichia coli CFT073
acugacaucac

SEQ ID NO: 595933 - RNA, 14 nt, Escherichia coli CFT073
acugacaucgcuua

SEQ ID NO: 595934 - RNA, 19 nt, Escherichia coli CFT073
acugacgguuucucccgcc

SEQ ID NO: 595935 - RNA, 20 nt, Escherichia coli CFT073
acugacgucacgcaccaacu

SEQ ID NO: 595936 - RNA, 12 nt, Escherichia coli CFT073
acugacuuccac

SEQ ID NO: 595937 - RNA, 18 nt, Escherichia coli CFT073
acugagaaccuuuaucac

SEQ ID NO: 595938 - RNA, 19 nt, Escherichia coli CFT073
acugaguaauagccugaug

SEQ ID NO: 595939 - RNA, 12 nt, Escherichia coli CFT073
acugaguucaua

SEQ ID NO: 595940 - RNA, 14 nt, Escherichia coli CFT073
acugauauccagcc

SEQ ID NO: 595941 - RNA, 20 nt, Escherichia coli CFT073
acugauauugugagcaugug

SEQ ID NO: 595942 - RNA, 12 nt, Escherichia coli CFT073
acucugaugacu

SEQ ID NO: 595943 - RNA, 14 nt, Escherichia coli CFT073
acucugcggcauca

SEQ ID NO: 595944 - RNA, 16 nt, Escherichia coli CFT073
acucguccagucgccu

SEQ ID NO: 595945 - RNA, 19 nt, Escherichia coli CFT073
acucguuaacuucaucccg

SEQ ID NO: 595946 - RNA, 15 nt, Escherichia coli CFT073
acugcgguucagcuu

SEQ ID NO: 595947 - RNA, 12 nt, Escherichia coli CFT073
acugcgggcaac

SEQ ID NO: 595948 - RNA, 22 nt, Escherichia coli CFT073
acugcggcaagaauuacuucuu

SEQ ID NO: 595949 - RNA, 15 nt, Escherichia coli CFT073
acuggcauacaucaa

SEQ ID NO: 595950 - RNA, 17 nt, Escherichia coli CFT073
acuggcaaucgccagcg

SEQ ID NO: 595951 - RNA, 13 nt, Escherichia coli CFT073
acugcgccguguc

SEQ ID NO: 595952 - RNA, 17 nt, Escherichia coli CFT073
acugcauucggcgacca

SEQ ID NO: 595953 - RNA, 19 nt, Escherichia coli CFT073
acuggcgcuaacguuaauc

SEQ ID NO: 595954 - RNA, 18 nt, Escherichia coli CFT073
acuggcgacacgcaucac

SEQ ID NO: 595955 - RNA, 19 nt, Escherichia coli CFT073
acuggcgacgccggauauc

SEQ ID NO: 595956 - RNA, 17 nt, Escherichia coli CFT073
acuggcucuuuuucggg

SEQ ID NO: 595957 - RNA, 20 nt, Escherichia coli CFT073
acuggcuguauauaauaccg

SEQ ID NO: 595958 - RNA, 15 nt, Escherichia coli CFT073
acuggcuugccagca

SEQ ID NO: 595959 - RNA, 22 nt, Escherichia coli CFT073
acugguuauaugaauacgcgau

SEQ ID NO: 595960 - RNA, 14 nt, Escherichia coli CFT073
acuggucaaacuga

SEQ ID NO: 595961 - RNA, 24 nt, Escherichia coli CFT073
acugguaacgauuucaucgcccag

SEQ ID NO: 595962 - RNA, 13 nt, Escherichia coli CFT073
acuggguuaacgu

SEQ ID NO: 595963 - RNA, 21 nt, Escherichia coli CFT073
acuucaaccagcggcgcaucc

SEQ ID NO: 595964 - RNA, 13 nt, Escherichia coli CFT073
acuuaugcugcgc

SEQ ID NO: 595965 - RNA, 14 nt, Escherichia coli CFT073
acuucaacgcugcg

SEQ ID NO: 595966 - RNA, 22 nt, Escherichia coli CFT073
acuguuuaacgguuucaaccag

SEQ ID NO: 595967 - RNA, 14 nt, Escherichia coli CFT073
acuguuuaagcgaa

SEQ ID NO: 595968 - RNA, 21 nt, Escherichia coli CFT073
acuguuuauuguugauucgau

SEQ ID NO: 595969 - RNA, 15 nt, Escherichia coli CFT073
acuguuuuuccagcu

SEQ ID NO: 595970 - RNA, 14 nt, Escherichia coli CFT073
acuuacacaucaug

SEQ ID NO: 595971 - RNA, 19 nt, Escherichia coli CFT073
acugucggguaagcgccac

SEQ ID NO: 595972 - RNA, 15 nt, Escherichia coli CFT073
acuguacaauaucga

SEQ ID NO: 595973 - RNA, 17 nt, Escherichia coli CFT073
acuguagcucgccuaca

SEQ ID NO: 595974 - RNA, 21 nt, Escherichia coli CFT073
acuguaucccagcccagcgga

SEQ ID NO: 595975 - RNA, 21 nt, Escherichia coli CFT073
acugucccaaaaugucggaug

SEQ ID NO: 595976 - RNA, 12 nt, Escherichia coli CFT073
acuguccgccag

SEQ ID NO: 595977 - RNA, 13 nt, Escherichia coli CFT073
acuguccgccaga

SEQ ID NO: 595978 - RNA, 12 nt, Escherichia coli CFT073
acuguccugcgg

SEQ ID NO: 595979 - RNA, 19 nt, Escherichia coli CFT073
acuguccugcggcguacca

SEQ ID NO: 595980 - RNA, 14 nt, Escherichia coli CFT073
acugugccaaaucu

SEQ ID NO: 595981 - RNA, 15 nt, Escherichia coli CFT073
acugugccagcguuu

SEQ ID NO: 595982 - RNA, 23 nt, Escherichia coli CFT073
acuguucgagguaauccagcguc

SEQ ID NO: 595983 - RNA, 15 nt, Escherichia coli CFT073
acuguucgccgcagc

SEQ ID NO: 595984 - RNA, 19 nt, Escherichia coli CFT073
acuuccggacguucagcca

SEQ ID NO: 595985 - RNA, 18 nt, Escherichia coli CFT073
acuuccugcaaucuuucc

SEQ ID NO: 595986 - RNA, 19 nt, Escherichia coli CFT073
acuuccugccaguuuuucc

SEQ ID NO: 595987 - RNA, 18 nt, Escherichia coli CFT073
acuuccugcgccagcguu

SEQ ID NO: 595988 - RNA, 12 nt, Escherichia coli CFT073
acuuccugcucg

SEQ ID NO: 595989 - RNA, 22 nt, Escherichia coli CFT073
acuuccugcucuuucgccggau

SEQ ID NO: 595990 - RNA, 15 nt, Escherichia coli CFT073
acuucgcaaacaccc

SEQ ID NO: 595991 - RNA, 16 nt, Escherichia coli CFT073
acuucgcugacgccug

SEQ ID NO: 595992 - RNA, 16 nt, Escherichia coli CFT073
acuucgccacagcggc

SEQ ID NO: 595993 - RNA, 23 nt, Escherichia coli CFT073
acuucgccagacguugauaacca

SEQ ID NO: 595994 - RNA, 19 nt, Escherichia coli CFT073
acuucgucaacugacgcag

SEQ ID NO: 595995 - RNA, 12 nt, Escherichia coli CFT073
acuucggcgcga

SEQ ID NO: 595996 - RNA, 18 nt, Escherichia coli CFT073
acuucccgcugugguuca

SEQ ID NO: 595997 - RNA, 15 nt, Escherichia coli CFT073
acuuccgauccagac

SEQ ID NO: 595998 - RNA, 13 nt, Escherichia coli CFT073
acuuccgccacca

SEQ ID NO: 595999 - RNA, 12 nt, Escherichia coli CFT073
acuuccagcggc

SEQ ID NO: 596000 - RNA, 16 nt, Escherichia coli CFT073
acuucaucggcaaagg

SEQ ID NO: 596001 - RNA, 19 nt, Escherichia coli CFT073
acuucaugaccuuccagcg

SEQ ID NO: 596002 - RNA, 22 nt, Escherichia coli CFT073
acuuccagaauauguucgcuua

SEQ ID NO: 596003 - RNA, 17 nt, Escherichia coli CFT073
acuucacccaucgccag

SEQ ID NO: 596004 - RNA, 17 nt, Escherichia coli CFT073
acuucaccgguucauca

SEQ ID NO: 596005 - RNA, 22 nt, Escherichia coli CFT073
acuucacgguuacggccuucgg

SEQ ID NO: 596006 - RNA, 15 nt, Escherichia coli CFT073
acuucagguucagca

SEQ ID NO: 596007 - RNA, 22 nt, Escherichia coli CFT073
acuucagguucagcaaccacaa

SEQ ID NO: 596008 - RNA, 16 nt, Escherichia coli CFT073
acuucauacauugcca

SEQ ID NO: 596009 - RNA, 18 nt, Escherichia coli CFT073
acuucauaggucauuggc

SEQ ID NO: 596010 - RNA, 20 nt, Escherichia coli CFT073
acuucauccgacaccagccg

SEQ ID NO: 596011 - RNA, 20 nt, Escherichia coli CFT073
acuuucgccaguucuuccgc

SEQ ID NO: 596012 - RNA, 16 nt, Escherichia coli CFT073
acuuucacuucaguaa

SEQ ID NO: 596013 - RNA, 16 nt, Escherichia coli CFT073
acuuucagaccgccga

SEQ ID NO: 596014 - RNA, 15 nt, Escherichia coli CFT073
acuuuccaucuuucc

SEQ ID NO: 596015 - RNA, 16 nt, Escherichia coli CFT073
acuuuccaugccaucu

SEQ ID NO: 596016 - RNA, 19 nt, Escherichia coli CFT073
acuuucucacaagcccagg

SEQ ID NO: 596017 - RNA, 20 nt, Escherichia coli CFT073
acuuucugauuguuauucau

SEQ ID NO: 596018 - RNA, 18 nt, Escherichia coli CFT073
acuuugcaaugagaucgg

SEQ ID NO: 596019 - RNA, 11 nt, Escherichia coli CFT073
acuuugccugg

SEQ ID NO: 596020 - RNA, 11 nt, Escherichia coli CFT073
acuuguuuaca

SEQ ID NO: 596021 - RNA, 21 nt, Escherichia coli CFT073
acuuuaauuuugugcagcaca

SEQ ID NO: 596022 - RNA, 15 nt, Escherichia coli CFT073
acuuuaccugccuga

SEQ ID NO: 596023 - RNA, 16 nt, Escherichia coli CFT073
acuuuagucgcuugca

SEQ ID NO: 596024 - RNA, 16 nt, Escherichia coli CFT073
acuuuauucaguggca

SEQ ID NO: 596025 - RNA, 14 nt, Escherichia coli CFT073
agaaaacgccugcu

SEQ ID NO: 596026 - RNA, 22 nt, Escherichia coli CFT073
agaaaaauaaaaacggcgcuaa

SEQ ID NO: 596027 - RNA, 18 nt, Escherichia coli CFT073
acuuugcuuucagauuca

SEQ ID NO: 596028 - RNA, 15 nt, Escherichia coli CFT073
acuuuguaccagcgg

SEQ ID NO: 596029 - RNA, 20 nt, Escherichia coli CFT073
acuuuuccuuugcgcgucac

SEQ ID NO: 596030 - RNA, 18 nt, Escherichia coli CFT073
acuuuucggcaaccgcau

SEQ ID NO: 596031 - RNA, 21 nt, Escherichia coli CFT073
acuuuucaggcuagccgccag

SEQ ID NO: 596032 - RNA, 22 nt, Escherichia coli CFT073
acuugcaggaacaaugccucgc

SEQ ID NO: 596033 - RNA, 16 nt, Escherichia coli CFT073
acuugguuacgcaccg

SEQ ID NO: 596034 - RNA, 20 nt, Escherichia coli CFT073
acuugguuugucggcgugaa

SEQ ID NO: 596035 - RNA, 23 nt, Escherichia coli CFT073
acuuguaaaaucuucgccacuuu

SEQ ID NO: 596036 - RNA, 13 nt, Escherichia coli CFT073
acuuguucagcga

SEQ ID NO: 596037 - RNA, 14 nt, Escherichia coli CFT073
acuucuauucacca

SEQ ID NO: 596038 - RNA, 16 nt, Escherichia coli CFT073
acuucuucauucaucc

SEQ ID NO: 596039 - RNA, 15 nt, Escherichia coli CFT073
acuucuuccagcggc

SEQ ID NO: 596040 - RNA, 16 nt, Escherichia coli CFT073
acuugagccgccacca

SEQ ID NO: 596041 - RNA, 17 nt, Escherichia coli CFT073
acuugagguaaucacuc

SEQ ID NO: 596042 - RNA, 16 nt, Escherichia coli CFT073
acuugaacuuaucauc

SEQ ID NO: 596043 - RNA, 14 nt, Escherichia coli CFT073
acuucuucuguuuc

SEQ ID NO: 596044 - RNA, 19 nt, Escherichia coli CFT073
acuucuuucacgcccgcgu

SEQ ID NO: 596045 - RNA, 20 nt, Escherichia coli CFT073
acuucuuucgcccagcguug

SEQ ID NO: 596046 - RNA, 21 nt, Escherichia coli CFT073
acgcuacucgccugccacauc

SEQ ID NO: 596047 - RNA, 24 nt, Escherichia coli CFT073
acgcuacgcuaacuucgccaucag

SEQ ID NO: 596048 - RNA, 19 nt, Escherichia coli CFT073
acgcuaacuucgccaucag

SEQ ID NO: 596049 - RNA, 15 nt, Escherichia coli CFT073
acgcucacccaucac

SEQ ID NO: 596050 - RNA, 19 nt, Escherichia coli CFT073
acgcucacaucugcaaugc

SEQ ID NO: 596051 - RNA, 23 nt, Escherichia coli CFT073
acgcucagcaacauggcgcggca

SEQ ID NO: 596052 - RNA, 13 nt, Escherichia coli CFT073
acgcuccaccacc

SEQ ID NO: 596053 - RNA, 14 nt, Escherichia coli CFT073
acgcuccaugcugc

SEQ ID NO: 596054 - RNA, 20 nt, Escherichia coli CFT073
acgcucccacggaauagaac

SEQ ID NO: 596055 - RNA, 15 nt, Escherichia coli CFT073
acgcucccuggauca

SEQ ID NO: 596056 - RNA, 13 nt, Escherichia coli CFT073
acgcucgccauuu

SEQ ID NO: 596057 - RNA, 14 nt, Escherichia coli CFT073
acgcucgcugcaaa

SEQ ID NO: 596058 - RNA, 19 nt, Escherichia coli CFT073
acgcguggcgucgcaucug

SEQ ID NO: 596059 - RNA, 21 nt, Escherichia coli CFT073
acgcguuaagcgucgcaucag

SEQ ID NO: 596060 - RNA, 14 nt, Escherichia coli CFT073
acgcguuaauaccu

SEQ ID NO: 596061 - RNA, 20 nt, Escherichia coli CFT073
acgcguuagcgucgcaucag

SEQ ID NO: 596062 - RNA, 22 nt, Escherichia coli CFT073
acgcguuauaggcauucucgcc

SEQ ID NO: 596063 - RNA, 21 nt, Escherichia coli CFT073
acgcgucuuaucaggccuaca

SEQ ID NO: 596064 - RNA, 20 nt, Escherichia coli CFT073
acgcgucugcgucgcaucug

SEQ ID NO: 596065 - RNA, 16 nt, Escherichia coli CFT073
acgcgucagcgccgca

SEQ ID NO: 596066 - RNA, 20 nt, Escherichia coli CFT073
acgcgucagcgccgcauccg

SEQ ID NO: 596067 - RNA, 17 nt, Escherichia coli CFT073
acgcgucauacgaucag

SEQ ID NO: 596068 - RNA, 16 nt, Escherichia coli CFT073
acgcgucccggaaucc

SEQ ID NO: 596069 - RNA, 21 nt, Escherichia coli CFT073
acgcguaaagcgucgcaucag

SEQ ID NO: 596070 - RNA, 19 nt, Escherichia coli CFT073
acgcguagugucgcaucag

SEQ ID NO: 596071 - RNA, 15 nt, Escherichia coli CFT073
acgcugacgcaucug

SEQ ID NO: 596072 - RNA, 23 nt, Escherichia coli CFT073
acgcugaauaauccccacaucag

SEQ ID NO: 596073 - RNA, 15 nt, Escherichia coli CFT073
acgcugacaaacugc

SEQ ID NO: 596074 - RNA, 19 nt, Escherichia coli CFT073
acgcugcgcugcaccagua

SEQ ID NO: 596075 - RNA, 19 nt, Escherichia coli CFT073
acgcugcauggcaacuuua

SEQ ID NO: 596076 - RNA, 17 nt, Escherichia coli CFT073
acgcugauugcauaaug

SEQ ID NO: 596077 - RNA, 19 nt, Escherichia coli CFT073
acgcugacaucaacagaag

SEQ ID NO: 596078 - RNA, 20 nt, Escherichia coli CFT073
acgcuuuguccagugcaacu

SEQ ID NO: 596079 - RNA, 16 nt, Escherichia coli CFT073
acgcugucuuaucagg

SEQ ID NO: 596080 - RNA, 23 nt, Escherichia coli CFT073
acgcugucggcaagauacugcau

SEQ ID NO: 596081 - RNA, 17 nt, Escherichia coli CFT073
acgcuguggcgcuggca

SEQ ID NO: 596082 - RNA, 22 nt, Escherichia coli CFT073
acgcuguucgcgucuuaucagg

SEQ ID NO: 596083 - RNA, 20 nt, Escherichia coli CFT073
acgcuggggccaucgccgcc

SEQ ID NO: 596084 - RNA, 24 nt, Escherichia coli CFT073
acggacuucaagcggacgaucgcu

SEQ ID NO: 596085 - RNA, 23 nt, Escherichia coli CFT073
acggagaauccagccccaccagc

SEQ ID NO: 596086 - RNA, 17 nt, Escherichia coli CFT073
acggagauuaaacgcau

SEQ ID NO: 596087 - RNA, 19 nt, Escherichia coli CFT073
acggaccaauaaacgccag

SEQ ID NO: 596088 - RNA, 20 nt, Escherichia coli CFT073
acggaccaauaaacgccagg

SEQ ID NO: 596089 - RNA, 13 nt, Escherichia coli CFT073
acggaauaaaccg

SEQ ID NO: 596090 - RNA, 18 nt, Escherichia coli CFT073
acggaacucuuccgggaa

SEQ ID NO: 596091 - RNA, 23 nt, Escherichia coli CFT073
acggaacucuuccgggaaaacau

SEQ ID NO: 596092 - RNA, 18 nt, Escherichia coli CFT073
acggaacugcuccagggc

SEQ ID NO: 596093 - RNA, 19 nt, Escherichia coli CFT073
acgcccuuaaucaacucac

SEQ ID NO: 596094 - RNA, 20 nt, Escherichia coli CFT073
acgcccugcaacugcugcau

SEQ ID NO: 596095 - RNA, 23 nt, Escherichia coli CFT073
acgccggguuauugguuucgucg

SEQ ID NO: 596096 - RNA, 18 nt, Escherichia coli CFT073
acgccugcggcugauaau

SEQ ID NO: 596097 - RNA, 20 nt, Escherichia coli CFT073
acgccugcaagcgucgcgcc

SEQ ID NO: 596098 - RNA, 23 nt, Escherichia coli CFT073
acgcgggccgcgucuuaucaggc

SEQ ID NO: 596099 - RNA, 14 nt, Escherichia coli CFT073
acgcgggaagucac

SEQ ID NO: 596100 - RNA, 21 nt, Escherichia coli CFT073
acgcgcuuucuucgcagcaaa

SEQ ID NO: 596101 - RNA, 17 nt, Escherichia coli CFT073
acgcgcuguaauuucac

SEQ ID NO: 596102 - RNA, 18 nt, Escherichia coli CFT073
acgcgcuguaauuucaca

SEQ ID NO: 596103 - RNA, 22 nt, Escherichia coli CFT073
acgcgcuguaauuucacaccau

SEQ ID NO: 596104 - RNA, 18 nt, Escherichia coli CFT073
acgcgcuggcaaaucaaa

SEQ ID NO: 596105 - RNA, 22 nt, Escherichia coli CFT073
acgcgccuuaaaaaccagagaa

SEQ ID NO: 596106 - RNA, 19 nt, Escherichia coli CFT073
acgcgaaggccagcaccac

SEQ ID NO: 596107 - RNA, 21 nt, Escherichia coli CFT073
acgcccauaacgcgcgcgaua

SEQ ID NO: 596108 - RNA, 15 nt, Escherichia coli CFT073
acgcccauacauacc

SEQ ID NO: 596109 - RNA, 18 nt, Escherichia coli CFT073
acgcccguuuucaccuua

SEQ ID NO: 596110 - RNA, 18 nt, Escherichia coli CFT073
acgccccgguuucucuuc

SEQ ID NO: 596111 - RNA, 23 nt, Escherichia coli CFT073
acgcccccaauguggagagcaac

SEQ ID NO: 596112 - RNA, 13 nt, Escherichia coli CFT073
acgccaucauucg

SEQ ID NO: 596113 - RNA, 15 nt, Escherichia coli CFT073
acgccaucaacgaaa

SEQ ID NO: 596114 - RNA, 20 nt, Escherichia coli CFT073
acgccagccaaucaucguac

SEQ ID NO: 596115 - RNA, 16 nt, Escherichia coli CFT073
acgccauacccgcaca

SEQ ID NO: 596116 - RNA, 17 nt, Escherichia coli CFT073
acgccaaaagcgauuau

SEQ ID NO: 596117 - RNA, 21 nt, Escherichia coli CFT073
acgcauucucgcuacccauga

SEQ ID NO: 596118 - RNA, 21 nt, Escherichia coli CFT073
acgcauuuacacucgccccug

SEQ ID NO: 596119 - RNA, 14 nt, Escherichia coli CFT073
acgccaacaaaaau

SEQ ID NO: 596120 - RNA, 16 nt, Escherichia coli CFT073
acgccaaccaccggaa

SEQ ID NO: 596121 - RNA, 13 nt, Escherichia coli CFT073
acgccaagaaaca

SEQ ID NO: 596122 - RNA, 17 nt, Escherichia coli CFT073
acgccacgccaccagcg

SEQ ID NO: 596123 - RNA, 18 nt, Escherichia coli CFT073
acgccagacagcgcaaua

SEQ ID NO: 596124 - RNA, 17 nt, Escherichia coli CFT073
acgccagacagcguaau

SEQ ID NO: 596125 - RNA, 22 nt, Escherichia coli CFT073
acgcaggcaucuuuuucaaugc

SEQ ID NO: 596126 - RNA, 18 nt, Escherichia coli CFT073
acgcaggccacgaaucag

SEQ ID NO: 596127 - RNA, 18 nt, Escherichia coli CFT073
acgcagcuucucgugaaa

SEQ ID NO: 596128 - RNA, 13 nt, Escherichia coli CFT073
acgauaucgauaa

SEQ ID NO: 596129 - RNA, 20 nt, Escherichia coli CFT073
acgauagaaccuuccacguu

SEQ ID NO: 596130 - RNA, 18 nt, Escherichia coli CFT073
acgauaggucauaucauc

SEQ ID NO: 596131 - RNA, 19 nt, Escherichia coli CFT073
acgauauucuguaccaaaa

SEQ ID NO: 596132 - RNA, 21 nt, Escherichia coli CFT073
acgaucaucgacaguaccagc

SEQ ID NO: 596133 - RNA, 16 nt, Escherichia coli CFT073
acgauccgacaucccg

SEQ ID NO: 596134 - RNA, 20 nt, Escherichia coli CFT073
acgaugccugaugcgacgcu

SEQ ID NO: 596135 - RNA, 18 nt, Escherichia coli CFT073
acgaugccugcaaugccg

SEQ ID NO: 596136 - RNA, 14 nt, Escherichia coli CFT073
acgaugauugccac

SEQ ID NO: 596137 - RNA, 18 nt, Escherichia coli CFT073
acgauuucacccagcguu

SEQ ID NO: 596138 - RNA, 22 nt, Escherichia coli CFT073
acgaugcuuuacguauccguuc

SEQ ID NO: 596139 - RNA, 15 nt, Escherichia coli CFT073
acgcaacugauauuu

SEQ ID NO: 596140 - RNA, 19 nt, Escherichia coli CFT073
acgcaccggaaauugcugc

SEQ ID NO: 596141 - RNA, 15 nt, Escherichia coli CFT073
acgcaccuuguucau

SEQ ID NO: 596142 - RNA, 23 nt, Escherichia coli CFT073
acgcagcucauaaccguccaguu

SEQ ID NO: 596143 - RNA, 14 nt, Escherichia coli CFT073
acgcagcggcggca

SEQ ID NO: 596144 - RNA, 21 nt, Escherichia coli CFT073
acgcacuucuucguuuucugc

SEQ ID NO: 596145 - RNA, 18 nt, Escherichia coli CFT073
acgcacucgacgcagcag

SEQ ID NO: 596146 - RNA, 13 nt, Escherichia coli CFT073
acgcacuuccggu

SEQ ID NO: 596147 - RNA, 16 nt, Escherichia coli CFT073
acgaacgcagugauaa

SEQ ID NO: 596148 - RNA, 15 nt, Escherichia coli CFT073
accuuugaacugcug

SEQ ID NO: 596149 - RNA, 12 nt, Escherichia coli CFT073
acgaaagcgcgg

SEQ ID NO: 596150 - RNA, 16 nt, Escherichia coli CFT073
acgaaacagacggcag

SEQ ID NO: 596151 - RNA, 21 nt, Escherichia coli CFT073
acgaaaucggcaccgccgcca

SEQ ID NO: 596152 - RNA, 17 nt, Escherichia coli CFT073
accuucugaauaaugac

SEQ ID NO: 596153 - RNA, 13 nt, Escherichia coli CFT073
accuucugcgccc

SEQ ID NO: 596154 - RNA, 13 nt, Escherichia coli CFT073
accuguccggcgg

SEQ ID NO: 596155 - RNA, 19 nt, Escherichia coli CFT073
accugucgcgucaaucacu

SEQ ID NO: 596156 - RNA, 16 nt, Escherichia coli CFT073
accugugccgccgccc

SEQ ID NO: 596157 - RNA, 15 nt, Escherichia coli CFT073
accuaauacucuggc

SEQ ID NO: 596158 - RNA, 20 nt, Escherichia coli CFT073
accguugcucagaaucacgc

SEQ ID NO: 596159 - RNA, 20 nt, Escherichia coli CFT073
accguuggacggucuaccag

SEQ ID NO: 596160 - RNA, 13 nt, Escherichia coli CFT073
accguuucugccg

SEQ ID NO: 596161 - RNA, 22 nt, Escherichia coli CFT073
accguuugccccggcugcgcga

SEQ ID NO: 596162 - RNA, 20 nt, Escherichia coli CFT073
acgauaacaaucaccaaacc

SEQ ID NO: 596163 - RNA, 18 nt, Escherichia coli CFT073
acgauacaaaagcaccgu

SEQ ID NO: 596164 - RNA, 14 nt, Escherichia coli CFT073
acgauaccgccgca

SEQ ID NO: 596165 - RNA, 14 nt, Escherichia coli CFT073
acgauacgcuggcg

SEQ ID NO: 596166 - RNA, 20 nt, Escherichia coli CFT073
acgauacgguuauccugcaa

SEQ ID NO: 596167 - RNA, 23 nt, Escherichia coli CFT073
acgagucgccuguacuuccuguu

SEQ ID NO: 596168 - RNA, 13 nt, Escherichia coli CFT073
acgaguggcggac

SEQ ID NO: 596169 - RNA, 22 nt, Escherichia coli CFT073
acgaguugcgguuucaacugcg

SEQ ID NO: 596170 - RNA, 20 nt, Escherichia coli CFT073
acgacuuugcgcaggcaagc

SEQ ID NO: 596171 - RNA, 20 nt, Escherichia coli CFT073
acgagaacgucgcagggaga

SEQ ID NO: 596172 - RNA, 23 nt, Escherichia coli CFT073
acgacggaauuucauaugcgcca

SEQ ID NO: 596173 - RNA, 16 nt, Escherichia coli CFT073
acgacuucaucgccaa

SEQ ID NO: 596174 - RNA, 22 nt, Escherichia coli CFT073
acgacuuccuggcuaccauccg

SEQ ID NO: 596175 - RNA, 18 nt, Escherichia coli CFT073
acgacacugcucgcagaa

SEQ ID NO: 596176 - RNA, 22 nt, Escherichia coli CFT073
acgacauaugcguagcaacggu

SEQ ID NO: 596177 - RNA, 17 nt, Escherichia coli CFT073
acgacauccgccagcgc

SEQ ID NO: 596178 - RNA, 21 nt, Escherichia coli CFT073
acgacaucgacucaccacggu

SEQ ID NO: 596179 - RNA, 14 nt, Escherichia coli CFT073
acgacaccacggua

SEQ ID NO: 596180 - RNA, 18 nt, Escherichia coli CFT073
acgaagcgccauucacaa

SEQ ID NO: 596181 - RNA, 13 nt, Escherichia coli CFT073
acgaagcggcugc

SEQ ID NO: 596182 - RNA, 23 nt, Escherichia coli CFT073
accgauuaauuccccugccagaa

SEQ ID NO: 596183 - RNA, 14 nt, Escherichia coli CFT073
accgaugccgcggc

SEQ ID NO: 596184 - RNA, 15 nt, Escherichia coli CFT073
accgcaaaaccaacg

SEQ ID NO: 596185 - RNA, 14 nt, Escherichia coli CFT073
accgcaaacugcug

SEQ ID NO: 596186 - RNA, 23 nt, Escherichia coli CFT073
accgcaccuucgaaugccgcagc

SEQ ID NO: 596187 - RNA, 17 nt, Escherichia coli CFT073
accgcaauaaccaucag

SEQ ID NO: 596188 - RNA, 17 nt, Escherichia coli CFT073
accgccacuaccaucag

SEQ ID NO: 596189 - RNA, 15 nt, Escherichia coli CFT073
accgccaggcacuuc

SEQ ID NO: 596190 - RNA, 22 nt, Escherichia coli CFT073
accgccaggccuaacaccauca

SEQ ID NO: 596191 - RNA, 17 nt, Escherichia coli CFT073
accgccagugcagcgaa

SEQ ID NO: 596192 - RNA, 20 nt, Escherichia coli CFT073
accgccauuaaacgcaguaa

SEQ ID NO: 596193 - RNA, 21 nt, Escherichia coli CFT073
accgagcacaccugcaacggc

SEQ ID NO: 596194 - RNA, 20 nt, Escherichia coli CFT073
accgagcagccacugcggca

SEQ ID NO: 596195 - RNA, 16 nt, Escherichia coli CFT073
accgacugacgcucug

SEQ ID NO: 596196 - RNA, 17 nt, Escherichia coli CFT073
accgaaguuaugccagu

SEQ ID NO: 596197 - RNA, 15 nt, Escherichia coli CFT073
accgaagaucaccac

SEQ ID NO: 596198 - RNA, 12 nt, Escherichia coli CFT073
accgaauucugc

SEQ ID NO: 596199 - RNA, 13 nt, Escherichia coli CFT073
accgacaaacagc

SEQ ID NO: 596200 - RNA, 15 nt, Escherichia coli CFT073
accgaugaucgccau

SEQ ID NO: 596201 - RNA, 14 nt, Escherichia coli CFT073
accgaugccaccca

SEQ ID NO: 596202 - RNA, 23 nt, Escherichia coli CFT073
accgauaaacgcgacgauuaagc

SEQ ID NO: 596203 - RNA, 12 nt, Escherichia coli CFT073
accgaucgccag

SEQ ID NO: 596204 - RNA, 21 nt, Escherichia coli CFT073
accgagaugguaaagcaccug

SEQ ID NO: 596205 - RNA, 18 nt, Escherichia coli CFT073
acccgaccgagcugguga

SEQ ID NO: 596206 - RNA, 15 nt, Escherichia coli CFT073
acccgacgcgccagg

SEQ ID NO: 596207 - RNA, 18 nt, Escherichia coli CFT073
acccaaccgauaaccacg

SEQ ID NO: 596208 - RNA, 15 nt, Escherichia coli CFT073
acccaaccggcaaug

SEQ ID NO: 596209 - RNA, 18 nt, Escherichia coli CFT073
acccgcagcaagcguuug

SEQ ID NO: 596210 - RNA, 18 nt, Escherichia coli CFT073
acccgcagccaucaccac

SEQ ID NO: 596211 - RNA, 22 nt, Escherichia coli CFT073
acccgcacaaauagccagcaga

SEQ ID NO: 596212 - RNA, 15 nt, Escherichia coli CFT073
acccggugccgccgu

SEQ ID NO: 596213 - RNA, 17 nt, Escherichia coli CFT073
acccggugccgccguca

SEQ ID NO: 596214 - RNA, 23 nt, Escherichia coli CFT073
acccgguucaauuuccaguuuca

SEQ ID NO: 596215 - RNA, 19 nt, Escherichia coli CFT073
acccguuguaaaugcugcu

SEQ ID NO: 596216 - RNA, 13 nt, Escherichia coli CFT073
acccuggcgcgaa

SEQ ID NO: 596217 - RNA, 16 nt, Escherichia coli CFT073
accguagaaggcgaca

SEQ ID NO: 596218 - RNA, 20 nt, Escherichia coli CFT073
accguacucggcaguaucgg

SEQ ID NO: 596219 - RNA, 14 nt, Escherichia coli CFT073
accguagcguguug

SEQ ID NO: 596220 - RNA, 12 nt, Escherichia coli CFT073
accgucagcgca

SEQ ID NO: 596221 - RNA, 13 nt, Escherichia coli CFT073
accguccagcguu

SEQ ID NO: 596222 - RNA, 14 nt, Escherichia coli CFT073
accguaaagcacug

SEQ ID NO: 596223 - RNA, 14 nt, Escherichia coli CFT073
accguaaauugcau

SEQ ID NO: 596224 - RNA, 16 nt, Escherichia coli CFT073
accguacgccagcguc

SEQ ID NO: 596225 - RNA, 15 nt, Escherichia coli CFT073
accggcuuucgcuuc

SEQ ID NO: 596226 - RNA, 23 nt, Escherichia coli CFT073
accgguccuaacaaccaucccca

SEQ ID NO: 596227 - RNA, 18 nt, Escherichia coli CFT073
accggucggggccagcgc

SEQ ID NO: 596228 - RNA, 19 nt, Escherichia coli CFT073
accggucggggccagcgca

SEQ ID NO: 596229 - RNA, 23 nt, Escherichia coli CFT073
accgguguaggcauacacaucac

SEQ ID NO: 596230 - RNA, 11 nt, Escherichia coli CFT073
accgugcuuca

SEQ ID NO: 596231 - RNA, 22 nt, Escherichia coli CFT073
accgugcgccagcaaaucagcc

SEQ ID NO: 596232 - RNA, 17 nt, Escherichia coli CFT073
accgugcacuucugcgg

SEQ ID NO: 596233 - RNA, 21 nt, Escherichia coli CFT073
accgugcagcgcaaucgccuc

SEQ ID NO: 596234 - RNA, 16 nt, Escherichia coli CFT073
accgugccgccgugac

SEQ ID NO: 596235 - RNA, 23 nt, Escherichia coli CFT073
accgugucgccaucaaaggcuuc

SEQ ID NO: 596236 - RNA, 13 nt, Escherichia coli CFT073
accguguucagcg

SEQ ID NO: 596237 - RNA, 18 nt, Escherichia coli CFT073
accguguucaugaccgug

SEQ ID NO: 596238 - RNA, 19 nt, Escherichia coli CFT073
accguucauuaacgcccca

SEQ ID NO: 596239 - RNA, 12 nt, Escherichia coli CFT073
accgucuguaac

SEQ ID NO: 596240 - RNA, 19 nt, Escherichia coli CFT073
accgugauccgccgcuggc

SEQ ID NO: 596241 - RNA, 21 nt, Escherichia coli CFT073
accgucguggucgugaucgug

SEQ ID NO: 596242 - RNA, 17 nt, Escherichia coli CFT073
accgucgccuucaacgu

SEQ ID NO: 596243 - RNA, 18 nt, Escherichia coli CFT073
accgcgggcaaucgccag

SEQ ID NO: 596244 - RNA, 19 nt, Escherichia coli CFT073
accgcgggcaaucgccaga

SEQ ID NO: 596245 - RNA, 17 nt, Escherichia coli CFT073
accgcuguugccagcag

SEQ ID NO: 596246 - RNA, 18 nt, Escherichia coli CFT073
accgcuguugccagcagc

SEQ ID NO: 596247 - RNA, 23 nt, Escherichia coli CFT073
accgcuguugccagcagcaacca

SEQ ID NO: 596248 - RNA, 20 nt, Escherichia coli CFT073
accgcuucaacagcggcauu

SEQ ID NO: 596249 - RNA, 19 nt, Escherichia coli CFT073
accggaauuuacccgccag

SEQ ID NO: 596250 - RNA, 18 nt, Escherichia coli CFT073
accgcuggccaguuuuca

SEQ ID NO: 596251 - RNA, 21 nt, Escherichia coli CFT073
accgcuggccaguuuucagaa

SEQ ID NO: 596252 - RNA, 13 nt, Escherichia coli CFT073
accggcaggugau

SEQ ID NO: 596253 - RNA, 20 nt, Escherichia coli CFT073
accggagaaaagaccagcca

SEQ ID NO: 596254 - RNA, 22 nt, Escherichia coli CFT073
accggcuggcuaacaugcccau

SEQ ID NO: 596255 - RNA, 17 nt, Escherichia coli CFT073
acaucauuucccacgcg

SEQ ID NO: 596256 - RNA, 20 nt, Escherichia coli CFT073
acaucauuucccacgcggca

SEQ ID NO: 596257 - RNA, 20 nt, Escherichia coli CFT073
acaucauucaaugcucaccc

SEQ ID NO: 596258 - RNA, 22 nt, Escherichia coli CFT073
acauccagcguaauaggcgcga

SEQ ID NO: 596259 - RNA, 19 nt, Escherichia coli CFT073
acaucgcccgauucacaua

SEQ ID NO: 596260 - RNA, 16 nt, Escherichia coli CFT073
acaucgccauaaacac

SEQ ID NO: 596261 - RNA, 16 nt, Escherichia coli CFT073
acaugccgucaaucca

SEQ ID NO: 596262 - RNA, 21 nt, Escherichia coli CFT073
acaucggcuuuuuuaucauua

SEQ ID NO: 596263 - RNA, 23 nt, Escherichia coli CFT073
acaucgguauagauaaagucugc

SEQ ID NO: 596264 - RNA, 20 nt, Escherichia coli CFT073
acaugcuuaacacacggaua

SEQ ID NO: 596265 - RNA, 21 nt, Escherichia coli CFT073
acauggcacugcgaucccggc

SEQ ID NO: 596266 - RNA, 22 nt, Escherichia coli CFT073
acauggcgcggcacaccagcca

SEQ ID NO: 596267 - RNA, 14 nt, Escherichia coli CFT073
acaugcucaucccc

SEQ ID NO: 596268 - RNA, 19 nt, Escherichia coli CFT073
acaugguuaaaaucucccg

SEQ ID NO: 596269 - RNA, 23 nt, Escherichia coli CFT073
acaugguuuucaauuaucaccgc

SEQ ID NO: 596270 - RNA, 23 nt, Escherichia coli CFT073
acauguauaaaaagaagaucauc

SEQ ID NO: 596271 - RNA, 17 nt, Escherichia coli CFT073
acaucaggcacaucggc

SEQ ID NO: 596272 - RNA, 10 nt, Escherichia coli CFT073
acaucaauac

SEQ ID NO: 596273 - RNA, 19 nt, Escherichia coli CFT073
acaucagcggcaaaacggu

SEQ ID NO: 596274 - RNA, 17 nt, Escherichia coli CFT073
acaucaucacgcagagc

SEQ ID NO: 596275 - RNA, 16 nt, Escherichia coli CFT073
acaucagugauacauc

SEQ ID NO: 596276 - RNA, 13 nt, Escherichia coli CFT073
acaucaucgcccc

SEQ ID NO: 596277 - RNA, 19 nt, Escherichia coli CFT073
acaucacauauucgccgcc

SEQ ID NO: 596278 - RNA, 13 nt, Escherichia coli CFT073
acaucaacagacc

SEQ ID NO: 596279 - RNA, 13 nt, Escherichia coli CFT073
acaucaaccagau

SEQ ID NO: 596280 - RNA, 18 nt, Escherichia coli CFT073
acaucaacgaugccuuau

SEQ ID NO: 596281 - RNA, 21 nt, Escherichia coli CFT073
acaucaccugaauaugaccca

SEQ ID NO: 596282 - RNA, 19 nt, Escherichia coli CFT073
acaucaccuuguuucagcg

SEQ ID NO: 596283 - RNA, 19 nt, Escherichia coli CFT073
acaucacgacgaccaccga

SEQ ID NO: 596284 - RNA, 17 nt, Escherichia coli CFT073
acaggugcaccgcaucc

SEQ ID NO: 596285 - RNA, 22 nt, Escherichia coli CFT073
acagguaagguaaugcgcgagc

SEQ ID NO: 596286 - RNA, 21 nt, Escherichia coli CFT073
acagguaauugaggaccccau

SEQ ID NO: 596287 - RNA, 19 nt, Escherichia coli CFT073
acagguugccguccagcgc

SEQ ID NO: 596288 - RNA, 16 nt, Escherichia coli CFT073
acaguacccagauuca

SEQ ID NO: 596289 - RNA, 17 nt, Escherichia coli CFT073
acaguaagcccaccaca

SEQ ID NO: 596290 - RNA, 21 nt, Escherichia coli CFT073
acagcguguuaaugcccauca

SEQ ID NO: 596291 - RNA, 17 nt, Escherichia coli CFT073
acagcguuucgccgccc

SEQ ID NO: 596292 - RNA, 19 nt, Escherichia coli CFT073
acagcuacgcaucaugccg

SEQ ID NO: 596293 - RNA, 18 nt, Escherichia coli CFT073
acagcucgacaccaaaca

SEQ ID NO: 596294 - RNA, 12 nt, Escherichia coli CFT073
acagcucacgcg

SEQ ID NO: 596295 - RNA, 14 nt, Escherichia coli CFT073
acagcgugccgcga

SEQ ID NO: 596296 - RNA, 15 nt, Escherichia coli CFT073
acagcuuaaaaugcu

SEQ ID NO: 596297 - RNA, 16 nt, Escherichia coli CFT073
acagcugcaacagcgc

SEQ ID NO: 596298 - RNA, 12 nt, Escherichia coli CFT073
acagcuuguuau

SEQ ID NO: 596299 - RNA, 20 nt, Escherichia coli CFT073
acaggaaccaaaugccggau

SEQ ID NO: 596300 - RNA, 18 nt, Escherichia coli CFT073
acaggauggcccaaaugg

SEQ ID NO: 596301 - RNA, 20 nt, Escherichia coli CFT073
acaggcuguuguucagugca

SEQ ID NO: 596302 - RNA, 16 nt, Escherichia coli CFT073
acagggcaacggccaa

SEQ ID NO: 596303 - RNA, 18 nt, Escherichia coli CFT073
acaggcugcugccguagc

SEQ ID NO: 596304 - RNA, 12 nt, Escherichia coli CFT073
acaggcgugauu

SEQ ID NO: 596305 - RNA, 12 nt, Escherichia coli CFT073
acaggcggcgcg

SEQ ID NO: 596306 - RNA, 12 nt, Escherichia coli CFT073
acaggcgcgacc

SEQ ID NO: 596307 - RNA, 16 nt, Escherichia coli CFT073
acaggccggagccagu

SEQ ID NO: 596308 - RNA, 13 nt, Escherichia coli CFT073
acaggccaccagg

SEQ ID NO: 596309 - RNA, 18 nt, Escherichia coli CFT073
aauuuguuugacgcgcaa

SEQ ID NO: 596310 - RNA, 18 nt, Escherichia coli CFT073
aauuuucggggugcuccg

SEQ ID NO: 596311 - RNA, 23 nt, Escherichia coli CFT073
aauuuugaaggaaaaaucgcacu

SEQ ID NO: 596312 - RNA, 16 nt, Escherichia coli CFT073
aauuugcgucaaugcc

SEQ ID NO: 596313 - RNA, 19 nt, Escherichia coli CFT073
aauuugcguuuucaccacu

SEQ ID NO: 596314 - RNA, 16 nt, Escherichia coli CFT073
aauuugcuccgccacu

SEQ ID NO: 596315 - RNA, 23 nt, Escherichia coli CFT073
aauuugccaucucugcaacgucu

SEQ ID NO: 596316 - RNA, 16 nt, Escherichia coli CFT073
aauuugcgccgccgac

SEQ ID NO: 596317 - RNA, 18 nt, Escherichia coli CFT073
aauuuccgcuuucaacgc

SEQ ID NO: 596318 - RNA, 14 nt, Escherichia coli CFT073
aauuucuccgccgg

SEQ ID NO: 596319 - RNA, 15 nt, Escherichia coli CFT073
aauuucuuuuuuuca

SEQ ID NO: 596320 - RNA, 18 nt, Escherichia coli CFT073
aauuucuuuuuuucauug

SEQ ID NO: 596321 - RNA, 23 nt, Escherichia coli CFT073
aauuugaaaccgucuucccgcag

SEQ ID NO: 596322 - RNA, 13 nt, Escherichia coli CFT073
acacaucgucgcc

SEQ ID NO: 596323 - RNA, 18 nt, Escherichia coli CFT073
acacaugguuuacggcgg

SEQ ID NO: 596324 - RNA, 20 nt, Escherichia coli CFT073
acacauuaucucaacacacg

SEQ ID NO: 596325 - RNA, 19 nt, Escherichia coli CFT073
acacaucagaaacgcgaca

SEQ ID NO: 596326 - RNA, 19 nt, Escherichia coli CFT073
acacaucagcaacgcugac

SEQ ID NO: 596327 - RNA, 14 nt, Escherichia coli CFT073
acaccacaaaucgg

SEQ ID NO: 596328 - RNA, 15 nt, Escherichia coli CFT073
acaccaaaauaacga

SEQ ID NO: 596329 - RNA, 13 nt, Escherichia coli CFT073
acaccaccaugcu

SEQ ID NO: 596330 - RNA, 23 nt, Escherichia coli CFT073
acaccucaucgcgcaacgucgcg

SEQ ID NO: 596331 - RNA, 21 nt, Escherichia coli CFT073
acacccccugcaaaacuggca

SEQ ID NO: 596332 - RNA, 13 nt, Escherichia coli CFT073
acaccggcagcgg

SEQ ID NO: 596333 - RNA, 11 nt, Escherichia coli CFT073
acaccaugcca

SEQ ID NO: 596334 - RNA, 12 nt, Escherichia coli CFT073
acaccagaacca

SEQ ID NO: 596335 - RNA, 16 nt, Escherichia coli CFT073
acaccagaaccagcaa

SEQ ID NO: 596336 - RNA, 21 nt, Escherichia coli CFT073
acaccagaaccagcaaccacu

SEQ ID NO: 596337 - RNA, 12 nt, Escherichia coli CFT073
acaccagcaaua

SEQ ID NO: 596338 - RNA, 12 nt, Escherichia coli CFT073
acagaugacgau

SEQ ID NO: 596339 - RNA, 18 nt, Escherichia coli CFT073
acagaguguauucaugcc

SEQ ID NO: 596340 - RNA, 14 nt, Escherichia coli CFT073
acagcauacggcug

SEQ ID NO: 596341 - RNA, 15 nt, Escherichia coli CFT073
acagcagcggcagaa

SEQ ID NO: 596342 - RNA, 12 nt, Escherichia coli CFT073
acagccgacaau

SEQ ID NO: 596343 - RNA, 14 nt, Escherichia coli CFT073
acagccgcauuuug

SEQ ID NO: 596344 - RNA, 14 nt, Escherichia coli CFT073
acacuaauccguaa

SEQ ID NO: 596345 - RNA, 16 nt, Escherichia coli CFT073
acagaaacgccaucca

SEQ ID NO: 596346 - RNA, 18 nt, Escherichia coli CFT073
acagaaacgccauccagc

SEQ ID NO: 596347 - RNA, 23 nt, Escherichia coli CFT073
acacguaauucauuacgaaguuu

SEQ ID NO: 596348 - RNA, 23 nt, Escherichia coli CFT073
acacgaaucaggcggcucaccug

SEQ ID NO: 596349 - RNA, 15 nt, Escherichia coli CFT073
acaccuuucacgccg

SEQ ID NO: 596350 - RNA, 20 nt, Escherichia coli CFT073
accaccgccagauugcugcu

SEQ ID NO: 596351 - RNA, 19 nt, Escherichia coli CFT073
accacgcaaaggcguuaug

SEQ ID NO: 596352 - RNA, 17 nt, Escherichia coli CFT073
accacgccccacgccau

SEQ ID NO: 596353 - RNA, 21 nt, Escherichia coli CFT073
accacgcagaaaaaucccucu

SEQ ID NO: 596354 - RNA, 17 nt, Escherichia coli CFT073
accacgagcggcguucc

SEQ ID NO: 596355 - RNA, 22 nt, Escherichia coli CFT073
accaauggcgaggaacgccccc

SEQ ID NO: 596356 - RNA, 23 nt, Escherichia coli CFT073
accaaugucagggccaucgcggu

SEQ ID NO: 596357 - RNA, 16 nt, Escherichia coli CFT073
acauguuuuccagcac

SEQ ID NO: 596358 - RNA, 22 nt, Escherichia coli CFT073
acaugugcgacaguugccgcuu

SEQ ID NO: 596359 - RNA, 22 nt, Escherichia coli CFT073
acauuaagcgcaucgacgccau

SEQ ID NO: 596360 - RNA, 14 nt, Escherichia coli CFT073
acauuacaaaauac

SEQ ID NO: 596361 - RNA, 21 nt, Escherichia coli CFT073
acauuacgcauuugagcguaa

SEQ ID NO: 596362 - RNA, 20 nt, Escherichia coli CFT073
acauuacuaauuaauaauau

SEQ ID NO: 596363 - RNA, 16 nt, Escherichia coli CFT073
accaccagcaccgcga

SEQ ID NO: 596364 - RNA, 22 nt, Escherichia coli CFT073
accaccagcgacagccagccca

SEQ ID NO: 596365 - RNA, 17 nt, Escherichia coli CFT073
accacaaauaccccacc

SEQ ID NO: 596366 - RNA, 16 nt, Escherichia coli CFT073
accacgcgguagcgcg

SEQ ID NO: 596367 - RNA, 16 nt, Escherichia coli CFT073
accagaaucgccagca

SEQ ID NO: 596368 - RNA, 21 nt, Escherichia coli CFT073
accagaauugaccaguaauau

SEQ ID NO: 596369 - RNA, 22 nt, Escherichia coli CFT073
accacgguuuuuugcagcaacc

SEQ ID NO: 596370 - RNA, 16 nt, Escherichia coli CFT073
accacguaacgacuga

SEQ ID NO: 596371 - RNA, 20 nt, Escherichia coli CFT073
accagaucgccuaauuucac

SEQ ID NO: 596372 - RNA, 20 nt, Escherichia coli CFT073
accagaucuucaucaccgau

SEQ ID NO: 596373 - RNA, 18 nt, Escherichia coli CFT073
accagaucuuccagcggc

SEQ ID NO: 596374 - RNA, 15 nt, Escherichia coli CFT073
accagauuaccgccu

SEQ ID NO: 596375 - RNA, 20 nt, Escherichia coli CFT073
accagaccauacagugucca

SEQ ID NO: 596376 - RNA, 16 nt, Escherichia coli CFT073
accagacgauuuuccc

SEQ ID NO: 596377 - RNA, 18 nt, Escherichia coli CFT073
accagauucggcgcaaug

SEQ ID NO: 596378 - RNA, 15 nt, Escherichia coli CFT073
accagcacaaagugg

SEQ ID NO: 596379 - RNA, 16 nt, Escherichia coli CFT073
accagcacaaaguggc

SEQ ID NO: 596380 - RNA, 16 nt, Escherichia coli CFT073
accagcacaucaucaa

SEQ ID NO: 596381 - RNA, 14 nt, Escherichia coli CFT073
accagcacaugcuu

SEQ ID NO: 596382 - RNA, 13 nt, Escherichia coli CFT073
accagcgccuggc

SEQ ID NO: 596383 - RNA, 14 nt, Escherichia coli CFT073
accagcgccucuuc

SEQ ID NO: 596384 - RNA, 17 nt, Escherichia coli CFT073
accagcgccgccacuac

SEQ ID NO: 596385 - RNA, 13 nt, Escherichia coli CFT073
accagcgccauua

SEQ ID NO: 596386 - RNA, 13 nt, Escherichia coli CFT073
accagcgccacca

SEQ ID NO: 596387 - RNA, 14 nt, Escherichia coli CFT073
accagcgcaauaug

SEQ ID NO: 596388 - RNA, 17 nt, Escherichia coli CFT073
accagccaguagcaccu

SEQ ID NO: 596389 - RNA, 19 nt, Escherichia coli CFT073
accagcauuccuaaaccau

SEQ ID NO: 596390 - RNA, 23 nt, Escherichia coli CFT073
accagcaucaacaacaauuucac

SEQ ID NO: 596391 - RNA, 15 nt, Escherichia coli CFT073
accagcacguuaauc

SEQ ID NO: 596392 - RNA, 22 nt, Escherichia coli CFT073
accagcaccgcgacaaucaggu

SEQ ID NO: 596393 - RNA, 14 nt, Escherichia coli CFT073
accaucaacaaacg

SEQ ID NO: 596394 - RNA, 23 nt, Escherichia coli CFT073
accaucacuccccuccugcaagc

SEQ ID NO: 596395 - RNA, 14 nt, Escherichia coli CFT073
accaucagcagcgg

SEQ ID NO: 596396 - RNA, 18 nt, Escherichia coli CFT073
accaucgcccacaccacg

SEQ ID NO: 596397 - RNA, 23 nt, Escherichia coli CFT073
accaucgcccacaccacgccacu

SEQ ID NO: 596398 - RNA, 21 nt, Escherichia coli CFT073
accaucgcgccaaacucgguc

SEQ ID NO: 596399 - RNA, 20 nt, Escherichia coli CFT073
accaucaguacccaaucagc

SEQ ID NO: 596400 - RNA, 15 nt, Escherichia coli CFT073
accauccagcagacg

SEQ ID NO: 596401 - RNA, 23 nt, Escherichia coli CFT073
accaucccuucaccuacgcuggc

SEQ ID NO: 596402 - RNA, 23 nt, Escherichia coli CFT073
accauccgcugaaaaacgaacau

SEQ ID NO: 596403 - RNA, 17 nt, Escherichia coli CFT073
accauccugaucgccau

SEQ ID NO: 596404 - RNA, 20 nt, Escherichia coli CFT073
accaucgacguccaaucagc

SEQ ID NO: 596405 - RNA, 21 nt, Escherichia coli CFT073
accaguugguagguccagccg

SEQ ID NO: 596406 - RNA, 14 nt, Escherichia coli CFT073
accaguugagcgga

SEQ ID NO: 596407 - RNA, 15 nt, Escherichia coli CFT073
accaguugugaugcc

SEQ ID NO: 596408 - RNA, 23 nt, Escherichia coli CFT073
accauauuaaauggcccgcgcag

SEQ ID NO: 596409 - RNA, 22 nt, Escherichia coli CFT073
accaguggucuuuagacgccau

SEQ ID NO: 596410 - RNA, 16 nt, Escherichia coli CFT073
accaguggcgggacag

SEQ ID NO: 596411 - RNA, 14 nt, Escherichia coli CFT073
accagugcccgacc

SEQ ID NO: 596412 - RNA, 13 nt, Escherichia coli CFT073
accagugccagaa

SEQ ID NO: 596413 - RNA, 17 nt, Escherichia coli CFT073
accagugccagaacaga

SEQ ID NO: 596414 - RNA, 17 nt, Escherichia coli CFT073
accauuagcuaauugcc

SEQ ID NO: 596415 - RNA, 13 nt, Escherichia coli CFT073
accauucccggcu

SEQ ID NO: 596416 - RNA, 19 nt, Escherichia coli CFT073
accauugcgucauaaugcu

SEQ ID NO: 596417 - RNA, 21 nt, Escherichia coli CFT073
accauuuaaacucaccgcucu

SEQ ID NO: 596418 - RNA, 20 nt, Escherichia coli CFT073
accaugauuucguauacugc

SEQ ID NO: 596419 - RNA, 16 nt, Escherichia coli CFT073
accaugcaaucacugc

SEQ ID NO: 596420 - RNA, 18 nt, Escherichia coli CFT073
accaugcagcgccgcgua

SEQ ID NO: 596421 - RNA, 15 nt, Escherichia coli CFT073
accaugaauuucacg

SEQ ID NO: 596422 - RNA, 21 nt, Escherichia coli CFT073
accaucuucacuguccgccag

SEQ ID NO: 596423 - RNA, 17 nt, Escherichia coli CFT073
accaucggaucggccau

SEQ ID NO: 596424 - RNA, 20 nt, Escherichia coli CFT073
accaucgguuguuuucagua

SEQ ID NO: 596425 - RNA, 20 nt, Escherichia coli CFT073
accaggcucuuugaacaguu

SEQ ID NO: 596426 - RNA, 15 nt, Escherichia coli CFT073
accagcggacggcug

SEQ ID NO: 596427 - RNA, 13 nt, Escherichia coli CFT073
accagcggcaccu

SEQ ID NO: 596428 - RNA, 18 nt, Escherichia coli CFT073
accagcgcgccgucgaug

SEQ ID NO: 596429 - RNA, 22 nt, Escherichia coli CFT073
accaguacacugguucccaaca

SEQ ID NO: 596430 - RNA, 17 nt, Escherichia coli CFT073
accaguaccgccgccau

SEQ ID NO: 596431 - RNA, 18 nt, Escherichia coli CFT073
accaguaccgccgccaua

SEQ ID NO: 596432 - RNA, 18 nt, Escherichia coli CFT073
accagucaaaacuuuuca

SEQ ID NO: 596433 - RNA, 17 nt, Escherichia coli CFT073
accagucgggugcgaca

SEQ ID NO: 596434 - RNA, 14 nt, Escherichia coli CFT073
accagugaggaugc

SEQ ID NO: 596435 - RNA, 19 nt, Escherichia coli CFT073
accagggugcguugaagau

SEQ ID NO: 596436 - RNA, 14 nt, Escherichia coli CFT073
aucgcgcauaucgu

SEQ ID NO: 596437 - RNA, 18 nt, Escherichia coli CFT073
aucgccguuaaccaugca

SEQ ID NO: 596438 - RNA, 16 nt, Escherichia coli CFT073
aucgccgccagcgggg

SEQ ID NO: 596439 - RNA, 20 nt, Escherichia coli CFT073
aucgccauuuaacgcaucac

SEQ ID NO: 596440 - RNA, 15 nt, Escherichia coli CFT073
aucgcccgcaaucag

SEQ ID NO: 596441 - RNA, 13 nt, Escherichia coli CFT073
aucgcccccauca

SEQ ID NO: 596442 - RNA, 15 nt, Escherichia coli CFT073
aucgccccgcagccg

SEQ ID NO: 596443 - RNA, 21 nt, Escherichia coli CFT073
aucgcccaguugaugaccagu

SEQ ID NO: 596444 - RNA, 19 nt, Escherichia coli CFT073
aucgcccacgcaccaccag

SEQ ID NO: 596445 - RNA, 18 nt, Escherichia coli CFT073
aucgagcgcagcaacauc

SEQ ID NO: 596446 - RNA, 20 nt, Escherichia coli CFT073
aucgagcgcagcaacaucac

SEQ ID NO: 596447 - RNA, 21 nt, Escherichia coli CFT073
aucgacucgcaauuauaauac

SEQ ID NO: 596448 - RNA, 21 nt, Escherichia coli CFT073
aucgacguggugaaaucgccg

SEQ ID NO: 596449 - RNA, 19 nt, Escherichia coli CFT073
aucgcucccaaaccgccca

SEQ ID NO: 596450 - RNA, 23 nt, Escherichia coli CFT073
aucgcuguacucaccaacgcaga

SEQ ID NO: 596451 - RNA, 16 nt, Escherichia coli CFT073
aucggaugaucaucca

SEQ ID NO: 596452 - RNA, 18 nt, Escherichia coli CFT073
aucgcgcguguugcgcca

SEQ ID NO: 596453 - RNA, 17 nt, Escherichia coli CFT073
aucgcgccaaucagcgc

SEQ ID NO: 596454 - RNA, 18 nt, Escherichia coli CFT073
aucgcggauaugcagcag

SEQ ID NO: 596455 - RNA, 21 nt, Escherichia coli CFT073
aucgcgcucguagguuucugc

SEQ ID NO: 596456 - RNA, 23 nt, Escherichia coli CFT073
aucgcgcucguagguuucugcca

SEQ ID NO: 596457 - RNA, 21 nt, Escherichia coli CFT073
aucgcggcacagaaacgccau

SEQ ID NO: 596458 - RNA, 14 nt, Escherichia coli CFT073
aucggcaaucacgc

SEQ ID NO: 596459 - RNA, 18 nt, Escherichia coli CFT073
aucggcacccaucgccag

SEQ ID NO: 596460 - RNA, 14 nt, Escherichia coli CFT073
aucggcaccgccag

SEQ ID NO: 596461 - RNA, 14 nt, Escherichia coli CFT073
aucggcccggcuuu

SEQ ID NO: 596462 - RNA, 20 nt, Escherichia coli CFT073
aucggccaucgguacacauu

SEQ ID NO: 596463 - RNA, 19 nt, Escherichia coli CFT073
aucggccuuuaacgccacg

SEQ ID NO: 596464 - RNA, 19 nt, Escherichia coli CFT073
aucggcgcacaaccgccgg

SEQ ID NO: 596465 - RNA, 17 nt, Escherichia coli CFT073
auccgaccuacagggaa

SEQ ID NO: 596466 - RNA, 12 nt, Escherichia coli CFT073
aucagcuacacc

SEQ ID NO: 596467 - RNA, 16 nt, Escherichia coli CFT073
aucccugccgccauca

SEQ ID NO: 596468 - RNA, 22 nt, Escherichia coli CFT073
aucccuuccgcuuuuaacaucu

SEQ ID NO: 596469 - RNA, 17 nt, Escherichia coli CFT073
aucagcguaugcagcca

SEQ ID NO: 596470 - RNA, 16 nt, Escherichia coli CFT073
aucagcgcuuuaucau

SEQ ID NO: 596471 - RNA, 23 nt, Escherichia coli CFT073
auccgccacuucuuuuugaacga

SEQ ID NO: 596472 - RNA, 19 nt, Escherichia coli CFT073
auccgccagccaauugcca

SEQ ID NO: 596473 - RNA, 19 nt, Escherichia coli CFT073
auccgccaggacaucagcg

SEQ ID NO: 596474 - RNA, 21 nt, Escherichia coli CFT073
auccgccaggacaucagcgca

SEQ ID NO: 596475 - RNA, 17 nt, Escherichia coli CFT073
auccgcgguaucgccgu

SEQ ID NO: 596476 - RNA, 16 nt, Escherichia coli CFT073
auccgcccacaccagu

SEQ ID NO: 596477 - RNA, 23 nt, Escherichia coli CFT073
auccgccccgcguuucaccacca

SEQ ID NO: 596478 - RNA, 15 nt, Escherichia coli CFT073
auccgccccggcuuc

SEQ ID NO: 596479 - RNA, 21 nt, Escherichia coli CFT073
auccgcacucaacuuauugau

SEQ ID NO: 596480 - RNA, 13 nt, Escherichia coli CFT073
auccgauccucac

SEQ ID NO: 596481 - RNA, 18 nt, Escherichia coli CFT073
auccgauuaaucaccgga

SEQ ID NO: 596482 - RNA, 21 nt, Escherichia coli CFT073
auccgcgucauugacgcuggc

SEQ ID NO: 596483 - RNA, 17 nt, Escherichia coli CFT073
auccgcgugacgcuggc

SEQ ID NO: 596484 - RNA, 23 nt, Escherichia coli CFT073
auccgcuuuugguuuuucaacca

SEQ ID NO: 596485 - RNA, 18 nt, Escherichia coli CFT073
auccggauggauccccgc

SEQ ID NO: 596486 - RNA, 22 nt, Escherichia coli CFT073
auccggcuccaguuaacgccgc

SEQ ID NO: 596487 - RNA, 18 nt, Escherichia coli CFT073
auccgcuucgguguauuu

SEQ ID NO: 596488 - RNA, 19 nt, Escherichia coli CFT073
auccggcaauuuugcgccg

SEQ ID NO: 596489 - RNA, 22 nt, Escherichia coli CFT073
auccguuucagcuuauucauca

SEQ ID NO: 596490 - RNA, 14 nt, Escherichia coli CFT073
auccucauaacgua

SEQ ID NO: 596491 - RNA, 18 nt, Escherichia coli CFT073
auccuccgcagccaugag

SEQ ID NO: 596492 - RNA, 17 nt, Escherichia coli CFT073
auccggggcaauuucag

SEQ ID NO: 596493 - RNA, 18 nt, Escherichia coli CFT073
auccggggcaauuucagu

SEQ ID NO: 596494 - RNA, 21 nt, Escherichia coli CFT073
auccggcugcugcaaugccau

SEQ ID NO: 596495 - RNA, 17 nt, Escherichia coli CFT073
auccgggcuaucaugcc

SEQ ID NO: 596496 - RNA, 15 nt, Escherichia coli CFT073
auccuuucgaaaaac

SEQ ID NO: 596497 - RNA, 14 nt, Escherichia coli CFT073
aucgaaaaugccac

SEQ ID NO: 596498 - RNA, 21 nt, Escherichia coli CFT073
aucgaaaccaagaccaauccg

SEQ ID NO: 596499 - RNA, 17 nt, Escherichia coli CFT073
aucgaaaccuucagcau

SEQ ID NO: 596500 - RNA, 21 nt, Escherichia coli CFT073
auccuucccccaccaccaucg

SEQ ID NO: 596501 - RNA, 23 nt, Escherichia coli CFT073
auccugcuuuuuuccagccauca

SEQ ID NO: 596502 - RNA, 16 nt, Escherichia coli CFT073
auccuguggacgcagc

SEQ ID NO: 596503 - RNA, 17 nt, Escherichia coli CFT073
auccugccaugcgcaau

SEQ ID NO: 596504 - RNA, 20 nt, Escherichia coli CFT073
auccugaguuaaucgccgca

SEQ ID NO: 596505 - RNA, 18 nt, Escherichia coli CFT073
auccugauagcacgucac

SEQ ID NO: 596506 - RNA, 17 nt, Escherichia coli CFT073
auccugccggugaugag

SEQ ID NO: 596507 - RNA, 12 nt, Escherichia coli CFT073
auccucuguaaa

SEQ ID NO: 596508 - RNA, 18 nt, Escherichia coli CFT073
auccugaaagcugagaaa

SEQ ID NO: 596509 - RNA, 14 nt, Escherichia coli CFT073
auccugaauuaacu

SEQ ID NO: 596510 - RNA, 21 nt, Escherichia coli CFT073
auccucccggaugcaccaucu

SEQ ID NO: 596511 - RNA, 15 nt, Escherichia coli CFT073
aucgacacagguauc

SEQ ID NO: 596512 - RNA, 16 nt, Escherichia coli CFT073
aucgacaguugcugcg

SEQ ID NO: 596513 - RNA, 16 nt, Escherichia coli CFT073
aucgacaccgguaauc

SEQ ID NO: 596514 - RNA, 19 nt, Escherichia coli CFT073
aucgaauaacuccgcgccg

SEQ ID NO: 596515 - RNA, 16 nt, Escherichia coli CFT073
aucgacaacguuuuca

SEQ ID NO: 596516 - RNA, 15 nt, Escherichia coli CFT073
aucgaagacaucauc

SEQ ID NO: 596517 - RNA, 21 nt, Escherichia coli CFT073
aucgacauucaacauauccag

SEQ ID NO: 596518 - RNA, 12 nt, Escherichia coli CFT073
augaaacugggu

SEQ ID NO: 596519 - RNA, 13 nt, Escherichia coli CFT073
augaaaacgccac

SEQ ID NO: 596520 - RNA, 11 nt, Escherichia coli CFT073
augaaaacucg

SEQ ID NO: 596521 - RNA, 20 nt, Escherichia coli CFT073
augaaaggauucgcuugcaa

SEQ ID NO: 596522 - RNA, 14 nt, Escherichia coli CFT073
augaaauaaaacaa

SEQ ID NO: 596523 - RNA, 21 nt, Escherichia coli CFT073
augaacggcuuuuucuggcgu

SEQ ID NO: 596524 - RNA, 19 nt, Escherichia coli CFT073
augaaccaguucaaggaug

SEQ ID NO: 596525 - RNA, 17 nt, Escherichia coli CFT073
aucuuugcccauacccg

SEQ ID NO: 596526 - RNA, 12 nt, Escherichia coli CFT073
augaaaaagcgu

SEQ ID NO: 596527 - RNA, 13 nt, Escherichia coli CFT073
aucuuuaaucgcu

SEQ ID NO: 596528 - RNA, 12 nt, Escherichia coli CFT073
augaauaacccc

SEQ ID NO: 596529 - RNA, 22 nt, Escherichia coli CFT073
augaauuucaccacugccuuua

SEQ ID NO: 596530 - RNA, 14 nt, Escherichia coli CFT073
augaaucauggcgu

SEQ ID NO: 596531 - RNA, 14 nt, Escherichia coli CFT073
augaaugaaaacga

SEQ ID NO: 596532 - RNA, 13 nt, Escherichia coli CFT073
augacaguaucac

SEQ ID NO: 596533 - RNA, 18 nt, Escherichia coli CFT073
augacaauuacaaaauga

SEQ ID NO: 596534 - RNA, 15 nt, Escherichia coli CFT073
augacacucacgcau

SEQ ID NO: 596535 - RNA, 18 nt, Escherichia coli CFT073
augacgaagccggaauau

SEQ ID NO: 596536 - RNA, 17 nt, Escherichia coli CFT073
augacgaguauauucug

SEQ ID NO: 596537 - RNA, 13 nt, Escherichia coli CFT073
augaccuucuacc

SEQ ID NO: 596538 - RNA, 15 nt, Escherichia coli CFT073
augaccgugaucgug

SEQ ID NO: 596539 - RNA, 17 nt, Escherichia coli CFT073
augaccgcuaauagcgc

SEQ ID NO: 596540 - RNA, 15 nt, Escherichia coli CFT073
augacgccacuggcu

SEQ ID NO: 596541 - RNA, 17 nt, Escherichia coli CFT073
augacgauacggaauau

SEQ ID NO: 596542 - RNA, 21 nt, Escherichia coli CFT073
augacgccggaugacuuuuca

SEQ ID NO: 596543 - RNA, 16 nt, Escherichia coli CFT073
augacgcgcucaccgc

SEQ ID NO: 596544 - RNA, 18 nt, Escherichia coli CFT073
augacgcugaauaauccc

SEQ ID NO: 596545 - RNA, 18 nt, Escherichia coli CFT073
augacgcuggaaguacgc

SEQ ID NO: 596546 - RNA, 20 nt, Escherichia coli CFT073
augauacuccacaucauuga

SEQ ID NO: 596547 - RNA, 22 nt, Escherichia coli CFT073
augauacucgccgaaccaaacg

SEQ ID NO: 596548 - RNA, 21 nt, Escherichia coli CFT073
augauaaauugccugcgugca

SEQ ID NO: 596549 - RNA, 16 nt, Escherichia coli CFT073
augauccugaucgggu

SEQ ID NO: 596550 - RNA, 13 nt, Escherichia coli CFT073
augaucaucaccu

SEQ ID NO: 596551 - RNA, 15 nt, Escherichia coli CFT073
augaucaucaucgcg

SEQ ID NO: 596552 - RNA, 19 nt, Escherichia coli CFT073
augaucgccguaacgccuu

SEQ ID NO: 596553 - RNA, 23 nt, Escherichia coli CFT073
augauccugcaauaccgccguua

SEQ ID NO: 596554 - RNA, 13 nt, Escherichia coli CFT073
augaucgccgcca

SEQ ID NO: 596555 - RNA, 15 nt, Escherichia coli CFT073
augcagccaggccau

SEQ ID NO: 596556 - RNA, 16 nt, Escherichia coli CFT073
augcaggcaucgguga

SEQ ID NO: 596557 - RNA, 20 nt, Escherichia coli CFT073
augcaggcaugcaauauucu

SEQ ID NO: 596558 - RNA, 18 nt, Escherichia coli CFT073
augcaucauaugcgccag

SEQ ID NO: 596559 - RNA, 21 nt, Escherichia coli CFT073
augcauacggcgauaaggcgu

SEQ ID NO: 596560 - RNA, 23 nt, Escherichia coli CFT073
augcauccggcacauuucauuca

SEQ ID NO: 596561 - RNA, 15 nt, Escherichia coli CFT073
augcagcaaccagag

SEQ ID NO: 596562 - RNA, 14 nt, Escherichia coli CFT073
augcagagcaucca

SEQ ID NO: 596563 - RNA, 14 nt, Escherichia coli CFT073
augcagauaacuua

SEQ ID NO: 596564 - RNA, 18 nt, Escherichia coli CFT073
augcacugcaacgccuuu

SEQ ID NO: 596565 - RNA, 18 nt, Escherichia coli CFT073
augcacuuuuacugacgu

SEQ ID NO: 596566 - RNA, 16 nt, Escherichia coli CFT073
augaugucgaauuucu

SEQ ID NO: 596567 - RNA, 14 nt, Escherichia coli CFT073
augaugcuccgcca

SEQ ID NO: 596568 - RNA, 22 nt, Escherichia coli CFT073
aucgugcgcgccgugaacguga

SEQ ID NO: 596569 - RNA, 18 nt, Escherichia coli CFT073
aucgugcgggaccagcac

SEQ ID NO: 596570 - RNA, 20 nt, Escherichia coli CFT073
aucgugcagcaccgccgcca

SEQ ID NO: 596571 - RNA, 15 nt, Escherichia coli CFT073
aucgugaauuuuagg

SEQ ID NO: 596572 - RNA, 14 nt, Escherichia coli CFT073
aucgucuggcgcgu

SEQ ID NO: 596573 - RNA, 19 nt, Escherichia coli CFT073
aucggcucauaaaaacucc

SEQ ID NO: 596574 - RNA, 22 nt, Escherichia coli CFT073
aucggcucauaaaaacuccagu

SEQ ID NO: 596575 - RNA, 22 nt, Escherichia coli CFT073
aucggcguacuggcaaucgcca

SEQ ID NO: 596576 - RNA, 19 nt, Escherichia coli CFT073
aucuaaugccauuaacauc

SEQ ID NO: 596577 - RNA, 22 nt, Escherichia coli CFT073
aucuaaugcuccuuuaaucaac

SEQ ID NO: 596578 - RNA, 16 nt, Escherichia coli CFT073
aucuccagcugcucgc

SEQ ID NO: 596579 - RNA, 18 nt, Escherichia coli CFT073
aucuccaguuucgagaaa

SEQ ID NO: 596580 - RNA, 11 nt, Escherichia coli CFT073
aucuccggcgg

SEQ ID NO: 596581 - RNA, 23 nt, Escherichia coli CFT073
aucugugcuuguaaaacagccaa

SEQ ID NO: 596582 - RNA, 19 nt, Escherichia coli CFT073
aucugguguucuuuuacgc

SEQ ID NO: 596583 - RNA, 19 nt, Escherichia coli CFT073
aucuggugccagcgccagc

SEQ ID NO: 596584 - RNA, 22 nt, Escherichia coli CFT073
aucuggugccagcgccagcacu

SEQ ID NO: 596585 - RNA, 23 nt, Escherichia coli CFT073
aucucgcgccaguaccgccgcag

SEQ ID NO: 596586 - RNA, 20 nt, Escherichia coli CFT073
aucucggggcaaguuucgug

SEQ ID NO: 596587 - RNA, 14 nt, Escherichia coli CFT073
aucugcugcguuug

SEQ ID NO: 596588 - RNA, 13 nt, Escherichia coli CFT073
aucuggacgccaa

SEQ ID NO: 596589 - RNA, 12 nt, Escherichia coli CFT073
aucugcuggcaa

SEQ ID NO: 596590 - RNA, 15 nt, Escherichia coli CFT073
aucuucugcuggcgu

SEQ ID NO: 596591 - RNA, 18 nt, Escherichia coli CFT073
aucuguucaucagucagg

SEQ ID NO: 596592 - RNA, 14 nt, Escherichia coli CFT073
aucuguuccggcuu

SEQ ID NO: 596593 - RNA, 14 nt, Escherichia coli CFT073
aucuguucuggaaa

SEQ ID NO: 596594 - RNA, 22 nt, Escherichia coli CFT073
aucuucauccgccccggcuuca

SEQ ID NO: 596595 - RNA, 15 nt, Escherichia coli CFT073
aucuucagucgcauc

SEQ ID NO: 596596 - RNA, 17 nt, Escherichia coli CFT073
aucuuccagaucaccgc

SEQ ID NO: 596597 - RNA, 14 nt, Escherichia coli CFT073
aucuuccagcauca

SEQ ID NO: 596598 - RNA, 23 nt, Escherichia coli CFT073
aucuuccagcgcaucgccaaaau

SEQ ID NO: 596599 - RNA, 17 nt, Escherichia coli CFT073
aucuuccggcguggcgu

SEQ ID NO: 596600 - RNA, 14 nt, Escherichia coli CFT073
aucuuccgggcaac

SEQ ID NO: 596601 - RNA, 23 nt, Escherichia coli CFT073
aucuuccgggcaacaaucgcuca

SEQ ID NO: 596602 - RNA, 17 nt, Escherichia coli CFT073
aucuuccugauaaccuu

SEQ ID NO: 596603 - RNA, 17 nt, Escherichia coli CFT073
auugccaaucgggaaga

SEQ ID NO: 596604 - RNA, 16 nt, Escherichia coli CFT073
auugcaucaucgacau

SEQ ID NO: 596605 - RNA, 18 nt, Escherichia coli CFT073
auugcauccgauuguucc

SEQ ID NO: 596606 - RNA, 23 nt, Escherichia coli CFT073
auugccagcauaaucaccaucag

SEQ ID NO: 596607 - RNA, 14 nt, Escherichia coli CFT073
auugccauacgccg

SEQ ID NO: 596608 - RNA, 18 nt, Escherichia coli CFT073
auugccgcacuuaaaaug

SEQ ID NO: 596609 - RNA, 20 nt, Escherichia coli CFT073
auugccgcaccaaccaucag

SEQ ID NO: 596610 - RNA, 15 nt, Escherichia coli CFT073
auugauaauaaaaag

SEQ ID NO: 596611 - RNA, 18 nt, Escherichia coli CFT073
auugaugcugccaucauc

SEQ ID NO: 596612 - RNA, 14 nt, Escherichia coli CFT073
auugauggcaaaau

SEQ ID NO: 596613 - RNA, 20 nt, Escherichia coli CFT073
auugcacgucuuugccgcgc

SEQ ID NO: 596614 - RNA, 14 nt, Escherichia coli CFT073
auugcagcaacgaa

SEQ ID NO: 596615 - RNA, 22 nt, Escherichia coli CFT073
auugauuuuaauaaaucacgcu

SEQ ID NO: 596616 - RNA, 23 nt, Escherichia coli CFT073
auugagaucuuucgcuuuaugau

SEQ ID NO: 596617 - RNA, 16 nt, Escherichia coli CFT073
auugagcagcaaaaug

SEQ ID NO: 596618 - RNA, 21 nt, Escherichia coli CFT073
auugauacaggaaaccggcga

SEQ ID NO: 596619 - RNA, 22 nt, Escherichia coli CFT073
auugaagcaauccauaccagca

SEQ ID NO: 596620 - RNA, 16 nt, Escherichia coli CFT073
auugaaggcaauugca

SEQ ID NO: 596621 - RNA, 20 nt, Escherichia coli CFT073
auugaaaauuacucaguaug

SEQ ID NO: 596622 - RNA, 21 nt, Escherichia coli CFT073
auugcgcucgcgcucgccgua

SEQ ID NO: 596623 - RNA, 19 nt, Escherichia coli CFT073
auugcguaaagccugcugg

SEQ ID NO: 596624 - RNA, 20 nt, Escherichia coli CFT073
auugcguucaaucuguccuu

SEQ ID NO: 596625 - RNA, 14 nt, Escherichia coli CFT073
auugcguaucccac

SEQ ID NO: 596626 - RNA, 20 nt, Escherichia coli CFT073
auugcugcgcccgcagcggc

SEQ ID NO: 596627 - RNA, 23 nt, Escherichia coli CFT073
auugcugcugauaaccgccgcca

SEQ ID NO: 596628 - RNA, 18 nt, Escherichia coli CFT073
auugcugcugccgcgcca

SEQ ID NO: 596629 - RNA, 20 nt, Escherichia coli CFT073
auugcuguaaauugccgucg

SEQ ID NO: 596630 - RNA, 16 nt, Escherichia coli CFT073
auugcugcaccagcag

SEQ ID NO: 596631 - RNA, 23 nt, Escherichia coli CFT073
auugccggauaaauuaaacgccu

SEQ ID NO: 596632 - RNA, 22 nt, Escherichia coli CFT073
auugccgcgccggaaaccagcg

SEQ ID NO: 596633 - RNA, 11 nt, Escherichia coli CFT073
auugccgccau

SEQ ID NO: 596634 - RNA, 14 nt, Escherichia coli CFT073
auugccgcgagaac

SEQ ID NO: 596635 - RNA, 21 nt, Escherichia coli CFT073
auugccguaauaagguucauu

SEQ ID NO: 596636 - RNA, 16 nt, Escherichia coli CFT073
auugcgccucaccgga

SEQ ID NO: 596637 - RNA, 16 nt, Escherichia coli CFT073
auugccugaugcgcua

SEQ ID NO: 596638 - RNA, 12 nt, Escherichia coli CFT073
auugccugaugg

SEQ ID NO: 596639 - RNA, 13 nt, Escherichia coli CFT073
auugccugugaag

SEQ ID NO: 596640 - RNA, 17 nt, Escherichia coli CFT073
auugucaggaucaccaa

SEQ ID NO: 596641 - RNA, 19 nt, Escherichia coli CFT073
auugucaauauccagcagg

SEQ ID NO: 596642 - RNA, 22 nt, Escherichia coli CFT073
auugucggaucgcugaacgcac

SEQ ID NO: 596643 - RNA, 18 nt, Escherichia coli CFT073
auugguucagacgccacu

SEQ ID NO: 596644 - RNA, 22 nt, Escherichia coli CFT073
auugcuuuuguggucaccauga

SEQ ID NO: 596645 - RNA, 17 nt, Escherichia coli CFT073
auugcuuugcugugaag

SEQ ID NO: 596646 - RNA, 21 nt, Escherichia coli CFT073
auugcuuugcugugaagcacc

SEQ ID NO: 596647 - RNA, 12 nt, Escherichia coli CFT073
auuggcaaaacc

SEQ ID NO: 596648 - RNA, 17 nt, Escherichia coli CFT073
auuggcaaaaccaaacc

SEQ ID NO: 596649 - RNA, 21 nt, Escherichia coli CFT073
auuggcaaaaccaaaccagcc

SEQ ID NO: 596650 - RNA, 13 nt, Escherichia coli CFT073
auuggcaacagcc

SEQ ID NO: 596651 - RNA, 15 nt, Escherichia coli CFT073
auuggcaacagccau

SEQ ID NO: 596652 - RNA, 19 nt, Escherichia coli CFT073
auuggcaauagugcgauug

SEQ ID NO: 596653 - RNA, 21 nt, Escherichia coli CFT073
auuggcaccgacaucaggcga

SEQ ID NO: 596654 - RNA, 23 nt, Escherichia coli CFT073
auuggcguuugaccgacaccggc

SEQ ID NO: 596655 - RNA, 13 nt, Escherichia coli CFT073
auuggcgcgggcg

SEQ ID NO: 596656 - RNA, 20 nt, Escherichia coli CFT073
auuggcgcgggcgucgaaaa

SEQ ID NO: 596657 - RNA, 17 nt, Escherichia coli CFT073
auuggcgcaaaggcgga

SEQ ID NO: 596658 - RNA, 16 nt, Escherichia coli CFT073
auuccgcaacgccgcc

SEQ ID NO: 596659 - RNA, 18 nt, Escherichia coli CFT073
auuccgcaccugccagcg

SEQ ID NO: 596660 - RNA, 13 nt, Escherichia coli CFT073
auucaucgcaugu

SEQ ID NO: 596661 - RNA, 14 nt, Escherichia coli CFT073
auucauuaauaacc

SEQ ID NO: 596662 - RNA, 14 nt, Escherichia coli CFT073
auuccgaauuucau

SEQ ID NO: 596663 - RNA, 18 nt, Escherichia coli CFT073
auucagaaauaaucaccu

SEQ ID NO: 596664 - RNA, 14 nt, Escherichia coli CFT073
auucagaucgcuac

SEQ ID NO: 596665 - RNA, 14 nt, Escherichia coli CFT073
auucagacaggcga

SEQ ID NO: 596666 - RNA, 14 nt, Escherichia coli CFT073
auucagcagcagac

SEQ ID NO: 596667 - RNA, 16 nt, Escherichia coli CFT073
auucagcagcguggug

SEQ ID NO: 596668 - RNA, 17 nt, Escherichia coli CFT073
auucagccacuguuuca

SEQ ID NO: 596669 - RNA, 22 nt, Escherichia coli CFT073
auucagccacuguuucaauccg

SEQ ID NO: 596670 - RNA, 22 nt, Escherichia coli CFT073
auucagcccggcaacguugcca

SEQ ID NO: 596671 - RNA, 20 nt, Escherichia coli CFT073
auucagccuucuugcugucc

SEQ ID NO: 596672 - RNA, 12 nt, Escherichia coli CFT073
auucagcguuug

SEQ ID NO: 596673 - RNA, 20 nt, Escherichia coli CFT073
auucaggccaaagccgccga

SEQ ID NO: 596674 - RNA, 12 nt, Escherichia coli CFT073
auucaguucauc

SEQ ID NO: 596675 - RNA, 21 nt, Escherichia coli CFT073
auucauaaagcuauuaaucca

SEQ ID NO: 596676 - RNA, 20 nt, Escherichia coli CFT073
auucauaguaagcagauucu

SEQ ID NO: 596677 - RNA, 14 nt, Escherichia coli CFT073
auucauaucaaacg

SEQ ID NO: 596678 - RNA, 12 nt, Escherichia coli CFT073
auucaucagcgu

SEQ ID NO: 596679 - RNA, 18 nt, Escherichia coli CFT073
auuaugcguuuugaucuu

SEQ ID NO: 596680 - RNA, 16 nt, Escherichia coli CFT073
auuauucugacacugc

SEQ ID NO: 596681 - RNA, 17 nt, Escherichia coli CFT073
auucacuucaucccuga

SEQ ID NO: 596682 - RNA, 21 nt, Escherichia coli CFT073
auucaccagcaaauccagcgg

SEQ ID NO: 596683 - RNA, 20 nt, Escherichia coli CFT073
auguugcguucaucaguucc

SEQ ID NO: 596684 - RNA, 10 nt, Escherichia coli CFT073
auguuggcgc

SEQ ID NO: 596685 - RNA, 19 nt, Escherichia coli CFT073
auuaaaaugaauaacuucc

SEQ ID NO: 596686 - RNA, 14 nt, Escherichia coli CFT073
auuaaacaaauaaa

SEQ ID NO: 596687 - RNA, 21 nt, Escherichia coli CFT073
auuaaagaguuguaauuuaaa

SEQ ID NO: 596688 - RNA, 14 nt, Escherichia coli CFT073
auuaaauaccaagc

SEQ ID NO: 596689 - RNA, 15 nt, Escherichia coli CFT073
auuaacaccaccagc

SEQ ID NO: 596690 - RNA, 16 nt, Escherichia coli CFT073
auuaacagguauagaa

SEQ ID NO: 596691 - RNA, 18 nt, Escherichia coli CFT073
auucgcgcacggugcauc

SEQ ID NO: 596692 - RNA, 17 nt, Escherichia coli CFT073
auucgcgccagguggca

SEQ ID NO: 596693 - RNA, 15 nt, Escherichia coli CFT073
auucgcgguuuuaca

SEQ ID NO: 596694 - RNA, 22 nt, Escherichia coli CFT073
auucggcaagauaaaucgcacg

SEQ ID NO: 596695 - RNA, 21 nt, Escherichia coli CFT073
auuccugacccagcaccagua

SEQ ID NO: 596696 - RNA, 19 nt, Escherichia coli CFT073
auuccugaaucagccagua

SEQ ID NO: 596697 - RNA, 21 nt, Escherichia coli CFT073
auucgaccauugcguguuacg

SEQ ID NO: 596698 - RNA, 19 nt, Escherichia coli CFT073
auucgaccacgcugcgcug

SEQ ID NO: 596699 - RNA, 16 nt, Escherichia coli CFT073
auucgaucaccgcaga

SEQ ID NO: 596700 - RNA, 19 nt, Escherichia coli CFT073
auucgcaccacguucggug

SEQ ID NO: 596701 - RNA, 14 nt, Escherichia coli CFT073
auucguauuuaaaa

SEQ ID NO: 596702 - RNA, 22 nt, Escherichia coli CFT073
auucguacaaacgcuuuacuca

SEQ ID NO: 596703 - RNA, 23 nt, Escherichia coli CFT073
auucguuuuccagggccaguaca

SEQ ID NO: 596704 - RNA, 17 nt, Escherichia coli CFT073
auucguuuucgcgcuua

SEQ ID NO: 596705 - RNA, 17 nt, Escherichia coli CFT073
auucucuuuucacgcaa

SEQ ID NO: 596706 - RNA, 18 nt, Escherichia coli CFT073
auucucgucuugcguuuc

SEQ ID NO: 596707 - RNA, 16 nt, Escherichia coli CFT073
auucucacugauuacc

SEQ ID NO: 596708 - RNA, 23 nt, Escherichia coli CFT073
auucuccaaacgucucuauuuca

SEQ ID NO: 596709 - RNA, 15 nt, Escherichia coli CFT073
auucugacgccacca

SEQ ID NO: 596710 - RNA, 18 nt, Escherichia coli CFT073
auucugcggcuucagcga

SEQ ID NO: 596711 - RNA, 20 nt, Escherichia coli CFT073
auucuggccgcuucagauug

SEQ ID NO: 596712 - RNA, 23 nt, Escherichia coli CFT073
auucuggcgcaacacccugaugu

SEQ ID NO: 596713 - RNA, 13 nt, Escherichia coli CFT073
auucuguuucauu

SEQ ID NO: 596714 - RNA, 22 nt, Escherichia coli CFT073
augucauacaugguuugaucgc

SEQ ID NO: 596715 - RNA, 17 nt, Escherichia coli CFT073
augucauacuauugcca

SEQ ID NO: 596716 - RNA, 22 nt, Escherichia coli CFT073
augucaccuaauuuaaaauuga

SEQ ID NO: 596717 - RNA, 19 nt, Escherichia coli CFT073
augucagaaagaaauuucg

SEQ ID NO: 596718 - RNA, 12 nt, Escherichia coli CFT073
augucaucucug

SEQ ID NO: 596719 - RNA, 22 nt, Escherichia coli CFT073
augucuuugcguuuggcaucag

SEQ ID NO: 596720 - RNA, 18 nt, Escherichia coli CFT073
augugacuggaaaucaaa

SEQ ID NO: 596721 - RNA, 22 nt, Escherichia coli CFT073
augugaaauaaaaucagcaagg

SEQ ID NO: 596722 - RNA, 15 nt, Escherichia coli CFT073
augugaaaucagcga

SEQ ID NO: 596723 - RNA, 14 nt, Escherichia coli CFT073
augugaacugacuc

SEQ ID NO: 596724 - RNA, 17 nt, Escherichia coli CFT073
augucguagacgggcgu

SEQ ID NO: 596725 - RNA, 19 nt, Escherichia coli CFT073
augugguuaccaucaacca

SEQ ID NO: 596726 - RNA, 12 nt, Escherichia coli CFT073
augugaucgaau

SEQ ID NO: 596727 - RNA, 19 nt, Escherichia coli CFT073
augugaugccgcauccggc

SEQ ID NO: 596728 - RNA, 20 nt, Escherichia coli CFT073
augugcuccgcucaucaggc

SEQ ID NO: 596729 - RNA, 21 nt, Escherichia coli CFT073
auguucccccagccagaugcc

SEQ ID NO: 596730 - RNA, 16 nt, Escherichia coli CFT073
auguucuuucggugca

SEQ ID NO: 596731 - RNA, 16 nt, Escherichia coli CFT073
auguugaucgccacgu

SEQ ID NO: 596732 - RNA, 22 nt, Escherichia coli CFT073
auguugaucgccacgucguucc

SEQ ID NO: 596733 - RNA, 21 nt, Escherichia coli CFT073
auguugcagggcauuccaucg

SEQ ID NO: 596734 - RNA, 20 nt, Escherichia coli CFT073
auguugcaguacucgcacuu

SEQ ID NO: 596735 - RNA, 12 nt, Escherichia coli CFT073
augggcgugaua

SEQ ID NO: 596736 - RNA, 20 nt, Escherichia coli CFT073
augggcaaacaaaaaaccua

SEQ ID NO: 596737 - RNA, 20 nt, Escherichia coli CFT073
augggaacugcugaccagcg

SEQ ID NO: 596738 - RNA, 22 nt, Escherichia coli CFT073
auggcuugaagcaauagcauua

SEQ ID NO: 596739 - RNA, 13 nt, Escherichia coli CFT073
auggcuuuccacc

SEQ ID NO: 596740 - RNA, 20 nt, Escherichia coli CFT073
auggcgaacauaaggaugcg

SEQ ID NO: 596741 - RNA, 16 nt, Escherichia coli CFT073
auggccucugccagcu

SEQ ID NO: 596742 - RNA, 13 nt, Escherichia coli CFT073
auggccuggugag

SEQ ID NO: 596743 - RNA, 19 nt, Escherichia coli CFT073
auggcgaacgggauaaacg

SEQ ID NO: 596744 - RNA, 17 nt, Escherichia coli CFT073
augguauccacacuggu

SEQ ID NO: 596745 - RNA, 18 nt, Escherichia coli CFT073
augguaucgacacaggua

SEQ ID NO: 596746 - RNA, 22 nt, Escherichia coli CFT073
augguaucuaucacuauaaaua

SEQ ID NO: 596747 - RNA, 13 nt, Escherichia coli CFT073
augguauucaucg

SEQ ID NO: 596748 - RNA, 14 nt, Escherichia coli CFT073
auggguuacgcgaa

SEQ ID NO: 596749 - RNA, 23 nt, Escherichia coli CFT073
auggggucaggugggaccaccgc

SEQ ID NO: 596750 - RNA, 18 nt, Escherichia coli CFT073
auguauuuguccacgccg

SEQ ID NO: 596751 - RNA, 21 nt, Escherichia coli CFT073
augucacaaucccuuccaccg

SEQ ID NO: 596752 - RNA, 12 nt, Escherichia coli CFT073
auguaaaucaau

SEQ ID NO: 596753 - RNA, 21 nt, Escherichia coli CFT073
auguaaaaguugcaguccgcu

SEQ ID NO: 596754 - RNA, 18 nt, Escherichia coli CFT073
auguaaacaagacaucac

SEQ ID NO: 596755 - RNA, 16 nt, Escherichia coli CFT073
augguggucgcaucau

SEQ ID NO: 596756 - RNA, 22 nt, Escherichia coli CFT073
augguguaagaaugcuccccag

SEQ ID NO: 596757 - RNA, 21 nt, Escherichia coli CFT073
augguuaaauugaaauuugca

SEQ ID NO: 596758 - RNA, 23 nt, Escherichia coli CFT073
augguuaaauugaaauuugcaua

SEQ ID NO: 596759 - RNA, 16 nt, Escherichia coli CFT073
augguucccuuuuuca

SEQ ID NO: 596760 - RNA, 20 nt, Escherichia coli CFT073
augcuuguuuauuaucaauu

SEQ ID NO: 596761 - RNA, 16 nt, Escherichia coli CFT073
augcuuuacguauccg

SEQ ID NO: 596762 - RNA, 20 nt, Escherichia coli CFT073
augcuuuacguauccguucc

SEQ ID NO: 596763 - RNA, 22 nt, Escherichia coli CFT073
augcuggcgcaucuuaucaggc

SEQ ID NO: 596764 - RNA, 20 nt, Escherichia coli CFT073
augcugggcgaucggcagga

SEQ ID NO: 596765 - RNA, 14 nt, Escherichia coli CFT073
augcuguauguucc

SEQ ID NO: 596766 - RNA, 21 nt, Escherichia coli CFT073
augcuucaucgugacaaucuc

SEQ ID NO: 596767 - RNA, 12 nt, Escherichia coli CFT073
auggaucaccau

SEQ ID NO: 596768 - RNA, 15 nt, Escherichia coli CFT073
auggacgucgauaaa

SEQ ID NO: 596769 - RNA, 23 nt, Escherichia coli CFT073
auggacuuuuacugucugcucgg

SEQ ID NO: 596770 - RNA, 17 nt, Escherichia coli CFT073
auggaguaguugaucgc

SEQ ID NO: 596771 - RNA, 15 nt, Escherichia coli CFT073
auggauggugcuaau

SEQ ID NO: 596772 - RNA, 22 nt, Escherichia coli CFT073
auggcaaucuuccucgccagcg

SEQ ID NO: 596773 - RNA, 15 nt, Escherichia coli CFT073
auggcagaguugcca

SEQ ID NO: 596774 - RNA, 21 nt, Escherichia coli CFT073
auggcacaugacuuccaacga

SEQ ID NO: 596775 - RNA, 15 nt, Escherichia coli CFT073
auggcagaccaaacg

SEQ ID NO: 596776 - RNA, 20 nt, Escherichia coli CFT073
auggcccaugacauccccau

SEQ ID NO: 596777 - RNA, 15 nt, Escherichia coli CFT073
auggccucugccagc

SEQ ID NO: 596778 - RNA, 13 nt, Escherichia coli CFT073
auggcaucaccau

SEQ ID NO: 596779 - RNA, 20 nt, Escherichia coli CFT073
auggcauccaagcugguggc

SEQ ID NO: 596780 - RNA, 13 nt, Escherichia coli CFT073
auggcauccagcg

SEQ ID NO: 596781 - RNA, 13 nt, Escherichia coli CFT073
auggcauccccug

SEQ ID NO: 596782 - RNA, 20 nt, Escherichia coli CFT073
auggcauccuguuuucugga

SEQ ID NO: 596783 - RNA, 22 nt, Escherichia coli CFT073
auggccaaugcggucgcgauaa

SEQ ID NO: 596784 - RNA, 14 nt, Escherichia coli CFT073
augcgggauguauc

SEQ ID NO: 596785 - RNA, 14 nt, Escherichia coli CFT073
augcggcgcugacg

SEQ ID NO: 596786 - RNA, 23 nt, Escherichia coli CFT073
augcugcaccccacaaacagaau

SEQ ID NO: 596787 - RNA, 13 nt, Escherichia coli CFT073
augcuggaaccac

SEQ ID NO: 596788 - RNA, 21 nt, Escherichia coli CFT073
augcugcgggucaaucggcgc

SEQ ID NO: 596789 - RNA, 16 nt, Escherichia coli CFT073
augcugcuccagcgua

SEQ ID NO: 596790 - RNA, 14 nt, Escherichia coli CFT073
augcugccacacug

SEQ ID NO: 596791 - RNA, 15 nt, Escherichia coli CFT073
augcgcaacaccgua

SEQ ID NO: 596792 - RNA, 20 nt, Escherichia coli CFT073
augcgcaacgcaauccccuc

SEQ ID NO: 596793 - RNA, 16 nt, Escherichia coli CFT073
augcauucuuauccgu

SEQ ID NO: 596794 - RNA, 12 nt, Escherichia coli CFT073
augcgccagacu

SEQ ID NO: 596795 - RNA, 20 nt, Escherichia coli CFT073
augcgcaugaugccggguuu

SEQ ID NO: 596796 - RNA, 18 nt, Escherichia coli CFT073
augcgcauaagaccguga

SEQ ID NO: 596797 - RNA, 21 nt, Escherichia coli CFT073
augcgccagcugcauuucaua

SEQ ID NO: 596798 - RNA, 16 nt, Escherichia coli CFT073
augcgccaguugcaua

SEQ ID NO: 596799 - RNA, 15 nt, Escherichia coli CFT073
augcgccagguaacg

SEQ ID NO: 596800 - RNA, 23 nt, Escherichia coli CFT073
augcgccuauaaacguucccgga

SEQ ID NO: 596801 - RNA, 20 nt, Escherichia coli CFT073
augcggcagagaucgccgcu

SEQ ID NO: 596802 - RNA, 15 nt, Escherichia coli CFT073
caaugucauaaaccg

SEQ ID NO: 596803 - RNA, 23 nt, Escherichia coli CFT073
caaugguguuauaggccccagcc

SEQ ID NO: 596804 - RNA, 16 nt, Escherichia coli CFT073
caaugccguaaccagc

SEQ ID NO: 596805 - RNA, 15 nt, Escherichia coli CFT073
caaugccugaugcga

SEQ ID NO: 596806 - RNA, 15 nt, Escherichia coli CFT073
caauggcuccgggug

SEQ ID NO: 596807 - RNA, 15 nt, Escherichia coli CFT073
caauggcugccgcca

SEQ ID NO: 596808 - RNA, 19 nt, Escherichia coli CFT073
caauggcgcggcuauaccg

SEQ ID NO: 596809 - RNA, 21 nt, Escherichia coli CFT073
caauugcguuaaaaucagcgu

SEQ ID NO: 596810 - RNA, 20 nt, Escherichia coli CFT073
caauugccggaugcgacaua

SEQ ID NO: 596811 - RNA, 18 nt, Escherichia coli CFT073
caauugccauaaaaacga

SEQ ID NO: 596812 - RNA, 20 nt, Escherichia coli CFT073
caauuuccgcuuucaacgcg

SEQ ID NO: 596813 - RNA, 21 nt, Escherichia coli CFT073
cacaaccgaggcucaacaccg

SEQ ID NO: 596814 - RNA, 21 nt, Escherichia coli CFT073
cacaaccgccagaugcggcgu

SEQ ID NO: 596815 - RNA, 19 nt, Escherichia coli CFT073
cacaaccgccggaugcggc

SEQ ID NO: 596816 - RNA, 12 nt, Escherichia coli CFT073
cacaaccgucag

SEQ ID NO: 596817 - RNA, 18 nt, Escherichia coli CFT073
cacaacguacaccgcagc

SEQ ID NO: 596818 - RNA, 18 nt, Escherichia coli CFT073
cacaauacauagaagcuc

SEQ ID NO: 596819 - RNA, 22 nt, Escherichia coli CFT073
cacaauccccgcgccaaccaug

SEQ ID NO: 596820 - RNA, 16 nt, Escherichia coli CFT073
cacaaucgcagcgcaa

SEQ ID NO: 596821 - RNA, 16 nt, Escherichia coli CFT073
cacaaucggcgggaaa

SEQ ID NO: 596822 - RNA, 20 nt, Escherichia coli CFT073
cacaaucgggaaaaucugcg

SEQ ID NO: 596823 - RNA, 15 nt, Escherichia coli CFT073
cacaaucucgcccgc

SEQ ID NO: 596824 - RNA, 14 nt, Escherichia coli CFT073
cacacaaaauugcc

SEQ ID NO: 596825 - RNA, 14 nt, Escherichia coli CFT073
cacaaugccgccaa

SEQ ID NO: 596826 - RNA, 15 nt, Escherichia coli CFT073
cacacaaagugcgag

SEQ ID NO: 596827 - RNA, 16 nt, Escherichia coli CFT073
cacacaaccauggaac

SEQ ID NO: 596828 - RNA, 22 nt, Escherichia coli CFT073
cacaauuuguggcccuugcgca

SEQ ID NO: 596829 - RNA, 14 nt, Escherichia coli CFT073
cacacacaucaacc

SEQ ID NO: 596830 - RNA, 20 nt, Escherichia coli CFT073
cacaccgccgccgccacugc

SEQ ID NO: 596831 - RNA, 21 nt, Escherichia coli CFT073
cacaccgccgccgccacugca

SEQ ID NO: 596832 - RNA, 15 nt, Escherichia coli CFT073
caauccagcuaacca

SEQ ID NO: 596833 - RNA, 15 nt, Escherichia coli CFT073
caauccagucagcgg

SEQ ID NO: 596834 - RNA, 13 nt, Escherichia coli CFT073
caauccaugccaa

SEQ ID NO: 596835 - RNA, 12 nt, Escherichia coli CFT073
caauccgccagc

SEQ ID NO: 596836 - RNA, 14 nt, Escherichia coli CFT073
caauccgccaggac

SEQ ID NO: 596837 - RNA, 18 nt, Escherichia coli CFT073
caauccgccaggacauca

SEQ ID NO: 596838 - RNA, 21 nt, Escherichia coli CFT073
caauccgccaggacaucagcg

SEQ ID NO: 596839 - RNA, 22 nt, Escherichia coli CFT073
caaucccguugccacucaggca

SEQ ID NO: 596840 - RNA, 14 nt, Escherichia coli CFT073
caauccuucuugcu

SEQ ID NO: 596841 - RNA, 20 nt, Escherichia coli CFT073
caaucgaucuguuuaucgcg

SEQ ID NO: 596842 - RNA, 21 nt, Escherichia coli CFT073
caaucgaucuguuuaucgcgc

SEQ ID NO: 596843 - RNA, 18 nt, Escherichia coli CFT073
caaucgcaaucuggcagc

SEQ ID NO: 596844 - RNA, 15 nt, Escherichia coli CFT073
caaucgcacccgcca

SEQ ID NO: 596845 - RNA, 12 nt, Escherichia coli CFT073
caaucgccagac

SEQ ID NO: 596846 - RNA, 14 nt, Escherichia coli CFT073
caaucgccuccagc

SEQ ID NO: 596847 - RNA, 18 nt, Escherichia coli CFT073
caaucacgcccgccagau

SEQ ID NO: 596848 - RNA, 19 nt, Escherichia coli CFT073
caaucacgcccgccagaua

SEQ ID NO: 596849 - RNA, 19 nt, Escherichia coli CFT073
caaucaacgccaccaucac

SEQ ID NO: 596850 - RNA, 15 nt, Escherichia coli CFT073
caaucaauucucgcc

SEQ ID NO: 596851 - RNA, 21 nt, Escherichia coli CFT073
caaucaagcccugguaacugc

SEQ ID NO: 596852 - RNA, 22 nt, Escherichia coli CFT073
caaucaccaaaccaacaagcac

SEQ ID NO: 596853 - RNA, 18 nt, Escherichia coli CFT073
caaucagcaguaucauug

SEQ ID NO: 596854 - RNA, 17 nt, Escherichia coli CFT073
caaucacugccaccagg

SEQ ID NO: 596855 - RNA, 20 nt, Escherichia coli CFT073
caaucacuuucugcgccagc

SEQ ID NO: 596856 - RNA, 21 nt, Escherichia coli CFT073
caaucagcgcagcacccagaa

SEQ ID NO: 596857 - RNA, 21 nt, Escherichia coli CFT073
caaucagcggcguaucuucca

SEQ ID NO: 596858 - RNA, 24 nt, Escherichia coli CFT073
caaucaggcuaucgaacaugcggg

SEQ ID NO: 596859 - RNA, 22 nt, Escherichia coli CFT073
caaucaggucuuucagggugau

SEQ ID NO: 596860 - RNA, 19 nt, Escherichia coli CFT073
caaucaguacguuaucacc

SEQ ID NO: 596861 - RNA, 18 nt, Escherichia coli CFT073
caaucauaaacgccugac

SEQ ID NO: 596862 - RNA, 14 nt, Escherichia coli CFT073
caaugcccgcagua

SEQ ID NO: 596863 - RNA, 14 nt, Escherichia coli CFT073
caaugcccacugca

SEQ ID NO: 596864 - RNA, 17 nt, Escherichia coli CFT073
caaugcccacugcacag

SEQ ID NO: 596865 - RNA, 20 nt, Escherichia coli CFT073
caaugccagaaacaucggca

SEQ ID NO: 596866 - RNA, 19 nt, Escherichia coli CFT073
caaugccagcguauaacac

SEQ ID NO: 596867 - RNA, 19 nt, Escherichia coli CFT073
caaugccaggcuccagaua

SEQ ID NO: 596868 - RNA, 21 nt, Escherichia coli CFT073
caaugcccgguguucccgcgc

SEQ ID NO: 596869 - RNA, 15 nt, Escherichia coli CFT073
caaugcauaucauug

SEQ ID NO: 596870 - RNA, 19 nt, Escherichia coli CFT073
caaucuuaggggacauuua

SEQ ID NO: 596871 - RNA, 23 nt, Escherichia coli CFT073
caaucuguccuuccaguaaccag

SEQ ID NO: 596872 - RNA, 15 nt, Escherichia coli CFT073
caaucucuuccagcg

SEQ ID NO: 596873 - RNA, 13 nt, Escherichia coli CFT073
caaucugauuccg

SEQ ID NO: 596874 - RNA, 14 nt, Escherichia coli CFT073
caaucugcccgacc

SEQ ID NO: 596875 - RNA, 19 nt, Escherichia coli CFT073
caaucggaucgauaucgau

SEQ ID NO: 596876 - RNA, 15 nt, Escherichia coli CFT073
caaucgggaaaaucu

SEQ ID NO: 596877 - RNA, 15 nt, Escherichia coli CFT073
caaucgcggcagcgg

SEQ ID NO: 596878 - RNA, 15 nt, Escherichia coli CFT073
caaucgcggcgauau

SEQ ID NO: 596879 - RNA, 21 nt, Escherichia coli CFT073
caaucgcucacaacaauauca

SEQ ID NO: 596880 - RNA, 18 nt, Escherichia coli CFT073
caaucgcuguacucacca

SEQ ID NO: 596881 - RNA, 16 nt, Escherichia coli CFT073
caaucgcuucaucgcc

SEQ ID NO: 596882 - RNA, 17 nt, Escherichia coli CFT073
caaucgcuucaucgccc

SEQ ID NO: 596883 - RNA, 16 nt, Escherichia coli CFT073
caaucguaacccaacu

SEQ ID NO: 596884 - RNA, 17 nt, Escherichia coli CFT073
caaucggcguaccgcac

SEQ ID NO: 596885 - RNA, 23 nt, Escherichia coli CFT073
caauauucaagauaacgccuggc

SEQ ID NO: 596886 - RNA, 23 nt, Escherichia coli CFT073
caauauuccagucagcaccagac

SEQ ID NO: 596887 - RNA, 17 nt, Escherichia coli CFT073
caauaugaauccaggcc

SEQ ID NO: 596888 - RNA, 18 nt, Escherichia coli CFT073
caauauauugaauuugca

SEQ ID NO: 596889 - RNA, 18 nt, Escherichia coli CFT073
caauaggcauauagccgc

SEQ ID NO: 596890 - RNA, 21 nt, Escherichia coli CFT073
caauagguguuaauggaauaa

SEQ ID NO: 596891 - RNA, 17 nt, Escherichia coli CFT073
caauaucaaagcguuuc

SEQ ID NO: 596892 - RNA, 21 nt, Escherichia coli CFT073
caauagugauguucuggcgaa

SEQ ID NO: 596893 - RNA, 15 nt, Escherichia coli CFT073
caauaguguugccgc

SEQ ID NO: 596894 - RNA, 22 nt, Escherichia coli CFT073
caauauaaacagccccuccgga

SEQ ID NO: 596895 - RNA, 14 nt, Escherichia coli CFT073
caauagccugaugu

SEQ ID NO: 596896 - RNA, 13 nt, Escherichia coli CFT073
caauacuugcgaa

SEQ ID NO: 596897 - RNA, 19 nt, Escherichia coli CFT073
caauacuuugcagaucgcg

SEQ ID NO: 596898 - RNA, 18 nt, Escherichia coli CFT073
caauagaaagugacagcc

SEQ ID NO: 596899 - RNA, 16 nt, Escherichia coli CFT073
caauacgauuaacgcc

SEQ ID NO: 596900 - RNA, 18 nt, Escherichia coli CFT073
caauacccugacccagac

SEQ ID NO: 596901 - RNA, 19 nt, Escherichia coli CFT073
caauaccgaucaguaccag

SEQ ID NO: 596902 - RNA, 23 nt, Escherichia coli CFT073
caauaccacccuugcccaccagc

SEQ ID NO: 596903 - RNA, 17 nt, Escherichia coli CFT073
caauacagccagccagc

SEQ ID NO: 596904 - RNA, 21 nt, Escherichia coli CFT073
caauaauugacgaauauagcg

SEQ ID NO: 596905 - RNA, 12 nt, Escherichia coli CFT073
caauacaaauga

SEQ ID NO: 596906 - RNA, 23 nt, Escherichia coli CFT073
caauaaucucuuuacccagcgga

SEQ ID NO: 596907 - RNA, 17 nt, Escherichia coli CFT073
caauaaucuuuacacca

SEQ ID NO: 596908 - RNA, 15 nt, Escherichia coli CFT073
caauaaucaucucuc

SEQ ID NO: 596909 - RNA, 19 nt, Escherichia coli CFT073
caauaauaauccgcugcac

SEQ ID NO: 596910 - RNA, 23 nt, Escherichia coli CFT073
caauaauauuaaucccugcuucg

SEQ ID NO: 596911 - RNA, 12 nt, Escherichia coli CFT073
caauaaaagcau

SEQ ID NO: 596912 - RNA, 18 nt, Escherichia coli CFT073
caauaacagaauuauccc

SEQ ID NO: 596913 - RNA, 14 nt, Escherichia coli CFT073
caauaaccauucca

SEQ ID NO: 596914 - RNA, 12 nt, Escherichia coli CFT073
caauaaacgccu

SEQ ID NO: 596915 - RNA, 19 nt, Escherichia coli CFT073
caauaaagccgcccauucc

SEQ ID NO: 596916 - RNA, 14 nt, Escherichia coli CFT073
caauaaagccggua

SEQ ID NO: 596917 - RNA, 16 nt, Escherichia coli CFT073
caauaaaauaucuucu

SEQ ID NO: 596918 - RNA, 23 nt, Escherichia coli CFT073
caauaaaacguugcccgcugcgc

SEQ ID NO: 596919 - RNA, 13 nt, Escherichia coli CFT073
caaguuuaugcaa

SEQ ID NO: 596920 - RNA, 20 nt, Escherichia coli CFT073
caauaaaaaucagauaugcg

SEQ ID NO: 596921 - RNA, 21 nt, Escherichia coli CFT073
caaguggaaauccccaucagg

SEQ ID NO: 596922 - RNA, 21 nt, Escherichia coli CFT073
caagugugaugguauucaucg

SEQ ID NO: 596923 - RNA, 18 nt, Escherichia coli CFT073
caaguguggccgccagug

SEQ ID NO: 596924 - RNA, 14 nt, Escherichia coli CFT073
caaguccugccaga

SEQ ID NO: 596925 - RNA, 16 nt, Escherichia coli CFT073
caaguccugccagaaa

SEQ ID NO: 596926 - RNA, 12 nt, Escherichia coli CFT073
caagucagcaac

SEQ ID NO: 596927 - RNA, 15 nt, Escherichia coli CFT073
caaguagcgccagac

SEQ ID NO: 596928 - RNA, 21 nt, Escherichia coli CFT073
caagucuuuuuugguuaucca

SEQ ID NO: 596929 - RNA, 15 nt, Escherichia coli CFT073
caagugaacuuucuc

SEQ ID NO: 596930 - RNA, 18 nt, Escherichia coli CFT073
caagugcggcgcaccagc

SEQ ID NO: 596931 - RNA, 11 nt, Escherichia coli CFT073
caaggcugaug

SEQ ID NO: 596932 - RNA, 18 nt, Escherichia coli CFT073
caaggcgcucgcgccgca

SEQ ID NO: 596933 - RNA, 17 nt, Escherichia coli CFT073
caagcugcaucuggcga

SEQ ID NO: 596934 - RNA, 12 nt, Escherichia coli CFT073
caagcgccgccu

SEQ ID NO: 596935 - RNA, 17 nt, Escherichia coli CFT073
caacucgccacgaucgg

SEQ ID NO: 596936 - RNA, 23 nt, Escherichia coli CFT073
caacuccggcgaaaaucccggca

SEQ ID NO: 596937 - RNA, 12 nt, Escherichia coli CFT073
caacgcuuaaua

SEQ ID NO: 596938 - RNA, 21 nt, Escherichia coli CFT073
caacgaugaagagauaaacga

SEQ ID NO: 596939 - RNA, 13 nt, Escherichia coli CFT073
caacgcgguuucg

SEQ ID NO: 596940 - RNA, 19 nt, Escherichia coli CFT073
caacgaugcgaccgccgcu

SEQ ID NO: 596941 - RNA, 20 nt, Escherichia coli CFT073
caacgaugcgaccgccgcuc

SEQ ID NO: 596942 - RNA, 16 nt, Escherichia coli CFT073
caacgaugggugauca

SEQ ID NO: 596943 - RNA, 17 nt, Escherichia coli CFT073
caacgacuacgccagaa

SEQ ID NO: 596944 - RNA, 17 nt, Escherichia coli CFT073
caaccucuggugugcgu

SEQ ID NO: 596945 - RNA, 16 nt, Escherichia coli CFT073
caaccugaguaaauca

SEQ ID NO: 596946 - RNA, 16 nt, Escherichia coli CFT073
caaccugaucgugcca

SEQ ID NO: 596947 - RNA, 18 nt, Escherichia coli CFT073
caacuaacugacuuucuu

SEQ ID NO: 596948 - RNA, 19 nt, Escherichia coli CFT073
caacucaggaacaucagca

SEQ ID NO: 596949 - RNA, 21 nt, Escherichia coli CFT073
caacucauuacuguaggccag

SEQ ID NO: 596950 - RNA, 18 nt, Escherichia coli CFT073
caacucauuccccggagc

SEQ ID NO: 596951 - RNA, 20 nt, Escherichia coli CFT073
caacgugacguuucaucgca

SEQ ID NO: 596952 - RNA, 20 nt, Escherichia coli CFT073
caacgugguuuaccaccagc

SEQ ID NO: 596953 - RNA, 17 nt, Escherichia coli CFT073
caacgugguuugcggca

SEQ ID NO: 596954 - RNA, 18 nt, Escherichia coli CFT073
caacguguaggccugaua

SEQ ID NO: 596955 - RNA, 20 nt, Escherichia coli CFT073
caacggcgucagccacaaca

SEQ ID NO: 596956 - RNA, 15 nt, Escherichia coli CFT073
caacguccucgucga

SEQ ID NO: 596957 - RNA, 21 nt, Escherichia coli CFT073
caacgucgucgucuucaacgu

SEQ ID NO: 596958 - RNA, 17 nt, Escherichia coli CFT073
caacgucguuuucgccg

SEQ ID NO: 596959 - RNA, 20 nt, Escherichia coli CFT073
caacgugaccaguaccaccg

SEQ ID NO: 596960 - RNA, 13 nt, Escherichia coli CFT073
caaccaucagcgu

SEQ ID NO: 596961 - RNA, 14 nt, Escherichia coli CFT073
caaccaugccgccc

SEQ ID NO: 596962 - RNA, 22 nt, Escherichia coli CFT073
caaccaagacuauuaauauaua

SEQ ID NO: 596963 - RNA, 19 nt, Escherichia coli CFT073
caaccaacgcgccgcaaca

SEQ ID NO: 596964 - RNA, 13 nt, Escherichia coli CFT073
caaccaaugccgc

SEQ ID NO: 596965 - RNA, 20 nt, Escherichia coli CFT073
caaccacacaggcaucguga

SEQ ID NO: 596966 - RNA, 14 nt, Escherichia coli CFT073
caaccauucgcgca

SEQ ID NO: 596967 - RNA, 16 nt, Escherichia coli CFT073
caacccauuucgucaa

SEQ ID NO: 596968 - RNA, 19 nt, Escherichia coli CFT073
caacccauuucgucaaacg

SEQ ID NO: 596969 - RNA, 11 nt, Escherichia coli CFT073
caacauucaga

SEQ ID NO: 596970 - RNA, 14 nt, Escherichia coli CFT073
caacauuccggcgc

SEQ ID NO: 596971 - RNA, 20 nt, Escherichia coli CFT073
caacacgccagcguuauccc

SEQ ID NO: 596972 - RNA, 23 nt, Escherichia coli CFT073
caacaccguuucguggaaaacac

SEQ ID NO: 596973 - RNA, 16 nt, Escherichia coli CFT073
caacaccucagccagc

SEQ ID NO: 596974 - RNA, 13 nt, Escherichia coli CFT073
caacaccguaaga

SEQ ID NO: 596975 - RNA, 14 nt, Escherichia coli CFT073
caaccgcgccaagc

SEQ ID NO: 596976 - RNA, 22 nt, Escherichia coli CFT073
caaccgcugauugcuggcgggc

SEQ ID NO: 596977 - RNA, 12 nt, Escherichia coli CFT073
caacccgcgcgc

SEQ ID NO: 596978 - RNA, 13 nt, Escherichia coli CFT073
caacaauaaaaag

SEQ ID NO: 596979 - RNA, 21 nt, Escherichia coli CFT073
caacaauuuucccuucccgca

SEQ ID NO: 596980 - RNA, 14 nt, Escherichia coli CFT073
caacacaggccggc

SEQ ID NO: 596981 - RNA, 20 nt, Escherichia coli CFT073
caacacaucgccuucgcgca

SEQ ID NO: 596982 - RNA, 11 nt, Escherichia coli CFT073
caacaacuucu

SEQ ID NO: 596983 - RNA, 15 nt, Escherichia coli CFT073
caacaaacgccagau

SEQ ID NO: 596984 - RNA, 18 nt, Escherichia coli CFT073
caacaaacgcugacauau

SEQ ID NO: 596985 - RNA, 19 nt, Escherichia coli CFT073
caacaacaauuucacgcgc

SEQ ID NO: 596986 - RNA, 23 nt, Escherichia coli CFT073
caacaacaucacaccugcucagc

SEQ ID NO: 596987 - RNA, 18 nt, Escherichia coli CFT073
caaauuacuggcggcgaa

SEQ ID NO: 596988 - RNA, 15 nt, Escherichia coli CFT073
caacaaaccaaaacc

SEQ ID NO: 596989 - RNA, 12 nt, Escherichia coli CFT073
caaauuugccag

SEQ ID NO: 596990 - RNA, 21 nt, Escherichia coli CFT073
caaaucuuucacuuuugccag

SEQ ID NO: 596991 - RNA, 18 nt, Escherichia coli CFT073
caaaugaugcaccaccug

SEQ ID NO: 596992 - RNA, 13 nt, Escherichia coli CFT073
caaaugccggaug

SEQ ID NO: 596993 - RNA, 20 nt, Escherichia coli CFT073
caaaucgacgccacuaucug

SEQ ID NO: 596994 - RNA, 19 nt, Escherichia coli CFT073
caaaucugccguaacugcg

SEQ ID NO: 596995 - RNA, 12 nt, Escherichia coli CFT073
caaaucguugcu

SEQ ID NO: 596996 - RNA, 18 nt, Escherichia coli CFT073
caaauacacgcacggcau

SEQ ID NO: 596997 - RNA, 22 nt, Escherichia coli CFT073
caaauacagcuuaaucaccagc

SEQ ID NO: 596998 - RNA, 20 nt, Escherichia coli CFT073
caaaggacaucccggcagag

SEQ ID NO: 596999 - RNA, 20 nt, Escherichia coli CFT073
caaauaccaccgugccgccg

SEQ ID NO: 597000 - RNA, 16 nt, Escherichia coli CFT073
caaauaccccugccgc

SEQ ID NO: 597001 - RNA, 18 nt, Escherichia coli CFT073
caaauaccccugccgccg

SEQ ID NO: 597002 - RNA, 18 nt, Escherichia coli CFT073
caaauacugacuggcgag

SEQ ID NO: 597003 - RNA, 15 nt, Escherichia coli CFT073
caaauagccagcaga

SEQ ID NO: 597004 - RNA, 18 nt, Escherichia coli CFT073
caaauaguacacagacga

SEQ ID NO: 597005 - RNA, 14 nt, Escherichia coli CFT073
caaauaucaacccg

SEQ ID NO: 597006 - RNA, 14 nt, Escherichia coli CFT073
caaauauucagcca

SEQ ID NO: 597007 - RNA, 16 nt, Escherichia coli CFT073
caaaucaaaucacgau

SEQ ID NO: 597008 - RNA, 18 nt, Escherichia coli CFT073
caaaucaacuaaaaucaa

SEQ ID NO: 597009 - RNA, 12 nt, Escherichia coli CFT073
caaaucacgcag

SEQ ID NO: 597010 - RNA, 22 nt, Escherichia coli CFT073
caaaucagcggcagauccacca

SEQ ID NO: 597011 - RNA, 18 nt, Escherichia coli CFT073
caaauccuuccgccaguc

SEQ ID NO: 597012 - RNA, 19 nt, Escherichia coli CFT073
caaauccuuccgccagucg

SEQ ID NO: 597013 - RNA, 21 nt, Escherichia coli CFT073
auugugcacagguaaacgcau

SEQ ID NO: 597014 - RNA, 22 nt, Escherichia coli CFT073
auuguuggucacaaugcguaaa

SEQ ID NO: 597015 - RNA, 15 nt, Escherichia coli CFT073
auuguuuaaucaacu

SEQ ID NO: 597016 - RNA, 14 nt, Escherichia coli CFT073
auuuaaaaucgcuu

SEQ ID NO: 597017 - RNA, 19 nt, Escherichia coli CFT073
caaaaugccguacagcaga

SEQ ID NO: 597018 - RNA, 23 nt, Escherichia coli CFT073
caaaauuaccugaugcgcuccgc

SEQ ID NO: 597019 - RNA, 14 nt, Escherichia coli CFT073
caaaauguugcgcc

SEQ ID NO: 597020 - RNA, 17 nt, Escherichia coli CFT073
caaaauuaaagccgcga

SEQ ID NO: 597021 - RNA, 22 nt, Escherichia coli CFT073
caaaauugccugaugcgcuacg

SEQ ID NO: 597022 - RNA, 15 nt, Escherichia coli CFT073
caaaauuuuugccaa

SEQ ID NO: 597023 - RNA, 23 nt, Escherichia coli CFT073
caaacaauuugcuuaagccgcuc

SEQ ID NO: 597024 - RNA, 14 nt, Escherichia coli CFT073
caaaccacugcgcc

SEQ ID NO: 597025 - RNA, 16 nt, Escherichia coli CFT073
caaaccagccgccaac

SEQ ID NO: 597026 - RNA, 22 nt, Escherichia coli CFT073
caaaccauagaauacgccacga

SEQ ID NO: 597027 - RNA, 18 nt, Escherichia coli CFT073
caaacccauuuucagccg

SEQ ID NO: 597028 - RNA, 13 nt, Escherichia coli CFT073
caaagaacagccc

SEQ ID NO: 597029 - RNA, 15 nt, Escherichia coli CFT073
caaagaacuuaucga

SEQ ID NO: 597030 - RNA, 15 nt, Escherichia coli CFT073
caaagaauccgcccu

SEQ ID NO: 597031 - RNA, 13 nt, Escherichia coli CFT073
caaacuuccggca

SEQ ID NO: 597032 - RNA, 23 nt, Escherichia coli CFT073
caaagaaaaacgggucgccagaa

SEQ ID NO: 597033 - RNA, 12 nt, Escherichia coli CFT073
caaagcgcauca

SEQ ID NO: 597034 - RNA, 13 nt, Escherichia coli CFT073
caaagcgccagcg

SEQ ID NO: 597035 - RNA, 15 nt, Escherichia coli CFT073
caaacucaucgccgc

SEQ ID NO: 597036 - RNA, 19 nt, Escherichia coli CFT073
caaacuccgagagauccug

SEQ ID NO: 597037 - RNA, 21 nt, Escherichia coli CFT073
caaacucuaccuggucaccga

SEQ ID NO: 597038 - RNA, 21 nt, Escherichia coli CFT073
caaacuggaauagcgccacgc

SEQ ID NO: 597039 - RNA, 18 nt, Escherichia coli CFT073
caaacuggcuggcgugac

SEQ ID NO: 597040 - RNA, 16 nt, Escherichia coli CFT073
caaaccggacgaucgg

SEQ ID NO: 597041 - RNA, 16 nt, Escherichia coli CFT073
caaacguaaaugccag

SEQ ID NO: 597042 - RNA, 13 nt, Escherichia coli CFT073
caaaccgacgcug

SEQ ID NO: 597043 - RNA, 16 nt, Escherichia coli CFT073
caaaccgcccagcagc

SEQ ID NO: 597044 - RNA, 18 nt, Escherichia coli CFT073
caccucacaccccggauu

SEQ ID NO: 597045 - RNA, 13 nt, Escherichia coli CFT073
caccuacaugacc

SEQ ID NO: 597046 - RNA, 22 nt, Escherichia coli CFT073
caccguuuccauaucgcuggcu

SEQ ID NO: 597047 - RNA, 14 nt, Escherichia coli CFT073
caccguuaccggac

SEQ ID NO: 597048 - RNA, 16 nt, Escherichia coli CFT073
caccguguucaugacc

SEQ ID NO: 597049 - RNA, 16 nt, Escherichia coli CFT073
caccgugaauugcacu

SEQ ID NO: 597050 - RNA, 20 nt, Escherichia coli CFT073
caccgugaaagagaucaaag

SEQ ID NO: 597051 - RNA, 14 nt, Escherichia coli CFT073
caccgucaucacgc

SEQ ID NO: 597052 - RNA, 20 nt, Escherichia coli CFT073
caccgucaggcguaacgaca

SEQ ID NO: 597053 - RNA, 15 nt, Escherichia coli CFT073
caccguaagaucgcg

SEQ ID NO: 597054 - RNA, 17 nt, Escherichia coli CFT073
caccguaauugccagac

SEQ ID NO: 597055 - RNA, 22 nt, Escherichia coli CFT073
caccggugauuauugucgugcc

SEQ ID NO: 597056 - RNA, 22 nt, Escherichia coli CFT073
caccgguucaucacgaaaauca

SEQ ID NO: 597057 - RNA, 19 nt, Escherichia coli CFT073
caccgggggguugccgcca

SEQ ID NO: 597058 - RNA, 16 nt, Escherichia coli CFT073
caccgguacaaacauc

SEQ ID NO: 597059 - RNA, 18 nt, Escherichia coli CFT073
caccgguacaaacaucau

SEQ ID NO: 597060 - RNA, 16 nt, Escherichia coli CFT073
caccgguacacaaccg

SEQ ID NO: 597061 - RNA, 16 nt, Escherichia coli CFT073
caccgccuaccgccag

SEQ ID NO: 597062 - RNA, 22 nt, Escherichia coli CFT073
caccgaugacagaaucagcagc

SEQ ID NO: 597063 - RNA, 23 nt, Escherichia coli CFT073
caccgaugacagaaucagcagcg

SEQ ID NO: 597064 - RNA, 14 nt, Escherichia coli CFT073
caccgaugcacaga

SEQ ID NO: 597065 - RNA, 16 nt, Escherichia coli CFT073
caccgcgugagaacac

SEQ ID NO: 597066 - RNA, 21 nt, Escherichia coli CFT073
caccgcgugagaacacgaccu

SEQ ID NO: 597067 - RNA, 12 nt, Escherichia coli CFT073
caccgcgugcga

SEQ ID NO: 597068 - RNA, 14 nt, Escherichia coli CFT073
caccgcgugcgacg

SEQ ID NO: 597069 - RNA, 23 nt, Escherichia coli CFT073
caccgcguaugcccagcgcagaa

SEQ ID NO: 597070 - RNA, 11 nt, Escherichia coli CFT073
caccggcaccg

SEQ ID NO: 597071 - RNA, 22 nt, Escherichia coli CFT073
caccggcaagcccugaucgcgc

SEQ ID NO: 597072 - RNA, 17 nt, Escherichia coli CFT073
caccggagcugccagcg

SEQ ID NO: 597073 - RNA, 20 nt, Escherichia coli CFT073
caccgcuuuuuucaucucuu

SEQ ID NO: 597074 - RNA, 21 nt, Escherichia coli CFT073
caccggaauggucaguuucgc

SEQ ID NO: 597075 - RNA, 16 nt, Escherichia coli CFT073
caccgcuucaacagcg

SEQ ID NO: 597076 - RNA, 21 nt, Escherichia coli CFT073
caccgcuucgcucacaucaug

SEQ ID NO: 597077 - RNA, 13 nt, Escherichia coli CFT073
caccagcgucgcg

SEQ ID NO: 597078 - RNA, 22 nt, Escherichia coli CFT073
caccagcgucaguucgccagca

SEQ ID NO: 597079 - RNA, 14 nt, Escherichia coli CFT073
caccagcggcaccu

SEQ ID NO: 597080 - RNA, 13 nt, Escherichia coli CFT073
caccagcggaaug

SEQ ID NO: 597081 - RNA, 11 nt, Escherichia coli CFT073
caccagcgccg

SEQ ID NO: 597082 - RNA, 14 nt, Escherichia coli CFT073
caccagcgccgccc

SEQ ID NO: 597083 - RNA, 17 nt, Escherichia coli CFT073
caccagcgccgcccaca

SEQ ID NO: 597084 - RNA, 12 nt, Escherichia coli CFT073
caccagcgccac

SEQ ID NO: 597085 - RNA, 13 nt, Escherichia coli CFT073
caccagcgccacc

SEQ ID NO: 597086 - RNA, 18 nt, Escherichia coli CFT073
caccagcgcauugacgau

SEQ ID NO: 597087 - RNA, 23 nt, Escherichia coli CFT073
caccagcccgacgauaccgccgc

SEQ ID NO: 597088 - RNA, 19 nt, Escherichia coli CFT073
caccagccaucuguuccgg

SEQ ID NO: 597089 - RNA, 20 nt, Escherichia coli CFT073
caccagccaacaaucgcugc

SEQ ID NO: 597090 - RNA, 19 nt, Escherichia coli CFT073
caccagcagcggaaacaau

SEQ ID NO: 597091 - RNA, 18 nt, Escherichia coli CFT073
caccagcaccgcgacaau

SEQ ID NO: 597092 - RNA, 18 nt, Escherichia coli CFT073
caccagcaccagcaacaa

SEQ ID NO: 597093 - RNA, 19 nt, Escherichia coli CFT073
caccagcaccagcaacaac

SEQ ID NO: 597094 - RNA, 20 nt, Escherichia coli CFT073
caccagcaaauauugcauug

SEQ ID NO: 597095 - RNA, 13 nt, Escherichia coli CFT073
caccagcaacacg

SEQ ID NO: 597096 - RNA, 20 nt, Escherichia coli CFT073
caccacuucuuucacgcccg

SEQ ID NO: 597097 - RNA, 21 nt, Escherichia coli CFT073
caccacuucuuucacgcccgc

SEQ ID NO: 597098 - RNA, 14 nt, Escherichia coli CFT073
caccacuugcuggu

SEQ ID NO: 597099 - RNA, 13 nt, Escherichia coli CFT073
caccagaaacaau

SEQ ID NO: 597100 - RNA, 12 nt, Escherichia coli CFT073
caccagaauacc

SEQ ID NO: 597101 - RNA, 20 nt, Escherichia coli CFT073
caccagaauaccuugcugcu

SEQ ID NO: 597102 - RNA, 17 nt, Escherichia coli CFT073
caccagacgcaacagaa

SEQ ID NO: 597103 - RNA, 14 nt, Escherichia coli CFT073
caccagauccagca

SEQ ID NO: 597104 - RNA, 16 nt, Escherichia coli CFT073
caccaccuggcggcgu

SEQ ID NO: 597105 - RNA, 23 nt, Escherichia coli CFT073
caccacggccagguuaaccagca

SEQ ID NO: 597106 - RNA, 18 nt, Escherichia coli CFT073
caccaccugauugcugcu

SEQ ID NO: 597107 - RNA, 14 nt, Escherichia coli CFT073
caccacauucugca

SEQ ID NO: 597108 - RNA, 14 nt, Escherichia coli CFT073
caccacaucgccga

SEQ ID NO: 597109 - RNA, 14 nt, Escherichia coli CFT073
cacacucugccagc

SEQ ID NO: 597110 - RNA, 16 nt, Escherichia coli CFT073
cacacuaccaaaacgg

SEQ ID NO: 597111 - RNA, 13 nt, Escherichia coli CFT073
cacacuaccgccg

SEQ ID NO: 597112 - RNA, 23 nt, Escherichia coli CFT073
caccgaaaaauaguuacuaucuu

SEQ ID NO: 597113 - RNA, 14 nt, Escherichia coli CFT073
caccgaaacuugcg

SEQ ID NO: 597114 - RNA, 22 nt, Escherichia coli CFT073
caccgaaagcacuguucgccgc

SEQ ID NO: 597115 - RNA, 21 nt, Escherichia coli CFT073
cacccgucguugcaaucagcg

SEQ ID NO: 597116 - RNA, 18 nt, Escherichia coli CFT073
cacccgcugcaacacuuc

SEQ ID NO: 597117 - RNA, 13 nt, Escherichia coli CFT073
cacccgcugcgaa

SEQ ID NO: 597118 - RNA, 16 nt, Escherichia coli CFT073
caccgacgggccugca

SEQ ID NO: 597119 - RNA, 20 nt, Escherichia coli CFT073
caccgacaucuuucugcgca

SEQ ID NO: 597120 - RNA, 14 nt, Escherichia coli CFT073
caccgaaguuaugc

SEQ ID NO: 597121 - RNA, 21 nt, Escherichia coli CFT073
cacccagugcggugccgcgaa

SEQ ID NO: 597122 - RNA, 18 nt, Escherichia coli CFT073
cacccaguacgggcagcg

SEQ ID NO: 597123 - RNA, 12 nt, Escherichia coli CFT073
cacccagcgaag

SEQ ID NO: 597124 - RNA, 14 nt, Escherichia coli CFT073
cacccagaacgccg

SEQ ID NO: 597125 - RNA, 13 nt, Escherichia coli CFT073
cacccacaccgca

SEQ ID NO: 597126 - RNA, 14 nt, Escherichia coli CFT073
cacccaccagcgcc

SEQ ID NO: 597127 - RNA, 19 nt, Escherichia coli CFT073
caccaggaagccuuccgca

SEQ ID NO: 597128 - RNA, 17 nt, Escherichia coli CFT073
caccaggaacgcgccaa

SEQ ID NO: 597129 - RNA, 19 nt, Escherichia coli CFT073
caccaggaacgcgccaaga

SEQ ID NO: 597130 - RNA, 14 nt, Escherichia coli CFT073
auaugaucgaaaau

SEQ ID NO: 597131 - RNA, 15 nt, Escherichia coli CFT073
auaugcaaaucacgc

SEQ ID NO: 597132 - RNA, 23 nt, Escherichia coli CFT073
auaugcaaaucgguuuguaagcg

SEQ ID NO: 597133 - RNA, 14 nt, Escherichia coli CFT073
auaugcauaaaccg

SEQ ID NO: 597134 - RNA, 20 nt, Escherichia coli CFT073
auaugccaggcuucaucggc

SEQ ID NO: 597135 - RNA, 21 nt, Escherichia coli CFT073
auaugccaugcgauggcggca

SEQ ID NO: 597136 - RNA, 16 nt, Escherichia coli CFT073
auaugccggcaucaaa

SEQ ID NO: 597137 - RNA, 16 nt, Escherichia coli CFT073
auauggacuuuuacug

SEQ ID NO: 597138 - RNA, 20 nt, Escherichia coli CFT073
auaugugaucgaauauauca

SEQ ID NO: 597139 - RNA, 21 nt, Escherichia coli CFT073
auauguuguguaggccugaga

SEQ ID NO: 597140 - RNA, 16 nt, Escherichia coli CFT073
auauuaagcggcacca

SEQ ID NO: 597141 - RNA, 17 nt, Escherichia coli CFT073
auauuacgugccgcguu

SEQ ID NO: 597142 - RNA, 15 nt, Escherichia coli CFT073
auauuacugacgccg

SEQ ID NO: 597143 - RNA, 19 nt, Escherichia coli CFT073
auauuaguggcaaccgcaa

SEQ ID NO: 597144 - RNA, 17 nt, Escherichia coli CFT073
auauuuaccggaucugc

SEQ ID NO: 597145 - RNA, 17 nt, Escherichia coli CFT073
auauuuauucaucagcg

SEQ ID NO: 597146 - RNA, 18 nt, Escherichia coli CFT073
auauuuauucaucagcgu

SEQ ID NO: 597147 - RNA, 12 nt, Escherichia coli CFT073
auauuucgucgc

SEQ ID NO: 597148 - RNA, 12 nt, Escherichia coli CFT073
auagccugaugu

SEQ ID NO: 597149 - RNA, 16 nt, Escherichia coli CFT073
auagccacucaccgcc

SEQ ID NO: 597150 - RNA, 15 nt, Escherichia coli CFT073
auagccagcaacauu

SEQ ID NO: 597151 - RNA, 12 nt, Escherichia coli CFT073
auagccagccuc

SEQ ID NO: 597152 - RNA, 13 nt, Escherichia coli CFT073
auagccaggcgga

SEQ ID NO: 597153 - RNA, 19 nt, Escherichia coli CFT073
auagccgcagcuaucagcg

SEQ ID NO: 597154 - RNA, 20 nt, Escherichia coli CFT073
auagccagguuuaccagcag

SEQ ID NO: 597155 - RNA, 22 nt, Escherichia coli CFT073
auaucacuuuuauauaaugaaa

SEQ ID NO: 597156 - RNA, 18 nt, Escherichia coli CFT073
auaucaggcaaacagaau

SEQ ID NO: 597157 - RNA, 21 nt, Escherichia coli CFT073
auaucaguuauugacgccgua

SEQ ID NO: 597158 - RNA, 12 nt, Escherichia coli CFT073
auaucaccagua

SEQ ID NO: 597159 - RNA, 19 nt, Escherichia coli CFT073
auagcgcaccaaccacugc

SEQ ID NO: 597160 - RNA, 15 nt, Escherichia coli CFT073
auagcgcauugcggc

SEQ ID NO: 597161 - RNA, 23 nt, Escherichia coli CFT073
auaucaacccgagcgccagcgaa

SEQ ID NO: 597162 - RNA, 17 nt, Escherichia coli CFT073
auauccagcgccugagc

SEQ ID NO: 597163 - RNA, 20 nt, Escherichia coli CFT073
auaucccaccagcgccgccc

SEQ ID NO: 597164 - RNA, 20 nt, Escherichia coli CFT073
auaucccagguuuaucaugc

SEQ ID NO: 597165 - RNA, 17 nt, Escherichia coli CFT073
auaucccgccagcacca

SEQ ID NO: 597166 - RNA, 14 nt, Escherichia coli CFT073
auauccacuggggu

SEQ ID NO: 597167 - RNA, 13 nt, Escherichia coli CFT073
auauccagaccgc

SEQ ID NO: 597168 - RNA, 14 nt, Escherichia coli CFT073
aucaaguauaugau

SEQ ID NO: 597169 - RNA, 19 nt, Escherichia coli CFT073
aucaagguugcacaaccaa

SEQ ID NO: 597170 - RNA, 13 nt, Escherichia coli CFT073
aucaaguaaccuu

SEQ ID NO: 597171 - RNA, 17 nt, Escherichia coli CFT073
aucaauaacacugagcg

SEQ ID NO: 597172 - RNA, 21 nt, Escherichia coli CFT073
aucaaggcugauguugauaaa

SEQ ID NO: 597173 - RNA, 23 nt, Escherichia coli CFT073
aucaacugcgcuauaucgcugau

SEQ ID NO: 597174 - RNA, 19 nt, Escherichia coli CFT073
aucaagaaaaauacugcug

SEQ ID NO: 597175 - RNA, 15 nt, Escherichia coli CFT073
aucaagcaccgccau

SEQ ID NO: 597176 - RNA, 19 nt, Escherichia coli CFT073
aucaacggcacguaggcga

SEQ ID NO: 597177 - RNA, 12 nt, Escherichia coli CFT073
aucaacgccuga

SEQ ID NO: 597178 - RNA, 20 nt, Escherichia coli CFT073
aucaacgcuauuugcugaau

SEQ ID NO: 597179 - RNA, 14 nt, Escherichia coli CFT073
aucacacagcgguu

SEQ ID NO: 597180 - RNA, 18 nt, Escherichia coli CFT073
aucacaaaauuuauccag

SEQ ID NO: 597181 - RNA, 23 nt, Escherichia coli CFT073
aucaauugcguucugucgauaaa

SEQ ID NO: 597182 - RNA, 17 nt, Escherichia coli CFT073
aucaauuugcuucuggc

SEQ ID NO: 597183 - RNA, 19 nt, Escherichia coli CFT073
aucaauuugcuucuggcug

SEQ ID NO: 597184 - RNA, 22 nt, Escherichia coli CFT073
aucaaugugcugagaacaagau

SEQ ID NO: 597185 - RNA, 14 nt, Escherichia coli CFT073
aucaauuaauccuu

SEQ ID NO: 597186 - RNA, 22 nt, Escherichia coli CFT073
aucaauuaauccuuucgaaaaa

SEQ ID NO: 597187 - RNA, 13 nt, Escherichia coli CFT073
aucaauuaaugcc

SEQ ID NO: 597188 - RNA, 19 nt, Escherichia coli CFT073
aucaauuacaccaucacgc

SEQ ID NO: 597189 - RNA, 12 nt, Escherichia coli CFT073
aucaaugccagg

SEQ ID NO: 597190 - RNA, 22 nt, Escherichia coli CFT073
aucaaugccaggaccacuggcg

SEQ ID NO: 597191 - RNA, 12 nt, Escherichia coli CFT073
aucaauaaucac

SEQ ID NO: 597192 - RNA, 14 nt, Escherichia coli CFT073
aucaauaaucucuu

SEQ ID NO: 597193 - RNA, 17 nt, Escherichia coli CFT073
aucaauaccauuaucau

SEQ ID NO: 597194 - RNA, 17 nt, Escherichia coli CFT073
aucaaucagcggaaaug

SEQ ID NO: 597195 - RNA, 18 nt, Escherichia coli CFT073
aucaauccggcaaucaac

SEQ ID NO: 597196 - RNA, 22 nt, Escherichia coli CFT073
aucaaucgcagccacguuaaua

SEQ ID NO: 597197 - RNA, 13 nt, Escherichia coli CFT073
aucaaauccccac

SEQ ID NO: 597198 - RNA, 22 nt, Escherichia coli CFT073
aucaaauaaccgguauugcucc

SEQ ID NO: 597199 - RNA, 16 nt, Escherichia coli CFT073
aucaaauggcuggcgu

SEQ ID NO: 597200 - RNA, 17 nt, Escherichia coli CFT073
aucaaauuugccagcga

SEQ ID NO: 597201 - RNA, 16 nt, Escherichia coli CFT073
aucaacgcacuggcgc

SEQ ID NO: 597202 - RNA, 18 nt, Escherichia coli CFT073
aucaacaucacaccauau

SEQ ID NO: 597203 - RNA, 21 nt, Escherichia coli CFT073
aucaacccgcgcgcuaacgga

SEQ ID NO: 597204 - RNA, 14 nt, Escherichia coli CFT073
aucaaacagaaaaa

SEQ ID NO: 597205 - RNA, 13 nt, Escherichia coli CFT073
aucaaacaggcug

SEQ ID NO: 597206 - RNA, 17 nt, Escherichia coli CFT073
aucaaacgguugauaaa

SEQ ID NO: 597207 - RNA, 21 nt, Escherichia coli CFT073
aucaaaguuaauagucaagcc

SEQ ID NO: 597208 - RNA, 12 nt, Escherichia coli CFT073
aucaaaaacucu

SEQ ID NO: 597209 - RNA, 19 nt, Escherichia coli CFT073
auauuuugcgacccguuua

SEQ ID NO: 597210 - RNA, 12 nt, Escherichia coli CFT073
auauuuucgcca

SEQ ID NO: 597211 - RNA, 16 nt, Escherichia coli CFT073
aucacuaccagcgcca

SEQ ID NO: 597212 - RNA, 23 nt, Escherichia coli CFT073
aucacugaaauuguaggccugau

SEQ ID NO: 597213 - RNA, 16 nt, Escherichia coli CFT073
aucacugacaucacgc

SEQ ID NO: 597214 - RNA, 19 nt, Escherichia coli CFT073
aucacugccaccaggaacg

SEQ ID NO: 597215 - RNA, 14 nt, Escherichia coli CFT073
aucacuggcgucau

SEQ ID NO: 597216 - RNA, 19 nt, Escherichia coli CFT073
aucacuuacgauuuuaaua

SEQ ID NO: 597217 - RNA, 14 nt, Escherichia coli CFT073
aucacuucaucgcc

SEQ ID NO: 597218 - RNA, 16 nt, Escherichia coli CFT073
aucacuucaucgccgc

SEQ ID NO: 597219 - RNA, 22 nt, Escherichia coli CFT073
aucagaaaugccaguaacucau

SEQ ID NO: 597220 - RNA, 14 nt, Escherichia coli CFT073
aucagaaacgcgac

SEQ ID NO: 597221 - RNA, 17 nt, Escherichia coli CFT073
aucacuuuuuccggugc

SEQ ID NO: 597222 - RNA, 23 nt, Escherichia coli CFT073
aucagauggcggcuggcgcaaua

SEQ ID NO: 597223 - RNA, 16 nt, Escherichia coli CFT073
aucagauuggcuucac

SEQ ID NO: 597224 - RNA, 13 nt, Escherichia coli CFT073
aucagcaacgccg

SEQ ID NO: 597225 - RNA, 15 nt, Escherichia coli CFT073
aucagcaauuucucc

SEQ ID NO: 597226 - RNA, 15 nt, Escherichia coli CFT073
aucagaaucgcgccc

SEQ ID NO: 597227 - RNA, 14 nt, Escherichia coli CFT073
aucagacgcaggcg

SEQ ID NO: 597228 - RNA, 22 nt, Escherichia coli CFT073
aucagacuaagcugcgggaaau

SEQ ID NO: 597229 - RNA, 16 nt, Escherichia coli CFT073
aucagauaaucgccau

SEQ ID NO: 597230 - RNA, 16 nt, Escherichia coli CFT073
aucagauccgcacccg

SEQ ID NO: 597231 - RNA, 14 nt, Escherichia coli CFT073
aucagaucgcgacc

SEQ ID NO: 597232 - RNA, 18 nt, Escherichia coli CFT073
aucagcauaaucaccagu

SEQ ID NO: 597233 - RNA, 17 nt, Escherichia coli CFT073
aucagcagcguucccag

SEQ ID NO: 597234 - RNA, 19 nt, Escherichia coli CFT073
aucagcacgcggaagaugg

SEQ ID NO: 597235 - RNA, 20 nt, Escherichia coli CFT073
aucagcgcauuuaccaggcg

SEQ ID NO: 597236 - RNA, 15 nt, Escherichia coli CFT073
aucagcgccaccaca

SEQ ID NO: 597237 - RNA, 16 nt, Escherichia coli CFT073
aucagcgaagcgcauc

SEQ ID NO: 597238 - RNA, 19 nt, Escherichia coli CFT073
aucagcgaagcgcaucagg

SEQ ID NO: 597239 - RNA, 20 nt, Escherichia coli CFT073
aucagcgaagcgcaucaggc

SEQ ID NO: 597240 - RNA, 24 nt, Escherichia coli CFT073
aucagcgaagcgcaucaggcaacg

SEQ ID NO: 597241 - RNA, 19 nt, Escherichia coli CFT073
aucagccguuucaccacga

SEQ ID NO: 597242 - RNA, 21 nt, Escherichia coli CFT073
aucagccacaguuuuccgcca

SEQ ID NO: 597243 - RNA, 12 nt, Escherichia coli CFT073
aucagccacuuc

SEQ ID NO: 597244 - RNA, 22 nt, Escherichia coli CFT073
aucagccauaauaaccucaugg

SEQ ID NO: 597245 - RNA, 14 nt, Escherichia coli CFT073
aucagcccaaccac

SEQ ID NO: 597246 - RNA, 17 nt, Escherichia coli CFT073
aucaccaauaccagcau

SEQ ID NO: 597247 - RNA, 19 nt, Escherichia coli CFT073
aucaccaauaccagcauca

SEQ ID NO: 597248 - RNA, 16 nt, Escherichia coli CFT073
aucacaucccagcaga

SEQ ID NO: 597249 - RNA, 21 nt, Escherichia coli CFT073
aucacaggucgcaaacggcga

SEQ ID NO: 597250 - RNA, 19 nt, Escherichia coli CFT073
aucacaucgcuaccgcgca

SEQ ID NO: 597251 - RNA, 19 nt, Escherichia coli CFT073
aucacaucguagacauaac

SEQ ID NO: 597252 - RNA, 23 nt, Escherichia coli CFT073
aucacaugcuggaaccacagcgc

SEQ ID NO: 597253 - RNA, 12 nt, Escherichia coli CFT073
aucaccacauac

SEQ ID NO: 597254 - RNA, 24 nt, Escherichia coli CFT073
aucacaucaaauccccacaggcga

SEQ ID NO: 597255 - RNA, 14 nt, Escherichia coli CFT073
aucacaucaccaua

SEQ ID NO: 597256 - RNA, 16 nt, Escherichia coli CFT073
aucacacggccaucac

SEQ ID NO: 597257 - RNA, 19 nt, Escherichia coli CFT073
aucacacggccaucacgga

SEQ ID NO: 597258 - RNA, 11 nt, Escherichia coli CFT073
aucaccagcaa

SEQ ID NO: 597259 - RNA, 12 nt, Escherichia coli CFT073
aucaccaguacc

SEQ ID NO: 597260 - RNA, 18 nt, Escherichia coli CFT073
aucaccaguccaucggca

SEQ ID NO: 597261 - RNA, 20 nt, Escherichia coli CFT073
aucaccauauucagcagcag

SEQ ID NO: 597262 - RNA, 16 nt, Escherichia coli CFT073
aucacccgauacucca

SEQ ID NO: 597263 - RNA, 22 nt, Escherichia coli CFT073
aucaccgacaaacagcgagaac

SEQ ID NO: 597264 - RNA, 20 nt, Escherichia coli CFT073
aucaccgccacuaucgccau

SEQ ID NO: 597265 - RNA, 21 nt, Escherichia coli CFT073
aucacguaaauguggcggaau

SEQ ID NO: 597266 - RNA, 23 nt, Escherichia coli CFT073
aucacgucgagauugugcucaau

SEQ ID NO: 597267 - RNA, 21 nt, Escherichia coli CFT073
aucacgggcgcggaaagcacc

SEQ ID NO: 597268 - RNA, 17 nt, Escherichia coli CFT073
aucacggcaaacugcgc

SEQ ID NO: 597269 - RNA, 21 nt, Escherichia coli CFT073
aucacgcaacauuccggcgcu

SEQ ID NO: 597270 - RNA, 18 nt, Escherichia coli CFT073
aucacgcacucgacgcag

SEQ ID NO: 597271 - RNA, 14 nt, Escherichia coli CFT073
aucacgaauuccgc

SEQ ID NO: 597272 - RNA, 17 nt, Escherichia coli CFT073
aucaccggaggccugau

SEQ ID NO: 597273 - RNA, 20 nt, Escherichia coli CFT073
aucaccguaacgaacacgaa

SEQ ID NO: 597274 - RNA, 18 nt, Escherichia coli CFT073
aucaccucuguucaggug

SEQ ID NO: 597275 - RNA, 14 nt, Escherichia coli CFT073
aucaccugacagca

SEQ ID NO: 597276 - RNA, 20 nt, Escherichia coli CFT073
aucaccugauugaccgccag

SEQ ID NO: 597277 - RNA, 16 nt, Escherichia coli CFT073
auagcaaugccaucac

SEQ ID NO: 597278 - RNA, 23 nt, Escherichia coli CFT073
auacuucagcgauggcgucauca

SEQ ID NO: 597279 - RNA, 23 nt, Escherichia coli CFT073
auacuguuuaccggugccagcaa

SEQ ID NO: 597280 - RNA, 18 nt, Escherichia coli CFT073
auacugcaacuucacggc

SEQ ID NO: 597281 - RNA, 15 nt, Escherichia coli CFT073
auacugcaucagcgc

SEQ ID NO: 597282 - RNA, 15 nt, Escherichia coli CFT073
auacucuuucccggc

SEQ ID NO: 597283 - RNA, 19 nt, Escherichia coli CFT073
auacucgccgaaccaaacg

SEQ ID NO: 597284 - RNA, 21 nt, Escherichia coli CFT073
auacaucgcgcuuaucgccag

SEQ ID NO: 597285 - RNA, 18 nt, Escherichia coli CFT073
auacauagcgccucuuua

SEQ ID NO: 597286 - RNA, 18 nt, Escherichia coli CFT073
auacagcguuuugccauc

SEQ ID NO: 597287 - RNA, 17 nt, Escherichia coli CFT073
auacaggcuacucccag

SEQ ID NO: 597288 - RNA, 20 nt, Escherichia coli CFT073
auacagguucguaagcgaua

SEQ ID NO: 597289 - RNA, 13 nt, Escherichia coli CFT073
auacauaauaauc

SEQ ID NO: 597290 - RNA, 14 nt, Escherichia coli CFT073
auaccgacgaucgg

SEQ ID NO: 597291 - RNA, 22 nt, Escherichia coli CFT073
auaccgagcagccacugcggca

SEQ ID NO: 597292 - RNA, 18 nt, Escherichia coli CFT073
auacccggcacacaaaua

SEQ ID NO: 597293 - RNA, 14 nt, Escherichia coli CFT073
auacccaaaaaaua

SEQ ID NO: 597294 - RNA, 16 nt, Escherichia coli CFT073
auacccagacaucggu

SEQ ID NO: 597295 - RNA, 23 nt, Escherichia coli CFT073
auacccagcaaugccaggcucca

SEQ ID NO: 597296 - RNA, 20 nt, Escherichia coli CFT073
auacucauuguuaucagcaa

SEQ ID NO: 597297 - RNA, 22 nt, Escherichia coli CFT073
auacguugcaaauauuccauca

SEQ ID NO: 597298 - RNA, 19 nt, Escherichia coli CFT073
auacgucccggggaagcgu

SEQ ID NO: 597299 - RNA, 21 nt, Escherichia coli CFT073
auacgugaucgcaauucuuca

SEQ ID NO: 597300 - RNA, 20 nt, Escherichia coli CFT073
auaccgcccacuaccagcug

SEQ ID NO: 597301 - RNA, 13 nt, Escherichia coli CFT073
auaaugaugccga

SEQ ID NO: 597302 - RNA, 20 nt, Escherichia coli CFT073
auaaugcccagcguuccggc

SEQ ID NO: 597303 - RNA, 17 nt, Escherichia coli CFT073
auaaugccgcaacgcca

SEQ ID NO: 597304 - RNA, 19 nt, Escherichia coli CFT073
auaaugccgcaacgccaua

SEQ ID NO: 597305 - RNA, 14 nt, Escherichia coli CFT073
auaaugccgguauc

SEQ ID NO: 597306 - RNA, 20 nt, Escherichia coli CFT073
auaaucguucccgcggcgca

SEQ ID NO: 597307 - RNA, 12 nt, Escherichia coli CFT073
auaaucugaaaa

SEQ ID NO: 597308 - RNA, 21 nt, Escherichia coli CFT073
auaaugaacgccaccccacac

SEQ ID NO: 597309 - RNA, 19 nt, Escherichia coli CFT073
auaaugacuaaugccgcca

SEQ ID NO: 597310 - RNA, 17 nt, Escherichia coli CFT073
auacaggaaaccggcga

SEQ ID NO: 597311 - RNA, 17 nt, Escherichia coli CFT073
auaauuuccaucgacuc

SEQ ID NO: 597312 - RNA, 17 nt, Escherichia coli CFT073
auaauuccucccguuau

SEQ ID NO: 597313 - RNA, 13 nt, Escherichia coli CFT073
auaauugccguuu

SEQ ID NO: 597314 - RNA, 12 nt, Escherichia coli CFT073
auaaaugccaaa

SEQ ID NO: 597315 - RNA, 23 nt, Escherichia coli CFT073
auaaaucggggucugauuuacaa

SEQ ID NO: 597316 - RNA, 21 nt, Escherichia coli CFT073
auaaauuaccaccagcgacag

SEQ ID NO: 597317 - RNA, 19 nt, Escherichia coli CFT073
auaacacccauaaaaaaac

SEQ ID NO: 597318 - RNA, 13 nt, Escherichia coli CFT073
auaagcaggccau

SEQ ID NO: 597319 - RNA, 20 nt, Escherichia coli CFT073
auaaggcauuuacgccgcau

SEQ ID NO: 597320 - RNA, 15 nt, Escherichia coli CFT073
auaaggagcaauaau

SEQ ID NO: 597321 - RNA, 20 nt, Escherichia coli CFT073
auaaggcguuaacgccgcau

SEQ ID NO: 597322 - RNA, 20 nt, Escherichia coli CFT073
auaaggcggcucuggcggcg

SEQ ID NO: 597323 - RNA, 20 nt, Escherichia coli CFT073
auaaggcgguuacgccgcau

SEQ ID NO: 597324 - RNA, 23 nt, Escherichia coli CFT073
auaaggcgcgucaagcgucgcau

SEQ ID NO: 597325 - RNA, 20 nt, Escherichia coli CFT073
auaaggcgcucgcgccgcau

SEQ ID NO: 597326 - RNA, 19 nt, Escherichia coli CFT073
auaaggcguucacgccgca

SEQ ID NO: 597327 - RNA, 20 nt, Escherichia coli CFT073
auaaggcguucacgccgcau

SEQ ID NO: 597328 - RNA, 20 nt, Escherichia coli CFT073
auaaggcguucgcgccgcau

SEQ ID NO: 597329 - RNA, 20 nt, Escherichia coli CFT073
auaaggcguuuaugccgcau

SEQ ID NO: 597330 - RNA, 13 nt, Escherichia coli CFT073
auaaucaccauca

SEQ ID NO: 597331 - RNA, 20 nt, Escherichia coli CFT073
auaaggcguuugcgucgcau

SEQ ID NO: 597332 - RNA, 20 nt, Escherichia coli CFT073
auaaggcguuuuagccgcau

SEQ ID NO: 597333 - RNA, 18 nt, Escherichia coli CFT073
auaaucgggaauacagaa

SEQ ID NO: 597334 - RNA, 15 nt, Escherichia coli CFT073
auaauccuggcagca

SEQ ID NO: 597335 - RNA, 12 nt, Escherichia coli CFT073
auaaucgcuuua

SEQ ID NO: 597336 - RNA, 17 nt, Escherichia coli CFT073
auaauccacggcguggu

SEQ ID NO: 597337 - RNA, 22 nt, Escherichia coli CFT073
auaauccaucccgcucuguaag

SEQ ID NO: 597338 - RNA, 20 nt, Escherichia coli CFT073
auaauccggguucggauaaa

SEQ ID NO: 597339 - RNA, 17 nt, Escherichia coli CFT073
aguuuacgucgccaguu

SEQ ID NO: 597340 - RNA, 18 nt, Escherichia coli CFT073
aguuuaauccguauuccu

SEQ ID NO: 597341 - RNA, 15 nt, Escherichia coli CFT073
aguuuacccagugaa

SEQ ID NO: 597342 - RNA, 14 nt, Escherichia coli CFT073
aguuucaccagcag

SEQ ID NO: 597343 - RNA, 20 nt, Escherichia coli CFT073
aguuucagccccaucagcgc

SEQ ID NO: 597344 - RNA, 23 nt, Escherichia coli CFT073
aguuucagccccaucagcgccau

SEQ ID NO: 597345 - RNA, 12 nt, Escherichia coli CFT073
aguuuucauaua

SEQ ID NO: 597346 - RNA, 18 nt, Escherichia coli CFT073
aguuguaugucauaaaaa

SEQ ID NO: 597347 - RNA, 21 nt, Escherichia coli CFT073
aguuguccauugcgucgcuga

SEQ ID NO: 597348 - RNA, 21 nt, Escherichia coli CFT073
aguugcccgcaucugcgguug

SEQ ID NO: 597349 - RNA, 15 nt, Escherichia coli CFT073
aguugccgagaaaau

SEQ ID NO: 597350 - RNA, 20 nt, Escherichia coli CFT073
aguuuuuguccccgcaucag

SEQ ID NO: 597351 - RNA, 20 nt, Escherichia coli CFT073
aguuuucgccggaucgaccg

SEQ ID NO: 597352 - RNA, 15 nt, Escherichia coli CFT073
aguuuuuccgccgcc

SEQ ID NO: 597353 - RNA, 21 nt, Escherichia coli CFT073
auaaaaacgauaaauaacgua

SEQ ID NO: 597354 - RNA, 14 nt, Escherichia coli CFT073
auaaaacgcgcagc

SEQ ID NO: 597355 - RNA, 22 nt, Escherichia coli CFT073
auaaaacgggauagcguaguga

SEQ ID NO: 597356 - RNA, 22 nt, Escherichia coli CFT073
auaaaagcuguacaucgcgcca

SEQ ID NO: 597357 - RNA, 13 nt, Escherichia coli CFT073
auaaagguaccga

SEQ ID NO: 597358 - RNA, 15 nt, Escherichia coli CFT073
auaaauaaaauaacc

SEQ ID NO: 597359 - RNA, 14 nt, Escherichia coli CFT073
auaaagucugcacc

SEQ ID NO: 597360 - RNA, 12 nt, Escherichia coli CFT073
auaaaguaaaac

SEQ ID NO: 597361 - RNA, 23 nt, Escherichia coli CFT073
auaaagaagugcucuuugccguc

SEQ ID NO: 597362 - RNA, 21 nt, Escherichia coli CFT073
auaaagaugaaaacgccacca

SEQ ID NO: 597363 - RNA, 23 nt, Escherichia coli CFT073
auaaagaugaaaacgccaccaga

SEQ ID NO: 597364 - RNA, 13 nt, Escherichia coli CFT073
auaaauaacaucu

SEQ ID NO: 597365 - RNA, 20 nt, Escherichia coli CFT073
auaaauaaucgaucacguaa

SEQ ID NO: 597366 - RNA, 20 nt, Escherichia coli CFT073
auaaaguuggguagcugcau

SEQ ID NO: 597367 - RNA, 19 nt, Escherichia coli CFT073
auaaaucaaagucagauca

SEQ ID NO: 597368 - RNA, 14 nt, Escherichia coli CFT073
auaaacaccagcaa

SEQ ID NO: 597369 - RNA, 14 nt, Escherichia coli CFT073
auaaacaccagcag

SEQ ID NO: 597370 - RNA, 15 nt, Escherichia coli CFT073
auaaacaccagcagc

SEQ ID NO: 597371 - RNA, 18 nt, Escherichia coli CFT073
auaaacaaccccaucgcg

SEQ ID NO: 597372 - RNA, 19 nt, Escherichia coli CFT073
auaaaaucaauaugcauaa

SEQ ID NO: 597373 - RNA, 19 nt, Escherichia coli CFT073
auaaaccgcaucauguaaa

SEQ ID NO: 597374 - RNA, 14 nt, Escherichia coli CFT073
auaaaccguggcaa

SEQ ID NO: 597375 - RNA, 18 nt, Escherichia coli CFT073
auaaacgccgucgccuuc

SEQ ID NO: 597376 - RNA, 16 nt, Escherichia coli CFT073
auaaacgcucggcaac

SEQ ID NO: 597377 - RNA, 22 nt, Escherichia coli CFT073
auaaacgucuugcugugcagca

SEQ ID NO: 597378 - RNA, 17 nt, Escherichia coli CFT073
aguucauauugcggcau

SEQ ID NO: 597379 - RNA, 13 nt, Escherichia coli CFT073
aguucauguauuu

SEQ ID NO: 597380 - RNA, 23 nt, Escherichia coli CFT073
aguucauuggucuccugaccguu

SEQ ID NO: 597381 - RNA, 22 nt, Escherichia coli CFT073
aguuccacaccuacgcccgcca

SEQ ID NO: 597382 - RNA, 22 nt, Escherichia coli CFT073
aguuccagcaucuguucuuuca

SEQ ID NO: 597383 - RNA, 13 nt, Escherichia coli CFT073
aguguaaaccaaa

SEQ ID NO: 597384 - RNA, 14 nt, Escherichia coli CFT073
aguguaaaugcaaa

SEQ ID NO: 597385 - RNA, 22 nt, Escherichia coli CFT073
aguggucaaauuucuucagcca

SEQ ID NO: 597386 - RNA, 21 nt, Escherichia coli CFT073
aguucgucuuuggguucaccg

SEQ ID NO: 597387 - RNA, 19 nt, Escherichia coli CFT073
aguucguccccaccaguga

SEQ ID NO: 597388 - RNA, 15 nt, Escherichia coli CFT073
aguugcaguccgcua

SEQ ID NO: 597389 - RNA, 16 nt, Escherichia coli CFT073
aguugauacucauugu

SEQ ID NO: 597390 - RNA, 17 nt, Escherichia coli CFT073
aguugauugccagcagg

SEQ ID NO: 597391 - RNA, 20 nt, Escherichia coli CFT073
aguuccugcauaucggcaua

SEQ ID NO: 597392 - RNA, 21 nt, Escherichia coli CFT073
aguuccgcaaagcccaucacc

SEQ ID NO: 597393 - RNA, 22 nt, Escherichia coli CFT073
aguuccaguuuauaucuuucuc

SEQ ID NO: 597394 - RNA, 18 nt, Escherichia coli CFT073
aguucccagggcuuucgc

SEQ ID NO: 597395 - RNA, 20 nt, Escherichia coli CFT073
aguuccuuaacuucaucggc

SEQ ID NO: 597396 - RNA, 15 nt, Escherichia coli CFT073
aggcgguuacgccgc

SEQ ID NO: 597397 - RNA, 18 nt, Escherichia coli CFT073
aggcggucauaaaaucaa

SEQ ID NO: 597398 - RNA, 15 nt, Escherichia coli CFT073
aggcguucacgccgc

SEQ ID NO: 597399 - RNA, 20 nt, Escherichia coli CFT073
aggcguucacgccgcauccg

SEQ ID NO: 597400 - RNA, 17 nt, Escherichia coli CFT073
aggcguuaacagcgcau

SEQ ID NO: 597401 - RNA, 16 nt, Escherichia coli CFT073
aggcguucgcgccgca

SEQ ID NO: 597402 - RNA, 18 nt, Escherichia coli CFT073
aggcguuuacgccgcauc

SEQ ID NO: 597403 - RNA, 18 nt, Escherichia coli CFT073
aggcguuuuagccgcauc

SEQ ID NO: 597404 - RNA, 12 nt, Escherichia coli CFT073
agggacgcgcaa

SEQ ID NO: 597405 - RNA, 21 nt, Escherichia coli CFT073
aggcuuuccgucagcggcagc

SEQ ID NO: 597406 - RNA, 12 nt, Escherichia coli CFT073
aggcugccgacg

SEQ ID NO: 597407 - RNA, 18 nt, Escherichia coli CFT073
aggcugauguugauaaag

SEQ ID NO: 597408 - RNA, 17 nt, Escherichia coli CFT073
aggcugcuugagccagu

SEQ ID NO: 597409 - RNA, 19 nt, Escherichia coli CFT073
aggcugcuugagccaguga

SEQ ID NO: 597410 - RNA, 13 nt, Escherichia coli CFT073
aggcuacgccaga

SEQ ID NO: 597411 - RNA, 13 nt, Escherichia coli CFT073
aggcuagccgcca

SEQ ID NO: 597412 - RNA, 14 nt, Escherichia coli CFT073
aggcuagccgccag

SEQ ID NO: 597413 - RNA, 17 nt, Escherichia coli CFT073
aggcgaucccagcgccu

SEQ ID NO: 597414 - RNA, 21 nt, Escherichia coli CFT073
aggcgauaauuuuucgauaac

SEQ ID NO: 597415 - RNA, 19 nt, Escherichia coli CFT073
aggccuacaauuucaguga

SEQ ID NO: 597416 - RNA, 20 nt, Escherichia coli CFT073
aggccuacauagccccugca

SEQ ID NO: 597417 - RNA, 17 nt, Escherichia coli CFT073
aggccuacaugccauca

SEQ ID NO: 597418 - RNA, 21 nt, Escherichia coli CFT073
aggccuacauuggugccggau

SEQ ID NO: 597419 - RNA, 16 nt, Escherichia coli CFT073
aggccuacuaccagua

SEQ ID NO: 597420 - RNA, 11 nt, Escherichia coli CFT073
aggccggugcu

SEQ ID NO: 597421 - RNA, 23 nt, Escherichia coli CFT073
aggcgcuggcgcauguuggcgcg

SEQ ID NO: 597422 - RNA, 14 nt, Escherichia coli CFT073
aggcgcugauuacc

SEQ ID NO: 597423 - RNA, 18 nt, Escherichia coli CFT073
aggcgcucgcgccgcauc

SEQ ID NO: 597424 - RNA, 20 nt, Escherichia coli CFT073
aggauuugauggucucgccg

SEQ ID NO: 597425 - RNA, 16 nt, Escherichia coli CFT073
aggccaacauccauca

SEQ ID NO: 597426 - RNA, 17 nt, Escherichia coli CFT073
aggccaacauccaucag

SEQ ID NO: 597427 - RNA, 21 nt, Escherichia coli CFT073
aggccaggguaaaaaccaggg

SEQ ID NO: 597428 - RNA, 22 nt, Escherichia coli CFT073
aggccagguuuucuuucaccuc

SEQ ID NO: 597429 - RNA, 14 nt, Escherichia coli CFT073
agcugccagcggua

SEQ ID NO: 597430 - RNA, 13 nt, Escherichia coli CFT073
agcugcagccagu

SEQ ID NO: 597431 - RNA, 16 nt, Escherichia coli CFT073
agcugcagccaguugc

SEQ ID NO: 597432 - RNA, 20 nt, Escherichia coli CFT073
agcugcaaaaguaccauuga

SEQ ID NO: 597433 - RNA, 21 nt, Escherichia coli CFT073
agcugcaacuggcggcggcga

SEQ ID NO: 597434 - RNA, 15 nt, Escherichia coli CFT073
agcugcggauccuga

SEQ ID NO: 597435 - RNA, 20 nt, Escherichia coli CFT073
aggccgcgaaccagaccagc

SEQ ID NO: 597436 - RNA, 13 nt, Escherichia coli CFT073
aggccgcuguuuu

SEQ ID NO: 597437 - RNA, 15 nt, Escherichia coli CFT073
agguucaaccgcagc

SEQ ID NO: 597438 - RNA, 18 nt, Escherichia coli CFT073
agguucagcaaccacaac

SEQ ID NO: 597439 - RNA, 12 nt, Escherichia coli CFT073
agguuaacugug

SEQ ID NO: 597440 - RNA, 17 nt, Escherichia coli CFT073
agguuaugcaaacgcaa

SEQ ID NO: 597441 - RNA, 14 nt, Escherichia coli CFT073
agguguacuggcaa

SEQ ID NO: 597442 - RNA, 15 nt, Escherichia coli CFT073
aggugguguugacga

SEQ ID NO: 597443 - RNA, 19 nt, Escherichia coli CFT073
aggugguuaccgccagcac

SEQ ID NO: 597444 - RNA, 21 nt, Escherichia coli CFT073
agguggcaaaucgacgccacu

SEQ ID NO: 597445 - RNA, 15 nt, Escherichia coli CFT073
agguuguaucaccac

SEQ ID NO: 597446 - RNA, 16 nt, Escherichia coli CFT073
agguugguaucgcaca

SEQ ID NO: 597447 - RNA, 23 nt, Escherichia coli CFT073
aguaaacuucaacgcugcggcgu

SEQ ID NO: 597448 - RNA, 13 nt, Escherichia coli CFT073
aguaaauucaucc

SEQ ID NO: 597449 - RNA, 21 nt, Escherichia coli CFT073
aguaaauuucgcgcuccggca

SEQ ID NO: 597450 - RNA, 18 nt, Escherichia coli CFT073
aguaaccgcauccggcgc

SEQ ID NO: 597451 - RNA, 13 nt, Escherichia coli CFT073
agguuuuucagcu

SEQ ID NO: 597452 - RNA, 17 nt, Escherichia coli CFT073
aguaaaaggcaccauaa

SEQ ID NO: 597453 - RNA, 18 nt, Escherichia coli CFT073
aguaaacaaacaugaauc

SEQ ID NO: 597454 - RNA, 13 nt, Escherichia coli CFT073
aguaaaccacauc

SEQ ID NO: 597455 - RNA, 18 nt, Escherichia coli CFT073
aguaaaccacaucagcga

SEQ ID NO: 597456 - RNA, 14 nt, Escherichia coli CFT073
agguucgaaucccg

SEQ ID NO: 597457 - RNA, 13 nt, Escherichia coli CFT073
agguugaaauaaa

SEQ ID NO: 597458 - RNA, 16 nt, Escherichia coli CFT073
agguugaaauaaaccg

SEQ ID NO: 597459 - RNA, 17 nt, Escherichia coli CFT073
agguugcagaucuuucu

SEQ ID NO: 597460 - RNA, 19 nt, Escherichia coli CFT073
aguaaucgggcaacugcug

SEQ ID NO: 597461 - RNA, 14 nt, Escherichia coli CFT073
aguaaucaaucacc

SEQ ID NO: 597462 - RNA, 13 nt, Escherichia coli CFT073
aguaaucaaugcg

SEQ ID NO: 597463 - RNA, 15 nt, Escherichia coli CFT073
aguaacgccagcggu

SEQ ID NO: 597464 - RNA, 18 nt, Escherichia coli CFT073
aguaacgguugaugccgu

SEQ ID NO: 597465 - RNA, 23 nt, Escherichia coli CFT073
aguaacguuugauuaacgccaga

SEQ ID NO: 597466 - RNA, 21 nt, Escherichia coli CFT073
aguaagccuaaauguagcgaa

SEQ ID NO: 597467 - RNA, 23 nt, Escherichia coli CFT073
aguaagcgacgggcgacaaacgc

SEQ ID NO: 597468 - RNA, 23 nt, Escherichia coli CFT073
aguaaggccugguucaucgcuac

SEQ ID NO: 597469 - RNA, 13 nt, Escherichia coli CFT073
aguaagugccgga

SEQ ID NO: 597470 - RNA, 15 nt, Escherichia coli CFT073
aguaauaaagacggu

SEQ ID NO: 597471 - RNA, 16 nt, Escherichia coli CFT073
aguaccaggcaauaaa

SEQ ID NO: 597472 - RNA, 20 nt, Escherichia coli CFT073
aguaccgugcagcgcaaucg

SEQ ID NO: 597473 - RNA, 16 nt, Escherichia coli CFT073
aguacccaaucagcga

SEQ ID NO: 597474 - RNA, 17 nt, Escherichia coli CFT073
aguaucaaacagaaaaa

SEQ ID NO: 597475 - RNA, 14 nt, Escherichia coli CFT073
aguauauauucguc

SEQ ID NO: 597476 - RNA, 22 nt, Escherichia coli CFT073
aguauccgcuauugaccagcgc

SEQ ID NO: 597477 - RNA, 17 nt, Escherichia coli CFT073
agucagcguuauagcgc

SEQ ID NO: 597478 - RNA, 20 nt, Escherichia coli CFT073
agucagugaagccauuaccg

SEQ ID NO: 597479 - RNA, 14 nt, Escherichia coli CFT073
agucaguucacgcg

SEQ ID NO: 597480 - RNA, 19 nt, Escherichia coli CFT073
agucccgcgacaaucgccc

SEQ ID NO: 597481 - RNA, 19 nt, Escherichia coli CFT073
agucccguacccagcaaga

SEQ ID NO: 597482 - RNA, 17 nt, Escherichia coli CFT073
agucccuuucaggucag

SEQ ID NO: 597483 - RNA, 15 nt, Escherichia coli CFT073
aggguaaacaucggu

SEQ ID NO: 597484 - RNA, 19 nt, Escherichia coli CFT073
agggguaaugccagucagu

SEQ ID NO: 597485 - RNA, 15 nt, Escherichia coli CFT073
agggauauuucaccg

SEQ ID NO: 597486 - RNA, 18 nt, Escherichia coli CFT073
agggaguuggaguaaaac

SEQ ID NO: 597487 - RNA, 15 nt, Escherichia coli CFT073
agggcagcaggauca

SEQ ID NO: 597488 - RNA, 15 nt, Escherichia coli CFT073
agggccaaacagcag

SEQ ID NO: 597489 - RNA, 18 nt, Escherichia coli CFT073
agguaccgcaaugcagaa

SEQ ID NO: 597490 - RNA, 18 nt, Escherichia coli CFT073
agguagcgauagaaauca

SEQ ID NO: 597491 - RNA, 12 nt, Escherichia coli CFT073
aggucuuuucuc

SEQ ID NO: 597492 - RNA, 22 nt, Escherichia coli CFT073
aggucuuuucucguuaccagcg

SEQ ID NO: 597493 - RNA, 14 nt, Escherichia coli CFT073
aggugaaaaauaaa

SEQ ID NO: 597494 - RNA, 15 nt, Escherichia coli CFT073
aggucugcaauauca

SEQ ID NO: 597495 - RNA, 14 nt, Escherichia coli CFT073
aggugaagguaagu

SEQ ID NO: 597496 - RNA, 16 nt, Escherichia coli CFT073
aggugcaucggggaau

SEQ ID NO: 597497 - RNA, 17 nt, Escherichia coli CFT073
aggugauucccagcaac

SEQ ID NO: 597498 - RNA, 23 nt, Escherichia coli CFT073
aggugauuugcgccugcuuaaca

SEQ ID NO: 597499 - RNA, 12 nt, Escherichia coli CFT073
aggucgccaguc

SEQ ID NO: 597500 - RNA, 22 nt, Escherichia coli CFT073
aggucgcccccggcagugauca

SEQ ID NO: 597501 - RNA, 20 nt, Escherichia coli CFT073
aggucaggaauagcgaaccg

SEQ ID NO: 597502 - RNA, 24 nt, Escherichia coli CFT073
agaaaaugagcguauagagcagcg

SEQ ID NO: 597503 - RNA, 19 nt, Escherichia coli CFT073
agaaaaucguuggucugca

SEQ ID NO: 597504 - RNA, 12 nt, Escherichia coli CFT073
agaaacaucauc

SEQ ID NO: 597505 - RNA, 14 nt, Escherichia coli CFT073
agaaacccggccac

SEQ ID NO: 597506 - RNA, 15 nt, Escherichia coli CFT073
agaaacgagcguacu

SEQ ID NO: 597507 - RNA, 13 nt, Escherichia coli CFT073
agaaacgccugau

SEQ ID NO: 597508 - RNA, 20 nt, Escherichia coli CFT073
agaaacgcuccaccaccgcg

SEQ ID NO: 597509 - RNA, 16 nt, Escherichia coli CFT073
agaaaggcgggaauaa

SEQ ID NO: 597510 - RNA, 16 nt, Escherichia coli CFT073
agagauaaacgaccac

SEQ ID NO: 597511 - RNA, 15 nt, Escherichia coli CFT073
agagauaacccaacg

SEQ ID NO: 597512 - RNA, 15 nt, Escherichia coli CFT073
agagauaauucagca

SEQ ID NO: 597513 - RNA, 16 nt, Escherichia coli CFT073
agacucauuaaaacgg

SEQ ID NO: 597514 - RNA, 18 nt, Escherichia coli CFT073
agacguuuguaacccacc

SEQ ID NO: 597515 - RNA, 23 nt, Escherichia coli CFT073
agacuacugacgaaggugccgga

SEQ ID NO: 597516 - RNA, 14 nt, Escherichia coli CFT073
agagauguugcugc

SEQ ID NO: 597517 - RNA, 17 nt, Escherichia coli CFT073
agagaucuucauacggc

SEQ ID NO: 597518 - RNA, 12 nt, Escherichia coli CFT073
agagaucaaagu

SEQ ID NO: 597519 - RNA, 20 nt, Escherichia coli CFT073
agagcaaaaaucgacagcag

SEQ ID NO: 597520 - RNA, 15 nt, Escherichia coli CFT073
agagcaaauaaaaca

SEQ ID NO: 597521 - RNA, 17 nt, Escherichia coli CFT073
agagcaaccagcaaugc

SEQ ID NO: 597522 - RNA, 11 nt, Escherichia coli CFT073
agagcagcacg

SEQ ID NO: 597523 - RNA, 12 nt, Escherichia coli CFT073
agagcacgaccu

SEQ ID NO: 597524 - RNA, 21 nt, Escherichia coli CFT073
agagcuugugcaccagcuggc

SEQ ID NO: 597525 - RNA, 17 nt, Escherichia coli CFT073
agagcuguagauauauc

SEQ ID NO: 597526 - RNA, 15 nt, Escherichia coli CFT073
agaggaauuuaucag

SEQ ID NO: 597527 - RNA, 23 nt, Escherichia coli CFT073
agagcugaaaauugcgcucgcgc

SEQ ID NO: 597528 - RNA, 19 nt, Escherichia coli CFT073
agagcguugccgcaggcaa

SEQ ID NO: 597529 - RNA, 14 nt, Escherichia coli CFT073
agaggccgccgcaa

SEQ ID NO: 597530 - RNA, 21 nt, Escherichia coli CFT073
agaggcguuccugcaacggau

SEQ ID NO: 597531 - RNA, 22 nt, Escherichia coli CFT073
agaggcguuuuuaucgcugcgc

SEQ ID NO: 597532 - RNA, 18 nt, Escherichia coli CFT073
agaggaucuggacgccaa

SEQ ID NO: 597533 - RNA, 17 nt, Escherichia coli CFT073
agaguaaacggugauac

SEQ ID NO: 597534 - RNA, 15 nt, Escherichia coli CFT073
agauauccacaacaa

SEQ ID NO: 597535 - RNA, 20 nt, Escherichia coli CFT073
agauaucccgccagcaccag

SEQ ID NO: 597536 - RNA, 14 nt, Escherichia coli CFT073
agagucagcaaugc

SEQ ID NO: 597537 - RNA, 23 nt, Escherichia coli CFT073
agauaugcgcugucauucauuca

SEQ ID NO: 597538 - RNA, 16 nt, Escherichia coli CFT073
agauauuuaacaucau

SEQ ID NO: 597539 - RNA, 14 nt, Escherichia coli CFT073
agaucacgcaucac

SEQ ID NO: 597540 - RNA, 20 nt, Escherichia coli CFT073
agaucgguuuuuuucgaacc

SEQ ID NO: 597541 - RNA, 15 nt, Escherichia coli CFT073
agaucggcaaucgcc

SEQ ID NO: 597542 - RNA, 15 nt, Escherichia coli CFT073
agaucgacaccggua

SEQ ID NO: 597543 - RNA, 12 nt, Escherichia coli CFT073
agaucgccagaa

SEQ ID NO: 597544 - RNA, 16 nt, Escherichia coli CFT073
agaucuuuaucaauca

SEQ ID NO: 597545 - RNA, 15 nt, Escherichia coli CFT073
agaugaaaacgccac

SEQ ID NO: 597546 - RNA, 20 nt, Escherichia coli CFT073
agaucugccuuugccggaug

SEQ ID NO: 597547 - RNA, 16 nt, Escherichia coli CFT073
agaucuucaucaccga

SEQ ID NO: 597548 - RNA, 21 nt, Escherichia coli CFT073
agaugcagcauagaagaaaua

SEQ ID NO: 597549 - RNA, 22 nt, Escherichia coli CFT073
agaugaucaacgaccagaaaga

SEQ ID NO: 597550 - RNA, 21 nt, Escherichia coli CFT073
agaugguaaagcaccugauua

SEQ ID NO: 597551 - RNA, 18 nt, Escherichia coli CFT073
agauggcuucaucccggu

SEQ ID NO: 597552 - RNA, 19 nt, Escherichia coli CFT073
agauggcauacaacgccau

SEQ ID NO: 597553 - RNA, 15 nt, Escherichia coli CFT073
agauggcauccagcg

SEQ ID NO: 597554 - RNA, 14 nt, Escherichia coli CFT073
agauggcggaaaua

SEQ ID NO: 597555 - RNA, 22 nt, Escherichia coli CFT073
agaugcugcucuucacgcccgc

SEQ ID NO: 597556 - RNA, 11 nt, Escherichia coli CFT073
agaugcggcgu

SEQ ID NO: 597557 - RNA, 19 nt, Escherichia coli CFT073
agaugcguuaagcgucgca

SEQ ID NO: 597558 - RNA, 21 nt, Escherichia coli CFT073
agaugcguuaagcgucgcauc

SEQ ID NO: 597559 - RNA, 16 nt, Escherichia coli CFT073
agaugcgacggcacca

SEQ ID NO: 597560 - RNA, 22 nt, Escherichia coli CFT073
agaugcgacguuacaaccacau

SEQ ID NO: 597561 - RNA, 15 nt, Escherichia coli CFT073
agaugcauuaccgga

SEQ ID NO: 597562 - RNA, 22 nt, Escherichia coli CFT073
agcagacuguaaaucugccguc

SEQ ID NO: 597563 - RNA, 18 nt, Escherichia coli CFT073
agcagagaaacgccagca

SEQ ID NO: 597564 - RNA, 20 nt, Escherichia coli CFT073
agcagagagacgaucgccac

SEQ ID NO: 597565 - RNA, 16 nt, Escherichia coli CFT073
agcagagcaaaaaucg

SEQ ID NO: 597566 - RNA, 17 nt, Escherichia coli CFT073
agcagacgcugcaccug

SEQ ID NO: 597567 - RNA, 13 nt, Escherichia coli CFT073
agcagacgccggu

SEQ ID NO: 597568 - RNA, 15 nt, Escherichia coli CFT073
agcagcagcgccagg

SEQ ID NO: 597569 - RNA, 16 nt, Escherichia coli CFT073
agcacuaucaaugaau

SEQ ID NO: 597570 - RNA, 21 nt, Escherichia coli CFT073
agcacuaacaugacaccaagc

SEQ ID NO: 597571 - RNA, 23 nt, Escherichia coli CFT073
agcaccgauugccggaugcgaag

SEQ ID NO: 597572 - RNA, 15 nt, Escherichia coli CFT073
agcacggcgcagacg

SEQ ID NO: 597573 - RNA, 20 nt, Escherichia coli CFT073
agcacggcgcgacucagcgg

SEQ ID NO: 597574 - RNA, 16 nt, Escherichia coli CFT073
agauucacuucgcucu

SEQ ID NO: 597575 - RNA, 20 nt, Escherichia coli CFT073
agauucauccaguuccaguu

SEQ ID NO: 597576 - RNA, 18 nt, Escherichia coli CFT073
agcaaauaauuccccacc

SEQ ID NO: 597577 - RNA, 22 nt, Escherichia coli CFT073
agcaacaauuuucccuucccgc

SEQ ID NO: 597578 - RNA, 16 nt, Escherichia coli CFT073
agcaaauaaaacugcg

SEQ ID NO: 597579 - RNA, 19 nt, Escherichia coli CFT073
agcaacaacuucagguuca

SEQ ID NO: 597580 - RNA, 17 nt, Escherichia coli CFT073
agcaacaaacguggugc

SEQ ID NO: 597581 - RNA, 23 nt, Escherichia coli CFT073
agauucguauuuaaaaccggugu

SEQ ID NO: 597582 - RNA, 15 nt, Escherichia coli CFT073
agauguaauaacgcu

SEQ ID NO: 597583 - RNA, 16 nt, Escherichia coli CFT073
agauguuccgccauuu

SEQ ID NO: 597584 - RNA, 18 nt, Escherichia coli CFT073
agcaacgauaacaaucac

SEQ ID NO: 597585 - RNA, 15 nt, Escherichia coli CFT073
agcaacgccuaaacu

SEQ ID NO: 597586 - RNA, 14 nt, Escherichia coli CFT073
agcaacacgccagc

SEQ ID NO: 597587 - RNA, 19 nt, Escherichia coli CFT073
agcaacagcaaagagagca

SEQ ID NO: 597588 - RNA, 17 nt, Escherichia coli CFT073
agcaaucaggucuuuca

SEQ ID NO: 597589 - RNA, 22 nt, Escherichia coli CFT073
agcaaucaggucuuucagggug

SEQ ID NO: 597590 - RNA, 19 nt, Escherichia coli CFT073
agcaauauguugauaauca

SEQ ID NO: 597591 - RNA, 12 nt, Escherichia coli CFT073
agcaauccccag

SEQ ID NO: 597592 - RNA, 12 nt, Escherichia coli CFT073
agcaaucgacca

SEQ ID NO: 597593 - RNA, 19 nt, Escherichia coli CFT073
agcaaucgucgauuguuau

SEQ ID NO: 597594 - RNA, 22 nt, Escherichia coli CFT073
agcaagagugguuagccggaua

SEQ ID NO: 597595 - RNA, 17 nt, Escherichia coli CFT073
agcaacuuaaucaucaa

SEQ ID NO: 597596 - RNA, 13 nt, Escherichia coli CFT073
agcaagaaccaug

SEQ ID NO: 597597 - RNA, 14 nt, Escherichia coli CFT073
agcaagaccaacac

SEQ ID NO: 597598 - RNA, 23 nt, Escherichia coli CFT073
agcaacucgucgcugauauugcu

SEQ ID NO: 597599 - RNA, 15 nt, Escherichia coli CFT073
agcaauuuccggcac

SEQ ID NO: 597600 - RNA, 20 nt, Escherichia coli CFT073
agcaaugaucucaauaguuc

SEQ ID NO: 597601 - RNA, 22 nt, Escherichia coli CFT073
agcaccagaucguguuuugcaa

SEQ ID NO: 597602 - RNA, 22 nt, Escherichia coli CFT073
agcaauuucuccgccggaauca

SEQ ID NO: 597603 - RNA, 19 nt, Escherichia coli CFT073
agcaccacuuuacgggcaa

SEQ ID NO: 597604 - RNA, 15 nt, Escherichia coli CFT073
agcacccaaugccau

SEQ ID NO: 597605 - RNA, 16 nt, Escherichia coli CFT073
agccauaaagaaauca

SEQ ID NO: 597606 - RNA, 18 nt, Escherichia coli CFT073
agccauaccgggaucagg

SEQ ID NO: 597607 - RNA, 12 nt, Escherichia coli CFT073
agccauaaaauc

SEQ ID NO: 597608 - RNA, 22 nt, Escherichia coli CFT073
agccagugauuccggugccgca

SEQ ID NO: 597609 - RNA, 15 nt, Escherichia coli CFT073
agccaucuggcugcc

SEQ ID NO: 597610 - RNA, 15 nt, Escherichia coli CFT073
agccaugcggcaucu

SEQ ID NO: 597611 - RNA, 15 nt, Escherichia coli CFT073
agccaggcuuuaccu

SEQ ID NO: 597612 - RNA, 23 nt, Escherichia coli CFT073
agccaggcaccaaaaaucaccgc

SEQ ID NO: 597613 - RNA, 18 nt, Escherichia coli CFT073
agccaggacgauaaacca

SEQ ID NO: 597614 - RNA, 15 nt, Escherichia coli CFT073
agccaggccgccagu

SEQ ID NO: 597615 - RNA, 18 nt, Escherichia coli CFT073
agccagcgcauccuggcu

SEQ ID NO: 597616 - RNA, 22 nt, Escherichia coli CFT073
agccagccuccaacccacaaaa

SEQ ID NO: 597617 - RNA, 22 nt, Escherichia coli CFT073
agccacgacguuugguggaaug

SEQ ID NO: 597618 - RNA, 20 nt, Escherichia coli CFT073
agccacgaucgaugugauaa

SEQ ID NO: 597619 - RNA, 20 nt, Escherichia coli CFT073
agccacgcgacauaaagcgc

SEQ ID NO: 597620 - RNA, 13 nt, Escherichia coli CFT073
agccaaaucgccc

SEQ ID NO: 597621 - RNA, 23 nt, Escherichia coli CFT073
agccaaaucgccccgcagccgau

SEQ ID NO: 597622 - RNA, 14 nt, Escherichia coli CFT073
agccagcaucgcau

SEQ ID NO: 597623 - RNA, 24 nt, Escherichia coli CFT073
agccagauaucgagaaucugccgc

SEQ ID NO: 597624 - RNA, 22 nt, Escherichia coli CFT073
agccacugcugcgcgaaaacgc

SEQ ID NO: 597625 - RNA, 15 nt, Escherichia coli CFT073
agccacuucaaccag

SEQ ID NO: 597626 - RNA, 16 nt, Escherichia coli CFT073
agccacucaccgccgu

SEQ ID NO: 597627 - RNA, 21 nt, Escherichia coli CFT073
agccacgucugccacggcaga

SEQ ID NO: 597628 - RNA, 15 nt, Escherichia coli CFT073
agccagaaaucacca

SEQ ID NO: 597629 - RNA, 13 nt, Escherichia coli CFT073
agccagaacucau

SEQ ID NO: 597630 - RNA, 19 nt, Escherichia coli CFT073
agcaucaaacuuuuaaauu

SEQ ID NO: 597631 - RNA, 21 nt, Escherichia coli CFT073
agcauaugacgaaagcgcagu

SEQ ID NO: 597632 - RNA, 19 nt, Escherichia coli CFT073
agcauauguuuacgcuggc

SEQ ID NO: 597633 - RNA, 18 nt, Escherichia coli CFT073
agcaucccaggcauccag

SEQ ID NO: 597634 - RNA, 12 nt, Escherichia coli CFT073
agcaucagcgau

SEQ ID NO: 597635 - RNA, 12 nt, Escherichia coli CFT073
agcaucagcgcu

SEQ ID NO: 597636 - RNA, 12 nt, Escherichia coli CFT073
agcaucaggaug

SEQ ID NO: 597637 - RNA, 20 nt, Escherichia coli CFT073
agcaugaaguaacagaagau

SEQ ID NO: 597638 - RNA, 22 nt, Escherichia coli CFT073
agcaugaaguaacagaagauca

SEQ ID NO: 597639 - RNA, 18 nt, Escherichia coli CFT073
agcaugaacauugcugcu

SEQ ID NO: 597640 - RNA, 13 nt, Escherichia coli CFT073
agcaugccgccaa

SEQ ID NO: 597641 - RNA, 21 nt, Escherichia coli CFT073
agcaugauuucaucaucaggc

SEQ ID NO: 597642 - RNA, 17 nt, Escherichia coli CFT073
agcagccacaccaauca

SEQ ID NO: 597643 - RNA, 15 nt, Escherichia coli CFT073
agcagccacugcggc

SEQ ID NO: 597644 - RNA, 17 nt, Escherichia coli CFT073
agcagccaguuguugau

SEQ ID NO: 597645 - RNA, 16 nt, Escherichia coli CFT073
agcaggugaaucaggc

SEQ ID NO: 597646 - RNA, 17 nt, Escherichia coli CFT073
agcaggugauacaucaa

SEQ ID NO: 597647 - RNA, 16 nt, Escherichia coli CFT073
agcaggcuggcgacga

SEQ ID NO: 597648 - RNA, 19 nt, Escherichia coli CFT073
agcagggcaaucgcgccaa

SEQ ID NO: 597649 - RNA, 17 nt, Escherichia coli CFT073
agccgccuuuuuguugu

SEQ ID NO: 597650 - RNA, 21 nt, Escherichia coli CFT073
agccgcgaaacugcguggcga

SEQ ID NO: 597651 - RNA, 14 nt, Escherichia coli CFT073
agccgcccagcgaa

SEQ ID NO: 597652 - RNA, 17 nt, Escherichia coli CFT073
agccgauaaaugccacc

SEQ ID NO: 597653 - RNA, 19 nt, Escherichia coli CFT073
agccgauaaaugccaccac

SEQ ID NO: 597654 - RNA, 14 nt, Escherichia coli CFT073
agccgaccgcaagg

SEQ ID NO: 597655 - RNA, 16 nt, Escherichia coli CFT073
agccgacgccagcguu

SEQ ID NO: 597656 - RNA, 20 nt, Escherichia coli CFT073
agcccagcggaaauuaccgc

SEQ ID NO: 597657 - RNA, 18 nt, Escherichia coli CFT073
agcccaggccaucgccac

SEQ ID NO: 597658 - RNA, 18 nt, Escherichia coli CFT073
agccccagaacucacgca

SEQ ID NO: 597659 - RNA, 17 nt, Escherichia coli CFT073
agcccaguaccgccagu

SEQ ID NO: 597660 - RNA, 18 nt, Escherichia coli CFT073
agcccaucaccgccaggc

SEQ ID NO: 597661 - RNA, 21 nt, Escherichia coli CFT073
agcccaucagguccacgccau

SEQ ID NO: 597662 - RNA, 19 nt, Escherichia coli CFT073
agcccaugacaggcagacg

SEQ ID NO: 597663 - RNA, 21 nt, Escherichia coli CFT073
agccccgcuuuuuucagcgcc

SEQ ID NO: 597664 - RNA, 14 nt, Escherichia coli CFT073
agcccccacgccau

SEQ ID NO: 597665 - RNA, 22 nt, Escherichia coli CFT073
agcccgccgccacaaucaccag

SEQ ID NO: 597666 - RNA, 17 nt, Escherichia coli CFT073
agcccgccaucgcccau

SEQ ID NO: 597667 - RNA, 18 nt, Escherichia coli CFT073
agcccgcagcguccagcg

SEQ ID NO: 597668 - RNA, 14 nt, Escherichia coli CFT073
agcccgccaauacc

SEQ ID NO: 597669 - RNA, 17 nt, Escherichia coli CFT073
agcccgccaaugccgcg

SEQ ID NO: 597670 - RNA, 18 nt, Escherichia coli CFT073
agcccgaugaugaucggc

SEQ ID NO: 597671 - RNA, 22 nt, Escherichia coli CFT073
agccuuuuuuaauauuucauuc

SEQ ID NO: 597672 - RNA, 13 nt, Escherichia coli CFT073
agccuuucucgcg

SEQ ID NO: 597673 - RNA, 21 nt, Escherichia coli CFT073
agcgaauaaaccacaccgccu

SEQ ID NO: 597674 - RNA, 17 nt, Escherichia coli CFT073
agccuugaggccauccg

SEQ ID NO: 597675 - RNA, 15 nt, Escherichia coli CFT073
agccuuucacaucag

SEQ ID NO: 597676 - RNA, 15 nt, Escherichia coli CFT073
agccuaacacagcaa

SEQ ID NO: 597677 - RNA, 15 nt, Escherichia coli CFT073
agccuacagaacgcu

SEQ ID NO: 597678 - RNA, 11 nt, Escherichia coli CFT073
agccgccgcau

SEQ ID NO: 597679 - RNA, 21 nt, Escherichia coli CFT073
agccgucgccaguaccagcag

SEQ ID NO: 597680 - RNA, 18 nt, Escherichia coli CFT073
agccgucccuaacaugcc

SEQ ID NO: 597681 - RNA, 14 nt, Escherichia coli CFT073
agccgugccagaug

SEQ ID NO: 597682 - RNA, 16 nt, Escherichia coli CFT073
agcgagcuggcgcuga

SEQ ID NO: 597683 - RNA, 14 nt, Escherichia coli CFT073
agcgaggccagcca

SEQ ID NO: 597684 - RNA, 17 nt, Escherichia coli CFT073
agcgagauaaugcgcca

SEQ ID NO: 597685 - RNA, 13 nt, Escherichia coli CFT073
agcgacaaucccu

SEQ ID NO: 597686 - RNA, 15 nt, Escherichia coli CFT073
agcgacaaucccugc

SEQ ID NO: 597687 - RNA, 17 nt, Escherichia coli CFT073
agcgacaaucccugcau

SEQ ID NO: 597688 - RNA, 22 nt, Escherichia coli CFT073
agcgacagcgcacggcgaaaau

SEQ ID NO: 597689 - RNA, 19 nt, Escherichia coli CFT073
agcgauaaaaauaccgagc

SEQ ID NO: 597690 - RNA, 16 nt, Escherichia coli CFT073
agcgaguuaccacgcc

SEQ ID NO: 597691 - RNA, 22 nt, Escherichia coli CFT073
agcgaguuccugcucuuccggc

SEQ ID NO: 597692 - RNA, 19 nt, Escherichia coli CFT073
agcgagggcuaugcgcauc

SEQ ID NO: 597693 - RNA, 13 nt, Escherichia coli CFT073
agcgcaaucgccu

SEQ ID NO: 597694 - RNA, 14 nt, Escherichia coli CFT073
agcgauacgccaga

SEQ ID NO: 597695 - RNA, 22 nt, Escherichia coli CFT073
agcgauaugccccagcccgcca

SEQ ID NO: 597696 - RNA, 14 nt, Escherichia coli CFT073
agcgcaccauaguc

SEQ ID NO: 597697 - RNA, 15 nt, Escherichia coli CFT073
agcgcagcaggcaau

SEQ ID NO: 597698 - RNA, 23 nt, Escherichia coli CFT073
agcgcacuuucacccugacuguu

SEQ ID NO: 597699 - RNA, 16 nt, Escherichia coli CFT073
agcgcaucgacgccau

SEQ ID NO: 597700 - RNA, 23 nt, Escherichia coli CFT073
agcgcaucagguaauuuugcuua

SEQ ID NO: 597701 - RNA, 20 nt, Escherichia coli CFT073
agcgcaucaugaaacgccca

SEQ ID NO: 597702 - RNA, 22 nt, Escherichia coli CFT073
agcgcaucguagauuucauccg

SEQ ID NO: 597703 - RNA, 19 nt, Escherichia coli CFT073
agcgcauaaaagauaaacg

SEQ ID NO: 597704 - RNA, 14 nt, Escherichia coli CFT073
agcgcaugacaugc

SEQ ID NO: 597705 - RNA, 18 nt, Escherichia coli CFT073
agcgcauuucauggcgga

SEQ ID NO: 597706 - RNA, 20 nt, Escherichia coli CFT073
agcgcauguuccucaucguc

SEQ ID NO: 597707 - RNA, 22 nt, Escherichia coli CFT073
agcgccugcacaaagcgccaga

SEQ ID NO: 597708 - RNA, 19 nt, Escherichia coli CFT073
agcgccuggcgaaucgccu

SEQ ID NO: 597709 - RNA, 12 nt, Escherichia coli CFT073
agcgccugcugc

SEQ ID NO: 597710 - RNA, 16 nt, Escherichia coli CFT073
agcgccugcagucagc

SEQ ID NO: 597711 - RNA, 23 nt, Escherichia coli CFT073
agcgccucuuuauaaauaucaaa

SEQ ID NO: 597712 - RNA, 22 nt, Escherichia coli CFT073
agcgcugaauaucuuucucgcg

SEQ ID NO: 597713 - RNA, 16 nt, Escherichia coli CFT073
agcgcuuuuggcgcgu

SEQ ID NO: 597714 - RNA, 18 nt, Escherichia coli CFT073
agcgcguuugucagcaaa

SEQ ID NO: 597715 - RNA, 21 nt, Escherichia coli CFT073
agcgcguccugaucgacgcgc

SEQ ID NO: 597716 - RNA, 19 nt, Escherichia coli CFT073
agcgcgccugaaugccaca

SEQ ID NO: 597717 - RNA, 22 nt, Escherichia coli CFT073
agcgguggugaaaagagcggua

SEQ ID NO: 597718 - RNA, 16 nt, Escherichia coli CFT073
agcggugcgguaagcu

SEQ ID NO: 597719 - RNA, 18 nt, Escherichia coli CFT073
agcggucgcugacauuaa

SEQ ID NO: 597720 - RNA, 13 nt, Escherichia coli CFT073
agcggugaaaacg

SEQ ID NO: 597721 - RNA, 14 nt, Escherichia coli CFT073
agcgugaaccgccu

SEQ ID NO: 597722 - RNA, 16 nt, Escherichia coli CFT073
agcguccgggaaaucc

SEQ ID NO: 597723 - RNA, 22 nt, Escherichia coli CFT073
agcguccgggaaauccucaacc

SEQ ID NO: 597724 - RNA, 14 nt, Escherichia coli CFT073
agcguccugcucgc

SEQ ID NO: 597725 - RNA, 22 nt, Escherichia coli CFT073
agcgucgccagcagcucacgca

SEQ ID NO: 597726 - RNA, 22 nt, Escherichia coli CFT073
agcgugccgcgaucccagacca

SEQ ID NO: 597727 - RNA, 15 nt, Escherichia coli CFT073
agcgugagugcgaaa

SEQ ID NO: 597728 - RNA, 12 nt, Escherichia coli CFT073
agcguuccccag

SEQ ID NO: 597729 - RNA, 20 nt, Escherichia coli CFT073
agcguguuaaugcccaucag

SEQ ID NO: 597730 - RNA, 20 nt, Escherichia coli CFT073
agcguuacccagacaaaauu

SEQ ID NO: 597731 - RNA, 18 nt, Escherichia coli CFT073
agcguuauauuauuauuc

SEQ ID NO: 597732 - RNA, 18 nt, Escherichia coli CFT073
agcggaugacccagcgcg

SEQ ID NO: 597733 - RNA, 14 nt, Escherichia coli CFT073
agcggaauaucaga

SEQ ID NO: 597734 - RNA, 16 nt, Escherichia coli CFT073
agcggcgagcuuuucu

SEQ ID NO: 597735 - RNA, 21 nt, Escherichia coli CFT073
agcggcgcgauaguaaucacc

SEQ ID NO: 597736 - RNA, 22 nt, Escherichia coli CFT073
agcggcguguuauugccgagaa

SEQ ID NO: 597737 - RNA, 22 nt, Escherichia coli CFT073
agcggcguuccggcaaccggau

SEQ ID NO: 597738 - RNA, 21 nt, Escherichia coli CFT073
agcggcucauguagccgcuuu

SEQ ID NO: 597739 - RNA, 23 nt, Escherichia coli CFT073
agcggcuacugauguucgccaga

SEQ ID NO: 597740 - RNA, 21 nt, Escherichia coli CFT073
agcggcuuaagaagaacggga

SEQ ID NO: 597741 - RNA, 18 nt, Escherichia coli CFT073
agcgggaugucgcggaaa

SEQ ID NO: 597742 - RNA, 14 nt, Escherichia coli CFT073
agcgggcaauaucg

SEQ ID NO: 597743 - RNA, 14 nt, Escherichia coli CFT073
agcuaccacgccga

SEQ ID NO: 597744 - RNA, 13 nt, Escherichia coli CFT073
agcuaauaaaacc

SEQ ID NO: 597745 - RNA, 20 nt, Escherichia coli CFT073
agcuaaucaucaucagcgcu

SEQ ID NO: 597746 - RNA, 15 nt, Escherichia coli CFT073
agcuaacgcguuauc

SEQ ID NO: 597747 - RNA, 14 nt, Escherichia coli CFT073
agcucaacgcaucg

SEQ ID NO: 597748 - RNA, 14 nt, Escherichia coli CFT073
agcucaccagcagg

SEQ ID NO: 597749 - RNA, 17 nt, Escherichia coli CFT073
agcguuuucugccagac

SEQ ID NO: 597750 - RNA, 18 nt, Escherichia coli CFT073
agcguuuucugccagaca

SEQ ID NO: 597751 - RNA, 14 nt, Escherichia coli CFT073
agcguuuuuucauu

SEQ ID NO: 597752 - RNA, 15 nt, Escherichia coli CFT073
agcguuuuuucauuu

SEQ ID NO: 597753 - RNA, 23 nt, Escherichia coli CFT073
  misc_feature (4)..(4): n is a, c, g or u
agcnuuaucgugccuacacauua

SEQ ID NO: 597754 - RNA, 21 nt, Escherichia coli CFT073
agcguugguauauuacagguu

SEQ ID NO: 597755 - RNA, 15 nt, Escherichia coli CFT073
agcguuugcggcgcu

SEQ ID NO: 597756 - RNA, 23 nt, Escherichia coli CFT073
agcguugccggaugacgccucag

SEQ ID NO: 597757 - RNA, 19 nt, Escherichia coli CFT073
agcguucuuuaacugccgc

SEQ ID NO: 597758 - RNA, 17 nt, Escherichia coli CFT073
agcguuuaauaaaacgg

SEQ ID NO: 597759 - RNA, 19 nt, Escherichia coli CFT073
agcuccgggcugguuuuca

SEQ ID NO: 597760 - RNA, 19 nt, Escherichia coli CFT073
agcuccagggcuuuauuca

SEQ ID NO: 597761 - RNA, 16 nt, Escherichia coli CFT073
agcucccacaguuuca

SEQ ID NO: 597762 - RNA, 15 nt, Escherichia coli CFT073
agcucacgcgccagc

SEQ ID NO: 597763 - RNA, 19 nt, Escherichia coli CFT073
agcucauaaccguccaguu

SEQ ID NO: 597764 - RNA, 18 nt, Escherichia coli CFT073
agcugaaaauugcgcucg

SEQ ID NO: 597765 - RNA, 20 nt, Escherichia coli CFT073
agcugaaaucaccgccacca

SEQ ID NO: 597766 - RNA, 17 nt, Escherichia coli CFT073
agcugaauaucacgggc

SEQ ID NO: 597767 - RNA, 20 nt, Escherichia coli CFT073
agcugaauggguaaacccgc

SEQ ID NO: 597768 - RNA, 14 nt, Escherichia coli CFT073
agcugagugcgaaa

SEQ ID NO: 597769 - RNA, 16 nt, Escherichia coli CFT073
agcugagugcgaaaau

SEQ ID NO: 597770 - RNA, 18 nt, Escherichia coli CFT073
agcugagugcgaaaauca

SEQ ID NO: 597771 - RNA, 22 nt, Escherichia coli CFT073
agcugagugcgaaaaucaauaa

SEQ ID NO: 597772 - RNA, 13 nt, Escherichia coli CFT073
cccccgguaauaa

SEQ ID NO: 597773 - RNA, 23 nt, Escherichia coli CFT073
ccccgacgaaacgacaguaucgu

SEQ ID NO: 597774 - RNA, 20 nt, Escherichia coli CFT073
ccccggcacugucaacagcg

SEQ ID NO: 597775 - RNA, 14 nt, Escherichia coli CFT073
ccccaucagcaucc

SEQ ID NO: 597776 - RNA, 14 nt, Escherichia coli CFT073
ccccaucagcgcca

SEQ ID NO: 597777 - RNA, 14 nt, Escherichia coli CFT073
ccccauaucccgga

SEQ ID NO: 597778 - RNA, 11 nt, Escherichia coli CFT073
ccccauugccc

SEQ ID NO: 597779 - RNA, 20 nt, Escherichia coli CFT073
cccccagcacuacggagauu

SEQ ID NO: 597780 - RNA, 14 nt, Escherichia coli CFT073
ccccagcuggcgcc

SEQ ID NO: 597781 - RNA, 13 nt, Escherichia coli CFT073
ccccagccgguca

SEQ ID NO: 597782 - RNA, 17 nt, Escherichia coli CFT073
ccccacugugcaccgcg

SEQ ID NO: 597783 - RNA, 23 nt, Escherichia coli CFT073
ccccacuucauccgacaccagcc

SEQ ID NO: 597784 - RNA, 19 nt, Escherichia coli CFT073
ccccacggcguguagccca

SEQ ID NO: 597785 - RNA, 12 nt, Escherichia coli CFT073
cccauugguugc

SEQ ID NO: 597786 - RNA, 13 nt, Escherichia coli CFT073
cccaucgccacgc

SEQ ID NO: 597787 - RNA, 13 nt, Escherichia coli CFT073
cccaucgccagca

SEQ ID NO: 597788 - RNA, 14 nt, Escherichia coli CFT073
cccaucgccagcac

SEQ ID NO: 597789 - RNA, 21 nt, Escherichia coli CFT073
cccagcgcguuaacuggaaca

SEQ ID NO: 597790 - RNA, 16 nt, Escherichia coli CFT073
cccagugcggugccgc

SEQ ID NO: 597791 - RNA, 15 nt, Escherichia coli CFT073
cccaguaccgccagu

SEQ ID NO: 597792 - RNA, 16 nt, Escherichia coli CFT073
cccaggccaucgccac

SEQ ID NO: 597793 - RNA, 12 nt, Escherichia coli CFT073
cccaggcaaaau

SEQ ID NO: 597794 - RNA, 22 nt, Escherichia coli CFT073
cccacccaacauggucaucauc

SEQ ID NO: 597795 - RNA, 23 nt, Escherichia coli CFT073
ccauugacguucccuucuugcgc

SEQ ID NO: 597796 - RNA, 23 nt, Escherichia coli CFT073
ccauugagccggaaguauccacg

SEQ ID NO: 597797 - RNA, 16 nt, Escherichia coli CFT073
ccauucuugcgcggau

SEQ ID NO: 597798 - RNA, 17 nt, Escherichia coli CFT073
ccauucgccguccagga

SEQ ID NO: 597799 - RNA, 16 nt, Escherichia coli CFT073
ccauucccggcuuugc

SEQ ID NO: 597800 - RNA, 14 nt, Escherichia coli CFT073
cccagcaaugccag

SEQ ID NO: 597801 - RNA, 16 nt, Escherichia coli CFT073
cccacggcguguagcc

SEQ ID NO: 597802 - RNA, 21 nt, Escherichia coli CFT073
cccagacuccagcagugcugc

SEQ ID NO: 597803 - RNA, 14 nt, Escherichia coli CFT073
ccagucuuuccaua

SEQ ID NO: 597804 - RNA, 13 nt, Escherichia coli CFT073
ccagugcagcgca

SEQ ID NO: 597805 - RNA, 22 nt, Escherichia coli CFT073
ccaguugcgcaacguaucaucg

SEQ ID NO: 597806 - RNA, 15 nt, Escherichia coli CFT073
ccaguugaugaccag

SEQ ID NO: 597807 - RNA, 22 nt, Escherichia coli CFT073
ccaguugaugaccagugcagau

SEQ ID NO: 597808 - RNA, 20 nt, Escherichia coli CFT073
ccaguugugaugccacuuca

SEQ ID NO: 597809 - RNA, 15 nt, Escherichia coli CFT073
ccaguucuagugcua

SEQ ID NO: 597810 - RNA, 14 nt, Escherichia coli CFT073
ccagugucgcauca

SEQ ID NO: 597811 - RNA, 16 nt, Escherichia coli CFT073
ccaguguuuccggaau

SEQ ID NO: 597812 - RNA, 15 nt, Escherichia coli CFT073
ccaguguuuuaccgg

SEQ ID NO: 597813 - RNA, 14 nt, Escherichia coli CFT073
ccagucgcugcuga

SEQ ID NO: 597814 - RNA, 16 nt, Escherichia coli CFT073
ccagucgaggcugacg

SEQ ID NO: 597815 - RNA, 21 nt, Escherichia coli CFT073
ccagguuuuaguuucgccguu

SEQ ID NO: 597816 - RNA, 19 nt, Escherichia coli CFT073
ccaguaaaccaauuucugu

SEQ ID NO: 597817 - RNA, 17 nt, Escherichia coli CFT073
ccaugauaaacggcacu

SEQ ID NO: 597818 - RNA, 20 nt, Escherichia coli CFT073
ccaugcaaucacugccacca

SEQ ID NO: 597819 - RNA, 22 nt, Escherichia coli CFT073
ccaugauuucguauacugcagc

SEQ ID NO: 597820 - RNA, 22 nt, Escherichia coli CFT073
ccaugaacgcgaaggccagcac

SEQ ID NO: 597821 - RNA, 17 nt, Escherichia coli CFT073
ccaucgcuucaugcccg

SEQ ID NO: 597822 - RNA, 21 nt, Escherichia coli CFT073
ccaucgcgaucaucaguacgc

SEQ ID NO: 597823 - RNA, 21 nt, Escherichia coli CFT073
ccauucacgagagcgggaaaa

SEQ ID NO: 597824 - RNA, 24 nt, Escherichia coli CFT073
ccauucaucacgcacugcaauauu

SEQ ID NO: 597825 - RNA, 16 nt, Escherichia coli CFT073
ccauucccaaaauggu

SEQ ID NO: 597826 - RNA, 22 nt, Escherichia coli CFT073
ccauuaaauaguuuuuuacgau

SEQ ID NO: 597827 - RNA, 15 nt, Escherichia coli CFT073
ccauuaacaaccgaa

SEQ ID NO: 597828 - RNA, 16 nt, Escherichia coli CFT073
ccauuacacugaaaaa

SEQ ID NO: 597829 - RNA, 17 nt, Escherichia coli CFT073
ccauggacaugcgcacc

SEQ ID NO: 597830 - RNA, 17 nt, Escherichia coli CFT073
ccauggaaucaccgcca

SEQ ID NO: 597831 - RNA, 18 nt, Escherichia coli CFT073
ccaugcuaugcgccacgg

SEQ ID NO: 597832 - RNA, 15 nt, Escherichia coli CFT073
ccaugccgcccagca

SEQ ID NO: 597833 - RNA, 18 nt, Escherichia coli CFT073
ccaugccgcccagcagca

SEQ ID NO: 597834 - RNA, 21 nt, Escherichia coli CFT073
ccaugccgccaccaccagcgc

SEQ ID NO: 597835 - RNA, 21 nt, Escherichia coli CFT073
ccaugcacgauauaccgugcu

SEQ ID NO: 597836 - RNA, 16 nt, Escherichia coli CFT073
ccaugccaucugccag

SEQ ID NO: 597837 - RNA, 15 nt, Escherichia coli CFT073
ccauccccaccaaaa

SEQ ID NO: 597838 - RNA, 21 nt, Escherichia coli CFT073
ccauccauucggugcgucgcu

SEQ ID NO: 597839 - RNA, 18 nt, Escherichia coli CFT073
ccauccauugcauaaaca

SEQ ID NO: 597840 - RNA, 23 nt, Escherichia coli CFT073
ccaucaugaucagaacaucgcca

SEQ ID NO: 597841 - RNA, 13 nt, Escherichia coli CFT073
ccaucaugcgcca

SEQ ID NO: 597842 - RNA, 16 nt, Escherichia coli CFT073
ccaucaugcgccaggu

SEQ ID NO: 597843 - RNA, 19 nt, Escherichia coli CFT073
ccauacuguucggacggcg

SEQ ID NO: 597844 - RNA, 21 nt, Escherichia coli CFT073
ccauacucuuucccggcaauc

SEQ ID NO: 597845 - RNA, 19 nt, Escherichia coli CFT073
ccauacggucugccagucg

SEQ ID NO: 597846 - RNA, 21 nt, Escherichia coli CFT073
ccaucaguacccaaucagcga

SEQ ID NO: 597847 - RNA, 17 nt, Escherichia coli CFT073
ccauaccgucgccagac

SEQ ID NO: 597848 - RNA, 13 nt, Escherichia coli CFT073
ccauacagaacag

SEQ ID NO: 597849 - RNA, 13 nt, Escherichia coli CFT073
ccauccggcaaca

SEQ ID NO: 597850 - RNA, 13 nt, Escherichia coli CFT073
ccaucccggcaac

SEQ ID NO: 597851 - RNA, 15 nt, Escherichia coli CFT073
ccaucccuaugcaua

SEQ ID NO: 597852 - RNA, 14 nt, Escherichia coli CFT073
ccauccugaucgcc

SEQ ID NO: 597853 - RNA, 15 nt, Escherichia coli CFT073
ccaucgacaccagcc

SEQ ID NO: 597854 - RNA, 23 nt, Escherichia coli CFT073
ccauccggcugauuuaucaggcu

SEQ ID NO: 597855 - RNA, 23 nt, Escherichia coli CFT073
ccaucgccgcacuauuuaccgcc

SEQ ID NO: 597856 - RNA, 19 nt, Escherichia coli CFT073
ccaucgccaccgcuucgcu

SEQ ID NO: 597857 - RNA, 14 nt, Escherichia coli CFT073
ccaucgccaccgga

SEQ ID NO: 597858 - RNA, 16 nt, Escherichia coli CFT073
ccaucgcaaacagcac

SEQ ID NO: 597859 - RNA, 15 nt, Escherichia coli CFT073
cccuuuacaggcgug

SEQ ID NO: 597860 - RNA, 18 nt, Escherichia coli CFT073
cccuuguugugccagacc

SEQ ID NO: 597861 - RNA, 23 nt, Escherichia coli CFT073
cccuucuuuaugcgcuuuuuugg

SEQ ID NO: 597862 - RNA, 13 nt, Escherichia coli CFT073
cccuugccugcag

SEQ ID NO: 597863 - RNA, 16 nt, Escherichia coli CFT073
cccuucgcccugcguc

SEQ ID NO: 597864 - RNA, 21 nt, Escherichia coli CFT073
cccugcucuuucagcaccgcg

SEQ ID NO: 597865 - RNA, 15 nt, Escherichia coli CFT073
cccuguugccugcac

SEQ ID NO: 597866 - RNA, 22 nt, Escherichia coli CFT073
cccuuaauuaucuggucaguua

SEQ ID NO: 597867 - RNA, 13 nt, Escherichia coli CFT073
cccugugucgccg

SEQ ID NO: 597868 - RNA, 13 nt, Escherichia coli CFT073
ccgaacagcaacu

SEQ ID NO: 597869 - RNA, 21 nt, Escherichia coli CFT073
ccgaacagccaggcuuuaccu

SEQ ID NO: 597870 - RNA, 22 nt, Escherichia coli CFT073
ccgaacgcagaaucucugcgcu

SEQ ID NO: 597871 - RNA, 21 nt, Escherichia coli CFT073
ccgaacuucgccagcgugacu

SEQ ID NO: 597872 - RNA, 12 nt, Escherichia coli CFT073
cccugauaaugu

SEQ ID NO: 597873 - RNA, 23 nt, Escherichia coli CFT073
cccugauacguagcgcaacaggc

SEQ ID NO: 597874 - RNA, 16 nt, Escherichia coli CFT073
cccugcguugagaaac

SEQ ID NO: 597875 - RNA, 15 nt, Escherichia coli CFT073
cccugcaacaucacc

SEQ ID NO: 597876 - RNA, 21 nt, Escherichia coli CFT073
cccugccagaaucgcaaccag

SEQ ID NO: 597877 - RNA, 15 nt, Escherichia coli CFT073
cccucgccccuccgg

SEQ ID NO: 597878 - RNA, 22 nt, Escherichia coli CFT073
cccguuucucuuaaaugcacaa

SEQ ID NO: 597879 - RNA, 20 nt, Escherichia coli CFT073
cccguuuuaaaucgccgcau

SEQ ID NO: 597880 - RNA, 15 nt, Escherichia coli CFT073
cccguugcuucgccg

SEQ ID NO: 597881 - RNA, 17 nt, Escherichia coli CFT073
cccuaucaucgcggcac

SEQ ID NO: 597882 - RNA, 18 nt, Escherichia coli CFT073
ccgacaucaacgccugau

SEQ ID NO: 597883 - RNA, 19 nt, Escherichia coli CFT073
ccgaagugcgcacagcuac

SEQ ID NO: 597884 - RNA, 21 nt, Escherichia coli CFT073
ccgaagucaaacugauauugu

SEQ ID NO: 597885 - RNA, 15 nt, Escherichia coli CFT073
ccgacaccgccugua

SEQ ID NO: 597886 - RNA, 18 nt, Escherichia coli CFT073
ccgacaccggcagagauu

SEQ ID NO: 597887 - RNA, 18 nt, Escherichia coli CFT073
ccgaccauauagcgcaca

SEQ ID NO: 597888 - RNA, 15 nt, Escherichia coli CFT073
ccgaccaucgccagc

SEQ ID NO: 597889 - RNA, 16 nt, Escherichia coli CFT073
ccgaccagaccggcaa

SEQ ID NO: 597890 - RNA, 21 nt, Escherichia coli CFT073
ccccggcggcuugcaccagca

SEQ ID NO: 597891 - RNA, 12 nt, Escherichia coli CFT073
cccgauccagcg

SEQ ID NO: 597892 - RNA, 13 nt, Escherichia coli CFT073
cccgcagcggcga

SEQ ID NO: 597893 - RNA, 15 nt, Escherichia coli CFT073
cccgcagcacggcga

SEQ ID NO: 597894 - RNA, 14 nt, Escherichia coli CFT073
cccggcagagaaaa

SEQ ID NO: 597895 - RNA, 13 nt, Escherichia coli CFT073
cccggaaucgcgu

SEQ ID NO: 597896 - RNA, 15 nt, Escherichia coli CFT073
cccggccucaacaau

SEQ ID NO: 597897 - RNA, 20 nt, Escherichia coli CFT073
cccggcguuuucagauccag

SEQ ID NO: 597898 - RNA, 12 nt, Escherichia coli CFT073
cccggccugaua

SEQ ID NO: 597899 - RNA, 23 nt, Escherichia coli CFT073
ccaaccacggaguugaccagcuc

SEQ ID NO: 597900 - RNA, 10 nt, Escherichia coli CFT073
ccaaccagcu

SEQ ID NO: 597901 - RNA, 13 nt, Escherichia coli CFT073
ccaaccaucaucc

SEQ ID NO: 597902 - RNA, 21 nt, Escherichia coli CFT073
ccaaggcuaguacaggcggca

SEQ ID NO: 597903 - RNA, 15 nt, Escherichia coli CFT073
ccaacccacaaaaac

SEQ ID NO: 597904 - RNA, 21 nt, Escherichia coli CFT073
ccaacccacaaaaacaccgcu

SEQ ID NO: 597905 - RNA, 20 nt, Escherichia coli CFT073
ccaaucaauucucgccagug

SEQ ID NO: 597906 - RNA, 13 nt, Escherichia coli CFT073
ccaaucagcgcag

SEQ ID NO: 597907 - RNA, 18 nt, Escherichia coli CFT073
ccaauccacgcggguuua

SEQ ID NO: 597908 - RNA, 20 nt, Escherichia coli CFT073
ccaaugccaauguagccacg

SEQ ID NO: 597909 - RNA, 17 nt, Escherichia coli CFT073
ccaaucugaaaccagcg

SEQ ID NO: 597910 - RNA, 17 nt, Escherichia coli CFT073
ccaaucggcccgcccag

SEQ ID NO: 597911 - RNA, 19 nt, Escherichia coli CFT073
ccaauggcaggaucuggug

SEQ ID NO: 597912 - RNA, 16 nt, Escherichia coli CFT073
ccaauggcugccgcca

SEQ ID NO: 597913 - RNA, 20 nt, Escherichia coli CFT073
ccaauggucauugucgcggu

SEQ ID NO: 597914 - RNA, 19 nt, Escherichia coli CFT073
ccaauguggagagcaacau

SEQ ID NO: 597915 - RNA, 20 nt, Escherichia coli CFT073
ccaauguaaccacaggcugg

SEQ ID NO: 597916 - RNA, 24 nt, Escherichia coli CFT073
ccaauguuacgaccuuccugacgg

SEQ ID NO: 597917 - RNA, 13 nt, Escherichia coli CFT073
ccacaaaccagcc

SEQ ID NO: 597918 - RNA, 22 nt, Escherichia coli CFT073
ccacaacaccuuucacgccgaa

SEQ ID NO: 597919 - RNA, 18 nt, Escherichia coli CFT073
ccaauuucaucgcugaau

SEQ ID NO: 597920 - RNA, 13 nt, Escherichia coli CFT073
ccaauuucugugc

SEQ ID NO: 597921 - RNA, 18 nt, Escherichia coli CFT073
ccacaaaaacaccgcugu

SEQ ID NO: 597922 - RNA, 16 nt, Escherichia coli CFT073
ccacaaucagccagaa

SEQ ID NO: 597923 - RNA, 17 nt, Escherichia coli CFT073
ccacaaucgcagcgcaa

SEQ ID NO: 597924 - RNA, 18 nt, Escherichia coli CFT073
ccacaaucgcagcgcaag

SEQ ID NO: 597925 - RNA, 21 nt, Escherichia coli CFT073
ccacaaucuuaggggacauuu

SEQ ID NO: 597926 - RNA, 18 nt, Escherichia coli CFT073
ccacaauggcauauuccg

SEQ ID NO: 597927 - RNA, 24 nt, Escherichia coli CFT073
ccacaagcccgccagaccagcuac

SEQ ID NO: 597928 - RNA, 22 nt, Escherichia coli CFT073
ccacaggcuggcgucacgccga

SEQ ID NO: 597929 - RNA, 22 nt, Escherichia coli CFT073
ccacaguuucagccccaucagc

SEQ ID NO: 597930 - RNA, 20 nt, Escherichia coli CFT073
ccaccacaccagaccagaca

SEQ ID NO: 597931 - RNA, 13 nt, Escherichia coli CFT073
ccacagcgccaga

SEQ ID NO: 597932 - RNA, 13 nt, Escherichia coli CFT073
ccacagcaguuag

SEQ ID NO: 597933 - RNA, 18 nt, Escherichia coli CFT073
ccacacugagcaccacac

SEQ ID NO: 597934 - RNA, 21 nt, Escherichia coli CFT073
ccacacugccuugcgauaucc

SEQ ID NO: 597935 - RNA, 22 nt, Escherichia coli CFT073
ccacacuucuucagccaguuuu

SEQ ID NO: 597936 - RNA, 23 nt, Escherichia coli CFT073
ccacacaaagugcgaggaucauc

SEQ ID NO: 597937 - RNA, 12 nt, Escherichia coli CFT073
ccacaccaauca

SEQ ID NO: 597938 - RNA, 16 nt, Escherichia coli CFT073
ccacaccaccaugcua

SEQ ID NO: 597939 - RNA, 13 nt, Escherichia coli CFT073
ccacaccacgcca

SEQ ID NO: 597940 - RNA, 18 nt, Escherichia coli CFT073
ccaccccagacuuccccg

SEQ ID NO: 597941 - RNA, 11 nt, Escherichia coli CFT073
ccaccagcggc

SEQ ID NO: 597942 - RNA, 13 nt, Escherichia coli CFT073
ccaccgccaggca

SEQ ID NO: 597943 - RNA, 14 nt, Escherichia coli CFT073
ccaccgcgcuaagg

SEQ ID NO: 597944 - RNA, 18 nt, Escherichia coli CFT073
ccaccgcuaacugcugcg

SEQ ID NO: 597945 - RNA, 20 nt, Escherichia coli CFT073
cauuucgauauguuccggcg

SEQ ID NO: 597946 - RNA, 17 nt, Escherichia coli CFT073
cauuucacguucacgua

SEQ ID NO: 597947 - RNA, 20 nt, Escherichia coli CFT073
cauuucauaaauuaccacca

SEQ ID NO: 597948 - RNA, 23 nt, Escherichia coli CFT073
cauuucauaaauuaccaccagcg

SEQ ID NO: 597949 - RNA, 19 nt, Escherichia coli CFT073
cauuucaugccgaacaggu

SEQ ID NO: 597950 - RNA, 18 nt, Escherichia coli CFT073
cauuuacgaacauuaaga

SEQ ID NO: 597951 - RNA, 21 nt, Escherichia coli CFT073
cauuuagcgcagcuacccgau

SEQ ID NO: 597952 - RNA, 22 nt, Escherichia coli CFT073
cauuuagcggccccauuuauuu

SEQ ID NO: 597953 - RNA, 17 nt, Escherichia coli CFT073
cauuuaaaaaucagucg

SEQ ID NO: 597954 - RNA, 21 nt, Escherichia coli CFT073
cauugaucgauaagccagcaa

SEQ ID NO: 597955 - RNA, 23 nt, Escherichia coli CFT073
cauugaucgauaagccagcaacc

SEQ ID NO: 597956 - RNA, 14 nt, Escherichia coli CFT073
cauugauuucuuau

SEQ ID NO: 597957 - RNA, 16 nt, Escherichia coli CFT073
cauugauggcgcuuuc

SEQ ID NO: 597958 - RNA, 18 nt, Escherichia coli CFT073
cauuuuguaggccugaua

SEQ ID NO: 597959 - RNA, 17 nt, Escherichia coli CFT073
cauuucuggaaugcgga

SEQ ID NO: 597960 - RNA, 11 nt, Escherichia coli CFT073
ccaaaaagggg

SEQ ID NO: 597961 - RNA, 13 nt, Escherichia coli CFT073
ccaaaaaaacggc

SEQ ID NO: 597962 - RNA, 20 nt, Escherichia coli CFT073
ccaaaaugucggaugcgacg

SEQ ID NO: 597963 - RNA, 21 nt, Escherichia coli CFT073
ccaaaauuugaaaagugcugu

SEQ ID NO: 597964 - RNA, 21 nt, Escherichia coli CFT073
ccaacaauaaaaagcggcagg

SEQ ID NO: 597965 - RNA, 13 nt, Escherichia coli CFT073
ccaacaggcgaga

SEQ ID NO: 597966 - RNA, 21 nt, Escherichia coli CFT073
ccaacagugccgaugccgcua

SEQ ID NO: 597967 - RNA, 21 nt, Escherichia coli CFT073
cauuacaagaaucaugccaaa

SEQ ID NO: 597968 - RNA, 23 nt, Escherichia coli CFT073
cauuacaucacgacgaccaccga

SEQ ID NO: 597969 - RNA, 15 nt, Escherichia coli CFT073
cauuaauauaaucgu

SEQ ID NO: 597970 - RNA, 21 nt, Escherichia coli CFT073
cauuaccgccaucaauugcuc

SEQ ID NO: 597971 - RNA, 16 nt, Escherichia coli CFT073
cauuacgaaaucggca

SEQ ID NO: 597972 - RNA, 21 nt, Escherichia coli CFT073
cauuacgcucgcugcaaaaca

SEQ ID NO: 597973 - RNA, 20 nt, Escherichia coli CFT073
cauuacugcuaucugucaga

SEQ ID NO: 597974 - RNA, 14 nt, Escherichia coli CFT073
cauuaaaacggaua

SEQ ID NO: 597975 - RNA, 12 nt, Escherichia coli CFT073
cauuaaaaucgg

SEQ ID NO: 597976 - RNA, 15 nt, Escherichia coli CFT073
cauguuggagauaac

SEQ ID NO: 597977 - RNA, 20 nt, Escherichia coli CFT073
cauguugacaaaaauaccau

SEQ ID NO: 597978 - RNA, 13 nt, Escherichia coli CFT073
cauguugacuuca

SEQ ID NO: 597979 - RNA, 19 nt, Escherichia coli CFT073
cauuaacucacuggcgcgc

SEQ ID NO: 597980 - RNA, 16 nt, Escherichia coli CFT073
cauuaacucaguugcc

SEQ ID NO: 597981 - RNA, 22 nt, Escherichia coli CFT073
cauuaagaacuccugaaagcga

SEQ ID NO: 597982 - RNA, 19 nt, Escherichia coli CFT073
cauuaacccgcuugucgcc

SEQ ID NO: 597983 - RNA, 12 nt, Escherichia coli CFT073
cauuaacgcgaa

SEQ ID NO: 597984 - RNA, 14 nt, Escherichia coli CFT073
cauguuuuccagca

SEQ ID NO: 597985 - RNA, 22 nt, Escherichia coli CFT073
cauuaaacgcaguaaacgccag

SEQ ID NO: 597986 - RNA, 22 nt, Escherichia coli CFT073
cauuaacaacgucguuuucgcc

SEQ ID NO: 597987 - RNA, 17 nt, Escherichia coli CFT073
cauuaacaccacgccag

SEQ ID NO: 597988 - RNA, 19 nt, Escherichia coli CFT073
cauuaaccagccacugcgc

SEQ ID NO: 597989 - RNA, 16 nt, Escherichia coli CFT073
cauuauuuuugcuaua

SEQ ID NO: 597990 - RNA, 15 nt, Escherichia coli CFT073
cauucaaugauuuaa

SEQ ID NO: 597991 - RNA, 18 nt, Escherichia coli CFT073
cauuauggcgcaguugcc

SEQ ID NO: 597992 - RNA, 20 nt, Escherichia coli CFT073
cauuauggcgcaguugccgg

SEQ ID NO: 597993 - RNA, 22 nt, Escherichia coli CFT073
cauuauggcgcaguugccggau

SEQ ID NO: 597994 - RNA, 23 nt, Escherichia coli CFT073
cauuauggcgcaguugccggaug

SEQ ID NO: 597995 - RNA, 13 nt, Escherichia coli CFT073
cauuagcccggca

SEQ ID NO: 597996 - RNA, 23 nt, Escherichia coli CFT073
cauuagcucuuaacgaaaacuga

SEQ ID NO: 597997 - RNA, 14 nt, Escherichia coli CFT073
cauuaucacaucag

SEQ ID NO: 597998 - RNA, 14 nt, Escherichia coli CFT073
cauucgcagcugca

SEQ ID NO: 597999 - RNA, 16 nt, Escherichia coli CFT073
cauucgccguccagga

SEQ ID NO: 598000 - RNA, 22 nt, Escherichia coli CFT073
cauucgccugacgcaauaacac

SEQ ID NO: 598001 - RNA, 15 nt, Escherichia coli CFT073
cauucacacuccagu

SEQ ID NO: 598002 - RNA, 19 nt, Escherichia coli CFT073
cauucagacacgccgccag

SEQ ID NO: 598003 - RNA, 16 nt, Escherichia coli CFT073
caugcuggauggcgca

SEQ ID NO: 598004 - RNA, 17 nt, Escherichia coli CFT073
caugggcauccacagua

SEQ ID NO: 598005 - RNA, 15 nt, Escherichia coli CFT073
caugcuggauggcgc

SEQ ID NO: 598006 - RNA, 17 nt, Escherichia coli CFT073
caugcuggaaccacagc

SEQ ID NO: 598007 - RNA, 21 nt, Escherichia coli CFT073
caugcuggaaccacagcgccg

SEQ ID NO: 598008 - RNA, 22 nt, Escherichia coli CFT073
caugcuggaaccacagcgccgu

SEQ ID NO: 598009 - RNA, 20 nt, Escherichia coli CFT073
caugcugaugcuacccauau

SEQ ID NO: 598010 - RNA, 12 nt, Escherichia coli CFT073
caugcuccgcac

SEQ ID NO: 598011 - RNA, 12 nt, Escherichia coli CFT073
caugugccagcg

SEQ ID NO: 598012 - RNA, 15 nt, Escherichia coli CFT073
caugugccgacaucg

SEQ ID NO: 598013 - RNA, 15 nt, Escherichia coli CFT073
cauguuauucaugcc

SEQ ID NO: 598014 - RNA, 14 nt, Escherichia coli CFT073
caugguuaaaaucu

SEQ ID NO: 598015 - RNA, 20 nt, Escherichia coli CFT073
caugguuaaugcuucgcacu

SEQ ID NO: 598016 - RNA, 15 nt, Escherichia coli CFT073
caugguuacgccggu

SEQ ID NO: 598017 - RNA, 23 nt, Escherichia coli CFT073
cauggugugcucguaaguuaacu

SEQ ID NO: 598018 - RNA, 20 nt, Escherichia coli CFT073
cauguaccguugcugccagu

SEQ ID NO: 598019 - RNA, 15 nt, Escherichia coli CFT073
caugucggacuucag

SEQ ID NO: 598020 - RNA, 14 nt, Escherichia coli CFT073
caugcuaugcgcca

SEQ ID NO: 598021 - RNA, 14 nt, Escherichia coli CFT073
caugcuauuacgcc

SEQ ID NO: 598022 - RNA, 22 nt, Escherichia coli CFT073
caugcuaauaaucagcacaaua

SEQ ID NO: 598023 - RNA, 15 nt, Escherichia coli CFT073
caugcguuaucgcca

SEQ ID NO: 598024 - RNA, 21 nt, Escherichia coli CFT073
caugcgguucacgcgccagag

SEQ ID NO: 598025 - RNA, 18 nt, Escherichia coli CFT073
caugcgguaaguuuucgc

SEQ ID NO: 598026 - RNA, 20 nt, Escherichia coli CFT073
caugcgguaaguuuucgccg

SEQ ID NO: 598027 - RNA, 21 nt, Escherichia coli CFT073
caugcccggucgggugcucau

SEQ ID NO: 598028 - RNA, 16 nt, Escherichia coli CFT073
caugccgcccagcagc

SEQ ID NO: 598029 - RNA, 17 nt, Escherichia coli CFT073
caugccggccagcgcca

SEQ ID NO: 598030 - RNA, 18 nt, Escherichia coli CFT073
caugccggccagcgccac

SEQ ID NO: 598031 - RNA, 17 nt, Escherichia coli CFT073
caugcacauccacgccu

SEQ ID NO: 598032 - RNA, 20 nt, Escherichia coli CFT073
caugauuguauggaaugcgc

SEQ ID NO: 598033 - RNA, 16 nt, Escherichia coli CFT073
caugauuuucaucuuu

SEQ ID NO: 598034 - RNA, 14 nt, Escherichia coli CFT073
caugauuaccagca

SEQ ID NO: 598035 - RNA, 17 nt, Escherichia coli CFT073
caugauuaucaugcccu

SEQ ID NO: 598036 - RNA, 22 nt, Escherichia coli CFT073
caucggcugcgcuucuuccagc

SEQ ID NO: 598037 - RNA, 13 nt, Escherichia coli CFT073
caucggcgucggu

SEQ ID NO: 598038 - RNA, 17 nt, Escherichia coli CFT073
ccagagccgcgccgcua

SEQ ID NO: 598039 - RNA, 18 nt, Escherichia coli CFT073
ccagagccgcgccgcuac

SEQ ID NO: 598040 - RNA, 19 nt, Escherichia coli CFT073
ccagagcggagauaaucgc

SEQ ID NO: 598041 - RNA, 16 nt, Escherichia coli CFT073
ccagauuaaucagcag

SEQ ID NO: 598042 - RNA, 14 nt, Escherichia coli CFT073
ccagcaaacgcacu

SEQ ID NO: 598043 - RNA, 14 nt, Escherichia coli CFT073
ccagcaacgcuuca

SEQ ID NO: 598044 - RNA, 19 nt, Escherichia coli CFT073
ccagcaaccaaugccgcca

SEQ ID NO: 598045 - RNA, 18 nt, Escherichia coli CFT073
ccagcaagcgcaccgauu

SEQ ID NO: 598046 - RNA, 16 nt, Escherichia coli CFT073
ccagcacauauucacg

SEQ ID NO: 598047 - RNA, 20 nt, Escherichia coli CFT073
ccagcacaucaucaaagcca

SEQ ID NO: 598048 - RNA, 22 nt, Escherichia coli CFT073
ccagcacauagccgaaaaugcu

SEQ ID NO: 598049 - RNA, 23 nt, Escherichia coli CFT073
ccagcaauaagccaguccagaaa

SEQ ID NO: 598050 - RNA, 19 nt, Escherichia coli CFT073
ccagcagcccgagcaacag

SEQ ID NO: 598051 - RNA, 17 nt, Escherichia coli CFT073
ccagcaggugauacauc

SEQ ID NO: 598052 - RNA, 16 nt, Escherichia coli CFT073
ccagcaucgcaucagg

SEQ ID NO: 598053 - RNA, 20 nt, Escherichia coli CFT073
ccagcaggaaucccaucaga

SEQ ID NO: 598054 - RNA, 14 nt, Escherichia coli CFT073
ccagaagggguaau

SEQ ID NO: 598055 - RNA, 19 nt, Escherichia coli CFT073
ccagaauccggugauugcu

SEQ ID NO: 598056 - RNA, 18 nt, Escherichia coli CFT073
ccagaaucgcaaccagcc

SEQ ID NO: 598057 - RNA, 19 nt, Escherichia coli CFT073
ccagaaucgcaaccagcca

SEQ ID NO: 598058 - RNA, 21 nt, Escherichia coli CFT073
ccagaagacgagccgucccua

SEQ ID NO: 598059 - RNA, 23 nt, Escherichia coli CFT073
ccagaacgacgaccgccgcucac

SEQ ID NO: 598060 - RNA, 14 nt, Escherichia coli CFT073
ccagaacgccgaau

SEQ ID NO: 598061 - RNA, 13 nt, Escherichia coli CFT073
ccagaaaguggca

SEQ ID NO: 598062 - RNA, 15 nt, Escherichia coli CFT073
ccagaaccagcaacc

SEQ ID NO: 598063 - RNA, 18 nt, Escherichia coli CFT073
ccagacgugcacgcagca

SEQ ID NO: 598064 - RNA, 22 nt, Escherichia coli CFT073
ccagacgugcacgcagcaaacg

SEQ ID NO: 598065 - RNA, 19 nt, Escherichia coli CFT073
ccagacugacaaucaucgc

SEQ ID NO: 598066 - RNA, 20 nt, Escherichia coli CFT073
ccagacugacaaucaucgcc

SEQ ID NO: 598067 - RNA, 14 nt, Escherichia coli CFT073
ccagacguuucgcc

SEQ ID NO: 598068 - RNA, 13 nt, Escherichia coli CFT073
ccagaaugcccca

SEQ ID NO: 598069 - RNA, 19 nt, Escherichia coli CFT073
ccagaauuccgugccagca

SEQ ID NO: 598070 - RNA, 20 nt, Escherichia coli CFT073
ccagaauuccgugccagcac

SEQ ID NO: 598071 - RNA, 15 nt, Escherichia coli CFT073
ccagacaacagucaa

SEQ ID NO: 598072 - RNA, 20 nt, Escherichia coli CFT073
ccagacaauccgcagcaaag

SEQ ID NO: 598073 - RNA, 22 nt, Escherichia coli CFT073
ccacuuuaaugugucugaaagc

SEQ ID NO: 598074 - RNA, 20 nt, Escherichia coli CFT073
ccacuucuuucgcccagcgu

SEQ ID NO: 598075 - RNA, 21 nt, Escherichia coli CFT073
ccacuugagccgccaccagaa

SEQ ID NO: 598076 - RNA, 14 nt, Escherichia coli CFT073
ccacuugcagcuca

SEQ ID NO: 598077 - RNA, 16 nt, Escherichia coli CFT073
ccacuuugcgcuccug

SEQ ID NO: 598078 - RNA, 20 nt, Escherichia coli CFT073
ccacuuuucggcaaccgcau

SEQ ID NO: 598079 - RNA, 19 nt, Escherichia coli CFT073
ccagaaaaccuggcgcagu

SEQ ID NO: 598080 - RNA, 18 nt, Escherichia coli CFT073
ccagaaaauacucagcac

SEQ ID NO: 598081 - RNA, 22 nt, Escherichia coli CFT073
ccagaaaauacucagcaccccg

SEQ ID NO: 598082 - RNA, 19 nt, Escherichia coli CFT073
ccagaaaaucacggcaaac

SEQ ID NO: 598083 - RNA, 20 nt, Escherichia coli CFT073
ccagaaacauccccagcguc

SEQ ID NO: 598084 - RNA, 14 nt, Escherichia coli CFT073
ccacuuccugcgga

SEQ ID NO: 598085 - RNA, 14 nt, Escherichia coli CFT073
ccacuuccugcucg

SEQ ID NO: 598086 - RNA, 19 nt, Escherichia coli CFT073
ccacuucccaacgcugcgu

SEQ ID NO: 598087 - RNA, 15 nt, Escherichia coli CFT073
ccacucugccaggca

SEQ ID NO: 598088 - RNA, 14 nt, Escherichia coli CFT073
ccacucuuaacgcc

SEQ ID NO: 598089 - RNA, 22 nt, Escherichia coli CFT073
ccacucuucccuauccggaaac

SEQ ID NO: 598090 - RNA, 21 nt, Escherichia coli CFT073
ccacugacacaggcagcaauc

SEQ ID NO: 598091 - RNA, 13 nt, Escherichia coli CFT073
ccacucuccuggu

SEQ ID NO: 598092 - RNA, 24 nt, Escherichia coli CFT073
ccacuccgguaauaucgcgcagaa

SEQ ID NO: 598093 - RNA, 14 nt, Escherichia coli CFT073
ccacggcagcaacu

SEQ ID NO: 598094 - RNA, 23 nt, Escherichia coli CFT073
ccacggacauaaagcccgcuuca

SEQ ID NO: 598095 - RNA, 21 nt, Escherichia coli CFT073
ccacggacuuaugaguucgcg

SEQ ID NO: 598096 - RNA, 19 nt, Escherichia coli CFT073
ccacggaguugaccagcuc

SEQ ID NO: 598097 - RNA, 18 nt, Escherichia coli CFT073
ccacggaaaggcaguuca

SEQ ID NO: 598098 - RNA, 16 nt, Escherichia coli CFT073
ccacgcucagcaaucg

SEQ ID NO: 598099 - RNA, 15 nt, Escherichia coli CFT073
ccacgcucgcuggcg

SEQ ID NO: 598100 - RNA, 14 nt, Escherichia coli CFT073
ccaccgucaaaucc

SEQ ID NO: 598101 - RNA, 13 nt, Escherichia coli CFT073
ccacgucaucagc

SEQ ID NO: 598102 - RNA, 19 nt, Escherichia coli CFT073
ccacgucacaggccaucac

SEQ ID NO: 598103 - RNA, 22 nt, Escherichia coli CFT073
ccacgguuuuuugcagcaacca

SEQ ID NO: 598104 - RNA, 18 nt, Escherichia coli CFT073
ccacgguaugacccagcg

SEQ ID NO: 598105 - RNA, 16 nt, Escherichia coli CFT073
ccacggcucgugcggu

SEQ ID NO: 598106 - RNA, 16 nt, Escherichia coli CFT073
ccacgggacgcugcac

SEQ ID NO: 598107 - RNA, 16 nt, Escherichia coli CFT073
ccacggccauauccag

SEQ ID NO: 598108 - RNA, 20 nt, Escherichia coli CFT073
ccagcaugaugcucucccaa

SEQ ID NO: 598109 - RNA, 14 nt, Escherichia coli CFT073
ccagcaugccgcca

SEQ ID NO: 598110 - RNA, 23 nt, Escherichia coli CFT073
ccagcaucucaaucgcacccgcc

SEQ ID NO: 598111 - RNA, 15 nt, Escherichia coli CFT073
ccagcaucggcaacg

SEQ ID NO: 598112 - RNA, 15 nt, Escherichia coli CFT073
ccagcaucuguucuu

SEQ ID NO: 598113 - RNA, 14 nt, Escherichia coli CFT073
ccagccuucuucau

SEQ ID NO: 598114 - RNA, 14 nt, Escherichia coli CFT073
ccagccgucgucgc

SEQ ID NO: 598115 - RNA, 13 nt, Escherichia coli CFT073
ccagcgauaucgc

SEQ ID NO: 598116 - RNA, 11 nt, Escherichia coli CFT073
ccagcgauccg

SEQ ID NO: 598117 - RNA, 17 nt, Escherichia coli CFT073
ccagcgacacaaugggc

SEQ ID NO: 598118 - RNA, 18 nt, Escherichia coli CFT073
ccagcgacagaaaucaga

SEQ ID NO: 598119 - RNA, 19 nt, Escherichia coli CFT073
ccagcgccaccaccaguac

SEQ ID NO: 598120 - RNA, 16 nt, Escherichia coli CFT073
ccagcgcaaggcgcga

SEQ ID NO: 598121 - RNA, 15 nt, Escherichia coli CFT073
ccagcgccuggcagc

SEQ ID NO: 598122 - RNA, 19 nt, Escherichia coli CFT073
ccagcggaaauuaccgcac

SEQ ID NO: 598123 - RNA, 20 nt, Escherichia coli CFT073
ccagcgcuucagcgaucgcu

SEQ ID NO: 598124 - RNA, 14 nt, Escherichia coli CFT073
ccagcgcugcccac

SEQ ID NO: 598125 - RNA, 18 nt, Escherichia coli CFT073
ccagcgcguuugucagca

SEQ ID NO: 598126 - RNA, 13 nt, Escherichia coli CFT073
ccagcuccgggcu

SEQ ID NO: 598127 - RNA, 16 nt, Escherichia coli CFT073
ccagcuccguccagcc

SEQ ID NO: 598128 - RNA, 18 nt, Escherichia coli CFT073
ccagcuaaucgagccgau

SEQ ID NO: 598129 - RNA, 18 nt, Escherichia coli CFT073
ccagcuaccacgccgaua

SEQ ID NO: 598130 - RNA, 19 nt, Escherichia coli CFT073
ccagcguuaucccauucca

SEQ ID NO: 598131 - RNA, 17 nt, Escherichia coli CFT073
ccagcggcaaccagcag

SEQ ID NO: 598132 - RNA, 21 nt, Escherichia coli CFT073
ccaggacuucaucacgaugca

SEQ ID NO: 598133 - RNA, 23 nt, Escherichia coli CFT073
ccaggaccacuggcgacgccgga

SEQ ID NO: 598134 - RNA, 21 nt, Escherichia coli CFT073
ccaggaacgggauugccagca

SEQ ID NO: 598135 - RNA, 22 nt, Escherichia coli CFT073
ccaggaacucagcgugccauca

SEQ ID NO: 598136 - RNA, 21 nt, Escherichia coli CFT073
ccaggaaaaagaucagcggcg

SEQ ID NO: 598137 - RNA, 21 nt, Escherichia coli CFT073
ccagcuucgcuucccaacgca

SEQ ID NO: 598138 - RNA, 19 nt, Escherichia coli CFT073
ccagcuuccaggcaaucag

SEQ ID NO: 598139 - RNA, 15 nt, Escherichia coli CFT073
ccagcuguaccagca

SEQ ID NO: 598140 - RNA, 16 nt, Escherichia coli CFT073
ccagcuguaccagcaa

SEQ ID NO: 598141 - RNA, 14 nt, Escherichia coli CFT073
ccagcugccugcca

SEQ ID NO: 598142 - RNA, 22 nt, Escherichia coli CFT073
ccagcugaaaucaccgccacca

SEQ ID NO: 598143 - RNA, 21 nt, Escherichia coli CFT073
caucaacuuaauacgcugcgu

SEQ ID NO: 598144 - RNA, 16 nt, Escherichia coli CFT073
caucaagcgaaaaugc

SEQ ID NO: 598145 - RNA, 22 nt, Escherichia coli CFT073
caucaaguagcagguaaucugc

SEQ ID NO: 598146 - RNA, 18 nt, Escherichia coli CFT073
caucaaggcugauaacgu

SEQ ID NO: 598147 - RNA, 18 nt, Escherichia coli CFT073
caucaauaaucaccgaac

SEQ ID NO: 598148 - RNA, 23 nt, Escherichia coli CFT073
caucaauaccauuaucauugagc

SEQ ID NO: 598149 - RNA, 21 nt, Escherichia coli CFT073
cauagcuuggcagagcgacau

SEQ ID NO: 598150 - RNA, 22 nt, Escherichia coli CFT073
cauagcuuggcagagcgacaua

SEQ ID NO: 598151 - RNA, 22 nt, Escherichia coli CFT073
cauagcuaauccccuccagcga

SEQ ID NO: 598152 - RNA, 19 nt, Escherichia coli CFT073
caucaacguaguaucguaa

SEQ ID NO: 598153 - RNA, 21 nt, Escherichia coli CFT073
caucaacgugaaucccaguac

SEQ ID NO: 598154 - RNA, 23 nt, Escherichia coli CFT073
caucaacguuaauacuacgcaga

SEQ ID NO: 598155 - RNA, 18 nt, Escherichia coli CFT073
cauagccccagcgcagac

SEQ ID NO: 598156 - RNA, 15 nt, Escherichia coli CFT073
cauagcacauccuga

SEQ ID NO: 598157 - RNA, 15 nt, Escherichia coli CFT073
cauagcaggcauccu

SEQ ID NO: 598158 - RNA, 18 nt, Escherichia coli CFT073
cauagcgugacaccagca

SEQ ID NO: 598159 - RNA, 18 nt, Escherichia coli CFT073
cauagcgggcaaucagcg

SEQ ID NO: 598160 - RNA, 18 nt, Escherichia coli CFT073
cauagcgguaaaugacgg

SEQ ID NO: 598161 - RNA, 21 nt, Escherichia coli CFT073
cauagccucugccccgccaac

SEQ ID NO: 598162 - RNA, 16 nt, Escherichia coli CFT073
caucaaugauaaucuc

SEQ ID NO: 598163 - RNA, 22 nt, Escherichia coli CFT073
caucaaugauauaccguagauu

SEQ ID NO: 598164 - RNA, 23 nt, Escherichia coli CFT073
caucaauaugaauuaacgucagg

SEQ ID NO: 598165 - RNA, 13 nt, Escherichia coli CFT073
caucaauauucca

SEQ ID NO: 598166 - RNA, 15 nt, Escherichia coli CFT073
caucaauccacuucg

SEQ ID NO: 598167 - RNA, 18 nt, Escherichia coli CFT073
caucaauccacuucgcca

SEQ ID NO: 598168 - RNA, 14 nt, Escherichia coli CFT073
caucacgaaaauca

SEQ ID NO: 598169 - RNA, 14 nt, Escherichia coli CFT073
caucaauugcaauc

SEQ ID NO: 598170 - RNA, 16 nt, Escherichia coli CFT073
caucacggcagccuga

SEQ ID NO: 598171 - RNA, 22 nt, Escherichia coli CFT073
caucacgacaaaugcgccgcca

SEQ ID NO: 598172 - RNA, 16 nt, Escherichia coli CFT073
caucagcagcaacaaa

SEQ ID NO: 598173 - RNA, 14 nt, Escherichia coli CFT073
caucaggcaacccg

SEQ ID NO: 598174 - RNA, 17 nt, Escherichia coli CFT073
caucaggcaaucggcgc

SEQ ID NO: 598175 - RNA, 22 nt, Escherichia coli CFT073
caucaggcaaucggcgcaaaau

SEQ ID NO: 598176 - RNA, 13 nt, Escherichia coli CFT073
caucaggcaugau

SEQ ID NO: 598177 - RNA, 17 nt, Escherichia coli CFT073
caucaggcaucgugcac

SEQ ID NO: 598178 - RNA, 21 nt, Escherichia coli CFT073
caucaggcaucgugcaccaau

SEQ ID NO: 598179 - RNA, 18 nt, Escherichia coli CFT073
caucagcuggaucgagau

SEQ ID NO: 598180 - RNA, 17 nt, Escherichia coli CFT073
caucagcggcaaaacgg

SEQ ID NO: 598181 - RNA, 22 nt, Escherichia coli CFT073
cauccacuaacccuucgccagc

SEQ ID NO: 598182 - RNA, 18 nt, Escherichia coli CFT073
cauccagaaaguaacaau

SEQ ID NO: 598183 - RNA, 21 nt, Escherichia coli CFT073
cauccacugcauacugaacca

SEQ ID NO: 598184 - RNA, 12 nt, Escherichia coli CFT073
cauccagcagag

SEQ ID NO: 598185 - RNA, 12 nt, Escherichia coli CFT073
cauccagcagcg

SEQ ID NO: 598186 - RNA, 23 nt, Escherichia coli CFT073
cauccagagaucgcguagcggcg

SEQ ID NO: 598187 - RNA, 12 nt, Escherichia coli CFT073
cauccaucagcg

SEQ ID NO: 598188 - RNA, 19 nt, Escherichia coli CFT073
cauccauagcuuuggcggc

SEQ ID NO: 598189 - RNA, 20 nt, Escherichia coli CFT073
cauccauugcauaaacaccu

SEQ ID NO: 598190 - RNA, 15 nt, Escherichia coli CFT073
caucccacacuguug

SEQ ID NO: 598191 - RNA, 15 nt, Escherichia coli CFT073
caucccaggcaucca

SEQ ID NO: 598192 - RNA, 15 nt, Escherichia coli CFT073
cauccccacaccuga

SEQ ID NO: 598193 - RNA, 15 nt, Escherichia coli CFT073
cauccugaaucgcuu

SEQ ID NO: 598194 - RNA, 17 nt, Escherichia coli CFT073
cauccugaauuaacuua

SEQ ID NO: 598195 - RNA, 21 nt, Escherichia coli CFT073
cauccuggggauucaucacca

SEQ ID NO: 598196 - RNA, 20 nt, Escherichia coli CFT073
cauccugaguuaaucgccgc

SEQ ID NO: 598197 - RNA, 15 nt, Escherichia coli CFT073
caucgacaucaacga

SEQ ID NO: 598198 - RNA, 18 nt, Escherichia coli CFT073
caucgacaccagccagac

SEQ ID NO: 598199 - RNA, 17 nt, Escherichia coli CFT073
caucgaauaaauugagc

SEQ ID NO: 598200 - RNA, 17 nt, Escherichia coli CFT073
caucgaaccaucggcuu

SEQ ID NO: 598201 - RNA, 21 nt, Escherichia coli CFT073
cauccggcgauuuucaucgcu

SEQ ID NO: 598202 - RNA, 17 nt, Escherichia coli CFT073
cauccggcaauauccau

SEQ ID NO: 598203 - RNA, 17 nt, Escherichia coli CFT073
cauccggcaaugaaacu

SEQ ID NO: 598204 - RNA, 21 nt, Escherichia coli CFT073
cauccggcacgucuucgauau

SEQ ID NO: 598205 - RNA, 18 nt, Escherichia coli CFT073
cauccgcugaaaaacgaa

SEQ ID NO: 598206 - RNA, 17 nt, Escherichia coli CFT073
caucgcauacgguuucu

SEQ ID NO: 598207 - RNA, 20 nt, Escherichia coli CFT073
caucgcauacgguuucucca

SEQ ID NO: 598208 - RNA, 16 nt, Escherichia coli CFT073
caucgcagauuucuuc

SEQ ID NO: 598209 - RNA, 21 nt, Escherichia coli CFT073
caucgcaccaaacgggcaagc

SEQ ID NO: 598210 - RNA, 14 nt, Escherichia coli CFT073
caucgaugccgccu

SEQ ID NO: 598211 - RNA, 15 nt, Escherichia coli CFT073
caucgcaaaauuucg

SEQ ID NO: 598212 - RNA, 19 nt, Escherichia coli CFT073
caucgcaaaggacaucccg

SEQ ID NO: 598213 - RNA, 18 nt, Escherichia coli CFT073
caucgacgaaauggugug

SEQ ID NO: 598214 - RNA, 21 nt, Escherichia coli CFT073
caucgacgaaauggugugcau

SEQ ID NO: 598215 - RNA, 20 nt, Escherichia coli CFT073
caucgagcagcauaauugcc

SEQ ID NO: 598216 - RNA, 14 nt, Escherichia coli CFT073
caucgacuccagcg

SEQ ID NO: 598217 - RNA, 21 nt, Escherichia coli CFT073
caucgacuccagcgcuucgcu

SEQ ID NO: 598218 - RNA, 15 nt, Escherichia coli CFT073
caucgacuucucgca

SEQ ID NO: 598219 - RNA, 17 nt, Escherichia coli CFT073
caucgcaucguacauca

SEQ ID NO: 598220 - RNA, 15 nt, Escherichia coli CFT073
caucgcaugacgcaa

SEQ ID NO: 598221 - RNA, 14 nt, Escherichia coli CFT073
caucgcaugccagc

SEQ ID NO: 598222 - RNA, 17 nt, Escherichia coli CFT073
caucgcaacgcaucuuu

SEQ ID NO: 598223 - RNA, 14 nt, Escherichia coli CFT073
caucgccacugcaa

SEQ ID NO: 598224 - RNA, 23 nt, Escherichia coli CFT073
caucgccagaacuacccgguucg

SEQ ID NO: 598225 - RNA, 20 nt, Escherichia coli CFT073
caucgccauuaccaccaccu

SEQ ID NO: 598226 - RNA, 12 nt, Escherichia coli CFT073
caucgccauuua

SEQ ID NO: 598227 - RNA, 18 nt, Escherichia coli CFT073
caucgccauaaacaccag

SEQ ID NO: 598228 - RNA, 23 nt, Escherichia coli CFT073
caucgccgcacuauuuaccgcca

SEQ ID NO: 598229 - RNA, 14 nt, Escherichia coli CFT073
caucgccgccaaac

SEQ ID NO: 598230 - RNA, 13 nt, Escherichia coli CFT073
caucgcuucaugc

SEQ ID NO: 598231 - RNA, 15 nt, Escherichia coli CFT073
caucggcaacgccag

SEQ ID NO: 598232 - RNA, 17 nt, Escherichia coli CFT073
caucggcaacgccagcg

SEQ ID NO: 598233 - RNA, 18 nt, Escherichia coli CFT073
caucgcugaauuucgccg

SEQ ID NO: 598234 - RNA, 21 nt, Escherichia coli CFT073
caucgcgguuaugccgccgac

SEQ ID NO: 598235 - RNA, 15 nt, Escherichia coli CFT073
caucgcguuaauccg

SEQ ID NO: 598236 - RNA, 18 nt, Escherichia coli CFT073
caucgcuacauaacgcag

SEQ ID NO: 598237 - RNA, 19 nt, Escherichia coli CFT073
caucggccuuuaacgccac

SEQ ID NO: 598238 - RNA, 14 nt, Escherichia coli CFT073
caucggcagcgcca

SEQ ID NO: 598239 - RNA, 24 nt, Escherichia coli CFT073
caucggcauuaaucugcucggcga

SEQ ID NO: 598240 - RNA, 16 nt, Escherichia coli CFT073
caucggcaccgccagc

SEQ ID NO: 598241 - RNA, 21 nt, Escherichia coli CFT073
caucggcagacagcgccaggc

SEQ ID NO: 598242 - RNA, 14 nt, Escherichia coli CFT073
caucgcgcuggcgc

SEQ ID NO: 598243 - RNA, 14 nt, Escherichia coli CFT073
caucgcggcugcgu

SEQ ID NO: 598244 - RNA, 23 nt, Escherichia coli CFT073
caucgcggcugcguaauucgcca

SEQ ID NO: 598245 - RNA, 21 nt, Escherichia coli CFT073
caucgcgguaauaaacgcccg

SEQ ID NO: 598246 - RNA, 15 nt, Escherichia coli CFT073
caucgcgcuuaucgc

SEQ ID NO: 598247 - RNA, 18 nt, Escherichia coli CFT073
caucgcgcuuaucgccag

SEQ ID NO: 598248 - RNA, 17 nt, Escherichia coli CFT073
caucgcgcccgccgcca

SEQ ID NO: 598249 - RNA, 23 nt, Escherichia coli CFT073
caucgcgcccgccgccauugaau

SEQ ID NO: 598250 - RNA, 13 nt, Escherichia coli CFT073
caucgcgacggca

SEQ ID NO: 598251 - RNA, 20 nt, Escherichia coli CFT073
caucgcgaggaaugacggau

SEQ ID NO: 598252 - RNA, 14 nt, Escherichia coli CFT073
caucgcgauccacg

SEQ ID NO: 598253 - RNA, 21 nt, Escherichia coli CFT073
caucgccugaucgcgcaguaa

SEQ ID NO: 598254 - RNA, 21 nt, Escherichia coli CFT073
caucgccuucgcaaaaaacca

SEQ ID NO: 598255 - RNA, 22 nt, Escherichia coli CFT073
caucgccuucgcaaaaaaccau

SEQ ID NO: 598256 - RNA, 19 nt, Escherichia coli CFT073
cagguucugaccagccagc

SEQ ID NO: 598257 - RNA, 20 nt, Escherichia coli CFT073
caggugguuagccgcguaca

SEQ ID NO: 598258 - RNA, 16 nt, Escherichia coli CFT073
cagguuaacccacagc

SEQ ID NO: 598259 - RNA, 13 nt, Escherichia coli CFT073
cagguuacggucg

SEQ ID NO: 598260 - RNA, 23 nt, Escherichia coli CFT073
cagguuauugaccgacgcauuaa

SEQ ID NO: 598261 - RNA, 17 nt, Escherichia coli CFT073
caggugaaucaggcgau

SEQ ID NO: 598262 - RNA, 23 nt, Escherichia coli CFT073
caggucgaugcacucgccaggau

SEQ ID NO: 598263 - RNA, 17 nt, Escherichia coli CFT073
caguaaucgcgccagcc

SEQ ID NO: 598264 - RNA, 18 nt, Escherichia coli CFT073
caguaaucggcugaacgu

SEQ ID NO: 598265 - RNA, 17 nt, Escherichia coli CFT073
caguagugaaaaaagca

SEQ ID NO: 598266 - RNA, 19 nt, Escherichia coli CFT073
cagucaccugcccuccggu

SEQ ID NO: 598267 - RNA, 18 nt, Escherichia coli CFT073
cagucaccagcaucagcg

SEQ ID NO: 598268 - RNA, 13 nt, Escherichia coli CFT073
cagucagccagcg

SEQ ID NO: 598269 - RNA, 14 nt, Escherichia coli CFT073
cagucagcgguuuu

SEQ ID NO: 598270 - RNA, 20 nt, Escherichia coli CFT073
caguaugaaacgccugauga

SEQ ID NO: 598271 - RNA, 22 nt, Escherichia coli CFT073
cagucaaaacuuuucaccagcg

SEQ ID NO: 598272 - RNA, 14 nt, Escherichia coli CFT073
cagguugcaguugg

SEQ ID NO: 598273 - RNA, 18 nt, Escherichia coli CFT073
cagguugccguccagcgc

SEQ ID NO: 598274 - RNA, 20 nt, Escherichia coli CFT073
cagguugccguccagcgccu

SEQ ID NO: 598275 - RNA, 19 nt, Escherichia coli CFT073
caguaaaaucgacaucugc

SEQ ID NO: 598276 - RNA, 15 nt, Escherichia coli CFT073
caguaaacacaccac

SEQ ID NO: 598277 - RNA, 14 nt, Escherichia coli CFT073
caguaaaccaauca

SEQ ID NO: 598278 - RNA, 19 nt, Escherichia coli CFT073
caguaaaccacaucagcga

SEQ ID NO: 598279 - RNA, 15 nt, Escherichia coli CFT073
caguaaagcagcgaa

SEQ ID NO: 598280 - RNA, 13 nt, Escherichia coli CFT073
caguaauauggcg

SEQ ID NO: 598281 - RNA, 15 nt, Escherichia coli CFT073
cagucuuaaaaagca

SEQ ID NO: 598282 - RNA, 17 nt, Escherichia coli CFT073
cagugaaaauggcgcuc

SEQ ID NO: 598283 - RNA, 16 nt, Escherichia coli CFT073
cagugaauuaaaaaca

SEQ ID NO: 598284 - RNA, 12 nt, Escherichia coli CFT073
cagugaccagcg

SEQ ID NO: 598285 - RNA, 13 nt, Escherichia coli CFT073
cagugaccagcgg

SEQ ID NO: 598286 - RNA, 21 nt, Escherichia coli CFT073
cagugaccaucuuccagcauc

SEQ ID NO: 598287 - RNA, 18 nt, Escherichia coli CFT073
cagugacccgcagccagc

SEQ ID NO: 598288 - RNA, 22 nt, Escherichia coli CFT073
cagucuccuugcuccacgcuca

SEQ ID NO: 598289 - RNA, 19 nt, Escherichia coli CFT073
cagucguuaugcacgcucu

SEQ ID NO: 598290 - RNA, 13 nt, Escherichia coli CFT073
cagucggucgauu

SEQ ID NO: 598291 - RNA, 20 nt, Escherichia coli CFT073
cagucgguucaaccaucagc

SEQ ID NO: 598292 - RNA, 15 nt, Escherichia coli CFT073
cagucguaaugaauc

SEQ ID NO: 598293 - RNA, 22 nt, Escherichia coli CFT073
cagucguaaugaaucagcagau

SEQ ID NO: 598294 - RNA, 16 nt, Escherichia coli CFT073
cagucgggugcugccg

SEQ ID NO: 598295 - RNA, 19 nt, Escherichia coli CFT073
cagucgcuuuaccgcugcg

SEQ ID NO: 598296 - RNA, 20 nt, Escherichia coli CFT073
cauaaagauguaaucgccuu

SEQ ID NO: 598297 - RNA, 14 nt, Escherichia coli CFT073
cauaaagccugaua

SEQ ID NO: 598298 - RNA, 17 nt, Escherichia coli CFT073
cauaaacaauacagcga

SEQ ID NO: 598299 - RNA, 16 nt, Escherichia coli CFT073
cauaaacacucacauc

SEQ ID NO: 598300 - RNA, 13 nt, Escherichia coli CFT073
cauaaaccagcgg

SEQ ID NO: 598301 - RNA, 15 nt, Escherichia coli CFT073
cauaagccgcggcgu

SEQ ID NO: 598302 - RNA, 20 nt, Escherichia coli CFT073
cauaagguguaccgguagca

SEQ ID NO: 598303 - RNA, 15 nt, Escherichia coli CFT073
caguuuuucacccgc

SEQ ID NO: 598304 - RNA, 15 nt, Escherichia coli CFT073
caguuuuuucugugc

SEQ ID NO: 598305 - RNA, 14 nt, Escherichia coli CFT073
caguucguucaguu

SEQ ID NO: 598306 - RNA, 16 nt, Escherichia coli CFT073
cauaauuucagcaucg

SEQ ID NO: 598307 - RNA, 20 nt, Escherichia coli CFT073
cauaaugucgcuggccggac

SEQ ID NO: 598308 - RNA, 16 nt, Escherichia coli CFT073
cauacaaucgguaacg

SEQ ID NO: 598309 - RNA, 13 nt, Escherichia coli CFT073
cauacaacgccau

SEQ ID NO: 598310 - RNA, 22 nt, Escherichia coli CFT073
cauacaccaccacauugccgaa

SEQ ID NO: 598311 - RNA, 18 nt, Escherichia coli CFT073
cauaauauagcagcgccg

SEQ ID NO: 598312 - RNA, 15 nt, Escherichia coli CFT073
cauaaucaaugccag

SEQ ID NO: 598313 - RNA, 18 nt, Escherichia coli CFT073
cauaauccugccgagaua

SEQ ID NO: 598314 - RNA, 21 nt, Escherichia coli CFT073
cauaaucgcuacgccuuccgu

SEQ ID NO: 598315 - RNA, 18 nt, Escherichia coli CFT073
cauaaucgggaugcguaa

SEQ ID NO: 598316 - RNA, 20 nt, Escherichia coli CFT073
cauaaugauggugaaagcaa

SEQ ID NO: 598317 - RNA, 19 nt, Escherichia coli CFT073
cauagacagccacaucccg

SEQ ID NO: 598318 - RNA, 16 nt, Escherichia coli CFT073
cauaccgucgccagac

SEQ ID NO: 598319 - RNA, 20 nt, Escherichia coli CFT073
cauaccuaaaagcacgccag

SEQ ID NO: 598320 - RNA, 22 nt, Escherichia coli CFT073
cauaccuaaaagcacgccagac

SEQ ID NO: 598321 - RNA, 20 nt, Escherichia coli CFT073
cauaccuggugcagcgguuc

SEQ ID NO: 598322 - RNA, 14 nt, Escherichia coli CFT073
caguucgccuucau

SEQ ID NO: 598323 - RNA, 20 nt, Escherichia coli CFT073
caguucgccuuccagcagcu

SEQ ID NO: 598324 - RNA, 20 nt, Escherichia coli CFT073
caguuaaagcaauuccagcg

SEQ ID NO: 598325 - RNA, 18 nt, Escherichia coli CFT073
caguuacugccaucuucc

SEQ ID NO: 598326 - RNA, 16 nt, Escherichia coli CFT073
cagugucggaugcggc

SEQ ID NO: 598327 - RNA, 14 nt, Escherichia coli CFT073
caguguccaaccga

SEQ ID NO: 598328 - RNA, 15 nt, Escherichia coli CFT073
caguggaugcgccau

SEQ ID NO: 598329 - RNA, 15 nt, Escherichia coli CFT073
caguggcaaccagcg

SEQ ID NO: 598330 - RNA, 14 nt, Escherichia coli CFT073
cagugcugacugau

SEQ ID NO: 598331 - RNA, 23 nt, Escherichia coli CFT073
cagugcucuuuguaggccugaua

SEQ ID NO: 598332 - RNA, 21 nt, Escherichia coli CFT073
cagugcccgcgauuuguuuca

SEQ ID NO: 598333 - RNA, 15 nt, Escherichia coli CFT073
cagugccgccugcgc

SEQ ID NO: 598334 - RNA, 21 nt, Escherichia coli CFT073
cagugcgcgguaguuuuucga

SEQ ID NO: 598335 - RNA, 16 nt, Escherichia coli CFT073
cagugcguacccagcg

SEQ ID NO: 598336 - RNA, 16 nt, Escherichia coli CFT073
cagugcauaaauaccg

SEQ ID NO: 598337 - RNA, 22 nt, Escherichia coli CFT073
cagugccagacaaaccacgccu

SEQ ID NO: 598338 - RNA, 19 nt, Escherichia coli CFT073
cagugccaucaauaaucac

SEQ ID NO: 598339 - RNA, 13 nt, Escherichia coli CFT073
cagugaccgucau

SEQ ID NO: 598340 - RNA, 19 nt, Escherichia coli CFT073
cagugacggcuucucggca

SEQ ID NO: 598341 - RNA, 19 nt, Escherichia coli CFT073
cagugaucgugugccacca

SEQ ID NO: 598342 - RNA, 23 nt, Escherichia coli CFT073
cagugaucuacguaggccggaua

SEQ ID NO: 598343 - RNA, 23 nt, Escherichia coli CFT073
cagugcaaaaaaucaacagccac

SEQ ID NO: 598344 - RNA, 16 nt, Escherichia coli CFT073
cagugauugccgcgac

SEQ ID NO: 598345 - RNA, 20 nt, Escherichia coli CFT073
cagugcagauaccaccagcg

SEQ ID NO: 598346 - RNA, 21 nt, Escherichia coli CFT073
cagugcagcgcaugauuuuca

SEQ ID NO: 598347 - RNA, 15 nt, Escherichia coli CFT073
cagugcaggaugcga

SEQ ID NO: 598348 - RNA, 12 nt, Escherichia coli CFT073
cagcuccagcgc

SEQ ID NO: 598349 - RNA, 14 nt, Escherichia coli CFT073
cagcuaaugccaac

SEQ ID NO: 598350 - RNA, 15 nt, Escherichia coli CFT073
cagcuaaugccaacg

SEQ ID NO: 598351 - RNA, 21 nt, Escherichia coli CFT073
cagcguuugcagcuuacgcgc

SEQ ID NO: 598352 - RNA, 16 nt, Escherichia coli CFT073
cagcguuugcggcgcu

SEQ ID NO: 598353 - RNA, 23 nt, Escherichia coli CFT073
cagcguuuaucaauauccagucg

SEQ ID NO: 598354 - RNA, 16 nt, Escherichia coli CFT073
cagcguuucgccgccc

SEQ ID NO: 598355 - RNA, 22 nt, Escherichia coli CFT073
cagcguugaggaacucaaacca

SEQ ID NO: 598356 - RNA, 20 nt, Escherichia coli CFT073
cagcguugagggauaggugg

SEQ ID NO: 598357 - RNA, 23 nt, Escherichia coli CFT073
cagcgugcauagcagcacaccac

SEQ ID NO: 598358 - RNA, 18 nt, Escherichia coli CFT073
cagcgugccaggcgcgcu

SEQ ID NO: 598359 - RNA, 14 nt, Escherichia coli CFT073
cagcgugagcggca

SEQ ID NO: 598360 - RNA, 15 nt, Escherichia coli CFT073
cagcgcgaucgcgcc

SEQ ID NO: 598361 - RNA, 15 nt, Escherichia coli CFT073
cagcggguuuucuac

SEQ ID NO: 598362 - RNA, 17 nt, Escherichia coli CFT073
cagcgguaaaaugguca

SEQ ID NO: 598363 - RNA, 21 nt, Escherichia coli CFT073
cagcgguaacuuaucuguaau

SEQ ID NO: 598364 - RNA, 18 nt, Escherichia coli CFT073
cagcgggcgucaaaauca

SEQ ID NO: 598365 - RNA, 16 nt, Escherichia coli CFT073
cagcguaauagccuga

SEQ ID NO: 598366 - RNA, 15 nt, Escherichia coli CFT073
cagcguaccugccgc

SEQ ID NO: 598367 - RNA, 17 nt, Escherichia coli CFT073
cagcguaccugccgcgc

SEQ ID NO: 598368 - RNA, 13 nt, Escherichia coli CFT073
cagcguacguuca

SEQ ID NO: 598369 - RNA, 18 nt, Escherichia coli CFT073
cagcggugccgcgauacc

SEQ ID NO: 598370 - RNA, 19 nt, Escherichia coli CFT073
cagcggugcaccugccagc

SEQ ID NO: 598371 - RNA, 16 nt, Escherichia coli CFT073
cagcgucgccagcagc

SEQ ID NO: 598372 - RNA, 20 nt, Escherichia coli CFT073
cagcgucgcauccgacauuu

SEQ ID NO: 598373 - RNA, 23 nt, Escherichia coli CFT073
caggauaauaauuugcgcgguaa

SEQ ID NO: 598374 - RNA, 15 nt, Escherichia coli CFT073
caggauaaacuccug

SEQ ID NO: 598375 - RNA, 16 nt, Escherichia coli CFT073
caggagguauuauuca

SEQ ID NO: 598376 - RNA, 13 nt, Escherichia coli CFT073
caggagcgcggca

SEQ ID NO: 598377 - RNA, 14 nt, Escherichia coli CFT073
caggaugugagcug

SEQ ID NO: 598378 - RNA, 17 nt, Escherichia coli CFT073
caggaugugagcuggcg

SEQ ID NO: 598379 - RNA, 16 nt, Escherichia coli CFT073
caggauuuccagcuca

SEQ ID NO: 598380 - RNA, 20 nt, Escherichia coli CFT073
caggcaaucaguaaucgcgc

SEQ ID NO: 598381 - RNA, 16 nt, Escherichia coli CFT073
caggcaaacuucccgc

SEQ ID NO: 598382 - RNA, 18 nt, Escherichia coli CFT073
caggcaaauucuguuuca

SEQ ID NO: 598383 - RNA, 15 nt, Escherichia coli CFT073
caggcaacaaaaaac

SEQ ID NO: 598384 - RNA, 17 nt, Escherichia coli CFT073
caggcaacccagaagaa

SEQ ID NO: 598385 - RNA, 19 nt, Escherichia coli CFT073
caggcaacuucaaggucaa

SEQ ID NO: 598386 - RNA, 12 nt, Escherichia coli CFT073
caggaccgcuga

SEQ ID NO: 598387 - RNA, 14 nt, Escherichia coli CFT073
caggacaucagcgc

SEQ ID NO: 598388 - RNA, 17 nt, Escherichia coli CFT073
caggaagggauuaugca

SEQ ID NO: 598389 - RNA, 18 nt, Escherichia coli CFT073
caggaaggcgacaagcga

SEQ ID NO: 598390 - RNA, 22 nt, Escherichia coli CFT073
cagcuugcuguuucgcugacga

SEQ ID NO: 598391 - RNA, 19 nt, Escherichia coli CFT073
cagcuuccggccagcaugc

SEQ ID NO: 598392 - RNA, 16 nt, Escherichia coli CFT073
cagcuggauaucaaug

SEQ ID NO: 598393 - RNA, 23 nt, Escherichia coli CFT073
cagcugccagaguuccugcauau

SEQ ID NO: 598394 - RNA, 13 nt, Escherichia coli CFT073
cagcuugcagccg

SEQ ID NO: 598395 - RNA, 23 nt, Escherichia coli CFT073
cagcuucgcuucccaacgcagca

SEQ ID NO: 598396 - RNA, 19 nt, Escherichia coli CFT073
cagcuucuucuccagcugc

SEQ ID NO: 598397 - RNA, 20 nt, Escherichia coli CFT073
cagcuucuucuccagcugcg

SEQ ID NO: 598398 - RNA, 16 nt, Escherichia coli CFT073
cagcucuuuauccagc

SEQ ID NO: 598399 - RNA, 19 nt, Escherichia coli CFT073
cagcucuuucucgcucagu

SEQ ID NO: 598400 - RNA, 17 nt, Escherichia coli CFT073
cagcugaugcgaacgcc

SEQ ID NO: 598401 - RNA, 16 nt, Escherichia coli CFT073
cagcugcacgccacga

SEQ ID NO: 598402 - RNA, 18 nt, Escherichia coli CFT073
cagcucuguagcaacgau

SEQ ID NO: 598403 - RNA, 20 nt, Escherichia coli CFT073
caggcaccaaaaaucaccgc

SEQ ID NO: 598404 - RNA, 14 nt, Escherichia coli CFT073
caggcccgucacgc

SEQ ID NO: 598405 - RNA, 13 nt, Escherichia coli CFT073
caggccggucauc

SEQ ID NO: 598406 - RNA, 18 nt, Escherichia coli CFT073
caggccggaugagacgcg

SEQ ID NO: 598407 - RNA, 23 nt, Escherichia coli CFT073
caggccggaugagacgcggcacu

SEQ ID NO: 598408 - RNA, 22 nt, Escherichia coli CFT073
caggcgcugaacuuccgggauc

SEQ ID NO: 598409 - RNA, 15 nt, Escherichia coli CFT073
caggcgcugcuggag

SEQ ID NO: 598410 - RNA, 19 nt, Escherichia coli CFT073
caggcgcgaagccugcgga

SEQ ID NO: 598411 - RNA, 19 nt, Escherichia coli CFT073
caggcgagugguaugacuu

SEQ ID NO: 598412 - RNA, 18 nt, Escherichia coli CFT073
caggcgaucuucccgcgc

SEQ ID NO: 598413 - RNA, 14 nt, Escherichia coli CFT073
caggcgucgcauca

SEQ ID NO: 598414 - RNA, 15 nt, Escherichia coli CFT073
caggcgucgcaucag

SEQ ID NO: 598415 - RNA, 16 nt, Escherichia coli CFT073
caggcuccagauaaca

SEQ ID NO: 598416 - RNA, 15 nt, Escherichia coli CFT073
caggcuacgccagau

SEQ ID NO: 598417 - RNA, 21 nt, Escherichia coli CFT073
caggcuacgccagauccgcca

SEQ ID NO: 598418 - RNA, 14 nt, Escherichia coli CFT073
cagggccuccugca

SEQ ID NO: 598419 - RNA, 16 nt, Escherichia coli CFT073
cagggccuccugcagc

SEQ ID NO: 598420 - RNA, 19 nt, Escherichia coli CFT073
cagggcagggaagcgaguu

SEQ ID NO: 598421 - RNA, 12 nt, Escherichia coli CFT073
cagggcaauacg

SEQ ID NO: 598422 - RNA, 19 nt, Escherichia coli CFT073
cagggacguaccaaugacc

SEQ ID NO: 598423 - RNA, 19 nt, Escherichia coli CFT073
cagggaucaacauucagau

SEQ ID NO: 598424 - RNA, 21 nt, Escherichia coli CFT073
cagggaucauccacccgcagc

SEQ ID NO: 598425 - RNA, 20 nt, Escherichia coli CFT073
cagggacgcgcaaaauggcc

SEQ ID NO: 598426 - RNA, 21 nt, Escherichia coli CFT073
cagggaaaaaagccccgcagc

SEQ ID NO: 598427 - RNA, 23 nt, Escherichia coli CFT073
caggcuuuccgucagcggcagcu

SEQ ID NO: 598428 - RNA, 19 nt, Escherichia coli CFT073
caggcuuuaaauuccgugc

SEQ ID NO: 598429 - RNA, 21 nt, Escherichia coli CFT073
caggcuuuauucugacgccac

SEQ ID NO: 598430 - RNA, 22 nt, Escherichia coli CFT073
caggcuggcgucacgccgacca

SEQ ID NO: 598431 - RNA, 23 nt, Escherichia coli CFT073
cagcaagagguaaauuugccauc

SEQ ID NO: 598432 - RNA, 14 nt, Escherichia coli CFT073
cagcaacaucacca

SEQ ID NO: 598433 - RNA, 14 nt, Escherichia coli CFT073
cagcaacaucacgc

SEQ ID NO: 598434 - RNA, 16 nt, Escherichia coli CFT073
cagcaagugcggcgca

SEQ ID NO: 598435 - RNA, 22 nt, Escherichia coli CFT073
cagcacguugugcccuuccagc

SEQ ID NO: 598436 - RNA, 16 nt, Escherichia coli CFT073
cagcacggugcgggcu

SEQ ID NO: 598437 - RNA, 14 nt, Escherichia coli CFT073
cagcaauaaucaga

SEQ ID NO: 598438 - RNA, 22 nt, Escherichia coli CFT073
cagcacuuccugcucuuucgcc

SEQ ID NO: 598439 - RNA, 19 nt, Escherichia coli CFT073
cagcacugacauuauccgg

SEQ ID NO: 598440 - RNA, 21 nt, Escherichia coli CFT073
cagcacugacauuauccggcu

SEQ ID NO: 598441 - RNA, 23 nt, Escherichia coli CFT073
cagcacugauaaucccggcggcg

SEQ ID NO: 598442 - RNA, 16 nt, Escherichia coli CFT073
cagcacguuuuauccg

SEQ ID NO: 598443 - RNA, 17 nt, Escherichia coli CFT073
cagcacguuuuauccgu

SEQ ID NO: 598444 - RNA, 17 nt, Escherichia coli CFT073
cagcacucacgccaggc

SEQ ID NO: 598445 - RNA, 15 nt, Escherichia coli CFT073
cagcacuaccgcccg

SEQ ID NO: 598446 - RNA, 13 nt, Escherichia coli CFT073
cagcagcacaaac

SEQ ID NO: 598447 - RNA, 14 nt, Escherichia coli CFT073
cagcagcaccaccg

SEQ ID NO: 598448 - RNA, 17 nt, Escherichia coli CFT073
cagcagcaccaccgccc

SEQ ID NO: 598449 - RNA, 12 nt, Escherichia coli CFT073
cagcagcacccg

SEQ ID NO: 598450 - RNA, 20 nt, Escherichia coli CFT073
cagcagcaaugcagguaccu

SEQ ID NO: 598451 - RNA, 15 nt, Escherichia coli CFT073
cagcaguucagucag

SEQ ID NO: 598452 - RNA, 12 nt, Escherichia coli CFT073
cagcagugucca

SEQ ID NO: 598453 - RNA, 15 nt, Escherichia coli CFT073
cagcaguucgcccgc

SEQ ID NO: 598454 - RNA, 19 nt, Escherichia coli CFT073
cagcagguuuugacgaguc

SEQ ID NO: 598455 - RNA, 16 nt, Escherichia coli CFT073
cagcaguaaaccgcuc

SEQ ID NO: 598456 - RNA, 21 nt, Escherichia coli CFT073
cagcaggugcgccagcgauug

SEQ ID NO: 598457 - RNA, 18 nt, Escherichia coli CFT073
cagcaggguuucaucggu

SEQ ID NO: 598458 - RNA, 23 nt, Escherichia coli CFT073
cagcagggcaauacgcuccgccc

SEQ ID NO: 598459 - RNA, 21 nt, Escherichia coli CFT073
cagcagggcaaucgcgccaac

SEQ ID NO: 598460 - RNA, 12 nt, Escherichia coli CFT073
cagcaucgacca

SEQ ID NO: 598461 - RNA, 18 nt, Escherichia coli CFT073
cagcauaaauuucucgcc

SEQ ID NO: 598462 - RNA, 22 nt, Escherichia coli CFT073
cagcauaaucaccaucagcagc

SEQ ID NO: 598463 - RNA, 22 nt, Escherichia coli CFT073
cagcaguuuuuccccugccaga

SEQ ID NO: 598464 - RNA, 21 nt, Escherichia coli CFT073
cagcaucgccgggaguuucag

SEQ ID NO: 598465 - RNA, 13 nt, Escherichia coli CFT073
cagcaucuccugc

SEQ ID NO: 598466 - RNA, 14 nt, Escherichia coli CFT073
cagcaucucgcgcu

SEQ ID NO: 598467 - RNA, 14 nt, Escherichia coli CFT073
cagccaaucauaaa

SEQ ID NO: 598468 - RNA, 15 nt, Escherichia coli CFT073
cagccaaucauaaac

SEQ ID NO: 598469 - RNA, 16 nt, Escherichia coli CFT073
cagcauggucgcagcg

SEQ ID NO: 598470 - RNA, 21 nt, Escherichia coli CFT073
cagccaguagaacaauuaaua

SEQ ID NO: 598471 - RNA, 19 nt, Escherichia coli CFT073
cagccagggcaccaguaaa

SEQ ID NO: 598472 - RNA, 16 nt, Escherichia coli CFT073
cagccacggcuccagc

SEQ ID NO: 598473 - RNA, 23 nt, Escherichia coli CFT073
cagccacaguuuuccgccauuca

SEQ ID NO: 598474 - RNA, 21 nt, Escherichia coli CFT073
cagccacaacaaacgaccgcg

SEQ ID NO: 598475 - RNA, 18 nt, Escherichia coli CFT073
cagccaguucgagaaaaa

SEQ ID NO: 598476 - RNA, 24 nt, Escherichia coli CFT073
cagccaguuuuucagcgccagcgc

SEQ ID NO: 598477 - RNA, 22 nt, Escherichia coli CFT073
cagccaguauugccaugcacgc

SEQ ID NO: 598478 - RNA, 18 nt, Escherichia coli CFT073
cagccaguccggcaaugu

SEQ ID NO: 598479 - RNA, 19 nt, Escherichia coli CFT073
cagccaucgccaccgcuuc

SEQ ID NO: 598480 - RNA, 17 nt, Escherichia coli CFT073
cagccaucuguuccggc

SEQ ID NO: 598481 - RNA, 16 nt, Escherichia coli CFT073
cagccaugccgccacc

SEQ ID NO: 598482 - RNA, 14 nt, Escherichia coli CFT073
cagccauaccggga

SEQ ID NO: 598483 - RNA, 23 nt, Escherichia coli CFT073
cagccccggcaaaugacgaugca

SEQ ID NO: 598484 - RNA, 13 nt, Escherichia coli CFT073
cagccccaguucc

SEQ ID NO: 598485 - RNA, 18 nt, Escherichia coli CFT073
cagccccaucagcgccau

SEQ ID NO: 598486 - RNA, 18 nt, Escherichia coli CFT073
cagccccauugguugccg

SEQ ID NO: 598487 - RNA, 17 nt, Escherichia coli CFT073
cagccgacaauaccaca

SEQ ID NO: 598488 - RNA, 14 nt, Escherichia coli CFT073
cagcgaaaucacgc

SEQ ID NO: 598489 - RNA, 21 nt, Escherichia coli CFT073
cagcgaaacucgcugacugau

SEQ ID NO: 598490 - RNA, 13 nt, Escherichia coli CFT073
cagcgaaaacgac

SEQ ID NO: 598491 - RNA, 12 nt, Escherichia coli CFT073
cagccggucauu

SEQ ID NO: 598492 - RNA, 17 nt, Escherichia coli CFT073
cagccgguaauuuauug

SEQ ID NO: 598493 - RNA, 21 nt, Escherichia coli CFT073
cagccgguaauuuauugugca

SEQ ID NO: 598494 - RNA, 22 nt, Escherichia coli CFT073
cagccggggaucagguacugca

SEQ ID NO: 598495 - RNA, 19 nt, Escherichia coli CFT073
cagccgauaucuuuccggc

SEQ ID NO: 598496 - RNA, 13 nt, Escherichia coli CFT073
cagccgaucagcg

SEQ ID NO: 598497 - RNA, 23 nt, Escherichia coli CFT073
cagcgauagcuucugcguucucu

SEQ ID NO: 598498 - RNA, 17 nt, Escherichia coli CFT073
cagcgacagauucagcg

SEQ ID NO: 598499 - RNA, 18 nt, Escherichia coli CFT073
cagcgacagauucagcgc

SEQ ID NO: 598500 - RNA, 16 nt, Escherichia coli CFT073
cagcgaacaccagcag

SEQ ID NO: 598501 - RNA, 17 nt, Escherichia coli CFT073
cagcgcaaagauaauga

SEQ ID NO: 598502 - RNA, 21 nt, Escherichia coli CFT073
cagcgcaaagcccgccgccac

SEQ ID NO: 598503 - RNA, 19 nt, Escherichia coli CFT073
cagcgcaaacggcagcaug

SEQ ID NO: 598504 - RNA, 16 nt, Escherichia coli CFT073
cagcgcaauagccuga

SEQ ID NO: 598505 - RNA, 16 nt, Escherichia coli CFT073
cagcgauuaacugcgc

SEQ ID NO: 598506 - RNA, 20 nt, Escherichia coli CFT073
cagcgauuaacugcgcggua

SEQ ID NO: 598507 - RNA, 14 nt, Escherichia coli CFT073
cagcgcacugccgc

SEQ ID NO: 598508 - RNA, 18 nt, Escherichia coli CFT073
cagcgcacuacgccgcaa

SEQ ID NO: 598509 - RNA, 12 nt, Escherichia coli CFT073
cagcgcagcacc

SEQ ID NO: 598510 - RNA, 18 nt, Escherichia coli CFT073
cagcgcaccgugaccacc

SEQ ID NO: 598511 - RNA, 20 nt, Escherichia coli CFT073
cagcgcaccaacggucagcg

SEQ ID NO: 598512 - RNA, 20 nt, Escherichia coli CFT073
cagcgcaauguugcuggcga

SEQ ID NO: 598513 - RNA, 14 nt, Escherichia coli CFT073
cagcgcaauucgcg

SEQ ID NO: 598514 - RNA, 15 nt, Escherichia coli CFT073
cagcgcagcuuccgg

SEQ ID NO: 598515 - RNA, 19 nt, Escherichia coli CFT073
cagcgcauagcuaaucccc

SEQ ID NO: 598516 - RNA, 18 nt, Escherichia coli CFT073
cagcgcauccuggcuguu

SEQ ID NO: 598517 - RNA, 24 nt, Escherichia coli CFT073
cagcgcaucaugaaacgcccacgc

SEQ ID NO: 598518 - RNA, 18 nt, Escherichia coli CFT073
cagcgccaccacccagaa

SEQ ID NO: 598519 - RNA, 20 nt, Escherichia coli CFT073
cagcgcauuuaccaggcggu

SEQ ID NO: 598520 - RNA, 15 nt, Escherichia coli CFT073
cagcgcauggcggca

SEQ ID NO: 598521 - RNA, 12 nt, Escherichia coli CFT073
cagcgccagcgc

SEQ ID NO: 598522 - RNA, 11 nt, Escherichia coli CFT073
cagcgccagaa

SEQ ID NO: 598523 - RNA, 21 nt, Escherichia coli CFT073
cagcgccgcauccgacauuug

SEQ ID NO: 598524 - RNA, 15 nt, Escherichia coli CFT073
cagcgcccucuuuuu

SEQ ID NO: 598525 - RNA, 19 nt, Escherichia coli CFT073
cagcgccaugccaacgcgg

SEQ ID NO: 598526 - RNA, 18 nt, Escherichia coli CFT073
cagcgcgaccggcggcga

SEQ ID NO: 598527 - RNA, 15 nt, Escherichia coli CFT073
cagcgccugcugcac

SEQ ID NO: 598528 - RNA, 19 nt, Escherichia coli CFT073
cagcgccugcugcacacca

SEQ ID NO: 598529 - RNA, 20 nt, Escherichia coli CFT073
cagcgccugcugcacaccau

SEQ ID NO: 598530 - RNA, 13 nt, Escherichia coli CFT073
cagcgccugaugg

SEQ ID NO: 598531 - RNA, 15 nt, Escherichia coli CFT073
cagcgccugcaaaau

SEQ ID NO: 598532 - RNA, 22 nt, Escherichia coli CFT073
cagcgccggauucacgccaacc

SEQ ID NO: 598533 - RNA, 15 nt, Escherichia coli CFT073
cacuagucccuccgc

SEQ ID NO: 598534 - RNA, 14 nt, Escherichia coli CFT073
cacuaucaaccacg

SEQ ID NO: 598535 - RNA, 14 nt, Escherichia coli CFT073
cacuaucgguucug

SEQ ID NO: 598536 - RNA, 17 nt, Escherichia coli CFT073
cacuacgcccgcugcgc

SEQ ID NO: 598537 - RNA, 18 nt, Escherichia coli CFT073
cacucacugaugccguuu

SEQ ID NO: 598538 - RNA, 11 nt, Escherichia coli CFT073
cacucacgaca

SEQ ID NO: 598539 - RNA, 12 nt, Escherichia coli CFT073
cacuauucagau

SEQ ID NO: 598540 - RNA, 20 nt, Escherichia coli CFT073
cacucaaaagcguaccgcca

SEQ ID NO: 598541 - RNA, 21 nt, Escherichia coli CFT073
cacucaaaagcguaccgccaa

SEQ ID NO: 598542 - RNA, 13 nt, Escherichia coli CFT073
cacuaacugcgcg

SEQ ID NO: 598543 - RNA, 22 nt, Escherichia coli CFT073
cacuaacuguuucgcggcaaac

SEQ ID NO: 598544 - RNA, 15 nt, Escherichia coli CFT073
cacuaccaaaacgga

SEQ ID NO: 598545 - RNA, 15 nt, Escherichia coli CFT073
cacguuugauggugg

SEQ ID NO: 598546 - RNA, 15 nt, Escherichia coli CFT073
cacguuuugcggaug

SEQ ID NO: 598547 - RNA, 18 nt, Escherichia coli CFT073
cacguuuuucauccagcg

SEQ ID NO: 598548 - RNA, 20 nt, Escherichia coli CFT073
cacguugcuuauugccggau

SEQ ID NO: 598549 - RNA, 13 nt, Escherichia coli CFT073
cacguugccagca

SEQ ID NO: 598550 - RNA, 20 nt, Escherichia coli CFT073
cacgucgagauugugcucaa

SEQ ID NO: 598551 - RNA, 21 nt, Escherichia coli CFT073
cacgucauauucgccaucagc

SEQ ID NO: 598552 - RNA, 12 nt, Escherichia coli CFT073
cacguagccacg

SEQ ID NO: 598553 - RNA, 22 nt, Escherichia coli CFT073
cacgggaaauagcuuaacggca

SEQ ID NO: 598554 - RNA, 20 nt, Escherichia coli CFT073
cacggucacuacacgaccau

SEQ ID NO: 598555 - RNA, 17 nt, Escherichia coli CFT073
cacggccugucggagcu

SEQ ID NO: 598556 - RNA, 23 nt, Escherichia coli CFT073
cacgcgggauaaucgcgccgcga

SEQ ID NO: 598557 - RNA, 15 nt, Escherichia coli CFT073
cacgcgguaugguca

SEQ ID NO: 598558 - RNA, 20 nt, Escherichia coli CFT073
cacgcgcugagacccggcca

SEQ ID NO: 598559 - RNA, 19 nt, Escherichia coli CFT073
cacgcgcguugauuaaccg

SEQ ID NO: 598560 - RNA, 20 nt, Escherichia coli CFT073
cacgccugcaagcgucgcgc

SEQ ID NO: 598561 - RNA, 22 nt, Escherichia coli CFT073
cacgccgguaugcgugcuucau

SEQ ID NO: 598562 - RNA, 12 nt, Escherichia coli CFT073
cacgccgcauca

SEQ ID NO: 598563 - RNA, 18 nt, Escherichia coli CFT073
cacgcccauaacgcgcgc

SEQ ID NO: 598564 - RNA, 12 nt, Escherichia coli CFT073
cacgcucagcaa

SEQ ID NO: 598565 - RNA, 15 nt, Escherichia coli CFT073
cacgcucagcaacau

SEQ ID NO: 598566 - RNA, 16 nt, Escherichia coli CFT073
cacgcucagcaacaug

SEQ ID NO: 598567 - RNA, 16 nt, Escherichia coli CFT073
cacgcucaaagacgcg

SEQ ID NO: 598568 - RNA, 15 nt, Escherichia coli CFT073
cacgcucgcuggcgu

SEQ ID NO: 598569 - RNA, 14 nt, Escherichia coli CFT073
cacgcugccgcgca

SEQ ID NO: 598570 - RNA, 16 nt, Escherichia coli CFT073
cacgcugacgcaucug

SEQ ID NO: 598571 - RNA, 15 nt, Escherichia coli CFT073
cacgcuuacugguca

SEQ ID NO: 598572 - RNA, 17 nt, Escherichia coli CFT073
cacgcuucacugccgga

SEQ ID NO: 598573 - RNA, 20 nt, Escherichia coli CFT073
cacgcuuugauccgccagau

SEQ ID NO: 598574 - RNA, 22 nt, Escherichia coli CFT073
cacgcuuuucaucagaucgcga

SEQ ID NO: 598575 - RNA, 12 nt, Escherichia coli CFT073
cagaaacgacac

SEQ ID NO: 598576 - RNA, 22 nt, Escherichia coli CFT073
cagaaaaaucccucuucgguaa

SEQ ID NO: 598577 - RNA, 23 nt, Escherichia coli CFT073
cagaaaaaucccucuucgguaau

SEQ ID NO: 598578 - RNA, 18 nt, Escherichia coli CFT073
cagaaaauacucagcacc

SEQ ID NO: 598579 - RNA, 17 nt, Escherichia coli CFT073
cagaaaguaaauuauuc

SEQ ID NO: 598580 - RNA, 22 nt, Escherichia coli CFT073
cagaaagucuucaccguuauga

SEQ ID NO: 598581 - RNA, 24 nt, Escherichia coli CFT073
cagaaagugaucccacaucacauc

SEQ ID NO: 598582 - RNA, 14 nt, Escherichia coli CFT073
cagaaagcgccagc

SEQ ID NO: 598583 - RNA, 17 nt, Escherichia coli CFT073
cagaaaguugcggauaa

SEQ ID NO: 598584 - RNA, 24 nt, Escherichia coli CFT073
cagaacgccgaauaacgcgcagcg

SEQ ID NO: 598585 - RNA, 18 nt, Escherichia coli CFT073
cagaaauaaucaccugau

SEQ ID NO: 598586 - RNA, 18 nt, Escherichia coli CFT073
cagaaagcgccagcaaga

SEQ ID NO: 598587 - RNA, 13 nt, Escherichia coli CFT073
cagaagaucggaa

SEQ ID NO: 598588 - RNA, 17 nt, Escherichia coli CFT073
cagacaaaaagaauacg

SEQ ID NO: 598589 - RNA, 14 nt, Escherichia coli CFT073
cagacaauccagcg

SEQ ID NO: 598590 - RNA, 15 nt, Escherichia coli CFT073
cagacaaggcgauuu

SEQ ID NO: 598591 - RNA, 13 nt, Escherichia coli CFT073
cagaacggcgaug

SEQ ID NO: 598592 - RNA, 23 nt, Escherichia coli CFT073
cagaacguccgcaggaugagcgc

SEQ ID NO: 598593 - RNA, 18 nt, Escherichia coli CFT073
cagaacugacgcccaguu

SEQ ID NO: 598594 - RNA, 18 nt, Escherichia coli CFT073
cagaacugcugcgccagc

SEQ ID NO: 598595 - RNA, 19 nt, Escherichia coli CFT073
cagaagaauaaaacauagc

SEQ ID NO: 598596 - RNA, 18 nt, Escherichia coli CFT073
cacuugacuaagcguuuu

SEQ ID NO: 598597 - RNA, 21 nt, Escherichia coli CFT073
cacuugcagucggcuuucuca

SEQ ID NO: 598598 - RNA, 14 nt, Escherichia coli CFT073
cacuucgcuggugu

SEQ ID NO: 598599 - RNA, 23 nt, Escherichia coli CFT073
cacuucuuccagcggcaggccgu

SEQ ID NO: 598600 - RNA, 11 nt, Escherichia coli CFT073
cacuuccugcg

SEQ ID NO: 598601 - RNA, 18 nt, Escherichia coli CFT073
cacucgugauaaccuguu

SEQ ID NO: 598602 - RNA, 14 nt, Escherichia coli CFT073
cacucuauccagcc

SEQ ID NO: 598603 - RNA, 19 nt, Escherichia coli CFT073
cacucaguguuggauggcg

SEQ ID NO: 598604 - RNA, 22 nt, Escherichia coli CFT073
cacucccccauuauuaacaaga

SEQ ID NO: 598605 - RNA, 15 nt, Escherichia coli CFT073
cacuccgccgcacaa

SEQ ID NO: 598606 - RNA, 19 nt, Escherichia coli CFT073
cacuccgccacgucaucag

SEQ ID NO: 598607 - RNA, 21 nt, Escherichia coli CFT073
cagaccguggucggaaaagua

SEQ ID NO: 598608 - RNA, 21 nt, Escherichia coli CFT073
cagaccugaauuugcuccaga

SEQ ID NO: 598609 - RNA, 15 nt, Escherichia coli CFT073
cagaccgugcgcagc

SEQ ID NO: 598610 - RNA, 12 nt, Escherichia coli CFT073
cagaccgccaau

SEQ ID NO: 598611 - RNA, 12 nt, Escherichia coli CFT073
cagaccgccagu

SEQ ID NO: 598612 - RNA, 19 nt, Escherichia coli CFT073
cagaccgcgcuugccgccg

SEQ ID NO: 598613 - RNA, 20 nt, Escherichia coli CFT073
cagacgaaaguuugaaagau

SEQ ID NO: 598614 - RNA, 20 nt, Escherichia coli CFT073
cagaccuucgcuaucaaacu

SEQ ID NO: 598615 - RNA, 22 nt, Escherichia coli CFT073
cagaccuucgcuaucaaacuga

SEQ ID NO: 598616 - RNA, 22 nt, Escherichia coli CFT073
cagacgaucuucggcgucagaa

SEQ ID NO: 598617 - RNA, 21 nt, Escherichia coli CFT073
cagacgcaacagaaacgccau

SEQ ID NO: 598618 - RNA, 15 nt, Escherichia coli CFT073
cagacgcaucgccca

SEQ ID NO: 598619 - RNA, 23 nt, Escherichia coli CFT073
cagacgcaucgcccagccaucga

SEQ ID NO: 598620 - RNA, 18 nt, Escherichia coli CFT073
cagacauuaagcaucgca

SEQ ID NO: 598621 - RNA, 16 nt, Escherichia coli CFT073
cagacauuacaaaaua

SEQ ID NO: 598622 - RNA, 14 nt, Escherichia coli CFT073
cagaccaauaaucc

SEQ ID NO: 598623 - RNA, 16 nt, Escherichia coli CFT073
cagaccaauagaaagu

SEQ ID NO: 598624 - RNA, 13 nt, Escherichia coli CFT073
cagaccaaucccg

SEQ ID NO: 598625 - RNA, 21 nt, Escherichia coli CFT073
cagaccgauacacaucgucgc

SEQ ID NO: 598626 - RNA, 17 nt, Escherichia coli CFT073
cagaccccccaggcgca

SEQ ID NO: 598627 - RNA, 22 nt, Escherichia coli CFT073
cagaccccggcauugacgaugc

SEQ ID NO: 598628 - RNA, 11 nt, Escherichia coli CFT073
cagaccagaaa

SEQ ID NO: 598629 - RNA, 18 nt, Escherichia coli CFT073
cagaccagaaacgccacc

SEQ ID NO: 598630 - RNA, 16 nt, Escherichia coli CFT073
cagaccauaaaugcgc

SEQ ID NO: 598631 - RNA, 20 nt, Escherichia coli CFT073
cagaccagcuaccacgccga

SEQ ID NO: 598632 - RNA, 17 nt, Escherichia coli CFT073
cagacugaagcuccgcu

SEQ ID NO: 598633 - RNA, 21 nt, Escherichia coli CFT073
cagacugaucaauaucagcaa

SEQ ID NO: 598634 - RNA, 17 nt, Escherichia coli CFT073
cagacuggauacgcuga

SEQ ID NO: 598635 - RNA, 21 nt, Escherichia coli CFT073
cagacugaugacaaacgcaaa

SEQ ID NO: 598636 - RNA, 17 nt, Escherichia coli CFT073
cagacguuucgccagcc

SEQ ID NO: 598637 - RNA, 16 nt, Escherichia coli CFT073
cagacguucuuccugu

SEQ ID NO: 598638 - RNA, 17 nt, Escherichia coli CFT073
cagacguuucacggucg

SEQ ID NO: 598639 - RNA, 16 nt, Escherichia coli CFT073
cagacguuucgccagc

SEQ ID NO: 598640 - RNA, 16 nt, Escherichia coli CFT073
cagacgugcacgcagc

SEQ ID NO: 598641 - RNA, 12 nt, Escherichia coli CFT073
cagacggcuguu

SEQ ID NO: 598642 - RNA, 23 nt, Escherichia coli CFT073
cagacgggcauuuucuuccguua

SEQ ID NO: 598643 - RNA, 19 nt, Escherichia coli CFT073
cagacggguaaacggcagg

SEQ ID NO: 598644 - RNA, 17 nt, Escherichia coli CFT073
cagacgguccgcgagau

SEQ ID NO: 598645 - RNA, 18 nt, Escherichia coli CFT073
cagacgguuggcaauacg

SEQ ID NO: 598646 - RNA, 16 nt, Escherichia coli CFT073
cagacgcaguacgcca

SEQ ID NO: 598647 - RNA, 15 nt, Escherichia coli CFT073
cagacgcgccgccac

SEQ ID NO: 598648 - RNA, 16 nt, Escherichia coli CFT073
cagacgcgccgccacc

SEQ ID NO: 598649 - RNA, 17 nt, Escherichia coli CFT073
cagacgcucgccauuuu

SEQ ID NO: 598650 - RNA, 15 nt, Escherichia coli CFT073
cagagcaaaaaucga

SEQ ID NO: 598651 - RNA, 14 nt, Escherichia coli CFT073
cagagcauccagca

SEQ ID NO: 598652 - RNA, 14 nt, Escherichia coli CFT073
cagagcaucgguau

SEQ ID NO: 598653 - RNA, 16 nt, Escherichia coli CFT073
cagagcauuacuuucg

SEQ ID NO: 598654 - RNA, 14 nt, Escherichia coli CFT073
cagagcauucccgc

SEQ ID NO: 598655 - RNA, 19 nt, Escherichia coli CFT073
cagagaaguguacgaacac

SEQ ID NO: 598656 - RNA, 14 nt, Escherichia coli CFT073
cagagacaacccgc

SEQ ID NO: 598657 - RNA, 16 nt, Escherichia coli CFT073
cagacuuggucgguau

SEQ ID NO: 598658 - RNA, 23 nt, Escherichia coli CFT073
cagacuuuuccuuugcgcgucac

SEQ ID NO: 598659 - RNA, 17 nt, Escherichia coli CFT073
cagagauuaacgucacu

SEQ ID NO: 598660 - RNA, 13 nt, Escherichia coli CFT073
cagagaucgccgc

SEQ ID NO: 598661 - RNA, 14 nt, Escherichia coli CFT073
cagagauaccgcgc

SEQ ID NO: 598662 - RNA, 20 nt, Escherichia coli CFT073
cagagaggacucugccggau

SEQ ID NO: 598663 - RNA, 20 nt, Escherichia coli CFT073
cagagcuaaaaucgccaaac

SEQ ID NO: 598664 - RNA, 18 nt, Escherichia coli CFT073
cagagcgauauccagcgc

SEQ ID NO: 598665 - RNA, 18 nt, Escherichia coli CFT073
cagagcuuuguugcgcug

SEQ ID NO: 598666 - RNA, 13 nt, Escherichia coli CFT073
cagaggugcgacc

SEQ ID NO: 598667 - RNA, 20 nt, Escherichia coli CFT073
cagaguaacuucaccaguga

SEQ ID NO: 598668 - RNA, 18 nt, Escherichia coli CFT073
cagagucagcaaugccag

SEQ ID NO: 598669 - RNA, 14 nt, Escherichia coli CFT073
cagagucagcacga

SEQ ID NO: 598670 - RNA, 18 nt, Escherichia coli CFT073
cagaguuuagcgaauuuu

SEQ ID NO: 598671 - RNA, 20 nt, Escherichia coli CFT073
cagauaaaaugcgaaaaaaa

SEQ ID NO: 598672 - RNA, 19 nt, Escherichia coli CFT073
cagaguuccugcauaucgg

SEQ ID NO: 598673 - RNA, 18 nt, Escherichia coli CFT073
cagaguauguauacaaaa

SEQ ID NO: 598674 - RNA, 15 nt, Escherichia coli CFT073
cagagugaaugguga

SEQ ID NO: 598675 - RNA, 13 nt, Escherichia coli CFT073
cagauaaccacua

SEQ ID NO: 598676 - RNA, 14 nt, Escherichia coli CFT073
cagauaacccagca

SEQ ID NO: 598677 - RNA, 16 nt, Escherichia coli CFT073
cagauccgcacccgca

SEQ ID NO: 598678 - RNA, 14 nt, Escherichia coli CFT073
cagaucggcaaucg

SEQ ID NO: 598679 - RNA, 22 nt, Escherichia coli CFT073
cagauuuuuauuaauaucguaa

SEQ ID NO: 598680 - RNA, 19 nt, Escherichia coli CFT073
cagcaaaacaccccgcgac

SEQ ID NO: 598681 - RNA, 23 nt, Escherichia coli CFT073
cagcaaaaugguacucggcacgu

SEQ ID NO: 598682 - RNA, 14 nt, Escherichia coli CFT073
cagauuuuugcgcc

SEQ ID NO: 598683 - RNA, 17 nt, Escherichia coli CFT073
cagauuuugcaggccug

SEQ ID NO: 598684 - RNA, 20 nt, Escherichia coli CFT073
cagauuuugcaggccugaua

SEQ ID NO: 598685 - RNA, 18 nt, Escherichia coli CFT073
cagauuugauuaucaauu

SEQ ID NO: 598686 - RNA, 19 nt, Escherichia coli CFT073
cagauuuaacggcagcaag

SEQ ID NO: 598687 - RNA, 14 nt, Escherichia coli CFT073
cagcaaaccacuga

SEQ ID NO: 598688 - RNA, 18 nt, Escherichia coli CFT073
cagcaaagagagcagcgc

SEQ ID NO: 598689 - RNA, 17 nt, Escherichia coli CFT073
cagcaaaguaccaucgu

SEQ ID NO: 598690 - RNA, 23 nt, Escherichia coli CFT073
cagauugaugcgaguaaucaggc

SEQ ID NO: 598691 - RNA, 17 nt, Escherichia coli CFT073
cagauuguuauccagcu

SEQ ID NO: 598692 - RNA, 21 nt, Escherichia coli CFT073
cagaugcaccugcguugccgc

SEQ ID NO: 598693 - RNA, 22 nt, Escherichia coli CFT073
cagaugcaccugcguugccgca

SEQ ID NO: 598694 - RNA, 13 nt, Escherichia coli CFT073
cagaucugcgcca

SEQ ID NO: 598695 - RNA, 14 nt, Escherichia coli CFT073
cagaucuuccagcg

SEQ ID NO: 598696 - RNA, 16 nt, Escherichia coli CFT073
cagaucguugaccugg

SEQ ID NO: 598697 - RNA, 23 nt, Escherichia coli CFT073
cugcauaaucgcuacgccuuccg

SEQ ID NO: 598698 - RNA, 23 nt, Escherichia coli CFT073
cugcauaaugucgcuggccggac

SEQ ID NO: 598699 - RNA, 14 nt, Escherichia coli CFT073
cugcauaccaagcc

SEQ ID NO: 598700 - RNA, 16 nt, Escherichia coli CFT073
cugcaguucaucaacg

SEQ ID NO: 598701 - RNA, 18 nt, Escherichia coli CFT073
cugcauaaaggcaaaaca

SEQ ID NO: 598702 - RNA, 17 nt, Escherichia coli CFT073
cugcaucgccugauuca

SEQ ID NO: 598703 - RNA, 12 nt, Escherichia coli CFT073
cugcauccagaa

SEQ ID NO: 598704 - RNA, 18 nt, Escherichia coli CFT073
cugcaucaaccagcaccu

SEQ ID NO: 598705 - RNA, 21 nt, Escherichia coli CFT073
cugcaucaaccagcaccuuuu

SEQ ID NO: 598706 - RNA, 14 nt, Escherichia coli CFT073
cugcaucagcgccu

SEQ ID NO: 598707 - RNA, 20 nt, Escherichia coli CFT073
cugccaaacgcucccagcca

SEQ ID NO: 598708 - RNA, 21 nt, Escherichia coli CFT073
cugcauggccagacauuacaa

SEQ ID NO: 598709 - RNA, 21 nt, Escherichia coli CFT073
cugcauguuuuuuaaguucag

SEQ ID NO: 598710 - RNA, 16 nt, Escherichia coli CFT073
cugccacucuccuggu

SEQ ID NO: 598711 - RNA, 24 nt, Escherichia coli CFT073
cugccagaaacgccugaucgagca

SEQ ID NO: 598712 - RNA, 17 nt, Escherichia coli CFT073
cugcagccaguugcucu

SEQ ID NO: 598713 - RNA, 19 nt, Escherichia coli CFT073
cugcagcagguugucgagu

SEQ ID NO: 598714 - RNA, 15 nt, Escherichia coli CFT073
cugccauuagcguau

SEQ ID NO: 598715 - RNA, 12 nt, Escherichia coli CFT073
cugccaucacua

SEQ ID NO: 598716 - RNA, 22 nt, Escherichia coli CFT073
cugccagggucaguuucaccuc

SEQ ID NO: 598717 - RNA, 19 nt, Escherichia coli CFT073
cugccagugcaaaaaauca

SEQ ID NO: 598718 - RNA, 17 nt, Escherichia coli CFT073
cugccagcuugcgaucc

SEQ ID NO: 598719 - RNA, 21 nt, Escherichia coli CFT073
cugccagcuugcgauccugca

SEQ ID NO: 598720 - RNA, 23 nt, Escherichia coli CFT073
cugccaggaccgcugaaauauca

SEQ ID NO: 598721 - RNA, 22 nt, Escherichia coli CFT073
cugccaggcagcgauuaacugc

SEQ ID NO: 598722 - RNA, 19 nt, Escherichia coli CFT073
cugccagccgucgucgcgc

SEQ ID NO: 598723 - RNA, 16 nt, Escherichia coli CFT073
cugccagaucaucguu

SEQ ID NO: 598724 - RNA, 13 nt, Escherichia coli CFT073
cugccagaucggc

SEQ ID NO: 598725 - RNA, 22 nt, Escherichia coli CFT073
cugccagaccuuaucacaaucg

SEQ ID NO: 598726 - RNA, 19 nt, Escherichia coli CFT073
cugccagauucuccagcau

SEQ ID NO: 598727 - RNA, 17 nt, Escherichia coli CFT073
cugccagcaagcgcacc

SEQ ID NO: 598728 - RNA, 19 nt, Escherichia coli CFT073
cugccagaaccgcuucuuc

SEQ ID NO: 598729 - RNA, 13 nt, Escherichia coli CFT073
cugcccggcagcu

SEQ ID NO: 598730 - RNA, 13 nt, Escherichia coli CFT073
cugccuugccagg

SEQ ID NO: 598731 - RNA, 15 nt, Escherichia coli CFT073
cugccugaucuuucu

SEQ ID NO: 598732 - RNA, 20 nt, Escherichia coli CFT073
cugccugaugcgacgcuuga

SEQ ID NO: 598733 - RNA, 13 nt, Escherichia coli CFT073
cugccugaugcgc

SEQ ID NO: 598734 - RNA, 19 nt, Escherichia coli CFT073
cugcgaauuuccugccaga

SEQ ID NO: 598735 - RNA, 21 nt, Escherichia coli CFT073
cugcgacaccagcauguucca

SEQ ID NO: 598736 - RNA, 11 nt, Escherichia coli CFT073
cugccgguucc

SEQ ID NO: 598737 - RNA, 12 nt, Escherichia coli CFT073
cugccgggaaga

SEQ ID NO: 598738 - RNA, 16 nt, Escherichia coli CFT073
cugccgucaucgacuu

SEQ ID NO: 598739 - RNA, 15 nt, Escherichia coli CFT073
cugccgcuccagaua

SEQ ID NO: 598740 - RNA, 17 nt, Escherichia coli CFT073
cugccgcuauguuuauu

SEQ ID NO: 598741 - RNA, 21 nt, Escherichia coli CFT073
cugccgacaauaaaacguugc

SEQ ID NO: 598742 - RNA, 20 nt, Escherichia coli CFT073
cucuuugggcagaaaaucca

SEQ ID NO: 598743 - RNA, 15 nt, Escherichia coli CFT073
cugaaccagcgccgg

SEQ ID NO: 598744 - RNA, 12 nt, Escherichia coli CFT073
cucuuucaccaa

SEQ ID NO: 598745 - RNA, 22 nt, Escherichia coli CFT073
cucuuucuucgcguuacggauc

SEQ ID NO: 598746 - RNA, 19 nt, Escherichia coli CFT073
cucuuucaggccgcgcagu

SEQ ID NO: 598747 - RNA, 15 nt, Escherichia coli CFT073
cucuuucccggcaau

SEQ ID NO: 598748 - RNA, 21 nt, Escherichia coli CFT073
cucuugcauuguguaauuaau

SEQ ID NO: 598749 - RNA, 12 nt, Escherichia coli CFT073
cucucuuccagu

SEQ ID NO: 598750 - RNA, 14 nt, Escherichia coli CFT073
cucugacauaaaaa

SEQ ID NO: 598751 - RNA, 21 nt, Escherichia coli CFT073
cucugacgauucucccacagc

SEQ ID NO: 598752 - RNA, 13 nt, Escherichia coli CFT073
cucugcgccgccu

SEQ ID NO: 598753 - RNA, 14 nt, Escherichia coli CFT073
cucuggauguuuca

SEQ ID NO: 598754 - RNA, 15 nt, Escherichia coli CFT073
cucuggagaaauaua

SEQ ID NO: 598755 - RNA, 22 nt, Escherichia coli CFT073
cucugcgccuuugaugccacca

SEQ ID NO: 598756 - RNA, 13 nt, Escherichia coli CFT073
cugacaccagcau

SEQ ID NO: 598757 - RNA, 24 nt, Escherichia coli CFT073
cugacagcgcgucuuguacuuccg

SEQ ID NO: 598758 - RNA, 23 nt, Escherichia coli CFT073
cugacaggcgggaagaacggcaa

SEQ ID NO: 598759 - RNA, 14 nt, Escherichia coli CFT073
cugacaucacgcca

SEQ ID NO: 598760 - RNA, 16 nt, Escherichia coli CFT073
cugaaucugagcauuu

SEQ ID NO: 598761 - RNA, 16 nt, Escherichia coli CFT073
cugaauuaacuuauca

SEQ ID NO: 598762 - RNA, 22 nt, Escherichia coli CFT073
cugaauucccccauugaaacga

SEQ ID NO: 598763 - RNA, 19 nt, Escherichia coli CFT073
cugaauugccagcaucaga

SEQ ID NO: 598764 - RNA, 17 nt, Escherichia coli CFT073
cugaauuugcuccagaa

SEQ ID NO: 598765 - RNA, 22 nt, Escherichia coli CFT073
cugaauuugcuccagaaaccau

SEQ ID NO: 598766 - RNA, 16 nt, Escherichia coli CFT073
cugacaaacugcgugu

SEQ ID NO: 598767 - RNA, 20 nt, Escherichia coli CFT073
cugacaacgcugaauggcga

SEQ ID NO: 598768 - RNA, 15 nt, Escherichia coli CFT073
cugaacggucgaggc

SEQ ID NO: 598769 - RNA, 16 nt, Escherichia coli CFT073
cugaacguucugcugu

SEQ ID NO: 598770 - RNA, 16 nt, Escherichia coli CFT073
cugaacgccugcacca

SEQ ID NO: 598771 - RNA, 20 nt, Escherichia coli CFT073
cugaauauucggcuccagau

SEQ ID NO: 598772 - RNA, 14 nt, Escherichia coli CFT073
cugaaucaggaacc

SEQ ID NO: 598773 - RNA, 15 nt, Escherichia coli CFT073
cugaauaucaucacc

SEQ ID NO: 598774 - RNA, 18 nt, Escherichia coli CFT073
cugaauauccuguucaga

SEQ ID NO: 598775 - RNA, 22 nt, Escherichia coli CFT073
cugaagaaccaagccugcuggc

SEQ ID NO: 598776 - RNA, 22 nt, Escherichia coli CFT073
cugaauaaucguaaucagcauc

SEQ ID NO: 598777 - RNA, 17 nt, Escherichia coli CFT073
cugaauacccgccagaa

SEQ ID NO: 598778 - RNA, 14 nt, Escherichia coli CFT073
cugaauaccguaaa

SEQ ID NO: 598779 - RNA, 12 nt, Escherichia coli CFT073
cucuacgcaaag

SEQ ID NO: 598780 - RNA, 21 nt, Escherichia coli CFT073
cucuacgcgcugaccuucagc

SEQ ID NO: 598781 - RNA, 21 nt, Escherichia coli CFT073
cucuauacugcgcgccgaagc

SEQ ID NO: 598782 - RNA, 13 nt, Escherichia coli CFT073
cucgguuuucagg

SEQ ID NO: 598783 - RNA, 20 nt, Escherichia coli CFT073
cugacgcuuaucuuccguau

SEQ ID NO: 598784 - RNA, 23 nt, Escherichia coli CFT073
cugacgggaaacucugcuggcgg

SEQ ID NO: 598785 - RNA, 15 nt, Escherichia coli CFT073
cugaccgguugcugg

SEQ ID NO: 598786 - RNA, 14 nt, Escherichia coli CFT073
cugacgcugcucag

SEQ ID NO: 598787 - RNA, 23 nt, Escherichia coli CFT073
cugacgcuggguuucgccugcca

SEQ ID NO: 598788 - RNA, 14 nt, Escherichia coli CFT073
cugaccauuacugu

SEQ ID NO: 598789 - RNA, 15 nt, Escherichia coli CFT073
cugauauucaggaug

SEQ ID NO: 598790 - RNA, 18 nt, Escherichia coli CFT073
cugauauugcuccagacg

SEQ ID NO: 598791 - RNA, 16 nt, Escherichia coli CFT073
cugaucaauaucagca

SEQ ID NO: 598792 - RNA, 16 nt, Escherichia coli CFT073
cugaucaauuucugcg

SEQ ID NO: 598793 - RNA, 12 nt, Escherichia coli CFT073
cugauauccagc

SEQ ID NO: 598794 - RNA, 13 nt, Escherichia coli CFT073
cugaucagcacga

SEQ ID NO: 598795 - RNA, 14 nt, Escherichia coli CFT073
cugauccgcuucgg

SEQ ID NO: 598796 - RNA, 22 nt, Escherichia coli CFT073
cugaucgagcaguaauccagca

SEQ ID NO: 598797 - RNA, 21 nt, Escherichia coli CFT073
cugagcgugccccugaauaau

SEQ ID NO: 598798 - RNA, 19 nt, Escherichia coli CFT073
cugauagcggcggauuuca

SEQ ID NO: 598799 - RNA, 13 nt, Escherichia coli CFT073
cugagccugugca

SEQ ID NO: 598800 - RNA, 22 nt, Escherichia coli CFT073
cugaucgucagcacucacgcca

SEQ ID NO: 598801 - RNA, 16 nt, Escherichia coli CFT073
cugaucgugcucgaca

SEQ ID NO: 598802 - RNA, 19 nt, Escherichia coli CFT073
cugaugauccuggauuucu

SEQ ID NO: 598803 - RNA, 17 nt, Escherichia coli CFT073
cugaugaucuaaaagca

SEQ ID NO: 598804 - RNA, 22 nt, Escherichia coli CFT073
cugaugaagacagaccuggcgc

SEQ ID NO: 598805 - RNA, 14 nt, Escherichia coli CFT073
cugaugcagcguca

SEQ ID NO: 598806 - RNA, 23 nt, Escherichia coli CFT073
cugaugcagguacucaccguuga

SEQ ID NO: 598807 - RNA, 19 nt, Escherichia coli CFT073
cugcaaacaguaacccagc

SEQ ID NO: 598808 - RNA, 18 nt, Escherichia coli CFT073
cugcaaagcguacaaccg

SEQ ID NO: 598809 - RNA, 14 nt, Escherichia coli CFT073
cugcaacuggcggc

SEQ ID NO: 598810 - RNA, 21 nt, Escherichia coli CFT073
cugcaacugugcggcaauuag

SEQ ID NO: 598811 - RNA, 16 nt, Escherichia coli CFT073
cugcacguuuugcugg

SEQ ID NO: 598812 - RNA, 17 nt, Escherichia coli CFT073
cugcacguuuugcuggu

SEQ ID NO: 598813 - RNA, 17 nt, Escherichia coli CFT073
cugcacauuaucaaacg

SEQ ID NO: 598814 - RNA, 12 nt, Escherichia coli CFT073
cugcaccagcag

SEQ ID NO: 598815 - RNA, 11 nt, Escherichia coli CFT073
cuccuguucac

SEQ ID NO: 598816 - RNA, 23 nt, Escherichia coli CFT073
cucgaacauccccacagaaacaa

SEQ ID NO: 598817 - RNA, 17 nt, Escherichia coli CFT073
cuccggcuuuuugagau

SEQ ID NO: 598818 - RNA, 22 nt, Escherichia coli CFT073
cucgaacgugaucgccccggaa

SEQ ID NO: 598819 - RNA, 17 nt, Escherichia coli CFT073
cuccgcuuaucaggccu

SEQ ID NO: 598820 - RNA, 20 nt, Escherichia coli CFT073
cuccgcuaaauccgccgcca

SEQ ID NO: 598821 - RNA, 16 nt, Escherichia coli CFT073
cuccgcggucagcgca

SEQ ID NO: 598822 - RNA, 18 nt, Escherichia coli CFT073
cuccggcgcauccaugau

SEQ ID NO: 598823 - RNA, 17 nt, Escherichia coli CFT073
cuccgcacaaacgccac

SEQ ID NO: 598824 - RNA, 19 nt, Escherichia coli CFT073
cuccgcacaaacgccaccu

SEQ ID NO: 598825 - RNA, 18 nt, Escherichia coli CFT073
cuccgcacagcaguugca

SEQ ID NO: 598826 - RNA, 19 nt, Escherichia coli CFT073
cucccuuucugccacgcca

SEQ ID NO: 598827 - RNA, 15 nt, Escherichia coli CFT073
cuccgccacgucauc

SEQ ID NO: 598828 - RNA, 13 nt, Escherichia coli CFT073
cuccgccagcaac

SEQ ID NO: 598829 - RNA, 17 nt, Escherichia coli CFT073
cucgcagagaucauaca

SEQ ID NO: 598830 - RNA, 19 nt, Escherichia coli CFT073
cucgaggcucugauugccu

SEQ ID NO: 598831 - RNA, 17 nt, Escherichia coli CFT073
cucgccacgaucgguga

SEQ ID NO: 598832 - RNA, 13 nt, Escherichia coli CFT073
cucgccaccggca

SEQ ID NO: 598833 - RNA, 18 nt, Escherichia coli CFT073
cucgccgcgcuccaucau

SEQ ID NO: 598834 - RNA, 12 nt, Escherichia coli CFT073
cucgccuuauca

SEQ ID NO: 598835 - RNA, 14 nt, Escherichia coli CFT073
cucgccuugcugcc

SEQ ID NO: 598836 - RNA, 15 nt, Escherichia coli CFT073
cucgccuauacgcac

SEQ ID NO: 598837 - RNA, 21 nt, Escherichia coli CFT073
cucgcugacugauauugcccg

SEQ ID NO: 598838 - RNA, 20 nt, Escherichia coli CFT073
cucggcaaggccaauacccg

SEQ ID NO: 598839 - RNA, 23 nt, Escherichia coli CFT073
cucgcuggcguuguccgccagaa

SEQ ID NO: 598840 - RNA, 14 nt, Escherichia coli CFT073
cucccguugcuucu

SEQ ID NO: 598841 - RNA, 19 nt, Escherichia coli CFT073
cuccaugggagaacgaugc

SEQ ID NO: 598842 - RNA, 17 nt, Escherichia coli CFT073
cucauuauuugccgcca

SEQ ID NO: 598843 - RNA, 22 nt, Escherichia coli CFT073
cucauguuguaagcgcgcaggu

SEQ ID NO: 598844 - RNA, 11 nt, Escherichia coli CFT073
cuccagcgcca

SEQ ID NO: 598845 - RNA, 13 nt, Escherichia coli CFT073
cuccagcgccgcc

SEQ ID NO: 598846 - RNA, 15 nt, Escherichia coli CFT073
cucauccuucagugc

SEQ ID NO: 598847 - RNA, 17 nt, Escherichia coli CFT073
cucauccuucagugccu

SEQ ID NO: 598848 - RNA, 12 nt, Escherichia coli CFT073
cucaucgcccgc

SEQ ID NO: 598849 - RNA, 20 nt, Escherichia coli CFT073
cucaucuucauaacuuugau

SEQ ID NO: 598850 - RNA, 14 nt, Escherichia coli CFT073
cucaucuuccgggc

SEQ ID NO: 598851 - RNA, 20 nt, Escherichia coli CFT073
cucaucuucuuuuuccgggc

SEQ ID NO: 598852 - RNA, 17 nt, Escherichia coli CFT073
cucaugcccacgcaaac

SEQ ID NO: 598853 - RNA, 17 nt, Escherichia coli CFT073
cucacgcgccagcuuca

SEQ ID NO: 598854 - RNA, 13 nt, Escherichia coli CFT073
cucaccagccgcg

SEQ ID NO: 598855 - RNA, 13 nt, Escherichia coli CFT073
cucagccuucugu

SEQ ID NO: 598856 - RNA, 22 nt, Escherichia coli CFT073
cucacgggugagccacaaaccg

SEQ ID NO: 598857 - RNA, 12 nt, Escherichia coli CFT073
cuagcaacaaaa

SEQ ID NO: 598858 - RNA, 17 nt, Escherichia coli CFT073
cuagcagcagcguaccu

SEQ ID NO: 598859 - RNA, 20 nt, Escherichia coli CFT073
cuagcgucgcauccggcauu

SEQ ID NO: 598860 - RNA, 18 nt, Escherichia coli CFT073
cuaucaauacuuuccagc

SEQ ID NO: 598861 - RNA, 19 nt, Escherichia coli CFT073
cuaucagugcaaagacauc

SEQ ID NO: 598862 - RNA, 13 nt, Escherichia coli CFT073
cuaucugucagac

SEQ ID NO: 598863 - RNA, 23 nt, Escherichia coli CFT073
cuauauacagcgccucuuuugac

SEQ ID NO: 598864 - RNA, 21 nt, Escherichia coli CFT073
cuauaccuaacacgaucagcc

SEQ ID NO: 598865 - RNA, 17 nt, Escherichia coli CFT073
cuauacuccugauggcc

SEQ ID NO: 598866 - RNA, 13 nt, Escherichia coli CFT073
cuauaucaacgcc

SEQ ID NO: 598867 - RNA, 23 nt, Escherichia coli CFT073
cuauauuaaagcuuuaauuucag

SEQ ID NO: 598868 - RNA, 20 nt, Escherichia coli CFT073
cuauauuuauucaucagcgu

SEQ ID NO: 598869 - RNA, 18 nt, Escherichia coli CFT073
cuaucaacaauaaacugc

SEQ ID NO: 598870 - RNA, 20 nt, Escherichia coli CFT073
cuaugagagccguuaaaacg

SEQ ID NO: 598871 - RNA, 18 nt, Escherichia coli CFT073
cucaaauaucugccggaa

SEQ ID NO: 598872 - RNA, 22 nt, Escherichia coli CFT073
cucaacauacaaauagccaauu

SEQ ID NO: 598873 - RNA, 14 nt, Escherichia coli CFT073
cucaagcaaccagg

SEQ ID NO: 598874 - RNA, 19 nt, Escherichia coli CFT073
cucaacuuauugaucaucc

SEQ ID NO: 598875 - RNA, 22 nt, Escherichia coli CFT073
cucaacuuucuuggcacccagc

SEQ ID NO: 598876 - RNA, 16 nt, Escherichia coli CFT073
cucaaccuucuucgcg

SEQ ID NO: 598877 - RNA, 17 nt, Escherichia coli CFT073
cucaacggaauaaacgc

SEQ ID NO: 598878 - RNA, 15 nt, Escherichia coli CFT073
cucaauguugcugcu

SEQ ID NO: 598879 - RNA, 15 nt, Escherichia coli CFT073
cucaaucgcacccgc

SEQ ID NO: 598880 - RNA, 16 nt, Escherichia coli CFT073
cucaaugaugccgcca

SEQ ID NO: 598881 - RNA, 20 nt, Escherichia coli CFT073
cucaagcuuacugagcagau

SEQ ID NO: 598882 - RNA, 22 nt, Escherichia coli CFT073
cuacaucaggcagaacgccaug

SEQ ID NO: 598883 - RNA, 12 nt, Escherichia coli CFT073
cuacaucgacaa

SEQ ID NO: 598884 - RNA, 12 nt, Escherichia coli CFT073
cuacccgguucg

SEQ ID NO: 598885 - RNA, 19 nt, Escherichia coli CFT073
cguugacucgguaaaauca

SEQ ID NO: 598886 - RNA, 15 nt, Escherichia coli CFT073
cguugaaauugcugg

SEQ ID NO: 598887 - RNA, 15 nt, Escherichia coli CFT073
cguugaaaaugcugg

SEQ ID NO: 598888 - RNA, 20 nt, Escherichia coli CFT073
cguucugcuguucuucugcc

SEQ ID NO: 598889 - RNA, 13 nt, Escherichia coli CFT073
cuacgugccgggc

SEQ ID NO: 598890 - RNA, 15 nt, Escherichia coli CFT073
cuacuaauaaaucgu

SEQ ID NO: 598891 - RNA, 21 nt, Escherichia coli CFT073
cuaccgcaccuuccggaauag

SEQ ID NO: 598892 - RNA, 15 nt, Escherichia coli CFT073
cuaccggaaucgcgc

SEQ ID NO: 598893 - RNA, 21 nt, Escherichia coli CFT073
cuacugccagauucuccagca

SEQ ID NO: 598894 - RNA, 16 nt, Escherichia coli CFT073
cuacuggcaauccugc

SEQ ID NO: 598895 - RNA, 12 nt, Escherichia coli CFT073
cguggcgucgca

SEQ ID NO: 598896 - RNA, 21 nt, Escherichia coli CFT073
cguggcccgccagcaugccgc

SEQ ID NO: 598897 - RNA, 22 nt, Escherichia coli CFT073
cguggccaugaccaccgcagca

SEQ ID NO: 598898 - RNA, 16 nt, Escherichia coli CFT073
cguggcaauugccgca

SEQ ID NO: 598899 - RNA, 14 nt, Escherichia coli CFT073
cguggcacgguaaa

SEQ ID NO: 598900 - RNA, 19 nt, Escherichia coli CFT073
cguguacccagcagcgcca

SEQ ID NO: 598901 - RNA, 20 nt, Escherichia coli CFT073
cgugguuuaccaccagcgga

SEQ ID NO: 598902 - RNA, 19 nt, Escherichia coli CFT073
cgugguuugcgcauucaga

SEQ ID NO: 598903 - RNA, 17 nt, Escherichia coli CFT073
cgugguggcuacuucuu

SEQ ID NO: 598904 - RNA, 16 nt, Escherichia coli CFT073
cguggucgugaucgug

SEQ ID NO: 598905 - RNA, 16 nt, Escherichia coli CFT073
cguggugaaaucgccg

SEQ ID NO: 598906 - RNA, 14 nt, Escherichia coli CFT073
cguggucgccagca

SEQ ID NO: 598907 - RNA, 22 nt, Escherichia coli CFT073
cguuaggcacaucaacaccgac

SEQ ID NO: 598908 - RNA, 20 nt, Escherichia coli CFT073
cguucaagcugcaucuggcg

SEQ ID NO: 598909 - RNA, 14 nt, Escherichia coli CFT073
cguuaugcaaauga

SEQ ID NO: 598910 - RNA, 20 nt, Escherichia coli CFT073
cguuauugggguuacgaccu

SEQ ID NO: 598911 - RNA, 22 nt, Escherichia coli CFT073
cguuauuuauucucacguugca

SEQ ID NO: 598912 - RNA, 23 nt, Escherichia coli CFT073
cguuauuugcggauuaacgauua

SEQ ID NO: 598913 - RNA, 19 nt, Escherichia coli CFT073
cguuauuuguugccggaug

SEQ ID NO: 598914 - RNA, 15 nt, Escherichia coli CFT073
cguucaaaccguaaa

SEQ ID NO: 598915 - RNA, 15 nt, Escherichia coli CFT073
cguuaauggcgauaa

SEQ ID NO: 598916 - RNA, 18 nt, Escherichia coli CFT073
cguuacccgacgcgccag

SEQ ID NO: 598917 - RNA, 14 nt, Escherichia coli CFT073
cguuaagcgucgca

SEQ ID NO: 598918 - RNA, 18 nt, Escherichia coli CFT073
cguuaagcgucgcaucag

SEQ ID NO: 598919 - RNA, 14 nt, Escherichia coli CFT073
cguuaaggccaaac

SEQ ID NO: 598920 - RNA, 22 nt, Escherichia coli CFT073
cguuaauccgcucugcccacgg

SEQ ID NO: 598921 - RNA, 14 nt, Escherichia coli CFT073
cguuacaaccacau

SEQ ID NO: 598922 - RNA, 15 nt, Escherichia coli CFT073
cguuacacagaguuu

SEQ ID NO: 598923 - RNA, 23 nt, Escherichia coli CFT073
cguuacggaucagaguacgcagu

SEQ ID NO: 598924 - RNA, 16 nt, Escherichia coli CFT073
cguuacuuaacacccc

SEQ ID NO: 598925 - RNA, 17 nt, Escherichia coli CFT073
cguuagaacccaacaga

SEQ ID NO: 598926 - RNA, 16 nt, Escherichia coli CFT073
cguguguugagauaau

SEQ ID NO: 598927 - RNA, 16 nt, Escherichia coli CFT073
cgugugauucagguau

SEQ ID NO: 598928 - RNA, 12 nt, Escherichia coli CFT073
cguguuccagcg

SEQ ID NO: 598929 - RNA, 22 nt, Escherichia coli CFT073
cguguugcuccacgccagcguu

SEQ ID NO: 598930 - RNA, 15 nt, Escherichia coli CFT073
cguuaaacgccaaac

SEQ ID NO: 598931 - RNA, 17 nt, Escherichia coli CFT073
cguuaaauccugccaac

SEQ ID NO: 598932 - RNA, 20 nt, Escherichia coli CFT073
cguuaaccacgaucccuugc

SEQ ID NO: 598933 - RNA, 22 nt, Escherichia coli CFT073
cguucugccaaacgcucccagc

SEQ ID NO: 598934 - RNA, 23 nt, Escherichia coli CFT073
cguucgcgaggugucuucgcgca

SEQ ID NO: 598935 - RNA, 17 nt, Escherichia coli CFT073
cguucgaucaccgcacg

SEQ ID NO: 598936 - RNA, 20 nt, Escherichia coli CFT073
cguucgaugcgauaaccagg

SEQ ID NO: 598937 - RNA, 15 nt, Escherichia coli CFT073
cguucaguuuaccgu

SEQ ID NO: 598938 - RNA, 17 nt, Escherichia coli CFT073
cguucaguuuauucugc

SEQ ID NO: 598939 - RNA, 23 nt, Escherichia coli CFT073
cguucauacgcaaugugcagcag

SEQ ID NO: 598940 - RNA, 16 nt, Escherichia coli CFT073
cguucacgccgcaucc

SEQ ID NO: 598941 - RNA, 10 nt, Escherichia coli CFT073
cguucacgca

SEQ ID NO: 598942 - RNA, 20 nt, Escherichia coli CFT073
cguucacgccgcaucuggca

SEQ ID NO: 598943 - RNA, 19 nt, Escherichia coli CFT073
cguucauuucguacagacg

SEQ ID NO: 598944 - RNA, 21 nt, Escherichia coli CFT073
cguucaucucgaauacgccga

SEQ ID NO: 598945 - RNA, 12 nt, Escherichia coli CFT073
cgucuuauccga

SEQ ID NO: 598946 - RNA, 20 nt, Escherichia coli CFT073
cgucuuauccgaccuacagg

SEQ ID NO: 598947 - RNA, 20 nt, Escherichia coli CFT073
cgucuuaucuggccuacaaa

SEQ ID NO: 598948 - RNA, 15 nt, Escherichia coli CFT073
cgucuuaucaggccu

SEQ ID NO: 598949 - RNA, 20 nt, Escherichia coli CFT073
cgucuuaucaggccuacaaa

SEQ ID NO: 598950 - RNA, 20 nt, Escherichia coli CFT073
cgucuuaucaggccuacaau

SEQ ID NO: 598951 - RNA, 20 nt, Escherichia coli CFT073
cgucuuaucaggccuacagg

SEQ ID NO: 598952 - RNA, 23 nt, Escherichia coli CFT073
cgucuguaaccagaugucgcgca

SEQ ID NO: 598953 - RNA, 15 nt, Escherichia coli CFT073
cgucuucaaccgcag

SEQ ID NO: 598954 - RNA, 14 nt, Escherichia coli CFT073
cgugaauaugucgc

SEQ ID NO: 598955 - RNA, 22 nt, Escherichia coli CFT073
cgugaaucccaguacuguacaa

SEQ ID NO: 598956 - RNA, 13 nt, Escherichia coli CFT073
cgucucgccagag

SEQ ID NO: 598957 - RNA, 23 nt, Escherichia coli CFT073
cgucgguaaagaaaauaccgaac

SEQ ID NO: 598958 - RNA, 20 nt, Escherichia coli CFT073
cgucggcuucacgcccagca

SEQ ID NO: 598959 - RNA, 19 nt, Escherichia coli CFT073
cgugauugguuucaaccug

SEQ ID NO: 598960 - RNA, 14 nt, Escherichia coli CFT073
cgugcacaccgaag

SEQ ID NO: 598961 - RNA, 14 nt, Escherichia coli CFT073
cgugaccucuucgg

SEQ ID NO: 598962 - RNA, 13 nt, Escherichia coli CFT073
cgugccagcacca

SEQ ID NO: 598963 - RNA, 20 nt, Escherichia coli CFT073
cgugcauaucgcuguuggcg

SEQ ID NO: 598964 - RNA, 16 nt, Escherichia coli CFT073
cgugccaaauauucag

SEQ ID NO: 598965 - RNA, 12 nt, Escherichia coli CFT073
cgugcaucggca

SEQ ID NO: 598966 - RNA, 12 nt, Escherichia coli CFT073
cgugcaccaauu

SEQ ID NO: 598967 - RNA, 22 nt, Escherichia coli CFT073
cguggagcaacacgccagcguu

SEQ ID NO: 598968 - RNA, 22 nt, Escherichia coli CFT073
cgugcucucaaauaucugccgg

SEQ ID NO: 598969 - RNA, 23 nt, Escherichia coli CFT073
cgugcucucaaauaucugccgga

SEQ ID NO: 598970 - RNA, 22 nt, Escherichia coli CFT073
cgugcggcaggcacaaaaccug

SEQ ID NO: 598971 - RNA, 20 nt, Escherichia coli CFT073
cgugcgcuggacgccgaggu

SEQ ID NO: 598972 - RNA, 14 nt, Escherichia coli CFT073
cgugcgcgccguga

SEQ ID NO: 598973 - RNA, 19 nt, Escherichia coli CFT073
cgugcgccagagcccguua

SEQ ID NO: 598974 - RNA, 12 nt, Escherichia coli CFT073
cgugcgccaccg

SEQ ID NO: 598975 - RNA, 19 nt, Escherichia coli CFT073
cgugcccgggucagcgcca

SEQ ID NO: 598976 - RNA, 17 nt, Escherichia coli CFT073
cgugccccugaauaauc

SEQ ID NO: 598977 - RNA, 15 nt, Escherichia coli CFT073
cguccccaaaaaagc

SEQ ID NO: 598978 - RNA, 20 nt, Escherichia coli CFT073
cguccaucccacacuguuga

SEQ ID NO: 598979 - RNA, 19 nt, Escherichia coli CFT073
cgucauucauuuaaucguu

SEQ ID NO: 598980 - RNA, 21 nt, Escherichia coli CFT073
cgucauuaugucuggcgagcu

SEQ ID NO: 598981 - RNA, 17 nt, Escherichia coli CFT073
cgucauuuccagacgcc

SEQ ID NO: 598982 - RNA, 18 nt, Escherichia coli CFT073
cguccaccagaacgacga

SEQ ID NO: 598983 - RNA, 15 nt, Escherichia coli CFT073
cguccacaaaccguu

SEQ ID NO: 598984 - RNA, 14 nt, Escherichia coli CFT073
cgucagggccugcg

SEQ ID NO: 598985 - RNA, 14 nt, Escherichia coli CFT073
cgucagccgcccgc

SEQ ID NO: 598986 - RNA, 23 nt, Escherichia coli CFT073
cguccgggcuaauacccucaacg

SEQ ID NO: 598987 - RNA, 21 nt, Escherichia coli CFT073
cgucgagcagagaaacgccag

SEQ ID NO: 598988 - RNA, 20 nt, Escherichia coli CFT073
cgucgcaacuccaccagcac

SEQ ID NO: 598989 - RNA, 14 nt, Escherichia coli CFT073
cgucgauugcucaa

SEQ ID NO: 598990 - RNA, 18 nt, Escherichia coli CFT073
cgguuguaggccugauca

SEQ ID NO: 598991 - RNA, 14 nt, Escherichia coli CFT073
cgguuuaccaucac

SEQ ID NO: 598992 - RNA, 15 nt, Escherichia coli CFT073
cgguuuaccaucacu

SEQ ID NO: 598993 - RNA, 14 nt, Escherichia coli CFT073
cgguuuagaaaaga

SEQ ID NO: 598994 - RNA, 23 nt, Escherichia coli CFT073
cgguuuagaaaagaguauuacau

SEQ ID NO: 598995 - RNA, 23 nt, Escherichia coli CFT073
cgguuguucaaccaccggcacca

SEQ ID NO: 598996 - RNA, 23 nt, Escherichia coli CFT073
cguaaaguggcggggucgugcag

SEQ ID NO: 598997 - RNA, 19 nt, Escherichia coli CFT073
cguaagccugauaagcguu

SEQ ID NO: 598998 - RNA, 20 nt, Escherichia coli CFT073
cguaacguuucuuucaucag

SEQ ID NO: 598999 - RNA, 16 nt, Escherichia coli CFT073
cguaacucauccaacu

SEQ ID NO: 599000 - RNA, 17 nt, Escherichia coli CFT073
cguaacgacccacaaua

SEQ ID NO: 599001 - RNA, 21 nt, Escherichia coli CFT073
cguaacgcucaagaacggcaa

SEQ ID NO: 599002 - RNA, 14 nt, Escherichia coli CFT073
cguaaauaaugacc

SEQ ID NO: 599003 - RNA, 22 nt, Escherichia coli CFT073
cguaaauuuauuccgagcagcu

SEQ ID NO: 599004 - RNA, 16 nt, Escherichia coli CFT073
cguaacacucgugcgu

SEQ ID NO: 599005 - RNA, 16 nt, Escherichia coli CFT073
cgguugcaaugcauca

SEQ ID NO: 599006 - RNA, 15 nt, Escherichia coli CFT073
cgguugccagcgcca

SEQ ID NO: 599007 - RNA, 15 nt, Escherichia coli CFT073
cgguugagauaacgu

SEQ ID NO: 599008 - RNA, 14 nt, Escherichia coli CFT073
cgguucaucacgaa

SEQ ID NO: 599009 - RNA, 18 nt, Escherichia coli CFT073
cgguguaggcauacacau

SEQ ID NO: 599010 - RNA, 20 nt, Escherichia coli CFT073
cggugaccgagcgcccgcca

SEQ ID NO: 599011 - RNA, 20 nt, Escherichia coli CFT073
cggugaagccaccagcgcca

SEQ ID NO: 599012 - RNA, 21 nt, Escherichia coli CFT073
cggugaauucaguaccagcac

SEQ ID NO: 599013 - RNA, 20 nt, Escherichia coli CFT073
cgucaaaauucauaaagcua

SEQ ID NO: 599014 - RNA, 18 nt, Escherichia coli CFT073
cgucaaacucauaaacca

SEQ ID NO: 599015 - RNA, 18 nt, Escherichia coli CFT073
cguauuuugcccuguuga

SEQ ID NO: 599016 - RNA, 13 nt, Escherichia coli CFT073
cguaugcgaagcu

SEQ ID NO: 599017 - RNA, 22 nt, Escherichia coli CFT073
cguaugcaucgguggcgauacu

SEQ ID NO: 599018 - RNA, 19 nt, Escherichia coli CFT073
cguaugauguauauuucug

SEQ ID NO: 599019 - RNA, 16 nt, Escherichia coli CFT073
cguaugcccagcgcag

SEQ ID NO: 599020 - RNA, 20 nt, Escherichia coli CFT073
cguaggucggauaagacgcg

SEQ ID NO: 599021 - RNA, 22 nt, Escherichia coli CFT073
cgucagcaucgcgcgggcauug

SEQ ID NO: 599022 - RNA, 13 nt, Escherichia coli CFT073
cgucagcaucucu

SEQ ID NO: 599023 - RNA, 17 nt, Escherichia coli CFT073
cgucagcacucacgcca

SEQ ID NO: 599024 - RNA, 20 nt, Escherichia coli CFT073
cgucagcaaaguaccaucgu

SEQ ID NO: 599025 - RNA, 11 nt, Escherichia coli CFT073
cgucaccgauu

SEQ ID NO: 599026 - RNA, 14 nt, Escherichia coli CFT073
cgucaccgccaggu

SEQ ID NO: 599027 - RNA, 17 nt, Escherichia coli CFT073
cgucaaccugaccaaau

SEQ ID NO: 599028 - RNA, 16 nt, Escherichia coli CFT073
cguagcuggcggcaau

SEQ ID NO: 599029 - RNA, 20 nt, Escherichia coli CFT073
cguagcguaagaaagucgcg

SEQ ID NO: 599030 - RNA, 13 nt, Escherichia coli CFT073
cguagcgcaucag

SEQ ID NO: 599031 - RNA, 15 nt, Escherichia coli CFT073
cguacugcggaaccg

SEQ ID NO: 599032 - RNA, 17 nt, Escherichia coli CFT073
cguacuggcaaucgcca

SEQ ID NO: 599033 - RNA, 15 nt, Escherichia coli CFT073
cguacugaccguaag

SEQ ID NO: 599034 - RNA, 15 nt, Escherichia coli CFT073
cguacguucauggcg

SEQ ID NO: 599035 - RNA, 17 nt, Escherichia coli CFT073
cguacuaucuacugccu

SEQ ID NO: 599036 - RNA, 20 nt, Escherichia coli CFT073
cguacgcguuaaauccugcc

SEQ ID NO: 599037 - RNA, 18 nt, Escherichia coli CFT073
cguacgccgcucgaauca

SEQ ID NO: 599038 - RNA, 14 nt, Escherichia coli CFT073
cguacgccagcguc

SEQ ID NO: 599039 - RNA, 15 nt, Escherichia coli CFT073
cguacgccagcguca

SEQ ID NO: 599040 - RNA, 13 nt, Escherichia coli CFT073
cguaaguaagaua

SEQ ID NO: 599041 - RNA, 23 nt, Escherichia coli CFT073
gaauccagcacgaagaggccgcc

SEQ ID NO: 599042 - RNA, 17 nt, Escherichia coli CFT073
gaaucagaauccggugc

SEQ ID NO: 599043 - RNA, 23 nt, Escherichia coli CFT073
gaaucaggaaccacaaccacuuu

SEQ ID NO: 599044 - RNA, 22 nt, Escherichia coli CFT073
gaaucuguucuggaaaaaauuc

SEQ ID NO: 599045 - RNA, 22 nt, Escherichia coli CFT073
gaaugaccgcuaauagcgcagc

SEQ ID NO: 599046 - RNA, 12 nt, Escherichia coli CFT073
gaauacugccgu

SEQ ID NO: 599047 - RNA, 22 nt, Escherichia coli CFT073
gaaucaccugauugaccgccag

SEQ ID NO: 599048 - RNA, 20 nt, Escherichia coli CFT073
gaauacccagcaaugccagg

SEQ ID NO: 599049 - RNA, 19 nt, Escherichia coli CFT073
gaauaccccagcggcaacc

SEQ ID NO: 599050 - RNA, 14 nt, Escherichia coli CFT073
gaauacccgccaga

SEQ ID NO: 599051 - RNA, 22 nt, Escherichia coli CFT073
gaauaccacgcguugauaacgu

SEQ ID NO: 599052 - RNA, 18 nt, Escherichia coli CFT073
gaauaccuugcugcucca

SEQ ID NO: 599053 - RNA, 15 nt, Escherichia coli CFT073
gaauaagcgcccagc

SEQ ID NO: 599054 - RNA, 19 nt, Escherichia coli CFT073
gaauaacggcugauaacaa

SEQ ID NO: 599055 - RNA, 13 nt, Escherichia coli CFT073
gaauaacgcuggg

SEQ ID NO: 599056 - RNA, 14 nt, Escherichia coli CFT073
gaacucuuccggga

SEQ ID NO: 599057 - RNA, 21 nt, Escherichia coli CFT073
gaacugaaaggcacucauuuu

SEQ ID NO: 599058 - RNA, 17 nt, Escherichia coli CFT073
gaacugaacaccgccuu

SEQ ID NO: 599059 - RNA, 20 nt, Escherichia coli CFT073
gaacucgcugcgcggcagcu

SEQ ID NO: 599060 - RNA, 19 nt, Escherichia coli CFT073
gaaugacguuuacuucgcu

SEQ ID NO: 599061 - RNA, 15 nt, Escherichia coli CFT073
gaaugacuaagcgau

SEQ ID NO: 599062 - RNA, 15 nt, Escherichia coli CFT073
gaauggcgaacgcua

SEQ ID NO: 599063 - RNA, 22 nt, Escherichia coli CFT073
gaauggcgacguaccagcgucg

SEQ ID NO: 599064 - RNA, 17 nt, Escherichia coli CFT073
gaaugcucgcuggcagg

SEQ ID NO: 599065 - RNA, 23 nt, Escherichia coli CFT073
gaauggucaccacaaaugcgcca

SEQ ID NO: 599066 - RNA, 17 nt, Escherichia coli CFT073
gaaugguuuugucagcc

SEQ ID NO: 599067 - RNA, 13 nt, Escherichia coli CFT073
gaauuucacuuuc

SEQ ID NO: 599068 - RNA, 19 nt, Escherichia coli CFT073
gaauuucacuuucugacca

SEQ ID NO: 599069 - RNA, 16 nt, Escherichia coli CFT073
gaauuuccagaaagug

SEQ ID NO: 599070 - RNA, 15 nt, Escherichia coli CFT073
gaauuuguaggccgg

SEQ ID NO: 599071 - RNA, 16 nt, Escherichia coli CFT073
gaauuuguaggccgga

SEQ ID NO: 599072 - RNA, 18 nt, Escherichia coli CFT073
gaauuuguaggccugaua

SEQ ID NO: 599073 - RNA, 21 nt, Escherichia coli CFT073
gacaaaagugaaugucggcgg

SEQ ID NO: 599074 - RNA, 23 nt, Escherichia coli CFT073
gacaaaaucaauauaaacagccc

SEQ ID NO: 599075 - RNA, 19 nt, Escherichia coli CFT073
gaauuuugaaggaaaaauc

SEQ ID NO: 599076 - RNA, 13 nt, Escherichia coli CFT073
gaauuuugcuggc

SEQ ID NO: 599077 - RNA, 16 nt, Escherichia coli CFT073
gacaaucgcccccauc

SEQ ID NO: 599078 - RNA, 17 nt, Escherichia coli CFT073
gacaaucaucacgauca

SEQ ID NO: 599079 - RNA, 17 nt, Escherichia coli CFT073
gacaaucaucgccguca

SEQ ID NO: 599080 - RNA, 22 nt, Escherichia coli CFT073
gacaauccaguugguucaacaa

SEQ ID NO: 599081 - RNA, 13 nt, Escherichia coli CFT073
gacaauaaacggu

SEQ ID NO: 599082 - RNA, 12 nt, Escherichia coli CFT073
gacaauaacgcc

SEQ ID NO: 599083 - RNA, 17 nt, Escherichia coli CFT073
gacacaauccaugccaa

SEQ ID NO: 599084 - RNA, 17 nt, Escherichia coli CFT073
gacaauuacaaaaugac

SEQ ID NO: 599085 - RNA, 13 nt, Escherichia coli CFT073
gacacaucagcaa

SEQ ID NO: 599086 - RNA, 17 nt, Escherichia coli CFT073
gacacaucagcaacgcu

SEQ ID NO: 599087 - RNA, 20 nt, Escherichia coli CFT073
gacacaucagcaacgcugac

SEQ ID NO: 599088 - RNA, 14 nt, Escherichia coli CFT073
gacaacgccgcuuu

SEQ ID NO: 599089 - RNA, 12 nt, Escherichia coli CFT073
gacaagcauaac

SEQ ID NO: 599090 - RNA, 19 nt, Escherichia coli CFT073
gacagguucaugcugcggc

SEQ ID NO: 599091 - RNA, 16 nt, Escherichia coli CFT073
gacagguggugugcaa

SEQ ID NO: 599092 - RNA, 17 nt, Escherichia coli CFT073
gacaguacccagauuca

SEQ ID NO: 599093 - RNA, 23 nt, Escherichia coli CFT073
gacauccagaucacgcagcaagc

SEQ ID NO: 599094 - RNA, 18 nt, Escherichia coli CFT073
gacaucaucgccccgcuc

SEQ ID NO: 599095 - RNA, 15 nt, Escherichia coli CFT073
gacauccgccagcgc

SEQ ID NO: 599096 - RNA, 16 nt, Escherichia coli CFT073
gacauccgccagcgcc

SEQ ID NO: 599097 - RNA, 22 nt, Escherichia coli CFT073
gacauccugaguuaaucgccgc

SEQ ID NO: 599098 - RNA, 22 nt, Escherichia coli CFT073
gaccaccucggcacugacgcgc

SEQ ID NO: 599099 - RNA, 20 nt, Escherichia coli CFT073
gaccagaccggcaaucgcgc

SEQ ID NO: 599100 - RNA, 18 nt, Escherichia coli CFT073
gaccagagccaaucggcc

SEQ ID NO: 599101 - RNA, 17 nt, Escherichia coli CFT073
gaccagagcugauacgg

SEQ ID NO: 599102 - RNA, 21 nt, Escherichia coli CFT073
gacagcgaaaacgacgagcca

SEQ ID NO: 599103 - RNA, 21 nt, Escherichia coli CFT073
gacaccccgguaaagcgcaug

SEQ ID NO: 599104 - RNA, 16 nt, Escherichia coli CFT073
gacaccagcgucgcgu

SEQ ID NO: 599105 - RNA, 22 nt, Escherichia coli CFT073
gacaccagccagacucagcaac

SEQ ID NO: 599106 - RNA, 12 nt, Escherichia coli CFT073
gacacaacgcuu

SEQ ID NO: 599107 - RNA, 14 nt, Escherichia coli CFT073
gaccuucugccaga

SEQ ID NO: 599108 - RNA, 17 nt, Escherichia coli CFT073
gaccuucuucagcaaua

SEQ ID NO: 599109 - RNA, 19 nt, Escherichia coli CFT073
gaccguacaaccaaaucug

SEQ ID NO: 599110 - RNA, 22 nt, Escherichia coli CFT073
gaccgucaaacaugccgucaau

SEQ ID NO: 599111 - RNA, 17 nt, Escherichia coli CFT073
gaccgguccacuuccug

SEQ ID NO: 599112 - RNA, 23 nt, Escherichia coli CFT073
gaccgggagauuugcaucaucaa

SEQ ID NO: 599113 - RNA, 16 nt, Escherichia coli CFT073
gaccagcaccgccagc

SEQ ID NO: 599114 - RNA, 16 nt, Escherichia coli CFT073
gaccagcggcaacauc

SEQ ID NO: 599115 - RNA, 23 nt, Escherichia coli CFT073
gaccagcggcaacaucaucacgc

SEQ ID NO: 599116 - RNA, 14 nt, Escherichia coli CFT073
gaccagccagcaau

SEQ ID NO: 599117 - RNA, 18 nt, Escherichia coli CFT073
gaccagccuugugccuca

SEQ ID NO: 599118 - RNA, 16 nt, Escherichia coli CFT073
gaccauaacccgcuuc

SEQ ID NO: 599119 - RNA, 15 nt, Escherichia coli CFT073
gaccagugcaacaga

SEQ ID NO: 599120 - RNA, 17 nt, Escherichia coli CFT073
gaccaguaccaccgcga

SEQ ID NO: 599121 - RNA, 16 nt, Escherichia coli CFT073
gaccagcuccagcagu

SEQ ID NO: 599122 - RNA, 22 nt, Escherichia coli CFT073
gaccagcuaccacgccgauaau

SEQ ID NO: 599123 - RNA, 20 nt, Escherichia coli CFT073
gaccauauuaacgcagcaaa

SEQ ID NO: 599124 - RNA, 12 nt, Escherichia coli CFT073
gaccauauuccc

SEQ ID NO: 599125 - RNA, 17 nt, Escherichia coli CFT073
gaccaucagcagcggca

SEQ ID NO: 599126 - RNA, 14 nt, Escherichia coli CFT073
gaccgagcugguga

SEQ ID NO: 599127 - RNA, 21 nt, Escherichia coli CFT073
gaccgacgcauuaacgcugaa

SEQ ID NO: 599128 - RNA, 21 nt, Escherichia coli CFT073
gacuuguggcgcaggggcaga

SEQ ID NO: 599129 - RNA, 17 nt, Escherichia coli CFT073
gacuuucaaagagagca

SEQ ID NO: 599130 - RNA, 19 nt, Escherichia coli CFT073
gacuuuacuaauagcaaaa

SEQ ID NO: 599131 - RNA, 16 nt, Escherichia coli CFT073
gacuuucucuggcugu

SEQ ID NO: 599132 - RNA, 19 nt, Escherichia coli CFT073
gacuuugccuggcggcaga

SEQ ID NO: 599133 - RNA, 16 nt, Escherichia coli CFT073
gacuuuuugcggcagc

SEQ ID NO: 599134 - RNA, 15 nt, Escherichia coli CFT073
gagaaaaaucuccgg

SEQ ID NO: 599135 - RNA, 13 nt, Escherichia coli CFT073
gagaaaaucacac

SEQ ID NO: 599136 - RNA, 17 nt, Escherichia coli CFT073
gacuucaucacgaugca

SEQ ID NO: 599137 - RNA, 19 nt, Escherichia coli CFT073
gacuuccaccagcggcuga

SEQ ID NO: 599138 - RNA, 16 nt, Escherichia coli CFT073
gacuuccacuuccugc

SEQ ID NO: 599139 - RNA, 22 nt, Escherichia coli CFT073
gacuuccccugccaaccaacgc

SEQ ID NO: 599140 - RNA, 21 nt, Escherichia coli CFT073
gacuucccucccguuucggua

SEQ ID NO: 599141 - RNA, 20 nt, Escherichia coli CFT073
gacuugccagccaugagaca

SEQ ID NO: 599142 - RNA, 22 nt, Escherichia coli CFT073
gacuugcgaacucaccaugacc

SEQ ID NO: 599143 - RNA, 20 nt, Escherichia coli CFT073
gacugccgcacuuacagcaa

SEQ ID NO: 599144 - RNA, 15 nt, Escherichia coli CFT073
gacuggaaaucaaau

SEQ ID NO: 599145 - RNA, 22 nt, Escherichia coli CFT073
gacuguucauuuuguaggccug

SEQ ID NO: 599146 - RNA, 18 nt, Escherichia coli CFT073
gacuguacaauaucgaua

SEQ ID NO: 599147 - RNA, 14 nt, Escherichia coli CFT073
gacuaaagccguga

SEQ ID NO: 599148 - RNA, 15 nt, Escherichia coli CFT073
gacguuguugaauag

SEQ ID NO: 599149 - RNA, 16 nt, Escherichia coli CFT073
gacucccugaugugau

SEQ ID NO: 599150 - RNA, 13 nt, Escherichia coli CFT073
gacugaaccagcg

SEQ ID NO: 599151 - RNA, 23 nt, Escherichia coli CFT073
gagcacgguuuugucggcaugau

SEQ ID NO: 599152 - RNA, 20 nt, Escherichia coli CFT073
gagcaccgccucgcggaucu

SEQ ID NO: 599153 - RNA, 18 nt, Escherichia coli CFT073
gagcacaucagcgcccuc

SEQ ID NO: 599154 - RNA, 17 nt, Escherichia coli CFT073
gagaucuuucacgccca

SEQ ID NO: 599155 - RNA, 16 nt, Escherichia coli CFT073
gagauccgcacucaac

SEQ ID NO: 599156 - RNA, 20 nt, Escherichia coli CFT073
gagauucauccaguuccagu

SEQ ID NO: 599157 - RNA, 18 nt, Escherichia coli CFT073
gagauguaauaacgcuua

SEQ ID NO: 599158 - RNA, 19 nt, Escherichia coli CFT073
gagauuuucuccugcgccu

SEQ ID NO: 599159 - RNA, 15 nt, Escherichia coli CFT073
gagcaaaaaucgaca

SEQ ID NO: 599160 - RNA, 16 nt, Escherichia coli CFT073
gagcaaaucgcggcuu

SEQ ID NO: 599161 - RNA, 13 nt, Escherichia coli CFT073
gagcaauaaacac

SEQ ID NO: 599162 - RNA, 17 nt, Escherichia coli CFT073
gagcaagaaccccagcc

SEQ ID NO: 599163 - RNA, 20 nt, Escherichia coli CFT073
gagcaaccagcaaugccagc

SEQ ID NO: 599164 - RNA, 13 nt, Escherichia coli CFT073
gagaguuaccguu

SEQ ID NO: 599165 - RNA, 15 nt, Escherichia coli CFT073
gagaguugcaccagc

SEQ ID NO: 599166 - RNA, 19 nt, Escherichia coli CFT073
gagauaaacucacucugca

SEQ ID NO: 599167 - RNA, 14 nt, Escherichia coli CFT073
gagauaaugcgcca

SEQ ID NO: 599168 - RNA, 16 nt, Escherichia coli CFT073
gagauaacguuuagcg

SEQ ID NO: 599169 - RNA, 16 nt, Escherichia coli CFT073
gagaucaaugcgccaa

SEQ ID NO: 599170 - RNA, 17 nt, Escherichia coli CFT073
gagagucauuaugcugg

SEQ ID NO: 599171 - RNA, 21 nt, Escherichia coli CFT073
gagagcgccucauaugcggca

SEQ ID NO: 599172 - RNA, 20 nt, Escherichia coli CFT073
gagagcuuauccagcaaagc

SEQ ID NO: 599173 - RNA, 17 nt, Escherichia coli CFT073
gagacuuauucuggcaa

SEQ ID NO: 599174 - RNA, 13 nt, Escherichia coli CFT073
gagagaagccagg

SEQ ID NO: 599175 - RNA, 15 nt, Escherichia coli CFT073
gagagccagccccac

SEQ ID NO: 599176 - RNA, 21 nt, Escherichia coli CFT073
gagagauccugagaaauuagc

SEQ ID NO: 599177 - RNA, 19 nt, Escherichia coli CFT073
gagagcaaccagcaaugcc

SEQ ID NO: 599178 - RNA, 20 nt, Escherichia coli CFT073
gagacgccagaaccgagcac

SEQ ID NO: 599179 - RNA, 20 nt, Escherichia coli CFT073
gagacaaaguaauucccagu

SEQ ID NO: 599180 - RNA, 17 nt, Escherichia coli CFT073
gagacaaugcaaacggc

SEQ ID NO: 599181 - RNA, 14 nt, Escherichia coli CFT073
gagaaugaauuuca

SEQ ID NO: 599182 - RNA, 21 nt, Escherichia coli CFT073
gagaaugacgacaaagaccug

SEQ ID NO: 599183 - RNA, 14 nt, Escherichia coli CFT073
gagacaccagcguc

SEQ ID NO: 599184 - RNA, 12 nt, Escherichia coli CFT073
gagaaugccagc

SEQ ID NO: 599185 - RNA, 19 nt, Escherichia coli CFT073
gagaauagcgccaucgcga

SEQ ID NO: 599186 - RNA, 15 nt, Escherichia coli CFT073
gagaauauugccggg

SEQ ID NO: 599187 - RNA, 17 nt, Escherichia coli CFT073
gagaacuuaaucaucgc

SEQ ID NO: 599188 - RNA, 17 nt, Escherichia coli CFT073
gagaagccgaccagcac

SEQ ID NO: 599189 - RNA, 22 nt, Escherichia coli CFT073
gagaagccgaccagcaccgcca

SEQ ID NO: 599190 - RNA, 13 nt, Escherichia coli CFT073
gagaaaccacauc

SEQ ID NO: 599191 - RNA, 20 nt, Escherichia coli CFT073
gagaacgccuuauccggccu

SEQ ID NO: 599192 - RNA, 14 nt, Escherichia coli CFT073
gacguguaugcaua

SEQ ID NO: 599193 - RNA, 17 nt, Escherichia coli CFT073
gacguguugucagcuca

SEQ ID NO: 599194 - RNA, 16 nt, Escherichia coli CFT073
gacguuaagaucaaac

SEQ ID NO: 599195 - RNA, 23 nt, Escherichia coli CFT073
gacguuacaaccacauauuacgg

SEQ ID NO: 599196 - RNA, 13 nt, Escherichia coli CFT073
gacgugcugcauc

SEQ ID NO: 599197 - RNA, 23 nt, Escherichia coli CFT073
gacgugcaguagcagcaggaaua

SEQ ID NO: 599198 - RNA, 15 nt, Escherichia coli CFT073
gacguugauaaccac

SEQ ID NO: 599199 - RNA, 14 nt, Escherichia coli CFT073
gacguucagccaua

SEQ ID NO: 599200 - RNA, 18 nt, Escherichia coli CFT073
gacguuccccaaccgcuu

SEQ ID NO: 599201 - RNA, 17 nt, Escherichia coli CFT073
gacgugauuccagacgg

SEQ ID NO: 599202 - RNA, 23 nt, Escherichia coli CFT073
gacgguuucucccgccugcugcg

SEQ ID NO: 599203 - RNA, 16 nt, Escherichia coli CFT073
gacggaucuuccagcg

SEQ ID NO: 599204 - RNA, 20 nt, Escherichia coli CFT073
gacggaucuuccagcgcauc

SEQ ID NO: 599205 - RNA, 22 nt, Escherichia coli CFT073
gacggaucuuccagcgcaucgc

SEQ ID NO: 599206 - RNA, 14 nt, Escherichia coli CFT073
gacggcugauaugc

SEQ ID NO: 599207 - RNA, 13 nt, Escherichia coli CFT073
gacggaauuauca

SEQ ID NO: 599208 - RNA, 19 nt, Escherichia coli CFT073
gacggacuucuuugucgua

SEQ ID NO: 599209 - RNA, 14 nt, Escherichia coli CFT073
gacgcugaauaauc

SEQ ID NO: 599210 - RNA, 13 nt, Escherichia coli CFT073
gacgcugaauacg

SEQ ID NO: 599211 - RNA, 17 nt, Escherichia coli CFT073
gacgcgguauuggugaa

SEQ ID NO: 599212 - RNA, 20 nt, Escherichia coli CFT073
gacgcguagugucgcaucag

SEQ ID NO: 599213 - RNA, 18 nt, Escherichia coli CFT073
gacgcgucagugucuuau

SEQ ID NO: 599214 - RNA, 22 nt, Escherichia coli CFT073
gacgcuccugaucaagcuggcg

SEQ ID NO: 599215 - RNA, 19 nt, Escherichia coli CFT073
gacgcuccauugcccgccc

SEQ ID NO: 599216 - RNA, 13 nt, Escherichia coli CFT073
gacgcgcaucacg

SEQ ID NO: 599217 - RNA, 15 nt, Escherichia coli CFT073
gacgcgccagcagcg

SEQ ID NO: 599218 - RNA, 14 nt, Escherichia coli CFT073
gacgcgccagcgcc

SEQ ID NO: 599219 - RNA, 15 nt, Escherichia coli CFT073
gacgaaucagcaaac

SEQ ID NO: 599220 - RNA, 18 nt, Escherichia coli CFT073
gacgaauuucaucgcuac

SEQ ID NO: 599221 - RNA, 12 nt, Escherichia coli CFT073
gacgcccagcgc

SEQ ID NO: 599222 - RNA, 18 nt, Escherichia coli CFT073
gacgccauugcuaucaac

SEQ ID NO: 599223 - RNA, 13 nt, Escherichia coli CFT073
gacgccaucaauu

SEQ ID NO: 599224 - RNA, 13 nt, Escherichia coli CFT073
gacgcccgcgccc

SEQ ID NO: 599225 - RNA, 19 nt, Escherichia coli CFT073
gacgcccugcgcgggugaa

SEQ ID NO: 599226 - RNA, 18 nt, Escherichia coli CFT073
gaaccugugacagcagcg

SEQ ID NO: 599227 - RNA, 19 nt, Escherichia coli CFT073
gaaccuguucaacaauucg

SEQ ID NO: 599228 - RNA, 15 nt, Escherichia coli CFT073
gaacgccuuauccgg

SEQ ID NO: 599229 - RNA, 16 nt, Escherichia coli CFT073
gaacgccuuauccggc

SEQ ID NO: 599230 - RNA, 18 nt, Escherichia coli CFT073
gaacgcgaaggccagcac

SEQ ID NO: 599231 - RNA, 13 nt, Escherichia coli CFT073
gaacucacgcgcc

SEQ ID NO: 599232 - RNA, 17 nt, Escherichia coli CFT073
gaacucaggcugccaga

SEQ ID NO: 599233 - RNA, 12 nt, Escherichia coli CFT073
gaaccaucgacg

SEQ ID NO: 599234 - RNA, 20 nt, Escherichia coli CFT073
gaaccguauagcauggcuuc

SEQ ID NO: 599235 - RNA, 23 nt, Escherichia coli CFT073
gaaccgguugccgguagcuucca

SEQ ID NO: 599236 - RNA, 16 nt, Escherichia coli CFT073
gaaccgaaauggcugc

SEQ ID NO: 599237 - RNA, 22 nt, Escherichia coli CFT073
gaaccgccgcugucugaaugau

SEQ ID NO: 599238 - RNA, 14 nt, Escherichia coli CFT073
gaaccgagcacacc

SEQ ID NO: 599239 - RNA, 15 nt, Escherichia coli CFT073
gaaauuucccaccga

SEQ ID NO: 599240 - RNA, 15 nt, Escherichia coli CFT073
gaaauuccagcggca

SEQ ID NO: 599241 - RNA, 11 nt, Escherichia coli CFT073
gaaaugcggcg

SEQ ID NO: 599242 - RNA, 15 nt, Escherichia coli CFT073
gaaauggucacacac

SEQ ID NO: 599243 - RNA, 21 nt, Escherichia coli CFT073
gaaaugugccggaugcaucac

SEQ ID NO: 599244 - RNA, 15 nt, Escherichia coli CFT073
gaaauguuccagugc

SEQ ID NO: 599245 - RNA, 20 nt, Escherichia coli CFT073
gaaauuaagaucagaagcau

SEQ ID NO: 599246 - RNA, 17 nt, Escherichia coli CFT073
gaaaugaccauaaaagg

SEQ ID NO: 599247 - RNA, 21 nt, Escherichia coli CFT073
gaaaucuuguuuuuuucgagu

SEQ ID NO: 599248 - RNA, 14 nt, Escherichia coli CFT073
gaaaucucacccgg

SEQ ID NO: 599249 - RNA, 19 nt, Escherichia coli CFT073
gaaaucuuccaguggcauu

SEQ ID NO: 599250 - RNA, 23 nt, Escherichia coli CFT073
gaaaucuuccaguggcauuuucu

SEQ ID NO: 599251 - RNA, 18 nt, Escherichia coli CFT073
gaacaagauugccugaug

SEQ ID NO: 599252 - RNA, 20 nt, Escherichia coli CFT073
gaacaagccaaauccagcac

SEQ ID NO: 599253 - RNA, 16 nt, Escherichia coli CFT073
gaacacauuugucgga

SEQ ID NO: 599254 - RNA, 20 nt, Escherichia coli CFT073
gaacacauuugucggaugcg

SEQ ID NO: 599255 - RNA, 19 nt, Escherichia coli CFT073
gaacaccaacggacggguc

SEQ ID NO: 599256 - RNA, 20 nt, Escherichia coli CFT073
gaacaaaucgcacguuguca

SEQ ID NO: 599257 - RNA, 16 nt, Escherichia coli CFT073
gaacaccagcaguaaa

SEQ ID NO: 599258 - RNA, 16 nt, Escherichia coli CFT073
gaacauaucagcgcaa

SEQ ID NO: 599259 - RNA, 15 nt, Escherichia coli CFT073
gaaccaaaugccgga

SEQ ID NO: 599260 - RNA, 14 nt, Escherichia coli CFT073
gaacaggcuggccg

SEQ ID NO: 599261 - RNA, 12 nt, Escherichia coli CFT073
gaacauaaacag

SEQ ID NO: 599262 - RNA, 16 nt, Escherichia coli CFT073
gaacagcgaccgcaga

SEQ ID NO: 599263 - RNA, 15 nt, Escherichia coli CFT073
gaaauaacgcugaua

SEQ ID NO: 599264 - RNA, 15 nt, Escherichia coli CFT073
gaaauacgacugaua

SEQ ID NO: 599265 - RNA, 15 nt, Escherichia coli CFT073
gaaauaccccgccag

SEQ ID NO: 599266 - RNA, 18 nt, Escherichia coli CFT073
gaaauaucagcagcacaa

SEQ ID NO: 599267 - RNA, 15 nt, Escherichia coli CFT073
gaaauaucauuaagc

SEQ ID NO: 599268 - RNA, 18 nt, Escherichia coli CFT073
gaaauaugcuuuuauuca

SEQ ID NO: 599269 - RNA, 13 nt, Escherichia coli CFT073
gaaaucaacggcg

SEQ ID NO: 599270 - RNA, 13 nt, Escherichia coli CFT073
gaaaucaaugcca

SEQ ID NO: 599271 - RNA, 13 nt, Escherichia coli CFT073
gaaaucagcagcu

SEQ ID NO: 599272 - RNA, 20 nt, Escherichia coli CFT073
gaaaucagccguuucaccac

SEQ ID NO: 599273 - RNA, 23 nt, Escherichia coli CFT073
gaaaucagcgagauaaugcgcca

SEQ ID NO: 599274 - RNA, 21 nt, Escherichia coli CFT073
gaaagugccggauguucgcau

SEQ ID NO: 599275 - RNA, 16 nt, Escherichia coli CFT073
gaaagucguaggccug

SEQ ID NO: 599276 - RNA, 22 nt, Escherichia coli CFT073
gaaaguuggcguucacugccgu

SEQ ID NO: 599277 - RNA, 21 nt, Escherichia coli CFT073
gaaauaauacguagcaccaac

SEQ ID NO: 599278 - RNA, 12 nt, Escherichia coli CFT073
gaaauaaucacc

SEQ ID NO: 599279 - RNA, 15 nt, Escherichia coli CFT073
gaaauaaaaucagca

SEQ ID NO: 599280 - RNA, 20 nt, Escherichia coli CFT073
gaaagcugcugaccaccagc

SEQ ID NO: 599281 - RNA, 21 nt, Escherichia coli CFT073
gaaagcugcugaccaccagca

SEQ ID NO: 599282 - RNA, 15 nt, Escherichia coli CFT073
gaaagguauuuagcg

SEQ ID NO: 599283 - RNA, 19 nt, Escherichia coli CFT073
gaaagguauuuagcgaaua

SEQ ID NO: 599284 - RNA, 13 nt, Escherichia coli CFT073
gaaacaaccucuu

SEQ ID NO: 599285 - RNA, 15 nt, Escherichia coli CFT073
gaaacaaccucuuuu

SEQ ID NO: 599286 - RNA, 22 nt, Escherichia coli CFT073
gaaacacuacgaucagaaugau

SEQ ID NO: 599287 - RNA, 21 nt, Escherichia coli CFT073
gaaacagauaaaaguuacauc

SEQ ID NO: 599288 - RNA, 15 nt, Escherichia coli CFT073
gaaacagcaccaucc

SEQ ID NO: 599289 - RNA, 22 nt, Escherichia coli CFT073
gaaacaccggugaccaucagca

SEQ ID NO: 599290 - RNA, 22 nt, Escherichia coli CFT073
gaaacaccgucaacguuuuucg

SEQ ID NO: 599291 - RNA, 21 nt, Escherichia coli CFT073
gaaacagccaaucauaaacgc

SEQ ID NO: 599292 - RNA, 21 nt, Escherichia coli CFT073
gaaacguuaugcaccgacaau

SEQ ID NO: 599293 - RNA, 14 nt, Escherichia coli CFT073
gaaacucugcggca

SEQ ID NO: 599294 - RNA, 22 nt, Escherichia coli CFT073
gaaacugacaggucaucgcauc

SEQ ID NO: 599295 - RNA, 17 nt, Escherichia coli CFT073
gaaagacugaauugcca

SEQ ID NO: 599296 - RNA, 21 nt, Escherichia coli CFT073
gaaagcagacuuuuugcggca

SEQ ID NO: 599297 - RNA, 21 nt, Escherichia coli CFT073
gaaagcagauaacccagcagc

SEQ ID NO: 599298 - RNA, 23 nt, Escherichia coli CFT073
gaaagauggacgccguauucacu

SEQ ID NO: 599299 - RNA, 15 nt, Escherichia coli CFT073
gaaagcaauuaacag

SEQ ID NO: 599300 - RNA, 13 nt, Escherichia coli CFT073
gaaagcccgcuuu

SEQ ID NO: 599301 - RNA, 15 nt, Escherichia coli CFT073
gaaagccgccgacau

SEQ ID NO: 599302 - RNA, 20 nt, Escherichia coli CFT073
gaaagcgacuuugccuggcg

SEQ ID NO: 599303 - RNA, 23 nt, Escherichia coli CFT073
gaaagcgacuuugccuggcggca

SEQ ID NO: 599304 - RNA, 19 nt, Escherichia coli CFT073
gaaagcguauccaucacua

SEQ ID NO: 599305 - RNA, 15 nt, Escherichia coli CFT073
gaaagcguauuaugc

SEQ ID NO: 599306 - RNA, 19 nt, Escherichia coli CFT073
gaaagcgaggcuuauccgg

SEQ ID NO: 599307 - RNA, 21 nt, Escherichia coli CFT073
gaaagcgucgccgccgccagc

SEQ ID NO: 599308 - RNA, 15 nt, Escherichia coli CFT073
cuuuugucgcuuuaa

SEQ ID NO: 599309 - RNA, 16 nt, Escherichia coli CFT073
cuuuuggugccggaua

SEQ ID NO: 599310 - RNA, 20 nt, Escherichia coli CFT073
cuuuugcccauaugcagcca

SEQ ID NO: 599311 - RNA, 11 nt, Escherichia coli CFT073
cuuuugccaga

SEQ ID NO: 599312 - RNA, 16 nt, Escherichia coli CFT073
cuuuucgucaggauua

SEQ ID NO: 599313 - RNA, 22 nt, Escherichia coli CFT073
cuuuucgcccaggucucccagu

SEQ ID NO: 599314 - RNA, 15 nt, Escherichia coli CFT073
cuuuucgcuuccggu

SEQ ID NO: 599315 - RNA, 19 nt, Escherichia coli CFT073
cuuuauuugauucgcccgc

SEQ ID NO: 599316 - RNA, 14 nt, Escherichia coli CFT073
cuuuaucuuucagu

SEQ ID NO: 599317 - RNA, 15 nt, Escherichia coli CFT073
cuuuuaccaucgcga

SEQ ID NO: 599318 - RNA, 18 nt, Escherichia coli CFT073
cuuuucccgauauaacca

SEQ ID NO: 599319 - RNA, 13 nt, Escherichia coli CFT073
cuuuuagcgacaa

SEQ ID NO: 599320 - RNA, 21 nt, Escherichia coli CFT073
gaaaaugccgcacaucaccgc

SEQ ID NO: 599321 - RNA, 21 nt, Escherichia coli CFT073
gaaaauuuuuucagauaaaag

SEQ ID NO: 599322 - RNA, 18 nt, Escherichia coli CFT073
gaaaauuacgccggaaag

SEQ ID NO: 599323 - RNA, 15 nt, Escherichia coli CFT073
gaaaauuauuuuaaa

SEQ ID NO: 599324 - RNA, 14 nt, Escherichia coli CFT073
gaaaauucaguucg

SEQ ID NO: 599325 - RNA, 21 nt, Escherichia coli CFT073
gaaaacgucgguuacaccgcg

SEQ ID NO: 599326 - RNA, 19 nt, Escherichia coli CFT073
gaaaacugcgcccgcuuuu

SEQ ID NO: 599327 - RNA, 13 nt, Escherichia coli CFT073
gaaaacgcuauuu

SEQ ID NO: 599328 - RNA, 15 nt, Escherichia coli CFT073
cuuuuuccugccgcu

SEQ ID NO: 599329 - RNA, 12 nt, Escherichia coli CFT073
cuuuuuagcgcc

SEQ ID NO: 599330 - RNA, 18 nt, Escherichia coli CFT073
cuuuuucaguuugcugac

SEQ ID NO: 599331 - RNA, 16 nt, Escherichia coli CFT073
cuuuuuccaggcuggc

SEQ ID NO: 599332 - RNA, 22 nt, Escherichia coli CFT073
cuuuuugugcggaagucgcugc

SEQ ID NO: 599333 - RNA, 20 nt, Escherichia coli CFT073
cuuuuugugggccugauaag

SEQ ID NO: 599334 - RNA, 18 nt, Escherichia coli CFT073
cuuuuuuaauauuucauu

SEQ ID NO: 599335 - RNA, 15 nt, Escherichia coli CFT073
cuuuuuuacaucauc

SEQ ID NO: 599336 - RNA, 16 nt, Escherichia coli CFT073
gaaaaccgauaaacgc

SEQ ID NO: 599337 - RNA, 16 nt, Escherichia coli CFT073
gaaaaccuggcgcagu

SEQ ID NO: 599338 - RNA, 17 nt, Escherichia coli CFT073
cuucuaauugugcugca

SEQ ID NO: 599339 - RNA, 14 nt, Escherichia coli CFT073
cuugcuuuccagcu

SEQ ID NO: 599340 - RNA, 15 nt, Escherichia coli CFT073
cuugcugugcagcaa

SEQ ID NO: 599341 - RNA, 21 nt, Escherichia coli CFT073
cuugcucgaagaguuccagcg

SEQ ID NO: 599342 - RNA, 14 nt, Escherichia coli CFT073
cuugcucauccgga

SEQ ID NO: 599343 - RNA, 18 nt, Escherichia coli CFT073
cuugcgcauaauaagcgc

SEQ ID NO: 599344 - RNA, 19 nt, Escherichia coli CFT073
cuuuaauuuugugcagcac

SEQ ID NO: 599345 - RNA, 23 nt, Escherichia coli CFT073
cuuuaccaccgucaauaaaaacg

SEQ ID NO: 599346 - RNA, 13 nt, Escherichia coli CFT073
cuuuaccagacgg

SEQ ID NO: 599347 - RNA, 19 nt, Escherichia coli CFT073
cuuuacccacgcuuuucau

SEQ ID NO: 599348 - RNA, 14 nt, Escherichia coli CFT073
cuuuacccagcgga

SEQ ID NO: 599349 - RNA, 15 nt, Escherichia coli CFT073
cuuuaucaagcacca

SEQ ID NO: 599350 - RNA, 14 nt, Escherichia coli CFT073
cuuuaucaccaaug

SEQ ID NO: 599351 - RNA, 17 nt, Escherichia coli CFT073
cuuuagucguugccgga

SEQ ID NO: 599352 - RNA, 16 nt, Escherichia coli CFT073
cuuuaccgcaaucgau

SEQ ID NO: 599353 - RNA, 17 nt, Escherichia coli CFT073
cuuuacgaagaaaucga

SEQ ID NO: 599354 - RNA, 12 nt, Escherichia coli CFT073
cuuguuccugca

SEQ ID NO: 599355 - RNA, 13 nt, Escherichia coli CFT073
cuuguuucagcac

SEQ ID NO: 599356 - RNA, 15 nt, Escherichia coli CFT073
cuuguuucagcgcau

SEQ ID NO: 599357 - RNA, 17 nt, Escherichia coli CFT073
cuuguguaggcccgaua

SEQ ID NO: 599358 - RNA, 15 nt, Escherichia coli CFT073
cuugguuacgcaccg

SEQ ID NO: 599359 - RNA, 14 nt, Escherichia coli CFT073
cuucgccuuucagu

SEQ ID NO: 599360 - RNA, 14 nt, Escherichia coli CFT073
cuucgcgcaccaau

SEQ ID NO: 599361 - RNA, 20 nt, Escherichia coli CFT073
cuucgcugacgccugccagc

SEQ ID NO: 599362 - RNA, 15 nt, Escherichia coli CFT073
cuucgcuuaaccggc

SEQ ID NO: 599363 - RNA, 19 nt, Escherichia coli CFT073
cuucgcuuaaccggcuucg

SEQ ID NO: 599364 - RNA, 22 nt, Escherichia coli CFT073
cuucggcaucacgaauccgcac

SEQ ID NO: 599365 - RNA, 13 nt, Escherichia coli CFT073
cuucgcaaaaaac

SEQ ID NO: 599366 - RNA, 18 nt, Escherichia coli CFT073
cuuccuucacauccaucg

SEQ ID NO: 599367 - RNA, 15 nt, Escherichia coli CFT073
cuuccaguuucgcca

SEQ ID NO: 599368 - RNA, 12 nt, Escherichia coli CFT073
cuuccaucccuu

SEQ ID NO: 599369 - RNA, 19 nt, Escherichia coli CFT073
cuuccauuucaucgccagc

SEQ ID NO: 599370 - RNA, 15 nt, Escherichia coli CFT073
cuuccuacguuaaaa

SEQ ID NO: 599371 - RNA, 19 nt, Escherichia coli CFT073
cuuccuggggaagugguga

SEQ ID NO: 599372 - RNA, 22 nt, Escherichia coli CFT073
cuuccugacggugauacagcaa

SEQ ID NO: 599373 - RNA, 20 nt, Escherichia coli CFT073
cuuccugauaaccuuccagc

SEQ ID NO: 599374 - RNA, 21 nt, Escherichia coli CFT073
cuuccugauaaccuuccagcu

SEQ ID NO: 599375 - RNA, 20 nt, Escherichia coli CFT073
cuuccucgcucucgccgcgc

SEQ ID NO: 599376 - RNA, 21 nt, Escherichia coli CFT073
cuucauaacuuugaucgcguu

SEQ ID NO: 599377 - RNA, 13 nt, Escherichia coli CFT073
cuucauagguaaa

SEQ ID NO: 599378 - RNA, 16 nt, Escherichia coli CFT073
cuucaguuuugcccgc

SEQ ID NO: 599379 - RNA, 22 nt, Escherichia coli CFT073
cuucagggcgcacgcacggcgu

SEQ ID NO: 599380 - RNA, 17 nt, Escherichia coli CFT073
cuucagcgaagcccaca

SEQ ID NO: 599381 - RNA, 22 nt, Escherichia coli CFT073
cuucagcguauccagcauaccu

SEQ ID NO: 599382 - RNA, 22 nt, Escherichia coli CFT073
cuucagcgucuucgccgucagu

SEQ ID NO: 599383 - RNA, 18 nt, Escherichia coli CFT073
cuucagcuguuucaguaa

SEQ ID NO: 599384 - RNA, 13 nt, Escherichia coli CFT073
cuucaucaucugc

SEQ ID NO: 599385 - RNA, 19 nt, Escherichia coli CFT073
cuucaucggaaugcacagc

SEQ ID NO: 599386 - RNA, 14 nt, Escherichia coli CFT073
cuucaugcuccagc

SEQ ID NO: 599387 - RNA, 21 nt, Escherichia coli CFT073
cuucaucgugcucgcuuucca

SEQ ID NO: 599388 - RNA, 16 nt, Escherichia coli CFT073
cuucaugcacucguaa

SEQ ID NO: 599389 - RNA, 17 nt, Escherichia coli CFT073
cuuccaggguaaacauc

SEQ ID NO: 599390 - RNA, 17 nt, Escherichia coli CFT073
cuuaucaaucucugcaa

SEQ ID NO: 599391 - RNA, 14 nt, Escherichia coli CFT073
cuuauccagcaacg

SEQ ID NO: 599392 - RNA, 16 nt, Escherichia coli CFT073
cuuauccgaccuacaa

SEQ ID NO: 599393 - RNA, 19 nt, Escherichia coli CFT073
cuucaccgguucaucacga

SEQ ID NO: 599394 - RNA, 22 nt, Escherichia coli CFT073
cuucaccguggucuuuugccuc

SEQ ID NO: 599395 - RNA, 17 nt, Escherichia coli CFT073
cuucaccuacgcuggca

SEQ ID NO: 599396 - RNA, 22 nt, Escherichia coli CFT073
cuucacuucagcgaaaucacgc

SEQ ID NO: 599397 - RNA, 21 nt, Escherichia coli CFT073
cuucagauuagccgcagguaa

SEQ ID NO: 599398 - RNA, 15 nt, Escherichia coli CFT073
cuucagauugcacca

SEQ ID NO: 599399 - RNA, 22 nt, Escherichia coli CFT073
cuucacuggcgacacgcaucac

SEQ ID NO: 599400 - RNA, 23 nt, Escherichia coli CFT073
cuucacggguugcgccuguguuu

SEQ ID NO: 599401 - RNA, 13 nt, Escherichia coli CFT073
cuucacugaaaau

SEQ ID NO: 599402 - RNA, 14 nt, Escherichia coli CFT073
cuucacugccggac

SEQ ID NO: 599403 - RNA, 23 nt, Escherichia coli CFT073
cuucagcaagaguuuuaaaacca

SEQ ID NO: 599404 - RNA, 16 nt, Escherichia coli CFT073
cuguuuucgauuuuuu

SEQ ID NO: 599405 - RNA, 22 nt, Escherichia coli CFT073
cuguuuucgauuuuuuccagcg

SEQ ID NO: 599406 - RNA, 14 nt, Escherichia coli CFT073
cuguuuuuccagcu

SEQ ID NO: 599407 - RNA, 14 nt, Escherichia coli CFT073
cuuaaaagcacaga

SEQ ID NO: 599408 - RNA, 13 nt, Escherichia coli CFT073
cuuaaauccaaac

SEQ ID NO: 599409 - RNA, 21 nt, Escherichia coli CFT073
cuuauaaaggcgcuucggcgc

SEQ ID NO: 599410 - RNA, 22 nt, Escherichia coli CFT073
cuuauaaccagacgauuuuccc

SEQ ID NO: 599411 - RNA, 20 nt, Escherichia coli CFT073
cuguucggaugagucggcgu

SEQ ID NO: 599412 - RNA, 21 nt, Escherichia coli CFT073
cuguucuggcguaucuccagu

SEQ ID NO: 599413 - RNA, 14 nt, Escherichia coli CFT073
cuguugcgguuucu

SEQ ID NO: 599414 - RNA, 18 nt, Escherichia coli CFT073
cuguugcccuuugcuggc

SEQ ID NO: 599415 - RNA, 21 nt, Escherichia coli CFT073
cugugccaggacuucaucacg

SEQ ID NO: 599416 - RNA, 22 nt, Escherichia coli CFT073
cugugccguggcgcucgcagga

SEQ ID NO: 599417 - RNA, 16 nt, Escherichia coli CFT073
cugucggugccaucau

SEQ ID NO: 599418 - RNA, 19 nt, Escherichia coli CFT073
cugucguacccagucgcgc

SEQ ID NO: 599419 - RNA, 16 nt, Escherichia coli CFT073
cugucgcuucacgcag

SEQ ID NO: 599420 - RNA, 19 nt, Escherichia coli CFT073
cuguucgaacauuagcgca

SEQ ID NO: 599421 - RNA, 15 nt, Escherichia coli CFT073
cuguucgccgccgcu

SEQ ID NO: 599422 - RNA, 14 nt, Escherichia coli CFT073
cuguucgcugguga

SEQ ID NO: 599423 - RNA, 19 nt, Escherichia coli CFT073
cuguucacgaccaucaacc

SEQ ID NO: 599424 - RNA, 20 nt, Escherichia coli CFT073
cuguaaguuacuaaaaguaa

SEQ ID NO: 599425 - RNA, 13 nt, Escherichia coli CFT073
cugguuuugccau

SEQ ID NO: 599426 - RNA, 15 nt, Escherichia coli CFT073
cuguaaaucugccgu

SEQ ID NO: 599427 - RNA, 11 nt, Escherichia coli CFT073
cuguaauggcu

SEQ ID NO: 599428 - RNA, 18 nt, Escherichia coli CFT073
cuguaauuaaauuaucaa

SEQ ID NO: 599429 - RNA, 22 nt, Escherichia coli CFT073
cuguaauuucacaccaucaaca

SEQ ID NO: 599430 - RNA, 17 nt, Escherichia coli CFT073
cuguacaauaucgauaa

SEQ ID NO: 599431 - RNA, 17 nt, Escherichia coli CFT073
cugguucccaacaacag

SEQ ID NO: 599432 - RNA, 13 nt, Escherichia coli CFT073
cugguucagucgu

SEQ ID NO: 599433 - RNA, 17 nt, Escherichia coli CFT073
cugguugaaauaaacca

SEQ ID NO: 599434 - RNA, 17 nt, Escherichia coli CFT073
cuguagauauauccuga

SEQ ID NO: 599435 - RNA, 13 nt, Escherichia coli CFT073
cuguagauauucu

SEQ ID NO: 599436 - RNA, 19 nt, Escherichia coli CFT073
cugucccaaaaugucggau

SEQ ID NO: 599437 - RNA, 13 nt, Escherichia coli CFT073
cugucauucauuc

SEQ ID NO: 599438 - RNA, 21 nt, Escherichia coli CFT073
cuggugaaaucagccguuuca

SEQ ID NO: 599439 - RNA, 13 nt, Escherichia coli CFT073
cuggugccagcgc

SEQ ID NO: 599440 - RNA, 14 nt, Escherichia coli CFT073
cuggucgcgcggca

SEQ ID NO: 599441 - RNA, 20 nt, Escherichia coli CFT073
cuggucgaggaucucugcaa

SEQ ID NO: 599442 - RNA, 16 nt, Escherichia coli CFT073
cugguaauugacgcca

SEQ ID NO: 599443 - RNA, 17 nt, Escherichia coli CFT073
cugguaacugccagggc

SEQ ID NO: 599444 - RNA, 15 nt, Escherichia coli CFT073
cugggaaaucaccac

SEQ ID NO: 599445 - RNA, 15 nt, Escherichia coli CFT073
cuggcuugccagcca

SEQ ID NO: 599446 - RNA, 14 nt, Escherichia coli CFT073
cuggcuguuaucgc

SEQ ID NO: 599447 - RNA, 22 nt, Escherichia coli CFT073
cuggcgguuugccauuuucuga

SEQ ID NO: 599448 - RNA, 20 nt, Escherichia coli CFT073
cuggcgguuacgaaagcgcg

SEQ ID NO: 599449 - RNA, 20 nt, Escherichia coli CFT073
cuggcgcgcuauuaccaggc

SEQ ID NO: 599450 - RNA, 16 nt, Escherichia coli CFT073
cuggguuuucacagaa

SEQ ID NO: 599451 - RNA, 20 nt, Escherichia coli CFT073
cugguaaagcagacggcugu

SEQ ID NO: 599452 - RNA, 14 nt, Escherichia coli CFT073
cuggagcuggcgaa

SEQ ID NO: 599453 - RNA, 23 nt, Escherichia coli CFT073
cuggaguguaaaaaagcgucgcc

SEQ ID NO: 599454 - RNA, 21 nt, Escherichia coli CFT073
cuggauaaggccaccagcggc

SEQ ID NO: 599455 - RNA, 20 nt, Escherichia coli CFT073
cuggauaaugaagucugccg

SEQ ID NO: 599456 - RNA, 19 nt, Escherichia coli CFT073
cuggacgccaauaccgauc

SEQ ID NO: 599457 - RNA, 17 nt, Escherichia coli CFT073
cuggcagauccugaaau

SEQ ID NO: 599458 - RNA, 18 nt, Escherichia coli CFT073
cuggcagaaaacgccugg

SEQ ID NO: 599459 - RNA, 19 nt, Escherichia coli CFT073
cuggauggcuugcugcgac

SEQ ID NO: 599460 - RNA, 19 nt, Escherichia coli CFT073
cuggaugcgaugcuggcgc

SEQ ID NO: 599461 - RNA, 13 nt, Escherichia coli CFT073
cuggccuggcgau

SEQ ID NO: 599462 - RNA, 14 nt, Escherichia coli CFT073
cuggcgcagcacga

SEQ ID NO: 599463 - RNA, 23 nt, Escherichia coli CFT073
cuggcgcaauauucaagauaacg

SEQ ID NO: 599464 - RNA, 21 nt, Escherichia coli CFT073
cuggcgauugucauucgccug

SEQ ID NO: 599465 - RNA, 22 nt, Escherichia coli CFT073
cuggcgagcgccagcauggcac

SEQ ID NO: 599466 - RNA, 18 nt, Escherichia coli CFT073
gccaacggggccagcaca

SEQ ID NO: 599467 - RNA, 17 nt, Escherichia coli CFT073
gccaacgcaacgcgcuu

SEQ ID NO: 599468 - RNA, 21 nt, Escherichia coli CFT073
gccaacgugacguuucaucgc

SEQ ID NO: 599469 - RNA, 23 nt, Escherichia coli CFT073
gccaacgugguuuaccaccagcg

SEQ ID NO: 599470 - RNA, 15 nt, Escherichia coli CFT073
gccacgaugcacagc

SEQ ID NO: 599471 - RNA, 15 nt, Escherichia coli CFT073
gccacgccaaaaagc

SEQ ID NO: 599472 - RNA, 15 nt, Escherichia coli CFT073
gccacgccaaccacc

SEQ ID NO: 599473 - RNA, 16 nt, Escherichia coli CFT073
gccacgccaaccaccg

SEQ ID NO: 599474 - RNA, 14 nt, Escherichia coli CFT073
gccacgcgacauaa

SEQ ID NO: 599475 - RNA, 17 nt, Escherichia coli CFT073
gccagaaagacgguuaa

SEQ ID NO: 599476 - RNA, 16 nt, Escherichia coli CFT073
gccagaaaaccuggcg

SEQ ID NO: 599477 - RNA, 18 nt, Escherichia coli CFT073
gccacuuucacgccgcca

SEQ ID NO: 599478 - RNA, 14 nt, Escherichia coli CFT073
gccacuuugcgggc

SEQ ID NO: 599479 - RNA, 20 nt, Escherichia coli CFT073
gccagaagaaccgccaccuc

SEQ ID NO: 599480 - RNA, 15 nt, Escherichia coli CFT073
gccagaacagaaaug

SEQ ID NO: 599481 - RNA, 14 nt, Escherichia coli CFT073
gccagaagcccgga

SEQ ID NO: 599482 - RNA, 17 nt, Escherichia coli CFT073
gccagaagcccggaucg

SEQ ID NO: 599483 - RNA, 19 nt, Escherichia coli CFT073
gccagaaucgcaaccagcc

SEQ ID NO: 599484 - RNA, 21 nt, Escherichia coli CFT073
gccagacaaaacugacgccau

SEQ ID NO: 599485 - RNA, 15 nt, Escherichia coli CFT073
gccagacaauccagc

SEQ ID NO: 599486 - RNA, 15 nt, Escherichia coli CFT073
gccagaccacucauu

SEQ ID NO: 599487 - RNA, 19 nt, Escherichia coli CFT073
gccacuccucgcgcgucca

SEQ ID NO: 599488 - RNA, 22 nt, Escherichia coli CFT073
gccacucaggcaaagcuguuuc

SEQ ID NO: 599489 - RNA, 16 nt, Escherichia coli CFT073
gccagauccuggcugu

SEQ ID NO: 599490 - RNA, 20 nt, Escherichia coli CFT073
gccagagaaagcccgcguaa

SEQ ID NO: 599491 - RNA, 14 nt, Escherichia coli CFT073
gccagagaauaccg

SEQ ID NO: 599492 - RNA, 17 nt, Escherichia coli CFT073
gccagauauugauucau

SEQ ID NO: 599493 - RNA, 21 nt, Escherichia coli CFT073
gccagacguccaaucggccau

SEQ ID NO: 599494 - RNA, 20 nt, Escherichia coli CFT073
gccagacguugauaaccacg

SEQ ID NO: 599495 - RNA, 20 nt, Escherichia coli CFT073
gccagacugacaaucaucgc

SEQ ID NO: 599496 - RNA, 19 nt, Escherichia coli CFT073
gccagacugaucaucgccc

SEQ ID NO: 599497 - RNA, 13 nt, Escherichia coli CFT073
gccagaccgaaca

SEQ ID NO: 599498 - RNA, 22 nt, Escherichia coli CFT073
gccagaccgaacagcauacggc

SEQ ID NO: 599499 - RNA, 15 nt, Escherichia coli CFT073
gccagccgccagcau

SEQ ID NO: 599500 - RNA, 14 nt, Escherichia coli CFT073
gccagccaucgccu

SEQ ID NO: 599501 - RNA, 16 nt, Escherichia coli CFT073
gccagccaucgccugc

SEQ ID NO: 599502 - RNA, 14 nt, Escherichia coli CFT073
gccagcauugcgcc

SEQ ID NO: 599503 - RNA, 19 nt, Escherichia coli CFT073
gccagcauugucaggauca

SEQ ID NO: 599504 - RNA, 15 nt, Escherichia coli CFT073
gccagccaagcaugu

SEQ ID NO: 599505 - RNA, 16 nt, Escherichia coli CFT073
gccagccaauugccau

SEQ ID NO: 599506 - RNA, 13 nt, Escherichia coli CFT073
gccagcaucgcau

SEQ ID NO: 599507 - RNA, 19 nt, Escherichia coli CFT073
gccagcauaaucaccauca

SEQ ID NO: 599508 - RNA, 22 nt, Escherichia coli CFT073
gccagcauaaucaccaucagca

SEQ ID NO: 599509 - RNA, 15 nt, Escherichia coli CFT073
gccagcagggcaaac

SEQ ID NO: 599510 - RNA, 15 nt, Escherichia coli CFT073
gccagcaccagcaac

SEQ ID NO: 599511 - RNA, 21 nt, Escherichia coli CFT073
gccagcagggcaaucgcgcca

SEQ ID NO: 599512 - RNA, 23 nt, Escherichia coli CFT073
gccagaugcggcgugaacgccuu

SEQ ID NO: 599513 - RNA, 17 nt, Escherichia coli CFT073
gccagcgcugcccacca

SEQ ID NO: 599514 - RNA, 21 nt, Escherichia coli CFT073
gccagcgcuguuagcgugcag

SEQ ID NO: 599515 - RNA, 20 nt, Escherichia coli CFT073
gccagcgucgcauccgacau

SEQ ID NO: 599516 - RNA, 16 nt, Escherichia coli CFT073
gccagcgcgaccgcca

SEQ ID NO: 599517 - RNA, 12 nt, Escherichia coli CFT073
gccagccugauc

SEQ ID NO: 599518 - RNA, 18 nt, Escherichia coli CFT073
gccaggcgcugcuggagc

SEQ ID NO: 599519 - RNA, 13 nt, Escherichia coli CFT073
gccaggcccaaua

SEQ ID NO: 599520 - RNA, 20 nt, Escherichia coli CFT073
gccaggcaaauucuguuuca

SEQ ID NO: 599521 - RNA, 22 nt, Escherichia coli CFT073
gccaguagcaccucuccacgca

SEQ ID NO: 599522 - RNA, 19 nt, Escherichia coli CFT073
gccaggucagagagccagc

SEQ ID NO: 599523 - RNA, 20 nt, Escherichia coli CFT073
gccaggucagagagccagcc

SEQ ID NO: 599524 - RNA, 15 nt, Escherichia coli CFT073
gccagguagcguuuc

SEQ ID NO: 599525 - RNA, 22 nt, Escherichia coli CFT073
gccagguaaaucagaccgauag

SEQ ID NO: 599526 - RNA, 20 nt, Escherichia coli CFT073
gccaggcuuuccgucagcgg

SEQ ID NO: 599527 - RNA, 19 nt, Escherichia coli CFT073
gccauagcgggcaaucagc

SEQ ID NO: 599528 - RNA, 20 nt, Escherichia coli CFT073
gccauagcgggcaaucagcg

SEQ ID NO: 599529 - RNA, 22 nt, Escherichia coli CFT073
gccagucacaaugggcgugaaa

SEQ ID NO: 599530 - RNA, 21 nt, Escherichia coli CFT073
gccagucccgcgacaaucgcc

SEQ ID NO: 599531 - RNA, 16 nt, Escherichia coli CFT073
gccauauugaccguuu

SEQ ID NO: 599532 - RNA, 19 nt, Escherichia coli CFT073
gccauaucuauuacagcgc

SEQ ID NO: 599533 - RNA, 17 nt, Escherichia coli CFT073
gccauauuuaacuccuu

SEQ ID NO: 599534 - RNA, 22 nt, Escherichia coli CFT073
gccaucaacaauucccagcuca

SEQ ID NO: 599535 - RNA, 15 nt, Escherichia coli CFT073
gccauauaugccauc

SEQ ID NO: 599536 - RNA, 14 nt, Escherichia coli CFT073
gccaucacacccug

SEQ ID NO: 599537 - RNA, 14 nt, Escherichia coli CFT073
gccaucaaucgacc

SEQ ID NO: 599538 - RNA, 18 nt, Escherichia coli CFT073
gccaucaaucgaccgacu

SEQ ID NO: 599539 - RNA, 13 nt, Escherichia coli CFT073
gccaucacggauc

SEQ ID NO: 599540 - RNA, 15 nt, Escherichia coli CFT073
gccaucacuauucag

SEQ ID NO: 599541 - RNA, 16 nt, Escherichia coli CFT073
gccaucgcccgcaggu

SEQ ID NO: 599542 - RNA, 22 nt, Escherichia coli CFT073
gccaucgcugacgaucauuccg

SEQ ID NO: 599543 - RNA, 16 nt, Escherichia coli CFT073
gccaucauuuugcuau

SEQ ID NO: 599544 - RNA, 19 nt, Escherichia coli CFT073
gccaucagggccaaucaac

SEQ ID NO: 599545 - RNA, 18 nt, Escherichia coli CFT073
gccaucaguguuggcggc

SEQ ID NO: 599546 - RNA, 16 nt, Escherichia coli CFT073
gccaucagcagcggag

SEQ ID NO: 599547 - RNA, 16 nt, Escherichia coli CFT073
gccaucagccacuuca

SEQ ID NO: 599548 - RNA, 18 nt, Escherichia coli CFT073
gccaucuuuuggcugaua

SEQ ID NO: 599549 - RNA, 14 nt, Escherichia coli CFT073
gccaugaacgcgaa

SEQ ID NO: 599550 - RNA, 22 nt, Escherichia coli CFT073
gccaugaguaauuuuucuuucg

SEQ ID NO: 599551 - RNA, 20 nt, Escherichia coli CFT073
gccauuacccggugccgccg

SEQ ID NO: 599552 - RNA, 14 nt, Escherichia coli CFT073
gccauuacggguau

SEQ ID NO: 599553 - RNA, 13 nt, Escherichia coli CFT073
gccauuccagcca

SEQ ID NO: 599554 - RNA, 16 nt, Escherichia coli CFT073
gccauguuuuccuuuu

SEQ ID NO: 599555 - RNA, 15 nt, Escherichia coli CFT073
gccauuaaccagcca

SEQ ID NO: 599556 - RNA, 12 nt, Escherichia coli CFT073
gcccaaacgccc

SEQ ID NO: 599557 - RNA, 16 nt, Escherichia coli CFT073
gcccaacacuuccccg

SEQ ID NO: 599558 - RNA, 12 nt, Escherichia coli CFT073
gcccaaccagca

SEQ ID NO: 599559 - RNA, 20 nt, Escherichia coli CFT073
gccauuugcgacaaagcuca

SEQ ID NO: 599560 - RNA, 17 nt, Escherichia coli CFT073
gccauuuugcaacgcuu

SEQ ID NO: 599561 - RNA, 23 nt, Escherichia coli CFT073
gccauuggcaggcucugacugau

SEQ ID NO: 599562 - RNA, 16 nt, Escherichia coli CFT073
gccauugacgguuucc

SEQ ID NO: 599563 - RNA, 18 nt, Escherichia coli CFT073
gccauugacguucccuuc

SEQ ID NO: 599564 - RNA, 16 nt, Escherichia coli CFT073
gccauugaaaccgcug

SEQ ID NO: 599565 - RNA, 14 nt, Escherichia coli CFT073
gccauuaucgauaa

SEQ ID NO: 599566 - RNA, 18 nt, Escherichia coli CFT073
gccccggaagccagacgu

SEQ ID NO: 599567 - RNA, 22 nt, Escherichia coli CFT073
gccccgcucacgcagcggcggc

SEQ ID NO: 599568 - RNA, 19 nt, Escherichia coli CFT073
gcccccugaagcaguuuca

SEQ ID NO: 599569 - RNA, 17 nt, Escherichia coli CFT073
gcccgagccgguugccu

SEQ ID NO: 599570 - RNA, 19 nt, Escherichia coli CFT073
gcccgaugaucaucaucgc

SEQ ID NO: 599571 - RNA, 20 nt, Escherichia coli CFT073
gcccgauggcaucaccaucg

SEQ ID NO: 599572 - RNA, 16 nt, Escherichia coli CFT073
gcccgcacugucgcca

SEQ ID NO: 599573 - RNA, 14 nt, Escherichia coli CFT073
gcccaauacugcgc

SEQ ID NO: 599574 - RNA, 15 nt, Escherichia coli CFT073
gcccaccauaaucag

SEQ ID NO: 599575 - RNA, 13 nt, Escherichia coli CFT073
gcccagcgccugg

SEQ ID NO: 599576 - RNA, 17 nt, Escherichia coli CFT073
gcccagcgcaggaaaga

SEQ ID NO: 599577 - RNA, 17 nt, Escherichia coli CFT073
gcccaggaagcccgccc

SEQ ID NO: 599578 - RNA, 17 nt, Escherichia coli CFT073
gccccacaagcccgcca

SEQ ID NO: 599579 - RNA, 21 nt, Escherichia coli CFT073
gcccaguuagacgugcgaaug

SEQ ID NO: 599580 - RNA, 13 nt, Escherichia coli CFT073
gcccagucuuccg

SEQ ID NO: 599581 - RNA, 19 nt, Escherichia coli CFT073
gcccagugccagcaccacu

SEQ ID NO: 599582 - RNA, 22 nt, Escherichia coli CFT073
gccccauugcucuuucacuuua

SEQ ID NO: 599583 - RNA, 23 nt, Escherichia coli CFT073
gccccauugcugaugcaccuuca

SEQ ID NO: 599584 - RNA, 14 nt, Escherichia coli CFT073
gccccaccagcaaa

SEQ ID NO: 599585 - RNA, 12 nt, Escherichia coli CFT073
gcccgcgaagcu

SEQ ID NO: 599586 - RNA, 16 nt, Escherichia coli CFT073
gcccgcgaagcuggug

SEQ ID NO: 599587 - RNA, 16 nt, Escherichia coli CFT073
gcccgcgucgcaucag

SEQ ID NO: 599588 - RNA, 18 nt, Escherichia coli CFT073
gcccgcgccucaacgccu

SEQ ID NO: 599589 - RNA, 20 nt, Escherichia coli CFT073
gcccgcgucguucaucgcaa

SEQ ID NO: 599590 - RNA, 14 nt, Escherichia coli CFT073
gcccggcagcuuua

SEQ ID NO: 599591 - RNA, 14 nt, Escherichia coli CFT073
gcccggcaaaacgu

SEQ ID NO: 599592 - RNA, 15 nt, Escherichia coli CFT073
gcccgggucagcgcc

SEQ ID NO: 599593 - RNA, 18 nt, Escherichia coli CFT073
gcccuauaaucaccguga

SEQ ID NO: 599594 - RNA, 13 nt, Escherichia coli CFT073
gcccuaucaucgc

SEQ ID NO: 599595 - RNA, 12 nt, Escherichia coli CFT073
gccgacaguagc

SEQ ID NO: 599596 - RNA, 23 nt, Escherichia coli CFT073
gccgagaagauuuuuugccagca

SEQ ID NO: 599597 - RNA, 21 nt, Escherichia coli CFT073
gccgacguugcguugccgcca

SEQ ID NO: 599598 - RNA, 19 nt, Escherichia coli CFT073
gccgagagaagcgcguuca

SEQ ID NO: 599599 - RNA, 13 nt, Escherichia coli CFT073
gccgagcgccagc

SEQ ID NO: 599600 - RNA, 17 nt, Escherichia coli CFT073
gccgagcagcuguuuca

SEQ ID NO: 599601 - RNA, 14 nt, Escherichia coli CFT073
gccgaggaacauaa

SEQ ID NO: 599602 - RNA, 16 nt, Escherichia coli CFT073
gccgaggauacagccg

SEQ ID NO: 599603 - RNA, 22 nt, Escherichia coli CFT073
gccgauaaaggucgacaguagc

SEQ ID NO: 599604 - RNA, 23 nt, Escherichia coli CFT073
gccgauaaaggucgacaguagcc

SEQ ID NO: 599605 - RNA, 15 nt, Escherichia coli CFT073
gccgauaaucaacgc

SEQ ID NO: 599606 - RNA, 18 nt, Escherichia coli CFT073
gccgauuuuauggcggaa

SEQ ID NO: 599607 - RNA, 15 nt, Escherichia coli CFT073
gccgcaaacgacacu

SEQ ID NO: 599608 - RNA, 21 nt, Escherichia coli CFT073
gccgauguuauugcagacauc

SEQ ID NO: 599609 - RNA, 14 nt, Escherichia coli CFT073
gccgaugccgcuac

SEQ ID NO: 599610 - RNA, 12 nt, Escherichia coli CFT073
gccgcaccgaag

SEQ ID NO: 599611 - RNA, 20 nt, Escherichia coli CFT073
gccgcauccgacaucaacgc

SEQ ID NO: 599612 - RNA, 18 nt, Escherichia coli CFT073
gccgcauccggcauaaac

SEQ ID NO: 599613 - RNA, 15 nt, Escherichia coli CFT073
gccgccaccagaacc

SEQ ID NO: 599614 - RNA, 22 nt, Escherichia coli CFT073
gccgcauuuuuucuucaguuca

SEQ ID NO: 599615 - RNA, 18 nt, Escherichia coli CFT073
gccgccaaacgccgcaug

SEQ ID NO: 599616 - RNA, 16 nt, Escherichia coli CFT073
gccgcauugguaaaac

SEQ ID NO: 599617 - RNA, 18 nt, Escherichia coli CFT073
gccgccagaaucaccucu

SEQ ID NO: 599618 - RNA, 21 nt, Escherichia coli CFT073
gccgccauuccagccagaaau

SEQ ID NO: 599619 - RNA, 13 nt, Escherichia coli CFT073
gccgccaugccau

SEQ ID NO: 599620 - RNA, 17 nt, Escherichia coli CFT073
gccgccauaaacagcag

SEQ ID NO: 599621 - RNA, 17 nt, Escherichia coli CFT073
gccgccucagccagaau

SEQ ID NO: 599622 - RNA, 13 nt, Escherichia coli CFT073
gccgcgauagcaa

SEQ ID NO: 599623 - RNA, 22 nt, Escherichia coli CFT073
gccgcgcggguggugcgcacca

SEQ ID NO: 599624 - RNA, 23 nt, Escherichia coli CFT073
gccgcucucuucguggcccgcca

SEQ ID NO: 599625 - RNA, 17 nt, Escherichia coli CFT073
gccgcuccggcagcagc

SEQ ID NO: 599626 - RNA, 18 nt, Escherichia coli CFT073
gccgcuaaauaccagcgu

SEQ ID NO: 599627 - RNA, 14 nt, Escherichia coli CFT073
gccgcuaacagcag

SEQ ID NO: 599628 - RNA, 22 nt, Escherichia coli CFT073
gccgcuaacgucugguaaagca

SEQ ID NO: 599629 - RNA, 21 nt, Escherichia coli CFT073
gccggauaaggcgcgucaagc

SEQ ID NO: 599630 - RNA, 14 nt, Escherichia coli CFT073
gccggauaaggcau

SEQ ID NO: 599631 - RNA, 19 nt, Escherichia coli CFT073
gccggauaaggcguucacg

SEQ ID NO: 599632 - RNA, 19 nt, Escherichia coli CFT073
gccggaauaccacuuucag

SEQ ID NO: 599633 - RNA, 22 nt, Escherichia coli CFT073
gccggaauaccacuuucagcaa

SEQ ID NO: 599634 - RNA, 16 nt, Escherichia coli CFT073
gccggaauauucuucc

SEQ ID NO: 599635 - RNA, 17 nt, Escherichia coli CFT073
gccggaacgccgcuggu

SEQ ID NO: 599636 - RNA, 19 nt, Escherichia coli CFT073
gccggaacgccgcuggugg

SEQ ID NO: 599637 - RNA, 24 nt, Escherichia coli CFT073
gccgcuuuuucguaccagugcagc

SEQ ID NO: 599638 - RNA, 16 nt, Escherichia coli CFT073
gccgcuuuuucugcac

SEQ ID NO: 599639 - RNA, 20 nt, Escherichia coli CFT073
gccgcuguguguaggccagc

SEQ ID NO: 599640 - RNA, 12 nt, Escherichia coli CFT073
gccgcuguggca

SEQ ID NO: 599641 - RNA, 20 nt, Escherichia coli CFT073
gccgcugcgauuucagcgcc

SEQ ID NO: 599642 - RNA, 18 nt, Escherichia coli CFT073
gccggaugguaugccauc

SEQ ID NO: 599643 - RNA, 22 nt, Escherichia coli CFT073
gccggauguggcguaaacgccu

SEQ ID NO: 599644 - RNA, 22 nt, Escherichia coli CFT073
gccggauucacgccaaccagcu

SEQ ID NO: 599645 - RNA, 13 nt, Escherichia coli CFT073
gccggauauuccu

SEQ ID NO: 599646 - RNA, 23 nt, Escherichia coli CFT073
gccggauauuccugaauggugac

SEQ ID NO: 599647 - RNA, 20 nt, Escherichia coli CFT073
gccggauaucccccuuucug

SEQ ID NO: 599648 - RNA, 22 nt, Escherichia coli CFT073
gccggauaucccccuuucugca

SEQ ID NO: 599649 - RNA, 14 nt, Escherichia coli CFT073
gcagcgaaucagcc

SEQ ID NO: 599650 - RNA, 20 nt, Escherichia coli CFT073
gcagcgcaauucgcgucggc

SEQ ID NO: 599651 - RNA, 14 nt, Escherichia coli CFT073
gcagccaucgucgc

SEQ ID NO: 599652 - RNA, 19 nt, Escherichia coli CFT073
gcagcagcuguuuggccug

SEQ ID NO: 599653 - RNA, 17 nt, Escherichia coli CFT073
gcagcaggaauaaucag

SEQ ID NO: 599654 - RNA, 14 nt, Escherichia coli CFT073
gcagccgccacaau

SEQ ID NO: 599655 - RNA, 12 nt, Escherichia coli CFT073
gcagccgccauc

SEQ ID NO: 599656 - RNA, 12 nt, Escherichia coli CFT073
gcagccggaaaa

SEQ ID NO: 599657 - RNA, 14 nt, Escherichia coli CFT073
gcagccggaaaacc

SEQ ID NO: 599658 - RNA, 18 nt, Escherichia coli CFT073
gcagacguuaaugccgga

SEQ ID NO: 599659 - RNA, 23 nt, Escherichia coli CFT073
gcagacuguaaaucugccgucau

SEQ ID NO: 599660 - RNA, 16 nt, Escherichia coli CFT073
gcagagauacaggcca

SEQ ID NO: 599661 - RNA, 19 nt, Escherichia coli CFT073
gcagagauagaacugcauu

SEQ ID NO: 599662 - RNA, 20 nt, Escherichia coli CFT073
gcagaugcucuucaaaacga

SEQ ID NO: 599663 - RNA, 17 nt, Escherichia coli CFT073
gcagauggaugagcaaa

SEQ ID NO: 599664 - RNA, 16 nt, Escherichia coli CFT073
gcagauggcauccagc

SEQ ID NO: 599665 - RNA, 15 nt, Escherichia coli CFT073
gcagagcauccagca

SEQ ID NO: 599666 - RNA, 19 nt, Escherichia coli CFT073
gcagagcauucccgccauc

SEQ ID NO: 599667 - RNA, 20 nt, Escherichia coli CFT073
gcagacuuuuugcggcagca

SEQ ID NO: 599668 - RNA, 23 nt, Escherichia coli CFT073
gcagacuuuuugcggcagcaaug

SEQ ID NO: 599669 - RNA, 20 nt, Escherichia coli CFT073
gcagagaucgccccggcaag

SEQ ID NO: 599670 - RNA, 22 nt, Escherichia coli CFT073
gcagagcaaaaaucgacagcag

SEQ ID NO: 599671 - RNA, 14 nt, Escherichia coli CFT073
gcagagcaaacagg

SEQ ID NO: 599672 - RNA, 23 nt, Escherichia coli CFT073
gcagcaaaucguaggaguaauca

SEQ ID NO: 599673 - RNA, 19 nt, Escherichia coli CFT073
gcagauuucuucuggcuac

SEQ ID NO: 599674 - RNA, 19 nt, Escherichia coli CFT073
gcagauuugccaguaccga

SEQ ID NO: 599675 - RNA, 21 nt, Escherichia coli CFT073
gcagauuugccaguaccgauu

SEQ ID NO: 599676 - RNA, 14 nt, Escherichia coli CFT073
gcagcaaccgucgu

SEQ ID NO: 599677 - RNA, 11 nt, Escherichia coli CFT073
gcagcaacgaa

SEQ ID NO: 599678 - RNA, 23 nt, Escherichia coli CFT073
gcagcaacaucacgcugacgcau

SEQ ID NO: 599679 - RNA, 15 nt, Escherichia coli CFT073
gcagcaaccagagcc

SEQ ID NO: 599680 - RNA, 20 nt, Escherichia coli CFT073
gcagaaucaaucucagcgau

SEQ ID NO: 599681 - RNA, 13 nt, Escherichia coli CFT073
gcagaacaucagc

SEQ ID NO: 599682 - RNA, 17 nt, Escherichia coli CFT073
gcagaacauccagcucg

SEQ ID NO: 599683 - RNA, 21 nt, Escherichia coli CFT073
gcagaacauccagcucgcguu

SEQ ID NO: 599684 - RNA, 15 nt, Escherichia coli CFT073
gcagaacgaccagcg

SEQ ID NO: 599685 - RNA, 17 nt, Escherichia coli CFT073
gcagaacgaccagcgcc

SEQ ID NO: 599686 - RNA, 23 nt, Escherichia coli CFT073
gcagaacgccaugccaaagaagg

SEQ ID NO: 599687 - RNA, 11 nt, Escherichia coli CFT073
gcagaaaaucc

SEQ ID NO: 599688 - RNA, 15 nt, Escherichia coli CFT073
gcagaaaauccagcg

SEQ ID NO: 599689 - RNA, 17 nt, Escherichia coli CFT073
gcagaaaauccagcguc

SEQ ID NO: 599690 - RNA, 19 nt, Escherichia coli CFT073
gcagaaauaccccgccagc

SEQ ID NO: 599691 - RNA, 15 nt, Escherichia coli CFT073
gcagaaaucaacggc

SEQ ID NO: 599692 - RNA, 22 nt, Escherichia coli CFT073
gcacuuucucgacauccaugca

SEQ ID NO: 599693 - RNA, 17 nt, Escherichia coli CFT073
gcacuucuuccgccagc

SEQ ID NO: 599694 - RNA, 15 nt, Escherichia coli CFT073
gcacuucuuccgggc

SEQ ID NO: 599695 - RNA, 13 nt, Escherichia coli CFT073
gcacuuugcuggu

SEQ ID NO: 599696 - RNA, 16 nt, Escherichia coli CFT073
gcacuuuucccacuaa

SEQ ID NO: 599697 - RNA, 16 nt, Escherichia coli CFT073
gcacuuuucgcacugc

SEQ ID NO: 599698 - RNA, 22 nt, Escherichia coli CFT073
gcagaccgugaagguaccgcaa

SEQ ID NO: 599699 - RNA, 19 nt, Escherichia coli CFT073
gcagacgcauacugauuac

SEQ ID NO: 599700 - RNA, 23 nt, Escherichia coli CFT073
gcagacgcaucgcccagccaucg

SEQ ID NO: 599701 - RNA, 20 nt, Escherichia coli CFT073
gcagacccgccaccggcuuu

SEQ ID NO: 599702 - RNA, 17 nt, Escherichia coli CFT073
gcagacagccuaccaga

SEQ ID NO: 599703 - RNA, 16 nt, Escherichia coli CFT073
gcagaccaaccgucag

SEQ ID NO: 599704 - RNA, 15 nt, Escherichia coli CFT073
gcaccgagugguuca

SEQ ID NO: 599705 - RNA, 19 nt, Escherichia coli CFT073
gcaccgcagagaucgcccc

SEQ ID NO: 599706 - RNA, 21 nt, Escherichia coli CFT073
gcaccgcgcccacauaaccaa

SEQ ID NO: 599707 - RNA, 18 nt, Escherichia coli CFT073
gcacgaauagucaguuca

SEQ ID NO: 599708 - RNA, 22 nt, Escherichia coli CFT073
gcaccugcggaaucaccggcaa

SEQ ID NO: 599709 - RNA, 13 nt, Escherichia coli CFT073
gcaccugccagcg

SEQ ID NO: 599710 - RNA, 22 nt, Escherichia coli CFT073
gcaccgugcauuuuucgcuuuu

SEQ ID NO: 599711 - RNA, 13 nt, Escherichia coli CFT073
gcacgaccgccuu

SEQ ID NO: 599712 - RNA, 14 nt, Escherichia coli CFT073
gcacgcccaucagc

SEQ ID NO: 599713 - RNA, 14 nt, Escherichia coli CFT073
gcacgcgcaucauu

SEQ ID NO: 599714 - RNA, 19 nt, Escherichia coli CFT073
gcacggcaucaaugccgga

SEQ ID NO: 599715 - RNA, 13 nt, Escherichia coli CFT073
gcacggcagauaa

SEQ ID NO: 599716 - RNA, 16 nt, Escherichia coli CFT073
gcacggcacacuuuca

SEQ ID NO: 599717 - RNA, 13 nt, Escherichia coli CFT073
gcacgcugcggca

SEQ ID NO: 599718 - RNA, 17 nt, Escherichia coli CFT073
gcacgcugaccgcuuca

SEQ ID NO: 599719 - RNA, 21 nt, Escherichia coli CFT073
gcacuauuuaccgccaacgca

SEQ ID NO: 599720 - RNA, 16 nt, Escherichia coli CFT073
gcacucacgccaggca

SEQ ID NO: 599721 - RNA, 13 nt, Escherichia coli CFT073
gcacguuaaucaa

SEQ ID NO: 599722 - RNA, 22 nt, Escherichia coli CFT073
gcacguuaucagacaccagcca

SEQ ID NO: 599723 - RNA, 18 nt, Escherichia coli CFT073
gcacggucacaucgcuga

SEQ ID NO: 599724 - RNA, 22 nt, Escherichia coli CFT073
gcacuguguuggguucacuuuc

SEQ ID NO: 599725 - RNA, 19 nt, Escherichia coli CFT073
gcacuguuucgccagguuu

SEQ ID NO: 599726 - RNA, 13 nt, Escherichia coli CFT073
gcacuuacagcaa

SEQ ID NO: 599727 - RNA, 17 nt, Escherichia coli CFT073
gcacuuaccuucacgaa

SEQ ID NO: 599728 - RNA, 16 nt, Escherichia coli CFT073
gcacuggugccaugaa

SEQ ID NO: 599729 - RNA, 21 nt, Escherichia coli CFT073
gcacugucgagaucgcggcaa

SEQ ID NO: 599730 - RNA, 16 nt, Escherichia coli CFT073
gcacuuauaugccgga

SEQ ID NO: 599731 - RNA, 22 nt, Escherichia coli CFT073
gcacuucacccaucgccagaua

SEQ ID NO: 599732 - RNA, 12 nt, Escherichia coli CFT073
gcacuucgcugg

SEQ ID NO: 599733 - RNA, 15 nt, Escherichia coli CFT073
gcacuucgcuggugu

SEQ ID NO: 599734 - RNA, 18 nt, Escherichia coli CFT073
gcacuggcggcagcaggu

SEQ ID NO: 599735 - RNA, 18 nt, Escherichia coli CFT073
gcacugccgccaugcggu

SEQ ID NO: 599736 - RNA, 20 nt, Escherichia coli CFT073
gcacugcgcccgccagcauc

SEQ ID NO: 599737 - RNA, 17 nt, Escherichia coli CFT073
gcacugcgcccgccagc

SEQ ID NO: 599738 - RNA, 13 nt, Escherichia coli CFT073
gcacugccagcca

SEQ ID NO: 599739 - RNA, 21 nt, Escherichia coli CFT073
gcacugcaaaaaacagccgga

SEQ ID NO: 599740 - RNA, 22 nt, Escherichia coli CFT073
gcacucuacauguguucugcau

SEQ ID NO: 599741 - RNA, 16 nt, Escherichia coli CFT073
gcaguuuauccagcca

SEQ ID NO: 599742 - RNA, 23 nt, Escherichia coli CFT073
gcauaaaaaaagcgggccaguaa

SEQ ID NO: 599743 - RNA, 16 nt, Escherichia coli CFT073
gcauaaaccgggucag

SEQ ID NO: 599744 - RNA, 14 nt, Escherichia coli CFT073
gcaguugcgcgcgu

SEQ ID NO: 599745 - RNA, 16 nt, Escherichia coli CFT073
gcaguugccggaugcg

SEQ ID NO: 599746 - RNA, 15 nt, Escherichia coli CFT073
gcagugcugcaccaa

SEQ ID NO: 599747 - RNA, 18 nt, Escherichia coli CFT073
gcauaaucgcuacgccuu

SEQ ID NO: 599748 - RNA, 13 nt, Escherichia coli CFT073
gcauaaucggcug

SEQ ID NO: 599749 - RNA, 19 nt, Escherichia coli CFT073
gcauaaugucgcuggccgg

SEQ ID NO: 599750 - RNA, 17 nt, Escherichia coli CFT073
gcauacaacgccaugaa

SEQ ID NO: 599751 - RNA, 17 nt, Escherichia coli CFT073
gcauacaccaccacauu

SEQ ID NO: 599752 - RNA, 16 nt, Escherichia coli CFT073
gcauaauaagcccggc

SEQ ID NO: 599753 - RNA, 19 nt, Escherichia coli CFT073
gcauaaucaccaguaccgc

SEQ ID NO: 599754 - RNA, 17 nt, Escherichia coli CFT073
gcauaaucaccaucagc

SEQ ID NO: 599755 - RNA, 21 nt, Escherichia coli CFT073
gcauaaucaccaucagcagca

SEQ ID NO: 599756 - RNA, 13 nt, Escherichia coli CFT073
gcauagacagcca

SEQ ID NO: 599757 - RNA, 16 nt, Escherichia coli CFT073
gcauagcuaauccccu

SEQ ID NO: 599758 - RNA, 14 nt, Escherichia coli CFT073
gcauagccccagcg

SEQ ID NO: 599759 - RNA, 15 nt, Escherichia coli CFT073
gcauagccccagcgc

SEQ ID NO: 599760 - RNA, 16 nt, Escherichia coli CFT073
gcauagccccagcgca

SEQ ID NO: 599761 - RNA, 20 nt, Escherichia coli CFT073
gcagguucucaauuaccguu

SEQ ID NO: 599762 - RNA, 18 nt, Escherichia coli CFT073
gcagguggguucugcggc

SEQ ID NO: 599763 - RNA, 16 nt, Escherichia coli CFT073
gcaggugggauaaggc

SEQ ID NO: 599764 - RNA, 19 nt, Escherichia coli CFT073
gcagguuaugaauauucug

SEQ ID NO: 599765 - RNA, 20 nt, Escherichia coli CFT073
gcaucaaguugauuuuucgu

SEQ ID NO: 599766 - RNA, 22 nt, Escherichia coli CFT073
gcauaggcuuugcuuagcgcaa

SEQ ID NO: 599767 - RNA, 18 nt, Escherichia coli CFT073
gcaucacgaccgcuucag

SEQ ID NO: 599768 - RNA, 21 nt, Escherichia coli CFT073
gcaucacccgcauaugcggcg

SEQ ID NO: 599769 - RNA, 16 nt, Escherichia coli CFT073
gcaucacccgcugcaa

SEQ ID NO: 599770 - RNA, 13 nt, Escherichia coli CFT073
gcaucacagacca

SEQ ID NO: 599771 - RNA, 15 nt, Escherichia coli CFT073
gcauccggcauaaac

SEQ ID NO: 599772 - RNA, 17 nt, Escherichia coli CFT073
gcauccggcauaaacaa

SEQ ID NO: 599773 - RNA, 18 nt, Escherichia coli CFT073
gcauccggcaacagugcc

SEQ ID NO: 599774 - RNA, 15 nt, Escherichia coli CFT073
gcauccgccagcagc

SEQ ID NO: 599775 - RNA, 17 nt, Escherichia coli CFT073
gcauccgaacgcugaca

SEQ ID NO: 599776 - RNA, 20 nt, Escherichia coli CFT073
gcauccgacaucaacgccug

SEQ ID NO: 599777 - RNA, 23 nt, Escherichia coli CFT073
gcauccgauuguuccugcucauc

SEQ ID NO: 599778 - RNA, 13 nt, Escherichia coli CFT073
gcaucgacgccau

SEQ ID NO: 599779 - RNA, 21 nt, Escherichia coli CFT073
gcaucgcaaaccagacgcgcg

SEQ ID NO: 599780 - RNA, 16 nt, Escherichia coli CFT073
gcaucgcaucaggcua

SEQ ID NO: 599781 - RNA, 17 nt, Escherichia coli CFT073
gcaucgcauccggcaau

SEQ ID NO: 599782 - RNA, 21 nt, Escherichia coli CFT073
gcaucgccgguuuugccaguc

SEQ ID NO: 599783 - RNA, 23 nt, Escherichia coli CFT073
gcagcgucucauaacggauugca

SEQ ID NO: 599784 - RNA, 15 nt, Escherichia coli CFT073
gcagcgggauuuccg

SEQ ID NO: 599785 - RNA, 22 nt, Escherichia coli CFT073
gcaggcaucaucagauucugcg

SEQ ID NO: 599786 - RNA, 10 nt, Escherichia coli CFT073
gcaggccgga

SEQ ID NO: 599787 - RNA, 12 nt, Escherichia coli CFT073
gcaggcgugcgc

SEQ ID NO: 599788 - RNA, 17 nt, Escherichia coli CFT073
gcaggguuugcgcccag

SEQ ID NO: 599789 - RNA, 17 nt, Escherichia coli CFT073
gcagggugcuaucgcga

SEQ ID NO: 599790 - RNA, 15 nt, Escherichia coli CFT073
gcauuauggcgcagu

SEQ ID NO: 599791 - RNA, 22 nt, Escherichia coli CFT073
gcauuauucaggcacuuucgcg

SEQ ID NO: 599792 - RNA, 19 nt, Escherichia coli CFT073
gcauucacauuuuuaagcc

SEQ ID NO: 599793 - RNA, 19 nt, Escherichia coli CFT073
gcauucaccucugcggcaa

SEQ ID NO: 599794 - RNA, 16 nt, Escherichia coli CFT073
gcauucacgggcggcg

SEQ ID NO: 599795 - RNA, 13 nt, Escherichia coli CFT073
gcauucagcuucc

SEQ ID NO: 599796 - RNA, 22 nt, Escherichia coli CFT073
gcauucaugaacacacccggag

SEQ ID NO: 599797 - RNA, 18 nt, Escherichia coli CFT073
gcauucaugcgaauacag

SEQ ID NO: 599798 - RNA, 18 nt, Escherichia coli CFT073
gcauuaauuaguaggccg

SEQ ID NO: 599799 - RNA, 20 nt, Escherichia coli CFT073
gcauuaauuaguaggccgga

SEQ ID NO: 599800 - RNA, 14 nt, Escherichia coli CFT073
gcauuaacgcgaaa

SEQ ID NO: 599801 - RNA, 21 nt, Escherichia coli CFT073
gcauuaacgcgaaauaaucaa

SEQ ID NO: 599802 - RNA, 19 nt, Escherichia coli CFT073
gcauuaaguguaaucagcc

SEQ ID NO: 599803 - RNA, 14 nt, Escherichia coli CFT073
gcauuacuuucggu

SEQ ID NO: 599804 - RNA, 22 nt, Escherichia coli CFT073
gcauuacuuucggugacuucaa

SEQ ID NO: 599805 - RNA, 14 nt, Escherichia coli CFT073
gcauuagccaggca

SEQ ID NO: 599806 - RNA, 15 nt, Escherichia coli CFT073
gcauuagugcgcagu

SEQ ID NO: 599807 - RNA, 13 nt, Escherichia coli CFT073
gcauuacgcccga

SEQ ID NO: 599808 - RNA, 19 nt, Escherichia coli CFT073
gcauucucuuuucacgcaa

SEQ ID NO: 599809 - RNA, 15 nt, Escherichia coli CFT073
gcauucguucucaau

SEQ ID NO: 599810 - RNA, 21 nt, Escherichia coli CFT073
gcauucggcgaccagcgcagc

SEQ ID NO: 599811 - RNA, 21 nt, Escherichia coli CFT073
gcauucgccacugccagcaaa

SEQ ID NO: 599812 - RNA, 14 nt, Escherichia coli CFT073
gcauugcggcauca

SEQ ID NO: 599813 - RNA, 22 nt, Escherichia coli CFT073
gcauugauucgccgccgcauau

SEQ ID NO: 599814 - RNA, 12 nt, Escherichia coli CFT073
gcauugccagca

SEQ ID NO: 599815 - RNA, 20 nt, Escherichia coli CFT073
gcauugaggguauccaggcc

SEQ ID NO: 599816 - RNA, 16 nt, Escherichia coli CFT073
gcauggugagcgcaca

SEQ ID NO: 599817 - RNA, 15 nt, Escherichia coli CFT073
gcaugguagaaaucu

SEQ ID NO: 599818 - RNA, 17 nt, Escherichia coli CFT073
gcauggucgcagcggcu

SEQ ID NO: 599819 - RNA, 21 nt, Escherichia coli CFT073
gcauggcuaaaguacguaaaa

SEQ ID NO: 599820 - RNA, 23 nt, Escherichia coli CFT073
gcaugggaacugcugaccagcga

SEQ ID NO: 599821 - RNA, 22 nt, Escherichia coli CFT073
gcaugucaggcaguguucuggc

SEQ ID NO: 599822 - RNA, 16 nt, Escherichia coli CFT073
gcaugucaggcgucgc

SEQ ID NO: 599823 - RNA, 23 nt, Escherichia coli CFT073
gcaugucguagacgggcgucagc

SEQ ID NO: 599824 - RNA, 15 nt, Escherichia coli CFT073
gcauguucuuucggu

SEQ ID NO: 599825 - RNA, 17 nt, Escherichia coli CFT073
gcauguugauuaccugu

SEQ ID NO: 599826 - RNA, 12 nt, Escherichia coli CFT073
gccaaacgccca

SEQ ID NO: 599827 - RNA, 14 nt, Escherichia coli CFT073
gccaaacgcccagc

SEQ ID NO: 599828 - RNA, 21 nt, Escherichia coli CFT073
gccaaagaauuggcuuuaucu

SEQ ID NO: 599829 - RNA, 21 nt, Escherichia coli CFT073
gccaaagcgccguagcuggcg

SEQ ID NO: 599830 - RNA, 23 nt, Escherichia coli CFT073
gccaaaaauggagagaaccagcg

SEQ ID NO: 599831 - RNA, 23 nt, Escherichia coli CFT073
gcauuuuuucuucaguucagcug

SEQ ID NO: 599832 - RNA, 15 nt, Escherichia coli CFT073
gccaaaaagcguccc

SEQ ID NO: 599833 - RNA, 22 nt, Escherichia coli CFT073
gcauugcuuuuguggucaccau

SEQ ID NO: 599834 - RNA, 17 nt, Escherichia coli CFT073
gcauugguacaacgucc

SEQ ID NO: 599835 - RNA, 12 nt, Escherichia coli CFT073
gcauuuccgcca

SEQ ID NO: 599836 - RNA, 16 nt, Escherichia coli CFT073
gcauuuccgcugauuc

SEQ ID NO: 599837 - RNA, 17 nt, Escherichia coli CFT073
gcauuuccucaacaucu

SEQ ID NO: 599838 - RNA, 20 nt, Escherichia coli CFT073
gcauugucugaacguucugc

SEQ ID NO: 599839 - RNA, 17 nt, Escherichia coli CFT073
gcauuuacucucaucaa

SEQ ID NO: 599840 - RNA, 22 nt, Escherichia coli CFT073
gcauuuaugccauguucaucaa

SEQ ID NO: 599841 - RNA, 17 nt, Escherichia coli CFT073
gccaacgcaccguaacc

SEQ ID NO: 599842 - RNA, 20 nt, Escherichia coli CFT073
gccaacgaucuggcgucagc

SEQ ID NO: 599843 - RNA, 12 nt, Escherichia coli CFT073
gccaaccaccgg

SEQ ID NO: 599844 - RNA, 17 nt, Escherichia coli CFT073
gccaaacugugcaccgc

SEQ ID NO: 599845 - RNA, 14 nt, Escherichia coli CFT073
gccaaagcggcagu

SEQ ID NO: 599846 - RNA, 21 nt, Escherichia coli CFT073
gccaaaggcuuucgcgacauc

SEQ ID NO: 599847 - RNA, 15 nt, Escherichia coli CFT073
gccaaauccagcgca

SEQ ID NO: 599848 - RNA, 16 nt, Escherichia coli CFT073
gccaaaugucaccagc

SEQ ID NO: 599849 - RNA, 18 nt, Escherichia coli CFT073
gccaacaaaaaugcaggc

SEQ ID NO: 599850 - RNA, 17 nt, Escherichia coli CFT073
gccaacaaaagcaacaa

SEQ ID NO: 599851 - RNA, 18 nt, Escherichia coli CFT073
gcaugauuucaucaucag

SEQ ID NO: 599852 - RNA, 15 nt, Escherichia coli CFT073
gcaugauacgccaau

SEQ ID NO: 599853 - RNA, 15 nt, Escherichia coli CFT073
gcaugacccagugca

SEQ ID NO: 599854 - RNA, 23 nt, Escherichia coli CFT073
gcaugacacacucugaccugucg

SEQ ID NO: 599855 - RNA, 15 nt, Escherichia coli CFT073
gcauggaagcgcagg

SEQ ID NO: 599856 - RNA, 14 nt, Escherichia coli CFT073
gcauggaucgccgc

SEQ ID NO: 599857 - RNA, 17 nt, Escherichia coli CFT073
gcauggccugaauaacg

SEQ ID NO: 599858 - RNA, 17 nt, Escherichia coli CFT073
gcaucuggcauaaacaa

SEQ ID NO: 599859 - RNA, 13 nt, Escherichia coli CFT073
gcaucucgcgcuc

SEQ ID NO: 599860 - RNA, 15 nt, Escherichia coli CFT073
gcaucuguucuuuca

SEQ ID NO: 599861 - RNA, 23 nt, Escherichia coli CFT073
gcaugaacaaaacauacuuucuc

SEQ ID NO: 599862 - RNA, 16 nt, Escherichia coli CFT073
gcaugaacaaagcuca

SEQ ID NO: 599863 - RNA, 17 nt, Escherichia coli CFT073
gcaugaacaaaucgcac

SEQ ID NO: 599864 - RNA, 14 nt, Escherichia coli CFT073
gcaugaacgccuga

SEQ ID NO: 599865 - RNA, 13 nt, Escherichia coli CFT073
gcaucuucuucug

SEQ ID NO: 599866 - RNA, 15 nt, Escherichia coli CFT073
gcaucuucuucuggc

SEQ ID NO: 599867 - RNA, 17 nt, Escherichia coli CFT073
gcaucuuuuucaaugca

SEQ ID NO: 599868 - RNA, 14 nt, Escherichia coli CFT073
gcaucuuaccgaug

SEQ ID NO: 599869 - RNA, 22 nt, Escherichia coli CFT073
gcaucuaucgaaucuguucugg

SEQ ID NO: 599870 - RNA, 15 nt, Escherichia coli CFT073
gcaucucauccauca

SEQ ID NO: 599871 - RNA, 18 nt, Escherichia coli CFT073
gcaucggcaauuuaccgc

SEQ ID NO: 599872 - RNA, 14 nt, Escherichia coli CFT073
gcaucggccugcaa

SEQ ID NO: 599873 - RNA, 15 nt, Escherichia coli CFT073
gcaucgucacugaua

SEQ ID NO: 599874 - RNA, 13 nt, Escherichia coli CFT073
gcaucgucaucag

SEQ ID NO: 599875 - RNA, 18 nt, Escherichia coli CFT073
gcaucgucaucagcucca

SEQ ID NO: 599876 - RNA, 22 nt, Escherichia coli CFT073
gauaucaauguauuguucgugc

SEQ ID NO: 599877 - RNA, 21 nt, Escherichia coli CFT073
gauaugaucaucaccuuacug

SEQ ID NO: 599878 - RNA, 17 nt, Escherichia coli CFT073
gauauagaccaucggcg

SEQ ID NO: 599879 - RNA, 22 nt, Escherichia coli CFT073
gauauacguguacguugaugga

SEQ ID NO: 599880 - RNA, 20 nt, Escherichia coli CFT073
gauauuacauaccagcagca

SEQ ID NO: 599881 - RNA, 18 nt, Escherichia coli CFT073
gauauucaucagcaucac

SEQ ID NO: 599882 - RNA, 16 nt, Escherichia coli CFT073
gauauuccccagacga

SEQ ID NO: 599883 - RNA, 17 nt, Escherichia coli CFT073
gaucagccauuuugcac

SEQ ID NO: 599884 - RNA, 17 nt, Escherichia coli CFT073
gaucacuuuuucuuucg

SEQ ID NO: 599885 - RNA, 13 nt, Escherichia coli CFT073
gaucagaccgcca

SEQ ID NO: 599886 - RNA, 15 nt, Escherichia coli CFT073
gauagaacugcggca

SEQ ID NO: 599887 - RNA, 22 nt, Escherichia coli CFT073
gauacuggcguuacccagcgcc

SEQ ID NO: 599888 - RNA, 15 nt, Escherichia coli CFT073
gauagcccaacgauc

SEQ ID NO: 599889 - RNA, 15 nt, Escherichia coli CFT073
gauaacacagcggca

SEQ ID NO: 599890 - RNA, 12 nt, Escherichia coli CFT073
gauacagccgac

SEQ ID NO: 599891 - RNA, 22 nt, Escherichia coli CFT073
gauaaaucgauaacgcgcugcc

SEQ ID NO: 599892 - RNA, 19 nt, Escherichia coli CFT073
gauaaaucgcacguugcca

SEQ ID NO: 599893 - RNA, 17 nt, Escherichia coli CFT073
gauaaaugccaccacac

SEQ ID NO: 599894 - RNA, 20 nt, Escherichia coli CFT073
gauaaauggcguaugccgga

SEQ ID NO: 599895 - RNA, 19 nt, Escherichia coli CFT073
gauaaagcgaccaaccauc

SEQ ID NO: 599896 - RNA, 21 nt, Escherichia coli CFT073
gauaaauacgaucaaccaccg

SEQ ID NO: 599897 - RNA, 16 nt, Escherichia coli CFT073
gauaaacaucgccaua

SEQ ID NO: 599898 - RNA, 17 nt, Escherichia coli CFT073
gauaaacucacucugca

SEQ ID NO: 599899 - RNA, 16 nt, Escherichia coli CFT073
gaguguggaccgguga

SEQ ID NO: 599900 - RNA, 14 nt, Escherichia coli CFT073
gaguuacuggcgag

SEQ ID NO: 599901 - RNA, 12 nt, Escherichia coli CFT073
gagugcagcacu

SEQ ID NO: 599902 - RNA, 19 nt, Escherichia coli CFT073
gagugcgguuuugucggca

SEQ ID NO: 599903 - RNA, 13 nt, Escherichia coli CFT073
gauaaaacauuac

SEQ ID NO: 599904 - RNA, 15 nt, Escherichia coli CFT073
gauaaaacugccaga

SEQ ID NO: 599905 - RNA, 22 nt, Escherichia coli CFT073
gauaaaagugcagaucgccaga

SEQ ID NO: 599906 - RNA, 14 nt, Escherichia coli CFT073
gauaaaaucagaaa

SEQ ID NO: 599907 - RNA, 16 nt, Escherichia coli CFT073
gaguuuucaguaccgc

SEQ ID NO: 599908 - RNA, 12 nt, Escherichia coli CFT073
gauaaaaacgaa

SEQ ID NO: 599909 - RNA, 20 nt, Escherichia coli CFT073
gaguugguuauucaaagcga

SEQ ID NO: 599910 - RNA, 20 nt, Escherichia coli CFT073
gagucgcaaaacucaccuuu

SEQ ID NO: 599911 - RNA, 21 nt, Escherichia coli CFT073
gaggugugaaaccuuuaugca

SEQ ID NO: 599912 - RNA, 19 nt, Escherichia coli CFT073
gagguuaauauuuucgcca

SEQ ID NO: 599913 - RNA, 18 nt, Escherichia coli CFT073
gagguucagccgagcacg

SEQ ID NO: 599914 - RNA, 19 nt, Escherichia coli CFT073
gagcagcaaccacuugcag

SEQ ID NO: 599915 - RNA, 18 nt, Escherichia coli CFT073
gaggccagcggcuuuuua

SEQ ID NO: 599916 - RNA, 21 nt, Escherichia coli CFT073
gaucauggucugcgccgcauu

SEQ ID NO: 599917 - RNA, 13 nt, Escherichia coli CFT073
gaucauucaccag

SEQ ID NO: 599918 - RNA, 15 nt, Escherichia coli CFT073
gaucauggcuggcau

SEQ ID NO: 599919 - RNA, 21 nt, Escherichia coli CFT073
gaucaugguagcgugauggcc

SEQ ID NO: 599920 - RNA, 15 nt, Escherichia coli CFT073
gaucaugccgacaaa

SEQ ID NO: 599921 - RNA, 17 nt, Escherichia coli CFT073
gaucauacugaacuuau

SEQ ID NO: 599922 - RNA, 12 nt, Escherichia coli CFT073
gaucauccgcac

SEQ ID NO: 599923 - RNA, 18 nt, Escherichia coli CFT073
gaucagcuccggcagcug

SEQ ID NO: 599924 - RNA, 15 nt, Escherichia coli CFT073
gaucaggugauggca

SEQ ID NO: 599925 - RNA, 15 nt, Escherichia coli CFT073
gaucagguguuacgc

SEQ ID NO: 599926 - RNA, 20 nt, Escherichia coli CFT073
gauccagcauucccgccacc

SEQ ID NO: 599927 - RNA, 22 nt, Escherichia coli CFT073
gauccgcgucauugacgcuggc

SEQ ID NO: 599928 - RNA, 14 nt, Escherichia coli CFT073
gaucgcacuuaauc

SEQ ID NO: 599929 - RNA, 20 nt, Escherichia coli CFT073
gaucgcacaugucaguugca

SEQ ID NO: 599930 - RNA, 18 nt, Escherichia coli CFT073
gaucgauauucaccguca

SEQ ID NO: 599931 - RNA, 13 nt, Escherichia coli CFT073
gaucgaugccaaa

SEQ ID NO: 599932 - RNA, 21 nt, Escherichia coli CFT073
gaucgccacuuucacgccgcc

SEQ ID NO: 599933 - RNA, 11 nt, Escherichia coli CFT073
gaucgccagag

SEQ ID NO: 599934 - RNA, 20 nt, Escherichia coli CFT073
gaucuguuuaucgcgcaacc

SEQ ID NO: 599935 - RNA, 14 nt, Escherichia coli CFT073
gaucuuccgaccgc

SEQ ID NO: 599936 - RNA, 13 nt, Escherichia coli CFT073
gaucgucgcucac

SEQ ID NO: 599937 - RNA, 13 nt, Escherichia coli CFT073
gaugaaucucaau

SEQ ID NO: 599938 - RNA, 17 nt, Escherichia coli CFT073
gaugacagaaucagcag

SEQ ID NO: 599939 - RNA, 23 nt, Escherichia coli CFT073
gaugaauaacccuaaagcaccca

SEQ ID NO: 599940 - RNA, 13 nt, Escherichia coli CFT073
gaugaauaacgcu

SEQ ID NO: 599941 - RNA, 20 nt, Escherichia coli CFT073
gaugaauagcauguuccagu

SEQ ID NO: 599942 - RNA, 14 nt, Escherichia coli CFT073
gaucgguugccaua

SEQ ID NO: 599943 - RNA, 18 nt, Escherichia coli CFT073
gaucgguuaucuugccga

SEQ ID NO: 599944 - RNA, 14 nt, Escherichia coli CFT073
gaucggcuggcggc

SEQ ID NO: 599945 - RNA, 14 nt, Escherichia coli CFT073
gaucggcuucaauc

SEQ ID NO: 599946 - RNA, 22 nt, Escherichia coli CFT073
gaucggcuucaaucucgcugau

SEQ ID NO: 599947 - RNA, 20 nt, Escherichia coli CFT073
gaucgcguaaggcuucaauc

SEQ ID NO: 599948 - RNA, 23 nt, Escherichia coli CFT073
gcaacucauaagguguaccggua

SEQ ID NO: 599949 - RNA, 18 nt, Escherichia coli CFT073
gcaacguuuuaagcaaau

SEQ ID NO: 599950 - RNA, 20 nt, Escherichia coli CFT073
gcaacuccaccagcaccagc

SEQ ID NO: 599951 - RNA, 18 nt, Escherichia coli CFT073
gcaacgugguuugcggca

SEQ ID NO: 599952 - RNA, 13 nt, Escherichia coli CFT073
gcaacgcugauuu

SEQ ID NO: 599953 - RNA, 20 nt, Escherichia coli CFT073
gcaacgcuucaaccagugca

SEQ ID NO: 599954 - RNA, 17 nt, Escherichia coli CFT073
gcaacggcgacaagaau

SEQ ID NO: 599955 - RNA, 15 nt, Escherichia coli CFT073
gcaacgcccugcaac

SEQ ID NO: 599956 - RNA, 19 nt, Escherichia coli CFT073
gcaacgcagccccagcgca

SEQ ID NO: 599957 - RNA, 13 nt, Escherichia coli CFT073
gcaacgccagcga

SEQ ID NO: 599958 - RNA, 14 nt, Escherichia coli CFT073
gcaacgccagcgaa

SEQ ID NO: 599959 - RNA, 15 nt, Escherichia coli CFT073
gcaacgauaacaauc

SEQ ID NO: 599960 - RNA, 15 nt, Escherichia coli CFT073
gcaaccuguaggccg

SEQ ID NO: 599961 - RNA, 15 nt, Escherichia coli CFT073
gcaacgacagaacgc

SEQ ID NO: 599962 - RNA, 20 nt, Escherichia coli CFT073
gcaacgacgguaaaccacgc

SEQ ID NO: 599963 - RNA, 15 nt, Escherichia coli CFT073
gcaacgacuacgcca

SEQ ID NO: 599964 - RNA, 20 nt, Escherichia coli CFT073
gcaacaucaaauacagcuua

SEQ ID NO: 599965 - RNA, 12 nt, Escherichia coli CFT073
gcaacaucacgc

SEQ ID NO: 599966 - RNA, 22 nt, Escherichia coli CFT073
gcaacauggcgcggcacaccag

SEQ ID NO: 599967 - RNA, 12 nt, Escherichia coli CFT073
gcaacagguuac

SEQ ID NO: 599968 - RNA, 15 nt, Escherichia coli CFT073
gcaacagcgcgucag

SEQ ID NO: 599969 - RNA, 16 nt, Escherichia coli CFT073
gcaacagcgcgucagc

SEQ ID NO: 599970 - RNA, 15 nt, Escherichia coli CFT073
gcaacacguugccau

SEQ ID NO: 599971 - RNA, 19 nt, Escherichia coli CFT073
gcaacaagccgcuugcgau

SEQ ID NO: 599972 - RNA, 22 nt, Escherichia coli CFT073
gcaacaauaacccccugcccca

SEQ ID NO: 599973 - RNA, 14 nt, Escherichia coli CFT073
gcaacaauuuccgc

SEQ ID NO: 599974 - RNA, 23 nt, Escherichia coli CFT073
gcaacaauuuccgcagcuccagc

SEQ ID NO: 599975 - RNA, 19 nt, Escherichia coli CFT073
gcaacauuaucugaugcgc

SEQ ID NO: 599976 - RNA, 13 nt, Escherichia coli CFT073
gcaaccacaacgc

SEQ ID NO: 599977 - RNA, 14 nt, Escherichia coli CFT073
gcaaccagcacgcc

SEQ ID NO: 599978 - RNA, 21 nt, Escherichia coli CFT073
gcaaccaccugaagaaaaucc

SEQ ID NO: 599979 - RNA, 15 nt, Escherichia coli CFT073
gcaaccagcgucgca

SEQ ID NO: 599980 - RNA, 21 nt, Escherichia coli CFT073
gcaaccggauuuuuaugacgc

SEQ ID NO: 599981 - RNA, 16 nt, Escherichia coli CFT073
gcaaccgccaacagca

SEQ ID NO: 599982 - RNA, 17 nt, Escherichia coli CFT073
gcaaccgccaacagcag

SEQ ID NO: 599983 - RNA, 11 nt, Escherichia coli CFT073
gcaauaaacaa

SEQ ID NO: 599984 - RNA, 15 nt, Escherichia coli CFT073
gcaauaaccaucagc

SEQ ID NO: 599985 - RNA, 20 nt, Escherichia coli CFT073
gcaauaacuccccuucuggc

SEQ ID NO: 599986 - RNA, 13 nt, Escherichia coli CFT073
gcaaucagcguuu

SEQ ID NO: 599987 - RNA, 14 nt, Escherichia coli CFT073
gcaaucagcguuuc

SEQ ID NO: 599988 - RNA, 18 nt, Escherichia coli CFT073
gcaaucagcguuucgcca

SEQ ID NO: 599989 - RNA, 20 nt, Escherichia coli CFT073
gcaagguaguuaaucaguac

SEQ ID NO: 599990 - RNA, 17 nt, Escherichia coli CFT073
gcaagggguucuucggc

SEQ ID NO: 599991 - RNA, 19 nt, Escherichia coli CFT073
gcaaguagcgccagacuga

SEQ ID NO: 599992 - RNA, 13 nt, Escherichia coli CFT073
gcaauccacaagc

SEQ ID NO: 599993 - RNA, 15 nt, Escherichia coli CFT073
gcaauccauaccagc

SEQ ID NO: 599994 - RNA, 17 nt, Escherichia coli CFT073
gcaaucuguaacaaggu

SEQ ID NO: 599995 - RNA, 22 nt, Escherichia coli CFT073
gcaaucuguuuauuugacagcc

SEQ ID NO: 599996 - RNA, 14 nt, Escherichia coli CFT073
gcaaucuuucgagu

SEQ ID NO: 599997 - RNA, 15 nt, Escherichia coli CFT073
gcaaugaaagcgagc

SEQ ID NO: 599998 - RNA, 15 nt, Escherichia coli CFT073
gcaaucugcuggcaa

SEQ ID NO: 599999 - RNA, 12 nt, Escherichia coli CFT073
gcaaucaucgca

SEQ ID NO: 600000 - RNA, 16 nt, Escherichia coli CFT073
gcaaucaucguacugu

SEQ ID NO: 600001 - RNA, 13 nt, Escherichia coli CFT073
gcaaucaugcgca

SEQ ID NO: 600002 - RNA, 22 nt, Escherichia coli CFT073
gcacaaugccguaaccagcgca

SEQ ID NO: 600003 - RNA, 15 nt, Escherichia coli CFT073
gcacaaugccugaug

SEQ ID NO: 600004 - RNA, 17 nt, Escherichia coli CFT073
gcacaaugccugaugcg

SEQ ID NO: 600005 - RNA, 20 nt, Escherichia coli CFT073
gcacacaaaauugccgcuau

SEQ ID NO: 600006 - RNA, 17 nt, Escherichia coli CFT073
gcacacacuaccgccga

SEQ ID NO: 600007 - RNA, 23 nt, Escherichia coli CFT073
gcaauugcugccccucaacuugc

SEQ ID NO: 600008 - RNA, 17 nt, Escherichia coli CFT073
gcaauugcauuugaacu

SEQ ID NO: 600009 - RNA, 14 nt, Escherichia coli CFT073
gcacaauccgccag

SEQ ID NO: 600010 - RNA, 17 nt, Escherichia coli CFT073
gcaauuucuccgccgga

SEQ ID NO: 600011 - RNA, 21 nt, Escherichia coli CFT073
gcaaugcaaucaaauggcugg

SEQ ID NO: 600012 - RNA, 20 nt, Escherichia coli CFT073
gcaaugauaaguccgaugcc

SEQ ID NO: 600013 - RNA, 21 nt, Escherichia coli CFT073
gcaaugaagaaccgcaccagg

SEQ ID NO: 600014 - RNA, 23 nt, Escherichia coli CFT073
gcaaugaagaaccgcaccaggca

SEQ ID NO: 600015 - RNA, 22 nt, Escherichia coli CFT073
gcaaugagacgguuaaaaacag

SEQ ID NO: 600016 - RNA, 20 nt, Escherichia coli CFT073
gcaauucuucauuccaguca

SEQ ID NO: 600017 - RNA, 19 nt, Escherichia coli CFT073
gcaauuacaggugaaucuu

SEQ ID NO: 600018 - RNA, 21 nt, Escherichia coli CFT073
gcaauguuaccgaucgccagc

SEQ ID NO: 600019 - RNA, 15 nt, Escherichia coli CFT073
gcaauguuauccggc

SEQ ID NO: 600020 - RNA, 13 nt, Escherichia coli CFT073
gcaauuaaaaauu

SEQ ID NO: 600021 - RNA, 14 nt, Escherichia coli CFT073
gcaauuaaaaauuu

SEQ ID NO: 600022 - RNA, 16 nt, Escherichia coli CFT073
gcaauuaacagugaca

SEQ ID NO: 600023 - RNA, 16 nt, Escherichia coli CFT073
gcaacugauauuuaaa

SEQ ID NO: 600024 - RNA, 21 nt, Escherichia coli CFT073
gcaacugucccauuccagcca

SEQ ID NO: 600025 - RNA, 15 nt, Escherichia coli CFT073
gcaacuuaaucauca

SEQ ID NO: 600026 - RNA, 21 nt, Escherichia coli CFT073
gcaagaccaacacccacagcc

SEQ ID NO: 600027 - RNA, 21 nt, Escherichia coli CFT073
gcaagacgaaaaaugaauacc

SEQ ID NO: 600028 - RNA, 22 nt, Escherichia coli CFT073
gcaagagcaaauaaaacaucac

SEQ ID NO: 600029 - RNA, 15 nt, Escherichia coli CFT073
gcaagaguauuacga

SEQ ID NO: 600030 - RNA, 14 nt, Escherichia coli CFT073
gcaagcagccgaua

SEQ ID NO: 600031 - RNA, 14 nt, Escherichia coli CFT073
gcaagccaugacgc

SEQ ID NO: 600032 - RNA, 17 nt, Escherichia coli CFT073
gcaagccgcuaacagca

SEQ ID NO: 600033 - RNA, 19 nt, Escherichia coli CFT073
gcaagccgcuaacagcagc

SEQ ID NO: 600034 - RNA, 16 nt, Escherichia coli CFT073
gcaagcgucgcaucag

SEQ ID NO: 600035 - RNA, 23 nt, Escherichia coli CFT073
gcaagcgucgcgccauuggccug

SEQ ID NO: 600036 - RNA, 15 nt, Escherichia coli CFT073
gcaaggagagccagu

SEQ ID NO: 600037 - RNA, 19 nt, Escherichia coli CFT073
gcaaggcuauucagcaguu

SEQ ID NO: 600038 - RNA, 18 nt, Escherichia coli CFT073
gauuacgcucaccaaaac

SEQ ID NO: 600039 - RNA, 16 nt, Escherichia coli CFT073
gauuaccgccuucacc

SEQ ID NO: 600040 - RNA, 16 nt, Escherichia coli CFT073
gauuaccuaccaacgc

SEQ ID NO: 600041 - RNA, 12 nt, Escherichia coli CFT073
gauguugaagaa

SEQ ID NO: 600042 - RNA, 15 nt, Escherichia coli CFT073
gauuaucuucgcacu

SEQ ID NO: 600043 - RNA, 14 nt, Escherichia coli CFT073
gauuauuuauuccc

SEQ ID NO: 600044 - RNA, 18 nt, Escherichia coli CFT073
gauuaucuucaccgguag

SEQ ID NO: 600045 - RNA, 14 nt, Escherichia coli CFT073
gaugugcuccauca

SEQ ID NO: 600046 - RNA, 19 nt, Escherichia coli CFT073
gaugguggucgcaucaucc

SEQ ID NO: 600047 - RNA, 12 nt, Escherichia coli CFT073
gauucuccagca

SEQ ID NO: 600048 - RNA, 17 nt, Escherichia coli CFT073
gauucuggugagagcaa

SEQ ID NO: 600049 - RNA, 13 nt, Escherichia coli CFT073
gauuggcuucacu

SEQ ID NO: 600050 - RNA, 16 nt, Escherichia coli CFT073
gauuguagaaaaucuc

SEQ ID NO: 600051 - RNA, 13 nt, Escherichia coli CFT073
gauugugacaaac

SEQ ID NO: 600052 - RNA, 23 nt, Escherichia coli CFT073
gauucgaaccucggaaugccgga

SEQ ID NO: 600053 - RNA, 14 nt, Escherichia coli CFT073
gauucggauccagc

SEQ ID NO: 600054 - RNA, 13 nt, Escherichia coli CFT073
gcaacaacaccag

SEQ ID NO: 600055 - RNA, 22 nt, Escherichia coli CFT073
gcaacaacacgaucagacgcag

SEQ ID NO: 600056 - RNA, 13 nt, Escherichia coli CFT073
gcaacaacagcgc

SEQ ID NO: 600057 - RNA, 16 nt, Escherichia coli CFT073
gcaacaaccaccacac

SEQ ID NO: 600058 - RNA, 18 nt, Escherichia coli CFT073
gcaaauuuuccccagaug

SEQ ID NO: 600059 - RNA, 21 nt, Escherichia coli CFT073
gcaaaguagcugaaaaucaga

SEQ ID NO: 600060 - RNA, 13 nt, Escherichia coli CFT073
gcaaaguaggccg

SEQ ID NO: 600061 - RNA, 18 nt, Escherichia coli CFT073
gcaaaguggcgcagagcc

SEQ ID NO: 600062 - RNA, 18 nt, Escherichia coli CFT073
gcaaauacccaaaaaaua

SEQ ID NO: 600063 - RNA, 20 nt, Escherichia coli CFT073
gcaaauauugccccagcguu

SEQ ID NO: 600064 - RNA, 21 nt, Escherichia coli CFT073
gcaaagcugucaccaaucagg

SEQ ID NO: 600065 - RNA, 21 nt, Escherichia coli CFT073
gcaaagcgacgugcaguagca

SEQ ID NO: 600066 - RNA, 20 nt, Escherichia coli CFT073
gcaaagcccaucaccgccag

SEQ ID NO: 600067 - RNA, 14 nt, Escherichia coli CFT073
gcaaagaaacgcgc

SEQ ID NO: 600068 - RNA, 18 nt, Escherichia coli CFT073
gauuucgauccggcacgc

SEQ ID NO: 600069 - RNA, 17 nt, Escherichia coli CFT073
gauuuccaucuccagcu

SEQ ID NO: 600070 - RNA, 14 nt, Escherichia coli CFT073
gauuucaugaagcu

SEQ ID NO: 600071 - RNA, 17 nt, Escherichia coli CFT073
gauuuccuucagcagca

SEQ ID NO: 600072 - RNA, 23 nt, Escherichia coli CFT073
gauuucgccaucaagaacacaua

SEQ ID NO: 600073 - RNA, 11 nt, Escherichia coli CFT073
gcaaacugcug

SEQ ID NO: 600074 - RNA, 20 nt, Escherichia coli CFT073
gcaaacaucgacucaagcgu

SEQ ID NO: 600075 - RNA, 19 nt, Escherichia coli CFT073
gcaaacaucgggauaucgc

SEQ ID NO: 600076 - RNA, 18 nt, Escherichia coli CFT073
gcaaaccauacucacauc

SEQ ID NO: 600077 - RNA, 14 nt, Escherichia coli CFT073
gcaaaauggcguuu

SEQ ID NO: 600078 - RNA, 18 nt, Escherichia coli CFT073
gcaaaauugccggaugcg

SEQ ID NO: 600079 - RNA, 16 nt, Escherichia coli CFT073
gcaaacaaaaaaccua

SEQ ID NO: 600080 - RNA, 14 nt, Escherichia coli CFT073
gcaaacacgccgcc

SEQ ID NO: 600081 - RNA, 18 nt, Escherichia coli CFT073
gcaaacagucgcccgacc

SEQ ID NO: 600082 - RNA, 23 nt, Escherichia coli CFT073
gcaaacagucgcccgaccaucgc

SEQ ID NO: 600083 - RNA, 11 nt, Escherichia coli CFT073
gaugccugaug

SEQ ID NO: 600084 - RNA, 16 nt, Escherichia coli CFT073
gaugccguuaauaaua

SEQ ID NO: 600085 - RNA, 18 nt, Escherichia coli CFT073
gaugcgaguaaucaggcu

SEQ ID NO: 600086 - RNA, 21 nt, Escherichia coli CFT073
gaugccgcuuauccccagaau

SEQ ID NO: 600087 - RNA, 17 nt, Escherichia coli CFT073
gaugccggaugaguauu

SEQ ID NO: 600088 - RNA, 17 nt, Escherichia coli CFT073
gaugacccagcgccagc

SEQ ID NO: 600089 - RNA, 19 nt, Escherichia coli CFT073
gaugcggcauaaacgccuu

SEQ ID NO: 600090 - RNA, 20 nt, Escherichia coli CFT073
gaugcggcauaaacgccuua

SEQ ID NO: 600091 - RNA, 19 nt, Escherichia coli CFT073
gaugcggcaugaacgccug

SEQ ID NO: 600092 - RNA, 23 nt, Escherichia coli CFT073
gaugcggcaugugaugccgcauc

SEQ ID NO: 600093 - RNA, 22 nt, Escherichia coli CFT073
gaugcgccauaccaugcaccaa

SEQ ID NO: 600094 - RNA, 20 nt, Escherichia coli CFT073
gaugcgacgcaaacgccuua

SEQ ID NO: 600095 - RNA, 19 nt, Escherichia coli CFT073
gaugcgacgcgauccgccg

SEQ ID NO: 600096 - RNA, 15 nt, Escherichia coli CFT073
gaugcggcguaaacg

SEQ ID NO: 600097 - RNA, 20 nt, Escherichia coli CFT073
gaugcggcgugaacaccuua

SEQ ID NO: 600098 - RNA, 20 nt, Escherichia coli CFT073
gaugcggcguuaacgccuua

SEQ ID NO: 600099 - RNA, 16 nt, Escherichia coli CFT073
gaugcugccaucaucu

SEQ ID NO: 600100 - RNA, 22 nt, Escherichia coli CFT073
gaugcugauguacccgcugcaa

SEQ ID NO: 600101 - RNA, 19 nt, Escherichia coli CFT073
gaugcugcaauaaaauauc

SEQ ID NO: 600102 - RNA, 22 nt, Escherichia coli CFT073
gauggcacaugacuuccaacga

SEQ ID NO: 600103 - RNA, 11 nt, Escherichia coli CFT073
gauggcagagu

SEQ ID NO: 600104 - RNA, 23 nt, Escherichia coli CFT073
gauggcauaccauccggcauaaa

SEQ ID NO: 600105 - RNA, 18 nt, Escherichia coli CFT073
gauggccgggugauuuuu

SEQ ID NO: 600106 - RNA, 18 nt, Escherichia coli CFT073
gauggcgauacugccgcc

SEQ ID NO: 600107 - RNA, 16 nt, Escherichia coli CFT073
gauggcgauucagcaa

SEQ ID NO: 600108 - RNA, 22 nt, Escherichia coli CFT073
gauggcuguuuucagcaccaga

SEQ ID NO: 600109 - RNA, 20 nt, Escherichia coli CFT073
gauggcuuuccaccugcaac

SEQ ID NO: 600110 - RNA, 17 nt, Escherichia coli CFT073
gauggucauauccagca

SEQ ID NO: 600111 - RNA, 16 nt, Escherichia coli CFT073
gaugguauucaucgcg

SEQ ID NO: 600112 - RNA, 15 nt, Escherichia coli CFT073
cggcgaaagcgucag

SEQ ID NO: 600113 - RNA, 20 nt, Escherichia coli CFT073
cggcgaccaguucgcuuuga

SEQ ID NO: 600114 - RNA, 13 nt, Escherichia coli CFT073
cggcgaccagcgc

SEQ ID NO: 600115 - RNA, 17 nt, Escherichia coli CFT073
cggccguaagaaaguca

SEQ ID NO: 600116 - RNA, 15 nt, Escherichia coli CFT073
cggcgcaacauccgc

SEQ ID NO: 600117 - RNA, 14 nt, Escherichia coli CFT073
cggcgcacaaccgc

SEQ ID NO: 600118 - RNA, 14 nt, Escherichia coli CFT073
cggcgcaccagaau

SEQ ID NO: 600119 - RNA, 23 nt, Escherichia coli CFT073
cggcgccuuuuucaguuugcuga

SEQ ID NO: 600120 - RNA, 21 nt, Escherichia coli CFT073
cggcgcgauaguaaucaccgg

SEQ ID NO: 600121 - RNA, 13 nt, Escherichia coli CFT073
cggauucgaugcc

SEQ ID NO: 600122 - RNA, 14 nt, Escherichia coli CFT073
cggauuucccgaua

SEQ ID NO: 600123 - RNA, 19 nt, Escherichia coli CFT073
cggauuucccgauaaccuu

SEQ ID NO: 600124 - RNA, 19 nt, Escherichia coli CFT073
cggcaacaauuuccgcagc

SEQ ID NO: 600125 - RNA, 13 nt, Escherichia coli CFT073
cggcaaccacacc

SEQ ID NO: 600126 - RNA, 11 nt, Escherichia coli CFT073
cggcaaacugc

SEQ ID NO: 600127 - RNA, 19 nt, Escherichia coli CFT073
cggcaaacaguugcugaua

SEQ ID NO: 600128 - RNA, 22 nt, Escherichia coli CFT073
cggcaaaaucuuccagaaugcc

SEQ ID NO: 600129 - RNA, 18 nt, Escherichia coli CFT073
cggauuauucacuacugg

SEQ ID NO: 600130 - RNA, 14 nt, Escherichia coli CFT073
cggauuauccagcc

SEQ ID NO: 600131 - RNA, 21 nt, Escherichia coli CFT073
cggauuauccagccaggcguu

SEQ ID NO: 600132 - RNA, 12 nt, Escherichia coli CFT073
cggaugacuucg

SEQ ID NO: 600133 - RNA, 20 nt, Escherichia coli CFT073
cggauggcagaguaucgcca

SEQ ID NO: 600134 - RNA, 22 nt, Escherichia coli CFT073
cggauagccagcaucgcaucga

SEQ ID NO: 600135 - RNA, 14 nt, Escherichia coli CFT073
cggauagagcgcug

SEQ ID NO: 600136 - RNA, 19 nt, Escherichia coli CFT073
cggauaccccagcuggcgc

SEQ ID NO: 600137 - RNA, 17 nt, Escherichia coli CFT073
cggaucggaacgcgauu

SEQ ID NO: 600138 - RNA, 17 nt, Escherichia coli CFT073
cggaucgcgugcggcau

SEQ ID NO: 600139 - RNA, 16 nt, Escherichia coli CFT073
cggaucggcuggcggc

SEQ ID NO: 600140 - RNA, 18 nt, Escherichia coli CFT073
cggaguugaccagcucca

SEQ ID NO: 600141 - RNA, 22 nt, Escherichia coli CFT073
cggaguugaccagcuccagcag

SEQ ID NO: 600142 - RNA, 12 nt, Escherichia coli CFT073
cggaguaaagca

SEQ ID NO: 600143 - RNA, 15 nt, Escherichia coli CFT073
cggaauaucgcuggc

SEQ ID NO: 600144 - RNA, 15 nt, Escherichia coli CFT073
cggcaaccgcaacga

SEQ ID NO: 600145 - RNA, 18 nt, Escherichia coli CFT073
cggcaaccggaucgucaa

SEQ ID NO: 600146 - RNA, 16 nt, Escherichia coli CFT073
cggcacaggucgcccc

SEQ ID NO: 600147 - RNA, 21 nt, Escherichia coli CFT073
cggcacagucgcgacgcugac

SEQ ID NO: 600148 - RNA, 18 nt, Escherichia coli CFT073
cggcacauagacggugac

SEQ ID NO: 600149 - RNA, 16 nt, Escherichia coli CFT073
cggcaccaaucaccgc

SEQ ID NO: 600150 - RNA, 23 nt, Escherichia coli CFT073
cggcaauuuugcgccgauugccu

SEQ ID NO: 600151 - RNA, 14 nt, Escherichia coli CFT073
cggcacaaaucccc

SEQ ID NO: 600152 - RNA, 15 nt, Escherichia coli CFT073
cggcagcaaccgcuu

SEQ ID NO: 600153 - RNA, 18 nt, Escherichia coli CFT073
cggcagauugagcgucaa

SEQ ID NO: 600154 - RNA, 17 nt, Escherichia coli CFT073
cggcagagaaaccacau

SEQ ID NO: 600155 - RNA, 16 nt, Escherichia coli CFT073
cggcagauccaccaga

SEQ ID NO: 600156 - RNA, 21 nt, Escherichia coli CFT073
cggcacuguuucgccagguuu

SEQ ID NO: 600157 - RNA, 13 nt, Escherichia coli CFT073
cggcacuucaacu

SEQ ID NO: 600158 - RNA, 22 nt, Escherichia coli CFT073
cggcaucgcgguugcugucggc

SEQ ID NO: 600159 - RNA, 15 nt, Escherichia coli CFT073
cggcaucgcaaacca

SEQ ID NO: 600160 - RNA, 20 nt, Escherichia coli CFT073
cggcaugauguccugcggac

SEQ ID NO: 600161 - RNA, 15 nt, Escherichia coli CFT073
cggcaugaacgccug

SEQ ID NO: 600162 - RNA, 16 nt, Escherichia coli CFT073
cggcaucuucuucugg

SEQ ID NO: 600163 - RNA, 15 nt, Escherichia coli CFT073
cggcauuagcaucaa

SEQ ID NO: 600164 - RNA, 14 nt, Escherichia coli CFT073
cggccacagcgcca

SEQ ID NO: 600165 - RNA, 15 nt, Escherichia coli CFT073
cggccacagcgccag

SEQ ID NO: 600166 - RNA, 22 nt, Escherichia coli CFT073
cggccagcauugcgccagcgag

SEQ ID NO: 600167 - RNA, 18 nt, Escherichia coli CFT073
cggccagacaccggcuuu

SEQ ID NO: 600168 - RNA, 14 nt, Escherichia coli CFT073
cggccagcgccacc

SEQ ID NO: 600169 - RNA, 20 nt, Escherichia coli CFT073
cggccagcgccaccaccagu

SEQ ID NO: 600170 - RNA, 17 nt, Escherichia coli CFT073
cggccccauuuauuucu

SEQ ID NO: 600171 - RNA, 20 nt, Escherichia coli CFT073
cggcuugaggaagcgcgccg

SEQ ID NO: 600172 - RNA, 16 nt, Escherichia coli CFT073
cggcuuggacgcacau

SEQ ID NO: 600173 - RNA, 19 nt, Escherichia coli CFT073
cggcuucugacauagccac

SEQ ID NO: 600174 - RNA, 22 nt, Escherichia coli CFT073
cggcuucugccaguacugcagg

SEQ ID NO: 600175 - RNA, 18 nt, Escherichia coli CFT073
cggcugauaacaauauca

SEQ ID NO: 600176 - RNA, 23 nt, Escherichia coli CFT073
cggcugauaugccaggcuucauc

SEQ ID NO: 600177 - RNA, 13 nt, Escherichia coli CFT073
cggcugcaaaccc

SEQ ID NO: 600178 - RNA, 13 nt, Escherichia coli CFT073
cggcugacugcuu

SEQ ID NO: 600179 - RNA, 21 nt, Escherichia coli CFT073
cgggaacagugcucuuuguag

SEQ ID NO: 600180 - RNA, 18 nt, Escherichia coli CFT073
cgggaacagugcuuuuug

SEQ ID NO: 600181 - RNA, 16 nt, Escherichia coli CFT073
cgggaagauaucgugc

SEQ ID NO: 600182 - RNA, 13 nt, Escherichia coli CFT073
cgggaucgccgga

SEQ ID NO: 600183 - RNA, 17 nt, Escherichia coli CFT073
cgggaguucgaugguga

SEQ ID NO: 600184 - RNA, 14 nt, Escherichia coli CFT073
cgggagcgcuuuuu

SEQ ID NO: 600185 - RNA, 14 nt, Escherichia coli CFT073
cgggagaguaucca

SEQ ID NO: 600186 - RNA, 19 nt, Escherichia coli CFT073
cgggagaauugccaaccga

SEQ ID NO: 600187 - RNA, 21 nt, Escherichia coli CFT073
cgggauuucaaugcgcaagcu

SEQ ID NO: 600188 - RNA, 19 nt, Escherichia coli CFT073
cgggcaaagucaauaaaaa

SEQ ID NO: 600189 - RNA, 17 nt, Escherichia coli CFT073
cgggcaaccucuggugu

SEQ ID NO: 600190 - RNA, 18 nt, Escherichia coli CFT073
cgggauucuccugagaau

SEQ ID NO: 600191 - RNA, 13 nt, Escherichia coli CFT073
cgggauugccagc

SEQ ID NO: 600192 - RNA, 19 nt, Escherichia coli CFT073
cgggauuuuacuucccagu

SEQ ID NO: 600193 - RNA, 23 nt, Escherichia coli CFT073
cgggcaauaaucucaauauccgg

SEQ ID NO: 600194 - RNA, 16 nt, Escherichia coli CFT073
cgggccauccaucaac

SEQ ID NO: 600195 - RNA, 21 nt, Escherichia coli CFT073
cggcgcggcggguuaaccagc

SEQ ID NO: 600196 - RNA, 20 nt, Escherichia coli CFT073
cggcggcggugugacguuau

SEQ ID NO: 600197 - RNA, 20 nt, Escherichia coli CFT073
cggcggguuaaccagcacca

SEQ ID NO: 600198 - RNA, 20 nt, Escherichia coli CFT073
cggcucauaaaaacuccagu

SEQ ID NO: 600199 - RNA, 18 nt, Escherichia coli CFT073
cggcucauguagccgcuu

SEQ ID NO: 600200 - RNA, 11 nt, Escherichia coli CFT073
cggcguucacc

SEQ ID NO: 600201 - RNA, 16 nt, Escherichia coli CFT073
cggcgugguaagaaga

SEQ ID NO: 600202 - RNA, 22 nt, Escherichia coli CFT073
cggcgugcuucgcgcguucaau

SEQ ID NO: 600203 - RNA, 21 nt, Escherichia coli CFT073
cggcgugccggaugcaaacga

SEQ ID NO: 600204 - RNA, 19 nt, Escherichia coli CFT073
cggcgucuaaucgcuuuau

SEQ ID NO: 600205 - RNA, 18 nt, Escherichia coli CFT073
cggcguaugaccggcguu

SEQ ID NO: 600206 - RNA, 13 nt, Escherichia coli CFT073
cgggcuucucgcu

SEQ ID NO: 600207 - RNA, 15 nt, Escherichia coli CFT073
cgggcuuccggcaau

SEQ ID NO: 600208 - RNA, 20 nt, Escherichia coli CFT073
cgggcugggaucugauuuuc

SEQ ID NO: 600209 - RNA, 23 nt, Escherichia coli CFT073
cgggcuaacacccgucguugcaa

SEQ ID NO: 600210 - RNA, 13 nt, Escherichia coli CFT073
cggggcuuuucuc

SEQ ID NO: 600211 - RNA, 14 nt, Escherichia coli CFT073
cgggggcgaccugu

SEQ ID NO: 600212 - RNA, 20 nt, Escherichia coli CFT073
cggggagaaugccagcagca

SEQ ID NO: 600213 - RNA, 21 nt, Escherichia coli CFT073
cggggagagucauuaugcugg

SEQ ID NO: 600214 - RNA, 22 nt, Escherichia coli CFT073
cggggagauguaauaacgcuua

SEQ ID NO: 600215 - RNA, 19 nt, Escherichia coli CFT073
cggguuuucuccaaccagc

SEQ ID NO: 600216 - RNA, 13 nt, Escherichia coli CFT073
cggguuuucucgc

SEQ ID NO: 600217 - RNA, 14 nt, Escherichia coli CFT073
cgguaaaaucaucc

SEQ ID NO: 600218 - RNA, 22 nt, Escherichia coli CFT073
cgguaaacaaaaacagcgccga

SEQ ID NO: 600219 - RNA, 14 nt, Escherichia coli CFT073
cgguaaucgcccgg

SEQ ID NO: 600220 - RNA, 21 nt, Escherichia coli CFT073
cgguaaucuguugagcgccgu

SEQ ID NO: 600221 - RNA, 13 nt, Escherichia coli CFT073
cgguaaugcgcgc

SEQ ID NO: 600222 - RNA, 14 nt, Escherichia coli CFT073
cgguacacaaccgc

SEQ ID NO: 600223 - RNA, 16 nt, Escherichia coli CFT073
cgguaauuccggcguu

SEQ ID NO: 600224 - RNA, 15 nt, Escherichia coli CFT073
cgguaacggaccgca

SEQ ID NO: 600225 - RNA, 15 nt, Escherichia coli CFT073
cggguggccagcaac

SEQ ID NO: 600226 - RNA, 23 nt, Escherichia coli CFT073
cggguggaucauuuucaugcugu

SEQ ID NO: 600227 - RNA, 13 nt, Escherichia coli CFT073
cgggucguaauaa

SEQ ID NO: 600228 - RNA, 15 nt, Escherichia coli CFT073
cgggucguaauaauu

SEQ ID NO: 600229 - RNA, 18 nt, Escherichia coli CFT073
cgggucgcaaacaacgcc

SEQ ID NO: 600230 - RNA, 14 nt, Escherichia coli CFT073
cgggucacugcggu

SEQ ID NO: 600231 - RNA, 13 nt, Escherichia coli CFT073
cggucauggucac

SEQ ID NO: 600232 - RNA, 15 nt, Escherichia coli CFT073
cgguccacuuccugc

SEQ ID NO: 600233 - RNA, 19 nt, Escherichia coli CFT073
cgguccacuuccugcgcca

SEQ ID NO: 600234 - RNA, 19 nt, Escherichia coli CFT073
cgguccgccauuuccagcg

SEQ ID NO: 600235 - RNA, 13 nt, Escherichia coli CFT073
cggucccuucugc

SEQ ID NO: 600236 - RNA, 16 nt, Escherichia coli CFT073
cggucaugauggcgau

SEQ ID NO: 600237 - RNA, 14 nt, Escherichia coli CFT073
cggucauaaaauca

SEQ ID NO: 600238 - RNA, 22 nt, Escherichia coli CFT073
cggucaucccuaacagcguggu

SEQ ID NO: 600239 - RNA, 14 nt, Escherichia coli CFT073
cggucagcgcaaug

SEQ ID NO: 600240 - RNA, 12 nt, Escherichia coli CFT073
cggucagcagca

SEQ ID NO: 600241 - RNA, 13 nt, Escherichia coli CFT073
cgguagcugguga

SEQ ID NO: 600242 - RNA, 13 nt, Escherichia coli CFT073
cggucgcuucgcg

SEQ ID NO: 600243 - RNA, 14 nt, Escherichia coli CFT073
cggucggugcaccu

SEQ ID NO: 600244 - RNA, 17 nt, Escherichia coli CFT073
cggucggggccagcgca

SEQ ID NO: 600245 - RNA, 22 nt, Escherichia coli CFT073
cgccuauuauccggcaaccacc

SEQ ID NO: 600246 - RNA, 24 nt, Escherichia coli CFT073
cgccguuaacacggugccaguacg

SEQ ID NO: 600247 - RNA, 16 nt, Escherichia coli CFT073
cgccguucccagcgga

SEQ ID NO: 600248 - RNA, 20 nt, Escherichia coli CFT073
cgccucaagaaucacuucau

SEQ ID NO: 600249 - RNA, 19 nt, Escherichia coli CFT073
cgccucagccgaaacacac

SEQ ID NO: 600250 - RNA, 19 nt, Escherichia coli CFT073
cgccucaccgccauuugca

SEQ ID NO: 600251 - RNA, 17 nt, Escherichia coli CFT073
cgccugaccauuaucaa

SEQ ID NO: 600252 - RNA, 18 nt, Escherichia coli CFT073
cgccugcgccaccacaac

SEQ ID NO: 600253 - RNA, 20 nt, Escherichia coli CFT073
cgccgguaauuccagcgguu

SEQ ID NO: 600254 - RNA, 16 nt, Escherichia coli CFT073
cgccggguuuauguga

SEQ ID NO: 600255 - RNA, 23 nt, Escherichia coli CFT073
cgccgggauauaugucaccagca

SEQ ID NO: 600256 - RNA, 17 nt, Escherichia coli CFT073
cgccguauacgcuucgg

SEQ ID NO: 600257 - RNA, 20 nt, Escherichia coli CFT073
cgccguauccgacguuacgc

SEQ ID NO: 600258 - RNA, 20 nt, Escherichia coli CFT073
cgccggugagcacaucagcg

SEQ ID NO: 600259 - RNA, 15 nt, Escherichia coli CFT073
cgcgaccgucuuuau

SEQ ID NO: 600260 - RNA, 22 nt, Escherichia coli CFT073
cgcgacaucgucuccagcgaau

SEQ ID NO: 600261 - RNA, 14 nt, Escherichia coli CFT073
cgcgagaacugaac

SEQ ID NO: 600262 - RNA, 14 nt, Escherichia coli CFT073
cgcgacucccugac

SEQ ID NO: 600263 - RNA, 15 nt, Escherichia coli CFT073
cgcgacggugcggcu

SEQ ID NO: 600264 - RNA, 22 nt, Escherichia coli CFT073
cgcgacgguugcggaacccagc

SEQ ID NO: 600265 - RNA, 15 nt, Escherichia coli CFT073
cgcgaaacugcgugg

SEQ ID NO: 600266 - RNA, 15 nt, Escherichia coli CFT073
cgccuuuucgcccgu

SEQ ID NO: 600267 - RNA, 21 nt, Escherichia coli CFT073
cgccuuuuugcgcgaagaaac

SEQ ID NO: 600268 - RNA, 17 nt, Escherichia coli CFT073
cgcgaaaacaucguuga

SEQ ID NO: 600269 - RNA, 13 nt, Escherichia coli CFT073
cgccuuugaugcc

SEQ ID NO: 600270 - RNA, 19 nt, Escherichia coli CFT073
cgccuuguucgcccugcag

SEQ ID NO: 600271 - RNA, 17 nt, Escherichia coli CFT073
cgccuuucacgccggga

SEQ ID NO: 600272 - RNA, 22 nt, Escherichia coli CFT073
cgccugcuucuacgcagguuaa

SEQ ID NO: 600273 - RNA, 23 nt, Escherichia coli CFT073
cgcgaaugggugaacccggcgau

SEQ ID NO: 600274 - RNA, 21 nt, Escherichia coli CFT073
cgcgaaucgccguuccggcgg

SEQ ID NO: 600275 - RNA, 15 nt, Escherichia coli CFT073
cgcgagcaaaaucgu

SEQ ID NO: 600276 - RNA, 17 nt, Escherichia coli CFT073
cgcgauaaucccaacgc

SEQ ID NO: 600277 - RNA, 14 nt, Escherichia coli CFT073
cgcgauacgcuuca

SEQ ID NO: 600278 - RNA, 21 nt, Escherichia coli CFT073
cgcgauacucuuuuggcguug

SEQ ID NO: 600279 - RNA, 13 nt, Escherichia coli CFT073
cgcgauaggccuu

SEQ ID NO: 600280 - RNA, 22 nt, Escherichia coli CFT073
cgcgauauuccgcaacgccgcc

SEQ ID NO: 600281 - RNA, 17 nt, Escherichia coli CFT073
cgcgaguucgagucucg

SEQ ID NO: 600282 - RNA, 15 nt, Escherichia coli CFT073
cgcgauaacgcccca

SEQ ID NO: 600283 - RNA, 22 nt, Escherichia coli CFT073
cgcgaucauuaacaccacgcca

SEQ ID NO: 600284 - RNA, 15 nt, Escherichia coli CFT073
cgcgauccagcgcaa

SEQ ID NO: 600285 - RNA, 21 nt, Escherichia coli CFT073
cgcgaugcuacuaugauuuuc

SEQ ID NO: 600286 - RNA, 19 nt, Escherichia coli CFT073
cgccaugccaacgcggccc

SEQ ID NO: 600287 - RNA, 15 nt, Escherichia coli CFT073
cgccccggcgauccc

SEQ ID NO: 600288 - RNA, 18 nt, Escherichia coli CFT073
cgccccggaagccagacg

SEQ ID NO: 600289 - RNA, 19 nt, Escherichia coli CFT073
cgcccgauagcgaaaguca

SEQ ID NO: 600290 - RNA, 21 nt, Escherichia coli CFT073
cgcccgagccgguugccugau

SEQ ID NO: 600291 - RNA, 14 nt, Escherichia coli CFT073
cgcccgccgccauu

SEQ ID NO: 600292 - RNA, 13 nt, Escherichia coli CFT073
cgcccgccgagaa

SEQ ID NO: 600293 - RNA, 23 nt, Escherichia coli CFT073
cgcccgccgagaaauaucagcag

SEQ ID NO: 600294 - RNA, 23 nt, Escherichia coli CFT073
cgcccgcaacuuuaccgcaaucg

SEQ ID NO: 600295 - RNA, 17 nt, Escherichia coli CFT073
cgcccgucauaccgucg

SEQ ID NO: 600296 - RNA, 20 nt, Escherichia coli CFT073
cgcccucgauaugccagacu

SEQ ID NO: 600297 - RNA, 17 nt, Escherichia coli CFT073
cgcccggcaccagcacc

SEQ ID NO: 600298 - RNA, 14 nt, Escherichia coli CFT073
cgcccgcuuuuugg

SEQ ID NO: 600299 - RNA, 14 nt, Escherichia coli CFT073
cgccgauaaucaac

SEQ ID NO: 600300 - RNA, 22 nt, Escherichia coli CFT073
cgccgauaaucaacgcgccgcc

SEQ ID NO: 600301 - RNA, 17 nt, Escherichia coli CFT073
cgccgaggaaacauuug

SEQ ID NO: 600302 - RNA, 17 nt, Escherichia coli CFT073
cgccgagaucaacagca

SEQ ID NO: 600303 - RNA, 17 nt, Escherichia coli CFT073
cgcccuuaccauuccca

SEQ ID NO: 600304 - RNA, 19 nt, Escherichia coli CFT073
cgcccugauaaaucaccug

SEQ ID NO: 600305 - RNA, 21 nt, Escherichia coli CFT073
cgccgcauuauggugaagaag

SEQ ID NO: 600306 - RNA, 13 nt, Escherichia coli CFT073
cgccgcauugccc

SEQ ID NO: 600307 - RNA, 17 nt, Escherichia coli CFT073
cgccgcauugcccaaua

SEQ ID NO: 600308 - RNA, 16 nt, Escherichia coli CFT073
cgccgcauaucaucaa

SEQ ID NO: 600309 - RNA, 23 nt, Escherichia coli CFT073
cgccgcauauuccaccacuucau

SEQ ID NO: 600310 - RNA, 21 nt, Escherichia coli CFT073
cgccgcaucaggccgccagca

SEQ ID NO: 600311 - RNA, 19 nt, Escherichia coli CFT073
cgccgcauccggcaacagu

SEQ ID NO: 600312 - RNA, 19 nt, Escherichia coli CFT073
cgccgcagguagcagcagc

SEQ ID NO: 600313 - RNA, 20 nt, Escherichia coli CFT073
cgccgcagguagcagcagcg

SEQ ID NO: 600314 - RNA, 20 nt, Escherichia coli CFT073
cgccgauaaaggucgacagu

SEQ ID NO: 600315 - RNA, 19 nt, Escherichia coli CFT073
cgccgauacgcauaaacau

SEQ ID NO: 600316 - RNA, 17 nt, Escherichia coli CFT073
cgccgauaucgcuggca

SEQ ID NO: 600317 - RNA, 17 nt, Escherichia coli CFT073
cgccgcccacaacagca

SEQ ID NO: 600318 - RNA, 21 nt, Escherichia coli CFT073
cgccgccauaaacagcaggca

SEQ ID NO: 600319 - RNA, 16 nt, Escherichia coli CFT073
cgccgccaaacgcggu

SEQ ID NO: 600320 - RNA, 13 nt, Escherichia coli CFT073
cgccgccaacgug

SEQ ID NO: 600321 - RNA, 20 nt, Escherichia coli CFT073
cgccgcugucuaccagcacc

SEQ ID NO: 600322 - RNA, 13 nt, Escherichia coli CFT073
cgccgcucaccug

SEQ ID NO: 600323 - RNA, 15 nt, Escherichia coli CFT073
cgccgcucaccugac

SEQ ID NO: 600324 - RNA, 16 nt, Escherichia coli CFT073
cgccgcuaucgcugau

SEQ ID NO: 600325 - RNA, 14 nt, Escherichia coli CFT073
cgccgcggcgcagc

SEQ ID NO: 600326 - RNA, 15 nt, Escherichia coli CFT073
cgcuuaacaguucca

SEQ ID NO: 600327 - RNA, 16 nt, Escherichia coli CFT073
cgcuuaaccggcuucg

SEQ ID NO: 600328 - RNA, 17 nt, Escherichia coli CFT073
cgcuguuuguucaucau

SEQ ID NO: 600329 - RNA, 19 nt, Escherichia coli CFT073
cgcuuagagcccaugcguu

SEQ ID NO: 600330 - RNA, 19 nt, Escherichia coli CFT073
cgcuuacucuucguucuuc

SEQ ID NO: 600331 - RNA, 16 nt, Escherichia coli CFT073
cgcuuaucaggcauug

SEQ ID NO: 600332 - RNA, 16 nt, Escherichia coli CFT073
cgcuguugccagcagc

SEQ ID NO: 600333 - RNA, 16 nt, Escherichia coli CFT073
cgcuguucugauuuug

SEQ ID NO: 600334 - RNA, 19 nt, Escherichia coli CFT073
cgcugugcguaaucgccga

SEQ ID NO: 600335 - RNA, 19 nt, Escherichia coli CFT073
cgcugucuuuugaucaaau

SEQ ID NO: 600336 - RNA, 17 nt, Escherichia coli CFT073
cgcuucgccaaucagaa

SEQ ID NO: 600337 - RNA, 16 nt, Escherichia coli CFT073
cgcuuccuccaccacu

SEQ ID NO: 600338 - RNA, 18 nt, Escherichia coli CFT073
cgcuucauuuacaucacg

SEQ ID NO: 600339 - RNA, 23 nt, Escherichia coli CFT073
cgcuuccaguuccauccaccagc

SEQ ID NO: 600340 - RNA, 16 nt, Escherichia coli CFT073
cgcuuccauauuggcg

SEQ ID NO: 600341 - RNA, 14 nt, Escherichia coli CFT073
cgcuuaucgcccug

SEQ ID NO: 600342 - RNA, 14 nt, Escherichia coli CFT073
cgcuucaacagcgg

SEQ ID NO: 600343 - RNA, 14 nt, Escherichia coli CFT073
cgcuucacugccgg

SEQ ID NO: 600344 - RNA, 16 nt, Escherichia coli CFT073
cgcuucauagccguug

SEQ ID NO: 600345 - RNA, 17 nt, Escherichia coli CFT073
cgcugucauucauucag

SEQ ID NO: 600346 - RNA, 22 nt, Escherichia coli CFT073
cgcugucuacaaccgggcgcag

SEQ ID NO: 600347 - RNA, 20 nt, Escherichia coli CFT073
cgcugucgcgucuuaucaug

SEQ ID NO: 600348 - RNA, 12 nt, Escherichia coli CFT073
cgcugucggcaa

SEQ ID NO: 600349 - RNA, 17 nt, Escherichia coli CFT073
cgcugguaacaucaaua

SEQ ID NO: 600350 - RNA, 14 nt, Escherichia coli CFT073
cgcugguacgcgca

SEQ ID NO: 600351 - RNA, 13 nt, Escherichia coli CFT073
cgcuggcgcgaau

SEQ ID NO: 600352 - RNA, 20 nt, Escherichia coli CFT073
cggaaauuaccgcaccacca

SEQ ID NO: 600353 - RNA, 15 nt, Escherichia coli CFT073
cggaaaucuccagau

SEQ ID NO: 600354 - RNA, 13 nt, Escherichia coli CFT073
cggaaccaccaga

SEQ ID NO: 600355 - RNA, 14 nt, Escherichia coli CFT073
cggaaaagcaacaa

SEQ ID NO: 600356 - RNA, 23 nt, Escherichia coli CFT073
cggaaaagguuaaaccgccaguc

SEQ ID NO: 600357 - RNA, 23 nt, Escherichia coli CFT073
cggaaaaguuuauuacucagcgc

SEQ ID NO: 600358 - RNA, 15 nt, Escherichia coli CFT073
cggaaaaaucaaaaa

SEQ ID NO: 600359 - RNA, 15 nt, Escherichia coli CFT073
cggaaaccagcggca

SEQ ID NO: 600360 - RNA, 23 nt, Escherichia coli CFT073
cggaaauaucggcgucguuguac

SEQ ID NO: 600361 - RNA, 17 nt, Escherichia coli CFT073
cggaacucgcugcgcgg

SEQ ID NO: 600362 - RNA, 15 nt, Escherichia coli CFT073
cggaagccaccacgc

SEQ ID NO: 600363 - RNA, 16 nt, Escherichia coli CFT073
cggaacgggagaaacc

SEQ ID NO: 600364 - RNA, 20 nt, Escherichia coli CFT073
cggaacgguaggccggauaa

SEQ ID NO: 600365 - RNA, 13 nt, Escherichia coli CFT073
cggaacgccgcug

SEQ ID NO: 600366 - RNA, 23 nt, Escherichia coli CFT073
cggaagcuuaucacagaggaaga

SEQ ID NO: 600367 - RNA, 20 nt, Escherichia coli CFT073
cggaaggugagggggcgaua

SEQ ID NO: 600368 - RNA, 23 nt, Escherichia coli CFT073
cggaauagaaccuaagaaccaga

SEQ ID NO: 600369 - RNA, 13 nt, Escherichia coli CFT073
cggaauaauaaug

SEQ ID NO: 600370 - RNA, 18 nt, Escherichia coli CFT073
cggaauaaaaagcgauau

SEQ ID NO: 600371 - RNA, 15 nt, Escherichia coli CFT073
cgcuuugugcucuuc

SEQ ID NO: 600372 - RNA, 16 nt, Escherichia coli CFT073
cgcuuuuacugcacuc

SEQ ID NO: 600373 - RNA, 22 nt, Escherichia coli CFT073
cgcuuuugggaucgccaucaca

SEQ ID NO: 600374 - RNA, 15 nt, Escherichia coli CFT073
cgcuuuuuccugccg

SEQ ID NO: 600375 - RNA, 20 nt, Escherichia coli CFT073
cgcuuuuuuacgccugcaau

SEQ ID NO: 600376 - RNA, 17 nt, Escherichia coli CFT073
cgcuuuuuucagcgcca

SEQ ID NO: 600377 - RNA, 21 nt, Escherichia coli CFT073
cgcuuuuuucagcgccagcuu

SEQ ID NO: 600378 - RNA, 17 nt, Escherichia coli CFT073
cgcuuugauccgccaga

SEQ ID NO: 600379 - RNA, 13 nt, Escherichia coli CFT073
cgcuuugauggca

SEQ ID NO: 600380 - RNA, 12 nt, Escherichia coli CFT073
cgcuuugcugau

SEQ ID NO: 600381 - RNA, 13 nt, Escherichia coli CFT073
cgcuuucgcgaau

SEQ ID NO: 600382 - RNA, 20 nt, Escherichia coli CFT073
cgcuuuaaacggcugggaaa

SEQ ID NO: 600383 - RNA, 16 nt, Escherichia coli CFT073
cgcuuuaacgcccuga

SEQ ID NO: 600384 - RNA, 22 nt, Escherichia coli CFT073
cgcuuuauagguggcaaagaaa

SEQ ID NO: 600385 - RNA, 14 nt, Escherichia coli CFT073
cgcuuuauccagca

SEQ ID NO: 600386 - RNA, 22 nt, Escherichia coli CFT073
cgcuuuaucgcccaccagcgac

SEQ ID NO: 600387 - RNA, 16 nt, Escherichia coli CFT073
cgcuuucagcacgaca

SEQ ID NO: 600388 - RNA, 20 nt, Escherichia coli CFT073
cgcuucuucagccugcacga

SEQ ID NO: 600389 - RNA, 16 nt, Escherichia coli CFT073
cgcuugaucuuccuga

SEQ ID NO: 600390 - RNA, 15 nt, Escherichia coli CFT073
cgcuugcugcgaucc

SEQ ID NO: 600391 - RNA, 19 nt, Escherichia coli CFT073
cgcuugcgcggcagcuuca

SEQ ID NO: 600392 - RNA, 15 nt, Escherichia coli CFT073
cgcuugcguaucggg

SEQ ID NO: 600393 - RNA, 22 nt, Escherichia coli CFT073
cgcuugcaggaucagcuccggc

SEQ ID NO: 600394 - RNA, 23 nt, Escherichia coli CFT073
cgcuugcaggaucagcuccggca

SEQ ID NO: 600395 - RNA, 22 nt, Escherichia coli CFT073
cgcuugcgggcuggcggggccg

SEQ ID NO: 600396 - RNA, 15 nt, Escherichia coli CFT073
cgcuaaccuguuuuc

SEQ ID NO: 600397 - RNA, 17 nt, Escherichia coli CFT073
cgcuaauuucagcaucg

SEQ ID NO: 600398 - RNA, 14 nt, Escherichia coli CFT073
cgcuaacuuccugc

SEQ ID NO: 600399 - RNA, 21 nt, Escherichia coli CFT073
cgcuaagauaccccagcgcaa

SEQ ID NO: 600400 - RNA, 17 nt, Escherichia coli CFT073
cgcuaaauccgccgcca

SEQ ID NO: 600401 - RNA, 19 nt, Escherichia coli CFT073
cgcguucgauagcgcgcca

SEQ ID NO: 600402 - RNA, 14 nt, Escherichia coli CFT073
cgcgugcugcgauu

SEQ ID NO: 600403 - RNA, 12 nt, Escherichia coli CFT073
cgcgugcuggga

SEQ ID NO: 600404 - RNA, 21 nt, Escherichia coli CFT073
cgcggugguguagaacaccuc

SEQ ID NO: 600405 - RNA, 14 nt, Escherichia coli CFT073
cgcuauccugguua

SEQ ID NO: 600406 - RNA, 19 nt, Escherichia coli CFT073
cgcuaguucucgggcggca

SEQ ID NO: 600407 - RNA, 14 nt, Escherichia coli CFT073
cgcuaguuucgugc

SEQ ID NO: 600408 - RNA, 18 nt, Escherichia coli CFT073
cgcuaguuucgugcccgc

SEQ ID NO: 600409 - RNA, 14 nt, Escherichia coli CFT073
cgcuaucaaacuga

SEQ ID NO: 600410 - RNA, 14 nt, Escherichia coli CFT073
cgcuaucagcgcca

SEQ ID NO: 600411 - RNA, 18 nt, Escherichia coli CFT073
cgcuacgccuuccgucag

SEQ ID NO: 600412 - RNA, 13 nt, Escherichia coli CFT073
cgcuacgacguuc

SEQ ID NO: 600413 - RNA, 15 nt, Escherichia coli CFT073
cgcuacggcguuuca

SEQ ID NO: 600414 - RNA, 14 nt, Escherichia coli CFT073
cgcucacugcacga

SEQ ID NO: 600415 - RNA, 17 nt, Escherichia coli CFT073
cgcucacgauucgguuc

SEQ ID NO: 600416 - RNA, 22 nt, Escherichia coli CFT073
cgcuauuacgaugaacaugcag

SEQ ID NO: 600417 - RNA, 19 nt, Escherichia coli CFT073
cgcuauugaccagcgccgc

SEQ ID NO: 600418 - RNA, 23 nt, Escherichia coli CFT073
cgcucucgccgcgcuccaucaug

SEQ ID NO: 600419 - RNA, 14 nt, Escherichia coli CFT073
cgcucucgccgcgc

SEQ ID NO: 600420 - RNA, 19 nt, Escherichia coli CFT073
cgcucucgccgcgcuccau

SEQ ID NO: 600421 - RNA, 15 nt, Escherichia coli CFT073
cgcucuacugucuca

SEQ ID NO: 600422 - RNA, 16 nt, Escherichia coli CFT073
cgcugaauaucuuucu

SEQ ID NO: 600423 - RNA, 19 nt, Escherichia coli CFT073
cgcugaauaauccccacau

SEQ ID NO: 600424 - RNA, 17 nt, Escherichia coli CFT073
cgcucaggugacggaaa

SEQ ID NO: 600425 - RNA, 23 nt, Escherichia coli CFT073
cgcugaccgcuuuguccgucgac

SEQ ID NO: 600426 - RNA, 13 nt, Escherichia coli CFT073
cgcugauugcugg

SEQ ID NO: 600427 - RNA, 22 nt, Escherichia coli CFT073
cgcugcaacacuuccgcuucca

SEQ ID NO: 600428 - RNA, 23 nt, Escherichia coli CFT073
cgcugcaaggcaacgcagcccca

SEQ ID NO: 600429 - RNA, 23 nt, Escherichia coli CFT073
cgcugauucuucccacgcgguua

SEQ ID NO: 600430 - RNA, 18 nt, Escherichia coli CFT073
cgcugauugccccuccgc

SEQ ID NO: 600431 - RNA, 20 nt, Escherichia coli CFT073
cgcugauugccccuccgcac

SEQ ID NO: 600432 - RNA, 18 nt, Escherichia coli CFT073
cgcugaggaucgggcagu

SEQ ID NO: 600433 - RNA, 21 nt, Escherichia coli CFT073
cgcgcggguggugcgcaccag

SEQ ID NO: 600434 - RNA, 14 nt, Escherichia coli CFT073
cgcgcgccaguuca

SEQ ID NO: 600435 - RNA, 16 nt, Escherichia coli CFT073
cgcgcucaauguugcu

SEQ ID NO: 600436 - RNA, 16 nt, Escherichia coli CFT073
cgcgcucacaccacaa

SEQ ID NO: 600437 - RNA, 23 nt, Escherichia coli CFT073
cgcgcucguagguuucugccagc

SEQ ID NO: 600438 - RNA, 15 nt, Escherichia coli CFT073
cgcgcuaacggagaa

SEQ ID NO: 600439 - RNA, 22 nt, Escherichia coli CFT073
cgcgcuaccacuucccaacgcu

SEQ ID NO: 600440 - RNA, 13 nt, Escherichia coli CFT073
cgcgcgugccgga

SEQ ID NO: 600441 - RNA, 14 nt, Escherichia coli CFT073
cgcgcgugccggaa

SEQ ID NO: 600442 - RNA, 19 nt, Escherichia coli CFT073
cgcgcguuaacucccgcgc

SEQ ID NO: 600443 - RNA, 14 nt, Escherichia coli CFT073
cgcggauaucuuuc

SEQ ID NO: 600444 - RNA, 17 nt, Escherichia coli CFT073
cgcggacaauaauaucu

SEQ ID NO: 600445 - RNA, 21 nt, Escherichia coli CFT073
cgcggacaauaauaucuuucu

SEQ ID NO: 600446 - RNA, 16 nt, Escherichia coli CFT073
cgcgccuucgugcggc

SEQ ID NO: 600447 - RNA, 16 nt, Escherichia coli CFT073
cgcgccuuaaaaacca

SEQ ID NO: 600448 - RNA, 16 nt, Escherichia coli CFT073
cgcgccgacugcgcca

SEQ ID NO: 600449 - RNA, 15 nt, Escherichia coli CFT073
cgcgcccgcguuccu

SEQ ID NO: 600450 - RNA, 20 nt, Escherichia coli CFT073
cgcgguacguuuuccagguu

SEQ ID NO: 600451 - RNA, 16 nt, Escherichia coli CFT073
cgcggguugccacguu

SEQ ID NO: 600452 - RNA, 16 nt, Escherichia coli CFT073
cgcgguaaaagcccau

SEQ ID NO: 600453 - RNA, 18 nt, Escherichia coli CFT073
cgcgguaaaagcccauca

SEQ ID NO: 600454 - RNA, 22 nt, Escherichia coli CFT073
cgcggcuccagaauauugccga

SEQ ID NO: 600455 - RNA, 14 nt, Escherichia coli CFT073
cgcggcgaucugca

SEQ ID NO: 600456 - RNA, 21 nt, Escherichia coli CFT073
cgaacgacauccgccagcgcc

SEQ ID NO: 600457 - RNA, 12 nt, Escherichia coli CFT073
cgaacgccacga

SEQ ID NO: 600458 - RNA, 16 nt, Escherichia coli CFT073
cgaagauauucaucag

SEQ ID NO: 600459 - RNA, 13 nt, Escherichia coli CFT073
cgaagaucaccac

SEQ ID NO: 600460 - RNA, 17 nt, Escherichia coli CFT073
cgaagagaucgauguuu

SEQ ID NO: 600461 - RNA, 16 nt, Escherichia coli CFT073
cgaacacgaaucaggc

SEQ ID NO: 600462 - RNA, 17 nt, Escherichia coli CFT073
cgaacagcgucgcauca

SEQ ID NO: 600463 - RNA, 20 nt, Escherichia coli CFT073
cgaacagcgucgcaucaggc

SEQ ID NO: 600464 - RNA, 22 nt, Escherichia coli CFT073
cgaacagcucaacgccgcuauc

SEQ ID NO: 600465 - RNA, 18 nt, Escherichia coli CFT073
cgaacauuaagaggcauu

SEQ ID NO: 600466 - RNA, 16 nt, Escherichia coli CFT073
cgaacaugccgccaac

SEQ ID NO: 600467 - RNA, 23 nt, Escherichia coli CFT073
cgaacauucccgguuucaggaug

SEQ ID NO: 600468 - RNA, 23 nt, Escherichia coli CFT073
cgaacagucgcugaucaccguag

SEQ ID NO: 600469 - RNA, 23 nt, Escherichia coli CFT073
cgaaccaugucaucaauugcgca

SEQ ID NO: 600470 - RNA, 14 nt, Escherichia coli CFT073
ccuguggaucgcgg

SEQ ID NO: 600471 - RNA, 22 nt, Escherichia coli CFT073
ccuguuaauucucccugcgacg

SEQ ID NO: 600472 - RNA, 17 nt, Escherichia coli CFT073
ccuggcaccaguggucu

SEQ ID NO: 600473 - RNA, 15 nt, Escherichia coli CFT073
ccuuccagcuucgcu

SEQ ID NO: 600474 - RNA, 16 nt, Escherichia coli CFT073
ccuuaugcccggcacg

SEQ ID NO: 600475 - RNA, 13 nt, Escherichia coli CFT073
ccuuauccggccu

SEQ ID NO: 600476 - RNA, 13 nt, Escherichia coli CFT073
ccuuaccaaccgc

SEQ ID NO: 600477 - RNA, 15 nt, Escherichia coli CFT073
ccuguugccugcacu

SEQ ID NO: 600478 - RNA, 16 nt, Escherichia coli CFT073
ccuguugcguuaagcc

SEQ ID NO: 600479 - RNA, 23 nt, Escherichia coli CFT073
ccuguuucacuucgucagaaaug

SEQ ID NO: 600480 - RNA, 16 nt, Escherichia coli CFT073
ccuguuucucauugac

SEQ ID NO: 600481 - RNA, 13 nt, Escherichia coli CFT073
ccuuaacgcaaaa

SEQ ID NO: 600482 - RNA, 20 nt, Escherichia coli CFT073
ccuuaauaccggcauccaga

SEQ ID NO: 600483 - RNA, 13 nt, Escherichia coli CFT073
ccuucuggcgacc

SEQ ID NO: 600484 - RNA, 21 nt, Escherichia coli CFT073
ccuucugagaucaaugcgcca

SEQ ID NO: 600485 - RNA, 23 nt, Escherichia coli CFT073
ccuucugccaccagguucaacag

SEQ ID NO: 600486 - RNA, 12 nt, Escherichia coli CFT073
ccuugcgcaaug

SEQ ID NO: 600487 - RNA, 16 nt, Escherichia coli CFT073
ccuuugaacugcugau

SEQ ID NO: 600488 - RNA, 12 nt, Escherichia coli CFT073
ccuuuuggcagu

SEQ ID NO: 600489 - RNA, 15 nt, Escherichia coli CFT073
ccuuuuggugccgga

SEQ ID NO: 600490 - RNA, 14 nt, Escherichia coli CFT073
ccuuguucaagagc

SEQ ID NO: 600491 - RNA, 14 nt, Escherichia coli CFT073
ccuuugguguggau

SEQ ID NO: 600492 - RNA, 21 nt, Escherichia coli CFT073
ccuuuguacuggagcuggcga

SEQ ID NO: 600493 - RNA, 17 nt, Escherichia coli CFT073
ccuuuugccuucugagc

SEQ ID NO: 600494 - RNA, 14 nt, Escherichia coli CFT073
cgacaugcuuacca

SEQ ID NO: 600495 - RNA, 20 nt, Escherichia coli CFT073
cgaccaaccaucaucccuaa

SEQ ID NO: 600496 - RNA, 20 nt, Escherichia coli CFT073
cgacauuucccccuuccugc

SEQ ID NO: 600497 - RNA, 21 nt, Escherichia coli CFT073
cgacauuuugggacagugcag

SEQ ID NO: 600498 - RNA, 23 nt, Escherichia coli CFT073
cgacaguugcugcgugaccgcca

SEQ ID NO: 600499 - RNA, 17 nt, Escherichia coli CFT073
cgaccacccaccgcagc

SEQ ID NO: 600500 - RNA, 23 nt, Escherichia coli CFT073
cgaccacaaauaccccaccgccg

SEQ ID NO: 600501 - RNA, 16 nt, Escherichia coli CFT073
cgaccaaucacacaac

SEQ ID NO: 600502 - RNA, 23 nt, Escherichia coli CFT073
cgacccauaauguguuaauaaug

SEQ ID NO: 600503 - RNA, 14 nt, Escherichia coli CFT073
cgaccaucgccagc

SEQ ID NO: 600504 - RNA, 18 nt, Escherichia coli CFT073
cgaccaggccaucagcag

SEQ ID NO: 600505 - RNA, 13 nt, Escherichia coli CFT073
cgaccagcgccgc

SEQ ID NO: 600506 - RNA, 15 nt, Escherichia coli CFT073
cgaccagcggcaaca

SEQ ID NO: 600507 - RNA, 20 nt, Escherichia coli CFT073
cgaccagcggcaacaucauc

SEQ ID NO: 600508 - RNA, 14 nt, Escherichia coli CFT073
cgaccacuucaugc

SEQ ID NO: 600509 - RNA, 22 nt, Escherichia coli CFT073
cgaaugggugaacccggcgauu

SEQ ID NO: 600510 - RNA, 14 nt, Escherichia coli CFT073
cgacaccagccauc

SEQ ID NO: 600511 - RNA, 13 nt, Escherichia coli CFT073
cgacaccggcaga

SEQ ID NO: 600512 - RNA, 22 nt, Escherichia coli CFT073
cgacacggcucgccuuuucgcc

SEQ ID NO: 600513 - RNA, 15 nt, Escherichia coli CFT073
cgacagcugcgacca

SEQ ID NO: 600514 - RNA, 17 nt, Escherichia coli CFT073
cgacagcguuucgccgc

SEQ ID NO: 600515 - RNA, 20 nt, Escherichia coli CFT073
cgacagcguuucgccgccca

SEQ ID NO: 600516 - RNA, 20 nt, Escherichia coli CFT073
cgaagugaaucggaucaauc

SEQ ID NO: 600517 - RNA, 16 nt, Escherichia coli CFT073
cgaagugagggccagc

SEQ ID NO: 600518 - RNA, 19 nt, Escherichia coli CFT073
cgaagugaugaaaaacguu

SEQ ID NO: 600519 - RNA, 16 nt, Escherichia coli CFT073
cgaagugguuccacgc

SEQ ID NO: 600520 - RNA, 17 nt, Escherichia coli CFT073
cgaaguucauccauacc

SEQ ID NO: 600521 - RNA, 21 nt, Escherichia coli CFT073
cgaaucguauuaucgacaaac

SEQ ID NO: 600522 - RNA, 14 nt, Escherichia coli CFT073
cgaauccggcagcg

SEQ ID NO: 600523 - RNA, 20 nt, Escherichia coli CFT073
cgaauccuucccccaccacc

SEQ ID NO: 600524 - RNA, 15 nt, Escherichia coli CFT073
cgaaucgccccagca

SEQ ID NO: 600525 - RNA, 14 nt, Escherichia coli CFT073
cgaagcaaagaguu

SEQ ID NO: 600526 - RNA, 17 nt, Escherichia coli CFT073
cgaagauguagucugug

SEQ ID NO: 600527 - RNA, 20 nt, Escherichia coli CFT073
cgaagguuccugcaaagcgu

SEQ ID NO: 600528 - RNA, 18 nt, Escherichia coli CFT073
cgagcuuucgaccagcca

SEQ ID NO: 600529 - RNA, 16 nt, Escherichia coli CFT073
cgagcugccaguugcg

SEQ ID NO: 600530 - RNA, 13 nt, Escherichia coli CFT073
cgagcuaauaauc

SEQ ID NO: 600531 - RNA, 19 nt, Escherichia coli CFT073
cgagcguucaaaacggcug

SEQ ID NO: 600532 - RNA, 15 nt, Escherichia coli CFT073
cgagcgccagcgaag

SEQ ID NO: 600533 - RNA, 20 nt, Escherichia coli CFT073
cgaggccaauuuggcugcca

SEQ ID NO: 600534 - RNA, 20 nt, Escherichia coli CFT073
cgaggaucacaaugccgcca

SEQ ID NO: 600535 - RNA, 20 nt, Escherichia coli CFT073
cgaggaagaccucacgguuu

SEQ ID NO: 600536 - RNA, 14 nt, Escherichia coli CFT073
cgacugaugaaguc

SEQ ID NO: 600537 - RNA, 15 nt, Escherichia coli CFT073
cgagagaacugcugc

SEQ ID NO: 600538 - RNA, 18 nt, Escherichia coli CFT073
cgagagagcguugccgca

SEQ ID NO: 600539 - RNA, 17 nt, Escherichia coli CFT073
cgagagaauuaaccaga

SEQ ID NO: 600540 - RNA, 20 nt, Escherichia coli CFT073
cgagcagaaucgguccgcca

SEQ ID NO: 600541 - RNA, 23 nt, Escherichia coli CFT073
cgagcaaguaguccgcaauaacg

SEQ ID NO: 600542 - RNA, 18 nt, Escherichia coli CFT073
cgagcgauccaacuaaau

SEQ ID NO: 600543 - RNA, 14 nt, Escherichia coli CFT073
cgagcgaauaaacc

SEQ ID NO: 600544 - RNA, 13 nt, Escherichia coli CFT073
cgagcauugccag

SEQ ID NO: 600545 - RNA, 19 nt, Escherichia coli CFT073
cgagccaaacgcccagcua

SEQ ID NO: 600546 - RNA, 15 nt, Escherichia coli CFT073
cgagcagcuccugcu

SEQ ID NO: 600547 - RNA, 15 nt, Escherichia coli CFT073
cgacgaccaccgaau

SEQ ID NO: 600548 - RNA, 13 nt, Escherichia coli CFT073
cgacgaccagcgg

SEQ ID NO: 600549 - RNA, 14 nt, Escherichia coli CFT073
cgacgcagcagacg

SEQ ID NO: 600550 - RNA, 19 nt, Escherichia coli CFT073
cgacgcagguuucgauuaa

SEQ ID NO: 600551 - RNA, 13 nt, Escherichia coli CFT073
cgacgcggcagcg

SEQ ID NO: 600552 - RNA, 17 nt, Escherichia coli CFT073
cgacggacgcccgccga

SEQ ID NO: 600553 - RNA, 16 nt, Escherichia coli CFT073
cgacgcgccagcagcg

SEQ ID NO: 600554 - RNA, 18 nt, Escherichia coli CFT073
cgacucgcgaaucgccgu

SEQ ID NO: 600555 - RNA, 15 nt, Escherichia coli CFT073
cgacguuacgcgcca

SEQ ID NO: 600556 - RNA, 22 nt, Escherichia coli CFT073
cgcagaaucuucuucucagcca

SEQ ID NO: 600557 - RNA, 16 nt, Escherichia coli CFT073
cgcagacaccagaaua

SEQ ID NO: 600558 - RNA, 18 nt, Escherichia coli CFT073
cgcagaccaaccgucaga

SEQ ID NO: 600559 - RNA, 19 nt, Escherichia coli CFT073
cgcagagccugaauaaacg

SEQ ID NO: 600560 - RNA, 20 nt, Escherichia coli CFT073
cgcagaucauccggcacgcu

SEQ ID NO: 600561 - RNA, 15 nt, Escherichia coli CFT073
cgcagauccagugcu

SEQ ID NO: 600562 - RNA, 13 nt, Escherichia coli CFT073
cgcagccgccaca

SEQ ID NO: 600563 - RNA, 15 nt, Escherichia coli CFT073
cgcagcaucgccauc

SEQ ID NO: 600564 - RNA, 19 nt, Escherichia coli CFT073
cgcagcaucagcgccuggg

SEQ ID NO: 600565 - RNA, 19 nt, Escherichia coli CFT073
cgcagauuuuugcgccauc

SEQ ID NO: 600566 - RNA, 18 nt, Escherichia coli CFT073
cgcagcaacuacagcauu

SEQ ID NO: 600567 - RNA, 14 nt, Escherichia coli CFT073
cgcagcuuugugcu

SEQ ID NO: 600568 - RNA, 19 nt, Escherichia coli CFT073
cgcagcuuugugcuucagu

SEQ ID NO: 600569 - RNA, 21 nt, Escherichia coli CFT073
cgcagcuauccugccggugau

SEQ ID NO: 600570 - RNA, 21 nt, Escherichia coli CFT073
cgcaguuucgcgucgucaacc

SEQ ID NO: 600571 - RNA, 16 nt, Escherichia coli CFT073
cgcauaagccacaaua

SEQ ID NO: 600572 - RNA, 20 nt, Escherichia coli CFT073
cgcauaccccaucagcguaa

SEQ ID NO: 600573 - RNA, 13 nt, Escherichia coli CFT073
cgcauaccaaaau

SEQ ID NO: 600574 - RNA, 17 nt, Escherichia coli CFT073
cgcaguuuaaucguuga

SEQ ID NO: 600575 - RNA, 13 nt, Escherichia coli CFT073
cgcaguugccgga

SEQ ID NO: 600576 - RNA, 22 nt, Escherichia coli CFT073
cgcauaguuuuuugggaugaua

SEQ ID NO: 600577 - RNA, 15 nt, Escherichia coli CFT073
cgcauagccuccggc

SEQ ID NO: 600578 - RNA, 13 nt, Escherichia coli CFT073
cgcauagcuggcg

SEQ ID NO: 600579 - RNA, 14 nt, Escherichia coli CFT073
cgcauagcccagcg

SEQ ID NO: 600580 - RNA, 19 nt, Escherichia coli CFT073
cgcauagacagccacaucc

SEQ ID NO: 600581 - RNA, 13 nt, Escherichia coli CFT073
cgcauagagaaag

SEQ ID NO: 600582 - RNA, 23 nt, Escherichia coli CFT073
cgcauagaucucaagcgguaaac

SEQ ID NO: 600583 - RNA, 22 nt, Escherichia coli CFT073
cgcagguaagauaaugugccga

SEQ ID NO: 600584 - RNA, 17 nt, Escherichia coli CFT073
cgcagguaaucaaugcg

SEQ ID NO: 600585 - RNA, 21 nt, Escherichia coli CFT073
cgcagugagaagccaccgcac

SEQ ID NO: 600586 - RNA, 20 nt, Escherichia coli CFT073
cgcagucuggugcugcgcuu

SEQ ID NO: 600587 - RNA, 15 nt, Escherichia coli CFT073
cgcagucuuugccgu

SEQ ID NO: 600588 - RNA, 14 nt, Escherichia coli CFT073
cgcagucgggugcu

SEQ ID NO: 600589 - RNA, 15 nt, Escherichia coli CFT073
cgcauucaccagcgg

SEQ ID NO: 600590 - RNA, 16 nt, Escherichia coli CFT073
cgcauucgaucaccgc

SEQ ID NO: 600591 - RNA, 20 nt, Escherichia coli CFT073
cgcauucgaucaccgcagaa

SEQ ID NO: 600592 - RNA, 16 nt, Escherichia coli CFT073
cgcauuauuuugcgga

SEQ ID NO: 600593 - RNA, 14 nt, Escherichia coli CFT073
cgcauguuguuuuc

SEQ ID NO: 600594 - RNA, 17 nt, Escherichia coli CFT073
cgcaugugcccccugca

SEQ ID NO: 600595 - RNA, 18 nt, Escherichia coli CFT073
cgcauguuccucaucguc

SEQ ID NO: 600596 - RNA, 21 nt, Escherichia coli CFT073
cgccaaacucggucacgcggu

SEQ ID NO: 600597 - RNA, 22 nt, Escherichia coli CFT073
cgccaaagccaguucggcagcc

SEQ ID NO: 600598 - RNA, 18 nt, Escherichia coli CFT073
cgccaaaugucaccagcc

SEQ ID NO: 600599 - RNA, 14 nt, Escherichia coli CFT073
cgccaacagcagcc

SEQ ID NO: 600600 - RNA, 19 nt, Escherichia coli CFT073
cgcaugaugccggguuugc

SEQ ID NO: 600601 - RNA, 18 nt, Escherichia coli CFT073
cgcauccgacaucaacgc

SEQ ID NO: 600602 - RNA, 19 nt, Escherichia coli CFT073
cgcauccgacaucuaacgc

SEQ ID NO: 600603 - RNA, 15 nt, Escherichia coli CFT073
cgcauccccagcgca

SEQ ID NO: 600604 - RNA, 17 nt, Escherichia coli CFT073
cgcauccccagcgcaag

SEQ ID NO: 600605 - RNA, 13 nt, Escherichia coli CFT073
cgcaucccgguuu

SEQ ID NO: 600606 - RNA, 15 nt, Escherichia coli CFT073
cgcaucaugccgccc

SEQ ID NO: 600607 - RNA, 17 nt, Escherichia coli CFT073
cgcaucaguuucauuuc

SEQ ID NO: 600608 - RNA, 23 nt, Escherichia coli CFT073
cgcaucaguuucgaucagcaauu

SEQ ID NO: 600609 - RNA, 23 nt, Escherichia coli CFT073
cgcaucauccucuucaccgguac

SEQ ID NO: 600610 - RNA, 22 nt, Escherichia coli CFT073
cgcaucagacaccggcgcacaa

SEQ ID NO: 600611 - RNA, 13 nt, Escherichia coli CFT073
cgcaucagcagau

SEQ ID NO: 600612 - RNA, 18 nt, Escherichia coli CFT073
cgcaucacgacagcacca

SEQ ID NO: 600613 - RNA, 20 nt, Escherichia coli CFT073
cgccaaguucgaacgccgcc

SEQ ID NO: 600614 - RNA, 22 nt, Escherichia coli CFT073
cgccaaguucgaacgccgccag

SEQ ID NO: 600615 - RNA, 14 nt, Escherichia coli CFT073
cgccaauaacagaa

SEQ ID NO: 600616 - RNA, 20 nt, Escherichia coli CFT073
cgccaauagccgcaccgagc

SEQ ID NO: 600617 - RNA, 14 nt, Escherichia coli CFT073
cgccaaucagcaua

SEQ ID NO: 600618 - RNA, 17 nt, Escherichia coli CFT073
cgccaaucagcgcagca

SEQ ID NO: 600619 - RNA, 16 nt, Escherichia coli CFT073
cgccaaucgucgccgu

SEQ ID NO: 600620 - RNA, 13 nt, Escherichia coli CFT073
cgccaaucugcaa

SEQ ID NO: 600621 - RNA, 21 nt, Escherichia coli CFT073
cgccagaauauugccauuacg

SEQ ID NO: 600622 - RNA, 14 nt, Escherichia coli CFT073
cgccagaaugcgga

SEQ ID NO: 600623 - RNA, 21 nt, Escherichia coli CFT073
cgccacugcaaaucaccacau

SEQ ID NO: 600624 - RNA, 16 nt, Escherichia coli CFT073
cgccacugcgccacgg

SEQ ID NO: 600625 - RNA, 17 nt, Escherichia coli CFT073
cgccagaaaguggcaca

SEQ ID NO: 600626 - RNA, 20 nt, Escherichia coli CFT073
cgccagcaauggacaccagg

SEQ ID NO: 600627 - RNA, 13 nt, Escherichia coli CFT073
cgccagcacagcc

SEQ ID NO: 600628 - RNA, 14 nt, Escherichia coli CFT073
cgccagaccagcua

SEQ ID NO: 600629 - RNA, 21 nt, Escherichia coli CFT073
cgccagaacacgcucccagca

SEQ ID NO: 600630 - RNA, 20 nt, Escherichia coli CFT073
cgccagagaaagcccgcgua

SEQ ID NO: 600631 - RNA, 21 nt, Escherichia coli CFT073
cgccagagagcggagcaauga

SEQ ID NO: 600632 - RNA, 15 nt, Escherichia coli CFT073
cgccagaggcgacaa

SEQ ID NO: 600633 - RNA, 14 nt, Escherichia coli CFT073
cgccagcaugccgc

SEQ ID NO: 600634 - RNA, 21 nt, Escherichia coli CFT073
cgccagcgaauuccaguugau

SEQ ID NO: 600635 - RNA, 18 nt, Escherichia coli CFT073
cgccagcgcgaccgccau

SEQ ID NO: 600636 - RNA, 19 nt, Escherichia coli CFT073
cgccagcgcgaccgccaug

SEQ ID NO: 600637 - RNA, 13 nt, Escherichia coli CFT073
cgccagcgcgaca

SEQ ID NO: 600638 - RNA, 22 nt, Escherichia coli CFT073
cgccagcuccgggcugguuuuc

SEQ ID NO: 600639 - RNA, 22 nt, Escherichia coli CFT073
cgccagcgcggcggcaaucauc

SEQ ID NO: 600640 - RNA, 19 nt, Escherichia coli CFT073
cgccagcguuugcggcgcu

SEQ ID NO: 600641 - RNA, 14 nt, Escherichia coli CFT073
cgccagcauuguca

SEQ ID NO: 600642 - RNA, 18 nt, Escherichia coli CFT073
cgccagcauguuguccca

SEQ ID NO: 600643 - RNA, 19 nt, Escherichia coli CFT073
cgccagcacgaccgccauu

SEQ ID NO: 600644 - RNA, 16 nt, Escherichia coli CFT073
cgccagcacuuccugc

SEQ ID NO: 600645 - RNA, 17 nt, Escherichia coli CFT073
cgccagcacuuccugcu

SEQ ID NO: 600646 - RNA, 20 nt, Escherichia coli CFT073
cgccaguuuguagccgauaa

SEQ ID NO: 600647 - RNA, 14 nt, Escherichia coli CFT073
cgccauaaacacca

SEQ ID NO: 600648 - RNA, 22 nt, Escherichia coli CFT073
cgccaguuucgggaucaucuca

SEQ ID NO: 600649 - RNA, 15 nt, Escherichia coli CFT073
cgccauaucaccacc

SEQ ID NO: 600650 - RNA, 16 nt, Escherichia coli CFT073
cgccauaaccgccagc

SEQ ID NO: 600651 - RNA, 16 nt, Escherichia coli CFT073
cgccauaaucccgaac

SEQ ID NO: 600652 - RNA, 14 nt, Escherichia coli CFT073
cgccaucaacgaaa

SEQ ID NO: 600653 - RNA, 14 nt, Escherichia coli CFT073
cgccaucaagaaca

SEQ ID NO: 600654 - RNA, 21 nt, Escherichia coli CFT073
cgccaucaauaaccagcguuu

SEQ ID NO: 600655 - RNA, 15 nt, Escherichia coli CFT073
cgccauccaccguaa

SEQ ID NO: 600656 - RNA, 18 nt, Escherichia coli CFT073
cgccauccagguagcaaa

SEQ ID NO: 600657 - RNA, 21 nt, Escherichia coli CFT073
cgccaucagccacuucaacca

SEQ ID NO: 600658 - RNA, 12 nt, Escherichia coli CFT073
cgccaucagcgc

SEQ ID NO: 600659 - RNA, 13 nt, Escherichia coli CFT073
cgccaucagcgcc

SEQ ID NO: 600660 - RNA, 16 nt, Escherichia coli CFT073
cgccaucaggcagaua

SEQ ID NO: 600661 - RNA, 14 nt, Escherichia coli CFT073
cgccaucuguuucu

SEQ ID NO: 600662 - RNA, 19 nt, Escherichia coli CFT073
cgccaucucuucugcgcua

SEQ ID NO: 600663 - RNA, 14 nt, Escherichia coli CFT073
cgccaucgccagga

SEQ ID NO: 600664 - RNA, 14 nt, Escherichia coli CFT073
cgccauccccacgc

SEQ ID NO: 600665 - RNA, 18 nt, Escherichia coli CFT073
cgccaguucgcgauccug

SEQ ID NO: 600666 - RNA, 19 nt, Escherichia coli CFT073
cgccagugacgccgccaga

SEQ ID NO: 600667 - RNA, 16 nt, Escherichia coli CFT073
cgccagugacugcgcc

SEQ ID NO: 600668 - RNA, 13 nt, Escherichia coli CFT073
cgccagugucgca

SEQ ID NO: 600669 - RNA, 19 nt, Escherichia coli CFT073
cgccaguaaucagcgcgga

SEQ ID NO: 600670 - RNA, 18 nt, Escherichia coli CFT073
cgccaguaaucggcugaa

SEQ ID NO: 600671 - RNA, 17 nt, Escherichia coli CFT073
cgccaguaauucuucaa

SEQ ID NO: 600672 - RNA, 17 nt, Escherichia coli CFT073
cgccaguaccagcagcg

SEQ ID NO: 600673 - RNA, 15 nt, Escherichia coli CFT073
cgccaguaccgccgc

SEQ ID NO: 600674 - RNA, 23 nt, Escherichia coli CFT073
cgccaguaccgucgucauguuua

SEQ ID NO: 600675 - RNA, 19 nt, Escherichia coli CFT073
cgccagguacucaugccca

SEQ ID NO: 600676 - RNA, 23 nt, Escherichia coli CFT073
cgccagguacucaugcccacgca

SEQ ID NO: 600677 - RNA, 18 nt, Escherichia coli CFT073
cgccaggcuuuccgucag

SEQ ID NO: 600678 - RNA, 15 nt, Escherichia coli CFT073
cgccaggcgcgagaa

SEQ ID NO: 600679 - RNA, 14 nt, Escherichia coli CFT073
cgcaaucgccucca

SEQ ID NO: 600680 - RNA, 14 nt, Escherichia coli CFT073
cgcaaucagcguuu

SEQ ID NO: 600681 - RNA, 19 nt, Escherichia coli CFT073
cgcaaucaaauuugccagc

SEQ ID NO: 600682 - RNA, 17 nt, Escherichia coli CFT073
cgcaacuuucgccgguu

SEQ ID NO: 600683 - RNA, 23 nt, Escherichia coli CFT073
cgcaauuuauugaauuugcagau

SEQ ID NO: 600684 - RNA, 22 nt, Escherichia coli CFT073
cgcaaugcguuuggagccgcug

SEQ ID NO: 600685 - RNA, 16 nt, Escherichia coli CFT073
cgcaaucugcuucuua

SEQ ID NO: 600686 - RNA, 12 nt, Escherichia coli CFT073
cgcaaucuggca

SEQ ID NO: 600687 - RNA, 18 nt, Escherichia coli CFT073
cgcacagcccgccgccau

SEQ ID NO: 600688 - RNA, 19 nt, Escherichia coli CFT073
cgcacagcccgccgccauc

SEQ ID NO: 600689 - RNA, 22 nt, Escherichia coli CFT073
cgcacaaugccguaaccagcgc

SEQ ID NO: 600690 - RNA, 18 nt, Escherichia coli CFT073
cgcacaggcggcccaguu

SEQ ID NO: 600691 - RNA, 20 nt, Escherichia coli CFT073
cgcacaguacgcgcccgccg

SEQ ID NO: 600692 - RNA, 14 nt, Escherichia coli CFT073
cgcacaucaccgcc

SEQ ID NO: 600693 - RNA, 21 nt, Escherichia coli CFT073
cgcacaugcagcuucgccauu

SEQ ID NO: 600694 - RNA, 14 nt, Escherichia coli CFT073
cgcacauugccgua

SEQ ID NO: 600695 - RNA, 22 nt, Escherichia coli CFT073
cgcaccaaaguuaaucagcgcc

SEQ ID NO: 600696 - RNA, 22 nt, Escherichia coli CFT073
cgcaccaacuccucuuugcugc

SEQ ID NO: 600697 - RNA, 15 nt, Escherichia coli CFT073
cgcaccaccagcagc

SEQ ID NO: 600698 - RNA, 16 nt, Escherichia coli CFT073
cgcaccaccagcagcu

SEQ ID NO: 600699 - RNA, 19 nt, Escherichia coli CFT073
cgcaccgagugguucauca

SEQ ID NO: 600700 - RNA, 16 nt, Escherichia coli CFT073
cgcaccgaccaucggc

SEQ ID NO: 600701 - RNA, 13 nt, Escherichia coli CFT073
cgcacccgccauc

SEQ ID NO: 600702 - RNA, 18 nt, Escherichia coli CFT073
cgauuccguugccagaug

SEQ ID NO: 600703 - RNA, 13 nt, Escherichia coli CFT073
cgauugccggaug

SEQ ID NO: 600704 - RNA, 16 nt, Escherichia coli CFT073
cgauugccacgccgua

SEQ ID NO: 600705 - RNA, 20 nt, Escherichia coli CFT073
cgauuggggagaaaaacgga

SEQ ID NO: 600706 - RNA, 21 nt, Escherichia coli CFT073
cgcaaacuucgguuaccacac

SEQ ID NO: 600707 - RNA, 16 nt, Escherichia coli CFT073
cgauuuuuuccgcaaa

SEQ ID NO: 600708 - RNA, 13 nt, Escherichia coli CFT073
cgcaaaauaaaaa

SEQ ID NO: 600709 - RNA, 16 nt, Escherichia coli CFT073
cgcaaccgccaacagc

SEQ ID NO: 600710 - RNA, 21 nt, Escherichia coli CFT073
cgcaaccagcgucgcaucagg

SEQ ID NO: 600711 - RNA, 13 nt, Escherichia coli CFT073
cgcaacauuccgg

SEQ ID NO: 600712 - RNA, 15 nt, Escherichia coli CFT073
cgcaacuccaccagc

SEQ ID NO: 600713 - RNA, 17 nt, Escherichia coli CFT073
cgauagcgcgccagccg

SEQ ID NO: 600714 - RNA, 20 nt, Escherichia coli CFT073
cgauagcgaaagucaucggg

SEQ ID NO: 600715 - RNA, 14 nt, Escherichia coli CFT073
cgauagcuaacugc

SEQ ID NO: 600716 - RNA, 23 nt, Escherichia coli CFT073
cgauagcuaacugccuccugcaa

SEQ ID NO: 600717 - RNA, 14 nt, Escherichia coli CFT073
cgauaaucguuggc

SEQ ID NO: 600718 - RNA, 18 nt, Escherichia coli CFT073
cgauaauguuaaccugca

SEQ ID NO: 600719 - RNA, 14 nt, Escherichia coli CFT073
cgauacaacgcuuu

SEQ ID NO: 600720 - RNA, 21 nt, Escherichia coli CFT073
cgauauccgugcauuccagca

SEQ ID NO: 600721 - RNA, 18 nt, Escherichia coli CFT073
cgauaucaggcaaacaga

SEQ ID NO: 600722 - RNA, 17 nt, Escherichia coli CFT073
cgauauacaaacauaaa

SEQ ID NO: 600723 - RNA, 16 nt, Escherichia coli CFT073
cgauauccagaccgcg

SEQ ID NO: 600724 - RNA, 15 nt, Escherichia coli CFT073
cgauaaggcguugau

SEQ ID NO: 600725 - RNA, 22 nt, Escherichia coli CFT073
cgauaagguaucgcgaaaaaaa

SEQ ID NO: 600726 - RNA, 17 nt, Escherichia coli CFT073
cgauaauaaucgcuucg

SEQ ID NO: 600727 - RNA, 16 nt, Escherichia coli CFT073
cgauaauauugaugca

SEQ ID NO: 600728 - RNA, 15 nt, Escherichia coli CFT073
cgauaaucagcgcca

SEQ ID NO: 600729 - RNA, 19 nt, Escherichia coli CFT073
cgauaaucaguaaugucgc

SEQ ID NO: 600730 - RNA, 16 nt, Escherichia coli CFT073
cgauaagccagcaacc

SEQ ID NO: 600731 - RNA, 17 nt, Escherichia coli CFT073
cgauaacgccccaaucc

SEQ ID NO: 600732 - RNA, 19 nt, Escherichia coli CFT073
cgauaaacgcgacgauuaa

SEQ ID NO: 600733 - RNA, 18 nt, Escherichia coli CFT073
cgauaaacucaaucaggc

SEQ ID NO: 600734 - RNA, 18 nt, Escherichia coli CFT073
cgauaaaacgccgcuggu

SEQ ID NO: 600735 - RNA, 22 nt, Escherichia coli CFT073
cgauaaaacuucugcaacguuu

SEQ ID NO: 600736 - RNA, 15 nt, Escherichia coli CFT073
cgauaaaauaaucac

SEQ ID NO: 600737 - RNA, 15 nt, Escherichia coli CFT073
cgauaaacagcgucg

SEQ ID NO: 600738 - RNA, 14 nt, Escherichia coli CFT073
cgaucaauuucuuc

SEQ ID NO: 600739 - RNA, 15 nt, Escherichia coli CFT073
cgaucaguaccagcc

SEQ ID NO: 600740 - RNA, 19 nt, Escherichia coli CFT073
cgaucaguaccagcccgcc

SEQ ID NO: 600741 - RNA, 18 nt, Escherichia coli CFT073
cgaucaguuacucugcaa

SEQ ID NO: 600742 - RNA, 16 nt, Escherichia coli CFT073
cgaucauauccagcau

SEQ ID NO: 600743 - RNA, 18 nt, Escherichia coli CFT073
cgaucaucaccugcgcug

SEQ ID NO: 600744 - RNA, 14 nt, Escherichia coli CFT073
cgaucaucacgaca

SEQ ID NO: 600745 - RNA, 19 nt, Escherichia coli CFT073
cgaucaucacgacauaauu

SEQ ID NO: 600746 - RNA, 14 nt, Escherichia coli CFT073
cgauccagcgcaau

SEQ ID NO: 600747 - RNA, 16 nt, Escherichia coli CFT073
cgauccuguucgaaca

SEQ ID NO: 600748 - RNA, 22 nt, Escherichia coli CFT073
cgaugaccaaaaacguugccgu

SEQ ID NO: 600749 - RNA, 18 nt, Escherichia coli CFT073
cgaugacagaaucagcag

SEQ ID NO: 600750 - RNA, 19 nt, Escherichia coli CFT073
cgaugaaauucacugucgu

SEQ ID NO: 600751 - RNA, 17 nt, Escherichia coli CFT073
cgaugaaaaaccuuaaa

SEQ ID NO: 600752 - RNA, 21 nt, Escherichia coli CFT073
cgaugaaaaaccuuaaagcga

SEQ ID NO: 600753 - RNA, 15 nt, Escherichia coli CFT073
cgaucuucugccaau

SEQ ID NO: 600754 - RNA, 19 nt, Escherichia coli CFT073
cgaucuucugccaauuuuu

SEQ ID NO: 600755 - RNA, 22 nt, Escherichia coli CFT073
cgaugagucgccgcaaucagcc

SEQ ID NO: 600756 - RNA, 21 nt, Escherichia coli CFT073
cgaugagcugcaacuggcggc

SEQ ID NO: 600757 - RNA, 14 nt, Escherichia coli CFT073
cgaugaugaucugc

SEQ ID NO: 600758 - RNA, 13 nt, Escherichia coli CFT073
cgaugaucgccgc

SEQ ID NO: 600759 - RNA, 16 nt, Escherichia coli CFT073
cgaugauuuccgccag

SEQ ID NO: 600760 - RNA, 15 nt, Escherichia coli CFT073
cgaucucggucacca

SEQ ID NO: 600761 - RNA, 20 nt, Escherichia coli CFT073
cgaucgcgccaaucagcgca

SEQ ID NO: 600762 - RNA, 19 nt, Escherichia coli CFT073
cgaucgccguuaaccauaa

SEQ ID NO: 600763 - RNA, 20 nt, Escherichia coli CFT073
cgaucgcccggcaccagcac

SEQ ID NO: 600764 - RNA, 11 nt, Escherichia coli CFT073
cgaucgcccgc

SEQ ID NO: 600765 - RNA, 22 nt, Escherichia coli CFT073
cgaucgccacuuucacgccgcc

SEQ ID NO: 600766 - RNA, 14 nt, Escherichia coli CFT073
ccgcaaaucgccga

SEQ ID NO: 600767 - RNA, 15 nt, Escherichia coli CFT073
ccgcaaacucaucgc

SEQ ID NO: 600768 - RNA, 15 nt, Escherichia coli CFT073
ccgcaaacaggcgca

SEQ ID NO: 600769 - RNA, 18 nt, Escherichia coli CFT073
ccgauggcaaaagugaua

SEQ ID NO: 600770 - RNA, 20 nt, Escherichia coli CFT073
ccgauggcagaaaucaacgg

SEQ ID NO: 600771 - RNA, 18 nt, Escherichia coli CFT073
ccgauggcccgcguaagc

SEQ ID NO: 600772 - RNA, 19 nt, Escherichia coli CFT073
ccgaugcgcuuuaucgucg

SEQ ID NO: 600773 - RNA, 23 nt, Escherichia coli CFT073
  misc_feature (14)..(14): n is a, c, g or u
ccgaugcgcaagcnuuaucgugc

SEQ ID NO: 600774 - RNA, 15 nt, Escherichia coli CFT073
ccgcacccgccagaa

SEQ ID NO: 600775 - RNA, 18 nt, Escherichia coli CFT073
ccgcacgacgaaucugau

SEQ ID NO: 600776 - RNA, 19 nt, Escherichia coli CFT073
ccgcagcaacuacagcauu

SEQ ID NO: 600777 - RNA, 17 nt, Escherichia coli CFT073
ccgcagauguagcucaa

SEQ ID NO: 600778 - RNA, 19 nt, Escherichia coli CFT073
ccgcagauccagugcucau

SEQ ID NO: 600779 - RNA, 21 nt, Escherichia coli CFT073
ccgcagauccagugcucaucc

SEQ ID NO: 600780 - RNA, 21 nt, Escherichia coli CFT073
ccgcagagauagaacugcauu

SEQ ID NO: 600781 - RNA, 18 nt, Escherichia coli CFT073
ccgcagacaaaauccugc

SEQ ID NO: 600782 - RNA, 21 nt, Escherichia coli CFT073
ccgcagacccacggauagauu

SEQ ID NO: 600783 - RNA, 13 nt, Escherichia coli CFT073
ccgcagaacagau

SEQ ID NO: 600784 - RNA, 12 nt, Escherichia coli CFT073
ccgcaucgcuca

SEQ ID NO: 600785 - RNA, 22 nt, Escherichia coli CFT073
ccgcagcggaauaaaaagcgau

SEQ ID NO: 600786 - RNA, 15 nt, Escherichia coli CFT073
ccgcagccgccacaa

SEQ ID NO: 600787 - RNA, 16 nt, Escherichia coli CFT073
ccgcaugaguacgcgg

SEQ ID NO: 600788 - RNA, 18 nt, Escherichia coli CFT073
ccgcaucgguuucgcuau

SEQ ID NO: 600789 - RNA, 18 nt, Escherichia coli CFT073
ccgccaaaggcuuucgcg

SEQ ID NO: 600790 - RNA, 16 nt, Escherichia coli CFT073
ccgccacgucaucagc

SEQ ID NO: 600791 - RNA, 13 nt, Escherichia coli CFT073
ccgccaccagaac

SEQ ID NO: 600792 - RNA, 16 nt, Escherichia coli CFT073
ccgccaccagaaccgc

SEQ ID NO: 600793 - RNA, 18 nt, Escherichia coli CFT073
ccgccaccagaaccgccg

SEQ ID NO: 600794 - RNA, 20 nt, Escherichia coli CFT073
ccgccaauaaugaacgccac

SEQ ID NO: 600795 - RNA, 14 nt, Escherichia coli CFT073
ccgccaaucagcau

SEQ ID NO: 600796 - RNA, 13 nt, Escherichia coli CFT073
ccgcccaucgcga

SEQ ID NO: 600797 - RNA, 20 nt, Escherichia coli CFT073
ccgccauugacagaauauac

SEQ ID NO: 600798 - RNA, 18 nt, Escherichia coli CFT073
ccgccauuccagccagaa

SEQ ID NO: 600799 - RNA, 22 nt, Escherichia coli CFT073
ccgccaucguugagcaucugca

SEQ ID NO: 600800 - RNA, 13 nt, Escherichia coli CFT073
ccgccaucgcguu

SEQ ID NO: 600801 - RNA, 20 nt, Escherichia coli CFT073
ccgccaucggcgggauuuuu

SEQ ID NO: 600802 - RNA, 18 nt, Escherichia coli CFT073
ccgccaguuccaggcaaa

SEQ ID NO: 600803 - RNA, 23 nt, Escherichia coli CFT073
ccgccagugugaauaauugugca

SEQ ID NO: 600804 - RNA, 22 nt, Escherichia coli CFT073
ccgccagugccaccaguaacgc

SEQ ID NO: 600805 - RNA, 15 nt, Escherichia coli CFT073
ccgccagcauuguca

SEQ ID NO: 600806 - RNA, 23 nt, Escherichia coli CFT073
ccgccagcagcagcgaauaauuc

SEQ ID NO: 600807 - RNA, 20 nt, Escherichia coli CFT073
ccgcgauccagcgcaauacc

SEQ ID NO: 600808 - RNA, 12 nt, Escherichia coli CFT073
ccgccugcugau

SEQ ID NO: 600809 - RNA, 13 nt, Escherichia coli CFT073
ccgccucgcucag

SEQ ID NO: 600810 - RNA, 15 nt, Escherichia coli CFT073
ccgccgucagacgcg

SEQ ID NO: 600811 - RNA, 15 nt, Escherichia coli CFT073
ccgccggaugcggcg

SEQ ID NO: 600812 - RNA, 19 nt, Escherichia coli CFT073
ccgccggaaucaacggcaa

SEQ ID NO: 600813 - RNA, 12 nt, Escherichia coli CFT073
ccgccgccagau

SEQ ID NO: 600814 - RNA, 21 nt, Escherichia coli CFT073
ccgccgcauuauggugaagaa

SEQ ID NO: 600815 - RNA, 15 nt, Escherichia coli CFT073
ccgccgccaaacugu

SEQ ID NO: 600816 - RNA, 18 nt, Escherichia coli CFT073
ccgccgccaaucgcccgg

SEQ ID NO: 600817 - RNA, 18 nt, Escherichia coli CFT073
ccgccgaccaacgcagaa

SEQ ID NO: 600818 - RNA, 16 nt, Escherichia coli CFT073
ccgccgacaucugcca

SEQ ID NO: 600819 - RNA, 13 nt, Escherichia coli CFT073
ccgccccggcgau

SEQ ID NO: 600820 - RNA, 15 nt, Escherichia coli CFT073
ccgcugaugcagcgu

SEQ ID NO: 600821 - RNA, 14 nt, Escherichia coli CFT073
ccgcuccgccaucu

SEQ ID NO: 600822 - RNA, 22 nt, Escherichia coli CFT073
ccgcucacgcagcggcggcacu

SEQ ID NO: 600823 - RNA, 17 nt, Escherichia coli CFT073
ccgcuauugaccagcgc

SEQ ID NO: 600824 - RNA, 17 nt, Escherichia coli CFT073
ccgcuauugagcaugau

SEQ ID NO: 600825 - RNA, 14 nt, Escherichia coli CFT073
ccgcugcgccauaa

SEQ ID NO: 600826 - RNA, 19 nt, Escherichia coli CFT073
ccgcuucaaaguucugcgu

SEQ ID NO: 600827 - RNA, 16 nt, Escherichia coli CFT073
ccgcuucaaaguucug

SEQ ID NO: 600828 - RNA, 18 nt, Escherichia coli CFT073
ccgcuguugccagcagca

SEQ ID NO: 600829 - RNA, 14 nt, Escherichia coli CFT073
ccgcuguugcuucc

SEQ ID NO: 600830 - RNA, 21 nt, Escherichia coli CFT073
ccgcuguuuguucaagcgcaa

SEQ ID NO: 600831 - RNA, 16 nt, Escherichia coli CFT073
ccgcuguucugauuuu

SEQ ID NO: 600832 - RNA, 21 nt, Escherichia coli CFT073
ccgcuguuauugucggcagau

SEQ ID NO: 600833 - RNA, 23 nt, Escherichia coli CFT073
ccgcuguguguaggccagcgaua

SEQ ID NO: 600834 - RNA, 12 nt, Escherichia coli CFT073
ccgcuucuuucu

SEQ ID NO: 600835 - RNA, 14 nt, Escherichia coli CFT073
ccgcuucauagccg

SEQ ID NO: 600836 - RNA, 22 nt, Escherichia coli CFT073
ccggaaccggcaacggcgugag

SEQ ID NO: 600837 - RNA, 21 nt, Escherichia coli CFT073
ccggaaaccaaacuuaugcag

SEQ ID NO: 600838 - RNA, 19 nt, Escherichia coli CFT073
ccgcuuuccucaucagaaa

SEQ ID NO: 600839 - RNA, 19 nt, Escherichia coli CFT073
ccgcgcuuucuucuucgcg

SEQ ID NO: 600840 - RNA, 17 nt, Escherichia coli CFT073
ccgcguccgcucgguca

SEQ ID NO: 600841 - RNA, 16 nt, Escherichia coli CFT073
ccgcguaacgccagaa

SEQ ID NO: 600842 - RNA, 15 nt, Escherichia coli CFT073
ccgcgguucccagcg

SEQ ID NO: 600843 - RNA, 14 nt, Escherichia coli CFT073
ccgcgguaucgccg

SEQ ID NO: 600844 - RNA, 14 nt, Escherichia coli CFT073
ccggauagaguguu

SEQ ID NO: 600845 - RNA, 18 nt, Escherichia coli CFT073
ccggauaaggcgcgucaa

SEQ ID NO: 600846 - RNA, 20 nt, Escherichia coli CFT073
ccggauaccccagcuggcgc

SEQ ID NO: 600847 - RNA, 20 nt, Escherichia coli CFT073
ccggauaagaggcgccagca

SEQ ID NO: 600848 - RNA, 19 nt, Escherichia coli CFT073
ccggauaaucggcaauacu

SEQ ID NO: 600849 - RNA, 18 nt, Escherichia coli CFT073
ccggauaaugcgccagau

SEQ ID NO: 600850 - RNA, 17 nt, Escherichia coli CFT073
ccggauuuucaccaucg

SEQ ID NO: 600851 - RNA, 15 nt, Escherichia coli CFT073
ccggauuuuuaugac

SEQ ID NO: 600852 - RNA, 19 nt, Escherichia coli CFT073
ccggauuuuucagcgccau

SEQ ID NO: 600853 - RNA, 17 nt, Escherichia coli CFT073
ccggauuacgcaucagu

SEQ ID NO: 600854 - RNA, 18 nt, Escherichia coli CFT073
ccggauucacgccaacca

SEQ ID NO: 600855 - RNA, 18 nt, Escherichia coli CFT073
ccggaugcggcgugaacg

SEQ ID NO: 600856 - RNA, 23 nt, Escherichia coli CFT073
ccggaugcggcguuaacgccuua

SEQ ID NO: 600857 - RNA, 20 nt, Escherichia coli CFT073
ccggauggcaacagcagcca

SEQ ID NO: 600858 - RNA, 15 nt, Escherichia coli CFT073
ccggaugcgacgcac

SEQ ID NO: 600859 - RNA, 20 nt, Escherichia coli CFT073
ccggaugcgacgcuggccgc

SEQ ID NO: 600860 - RNA, 19 nt, Escherichia coli CFT073
ccggaugcgaugcuggcgc

SEQ ID NO: 600861 - RNA, 16 nt, Escherichia coli CFT073
ccggaugcccggucaa

SEQ ID NO: 600862 - RNA, 10 nt, Escherichia coli CFT073
ccggaugauu

SEQ ID NO: 600863 - RNA, 19 nt, Escherichia coli CFT073
ccggaugcaacgcuggcgc

SEQ ID NO: 600864 - RNA, 17 nt, Escherichia coli CFT073
ccggaucugccauaucc

SEQ ID NO: 600865 - RNA, 12 nt, Escherichia coli CFT073
ccggagcuggcg

SEQ ID NO: 600866 - RNA, 19 nt, Escherichia coli CFT073
ccggacuuaacgucacaga

SEQ ID NO: 600867 - RNA, 16 nt, Escherichia coli CFT073
ccggagaaauccgggg

SEQ ID NO: 600868 - RNA, 17 nt, Escherichia coli CFT073
ccggacguucagccaua

SEQ ID NO: 600869 - RNA, 12 nt, Escherichia coli CFT073
ccggacgucagg

SEQ ID NO: 600870 - RNA, 20 nt, Escherichia coli CFT073
ccggaauuuacccgccaggu

SEQ ID NO: 600871 - RNA, 12 nt, Escherichia coli CFT073
ccggaacgggag

SEQ ID NO: 600872 - RNA, 21 nt, Escherichia coli CFT073
ccggaacugaugaacggugcg

SEQ ID NO: 600873 - RNA, 14 nt, Escherichia coli CFT073
ccggcagaaaccag

SEQ ID NO: 600874 - RNA, 17 nt, Escherichia coli CFT073
ccggcagaccaucguca

SEQ ID NO: 600875 - RNA, 16 nt, Escherichia coli CFT073
ccggcacuuacuuucc

SEQ ID NO: 600876 - RNA, 16 nt, Escherichia coli CFT073
ccggcacgucgcguua

SEQ ID NO: 600877 - RNA, 18 nt, Escherichia coli CFT073
ccggcacguuuugcggau

SEQ ID NO: 600878 - RNA, 17 nt, Escherichia coli CFT073
ccggcacaucgccgaag

SEQ ID NO: 600879 - RNA, 13 nt, Escherichia coli CFT073
ccggcacauuuca

SEQ ID NO: 600880 - RNA, 12 nt, Escherichia coli CFT073
ccggcaccagcg

SEQ ID NO: 600881 - RNA, 21 nt, Escherichia coli CFT073
ccggcaccagcgcugcggccu

SEQ ID NO: 600882 - RNA, 20 nt, Escherichia coli CFT073
ccggcaaucaacagauaaau

SEQ ID NO: 600883 - RNA, 16 nt, Escherichia coli CFT073
ccggcaaucgccagau

SEQ ID NO: 600884 - RNA, 15 nt, Escherichia coli CFT073
ccggcaaugcgcacg

SEQ ID NO: 600885 - RNA, 14 nt, Escherichia coli CFT073
ccggcaaugggcaa

SEQ ID NO: 600886 - RNA, 19 nt, Escherichia coli CFT073
ccggcaauggugugauauu

SEQ ID NO: 600887 - RNA, 13 nt, Escherichia coli CFT073
ccggcaaccagca

SEQ ID NO: 600888 - RNA, 21 nt, Escherichia coli CFT073
ccggcaacgaccgcgagcaaa

SEQ ID NO: 600889 - RNA, 17 nt, Escherichia coli CFT073
ccggcaaaaucaaugcc

SEQ ID NO: 600890 - RNA, 16 nt, Escherichia coli CFT073
ccggcaaccacaccca

SEQ ID NO: 600891 - RNA, 15 nt, Escherichia coli CFT073
ccggauuucauaucc

SEQ ID NO: 600892 - RNA, 21 nt, Escherichia coli CFT073
ccggcagcgaaccgucgagau

SEQ ID NO: 600893 - RNA, 23 nt, Escherichia coli CFT073
ccggcaggaaauuaagaucagaa

SEQ ID NO: 600894 - RNA, 15 nt, Escherichia coli CFT073
ccggcaucgccagcg

SEQ ID NO: 600895 - RNA, 21 nt, Escherichia coli CFT073
ccguugacgaugucgacagga

SEQ ID NO: 600896 - RNA, 18 nt, Escherichia coli CFT073
ccguucuucccgccuguc

SEQ ID NO: 600897 - RNA, 19 nt, Escherichia coli CFT073
ccguucuccucaacgaugc

SEQ ID NO: 600898 - RNA, 20 nt, Escherichia coli CFT073
ccguucggugguaucaaaau

SEQ ID NO: 600899 - RNA, 17 nt, Escherichia coli CFT073
ccguguacgaacggucc

SEQ ID NO: 600900 - RNA, 21 nt, Escherichia coli CFT073
ccuaaaagcacgccagacauc

SEQ ID NO: 600901 - RNA, 18 nt, Escherichia coli CFT073
ccguugggaaucgucagg

SEQ ID NO: 600902 - RNA, 20 nt, Escherichia coli CFT073
ccguugcuucgccgcaucgu

SEQ ID NO: 600903 - RNA, 13 nt, Escherichia coli CFT073
ccuaucgcgucgc

SEQ ID NO: 600904 - RNA, 14 nt, Escherichia coli CFT073
ccucaagcguugcu

SEQ ID NO: 600905 - RNA, 16 nt, Escherichia coli CFT073
ccucaaaagguucagc

SEQ ID NO: 600906 - RNA, 23 nt, Escherichia coli CFT073
ccucaauaaucauucgcccgccg

SEQ ID NO: 600907 - RNA, 18 nt, Escherichia coli CFT073
ccucaaucagcggcucau

SEQ ID NO: 600908 - RNA, 17 nt, Escherichia coli CFT073
ccuaacucuuccugcgc

SEQ ID NO: 600909 - RNA, 19 nt, Escherichia coli CFT073
ccuaaauaaacaccagcag

SEQ ID NO: 600910 - RNA, 13 nt, Escherichia coli CFT073
ccuacaaaccauc

SEQ ID NO: 600911 - RNA, 14 nt, Escherichia coli CFT073
ccuccagcaucaga

SEQ ID NO: 600912 - RNA, 18 nt, Escherichia coli CFT073
ccucacuuaaagcaacac

SEQ ID NO: 600913 - RNA, 16 nt, Escherichia coli CFT073
ccucaccucaauggca

SEQ ID NO: 600914 - RNA, 20 nt, Escherichia coli CFT073
ccucacgcaaauucuucgcg

SEQ ID NO: 600915 - RNA, 22 nt, Escherichia coli CFT073
ccgucgcaccgguaucugccag

SEQ ID NO: 600916 - RNA, 16 nt, Escherichia coli CFT073
ccgucgauaugcaaau

SEQ ID NO: 600917 - RNA, 19 nt, Escherichia coli CFT073
ccgucgccaguaccagcag

SEQ ID NO: 600918 - RNA, 21 nt, Escherichia coli CFT073
ccgucgcauggggaucgugau

SEQ ID NO: 600919 - RNA, 22 nt, Escherichia coli CFT073
ccgucgcggcaaauuacuggcg

SEQ ID NO: 600920 - RNA, 20 nt, Escherichia coli CFT073
ccgugacgguaacguugcuc

SEQ ID NO: 600921 - RNA, 16 nt, Escherichia coli CFT073
ccgucguggucgugau

SEQ ID NO: 600922 - RNA, 21 nt, Escherichia coli CFT073
ccgucguggucgugaucgugg

SEQ ID NO: 600923 - RNA, 21 nt, Escherichia coli CFT073
ccgugaugcggucgcugccgc

SEQ ID NO: 600924 - RNA, 15 nt, Escherichia coli CFT073
ccugcucaaucgcau

SEQ ID NO: 600925 - RNA, 23 nt, Escherichia coli CFT073
ccugcucacgcaucaacgcggca

SEQ ID NO: 600926 - RNA, 17 nt, Escherichia coli CFT073
ccugcguuuguccgcca

SEQ ID NO: 600927 - RNA, 17 nt, Escherichia coli CFT073
ccugcuacaccauugcg

SEQ ID NO: 600928 - RNA, 18 nt, Escherichia coli CFT073
ccugcucaagcguuucau

SEQ ID NO: 600929 - RNA, 12 nt, Escherichia coli CFT073
ccugcuccgcca

SEQ ID NO: 600930 - RNA, 14 nt, Escherichia coli CFT073
ccuggagaguguuu

SEQ ID NO: 600931 - RNA, 14 nt, Escherichia coli CFT073
ccuggacaguuuca

SEQ ID NO: 600932 - RNA, 13 nt, Escherichia coli CFT073
ccuggaacgaugc

SEQ ID NO: 600933 - RNA, 20 nt, Escherichia coli CFT073
ccugcauaaugucgcuggcc

SEQ ID NO: 600934 - RNA, 17 nt, Escherichia coli CFT073
ccugcgaacuguaauga

SEQ ID NO: 600935 - RNA, 13 nt, Escherichia coli CFT073
ccugcguguggcg

SEQ ID NO: 600936 - RNA, 22 nt, Escherichia coli CFT073
ccugcguguggcgguagcgacc

SEQ ID NO: 600937 - RNA, 19 nt, Escherichia coli CFT073
ccugcgucgccaucgucac

SEQ ID NO: 600938 - RNA, 18 nt, Escherichia coli CFT073
ccugcgucuaucagugca

SEQ ID NO: 600939 - RNA, 16 nt, Escherichia coli CFT073
ccugcggguucuuacc

SEQ ID NO: 600940 - RNA, 11 nt, Escherichia coli CFT073
ccugcggcagc

SEQ ID NO: 600941 - RNA, 14 nt, Escherichia coli CFT073
ccugcggaucaagu

SEQ ID NO: 600942 - RNA, 14 nt, Escherichia coli CFT073
ccugcgcuggcagg

SEQ ID NO: 600943 - RNA, 16 nt, Escherichia coli CFT073
ccugcgcgcuggcgcg

SEQ ID NO: 600944 - RNA, 20 nt, Escherichia coli CFT073
ccugacuguuuuuccagcuu

SEQ ID NO: 600945 - RNA, 19 nt, Escherichia coli CFT073
ccugacuuuguaccagcgg

SEQ ID NO: 600946 - RNA, 20 nt, Escherichia coli CFT073
ccugagaagcgcagcgcauc

SEQ ID NO: 600947 - RNA, 16 nt, Escherichia coli CFT073
ccugacgcaauaacac

SEQ ID NO: 600948 - RNA, 15 nt, Escherichia coli CFT073
ccugacgcugcucag

SEQ ID NO: 600949 - RNA, 22 nt, Escherichia coli CFT073
ccugacggaaaucauccagcac

SEQ ID NO: 600950 - RNA, 14 nt, Escherichia coli CFT073
ccugcaaacgcuuu

SEQ ID NO: 600951 - RNA, 19 nt, Escherichia coli CFT073
ccugauaaccuuccagcuu

SEQ ID NO: 600952 - RNA, 22 nt, Escherichia coli CFT073
ccugagcagcgauaucugccga

SEQ ID NO: 600953 - RNA, 19 nt, Escherichia coli CFT073
ccugaguaucgaaaacauc

SEQ ID NO: 600954 - RNA, 15 nt, Escherichia coli CFT073
ccugcaagcgucgcg

SEQ ID NO: 600955 - RNA, 23 nt, Escherichia coli CFT073
ccugcaaauucaacguccuggcg

SEQ ID NO: 600956 - RNA, 18 nt, Escherichia coli CFT073
ccugcacggucacaucgc

SEQ ID NO: 600957 - RNA, 15 nt, Escherichia coli CFT073
ccugcaaggugguca

SEQ ID NO: 600958 - RNA, 16 nt, Escherichia coli CFT073
ccugcaauaaacaaac

SEQ ID NO: 600959 - RNA, 18 nt, Escherichia coli CFT073
ccugcaauaccgccguua

SEQ ID NO: 600960 - RNA, 19 nt, Escherichia coli CFT073
ccugcacaaagcgccagaa

SEQ ID NO: 600961 - RNA, 14 nt, Escherichia coli CFT073
ccugcaccacaaca

SEQ ID NO: 600962 - RNA, 20 nt, Escherichia coli CFT073
ccucgcuuuuaugccuggcg

SEQ ID NO: 600963 - RNA, 12 nt, Escherichia coli CFT073
ccguagcguuuu

SEQ ID NO: 600964 - RNA, 19 nt, Escherichia coli CFT073
ccguagcggcgauaaacag

SEQ ID NO: 600965 - RNA, 20 nt, Escherichia coli CFT073
ccguagcuggcaaugauauu

SEQ ID NO: 600966 - RNA, 18 nt, Escherichia coli CFT073
ccguagaaggcgacaaag

SEQ ID NO: 600967 - RNA, 17 nt, Escherichia coli CFT073
ccguccggcaucgcaaa

SEQ ID NO: 600968 - RNA, 12 nt, Escherichia coli CFT073
ccguccagcguu

SEQ ID NO: 600969 - RNA, 14 nt, Escherichia coli CFT073
ccgucacgacccau

SEQ ID NO: 600970 - RNA, 22 nt, Escherichia coli CFT073
ccgguuaaaucgacguucugcc

SEQ ID NO: 600971 - RNA, 15 nt, Escherichia coli CFT073
ccggugccgguuuca

SEQ ID NO: 600972 - RNA, 20 nt, Escherichia coli CFT073
ccggugcccgccagugcauc

SEQ ID NO: 600973 - RNA, 17 nt, Escherichia coli CFT073
ccggugccgccgucaga

SEQ ID NO: 600974 - RNA, 20 nt, Escherichia coli CFT073
ccggucuaccgauccggcac

SEQ ID NO: 600975 - RNA, 19 nt, Escherichia coli CFT073
ccgguaauugcacguccag

SEQ ID NO: 600976 - RNA, 14 nt, Escherichia coli CFT073
ccgguaaacaaaaa

SEQ ID NO: 600977 - RNA, 15 nt, Escherichia coli CFT073
ccgguaaagcgcaug

SEQ ID NO: 600978 - RNA, 21 nt, Escherichia coli CFT073
ccggguuuccuggagaguguu

SEQ ID NO: 600979 - RNA, 13 nt, Escherichia coli CFT073
ccgguagaugcca

SEQ ID NO: 600980 - RNA, 14 nt, Escherichia coli CFT073
ccgguacuuuccuu

SEQ ID NO: 600981 - RNA, 17 nt, Escherichia coli CFT073
ccgguacaucaauacca

SEQ ID NO: 600982 - RNA, 20 nt, Escherichia coli CFT073
ccggguuauuaguauggucg

SEQ ID NO: 600983 - RNA, 15 nt, Escherichia coli CFT073
ccgggugugacaaca

SEQ ID NO: 600984 - RNA, 20 nt, Escherichia coli CFT073
ccgggugugacaacaacauc

SEQ ID NO: 600985 - RNA, 19 nt, Escherichia coli CFT073
ccggguggaucauuuucau

SEQ ID NO: 600986 - RNA, 15 nt, Escherichia coli CFT073
ccgguauccaucaga

SEQ ID NO: 600987 - RNA, 23 nt, Escherichia coli CFT073
ccgguauguucagaaagcgccag

SEQ ID NO: 600988 - RNA, 21 nt, Escherichia coli CFT073
ccggucaacccaaccugccag

SEQ ID NO: 600989 - RNA, 13 nt, Escherichia coli CFT073
ccggucaccggau

SEQ ID NO: 600990 - RNA, 22 nt, Escherichia coli CFT073
ccggucauuggccggaauacca

SEQ ID NO: 600991 - RNA, 14 nt, Escherichia coli CFT073
ccggcgggcaaacg

SEQ ID NO: 600992 - RNA, 14 nt, Escherichia coli CFT073
ccggcuauauugca

SEQ ID NO: 600993 - RNA, 19 nt, Escherichia coli CFT073
ccggcucccgcagccacuc

SEQ ID NO: 600994 - RNA, 22 nt, Escherichia coli CFT073
ccgggaucauaaccaacaaaac

SEQ ID NO: 600995 - RNA, 18 nt, Escherichia coli CFT073
ccgggaucaucgccugau

SEQ ID NO: 600996 - RNA, 14 nt, Escherichia coli CFT073
ccgggaaggaaccu

SEQ ID NO: 600997 - RNA, 19 nt, Escherichia coli CFT073
ccggcugaauacgcagcgu

SEQ ID NO: 600998 - RNA, 21 nt, Escherichia coli CFT073
ccggcuguugaccccacagcg

SEQ ID NO: 600999 - RNA, 13 nt, Escherichia coli CFT073
ccggcuuaaugca

SEQ ID NO: 601000 - RNA, 13 nt, Escherichia coli CFT073
aaauaaucucacc

SEQ ID NO: 601001 - RNA, 12 nt, Escherichia coli CFT073
aaauaaucacca

SEQ ID NO: 601002 - RNA, 19 nt, Escherichia coli CFT073
aaauaauacguagcaccaa

SEQ ID NO: 601003 - RNA, 22 nt, Escherichia coli CFT073
aaaucagcaucaacccgcucau

SEQ ID NO: 601004 - RNA, 22 nt, Escherichia coli CFT073
aaaucaguugccgaauaccgua

SEQ ID NO: 601005 - RNA, 18 nt, Escherichia coli CFT073
aaauaacgguauugcuuu

SEQ ID NO: 601006 - RNA, 17 nt, Escherichia coli CFT073
aaauaacugguuagcuu

SEQ ID NO: 601007 - RNA, 15 nt, Escherichia coli CFT073
aaaucaucaguacca

SEQ ID NO: 601008 - RNA, 23 nt, Escherichia coli CFT073
aaaacaccgcuguugccagcagc

SEQ ID NO: 601009 - RNA, 23 nt, Escherichia coli CFT073
aaaacccaggcuuaauugcgcag

SEQ ID NO: 601010 - RNA, 20 nt, Escherichia coli CFT073
aaaacccgcuuuuugaagcg

SEQ ID NO: 601011 - RNA, 20 nt, Escherichia coli CFT073
aaaucauggcagcuuuuuca

SEQ ID NO: 601012 - RNA, 13 nt, Escherichia coli CFT073
aaaugacgaugca

SEQ ID NO: 601013 - RNA, 17 nt, Escherichia coli CFT073
aaaugacgcuuuauuca

SEQ ID NO: 601014 - RNA, 22 nt, Escherichia coli CFT073
aaaugccccacuuuacggcccg

SEQ ID NO: 601015 - RNA, 17 nt, Escherichia coli CFT073
aaaugcagcaaccagag

SEQ ID NO: 601016 - RNA, 23 nt, Escherichia coli CFT073
aaaugccaaauguauccaucacc

SEQ ID NO: 601017 - RNA, 15 nt, Escherichia coli CFT073
aaaugccgcacauca

SEQ ID NO: 601018 - RNA, 23 nt, Escherichia coli CFT073
aaaugccggaauuaauaauccgg

SEQ ID NO: 601019 - RNA, 20 nt, Escherichia coli CFT073
aaaugccgguuaauacgccg

SEQ ID NO: 601020 - RNA, 22 nt, Escherichia coli CFT073
aaaucggacuggguccgguggc

SEQ ID NO: 601021 - RNA, 18 nt, Escherichia coli CFT073
aaaucggcaccgccgcca

SEQ ID NO: 601022 - RNA, 13 nt, Escherichia coli CFT073
aaaucgggcgaca

SEQ ID NO: 601023 - RNA, 16 nt, Escherichia coli CFT073
aaaucgccgcaucauc

SEQ ID NO: 601024 - RNA, 12 nt, Escherichia coli CFT073
aaaucgccugaa

SEQ ID NO: 601025 - RNA, 12 nt, Escherichia coli CFT073
aaaucgacaucu

SEQ ID NO: 601026 - RNA, 20 nt, Escherichia coli CFT073
aaaucccugccgccaucacc

SEQ ID NO: 601027 - RNA, 23 nt, Escherichia coli CFT073
aaauccucuuuuaccaucagcgu

SEQ ID NO: 601028 - RNA, 20 nt, Escherichia coli CFT073
aaauccugccaacgcaccgu

SEQ ID NO: 601029 - RNA, 22 nt, Escherichia coli CFT073
aaauccuucagcaauuuguuca

SEQ ID NO: 601030 - RNA, 22 nt, Escherichia coli CFT073
aacaaagugcgcguuguucaug

SEQ ID NO: 601031 - RNA, 17 nt, Escherichia coli CFT073
aacaaagccgcuuaaua

SEQ ID NO: 601032 - RNA, 20 nt, Escherichia coli CFT073
aacaaauaguacacagacga

SEQ ID NO: 601033 - RNA, 19 nt, Escherichia coli CFT073
aaaagguaaggauaaaaaa

SEQ ID NO: 601034 - RNA, 18 nt, Escherichia coli CFT073
aacaaaaaacccaucaac

SEQ ID NO: 601035 - RNA, 12 nt, Escherichia coli CFT073
aacaaaaaauug

SEQ ID NO: 601036 - RNA, 14 nt, Escherichia coli CFT073
aacaauggcauaac

SEQ ID NO: 601037 - RNA, 23 nt, Escherichia coli CFT073
aacaaugucuucacaaccgccau

SEQ ID NO: 601038 - RNA, 12 nt, Escherichia coli CFT073
aacaacaacacg

SEQ ID NO: 601039 - RNA, 21 nt, Escherichia coli CFT073
aacaacacgccgauaaucaac

SEQ ID NO: 601040 - RNA, 20 nt, Escherichia coli CFT073
aacaaccaagacuauuaaua

SEQ ID NO: 601041 - RNA, 15 nt, Escherichia coli CFT073
aacaaccauccccaa

SEQ ID NO: 601042 - RNA, 13 nt, Escherichia coli CFT073
aacacauaacgcc

SEQ ID NO: 601043 - RNA, 17 nt, Escherichia coli CFT073
aacacauuuaucaagau

SEQ ID NO: 601044 - RNA, 13 nt, Escherichia coli CFT073
aacaccagcagca

SEQ ID NO: 601045 - RNA, 19 nt, Escherichia coli CFT073
aacaauguugucgccagua

SEQ ID NO: 601046 - RNA, 11 nt, Escherichia coli CFT073
aacacaccaca

SEQ ID NO: 601047 - RNA, 18 nt, Escherichia coli CFT073
aacacaguuguaauaaga

SEQ ID NO: 601048 - RNA, 12 nt, Escherichia coli CFT073
aacaccagggaa

SEQ ID NO: 601049 - RNA, 19 nt, Escherichia coli CFT073
aaaugucgauuaucgacuc

SEQ ID NO: 601050 - RNA, 23 nt, Escherichia coli CFT073
aaaacugcgcccgcuuuucgcca

SEQ ID NO: 601051 - RNA, 13 nt, Escherichia coli CFT073
aaaacggucauau

SEQ ID NO: 601052 - RNA, 16 nt, Escherichia coli CFT073
aaaacgguccggcauc

SEQ ID NO: 601053 - RNA, 21 nt, Escherichia coli CFT073
aaaacgccucauccggccuac

SEQ ID NO: 601054 - RNA, 22 nt, Escherichia coli CFT073
aaaacgcggcagguaacugacu

SEQ ID NO: 601055 - RNA, 19 nt, Escherichia coli CFT073
aaauuucauuuucagggca

SEQ ID NO: 601056 - RNA, 19 nt, Escherichia coli CFT073
aaaagaauugcagauacca

SEQ ID NO: 601057 - RNA, 20 nt, Escherichia coli CFT073
aaacgcgcgauagucaugau

SEQ ID NO: 601058 - RNA, 17 nt, Escherichia coli CFT073
aaacgcgacaauaccgg

SEQ ID NO: 601059 - RNA, 12 nt, Escherichia coli CFT073
aaacuuuuauca

SEQ ID NO: 601060 - RNA, 14 nt, Escherichia coli CFT073
aaacuuuucaccag

SEQ ID NO: 601061 - RNA, 20 nt, Escherichia coli CFT073
aaacggcugggaaaucacca

SEQ ID NO: 601062 - RNA, 21 nt, Escherichia coli CFT073
aaacgcuggugaaaucagccg

SEQ ID NO: 601063 - RNA, 20 nt, Escherichia coli CFT073
aaacgcuguaauuaccagcg

SEQ ID NO: 601064 - RNA, 21 nt, Escherichia coli CFT073
aaagaggcguugaucgcuuuc

SEQ ID NO: 601065 - RNA, 14 nt, Escherichia coli CFT073
aaagccaauuacaa

SEQ ID NO: 601066 - RNA, 13 nt, Escherichia coli CFT073
aaagaaacgccau

SEQ ID NO: 601067 - RNA, 18 nt, Escherichia coli CFT073
aaagaacccggcaauggu

SEQ ID NO: 601068 - RNA, 18 nt, Escherichia coli CFT073
aaagaacgcaccgaccau

SEQ ID NO: 601069 - RNA, 17 nt, Escherichia coli CFT073
aaagacuauccgccaua

SEQ ID NO: 601070 - RNA, 15 nt, Escherichia coli CFT073
aaagaaggaaaauac

SEQ ID NO: 601071 - RNA, 21 nt, Escherichia coli CFT073
aaagcguuccacgucacaggc

SEQ ID NO: 601072 - RNA, 21 nt, Escherichia coli CFT073
aaagguugcagcuccccacac

SEQ ID NO: 601073 - RNA, 21 nt, Escherichia coli CFT073
aaaggucaauuccuucugggc

SEQ ID NO: 601074 - RNA, 19 nt, Escherichia coli CFT073
aaagcgucgccgccgccag

SEQ ID NO: 601075 - RNA, 16 nt, Escherichia coli CFT073
aaagcgucgcaucagg

SEQ ID NO: 601076 - RNA, 23 nt, Escherichia coli CFT073
aaagcgcacuuuauuaacaagcg

SEQ ID NO: 601077 - RNA, 11 nt, Escherichia coli CFT073
aaagcggcagu

SEQ ID NO: 601078 - RNA, 12 nt, Escherichia coli CFT073
aaagccgacuca

SEQ ID NO: 601079 - RNA, 21 nt, Escherichia coli CFT073
aaagcccgcguaacgccagaa

SEQ ID NO: 601080 - RNA, 14 nt, Escherichia coli CFT073
aaagcccaucaccg

SEQ ID NO: 601081 - RNA, 16 nt, Escherichia coli CFT073
aaagcgauuauagcua

SEQ ID NO: 601082 - RNA, 22 nt, Escherichia coli CFT073
aaagcgacgguuguuuaagacg

SEQ ID NO: 601083 - RNA, 13 nt, Escherichia coli CFT073
aaagcgagcagua

SEQ ID NO: 601084 - RNA, 15 nt, Escherichia coli CFT073
aaagccgcgaaacug

SEQ ID NO: 601085 - RNA, 20 nt, Escherichia coli CFT073
aaagcgacacaaucaaaucc

SEQ ID NO: 601086 - RNA, 20 nt, Escherichia coli CFT073
aaacagccagcagcgaauca

SEQ ID NO: 601087 - RNA, 22 nt, Escherichia coli CFT073
aaacagccugcguucaguugau

SEQ ID NO: 601088 - RNA, 17 nt, Escherichia coli CFT073
aaacacuugcggcaccc

SEQ ID NO: 601089 - RNA, 18 nt, Escherichia coli CFT073
aaacagagauucgcuggc

SEQ ID NO: 601090 - RNA, 21 nt, Escherichia coli CFT073
aaacaggaauucggcaucgcg

SEQ ID NO: 601091 - RNA, 22 nt, Escherichia coli CFT073
aaacagguggcguuugccaccu

SEQ ID NO: 601092 - RNA, 20 nt, Escherichia coli CFT073
aaacaguaacccagcaccaa

SEQ ID NO: 601093 - RNA, 17 nt, Escherichia coli CFT073
aaacagucgcucggcga

SEQ ID NO: 601094 - RNA, 24 nt, Escherichia coli CFT073
aaacaucgucaggaagaagcccau

SEQ ID NO: 601095 - RNA, 15 nt, Escherichia coli CFT073
aaacaucccugaacc

SEQ ID NO: 601096 - RNA, 21 nt, Escherichia coli CFT073
aaacauccgguuucaucagcc

SEQ ID NO: 601097 - RNA, 18 nt, Escherichia coli CFT073
aaaccaaaaccggcucua

SEQ ID NO: 601098 - RNA, 13 nt, Escherichia coli CFT073
aaaccaaccagcg

SEQ ID NO: 601099 - RNA, 21 nt, Escherichia coli CFT073
aaaccaacuccaguggcgcau

SEQ ID NO: 601100 - RNA, 10 nt, Escherichia coli CFT073
aaaauuucau

SEQ ID NO: 601101 - RNA, 15 nt, Escherichia coli CFT073
aaacaaaugaaauau

SEQ ID NO: 601102 - RNA, 22 nt, Escherichia coli CFT073
aaacaaacugcgauuuaacgcc

SEQ ID NO: 601103 - RNA, 15 nt, Escherichia coli CFT073
aaacaaagcgcacgu

SEQ ID NO: 601104 - RNA, 16 nt, Escherichia coli CFT073
aaacaccguaccauca

SEQ ID NO: 601105 - RNA, 21 nt, Escherichia coli CFT073
aaacaccgcuguugccagcag

SEQ ID NO: 601106 - RNA, 23 nt, Escherichia coli CFT073
aaacaccgcuguugccagcagca

SEQ ID NO: 601107 - RNA, 13 nt, Escherichia coli CFT073
aaacacgcucagg

SEQ ID NO: 601108 - RNA, 23 nt, Escherichia coli CFT073
aaacacggcgaacauucccgguu

SEQ ID NO: 601109 - RNA, 23 nt, Escherichia coli CFT073
aaacacucuucaacacacugaau

SEQ ID NO: 601110 - RNA, 22 nt, Escherichia coli CFT073
aaacacugccucaggcaacggu

SEQ ID NO: 601111 - RNA, 20 nt, Escherichia coli CFT073
aaacacugcuuuuaaaugcc

SEQ ID NO: 601112 - RNA, 21 nt, Escherichia coli CFT073
aaacacugcuuuuaaaugccc

SEQ ID NO: 601113 - RNA, 13 nt, Escherichia coli CFT073
aaacaacgccaca

SEQ ID NO: 601114 - RNA, 14 nt, Escherichia coli CFT073
aaacaaucguugcc

SEQ ID NO: 601115 - RNA, 13 nt, Escherichia coli CFT073
aaacaauuacgcc

SEQ ID NO: 601116 - RNA, 17 nt, Escherichia coli CFT073
aaaccgagauaaaugcc

SEQ ID NO: 601117 - RNA, 17 nt, Escherichia coli CFT073
aaaccgagccaaacgcc

SEQ ID NO: 601118 - RNA, 17 nt, Escherichia coli CFT073
aaacccgcucaucagcg

SEQ ID NO: 601119 - RNA, 13 nt, Escherichia coli CFT073
aaacccggcauca

SEQ ID NO: 601120 - RNA, 21 nt, Escherichia coli CFT073
aaaccacaccgccuaccgcca

SEQ ID NO: 601121 - RNA, 14 nt, Escherichia coli CFT073
aaaccacaucagcg

SEQ ID NO: 601122 - RNA, 21 nt, Escherichia coli CFT073
aaaccagcgucauaaaaaucc

SEQ ID NO: 601123 - RNA, 17 nt, Escherichia coli CFT073
aaaccaggaacagugaa

SEQ ID NO: 601124 - RNA, 19 nt, Escherichia coli CFT073
aaaccauagaauacgccac

SEQ ID NO: 601125 - RNA, 20 nt, Escherichia coli CFT073
aaaccauagaauacgccacg

SEQ ID NO: 601126 - RNA, 15 nt, Escherichia coli CFT073
aaaccuuacgccauc

SEQ ID NO: 601127 - RNA, 23 nt, Escherichia coli CFT073
aaaccucaccucaauggcagcau

SEQ ID NO: 601128 - RNA, 21 nt, Escherichia coli CFT073
aaaccgguuuugguuaacuga

SEQ ID NO: 601129 - RNA, 17 nt, Escherichia coli CFT073
aaaccguggcaaaaucc

SEQ ID NO: 601130 - RNA, 12 nt, Escherichia coli CFT073
aaaccguuaauc

SEQ ID NO: 601131 - RNA, 20 nt, Escherichia coli CFT073
aaaaagcggcagggaucuuc

SEQ ID NO: 601132 - RNA, 19 nt, Escherichia coli CFT073
aaaauuacuuuccgccauu

SEQ ID NO: 601133 - RNA, 10 nt, Escherichia coli CFT073
aaaaaaugca

SEQ ID NO: 601134 - RNA, 12 nt, Escherichia coli CFT073
aaaaacaucaua

SEQ ID NO: 601135 - RNA, 19 nt, Escherichia coli CFT073
aaaaaccccgcuccggcgg

SEQ ID NO: 601136 - RNA, 21 nt, Escherichia coli CFT073
aaaaacgcauaccccaucagc

SEQ ID NO: 601137 - RNA, 22 nt, Escherichia coli CFT073
aaaauggagagaaccagcgcac

SEQ ID NO: 601138 - RNA, 17 nt, Escherichia coli CFT073
aaaaugguuugccagca

SEQ ID NO: 601139 - RNA, 14 nt, Escherichia coli CFT073
aaaaugcaccggau

SEQ ID NO: 601140 - RNA, 19 nt, Escherichia coli CFT073
aaaaugccagcaacuggcu

SEQ ID NO: 601141 - RNA, 12 nt, Escherichia coli CFT073
aaaaucggcaac

SEQ ID NO: 601142 - RNA, 15 nt, Escherichia coli CFT073
aaaaucuaccagcgg

SEQ ID NO: 601143 - RNA, 23 nt, Escherichia coli CFT073
aaaauacguuuucaccucugucg

SEQ ID NO: 601144 - RNA, 14 nt, Escherichia coli CFT073
aaaauaaucucacc

SEQ ID NO: 601145 - RNA, 18 nt, Escherichia coli CFT073
aaaauccucaacgccgca

SEQ ID NO: 601146 - RNA, 22 nt, Escherichia coli CFT073
aaaaucgagcguugcuucgcca

SEQ ID NO: 601147 - RNA, 13 nt, Escherichia coli CFT073
aaaauauggggca

SEQ ID NO: 601148 - RNA, 15 nt, Escherichia coli CFT073
aaaaucaaacagaau

SEQ ID NO: 601149 - RNA, 15 nt, Escherichia coli CFT073
aaaaucaacgccgca

SEQ ID NO: 601150 - RNA, 11 nt, Escherichia coli CFT073
aaaaucaccau

SEQ ID NO: 601151 - RNA, 11 nt, Escherichia coli CFT073
aaaaucacggc

SEQ ID NO: 601152 - RNA, 13 nt, Escherichia coli CFT073
aaaaucacucgcc

SEQ ID NO: 601153 - RNA, 20 nt, Escherichia coli CFT073
aaaaucagaaucgcgcccca

SEQ ID NO: 601154 - RNA, 23 nt, Escherichia coli CFT073
aaaagcccaucauugacagaccg

SEQ ID NO: 601155 - RNA, 17 nt, Escherichia coli CFT073
aaaagcauagccccagc

SEQ ID NO: 601156 - RNA, 16 nt, Escherichia coli CFT073
aaaagcccuggcaguu

SEQ ID NO: 601157 - RNA, 19 nt, Escherichia coli CFT073
aaaagcgauauccgggcaa

SEQ ID NO: 601158 - RNA, 19 nt, Escherichia coli CFT073
aaaagugaaugucggcggc

SEQ ID NO: 601159 - RNA, 15 nt, Escherichia coli CFT073
aaaacagccagcagc

SEQ ID NO: 601160 - RNA, 16 nt, Escherichia coli CFT073
aaaacagaaacccauu

SEQ ID NO: 601161 - RNA, 21 nt, Escherichia coli CFT073
aaaacaaagaaugccauaaaa

SEQ ID NO: 601162 - RNA, 16 nt, Escherichia coli CFT073
aaaaagggugacagca

SEQ ID NO: 601163 - RNA, 19 nt, Escherichia coli CFT073
aaaacauuacuaauuaaua

SEQ ID NO: 601164 - RNA, 17 nt, Escherichia coli CFT073
aaaaccaaaaccggcuc

SEQ ID NO: 601165 - RNA, 17 nt, Escherichia coli CFT073
aaaagaaauaucccuga

SEQ ID NO: 601166 - RNA, 13 nt, Escherichia coli CFT073
aaaacggcaacgg

SEQ ID NO: 601167 - RNA, 23 nt, Escherichia coli CFT073
aaaacgguggccacagcaagcag

SEQ ID NO: 601168 - RNA, 16 nt, Escherichia coli CFT073
aaaaauaaugccacca

SEQ ID NO: 601169 - RNA, 13 nt, Escherichia coli CFT073
aaaaaugcaagca

SEQ ID NO: 601170 - RNA, 20 nt, Escherichia coli CFT073
aaaaacgaagacagcgaaaa

SEQ ID NO: 601171 - RNA, 19 nt, Escherichia coli CFT073
aaaaagcgauauccgggca

SEQ ID NO: 601172 - RNA, 13 nt, Escherichia coli CFT073
acagccucaagca

SEQ ID NO: 601173 - RNA, 18 nt, Escherichia coli CFT073
acagcgggguaaucgcca

SEQ ID NO: 601174 - RNA, 21 nt, Escherichia coli CFT073
acagcggugcaccugccagca

SEQ ID NO: 601175 - RNA, 20 nt, Escherichia coli CFT073
acagcggcaucaaccgccgg

SEQ ID NO: 601176 - RNA, 19 nt, Escherichia coli CFT073
acagcggcguuuuaucacg

SEQ ID NO: 601177 - RNA, 18 nt, Escherichia coli CFT073
acagcgcaucucugucau

SEQ ID NO: 601178 - RNA, 15 nt, Escherichia coli CFT073
acagcgauuccaguu

SEQ ID NO: 601179 - RNA, 14 nt, Escherichia coli CFT073
acagcgcaaucacc

SEQ ID NO: 601180 - RNA, 23 nt, Escherichia coli CFT073
acagcuuagacaacgccgcuuuu

SEQ ID NO: 601181 - RNA, 15 nt, Escherichia coli CFT073
acaggaaaccggcga

SEQ ID NO: 601182 - RNA, 20 nt, Escherichia coli CFT073
acaggaaccaaaugccggaa

SEQ ID NO: 601183 - RNA, 17 nt, Escherichia coli CFT073
acagcugcgaccagugg

SEQ ID NO: 601184 - RNA, 22 nt, Escherichia coli CFT073
acagcugcgaccaguggcggga

SEQ ID NO: 601185 - RNA, 18 nt, Escherichia coli CFT073
acaggagacaccagcguc

SEQ ID NO: 601186 - RNA, 21 nt, Escherichia coli CFT073
acaggcgaucuucccgcgcau

SEQ ID NO: 601187 - RNA, 21 nt, Escherichia coli CFT073
acaggugcgagagguaauuug

SEQ ID NO: 601188 - RNA, 16 nt, Escherichia coli CFT073
acaggcggucgccguc

SEQ ID NO: 601189 - RNA, 23 nt, Escherichia coli CFT073
acaggcguuaugucuucccggcu

SEQ ID NO: 601190 - RNA, 18 nt, Escherichia coli CFT073
acaggcuacugccguggu

SEQ ID NO: 601191 - RNA, 13 nt, Escherichia coli CFT073
acagguccuggcu

SEQ ID NO: 601192 - RNA, 13 nt, Escherichia coli CFT073
acaggcgggaaga

SEQ ID NO: 601193 - RNA, 23 nt, Escherichia coli CFT073
acagacgaauaauccgcccggca

SEQ ID NO: 601194 - RNA, 11 nt, Escherichia coli CFT073
acagacgccag

SEQ ID NO: 601195 - RNA, 12 nt, Escherichia coli CFT073
acagacggcaga

SEQ ID NO: 601196 - RNA, 16 nt, Escherichia coli CFT073
acagagauucgcuggc

SEQ ID NO: 601197 - RNA, 22 nt, Escherichia coli CFT073
acagaguauuuccagcucaacc

SEQ ID NO: 601198 - RNA, 17 nt, Escherichia coli CFT073
acagauaauaaaaaaga

SEQ ID NO: 601199 - RNA, 12 nt, Escherichia coli CFT073
acagaugcgacg

SEQ ID NO: 601200 - RNA, 15 nt, Escherichia coli CFT073
acagauuagcuggcc

SEQ ID NO: 601201 - RNA, 21 nt, Escherichia coli CFT073
acagauucaauacuucagcga

SEQ ID NO: 601202 - RNA, 22 nt, Escherichia coli CFT073
acagcagaucgaacucaaugcc

SEQ ID NO: 601203 - RNA, 21 nt, Escherichia coli CFT073
acagcacggcagcaacagcag

SEQ ID NO: 601204 - RNA, 19 nt, Escherichia coli CFT073
acagcacguuacccgccgu

SEQ ID NO: 601205 - RNA, 19 nt, Escherichia coli CFT073
acagcagaacgaccagcgc

SEQ ID NO: 601206 - RNA, 18 nt, Escherichia coli CFT073
acagcaauacguuucaua

SEQ ID NO: 601207 - RNA, 15 nt, Escherichia coli CFT073
acagcaacucagcca

SEQ ID NO: 601208 - RNA, 14 nt, Escherichia coli CFT073
acagaaaguagcgg

SEQ ID NO: 601209 - RNA, 22 nt, Escherichia coli CFT073
acacuuuccaguuccggcauua

SEQ ID NO: 601210 - RNA, 20 nt, Escherichia coli CFT073
acacuuuccugcucggcaaa

SEQ ID NO: 601211 - RNA, 21 nt, Escherichia coli CFT073
acagaaugcgcgcgaaaacau

SEQ ID NO: 601212 - RNA, 17 nt, Escherichia coli CFT073
acagaaaucugaucgug

SEQ ID NO: 601213 - RNA, 23 nt, Escherichia coli CFT073
acagaagagagauaauucagcag

SEQ ID NO: 601214 - RNA, 18 nt, Escherichia coli CFT073
acacuggcagugugccug

SEQ ID NO: 601215 - RNA, 17 nt, Escherichia coli CFT073
acacugguucccaacaa

SEQ ID NO: 601216 - RNA, 20 nt, Escherichia coli CFT073
acacugguucccaacaacag

SEQ ID NO: 601217 - RNA, 15 nt, Escherichia coli CFT073
acacuguaccugguc

SEQ ID NO: 601218 - RNA, 19 nt, Escherichia coli CFT073
acacuguaccuggucgaua

SEQ ID NO: 601219 - RNA, 19 nt, Escherichia coli CFT073
acacuucauuggcuugcac

SEQ ID NO: 601220 - RNA, 13 nt, Escherichia coli CFT073
acacuguucauua

SEQ ID NO: 601221 - RNA, 17 nt, Escherichia coli CFT073
acacuucugccgcuuua

SEQ ID NO: 601222 - RNA, 15 nt, Escherichia coli CFT073
acacuucuucagcca

SEQ ID NO: 601223 - RNA, 21 nt, Escherichia coli CFT073
acacuacaccccagcguaaua

SEQ ID NO: 601224 - RNA, 17 nt, Escherichia coli CFT073
acacuacccgcgccaau

SEQ ID NO: 601225 - RNA, 14 nt, Escherichia coli CFT073
acacucacgcauac

SEQ ID NO: 601226 - RNA, 19 nt, Escherichia coli CFT073
acacucgugcgucgcaucc

SEQ ID NO: 601227 - RNA, 13 nt, Escherichia coli CFT073
acacucugcgccu

SEQ ID NO: 601228 - RNA, 19 nt, Escherichia coli CFT073
acacucuucaacacacuga

SEQ ID NO: 601229 - RNA, 15 nt, Escherichia coli CFT073
acacugagcaccaca

SEQ ID NO: 601230 - RNA, 21 nt, Escherichia coli CFT073
acacggugcuccagugcgcuu

SEQ ID NO: 601231 - RNA, 15 nt, Escherichia coli CFT073
acaccagaaccagca

SEQ ID NO: 601232 - RNA, 17 nt, Escherichia coli CFT073
acaccagaccagacaau

SEQ ID NO: 601233 - RNA, 14 nt, Escherichia coli CFT073
acaccaacaucacg

SEQ ID NO: 601234 - RNA, 21 nt, Escherichia coli CFT073
acaccaauaccgcccacuacc

SEQ ID NO: 601235 - RNA, 20 nt, Escherichia coli CFT073
acaccaccagcgccaccacg

SEQ ID NO: 601236 - RNA, 15 nt, Escherichia coli CFT073
acaccaccgcccggu

SEQ ID NO: 601237 - RNA, 18 nt, Escherichia coli CFT073
acacaguaaaauauucga

SEQ ID NO: 601238 - RNA, 22 nt, Escherichia coli CFT073
acacauaaugaugccgucuuua

SEQ ID NO: 601239 - RNA, 14 nt, Escherichia coli CFT073
acaccaugccagaa

SEQ ID NO: 601240 - RNA, 20 nt, Escherichia coli CFT073
acaccauccagcaacaacag

SEQ ID NO: 601241 - RNA, 20 nt, Escherichia coli CFT073
acaccagccagacucagcaa

SEQ ID NO: 601242 - RNA, 18 nt, Escherichia coli CFT073
acaccgcgaagcagcucc

SEQ ID NO: 601243 - RNA, 13 nt, Escherichia coli CFT073
acaccgcggaacg

SEQ ID NO: 601244 - RNA, 18 nt, Escherichia coli CFT073
acaccgcaaacugcuguu

SEQ ID NO: 601245 - RNA, 13 nt, Escherichia coli CFT073
acaccccagcgua

SEQ ID NO: 601246 - RNA, 14 nt, Escherichia coli CFT073
acacccgcaagacg

SEQ ID NO: 601247 - RNA, 15 nt, Escherichia coli CFT073
acacccggucagcca

SEQ ID NO: 601248 - RNA, 20 nt, Escherichia coli CFT073
acacccugauggcugauuac

SEQ ID NO: 601249 - RNA, 14 nt, Escherichia coli CFT073
aaaauaccgagcag

SEQ ID NO: 601250 - RNA, 19 nt, Escherichia coli CFT073
aaaauaccgagcagccacu

SEQ ID NO: 601251 - RNA, 21 nt, Escherichia coli CFT073
aaaaguuuauuacucagcgca

SEQ ID NO: 601252 - RNA, 18 nt, Escherichia coli CFT073
aaaauaaucucaccauuu

SEQ ID NO: 601253 - RNA, 16 nt, Escherichia coli CFT073
aaaagucauccggcgu

SEQ ID NO: 601254 - RNA, 17 nt, Escherichia coli CFT073
acacgcagaccaaccgu

SEQ ID NO: 601255 - RNA, 17 nt, Escherichia coli CFT073
aaaaguaguuccagcau

SEQ ID NO: 601256 - RNA, 20 nt, Escherichia coli CFT073
acacgccagugucgcaucag

SEQ ID NO: 601257 - RNA, 15 nt, Escherichia coli CFT073
acacgcggagccagu

SEQ ID NO: 601258 - RNA, 16 nt, Escherichia coli CFT073
acacgggguuaaauug

SEQ ID NO: 601259 - RNA, 17 nt, Escherichia coli CFT073
acaccugcuccgccaga

SEQ ID NO: 601260 - RNA, 13 nt, Escherichia coli CFT073
acaccugggcaau

SEQ ID NO: 601261 - RNA, 20 nt, Escherichia coli CFT073
acaccuuuccccggcagcau

SEQ ID NO: 601262 - RNA, 13 nt, Escherichia coli CFT073
acacgacgccagc

SEQ ID NO: 601263 - RNA, 18 nt, Escherichia coli CFT073
acacgacgcgccagcagc

SEQ ID NO: 601264 - RNA, 16 nt, Escherichia coli CFT073
acaccucacaccccgg

SEQ ID NO: 601265 - RNA, 14 nt, Escherichia coli CFT073
acaccgucagccag

SEQ ID NO: 601266 - RNA, 17 nt, Escherichia coli CFT073
acaccguccggcgggca

SEQ ID NO: 601267 - RNA, 16 nt, Escherichia coli CFT073
acaccgucgcaauacc

SEQ ID NO: 601268 - RNA, 19 nt, Escherichia coli CFT073
acaccguaauugccagacu

SEQ ID NO: 601269 - RNA, 15 nt, Escherichia coli CFT073
aauuucuucguucgc

SEQ ID NO: 601270 - RNA, 14 nt, Escherichia coli CFT073
aauuugaacugguu

SEQ ID NO: 601271 - RNA, 14 nt, Escherichia coli CFT073
aauuucuuuucaua

SEQ ID NO: 601272 - RNA, 21 nt, Escherichia coli CFT073
aauuuccgcagcuccagcccg

SEQ ID NO: 601273 - RNA, 17 nt, Escherichia coli CFT073
acaaaaacccgcucauc

SEQ ID NO: 601274 - RNA, 18 nt, Escherichia coli CFT073
acaaaaacgccgcucagu

SEQ ID NO: 601275 - RNA, 14 nt, Escherichia coli CFT073
aauuuuucuuucgu

SEQ ID NO: 601276 - RNA, 22 nt, Escherichia coli CFT073
aauuuuuccguuuuccagccuu

SEQ ID NO: 601277 - RNA, 23 nt, Escherichia coli CFT073
aauuuuucgcucuuucgcaucgc

SEQ ID NO: 601278 - RNA, 19 nt, Escherichia coli CFT073
aauuuuuuaauaaaaaggu

SEQ ID NO: 601279 - RNA, 15 nt, Escherichia coli CFT073
acaaaugcgccgcca

SEQ ID NO: 601280 - RNA, 19 nt, Escherichia coli CFT073
acaaauguguucagcgaca

SEQ ID NO: 601281 - RNA, 13 nt, Escherichia coli CFT073
acaaaugaguuau

SEQ ID NO: 601282 - RNA, 20 nt, Escherichia coli CFT073
acaaaucgugacagcauacc

SEQ ID NO: 601283 - RNA, 14 nt, Escherichia coli CFT073
acaaauacaugaug

SEQ ID NO: 601284 - RNA, 18 nt, Escherichia coli CFT073
acaaaguggcggcagcgg

SEQ ID NO: 601285 - RNA, 20 nt, Escherichia coli CFT073
acaaaacauaucccaccagc

SEQ ID NO: 601286 - RNA, 21 nt, Escherichia coli CFT073
acaaaacuguaucccagccca

SEQ ID NO: 601287 - RNA, 20 nt, Escherichia coli CFT073
acaaaaaaaccaucaccuaa

SEQ ID NO: 601288 - RNA, 14 nt, Escherichia coli CFT073
acaaagccaacagc

SEQ ID NO: 601289 - RNA, 14 nt, Escherichia coli CFT073
acaacacaccacca

SEQ ID NO: 601290 - RNA, 23 nt, Escherichia coli CFT073
acaaauguugcaucgccugcgcg

SEQ ID NO: 601291 - RNA, 17 nt, Escherichia coli CFT073
acaaccagcacaugcuu

SEQ ID NO: 601292 - RNA, 12 nt, Escherichia coli CFT073
acaaccaucccc

SEQ ID NO: 601293 - RNA, 14 nt, Escherichia coli CFT073
acaaccaaaucuga

SEQ ID NO: 601294 - RNA, 15 nt, Escherichia coli CFT073
acaacccaagcgcgc

SEQ ID NO: 601295 - RNA, 21 nt, Escherichia coli CFT073
acaacccagcggaugacccag

SEQ ID NO: 601296 - RNA, 21 nt, Escherichia coli CFT073
acaacaugcuauuacgccagc

SEQ ID NO: 601297 - RNA, 15 nt, Escherichia coli CFT073
acaaccucagcaguu

SEQ ID NO: 601298 - RNA, 16 nt, Escherichia coli CFT073
acaaccuccuccggca

SEQ ID NO: 601299 - RNA, 18 nt, Escherichia coli CFT073
acaacgggcaccgccgcc

SEQ ID NO: 601300 - RNA, 19 nt, Escherichia coli CFT073
acaacgggcaccgccgcca

SEQ ID NO: 601301 - RNA, 18 nt, Escherichia coli CFT073
acaauaaaaggugcguua

SEQ ID NO: 601302 - RNA, 16 nt, Escherichia coli CFT073
acaauaaacugcgacc

SEQ ID NO: 601303 - RNA, 15 nt, Escherichia coli CFT073
acaauaauaucuuuc

SEQ ID NO: 601304 - RNA, 13 nt, Escherichia coli CFT073
acaaguccagcac

SEQ ID NO: 601305 - RNA, 23 nt, Escherichia coli CFT073
acaaguccccgcuucgcccgcca

SEQ ID NO: 601306 - RNA, 20 nt, Escherichia coli CFT073
acaauacgcccacgcuucac

SEQ ID NO: 601307 - RNA, 14 nt, Escherichia coli CFT073
acaauacgcccggu

SEQ ID NO: 601308 - RNA, 23 nt, Escherichia coli CFT073
acaauauccagcgcgcgcagcac

SEQ ID NO: 601309 - RNA, 16 nt, Escherichia coli CFT073
acaauauuaacaacau

SEQ ID NO: 601310 - RNA, 20 nt, Escherichia coli CFT073
acaauauuaacaacauuacc

SEQ ID NO: 601311 - RNA, 15 nt, Escherichia coli CFT073
acaauauugcggaua

SEQ ID NO: 601312 - RNA, 16 nt, Escherichia coli CFT073
acaaucaacgccacca

SEQ ID NO: 601313 - RNA, 10 nt, Escherichia coli CFT073
acaaucacca

SEQ ID NO: 601314 - RNA, 11 nt, Escherichia coli CFT073
acaaucaccag

SEQ ID NO: 601315 - RNA, 15 nt, Escherichia coli CFT073
acaaucacuucauuc

SEQ ID NO: 601316 - RNA, 13 nt, Escherichia coli CFT073
acaagauuagcca

SEQ ID NO: 601317 - RNA, 18 nt, Escherichia coli CFT073
acaagccaaauccagcac

SEQ ID NO: 601318 - RNA, 19 nt, Escherichia coli CFT073
acaagcccaggccaucgcc

SEQ ID NO: 601319 - RNA, 14 nt, Escherichia coli CFT073
acaagcccgccaga

SEQ ID NO: 601320 - RNA, 16 nt, Escherichia coli CFT073
acaaggugcgaaaaaa

SEQ ID NO: 601321 - RNA, 22 nt, Escherichia coli CFT073
acaauucacacucugccagcga

SEQ ID NO: 601322 - RNA, 15 nt, Escherichia coli CFT073
acacaauccaugcca

SEQ ID NO: 601323 - RNA, 17 nt, Escherichia coli CFT073
acacaauccaugccaaa

SEQ ID NO: 601324 - RNA, 24 nt, Escherichia coli CFT073
acaauuugcgguccauauaaucga

SEQ ID NO: 601325 - RNA, 15 nt, Escherichia coli CFT073
acacacugcgccgcc

SEQ ID NO: 601326 - RNA, 15 nt, Escherichia coli CFT073
acacacuaccgccga

SEQ ID NO: 601327 - RNA, 21 nt, Escherichia coli CFT073
acacacuaccgccgagcacaa

SEQ ID NO: 601328 - RNA, 18 nt, Escherichia coli CFT073
acaauguugucgccagua

SEQ ID NO: 601329 - RNA, 12 nt, Escherichia coli CFT073
acaauuaauaca

SEQ ID NO: 601330 - RNA, 20 nt, Escherichia coli CFT073
acaauuaauacaauccagua

SEQ ID NO: 601331 - RNA, 15 nt, Escherichia coli CFT073
acaauuacgccgagc

SEQ ID NO: 601332 - RNA, 23 nt, Escherichia coli CFT073
acaauuacgccgagcgccagcca

SEQ ID NO: 601333 - RNA, 14 nt, Escherichia coli CFT073
acaauguaucuuuc

SEQ ID NO: 601334 - RNA, 22 nt, Escherichia coli CFT073
acaaugucauggcagucuuaau

SEQ ID NO: 601335 - RNA, 17 nt, Escherichia coli CFT073
acaaugucguccgguac

SEQ ID NO: 601336 - RNA, 15 nt, Escherichia coli CFT073
acaaugugaaaaccc

SEQ ID NO: 601337 - RNA, 22 nt, Escherichia coli CFT073
acaaugcaauauuuugaauuag

SEQ ID NO: 601338 - RNA, 16 nt, Escherichia coli CFT073
acaauggcccgccgca

SEQ ID NO: 601339 - RNA, 21 nt, Escherichia coli CFT073
acaaugccauauaacgggcuu

SEQ ID NO: 601340 - RNA, 20 nt, Escherichia coli CFT073
acaaucggcguaccgcacac

SEQ ID NO: 601341 - RNA, 17 nt, Escherichia coli CFT073
acaaucucaaccgcuuc

SEQ ID NO: 601342 - RNA, 14 nt, Escherichia coli CFT073
acaaugaucgacag

SEQ ID NO: 601343 - RNA, 16 nt, Escherichia coli CFT073
acaaucccuuccaccg

SEQ ID NO: 601344 - RNA, 15 nt, Escherichia coli CFT073
acaauccgauaaucc

SEQ ID NO: 601345 - RNA, 17 nt, Escherichia coli CFT073
acaaucgcccccaucac

SEQ ID NO: 601346 - RNA, 20 nt, Escherichia coli CFT073
aauguuuuccuguuucacgc

SEQ ID NO: 601347 - RNA, 19 nt, Escherichia coli CFT073
aauguugccggauggcacg

SEQ ID NO: 601348 - RNA, 17 nt, Escherichia coli CFT073
aauggcguuaucacggu

SEQ ID NO: 601349 - RNA, 23 nt, Escherichia coli CFT073
aauggcuccgggugugacaacaa

SEQ ID NO: 601350 - RNA, 23 nt, Escherichia coli CFT073
aauggcugcacuuucaguacguu

SEQ ID NO: 601351 - RNA, 19 nt, Escherichia coli CFT073
aaugggcaagcgaccaucg

SEQ ID NO: 601352 - RNA, 16 nt, Escherichia coli CFT073
aaugggcgcgggcaau

SEQ ID NO: 601353 - RNA, 13 nt, Escherichia coli CFT073
aauggggacauca

SEQ ID NO: 601354 - RNA, 10 nt, Escherichia coli CFT073
aauucaggcc

SEQ ID NO: 601355 - RNA, 11 nt, Escherichia coli CFT073
aauucaggccg

SEQ ID NO: 601356 - RNA, 22 nt, Escherichia coli CFT073
aauuaacccgcgacgacgacag

SEQ ID NO: 601357 - RNA, 13 nt, Escherichia coli CFT073
aauuaaguugauu

SEQ ID NO: 601358 - RNA, 23 nt, Escherichia coli CFT073
aauuaacaccaccagcgccacca

SEQ ID NO: 601359 - RNA, 17 nt, Escherichia coli CFT073
aauucccgacaauggcg

SEQ ID NO: 601360 - RNA, 22 nt, Escherichia coli CFT073
aauuccgccuccgcucaucacc

SEQ ID NO: 601361 - RNA, 22 nt, Escherichia coli CFT073
aauucccugugccagcggcagu

SEQ ID NO: 601362 - RNA, 22 nt, Escherichia coli CFT073
aauuccggcguuuugauuuuca

SEQ ID NO: 601363 - RNA, 13 nt, Escherichia coli CFT073
aauucaguaccag

SEQ ID NO: 601364 - RNA, 15 nt, Escherichia coli CFT073
aauucaguaccagca

SEQ ID NO: 601365 - RNA, 14 nt, Escherichia coli CFT073
aauuccagcgccag

SEQ ID NO: 601366 - RNA, 21 nt, Escherichia coli CFT073
aauugcucgacuagauacuga

SEQ ID NO: 601367 - RNA, 12 nt, Escherichia coli CFT073
aauugcggcagg

SEQ ID NO: 601368 - RNA, 19 nt, Escherichia coli CFT073
aauugcguuaaaaucagcg

SEQ ID NO: 601369 - RNA, 11 nt, Escherichia coli CFT073
aauugccagcu

SEQ ID NO: 601370 - RNA, 14 nt, Escherichia coli CFT073
aauugccauuacua

SEQ ID NO: 601371 - RNA, 24 nt, Escherichia coli CFT073
aauucgagcaucaucucacgcagu

SEQ ID NO: 601372 - RNA, 21 nt, Escherichia coli CFT073
aauucgcagaccgggaaucga

SEQ ID NO: 601373 - RNA, 18 nt, Escherichia coli CFT073
aauucgcuuucacucagu

SEQ ID NO: 601374 - RNA, 20 nt, Escherichia coli CFT073
aauucggccugguaaucgcg

SEQ ID NO: 601375 - RNA, 17 nt, Escherichia coli CFT073
aauugagaugacgccac

SEQ ID NO: 601376 - RNA, 17 nt, Escherichia coli CFT073
aauuucaucaucacgaa

SEQ ID NO: 601377 - RNA, 11 nt, Escherichia coli CFT073
aauuucaggcu

SEQ ID NO: 601378 - RNA, 23 nt, Escherichia coli CFT073
aauuucagguucugaccagccag

SEQ ID NO: 601379 - RNA, 21 nt, Escherichia coli CFT073
aauuguuuacuaaaaguuauu

SEQ ID NO: 601380 - RNA, 20 nt, Escherichia coli CFT073
aauuguuccgucagccgccc

SEQ ID NO: 601381 - RNA, 14 nt, Escherichia coli CFT073
aauuuaaaugacaa

SEQ ID NO: 601382 - RNA, 22 nt, Escherichia coli CFT073
aauugucaacggcacggaaagc

SEQ ID NO: 601383 - RNA, 18 nt, Escherichia coli CFT073
aauuggcagaccagagcu

SEQ ID NO: 601384 - RNA, 19 nt, Escherichia coli CFT073
aauuguccagaucuuucgc

SEQ ID NO: 601385 - RNA, 15 nt, Escherichia coli CFT073
aaucacaauccgcuc

SEQ ID NO: 601386 - RNA, 23 nt, Escherichia coli CFT073
aaucacacagcgguuuaccgaug

SEQ ID NO: 601387 - RNA, 21 nt, Escherichia coli CFT073
aaucacaguauuuaagugaca

SEQ ID NO: 601388 - RNA, 14 nt, Escherichia coli CFT073
aaucacaucaccau

SEQ ID NO: 601389 - RNA, 12 nt, Escherichia coli CFT073
aaucacaucgcg

SEQ ID NO: 601390 - RNA, 14 nt, Escherichia coli CFT073
aaucaccagcaaca

SEQ ID NO: 601391 - RNA, 14 nt, Escherichia coli CFT073
aaucaccaucagca

SEQ ID NO: 601392 - RNA, 13 nt, Escherichia coli CFT073
aaucaccugccgg

SEQ ID NO: 601393 - RNA, 20 nt, Escherichia coli CFT073
aaucaccucuuuguaccagu

SEQ ID NO: 601394 - RNA, 14 nt, Escherichia coli CFT073
aaucuuuacaccaa

SEQ ID NO: 601395 - RNA, 23 nt, Escherichia coli CFT073
aaucuuuagcggcggaauuaacc

SEQ ID NO: 601396 - RNA, 23 nt, Escherichia coli CFT073
aaucacugccaccaggaacgcgc

SEQ ID NO: 601397 - RNA, 17 nt, Escherichia coli CFT073
aaugacaguaucaccaa

SEQ ID NO: 601398 - RNA, 12 nt, Escherichia coli CFT073
aaugacaacauu

SEQ ID NO: 601399 - RNA, 21 nt, Escherichia coli CFT073
aaugaccgcuaauagcgcagc

SEQ ID NO: 601400 - RNA, 23 nt, Escherichia coli CFT073
aaugcugguuuugugcgccacau

SEQ ID NO: 601401 - RNA, 18 nt, Escherichia coli CFT073
aauggcgacguaccagcg

SEQ ID NO: 601402 - RNA, 16 nt, Escherichia coli CFT073
aauggcgcccaucggc

SEQ ID NO: 601403 - RNA, 22 nt, Escherichia coli CFT073
aaugcuugacucuguggcggga

SEQ ID NO: 601404 - RNA, 22 nt, Escherichia coli CFT073
aaugcucccgcaaggucgacuu

SEQ ID NO: 601405 - RNA, 16 nt, Escherichia coli CFT073
aaugcgcuuccggcag

SEQ ID NO: 601406 - RNA, 23 nt, Escherichia coli CFT073
aaugcgcuuccggcagcuucacg

SEQ ID NO: 601407 - RNA, 12 nt, Escherichia coli CFT073
aaugcgcuugca

SEQ ID NO: 601408 - RNA, 18 nt, Escherichia coli CFT073
aaugcgcggucagaaaau

SEQ ID NO: 601409 - RNA, 13 nt, Escherichia coli CFT073
aaugcgccgccaa

SEQ ID NO: 601410 - RNA, 15 nt, Escherichia coli CFT073
aaugcgccgccaaac

SEQ ID NO: 601411 - RNA, 22 nt, Escherichia coli CFT073
aaugcgcucgcauccugccagg

SEQ ID NO: 601412 - RNA, 13 nt, Escherichia coli CFT073
aaugcgcgagcca

SEQ ID NO: 601413 - RNA, 19 nt, Escherichia coli CFT073
aaugcgccagacgugcacg

SEQ ID NO: 601414 - RNA, 19 nt, Escherichia coli CFT073
aaugcgccccgcaacgccg

SEQ ID NO: 601415 - RNA, 14 nt, Escherichia coli CFT073
aaugcacccgccag

SEQ ID NO: 601416 - RNA, 13 nt, Escherichia coli CFT073
aaugcacuccgcc

SEQ ID NO: 601417 - RNA, 17 nt, Escherichia coli CFT073
aaugcacuccgccgcac

SEQ ID NO: 601418 - RNA, 16 nt, Escherichia coli CFT073
aaugcacuuccagcgg

SEQ ID NO: 601419 - RNA, 12 nt, Escherichia coli CFT073
aaugcaggcguu

SEQ ID NO: 601420 - RNA, 21 nt, Escherichia coli CFT073
aaugcagguccacgaccagcg

SEQ ID NO: 601421 - RNA, 15 nt, Escherichia coli CFT073
aaugcaggcaucggu

SEQ ID NO: 601422 - RNA, 21 nt, Escherichia coli CFT073
aaugccaaucuucacaucauc

SEQ ID NO: 601423 - RNA, 23 nt, Escherichia coli CFT073
aaugcccaguguuguauucagac

SEQ ID NO: 601424 - RNA, 14 nt, Escherichia coli CFT073
aaugccgacauagg

SEQ ID NO: 601425 - RNA, 13 nt, Escherichia coli CFT073
aaguuaccgcgcc

SEQ ID NO: 601426 - RNA, 23 nt, Escherichia coli CFT073
aaguuagucgcuuucauucagaa

SEQ ID NO: 601427 - RNA, 20 nt, Escherichia coli CFT073
aaguucguccccaccaguga

SEQ ID NO: 601428 - RNA, 14 nt, Escherichia coli CFT073
aaguucauccauac

SEQ ID NO: 601429 - RNA, 16 nt, Escherichia coli CFT073
aaguguggccgccagu

SEQ ID NO: 601430 - RNA, 17 nt, Escherichia coli CFT073
aagugcgagucgucagu

SEQ ID NO: 601431 - RNA, 12 nt, Escherichia coli CFT073
aagugcggcgca

SEQ ID NO: 601432 - RNA, 15 nt, Escherichia coli CFT073
aagugcggcgcacca

SEQ ID NO: 601433 - RNA, 20 nt, Escherichia coli CFT073
aaggugacguccagaaccgc

SEQ ID NO: 601434 - RNA, 14 nt, Escherichia coli CFT073
aagucguaggccug

SEQ ID NO: 601435 - RNA, 14 nt, Escherichia coli CFT073
aagugaucauccau

SEQ ID NO: 601436 - RNA, 18 nt, Escherichia coli CFT073
aagugcacuuugucagca

SEQ ID NO: 601437 - RNA, 21 nt, Escherichia coli CFT073
aauaauugaauaacggcccca

SEQ ID NO: 601438 - RNA, 21 nt, Escherichia coli CFT073
aauaaugucgcugguaacauc

SEQ ID NO: 601439 - RNA, 14 nt, Escherichia coli CFT073
aauaauccccacau

SEQ ID NO: 601440 - RNA, 14 nt, Escherichia coli CFT073
aauaaucgcaucaa

SEQ ID NO: 601441 - RNA, 20 nt, Escherichia coli CFT073
aauaaucagauacaccgcga

SEQ ID NO: 601442 - RNA, 12 nt, Escherichia coli CFT073
aauaaucagccc

SEQ ID NO: 601443 - RNA, 12 nt, Escherichia coli CFT073
aauaaccauucc

SEQ ID NO: 601444 - RNA, 23 nt, Escherichia coli CFT073
aauaaccgaaucguuuuuuucgc

SEQ ID NO: 601445 - RNA, 14 nt, Escherichia coli CFT073
aauaaccgucuuug

SEQ ID NO: 601446 - RNA, 17 nt, Escherichia coli CFT073
aauaacagugauugcuu

SEQ ID NO: 601447 - RNA, 19 nt, Escherichia coli CFT073
aaguugccggauguguugc

SEQ ID NO: 601448 - RNA, 20 nt, Escherichia coli CFT073
aauaucuucuacuucacggc

SEQ ID NO: 601449 - RNA, 16 nt, Escherichia coli CFT073
aauaucguaauugaag

SEQ ID NO: 601450 - RNA, 17 nt, Escherichia coli CFT073
aauaucguuguuggcuu

SEQ ID NO: 601451 - RNA, 13 nt, Escherichia coli CFT073
aauauccauuaaa

SEQ ID NO: 601452 - RNA, 18 nt, Escherichia coli CFT073
aauauccggauuuuucgc

SEQ ID NO: 601453 - RNA, 19 nt, Escherichia coli CFT073
aauaucgaauggcguuaac

SEQ ID NO: 601454 - RNA, 18 nt, Escherichia coli CFT073
aauaauuacuuacaucug

SEQ ID NO: 601455 - RNA, 20 nt, Escherichia coli CFT073
aauacgauccugagcagcaa

SEQ ID NO: 601456 - RNA, 21 nt, Escherichia coli CFT073
aauacgcaucaccucaccggu

SEQ ID NO: 601457 - RNA, 20 nt, Escherichia coli CFT073
aauacgcaucauauucauag

SEQ ID NO: 601458 - RNA, 16 nt, Escherichia coli CFT073
aauacguuuaugucgc

SEQ ID NO: 601459 - RNA, 21 nt, Escherichia coli CFT073
aauacguuuaugucgcauccu

SEQ ID NO: 601460 - RNA, 13 nt, Escherichia coli CFT073
aauacguuucaua

SEQ ID NO: 601461 - RNA, 21 nt, Escherichia coli CFT073
aauacgucuuuaggaacgcgc

SEQ ID NO: 601462 - RNA, 20 nt, Escherichia coli CFT073
aauacucuucgcggcuguug

SEQ ID NO: 601463 - RNA, 19 nt, Escherichia coli CFT073
aauacugcaacuucacggc

SEQ ID NO: 601464 - RNA, 21 nt, Escherichia coli CFT073
aauagaaaguugccagauaaa

SEQ ID NO: 601465 - RNA, 23 nt, Escherichia coli CFT073
aauauuuuucgucaguuuauaca

SEQ ID NO: 601466 - RNA, 20 nt, Escherichia coli CFT073
aaucaaaguuaguaaaacua

SEQ ID NO: 601467 - RNA, 21 nt, Escherichia coli CFT073
aaucaaauaaauaaucucuuc

SEQ ID NO: 601468 - RNA, 15 nt, Escherichia coli CFT073
aauauuuucgccgcc

SEQ ID NO: 601469 - RNA, 12 nt, Escherichia coli CFT073
aauauuucauuc

SEQ ID NO: 601470 - RNA, 21 nt, Escherichia coli CFT073
aaucaauccggcaaucaacau

SEQ ID NO: 601471 - RNA, 22 nt, Escherichia coli CFT073
aaucaagguaauugcuuucuuc

SEQ ID NO: 601472 - RNA, 14 nt, Escherichia coli CFT073
aaucaaccauuaaa

SEQ ID NO: 601473 - RNA, 19 nt, Escherichia coli CFT073
aauauugaugcacaccauc

SEQ ID NO: 601474 - RNA, 21 nt, Escherichia coli CFT073
aauauuggucauucggcgcag

SEQ ID NO: 601475 - RNA, 22 nt, Escherichia coli CFT073
aauauucgcgugaguggcgcgc

SEQ ID NO: 601476 - RNA, 14 nt, Escherichia coli CFT073
aauauucuuccggc

SEQ ID NO: 601477 - RNA, 16 nt, Escherichia coli CFT073
aauaugcuuuuauuca

SEQ ID NO: 601478 - RNA, 17 nt, Escherichia coli CFT073
aauaugucgcgccaggc

SEQ ID NO: 601479 - RNA, 14 nt, Escherichia coli CFT073
aauaugugcgccac

SEQ ID NO: 601480 - RNA, 22 nt, Escherichia coli CFT073
aauauuaaaccacccgcggcga

SEQ ID NO: 601481 - RNA, 19 nt, Escherichia coli CFT073
aauaucuuucuaccauccg

SEQ ID NO: 601482 - RNA, 19 nt, Escherichia coli CFT073
aaggaugaaacugccggaa

SEQ ID NO: 601483 - RNA, 18 nt, Escherichia coli CFT073
aaggcaaacaggauccgc

SEQ ID NO: 601484 - RNA, 14 nt, Escherichia coli CFT073
aaggcaaaguccgc

SEQ ID NO: 601485 - RNA, 22 nt, Escherichia coli CFT073
aaggcaaucggaugacccgcau

SEQ ID NO: 601486 - RNA, 23 nt, Escherichia coli CFT073
aaggcacgccaauuacgccugcc

SEQ ID NO: 601487 - RNA, 21 nt, Escherichia coli CFT073
aaggccaauacccguacgguu

SEQ ID NO: 601488 - RNA, 18 nt, Escherichia coli CFT073
aaggccagcaauccccag

SEQ ID NO: 601489 - RNA, 19 nt, Escherichia coli CFT073
aagcgcaucgacgccauca

SEQ ID NO: 601490 - RNA, 17 nt, Escherichia coli CFT073
aagcgcaugaugucugc

SEQ ID NO: 601491 - RNA, 15 nt, Escherichia coli CFT073
aagcgccacaaucgc

SEQ ID NO: 601492 - RNA, 14 nt, Escherichia coli CFT073
aagcguagcgcauc

SEQ ID NO: 601493 - RNA, 22 nt, Escherichia coli CFT073
aagcggugaucaaaacgggcaa

SEQ ID NO: 601494 - RNA, 18 nt, Escherichia coli CFT073
aaggucaucacaucccag

SEQ ID NO: 601495 - RNA, 21 nt, Escherichia coli CFT073
aagguagugcuucuaaaggaa

SEQ ID NO: 601496 - RNA, 22 nt, Escherichia coli CFT073
aaggucggggucgcgaguucga

SEQ ID NO: 601497 - RNA, 14 nt, Escherichia coli CFT073
aaggcuacgccaca

SEQ ID NO: 601498 - RNA, 20 nt, Escherichia coli CFT073
aaggcuaguacaggcggcaa

SEQ ID NO: 601499 - RNA, 21 nt, Escherichia coli CFT073
aaggcucucuuaccagccgcg

SEQ ID NO: 601500 - RNA, 24 nt, Escherichia coli CFT073
aaggcuuccagcgucgcggucaga

SEQ ID NO: 601501 - RNA, 17 nt, Escherichia coli CFT073
aaggcguuuacgccgca

SEQ ID NO: 601502 - RNA, 18 nt, Escherichia coli CFT073
aaggcguuuacgccgcau

SEQ ID NO: 601503 - RNA, 22 nt, Escherichia coli CFT073
aaggcguuugcgucgcauccgg

SEQ ID NO: 601504 - RNA, 20 nt, Escherichia coli CFT073
aaggcguugauuggcgcagg

SEQ ID NO: 601505 - RNA, 14 nt, Escherichia coli CFT073
aagacugcgacgau

SEQ ID NO: 601506 - RNA, 14 nt, Escherichia coli CFT073
aagacuucaucggu

SEQ ID NO: 601507 - RNA, 17 nt, Escherichia coli CFT073
aagagauccgcacucaa

SEQ ID NO: 601508 - RNA, 15 nt, Escherichia coli CFT073
aagccaagcgccgcc

SEQ ID NO: 601509 - RNA, 18 nt, Escherichia coli CFT073
aagccaguucucaccaaa

SEQ ID NO: 601510 - RNA, 22 nt, Escherichia coli CFT073
aagccagaauaaucggcgucau

SEQ ID NO: 601511 - RNA, 13 nt, Escherichia coli CFT073
aagccagacgugc

SEQ ID NO: 601512 - RNA, 18 nt, Escherichia coli CFT073
aagccacccacaccgcag

SEQ ID NO: 601513 - RNA, 19 nt, Escherichia coli CFT073
aagccacaaucgcagcgca

SEQ ID NO: 601514 - RNA, 12 nt, Escherichia coli CFT073
aagacgacgaac

SEQ ID NO: 601515 - RNA, 13 nt, Escherichia coli CFT073
aagacgcgccagc

SEQ ID NO: 601516 - RNA, 21 nt, Escherichia coli CFT073
aagacgcggcaagcgucgcau

SEQ ID NO: 601517 - RNA, 23 nt, Escherichia coli CFT073
aagacgcggcagcgucgcaucag

SEQ ID NO: 601518 - RNA, 21 nt, Escherichia coli CFT073
aagacgcggcaggcgucgcau

SEQ ID NO: 601519 - RNA, 20 nt, Escherichia coli CFT073
aagacgcggcagcgucgcau

SEQ ID NO: 601520 - RNA, 21 nt, Escherichia coli CFT073
aagacgcguaaagcgucgcau

SEQ ID NO: 601521 - RNA, 18 nt, Escherichia coli CFT073
aagacgguuaacgccagc

SEQ ID NO: 601522 - RNA, 21 nt, Escherichia coli CFT073
aagacgguuaacgccagccac

SEQ ID NO: 601523 - RNA, 20 nt, Escherichia coli CFT073
aagacgcgucagcgccgcau

SEQ ID NO: 601524 - RNA, 20 nt, Escherichia coli CFT073
aagacgcgucagcgucgcau

SEQ ID NO: 601525 - RNA, 20 nt, Escherichia coli CFT073
aagacgcgucugcgucgcau

SEQ ID NO: 601526 - RNA, 21 nt, Escherichia coli CFT073
aagacgcguuaagcgucgcau

SEQ ID NO: 601527 - RNA, 21 nt, Escherichia coli CFT073
aagacgcgucaagcgucgcau

SEQ ID NO: 601528 - RNA, 17 nt, Escherichia coli CFT073
aagacggccaucccagu

SEQ ID NO: 601529 - RNA, 19 nt, Escherichia coli CFT073
aagcgcaaaauaccagcaa

SEQ ID NO: 601530 - RNA, 20 nt, Escherichia coli CFT073
aagccgguaaucaccagcaa

SEQ ID NO: 601531 - RNA, 23 nt, Escherichia coli CFT073
aagccggaugaucauccggcuuu

SEQ ID NO: 601532 - RNA, 17 nt, Escherichia coli CFT073
aagccggaugcuuucgu

SEQ ID NO: 601533 - RNA, 16 nt, Escherichia coli CFT073
aagccgcuaacagcag

SEQ ID NO: 601534 - RNA, 21 nt, Escherichia coli CFT073
aagccgauaccuuccggcguu

SEQ ID NO: 601535 - RNA, 20 nt, Escherichia coli CFT073
aagcccguguuucugauaca

SEQ ID NO: 601536 - RNA, 18 nt, Escherichia coli CFT073
aagcccugaucgcgcgcc

SEQ ID NO: 601537 - RNA, 22 nt, Escherichia coli CFT073
aagcccuuaagaaaacugcgcc

SEQ ID NO: 601538 - RNA, 16 nt, Escherichia coli CFT073
aaccgugcuucagcca

SEQ ID NO: 601539 - RNA, 14 nt, Escherichia coli CFT073
aaccgucgcgccgg

SEQ ID NO: 601540 - RNA, 14 nt, Escherichia coli CFT073
aaccggugcgcgau

SEQ ID NO: 601541 - RNA, 21 nt, Escherichia coli CFT073
aaccggugcugcgccuaacaa

SEQ ID NO: 601542 - RNA, 20 nt, Escherichia coli CFT073
aaccugacggcgcaacgcau

SEQ ID NO: 601543 - RNA, 12 nt, Escherichia coli CFT073
aaccugccagag

SEQ ID NO: 601544 - RNA, 21 nt, Escherichia coli CFT073
aaccugccgcgccugcgccau

SEQ ID NO: 601545 - RNA, 18 nt, Escherichia coli CFT073
aaccucauuaaucaccag

SEQ ID NO: 601546 - RNA, 19 nt, Escherichia coli CFT073
aaccucauuaaucaccagu

SEQ ID NO: 601547 - RNA, 23 nt, Escherichia coli CFT073
aacacggcuuucugcaaccagaa

SEQ ID NO: 601548 - RNA, 15 nt, Escherichia coli CFT073
aacacggugccagua

SEQ ID NO: 601549 - RNA, 16 nt, Escherichia coli CFT073
aacacgccagcguuau

SEQ ID NO: 601550 - RNA, 12 nt, Escherichia coli CFT073
aacacgccgccg

SEQ ID NO: 601551 - RNA, 17 nt, Escherichia coli CFT073
aacaccugcggcggcau

SEQ ID NO: 601552 - RNA, 16 nt, Escherichia coli CFT073
aacaccuucguccagc

SEQ ID NO: 601553 - RNA, 21 nt, Escherichia coli CFT073
aacaccuaccggcuggcgcau

SEQ ID NO: 601554 - RNA, 14 nt, Escherichia coli CFT073
aacaccucagccag

SEQ ID NO: 601555 - RNA, 20 nt, Escherichia coli CFT073
aacgccugauagcccgcaca

SEQ ID NO: 601556 - RNA, 20 nt, Escherichia coli CFT073
aacgccugauucggccuaca

SEQ ID NO: 601557 - RNA, 22 nt, Escherichia coli CFT073
aacgccccuaaauaaacaccag

SEQ ID NO: 601558 - RNA, 22 nt, Escherichia coli CFT073
aacgccccacaagcccgccaga

SEQ ID NO: 601559 - RNA, 20 nt, Escherichia coli CFT073
aacgcccucuaaaauaacga

SEQ ID NO: 601560 - RNA, 20 nt, Escherichia coli CFT073
aacgccagauccgggcuaau

SEQ ID NO: 601561 - RNA, 18 nt, Escherichia coli CFT073
aacgccagccacaaacca

SEQ ID NO: 601562 - RNA, 20 nt, Escherichia coli CFT073
aaccuucacccucacgcauu

SEQ ID NO: 601563 - RNA, 18 nt, Escherichia coli CFT073
aacgacccacaauagcga

SEQ ID NO: 601564 - RNA, 23 nt, Escherichia coli CFT073
aacgaccgcgggacaaauaauga

SEQ ID NO: 601565 - RNA, 17 nt, Escherichia coli CFT073
aacgaccuccaucgcac

SEQ ID NO: 601566 - RNA, 22 nt, Escherichia coli CFT073
aacgacgaccgccgcucaccug

SEQ ID NO: 601567 - RNA, 21 nt, Escherichia coli CFT073
aacgccaccacucaaaagcgu

SEQ ID NO: 601568 - RNA, 22 nt, Escherichia coli CFT073
aacgccaccauuuuacgcccgc

SEQ ID NO: 601569 - RNA, 14 nt, Escherichia coli CFT073
aacgagaaaagcca

SEQ ID NO: 601570 - RNA, 22 nt, Escherichia coli CFT073
aacgcuggggccaucgccgccu

SEQ ID NO: 601571 - RNA, 12 nt, Escherichia coli CFT073
aacgcugccaug

SEQ ID NO: 601572 - RNA, 17 nt, Escherichia coli CFT073
aacgcugcccgccgcga

SEQ ID NO: 601573 - RNA, 21 nt, Escherichia coli CFT073
aacgcugugcguaaucgccga

SEQ ID NO: 601574 - RNA, 21 nt, Escherichia coli CFT073
aacgcuucagcguaucccagu

SEQ ID NO: 601575 - RNA, 22 nt, Escherichia coli CFT073
aacgcuucugucgcuucacgca

SEQ ID NO: 601576 - RNA, 17 nt, Escherichia coli CFT073
aacgcguucucgccaaa

SEQ ID NO: 601577 - RNA, 19 nt, Escherichia coli CFT073
aacgcuccugcuacaccau

SEQ ID NO: 601578 - RNA, 21 nt, Escherichia coli CFT073
aacgcucgcagcccguggcgc

SEQ ID NO: 601579 - RNA, 16 nt, Escherichia coli CFT073
aacgcuccaugcugcg

SEQ ID NO: 601580 - RNA, 16 nt, Escherichia coli CFT073
aacgcggcguaaccac

SEQ ID NO: 601581 - RNA, 12 nt, Escherichia coli CFT073
aacgccugcucc

SEQ ID NO: 601582 - RNA, 20 nt, Escherichia coli CFT073
aacgccuuauccggccuacg

SEQ ID NO: 601583 - RNA, 16 nt, Escherichia coli CFT073
aacgccuuguucgccc

SEQ ID NO: 601584 - RNA, 17 nt, Escherichia coli CFT073
aacgcgcuuucuucgca

SEQ ID NO: 601585 - RNA, 15 nt, Escherichia coli CFT073
aacgcggcaaaaccc

SEQ ID NO: 601586 - RNA, 22 nt, Escherichia coli CFT073
aacuggugacuuuugcccggca

SEQ ID NO: 601587 - RNA, 20 nt, Escherichia coli CFT073
aacugugcaccgcccugcau

SEQ ID NO: 601588 - RNA, 15 nt, Escherichia coli CFT073
aacugugccagacgc

SEQ ID NO: 601589 - RNA, 22 nt, Escherichia coli CFT073
aacugugccagacgcguuaaua

SEQ ID NO: 601590 - RNA, 23 nt, Escherichia coli CFT073
aacuuaagauucggcuucuuccu

SEQ ID NO: 601591 - RNA, 12 nt, Escherichia coli CFT073
aacuuaagcgcc

SEQ ID NO: 601592 - RNA, 17 nt, Escherichia coli CFT073
aacuucccgcugugguu

SEQ ID NO: 601593 - RNA, 23 nt, Escherichia coli CFT073
aacuucgccacagcggcaucaac

SEQ ID NO: 601594 - RNA, 14 nt, Escherichia coli CFT073
aacuuccugcuggc

SEQ ID NO: 601595 - RNA, 16 nt, Escherichia coli CFT073
aacuugcgacagccau

SEQ ID NO: 601596 - RNA, 18 nt, Escherichia coli CFT073
aacuucgcguucuguggc

SEQ ID NO: 601597 - RNA, 16 nt, Escherichia coli CFT073
aacuucuauucaccag

SEQ ID NO: 601598 - RNA, 21 nt, Escherichia coli CFT073
aacuucucuucuuccgcuuca

SEQ ID NO: 601599 - RNA, 16 nt, Escherichia coli CFT073
aagacaucgcccgauu

SEQ ID NO: 601600 - RNA, 12 nt, Escherichia coli CFT073
aagacccggcgc

SEQ ID NO: 601601 - RNA, 17 nt, Escherichia coli CFT073
aagaccaauccagccgg

SEQ ID NO: 601602 - RNA, 21 nt, Escherichia coli CFT073
aagaaguuagagccgauaucc

SEQ ID NO: 601603 - RNA, 14 nt, Escherichia coli CFT073
aagaacaccagcac

SEQ ID NO: 601604 - RNA, 16 nt, Escherichia coli CFT073
aagaacuccggcgcgu

SEQ ID NO: 601605 - RNA, 12 nt, Escherichia coli CFT073
aagaaccgccac

SEQ ID NO: 601606 - RNA, 19 nt, Escherichia coli CFT073
aagaacgcaccgaccaucg

SEQ ID NO: 601607 - RNA, 16 nt, Escherichia coli CFT073
aagaaaaaaugcugca

SEQ ID NO: 601608 - RNA, 22 nt, Escherichia coli CFT073
aagaaacgcuccaccaccgcga

SEQ ID NO: 601609 - RNA, 18 nt, Escherichia coli CFT073
aacucaccuuuuuucuua

SEQ ID NO: 601610 - RNA, 23 nt, Escherichia coli CFT073
aacucaggaacuuaguaggccug

SEQ ID NO: 601611 - RNA, 19 nt, Escherichia coli CFT073
aacuccaguagcgagccgu

SEQ ID NO: 601612 - RNA, 20 nt, Escherichia coli CFT073
aacuccaguggcgcaucagc

SEQ ID NO: 601613 - RNA, 17 nt, Escherichia coli CFT073
aacucauugccagcccu

SEQ ID NO: 601614 - RNA, 22 nt, Escherichia coli CFT073
aacuccugauuccaggucaauc

SEQ ID NO: 601615 - RNA, 15 nt, Escherichia coli CFT073
aacuccgucauccug

SEQ ID NO: 601616 - RNA, 19 nt, Escherichia coli CFT073
aacuccccgcaaaccagac

SEQ ID NO: 601617 - RNA, 15 nt, Escherichia coli CFT073
aacuccggcauaaua

SEQ ID NO: 601618 - RNA, 18 nt, Escherichia coli CFT073
aacuaucccaucagcggg

SEQ ID NO: 601619 - RNA, 13 nt, Escherichia coli CFT073
aacucaacgugga

SEQ ID NO: 601620 - RNA, 19 nt, Escherichia coli CFT073
aacucaccauccugaucgc

SEQ ID NO: 601621 - RNA, 20 nt, Escherichia coli CFT073
aacggcgagaucuucgccau

SEQ ID NO: 601622 - RNA, 13 nt, Escherichia coli CFT073
aacggccugacca

SEQ ID NO: 601623 - RNA, 19 nt, Escherichia coli CFT073
aacggcagcgccugcagcu

SEQ ID NO: 601624 - RNA, 22 nt, Escherichia coli CFT073
aacggcagaguuguucugcgac

SEQ ID NO: 601625 - RNA, 12 nt, Escherichia coli CFT073
aacggcagguuu

SEQ ID NO: 601626 - RNA, 14 nt, Escherichia coli CFT073
aacucuuucacuuu

SEQ ID NO: 601627 - RNA, 22 nt, Escherichia coli CFT073
aacugacgaaugcguugcguca

SEQ ID NO: 601628 - RNA, 22 nt, Escherichia coli CFT073
aacucuugccagauuuucuuca

SEQ ID NO: 601629 - RNA, 13 nt, Escherichia coli CFT073
aacucgucgcuga

SEQ ID NO: 601630 - RNA, 20 nt, Escherichia coli CFT073
aacucguuaacuucaucccg

SEQ ID NO: 601631 - RNA, 15 nt, Escherichia coli CFT073
aacucgcuggcggcu

SEQ ID NO: 601632 - RNA, 13 nt, Escherichia coli CFT073
aacucgccaaacc

SEQ ID NO: 601633 - RNA, 20 nt, Escherichia coli CFT073
aacugacgguuucucccgcc

SEQ ID NO: 601634 - RNA, 15 nt, Escherichia coli CFT073
aacugagcgcgggag

SEQ ID NO: 601635 - RNA, 13 nt, Escherichia coli CFT073
aacugaguucaua

SEQ ID NO: 601636 - RNA, 23 nt, Escherichia coli CFT073
aacugauacucgucgcgcacgcc

SEQ ID NO: 601637 - RNA, 21 nt, Escherichia coli CFT073
aacugauuuagcaucagcgcu

SEQ ID NO: 601638 - RNA, 18 nt, Escherichia coli CFT073
aacugcacaccgcggaac

SEQ ID NO: 601639 - RNA, 16 nt, Escherichia coli CFT073
aacugcagcaggcgag

SEQ ID NO: 601640 - RNA, 23 nt, Escherichia coli CFT073
aacugcccaggcaaaaaggccua

SEQ ID NO: 601641 - RNA, 20 nt, Escherichia coli CFT073
aacugccuuucccuuucuua

SEQ ID NO: 601642 - RNA, 21 nt, Escherichia coli CFT073
aacugcgaccguacaaccaaa

SEQ ID NO: 601643 - RNA, 18 nt, Escherichia coli CFT073
aacugcguagaguccagc

SEQ ID NO: 601644 - RNA, 16 nt, Escherichia coli CFT073
agaccuucugccagac

SEQ ID NO: 601645 - RNA, 13 nt, Escherichia coli CFT073
agacgaucgccac

SEQ ID NO: 601646 - RNA, 20 nt, Escherichia coli CFT073
agacgcaacagaaacgccau

SEQ ID NO: 601647 - RNA, 13 nt, Escherichia coli CFT073
agacgcaucgccc

SEQ ID NO: 601648 - RNA, 23 nt, Escherichia coli CFT073
agacgcaucgcccagccaucgac

SEQ ID NO: 601649 - RNA, 14 nt, Escherichia coli CFT073
agacgccauugaug

SEQ ID NO: 601650 - RNA, 15 nt, Escherichia coli CFT073
agaccgaacagcaua

SEQ ID NO: 601651 - RNA, 20 nt, Escherichia coli CFT073
agaccgcaucacgacagcac

SEQ ID NO: 601652 - RNA, 15 nt, Escherichia coli CFT073
agaccgcgcaguacc

SEQ ID NO: 601653 - RNA, 22 nt, Escherichia coli CFT073
agaccguugcucagaaucacgc

SEQ ID NO: 601654 - RNA, 20 nt, Escherichia coli CFT073
agaccugaauuugcuccaga

SEQ ID NO: 601655 - RNA, 22 nt, Escherichia coli CFT073
agaccugauaagacgcgccagc

SEQ ID NO: 601656 - RNA, 15 nt, Escherichia coli CFT073
agaccugcgcaucgg

SEQ ID NO: 601657 - RNA, 16 nt, Escherichia coli CFT073
agaccgugagcaaugc

SEQ ID NO: 601658 - RNA, 19 nt, Escherichia coli CFT073
agaccacaaucaacgccac

SEQ ID NO: 601659 - RNA, 16 nt, Escherichia coli CFT073
agaccagaaacgccac

SEQ ID NO: 601660 - RNA, 16 nt, Escherichia coli CFT073
agaccagccagcaaug

SEQ ID NO: 601661 - RNA, 12 nt, Escherichia coli CFT073
agacccggccau

SEQ ID NO: 601662 - RNA, 13 nt, Escherichia coli CFT073
agaccaucggcgc

SEQ ID NO: 601663 - RNA, 15 nt, Escherichia coli CFT073
agaauuuucgcugga

SEQ ID NO: 601664 - RNA, 16 nt, Escherichia coli CFT073
agacaauccagcgaaa

SEQ ID NO: 601665 - RNA, 17 nt, Escherichia coli CFT073
agacaauccccgccagc

SEQ ID NO: 601666 - RNA, 13 nt, Escherichia coli CFT073
agacaccagcguc

SEQ ID NO: 601667 - RNA, 14 nt, Escherichia coli CFT073
agacaccggcgcac

SEQ ID NO: 601668 - RNA, 21 nt, Escherichia coli CFT073
agacaccguuuccauaucgcu

SEQ ID NO: 601669 - RNA, 20 nt, Escherichia coli CFT073
agacacacugucaaucgcac

SEQ ID NO: 601670 - RNA, 19 nt, Escherichia coli CFT073
agacacgccagugucgcau

SEQ ID NO: 601671 - RNA, 20 nt, Escherichia coli CFT073
agacacgccagugucgcauc

SEQ ID NO: 601672 - RNA, 19 nt, Escherichia coli CFT073
agacacugcgaucgcccgc

SEQ ID NO: 601673 - RNA, 15 nt, Escherichia coli CFT073
agaccaaaccaucac

SEQ ID NO: 601674 - RNA, 19 nt, Escherichia coli CFT073
agacauagcacauaaaaug

SEQ ID NO: 601675 - RNA, 14 nt, Escherichia coli CFT073
agacaucaucguga

SEQ ID NO: 601676 - RNA, 13 nt, Escherichia coli CFT073
agagaucgccgcu

SEQ ID NO: 601677 - RNA, 19 nt, Escherichia coli CFT073
agagcaccgccucgcggau

SEQ ID NO: 601678 - RNA, 18 nt, Escherichia coli CFT073
agagcaaccagcaaugcc

SEQ ID NO: 601679 - RNA, 21 nt, Escherichia coli CFT073
agagcacgaccuugccaaggu

SEQ ID NO: 601680 - RNA, 18 nt, Escherichia coli CFT073
agagcgcugcgcaggcaa

SEQ ID NO: 601681 - RNA, 15 nt, Escherichia coli CFT073
agagcgaauaucauu

SEQ ID NO: 601682 - RNA, 19 nt, Escherichia coli CFT073
agagccccagccgcaaacg

SEQ ID NO: 601683 - RNA, 20 nt, Escherichia coli CFT073
agagccgguuuugguuuucu

SEQ ID NO: 601684 - RNA, 12 nt, Escherichia coli CFT073
agagaacugcug

SEQ ID NO: 601685 - RNA, 15 nt, Escherichia coli CFT073
agagaacugugccag

SEQ ID NO: 601686 - RNA, 21 nt, Escherichia coli CFT073
agagaagcgcguucaucccac

SEQ ID NO: 601687 - RNA, 17 nt, Escherichia coli CFT073
agacuuuuuucaugggu

SEQ ID NO: 601688 - RNA, 15 nt, Escherichia coli CFT073
agagaaagcaaaaau

SEQ ID NO: 601689 - RNA, 18 nt, Escherichia coli CFT073
agagaaccagcugccgaa

SEQ ID NO: 601690 - RNA, 23 nt, Escherichia coli CFT073
agagacuauuucuucaucgguau

SEQ ID NO: 601691 - RNA, 23 nt, Escherichia coli CFT073
agagagauccagcuucgccagcg

SEQ ID NO: 601692 - RNA, 17 nt, Escherichia coli CFT073
agagagauguugcugcu

SEQ ID NO: 601693 - RNA, 20 nt, Escherichia coli CFT073
agacuuuauagaucaggaaa

SEQ ID NO: 601694 - RNA, 13 nt, Escherichia coli CFT073
agacuuugcugcc

SEQ ID NO: 601695 - RNA, 21 nt, Escherichia coli CFT073
agacuuuuugcggcagcaaug

SEQ ID NO: 601696 - RNA, 20 nt, Escherichia coli CFT073
agacuucacugaaaaucacc

SEQ ID NO: 601697 - RNA, 20 nt, Escherichia coli CFT073
agacugaagcuccgcugaaa

SEQ ID NO: 601698 - RNA, 14 nt, Escherichia coli CFT073
agacucaccaaucg

SEQ ID NO: 601699 - RNA, 23 nt, Escherichia coli CFT073
agacguuuguaacccaccaugcc

SEQ ID NO: 601700 - RNA, 16 nt, Escherichia coli CFT073
agacgguuaaaaacag

SEQ ID NO: 601701 - RNA, 17 nt, Escherichia coli CFT073
agacgguuaacgccagc

SEQ ID NO: 601702 - RNA, 15 nt, Escherichia coli CFT073
agacgggcgucagcg

SEQ ID NO: 601703 - RNA, 14 nt, Escherichia coli CFT073
agacggccauccca

SEQ ID NO: 601704 - RNA, 20 nt, Escherichia coli CFT073
agacgcucuuucaccagugg

SEQ ID NO: 601705 - RNA, 19 nt, Escherichia coli CFT073
agacgcguagugucgcauc

SEQ ID NO: 601706 - RNA, 13 nt, Escherichia coli CFT073
agacgcgucagcg

SEQ ID NO: 601707 - RNA, 15 nt, Escherichia coli CFT073
agacgcgucagcgcc

SEQ ID NO: 601708 - RNA, 20 nt, Escherichia coli CFT073
agacgcgucagcgccgcauc

SEQ ID NO: 601709 - RNA, 21 nt, Escherichia coli CFT073
agacgcguaaagcgucgcauc

SEQ ID NO: 601710 - RNA, 20 nt, Escherichia coli CFT073
agacgcgucagcgucgcauc

SEQ ID NO: 601711 - RNA, 19 nt, Escherichia coli CFT073
agacgcguggcgucgcauc

SEQ ID NO: 601712 - RNA, 18 nt, Escherichia coli CFT073
agacgcguuaauaccuga

SEQ ID NO: 601713 - RNA, 20 nt, Escherichia coli CFT073
agacgcguuagcgucgcauc

SEQ ID NO: 601714 - RNA, 21 nt, Escherichia coli CFT073
agacgcggcccgcgucgcauc

SEQ ID NO: 601715 - RNA, 21 nt, Escherichia coli CFT073
agacgcggcuagcgucgcauc

SEQ ID NO: 601716 - RNA, 14 nt, Escherichia coli CFT073
agacgcgccagcgc

SEQ ID NO: 601717 - RNA, 15 nt, Escherichia coli CFT073
agacgcgccagcguc

SEQ ID NO: 601718 - RNA, 21 nt, Escherichia coli CFT073
agacgcgccagcgucgcauca

SEQ ID NO: 601719 - RNA, 13 nt, Escherichia coli CFT073
agacgcgccgcca

SEQ ID NO: 601720 - RNA, 21 nt, Escherichia coli CFT073
agacgcgaacagcgucgcauc

SEQ ID NO: 601721 - RNA, 19 nt, Escherichia coli CFT073
agaugaacggcuuuuucug

SEQ ID NO: 601722 - RNA, 23 nt, Escherichia coli CFT073
agaugaauaacuccgucauccug

SEQ ID NO: 601723 - RNA, 18 nt, Escherichia coli CFT073
agaugcacaagcggcagu

SEQ ID NO: 601724 - RNA, 13 nt, Escherichia coli CFT073
agaugcagcggua

SEQ ID NO: 601725 - RNA, 20 nt, Escherichia coli CFT073
agaugcgccagcaucgcauc

SEQ ID NO: 601726 - RNA, 22 nt, Escherichia coli CFT073
agaugcgacguuuaccgcaucc

SEQ ID NO: 601727 - RNA, 20 nt, Escherichia coli CFT073
agaugcggcgugaacgccuu

SEQ ID NO: 601728 - RNA, 23 nt, Escherichia coli CFT073
agaugcugugccuccugcggcuu

SEQ ID NO: 601729 - RNA, 17 nt, Escherichia coli CFT073
agaugcggggauuuucg

SEQ ID NO: 601730 - RNA, 12 nt, Escherichia coli CFT073
agauggaucagc

SEQ ID NO: 601731 - RNA, 16 nt, Escherichia coli CFT073
agaucuaugucgcauc

SEQ ID NO: 601732 - RNA, 17 nt, Escherichia coli CFT073
agaucuuuaucaaucac

SEQ ID NO: 601733 - RNA, 16 nt, Escherichia coli CFT073
agaucgugcagcaccg

SEQ ID NO: 601734 - RNA, 21 nt, Escherichia coli CFT073
agaucguguuuugcaaucauc

SEQ ID NO: 601735 - RNA, 14 nt, Escherichia coli CFT073
agaucguugaccug

SEQ ID NO: 601736 - RNA, 18 nt, Escherichia coli CFT073
agaucggugccgccacga

SEQ ID NO: 601737 - RNA, 22 nt, Escherichia coli CFT073
agaucgggcuuguggcucgcca

SEQ ID NO: 601738 - RNA, 14 nt, Escherichia coli CFT073
agaucgcacauguc

SEQ ID NO: 601739 - RNA, 13 nt, Escherichia coli CFT073
agaucgccagccc

SEQ ID NO: 601740 - RNA, 23 nt, Escherichia coli CFT073
agauccuggcgaaaacgcccggc

SEQ ID NO: 601741 - RNA, 13 nt, Escherichia coli CFT073
agaucggccaucg

SEQ ID NO: 601742 - RNA, 16 nt, Escherichia coli CFT073
agaucgcuucaauacc

SEQ ID NO: 601743 - RNA, 11 nt, Escherichia coli CFT073
agaucgcgacc

SEQ ID NO: 601744 - RNA, 19 nt, Escherichia coli CFT073
agaucgcgaugagucgccg

SEQ ID NO: 601745 - RNA, 23 nt, Escherichia coli CFT073
agaguaaagcccgccaucgccca

SEQ ID NO: 601746 - RNA, 16 nt, Escherichia coli CFT073
agaguacguucacuuu

SEQ ID NO: 601747 - RNA, 13 nt, Escherichia coli CFT073
agaguaucgccau

SEQ ID NO: 601748 - RNA, 14 nt, Escherichia coli CFT073
agagucauuaugcu

SEQ ID NO: 601749 - RNA, 20 nt, Escherichia coli CFT073
agaguuugaacucacagggc

SEQ ID NO: 601750 - RNA, 14 nt, Escherichia coli CFT073
agaguuacuggcga

SEQ ID NO: 601751 - RNA, 14 nt, Escherichia coli CFT073
agaguugagcaguc

SEQ ID NO: 601752 - RNA, 19 nt, Escherichia coli CFT073
agauaaacgauuuuuacuc

SEQ ID NO: 601753 - RNA, 16 nt, Escherichia coli CFT073
agaguugcaccagcaa

SEQ ID NO: 601754 - RNA, 21 nt, Escherichia coli CFT073
agauaacuggcaaaaacaagg

SEQ ID NO: 601755 - RNA, 16 nt, Escherichia coli CFT073
agagcuaaaaucgcca

SEQ ID NO: 601756 - RNA, 23 nt, Escherichia coli CFT073
agagcuaccggcaggaaauuaag

SEQ ID NO: 601757 - RNA, 18 nt, Escherichia coli CFT073
agaggcgauaucuuccgu

SEQ ID NO: 601758 - RNA, 23 nt, Escherichia coli CFT073
agaggcgcgcgggugaugugcca

SEQ ID NO: 601759 - RNA, 20 nt, Escherichia coli CFT073
agaucagcaaauaauucauc

SEQ ID NO: 601760 - RNA, 15 nt, Escherichia coli CFT073
agaucacgcaucacc

SEQ ID NO: 601761 - RNA, 19 nt, Escherichia coli CFT073
agaucacucacccgccagc

SEQ ID NO: 601762 - RNA, 22 nt, Escherichia coli CFT073
agaucacuucuguuugcgccac

SEQ ID NO: 601763 - RNA, 13 nt, Escherichia coli CFT073
agaucaccacaua

SEQ ID NO: 601764 - RNA, 22 nt, Escherichia coli CFT073
agauauucaucagcaucacgaa

SEQ ID NO: 601765 - RNA, 18 nt, Escherichia coli CFT073
agaucaaugcgccaaccu

SEQ ID NO: 601766 - RNA, 15 nt, Escherichia coli CFT073
agaucagcggcggcg

SEQ ID NO: 601767 - RNA, 13 nt, Escherichia coli CFT073
agauccagcgagc

SEQ ID NO: 601768 - RNA, 18 nt, Escherichia coli CFT073
agauccaugaagcaauga

SEQ ID NO: 601769 - RNA, 17 nt, Escherichia coli CFT073
agauauuuaacaucauu

SEQ ID NO: 601770 - RNA, 17 nt, Escherichia coli CFT073
agauauuucaccagcgc

SEQ ID NO: 601771 - RNA, 13 nt, Escherichia coli CFT073
agauaucccgcca

SEQ ID NO: 601772 - RNA, 19 nt, Escherichia coli CFT073
agauauagccuaacacagc

SEQ ID NO: 601773 - RNA, 13 nt, Escherichia coli CFT073
agauagaaccacg

SEQ ID NO: 601774 - RNA, 14 nt, Escherichia coli CFT073
agauagaaccacgc

SEQ ID NO: 601775 - RNA, 23 nt, Escherichia coli CFT073
agauagccagguuuaccagcagc

SEQ ID NO: 601776 - RNA, 14 nt, Escherichia coli CFT073
agauagaacugcau

SEQ ID NO: 601777 - RNA, 23 nt, Escherichia coli CFT073
agauaaugacuuccgccaccacg

SEQ ID NO: 601778 - RNA, 15 nt, Escherichia coli CFT073
agauaccaccagcgc

SEQ ID NO: 601779 - RNA, 20 nt, Escherichia coli CFT073
agaauuauuagcaacgauau

SEQ ID NO: 601780 - RNA, 14 nt, Escherichia coli CFT073
agaaugcagcagca

SEQ ID NO: 601781 - RNA, 12 nt, Escherichia coli CFT073
agaaugccagca

SEQ ID NO: 601782 - RNA, 17 nt, Escherichia coli CFT073
agaauuaaccagaaaua

SEQ ID NO: 601783 - RNA, 14 nt, Escherichia coli CFT073
agaauuaauugcua

SEQ ID NO: 601784 - RNA, 19 nt, Escherichia coli CFT073
agaaucuucuucucagcca

SEQ ID NO: 601785 - RNA, 17 nt, Escherichia coli CFT073
agaaucgggauauugcc

SEQ ID NO: 601786 - RNA, 19 nt, Escherichia coli CFT073
agaaucgggauauugcccu

SEQ ID NO: 601787 - RNA, 12 nt, Escherichia coli CFT073
agaaucucugcg

SEQ ID NO: 601788 - RNA, 14 nt, Escherichia coli CFT073
agaaucacgccaac

SEQ ID NO: 601789 - RNA, 16 nt, Escherichia coli CFT073
agaauccggugccuua

SEQ ID NO: 601790 - RNA, 19 nt, Escherichia coli CFT073
agaauaucgccaaggauau

SEQ ID NO: 601791 - RNA, 18 nt, Escherichia coli CFT073
agaaucaaacugccguua

SEQ ID NO: 601792 - RNA, 20 nt, Escherichia coli CFT073
agaaucaacgaugucaauca

SEQ ID NO: 601793 - RNA, 21 nt, Escherichia coli CFT073
agaagucggcuuuuagcgaca

SEQ ID NO: 601794 - RNA, 16 nt, Escherichia coli CFT073
agaaggauauaaaaau

SEQ ID NO: 601795 - RNA, 19 nt, Escherichia coli CFT073
agaaggccagugguaaaaa

SEQ ID NO: 601796 - RNA, 20 nt, Escherichia coli CFT073
agaaggcguucacgccgcau

SEQ ID NO: 601797 - RNA, 12 nt, Escherichia coli CFT073
agaagggaauau

SEQ ID NO: 601798 - RNA, 13 nt, Escherichia coli CFT073
agaacugcugcau

SEQ ID NO: 601799 - RNA, 14 nt, Escherichia coli CFT073
agaagaauaucucc

SEQ ID NO: 601800 - RNA, 17 nt, Escherichia coli CFT073
agaagacaauccccgcc

SEQ ID NO: 601801 - RNA, 14 nt, Escherichia coli CFT073
agaagaccgccgcu

SEQ ID NO: 601802 - RNA, 23 nt, Escherichia coli CFT073
agaacguuuaucugccggaaccg

SEQ ID NO: 601803 - RNA, 16 nt, Escherichia coli CFT073
agaacuaguagcauga

SEQ ID NO: 601804 - RNA, 19 nt, Escherichia coli CFT073
agaagccgcuccggcagca

SEQ ID NO: 601805 - RNA, 19 nt, Escherichia coli CFT073
agaagcgcagcgcaucagg

SEQ ID NO: 601806 - RNA, 18 nt, Escherichia coli CFT073
agaagagugaccauacau

SEQ ID NO: 601807 - RNA, 19 nt, Escherichia coli CFT073
agaagauuuuuugccagca

SEQ ID NO: 601808 - RNA, 16 nt, Escherichia coli CFT073
agaacaucauccccac

SEQ ID NO: 601809 - RNA, 19 nt, Escherichia coli CFT073
agaaccagcgcacagagca

SEQ ID NO: 601810 - RNA, 18 nt, Escherichia coli CFT073
agaaccgcacagguugca

SEQ ID NO: 601811 - RNA, 15 nt, Escherichia coli CFT073
agaaccgccaccucc

SEQ ID NO: 601812 - RNA, 21 nt, Escherichia coli CFT073
agaacggcagagaaaccacau

SEQ ID NO: 601813 - RNA, 19 nt, Escherichia coli CFT073
agaacggggcuauaccaga

SEQ ID NO: 601814 - RNA, 22 nt, Escherichia coli CFT073
agaacggugcgaccaaacugcu

SEQ ID NO: 601815 - RNA, 18 nt, Escherichia coli CFT073
agaacgucugccucccau

SEQ ID NO: 601816 - RNA, 16 nt, Escherichia coli CFT073
agaacgccaugccaaa

SEQ ID NO: 601817 - RNA, 18 nt, Escherichia coli CFT073
agaacgccgaauaacgcg

SEQ ID NO: 601818 - RNA, 22 nt, Escherichia coli CFT073
agaacgccgaauaacgcgcagc

SEQ ID NO: 601819 - RNA, 15 nt, Escherichia coli CFT073
agaacgccugugcga

SEQ ID NO: 601820 - RNA, 18 nt, Escherichia coli CFT073
agaacgaugaagucgauc

SEQ ID NO: 601821 - RNA, 22 nt, Escherichia coli CFT073
agaacgcaccgaccaucggcac

SEQ ID NO: 601822 - RNA, 11 nt, Escherichia coli CFT073
agaaaaggagu

SEQ ID NO: 601823 - RNA, 13 nt, Escherichia coli CFT073
agaaaaucacggc

SEQ ID NO: 601824 - RNA, 12 nt, Escherichia coli CFT073
agaaacaccguc

SEQ ID NO: 601825 - RNA, 15 nt, Escherichia coli CFT073
agaaacaucaucccc

SEQ ID NO: 601826 - RNA, 15 nt, Escherichia coli CFT073
agaaacucugcggca

SEQ ID NO: 601827 - RNA, 18 nt, Escherichia coli CFT073
agaaauugagauaagcaa

SEQ ID NO: 601828 - RNA, 18 nt, Escherichia coli CFT073
agaacaagauugccugau

SEQ ID NO: 601829 - RNA, 18 nt, Escherichia coli CFT073
agaaaugucggcccgcau

SEQ ID NO: 601830 - RNA, 23 nt, Escherichia coli CFT073
agaaagacgguuaacgccagcca

SEQ ID NO: 601831 - RNA, 13 nt, Escherichia coli CFT073
agaaaucagcagg

SEQ ID NO: 601832 - RNA, 19 nt, Escherichia coli CFT073
agaaauccggggcaauuuc

SEQ ID NO: 601833 - RNA, 19 nt, Escherichia coli CFT073
agaaagucguaggccugau

SEQ ID NO: 601834 - RNA, 22 nt, Escherichia coli CFT073
agaaaguuuuucaacaccguga

SEQ ID NO: 601835 - RNA, 16 nt, Escherichia coli CFT073
agaaauaccccgccag

SEQ ID NO: 601836 - RNA, 17 nt, Escherichia coli CFT073
agaaauaccccgccagc

SEQ ID NO: 601837 - RNA, 15 nt, Escherichia coli CFT073
acuuccuucgccgcu

SEQ ID NO: 601838 - RNA, 19 nt, Escherichia coli CFT073
acuuccugcgccagcguuu

SEQ ID NO: 601839 - RNA, 13 nt, Escherichia coli CFT073
acuuccugcucgg

SEQ ID NO: 601840 - RNA, 17 nt, Escherichia coli CFT073
acuucgauccagugauu

SEQ ID NO: 601841 - RNA, 24 nt, Escherichia coli CFT073
acuuugccgugaacaauuucagca

SEQ ID NO: 601842 - RNA, 12 nt, Escherichia coli CFT073
acuuugccuggc

SEQ ID NO: 601843 - RNA, 23 nt, Escherichia coli CFT073
acuuccccggcagugcuuucauu

SEQ ID NO: 601844 - RNA, 21 nt, Escherichia coli CFT073
acuuccauacggcguuaacuu

SEQ ID NO: 601845 - RNA, 16 nt, Escherichia coli CFT073
acuuccgccaccacgc

SEQ ID NO: 601846 - RNA, 19 nt, Escherichia coli CFT073
acuuccgcguaguugcgcu

SEQ ID NO: 601847 - RNA, 16 nt, Escherichia coli CFT073
acuuuguaccagcggg

SEQ ID NO: 601848 - RNA, 14 nt, Escherichia coli CFT073
acuuuugccagacg

SEQ ID NO: 601849 - RNA, 16 nt, Escherichia coli CFT073
acuuuuggaccacgga

SEQ ID NO: 601850 - RNA, 18 nt, Escherichia coli CFT073
acuauauaaaccuucugu

SEQ ID NO: 601851 - RNA, 16 nt, Escherichia coli CFT073
acuaucccaucagcgg

SEQ ID NO: 601852 - RNA, 15 nt, Escherichia coli CFT073
acuauaucucaauca

SEQ ID NO: 601853 - RNA, 18 nt, Escherichia coli CFT073
acucuuucccggcaauca

SEQ ID NO: 601854 - RNA, 13 nt, Escherichia coli CFT073
acugaagauucgc

SEQ ID NO: 601855 - RNA, 17 nt, Escherichia coli CFT073
acugaggcgauagcauc

SEQ ID NO: 601856 - RNA, 23 nt, Escherichia coli CFT073
acugagaucugaccuauuucauu

SEQ ID NO: 601857 - RNA, 23 nt, Escherichia coli CFT073
acugauaacuuuuuauccgguaa

SEQ ID NO: 601858 - RNA, 18 nt, Escherichia coli CFT073
acugauaaucccggcggc

SEQ ID NO: 601859 - RNA, 23 nt, Escherichia coli CFT073
acugacgcgcuuuucaccgacga

SEQ ID NO: 601860 - RNA, 22 nt, Escherichia coli CFT073
acugacggucgguaaacccggc

SEQ ID NO: 601861 - RNA, 12 nt, Escherichia coli CFT073
acugacuuucuu

SEQ ID NO: 601862 - RNA, 18 nt, Escherichia coli CFT073
acugaauaaacagcagau

SEQ ID NO: 601863 - RNA, 12 nt, Escherichia coli CFT073
acugaauaauac

SEQ ID NO: 601864 - RNA, 18 nt, Escherichia coli CFT073
acugaauaccguaaaacu

SEQ ID NO: 601865 - RNA, 17 nt, Escherichia coli CFT073
acugaauagugccgcac

SEQ ID NO: 601866 - RNA, 23 nt, Escherichia coli CFT073
acugaauggcgacguaccagcgu

SEQ ID NO: 601867 - RNA, 12 nt, Escherichia coli CFT073
acugaauugcca

SEQ ID NO: 601868 - RNA, 17 nt, Escherichia coli CFT073
acugacaaucaucgccg

SEQ ID NO: 601869 - RNA, 13 nt, Escherichia coli CFT073
acugacaccagca

SEQ ID NO: 601870 - RNA, 23 nt, Escherichia coli CFT073
acugacaucaaacccuucccggg

SEQ ID NO: 601871 - RNA, 17 nt, Escherichia coli CFT073
acugccacacaggccau

SEQ ID NO: 601872 - RNA, 20 nt, Escherichia coli CFT073
acugccagccacaggccggu

SEQ ID NO: 601873 - RNA, 14 nt, Escherichia coli CFT073
acugccaucuuccg

SEQ ID NO: 601874 - RNA, 19 nt, Escherichia coli CFT073
acugccgaccaucuguucu

SEQ ID NO: 601875 - RNA, 14 nt, Escherichia coli CFT073
acugccgcacauuu

SEQ ID NO: 601876 - RNA, 17 nt, Escherichia coli CFT073
acugcaaggccaucggc

SEQ ID NO: 601877 - RNA, 16 nt, Escherichia coli CFT073
acugaucaauaucagc

SEQ ID NO: 601878 - RNA, 22 nt, Escherichia coli CFT073
acugaucaccugcgauaaaccg

SEQ ID NO: 601879 - RNA, 22 nt, Escherichia coli CFT073
acugaucuuuaucaagcaccaa

SEQ ID NO: 601880 - RNA, 14 nt, Escherichia coli CFT073
acugcaaaucacca

SEQ ID NO: 601881 - RNA, 15 nt, Escherichia coli CFT073
acugcaaaucaccac

SEQ ID NO: 601882 - RNA, 16 nt, Escherichia coli CFT073
acuuaagucuccauuu

SEQ ID NO: 601883 - RNA, 22 nt, Escherichia coli CFT073
acuuaaagccgcuuccgggcug

SEQ ID NO: 601884 - RNA, 15 nt, Escherichia coli CFT073
acuguuggaaucacu

SEQ ID NO: 601885 - RNA, 23 nt, Escherichia coli CFT073
acuguuuaucgucacgcaucacg

SEQ ID NO: 601886 - RNA, 16 nt, Escherichia coli CFT073
acuuauaagucucaga

SEQ ID NO: 601887 - RNA, 22 nt, Escherichia coli CFT073
acugugauugugauuaccgcaa

SEQ ID NO: 601888 - RNA, 19 nt, Escherichia coli CFT073
acuggcgcgccuguugcgg

SEQ ID NO: 601889 - RNA, 15 nt, Escherichia coli CFT073
acugucguucauugu

SEQ ID NO: 601890 - RNA, 20 nt, Escherichia coli CFT073
acugugaaguauuaauguca

SEQ ID NO: 601891 - RNA, 21 nt, Escherichia coli CFT073
acugugacgcggugcuuccgg

SEQ ID NO: 601892 - RNA, 21 nt, Escherichia coli CFT073
acugugcauuuggcgcaucgg

SEQ ID NO: 601893 - RNA, 13 nt, Escherichia coli CFT073
acugugccagacg

SEQ ID NO: 601894 - RNA, 15 nt, Escherichia coli CFT073
acuggcgacugccag

SEQ ID NO: 601895 - RNA, 19 nt, Escherichia coli CFT073
acuggcgacugccagccac

SEQ ID NO: 601896 - RNA, 18 nt, Escherichia coli CFT073
acugguaaccgaggcgga

SEQ ID NO: 601897 - RNA, 16 nt, Escherichia coli CFT073
acugguaagcaaagca

SEQ ID NO: 601898 - RNA, 17 nt, Escherichia coli CFT073
acuggcgcggcagguug

SEQ ID NO: 601899 - RNA, 22 nt, Escherichia coli CFT073
acuggcgcggcagguugagcaa

SEQ ID NO: 601900 - RNA, 17 nt, Escherichia coli CFT073
acuggcgcagcaguucg

SEQ ID NO: 601901 - RNA, 16 nt, Escherichia coli CFT073
acugcgguguaaacca

SEQ ID NO: 601902 - RNA, 19 nt, Escherichia coli CFT073
acugcguagaguccagcgc

SEQ ID NO: 601903 - RNA, 14 nt, Escherichia coli CFT073
acugcggcagguug

SEQ ID NO: 601904 - RNA, 22 nt, Escherichia coli CFT073
acugcgggaucuuauccugcgu

SEQ ID NO: 601905 - RNA, 20 nt, Escherichia coli CFT073
acugcgcguggucagcacaa

SEQ ID NO: 601906 - RNA, 20 nt, Escherichia coli CFT073
acugcgcuauaucgcugaua

SEQ ID NO: 601907 - RNA, 22 nt, Escherichia coli CFT073
acugcgcucuaaaaucaucacg

SEQ ID NO: 601908 - RNA, 15 nt, Escherichia coli CFT073
acugcgcucuucugg

SEQ ID NO: 601909 - RNA, 19 nt, Escherichia coli CFT073
acugcgcuucaauacgcuc

SEQ ID NO: 601910 - RNA, 20 nt, Escherichia coli CFT073
acugccguagugaugcauca

SEQ ID NO: 601911 - RNA, 20 nt, Escherichia coli CFT073
acgcuggcaucaaucgcucc

SEQ ID NO: 601912 - RNA, 23 nt, Escherichia coli CFT073
acgcugguugcgucuuaucaggc

SEQ ID NO: 601913 - RNA, 13 nt, Escherichia coli CFT073
acgcugucgcguc

SEQ ID NO: 601914 - RNA, 20 nt, Escherichia coli CFT073
acgcugucggcaagauacug

SEQ ID NO: 601915 - RNA, 19 nt, Escherichia coli CFT073
acgcuguaauuaccagcgc

SEQ ID NO: 601916 - RNA, 18 nt, Escherichia coli CFT073
acgcuuaucaggccugca

SEQ ID NO: 601917 - RNA, 19 nt, Escherichia coli CFT073
acgcuguuccggcggcagg

SEQ ID NO: 601918 - RNA, 23 nt, Escherichia coli CFT073
acgcuuaaagcguuccacgucac

SEQ ID NO: 601919 - RNA, 15 nt, Escherichia coli CFT073
acgcuuacucuuuca

SEQ ID NO: 601920 - RNA, 12 nt, Escherichia coli CFT073
acgcugccgcgc

SEQ ID NO: 601921 - RNA, 13 nt, Escherichia coli CFT073
acgcuuugcugcc

SEQ ID NO: 601922 - RNA, 16 nt, Escherichia coli CFT073
acgcuuucugcgugau

SEQ ID NO: 601923 - RNA, 18 nt, Escherichia coli CFT073
acgcuuucuggcgcgcgg

SEQ ID NO: 601924 - RNA, 15 nt, Escherichia coli CFT073
acggaaagcagauaa

SEQ ID NO: 601925 - RNA, 17 nt, Escherichia coli CFT073
acggaaagcagauaacc

SEQ ID NO: 601926 - RNA, 13 nt, Escherichia coli CFT073
acgcuugccgcgu

SEQ ID NO: 601927 - RNA, 20 nt, Escherichia coli CFT073
acgcuugauucuguucagua

SEQ ID NO: 601928 - RNA, 20 nt, Escherichia coli CFT073
acgcuucggcaauuucagug

SEQ ID NO: 601929 - RNA, 15 nt, Escherichia coli CFT073
acgcuucggcgcaua

SEQ ID NO: 601930 - RNA, 17 nt, Escherichia coli CFT073
acgcuucacgcaccaua

SEQ ID NO: 601931 - RNA, 13 nt, Escherichia coli CFT073
acgcuucagcgua

SEQ ID NO: 601932 - RNA, 15 nt, Escherichia coli CFT073
acggaccgcaugcag

SEQ ID NO: 601933 - RNA, 20 nt, Escherichia coli CFT073
acggaguaacaaaugugcca

SEQ ID NO: 601934 - RNA, 20 nt, Escherichia coli CFT073
acggacaguacugccgggaa

SEQ ID NO: 601935 - RNA, 17 nt, Escherichia coli CFT073
acggaauaucgcuggcc

SEQ ID NO: 601936 - RNA, 22 nt, Escherichia coli CFT073
acggaacugcuccagggcaggu

SEQ ID NO: 601937 - RNA, 13 nt, Escherichia coli CFT073
acggaauaaaccc

SEQ ID NO: 601938 - RNA, 16 nt, Escherichia coli CFT073
acggaucuuccagcgc

SEQ ID NO: 601939 - RNA, 21 nt, Escherichia coli CFT073
acggauaacguuuagcggugg

SEQ ID NO: 601940 - RNA, 13 nt, Escherichia coli CFT073
acggauacgguca

SEQ ID NO: 601941 - RNA, 21 nt, Escherichia coli CFT073
acggaucacacggccaucacg

SEQ ID NO: 601942 - RNA, 15 nt, Escherichia coli CFT073
acggcacuucaauga

SEQ ID NO: 601943 - RNA, 21 nt, Escherichia coli CFT073
acggcagaaguaguugcuguc

SEQ ID NO: 601944 - RNA, 22 nt, Escherichia coli CFT073
acggcaagaucagcauccauau

SEQ ID NO: 601945 - RNA, 13 nt, Escherichia coli CFT073
acggcaucgccau

SEQ ID NO: 601946 - RNA, 22 nt, Escherichia coli CFT073
acggcauuuccgccaaucaaga

SEQ ID NO: 601947 - RNA, 13 nt, Escherichia coli CFT073
acggcauuaacga

SEQ ID NO: 601948 - RNA, 12 nt, Escherichia coli CFT073
acggcauuuucc

SEQ ID NO: 601949 - RNA, 22 nt, Escherichia coli CFT073
acggcaggucaaggucaugaug

SEQ ID NO: 601950 - RNA, 14 nt, Escherichia coli CFT073
acggcauaauaccg

SEQ ID NO: 601951 - RNA, 20 nt, Escherichia coli CFT073
acggcaccagccauuaacca

SEQ ID NO: 601952 - RNA, 13 nt, Escherichia coli CFT073
acggcagaaucuu

SEQ ID NO: 601953 - RNA, 15 nt, Escherichia coli CFT073
acggcagagaaacca

SEQ ID NO: 601954 - RNA, 21 nt, Escherichia coli CFT073
acggcagagaaaccacaucaa

SEQ ID NO: 601955 - RNA, 17 nt, Escherichia coli CFT073
acgcgcuaauuucagca

SEQ ID NO: 601956 - RNA, 16 nt, Escherichia coli CFT073
acgcgcuacugaaucc

SEQ ID NO: 601957 - RNA, 18 nt, Escherichia coli CFT073
acgcgcaccgcgugaugc

SEQ ID NO: 601958 - RNA, 13 nt, Escherichia coli CFT073
acgcgcagcgucg

SEQ ID NO: 601959 - RNA, 20 nt, Escherichia coli CFT073
acgcgacauaaagcgcaaua

SEQ ID NO: 601960 - RNA, 14 nt, Escherichia coli CFT073
acgcgacauuuuua

SEQ ID NO: 601961 - RNA, 18 nt, Escherichia coli CFT073
acgccuuugacguugguu

SEQ ID NO: 601962 - RNA, 14 nt, Escherichia coli CFT073
aaacaccagcagca

SEQ ID NO: 601963 - RNA, 19 nt, Escherichia coli CFT073
aaacaccgcuucaacagcg

SEQ ID NO: 601964 - RNA, 15 nt, Escherichia coli CFT073
aaacacgcaaucccg

SEQ ID NO: 601965 - RNA, 14 nt, Escherichia coli CFT073
acgcacuggcgcgc

SEQ ID NO: 601966 - RNA, 14 nt, Escherichia coli CFT073
acgcacugcaauau

SEQ ID NO: 601967 - RNA, 21 nt, Escherichia coli CFT073
acgcagaaaggaucacaauaa

SEQ ID NO: 601968 - RNA, 21 nt, Escherichia coli CFT073
acgcgaacagcgucgcaucag

SEQ ID NO: 601969 - RNA, 17 nt, Escherichia coli CFT073
aaacauaaagccugaua

SEQ ID NO: 601970 - RNA, 18 nt, Escherichia coli CFT073
aaacagcguaaauaugcc

SEQ ID NO: 601971 - RNA, 17 nt, Escherichia coli CFT073
aaacagguuauugaccg

SEQ ID NO: 601972 - RNA, 22 nt, Escherichia coli CFT073
aaacagugaccaucuuccagca

SEQ ID NO: 601973 - RNA, 14 nt, Escherichia coli CFT073
aaacacuugcggca

SEQ ID NO: 601974 - RNA, 13 nt, Escherichia coli CFT073
aaacagccagcag

SEQ ID NO: 601975 - RNA, 15 nt, Escherichia coli CFT073
aaacagccagcagcg

SEQ ID NO: 601976 - RNA, 13 nt, Escherichia coli CFT073
aaacagccugcgu

SEQ ID NO: 601977 - RNA, 18 nt, Escherichia coli CFT073
acgcgggcaaucggcugc

SEQ ID NO: 601978 - RNA, 14 nt, Escherichia coli CFT073
acgcggauaaacgu

SEQ ID NO: 601979 - RNA, 16 nt, Escherichia coli CFT073
acgcgcugaccuucuu

SEQ ID NO: 601980 - RNA, 19 nt, Escherichia coli CFT073
acgcugacggugccaggua

SEQ ID NO: 601981 - RNA, 17 nt, Escherichia coli CFT073
acgcugacgugcugcau

SEQ ID NO: 601982 - RNA, 16 nt, Escherichia coli CFT073
acgcucggcgcaaucg

SEQ ID NO: 601983 - RNA, 12 nt, Escherichia coli CFT073
acgcucauaaau

SEQ ID NO: 601984 - RNA, 16 nt, Escherichia coli CFT073
acgcucauaaauugca

SEQ ID NO: 601985 - RNA, 23 nt, Escherichia coli CFT073
acgcuccaguaccugcaaaccgu

SEQ ID NO: 601986 - RNA, 18 nt, Escherichia coli CFT073
acgcuccauugcccgccc

SEQ ID NO: 601987 - RNA, 23 nt, Escherichia coli CFT073
acgcgguacguuuuccagguuau

SEQ ID NO: 601988 - RNA, 13 nt, Escherichia coli CFT073
acgcggugcgccg

SEQ ID NO: 601989 - RNA, 20 nt, Escherichia coli CFT073
acgcgguuaucccaaaucgc

SEQ ID NO: 601990 - RNA, 16 nt, Escherichia coli CFT073
acgcucaaacagcgua

SEQ ID NO: 601991 - RNA, 21 nt, Escherichia coli CFT073
acgcucaauauuugcaccuaa

SEQ ID NO: 601992 - RNA, 19 nt, Escherichia coli CFT073
acgguaagccgcaaccacc

SEQ ID NO: 601993 - RNA, 16 nt, Escherichia coli CFT073
acgguaaaauacagga

SEQ ID NO: 601994 - RNA, 15 nt, Escherichia coli CFT073
acgggucaucaaaau

SEQ ID NO: 601995 - RNA, 12 nt, Escherichia coli CFT073
acggucagcgca

SEQ ID NO: 601996 - RNA, 22 nt, Escherichia coli CFT073
acggucaggcuaaagaaaacga

SEQ ID NO: 601997 - RNA, 21 nt, Escherichia coli CFT073
acgguaugacccagcgcggua

SEQ ID NO: 601998 - RNA, 22 nt, Escherichia coli CFT073
acgguccgccauuuccagcguc

SEQ ID NO: 601999 - RNA, 14 nt, Escherichia coli CFT073
acggucgugcgguu

SEQ ID NO: 602000 - RNA, 19 nt, Escherichia coli CFT073
acgguucagggauacaagc

SEQ ID NO: 602001 - RNA, 16 nt, Escherichia coli CFT073
acgguugaugccguuc

SEQ ID NO: 602002 - RNA, 21 nt, Escherichia coli CFT073
acgguguugguaaacgcauag

SEQ ID NO: 602003 - RNA, 19 nt, Escherichia coli CFT073
acgguguaaccaccgcagg

SEQ ID NO: 602004 - RNA, 22 nt, Escherichia coli CFT073
acgggcugaagaaguaaaacag

SEQ ID NO: 602005 - RNA, 21 nt, Escherichia coli CFT073
acggccccagagcuaaaaucg

SEQ ID NO: 602006 - RNA, 18 nt, Escherichia coli CFT073
acggccaucacggaucag

SEQ ID NO: 602007 - RNA, 18 nt, Escherichia coli CFT073
acgugcucugcgccgccu

SEQ ID NO: 602008 - RNA, 22 nt, Escherichia coli CFT073
acgugcugcauuuggacaccau

SEQ ID NO: 602009 - RNA, 19 nt, Escherichia coli CFT073
acguggcggagugccgcgu

SEQ ID NO: 602010 - RNA, 13 nt, Escherichia coli CFT073
acgugggcgacgg

SEQ ID NO: 602011 - RNA, 17 nt, Escherichia coli CFT073
acgucguucgggccgaa

SEQ ID NO: 602012 - RNA, 13 nt, Escherichia coli CFT073
acgucucaaucac

SEQ ID NO: 602013 - RNA, 16 nt, Escherichia coli CFT073
acgucucaaucaccac

SEQ ID NO: 602014 - RNA, 23 nt, Escherichia coli CFT073
acgucucaauuuauauucacuuc

SEQ ID NO: 602015 - RNA, 19 nt, Escherichia coli CFT073
acgugauuccugcaauuua

SEQ ID NO: 602016 - RNA, 13 nt, Escherichia coli CFT073
acgugcaaaauca

SEQ ID NO: 602017 - RNA, 20 nt, Escherichia coli CFT073
acgguuugagagucauccau

SEQ ID NO: 602018 - RNA, 19 nt, Escherichia coli CFT073
acguaggcgaucccagcgc

SEQ ID NO: 602019 - RNA, 22 nt, Escherichia coli CFT073
acgucgucgccaaugcgcaaua

SEQ ID NO: 602020 - RNA, 14 nt, Escherichia coli CFT073
acgucgcguuaauc

SEQ ID NO: 602021 - RNA, 22 nt, Escherichia coli CFT073
acgucggcauauuuaaaaacga

SEQ ID NO: 602022 - RNA, 11 nt, Escherichia coli CFT073
acguaucaggg

SEQ ID NO: 602023 - RNA, 22 nt, Escherichia coli CFT073
acguuaguucgcguagcugcug

SEQ ID NO: 602024 - RNA, 13 nt, Escherichia coli CFT073
acguguugcugca

SEQ ID NO: 602025 - RNA, 19 nt, Escherichia coli CFT073
acguuacccaaucgcccca

SEQ ID NO: 602026 - RNA, 15 nt, Escherichia coli CFT073
acguuacccagcacg

SEQ ID NO: 602027 - RNA, 16 nt, Escherichia coli CFT073
acguuacugaucaccu

SEQ ID NO: 602028 - RNA, 19 nt, Escherichia coli CFT073
acguuccguauaccgucag

SEQ ID NO: 602029 - RNA, 18 nt, Escherichia coli CFT073
acguugcuuauugccgga

SEQ ID NO: 602030 - RNA, 19 nt, Escherichia coli CFT073
acguuccccaaccgcuuuc

SEQ ID NO: 602031 - RNA, 17 nt, Escherichia coli CFT073
acguucccuucuugcgc

SEQ ID NO: 602032 - RNA, 23 nt, Escherichia coli CFT073
acguucccuucuugcgcaaaccu

SEQ ID NO: 602033 - RNA, 22 nt, Escherichia coli CFT073
acguucggugauauacgccacu

SEQ ID NO: 602034 - RNA, 19 nt, Escherichia coli CFT073
acguuggcagugccaucaa

SEQ ID NO: 602035 - RNA, 21 nt, Escherichia coli CFT073
acguugguuucgcauuucgca

SEQ ID NO: 602036 - RNA, 19 nt, Escherichia coli CFT073
acguuuggccacaccaucg

SEQ ID NO: 602037 - RNA, 14 nt, Escherichia coli CFT073
acguuugccagcca

SEQ ID NO: 602038 - RNA, 21 nt, Escherichia coli CFT073
acguuugccagccacaccacg

SEQ ID NO: 602039 - RNA, 19 nt, Escherichia coli CFT073
acguuuuucauccagcggc

SEQ ID NO: 602040 - RNA, 14 nt, Escherichia coli CFT073
acguuuaauugcag

SEQ ID NO: 602041 - RNA, 21 nt, Escherichia coli CFT073
acguuuaccgcccaugccagu

SEQ ID NO: 602042 - RNA, 15 nt, Escherichia coli CFT073
acguuucgccagccu

SEQ ID NO: 602043 - RNA, 14 nt, Escherichia coli CFT073
acuaaugccgccau

SEQ ID NO: 602044 - RNA, 15 nt, Escherichia coli CFT073
acuacgugaucgucu

SEQ ID NO: 602045 - RNA, 15 nt, Escherichia coli CFT073
acuacugacuccagg

SEQ ID NO: 602046 - RNA, 18 nt, Escherichia coli CFT073
acuaccgccgagcacaaa

SEQ ID NO: 602047 - RNA, 16 nt, Escherichia coli CFT073
acuaccgcguuuuuua

SEQ ID NO: 602048 - RNA, 18 nt, Escherichia coli CFT073
acuaccguaaauaaugac

SEQ ID NO: 602049 - RNA, 19 nt, Escherichia coli CFT073
acuacgcuguagccgccau

SEQ ID NO: 602050 - RNA, 19 nt, Escherichia coli CFT073
acuacggcuuuuuucauuu

SEQ ID NO: 602051 - RNA, 19 nt, Escherichia coli CFT073
accauuuacccgauccacu

SEQ ID NO: 602052 - RNA, 23 nt, Escherichia coli CFT073
accauugaagcaauccauaccag

SEQ ID NO: 602053 - RNA, 19 nt, Escherichia coli CFT073
accauugcaucaucgacau

SEQ ID NO: 602054 - RNA, 14 nt, Escherichia coli CFT073
accauuaccccuga

SEQ ID NO: 602055 - RNA, 14 nt, Escherichia coli CFT073
accauuaucaccaa

SEQ ID NO: 602056 - RNA, 23 nt, Escherichia coli CFT073
acccagcggauguuggguuagcc

SEQ ID NO: 602057 - RNA, 14 nt, Escherichia coli CFT073
acccauugccugau

SEQ ID NO: 602058 - RNA, 23 nt, Escherichia coli CFT073
accccaaaaccuggacaguuuca

SEQ ID NO: 602059 - RNA, 22 nt, Escherichia coli CFT073
accccccaggcgcaccagcaca

SEQ ID NO: 602060 - RNA, 17 nt, Escherichia coli CFT073
accccgagcgaauaaac

SEQ ID NO: 602061 - RNA, 19 nt, Escherichia coli CFT073
accccggauuacgcaucag

SEQ ID NO: 602062 - RNA, 23 nt, Escherichia coli CFT073
aaaauuaauuuuuuaauaaaaag

SEQ ID NO: 602063 - RNA, 23 nt, Escherichia coli CFT073
acccgcccagugcugagaguaac

SEQ ID NO: 602064 - RNA, 21 nt, Escherichia coli CFT073
acccgccagaauccccggcag

SEQ ID NO: 602065 - RNA, 20 nt, Escherichia coli CFT073
acccgcagugauugccgcga

SEQ ID NO: 602066 - RNA, 13 nt, Escherichia coli CFT073
aaaauucgcgcag

SEQ ID NO: 602067 - RNA, 15 nt, Escherichia coli CFT073
aaaauugauaaccaa

SEQ ID NO: 602068 - RNA, 14 nt, Escherichia coli CFT073
aaaauugccgcuau

SEQ ID NO: 602069 - RNA, 19 nt, Escherichia coli CFT073
aaaauugccggaugcggcg

SEQ ID NO: 602070 - RNA, 22 nt, Escherichia coli CFT073
aaaauugccuguugcgcuacgu

SEQ ID NO: 602071 - RNA, 18 nt, Escherichia coli CFT073
accaucaccucucacgac

SEQ ID NO: 602072 - RNA, 22 nt, Escherichia coli CFT073
accaucacuccccuccugcaag

SEQ ID NO: 602073 - RNA, 18 nt, Escherichia coli CFT073
accaucagcagcggcacg

SEQ ID NO: 602074 - RNA, 15 nt, Escherichia coli CFT073
accaucagcaguacg

SEQ ID NO: 602075 - RNA, 17 nt, Escherichia coli CFT073
accaucaucccuaaugu

SEQ ID NO: 602076 - RNA, 13 nt, Escherichia coli CFT073
accauccagcaac

SEQ ID NO: 602077 - RNA, 23 nt, Escherichia coli CFT073
accaucaggcagucugcgcccug

SEQ ID NO: 602078 - RNA, 21 nt, Escherichia coli CFT073
accaucccgccgaccaacgca

SEQ ID NO: 602079 - RNA, 13 nt, Escherichia coli CFT073
accaucgccauuu

SEQ ID NO: 602080 - RNA, 20 nt, Escherichia coli CFT073
accaucccggugucaugcgg

SEQ ID NO: 602081 - RNA, 14 nt, Escherichia coli CFT073
accauccgcgcgcg

SEQ ID NO: 602082 - RNA, 14 nt, Escherichia coli CFT073
accaucgacaccau

SEQ ID NO: 602083 - RNA, 16 nt, Escherichia coli CFT073
accaugccaacgcgga

SEQ ID NO: 602084 - RNA, 18 nt, Escherichia coli CFT073
accaugauuccccagcca

SEQ ID NO: 602085 - RNA, 14 nt, Escherichia coli CFT073
accaugcaaucacu

SEQ ID NO: 602086 - RNA, 21 nt, Escherichia coli CFT073
accaugcaaucacugccacca

SEQ ID NO: 602087 - RNA, 18 nt, Escherichia coli CFT073
accaugaccgaucaaggc

SEQ ID NO: 602088 - RNA, 21 nt, Escherichia coli CFT073
accaucgcuacauaacgcagc

SEQ ID NO: 602089 - RNA, 15 nt, Escherichia coli CFT073
accaucggcgcuggc

SEQ ID NO: 602090 - RNA, 17 nt, Escherichia coli CFT073
accaucggcgcuggcgu

SEQ ID NO: 602091 - RNA, 14 nt, Escherichia coli CFT073
accaucgguacgcu

SEQ ID NO: 602092 - RNA, 18 nt, Escherichia coli CFT073
accaucgguacgcuuuca

SEQ ID NO: 602093 - RNA, 20 nt, Escherichia coli CFT073
accaguugugaugccacuuc

SEQ ID NO: 602094 - RNA, 21 nt, Escherichia coli CFT073
aaaaucgccugaacaccagaa

SEQ ID NO: 602095 - RNA, 14 nt, Escherichia coli CFT073
accauauucccgca

SEQ ID NO: 602096 - RNA, 14 nt, Escherichia coli CFT073
accauauccagcgc

SEQ ID NO: 602097 - RNA, 13 nt, Escherichia coli CFT073
accaguuugccuu

SEQ ID NO: 602098 - RNA, 14 nt, Escherichia coli CFT073
accagugacgcagc

SEQ ID NO: 602099 - RNA, 12 nt, Escherichia coli CFT073
accagugcaaca

SEQ ID NO: 602100 - RNA, 18 nt, Escherichia coli CFT073
accagugcagacucaccu

SEQ ID NO: 602101 - RNA, 16 nt, Escherichia coli CFT073
accagugcagauacca

SEQ ID NO: 602102 - RNA, 11 nt, Escherichia coli CFT073
aaaauacuggc

SEQ ID NO: 602103 - RNA, 20 nt, Escherichia coli CFT073
aaaauagccaccagccagua

SEQ ID NO: 602104 - RNA, 13 nt, Escherichia coli CFT073
aaaaucaacgaca

SEQ ID NO: 602105 - RNA, 20 nt, Escherichia coli CFT073
aaaaucacggcaaacugcgc

SEQ ID NO: 602106 - RNA, 11 nt, Escherichia coli CFT073
aaaaucagcgu

SEQ ID NO: 602107 - RNA, 14 nt, Escherichia coli CFT073
aaaauccaucccaa

SEQ ID NO: 602108 - RNA, 22 nt, Escherichia coli CFT073
aaaaucccauaagugcgucauu

SEQ ID NO: 602109 - RNA, 14 nt, Escherichia coli CFT073
aaaaucccggcaac

SEQ ID NO: 602110 - RNA, 21 nt, Escherichia coli CFT073
aaaauccucaacgccgcacag

SEQ ID NO: 602111 - RNA, 15 nt, Escherichia coli CFT073
aaaauccugccagcg

SEQ ID NO: 602112 - RNA, 20 nt, Escherichia coli CFT073
acauaaucaaccauuaaacg

SEQ ID NO: 602113 - RNA, 13 nt, Escherichia coli CFT073
acauaaucgccgu

SEQ ID NO: 602114 - RNA, 15 nt, Escherichia coli CFT073
acauaaccaaucauc

SEQ ID NO: 602115 - RNA, 15 nt, Escherichia coli CFT073
acauaacccagcgau

SEQ ID NO: 602116 - RNA, 18 nt, Escherichia coli CFT073
acauaaccgguuccgcaa

SEQ ID NO: 602117 - RNA, 13 nt, Escherichia coli CFT073
acauaacgccaau

SEQ ID NO: 602118 - RNA, 18 nt, Escherichia coli CFT073
acaguaacccagcaccaa

SEQ ID NO: 602119 - RNA, 20 nt, Escherichia coli CFT073
acaguaacccagcaccaaca

SEQ ID NO: 602120 - RNA, 23 nt, Escherichia coli CFT073
acaguaaagcgcaaaauaccagc

SEQ ID NO: 602121 - RNA, 18 nt, Escherichia coli CFT073
acaguuuuacugcagcca

SEQ ID NO: 602122 - RNA, 20 nt, Escherichia coli CFT073
acaguuuuacugcagccagc

SEQ ID NO: 602123 - RNA, 21 nt, Escherichia coli CFT073
acaguuuucgcaccgcguuua

SEQ ID NO: 602124 - RNA, 21 nt, Escherichia coli CFT073
acaguuuugagugauuccguu

SEQ ID NO: 602125 - RNA, 14 nt, Escherichia coli CFT073
acauaaacaccagc

SEQ ID NO: 602126 - RNA, 14 nt, Escherichia coli CFT073
acauaaauaacauc

SEQ ID NO: 602127 - RNA, 14 nt, Escherichia coli CFT073
accaggcgaccguu

SEQ ID NO: 602128 - RNA, 23 nt, Escherichia coli CFT073
accaggcgaccguuuucaccagu

SEQ ID NO: 602129 - RNA, 14 nt, Escherichia coli CFT073
accaguaccgccac

SEQ ID NO: 602130 - RNA, 16 nt, Escherichia coli CFT073
accaguaccgccacca

SEQ ID NO: 602131 - RNA, 21 nt, Escherichia coli CFT073
accaguaccgccaccaccaga

SEQ ID NO: 602132 - RNA, 14 nt, Escherichia coli CFT073
accaguaccgccgc

SEQ ID NO: 602133 - RNA, 22 nt, Escherichia coli CFT073
accagguuucggaugggcugau

SEQ ID NO: 602134 - RNA, 14 nt, Escherichia coli CFT073
accaguaauacggc

SEQ ID NO: 602135 - RNA, 17 nt, Escherichia coli CFT073
accaguacaccaauugu

SEQ ID NO: 602136 - RNA, 16 nt, Escherichia coli CFT073
accaguccaucggcau

SEQ ID NO: 602137 - RNA, 14 nt, Escherichia coli CFT073
accaguccggcuua

SEQ ID NO: 602138 - RNA, 14 nt, Escherichia coli CFT073
accaggucgccagu

SEQ ID NO: 602139 - RNA, 21 nt, Escherichia coli CFT073
accagguaucguuacgccagu

SEQ ID NO: 602140 - RNA, 12 nt, Escherichia coli CFT073
accagguaugcc

SEQ ID NO: 602141 - RNA, 14 nt, Escherichia coli CFT073
accaggucaaugca

SEQ ID NO: 602142 - RNA, 20 nt, Escherichia coli CFT073
accaggucaaugcaacccca

SEQ ID NO: 602143 - RNA, 18 nt, Escherichia coli CFT073
accgaggaugaauaacgc

SEQ ID NO: 602144 - RNA, 16 nt, Escherichia coli CFT073
accgauagaaccaaag

SEQ ID NO: 602145 - RNA, 18 nt, Escherichia coli CFT073
accgacgaucaacagaau

SEQ ID NO: 602146 - RNA, 20 nt, Escherichia coli CFT073
accgaccacggccaguccgu

SEQ ID NO: 602147 - RNA, 19 nt, Escherichia coli CFT073
accgaagaguaaccaaacg

SEQ ID NO: 602148 - RNA, 16 nt, Escherichia coli CFT073
accgaagaucaccacc

SEQ ID NO: 602149 - RNA, 14 nt, Escherichia coli CFT073
accgaauccagcaa

SEQ ID NO: 602150 - RNA, 20 nt, Escherichia coli CFT073
acccggagccauugcccgau

SEQ ID NO: 602151 - RNA, 19 nt, Escherichia coli CFT073
accgcaaacucaucgccgc

SEQ ID NO: 602152 - RNA, 23 nt, Escherichia coli CFT073
accgcaaagaaacgcgcggcaau

SEQ ID NO: 602153 - RNA, 21 nt, Escherichia coli CFT073
accgcaaagguugcagcuccc

SEQ ID NO: 602154 - RNA, 14 nt, Escherichia coli CFT073
accgcaaaucacca

SEQ ID NO: 602155 - RNA, 14 nt, Escherichia coli CFT073
accgcaaccgccgu

SEQ ID NO: 602156 - RNA, 16 nt, Escherichia coli CFT073
accgcaccaccagcag

SEQ ID NO: 602157 - RNA, 17 nt, Escherichia coli CFT073
accgcaccaccagcagc

SEQ ID NO: 602158 - RNA, 12 nt, Escherichia coli CFT073
accgaugaucgc

SEQ ID NO: 602159 - RNA, 15 nt, Escherichia coli CFT073
accgauccggcacca

SEQ ID NO: 602160 - RNA, 21 nt, Escherichia coli CFT073
accgauggcaaacaaacugcg

SEQ ID NO: 602161 - RNA, 19 nt, Escherichia coli CFT073
accgauucccccggugccu

SEQ ID NO: 602162 - RNA, 23 nt, Escherichia coli CFT073
accgccaggccuaacaccaucag

SEQ ID NO: 602163 - RNA, 18 nt, Escherichia coli CFT073
accgccccggguuuccug

SEQ ID NO: 602164 - RNA, 22 nt, Escherichia coli CFT073
accgcaucggcaucaaaccauu

SEQ ID NO: 602165 - RNA, 13 nt, Escherichia coli CFT073
accgcaucggcau

SEQ ID NO: 602166 - RNA, 15 nt, Escherichia coli CFT073
accgcagugaaauuu

SEQ ID NO: 602167 - RNA, 22 nt, Escherichia coli CFT073
accgcaucaaagaacucacgcg

SEQ ID NO: 602168 - RNA, 17 nt, Escherichia coli CFT073
accgcagagaucgcccc

SEQ ID NO: 602169 - RNA, 17 nt, Escherichia coli CFT073
accgcccugagcaucaa

SEQ ID NO: 602170 - RNA, 18 nt, Escherichia coli CFT073
accgcccugcaucaugcg

SEQ ID NO: 602171 - RNA, 13 nt, Escherichia coli CFT073
accgccgaagaca

SEQ ID NO: 602172 - RNA, 21 nt, Escherichia coli CFT073
accgccgaagacaaacaugcu

SEQ ID NO: 602173 - RNA, 21 nt, Escherichia coli CFT073
accgccgcucucuucguggcc

SEQ ID NO: 602174 - RNA, 22 nt, Escherichia coli CFT073
accgccugcggagaucaccaca

SEQ ID NO: 602175 - RNA, 18 nt, Escherichia coli CFT073
accgccugccuucccuuc

SEQ ID NO: 602176 - RNA, 19 nt, Escherichia coli CFT073
accggauacugcaauuuca

SEQ ID NO: 602177 - RNA, 20 nt, Escherichia coli CFT073
accggaugacguuucgcgcc

SEQ ID NO: 602178 - RNA, 13 nt, Escherichia coli CFT073
accggcaaauugg

SEQ ID NO: 602179 - RNA, 21 nt, Escherichia coli CFT073
accggcaaauuggcguggcgg

SEQ ID NO: 602180 - RNA, 22 nt, Escherichia coli CFT073
accggagcacagacuccgguuu

SEQ ID NO: 602181 - RNA, 16 nt, Escherichia coli CFT073
accgcuuggcgauacc

SEQ ID NO: 602182 - RNA, 19 nt, Escherichia coli CFT073
accgcugucgaucagagaa

SEQ ID NO: 602183 - RNA, 16 nt, Escherichia coli CFT073
accgcuguugccagca

SEQ ID NO: 602184 - RNA, 14 nt, Escherichia coli CFT073
accgcugccaggca

SEQ ID NO: 602185 - RNA, 21 nt, Escherichia coli CFT073
accgcugcgccauaaccgcca

SEQ ID NO: 602186 - RNA, 15 nt, Escherichia coli CFT073
accgcucucauccau

SEQ ID NO: 602187 - RNA, 22 nt, Escherichia coli CFT073
accgcgugagaacacgaccugc

SEQ ID NO: 602188 - RNA, 17 nt, Escherichia coli CFT073
accgcgugaugcggcau

SEQ ID NO: 602189 - RNA, 22 nt, Escherichia coli CFT073
accgcgcggcugguaacagucc

SEQ ID NO: 602190 - RNA, 14 nt, Escherichia coli CFT073
accgcggaacgcac

SEQ ID NO: 602191 - RNA, 19 nt, Escherichia coli CFT073
accuaaugaauccagcgac

SEQ ID NO: 602192 - RNA, 13 nt, Escherichia coli CFT073
accuaacgccagc

SEQ ID NO: 602193 - RNA, 15 nt, Escherichia coli CFT073
accuaacuccugcgu

SEQ ID NO: 602194 - RNA, 16 nt, Escherichia coli CFT073
accuaagaaccagaau

SEQ ID NO: 602195 - RNA, 22 nt, Escherichia coli CFT073
accuagcaaacuaucuguguaa

SEQ ID NO: 602196 - RNA, 20 nt, Escherichia coli CFT073
accguuuuagcgaaaaucgu

SEQ ID NO: 602197 - RNA, 13 nt, Escherichia coli CFT073
accuaaagcgcgu

SEQ ID NO: 602198 - RNA, 22 nt, Escherichia coli CFT073
accguuuaccucgucaccaccu

SEQ ID NO: 602199 - RNA, 18 nt, Escherichia coli CFT073
accucaccuuucgguuca

SEQ ID NO: 602200 - RNA, 17 nt, Escherichia coli CFT073
accucaggaaauugcac

SEQ ID NO: 602201 - RNA, 19 nt, Escherichia coli CFT073
accucaacaaaauaauccg

SEQ ID NO: 602202 - RNA, 18 nt, Escherichia coli CFT073
accucaauaauuucuuca

SEQ ID NO: 602203 - RNA, 12 nt, Escherichia coli CFT073
accuccgcuuug

SEQ ID NO: 602204 - RNA, 18 nt, Escherichia coli CFT073
accguuccaacgccacca

SEQ ID NO: 602205 - RNA, 18 nt, Escherichia coli CFT073
accguucacgcauuugca

SEQ ID NO: 602206 - RNA, 22 nt, Escherichia coli CFT073
accguucacugcgaccagcagc

SEQ ID NO: 602207 - RNA, 15 nt, Escherichia coli CFT073
accgugugcggcgau

SEQ ID NO: 602208 - RNA, 22 nt, Escherichia coli CFT073
accgugccgcuguucugauuuu

SEQ ID NO: 602209 - RNA, 22 nt, Escherichia coli CFT073
accucgguuaacagcgcaccag

SEQ ID NO: 602210 - RNA, 16 nt, Escherichia coli CFT073
accugaccgagccagu

SEQ ID NO: 602211 - RNA, 17 nt, Escherichia coli CFT073
accugacagaccgccag

SEQ ID NO: 602212 - RNA, 13 nt, Escherichia coli CFT073
accugacgcugcu

SEQ ID NO: 602213 - RNA, 21 nt, Escherichia coli CFT073
accugauaagacgcgccagca

SEQ ID NO: 602214 - RNA, 17 nt, Escherichia coli CFT073
accucugucgaugcgcu

SEQ ID NO: 602215 - RNA, 20 nt, Escherichia coli CFT073
accggcaaacuucgucaacu

SEQ ID NO: 602216 - RNA, 15 nt, Escherichia coli CFT073
accggcaaccagcac

SEQ ID NO: 602217 - RNA, 21 nt, Escherichia coli CFT073
accgggcgcgaggccagcggc

SEQ ID NO: 602218 - RNA, 22 nt, Escherichia coli CFT073
accggucggggccagcgcaucc

SEQ ID NO: 602219 - RNA, 17 nt, Escherichia coli CFT073
accggucucagcccaga

SEQ ID NO: 602220 - RNA, 15 nt, Escherichia coli CFT073
accgguuagcucaac

SEQ ID NO: 602221 - RNA, 14 nt, Escherichia coli CFT073
accgguauugcucc

SEQ ID NO: 602222 - RNA, 17 nt, Escherichia coli CFT073
accgguauugcuccaga

SEQ ID NO: 602223 - RNA, 18 nt, Escherichia coli CFT073
accguaaauucucccgcc

SEQ ID NO: 602224 - RNA, 13 nt, Escherichia coli CFT073
accguaaauugca

SEQ ID NO: 602225 - RNA, 15 nt, Escherichia coli CFT073
accguaacccugaaa

SEQ ID NO: 602226 - RNA, 21 nt, Escherichia coli CFT073
accguaacgcauucgccguua

SEQ ID NO: 602227 - RNA, 17 nt, Escherichia coli CFT073
accguacaaccaaaucu

SEQ ID NO: 602228 - RNA, 19 nt, Escherichia coli CFT073
accguaccaggcauauuca

SEQ ID NO: 602229 - RNA, 22 nt, Escherichia coli CFT073
accguaccaucauaagcgccag

SEQ ID NO: 602230 - RNA, 20 nt, Escherichia coli CFT073
accgguugucgugguuggua

SEQ ID NO: 602231 - RNA, 19 nt, Escherichia coli CFT073
accgguuuguaggccggau

SEQ ID NO: 602232 - RNA, 17 nt, Escherichia coli CFT073
accguauucaucgccau

SEQ ID NO: 602233 - RNA, 19 nt, Escherichia coli CFT073
accgucaaagcgccagcgc

SEQ ID NO: 602234 - RNA, 19 nt, Escherichia coli CFT073
accguagcguaaaucaucg

SEQ ID NO: 602235 - RNA, 20 nt, Escherichia coli CFT073
accguaggucggauaagacg

SEQ ID NO: 602236 - RNA, 21 nt, Escherichia coli CFT073
accguagguuuaccguugccg

SEQ ID NO: 602237 - RNA, 14 nt, Escherichia coli CFT073
accgucaggauaaa

SEQ ID NO: 602238 - RNA, 13 nt, Escherichia coli CFT073
accgucaggcgua

SEQ ID NO: 602239 - RNA, 14 nt, Escherichia coli CFT073
accgucagccagca

SEQ ID NO: 602240 - RNA, 13 nt, Escherichia coli CFT073
accguccaccaga

SEQ ID NO: 602241 - RNA, 13 nt, Escherichia coli CFT073
accgugaccgccu

SEQ ID NO: 602242 - RNA, 17 nt, Escherichia coli CFT073
accgugaccgccugcgg

SEQ ID NO: 602243 - RNA, 21 nt, Escherichia coli CFT073
accgucuuuauccagcaccac

SEQ ID NO: 602244 - RNA, 16 nt, Escherichia coli CFT073
accgugaaagagauca

SEQ ID NO: 602245 - RNA, 14 nt, Escherichia coli CFT073
accgugaauugcac

SEQ ID NO: 602246 - RNA, 18 nt, Escherichia coli CFT073
accgucuucccgcagcca

SEQ ID NO: 602247 - RNA, 22 nt, Escherichia coli CFT073
accgucuucccgcagccacguc

SEQ ID NO: 602248 - RNA, 21 nt, Escherichia coli CFT073
accgucgucccuuccgcaaua

SEQ ID NO: 602249 - RNA, 23 nt, Escherichia coli CFT073
accgucgcaauacccugacccag

SEQ ID NO: 602250 - RNA, 17 nt, Escherichia coli CFT073
accgucgcagccagcgc

SEQ ID NO: 602251 - RNA, 16 nt, Escherichia coli CFT073
acgaccuacacgcccg

SEQ ID NO: 602252 - RNA, 19 nt, Escherichia coli CFT073
acgaccuuccugacgguga

SEQ ID NO: 602253 - RNA, 19 nt, Escherichia coli CFT073
acgacgagucacggaaucc

SEQ ID NO: 602254 - RNA, 17 nt, Escherichia coli CFT073
acgacaugugccagcga

SEQ ID NO: 602255 - RNA, 23 nt, Escherichia coli CFT073
acgaccaguucacaccgaccacc

SEQ ID NO: 602256 - RNA, 20 nt, Escherichia coli CFT073
acgaccgccuaccggaaucg

SEQ ID NO: 602257 - RNA, 23 nt, Escherichia coli CFT073
acgaccgccuaccggaaucgcgc

SEQ ID NO: 602258 - RNA, 15 nt, Escherichia coli CFT073
acgaauuccuucgcg

SEQ ID NO: 602259 - RNA, 17 nt, Escherichia coli CFT073
acgacaaaugcgccgcc

SEQ ID NO: 602260 - RNA, 14 nt, Escherichia coli CFT073
acgacauccgccag

SEQ ID NO: 602261 - RNA, 17 nt, Escherichia coli CFT073
acgacacaaugccauau

SEQ ID NO: 602262 - RNA, 17 nt, Escherichia coli CFT073
acgacacauaaauaaca

SEQ ID NO: 602263 - RNA, 15 nt, Escherichia coli CFT073
acgaaucagauuuac

SEQ ID NO: 602264 - RNA, 14 nt, Escherichia coli CFT073
acgaaccaaucacc

SEQ ID NO: 602265 - RNA, 19 nt, Escherichia coli CFT073
acgaagaaaucgacauuga

SEQ ID NO: 602266 - RNA, 15 nt, Escherichia coli CFT073
acgaacuaaccgcac

SEQ ID NO: 602267 - RNA, 23 nt, Escherichia coli CFT073
acgaacuaccgugcuguacagca

SEQ ID NO: 602268 - RNA, 21 nt, Escherichia coli CFT073
accuuuugccgcccagucacg

SEQ ID NO: 602269 - RNA, 12 nt, Escherichia coli CFT073
acgaaaccacuc

SEQ ID NO: 602270 - RNA, 19 nt, Escherichia coli CFT073
acgaaaguuaauccacagc

SEQ ID NO: 602271 - RNA, 18 nt, Escherichia coli CFT073
acgaaaucucacccggua

SEQ ID NO: 602272 - RNA, 15 nt, Escherichia coli CFT073
acgaaaucuuccagu

SEQ ID NO: 602273 - RNA, 14 nt, Escherichia coli CFT073
acgaaaugaauaau

SEQ ID NO: 602274 - RNA, 21 nt, Escherichia coli CFT073
accuuguuggaucaugcucuu

SEQ ID NO: 602275 - RNA, 15 nt, Escherichia coli CFT073
accuugauccugcag

SEQ ID NO: 602276 - RNA, 13 nt, Escherichia coli CFT073
accugcaacggca

SEQ ID NO: 602277 - RNA, 19 nt, Escherichia coli CFT073
accugcaacggcaucgcca

SEQ ID NO: 602278 - RNA, 14 nt, Escherichia coli CFT073
accugaugcgcucc

SEQ ID NO: 602279 - RNA, 17 nt, Escherichia coli CFT073
accugauugaccgccag

SEQ ID NO: 602280 - RNA, 14 nt, Escherichia coli CFT073
acgacgguaaacca

SEQ ID NO: 602281 - RNA, 17 nt, Escherichia coli CFT073
acgacgguaaaccacgc

SEQ ID NO: 602282 - RNA, 16 nt, Escherichia coli CFT073
acgacgguuuccaccg

SEQ ID NO: 602283 - RNA, 22 nt, Escherichia coli CFT073
aaaauuucucccgcuaacugau

SEQ ID NO: 602284 - RNA, 13 nt, Escherichia coli CFT073
aaacaaccccauc

SEQ ID NO: 602285 - RNA, 17 nt, Escherichia coli CFT073
aaacaaggaucgcgaca

SEQ ID NO: 602286 - RNA, 17 nt, Escherichia coli CFT073
aaacaauugcauaucaa

SEQ ID NO: 602287 - RNA, 19 nt, Escherichia coli CFT073
acgacgucgggcggaaaac

SEQ ID NO: 602288 - RNA, 21 nt, Escherichia coli CFT073
acgagaacucggaagcagcgu

SEQ ID NO: 602289 - RNA, 20 nt, Escherichia coli CFT073
acgacuucaaacggcgagau

SEQ ID NO: 602290 - RNA, 17 nt, Escherichia coli CFT073
acgagagaaccagccgu

SEQ ID NO: 602291 - RNA, 14 nt, Escherichia coli CFT073
acgaggugccacca

SEQ ID NO: 602292 - RNA, 13 nt, Escherichia coli CFT073
acgauuccggcaa

SEQ ID NO: 602293 - RNA, 15 nt, Escherichia coli CFT073
acgauguuugcugcg

SEQ ID NO: 602294 - RNA, 17 nt, Escherichia coli CFT073
acgauuaacgccagacu

SEQ ID NO: 602295 - RNA, 20 nt, Escherichia coli CFT073
acgauuugcguaaaaccugc

SEQ ID NO: 602296 - RNA, 21 nt, Escherichia coli CFT073
acgcaaccagcgucgcaucag

SEQ ID NO: 602297 - RNA, 11 nt, Escherichia coli CFT073
acgaucgccga

SEQ ID NO: 602298 - RNA, 17 nt, Escherichia coli CFT073
acgaucgccgagaaucg

SEQ ID NO: 602299 - RNA, 21 nt, Escherichia coli CFT073
acgaguuaccgugugcggcga

SEQ ID NO: 602300 - RNA, 17 nt, Escherichia coli CFT073
acgauaacaaucaccaa

SEQ ID NO: 602301 - RNA, 18 nt, Escherichia coli CFT073
acgauaauuuacaaucac

SEQ ID NO: 602302 - RNA, 19 nt, Escherichia coli CFT073
acgauaauggcuuccagua

SEQ ID NO: 602303 - RNA, 21 nt, Escherichia coli CFT073
acgauacggaauaucgcuggc

SEQ ID NO: 602304 - RNA, 16 nt, Escherichia coli CFT073
acgauccguccgacgg

SEQ ID NO: 602305 - RNA, 23 nt, Escherichia coli CFT073
acgauccugagcagcaaccacuu

SEQ ID NO: 602306 - RNA, 18 nt, Escherichia coli CFT073
cucgaaguuuuccucagu

SEQ ID NO: 602307 - RNA, 16 nt, Escherichia coli CFT073
cucgacgguugaauca

SEQ ID NO: 602308 - RNA, 18 nt, Escherichia coli CFT073
cuccggcacuuaauacca

SEQ ID NO: 602309 - RNA, 23 nt, Escherichia coli CFT073
cuccugguuguauggccugguga

SEQ ID NO: 602310 - RNA, 16 nt, Escherichia coli CFT073
cuccugcuacaccauu

SEQ ID NO: 602311 - RNA, 17 nt, Escherichia coli CFT073
cuccauccgggaucaca

SEQ ID NO: 602312 - RNA, 20 nt, Escherichia coli CFT073
cucggaaauauucaacaccg

SEQ ID NO: 602313 - RNA, 21 nt, Escherichia coli CFT073
cucgcuuaaugguaacgccag

SEQ ID NO: 602314 - RNA, 21 nt, Escherichia coli CFT073
cucgccgagcagcuguuucau

SEQ ID NO: 602315 - RNA, 16 nt, Escherichia coli CFT073
cucgccgcaaaaccca

SEQ ID NO: 602316 - RNA, 17 nt, Escherichia coli CFT073
cucgccgcaaaacccag

SEQ ID NO: 602317 - RNA, 23 nt, Escherichia coli CFT073
cuccaacccacaaaaacaccgcu

SEQ ID NO: 602318 - RNA, 23 nt, Escherichia coli CFT073
cuccacucugccaggcagcgauu

SEQ ID NO: 602319 - RNA, 17 nt, Escherichia coli CFT073
cuccacuuccugccagu

SEQ ID NO: 602320 - RNA, 17 nt, Escherichia coli CFT073
cucauuaauguaugugc

SEQ ID NO: 602321 - RNA, 19 nt, Escherichia coli CFT073
cucauuaauuucaggcugu

SEQ ID NO: 602322 - RNA, 22 nt, Escherichia coli CFT073
cuccagugcgcuuuauucagau

SEQ ID NO: 602323 - RNA, 18 nt, Escherichia coli CFT073
cuccaguuaacgccgcgc

SEQ ID NO: 602324 - RNA, 20 nt, Escherichia coli CFT073
cuccaguucguucaguugcg

SEQ ID NO: 602325 - RNA, 17 nt, Escherichia coli CFT073
cuccacuucaccgcgaa

SEQ ID NO: 602326 - RNA, 14 nt, Escherichia coli CFT073
cuccagacaccgcu

SEQ ID NO: 602327 - RNA, 19 nt, Escherichia coli CFT073
cucagccaaaucccgugau

SEQ ID NO: 602328 - RNA, 17 nt, Escherichia coli CFT073
cucagcggucaccggaa

SEQ ID NO: 602329 - RNA, 12 nt, Escherichia coli CFT073
cucagcaguuuc

SEQ ID NO: 602330 - RNA, 19 nt, Escherichia coli CFT073
cucagcacaaccaccugau

SEQ ID NO: 602331 - RNA, 13 nt, Escherichia coli CFT073
cucagagaaucau

SEQ ID NO: 602332 - RNA, 12 nt, Escherichia coli CFT073
cucacgcaucaa

SEQ ID NO: 602333 - RNA, 15 nt, Escherichia coli CFT073
cucacgcaucaacgc

SEQ ID NO: 602334 - RNA, 20 nt, Escherichia coli CFT073
cucacgguuaauggccggaa

SEQ ID NO: 602335 - RNA, 17 nt, Escherichia coli CFT073
cucacuaucgccgagau

SEQ ID NO: 602336 - RNA, 20 nt, Escherichia coli CFT073
cucacuuaaagcaacaccau

SEQ ID NO: 602337 - RNA, 16 nt, Escherichia coli CFT073
cucacuucacgcugcc

SEQ ID NO: 602338 - RNA, 15 nt, Escherichia coli CFT073
cucacccccaucagc

SEQ ID NO: 602339 - RNA, 23 nt, Escherichia coli CFT073
cucacagggcugcugaugcgccg

SEQ ID NO: 602340 - RNA, 18 nt, Escherichia coli CFT073
cucaccaauaaugucgcu

SEQ ID NO: 602341 - RNA, 21 nt, Escherichia coli CFT073
cucacaagcccaggccaucgc

SEQ ID NO: 602342 - RNA, 14 nt, Escherichia coli CFT073
cucacaccaugcca

SEQ ID NO: 602343 - RNA, 14 nt, Escherichia coli CFT073
cucaaucaccacca

SEQ ID NO: 602344 - RNA, 20 nt, Escherichia coli CFT073
cucaaugaugccgccacagc

SEQ ID NO: 602345 - RNA, 20 nt, Escherichia coli CFT073
cucacgauuguuaaucacau

SEQ ID NO: 602346 - RNA, 14 nt, Escherichia coli CFT073
cucacgcagcuucu

SEQ ID NO: 602347 - RNA, 14 nt, Escherichia coli CFT073
cucacgcauucucu

SEQ ID NO: 602348 - RNA, 22 nt, Escherichia coli CFT073
cuauagacaccuugcaacuccg

SEQ ID NO: 602349 - RNA, 14 nt, Escherichia coli CFT073
cuauaccgccaggc

SEQ ID NO: 602350 - RNA, 14 nt, Escherichia coli CFT073
cuauaucucaauca

SEQ ID NO: 602351 - RNA, 12 nt, Escherichia coli CFT073
cuaucagcgcca

SEQ ID NO: 602352 - RNA, 21 nt, Escherichia coli CFT073
cuaucaggccaccucgcaaca

SEQ ID NO: 602353 - RNA, 14 nt, Escherichia coli CFT073
cuacguuauugucg

SEQ ID NO: 602354 - RNA, 20 nt, Escherichia coli CFT073
cuacguucgaucaccgcacg

SEQ ID NO: 602355 - RNA, 15 nt, Escherichia coli CFT073
cuacggugcugacgc

SEQ ID NO: 602356 - RNA, 19 nt, Escherichia coli CFT073
cguugccgguuaucccgcu

SEQ ID NO: 602357 - RNA, 20 nt, Escherichia coli CFT073
cguugccguaagcaacgcca

SEQ ID NO: 602358 - RNA, 22 nt, Escherichia coli CFT073
cuaugcauaauccugccgagau

SEQ ID NO: 602359 - RNA, 14 nt, Escherichia coli CFT073
cuaugcgcaucaag

SEQ ID NO: 602360 - RNA, 21 nt, Escherichia coli CFT073
cuauuacuuuaagccuuccgc

SEQ ID NO: 602361 - RNA, 18 nt, Escherichia coli CFT073
cuaucugccguucagcca

SEQ ID NO: 602362 - RNA, 20 nt, Escherichia coli CFT073
cuaucucugguaggccugau

SEQ ID NO: 602363 - RNA, 20 nt, Escherichia coli CFT073
cuaucggcaaaaauaaucuc

SEQ ID NO: 602364 - RNA, 12 nt, Escherichia coli CFT073
cuaucggcgaug

SEQ ID NO: 602365 - RNA, 15 nt, Escherichia coli CFT073
cuauccgccauauca

SEQ ID NO: 602366 - RNA, 22 nt, Escherichia coli CFT073
cuaucccugcguugagaaacgc

SEQ ID NO: 602367 - RNA, 18 nt, Escherichia coli CFT073
cuaucccuugucuuuuau

SEQ ID NO: 602368 - RNA, 23 nt, Escherichia coli CFT073
cuaucgcauuauccuuuaucugc

SEQ ID NO: 602369 - RNA, 24 nt, Escherichia coli CFT073
cuaucgcauuauccuuuaucugcc

SEQ ID NO: 602370 - RNA, 12 nt, Escherichia coli CFT073
cucaacaguaag

SEQ ID NO: 602371 - RNA, 11 nt, Escherichia coli CFT073
cuauugcgcug

SEQ ID NO: 602372 - RNA, 18 nt, Escherichia coli CFT073
cuauuuaccgccaacgca

SEQ ID NO: 602373 - RNA, 17 nt, Escherichia coli CFT073
cucaagagugaacacgu

SEQ ID NO: 602374 - RNA, 22 nt, Escherichia coli CFT073
cucaagcguugcuucacgcggg

SEQ ID NO: 602375 - RNA, 22 nt, Escherichia coli CFT073
cucuacaaccaguuuaugccug

SEQ ID NO: 602376 - RNA, 23 nt, Escherichia coli CFT073
cucuauucgaccacgcugcgcug

SEQ ID NO: 602377 - RNA, 19 nt, Escherichia coli CFT073
cucucauuauuugccgcca

SEQ ID NO: 602378 - RNA, 14 nt, Escherichia coli CFT073
cucuauccagccuu

SEQ ID NO: 602379 - RNA, 13 nt, Escherichia coli CFT073
cucucauccgcca

SEQ ID NO: 602380 - RNA, 14 nt, Escherichia coli CFT073
cucucauccgccaa

SEQ ID NO: 602381 - RNA, 19 nt, Escherichia coli CFT073
cucugcaagucuugcugcg

SEQ ID NO: 602382 - RNA, 19 nt, Escherichia coli CFT073
cucugcauguagcaacaaa

SEQ ID NO: 602383 - RNA, 20 nt, Escherichia coli CFT073
cucugcauguagcaacaaac

SEQ ID NO: 602384 - RNA, 13 nt, Escherichia coli CFT073
cucugccagcgua

SEQ ID NO: 602385 - RNA, 19 nt, Escherichia coli CFT073
cucugcggcaagaucgcga

SEQ ID NO: 602386 - RNA, 15 nt, Escherichia coli CFT073
cucugcggcaucaua

SEQ ID NO: 602387 - RNA, 18 nt, Escherichia coli CFT073
cucugcguuauuuucagg

SEQ ID NO: 602388 - RNA, 21 nt, Escherichia coli CFT073
cucugcuaaucguaccgaccc

SEQ ID NO: 602389 - RNA, 19 nt, Escherichia coli CFT073
cucugcuuucucaacaaau

SEQ ID NO: 602390 - RNA, 21 nt, Escherichia coli CFT073
cucuuuauuuccugcgcaaua

SEQ ID NO: 602391 - RNA, 21 nt, Escherichia coli CFT073
cucuuucacuccauugucuuu

SEQ ID NO: 602392 - RNA, 15 nt, Escherichia coli CFT073
cucuuuccauccggu

SEQ ID NO: 602393 - RNA, 14 nt, Escherichia coli CFT073
cucuuucuucgcgu

SEQ ID NO: 602394 - RNA, 23 nt, Escherichia coli CFT073
cucuuugcgguuaaagcaguacg

SEQ ID NO: 602395 - RNA, 23 nt, Escherichia coli CFT073
cucuuugugacaaacuaaccaga

SEQ ID NO: 602396 - RNA, 18 nt, Escherichia coli CFT073
cucuugccguguuauccg

SEQ ID NO: 602397 - RNA, 15 nt, Escherichia coli CFT073
cugaacagucgcuga

SEQ ID NO: 602398 - RNA, 18 nt, Escherichia coli CFT073
cugaaaaucuucucucau

SEQ ID NO: 602399 - RNA, 16 nt, Escherichia coli CFT073
cugaaaaugaaauaaa

SEQ ID NO: 602400 - RNA, 19 nt, Escherichia coli CFT073
cugaaaaugaaauaaaaca

SEQ ID NO: 602401 - RNA, 21 nt, Escherichia coli CFT073
cugaaaagguuacucccggau

SEQ ID NO: 602402 - RNA, 15 nt, Escherichia coli CFT073
cugaaaaacgaacau

SEQ ID NO: 602403 - RNA, 20 nt, Escherichia coli CFT073
cugaaaaaugagcgaacaau

SEQ ID NO: 602404 - RNA, 17 nt, Escherichia coli CFT073
cugaaaaaaagugcaua

SEQ ID NO: 602405 - RNA, 14 nt, Escherichia coli CFT073
cucuucaucuucca

SEQ ID NO: 602406 - RNA, 16 nt, Escherichia coli CFT073
cucuucaucuuccagu

SEQ ID NO: 602407 - RNA, 19 nt, Escherichia coli CFT073
cucuuccagcagcggcaga

SEQ ID NO: 602408 - RNA, 11 nt, Escherichia coli CFT073
cucuuccagcg

SEQ ID NO: 602409 - RNA, 23 nt, Escherichia coli CFT073
cucuuccagcgacaccuuccgcg

SEQ ID NO: 602410 - RNA, 23 nt, Escherichia coli CFT073
cucuucaauuaacaacacccggu

SEQ ID NO: 602411 - RNA, 19 nt, Escherichia coli CFT073
cucuguaucgcaucaggca

SEQ ID NO: 602412 - RNA, 14 nt, Escherichia coli CFT073
cucuggcagcacca

SEQ ID NO: 602413 - RNA, 23 nt, Escherichia coli CFT073
cucuggcugcuucaguaauaccg

SEQ ID NO: 602414 - RNA, 23 nt, Escherichia coli CFT073
cugaaccggucgugacugccgcc

SEQ ID NO: 602415 - RNA, 11 nt, Escherichia coli CFT073
cugaacgccgg

SEQ ID NO: 602416 - RNA, 13 nt, Escherichia coli CFT073
cugaacgccugca

SEQ ID NO: 602417 - RNA, 14 nt, Escherichia coli CFT073
cugaaccagcgccg

SEQ ID NO: 602418 - RNA, 20 nt, Escherichia coli CFT073
cugaagcaacaguaauaaug

SEQ ID NO: 602419 - RNA, 20 nt, Escherichia coli CFT073
cugaagcaguuucaccagca

SEQ ID NO: 602420 - RNA, 23 nt, Escherichia coli CFT073
cugaacgucuuugcgcuccauca

SEQ ID NO: 602421 - RNA, 19 nt, Escherichia coli CFT073
cugaagguaagcaacagau

SEQ ID NO: 602422 - RNA, 18 nt, Escherichia coli CFT073
cugaaguggguaauguca

SEQ ID NO: 602423 - RNA, 15 nt, Escherichia coli CFT073
cugaauaaacgccau

SEQ ID NO: 602424 - RNA, 19 nt, Escherichia coli CFT073
cugaauaaucguaaucagc

SEQ ID NO: 602425 - RNA, 23 nt, Escherichia coli CFT073
cugaauacacaucagaaacgcga

SEQ ID NO: 602426 - RNA, 17 nt, Escherichia coli CFT073
cugaauacacugcugau

SEQ ID NO: 602427 - RNA, 19 nt, Escherichia coli CFT073
cugaauacgauccgacauc

SEQ ID NO: 602428 - RNA, 16 nt, Escherichia coli CFT073
cugaaucagccaguaa

SEQ ID NO: 602429 - RNA, 13 nt, Escherichia coli CFT073
cugaaucgccgaa

SEQ ID NO: 602430 - RNA, 14 nt, Escherichia coli CFT073
cugaauuuccugcg

SEQ ID NO: 602431 - RNA, 23 nt, Escherichia coli CFT073
cugaauuuccugcgcuuucugcu

SEQ ID NO: 602432 - RNA, 22 nt, Escherichia coli CFT073
cugaauuggguucuuuccugcg

SEQ ID NO: 602433 - RNA, 22 nt, Escherichia coli CFT073
cugaauuaaguuuuccgcuucu

SEQ ID NO: 602434 - RNA, 18 nt, Escherichia coli CFT073
cugaauugccagcaucag

SEQ ID NO: 602435 - RNA, 16 nt, Escherichia coli CFT073
cugaccaaauacacgc

SEQ ID NO: 602436 - RNA, 20 nt, Escherichia coli CFT073
cugaccaaauacacgcacgg

SEQ ID NO: 602437 - RNA, 21 nt, Escherichia coli CFT073
cugaccacaaaggcgcgaagc

SEQ ID NO: 602438 - RNA, 14 nt, Escherichia coli CFT073
cugaccaccagcac

SEQ ID NO: 602439 - RNA, 18 nt, Escherichia coli CFT073
cugacacuauucgccagc

SEQ ID NO: 602440 - RNA, 23 nt, Escherichia coli CFT073
cugacagaccacucucuggcaac

SEQ ID NO: 602441 - RNA, 17 nt, Escherichia coli CFT073
cugacaucacgccacuc

SEQ ID NO: 602442 - RNA, 13 nt, Escherichia coli CFT073
cugacauccacgu

SEQ ID NO: 602443 - RNA, 13 nt, Escherichia coli CFT073
cugacaugcacgc

SEQ ID NO: 602444 - RNA, 17 nt, Escherichia coli CFT073
cugacauuaaauugcga

SEQ ID NO: 602445 - RNA, 23 nt, Escherichia coli CFT073
cugacguugcggauuaaauacau

SEQ ID NO: 602446 - RNA, 17 nt, Escherichia coli CFT073
cugacugaauacgaucc

SEQ ID NO: 602447 - RNA, 23 nt, Escherichia coli CFT073
cugacugacgugaugauaaguga

SEQ ID NO: 602448 - RNA, 13 nt, Escherichia coli CFT073
cugacuccaggug

SEQ ID NO: 602449 - RNA, 18 nt, Escherichia coli CFT073
cugacuuuguaccagcgg

SEQ ID NO: 602450 - RNA, 20 nt, Escherichia coli CFT073
cugagaauuccggcagagaa

SEQ ID NO: 602451 - RNA, 22 nt, Escherichia coli CFT073
cugacuuacuuccugucuuccc

SEQ ID NO: 602452 - RNA, 13 nt, Escherichia coli CFT073
cugacuugccagg

SEQ ID NO: 602453 - RNA, 20 nt, Escherichia coli CFT073
cugacggaucggcucaacau

SEQ ID NO: 602454 - RNA, 17 nt, Escherichia coli CFT073
cugacgcgugguuacgc

SEQ ID NO: 602455 - RNA, 22 nt, Escherichia coli CFT073
cugacgcgugguuacgccgggc

SEQ ID NO: 602456 - RNA, 15 nt, Escherichia coli CFT073
cugacgcgcuuuuca

SEQ ID NO: 602457 - RNA, 16 nt, Escherichia coli CFT073
cugacgaucggcaucg

SEQ ID NO: 602458 - RNA, 21 nt, Escherichia coli CFT073
cugacgaaugguuucacgcug

SEQ ID NO: 602459 - RNA, 19 nt, Escherichia coli CFT073
cugaccuuaguuggucgcc

SEQ ID NO: 602460 - RNA, 18 nt, Escherichia coli CFT073
cugacgaaggugccggau

SEQ ID NO: 602461 - RNA, 18 nt, Escherichia coli CFT073
cugaccuauuucauucag

SEQ ID NO: 602462 - RNA, 16 nt, Escherichia coli CFT073
cugaccgguugcugga

SEQ ID NO: 602463 - RNA, 23 nt, Escherichia coli CFT073
cugaccgucuuuuuuuacgggua

SEQ ID NO: 602464 - RNA, 12 nt, Escherichia coli CFT073
cugagcaucaau

SEQ ID NO: 602465 - RNA, 22 nt, Escherichia coli CFT073
cugagcauuuaugccauguuca

SEQ ID NO: 602466 - RNA, 19 nt, Escherichia coli CFT073
cugagacugucuguccggg

SEQ ID NO: 602467 - RNA, 20 nt, Escherichia coli CFT073
cugauaagcguagcgcagca

SEQ ID NO: 602468 - RNA, 19 nt, Escherichia coli CFT073
cugauaaccgccgccaaac

SEQ ID NO: 602469 - RNA, 15 nt, Escherichia coli CFT073
cugauaacgccacgc

SEQ ID NO: 602470 - RNA, 16 nt, Escherichia coli CFT073
cugaguaauagccuga

SEQ ID NO: 602471 - RNA, 17 nt, Escherichia coli CFT073
cugagucagcagcgcca

SEQ ID NO: 602472 - RNA, 22 nt, Escherichia coli CFT073
cugagucggaacuuugcugcaa

SEQ ID NO: 602473 - RNA, 20 nt, Escherichia coli CFT073
cugaguggugagauugcugc

SEQ ID NO: 602474 - RNA, 16 nt, Escherichia coli CFT073
cugaguuuuauucuuu

SEQ ID NO: 602475 - RNA, 17 nt, Escherichia coli CFT073
cugaguuuucaguaccg

SEQ ID NO: 602476 - RNA, 18 nt, Escherichia coli CFT073
cugauaaaacgcgcagcg

SEQ ID NO: 602477 - RNA, 14 nt, Escherichia coli CFT073
cugaucaucgccca

SEQ ID NO: 602478 - RNA, 19 nt, Escherichia coli CFT073
cugaucaucgcccaguuga

SEQ ID NO: 602479 - RNA, 13 nt, Escherichia coli CFT073
cugaucaccguag

SEQ ID NO: 602480 - RNA, 21 nt, Escherichia coli CFT073
cugaucaccugcgauaaaccg

SEQ ID NO: 602481 - RNA, 15 nt, Escherichia coli CFT073
cugaucaauaaucuc

SEQ ID NO: 602482 - RNA, 15 nt, Escherichia coli CFT073
cugauagaacauguc

SEQ ID NO: 602483 - RNA, 18 nt, Escherichia coli CFT073
cugauagugcccggcaau

SEQ ID NO: 602484 - RNA, 13 nt, Escherichia coli CFT073
cugauaguuccag

SEQ ID NO: 602485 - RNA, 21 nt, Escherichia coli CFT073
cugauaucggcucauaaaaac

SEQ ID NO: 602486 - RNA, 15 nt, Escherichia coli CFT073
cugauauucagcgcc

SEQ ID NO: 602487 - RNA, 13 nt, Escherichia coli CFT073
cugcauacucugc

SEQ ID NO: 602488 - RNA, 17 nt, Escherichia coli CFT073
cugcaguuguuccugau

SEQ ID NO: 602489 - RNA, 21 nt, Escherichia coli CFT073
cugcagguguaucguaaaaug

SEQ ID NO: 602490 - RNA, 21 nt, Escherichia coli CFT073
cugcaggaaagcaagaccaac

SEQ ID NO: 602491 - RNA, 18 nt, Escherichia coli CFT073
cugcagcggccaguagcu

SEQ ID NO: 602492 - RNA, 14 nt, Escherichia coli CFT073
cugcaucaaccagc

SEQ ID NO: 602493 - RNA, 12 nt, Escherichia coli CFT073
cugcauccgcgc

SEQ ID NO: 602494 - RNA, 16 nt, Escherichia coli CFT073
cugcauccgcgcuuuc

SEQ ID NO: 602495 - RNA, 19 nt, Escherichia coli CFT073
cugcauccgcgcuuucugg

SEQ ID NO: 602496 - RNA, 14 nt, Escherichia coli CFT073
cugcaugauuagca

SEQ ID NO: 602497 - RNA, 19 nt, Escherichia coli CFT073
cugcaugaaauagcccacu

SEQ ID NO: 602498 - RNA, 14 nt, Escherichia coli CFT073
cugcaucuggcgau

SEQ ID NO: 602499 - RNA, 19 nt, Escherichia coli CFT073
cugcauuagcaaugcccug

SEQ ID NO: 602500 - RNA, 16 nt, Escherichia coli CFT073
cugcauucggcgacca

SEQ ID NO: 602501 - RNA, 15 nt, Escherichia coli CFT073
cugcauugcgcugaa

SEQ ID NO: 602502 - RNA, 18 nt, Escherichia coli CFT073
cugcauugcgcugaacau

SEQ ID NO: 602503 - RNA, 21 nt, Escherichia coli CFT073
cugccaauaaugcccgcacca

SEQ ID NO: 602504 - RNA, 12 nt, Escherichia coli CFT073
cugcauuugcgc

SEQ ID NO: 602505 - RNA, 14 nt, Escherichia coli CFT073
cugccacgccacgc

SEQ ID NO: 602506 - RNA, 16 nt, Escherichia coli CFT073
cugccacgccacgcug

SEQ ID NO: 602507 - RNA, 17 nt, Escherichia coli CFT073
cugcccgcgauccagcg

SEQ ID NO: 602508 - RNA, 13 nt, Escherichia coli CFT073
cugcccaucaucg

SEQ ID NO: 602509 - RNA, 14 nt, Escherichia coli CFT073
cugcccaagugcag

SEQ ID NO: 602510 - RNA, 15 nt, Escherichia coli CFT073
cugcccaaucaaacu

SEQ ID NO: 602511 - RNA, 14 nt, Escherichia coli CFT073
cugccaugccaaac

SEQ ID NO: 602512 - RNA, 22 nt, Escherichia coli CFT073
cugccaucuuuuggcugauaau

SEQ ID NO: 602513 - RNA, 15 nt, Escherichia coli CFT073
cugccauauccagcc

SEQ ID NO: 602514 - RNA, 14 nt, Escherichia coli CFT073
cugccaguugcgcu

SEQ ID NO: 602515 - RNA, 19 nt, Escherichia coli CFT073
cugccaguuucgucaguuc

SEQ ID NO: 602516 - RNA, 17 nt, Escherichia coli CFT073
cugccauaaacgguuuc

SEQ ID NO: 602517 - RNA, 20 nt, Escherichia coli CFT073
cugccaguaaagcagcgaag

SEQ ID NO: 602518 - RNA, 22 nt, Escherichia coli CFT073
cugccagucggggggaggcugc

SEQ ID NO: 602519 - RNA, 19 nt, Escherichia coli CFT073
cugccagcccgcugguugu

SEQ ID NO: 602520 - RNA, 12 nt, Escherichia coli CFT073
cugccagcgccg

SEQ ID NO: 602521 - RNA, 19 nt, Escherichia coli CFT073
cugccagagcugaauauca

SEQ ID NO: 602522 - RNA, 13 nt, Escherichia coli CFT073
cugccagaugcag

SEQ ID NO: 602523 - RNA, 18 nt, Escherichia coli CFT073
cugccagcagacgccggu

SEQ ID NO: 602524 - RNA, 19 nt, Escherichia coli CFT073
cugccacucuccugguugu

SEQ ID NO: 602525 - RNA, 14 nt, Escherichia coli CFT073
cugccagacaaaac

SEQ ID NO: 602526 - RNA, 20 nt, Escherichia coli CFT073
cugccagacaaaacugacgc

SEQ ID NO: 602527 - RNA, 20 nt, Escherichia coli CFT073
cugcaaggccaucggcagcg

SEQ ID NO: 602528 - RNA, 20 nt, Escherichia coli CFT073
cugcaagagggacuccggau

SEQ ID NO: 602529 - RNA, 18 nt, Escherichia coli CFT073
cugcacaaagcgccagaa

SEQ ID NO: 602530 - RNA, 16 nt, Escherichia coli CFT073
cugcacaccaaccgcu

SEQ ID NO: 602531 - RNA, 19 nt, Escherichia coli CFT073
cugcacauacugcaucagc

SEQ ID NO: 602532 - RNA, 21 nt, Escherichia coli CFT073
cugcacauacugcaucagcgc

SEQ ID NO: 602533 - RNA, 11 nt, Escherichia coli CFT073
cugcaccagca

SEQ ID NO: 602534 - RNA, 18 nt, Escherichia coli CFT073
cugcaccaggccguaccu

SEQ ID NO: 602535 - RNA, 13 nt, Escherichia coli CFT073
cugcaccccacaa

SEQ ID NO: 602536 - RNA, 15 nt, Escherichia coli CFT073
cugcagaauauccgc

SEQ ID NO: 602537 - RNA, 13 nt, Escherichia coli CFT073
cugcacgguuuuu

SEQ ID NO: 602538 - RNA, 20 nt, Escherichia coli CFT073
cugcacuaacccucuguccg

SEQ ID NO: 602539 - RNA, 16 nt, Escherichia coli CFT073
cugaugcgaugcuggc

SEQ ID NO: 602540 - RNA, 16 nt, Escherichia coli CFT073
cugaugagcggagcac

SEQ ID NO: 602541 - RNA, 20 nt, Escherichia coli CFT073
cugauggaagugacaccggu

SEQ ID NO: 602542 - RNA, 13 nt, Escherichia coli CFT073
cugaugaaguuga

SEQ ID NO: 602543 - RNA, 20 nt, Escherichia coli CFT073
cugaugaauuuaucuuucag

SEQ ID NO: 602544 - RNA, 16 nt, Escherichia coli CFT073
cugaucguccugcggu

SEQ ID NO: 602545 - RNA, 16 nt, Escherichia coli CFT073
cugaucggcaaucacg

SEQ ID NO: 602546 - RNA, 18 nt, Escherichia coli CFT073
cugaucgacaguugcugc

SEQ ID NO: 602547 - RNA, 14 nt, Escherichia coli CFT073
cugauuuaaaaaug

SEQ ID NO: 602548 - RNA, 20 nt, Escherichia coli CFT073
cugauuuccccccggcagcu

SEQ ID NO: 602549 - RNA, 23 nt, Escherichia coli CFT073
cugauuugcccgaugcgcaagcu

SEQ ID NO: 602550 - RNA, 20 nt, Escherichia coli CFT073
cugauugaccgccagcgcca

SEQ ID NO: 602551 - RNA, 14 nt, Escherichia coli CFT073
cugauugauugcga

SEQ ID NO: 602552 - RNA, 14 nt, Escherichia coli CFT073
cugauugccggaug

SEQ ID NO: 602553 - RNA, 13 nt, Escherichia coli CFT073
cugauuuaaucgc

SEQ ID NO: 602554 - RNA, 19 nt, Escherichia coli CFT073
cugaugguuuuaauacugc

SEQ ID NO: 602555 - RNA, 19 nt, Escherichia coli CFT073
cugauguagcgugauuuuu

SEQ ID NO: 602556 - RNA, 14 nt, Escherichia coli CFT073
cugauuaacgcuug

SEQ ID NO: 602557 - RNA, 14 nt, Escherichia coli CFT073
cugcaagcgucgcg

SEQ ID NO: 602558 - RNA, 14 nt, Escherichia coli CFT073
cugcaacguuuccg

SEQ ID NO: 602559 - RNA, 15 nt, Escherichia coli CFT073
cugcaacgucuuccc

SEQ ID NO: 602560 - RNA, 14 nt, Escherichia coli CFT073
cugcaacugaugac

SEQ ID NO: 602561 - RNA, 11 nt, Escherichia coli CFT073
cugcaaccaga

SEQ ID NO: 602562 - RNA, 16 nt, Escherichia coli CFT073
cugcaaagcugauggu

SEQ ID NO: 602563 - RNA, 14 nt, Escherichia coli CFT073
cugcaaauauuguc

SEQ ID NO: 602564 - RNA, 15 nt, Escherichia coli CFT073
cugcaacaacaccag

SEQ ID NO: 602565 - RNA, 21 nt, Escherichia coli CFT073
cugcaacacuuccgcuuccag

SEQ ID NO: 602566 - RNA, 18 nt, Escherichia coli CFT073
cugcaacacccgguaccu

SEQ ID NO: 602567 - RNA, 22 nt, Escherichia coli CFT073
aacccuaaagcacccagcaauc

SEQ ID NO: 602568 - RNA, 19 nt, Escherichia coli CFT073
aaccgacauugccaguuuu

SEQ ID NO: 602569 - RNA, 15 nt, Escherichia coli CFT073
aacccuuccgccgca

SEQ ID NO: 602570 - RNA, 18 nt, Escherichia coli CFT073
aacccuggugcaauuacg

SEQ ID NO: 602571 - RNA, 20 nt, Escherichia coli CFT073
cgucuuaucuggccuacagg

SEQ ID NO: 602572 - RNA, 17 nt, Escherichia coli CFT073
cgucuucuucaaaacca

SEQ ID NO: 602573 - RNA, 22 nt, Escherichia coli CFT073
cgucuucuucccagacccaguu

SEQ ID NO: 602574 - RNA, 20 nt, Escherichia coli CFT073
cgucuuaucaggccuacaag

SEQ ID NO: 602575 - RNA, 18 nt, Escherichia coli CFT073
cgucuuaucaggccuacg

SEQ ID NO: 602576 - RNA, 16 nt, Escherichia coli CFT073
cgucugggcaaaauca

SEQ ID NO: 602577 - RNA, 18 nt, Escherichia coli CFT073
cgucugggcaaaaucauc

SEQ ID NO: 602578 - RNA, 20 nt, Escherichia coli CFT073
cgugaaaguuugugccgccg

SEQ ID NO: 602579 - RNA, 15 nt, Escherichia coli CFT073
cgugaaagaaaauga

SEQ ID NO: 602580 - RNA, 20 nt, Escherichia coli CFT073
cgucuuuggguucaccgcga

SEQ ID NO: 602581 - RNA, 15 nt, Escherichia coli CFT073
cgucugaauaucauc

SEQ ID NO: 602582 - RNA, 21 nt, Escherichia coli CFT073
cgucguuaguuuucgacaucg

SEQ ID NO: 602583 - RNA, 23 nt, Escherichia coli CFT073
cgucugacgcguaccuaacaguu

SEQ ID NO: 602584 - RNA, 20 nt, Escherichia coli CFT073
cgucugcgcagguuuaccug

SEQ ID NO: 602585 - RNA, 13 nt, Escherichia coli CFT073
cgucugcgucgca

SEQ ID NO: 602586 - RNA, 17 nt, Escherichia coli CFT073
cgugagguuaucgcccu

SEQ ID NO: 602587 - RNA, 15 nt, Escherichia coli CFT073
cgugagucuccuuua

SEQ ID NO: 602588 - RNA, 21 nt, Escherichia coli CFT073
cgugauauuacauaccagcag

SEQ ID NO: 602589 - RNA, 23 nt, Escherichia coli CFT073
cgugauauuacauaccagcagca

SEQ ID NO: 602590 - RNA, 17 nt, Escherichia coli CFT073
cgugagguaugaaaauc

SEQ ID NO: 602591 - RNA, 14 nt, Escherichia coli CFT073
cgugacugccgcca

SEQ ID NO: 602592 - RNA, 19 nt, Escherichia coli CFT073
cgugacugccgccagcauu

SEQ ID NO: 602593 - RNA, 19 nt, Escherichia coli CFT073
cgugacugggauauaaacu

SEQ ID NO: 602594 - RNA, 16 nt, Escherichia coli CFT073
cgugacggcuuuuuug

SEQ ID NO: 602595 - RNA, 18 nt, Escherichia coli CFT073
cgugacgcuggcagaaag

SEQ ID NO: 602596 - RNA, 19 nt, Escherichia coli CFT073
cgugacgccagaaaaccug

SEQ ID NO: 602597 - RNA, 23 nt, Escherichia coli CFT073
cgugcaucucuucaaauagcgga

SEQ ID NO: 602598 - RNA, 16 nt, Escherichia coli CFT073
cgugcauuccagcauu

SEQ ID NO: 602599 - RNA, 19 nt, Escherichia coli CFT073
cgugcauuuuucgcuuuuc

SEQ ID NO: 602600 - RNA, 20 nt, Escherichia coli CFT073
cgugcauuuuucgcuuuuca

SEQ ID NO: 602601 - RNA, 16 nt, Escherichia coli CFT073
cgugcacuucugcggu

SEQ ID NO: 602602 - RNA, 18 nt, Escherichia coli CFT073
cguugacguucaugccgg

SEQ ID NO: 602603 - RNA, 18 nt, Escherichia coli CFT073
cguugaugcaggcaguaa

SEQ ID NO: 602604 - RNA, 14 nt, Escherichia coli CFT073
cguugauuggcgca

SEQ ID NO: 602605 - RNA, 16 nt, Escherichia coli CFT073
cguugauuguugcaga

SEQ ID NO: 602606 - RNA, 19 nt, Escherichia coli CFT073
cguugcaaauauuccauca

SEQ ID NO: 602607 - RNA, 23 nt, Escherichia coli CFT073
cguugcaaucagcggugccgcga

SEQ ID NO: 602608 - RNA, 14 nt, Escherichia coli CFT073
cguucuucccgccu

SEQ ID NO: 602609 - RNA, 20 nt, Escherichia coli CFT073
cguucgguggugccgacauu

SEQ ID NO: 602610 - RNA, 20 nt, Escherichia coli CFT073
cguucguccgagcggcacca

SEQ ID NO: 602611 - RNA, 22 nt, Escherichia coli CFT073
cguucgguaaguuaccggcaau

SEQ ID NO: 602612 - RNA, 18 nt, Escherichia coli CFT073
cguucggcggaugcagga

SEQ ID NO: 602613 - RNA, 19 nt, Escherichia coli CFT073
cguuccggauaucggcagc

SEQ ID NO: 602614 - RNA, 22 nt, Escherichia coli CFT073
cguuccggcaacgacgucgauu

SEQ ID NO: 602615 - RNA, 14 nt, Escherichia coli CFT073
cguuccggcgguga

SEQ ID NO: 602616 - RNA, 15 nt, Escherichia coli CFT073
cguuccggcggugau

SEQ ID NO: 602617 - RNA, 13 nt, Escherichia coli CFT073
cguucccggaaca

SEQ ID NO: 602618 - RNA, 15 nt, Escherichia coli CFT073
cguuccccaucaccu

SEQ ID NO: 602619 - RNA, 18 nt, Escherichia coli CFT073
cguucccagcggauacca

SEQ ID NO: 602620 - RNA, 15 nt, Escherichia coli CFT073
cguuaaagcguccag

SEQ ID NO: 602621 - RNA, 16 nt, Escherichia coli CFT073
cguuaacagcgcauuc

SEQ ID NO: 602622 - RNA, 17 nt, Escherichia coli CFT073
cguguugcuccacgcca

SEQ ID NO: 602623 - RNA, 15 nt, Escherichia coli CFT073
cguguuccaguugca

SEQ ID NO: 602624 - RNA, 22 nt, Escherichia coli CFT073
cguguucaugaccgugaucgug

SEQ ID NO: 602625 - RNA, 20 nt, Escherichia coli CFT073
cguguuccagagaacgaccc

SEQ ID NO: 602626 - RNA, 18 nt, Escherichia coli CFT073
cgugguguaacgagacaa

SEQ ID NO: 602627 - RNA, 12 nt, Escherichia coli CFT073
cgugguuacgcc

SEQ ID NO: 602628 - RNA, 19 nt, Escherichia coli CFT073
cgugguggugaucgugcgc

SEQ ID NO: 602629 - RNA, 18 nt, Escherichia coli CFT073
cguggugauuucaggcuu

SEQ ID NO: 602630 - RNA, 19 nt, Escherichia coli CFT073
cguggugcugauacgcgca

SEQ ID NO: 602631 - RNA, 18 nt, Escherichia coli CFT073
cguucaauacgcaguuuu

SEQ ID NO: 602632 - RNA, 21 nt, Escherichia coli CFT073
cguucaccuaacagcaucgca

SEQ ID NO: 602633 - RNA, 16 nt, Escherichia coli CFT073
cguuaugcuuacugag

SEQ ID NO: 602634 - RNA, 15 nt, Escherichia coli CFT073
cguuaugaucagcaa

SEQ ID NO: 602635 - RNA, 15 nt, Escherichia coli CFT073
cguuauucaauuacg

SEQ ID NO: 602636 - RNA, 22 nt, Escherichia coli CFT073
cguuauucaauuacgcggcuuc

SEQ ID NO: 602637 - RNA, 16 nt, Escherichia coli CFT073
cguuauuuguugccgg

SEQ ID NO: 602638 - RNA, 23 nt, Escherichia coli CFT073
cguuauuuguugccggaugcggc

SEQ ID NO: 602639 - RNA, 13 nt, Escherichia coli CFT073
cguuaaccaugca

SEQ ID NO: 602640 - RNA, 14 nt, Escherichia coli CFT073
cguuaacgcguccu

SEQ ID NO: 602641 - RNA, 21 nt, Escherichia coli CFT073
cguuaacggcauuuuccagcu

SEQ ID NO: 602642 - RNA, 15 nt, Escherichia coli CFT073
cguuaacuggaacag

SEQ ID NO: 602643 - RNA, 19 nt, Escherichia coli CFT073
cguuaagcgucgcaucagg

SEQ ID NO: 602644 - RNA, 14 nt, Escherichia coli CFT073
cguuaaucgccugc

SEQ ID NO: 602645 - RNA, 13 nt, Escherichia coli CFT073
cguuaauuucuuu

SEQ ID NO: 602646 - RNA, 22 nt, Escherichia coli CFT073
cguuacaccuuuccccggcagc

SEQ ID NO: 602647 - RNA, 20 nt, Escherichia coli CFT073
aaccgccgacgcgaagcaca

SEQ ID NO: 602648 - RNA, 20 nt, Escherichia coli CFT073
aaccgccaaauucggcgguu

SEQ ID NO: 602649 - RNA, 24 nt, Escherichia coli CFT073
aaccgcccagcagcgccgcgccua

SEQ ID NO: 602650 - RNA, 22 nt, Escherichia coli CFT073
aaccgcaucauguaaaucaauu

SEQ ID NO: 602651 - RNA, 17 nt, Escherichia coli CFT073
aaccgcauccggcgcaa

SEQ ID NO: 602652 - RNA, 14 nt, Escherichia coli CFT073
cgugcgcaucgcca

SEQ ID NO: 602653 - RNA, 19 nt, Escherichia coli CFT073
cgugccuuuaauggucagg

SEQ ID NO: 602654 - RNA, 19 nt, Escherichia coli CFT073
cgugccugacggacgcgcg

SEQ ID NO: 602655 - RNA, 18 nt, Escherichia coli CFT073
cgugccuucacgggcaac

SEQ ID NO: 602656 - RNA, 22 nt, Escherichia coli CFT073
cgugccgggcaaauucagacua

SEQ ID NO: 602657 - RNA, 16 nt, Escherichia coli CFT073
cgugccgccgugacga

SEQ ID NO: 602658 - RNA, 23 nt, Escherichia coli CFT073
cgugccggaagucucuugccggu

SEQ ID NO: 602659 - RNA, 19 nt, Escherichia coli CFT073
cgucgcaacuccaccagca

SEQ ID NO: 602660 - RNA, 18 nt, Escherichia coli CFT073
cgucgcgcacgcccauca

SEQ ID NO: 602661 - RNA, 14 nt, Escherichia coli CFT073
cgucgccagcgccu

SEQ ID NO: 602662 - RNA, 14 nt, Escherichia coli CFT073
cgucgcgccaggcg

SEQ ID NO: 602663 - RNA, 17 nt, Escherichia coli CFT073
cgucgcgcguaacauau

SEQ ID NO: 602664 - RNA, 17 nt, Escherichia coli CFT073
cgucgcugcucuucugu

SEQ ID NO: 602665 - RNA, 19 nt, Escherichia coli CFT073
cgucgcucacuucacgcug

SEQ ID NO: 602666 - RNA, 22 nt, Escherichia coli CFT073
cgucgcucacuucacgcugcca

SEQ ID NO: 602667 - RNA, 14 nt, Escherichia coli CFT073
cgucaucggcagca

SEQ ID NO: 602668 - RNA, 22 nt, Escherichia coli CFT073
cgucaugcuccugauuggcagg

SEQ ID NO: 602669 - RNA, 15 nt, Escherichia coli CFT073
cgucacgcaccaacu

SEQ ID NO: 602670 - RNA, 16 nt, Escherichia coli CFT073
cgucacgauaucgaua

SEQ ID NO: 602671 - RNA, 15 nt, Escherichia coli CFT073
cguccagcagcaaug

SEQ ID NO: 602672 - RNA, 16 nt, Escherichia coli CFT073
cguccagcgaaccuuc

SEQ ID NO: 602673 - RNA, 16 nt, Escherichia coli CFT073
cguccagccaccgcgu

SEQ ID NO: 602674 - RNA, 24 nt, Escherichia coli CFT073
cgucauugaugcugccaucaucuu

SEQ ID NO: 602675 - RNA, 19 nt, Escherichia coli CFT073
cguccagcugccugcggcg

SEQ ID NO: 602676 - RNA, 22 nt, Escherichia coli CFT073
cguccucacuuaaagcaacacc

SEQ ID NO: 602677 - RNA, 20 nt, Escherichia coli CFT073
cguccggcgucgcuucucaa

SEQ ID NO: 602678 - RNA, 19 nt, Escherichia coli CFT073
cguccgcucaauauauucu

SEQ ID NO: 602679 - RNA, 14 nt, Escherichia coli CFT073
cguaauugccagac

SEQ ID NO: 602680 - RNA, 19 nt, Escherichia coli CFT073
cguaacguuucuuucauca

SEQ ID NO: 602681 - RNA, 14 nt, Escherichia coli CFT073
cguaacucaggugg

SEQ ID NO: 602682 - RNA, 20 nt, Escherichia coli CFT073
cguaacggcucacccccauc

SEQ ID NO: 602683 - RNA, 20 nt, Escherichia coli CFT073
cguaaccaaugccacccagc

SEQ ID NO: 602684 - RNA, 11 nt, Escherichia coli CFT073
cguaacauauu

SEQ ID NO: 602685 - RNA, 14 nt, Escherichia coli CFT073
cguaacgaacacga

SEQ ID NO: 602686 - RNA, 14 nt, Escherichia coli CFT073
cguaacgcccacgc

SEQ ID NO: 602687 - RNA, 18 nt, Escherichia coli CFT073
cguaacgccuuucaggug

SEQ ID NO: 602688 - RNA, 13 nt, Escherichia coli CFT073
cguaccaucgcca

SEQ ID NO: 602689 - RNA, 13 nt, Escherichia coli CFT073
cguaccagcgaaa

SEQ ID NO: 602690 - RNA, 19 nt, Escherichia coli CFT073
cguacagacaccaaucagc

SEQ ID NO: 602691 - RNA, 12 nt, Escherichia coli CFT073
cguacagcagaa

SEQ ID NO: 602692 - RNA, 21 nt, Escherichia coli CFT073
cguacaggacgggguugugau

SEQ ID NO: 602693 - RNA, 13 nt, Escherichia coli CFT073
cguaccggaaccu

SEQ ID NO: 602694 - RNA, 20 nt, Escherichia coli CFT073
cguaccggcgcguaucgcga

SEQ ID NO: 602695 - RNA, 22 nt, Escherichia coli CFT073
cguaccugacgguaaauacgcg

SEQ ID NO: 602696 - RNA, 19 nt, Escherichia coli CFT073
cguacccaucaacaacugg

SEQ ID NO: 602697 - RNA, 15 nt, Escherichia coli CFT073
cguacauccggcaau

SEQ ID NO: 602698 - RNA, 16 nt, Escherichia coli CFT073
cguacggcccauaacc

SEQ ID NO: 602699 - RNA, 15 nt, Escherichia coli CFT073
cguaccuucgaugaa

SEQ ID NO: 602700 - RNA, 13 nt, Escherichia coli CFT073
cguacugaccgua

SEQ ID NO: 602701 - RNA, 22 nt, Escherichia coli CFT073
cguacugaucuuuuuucagccg

SEQ ID NO: 602702 - RNA, 21 nt, Escherichia coli CFT073
cguacucggcaguaucggaga

SEQ ID NO: 602703 - RNA, 14 nt, Escherichia coli CFT073
cguacuacgcgccg

SEQ ID NO: 602704 - RNA, 23 nt, Escherichia coli CFT073
cgguucggacauguuuuccagca

SEQ ID NO: 602705 - RNA, 15 nt, Escherichia coli CFT073
cgguucggcgucgcc

SEQ ID NO: 602706 - RNA, 13 nt, Escherichia coli CFT073
cgguugauaauga

SEQ ID NO: 602707 - RNA, 22 nt, Escherichia coli CFT073
cgguugccccgcacgcuucauc

SEQ ID NO: 602708 - RNA, 19 nt, Escherichia coli CFT073
cgguugaucucaucuucca

SEQ ID NO: 602709 - RNA, 15 nt, Escherichia coli CFT073
cguaaauucucccgc

SEQ ID NO: 602710 - RNA, 16 nt, Escherichia coli CFT073
cgguuuucuuccagcc

SEQ ID NO: 602711 - RNA, 13 nt, Escherichia coli CFT073
cgguuuugccagc

SEQ ID NO: 602712 - RNA, 17 nt, Escherichia coli CFT073
cgguuugcgccgugcga

SEQ ID NO: 602713 - RNA, 20 nt, Escherichia coli CFT073
cgguuugaguucaccgccau

SEQ ID NO: 602714 - RNA, 14 nt, Escherichia coli CFT073
cgguugcggaaccc

SEQ ID NO: 602715 - RNA, 21 nt, Escherichia coli CFT073
cgguugcggaacccagcgcga

SEQ ID NO: 602716 - RNA, 14 nt, Escherichia coli CFT073
cgguuauccugcaa

SEQ ID NO: 602717 - RNA, 21 nt, Escherichia coli CFT073
cgguuaugaauaacuccgccg

SEQ ID NO: 602718 - RNA, 16 nt, Escherichia coli CFT073
cgguuagcucaacgca

SEQ ID NO: 602719 - RNA, 23 nt, Escherichia coli CFT073
cgguuaucacccugugucgccga

SEQ ID NO: 602720 - RNA, 14 nt, Escherichia coli CFT073
cguauuuuuggcuc

SEQ ID NO: 602721 - RNA, 22 nt, Escherichia coli CFT073
aacccgaugguucccuuuuuca

SEQ ID NO: 602722 - RNA, 11 nt, Escherichia coli CFT073
cgucaccaccu

SEQ ID NO: 602723 - RNA, 16 nt, Escherichia coli CFT073
cgucaccaccucaccc

SEQ ID NO: 602724 - RNA, 18 nt, Escherichia coli CFT073
cgucaccaccucacccgc

SEQ ID NO: 602725 - RNA, 22 nt, Escherichia coli CFT073
aacccgcgacgacgacaggcaa

SEQ ID NO: 602726 - RNA, 18 nt, Escherichia coli CFT073
cguauuucagccccagca

SEQ ID NO: 602727 - RNA, 21 nt, Escherichia coli CFT073
cguaucuuuaaagcccgcagc

SEQ ID NO: 602728 - RNA, 21 nt, Escherichia coli CFT073
cguauccgacguuacgcgcca

SEQ ID NO: 602729 - RNA, 20 nt, Escherichia coli CFT073
cguaggccggauaagaugcg

SEQ ID NO: 602730 - RNA, 12 nt, Escherichia coli CFT073
cguaggccggau

SEQ ID NO: 602731 - RNA, 13 nt, Escherichia coli CFT073
cguaggccggaua

SEQ ID NO: 602732 - RNA, 20 nt, Escherichia coli CFT073
cguaggccggauaaggcguu

SEQ ID NO: 602733 - RNA, 13 nt, Escherichia coli CFT073
cguaggccugaua

SEQ ID NO: 602734 - RNA, 20 nt, Escherichia coli CFT073
cguaggccugauaagacgcg

SEQ ID NO: 602735 - RNA, 20 nt, Escherichia coli CFT073
cguaggccugauaagacgca

SEQ ID NO: 602736 - RNA, 18 nt, Escherichia coli CFT073
aacccgagcgccagcgaa

SEQ ID NO: 602737 - RNA, 17 nt, Escherichia coli CFT073
cguagcugggcaacaaa

SEQ ID NO: 602738 - RNA, 19 nt, Escherichia coli CFT073
aacccauuuucagccggca

SEQ ID NO: 602739 - RNA, 12 nt, Escherichia coli CFT073
aacccauccagc

SEQ ID NO: 602740 - RNA, 12 nt, Escherichia coli CFT073
cguagcgcagca

SEQ ID NO: 602741 - RNA, 16 nt, Escherichia coli CFT073
cguagacauaaccggu

SEQ ID NO: 602742 - RNA, 23 nt, Escherichia coli CFT073
gacgcguaaauccagcaccgcuu

SEQ ID NO: 602743 - RNA, 16 nt, Escherichia coli CFT073
gacgcguagugucgca

SEQ ID NO: 602744 - RNA, 21 nt, Escherichia coli CFT073
gacgcgucagcgucgcaucug

SEQ ID NO: 602745 - RNA, 16 nt, Escherichia coli CFT073
gacgcgugcagaguca

SEQ ID NO: 602746 - RNA, 20 nt, Escherichia coli CFT073
gacgcguggcgucgcaucug

SEQ ID NO: 602747 - RNA, 19 nt, Escherichia coli CFT073
gacgcguuaagcgucgcau

SEQ ID NO: 602748 - RNA, 22 nt, Escherichia coli CFT073
gacgcguuaagcgucgcaucag

SEQ ID NO: 602749 - RNA, 18 nt, Escherichia coli CFT073
gacgcgucugcgucgcau

SEQ ID NO: 602750 - RNA, 21 nt, Escherichia coli CFT073
gacgcgucugcgucgcaucug

SEQ ID NO: 602751 - RNA, 16 nt, Escherichia coli CFT073
gacgcgcaaaauggcc

SEQ ID NO: 602752 - RNA, 14 nt, Escherichia coli CFT073
gacgcgccagcagc

SEQ ID NO: 602753 - RNA, 17 nt, Escherichia coli CFT073
gacgcgccagcagcgca

SEQ ID NO: 602754 - RNA, 17 nt, Escherichia coli CFT073
gacgcgccagcaucgca

SEQ ID NO: 602755 - RNA, 20 nt, Escherichia coli CFT073
gacgcgccagcaucgcauca

SEQ ID NO: 602756 - RNA, 23 nt, Escherichia coli CFT073
gacgcgccagcaucgcaucaggc

SEQ ID NO: 602757 - RNA, 14 nt, Escherichia coli CFT073
gacgcugaccgcuu

SEQ ID NO: 602758 - RNA, 23 nt, Escherichia coli CFT073
gacgcuggcagaaaguucgcgaa

SEQ ID NO: 602759 - RNA, 15 nt, Escherichia coli CFT073
gacggacgcccgccg

SEQ ID NO: 602760 - RNA, 17 nt, Escherichia coli CFT073
gacggaacaucugcccc

SEQ ID NO: 602761 - RNA, 15 nt, Escherichia coli CFT073
gacgcuguccggcgc

SEQ ID NO: 602762 - RNA, 17 nt, Escherichia coli CFT073
gacgcuguccggcgcac

SEQ ID NO: 602763 - RNA, 18 nt, Escherichia coli CFT073
gacggaucuuccagcgca

SEQ ID NO: 602764 - RNA, 20 nt, Escherichia coli CFT073
gacggcugucauccagcagu

SEQ ID NO: 602765 - RNA, 15 nt, Escherichia coli CFT073
gacggcguucuuuac

SEQ ID NO: 602766 - RNA, 17 nt, Escherichia coli CFT073
aacgugcggcaggcaca

SEQ ID NO: 602767 - RNA, 23 nt, Escherichia coli CFT073
aacgucggcauauuuaaaaacga

SEQ ID NO: 602768 - RNA, 22 nt, Escherichia coli CFT073
aacgucgccaguccuucaauau

SEQ ID NO: 602769 - RNA, 16 nt, Escherichia coli CFT073
aacgucgcgccuguca

SEQ ID NO: 602770 - RNA, 16 nt, Escherichia coli CFT073
aacgucuucgccaaau

SEQ ID NO: 602771 - RNA, 17 nt, Escherichia coli CFT073
aacgugaaaugucauua

SEQ ID NO: 602772 - RNA, 15 nt, Escherichia coli CFT073
aacgugaccaugagc

SEQ ID NO: 602773 - RNA, 14 nt, Escherichia coli CFT073
gacggcgacgcgcg

SEQ ID NO: 602774 - RNA, 21 nt, Escherichia coli CFT073
gacgggcauuucgucuugcag

SEQ ID NO: 602775 - RNA, 13 nt, Escherichia coli CFT073
gacgggucgcuuc

SEQ ID NO: 602776 - RNA, 20 nt, Escherichia coli CFT073
gacgguuaaaaacagccagc

SEQ ID NO: 602777 - RNA, 23 nt, Escherichia coli CFT073
gacgguuuccaggcagccauaac

SEQ ID NO: 602778 - RNA, 21 nt, Escherichia coli CFT073
aacguacaccgcagccgccac

SEQ ID NO: 602779 - RNA, 23 nt, Escherichia coli CFT073
aacguacagacaccaaucagccc

SEQ ID NO: 602780 - RNA, 16 nt, Escherichia coli CFT073
aacguaaaugccagcc

SEQ ID NO: 602781 - RNA, 16 nt, Escherichia coli CFT073
aacgguucugcugccg

SEQ ID NO: 602782 - RNA, 16 nt, Escherichia coli CFT073
aacgguugauagcgac

SEQ ID NO: 602783 - RNA, 16 nt, Escherichia coli CFT073
aacgguugcaauaucg

SEQ ID NO: 602784 - RNA, 19 nt, Escherichia coli CFT073
aacguacuguuauccgcca

SEQ ID NO: 602785 - RNA, 22 nt, Escherichia coli CFT073
aacgguuaugaauaacuccgcc

SEQ ID NO: 602786 - RNA, 19 nt, Escherichia coli CFT073
gacgaucauuccgcccaga

SEQ ID NO: 602787 - RNA, 22 nt, Escherichia coli CFT073
gacgauaucgauaaagaacgca

SEQ ID NO: 602788 - RNA, 15 nt, Escherichia coli CFT073
gacgauaggucauau

SEQ ID NO: 602789 - RNA, 21 nt, Escherichia coli CFT073
gacgacgcgcuuguccugcca

SEQ ID NO: 602790 - RNA, 18 nt, Escherichia coli CFT073
gacgaccuuuuccaucgc

SEQ ID NO: 602791 - RNA, 20 nt, Escherichia coli CFT073
aacggccacgaugcacagcu

SEQ ID NO: 602792 - RNA, 16 nt, Escherichia coli CFT073
aacggcccggcgacga

SEQ ID NO: 602793 - RNA, 19 nt, Escherichia coli CFT073
gacgcaccuuguucaucgg

SEQ ID NO: 602794 - RNA, 22 nt, Escherichia coli CFT073
gacgcaacugcgcuucaauacg

SEQ ID NO: 602795 - RNA, 15 nt, Escherichia coli CFT073
gacgaugauuguccc

SEQ ID NO: 602796 - RNA, 12 nt, Escherichia coli CFT073
gacgccagcgcu

SEQ ID NO: 602797 - RNA, 19 nt, Escherichia coli CFT073
gacgcgaacagcgucgcau

SEQ ID NO: 602798 - RNA, 15 nt, Escherichia coli CFT073
gacgccugcagcauc

SEQ ID NO: 602799 - RNA, 14 nt, Escherichia coli CFT073
gacgcccugugcgc

SEQ ID NO: 602800 - RNA, 16 nt, Escherichia coli CFT073
gacgcccugugcgccc

SEQ ID NO: 602801 - RNA, 14 nt, Escherichia coli CFT073
aacgauacgcuggc

SEQ ID NO: 602802 - RNA, 12 nt, Escherichia coli CFT073
gaccaccgcagc

SEQ ID NO: 602803 - RNA, 22 nt, Escherichia coli CFT073
gacaucgucugcggugcgccaa

SEQ ID NO: 602804 - RNA, 14 nt, Escherichia coli CFT073
gacaucuccagcgc

SEQ ID NO: 602805 - RNA, 15 nt, Escherichia coli CFT073
gacaugaaugucaua

SEQ ID NO: 602806 - RNA, 20 nt, Escherichia coli CFT073
gacaucgccacggcaugaaa

SEQ ID NO: 602807 - RNA, 19 nt, Escherichia coli CFT073
gacaucgcccucuuucacc

SEQ ID NO: 602808 - RNA, 21 nt, Escherichia coli CFT073
gacaucgggaacaguucggua

SEQ ID NO: 602809 - RNA, 19 nt, Escherichia coli CFT073
aacgccaccccacaccagu

SEQ ID NO: 602810 - RNA, 23 nt, Escherichia coli CFT073
aacgauuucaucgcccaggcaag

SEQ ID NO: 602811 - RNA, 18 nt, Escherichia coli CFT073
aacgccagauccgggcua

SEQ ID NO: 602812 - RNA, 22 nt, Escherichia coli CFT073
aacgcccagcuaaucgagccga

SEQ ID NO: 602813 - RNA, 18 nt, Escherichia coli CFT073
aacgcccacgcuacucgc

SEQ ID NO: 602814 - RNA, 18 nt, Escherichia coli CFT073
aacgcccagcuaaucgag

SEQ ID NO: 602815 - RNA, 20 nt, Escherichia coli CFT073
aacgccccacaagcccgcca

SEQ ID NO: 602816 - RNA, 14 nt, Escherichia coli CFT073
gaccagcacggugg

SEQ ID NO: 602817 - RNA, 14 nt, Escherichia coli CFT073
aacgccgcugguga

SEQ ID NO: 602818 - RNA, 13 nt, Escherichia coli CFT073
aacgccucauccg

SEQ ID NO: 602819 - RNA, 20 nt, Escherichia coli CFT073
aacgccucauccggccuaca

SEQ ID NO: 602820 - RNA, 17 nt, Escherichia coli CFT073
gaccaucuuccagcauc

SEQ ID NO: 602821 - RNA, 19 nt, Escherichia coli CFT073
gaccaggccaucagcagcg

SEQ ID NO: 602822 - RNA, 14 nt, Escherichia coli CFT073
gaccauugaugcuc

SEQ ID NO: 602823 - RNA, 13 nt, Escherichia coli CFT073
gaccauuacugua

SEQ ID NO: 602824 - RNA, 14 nt, Escherichia coli CFT073
aacggaucgcguaa

SEQ ID NO: 602825 - RNA, 18 nt, Escherichia coli CFT073
aacggaugacuucgcuac

SEQ ID NO: 602826 - RNA, 14 nt, Escherichia coli CFT073
gaccgacagguuaa

SEQ ID NO: 602827 - RNA, 14 nt, Escherichia coli CFT073
gaccgauagcagcc

SEQ ID NO: 602828 - RNA, 15 nt, Escherichia coli CFT073
gaccgagcuggugau

SEQ ID NO: 602829 - RNA, 17 nt, Escherichia coli CFT073
gaccgagcgcccgccaa

SEQ ID NO: 602830 - RNA, 20 nt, Escherichia coli CFT073
aacgcggcaggagagaucga

SEQ ID NO: 602831 - RNA, 19 nt, Escherichia coli CFT073
gacccggcaucuaucgaau

SEQ ID NO: 602832 - RNA, 16 nt, Escherichia coli CFT073
aacgcuuucucaccau

SEQ ID NO: 602833 - RNA, 12 nt, Escherichia coli CFT073
aacggaccgcau

SEQ ID NO: 602834 - RNA, 21 nt, Escherichia coli CFT073
aacgcguuuuguagcgugcgg

SEQ ID NO: 602835 - RNA, 22 nt, Escherichia coli CFT073
aacgcuacgcuaacuucgccau

SEQ ID NO: 602836 - RNA, 18 nt, Escherichia coli CFT073
aacgcucaagaacggcaa

SEQ ID NO: 602837 - RNA, 14 nt, Escherichia coli CFT073
aacgcguucucgcc

SEQ ID NO: 602838 - RNA, 15 nt, Escherichia coli CFT073
gaauaacgcgcagcg

SEQ ID NO: 602839 - RNA, 15 nt, Escherichia coli CFT073
gaauaaauuugggug

SEQ ID NO: 602840 - RNA, 21 nt, Escherichia coli CFT073
gaaguuuuucgucaccuggua

SEQ ID NO: 602841 - RNA, 13 nt, Escherichia coli CFT073
gaauaaaaagcga

SEQ ID NO: 602842 - RNA, 17 nt, Escherichia coli CFT073
gaauaaaacgccugaua

SEQ ID NO: 602843 - RNA, 21 nt, Escherichia coli CFT073
gaauaaacagcagauggcagc

SEQ ID NO: 602844 - RNA, 23 nt, Escherichia coli CFT073
gaauaaaguuuuaguugccguuc

SEQ ID NO: 602845 - RNA, 14 nt, Escherichia coli CFT073
gaaguggugauuca

SEQ ID NO: 602846 - RNA, 20 nt, Escherichia coli CFT073
gaaguggauauccuggucaa

SEQ ID NO: 602847 - RNA, 15 nt, Escherichia coli CFT073
gaacugcugcgccag

SEQ ID NO: 602848 - RNA, 16 nt, Escherichia coli CFT073
gaacugcauugucgga

SEQ ID NO: 602849 - RNA, 18 nt, Escherichia coli CFT073
gaacugcaacucaccuuu

SEQ ID NO: 602850 - RNA, 23 nt, Escherichia coli CFT073
gaauauugguguugugaagugag

SEQ ID NO: 602851 - RNA, 14 nt, Escherichia coli CFT073
gaauauguaggccg

SEQ ID NO: 602852 - RNA, 15 nt, Escherichia coli CFT073
gaauauguuugggug

SEQ ID NO: 602853 - RNA, 23 nt, Escherichia coli CFT073
gaauauucucggcugccuggaua

SEQ ID NO: 602854 - RNA, 19 nt, Escherichia coli CFT073
gaauaugcugaauuagcca

SEQ ID NO: 602855 - RNA, 17 nt, Escherichia coli CFT073
gaauaucgaucgccgca

SEQ ID NO: 602856 - RNA, 13 nt, Escherichia coli CFT073
gaauauccgccgu

SEQ ID NO: 602857 - RNA, 19 nt, Escherichia coli CFT073
gaauaaucccggcaccaau

SEQ ID NO: 602858 - RNA, 14 nt, Escherichia coli CFT073
gaauaacuuccugu

SEQ ID NO: 602859 - RNA, 14 nt, Escherichia coli CFT073
gaauaaggcgguua

SEQ ID NO: 602860 - RNA, 13 nt, Escherichia coli CFT073
gaauaaggcguuu

SEQ ID NO: 602861 - RNA, 23 nt, Escherichia coli CFT073
gaauaacucccuauaaugcgcca

SEQ ID NO: 602862 - RNA, 16 nt, Escherichia coli CFT073
gaauaaugucgacguu

SEQ ID NO: 602863 - RNA, 16 nt, Escherichia coli CFT073
gaauccuucccccacc

SEQ ID NO: 602864 - RNA, 20 nt, Escherichia coli CFT073
gaaucgccgaaauuucgccg

SEQ ID NO: 602865 - RNA, 17 nt, Escherichia coli CFT073
gaaucgccacaacuuca

SEQ ID NO: 602866 - RNA, 13 nt, Escherichia coli CFT073
gaauccggcagcg

SEQ ID NO: 602867 - RNA, 15 nt, Escherichia coli CFT073
gaaucaagcgccgag

SEQ ID NO: 602868 - RNA, 19 nt, Escherichia coli CFT073
gaaucaccauguuucgccu

SEQ ID NO: 602869 - RNA, 15 nt, Escherichia coli CFT073
gaauccgccccgcgu

SEQ ID NO: 602870 - RNA, 18 nt, Escherichia coli CFT073
gacaaauaacccgccaug

SEQ ID NO: 602871 - RNA, 14 nt, Escherichia coli CFT073
gacaaaugcgccgc

SEQ ID NO: 602872 - RNA, 21 nt, Escherichia coli CFT073
gacaaauguguucagcgacag

SEQ ID NO: 602873 - RNA, 14 nt, Escherichia coli CFT073
gacaacaaacgcaa

SEQ ID NO: 602874 - RNA, 23 nt, Escherichia coli CFT073
gacaaccugaccuuuuuucagcg

SEQ ID NO: 602875 - RNA, 19 nt, Escherichia coli CFT073
gacaacagucaaccgccug

SEQ ID NO: 602876 - RNA, 20 nt, Escherichia coli CFT073
gacaaucagguaagcgauaa

SEQ ID NO: 602877 - RNA, 14 nt, Escherichia coli CFT073
gacaauccagcgaa

SEQ ID NO: 602878 - RNA, 16 nt, Escherichia coli CFT073
gacaauccccgccagc

SEQ ID NO: 602879 - RNA, 13 nt, Escherichia coli CFT073
gacaauccgcgag

SEQ ID NO: 602880 - RNA, 23 nt, Escherichia coli CFT073
gacaaucugugugggcacucgaa

SEQ ID NO: 602881 - RNA, 15 nt, Escherichia coli CFT073
gacaacgugcgauuu

SEQ ID NO: 602882 - RNA, 23 nt, Escherichia coli CFT073
gaauucguucaaacgauucggca

SEQ ID NO: 602883 - RNA, 12 nt, Escherichia coli CFT073
gaaugccugauc

SEQ ID NO: 602884 - RNA, 12 nt, Escherichia coli CFT073
gaaugcgaaaac

SEQ ID NO: 602885 - RNA, 13 nt, Escherichia coli CFT073
gaaugcuccccag

SEQ ID NO: 602886 - RNA, 15 nt, Escherichia coli CFT073
gaaugcucgcuggca

SEQ ID NO: 602887 - RNA, 17 nt, Escherichia coli CFT073
gaauuuaucuucaccaa

SEQ ID NO: 602888 - RNA, 16 nt, Escherichia coli CFT073
gaauuucauccuguau

SEQ ID NO: 602889 - RNA, 15 nt, Escherichia coli CFT073
gaauuuccugcgcuu

SEQ ID NO: 602890 - RNA, 23 nt, Escherichia coli CFT073
gaauuuugcuggcuucgcgcgcu

SEQ ID NO: 602891 - RNA, 15 nt, Escherichia coli CFT073
gaauuuuuaaccguc

SEQ ID NO: 602892 - RNA, 20 nt, Escherichia coli CFT073
gacaaacgcaaaacugccug

SEQ ID NO: 602893 - RNA, 23 nt, Escherichia coli CFT073
gacaaacguauaauugccugaug

SEQ ID NO: 602894 - RNA, 18 nt, Escherichia coli CFT073
gacaaaccagguaucguu

SEQ ID NO: 602895 - RNA, 22 nt, Escherichia coli CFT073
gacauacucagcgccugcugca

SEQ ID NO: 602896 - RNA, 12 nt, Escherichia coli CFT073
gacauacagcgu

SEQ ID NO: 602897 - RNA, 13 nt, Escherichia coli CFT073
gacaggccugauu

SEQ ID NO: 602898 - RNA, 19 nt, Escherichia coli CFT073
gacaggcgaaaccagcagc

SEQ ID NO: 602899 - RNA, 21 nt, Escherichia coli CFT073
gacaggcgaaaccagcagcca

SEQ ID NO: 602900 - RNA, 22 nt, Escherichia coli CFT073
aacgaccuggaaaacgucgguu

SEQ ID NO: 602901 - RNA, 14 nt, Escherichia coli CFT073
aacgaccagaaaug

SEQ ID NO: 602902 - RNA, 17 nt, Escherichia coli CFT073
aacgaccagcgccgcaa

SEQ ID NO: 602903 - RNA, 13 nt, Escherichia coli CFT073
gacaucaaacagg

SEQ ID NO: 602904 - RNA, 14 nt, Escherichia coli CFT073
gacaucaacgccug

SEQ ID NO: 602905 - RNA, 20 nt, Escherichia coli CFT073
gacaucaacgccugaugcga

SEQ ID NO: 602906 - RNA, 16 nt, Escherichia coli CFT073
gacaucccggcagaga

SEQ ID NO: 602907 - RNA, 15 nt, Escherichia coli CFT073
gacacugccacuuuu

SEQ ID NO: 602908 - RNA, 15 nt, Escherichia coli CFT073
gacagaaucagcagc

SEQ ID NO: 602909 - RNA, 20 nt, Escherichia coli CFT073
gacagaccacucucuggcaa

SEQ ID NO: 602910 - RNA, 14 nt, Escherichia coli CFT073
gacagaccgccagu

SEQ ID NO: 602911 - RNA, 20 nt, Escherichia coli CFT073
gacagacggcgacgcgcgcg

SEQ ID NO: 602912 - RNA, 15 nt, Escherichia coli CFT073
gacagagauauucag

SEQ ID NO: 602913 - RNA, 16 nt, Escherichia coli CFT073
gacagcucacgcgcca

SEQ ID NO: 602914 - RNA, 14 nt, Escherichia coli CFT073
gacagcaggaaaau

SEQ ID NO: 602915 - RNA, 22 nt, Escherichia coli CFT073
gacaaugugaaaacccugcgca

SEQ ID NO: 602916 - RNA, 13 nt, Escherichia coli CFT073
gacaauuaacacg

SEQ ID NO: 602917 - RNA, 17 nt, Escherichia coli CFT073
gacaauuccgccugcag

SEQ ID NO: 602918 - RNA, 14 nt, Escherichia coli CFT073
gacacaaugccaua

SEQ ID NO: 602919 - RNA, 16 nt, Escherichia coli CFT073
gacacagguaucgaca

SEQ ID NO: 602920 - RNA, 14 nt, Escherichia coli CFT073
gacacauaaccagg

SEQ ID NO: 602921 - RNA, 18 nt, Escherichia coli CFT073
gacaccccgguaaagcgc

SEQ ID NO: 602922 - RNA, 13 nt, Escherichia coli CFT073
gacaccagcgucg

SEQ ID NO: 602923 - RNA, 19 nt, Escherichia coli CFT073
gacaccaucacccaacaau

SEQ ID NO: 602924 - RNA, 20 nt, Escherichia coli CFT073
gacacgcugccccugguuau

SEQ ID NO: 602925 - RNA, 20 nt, Escherichia coli CFT073
gacacgaucuugauguggac

SEQ ID NO: 602926 - RNA, 23 nt, Escherichia coli CFT073
gaaacgcgucugaccgucuuuca

SEQ ID NO: 602927 - RNA, 16 nt, Escherichia coli CFT073
gaaacccggccacagc

SEQ ID NO: 602928 - RNA, 19 nt, Escherichia coli CFT073
gaaacccggccacagcgcc

SEQ ID NO: 602929 - RNA, 18 nt, Escherichia coli CFT073
gaaauacuaaauaugaaa

SEQ ID NO: 602930 - RNA, 20 nt, Escherichia coli CFT073
gaaauacuguuuaccggugc

SEQ ID NO: 602931 - RNA, 14 nt, Escherichia coli CFT073
gaaauaagaagcca

SEQ ID NO: 602932 - RNA, 14 nt, Escherichia coli CFT073
gaaauagccgaaaa

SEQ ID NO: 602933 - RNA, 11 nt, Escherichia coli CFT073
gaaauauugcu

SEQ ID NO: 602934 - RNA, 20 nt, Escherichia coli CFT073
gaaaucaaauacaucgcgaa

SEQ ID NO: 602935 - RNA, 22 nt, Escherichia coli CFT073
gaaaucaacauguuccugccag

SEQ ID NO: 602936 - RNA, 19 nt, Escherichia coli CFT073
gaaaucaacggcgucagcc

SEQ ID NO: 602937 - RNA, 14 nt, Escherichia coli CFT073
gaaauuaagcggca

SEQ ID NO: 602938 - RNA, 17 nt, Escherichia coli CFT073
gaaauugugauaaaaau

SEQ ID NO: 602939 - RNA, 18 nt, Escherichia coli CFT073
gaaauugugauaaaaauc

SEQ ID NO: 602940 - RNA, 22 nt, Escherichia coli CFT073
gaaauugugauaaaaaucggca

SEQ ID NO: 602941 - RNA, 22 nt, Escherichia coli CFT073
gaaauguugccggauggcacgc

SEQ ID NO: 602942 - RNA, 20 nt, Escherichia coli CFT073
gaaauguugguuucgugcau

SEQ ID NO: 602943 - RNA, 18 nt, Escherichia coli CFT073
gaacacgcucccagcagu

SEQ ID NO: 602944 - RNA, 17 nt, Escherichia coli CFT073
gaacacgaccugccaga

SEQ ID NO: 602945 - RNA, 20 nt, Escherichia coli CFT073
gaacacgcaacaccagcagu

SEQ ID NO: 602946 - RNA, 13 nt, Escherichia coli CFT073
gaaaagaaauauc

SEQ ID NO: 602947 - RNA, 14 nt, Escherichia coli CFT073
gaaaagaguucauc

SEQ ID NO: 602948 - RNA, 23 nt, Escherichia coli CFT073
gaaaagccuguaccaaaaucauc

SEQ ID NO: 602949 - RNA, 23 nt, Escherichia coli CFT073
gaaaaguuagccacagccuggga

SEQ ID NO: 602950 - RNA, 18 nt, Escherichia coli CFT073
aaccucuguuggcgacgu

SEQ ID NO: 602951 - RNA, 18 nt, Escherichia coli CFT073
aaccucaagcacagccgc

SEQ ID NO: 602952 - RNA, 15 nt, Escherichia coli CFT073
aaccuaagccgcgug

SEQ ID NO: 602953 - RNA, 18 nt, Escherichia coli CFT073
aaccuguucaacaauucg

SEQ ID NO: 602954 - RNA, 21 nt, Escherichia coli CFT073
aaccuucacggguugcgccug

SEQ ID NO: 602955 - RNA, 11 nt, Escherichia coli CFT073
aaccuuuucca

SEQ ID NO: 602956 - RNA, 21 nt, Escherichia coli CFT073
gaaaaucgggcgacagcugcg

SEQ ID NO: 602957 - RNA, 18 nt, Escherichia coli CFT073
gaaaaucuggcgcgcgga

SEQ ID NO: 602958 - RNA, 15 nt, Escherichia coli CFT073
gaaacaagaaguuau

SEQ ID NO: 602959 - RNA, 20 nt, Escherichia coli CFT073
gaaacaccagaaugccccau

SEQ ID NO: 602960 - RNA, 20 nt, Escherichia coli CFT073
gaaaauuguaguguugcagu

SEQ ID NO: 602961 - RNA, 21 nt, Escherichia coli CFT073
gaaaaugcccgguccuggcga

SEQ ID NO: 602962 - RNA, 16 nt, Escherichia coli CFT073
gaaaauuacgaauucc

SEQ ID NO: 602963 - RNA, 22 nt, Escherichia coli CFT073
gaaacaccugcauuuacggcca

SEQ ID NO: 602964 - RNA, 20 nt, Escherichia coli CFT073
gaaacagccaaucauaaacg

SEQ ID NO: 602965 - RNA, 16 nt, Escherichia coli CFT073
gaaacaguaaguucac

SEQ ID NO: 602966 - RNA, 24 nt, Escherichia coli CFT073
gaacggugcgaccaaacugcucgu

SEQ ID NO: 602967 - RNA, 16 nt, Escherichia coli CFT073
gaacggggcugccagc

SEQ ID NO: 602968 - RNA, 13 nt, Escherichia coli CFT073
gaacgggugauuu

SEQ ID NO: 602969 - RNA, 12 nt, Escherichia coli CFT073
gaacuaguagca

SEQ ID NO: 602970 - RNA, 20 nt, Escherichia coli CFT073
gaacguuccccgcgauggcu

SEQ ID NO: 602971 - RNA, 22 nt, Escherichia coli CFT073
gaacguuccccgcgauggcugg

SEQ ID NO: 602972 - RNA, 15 nt, Escherichia coli CFT073
gaacgugaucgcccc

SEQ ID NO: 602973 - RNA, 18 nt, Escherichia coli CFT073
gaacuccgccccggcaau

SEQ ID NO: 602974 - RNA, 12 nt, Escherichia coli CFT073
gaacucagcgug

SEQ ID NO: 602975 - RNA, 16 nt, Escherichia coli CFT073
gaacgcguuauccggc

SEQ ID NO: 602976 - RNA, 21 nt, Escherichia coli CFT073
gaacggagucgggucgccgua

SEQ ID NO: 602977 - RNA, 13 nt, Escherichia coli CFT073
gaacggcaaacgc

SEQ ID NO: 602978 - RNA, 18 nt, Escherichia coli CFT073
gaacgaucgcuuucaacg

SEQ ID NO: 602979 - RNA, 17 nt, Escherichia coli CFT073
gaacgcgccaagauaga

SEQ ID NO: 602980 - RNA, 21 nt, Escherichia coli CFT073
gaacgccuuauccgaccuaca

SEQ ID NO: 602981 - RNA, 19 nt, Escherichia coli CFT073
gaacgccuuauccggccua

SEQ ID NO: 602982 - RNA, 12 nt, Escherichia coli CFT073
gaacgccugauu

SEQ ID NO: 602983 - RNA, 12 nt, Escherichia coli CFT073
gaacgccugcac

SEQ ID NO: 602984 - RNA, 21 nt, Escherichia coli CFT073
gaaccagaauuuccagaaagu

SEQ ID NO: 602985 - RNA, 22 nt, Escherichia coli CFT073
gaaccagaauuuccagaaagug

SEQ ID NO: 602986 - RNA, 12 nt, Escherichia coli CFT073
gaaccagcugcc

SEQ ID NO: 602987 - RNA, 13 nt, Escherichia coli CFT073
gaacagcggagca

SEQ ID NO: 602988 - RNA, 17 nt, Escherichia coli CFT073
gaacgacauccgccagc

SEQ ID NO: 602989 - RNA, 20 nt, Escherichia coli CFT073
cuuucucgcgcccaaccagc

SEQ ID NO: 602990 - RNA, 14 nt, Escherichia coli CFT073
cuuucuccgcaucc

SEQ ID NO: 602991 - RNA, 16 nt, Escherichia coli CFT073
cuuucguuauuacagc

SEQ ID NO: 602992 - RNA, 12 nt, Escherichia coli CFT073
cuuucuguuucg

SEQ ID NO: 602993 - RNA, 19 nt, Escherichia coli CFT073
cuuucugcuucgccaucuc

SEQ ID NO: 602994 - RNA, 14 nt, Escherichia coli CFT073
cuuucucuuccagc

SEQ ID NO: 602995 - RNA, 23 nt, Escherichia coli CFT073
cuuucugcagggcaauagccagc

SEQ ID NO: 602996 - RNA, 20 nt, Escherichia coli CFT073
cuuucgcuuucucuucggcu

SEQ ID NO: 602997 - RNA, 15 nt, Escherichia coli CFT073
cuuucgcuucaacca

SEQ ID NO: 602998 - RNA, 17 nt, Escherichia coli CFT073
cuuucgggcgcaaaaac

SEQ ID NO: 602999 - RNA, 13 nt, Escherichia coli CFT073
cuuucgcaucagc

SEQ ID NO: 603000 - RNA, 20 nt, Escherichia coli CFT073
cuuucgccggaugcgacguu

SEQ ID NO: 603001 - RNA, 15 nt, Escherichia coli CFT073
cuuucgccugcggcg

SEQ ID NO: 603002 - RNA, 16 nt, Escherichia coli CFT073
cuuucauauuccagcc

SEQ ID NO: 603003 - RNA, 20 nt, Escherichia coli CFT073
cuuucccgcgcccgugcauc

SEQ ID NO: 603004 - RNA, 17 nt, Escherichia coli CFT073
cuuucaugguacuggcg

SEQ ID NO: 603005 - RNA, 21 nt, Escherichia coli CFT073
cuuuccggaaaaaucaaaaac

SEQ ID NO: 603006 - RNA, 21 nt, Escherichia coli CFT073
cuuuccgggguaaauuucuuc

SEQ ID NO: 603007 - RNA, 21 nt, Escherichia coli CFT073
cuuuccggcauuagcaucaag

SEQ ID NO: 603008 - RNA, 23 nt, Escherichia coli CFT073
cuuugcugauacuccaugaguaa

SEQ ID NO: 603009 - RNA, 17 nt, Escherichia coli CFT073
cuuugcuaaaacgugaa

SEQ ID NO: 603010 - RNA, 12 nt, Escherichia coli CFT073
cuuugccggaug

SEQ ID NO: 603011 - RNA, 16 nt, Escherichia coli CFT073
cuuuguaaagcgccaa

SEQ ID NO: 603012 - RNA, 18 nt, Escherichia coli CFT073
cuuuguaggccugauaag

SEQ ID NO: 603013 - RNA, 19 nt, Escherichia coli CFT073
cuuuggacucauuaaacca

SEQ ID NO: 603014 - RNA, 21 nt, Escherichia coli CFT073
cuuucuuuuauaguucggcug

SEQ ID NO: 603015 - RNA, 17 nt, Escherichia coli CFT073
cuuucuuugcuuuguaa

SEQ ID NO: 603016 - RNA, 18 nt, Escherichia coli CFT073
cuuugaaaauaacgucgc

SEQ ID NO: 603017 - RNA, 15 nt, Escherichia coli CFT073
cuuugaaacgcacgc

SEQ ID NO: 603018 - RNA, 15 nt, Escherichia coli CFT073
cuuugaacagccaga

SEQ ID NO: 603019 - RNA, 21 nt, Escherichia coli CFT073
cuuugacaccgcuguugcuuc

SEQ ID NO: 603020 - RNA, 20 nt, Escherichia coli CFT073
cuuugacgucgaaacugaca

SEQ ID NO: 603021 - RNA, 23 nt, Escherichia coli CFT073
cuuugacguugguuucgcauuuc

SEQ ID NO: 603022 - RNA, 16 nt, Escherichia coli CFT073
cuuugacugaaauuua

SEQ ID NO: 603023 - RNA, 18 nt, Escherichia coli CFT073
cuuugacuguccgcaucc

SEQ ID NO: 603024 - RNA, 12 nt, Escherichia coli CFT073
cuuugaucgcgu

SEQ ID NO: 603025 - RNA, 22 nt, Escherichia coli CFT073
cuuugcacucugcgacgguuuc

SEQ ID NO: 603026 - RNA, 17 nt, Escherichia coli CFT073
cuuugcagguucugcuc

SEQ ID NO: 603027 - RNA, 21 nt, Escherichia coli CFT073
cuuuuuuuacggguaaugacg

SEQ ID NO: 603028 - RNA, 12 nt, Escherichia coli CFT073
cuuuuuccugcc

SEQ ID NO: 603029 - RNA, 16 nt, Escherichia coli CFT073
cuuuuucuucacccgu

SEQ ID NO: 603030 - RNA, 13 nt, Escherichia coli CFT073
gaaaaauucaggg

SEQ ID NO: 603031 - RNA, 16 nt, Escherichia coli CFT073
gaaaaauugccugaug

SEQ ID NO: 603032 - RNA, 15 nt, Escherichia coli CFT073
gaaaacaacuggcaa

SEQ ID NO: 603033 - RNA, 20 nt, Escherichia coli CFT073
gaaaaccauaaugaugccga

SEQ ID NO: 603034 - RNA, 11 nt, Escherichia coli CFT073
gaaaacgccuu

SEQ ID NO: 603035 - RNA, 20 nt, Escherichia coli CFT073
gaaaacguugggcgaauucc

SEQ ID NO: 603036 - RNA, 14 nt, Escherichia coli CFT073
gaaaacccugcgca

SEQ ID NO: 603037 - RNA, 18 nt, Escherichia coli CFT073
cuuuuuauguuagccgcc

SEQ ID NO: 603038 - RNA, 21 nt, Escherichia coli CFT073
cuuuugccagcaguugcugac

SEQ ID NO: 603039 - RNA, 15 nt, Escherichia coli CFT073
cuuuugccuguugca

SEQ ID NO: 603040 - RNA, 16 nt, Escherichia coli CFT073
cuuuugccuguugcac

SEQ ID NO: 603041 - RNA, 17 nt, Escherichia coli CFT073
cuuuguguguuucggcu

SEQ ID NO: 603042 - RNA, 15 nt, Escherichia coli CFT073
cuuugucgggcaggc

SEQ ID NO: 603043 - RNA, 17 nt, Escherichia coli CFT073
cuuuuaaauccugcaca

SEQ ID NO: 603044 - RNA, 22 nt, Escherichia coli CFT073
cuuuuaacgccucguuugcggc

SEQ ID NO: 603045 - RNA, 15 nt, Escherichia coli CFT073
cuuuuccucauuuaa

SEQ ID NO: 603046 - RNA, 11 nt, Escherichia coli CFT073
cuuuuccagcg

SEQ ID NO: 603047 - RNA, 21 nt, Escherichia coli CFT073
cuuuucagauugucguacaua

SEQ ID NO: 603048 - RNA, 18 nt, Escherichia coli CFT073
cuuuucaucagaucgcga

SEQ ID NO: 603049 - RNA, 13 nt, Escherichia coli CFT073
cuuuauuuccaua

SEQ ID NO: 603050 - RNA, 14 nt, Escherichia coli CFT073
cuuuauuuccugcg

SEQ ID NO: 603051 - RNA, 19 nt, Escherichia coli CFT073
cuuuaucggcacccaucgc

SEQ ID NO: 603052 - RNA, 23 nt, Escherichia coli CFT073
cuuuaucggcacccaucgccagc

SEQ ID NO: 603053 - RNA, 16 nt, Escherichia coli CFT073
cuuuauuaacaagcga

SEQ ID NO: 603054 - RNA, 18 nt, Escherichia coli CFT073
cuuuauaaauaucaaaaa

SEQ ID NO: 603055 - RNA, 23 nt, Escherichia coli CFT073
cuuuauagaacagagucugacca

SEQ ID NO: 603056 - RNA, 18 nt, Escherichia coli CFT073
cuuuauagcuuuucgcgu

SEQ ID NO: 603057 - RNA, 22 nt, Escherichia coli CFT073
cuuuaucacgaccgucaagaaa

SEQ ID NO: 603058 - RNA, 15 nt, Escherichia coli CFT073
cuuuauccagcacca

SEQ ID NO: 603059 - RNA, 22 nt, Escherichia coli CFT073
cuuucaccagaauagcggcuuc

SEQ ID NO: 603060 - RNA, 15 nt, Escherichia coli CFT073
cuuuauucaccagua

SEQ ID NO: 603061 - RNA, 16 nt, Escherichia coli CFT073
cuuucacgcccgcguu

SEQ ID NO: 603062 - RNA, 14 nt, Escherichia coli CFT073
cuuucacuccauug

SEQ ID NO: 603063 - RNA, 15 nt, Escherichia coli CFT073
cuuucacuucaguaa

SEQ ID NO: 603064 - RNA, 20 nt, Escherichia coli CFT073
cuuucacuuuugccagacga

SEQ ID NO: 603065 - RNA, 21 nt, Escherichia coli CFT073
cuuucacuuuugccagacgaa

SEQ ID NO: 603066 - RNA, 14 nt, Escherichia coli CFT073
cuuucacgccgcca

SEQ ID NO: 603067 - RNA, 20 nt, Escherichia coli CFT073
cuuucacgccgccaaaacgg

SEQ ID NO: 603068 - RNA, 23 nt, Escherichia coli CFT073
aaccgucguugcugucgcgcagc

SEQ ID NO: 603069 - RNA, 23 nt, Escherichia coli CFT073
aaccgugauauugggucuaucca

SEQ ID NO: 603070 - RNA, 23 nt, Escherichia coli CFT073
aaccgucacguugcgacaaacca

SEQ ID NO: 603071 - RNA, 22 nt, Escherichia coli CFT073
aaccguuauuauuacguccacc

SEQ ID NO: 603072 - RNA, 19 nt, Escherichia coli CFT073
cuuucagaguuguaccacc

SEQ ID NO: 603073 - RNA, 20 nt, Escherichia coli CFT073
cuuucagaguuguaccaccc

SEQ ID NO: 603074 - RNA, 22 nt, Escherichia coli CFT073
cuuucagcaccagcccgacgau

SEQ ID NO: 603075 - RNA, 18 nt, Escherichia coli CFT073
cuuucagcacuucggcau

SEQ ID NO: 603076 - RNA, 14 nt, Escherichia coli CFT073
cuuucaggcgugaa

SEQ ID NO: 603077 - RNA, 20 nt, Escherichia coli CFT073
cuugucgaguagcaaccgga

SEQ ID NO: 603078 - RNA, 14 nt, Escherichia coli CFT073
cuugugcaaugugg

SEQ ID NO: 603079 - RNA, 20 nt, Escherichia coli CFT073
cuuuagacacaucagcaacg

SEQ ID NO: 603080 - RNA, 20 nt, Escherichia coli CFT073
cuuuaaccccagaggcgaua

SEQ ID NO: 603081 - RNA, 16 nt, Escherichia coli CFT073
cuuuaacggccugacc

SEQ ID NO: 603082 - RNA, 15 nt, Escherichia coli CFT073
cuuuacaggcgugau

SEQ ID NO: 603083 - RNA, 14 nt, Escherichia coli CFT073
cuugcguacaccaa

SEQ ID NO: 603084 - RNA, 16 nt, Escherichia coli CFT073
cuugcgucacaaauac

SEQ ID NO: 603085 - RNA, 14 nt, Escherichia coli CFT073
cuucgucgucuucg

SEQ ID NO: 603086 - RNA, 22 nt, Escherichia coli CFT073
cuucgucaccuguucuucgcuc

SEQ ID NO: 603087 - RNA, 12 nt, Escherichia coli CFT073
cuugcucauccg

SEQ ID NO: 603088 - RNA, 23 nt, Escherichia coli CFT073
cuugcucgaucagacgaucgcgc

SEQ ID NO: 603089 - RNA, 11 nt, Escherichia coli CFT073
cuugcgugacg

SEQ ID NO: 603090 - RNA, 15 nt, Escherichia coli CFT073
cuugcugcgauccgc

SEQ ID NO: 603091 - RNA, 16 nt, Escherichia coli CFT073
cuugcuucgccaguuc

SEQ ID NO: 603092 - RNA, 16 nt, Escherichia coli CFT073
cuugcugcauuacugg

SEQ ID NO: 603093 - RNA, 13 nt, Escherichia coli CFT073
cuuccuugcugau

SEQ ID NO: 603094 - RNA, 13 nt, Escherichia coli CFT073
cuuccgggcaaca

SEQ ID NO: 603095 - RNA, 21 nt, Escherichia coli CFT073
cuuccggguagcgcggcagcg

SEQ ID NO: 603096 - RNA, 18 nt, Escherichia coli CFT073
cuuccggcaagauuugca

SEQ ID NO: 603097 - RNA, 12 nt, Escherichia coli CFT073
cuuccggcagca

SEQ ID NO: 603098 - RNA, 15 nt, Escherichia coli CFT073
cuuccggaaccacca

SEQ ID NO: 603099 - RNA, 21 nt, Escherichia coli CFT073
cuuccgcagaguaaugcgacg

SEQ ID NO: 603100 - RNA, 16 nt, Escherichia coli CFT073
cuuccgccaucaaucg

SEQ ID NO: 603101 - RNA, 16 nt, Escherichia coli CFT073
cuuccaguaacacuuc

SEQ ID NO: 603102 - RNA, 19 nt, Escherichia coli CFT073
cuuccagcgcaucgccaaa

SEQ ID NO: 603103 - RNA, 21 nt, Escherichia coli CFT073
cuuccagcguagugaaggcaa

SEQ ID NO: 603104 - RNA, 13 nt, Escherichia coli CFT073
cuuccagcguuuc

SEQ ID NO: 603105 - RNA, 14 nt, Escherichia coli CFT073
cuuccagcuccagc

SEQ ID NO: 603106 - RNA, 15 nt, Escherichia coli CFT073
cuuccagcuccagcc

SEQ ID NO: 603107 - RNA, 18 nt, Escherichia coli CFT073
cuuccagcuucagacgga

SEQ ID NO: 603108 - RNA, 12 nt, Escherichia coli CFT073
cuucggucagaa

SEQ ID NO: 603109 - RNA, 15 nt, Escherichia coli CFT073
cuucggucagcacgc

SEQ ID NO: 603110 - RNA, 21 nt, Escherichia coli CFT073
cuucgcucucuuucaccagcg

SEQ ID NO: 603111 - RNA, 14 nt, Escherichia coli CFT073
cuucgcaucccggu

SEQ ID NO: 603112 - RNA, 18 nt, Escherichia coli CFT073
cuucgccaaugaucccgc

SEQ ID NO: 603113 - RNA, 19 nt, Escherichia coli CFT073
cuucgccaauggcugccgc

SEQ ID NO: 603114 - RNA, 21 nt, Escherichia coli CFT073
cuucgccaauggcugccgcca

SEQ ID NO: 603115 - RNA, 12 nt, Escherichia coli CFT073
cuucgccacagc

SEQ ID NO: 603116 - RNA, 18 nt, Escherichia coli CFT073
cuucgccacagcggcauc

SEQ ID NO: 603117 - RNA, 22 nt, Escherichia coli CFT073
cuucgccagcgcgcggcuggca

SEQ ID NO: 603118 - RNA, 17 nt, Escherichia coli CFT073
cuucgccauuucgucgu

SEQ ID NO: 603119 - RNA, 16 nt, Escherichia coli CFT073
cuucgccagcgugacu

SEQ ID NO: 603120 - RNA, 13 nt, Escherichia coli CFT073
cuucgcggcuguu

SEQ ID NO: 603121 - RNA, 13 nt, Escherichia coli CFT073
cuucaauaaaccc

SEQ ID NO: 603122 - RNA, 13 nt, Escherichia coli CFT073
cuucaauaccacc

SEQ ID NO: 603123 - RNA, 18 nt, Escherichia coli CFT073
cuucaauaucaucauccg

SEQ ID NO: 603124 - RNA, 13 nt, Escherichia coli CFT073
cuucaaucaauaa

SEQ ID NO: 603125 - RNA, 19 nt, Escherichia coli CFT073
cuucaagccgggagcggcg

SEQ ID NO: 603126 - RNA, 11 nt, Escherichia coli CFT073
cuucagcgaug

SEQ ID NO: 603127 - RNA, 22 nt, Escherichia coli CFT073
cuucaggccagccugauccacu

SEQ ID NO: 603128 - RNA, 21 nt, Escherichia coli CFT073
cuuauugcuucaagaugccau

SEQ ID NO: 603129 - RNA, 21 nt, Escherichia coli CFT073
cuucaaauuuaauuugcugcg

SEQ ID NO: 603130 - RNA, 16 nt, Escherichia coli CFT073
cuucaaccacauucag

SEQ ID NO: 603131 - RNA, 18 nt, Escherichia coli CFT073
cuucaaccagcggcgcau

SEQ ID NO: 603132 - RNA, 21 nt, Escherichia coli CFT073
cuucauuuacaucacgcagcu

SEQ ID NO: 603133 - RNA, 18 nt, Escherichia coli CFT073
cuuccaccacuuccugcu

SEQ ID NO: 603134 - RNA, 15 nt, Escherichia coli CFT073
cuucauucacgauuu

SEQ ID NO: 603135 - RNA, 20 nt, Escherichia coli CFT073
cuucaucuauagcacccgcc

SEQ ID NO: 603136 - RNA, 21 nt, Escherichia coli CFT073
cuucaucuucuuugcgccagc

SEQ ID NO: 603137 - RNA, 20 nt, Escherichia coli CFT073
cuuccagaaaaagaaugcgc

SEQ ID NO: 603138 - RNA, 21 nt, Escherichia coli CFT073
cuuccagcgcguucuguucaa

SEQ ID NO: 603139 - RNA, 14 nt, Escherichia coli CFT073
cuuccagcaucagc

SEQ ID NO: 603140 - RNA, 16 nt, Escherichia coli CFT073
cuuccagauucaguuu

SEQ ID NO: 603141 - RNA, 17 nt, Escherichia coli CFT073
cuucauaccauauuguu

SEQ ID NO: 603142 - RNA, 12 nt, Escherichia coli CFT073
cuucauacugcg

SEQ ID NO: 603143 - RNA, 18 nt, Escherichia coli CFT073
cuucauagucucgcccac

SEQ ID NO: 603144 - RNA, 17 nt, Escherichia coli CFT073
cuucauccgacaccagc

SEQ ID NO: 603145 - RNA, 18 nt, Escherichia coli CFT073
cuucaucgaacgggugau

SEQ ID NO: 603146 - RNA, 15 nt, Escherichia coli CFT073
cuucaucguccagcg

SEQ ID NO: 603147 - RNA, 22 nt, Escherichia coli CFT073
cuucagguaauauugcguaccu

SEQ ID NO: 603148 - RNA, 22 nt, Escherichia coli CFT073
aaccggccuugcggaaagccag

SEQ ID NO: 603149 - RNA, 20 nt, Escherichia coli CFT073
cuuauaacugcccgcaucaa

SEQ ID NO: 603150 - RNA, 20 nt, Escherichia coli CFT073
cuuaagauaagaauaauaag

SEQ ID NO: 603151 - RNA, 11 nt, Escherichia coli CFT073
cuuaacggcag

SEQ ID NO: 603152 - RNA, 22 nt, Escherichia coli CFT073
cuuaacgguuuuaccuucugcu

SEQ ID NO: 603153 - RNA, 14 nt, Escherichia coli CFT073
cuuaaccgccgcca

SEQ ID NO: 603154 - RNA, 16 nt, Escherichia coli CFT073
cuuaauaagaaaaaag

SEQ ID NO: 603155 - RNA, 15 nt, Escherichia coli CFT073
cuuaagccagcgccc

SEQ ID NO: 603156 - RNA, 18 nt, Escherichia coli CFT073
cuuaagccaucaucaaua

SEQ ID NO: 603157 - RNA, 13 nt, Escherichia coli CFT073
cuguuuugccagg

SEQ ID NO: 603158 - RNA, 20 nt, Escherichia coli CFT073
cuuaaaacucacccugaugc

SEQ ID NO: 603159 - RNA, 14 nt, Escherichia coli CFT073
cugugcgauagcaa

SEQ ID NO: 603160 - RNA, 17 nt, Escherichia coli CFT073
cugugcguaaucgccga

SEQ ID NO: 603161 - RNA, 16 nt, Escherichia coli CFT073
cuguggcguauucggc

SEQ ID NO: 603162 - RNA, 17 nt, Escherichia coli CFT073
cuguggcguuauggcaa

SEQ ID NO: 603163 - RNA, 15 nt, Escherichia coli CFT073
cugugguacugccga

SEQ ID NO: 603164 - RNA, 12 nt, Escherichia coli CFT073
cuguucaacaau

SEQ ID NO: 603165 - RNA, 23 nt, Escherichia coli CFT073
cuguuaaugcgaaugaaagauga

SEQ ID NO: 603166 - RNA, 17 nt, Escherichia coli CFT073
cuguuaccgcugcuggc

SEQ ID NO: 603167 - RNA, 20 nt, Escherichia coli CFT073
cuguuaccuacgcuugcugc

SEQ ID NO: 603168 - RNA, 14 nt, Escherichia coli CFT073
cugugucgccgagc

SEQ ID NO: 603169 - RNA, 16 nt, Escherichia coli CFT073
cuguuugguugccagc

SEQ ID NO: 603170 - RNA, 12 nt, Escherichia coli CFT073
cuguuuaagcga

SEQ ID NO: 603171 - RNA, 20 nt, Escherichia coli CFT073
cuguuuaccggugccagcaa

SEQ ID NO: 603172 - RNA, 15 nt, Escherichia coli CFT073
cugucggcggcgaua

SEQ ID NO: 603173 - RNA, 18 nt, Escherichia coli CFT073
cugucggguaagcgccac

SEQ ID NO: 603174 - RNA, 11 nt, Escherichia coli CFT073
cugugccagcu

SEQ ID NO: 603175 - RNA, 14 nt, Escherichia coli CFT073
cugugccagcucca

SEQ ID NO: 603176 - RNA, 17 nt, Escherichia coli CFT073
cugugcggggguaaaac

SEQ ID NO: 603177 - RNA, 20 nt, Escherichia coli CFT073
cugugcgauuuccuucagca

SEQ ID NO: 603178 - RNA, 16 nt, Escherichia coli CFT073
cuguauucaucgacug

SEQ ID NO: 603179 - RNA, 13 nt, Escherichia coli CFT073
cugucaccaauca

SEQ ID NO: 603180 - RNA, 15 nt, Escherichia coli CFT073
cugucaccucugcaa

SEQ ID NO: 603181 - RNA, 20 nt, Escherichia coli CFT073
cuguaggguggggaaaaaac

SEQ ID NO: 603182 - RNA, 15 nt, Escherichia coli CFT073
cuguaggucggauaa

SEQ ID NO: 603183 - RNA, 23 nt, Escherichia coli CFT073
cuguaggucggauaaggcguuca

SEQ ID NO: 603184 - RNA, 20 nt, Escherichia coli CFT073
cuguaguccaggccugauua

SEQ ID NO: 603185 - RNA, 18 nt, Escherichia coli CFT073
cuguaucaccggcauuuu

SEQ ID NO: 603186 - RNA, 16 nt, Escherichia coli CFT073
cuguacuuaaaacuca

SEQ ID NO: 603187 - RNA, 16 nt, Escherichia coli CFT073
cuggucauaggcugcc

SEQ ID NO: 603188 - RNA, 14 nt, Escherichia coli CFT073
cuggcguuggcgua

SEQ ID NO: 603189 - RNA, 19 nt, Escherichia coli CFT073
cuggcguuguccgccagaa

SEQ ID NO: 603190 - RNA, 23 nt, Escherichia coli CFT073
cuggcguuaagcauucgcgaggu

SEQ ID NO: 603191 - RNA, 20 nt, Escherichia coli CFT073
cuggcucaucgccuuccagu

SEQ ID NO: 603192 - RNA, 15 nt, Escherichia coli CFT073
cuggcgugaaauuca

SEQ ID NO: 603193 - RNA, 16 nt, Escherichia coli CFT073
cuggcgguugauaaug

SEQ ID NO: 603194 - RNA, 14 nt, Escherichia coli CFT073
cuggcggcagcagg

SEQ ID NO: 603195 - RNA, 20 nt, Escherichia coli CFT073
cuggcggcaaugaaagcgag

SEQ ID NO: 603196 - RNA, 18 nt, Escherichia coli CFT073
cuggcggcgugaugccga

SEQ ID NO: 603197 - RNA, 20 nt, Escherichia coli CFT073
cuggcggcguguuauccggc

SEQ ID NO: 603198 - RNA, 14 nt, Escherichia coli CFT073
cuggcgcggcgcaa

SEQ ID NO: 603199 - RNA, 13 nt, Escherichia coli CFT073
cuggcuuucauuu

SEQ ID NO: 603200 - RNA, 19 nt, Escherichia coli CFT073
cuggcuuuuggaccgccaa

SEQ ID NO: 603201 - RNA, 15 nt, Escherichia coli CFT073
cuggcuguuacucaa

SEQ ID NO: 603202 - RNA, 17 nt, Escherichia coli CFT073
cugggccugcauaucgg

SEQ ID NO: 603203 - RNA, 15 nt, Escherichia coli CFT073
cuggucaggccaaac

SEQ ID NO: 603204 - RNA, 15 nt, Escherichia coli CFT073
cuggucaauggcgac

SEQ ID NO: 603205 - RNA, 19 nt, Escherichia coli CFT073
cugggcuucauccagcagc

SEQ ID NO: 603206 - RNA, 20 nt, Escherichia coli CFT073
cugggcuaccgcgagcguag

SEQ ID NO: 603207 - RNA, 13 nt, Escherichia coli CFT073
cuggagcuggcga

SEQ ID NO: 603208 - RNA, 14 nt, Escherichia coli CFT073
cuggaggagauauu

SEQ ID NO: 603209 - RNA, 19 nt, Escherichia coli CFT073
cugccgaccagaauaucgu

SEQ ID NO: 603210 - RNA, 20 nt, Escherichia coli CFT073
cugcccucuuuagcauucag

SEQ ID NO: 603211 - RNA, 18 nt, Escherichia coli CFT073
cugcccguuuaacguuau

SEQ ID NO: 603212 - RNA, 14 nt, Escherichia coli CFT073
cuggcacgcucgcg

SEQ ID NO: 603213 - RNA, 19 nt, Escherichia coli CFT073
cuggcacgcccgcgccauu

SEQ ID NO: 603214 - RNA, 14 nt, Escherichia coli CFT073
cuggcaaucgacuc

SEQ ID NO: 603215 - RNA, 14 nt, Escherichia coli CFT073
cuggcgcaggagcc

SEQ ID NO: 603216 - RNA, 17 nt, Escherichia coli CFT073
cuggcgcagcaggcggu

SEQ ID NO: 603217 - RNA, 23 nt, Escherichia coli CFT073
cuggcgauauugccgcgauagca

SEQ ID NO: 603218 - RNA, 22 nt, Escherichia coli CFT073
cuggcgcaauauucaagauaac

SEQ ID NO: 603219 - RNA, 18 nt, Escherichia coli CFT073
cuggcgcaacacccugau

SEQ ID NO: 603220 - RNA, 14 nt, Escherichia coli CFT073
cuggcgagcgccag

SEQ ID NO: 603221 - RNA, 16 nt, Escherichia coli CFT073
cuggcgagcgccagca

SEQ ID NO: 603222 - RNA, 15 nt, Escherichia coli CFT073
cuggcgacggcuacg

SEQ ID NO: 603223 - RNA, 19 nt, Escherichia coli CFT073
cuggcgacugccagccaca

SEQ ID NO: 603224 - RNA, 15 nt, Escherichia coli CFT073
cuggcgagaacaccg

SEQ ID NO: 603225 - RNA, 13 nt, Escherichia coli CFT073
gccgcuccaaggu

SEQ ID NO: 603226 - RNA, 18 nt, Escherichia coli CFT073
gccgcuccaaggucuccg

SEQ ID NO: 603227 - RNA, 21 nt, Escherichia coli CFT073
gccgcuccaaggucuccgccc

SEQ ID NO: 603228 - RNA, 15 nt, Escherichia coli CFT073
gccgcuccggcagca

SEQ ID NO: 603229 - RNA, 17 nt, Escherichia coli CFT073
gccgcucccggcauaac

SEQ ID NO: 603230 - RNA, 14 nt, Escherichia coli CFT073
gccgcgugccacca

SEQ ID NO: 603231 - RNA, 16 nt, Escherichia coli CFT073
gccgcgugccaccauu

SEQ ID NO: 603232 - RNA, 17 nt, Escherichia coli CFT073
gccgcguucgccagcgu

SEQ ID NO: 603233 - RNA, 19 nt, Escherichia coli CFT073
gccgcguucgccagcguca

SEQ ID NO: 603234 - RNA, 19 nt, Escherichia coli CFT073
gccgcuaucgcugauauac

SEQ ID NO: 603235 - RNA, 16 nt, Escherichia coli CFT073
gccgcuaaauaccagc

SEQ ID NO: 603236 - RNA, 19 nt, Escherichia coli CFT073
gccgcuaaauaccagcgua

SEQ ID NO: 603237 - RNA, 15 nt, Escherichia coli CFT073
gccgcuaacagcagc

SEQ ID NO: 603238 - RNA, 21 nt, Escherichia coli CFT073
gccgcuaacagcagcagcgca

SEQ ID NO: 603239 - RNA, 19 nt, Escherichia coli CFT073
gccgccacuugagccgcca

SEQ ID NO: 603240 - RNA, 23 nt, Escherichia coli CFT073
gccgccggaaucaacgguugcaa

SEQ ID NO: 603241 - RNA, 21 nt, Escherichia coli CFT073
gccgccucugccgcaauggcc

SEQ ID NO: 603242 - RNA, 15 nt, Escherichia coli CFT073
gccgcgacacaacgc

SEQ ID NO: 603243 - RNA, 15 nt, Escherichia coli CFT073
gccgcgacgguugcg

SEQ ID NO: 603244 - RNA, 20 nt, Escherichia coli CFT073
gccgcgaaccagaccagcaa

SEQ ID NO: 603245 - RNA, 14 nt, Escherichia coli CFT073
gccgcgaaacugcg

SEQ ID NO: 603246 - RNA, 17 nt, Escherichia coli CFT073
gccgccuuuacgcaaag

SEQ ID NO: 603247 - RNA, 19 nt, Escherichia coli CFT073
gccgccuuuacgcaaagca

SEQ ID NO: 603248 - RNA, 18 nt, Escherichia coli CFT073
gccgccuuuuacgcauuc

SEQ ID NO: 603249 - RNA, 17 nt, Escherichia coli CFT073
gccgcgaucucgucagc

SEQ ID NO: 603250 - RNA, 18 nt, Escherichia coli CFT073
gccgcgaugauagggcug

SEQ ID NO: 603251 - RNA, 17 nt, Escherichia coli CFT073
gccgcgaucccagacca

SEQ ID NO: 603252 - RNA, 17 nt, Escherichia coli CFT073
gccgcgaucgucaaaac

SEQ ID NO: 603253 - RNA, 21 nt, Escherichia coli CFT073
gccgcgaucgucaaaacgcgc

SEQ ID NO: 603254 - RNA, 14 nt, Escherichia coli CFT073
gccgcgcccgcuaa

SEQ ID NO: 603255 - RNA, 17 nt, Escherichia coli CFT073
gccgaugacgcagacuu

SEQ ID NO: 603256 - RNA, 15 nt, Escherichia coli CFT073
gccgauccgcgucau

SEQ ID NO: 603257 - RNA, 13 nt, Escherichia coli CFT073
gccgaguagccag

SEQ ID NO: 603258 - RNA, 21 nt, Escherichia coli CFT073
aagaugcguuaagcgucgcau

SEQ ID NO: 603259 - RNA, 21 nt, Escherichia coli CFT073
aagauggucuguaccaccaga

SEQ ID NO: 603260 - RNA, 16 nt, Escherichia coli CFT073
aagauguuggcagcgg

SEQ ID NO: 603261 - RNA, 23 nt, Escherichia coli CFT073
gccgacgcuccugaucaagcugg

SEQ ID NO: 603262 - RNA, 23 nt, Escherichia coli CFT073
gccgagcgcuaccaucgacacca

SEQ ID NO: 603263 - RNA, 22 nt, Escherichia coli CFT073
gccgaggcaaugccccagaaua

SEQ ID NO: 603264 - RNA, 13 nt, Escherichia coli CFT073
aagcaauaaacca

SEQ ID NO: 603265 - RNA, 22 nt, Escherichia coli CFT073
aagcaaugauaaguccgaugcc

SEQ ID NO: 603266 - RNA, 20 nt, Escherichia coli CFT073
aagcaaccggugucaucauc

SEQ ID NO: 603267 - RNA, 13 nt, Escherichia coli CFT073
aagcacagaaucu

SEQ ID NO: 603268 - RNA, 23 nt, Escherichia coli CFT073
aagcaccaacucgccacgaucgg

SEQ ID NO: 603269 - RNA, 21 nt, Escherichia coli CFT073
aagcacguuacccaaucgccc

SEQ ID NO: 603270 - RNA, 18 nt, Escherichia coli CFT073
gccgaugggcgccauuuu

SEQ ID NO: 603271 - RNA, 14 nt, Escherichia coli CFT073
gccgcauccgacau

SEQ ID NO: 603272 - RNA, 22 nt, Escherichia coli CFT073
gccgcauccgacaucaacgccu

SEQ ID NO: 603273 - RNA, 15 nt, Escherichia coli CFT073
gccgcauccgacgau

SEQ ID NO: 603274 - RNA, 12 nt, Escherichia coli CFT073
gccgcauccggc

SEQ ID NO: 603275 - RNA, 21 nt, Escherichia coli CFT073
gccgcauccggcaaucaacgc

SEQ ID NO: 603276 - RNA, 21 nt, Escherichia coli CFT073
gccgcauccggcauaauacau

SEQ ID NO: 603277 - RNA, 21 nt, Escherichia coli CFT073
gccgcauccggcauuguucau

SEQ ID NO: 603278 - RNA, 12 nt, Escherichia coli CFT073
gccgcaggcgug

SEQ ID NO: 603279 - RNA, 15 nt, Escherichia coli CFT073
gccgcauccgacaaa

SEQ ID NO: 603280 - RNA, 15 nt, Escherichia coli CFT073
gccgcauccgacacu

SEQ ID NO: 603281 - RNA, 22 nt, Escherichia coli CFT073
gccgcaucuggcauucagaaca

SEQ ID NO: 603282 - RNA, 16 nt, Escherichia coli CFT073
gccgcaucuggcauuu

SEQ ID NO: 603283 - RNA, 16 nt, Escherichia coli CFT073
gccgcacuuacagcaa

SEQ ID NO: 603284 - RNA, 14 nt, Escherichia coli CFT073
aagauaaugccagc

SEQ ID NO: 603285 - RNA, 14 nt, Escherichia coli CFT073
aagauacgcaucgc

SEQ ID NO: 603286 - RNA, 23 nt, Escherichia coli CFT073
aagauacggauucuuaacgucgc

SEQ ID NO: 603287 - RNA, 11 nt, Escherichia coli CFT073
aagaucagcgg

SEQ ID NO: 603288 - RNA, 14 nt, Escherichia coli CFT073
aagaucaucaccag

SEQ ID NO: 603289 - RNA, 18 nt, Escherichia coli CFT073
aagauccaguugaccugc

SEQ ID NO: 603290 - RNA, 24 nt, Escherichia coli CFT073
gccgacgauauuccgacggcgagc

SEQ ID NO: 603291 - RNA, 14 nt, Escherichia coli CFT073
gccgacaucgccac

SEQ ID NO: 603292 - RNA, 14 nt, Escherichia coli CFT073
gccgacaauaaacg

SEQ ID NO: 603293 - RNA, 15 nt, Escherichia coli CFT073
gcccuugugcugcgc

SEQ ID NO: 603294 - RNA, 20 nt, Escherichia coli CFT073
gcccuuugcuggcaugaaug

SEQ ID NO: 603295 - RNA, 17 nt, Escherichia coli CFT073
gcccuuucgacgcgugc

SEQ ID NO: 603296 - RNA, 20 nt, Escherichia coli CFT073
gcccuuucgacgcgugcaga

SEQ ID NO: 603297 - RNA, 15 nt, Escherichia coli CFT073
gcccugcaacaucac

SEQ ID NO: 603298 - RNA, 15 nt, Escherichia coli CFT073
gcccugaaccaucga

SEQ ID NO: 603299 - RNA, 14 nt, Escherichia coli CFT073
gcccucuuucacca

SEQ ID NO: 603300 - RNA, 22 nt, Escherichia coli CFT073
gcccuggcccauugccagcgcu

SEQ ID NO: 603301 - RNA, 15 nt, Escherichia coli CFT073
gcccugcucgucggc

SEQ ID NO: 603302 - RNA, 13 nt, Escherichia coli CFT073
gcccugccagcga

SEQ ID NO: 603303 - RNA, 15 nt, Escherichia coli CFT073
gcccugccagcgaua

SEQ ID NO: 603304 - RNA, 19 nt, Escherichia coli CFT073
gcccuucccggugcgcaga

SEQ ID NO: 603305 - RNA, 13 nt, Escherichia coli CFT073
gcccuucaugcac

SEQ ID NO: 603306 - RNA, 21 nt, Escherichia coli CFT073
gcccugucaccgggcaaacgc

SEQ ID NO: 603307 - RNA, 18 nt, Escherichia coli CFT073
gcccuuaccauucccaga

SEQ ID NO: 603308 - RNA, 20 nt, Escherichia coli CFT073
gccauuuuucacugcggcaa

SEQ ID NO: 603309 - RNA, 20 nt, Escherichia coli CFT073
gccauuuuuucgauaaucaa

SEQ ID NO: 603310 - RNA, 18 nt, Escherichia coli CFT073
gccauuuuuuuacccagc

SEQ ID NO: 603311 - RNA, 20 nt, Escherichia coli CFT073
gccauuuuuuuacccagcgu

SEQ ID NO: 603312 - RNA, 16 nt, Escherichia coli CFT073
gcccaaaauaucacgc

SEQ ID NO: 603313 - RNA, 16 nt, Escherichia coli CFT073
gcccacaccagucagc

SEQ ID NO: 603314 - RNA, 20 nt, Escherichia coli CFT073
gccauucauucaaauuaaac

SEQ ID NO: 603315 - RNA, 17 nt, Escherichia coli CFT073
gccauuccagccagaaa

SEQ ID NO: 603316 - RNA, 14 nt, Escherichia coli CFT073
gccaugucugcaua

SEQ ID NO: 603317 - RNA, 22 nt, Escherichia coli CFT073
gccaugugcuuuuccucauuua

SEQ ID NO: 603318 - RNA, 16 nt, Escherichia coli CFT073
gccauuaacaguccga

SEQ ID NO: 603319 - RNA, 17 nt, Escherichia coli CFT073
gccauuaacaucccuuc

SEQ ID NO: 603320 - RNA, 19 nt, Escherichia coli CFT073
gccauuaaugucggaugcg

SEQ ID NO: 603321 - RNA, 22 nt, Escherichia coli CFT073
gccauucuugucagaugcggcg

SEQ ID NO: 603322 - RNA, 17 nt, Escherichia coli CFT073
gccauuucguuagcaaa

SEQ ID NO: 603323 - RNA, 16 nt, Escherichia coli CFT073
gccauuucgcugguac

SEQ ID NO: 603324 - RNA, 17 nt, Escherichia coli CFT073
aagacaauauaauaaga

SEQ ID NO: 603325 - RNA, 16 nt, Escherichia coli CFT073
aagacagcgaaaacga

SEQ ID NO: 603326 - RNA, 15 nt, Escherichia coli CFT073
gccagucuccaggca

SEQ ID NO: 603327 - RNA, 18 nt, Escherichia coli CFT073
gccagucuuccaucacaa

SEQ ID NO: 603328 - RNA, 23 nt, Escherichia coli CFT073
gccagucguaaugaaucagcaga

SEQ ID NO: 603329 - RNA, 13 nt, Escherichia coli CFT073
aagaccaauccag

SEQ ID NO: 603330 - RNA, 14 nt, Escherichia coli CFT073
gccaugcugguuac

SEQ ID NO: 603331 - RNA, 22 nt, Escherichia coli CFT073
gccauggcauuaaauucagcaa

SEQ ID NO: 603332 - RNA, 23 nt, Escherichia coli CFT073
gccaugauuaccagcaucaccga

SEQ ID NO: 603333 - RNA, 21 nt, Escherichia coli CFT073
gcccaggcaaguagcgccaga

SEQ ID NO: 603334 - RNA, 22 nt, Escherichia coli CFT073
gcccacuacgcccgcaaucaac

SEQ ID NO: 603335 - RNA, 23 nt, Escherichia coli CFT073
gcccaucaucaucggcaccgcca

SEQ ID NO: 603336 - RNA, 15 nt, Escherichia coli CFT073
gcccaucaugcgcca

SEQ ID NO: 603337 - RNA, 16 nt, Escherichia coli CFT073
gcccaguuuuucagga

SEQ ID NO: 603338 - RNA, 16 nt, Escherichia coli CFT073
gcccauaccacagcaa

SEQ ID NO: 603339 - RNA, 15 nt, Escherichia coli CFT073
gccccaccagcaaaa

SEQ ID NO: 603340 - RNA, 19 nt, Escherichia coli CFT073
gcccaucggaccauuggca

SEQ ID NO: 603341 - RNA, 21 nt, Escherichia coli CFT073
aagacgcaaccagcgucgcau

SEQ ID NO: 603342 - RNA, 22 nt, Escherichia coli CFT073
aagacgcagauuuuuauuaaua

SEQ ID NO: 603343 - RNA, 16 nt, Escherichia coli CFT073
aagacgcauaauccag

SEQ ID NO: 603344 - RNA, 21 nt, Escherichia coli CFT073
aagacgcgaacagcgucgcau

SEQ ID NO: 603345 - RNA, 23 nt, Escherichia coli CFT073
aagacgcgccagcaucgcaucag

SEQ ID NO: 603346 - RNA, 20 nt, Escherichia coli CFT073
aagacgcgccagcgucgcau

SEQ ID NO: 603347 - RNA, 18 nt, Escherichia coli CFT073
aagagauccgcacucaac

SEQ ID NO: 603348 - RNA, 19 nt, Escherichia coli CFT073
aagagaugaaugaauuucc

SEQ ID NO: 603349 - RNA, 18 nt, Escherichia coli CFT073
gccccgucgcccgaugcc

SEQ ID NO: 603350 - RNA, 22 nt, Escherichia coli CFT073
gccccuggugcuugccagagca

SEQ ID NO: 603351 - RNA, 16 nt, Escherichia coli CFT073
gcccgccaucgcccau

SEQ ID NO: 603352 - RNA, 20 nt, Escherichia coli CFT073
gcccgcaacuuuaccgcaau

SEQ ID NO: 603353 - RNA, 19 nt, Escherichia coli CFT073
gcccgcagcguccagcgcc

SEQ ID NO: 603354 - RNA, 13 nt, Escherichia coli CFT073
gcccgcgcguuaa

SEQ ID NO: 603355 - RNA, 19 nt, Escherichia coli CFT073
gccaauuucccgcguccgc

SEQ ID NO: 603356 - RNA, 14 nt, Escherichia coli CFT073
gccaauuuccggaa

SEQ ID NO: 603357 - RNA, 19 nt, Escherichia coli CFT073
gccaauguagccacggauc

SEQ ID NO: 603358 - RNA, 20 nt, Escherichia coli CFT073
gccacagcaagcagccgaua

SEQ ID NO: 603359 - RNA, 19 nt, Escherichia coli CFT073
gccaauaaaacgcaccggc

SEQ ID NO: 603360 - RNA, 17 nt, Escherichia coli CFT073
gccaauaaucgauugca

SEQ ID NO: 603361 - RNA, 15 nt, Escherichia coli CFT073
gccaauaaugcccgc

SEQ ID NO: 603362 - RNA, 20 nt, Escherichia coli CFT073
gccaauaaugcccgcaccac

SEQ ID NO: 603363 - RNA, 18 nt, Escherichia coli CFT073
gccaauaccaaaaucauc

SEQ ID NO: 603364 - RNA, 17 nt, Escherichia coli CFT073
gccaagauagaaccacg

SEQ ID NO: 603365 - RNA, 15 nt, Escherichia coli CFT073
gcagugaaauuucug
